United States Patent 7,691,997 (FUNCTIONAL AND HYPERFUNCTIONAL SIRNA) - sequence listing, part 23

SEQ ID NO: 922761 - RNA, 19 nt, Homo sapiens
ggaaagcccagcagaaucg

SEQ ID NO: 922762 - RNA, 19 nt, Homo sapiens
gagaagaucgagcagaagu

SEQ ID NO: 922763 - RNA, 19 nt, Homo sapiens
gcggagaccuaugguguca

SEQ ID NO: 922764 - RNA, 19 nt, Homo sapiens
gaccuucuccucuuucuca

SEQ ID NO: 922765 - RNA, 19 nt, Homo sapiens
agaaugcaccuaauaaagu

SEQ ID NO: 922766 - RNA, 19 nt, Homo sapiens
ggcccgagcuauggcuuaa

SEQ ID NO: 922767 - RNA, 19 nt, Homo sapiens
gagccauccugguuucaca

SEQ ID NO: 922768 - RNA, 19 nt, Homo sapiens
gaaccaccgacaucuuuca

SEQ ID NO: 922769 - RNA, 19 nt, Homo sapiens
ccaggcagaucauguuagg

SEQ ID NO: 922770 - RNA, 19 nt, Homo sapiens
gggagagccauccugguuu

SEQ ID NO: 922771 - RNA, 19 nt, Homo sapiens
caggaaagcccagcagaau

SEQ ID NO: 922772 - RNA, 19 nt, Homo sapiens
gcccaggcagaucauguua

SEQ ID NO: 922773 - RNA, 19 nt, Homo sapiens
gcagaugggcagcaacaag

SEQ ID NO: 922774 - RNA, 19 nt, Homo sapiens
caaaucucccaguuccuaa

SEQ ID NO: 922775 - RNA, 19 nt, Homo sapiens
agaucgagcagaaguauga

SEQ ID NO: 922776 - RNA, 19 nt, Homo sapiens
cuucugaccuucuccucuu

SEQ ID NO: 922777 - RNA, 19 nt, Homo sapiens
gagaggugcaggagaagau

SEQ ID NO: 922778 - RNA, 19 nt, Homo sapiens
uagaaugcaccuaauaaag

SEQ ID NO: 922779 - RNA, 19 nt, Homo sapiens
gagucucuguuugauuauu

SEQ ID NO: 922780 - RNA, 19 nt, Homo sapiens
augcggaccuggagaacaa

SEQ ID NO: 922781 - RNA, 19 nt, Homo sapiens
acaccauggucucuacgaa

SEQ ID NO: 922782 - RNA, 19 nt, Homo sapiens
aaauucuccucuucaacuu

SEQ ID NO: 922783 - RNA, 19 nt, Homo sapiens
gcguugcagucaccaagga

SEQ ID NO: 922784 - RNA, 19 nt, Homo sapiens
cccaagaucucagagucaa

SEQ ID NO: 922785 - RNA, 19 nt, Homo sapiens
caccuccuguucauuuaga

SEQ ID NO: 922786 - RNA, 19 nt, Homo sapiens
cguaauaggccugcagaug

SEQ ID NO: 922787 - RNA, 19 nt, Homo sapiens
uuagaacuaugcaaagacu

SEQ ID NO: 922788 - RNA, 19 nt, Homo sapiens
gaauccgcguugccuacug

SEQ ID NO: 922789 - RNA, 19 nt, Homo sapiens
caccauggucucuacgaaa

SEQ ID NO: 922790 - RNA, 19 nt, Homo sapiens
gcagaaucggagaggcuuu

SEQ ID NO: 922791 - RNA, 19 nt, Homo sapiens
caagaucucagagucaaag

SEQ ID NO: 922792 - RNA, 19 nt, Homo sapiens
cuuauagaaugcaccuaau

SEQ ID NO: 922793 - RNA, 19 nt, Homo sapiens
ccaaggaugauggcugcua

SEQ ID NO: 922794 - RNA, 19 nt, Homo sapiens
ggacccugauggcuuuagg

SEQ ID NO: 922795 - RNA, 19 nt, Homo sapiens
gcccauacccaagaucuca

SEQ ID NO: 922796 - RNA, 19 nt, Homo sapiens
ccucuucaacuuauagaau

SEQ ID NO: 922797 - RNA, 19 nt, Homo sapiens
ugccaccuccuguucauuu

SEQ ID NO: 922798 - RNA, 19 nt, Homo sapiens
acaggaaagcccagcagaa

SEQ ID NO: 922799 - RNA, 19 nt, Homo sapiens
acuuauagaaugcaccuaa

SEQ ID NO: 922800 - RNA, 19 nt, Homo sapiens
agaagaucgagcagaagua

SEQ ID NO: 922801 - RNA, 19 nt, Homo sapiens
gcugccaccuccuguucau

SEQ ID NO: 922802 - RNA, 19 nt, Homo sapiens
gacgaauguuccacaccau

SEQ ID NO: 922803 - RNA, 19 nt, Homo sapiens
ucagaaccaccgacaucuu

SEQ ID NO: 922804 - RNA, 19 nt, Homo sapiens
auucuccucuucaacuuau

SEQ ID NO: 922805 - RNA, 19 nt, Homo sapiens
uuccagagauggcuaacag

SEQ ID NO: 922806 - RNA, 19 nt, Homo sapiens
uaaaagcugcggagaccua

SEQ ID NO: 922807 - RNA, 19 nt, Homo sapiens
gaaaggugguucugaaaug

SEQ ID NO: 922808 - RNA, 19 nt, Homo sapiens
ggagaaaggcggauuggua

SEQ ID NO: 922809 - RNA, 19 nt, Homo sapiens
gagaggagcuucuguuugg

SEQ ID NO: 922810 - RNA, 19 nt, Homo sapiens
gaacaugucgccugaugaa

SEQ ID NO: 922811 - RNA, 19 nt, Homo sapiens
guucagaggagacuauuua

SEQ ID NO: 922812 - RNA, 19 nt, Homo sapiens
ggcggcagcucauuguuua

SEQ ID NO: 922813 - RNA, 19 nt, Homo sapiens
gaauggauaugaacuacau

SEQ ID NO: 922814 - RNA, 19 nt, Homo sapiens
gggcagagguuuagaaagg

SEQ ID NO: 922815 - RNA, 19 nt, Homo sapiens
ucaaaucacuugcaagaca

SEQ ID NO: 922816 - RNA, 19 nt, Homo sapiens
guaauaaagcgucguaaga

SEQ ID NO: 922817 - RNA, 19 nt, Homo sapiens
ugaagaugguuaugaagaa

SEQ ID NO: 922818 - RNA, 19 nt, Homo sapiens
gaagaaggccaagcaguga

SEQ ID NO: 922819 - RNA, 19 nt, Homo sapiens
gacaagauccagaagcuuu

SEQ ID NO: 922820 - RNA, 19 nt, Homo sapiens
caagaagucaccguuguua

SEQ ID NO: 922821 - RNA, 19 nt, Homo sapiens
ugucgucucucgcaguuua

SEQ ID NO: 922822 - RNA, 19 nt, Homo sapiens
ugaugaagaugguuaugaa

SEQ ID NO: 922823 - RNA, 19 nt, Homo sapiens
gagaaaggcggauugguau

SEQ ID NO: 922824 - RNA, 19 nt, Homo sapiens
gaagggccguguugcuuuc

SEQ ID NO: 922825 - RNA, 19 nt, Homo sapiens
uaaaagugccguauucuua

SEQ ID NO: 922826 - RNA, 19 nt, Homo sapiens
gaagaugacgauucagaga

SEQ ID NO: 922827 - RNA, 19 nt, Homo sapiens
uaagaugguugggaagaaa

SEQ ID NO: 922828 - RNA, 19 nt, Homo sapiens
gcacuggccucuccugcau

SEQ ID NO: 922829 - RNA, 19 nt, Homo sapiens
gaacuacauuauccaaagg

SEQ ID NO: 922830 - RNA, 19 nt, Homo sapiens
gcugaugacccaaaggaua

SEQ ID NO: 922831 - RNA, 19 nt, Homo sapiens
acgagaagcugauccaguu

SEQ ID NO: 922832 - RNA, 19 nt, Homo sapiens
ccaaaggaagaaagaauuu

SEQ ID NO: 922833 - RNA, 19 nt, Homo sapiens
caaaucacuugcaagacaa

SEQ ID NO: 922834 - RNA, 19 nt, Homo sapiens
guaagaugguugggaagaa

SEQ ID NO: 922835 - RNA, 19 nt, Homo sapiens
gaagaugguuaugaagaag

SEQ ID NO: 922836 - RNA, 19 nt, Homo sapiens
guucaaaucacuugcaaga

SEQ ID NO: 922837 - RNA, 19 nt, Homo sapiens
gaagaagaugagaacagua

SEQ ID NO: 922838 - RNA, 19 nt, Homo sapiens
caagggcacuguggauguu

SEQ ID NO: 922839 - RNA, 19 nt, Homo sapiens
guagacagucggaagauga

SEQ ID NO: 922840 - RNA, 19 nt, Homo sapiens
gcaaaugcuucagcucaca

SEQ ID NO: 922841 - RNA, 19 nt, Homo sapiens
ugaacuacauuauccaaag

SEQ ID NO: 922842 - RNA, 19 nt, Homo sapiens
uaaaggagggaauggauau

SEQ ID NO: 922843 - RNA, 19 nt, Homo sapiens
aauaaagcgucguaagaug

SEQ ID NO: 922844 - RNA, 19 nt, Homo sapiens
gagcuucuguuuggcauuc

SEQ ID NO: 922845 - RNA, 19 nt, Homo sapiens
gaugagaacaguagacagu

SEQ ID NO: 922846 - RNA, 19 nt, Homo sapiens
gcaagugggauucggcuau

SEQ ID NO: 922847 - RNA, 19 nt, Homo sapiens
agaaagagcaagugggauu

SEQ ID NO: 922848 - RNA, 19 nt, Homo sapiens
ccaacuacccaaaggauau

SEQ ID NO: 922849 - RNA, 19 nt, Homo sapiens
gauaaaggagggaauggau

SEQ ID NO: 922850 - RNA, 19 nt, Homo sapiens
ccagaagcuuuaugaacga

SEQ ID NO: 922851 - RNA, 19 nt, Homo sapiens
gauaauacagaagcagaaa

SEQ ID NO: 922852 - RNA, 19 nt, Homo sapiens
agaagaagaugagaacagu

SEQ ID NO: 922853 - RNA, 19 nt, Homo sapiens
ggaggcgccacuuuguaua

SEQ ID NO: 922854 - RNA, 19 nt, Homo sapiens
uaaggaacucugugcauga

SEQ ID NO: 922855 - RNA, 19 nt, Homo sapiens
cccaaaggauaauacagaa

SEQ ID NO: 922856 - RNA, 19 nt, Homo sapiens
uaauaaagcgucguaagau

SEQ ID NO: 922857 - RNA, 19 nt, Homo sapiens
gccguauucuuaccucuug

SEQ ID NO: 922858 - RNA, 19 nt, Homo sapiens
gggaggcgccacuuuguau

SEQ ID NO: 922859 - RNA, 19 nt, Homo sapiens
gagauggacaaauuggaaa

SEQ ID NO: 922860 - RNA, 19 nt, Homo sapiens
gucggaagaugacgauuca

SEQ ID NO: 922861 - RNA, 19 nt, Homo sapiens
gaaaggcggauugguaucu

SEQ ID NO: 922862 - RNA, 19 nt, Homo sapiens
cggaacaugucgccugaug

SEQ ID NO: 922863 - RNA, 19 nt, Homo sapiens
ggaagggcugugugucaaa

SEQ ID NO: 922864 - RNA, 19 nt, Homo sapiens
gcugugggcaccauuguga

SEQ ID NO: 922865 - RNA, 19 nt, Homo sapiens
cagaugcucagaagagaaa

SEQ ID NO: 922866 - RNA, 19 nt, Homo sapiens
gggaauggauaugaacuac

SEQ ID NO: 922867 - RNA, 19 nt, Homo sapiens
ggauaauacagaagcagaa

SEQ ID NO: 922868 - RNA, 19 nt, Homo sapiens
ggcgccacuuuguauauuu

SEQ ID NO: 922869 - RNA, 19 nt, Homo sapiens
ccuggcagauguucaaauc

SEQ ID NO: 922870 - RNA, 19 nt, Homo sapiens
caugucgccugaugaaauc

SEQ ID NO: 922871 - RNA, 19 nt, Homo sapiens
ugaagggccguguugcuuu

SEQ ID NO: 922872 - RNA, 19 nt, Homo sapiens
gaaagagcaagugggauuc

SEQ ID NO: 922873 - RNA, 19 nt, Homo sapiens
acaagauccagaagcuuua

SEQ ID NO: 922874 - RNA, 19 nt, Homo sapiens
ccaagaagucaccguuguu

SEQ ID NO: 922875 - RNA, 19 nt, Homo sapiens
gcgccacuuuguauauuuc

SEQ ID NO: 922876 - RNA, 19 nt, Homo sapiens
ugagauggacaaauuggaa

SEQ ID NO: 922877 - RNA, 19 nt, Homo sapiens
cugaugacccaaaggauaa

SEQ ID NO: 922878 - RNA, 19 nt, Homo sapiens
ggaauauaaggaacucugu

SEQ ID NO: 922879 - RNA, 19 nt, Homo sapiens
ggagacuauuuacccuuca

SEQ ID NO: 922880 - RNA, 19 nt, Homo sapiens
gaagaagaagaagaugaga

SEQ ID NO: 922881 - RNA, 19 nt, Homo sapiens
gaaagauaaaggagggaau

SEQ ID NO: 922882 - RNA, 19 nt, Homo sapiens
ggaacaugucgccugauga

SEQ ID NO: 922883 - RNA, 19 nt, Homo sapiens
ggaacucguggccuccuuu

SEQ ID NO: 922884 - RNA, 19 nt, Homo sapiens
gaagggcugugugucaaaa

SEQ ID NO: 922885 - RNA, 19 nt, Homo sapiens
caagugggauucggcuauc

SEQ ID NO: 922886 - RNA, 19 nt, Homo sapiens
gcagaugcucagaagagaa

SEQ ID NO: 922887 - RNA, 19 nt, Homo sapiens
cggaagggcugugugucaa

SEQ ID NO: 922888 - RNA, 19 nt, Homo sapiens
gcggaagggcuguguguca

SEQ ID NO: 922889 - RNA, 19 nt, Homo sapiens
cccaagaagucaccguugu

SEQ ID NO: 922890 - RNA, 19 nt, Homo sapiens
gaggcgccacuuuguauau

SEQ ID NO: 922891 - RNA, 19 nt, Homo sapiens
gagcggaagggcugugugu

SEQ ID NO: 922892 - RNA, 19 nt, Homo sapiens
gcaccaacuacccaaagga

SEQ ID NO: 922893 - RNA, 19 nt, Homo sapiens
gcagauguucaaaucacuu

SEQ ID NO: 922894 - RNA, 19 nt, Homo sapiens
caagaccaccgucaucucu

SEQ ID NO: 922895 - RNA, 19 nt, Homo sapiens
uacauuauccaaaggaaga

SEQ ID NO: 922896 - RNA, 19 nt, Homo sapiens
gugaugaagaugguuauga

SEQ ID NO: 922897 - RNA, 19 nt, Homo sapiens
auugguaucugaugccuau

SEQ ID NO: 922898 - RNA, 19 nt, Homo sapiens
gaacucugugcaugagguu

SEQ ID NO: 922899 - RNA, 19 nt, Homo sapiens
gagacuauuuacccuucau

SEQ ID NO: 922900 - RNA, 19 nt, Homo sapiens
agaagucaccguuguuauc

SEQ ID NO: 922901 - RNA, 19 nt, Homo sapiens
ugagaggagcuucuguuug

SEQ ID NO: 922902 - RNA, 19 nt, Homo sapiens
cuccuacuaugaggcauua

SEQ ID NO: 922903 - RNA, 19 nt, Homo sapiens
auaaaggagggaauggaua

SEQ ID NO: 922904 - RNA, 19 nt, Homo sapiens
gauccagaagcuuuaugaa

SEQ ID NO: 922905 - RNA, 19 nt, Homo sapiens
gaaauggcaccugguacuc

SEQ ID NO: 922906 - RNA, 19 nt, Homo sapiens
aaaggugguucugaaaugg

SEQ ID NO: 922907 - RNA, 19 nt, Homo sapiens
gaaggaaucucaauuugua

SEQ ID NO: 922908 - RNA, 19 nt, Homo sapiens
uagcaaaggugaaaguuua

SEQ ID NO: 922909 - RNA, 19 nt, Homo sapiens
gaacugcacuauuauaaac

SEQ ID NO: 922910 - RNA, 19 nt, Homo sapiens
uccaugaacugcacuauua

SEQ ID NO: 922911 - RNA, 19 nt, Homo sapiens
ggugaaaguuuauggcuaa

SEQ ID NO: 922912 - RNA, 19 nt, Homo sapiens
gacuuuagcccaauuaaua

SEQ ID NO: 922913 - RNA, 19 nt, Homo sapiens
caaucugacuguaaucuaa

SEQ ID NO: 922914 - RNA, 19 nt, Homo sapiens
ccagaacacugccaaguau

SEQ ID NO: 922915 - RNA, 19 nt, Homo sapiens
gcaucgugcucuuguuuaa

SEQ ID NO: 922916 - RNA, 19 nt, Homo sapiens
gaacaucaaaggaggugua

SEQ ID NO: 922917 - RNA, 19 nt, Homo sapiens
gcacaccagucuucucaau

SEQ ID NO: 922918 - RNA, 19 nt, Homo sapiens
uaacagagacgcacgcauu

SEQ ID NO: 922919 - RNA, 19 nt, Homo sapiens
aaugauagauguuggagaa

SEQ ID NO: 922920 - RNA, 19 nt, Homo sapiens
caucaaaggagguguauga

SEQ ID NO: 922921 - RNA, 19 nt, Homo sapiens
ccacuuggcaucucuguuu

SEQ ID NO: 922922 - RNA, 19 nt, Homo sapiens
ggagggcucuguacaaugc

SEQ ID NO: 922923 - RNA, 19 nt, Homo sapiens
aaucuaaucuguugugcuu

SEQ ID NO: 922924 - RNA, 19 nt, Homo sapiens
ggagccucaucucaucuua

SEQ ID NO: 922925 - RNA, 19 nt, Homo sapiens
gagaucaacuccaccuucu

SEQ ID NO: 922926 - RNA, 19 nt, Homo sapiens
gcagauggccacccaguca

SEQ ID NO: 922927 - RNA, 19 nt, Homo sapiens
gauagauguuggagaaagu

SEQ ID NO: 922928 - RNA, 19 nt, Homo sapiens
gccaugcuguguuauguga

SEQ ID NO: 922929 - RNA, 19 nt, Homo sapiens
gaucaacuccaccuucugu

SEQ ID NO: 922930 - RNA, 19 nt, Homo sapiens
ccuuacaggcuuaaacuua

SEQ ID NO: 922931 - RNA, 19 nt, Homo sapiens
uggcaucucuguuucugaa

SEQ ID NO: 922932 - RNA, 19 nt, Homo sapiens
cugaaggaaucucaauuug

SEQ ID NO: 922933 - RNA, 19 nt, Homo sapiens
gcaauuuacggguagcaaa

SEQ ID NO: 922934 - RNA, 19 nt, Homo sapiens
gauguuggagaaaguaauu

SEQ ID NO: 922935 - RNA, 19 nt, Homo sapiens
ggacuuggcauguuuccau

SEQ ID NO: 922936 - RNA, 19 nt, Homo sapiens
gcaucucuguuucugaaug

SEQ ID NO: 922937 - RNA, 19 nt, Homo sapiens
gguuggaccugaaggaauc

SEQ ID NO: 922938 - RNA, 19 nt, Homo sapiens
caggagggcucuguacaau

SEQ ID NO: 922939 - RNA, 19 nt, Homo sapiens
gcgccgugaugaugcagua

SEQ ID NO: 922940 - RNA, 19 nt, Homo sapiens
acuguaaucuaaucuguug

SEQ ID NO: 922941 - RNA, 19 nt, Homo sapiens
caucucuguuucugaauga

SEQ ID NO: 922942 - RNA, 19 nt, Homo sapiens
ccugaaggaaucucaauuu

SEQ ID NO: 922943 - RNA, 19 nt, Homo sapiens
guagcaaaggugaaaguuu

SEQ ID NO: 922944 - RNA, 19 nt, Homo sapiens
ugacuguaaucuaaucugu

SEQ ID NO: 922945 - RNA, 19 nt, Homo sapiens
caugaacugcacuauuaua

SEQ ID NO: 922946 - RNA, 19 nt, Homo sapiens
acaccagucuucucaaucu

SEQ ID NO: 922947 - RNA, 19 nt, Homo sapiens
guauagccgugacuugaag

SEQ ID NO: 922948 - RNA, 19 nt, Homo sapiens
ucagcugaauaccaaguuu

SEQ ID NO: 922949 - RNA, 19 nt, Homo sapiens
agaacacugccaaguauaa

SEQ ID NO: 922950 - RNA, 19 nt, Homo sapiens
cagagacgcacgcauucua

SEQ ID NO: 922951 - RNA, 19 nt, Homo sapiens
gaugacuuuagcccaauua

SEQ ID NO: 922952 - RNA, 19 nt, Homo sapiens
gcagacuaggcauaucuuu

SEQ ID NO: 922953 - RNA, 19 nt, Homo sapiens
gaccagcgccgugaugaug

SEQ ID NO: 922954 - RNA, 19 nt, Homo sapiens
gcaguauagccgugacuug

SEQ ID NO: 922955 - RNA, 19 nt, Homo sapiens
ugaaggaaucucaauuugu

SEQ ID NO: 922956 - RNA, 19 nt, Homo sapiens
gagcagacuaggcauaucu

SEQ ID NO: 922957 - RNA, 19 nt, Homo sapiens
uuacaggcuuaaacuuaga

SEQ ID NO: 922958 - RNA, 19 nt, Homo sapiens
ucagaaagcagcaugaacu

SEQ ID NO: 922959 - RNA, 19 nt, Homo sapiens
caguauagccgugacuuga

SEQ ID NO: 922960 - RNA, 19 nt, Homo sapiens
caggccaccucuuguguuc

SEQ ID NO: 922961 - RNA, 19 nt, Homo sapiens
cuuacaggcuuaaacuuag

SEQ ID NO: 922962 - RNA, 19 nt, Homo sapiens
ccaggagggcucuguacaa

SEQ ID NO: 922963 - RNA, 19 nt, Homo sapiens
gcaaaggugaaaguuuaug

SEQ ID NO: 922964 - RNA, 19 nt, Homo sapiens
gcaggccaccucuuguguu

SEQ ID NO: 922965 - RNA, 19 nt, Homo sapiens
ugauagauguuggagaaag

SEQ ID NO: 922966 - RNA, 19 nt, Homo sapiens
ggucgcguguggagcaugu

SEQ ID NO: 922967 - RNA, 19 nt, Homo sapiens
ccaauuaauaggauagcuu

SEQ ID NO: 922968 - RNA, 19 nt, Homo sapiens
acacugccaaguauaacua

SEQ ID NO: 922969 - RNA, 19 nt, Homo sapiens
cagaacacugccaaguaua

SEQ ID NO: 922970 - RNA, 19 nt, Homo sapiens
ggagaaaguaauuauucca

SEQ ID NO: 922971 - RNA, 19 nt, Homo sapiens
uguuggacuuggcauguuu

SEQ ID NO: 922972 - RNA, 19 nt, Homo sapiens
gcuuaaacuuagagucaag

SEQ ID NO: 922973 - RNA, 19 nt, Homo sapiens
uagcccaauuaauaggaua

SEQ ID NO: 922974 - RNA, 19 nt, Homo sapiens
ucaaucugacuguaaucua

SEQ ID NO: 922975 - RNA, 19 nt, Homo sapiens
ccgcccagcuacagucaug

SEQ ID NO: 922976 - RNA, 19 nt, Homo sapiens
gcaaccagagcccuucaca

SEQ ID NO: 922977 - RNA, 19 nt, Homo sapiens
ggagcagacuaggcauauc

SEQ ID NO: 922978 - RNA, 19 nt, Homo sapiens
cguggagccucaucucauc

SEQ ID NO: 922979 - RNA, 19 nt, Homo sapiens
cgacugggaaucauagaag

SEQ ID NO: 922980 - RNA, 19 nt, Homo sapiens
gccgugaugaugcaguaua

SEQ ID NO: 922981 - RNA, 19 nt, Homo sapiens
gaacacugccaaguauaac

SEQ ID NO: 922982 - RNA, 19 nt, Homo sapiens
gcauguccagcacgucuau

SEQ ID NO: 922983 - RNA, 19 nt, Homo sapiens
gacugggaaucauagaagu

SEQ ID NO: 922984 - RNA, 19 nt, Homo sapiens
ugacuugaagggccacuug

SEQ ID NO: 922985 - RNA, 19 nt, Homo sapiens
caaaggugaaaguuuaugg

SEQ ID NO: 922986 - RNA, 19 nt, Homo sapiens
gcaggcgacugggaaucau

SEQ ID NO: 922987 - RNA, 19 nt, Homo sapiens
ggaaucucaauuuguaaag

SEQ ID NO: 922988 - RNA, 19 nt, Homo sapiens
caggagcagacuaggcaua

SEQ ID NO: 922989 - RNA, 19 nt, Homo sapiens
ggcuuaaacuuagagucaa

SEQ ID NO: 922990 - RNA, 19 nt, Homo sapiens
ucuaaucuguugugcuuuu

SEQ ID NO: 922991 - RNA, 19 nt, Homo sapiens
gaccucguuucaagaagca

SEQ ID NO: 922992 - RNA, 19 nt, Homo sapiens
agucaggaaagaauguaua

SEQ ID NO: 922993 - RNA, 19 nt, Homo sapiens
ccaacgcacaccagucuuc

SEQ ID NO: 922994 - RNA, 19 nt, Homo sapiens
ccuucacacucgccucuga

SEQ ID NO: 922995 - RNA, 19 nt, Homo sapiens
guggaccucguuucaagaa

SEQ ID NO: 922996 - RNA, 19 nt, Homo sapiens
gucaggaaagaauguauau

SEQ ID NO: 922997 - RNA, 19 nt, Homo sapiens
gaccugaaggaaucucaau

SEQ ID NO: 922998 - RNA, 19 nt, Homo sapiens
ggauagcgaagggcagaga

SEQ ID NO: 922999 - RNA, 19 nt, Homo sapiens
accagaacacugccaagua

SEQ ID NO: 923000 - RNA, 19 nt, Homo sapiens
ugacuuuagcccaauuaau

SEQ ID NO: 923001 - RNA, 19 nt, Homo sapiens
caauuuacggguagcaaag

SEQ ID NO: 923002 - RNA, 19 nt, Homo sapiens
gcgacugggaaucauagaa

SEQ ID NO: 923003 - RNA, 19 nt, Homo sapiens
gagcaggcaguggaacuca

SEQ ID NO: 923004 - RNA, 19 nt, Homo sapiens
ggaccugaaggaaucucaa

SEQ ID NO: 923005 - RNA, 19 nt, Homo sapiens
gguagcaaaggugaaaguu

SEQ ID NO: 923006 - RNA, 19 nt, Homo sapiens
aggcuuaaacuuagaguca

SEQ ID NO: 923007 - RNA, 19 nt, Homo sapiens
ugaagaagcugaaauauuc

SEQ ID NO: 923008 - RNA, 19 nt, Homo sapiens
caaggaugauucugauuua

SEQ ID NO: 923009 - RNA, 19 nt, Homo sapiens
guacuaaugccaugauuua

SEQ ID NO: 923010 - RNA, 19 nt, Homo sapiens
gaaggaaucuggaggaaag

SEQ ID NO: 923011 - RNA, 19 nt, Homo sapiens
gcaaguaacuccaggugau

SEQ ID NO: 923012 - RNA, 19 nt, Homo sapiens
ccagagaccauuuauuaua

SEQ ID NO: 923013 - RNA, 19 nt, Homo sapiens
caagugaccaauaaucuua

SEQ ID NO: 923014 - RNA, 19 nt, Homo sapiens
gcaaggaugauucugauuu

SEQ ID NO: 923015 - RNA, 19 nt, Homo sapiens
gcaauaauuuagagagaga

SEQ ID NO: 923016 - RNA, 19 nt, Homo sapiens
acaaagauaugcuugaaga

SEQ ID NO: 923017 - RNA, 19 nt, Homo sapiens
gagaccagguggagaauga

SEQ ID NO: 923018 - RNA, 19 nt, Homo sapiens
gcugaaauauuccagaaga

SEQ ID NO: 923019 - RNA, 19 nt, Homo sapiens
gaacagucagugcgaauuu

SEQ ID NO: 923020 - RNA, 19 nt, Homo sapiens
aaccagagaccauuuauua

SEQ ID NO: 923021 - RNA, 19 nt, Homo sapiens
gaacaugaucugucucuug

SEQ ID NO: 923022 - RNA, 19 nt, Homo sapiens
gaagaugaaggccauacua

SEQ ID NO: 923023 - RNA, 19 nt, Homo sapiens
gcaagaagcacaagaagca

SEQ ID NO: 923024 - RNA, 19 nt, Homo sapiens
gaacaagugaccaauaauc

SEQ ID NO: 923025 - RNA, 19 nt, Homo sapiens
gcuacuccaugaucauuaa

SEQ ID NO: 923026 - RNA, 19 nt, Homo sapiens
cugaacaagugaccaauaa

SEQ ID NO: 923027 - RNA, 19 nt, Homo sapiens
caaacaagaagaaguagaa

SEQ ID NO: 923028 - RNA, 19 nt, Homo sapiens
cauuaugacuccacauuug

SEQ ID NO: 923029 - RNA, 19 nt, Homo sapiens
cacaagcucuuuagccaaa

SEQ ID NO: 923030 - RNA, 19 nt, Homo sapiens
gaagcugguccucaaagua

SEQ ID NO: 923031 - RNA, 19 nt, Homo sapiens
gcugaaagcaguaacaaau

SEQ ID NO: 923032 - RNA, 19 nt, Homo sapiens
aaagaaauggagcagauua

SEQ ID NO: 923033 - RNA, 19 nt, Homo sapiens
acucugaucuuccaaguga

SEQ ID NO: 923034 - RNA, 19 nt, Homo sapiens
uuauaaagcugcaaagaag

SEQ ID NO: 923035 - RNA, 19 nt, Homo sapiens
gaaaggagagaagcagauu

SEQ ID NO: 923036 - RNA, 19 nt, Homo sapiens
agacaaagauaugcuugaa

SEQ ID NO: 923037 - RNA, 19 nt, Homo sapiens
gcuccuggcuacuccauga

SEQ ID NO: 923038 - RNA, 19 nt, Homo sapiens
ggagcagauuacagaagua

SEQ ID NO: 923039 - RNA, 19 nt, Homo sapiens
ugucauggcagauaguuua

SEQ ID NO: 923040 - RNA, 19 nt, Homo sapiens
cuaaugccaugauuuacaa

SEQ ID NO: 923041 - RNA, 19 nt, Homo sapiens
gaugaaggccauacuagga

SEQ ID NO: 923042 - RNA, 19 nt, Homo sapiens
gaaagacaaagauaugcuu

SEQ ID NO: 923043 - RNA, 19 nt, Homo sapiens
gaacuaaaggauaacuuca

SEQ ID NO: 923044 - RNA, 19 nt, Homo sapiens
ugagacaauugcagagaaa

SEQ ID NO: 923045 - RNA, 19 nt, Homo sapiens
gaucaagaacaaugacuau

SEQ ID NO: 923046 - RNA, 19 nt, Homo sapiens
gacagaagacacugaagaa

SEQ ID NO: 923047 - RNA, 19 nt, Homo sapiens
agaaaugcaucuugcugaa

SEQ ID NO: 923048 - RNA, 19 nt, Homo sapiens
gugccaagauuauccguau

SEQ ID NO: 923049 - RNA, 19 nt, Homo sapiens
gcauuaugacuccacauuu

SEQ ID NO: 923050 - RNA, 19 nt, Homo sapiens
gugcgaauuugaaagaaga

SEQ ID NO: 923051 - RNA, 19 nt, Homo sapiens
uuaaacacccaauggauuu

SEQ ID NO: 923052 - RNA, 19 nt, Homo sapiens
cagcaaggaugauucugau

SEQ ID NO: 923053 - RNA, 19 nt, Homo sapiens
ggaacgaagucaccgaacu

SEQ ID NO: 923054 - RNA, 19 nt, Homo sapiens
gaaaagaucaagaacaaug

SEQ ID NO: 923055 - RNA, 19 nt, Homo sapiens
caaaagaaauggagcagau

SEQ ID NO: 923056 - RNA, 19 nt, Homo sapiens
gaaagaaaggagagaagca

SEQ ID NO: 923057 - RNA, 19 nt, Homo sapiens
gcugaacaagugaccaaua

SEQ ID NO: 923058 - RNA, 19 nt, Homo sapiens
caagaacaaugacuaucag

SEQ ID NO: 923059 - RNA, 19 nt, Homo sapiens
gcacguauggaguucgaaa

SEQ ID NO: 923060 - RNA, 19 nt, Homo sapiens
uacaagagauggagauguc

SEQ ID NO: 923061 - RNA, 19 nt, Homo sapiens
ucaagaacaaugacuauca

SEQ ID NO: 923062 - RNA, 19 nt, Homo sapiens
caaguaacuccaggugaua

SEQ ID NO: 923063 - RNA, 19 nt, Homo sapiens
agucuggagugaauacuuu

SEQ ID NO: 923064 - RNA, 19 nt, Homo sapiens
gcacgacuccagccucuuc

SEQ ID NO: 923065 - RNA, 19 nt, Homo sapiens
caagaguuaaggaggauaa

SEQ ID NO: 923066 - RNA, 19 nt, Homo sapiens
ugacagaagacacugaaga

SEQ ID NO: 923067 - RNA, 19 nt, Homo sapiens
aagcugaaauauuccagaa

SEQ ID NO: 923068 - RNA, 19 nt, Homo sapiens
gaacgaagucaccgaacuc

SEQ ID NO: 923069 - RNA, 19 nt, Homo sapiens
aaugacaacuggaagacuu

SEQ ID NO: 923070 - RNA, 19 nt, Homo sapiens
aaaugcaucuugcugaaca

SEQ ID NO: 923071 - RNA, 19 nt, Homo sapiens
ccaggaagcccagaaugaa

SEQ ID NO: 923072 - RNA, 19 nt, Homo sapiens
aaauggagcagauuacaga

SEQ ID NO: 923073 - RNA, 19 nt, Homo sapiens
caaaguaggagggaacgaa

SEQ ID NO: 923074 - RNA, 19 nt, Homo sapiens
ggaacagacaccucacaga

SEQ ID NO: 923075 - RNA, 19 nt, Homo sapiens
gaaauauuccagaagaaac

SEQ ID NO: 923076 - RNA, 19 nt, Homo sapiens
caagagucccagcaaagaa

SEQ ID NO: 923077 - RNA, 19 nt, Homo sapiens
agacuugccuccugagaag

SEQ ID NO: 923078 - RNA, 19 nt, Homo sapiens
agagguuggacuuguauua

SEQ ID NO: 923079 - RNA, 19 nt, Homo sapiens
cugaagaagcugaaauauu

SEQ ID NO: 923080 - RNA, 19 nt, Homo sapiens
gcugccugguauuugauua

SEQ ID NO: 923081 - RNA, 19 nt, Homo sapiens
gcucauagcgcugaaagca

SEQ ID NO: 923082 - RNA, 19 nt, Homo sapiens
gagaugucauugccugaag

SEQ ID NO: 923083 - RNA, 19 nt, Homo sapiens
caaauaucagcaaggauga

SEQ ID NO: 923084 - RNA, 19 nt, Homo sapiens
caauaaaccagagaccauu

SEQ ID NO: 923085 - RNA, 19 nt, Homo sapiens
cagaagaaacuugaugaga

SEQ ID NO: 923086 - RNA, 19 nt, Homo sapiens
gacaagaguuaaggaggau

SEQ ID NO: 923087 - RNA, 19 nt, Homo sapiens
gauaguuuacuggauguuu

SEQ ID NO: 923088 - RNA, 19 nt, Homo sapiens
ggauaacuucaaacuaaug

SEQ ID NO: 923089 - RNA, 19 nt, Homo sapiens
cgaggaguauguagagaag

SEQ ID NO: 923090 - RNA, 19 nt, Homo sapiens
gcucagggaacuccaggaa

SEQ ID NO: 923091 - RNA, 19 nt, Homo sapiens
gugaaggaaucuggaggaa

SEQ ID NO: 923092 - RNA, 19 nt, Homo sapiens
gagagcaggagcagcuuga

SEQ ID NO: 923093 - RNA, 19 nt, Homo sapiens
cauuuccugugacugauuu

SEQ ID NO: 923094 - RNA, 19 nt, Homo sapiens
guaagcacguauggaguuc

SEQ ID NO: 923095 - RNA, 19 nt, Homo sapiens
gcacaagucggacaaacac

SEQ ID NO: 923096 - RNA, 19 nt, Homo sapiens
gaaauggagcagauuacag

SEQ ID NO: 923097 - RNA, 19 nt, Homo sapiens
acaaacacaaggacagaaa

SEQ ID NO: 923098 - RNA, 19 nt, Homo sapiens
ccaggacccuacaagagau

SEQ ID NO: 923099 - RNA, 19 nt, Homo sapiens
gaaagaagaaaaccagaug

SEQ ID NO: 923100 - RNA, 19 nt, Homo sapiens
cuucaagagucccagcaaa

SEQ ID NO: 923101 - RNA, 19 nt, Homo sapiens
cauagaagaacuaaaggau

SEQ ID NO: 923102 - RNA, 19 nt, Homo sapiens
gcagauuacagaaguagag

SEQ ID NO: 923103 - RNA, 19 nt, Homo sapiens
gggaaugacaacuggaaga

SEQ ID NO: 923104 - RNA, 19 nt, Homo sapiens
ucagugcgaauuugaaaga

SEQ ID NO: 923105 - RNA, 19 nt, Homo sapiens
gaacagacaccccuucaag

SEQ ID NO: 923106 - RNA, 19 nt, Homo sapiens
gaugagaccaccagauugc

SEQ ID NO: 923107 - RNA, 19 nt, Homo sapiens
gcagcgagcuuccaucauu

SEQ ID NO: 923108 - RNA, 19 nt, Homo sapiens
gaacuuugaucucccugua

SEQ ID NO: 923109 - RNA, 19 nt, Homo sapiens
gaucccagcucuccacuuu

SEQ ID NO: 923110 - RNA, 19 nt, Homo sapiens
caaugaagaugaugaagaa

SEQ ID NO: 923111 - RNA, 19 nt, Homo sapiens
gagaggagccggacuauga

SEQ ID NO: 923112 - RNA, 19 nt, Homo sapiens
cgacaucacuaaacagauu

SEQ ID NO: 923113 - RNA, 19 nt, Homo sapiens
guuaauccaucaauccuua

SEQ ID NO: 923114 - RNA, 19 nt, Homo sapiens
agacauggaugaaauugaa

SEQ ID NO: 923115 - RNA, 19 nt, Homo sapiens
gcaccgacaucacuaaaca

SEQ ID NO: 923116 - RNA, 19 nt, Homo sapiens
caacaugauugaaguagau

SEQ ID NO: 923117 - RNA, 19 nt, Homo sapiens
gcagcuaauucacucuuaa

SEQ ID NO: 923118 - RNA, 19 nt, Homo sapiens
gaucauaguauucguauuc

SEQ ID NO: 923119 - RNA, 19 nt, Homo sapiens
caaggauucucagaucaua

SEQ ID NO: 923120 - RNA, 19 nt, Homo sapiens
aagcagaugugaugauuga

SEQ ID NO: 923121 - RNA, 19 nt, Homo sapiens
ugaagaagauguaguggau

SEQ ID NO: 923122 - RNA, 19 nt, Homo sapiens
aagaagauguaguggauuu

SEQ ID NO: 923123 - RNA, 19 nt, Homo sapiens
caagcucugugcaacauuu

SEQ ID NO: 923124 - RNA, 19 nt, Homo sapiens
gaagccaaauugaugugaa

SEQ ID NO: 923125 - RNA, 19 nt, Homo sapiens
gcaguauccuaguuuaugu

SEQ ID NO: 923126 - RNA, 19 nt, Homo sapiens
gcaauguuaagcagaguua

SEQ ID NO: 923127 - RNA, 19 nt, Homo sapiens
ggccuugccuucaacauga

SEQ ID NO: 923128 - RNA, 19 nt, Homo sapiens
uaacagcaguauuaagcaa

SEQ ID NO: 923129 - RNA, 19 nt, Homo sapiens
ugaagcaggucacaauugu

SEQ ID NO: 923130 - RNA, 19 nt, Homo sapiens
aauauuacgugcuguguga

SEQ ID NO: 923131 - RNA, 19 nt, Homo sapiens
gaacaacauccggcaauau

SEQ ID NO: 923132 - RNA, 19 nt, Homo sapiens
aagaggagcucacacugaa

SEQ ID NO: 923133 - RNA, 19 nt, Homo sapiens
ugaagcagaugugaugauu

SEQ ID NO: 923134 - RNA, 19 nt, Homo sapiens
gaaagacagcggcauuugu

SEQ ID NO: 923135 - RNA, 19 nt, Homo sapiens
ugaacaacauccggcaaua

SEQ ID NO: 923136 - RNA, 19 nt, Homo sapiens
gcacuuugcugagcgaauc

SEQ ID NO: 923137 - RNA, 19 nt, Homo sapiens
ggaugaagcagaugugaug

SEQ ID NO: 923138 - RNA, 19 nt, Homo sapiens
acucaacgcugaagacaug

SEQ ID NO: 923139 - RNA, 19 nt, Homo sapiens
ugacuaagauucguguguu

SEQ ID NO: 923140 - RNA, 19 nt, Homo sapiens
gacuaagauucguguguuu

SEQ ID NO: 923141 - RNA, 19 nt, Homo sapiens
ggaaagacagcggcauuug

SEQ ID NO: 923142 - RNA, 19 nt, Homo sapiens
ugaagaugaugaagaagau

SEQ ID NO: 923143 - RNA, 19 nt, Homo sapiens
cacuuuaacagcaguauua

SEQ ID NO: 923144 - RNA, 19 nt, Homo sapiens
caauuguugugaacuuuga

SEQ ID NO: 923145 - RNA, 19 nt, Homo sapiens
gcacaggaaagacaaauac

SEQ ID NO: 923146 - RNA, 19 nt, Homo sapiens
uauccuaguuuaugugaga

SEQ ID NO: 923147 - RNA, 19 nt, Homo sapiens
guuaaugccuuggaauugu

SEQ ID NO: 923148 - RNA, 19 nt, Homo sapiens
gauuuaauaggccaucuaa

SEQ ID NO: 923149 - RNA, 19 nt, Homo sapiens
gcaaagaggagcucacacu

SEQ ID NO: 923150 - RNA, 19 nt, Homo sapiens
ggcagcuaauucacucuua

SEQ ID NO: 923151 - RNA, 19 nt, Homo sapiens
ugucacagauggcaaaaua

SEQ ID NO: 923152 - RNA, 19 nt, Homo sapiens
gaagacauggaugaaauug

SEQ ID NO: 923153 - RNA, 19 nt, Homo sapiens
cugaagacauggaugaaau

SEQ ID NO: 923154 - RNA, 19 nt, Homo sapiens
ccaaauugaugugaagcuu

SEQ ID NO: 923155 - RNA, 19 nt, Homo sapiens
gaaaauccaggaccacuuu

SEQ ID NO: 923156 - RNA, 19 nt, Homo sapiens
gaguuaaugccuuggaauu

SEQ ID NO: 923157 - RNA, 19 nt, Homo sapiens
ggauuuggcagcuaauuca

SEQ ID NO: 923158 - RNA, 19 nt, Homo sapiens
caagugauguaugccauuc

SEQ ID NO: 923159 - RNA, 19 nt, Homo sapiens
ugaauuggcucugcaaacu

SEQ ID NO: 923160 - RNA, 19 nt, Homo sapiens
ggaagaaccuuugggguau

SEQ ID NO: 923161 - RNA, 19 nt, Homo sapiens
gagcagcgagcuuccauca

SEQ ID NO: 923162 - RNA, 19 nt, Homo sapiens
aaucaucccugacccuaau

SEQ ID NO: 923163 - RNA, 19 nt, Homo sapiens
gcuaaaggaagaguuacua

SEQ ID NO: 923164 - RNA, 19 nt, Homo sapiens
gaagagcugcggcuaaagg

SEQ ID NO: 923165 - RNA, 19 nt, Homo sapiens
uugaagagcugcggcuaaa

SEQ ID NO: 923166 - RNA, 19 nt, Homo sapiens
gcucuccacuuuacucagu

SEQ ID NO: 923167 - RNA, 19 nt, Homo sapiens
caucaauccuuaguagaau

SEQ ID NO: 923168 - RNA, 19 nt, Homo sapiens
cugccuagcuccuacuuau

SEQ ID NO: 923169 - RNA, 19 nt, Homo sapiens
aaaggaaucuaugcaaugg

SEQ ID NO: 923170 - RNA, 19 nt, Homo sapiens
ccaucaauccuuaguagaa

SEQ ID NO: 923171 - RNA, 19 nt, Homo sapiens
aaauugaugugaagcuugu

SEQ ID NO: 923172 - RNA, 19 nt, Homo sapiens
auaaaugucacgguacuua

SEQ ID NO: 923173 - RNA, 19 nt, Homo sapiens
gauugacuauugaagaaag

SEQ ID NO: 923174 - RNA, 19 nt, Homo sapiens
gcggcuaaaggaagaguua

SEQ ID NO: 923175 - RNA, 19 nt, Homo sapiens
acaacauccggcaauauua

SEQ ID NO: 923176 - RNA, 19 nt, Homo sapiens
gcaaacuggccgugugguu

SEQ ID NO: 923177 - RNA, 19 nt, Homo sapiens
ucaaugaagaugaugaaga

SEQ ID NO: 923178 - RNA, 19 nt, Homo sapiens
aaagaggagcucacacuga

SEQ ID NO: 923179 - RNA, 19 nt, Homo sapiens
acccuaauguuaucaaguu

SEQ ID NO: 923180 - RNA, 19 nt, Homo sapiens
gaaucaucccugacccuaa

SEQ ID NO: 923181 - RNA, 19 nt, Homo sapiens
gccuagcuccuacuuauga

SEQ ID NO: 923182 - RNA, 19 nt, Homo sapiens
ucuaugcaaugggauuuaa

SEQ ID NO: 923183 - RNA, 19 nt, Homo sapiens
cuaaaggaagaguuacuaa

SEQ ID NO: 923184 - RNA, 19 nt, Homo sapiens
gaaagacaaauaccaagcu

SEQ ID NO: 923185 - RNA, 19 nt, Homo sapiens
guuaucaaguuacgcaaag

SEQ ID NO: 923186 - RNA, 19 nt, Homo sapiens
acucaaggauucucagauc

SEQ ID NO: 923187 - RNA, 19 nt, Homo sapiens
gcagaugugaugauugaca

SEQ ID NO: 923188 - RNA, 19 nt, Homo sapiens
cagaguuaaugccuuggaa

SEQ ID NO: 923189 - RNA, 19 nt, Homo sapiens
caacauccggcaauauuac

SEQ ID NO: 923190 - RNA, 19 nt, Homo sapiens
gcuaauucacucuuaaaca

SEQ ID NO: 923191 - RNA, 19 nt, Homo sapiens
gacaucacuaaacagauua

SEQ ID NO: 923192 - RNA, 19 nt, Homo sapiens
uuaaugccuuggaauuguu

SEQ ID NO: 923193 - RNA, 19 nt, Homo sapiens
gacagcggcauuuguguug

SEQ ID NO: 923194 - RNA, 19 nt, Homo sapiens
aaagacagcggcauuugug

SEQ ID NO: 923195 - RNA, 19 nt, Homo sapiens
ugugcaguauccuaguuua

SEQ ID NO: 923196 - RNA, 19 nt, Homo sapiens
caggaaagacaaauaccaa

SEQ ID NO: 923197 - RNA, 19 nt, Homo sapiens
caguaaagacauuugaaga

SEQ ID NO: 923198 - RNA, 19 nt, Homo sapiens
gaagaagauguaguggauu

SEQ ID NO: 923199 - RNA, 19 nt, Homo sapiens
gaagcagaugugaugauug

SEQ ID NO: 923200 - RNA, 19 nt, Homo sapiens
guacugcaguccgaaacau

SEQ ID NO: 923201 - RNA, 19 nt, Homo sapiens
ggauuuaauaggccaucua

SEQ ID NO: 923202 - RNA, 19 nt, Homo sapiens
aaauaaaugucacgguacu

SEQ ID NO: 923203 - RNA, 19 nt, Homo sapiens
ugaagacauggaugaaauu

SEQ ID NO: 923204 - RNA, 19 nt, Homo sapiens
acuuugaucucccuguaaa

SEQ ID NO: 923205 - RNA, 19 nt, Homo sapiens
aagcaggucacaauuguug

SEQ ID NO: 923206 - RNA, 19 nt, Homo sapiens
gaagcaggucacaauuguu

SEQ ID NO: 923207 - RNA, 19 nt, Homo sapiens
gaaaggagcuggaaaauuu

SEQ ID NO: 923208 - RNA, 19 nt, Homo sapiens
ggaagcaacuuggaauuua

SEQ ID NO: 923209 - RNA, 19 nt, Homo sapiens
gaagacaaaucuacugaaa

SEQ ID NO: 923210 - RNA, 19 nt, Homo sapiens
uaaccacacugcuuuauuu

SEQ ID NO: 923211 - RNA, 19 nt, Homo sapiens
ccaggaugcugauaauuua

SEQ ID NO: 923212 - RNA, 19 nt, Homo sapiens
caaagaagaucuaugauac

SEQ ID NO: 923213 - RNA, 19 nt, Homo sapiens
gaaaguaucagcugagaga

SEQ ID NO: 923214 - RNA, 19 nt, Homo sapiens
gauaucagauguucaguca

SEQ ID NO: 923215 - RNA, 19 nt, Homo sapiens
uugaugagcuggagaauuu

SEQ ID NO: 923216 - RNA, 19 nt, Homo sapiens
gcugagagauuuacagaug

SEQ ID NO: 923217 - RNA, 19 nt, Homo sapiens
gaggagagcucaucauguc

SEQ ID NO: 923218 - RNA, 19 nt, Homo sapiens
ucagaaugcucucaaugua

SEQ ID NO: 923219 - RNA, 19 nt, Homo sapiens
gaagcaacuuggaauuuau

SEQ ID NO: 923220 - RNA, 19 nt, Homo sapiens
gaauuuagaggaagacaaa

SEQ ID NO: 923221 - RNA, 19 nt, Homo sapiens
gaauauugcuuuagacaac

SEQ ID NO: 923222 - RNA, 19 nt, Homo sapiens
ggaguaauacccugaauau

SEQ ID NO: 923223 - RNA, 19 nt, Homo sapiens
gaaauacgaccaucacuag

SEQ ID NO: 923224 - RNA, 19 nt, Homo sapiens
gcauacaacugaugugauc

SEQ ID NO: 923225 - RNA, 19 nt, Homo sapiens
ggaaauacgaccaucacua

SEQ ID NO: 923226 - RNA, 19 nt, Homo sapiens
caacugaugugaucuaugc

SEQ ID NO: 923227 - RNA, 19 nt, Homo sapiens
caaccaagaucauccgaau

SEQ ID NO: 923228 - RNA, 19 nt, Homo sapiens
gacaacauguguaagaaga

SEQ ID NO: 923229 - RNA, 19 nt, Homo sapiens
caagggauccagaauauga

SEQ ID NO: 923230 - RNA, 19 nt, Homo sapiens
cacaagggauccagaauau

SEQ ID NO: 923231 - RNA, 19 nt, Homo sapiens
cgggugaaauggacaguua

SEQ ID NO: 923232 - RNA, 19 nt, Homo sapiens
ccaggaagcuacaguuuua

SEQ ID NO: 923233 - RNA, 19 nt, Homo sapiens
uaucagauguucagucaug

SEQ ID NO: 923234 - RNA, 19 nt, Homo sapiens
gaaugaaggcuccugcaaa

SEQ ID NO: 923235 - RNA, 19 nt, Homo sapiens
gaagaugucaacaagugua

SEQ ID NO: 923236 - RNA, 19 nt, Homo sapiens
guugugauguggagaauga

SEQ ID NO: 923237 - RNA, 19 nt, Homo sapiens
gccaagaacauguguauga

SEQ ID NO: 923238 - RNA, 19 nt, Homo sapiens
cagaggaacuggaggaugu

SEQ ID NO: 923239 - RNA, 19 nt, Homo sapiens
ugaggaaguucgcaaagaa

SEQ ID NO: 923240 - RNA, 19 nt, Homo sapiens
ugaauguguuggaugauaa

SEQ ID NO: 923241 - RNA, 19 nt, Homo sapiens
gguguaaugagaaauguua

SEQ ID NO: 923242 - RNA, 19 nt, Homo sapiens
cauugaagcugcuaagaau

SEQ ID NO: 923243 - RNA, 19 nt, Homo sapiens
caagagaccuucgcagaca

SEQ ID NO: 923244 - RNA, 19 nt, Homo sapiens
gaaacgccuugaagccauu

SEQ ID NO: 923245 - RNA, 19 nt, Homo sapiens
ucaauuugguacucuguaa

SEQ ID NO: 923246 - RNA, 19 nt, Homo sapiens
ucagagagaugaaauugca

SEQ ID NO: 923247 - RNA, 19 nt, Homo sapiens
gaaaccacuauucuacaua

SEQ ID NO: 923248 - RNA, 19 nt, Homo sapiens
guacaugggagaaucauau

SEQ ID NO: 923249 - RNA, 19 nt, Homo sapiens
ucacaagggauccagaaua

SEQ ID NO: 923250 - RNA, 19 nt, Homo sapiens
uaagcuggaugcugagauu

SEQ ID NO: 923251 - RNA, 19 nt, Homo sapiens
guggacaucucaaagaaga

SEQ ID NO: 923252 - RNA, 19 nt, Homo sapiens
gcaacgacaucauuguucu

SEQ ID NO: 923253 - RNA, 19 nt, Homo sapiens
ggauguuucugaccuugaa

SEQ ID NO: 923254 - RNA, 19 nt, Homo sapiens
gaagguguaaugagaaaug

SEQ ID NO: 923255 - RNA, 19 nt, Homo sapiens
ugaaagccauaucuuggaa

SEQ ID NO: 923256 - RNA, 19 nt, Homo sapiens
aagugaagcucugaaagua

SEQ ID NO: 923257 - RNA, 19 nt, Homo sapiens
agacgaggcucagcaaaga

SEQ ID NO: 923258 - RNA, 19 nt, Homo sapiens
gcaaaggaccacuaaagca

SEQ ID NO: 923259 - RNA, 19 nt, Homo sapiens
gggcuaagaugacucaacu

SEQ ID NO: 923260 - RNA, 19 nt, Homo sapiens
ucucaaagaagaucuauga

SEQ ID NO: 923261 - RNA, 19 nt, Homo sapiens
uggaagaugucaacaagug

SEQ ID NO: 923262 - RNA, 19 nt, Homo sapiens
agaaugcucucaauguaau

SEQ ID NO: 923263 - RNA, 19 nt, Homo sapiens
gaaguucuguaauuucacu

SEQ ID NO: 923264 - RNA, 19 nt, Homo sapiens
gcuaaucagugcccagauc

SEQ ID NO: 923265 - RNA, 19 nt, Homo sapiens
aaaagaauaugcugcgaua

SEQ ID NO: 923266 - RNA, 19 nt, Homo sapiens
gaaaagagccaguguccuu

SEQ ID NO: 923267 - RNA, 19 nt, Homo sapiens
gcaagucaugagugaauuu

SEQ ID NO: 923268 - RNA, 19 nt, Homo sapiens
aguaucagcugagagauuu

SEQ ID NO: 923269 - RNA, 19 nt, Homo sapiens
gugaagcucugaaaguauc

SEQ ID NO: 923270 - RNA, 19 nt, Homo sapiens
aagaacauguguaugauca

SEQ ID NO: 923271 - RNA, 19 nt, Homo sapiens
gagaaauguuaacuuccuu

SEQ ID NO: 923272 - RNA, 19 nt, Homo sapiens
gggagaaucauauacaugu

SEQ ID NO: 923273 - RNA, 19 nt, Homo sapiens
ugauguugcuucccucaaa

SEQ ID NO: 923274 - RNA, 19 nt, Homo sapiens
aaucugcagucaaguuaaa

SEQ ID NO: 923275 - RNA, 19 nt, Homo sapiens
cacggaagguguaaugaga

SEQ ID NO: 923276 - RNA, 19 nt, Homo sapiens
uuacaagcauugaugacuu

SEQ ID NO: 923277 - RNA, 19 nt, Homo sapiens
ucacugaagccguagauga

SEQ ID NO: 923278 - RNA, 19 nt, Homo sapiens
gagcuuacggcuucacuug

SEQ ID NO: 923279 - RNA, 19 nt, Homo sapiens
gauaucagaaucaggauca

SEQ ID NO: 923280 - RNA, 19 nt, Homo sapiens
ccaagaacauguguaugau

SEQ ID NO: 923281 - RNA, 19 nt, Homo sapiens
gauacgacagucccucuuu

SEQ ID NO: 923282 - RNA, 19 nt, Homo sapiens
gcaagcaaggacacaguuu

SEQ ID NO: 923283 - RNA, 19 nt, Homo sapiens
gguguuuaacucacaaaua

SEQ ID NO: 923284 - RNA, 19 nt, Homo sapiens
ugaaaccacuauucuacau

SEQ ID NO: 923285 - RNA, 19 nt, Homo sapiens
caagucaugagugaauuua

SEQ ID NO: 923286 - RNA, 19 nt, Homo sapiens
ugauggagaugacagacuu

SEQ ID NO: 923287 - RNA, 19 nt, Homo sapiens
cggaagguguaaugagaaa

SEQ ID NO: 923288 - RNA, 19 nt, Homo sapiens
gagaccaggaugcugauaa

SEQ ID NO: 923289 - RNA, 19 nt, Homo sapiens
caacauguguaagaagaca

SEQ ID NO: 923290 - RNA, 19 nt, Homo sapiens
cagaaugcucucaauguaa

SEQ ID NO: 923291 - RNA, 19 nt, Homo sapiens
gggcaaaggaccacuaaag

SEQ ID NO: 923292 - RNA, 19 nt, Homo sapiens
gaaagugaagcucugaaag

SEQ ID NO: 923293 - RNA, 19 nt, Homo sapiens
ggaggaagcaacuuggaau

SEQ ID NO: 923294 - RNA, 19 nt, Homo sapiens
uacauugccucaaccaaga

SEQ ID NO: 923295 - RNA, 19 nt, Homo sapiens
ggaggauguuucugaccuu

SEQ ID NO: 923296 - RNA, 19 nt, Homo sapiens
guaacucugugaccaccaa

SEQ ID NO: 923297 - RNA, 19 nt, Homo sapiens
gaucaugugucagacucuu

SEQ ID NO: 923298 - RNA, 19 nt, Homo sapiens
ggaagacaaaucuacugaa

SEQ ID NO: 923299 - RNA, 19 nt, Homo sapiens
caaaggaccacuaaagcau

SEQ ID NO: 923300 - RNA, 19 nt, Homo sapiens
gucaacaaguguaucauag

SEQ ID NO: 923301 - RNA, 19 nt, Homo sapiens
caacaaaugaagauggaau

SEQ ID NO: 923302 - RNA, 19 nt, Homo sapiens
gaugagcuggagaauuuaa

SEQ ID NO: 923303 - RNA, 19 nt, Homo sapiens
gaggaaguucgcaaagaaa

SEQ ID NO: 923304 - RNA, 19 nt, Homo sapiens
agacaaaucuacugaaacc

SEQ ID NO: 923305 - RNA, 19 nt, Homo sapiens
agucaugagugaauuuaga

SEQ ID NO: 923306 - RNA, 19 nt, Homo sapiens
gagagaagccagaggaaac

SEQ ID NO: 923307 - RNA, 19 nt, Homo sapiens
gaacugaauuuccuguuga

SEQ ID NO: 923308 - RNA, 19 nt, Homo sapiens
ugaauuuccuguugagaua

SEQ ID NO: 923309 - RNA, 19 nt, Homo sapiens
gagaggaaguggauuuguu

SEQ ID NO: 923310 - RNA, 19 nt, Homo sapiens
guaacaauguggagaaaga

SEQ ID NO: 923311 - RNA, 19 nt, Homo sapiens
gaacaaggccaaccaugga

SEQ ID NO: 923312 - RNA, 19 nt, Homo sapiens
ggacaagacaguuuccuau

SEQ ID NO: 923313 - RNA, 19 nt, Homo sapiens
ugacaaaggugccaguagu

SEQ ID NO: 923314 - RNA, 19 nt, Homo sapiens
gauaaaugguacugaaugg

SEQ ID NO: 923315 - RNA, 19 nt, Homo sapiens
uggaaugguugcugcuuua

SEQ ID NO: 923316 - RNA, 19 nt, Homo sapiens
cagguugucugcauucaaa

SEQ ID NO: 923317 - RNA, 19 nt, Homo sapiens
gugcuaauauuaccuguuc

SEQ ID NO: 923318 - RNA, 19 nt, Homo sapiens
caaaucagauauacauguc

SEQ ID NO: 923319 - RNA, 19 nt, Homo sapiens
gauauaaaggcccaucuga

SEQ ID NO: 923320 - RNA, 19 nt, Homo sapiens
ggauugggcugagcagaga

SEQ ID NO: 923321 - RNA, 19 nt, Homo sapiens
gaaagacauuacaccaucu

SEQ ID NO: 923322 - RNA, 19 nt, Homo sapiens
gaacugauaacuccauuuu

SEQ ID NO: 923323 - RNA, 19 nt, Homo sapiens
agauauacaugucuagaug

SEQ ID NO: 923324 - RNA, 19 nt, Homo sapiens
ggacaucaagucagagguu

SEQ ID NO: 923325 - RNA, 19 nt, Homo sapiens
ggauaaaugguacugaaug

SEQ ID NO: 923326 - RNA, 19 nt, Homo sapiens
caagcugcaugcccagaaa

SEQ ID NO: 923327 - RNA, 19 nt, Homo sapiens
cuaaugacauacccgagaa

SEQ ID NO: 923328 - RNA, 19 nt, Homo sapiens
gcaaaaugcaugacaguaa

SEQ ID NO: 923329 - RNA, 19 nt, Homo sapiens
cauaguguguggaaugguu

SEQ ID NO: 923330 - RNA, 19 nt, Homo sapiens
caggagagugugccuauuu

SEQ ID NO: 923331 - RNA, 19 nt, Homo sapiens
gagugugccuauuugaaug

SEQ ID NO: 923332 - RNA, 19 nt, Homo sapiens
gacaucaagucagagguuu

SEQ ID NO: 923333 - RNA, 19 nt, Homo sapiens
guggaaugguugcugcuuu

SEQ ID NO: 923334 - RNA, 19 nt, Homo sapiens
gagagugugccuauuugaa

SEQ ID NO: 923335 - RNA, 19 nt, Homo sapiens
gcaggagagugugccuauu

SEQ ID NO: 923336 - RNA, 19 nt, Homo sapiens
uauaaaggcccaucugauc

SEQ ID NO: 923337 - RNA, 19 nt, Homo sapiens
gacauuacaccaucugaau

SEQ ID NO: 923338 - RNA, 19 nt, Homo sapiens
agaagcauauuggaacuga

SEQ ID NO: 923339 - RNA, 19 nt, Homo sapiens
ccaaaucagauauacaugu

SEQ ID NO: 923340 - RNA, 19 nt, Homo sapiens
aagcauauuggaacugaua

SEQ ID NO: 923341 - RNA, 19 nt, Homo sapiens
gagaaagacauuacaccau

SEQ ID NO: 923342 - RNA, 19 nt, Homo sapiens
ugaauggacaagacaguuu

SEQ ID NO: 923343 - RNA, 19 nt, Homo sapiens
caucaagagccaucaguau

SEQ ID NO: 923344 - RNA, 19 nt, Homo sapiens
acagagaggaaguggauuu

SEQ ID NO: 923345 - RNA, 19 nt, Homo sapiens
accaagaacuggacaucaa

SEQ ID NO: 923346 - RNA, 19 nt, Homo sapiens
uaccuuaauuuggcgcuua

SEQ ID NO: 923347 - RNA, 19 nt, Homo sapiens
gucuagauguuacagcaaa

SEQ ID NO: 923348 - RNA, 19 nt, Homo sapiens
gccaggcacuacacagaga

SEQ ID NO: 923349 - RNA, 19 nt, Homo sapiens
ggagagugugccuauuuga

SEQ ID NO: 923350 - RNA, 19 nt, Homo sapiens
gaauggacaagacaguuuc

SEQ ID NO: 923351 - RNA, 19 nt, Homo sapiens
gcaugacaguaacaaugug

SEQ ID NO: 923352 - RNA, 19 nt, Homo sapiens
cauuacaccaucugaauug

SEQ ID NO: 923353 - RNA, 19 nt, Homo sapiens
ucaagagccaucaguaugu

SEQ ID NO: 923354 - RNA, 19 nt, Homo sapiens
ucccacugcuaaugacaua

SEQ ID NO: 923355 - RNA, 19 nt, Homo sapiens
ggaaugguugcugcuuuaa

SEQ ID NO: 923356 - RNA, 19 nt, Homo sapiens
caagagccaucaguauguc

SEQ ID NO: 923357 - RNA, 19 nt, Homo sapiens
gagcuaacugccaucaaga

SEQ ID NO: 923358 - RNA, 19 nt, Homo sapiens
agagcuaacugccaucaag

SEQ ID NO: 923359 - RNA, 19 nt, Homo sapiens
caguaacaauguggagaaa

SEQ ID NO: 923360 - RNA, 19 nt, Homo sapiens
caagacaguuuccuauccu

SEQ ID NO: 923361 - RNA, 19 nt, Homo sapiens
ggaacugauaacuccauuu

SEQ ID NO: 923362 - RNA, 19 nt, Homo sapiens
acacagagaggaaguggau

SEQ ID NO: 923363 - RNA, 19 nt, Homo sapiens
gugccuauuugaaugacaa

SEQ ID NO: 923364 - RNA, 19 nt, Homo sapiens
gagcauucuauuaaagcua

SEQ ID NO: 923365 - RNA, 19 nt, Homo sapiens
ccgagaaugaguaauuuau

SEQ ID NO: 923366 - RNA, 19 nt, Homo sapiens
aggagagugugccuauuug

SEQ ID NO: 923367 - RNA, 19 nt, Homo sapiens
gacaagacaguuuccuauc

SEQ ID NO: 923368 - RNA, 19 nt, Homo sapiens
ccaucaagagccaucagua

SEQ ID NO: 923369 - RNA, 19 nt, Homo sapiens
aaucauaguguguggaaug

SEQ ID NO: 923370 - RNA, 19 nt, Homo sapiens
gaagcauauuggaacugau

SEQ ID NO: 923371 - RNA, 19 nt, Homo sapiens
gacaaaggugccaguagug

SEQ ID NO: 923372 - RNA, 19 nt, Homo sapiens
guacugaauggacaagaca

SEQ ID NO: 923373 - RNA, 19 nt, Homo sapiens
uaagcgcaauaagagcuaa

SEQ ID NO: 923374 - RNA, 19 nt, Homo sapiens
uacccgagaaugaguaauu

SEQ ID NO: 923375 - RNA, 19 nt, Homo sapiens
ugacauacccgagaaugag

SEQ ID NO: 923376 - RNA, 19 nt, Homo sapiens
uggaaauggauaaauggua

SEQ ID NO: 923377 - RNA, 19 nt, Homo sapiens
cagaaagcuggauugguuu

SEQ ID NO: 923378 - RNA, 19 nt, Homo sapiens
guucucccacugcuaauga

SEQ ID NO: 923379 - RNA, 19 nt, Homo sapiens
ccuguucucccacugcuaa

SEQ ID NO: 923380 - RNA, 19 nt, Homo sapiens
acaagacaguuuccuaucc

SEQ ID NO: 923381 - RNA, 19 nt, Homo sapiens
auggauaaaugguacugaa

SEQ ID NO: 923382 - RNA, 19 nt, Homo sapiens
acccgagaaugaguaauuu

SEQ ID NO: 923383 - RNA, 19 nt, Homo sapiens
uaaagcuaccuuaauuugg

SEQ ID NO: 923384 - RNA, 19 nt, Homo sapiens
agagugugccuauuugaau

SEQ ID NO: 923385 - RNA, 19 nt, Homo sapiens
gguacugaauggacaagac

SEQ ID NO: 923386 - RNA, 19 nt, Homo sapiens
gcaaagccccaacuaaucu

SEQ ID NO: 923387 - RNA, 19 nt, Homo sapiens
gggcugagcagagaacaag

SEQ ID NO: 923388 - RNA, 19 nt, Homo sapiens
uugcucagguugaaagcuu

SEQ ID NO: 923389 - RNA, 19 nt, Homo sapiens
cagcaaagccccaacuaau

SEQ ID NO: 923390 - RNA, 19 nt, Homo sapiens
caaaaugcaugacaguaac

SEQ ID NO: 923391 - RNA, 19 nt, Homo sapiens
acaguaacaauguggagaa

SEQ ID NO: 923392 - RNA, 19 nt, Homo sapiens
auaaaggcccaucugauca

SEQ ID NO: 923393 - RNA, 19 nt, Homo sapiens
cuuaauuuggcgcuuauuu

SEQ ID NO: 923394 - RNA, 19 nt, Homo sapiens
acaaucauaguguguggaa

SEQ ID NO: 923395 - RNA, 19 nt, Homo sapiens
caaggccaaccauggaaau

SEQ ID NO: 923396 - RNA, 19 nt, Homo sapiens
gaauuuccuguugagauau

SEQ ID NO: 923397 - RNA, 19 nt, Homo sapiens
cagauauacaugucuagau

SEQ ID NO: 923398 - RNA, 19 nt, Homo sapiens
acauuacaccaucugaauu

SEQ ID NO: 923399 - RNA, 19 nt, Homo sapiens
gaaugguugcugcuuuaag

SEQ ID NO: 923400 - RNA, 19 nt, Homo sapiens
agacauuacaccaucugaa

SEQ ID NO: 923401 - RNA, 19 nt, Homo sapiens
cccgagaaugaguaauuua

SEQ ID NO: 923402 - RNA, 19 nt, Homo sapiens
agaggaaguggauuuguuc

SEQ ID NO: 923403 - RNA, 19 nt, Homo sapiens
ucauguuucugacaaucau

SEQ ID NO: 923404 - RNA, 19 nt, Homo sapiens
ccaucaguaugucuucaag

SEQ ID NO: 923405 - RNA, 19 nt, Homo sapiens
aaucauguuucugacaauc

SEQ ID NO: 923406 - RNA, 19 nt, Homo sapiens
caagaacuggacaucaagu

SEQ ID NO: 923407 - RNA, 19 nt, Homo sapiens
gaacucaaguacagcaauu

SEQ ID NO: 923408 - RNA, 19 nt, Homo sapiens
gauguuaucuacucaguga

SEQ ID NO: 923409 - RNA, 19 nt, Homo sapiens
caaagagugugacaauuuc

SEQ ID NO: 923410 - RNA, 19 nt, Homo sapiens
ggugcucaauuaaacauua

SEQ ID NO: 923411 - RNA, 19 nt, Homo sapiens
caacaaagagugugacaau

SEQ ID NO: 923412 - RNA, 19 nt, Homo sapiens
acaaagagugugacaauuu

SEQ ID NO: 923413 - RNA, 19 nt, Homo sapiens
gaaguucugcuaugagcua

SEQ ID NO: 923414 - RNA, 19 nt, Homo sapiens
gagacccaauucccaguuu

SEQ ID NO: 923415 - RNA, 19 nt, Homo sapiens
gaucuggcgugauguuauc

SEQ ID NO: 923416 - RNA, 19 nt, Homo sapiens
gaagucaucauccugaaca

SEQ ID NO: 923417 - RNA, 19 nt, Homo sapiens
cgugguaccuggugggauu

SEQ ID NO: 923418 - RNA, 19 nt, Homo sapiens
ggagaaggaagucaucauc

SEQ ID NO: 923419 - RNA, 19 nt, Homo sapiens
gcacggacuauguguugaa

SEQ ID NO: 923420 - RNA, 19 nt, Homo sapiens
ucaagcaggaacucaagua

SEQ ID NO: 923421 - RNA, 19 nt, Homo sapiens
cggacuauguguugaagga

SEQ ID NO: 923422 - RNA, 19 nt, Homo sapiens
ugccugaucuggcgugaug

SEQ ID NO: 923423 - RNA, 19 nt, Homo sapiens
aaggcaaagucgacccaua

SEQ ID NO: 923424 - RNA, 19 nt, Homo sapiens
ccaauucccaguuucugaa

SEQ ID NO: 923425 - RNA, 19 nt, Homo sapiens
ccuccuugcugcccucuga

SEQ ID NO: 923426 - RNA, 19 nt, Homo sapiens
gacaauuucuaccacaacu

SEQ ID NO: 923427 - RNA, 19 nt, Homo sapiens
cgacaucggccuccucaag

SEQ ID NO: 923428 - RNA, 19 nt, Homo sapiens
caauuucuaccacaacuuc

SEQ ID NO: 923429 - RNA, 19 nt, Homo sapiens
gugacaauuucuaccacaa

SEQ ID NO: 923430 - RNA, 19 nt, Homo sapiens
ccauggagggcacguggua

SEQ ID NO: 923431 - RNA, 19 nt, Homo sapiens
aacaaagagugugacaauu

SEQ ID NO: 923432 - RNA, 19 nt, Homo sapiens
uaccacaacuucaccaaaa

SEQ ID NO: 923433 - RNA, 19 nt, Homo sapiens
ggcgugauguuaucuacuc

SEQ ID NO: 923434 - RNA, 19 nt, Homo sapiens
ggagacccaauucccaguu

SEQ ID NO: 923435 - RNA, 19 nt, Homo sapiens
ggaccauucaggagaagga

SEQ ID NO: 923436 - RNA, 19 nt, Homo sapiens
cauucccgcugcacuguga

SEQ ID NO: 923437 - RNA, 19 nt, Homo sapiens
gaucugggacugccucaac

SEQ ID NO: 923438 - RNA, 19 nt, Homo sapiens
cccaguuucugaaggcaaa

SEQ ID NO: 923439 - RNA, 19 nt, Homo sapiens
guccguggauugaccagau

SEQ ID NO: 923440 - RNA, 19 nt, Homo sapiens
ggaacucaaguacagcaau

SEQ ID NO: 923441 - RNA, 19 nt, Homo sapiens
ucaucauccugaacaacaa

SEQ ID NO: 923442 - RNA, 19 nt, Homo sapiens
gugauguuaucuacucagu

SEQ ID NO: 923443 - RNA, 19 nt, Homo sapiens
caauggcacacacaucugu

SEQ ID NO: 923444 - RNA, 19 nt, Homo sapiens
ucaagucccagaugaugug

SEQ ID NO: 923445 - RNA, 19 nt, Homo sapiens
ugaacaacaaagaguguga

SEQ ID NO: 923446 - RNA, 19 nt, Homo sapiens
caaaauccccacucugguu

SEQ ID NO: 923447 - RNA, 19 nt, Homo sapiens
gacggcauguggccucagu

SEQ ID NO: 923448 - RNA, 19 nt, Homo sapiens
uggcacggacuauguguug

SEQ ID NO: 923449 - RNA, 19 nt, Homo sapiens
uugcugaggucugcagguu

SEQ ID NO: 923450 - RNA, 19 nt, Homo sapiens
gugcucaauuaaacauuac

SEQ ID NO: 923451 - RNA, 19 nt, Homo sapiens
gaggugcucaauuaaacau

SEQ ID NO: 923452 - RNA, 19 nt, Homo sapiens
ugugugcccucccucacuu

SEQ ID NO: 923453 - RNA, 19 nt, Homo sapiens
caucauccugaacaacaaa

SEQ ID NO: 923454 - RNA, 19 nt, Homo sapiens
ucaaguacagcaauuacgu

SEQ ID NO: 923455 - RNA, 19 nt, Homo sapiens
gcucaagcaggaacucaag

SEQ ID NO: 923456 - RNA, 19 nt, Homo sapiens
cuaccacaacuucaccaaa

SEQ ID NO: 923457 - RNA, 19 nt, Homo sapiens
ccucaguuccggaccauuc

SEQ ID NO: 923458 - RNA, 19 nt, Homo sapiens
gaaacgaaauccaauaguu

SEQ ID NO: 923459 - RNA, 19 nt, Homo sapiens
ggaagaggauuaagaagga

SEQ ID NO: 923460 - RNA, 19 nt, Homo sapiens
gcacgacgcugccaacaac

SEQ ID NO: 923461 - RNA, 19 nt, Homo sapiens
gcagacgguugaugaugaa

SEQ ID NO: 923462 - RNA, 19 nt, Homo sapiens
cauacgauauugccuggua

SEQ ID NO: 923463 - RNA, 19 nt, Homo sapiens
gcaaaggcacuuacacuuc

SEQ ID NO: 923464 - RNA, 19 nt, Homo sapiens
gauauugccugguaguaag

SEQ ID NO: 923465 - RNA, 19 nt, Homo sapiens
gauggugaaccuccuguua

SEQ ID NO: 923466 - RNA, 19 nt, Homo sapiens
gcagcgacaugguggagaa

SEQ ID NO: 923467 - RNA, 19 nt, Homo sapiens
cgacaagcaccuauugaaa

SEQ ID NO: 923468 - RNA, 19 nt, Homo sapiens
gcagguggcccuucucaug

SEQ ID NO: 923469 - RNA, 19 nt, Homo sapiens
ggacgacaagcaccuauug

SEQ ID NO: 923470 - RNA, 19 nt, Homo sapiens
caaggacgaguaugaguuu

SEQ ID NO: 923471 - RNA, 19 nt, Homo sapiens
gauaaaguuucucuaacca

SEQ ID NO: 923472 - RNA, 19 nt, Homo sapiens
aagauaaacugaacaagag

SEQ ID NO: 923473 - RNA, 19 nt, Homo sapiens
aagaaagcgucccaucgua

SEQ ID NO: 923474 - RNA, 19 nt, Homo sapiens
ggagagcucagaagaggaa

SEQ ID NO: 923475 - RNA, 19 nt, Homo sapiens
gaaaagaaacgaaauccaa

SEQ ID NO: 923476 - RNA, 19 nt, Homo sapiens
gagcggaagaggauuaaga

SEQ ID NO: 923477 - RNA, 19 nt, Homo sapiens
ccucggagcacgaauauau

SEQ ID NO: 923478 - RNA, 19 nt, Homo sapiens
ggacgaguaugaguuugau

SEQ ID NO: 923479 - RNA, 19 nt, Homo sapiens
gaagggaacgcccaacucu

SEQ ID NO: 923480 - RNA, 19 nt, Homo sapiens
ccaaagauaaacugaacaa

SEQ ID NO: 923481 - RNA, 19 nt, Homo sapiens
gaaagcgucccaucguauc

SEQ ID NO: 923482 - RNA, 19 nt, Homo sapiens
cgacggagagcucagaaga

SEQ ID NO: 923483 - RNA, 19 nt, Homo sapiens
gaacaccaagggccuagau

SEQ ID NO: 923484 - RNA, 19 nt, Homo sapiens
cgcagacgguugaugauga

SEQ ID NO: 923485 - RNA, 19 nt, Homo sapiens
gcgagacgccgcugaaagu

SEQ ID NO: 923486 - RNA, 19 nt, Homo sapiens
caacaacgggcacuacaag

SEQ ID NO: 923487 - RNA, 19 nt, Homo sapiens
gauaaacugaacaagagaa

SEQ ID NO: 923488 - RNA, 19 nt, Homo sapiens
uaacacgauugcaccaaag

SEQ ID NO: 923489 - RNA, 19 nt, Homo sapiens
cgauauugccugguaguaa

SEQ ID NO: 923490 - RNA, 19 nt, Homo sapiens
auaacacgauugcaccaaa

SEQ ID NO: 923491 - RNA, 19 nt, Homo sapiens
ggcaaaggcacuuacacuu

SEQ ID NO: 923492 - RNA, 19 nt, Homo sapiens
gcccaacucugccucaaaa

SEQ ID NO: 923493 - RNA, 19 nt, Homo sapiens
gaggaggacgcgaguguca

SEQ ID NO: 923494 - RNA, 19 nt, Homo sapiens
gaacccagagccacagaag

SEQ ID NO: 923495 - RNA, 19 nt, Homo sapiens
cacgagagccuucuaaugc

SEQ ID NO: 923496 - RNA, 19 nt, Homo sapiens
gacaagcaccuauugaaaa

SEQ ID NO: 923497 - RNA, 19 nt, Homo sapiens
ucaaggacgaguaugaguu

SEQ ID NO: 923498 - RNA, 19 nt, Homo sapiens
gaaccuccuguuaggcaaa

SEQ ID NO: 923499 - RNA, 19 nt, Homo sapiens
gcaccauccuucgcaccuu

SEQ ID NO: 923500 - RNA, 19 nt, Homo sapiens
cagcagagcaacaggaaag

SEQ ID NO: 923501 - RNA, 19 nt, Homo sapiens
gcagaaggacucggacaca

SEQ ID NO: 923502 - RNA, 19 nt, Homo sapiens
ggagaagcagacugggaaa

SEQ ID NO: 923503 - RNA, 19 nt, Homo sapiens
aaccaaagauaaacugaac

SEQ ID NO: 923504 - RNA, 19 nt, Homo sapiens
aaucgcagacgguugauga

SEQ ID NO: 923505 - RNA, 19 nt, Homo sapiens
acacgagagccuucuaaug

SEQ ID NO: 923506 - RNA, 19 nt, Homo sapiens
aaagaaagcgucccaucgu

SEQ ID NO: 923507 - RNA, 19 nt, Homo sapiens
acaccaagggccuagauga

SEQ ID NO: 923508 - RNA, 19 nt, Homo sapiens
ccugagcggaagaggauua

SEQ ID NO: 923509 - RNA, 19 nt, Homo sapiens
agaaagcgucccaucguau

SEQ ID NO: 923510 - RNA, 19 nt, Homo sapiens
caaaauggagguuaaaagu

SEQ ID NO: 923511 - RNA, 19 nt, Homo sapiens
gacgacaagcaccuauuga

SEQ ID NO: 923512 - RNA, 19 nt, Homo sapiens
uggaaucgcagacgguuga

SEQ ID NO: 923513 - RNA, 19 nt, Homo sapiens
ucaagcacaaggccaagaa

SEQ ID NO: 923514 - RNA, 19 nt, Homo sapiens
ggaacccgcagcagagcaa

SEQ ID NO: 923515 - RNA, 19 nt, Homo sapiens
uagaugacgacacgccuuu

SEQ ID NO: 923516 - RNA, 19 nt, Homo sapiens
agacacgagagccuucuaa

SEQ ID NO: 923517 - RNA, 19 nt, Homo sapiens
uaaagcaccacagcaggaa

SEQ ID NO: 923518 - RNA, 19 nt, Homo sapiens
cuucgcaccuuccaguuca

SEQ ID NO: 923519 - RNA, 19 nt, Homo sapiens
caacagcccaguggacaca

SEQ ID NO: 923520 - RNA, 19 nt, Homo sapiens
gcauggggcugucuggaau

SEQ ID NO: 923521 - RNA, 19 nt, Homo sapiens
gcccugagcggaagaggau

SEQ ID NO: 923522 - RNA, 19 nt, Homo sapiens
cacgauugcaccaaagaaa

SEQ ID NO: 923523 - RNA, 19 nt, Homo sapiens
gcgacaugguggagaagca

SEQ ID NO: 923524 - RNA, 19 nt, Homo sapiens
agauaaaguuucucuaacc

SEQ ID NO: 923525 - RNA, 19 nt, Homo sapiens
ccaacaacgggcacuacaa

SEQ ID NO: 923526 - RNA, 19 nt, Homo sapiens
ccaagcagcagaaggaaaa

SEQ ID NO: 923527 - RNA, 19 nt, Homo sapiens
ggacucggacacagagaag

SEQ ID NO: 923528 - RNA, 19 nt, Homo sapiens
aagaaacgaaauccaauag

SEQ ID NO: 923529 - RNA, 19 nt, Homo sapiens
agaaggacucggacacaga

SEQ ID NO: 923530 - RNA, 19 nt, Homo sapiens
gacacgagagccuucuaau

SEQ ID NO: 923531 - RNA, 19 nt, Homo sapiens
ucucggcacauacgauauu

SEQ ID NO: 923532 - RNA, 19 nt, Homo sapiens
gcagcagagcaacaggaaa

SEQ ID NO: 923533 - RNA, 19 nt, Homo sapiens
ccaguggacacaacaccaa

SEQ ID NO: 923534 - RNA, 19 nt, Homo sapiens
acgaguaugaguuugauga

SEQ ID NO: 923535 - RNA, 19 nt, Homo sapiens
aaacugaacaagagaaacg

SEQ ID NO: 923536 - RNA, 19 nt, Homo sapiens
gccaagcagcagaaggaaa

SEQ ID NO: 923537 - RNA, 19 nt, Homo sapiens
ggagcacgaauauauacag

SEQ ID NO: 923538 - RNA, 19 nt, Homo sapiens
acgacaagcaccuauugaa

SEQ ID NO: 923539 - RNA, 19 nt, Homo sapiens
ggacaccaauccacucuuu

SEQ ID NO: 923540 - RNA, 19 nt, Homo sapiens
ggaugaggauucagauauu

SEQ ID NO: 923541 - RNA, 19 nt, Homo sapiens
gugcaagugucgagagaua

SEQ ID NO: 923542 - RNA, 19 nt, Homo sapiens
aauaaucccugcucacauu

SEQ ID NO: 923543 - RNA, 19 nt, Homo sapiens
gauaaaggucaauggcaua

SEQ ID NO: 923544 - RNA, 19 nt, Homo sapiens
gaugaggauucagauauug

SEQ ID NO: 923545 - RNA, 19 nt, Homo sapiens
ugacauggaugaggauuca

SEQ ID NO: 923546 - RNA, 19 nt, Homo sapiens
gcagguggauuucuacacu

SEQ ID NO: 923547 - RNA, 19 nt, Homo sapiens
cagacuacgugcccuuuga

SEQ ID NO: 923548 - RNA, 19 nt, Homo sapiens
gcaucuacguacauuacaa

SEQ ID NO: 923549 - RNA, 19 nt, Homo sapiens
gaaccugcuaacagaauaa

SEQ ID NO: 923550 - RNA, 19 nt, Homo sapiens
cccagaaccugcuaacaga

SEQ ID NO: 923551 - RNA, 19 nt, Homo sapiens
gauauugccuuccguuucc

SEQ ID NO: 923552 - RNA, 19 nt, Homo sapiens
acaaacugccugugucuuu

SEQ ID NO: 923553 - RNA, 19 nt, Homo sapiens
agaaccugcuaacagaaua

SEQ ID NO: 923554 - RNA, 19 nt, Homo sapiens
aauuugagcugugcaucua

SEQ ID NO: 923555 - RNA, 19 nt, Homo sapiens
caagaaggagagaacaaug

SEQ ID NO: 923556 - RNA, 19 nt, Homo sapiens
ccaauccacucuuuuauca

SEQ ID NO: 923557 - RNA, 19 nt, Homo sapiens
gcaagugucgagagauauc

SEQ ID NO: 923558 - RNA, 19 nt, Homo sapiens
cauacgcauuuacggcuuu

SEQ ID NO: 923559 - RNA, 19 nt, Homo sapiens
caaugaguaugagauaaag

SEQ ID NO: 923560 - RNA, 19 nt, Homo sapiens
ucgaaucccgccaucauuu

SEQ ID NO: 923561 - RNA, 19 nt, Homo sapiens
gaauaaucccugcucacau

SEQ ID NO: 923562 - RNA, 19 nt, Homo sapiens
cgagugcacuuuggcaauc

SEQ ID NO: 923563 - RNA, 19 nt, Homo sapiens
ccuacacuuugucauuaaa

SEQ ID NO: 923564 - RNA, 19 nt, Homo sapiens
ugaggauggcaaacaauuu

SEQ ID NO: 923565 - RNA, 19 nt, Homo sapiens
guugguuccugcgugauaa

SEQ ID NO: 923566 - RNA, 19 nt, Homo sapiens
ccaagaaggagagaacaau

SEQ ID NO: 923567 - RNA, 19 nt, Homo sapiens
caugaacaggcgugaguuu

SEQ ID NO: 923568 - RNA, 19 nt, Homo sapiens
gcacuuuggcaaucaugug

SEQ ID NO: 923569 - RNA, 19 nt, Homo sapiens
uggaugaggauucagauau

SEQ ID NO: 923570 - RNA, 19 nt, Homo sapiens
caauugagggagaugauca

SEQ ID NO: 923571 - RNA, 19 nt, Homo sapiens
gugaagauggugcaagugu

SEQ ID NO: 923572 - RNA, 19 nt, Homo sapiens
cgaaucccgccaucauuug

SEQ ID NO: 923573 - RNA, 19 nt, Homo sapiens
aguaugagauaaaggucaa

SEQ ID NO: 923574 - RNA, 19 nt, Homo sapiens
gaacaaugucuucuuuacc

SEQ ID NO: 923575 - RNA, 19 nt, Homo sapiens
cccuacacuuugucauuaa

SEQ ID NO: 923576 - RNA, 19 nt, Homo sapiens
gaaucccgccaucauuugu

SEQ ID NO: 923577 - RNA, 19 nt, Homo sapiens
cagugugugucugcaauug

SEQ ID NO: 923578 - RNA, 19 nt, Homo sapiens
caucgaaucccgccaucau

SEQ ID NO: 923579 - RNA, 19 nt, Homo sapiens
ggcgugaguuugggauaug

SEQ ID NO: 923580 - RNA, 19 nt, Homo sapiens
uuucuacacugacauggau

SEQ ID NO: 923581 - RNA, 19 nt, Homo sapiens
ggauuucuacacugacaug

SEQ ID NO: 923582 - RNA, 19 nt, Homo sapiens
agaauaaucccugcucaca

SEQ ID NO: 923583 - RNA, 19 nt, Homo sapiens
cgccaucauuugugaagau

SEQ ID NO: 923584 - RNA, 19 nt, Homo sapiens
guggauuucuacacugaca

SEQ ID NO: 923585 - RNA, 19 nt, Homo sapiens
uggaggagacaacagacua

SEQ ID NO: 923586 - RNA, 19 nt, Homo sapiens
gagugcacuuuggcaauca

SEQ ID NO: 923587 - RNA, 19 nt, Homo sapiens
cagauauugccuuccguuu

SEQ ID NO: 923588 - RNA, 19 nt, Homo sapiens
cagaaccugcuaacagaau

SEQ ID NO: 923589 - RNA, 19 nt, Homo sapiens
ccauacaaacugccugugu

SEQ ID NO: 923590 - RNA, 19 nt, Homo sapiens
cuacgugcccuuugaggau

SEQ ID NO: 923591 - RNA, 19 nt, Homo sapiens
gccaagaaggagagaacaa

SEQ ID NO: 923592 - RNA, 19 nt, Homo sapiens
acaccaauccacucuuuua

SEQ ID NO: 923593 - RNA, 19 nt, Homo sapiens
gaguuugggauauggaugu

SEQ ID NO: 923594 - RNA, 19 nt, Homo sapiens
gaaggagagaacaaugucu

SEQ ID NO: 923595 - RNA, 19 nt, Homo sapiens
gcaauugagggagaugauc

SEQ ID NO: 923596 - RNA, 19 nt, Homo sapiens
caucuacguacauuacaau

SEQ ID NO: 923597 - RNA, 19 nt, Homo sapiens
gugcaucuacguacauuac

SEQ ID NO: 923598 - RNA, 19 nt, Homo sapiens
ggaggagacaacagacuac

SEQ ID NO: 923599 - RNA, 19 nt, Homo sapiens
ccccuacacuuugucauua

SEQ ID NO: 923600 - RNA, 19 nt, Homo sapiens
aagaaggagagaacaaugu

SEQ ID NO: 923601 - RNA, 19 nt, Homo sapiens
ccagaaccugcuaacagaa

SEQ ID NO: 923602 - RNA, 19 nt, Homo sapiens
uggcauaucuccacuauua

SEQ ID NO: 923603 - RNA, 19 nt, Homo sapiens
gcaaauguguaauggcaua

SEQ ID NO: 923604 - RNA, 19 nt, Homo sapiens
gaggacagcuguaugaaga

SEQ ID NO: 923605 - RNA, 19 nt, Homo sapiens
gggcagaggugauagaugu

SEQ ID NO: 923606 - RNA, 19 nt, Homo sapiens
caacugcuguuccagauau

SEQ ID NO: 923607 - RNA, 19 nt, Homo sapiens
ggagaaagaaggacaguga

SEQ ID NO: 923608 - RNA, 19 nt, Homo sapiens
cuaauuggcuuguguggaa

SEQ ID NO: 923609 - RNA, 19 nt, Homo sapiens
gaaccaauauugaccuagu

SEQ ID NO: 923610 - RNA, 19 nt, Homo sapiens
acagagaaauugagcauau

SEQ ID NO: 923611 - RNA, 19 nt, Homo sapiens
uagagcaguuucauguuua

SEQ ID NO: 923612 - RNA, 19 nt, Homo sapiens
acacacaguuucccuuauu

SEQ ID NO: 923613 - RNA, 19 nt, Homo sapiens
ggugaacucugccuaggaa

SEQ ID NO: 923614 - RNA, 19 nt, Homo sapiens
ggaaucagcagcaccuuga

SEQ ID NO: 923615 - RNA, 19 nt, Homo sapiens
uuagagcaguuucauguuu

SEQ ID NO: 923616 - RNA, 19 nt, Homo sapiens
ggcauuugcugacaucuga

SEQ ID NO: 923617 - RNA, 19 nt, Homo sapiens
ugauacaucuuugcaauug

SEQ ID NO: 923618 - RNA, 19 nt, Homo sapiens
gaauuacugugauacaucu

SEQ ID NO: 923619 - RNA, 19 nt, Homo sapiens
gcaguuucauguuuacaga

SEQ ID NO: 923620 - RNA, 19 nt, Homo sapiens
ggacagugaauccugguaa

SEQ ID NO: 923621 - RNA, 19 nt, Homo sapiens
ucagugggcucacggaguu

SEQ ID NO: 923622 - RNA, 19 nt, Homo sapiens
ccauacuccuacaaacuua

SEQ ID NO: 923623 - RNA, 19 nt, Homo sapiens
gagugaaggcagugaauuu

SEQ ID NO: 923624 - RNA, 19 nt, Homo sapiens
gacagugaauccugguaaa

SEQ ID NO: 923625 - RNA, 19 nt, Homo sapiens
gaugggacuuggacuuaga

SEQ ID NO: 923626 - RNA, 19 nt, Homo sapiens
cacacaguuucccuuauua

SEQ ID NO: 923627 - RNA, 19 nt, Homo sapiens
ggacuuggacuuagaagca

SEQ ID NO: 923628 - RNA, 19 nt, Homo sapiens
gaaagaaggacagugaauc

SEQ ID NO: 923629 - RNA, 19 nt, Homo sapiens
aaacacccaucggaucuaa

SEQ ID NO: 923630 - RNA, 19 nt, Homo sapiens
uuacuggacucuaacucua

SEQ ID NO: 923631 - RNA, 19 nt, Homo sapiens
gggcuacuaugcugggaaa

SEQ ID NO: 923632 - RNA, 19 nt, Homo sapiens
uagcaucucucccuacaca

SEQ ID NO: 923633 - RNA, 19 nt, Homo sapiens
ggagugaucucugcuuagg

SEQ ID NO: 923634 - RNA, 19 nt, Homo sapiens
ccggagugaucucugcuua

SEQ ID NO: 923635 - RNA, 19 nt, Homo sapiens
gcagugaauuugggcaaug

SEQ ID NO: 923636 - RNA, 19 nt, Homo sapiens
ucacucaccucaugucuac

SEQ ID NO: 923637 - RNA, 19 nt, Homo sapiens
gggaugggacuuggacuua

SEQ ID NO: 923638 - RNA, 19 nt, Homo sapiens
cacgggagcuggagcaaug

SEQ ID NO: 923639 - RNA, 19 nt, Homo sapiens
ucacuucccuagccucaga

SEQ ID NO: 923640 - RNA, 19 nt, Homo sapiens
gguuugaggugaguucuga

SEQ ID NO: 923641 - RNA, 19 nt, Homo sapiens
caacgugugaaauauguuu

SEQ ID NO: 923642 - RNA, 19 nt, Homo sapiens
gcagauuggagcuaacuga

SEQ ID NO: 923643 - RNA, 19 nt, Homo sapiens
cuacacacaguuucccuua

SEQ ID NO: 923644 - RNA, 19 nt, Homo sapiens
cagagaaauugagcauauu

SEQ ID NO: 923645 - RNA, 19 nt, Homo sapiens
ggacagcuguaugaagaca

SEQ ID NO: 923646 - RNA, 19 nt, Homo sapiens
gauacaucuuugcaauuga

SEQ ID NO: 923647 - RNA, 19 nt, Homo sapiens
caguuucccuuauuauuca

SEQ ID NO: 923648 - RNA, 19 nt, Homo sapiens
gaggugaguucugauaucu

SEQ ID NO: 923649 - RNA, 19 nt, Homo sapiens
ccagcaacgugugaaauau

SEQ ID NO: 923650 - RNA, 19 nt, Homo sapiens
ucagaggacagcuguauga

SEQ ID NO: 923651 - RNA, 19 nt, Homo sapiens
ucagaugggugaguaaaca

SEQ ID NO: 923652 - RNA, 19 nt, Homo sapiens
ggacuggguugcccuugag

SEQ ID NO: 923653 - RNA, 19 nt, Homo sapiens
cuccagaacugcaagaaau

SEQ ID NO: 923654 - RNA, 19 nt, Homo sapiens
cagcagcaccuugauauug

SEQ ID NO: 923655 - RNA, 19 nt, Homo sapiens
gugaauccugguaaacuua

SEQ ID NO: 923656 - RNA, 19 nt, Homo sapiens
cagcacucauucauucauu

SEQ ID NO: 923657 - RNA, 19 nt, Homo sapiens
gcaccuugauauuggacuu

SEQ ID NO: 923658 - RNA, 19 nt, Homo sapiens
cugcugcugucucaguuua

SEQ ID NO: 923659 - RNA, 19 nt, Homo sapiens
ugaguaaacagacguaugu

SEQ ID NO: 923660 - RNA, 19 nt, Homo sapiens
acacccaucggaucuaaua

SEQ ID NO: 923661 - RNA, 19 nt, Homo sapiens
gagaaggcagccaucugua

SEQ ID NO: 923662 - RNA, 19 nt, Homo sapiens
uuccagauaugacuacuga

SEQ ID NO: 923663 - RNA, 19 nt, Homo sapiens
gcaacugcuguuccagaua

SEQ ID NO: 923664 - RNA, 19 nt, Homo sapiens
cagguggccucacuuguca

SEQ ID NO: 923665 - RNA, 19 nt, Homo sapiens
agacaccucuguggacuug

SEQ ID NO: 923666 - RNA, 19 nt, Homo sapiens
gaaggcagccaucuguaag

SEQ ID NO: 923667 - RNA, 19 nt, Homo sapiens
agacauggccucguucuug

SEQ ID NO: 923668 - RNA, 19 nt, Homo sapiens
ggaccuugccauacuccua

SEQ ID NO: 923669 - RNA, 19 nt, Homo sapiens
gcauaucuccacuauuaca

SEQ ID NO: 923670 - RNA, 19 nt, Homo sapiens
ugugauacaucuuugcaau

SEQ ID NO: 923671 - RNA, 19 nt, Homo sapiens
gaagaagggcaggcaggaa

SEQ ID NO: 923672 - RNA, 19 nt, Homo sapiens
aggaagacauggccucguu

SEQ ID NO: 923673 - RNA, 19 nt, Homo sapiens
ucccagcacucauucauuc

SEQ ID NO: 923674 - RNA, 19 nt, Homo sapiens
gaacugcaagaaauaagca

SEQ ID NO: 923675 - RNA, 19 nt, Homo sapiens
ggaagagagcccucaccaa

SEQ ID NO: 923676 - RNA, 19 nt, Homo sapiens
caguuuaccugggcaguug

SEQ ID NO: 923677 - RNA, 19 nt, Homo sapiens
ccauugaucuggcgaaagc

SEQ ID NO: 923678 - RNA, 19 nt, Homo sapiens
gagaaagaaggacagugaa

SEQ ID NO: 923679 - RNA, 19 nt, Homo sapiens
ggaaaauugucagucaaaa

SEQ ID NO: 923680 - RNA, 19 nt, Homo sapiens
ccagaacugcaagaaauaa

SEQ ID NO: 923681 - RNA, 19 nt, Homo sapiens
ggacuuccagccuccagaa

SEQ ID NO: 923682 - RNA, 19 nt, Homo sapiens
uauagcaucucucccuaca

SEQ ID NO: 923683 - RNA, 19 nt, Homo sapiens
ggagugaaggcagugaauu

SEQ ID NO: 923684 - RNA, 19 nt, Homo sapiens
gcagcaccuugauauugga

SEQ ID NO: 923685 - RNA, 19 nt, Homo sapiens
agaaggcagccaucuguaa

SEQ ID NO: 923686 - RNA, 19 nt, Homo sapiens
ggaugggacuuggacuuag

SEQ ID NO: 923687 - RNA, 19 nt, Homo sapiens
gccauacuccuacaaacuu

SEQ ID NO: 923688 - RNA, 19 nt, Homo sapiens
gcacucauucauucauuca

SEQ ID NO: 923689 - RNA, 19 nt, Homo sapiens
uauggcagauuggagcuaa

SEQ ID NO: 923690 - RNA, 19 nt, Homo sapiens
cugcagugcuuccuuaugg

SEQ ID NO: 923691 - RNA, 19 nt, Homo sapiens
ggggauuacuggacucuaa

SEQ ID NO: 923692 - RNA, 19 nt, Homo sapiens
ugaggugaguucugauauc

SEQ ID NO: 923693 - RNA, 19 nt, Homo sapiens
ucaccagccucccaacaca

SEQ ID NO: 923694 - RNA, 19 nt, Homo sapiens
caagacaccagggcauuug

SEQ ID NO: 923695 - RNA, 19 nt, Homo sapiens
guaugaagacacagagaga

SEQ ID NO: 923696 - RNA, 19 nt, Homo sapiens
guucacucuucuuguugua

SEQ ID NO: 923697 - RNA, 19 nt, Homo sapiens
cccagcaacgugugaaaua

SEQ ID NO: 923698 - RNA, 19 nt, Homo sapiens
aauggcauaucuccacuau

SEQ ID NO: 923699 - RNA, 19 nt, Homo sapiens
gcugugaguucgggcaaau

SEQ ID NO: 923700 - RNA, 19 nt, Homo sapiens
acaugaggguucacucuuc

SEQ ID NO: 923701 - RNA, 19 nt, Homo sapiens
uuacugugauacaucuuug

SEQ ID NO: 923702 - RNA, 19 nt, Homo sapiens
gaagaaagauggagucaaa

SEQ ID NO: 923703 - RNA, 19 nt, Homo sapiens
aaacuaaacuugcugcuua

SEQ ID NO: 923704 - RNA, 19 nt, Homo sapiens
ugaaaggacucacuuggua

SEQ ID NO: 923705 - RNA, 19 nt, Homo sapiens
ggacaguauuuauguauga

SEQ ID NO: 923706 - RNA, 19 nt, Homo sapiens
gaggauauuugcugucuuu

SEQ ID NO: 923707 - RNA, 19 nt, Homo sapiens
uaaacuugcugcuuaauga

SEQ ID NO: 923708 - RNA, 19 nt, Homo sapiens
gaagucaucuggacaagca

SEQ ID NO: 923709 - RNA, 19 nt, Homo sapiens
ggaggagaaugaagaaaga

SEQ ID NO: 923710 - RNA, 19 nt, Homo sapiens
ccagaaagaugaggauauu

SEQ ID NO: 923711 - RNA, 19 nt, Homo sapiens
cauaguagcuacagacaga

SEQ ID NO: 923712 - RNA, 19 nt, Homo sapiens
gaaaggauacuucugaaca

SEQ ID NO: 923713 - RNA, 19 nt, Homo sapiens
ccaagcaaaucauccauug

SEQ ID NO: 923714 - RNA, 19 nt, Homo sapiens
ggagaaugauggaugugaa

SEQ ID NO: 923715 - RNA, 19 nt, Homo sapiens
agaccuggcugcacuaauu

SEQ ID NO: 923716 - RNA, 19 nt, Homo sapiens
gaacgggacaguauuuaug

SEQ ID NO: 923717 - RNA, 19 nt, Homo sapiens
ucaaagaagcaaagugaua

SEQ ID NO: 923718 - RNA, 19 nt, Homo sapiens
agggagaccuugauacuuu

SEQ ID NO: 923719 - RNA, 19 nt, Homo sapiens
gaaaggacucacuugguaa

SEQ ID NO: 923720 - RNA, 19 nt, Homo sapiens
gcacauccuccaaaugaaa

SEQ ID NO: 923721 - RNA, 19 nt, Homo sapiens
gguugagaaucccuaauuu

SEQ ID NO: 923722 - RNA, 19 nt, Homo sapiens
gaagcaaagugauacacau

SEQ ID NO: 923723 - RNA, 19 nt, Homo sapiens
cacaacaacuaaugagauu

SEQ ID NO: 923724 - RNA, 19 nt, Homo sapiens
gcagggcauuccagaaaga

SEQ ID NO: 923725 - RNA, 19 nt, Homo sapiens
acauucaucuuccguuuaa

SEQ ID NO: 923726 - RNA, 19 nt, Homo sapiens
ugacauucaucuuccguuu

SEQ ID NO: 923727 - RNA, 19 nt, Homo sapiens
gguugugaaugauuucuuu

SEQ ID NO: 923728 - RNA, 19 nt, Homo sapiens
ucugggagccaucuuauua

SEQ ID NO: 923729 - RNA, 19 nt, Homo sapiens
caucaaguccugaguggua

SEQ ID NO: 923730 - RNA, 19 nt, Homo sapiens
gaauuacugugaaagucaa

SEQ ID NO: 923731 - RNA, 19 nt, Homo sapiens
gaagacggguugagaaucc

SEQ ID NO: 923732 - RNA, 19 nt, Homo sapiens
cuaauugucuauugggaaa

SEQ ID NO: 923733 - RNA, 19 nt, Homo sapiens
ugagugugguugugaauga

SEQ ID NO: 923734 - RNA, 19 nt, Homo sapiens
gaaucaacacaacaacuaa

SEQ ID NO: 923735 - RNA, 19 nt, Homo sapiens
ggauacuucugaacaagga

SEQ ID NO: 923736 - RNA, 19 nt, Homo sapiens
caagauacaaacucaaaga

SEQ ID NO: 923737 - RNA, 19 nt, Homo sapiens
ggacucacuugguaauucu

SEQ ID NO: 923738 - RNA, 19 nt, Homo sapiens
gacaagcagugaccaucaa

SEQ ID NO: 923739 - RNA, 19 nt, Homo sapiens
ggcauuugcugaacgcauu

SEQ ID NO: 923740 - RNA, 19 nt, Homo sapiens
aaaggauacuucugaacaa

SEQ ID NO: 923741 - RNA, 19 nt, Homo sapiens
cauccaagauacaaacuca

SEQ ID NO: 923742 - RNA, 19 nt, Homo sapiens
caagcgaauuacugugaaa

SEQ ID NO: 923743 - RNA, 19 nt, Homo sapiens
gauuugcucacaucuagua

SEQ ID NO: 923744 - RNA, 19 nt, Homo sapiens
agaaagaugaggauauuug

SEQ ID NO: 923745 - RNA, 19 nt, Homo sapiens
aaauguggcauccaagaua

SEQ ID NO: 923746 - RNA, 19 nt, Homo sapiens
ggacaagcagugaccauca

SEQ ID NO: 923747 - RNA, 19 nt, Homo sapiens
cauuggaacuucugaucuu

SEQ ID NO: 923748 - RNA, 19 nt, Homo sapiens
ggaaauggaggauaagaac

SEQ ID NO: 923749 - RNA, 19 nt, Homo sapiens
ggaccuauaugugguagag

SEQ ID NO: 923750 - RNA, 19 nt, Homo sapiens
ggaacgggacaguauuuau

SEQ ID NO: 923751 - RNA, 19 nt, Homo sapiens
aagcagaggaggagaauga

SEQ ID NO: 923752 - RNA, 19 nt, Homo sapiens
gagacguaauccagcauug

SEQ ID NO: 923753 - RNA, 19 nt, Homo sapiens
gagaaugauggaugugaaa

SEQ ID NO: 923754 - RNA, 19 nt, Homo sapiens
gacauucaucuuccguuua

SEQ ID NO: 923755 - RNA, 19 nt, Homo sapiens
caaaugaaaggacucacuu

SEQ ID NO: 923756 - RNA, 19 nt, Homo sapiens
gguagaguaugguagcaau

SEQ ID NO: 923757 - RNA, 19 nt, Homo sapiens
uggcacauccuccaaauga

SEQ ID NO: 923758 - RNA, 19 nt, Homo sapiens
agaaucaacacaacaacua

SEQ ID NO: 923759 - RNA, 19 nt, Homo sapiens
gagaagcuuuucaauguga

SEQ ID NO: 923760 - RNA, 19 nt, Homo sapiens
ggaaaugcugcacuucaga

SEQ ID NO: 923761 - RNA, 19 nt, Homo sapiens
gaaagcagaggaggagaau

SEQ ID NO: 923762 - RNA, 19 nt, Homo sapiens
gcacuucagaucacagaug

SEQ ID NO: 923763 - RNA, 19 nt, Homo sapiens
gaaaugcugcacuucagau

SEQ ID NO: 923764 - RNA, 19 nt, Homo sapiens
gaguaugguagcaauauga

SEQ ID NO: 923765 - RNA, 19 nt, Homo sapiens
gggacaguauuuauguaug

SEQ ID NO: 923766 - RNA, 19 nt, Homo sapiens
ccacucaaugccucaauuu

SEQ ID NO: 923767 - RNA, 19 nt, Homo sapiens
ccagucaccucugaacaug

SEQ ID NO: 923768 - RNA, 19 nt, Homo sapiens
gcgaauuacugugaaaguc

SEQ ID NO: 923769 - RNA, 19 nt, Homo sapiens
gggaaaugcugcacuucag

SEQ ID NO: 923770 - RNA, 19 nt, Homo sapiens
uuaaugauuugcucacauc

SEQ ID NO: 923771 - RNA, 19 nt, Homo sapiens
ggguugagaaucccuaauu

SEQ ID NO: 923772 - RNA, 19 nt, Homo sapiens
ggauauuugcugucuuuau

SEQ ID NO: 923773 - RNA, 19 nt, Homo sapiens
ggagggagaccuugauacu

SEQ ID NO: 923774 - RNA, 19 nt, Homo sapiens
gggcauuccagaaagauga

SEQ ID NO: 923775 - RNA, 19 nt, Homo sapiens
gaaauggaggauaagaaca

SEQ ID NO: 923776 - RNA, 19 nt, Homo sapiens
gggaaauggaggauaagaa

SEQ ID NO: 923777 - RNA, 19 nt, Homo sapiens
gaaagucaaugccccauac

SEQ ID NO: 923778 - RNA, 19 nt, Homo sapiens
uugagaaucccuaauuuga

SEQ ID NO: 923779 - RNA, 19 nt, Homo sapiens
cagaggaggagaaugaaga

SEQ ID NO: 923780 - RNA, 19 nt, Homo sapiens
caaagaagcaaagugauac

SEQ ID NO: 923781 - RNA, 19 nt, Homo sapiens
gaaagaugaggauauuugc

SEQ ID NO: 923782 - RNA, 19 nt, Homo sapiens
acucaaagaagcaaaguga

SEQ ID NO: 923783 - RNA, 19 nt, Homo sapiens
guguaccgcugcaugauca

SEQ ID NO: 923784 - RNA, 19 nt, Homo sapiens
gggagaccuugauacuuuc

SEQ ID NO: 923785 - RNA, 19 nt, Homo sapiens
gggcugagcgugacaagag

SEQ ID NO: 923786 - RNA, 19 nt, Homo sapiens
agucaccucugaacaugaa

SEQ ID NO: 923787 - RNA, 19 nt, Homo sapiens
gcucacaucuaguaaaaca

SEQ ID NO: 923788 - RNA, 19 nt, Homo sapiens
guugagaaucccuaauuug

SEQ ID NO: 923789 - RNA, 19 nt, Homo sapiens
ggaaaaccauacagcugaa

SEQ ID NO: 923790 - RNA, 19 nt, Homo sapiens
cuaaugagauuuucuacug

SEQ ID NO: 923791 - RNA, 19 nt, Homo sapiens
auugggaaauggaggauaa

SEQ ID NO: 923792 - RNA, 19 nt, Homo sapiens
gaggucuucuugucaugug

SEQ ID NO: 923793 - RNA, 19 nt, Homo sapiens
caagagagaggagaagcuu

SEQ ID NO: 923794 - RNA, 19 nt, Homo sapiens
caccaccaauuccaagaga

SEQ ID NO: 923795 - RNA, 19 nt, Homo sapiens
guagaguaugguagcaaua

SEQ ID NO: 923796 - RNA, 19 nt, Homo sapiens
cgaauuacugugaaaguca

SEQ ID NO: 923797 - RNA, 19 nt, Homo sapiens
gaaagauggagucaaacag

SEQ ID NO: 923798 - RNA, 19 nt, Homo sapiens
cgaaagcagaggaggagaa

SEQ ID NO: 923799 - RNA, 19 nt, Homo sapiens
gcaggcaaugugggacuua

SEQ ID NO: 923800 - RNA, 19 nt, Homo sapiens
caacacaacaacuaaugag

SEQ ID NO: 923801 - RNA, 19 nt, Homo sapiens
acacugagaaucaacacaa

SEQ ID NO: 923802 - RNA, 19 nt, Homo sapiens
gaacugagcuauaauaugg

SEQ ID NO: 923803 - RNA, 19 nt, Homo sapiens
caagaacacuccuagauuu

SEQ ID NO: 923804 - RNA, 19 nt, Homo sapiens
gaagugcucuggauguuaa

SEQ ID NO: 923805 - RNA, 19 nt, Homo sapiens
gaaaguacaacucguauuu

SEQ ID NO: 923806 - RNA, 19 nt, Homo sapiens
gaacauagccacaucuaga

SEQ ID NO: 923807 - RNA, 19 nt, Homo sapiens
gaauguaucuccuagcuau

SEQ ID NO: 923808 - RNA, 19 nt, Homo sapiens
uaacagagccuuuauggaa

SEQ ID NO: 923809 - RNA, 19 nt, Homo sapiens
uagaagagcuaaagaaaga

SEQ ID NO: 923810 - RNA, 19 nt, Homo sapiens
caaauuaucucugaagugu

SEQ ID NO: 923811 - RNA, 19 nt, Homo sapiens
gagagaugcucauguguga

SEQ ID NO: 923812 - RNA, 19 nt, Homo sapiens
cagcagaaaucacagauga

SEQ ID NO: 923813 - RNA, 19 nt, Homo sapiens
uaaaagagcugaaagagaa

SEQ ID NO: 923814 - RNA, 19 nt, Homo sapiens
uaaaugagauugagcaaag

SEQ ID NO: 923815 - RNA, 19 nt, Homo sapiens
ccacagacaccagauauua

SEQ ID NO: 923816 - RNA, 19 nt, Homo sapiens
gaagcuguguccacuauug

SEQ ID NO: 923817 - RNA, 19 nt, Homo sapiens
gauaucagcuuugacaaga

SEQ ID NO: 923818 - RNA, 19 nt, Homo sapiens
cgaaggacuuugaggauuu

SEQ ID NO: 923819 - RNA, 19 nt, Homo sapiens
gaacaucagcuucucaaga

SEQ ID NO: 923820 - RNA, 19 nt, Homo sapiens
gggaaugaauccauaguug

SEQ ID NO: 923821 - RNA, 19 nt, Homo sapiens
gcuuugauuuggaugauua

SEQ ID NO: 923822 - RNA, 19 nt, Homo sapiens
cacauuagcuuuccucaug

SEQ ID NO: 923823 - RNA, 19 nt, Homo sapiens
gauagaagagcuaaagaaa

SEQ ID NO: 923824 - RNA, 19 nt, Homo sapiens
ugacacaucuggcagcauu

SEQ ID NO: 923825 - RNA, 19 nt, Homo sapiens
gaacaccugucaagauugg

SEQ ID NO: 923826 - RNA, 19 nt, Homo sapiens
cuucugaccuuucgccuua

SEQ ID NO: 923827 - RNA, 19 nt, Homo sapiens
guaaucagguggauguaga

SEQ ID NO: 923828 - RNA, 19 nt, Homo sapiens
gaaaacagguacuuuacaa

SEQ ID NO: 923829 - RNA, 19 nt, Homo sapiens
cuagauagaugugagcuuu

SEQ ID NO: 923830 - RNA, 19 nt, Homo sapiens
caauugacguugaauagga

SEQ ID NO: 923831 - RNA, 19 nt, Homo sapiens
gcuauaauauggagcuuuc

SEQ ID NO: 923832 - RNA, 19 nt, Homo sapiens
gcucagaguccacauacua

SEQ ID NO: 923833 - RNA, 19 nt, Homo sapiens
caaguuuaauugugcauga

SEQ ID NO: 923834 - RNA, 19 nt, Homo sapiens
gagaaauuccucagaguga

SEQ ID NO: 923835 - RNA, 19 nt, Homo sapiens
gucaauauaucauccuuug

SEQ ID NO: 923836 - RNA, 19 nt, Homo sapiens
gauuagaccagaggauuua

SEQ ID NO: 923837 - RNA, 19 nt, Homo sapiens
gccaaaugcugcucauaga

SEQ ID NO: 923838 - RNA, 19 nt, Homo sapiens
gcuauggacuaaauaauac

SEQ ID NO: 923839 - RNA, 19 nt, Homo sapiens
gcagaggacugaccaugag

SEQ ID NO: 923840 - RNA, 19 nt, Homo sapiens
ugaaggaaaugaaguccaa

SEQ ID NO: 923841 - RNA, 19 nt, Homo sapiens
aaagauggauacuaugaug

SEQ ID NO: 923842 - RNA, 19 nt, Homo sapiens
aaacaccuauuugggauaa

SEQ ID NO: 923843 - RNA, 19 nt, Homo sapiens
uagaauguuugacuucgua

SEQ ID NO: 923844 - RNA, 19 nt, Homo sapiens
cagcauugacugacuauaa

SEQ ID NO: 923845 - RNA, 19 nt, Homo sapiens
gaaagagaaauuccucaga

SEQ ID NO: 923846 - RNA, 19 nt, Homo sapiens
ugaugaaucugguuccauu

SEQ ID NO: 923847 - RNA, 19 nt, Homo sapiens
gcgaaggacuuugaggauu

SEQ ID NO: 923848 - RNA, 19 nt, Homo sapiens
ccaagaacacuccuagauu

SEQ ID NO: 923849 - RNA, 19 nt, Homo sapiens
uauugacccuuaucuguaa

SEQ ID NO: 923850 - RNA, 19 nt, Homo sapiens
guacaacucguauuuaucu

SEQ ID NO: 923851 - RNA, 19 nt, Homo sapiens
gaaugaucuuucucuaguu

SEQ ID NO: 923852 - RNA, 19 nt, Homo sapiens
ggaagcagcagaaaucaca

SEQ ID NO: 923853 - RNA, 19 nt, Homo sapiens
gcaggaaaauuacaacuau

SEQ ID NO: 923854 - RNA, 19 nt, Homo sapiens
guauugacccuuaucugua

SEQ ID NO: 923855 - RNA, 19 nt, Homo sapiens
cacauaauaucagcacuuu

SEQ ID NO: 923856 - RNA, 19 nt, Homo sapiens
gaaauuccucagagugaaa

SEQ ID NO: 923857 - RNA, 19 nt, Homo sapiens
gggccaggcugacugaaug

SEQ ID NO: 923858 - RNA, 19 nt, Homo sapiens
aggaacaccugucaagauu

SEQ ID NO: 923859 - RNA, 19 nt, Homo sapiens
caucccaacuaacaauaaa

SEQ ID NO: 923860 - RNA, 19 nt, Homo sapiens
gagcccaacuucuaaaggu

SEQ ID NO: 923861 - RNA, 19 nt, Homo sapiens
guagaaggguuaguaugga

SEQ ID NO: 923862 - RNA, 19 nt, Homo sapiens
cauaauaucagcacuuugu

SEQ ID NO: 923863 - RNA, 19 nt, Homo sapiens
caauaaagaguaggcuaua

SEQ ID NO: 923864 - RNA, 19 nt, Homo sapiens
ggauuagaccagaggauuu

SEQ ID NO: 923865 - RNA, 19 nt, Homo sapiens
uaagaaaggacacaucugu

SEQ ID NO: 923866 - RNA, 19 nt, Homo sapiens
aaagaaaacucguuccauu

SEQ ID NO: 923867 - RNA, 19 nt, Homo sapiens
gcgaagugcucuggauguu

SEQ ID NO: 923868 - RNA, 19 nt, Homo sapiens
gaagauuauacuacuggua

SEQ ID NO: 923869 - RNA, 19 nt, Homo sapiens
gaagucacaucugccuguu

SEQ ID NO: 923870 - RNA, 19 nt, Homo sapiens
ucagcaaaguggaugauau

SEQ ID NO: 923871 - RNA, 19 nt, Homo sapiens
gaaggacuuugaggauuuc

SEQ ID NO: 923872 - RNA, 19 nt, Homo sapiens
ugacagaaacccuaccuau

SEQ ID NO: 923873 - RNA, 19 nt, Homo sapiens
caaaugcugcucauagaau

SEQ ID NO: 923874 - RNA, 19 nt, Homo sapiens
gaagagcuaaagaaagaug

SEQ ID NO: 923875 - RNA, 19 nt, Homo sapiens
agaaagauggauacuauga

SEQ ID NO: 923876 - RNA, 19 nt, Homo sapiens
guuccacccucaccaagaa

SEQ ID NO: 923877 - RNA, 19 nt, Homo sapiens
aagaaaagcuacagucauu

SEQ ID NO: 923878 - RNA, 19 nt, Homo sapiens
cuccucaagucacauaaua

SEQ ID NO: 923879 - RNA, 19 nt, Homo sapiens
gacaccagauauuaaagug

SEQ ID NO: 923880 - RNA, 19 nt, Homo sapiens
ggagucaguucaugauggu

SEQ ID NO: 923881 - RNA, 19 nt, Homo sapiens
gaaagauggauacuaugau

SEQ ID NO: 923882 - RNA, 19 nt, Homo sapiens
caaagaggucugacugaga

SEQ ID NO: 923883 - RNA, 19 nt, Homo sapiens
ggaaauacaaggaucuuuu

SEQ ID NO: 923884 - RNA, 19 nt, Homo sapiens
cacuuuggaugcugaaauu

SEQ ID NO: 923885 - RNA, 19 nt, Homo sapiens
guugggagcuuuuagauga

SEQ ID NO: 923886 - RNA, 19 nt, Homo sapiens
gcagccuccuguacucauu

SEQ ID NO: 923887 - RNA, 19 nt, Homo sapiens
ggccaacagggacacauua

SEQ ID NO: 923888 - RNA, 19 nt, Homo sapiens
gcaaauuaucucugaagug

SEQ ID NO: 923889 - RNA, 19 nt, Homo sapiens
ugcaugacuuuguuucuaa

SEQ ID NO: 923890 - RNA, 19 nt, Homo sapiens
gacuucguauugacccuua

SEQ ID NO: 923891 - RNA, 19 nt, Homo sapiens
gaaggguuaguauggaauu

SEQ ID NO: 923892 - RNA, 19 nt, Homo sapiens
uagaaggguuaguauggaa

SEQ ID NO: 923893 - RNA, 19 nt, Homo sapiens
ucuccuagcuauggacuaa

SEQ ID NO: 923894 - RNA, 19 nt, Homo sapiens
ucccagacuucuccaauga

SEQ ID NO: 923895 - RNA, 19 nt, Homo sapiens
gauaggaacaccugucaag

SEQ ID NO: 923896 - RNA, 19 nt, Homo sapiens
aaaccugaauccuguguuc

SEQ ID NO: 923897 - RNA, 19 nt, Homo sapiens
gaaugaauccauaguugca

SEQ ID NO: 923898 - RNA, 19 nt, Homo sapiens
gauugggacucuucuuugg

SEQ ID NO: 923899 - RNA, 19 nt, Homo sapiens
caacuaagcgaggagcaaa

SEQ ID NO: 923900 - RNA, 19 nt, Homo sapiens
gaacuagugaugggaguau

SEQ ID NO: 923901 - RNA, 19 nt, Homo sapiens
aaauggauguugccaaucu

SEQ ID NO: 923902 - RNA, 19 nt, Homo sapiens
ucacauaccugcagacaaa

SEQ ID NO: 923903 - RNA, 19 nt, Homo sapiens
gcucagaggugcugguaaa

SEQ ID NO: 923904 - RNA, 19 nt, Homo sapiens
gaggagacguuccagugua

SEQ ID NO: 923905 - RNA, 19 nt, Homo sapiens
ggaaggaccggaucaagaa

SEQ ID NO: 923906 - RNA, 19 nt, Homo sapiens
gggaaccguuugagccuua

SEQ ID NO: 923907 - RNA, 19 nt, Homo sapiens
gauauaacguuaggguuug

SEQ ID NO: 923908 - RNA, 19 nt, Homo sapiens
gggccuaguucaaaccuuu

SEQ ID NO: 923909 - RNA, 19 nt, Homo sapiens
gcaagggcauggccugugu

SEQ ID NO: 923910 - RNA, 19 nt, Homo sapiens
gcaagaagaaggcgaagau

SEQ ID NO: 923911 - RNA, 19 nt, Homo sapiens
cagacaaacuggagcaaug

SEQ ID NO: 923912 - RNA, 19 nt, Homo sapiens
uguacaaggucaaugagua

SEQ ID NO: 923913 - RNA, 19 nt, Homo sapiens
gaacagucuugugaucaga

SEQ ID NO: 923914 - RNA, 19 nt, Homo sapiens
gaucagaaacucaccaaca

SEQ ID NO: 923915 - RNA, 19 nt, Homo sapiens
gccauacccucuucgacua

SEQ ID NO: 923916 - RNA, 19 nt, Homo sapiens
uguuagcacugaauuauug

SEQ ID NO: 923917 - RNA, 19 nt, Homo sapiens
ggacuucucaguauugugu

SEQ ID NO: 923918 - RNA, 19 nt, Homo sapiens
cgacauggccuuccacauc

SEQ ID NO: 923919 - RNA, 19 nt, Homo sapiens
ggacggccauacccucuuc

SEQ ID NO: 923920 - RNA, 19 nt, Homo sapiens
ucagcugucuguugaaguu

SEQ ID NO: 923921 - RNA, 19 nt, Homo sapiens
caucuaaaguccagugaca

SEQ ID NO: 923922 - RNA, 19 nt, Homo sapiens
gggaagaaugagacaauuu

SEQ ID NO: 923923 - RNA, 19 nt, Homo sapiens
caagugccuuugauucguu

SEQ ID NO: 923924 - RNA, 19 nt, Homo sapiens
ggucagagcaagcaucuuc

SEQ ID NO: 923925 - RNA, 19 nt, Homo sapiens
aaacaucucgggccuaguu

SEQ ID NO: 923926 - RNA, 19 nt, Homo sapiens
uggcucagcugucuguuga

SEQ ID NO: 923927 - RNA, 19 nt, Homo sapiens
cagcagagcagccucauca

SEQ ID NO: 923928 - RNA, 19 nt, Homo sapiens
ccaguacuuuguccagauu

SEQ ID NO: 923929 - RNA, 19 nt, Homo sapiens
gggaaggaccggaucaaga

SEQ ID NO: 923930 - RNA, 19 nt, Homo sapiens
ggaacagucuugugaucag

SEQ ID NO: 923931 - RNA, 19 nt, Homo sapiens
ccaagaaagauauaacguu

SEQ ID NO: 923932 - RNA, 19 nt, Homo sapiens
guauauguaccaagaaaga

SEQ ID NO: 923933 - RNA, 19 nt, Homo sapiens
gcagagcagccucaucaga

SEQ ID NO: 923934 - RNA, 19 nt, Homo sapiens
gacauggccuuccacaucu

SEQ ID NO: 923935 - RNA, 19 nt, Homo sapiens
gagagaaggagaacagcaa

SEQ ID NO: 923936 - RNA, 19 nt, Homo sapiens
uggaggaggacgucauuua

SEQ ID NO: 923937 - RNA, 19 nt, Homo sapiens
gaggacaugugggaugaga

SEQ ID NO: 923938 - RNA, 19 nt, Homo sapiens
ggaagaaugagacaauuuu

SEQ ID NO: 923939 - RNA, 19 nt, Homo sapiens
gcaagugccuuugauucgu

SEQ ID NO: 923940 - RNA, 19 nt, Homo sapiens
ugaaguuguugcaaggaaa

SEQ ID NO: 923941 - RNA, 19 nt, Homo sapiens
gcuaugccaugcaggugaa

SEQ ID NO: 923942 - RNA, 19 nt, Homo sapiens
ugucaaggguggcaagaau

SEQ ID NO: 923943 - RNA, 19 nt, Homo sapiens
uuucaccuccuuauucuua

SEQ ID NO: 923944 - RNA, 19 nt, Homo sapiens
agauauaacguuaggguuu

SEQ ID NO: 923945 - RNA, 19 nt, Homo sapiens
agaaagauauaacguuagg

SEQ ID NO: 923946 - RNA, 19 nt, Homo sapiens
gcggaacagucuugugauc

SEQ ID NO: 923947 - RNA, 19 nt, Homo sapiens
ccacguggcuggcauacac

SEQ ID NO: 923948 - RNA, 19 nt, Homo sapiens
gaacggcgugguccagaug

SEQ ID NO: 923949 - RNA, 19 nt, Homo sapiens
acgacagucuuuguuguua

SEQ ID NO: 923950 - RNA, 19 nt, Homo sapiens
gcaucuuccugacagcauu

SEQ ID NO: 923951 - RNA, 19 nt, Homo sapiens
uguggaggcuguugauguu

SEQ ID NO: 923952 - RNA, 19 nt, Homo sapiens
acgccaagcuguggaauga

SEQ ID NO: 923953 - RNA, 19 nt, Homo sapiens
gcuuugcucccaucaauga

SEQ ID NO: 923954 - RNA, 19 nt, Homo sapiens
ccuccuuauucuuagauua

SEQ ID NO: 923955 - RNA, 19 nt, Homo sapiens
acaaacuggagcaauguua

SEQ ID NO: 923956 - RNA, 19 nt, Homo sapiens
guuugagccuuauagauca

SEQ ID NO: 923957 - RNA, 19 nt, Homo sapiens
cauaaaagccugcaauuuc

SEQ ID NO: 923958 - RNA, 19 nt, Homo sapiens
cagccuauaccucaauaaa

SEQ ID NO: 923959 - RNA, 19 nt, Homo sapiens
uaagaaggcgacaggauca

SEQ ID NO: 923960 - RNA, 19 nt, Homo sapiens
gaaauacuggcccgagaag

SEQ ID NO: 923961 - RNA, 19 nt, Homo sapiens
ucccaucaaugaccaagaa

SEQ ID NO: 923962 - RNA, 19 nt, Homo sapiens
ggaggaggacgucauuuac

SEQ ID NO: 923963 - RNA, 19 nt, Homo sapiens
caaacuggagcaauguuau

SEQ ID NO: 923964 - RNA, 19 nt, Homo sapiens
caaccagauucuagaaacu

SEQ ID NO: 923965 - RNA, 19 nt, Homo sapiens
aagauggaaucagaaacua

SEQ ID NO: 923966 - RNA, 19 nt, Homo sapiens
ucaguauuguguuuaguuc

SEQ ID NO: 923967 - RNA, 19 nt, Homo sapiens
gcacugauuuuguucuuag

SEQ ID NO: 923968 - RNA, 19 nt, Homo sapiens
ggaggagacguuccagugu

SEQ ID NO: 923969 - RNA, 19 nt, Homo sapiens
ucaaccagauucuagaaac

SEQ ID NO: 923970 - RNA, 19 nt, Homo sapiens
guaaaguggaggagacguu

SEQ ID NO: 923971 - RNA, 19 nt, Homo sapiens
aaacuggagcaauguuauu

SEQ ID NO: 923972 - RNA, 19 nt, Homo sapiens
gaaaaugucaaccagauuc

SEQ ID NO: 923973 - RNA, 19 nt, Homo sapiens
cgacagucuuuguuguuag

SEQ ID NO: 923974 - RNA, 19 nt, Homo sapiens
auucguuccuucuuucuaa

SEQ ID NO: 923975 - RNA, 19 nt, Homo sapiens
aaaguccagugacaugguu

SEQ ID NO: 923976 - RNA, 19 nt, Homo sapiens
gcagcccguuccaguuguu

SEQ ID NO: 923977 - RNA, 19 nt, Homo sapiens
guggagcccuacagucuca

SEQ ID NO: 923978 - RNA, 19 nt, Homo sapiens
gaagauccaggagcuguuc

SEQ ID NO: 923979 - RNA, 19 nt, Homo sapiens
gagccuuauagaucauuua

SEQ ID NO: 923980 - RNA, 19 nt, Homo sapiens
gacgacagucuuuguuguu

SEQ ID NO: 923981 - RNA, 19 nt, Homo sapiens
gcucagcugucuguugaag

SEQ ID NO: 923982 - RNA, 19 nt, Homo sapiens
ucagagaggacaagagcaa

SEQ ID NO: 923983 - RNA, 19 nt, Homo sapiens
agagcagccucaucagaga

SEQ ID NO: 923984 - RNA, 19 nt, Homo sapiens
cuguauauguaccaagaaa

SEQ ID NO: 923985 - RNA, 19 nt, Homo sapiens
guuguuagcacugaauuau

SEQ ID NO: 923986 - RNA, 19 nt, Homo sapiens
gaccaugcaguauccagaa

SEQ ID NO: 923987 - RNA, 19 nt, Homo sapiens
acagggcgcuggcucucaa

SEQ ID NO: 923988 - RNA, 19 nt, Homo sapiens
ccgcggaacagucuuguga

SEQ ID NO: 923989 - RNA, 19 nt, Homo sapiens
ggaagauccaggagcuguu

SEQ ID NO: 923990 - RNA, 19 nt, Homo sapiens
gagaaggagaacagcaaga

SEQ ID NO: 923991 - RNA, 19 nt, Homo sapiens
ugaaauacuggcccgagaa

SEQ ID NO: 923992 - RNA, 19 nt, Homo sapiens
uacuguauauguaccaaga

SEQ ID NO: 923993 - RNA, 19 nt, Homo sapiens
ucuagaaacugcggucauc

SEQ ID NO: 923994 - RNA, 19 nt, Homo sapiens
gugcaagugccuuugauuc

SEQ ID NO: 923995 - RNA, 19 nt, Homo sapiens
cgucugagauccgcgugaa

SEQ ID NO: 923996 - RNA, 19 nt, Homo sapiens
ccugcaauuucucgacaaa

SEQ ID NO: 923997 - RNA, 19 nt, Homo sapiens
cugcuuugcucccaucaau

SEQ ID NO: 923998 - RNA, 19 nt, Homo sapiens
ccagcgaggacgaguggua

SEQ ID NO: 923999 - RNA, 19 nt, Homo sapiens
cguuaggguuugguuguuu

SEQ ID NO: 924000 - RNA, 19 nt, Homo sapiens
gagguccgccugaaugaca

SEQ ID NO: 924001 - RNA, 19 nt, Homo sapiens
gaaccguuugagccuuaua

SEQ ID NO: 924002 - RNA, 19 nt, Homo sapiens
gcaagacacuucccaguaa

SEQ ID NO: 924003 - RNA, 19 nt, Homo sapiens
aaacaaggauggaucauuu

SEQ ID NO: 924004 - RNA, 19 nt, Homo sapiens
gaagguggaauaaugaaua

SEQ ID NO: 924005 - RNA, 19 nt, Homo sapiens
guuaauaucuggugagguu

SEQ ID NO: 924006 - RNA, 19 nt, Homo sapiens
caaugaagguggaauaaug

SEQ ID NO: 924007 - RNA, 19 nt, Homo sapiens
aaggauggaucauuucuua

SEQ ID NO: 924008 - RNA, 19 nt, Homo sapiens
ggagucagcuauugaagug

SEQ ID NO: 924009 - RNA, 19 nt, Homo sapiens
gaauggacaagcuuaauaa

SEQ ID NO: 924010 - RNA, 19 nt, Homo sapiens
gaagaggcauugcacagau

SEQ ID NO: 924011 - RNA, 19 nt, Homo sapiens
caaagcaccuccaaguguu

SEQ ID NO: 924012 - RNA, 19 nt, Homo sapiens
gaaguaugcaguuaaaguu

SEQ ID NO: 924013 - RNA, 19 nt, Homo sapiens
ggaugaggcugauuaugug

SEQ ID NO: 924014 - RNA, 19 nt, Homo sapiens
gcagugguccgaugacuuu

SEQ ID NO: 924015 - RNA, 19 nt, Homo sapiens
cagaaugcuucaaguguuu

SEQ ID NO: 924016 - RNA, 19 nt, Homo sapiens
gaagauggagucagcuauu

SEQ ID NO: 924017 - RNA, 19 nt, Homo sapiens
gaaaucaucaggaaucauc

SEQ ID NO: 924018 - RNA, 19 nt, Homo sapiens
cagcuggccuucagagaaa

SEQ ID NO: 924019 - RNA, 19 nt, Homo sapiens
caaacaaccauauacacua

SEQ ID NO: 924020 - RNA, 19 nt, Homo sapiens
ggauggaucauuucuuauu

SEQ ID NO: 924021 - RNA, 19 nt, Homo sapiens
acaagaagcugugcaguca

SEQ ID NO: 924022 - RNA, 19 nt, Homo sapiens
ugaguuaucaugcuacuaa

SEQ ID NO: 924023 - RNA, 19 nt, Homo sapiens
gaaaagcucuggccaugau

SEQ ID NO: 924024 - RNA, 19 nt, Homo sapiens
gaugaacuguuaauaucug

SEQ ID NO: 924025 - RNA, 19 nt, Homo sapiens
gauggaucauuucuuauuc

SEQ ID NO: 924026 - RNA, 19 nt, Homo sapiens
aaacaaccauauacacuag

SEQ ID NO: 924027 - RNA, 19 nt, Homo sapiens
gcacagaucaaacaaggau

SEQ ID NO: 924028 - RNA, 19 nt, Homo sapiens
cauguggacuuguucuauu

SEQ ID NO: 924029 - RNA, 19 nt, Homo sapiens
uaauauuccugugcgauuu

SEQ ID NO: 924030 - RNA, 19 nt, Homo sapiens
aaacaaugaagguggaaua

SEQ ID NO: 924031 - RNA, 19 nt, Homo sapiens
cauaguccuuugguucuua

SEQ ID NO: 924032 - RNA, 19 nt, Homo sapiens
ccauaccucugccaagauu

SEQ ID NO: 924033 - RNA, 19 nt, Homo sapiens
acagaaugcuucaaguguu

SEQ ID NO: 924034 - RNA, 19 nt, Homo sapiens
gaucaaccaagccaaauuc

SEQ ID NO: 924035 - RNA, 19 nt, Homo sapiens
cugaugaacuguuaauauc

SEQ ID NO: 924036 - RNA, 19 nt, Homo sapiens
caucaggaaucaucaacau

SEQ ID NO: 924037 - RNA, 19 nt, Homo sapiens
caacagaaugcuucaagug

SEQ ID NO: 924038 - RNA, 19 nt, Homo sapiens
guauauagacaaucgauca

SEQ ID NO: 924039 - RNA, 19 nt, Homo sapiens
agaauggacaagcuuaaua

SEQ ID NO: 924040 - RNA, 19 nt, Homo sapiens
ggugaagaguacuuuggaa

SEQ ID NO: 924041 - RNA, 19 nt, Homo sapiens
gaucgaaagucugcugaag

SEQ ID NO: 924042 - RNA, 19 nt, Homo sapiens
ucaaagcaccuccaagugu

SEQ ID NO: 924043 - RNA, 19 nt, Homo sapiens
cgacaccacugaagacaac

SEQ ID NO: 924044 - RNA, 19 nt, Homo sapiens
cguggaagauaaugaugaa

SEQ ID NO: 924045 - RNA, 19 nt, Homo sapiens
gcacucggacucagagaug

SEQ ID NO: 924046 - RNA, 19 nt, Homo sapiens
gaaguggucauccauuucu

SEQ ID NO: 924047 - RNA, 19 nt, Homo sapiens
uugaaguggucauccauuu

SEQ ID NO: 924048 - RNA, 19 nt, Homo sapiens
gcgaguauauagacaaucg

SEQ ID NO: 924049 - RNA, 19 nt, Homo sapiens
caaacaaggauggaucauu

SEQ ID NO: 924050 - RNA, 19 nt, Homo sapiens
ucuauugccugaccugaug

SEQ ID NO: 924051 - RNA, 19 nt, Homo sapiens
guccuuugguucuuauuga

SEQ ID NO: 924052 - RNA, 19 nt, Homo sapiens
ucaaguguuugugaagaaa

SEQ ID NO: 924053 - RNA, 19 nt, Homo sapiens
ucucagaaaucagacuuga

SEQ ID NO: 924054 - RNA, 19 nt, Homo sapiens
auucgugucucuuacaauu

SEQ ID NO: 924055 - RNA, 19 nt, Homo sapiens
ucgaaagucugcugaagag

SEQ ID NO: 924056 - RNA, 19 nt, Homo sapiens
gauggagucagcuauugaa

SEQ ID NO: 924057 - RNA, 19 nt, Homo sapiens
guaugcaguuaaaguuuca

SEQ ID NO: 924058 - RNA, 19 nt, Homo sapiens
caaacagaauggacaagcu

SEQ ID NO: 924059 - RNA, 19 nt, Homo sapiens
ucagaaaucagacuugagu

SEQ ID NO: 924060 - RNA, 19 nt, Homo sapiens
acaaccauauacacuaguu

SEQ ID NO: 924061 - RNA, 19 nt, Homo sapiens
acaggaagcuggcguucuc

SEQ ID NO: 924062 - RNA, 19 nt, Homo sapiens
caagacacuucccaguaag

SEQ ID NO: 924063 - RNA, 19 nt, Homo sapiens
acucagagauguacgugau

SEQ ID NO: 924064 - RNA, 19 nt, Homo sapiens
ccugaugaacuguuaauau

SEQ ID NO: 924065 - RNA, 19 nt, Homo sapiens
ggaagauggagucagcuau

SEQ ID NO: 924066 - RNA, 19 nt, Homo sapiens
ucaggaaucaucaacauag

SEQ ID NO: 924067 - RNA, 19 nt, Homo sapiens
gcauugcacagaucaaaca

SEQ ID NO: 924068 - RNA, 19 nt, Homo sapiens
gcuggagccugugaucgaa

SEQ ID NO: 924069 - RNA, 19 nt, Homo sapiens
agaaacaaauccaccaaaa

SEQ ID NO: 924070 - RNA, 19 nt, Homo sapiens
cuaauuccacuauuucaga

SEQ ID NO: 924071 - RNA, 19 nt, Homo sapiens
caucuaauuccacuauuuc

SEQ ID NO: 924072 - RNA, 19 nt, Homo sapiens
gcugugcagucaccagugu

SEQ ID NO: 924073 - RNA, 19 nt, Homo sapiens
gaacagcuucaggucgaaa

SEQ ID NO: 924074 - RNA, 19 nt, Homo sapiens
ggaacagcuucaggucgaa

SEQ ID NO: 924075 - RNA, 19 nt, Homo sapiens
aagcucauguggacuuguu

SEQ ID NO: 924076 - RNA, 19 nt, Homo sapiens
aagauggagucagcuauug

SEQ ID NO: 924077 - RNA, 19 nt, Homo sapiens
ugaaguaugcaguuaaagu

SEQ ID NO: 924078 - RNA, 19 nt, Homo sapiens
ucaacagaaugcuucaagu

SEQ ID NO: 924079 - RNA, 19 nt, Homo sapiens
ccaacgacaccacugaaga

SEQ ID NO: 924080 - RNA, 19 nt, Homo sapiens
acaauuaccaaacagaaug

SEQ ID NO: 924081 - RNA, 19 nt, Homo sapiens
gaucaagccagaggcauuc

SEQ ID NO: 924082 - RNA, 19 nt, Homo sapiens
ccagcuggccuucagagaa

SEQ ID NO: 924083 - RNA, 19 nt, Homo sapiens
ucaacauaguccuuugguu

SEQ ID NO: 924084 - RNA, 19 nt, Homo sapiens
ccaaacaaccauauacacu

SEQ ID NO: 924085 - RNA, 19 nt, Homo sapiens
cagaaacaaauccaccaaa

SEQ ID NO: 924086 - RNA, 19 nt, Homo sapiens
ugccugaccugaugaacug

SEQ ID NO: 924087 - RNA, 19 nt, Homo sapiens
acagucagaauaacacaaa

SEQ ID NO: 924088 - RNA, 19 nt, Homo sapiens
ccugugcgauuuauugaag

SEQ ID NO: 924089 - RNA, 19 nt, Homo sapiens
auaccucugccaagauuua

SEQ ID NO: 924090 - RNA, 19 nt, Homo sapiens
aaacagaauggacaagcuu

SEQ ID NO: 924091 - RNA, 19 nt, Homo sapiens
cugaccugaugaacuguua

SEQ ID NO: 924092 - RNA, 19 nt, Homo sapiens
cuacccagcuuuucaucua

SEQ ID NO: 924093 - RNA, 19 nt, Homo sapiens
ggucaagucacagacaaga

SEQ ID NO: 924094 - RNA, 19 nt, Homo sapiens
caccgagggucaagucaca

SEQ ID NO: 924095 - RNA, 19 nt, Homo sapiens
aaaccaacgacaccacuga

SEQ ID NO: 924096 - RNA, 19 nt, Homo sapiens
aggaugaggcugauuaugu

SEQ ID NO: 924097 - RNA, 19 nt, Homo sapiens
cuacgagccgccuccagua

SEQ ID NO: 924098 - RNA, 19 nt, Homo sapiens
ccgaggagaacgcugauga

SEQ ID NO: 924099 - RNA, 19 nt, Homo sapiens
gagguugaguuaucaugcu

SEQ ID NO: 924100 - RNA, 19 nt, Homo sapiens
cuggugagguugaguuauc

SEQ ID NO: 924101 - RNA, 19 nt, Homo sapiens
cuucagacacuuucccaaa

SEQ ID NO: 924102 - RNA, 19 nt, Homo sapiens
ucaagagacugaaagauua

SEQ ID NO: 924103 - RNA, 19 nt, Homo sapiens
gaaaguugcucaagccaaa

SEQ ID NO: 924104 - RNA, 19 nt, Homo sapiens
gcacagaaacagagaaaua

SEQ ID NO: 924105 - RNA, 19 nt, Homo sapiens
gauaaaaccugaagaagua

SEQ ID NO: 924106 - RNA, 19 nt, Homo sapiens
gcagauggaugaaguacaa

SEQ ID NO: 924107 - RNA, 19 nt, Homo sapiens
gaaagcagauggaugaagu

SEQ ID NO: 924108 - RNA, 19 nt, Homo sapiens
ugaaaggugucacaacaua

SEQ ID NO: 924109 - RNA, 19 nt, Homo sapiens
gagcugagguaucuauuug

SEQ ID NO: 924110 - RNA, 19 nt, Homo sapiens
ggagacaacuuacuaccaa

SEQ ID NO: 924111 - RNA, 19 nt, Homo sapiens
ccuagaagcugcaaugauu

SEQ ID NO: 924112 - RNA, 19 nt, Homo sapiens
aagauaaacugcacacuuu

SEQ ID NO: 924113 - RNA, 19 nt, Homo sapiens
gaugaaaggugucacaaca

SEQ ID NO: 924114 - RNA, 19 nt, Homo sapiens
gcaauuaaguuggaauaug

SEQ ID NO: 924115 - RNA, 19 nt, Homo sapiens
acaaguuccuuaucgauua

SEQ ID NO: 924116 - RNA, 19 nt, Homo sapiens
ggcaauacuuguugguuua

SEQ ID NO: 924117 - RNA, 19 nt, Homo sapiens
ggauuaagauuggauaguu

SEQ ID NO: 924118 - RNA, 19 nt, Homo sapiens
ccagaaagcuuugcaggaa

SEQ ID NO: 924119 - RNA, 19 nt, Homo sapiens
gaagagaucaagagacuga

SEQ ID NO: 924120 - RNA, 19 nt, Homo sapiens
gcauugguuuacugaauua

SEQ ID NO: 924121 - RNA, 19 nt, Homo sapiens
ucaagagaaucccaaagua

SEQ ID NO: 924122 - RNA, 19 nt, Homo sapiens
ggacagaaauagaaaauga

SEQ ID NO: 924123 - RNA, 19 nt, Homo sapiens
ugaauuaccaccuguguua

SEQ ID NO: 924124 - RNA, 19 nt, Homo sapiens
gcaauugccuugaguuugg

SEQ ID NO: 924125 - RNA, 19 nt, Homo sapiens
guaagcagguauauuguau

SEQ ID NO: 924126 - RNA, 19 nt, Homo sapiens
uaaggaugcuuucaaauca

SEQ ID NO: 924127 - RNA, 19 nt, Homo sapiens
aaccggaacugauguauaa

SEQ ID NO: 924128 - RNA, 19 nt, Homo sapiens
gaagugauuucucaaagca

SEQ ID NO: 924129 - RNA, 19 nt, Homo sapiens
gaagacaaccaacgauuug

SEQ ID NO: 924130 - RNA, 19 nt, Homo sapiens
gaauaaagcauguuugaag

SEQ ID NO: 924131 - RNA, 19 nt, Homo sapiens
gcauggcgcucagacauuu

SEQ ID NO: 924132 - RNA, 19 nt, Homo sapiens
gaagauaaacugcacacuu

SEQ ID NO: 924133 - RNA, 19 nt, Homo sapiens
gaaccacaccuccaagaaa

SEQ ID NO: 924134 - RNA, 19 nt, Homo sapiens
gaaccaggcaccaaagaaa

SEQ ID NO: 924135 - RNA, 19 nt, Homo sapiens
ggaagacaaccaacgauuu

SEQ ID NO: 924136 - RNA, 19 nt, Homo sapiens
gagcauugguuuacugaau

SEQ ID NO: 924137 - RNA, 19 nt, Homo sapiens
gaggacaccuacagaaguu

SEQ ID NO: 924138 - RNA, 19 nt, Homo sapiens
gagaauaaagcauguuuga

SEQ ID NO: 924139 - RNA, 19 nt, Homo sapiens
caaacuacacugaaacuuu

SEQ ID NO: 924140 - RNA, 19 nt, Homo sapiens
gaauuugccucaaguaaac

SEQ ID NO: 924141 - RNA, 19 nt, Homo sapiens
aacaaaggcuagaaagaua

SEQ ID NO: 924142 - RNA, 19 nt, Homo sapiens
uggaauaacugaugaggaa

SEQ ID NO: 924143 - RNA, 19 nt, Homo sapiens
cagaggacaugaugaagaa

SEQ ID NO: 924144 - RNA, 19 nt, Homo sapiens
gagcagccaucaagaagug

SEQ ID NO: 924145 - RNA, 19 nt, Homo sapiens
cagaauccaucgaacaauu

SEQ ID NO: 924146 - RNA, 19 nt, Homo sapiens
ggaauuugccucaaguaaa

SEQ ID NO: 924147 - RNA, 19 nt, Homo sapiens
acagauacaugcacagaaa

SEQ ID NO: 924148 - RNA, 19 nt, Homo sapiens
gcuauuauaugaugcuguu

SEQ ID NO: 924149 - RNA, 19 nt, Homo sapiens
uuugguagcuuguaaauga

SEQ ID NO: 924150 - RNA, 19 nt, Homo sapiens
gaauaugcaagguugguua

SEQ ID NO: 924151 - RNA, 19 nt, Homo sapiens
aaggagaaauugagucuuu

SEQ ID NO: 924152 - RNA, 19 nt, Homo sapiens
ggaggaguaagaugaaaua

SEQ ID NO: 924153 - RNA, 19 nt, Homo sapiens
uaacugccuuuauuccuuu

SEQ ID NO: 924154 - RNA, 19 nt, Homo sapiens
gcaaggugauuauuucaag

SEQ ID NO: 924155 - RNA, 19 nt, Homo sapiens
ucacaggguuugcuuguug

SEQ ID NO: 924156 - RNA, 19 nt, Homo sapiens
uauacuagcuguagaagau

SEQ ID NO: 924157 - RNA, 19 nt, Homo sapiens
aagaaaagcugacagauuu

SEQ ID NO: 924158 - RNA, 19 nt, Homo sapiens
gaaagcauauccagaaucc

SEQ ID NO: 924159 - RNA, 19 nt, Homo sapiens
gaagaggacaccuacagaa

SEQ ID NO: 924160 - RNA, 19 nt, Homo sapiens
gaagagaauguuugcuaaa

SEQ ID NO: 924161 - RNA, 19 nt, Homo sapiens
caaagcacuugaaagaaga

SEQ ID NO: 924162 - RNA, 19 nt, Homo sapiens
ggauaguaauggaaacuug

SEQ ID NO: 924163 - RNA, 19 nt, Homo sapiens
gaauuaauguacucugaca

SEQ ID NO: 924164 - RNA, 19 nt, Homo sapiens
ccggauaccuccagauuug

SEQ ID NO: 924165 - RNA, 19 nt, Homo sapiens
ucacagacauuaccaagca

SEQ ID NO: 924166 - RNA, 19 nt, Homo sapiens
ggagauagaaauuugaguu

SEQ ID NO: 924167 - RNA, 19 nt, Homo sapiens
gcacaucaccuucaucagu

SEQ ID NO: 924168 - RNA, 19 nt, Homo sapiens
gggaagagaucaagagacu

SEQ ID NO: 924169 - RNA, 19 nt, Homo sapiens
gaagauaugagaaaucgau

SEQ ID NO: 924170 - RNA, 19 nt, Homo sapiens
agaagagaauguuugcuaa

SEQ ID NO: 924171 - RNA, 19 nt, Homo sapiens
gauuaucguuuacaucaug

SEQ ID NO: 924172 - RNA, 19 nt, Homo sapiens
gaagcaggguucuuuaagg

SEQ ID NO: 924173 - RNA, 19 nt, Homo sapiens
caacaaaggcuagaaagau

SEQ ID NO: 924174 - RNA, 19 nt, Homo sapiens
ccaaaguacuugaauaagg

SEQ ID NO: 924175 - RNA, 19 nt, Homo sapiens
uauaggaaauucagggaaa

SEQ ID NO: 924176 - RNA, 19 nt, Homo sapiens
gcaucaggauuauaggaaa

SEQ ID NO: 924177 - RNA, 19 nt, Homo sapiens
uuacaagccuccaucaaau

SEQ ID NO: 924178 - RNA, 19 nt, Homo sapiens
gaaaggugucacaacauaa

SEQ ID NO: 924179 - RNA, 19 nt, Homo sapiens
uaaagaauguuggcaauac

SEQ ID NO: 924180 - RNA, 19 nt, Homo sapiens
gacaaggaauuaguacuau

SEQ ID NO: 924181 - RNA, 19 nt, Homo sapiens
ugacaaggaauuaguacua

SEQ ID NO: 924182 - RNA, 19 nt, Homo sapiens
uggagaggaucgagaagua

SEQ ID NO: 924183 - RNA, 19 nt, Homo sapiens
ccgcagaacucuucgaauc

SEQ ID NO: 924184 - RNA, 19 nt, Homo sapiens
cuagaacaauuuggagaua

SEQ ID NO: 924185 - RNA, 19 nt, Homo sapiens
gaacaugcaagguauuauc

SEQ ID NO: 924186 - RNA, 19 nt, Homo sapiens
uggaugaaguacaaugaua

SEQ ID NO: 924187 - RNA, 19 nt, Homo sapiens
gggaguacuugaagguaaa

SEQ ID NO: 924188 - RNA, 19 nt, Homo sapiens
ggagacggaugaagagaag

SEQ ID NO: 924189 - RNA, 19 nt, Homo sapiens
caagagcaguugaaauucu

SEQ ID NO: 924190 - RNA, 19 nt, Homo sapiens
gcuaaagaauguuggcaau

SEQ ID NO: 924191 - RNA, 19 nt, Homo sapiens
caacagcuuuccauucagu

SEQ ID NO: 924192 - RNA, 19 nt, Homo sapiens
ucgaaacccuuaugauaga

SEQ ID NO: 924193 - RNA, 19 nt, Homo sapiens
ucucgaaacccuuaugaua

SEQ ID NO: 924194 - RNA, 19 nt, Homo sapiens
caauuaaguuggaauaugc

SEQ ID NO: 924195 - RNA, 19 nt, Homo sapiens
ccaccuguguuaacauuug

SEQ ID NO: 924196 - RNA, 19 nt, Homo sapiens
agaaugggaugcacaacuu

SEQ ID NO: 924197 - RNA, 19 nt, Homo sapiens
cagcauagcagagaauaaa

SEQ ID NO: 924198 - RNA, 19 nt, Homo sapiens
gagcaauugccuugaguuu

SEQ ID NO: 924199 - RNA, 19 nt, Homo sapiens
ccaccuuccuguugcagua

SEQ ID NO: 924200 - RNA, 19 nt, Homo sapiens
ggauggaggaguaagauga

SEQ ID NO: 924201 - RNA, 19 nt, Homo sapiens
cuacagccauuuaaguguu

SEQ ID NO: 924202 - RNA, 19 nt, Homo sapiens
gggaggagcugcugaagau

SEQ ID NO: 924203 - RNA, 19 nt, Homo sapiens
ugacuacgcuggccaggaa

SEQ ID NO: 924204 - RNA, 19 nt, Homo sapiens
gcagugagaaguuccauga

SEQ ID NO: 924205 - RNA, 19 nt, Homo sapiens
gguugaggcuuccaagaaa

SEQ ID NO: 924206 - RNA, 19 nt, Homo sapiens
gaugaggaguggucagaug

SEQ ID NO: 924207 - RNA, 19 nt, Homo sapiens
ugagggcacucuaugacua

SEQ ID NO: 924208 - RNA, 19 nt, Homo sapiens
ccaacuacguggagugugu

SEQ ID NO: 924209 - RNA, 19 nt, Homo sapiens
ggacauggaacaggccuuu

SEQ ID NO: 924210 - RNA, 19 nt, Homo sapiens
caccauggcuccagaagag

SEQ ID NO: 924211 - RNA, 19 nt, Homo sapiens
gaggagcugcugaagauga

SEQ ID NO: 924212 - RNA, 19 nt, Homo sapiens
acaaucagccggaaagaga

SEQ ID NO: 924213 - RNA, 19 nt, Homo sapiens
gcauugaggcagccaguga

SEQ ID NO: 924214 - RNA, 19 nt, Homo sapiens
ggauaugcugcucaccuua

SEQ ID NO: 924215 - RNA, 19 nt, Homo sapiens
acacacacccacacacaaa

SEQ ID NO: 924216 - RNA, 19 nt, Homo sapiens
ccggagcccugaugagguu

SEQ ID NO: 924217 - RNA, 19 nt, Homo sapiens
gagucacgguggcagcauu

SEQ ID NO: 924218 - RNA, 19 nt, Homo sapiens
gagcgccagcggcuucuuu

SEQ ID NO: 924219 - RNA, 19 nt, Homo sapiens
guucuagcguguauuaaaa

SEQ ID NO: 924220 - RNA, 19 nt, Homo sapiens
cccaggagcuguggacuca

SEQ ID NO: 924221 - RNA, 19 nt, Homo sapiens
guggucagaugaagagagu

SEQ ID NO: 924222 - RNA, 19 nt, Homo sapiens
ggaguggucagaugaagag

SEQ ID NO: 924223 - RNA, 19 nt, Homo sapiens
agacaaaagcucaguauga

SEQ ID NO: 924224 - RNA, 19 nt, Homo sapiens
cgagggagagccacgcaaa

SEQ ID NO: 924225 - RNA, 19 nt, Homo sapiens
gccuguacccugccaacua

SEQ ID NO: 924226 - RNA, 19 nt, Homo sapiens
gaggaguggucagaugaag

SEQ ID NO: 924227 - RNA, 19 nt, Homo sapiens
caggagcuguggacucagu

SEQ ID NO: 924228 - RNA, 19 nt, Homo sapiens
ggacaaucagccggaaaga

SEQ ID NO: 924229 - RNA, 19 nt, Homo sapiens
gaagacaaaagcucaguau

SEQ ID NO: 924230 - RNA, 19 nt, Homo sapiens
ccaaggaggccgagaagac

SEQ ID NO: 924231 - RNA, 19 nt, Homo sapiens
cagcccuucugcaacguuu

SEQ ID NO: 924232 - RNA, 19 nt, Homo sapiens
caaggaggccgagaagaca

SEQ ID NO: 924233 - RNA, 19 nt, Homo sapiens
cuuguucuagcguguauua

SEQ ID NO: 924234 - RNA, 19 nt, Homo sapiens
guggcagcauugagaguug

SEQ ID NO: 924235 - RNA, 19 nt, Homo sapiens
ggacaccauggcuccagaa

SEQ ID NO: 924236 - RNA, 19 nt, Homo sapiens
ugacacacacccacacaca

SEQ ID NO: 924237 - RNA, 19 nt, Homo sapiens
ccugacagcccuucugcaa

SEQ ID NO: 924238 - RNA, 19 nt, Homo sapiens
ugaggcagccagugacgaa

SEQ ID NO: 924239 - RNA, 19 nt, Homo sapiens
aggauaugcugcucaccuu

SEQ ID NO: 924240 - RNA, 19 nt, Homo sapiens
uagcguguauuaaaacuug

SEQ ID NO: 924241 - RNA, 19 nt, Homo sapiens
ccuguacccugccaacuac

SEQ ID NO: 924242 - RNA, 19 nt, Homo sapiens
gauaugcugcucaccuuac

SEQ ID NO: 924243 - RNA, 19 nt, Homo sapiens
acauggaacaggccuuuga

SEQ ID NO: 924244 - RNA, 19 nt, Homo sapiens
gacacacacccacacacaa

SEQ ID NO: 924245 - RNA, 19 nt, Homo sapiens
ugaacuccaccgugacuug

SEQ ID NO: 924246 - RNA, 19 nt, Homo sapiens
gagguugaggcuuccaaga

SEQ ID NO: 924247 - RNA, 19 nt, Homo sapiens
cugcuccucugucccuuga

SEQ ID NO: 924248 - RNA, 19 nt, Homo sapiens
gggugagggcacucuauga

SEQ ID NO: 924249 - RNA, 19 nt, Homo sapiens
ugcaagggcaggacaguga

SEQ ID NO: 924250 - RNA, 19 nt, Homo sapiens
uguucuagcguguauuaaa

SEQ ID NO: 924251 - RNA, 19 nt, Homo sapiens
guuccugaccucugcuuug

SEQ ID NO: 924252 - RNA, 19 nt, Homo sapiens
caaucagccggaaagagaa

SEQ ID NO: 924253 - RNA, 19 nt, Homo sapiens
gaggacaaucagccggaaa

SEQ ID NO: 924254 - RNA, 19 nt, Homo sapiens
cugggaggcuggcaacuac

SEQ ID NO: 924255 - RNA, 19 nt, Homo sapiens
guguaguucuggccuagca

SEQ ID NO: 924256 - RNA, 19 nt, Homo sapiens
guucagagcccagcuucuc

SEQ ID NO: 924257 - RNA, 19 nt, Homo sapiens
gaccuuuccagcagugaga

SEQ ID NO: 924258 - RNA, 19 nt, Homo sapiens
gguggcagcauugagaguu

SEQ ID NO: 924259 - RNA, 19 nt, Homo sapiens
gaggugaacuugaauaaua

SEQ ID NO: 924260 - RNA, 19 nt, Homo sapiens
agaaggaacuggagaaaua

SEQ ID NO: 924261 - RNA, 19 nt, Homo sapiens
ggagaaauacagagacaua

SEQ ID NO: 924262 - RNA, 19 nt, Homo sapiens
caaagagcgugaugacuug

SEQ ID NO: 924263 - RNA, 19 nt, Homo sapiens
gaagagauaacacugcauu

SEQ ID NO: 924264 - RNA, 19 nt, Homo sapiens
ccacaaacauugaggagau

SEQ ID NO: 924265 - RNA, 19 nt, Homo sapiens
cagcaauucuggacaugua

SEQ ID NO: 924266 - RNA, 19 nt, Homo sapiens
guaacaagcaauacuauga

SEQ ID NO: 924267 - RNA, 19 nt, Homo sapiens
ugggagcacuggacacuua

SEQ ID NO: 924268 - RNA, 19 nt, Homo sapiens
gaauccaacuucauuagca

SEQ ID NO: 924269 - RNA, 19 nt, Homo sapiens
ggagauggauccugagaac

SEQ ID NO: 924270 - RNA, 19 nt, Homo sapiens
agacauagaugaagaugag

SEQ ID NO: 924271 - RNA, 19 nt, Homo sapiens
gaacuacgucgccagcaaa

SEQ ID NO: 924272 - RNA, 19 nt, Homo sapiens
ggagauggccaccgugcua

SEQ ID NO: 924273 - RNA, 19 nt, Homo sapiens
gaaggcaaauaccuaugug

SEQ ID NO: 924274 - RNA, 19 nt, Homo sapiens
ccaaaucccacaaacauug

SEQ ID NO: 924275 - RNA, 19 nt, Homo sapiens
gguacagccugacaaguau

SEQ ID NO: 924276 - RNA, 19 nt, Homo sapiens
ucaaagagcgugaugacuu

SEQ ID NO: 924277 - RNA, 19 nt, Homo sapiens
gaaauacagagacauagau

SEQ ID NO: 924278 - RNA, 19 nt, Homo sapiens
caauacccaugcuaaguga

SEQ ID NO: 924279 - RNA, 19 nt, Homo sapiens
caacgugaccagacaaaga

SEQ ID NO: 924280 - RNA, 19 nt, Homo sapiens
uguacacacugaugaguaa

SEQ ID NO: 924281 - RNA, 19 nt, Homo sapiens
gcugacauguugcgugaga

SEQ ID NO: 924282 - RNA, 19 nt, Homo sapiens
caucgaauccaacuucauu

SEQ ID NO: 924283 - RNA, 19 nt, Homo sapiens
uggaggaggugaacuugaa

SEQ ID NO: 924284 - RNA, 19 nt, Homo sapiens
ggacauguacacacugaug

SEQ ID NO: 924285 - RNA, 19 nt, Homo sapiens
gagaggcccuuuugcagua

SEQ ID NO: 924286 - RNA, 19 nt, Homo sapiens
acagagacauagaugaaga

SEQ ID NO: 924287 - RNA, 19 nt, Homo sapiens
gcauuucccuuuaccaacu

SEQ ID NO: 924288 - RNA, 19 nt, Homo sapiens
uaacacugcauuucccuuu

SEQ ID NO: 924289 - RNA, 19 nt, Homo sapiens
gagcagugucccucuauug

SEQ ID NO: 924290 - RNA, 19 nt, Homo sapiens
uaaaagcccuucuauccaa

SEQ ID NO: 924291 - RNA, 19 nt, Homo sapiens
aaacaucgaauccaacuuc

SEQ ID NO: 924292 - RNA, 19 nt, Homo sapiens
caaugaaggcaaauaccua

SEQ ID NO: 924293 - RNA, 19 nt, Homo sapiens
uaaagaggguccgaagcaa

SEQ ID NO: 924294 - RNA, 19 nt, Homo sapiens
cugcaacacugaaggcauu

SEQ ID NO: 924295 - RNA, 19 nt, Homo sapiens
acacuuaaauccucaucug

SEQ ID NO: 924296 - RNA, 19 nt, Homo sapiens
ugcaguggcugacauguug

SEQ ID NO: 924297 - RNA, 19 nt, Homo sapiens
cacaaacauugaggagaua

SEQ ID NO: 924298 - RNA, 19 nt, Homo sapiens
ugccacagaugcugaaaug

SEQ ID NO: 924299 - RNA, 19 nt, Homo sapiens
gugaggcaaugaaggcaaa

SEQ ID NO: 924300 - RNA, 19 nt, Homo sapiens
gaggaggugaacuugaaua

SEQ ID NO: 924301 - RNA, 19 nt, Homo sapiens
ggccacaugucaucauauc

SEQ ID NO: 924302 - RNA, 19 nt, Homo sapiens
gcaacaggcacuagaaguc

SEQ ID NO: 924303 - RNA, 19 nt, Homo sapiens
gccaugacccgaaacaaug

SEQ ID NO: 924304 - RNA, 19 nt, Homo sapiens
ucauugagcuccguguaga

SEQ ID NO: 924305 - RNA, 19 nt, Homo sapiens
ccugccagcuggacuaaga

SEQ ID NO: 924306 - RNA, 19 nt, Homo sapiens
ugaacuacgucgccagcaa

SEQ ID NO: 924307 - RNA, 19 nt, Homo sapiens
agaugaagaugagauccua

SEQ ID NO: 924308 - RNA, 19 nt, Homo sapiens
gccuaaacaucgaauccaa

SEQ ID NO: 924309 - RNA, 19 nt, Homo sapiens
ggagcaacaggcacuagaa

SEQ ID NO: 924310 - RNA, 19 nt, Homo sapiens
auacagagacauagaugaa

SEQ ID NO: 924311 - RNA, 19 nt, Homo sapiens
ccaauacccaugcuaagug

SEQ ID NO: 924312 - RNA, 19 nt, Homo sapiens
ugguacagccugacaagua

SEQ ID NO: 924313 - RNA, 19 nt, Homo sapiens
caaaucccacaaacauuga

SEQ ID NO: 924314 - RNA, 19 nt, Homo sapiens
caacaggcacuagaaguca

SEQ ID NO: 924315 - RNA, 19 nt, Homo sapiens
gauggauccugagaacaug

SEQ ID NO: 924316 - RNA, 19 nt, Homo sapiens
cgcuuuggcuaccacuuua

SEQ ID NO: 924317 - RNA, 19 nt, Homo sapiens
ggaacuggagaaauacaga

SEQ ID NO: 924318 - RNA, 19 nt, Homo sapiens
ccucaucuguccuccuuuc

SEQ ID NO: 924319 - RNA, 19 nt, Homo sapiens
aacacugcauuucccuuua

SEQ ID NO: 924320 - RNA, 19 nt, Homo sapiens
ggccaugacccgaaacaau

SEQ ID NO: 924321 - RNA, 19 nt, Homo sapiens
ccaaugcaguggcugacau

SEQ ID NO: 924322 - RNA, 19 nt, Homo sapiens
gcacuggacacuuaaaucc

SEQ ID NO: 924323 - RNA, 19 nt, Homo sapiens
gacccgaaacaaugaacua

SEQ ID NO: 924324 - RNA, 19 nt, Homo sapiens
guacagccugacaaguaua

SEQ ID NO: 924325 - RNA, 19 nt, Homo sapiens
ccuccuuuccuguaaauaa

SEQ ID NO: 924326 - RNA, 19 nt, Homo sapiens
caucauaucagaaggaacu

SEQ ID NO: 924327 - RNA, 19 nt, Homo sapiens
cuaaagaggguccgaagca

SEQ ID NO: 924328 - RNA, 19 nt, Homo sapiens
aaacauugaggagauacua

SEQ ID NO: 924329 - RNA, 19 nt, Homo sapiens
ccucugcaguggagaaauc

SEQ ID NO: 924330 - RNA, 19 nt, Homo sapiens
gaagucaaagagcgugaug

SEQ ID NO: 924331 - RNA, 19 nt, Homo sapiens
gagcacuggacacuuaaau

SEQ ID NO: 924332 - RNA, 19 nt, Homo sapiens
agaaauacagagacauaga

SEQ ID NO: 924333 - RNA, 19 nt, Homo sapiens
gugaugcaguggagaugga

SEQ ID NO: 924334 - RNA, 19 nt, Homo sapiens
gacauguacacacugauga

SEQ ID NO: 924335 - RNA, 19 nt, Homo sapiens
guaaauaaaagcccuucua

SEQ ID NO: 924336 - RNA, 19 nt, Homo sapiens
ccgaaacaaugaacuacgu

SEQ ID NO: 924337 - RNA, 19 nt, Homo sapiens
uauacaggacaucccaaua

SEQ ID NO: 924338 - RNA, 19 nt, Homo sapiens
gaaaucugcaacacugaag

SEQ ID NO: 924339 - RNA, 19 nt, Homo sapiens
gagaaaucugcaacacuga

SEQ ID NO: 924340 - RNA, 19 nt, Homo sapiens
cuccuuuccuguaaauaaa

SEQ ID NO: 924341 - RNA, 19 nt, Homo sapiens
cacaugucaucauaucaga

SEQ ID NO: 924342 - RNA, 19 nt, Homo sapiens
gcaaugaaggcaaauaccu

SEQ ID NO: 924343 - RNA, 19 nt, Homo sapiens
ggaggugaacuugaauaau

SEQ ID NO: 924344 - RNA, 19 nt, Homo sapiens
ugaaggcaaauaccuaugu

SEQ ID NO: 924345 - RNA, 19 nt, Homo sapiens
aacaagcaauacuaugaug

SEQ ID NO: 924346 - RNA, 19 nt, Homo sapiens
acacacugaugaguaacaa

SEQ ID NO: 924347 - RNA, 19 nt, Homo sapiens
gaaggaacuggagaaauac

SEQ ID NO: 924348 - RNA, 19 nt, Homo sapiens
gagaaauacagagacauag

SEQ ID NO: 924349 - RNA, 19 nt, Homo sapiens
gagauaacacugcauuucc

SEQ ID NO: 924350 - RNA, 19 nt, Homo sapiens
gaugaagaugagauccuaa

SEQ ID NO: 924351 - RNA, 19 nt, Homo sapiens
gaaggcaguucgggaaaau

SEQ ID NO: 924352 - RNA, 19 nt, Homo sapiens
aggacuggcucugugagua

SEQ ID NO: 924353 - RNA, 19 nt, Homo sapiens
ugaugaguaacaagcaaua

SEQ ID NO: 924354 - RNA, 19 nt, Homo sapiens
gagcaacaggcacuagaag

SEQ ID NO: 924355 - RNA, 19 nt, Homo sapiens
gacaacgugaccagacaaa

SEQ ID NO: 924356 - RNA, 19 nt, Homo sapiens
cagcuggacugcgaacuac

SEQ ID NO: 924357 - RNA, 19 nt, Homo sapiens
agagauaacacugcauuuc

SEQ ID NO: 924358 - RNA, 19 nt, Homo sapiens
ugagcuccguguagacaau

SEQ ID NO: 924359 - RNA, 19 nt, Homo sapiens
gaagagaguuugaagagaa

SEQ ID NO: 924360 - RNA, 19 nt, Homo sapiens
ugaaggagaucaccaguaa

SEQ ID NO: 924361 - RNA, 19 nt, Homo sapiens
gaaguucauuccaguguuu

SEQ ID NO: 924362 - RNA, 19 nt, Homo sapiens
acaaagaccuugaugaaga

SEQ ID NO: 924363 - RNA, 19 nt, Homo sapiens
ggucauuuguguagaauaa

SEQ ID NO: 924364 - RNA, 19 nt, Homo sapiens
guacaaagaccuugaugaa

SEQ ID NO: 924365 - RNA, 19 nt, Homo sapiens
gcagaaaugcugaaaguga

SEQ ID NO: 924366 - RNA, 19 nt, Homo sapiens
gaagaagcuuugacaagug

SEQ ID NO: 924367 - RNA, 19 nt, Homo sapiens
ugaaacaacuggaaacugu

SEQ ID NO: 924368 - RNA, 19 nt, Homo sapiens
aaacagaacugaaacaacu

SEQ ID NO: 924369 - RNA, 19 nt, Homo sapiens
gcugguaucagaauuguua

SEQ ID NO: 924370 - RNA, 19 nt, Homo sapiens
gaacugaaacaacuggaaa

SEQ ID NO: 924371 - RNA, 19 nt, Homo sapiens
caucagcuuugccagguua

SEQ ID NO: 924372 - RNA, 19 nt, Homo sapiens
ggacagcuguagaauugga

SEQ ID NO: 924373 - RNA, 19 nt, Homo sapiens
ggauguugcugguaucaga

SEQ ID NO: 924374 - RNA, 19 nt, Homo sapiens
cagaaaugcugaaagugaa

SEQ ID NO: 924375 - RNA, 19 nt, Homo sapiens
ggucaaaggugaaaagauu

SEQ ID NO: 924376 - RNA, 19 nt, Homo sapiens
gacaagugcuucugauaca

SEQ ID NO: 924377 - RNA, 19 nt, Homo sapiens
caacacccaggucuucuua

SEQ ID NO: 924378 - RNA, 19 nt, Homo sapiens
gaagagaacuaaagaaaac

SEQ ID NO: 924379 - RNA, 19 nt, Homo sapiens
gauaacgaauacaaaguuc

SEQ ID NO: 924380 - RNA, 19 nt, Homo sapiens
caaagaccuugaugaagau

SEQ ID NO: 924381 - RNA, 19 nt, Homo sapiens
gagcaucuccuuucauauc

SEQ ID NO: 924382 - RNA, 19 nt, Homo sapiens
agaagaagcuuugacaagu

SEQ ID NO: 924383 - RNA, 19 nt, Homo sapiens
gcacugccauuccguaagg

SEQ ID NO: 924384 - RNA, 19 nt, Homo sapiens
agagaucacuucugacugu

SEQ ID NO: 924385 - RNA, 19 nt, Homo sapiens
aaagaagcauuggagcaua

SEQ ID NO: 924386 - RNA, 19 nt, Homo sapiens
aaagggauguugcugguau

SEQ ID NO: 924387 - RNA, 19 nt, Homo sapiens
cagcuaaugcuauaacaaa

SEQ ID NO: 924388 - RNA, 19 nt, Homo sapiens
ggggacagcuguagaauug

SEQ ID NO: 924389 - RNA, 19 nt, Homo sapiens
gaaagaagcauuggagcau

SEQ ID NO: 924390 - RNA, 19 nt, Homo sapiens
uguggaagcuaauaguaaa

SEQ ID NO: 924391 - RNA, 19 nt, Homo sapiens
uuacugcacuugucugaug

SEQ ID NO: 924392 - RNA, 19 nt, Homo sapiens
aagaagcauuggagcauaa

SEQ ID NO: 924393 - RNA, 19 nt, Homo sapiens
acacccaggucuucuuaaa

SEQ ID NO: 924394 - RNA, 19 nt, Homo sapiens
gagacgaguugaaggagau

SEQ ID NO: 924395 - RNA, 19 nt, Homo sapiens
ccagucagcuuuaagaaaa

SEQ ID NO: 924396 - RNA, 19 nt, Homo sapiens
agaaaccuguacagacuuu

SEQ ID NO: 924397 - RNA, 19 nt, Homo sapiens
ggaaauggccaagaugcuu

SEQ ID NO: 924398 - RNA, 19 nt, Homo sapiens
ccacagggccauuugauag

SEQ ID NO: 924399 - RNA, 19 nt, Homo sapiens
agaagaaccagacaucaaa

SEQ ID NO: 924400 - RNA, 19 nt, Homo sapiens
acaaugacuuagugcguaa

SEQ ID NO: 924401 - RNA, 19 nt, Homo sapiens
gggaugcacaauuugauaa

SEQ ID NO: 924402 - RNA, 19 nt, Homo sapiens
gagaucacuucugacugua

SEQ ID NO: 924403 - RNA, 19 nt, Homo sapiens
uccgugaccuggagaguuu

SEQ ID NO: 924404 - RNA, 19 nt, Homo sapiens
ucauuccaguguuucauuu

SEQ ID NO: 924405 - RNA, 19 nt, Homo sapiens
uaagagacgaguugaagga

SEQ ID NO: 924406 - RNA, 19 nt, Homo sapiens
agaauuagaagaagcuuug

SEQ ID NO: 924407 - RNA, 19 nt, Homo sapiens
gguaucagaauuguuauug

SEQ ID NO: 924408 - RNA, 19 nt, Homo sapiens
guuaagagauaaugaaacc

SEQ ID NO: 924409 - RNA, 19 nt, Homo sapiens
ggcacugauugaugcguua

SEQ ID NO: 924410 - RNA, 19 nt, Homo sapiens
caccaaauccaaccaaugu

SEQ ID NO: 924411 - RNA, 19 nt, Homo sapiens
cagaagaaccagacaucaa

SEQ ID NO: 924412 - RNA, 19 nt, Homo sapiens
caaaaugccagaauguuaa

SEQ ID NO: 924413 - RNA, 19 nt, Homo sapiens
ggagaucaccaguaagucu

SEQ ID NO: 924414 - RNA, 19 nt, Homo sapiens
gcucaucuuguugaaguua

SEQ ID NO: 924415 - RNA, 19 nt, Homo sapiens
cgaaguucauuccaguguu

SEQ ID NO: 924416 - RNA, 19 nt, Homo sapiens
gaacaaaaugccagaaugu

SEQ ID NO: 924417 - RNA, 19 nt, Homo sapiens
auugaugcguuaagagaua

SEQ ID NO: 924418 - RNA, 19 nt, Homo sapiens
uugcagaaaugcugaaagu

SEQ ID NO: 924419 - RNA, 19 nt, Homo sapiens
guaauauaaugggaaguag

SEQ ID NO: 924420 - RNA, 19 nt, Homo sapiens
gaaacagaacugaaacaac

SEQ ID NO: 924421 - RNA, 19 nt, Homo sapiens
acaggucauuuguguagaa

SEQ ID NO: 924422 - RNA, 19 nt, Homo sapiens
guagaagagaguuugaaga

SEQ ID NO: 924423 - RNA, 19 nt, Homo sapiens
ggaaguaguaaugguguug

SEQ ID NO: 924424 - RNA, 19 nt, Homo sapiens
uaaagacagggaagacuau

SEQ ID NO: 924425 - RNA, 19 nt, Homo sapiens
auagugaggucgaaguuca

SEQ ID NO: 924426 - RNA, 19 nt, Homo sapiens
guaagucugcaaaggugua

SEQ ID NO: 924427 - RNA, 19 nt, Homo sapiens
ggcguacagccaacucuua

SEQ ID NO: 924428 - RNA, 19 nt, Homo sapiens
guagagaucacuucugacu

SEQ ID NO: 924429 - RNA, 19 nt, Homo sapiens
gucucuugauccagaauua

SEQ ID NO: 924430 - RNA, 19 nt, Homo sapiens
gcagaagaaccagacauca

SEQ ID NO: 924431 - RNA, 19 nt, Homo sapiens
agaagagaguuugaagaga

SEQ ID NO: 924432 - RNA, 19 nt, Homo sapiens
ccaaauccaaccaauguag

SEQ ID NO: 924433 - RNA, 19 nt, Homo sapiens
gaugagccaccaaauccaa

SEQ ID NO: 924434 - RNA, 19 nt, Homo sapiens
gaaguaguaaugguguuga

SEQ ID NO: 924435 - RNA, 19 nt, Homo sapiens
ucaccaagggcucauguug

SEQ ID NO: 924436 - RNA, 19 nt, Homo sapiens
uagaagagaguuugaagag

SEQ ID NO: 924437 - RNA, 19 nt, Homo sapiens
caaauccaaccaauguaga

SEQ ID NO: 924438 - RNA, 19 nt, Homo sapiens
gcaggguuccggcagaaga

SEQ ID NO: 924439 - RNA, 19 nt, Homo sapiens
gggaaguaguaaugguguu

SEQ ID NO: 924440 - RNA, 19 nt, Homo sapiens
gaucacuucugacuguacu

SEQ ID NO: 924441 - RNA, 19 nt, Homo sapiens
guacagacuuuuacagaag

SEQ ID NO: 924442 - RNA, 19 nt, Homo sapiens
gaagaaccagacaucaaag

SEQ ID NO: 924443 - RNA, 19 nt, Homo sapiens
gccagucagcuuuaagaaa

SEQ ID NO: 924444 - RNA, 19 nt, Homo sapiens
cauuucuacuuucugcuaa

SEQ ID NO: 924445 - RNA, 19 nt, Homo sapiens
uuucaaauguggucaaagg

SEQ ID NO: 924446 - RNA, 19 nt, Homo sapiens
uagaagaagcuuugacaag

SEQ ID NO: 924447 - RNA, 19 nt, Homo sapiens
ccagguuacauacuuuauu

SEQ ID NO: 924448 - RNA, 19 nt, Homo sapiens
gcaacacccaggucuucuu

SEQ ID NO: 924449 - RNA, 19 nt, Homo sapiens
ugucugaugugacguagca

SEQ ID NO: 924450 - RNA, 19 nt, Homo sapiens
acaaaaugccagaauguua

SEQ ID NO: 924451 - RNA, 19 nt, Homo sapiens
cagaauuguuauugcuuca

SEQ ID NO: 924452 - RNA, 19 nt, Homo sapiens
gcagcuaaugcuauaacaa

SEQ ID NO: 924453 - RNA, 19 nt, Homo sapiens
ccacgaaccagagcagcua

SEQ ID NO: 924454 - RNA, 19 nt, Homo sapiens
gcguuaagagauaaugaaa

SEQ ID NO: 924455 - RNA, 19 nt, Homo sapiens
uaacgaauacaaaguucug

SEQ ID NO: 924456 - RNA, 19 nt, Homo sapiens
gauccagaauuagaagaag

SEQ ID NO: 924457 - RNA, 19 nt, Homo sapiens
auaaagacagggaagacua

SEQ ID NO: 924458 - RNA, 19 nt, Homo sapiens
gucugugcauuccagguua

SEQ ID NO: 924459 - RNA, 19 nt, Homo sapiens
ggacaaagccugugaaagu

SEQ ID NO: 924460 - RNA, 19 nt, Homo sapiens
caagaucacuggauuaaau

SEQ ID NO: 924461 - RNA, 19 nt, Homo sapiens
gaagaaacagccaacaaua

SEQ ID NO: 924462 - RNA, 19 nt, Homo sapiens
gagaaaggcuuauaagaag

SEQ ID NO: 924463 - RNA, 19 nt, Homo sapiens
caaaggaccugucagaaau

SEQ ID NO: 924464 - RNA, 19 nt, Homo sapiens
uagcacaaauucucucuua

SEQ ID NO: 924465 - RNA, 19 nt, Homo sapiens
caagugagaugguugcauu

SEQ ID NO: 924466 - RNA, 19 nt, Homo sapiens
gggaacagcuguagagaug

SEQ ID NO: 924467 - RNA, 19 nt, Homo sapiens
gcaaaggaccugucagaaa

SEQ ID NO: 924468 - RNA, 19 nt, Homo sapiens
ucaggaaacuggaccauuu

SEQ ID NO: 924469 - RNA, 19 nt, Homo sapiens
caauaaagguggcaaagga

SEQ ID NO: 924470 - RNA, 19 nt, Homo sapiens
gacaaagccugugaaagua

SEQ ID NO: 924471 - RNA, 19 nt, Homo sapiens
guaacaagaucacuggauu

SEQ ID NO: 924472 - RNA, 19 nt, Homo sapiens
gcacaugcccuguugauug

SEQ ID NO: 924473 - RNA, 19 nt, Homo sapiens
gaacauugaugaagaugag

SEQ ID NO: 924474 - RNA, 19 nt, Homo sapiens
ucacaacucugauaacugu

SEQ ID NO: 924475 - RNA, 19 nt, Homo sapiens
gaacagcuguagagaugga

SEQ ID NO: 924476 - RNA, 19 nt, Homo sapiens
gauccuagcuugcaagaag

SEQ ID NO: 924477 - RNA, 19 nt, Homo sapiens
gaaacuggaccauuuaaau

SEQ ID NO: 924478 - RNA, 19 nt, Homo sapiens
gcagacaugcugaaaguaa

SEQ ID NO: 924479 - RNA, 19 nt, Homo sapiens
gagagaagcuuuuaaaaca

SEQ ID NO: 924480 - RNA, 19 nt, Homo sapiens
gcgagcaccuccucaugua

SEQ ID NO: 924481 - RNA, 19 nt, Homo sapiens
auaaugaccugguucguaa

SEQ ID NO: 924482 - RNA, 19 nt, Homo sapiens
caaaggcucuggagaccaa

SEQ ID NO: 924483 - RNA, 19 nt, Homo sapiens
ugucagaaauguugucaaa

SEQ ID NO: 924484 - RNA, 19 nt, Homo sapiens
ugagaaaggcuuauaagaa

SEQ ID NO: 924485 - RNA, 19 nt, Homo sapiens
gcucaacaauccaaaguuc

SEQ ID NO: 924486 - RNA, 19 nt, Homo sapiens
acaagaacauugaugaaga

SEQ ID NO: 924487 - RNA, 19 nt, Homo sapiens
caaggcaacucacccucua

SEQ ID NO: 924488 - RNA, 19 nt, Homo sapiens
ggagagucuuuaucccuaa

SEQ ID NO: 924489 - RNA, 19 nt, Homo sapiens
uaacaagaucacuggauua

SEQ ID NO: 924490 - RNA, 19 nt, Homo sapiens
gaucaguagugucaucuuc

SEQ ID NO: 924491 - RNA, 19 nt, Homo sapiens
caagaacauugaugaagau

SEQ ID NO: 924492 - RNA, 19 nt, Homo sapiens
cauguuaucucaaggacaa

SEQ ID NO: 924493 - RNA, 19 nt, Homo sapiens
aaaguucgaugaagaaaca

SEQ ID NO: 924494 - RNA, 19 nt, Homo sapiens
cacaaauucucucuuaguu

SEQ ID NO: 924495 - RNA, 19 nt, Homo sapiens
gaagucaaccucaacaaca

SEQ ID NO: 924496 - RNA, 19 nt, Homo sapiens
ccacaaauguagcaucaag

SEQ ID NO: 924497 - RNA, 19 nt, Homo sapiens
aaugacaccuugacagaaa

SEQ ID NO: 924498 - RNA, 19 nt, Homo sapiens
gaccaacacucacgugaag

SEQ ID NO: 924499 - RNA, 19 nt, Homo sapiens
agaaacagccaacaauaaa

SEQ ID NO: 924500 - RNA, 19 nt, Homo sapiens
guacacaauuugcucaaca

SEQ ID NO: 924501 - RNA, 19 nt, Homo sapiens
gaaggaggcuuuggaacag

SEQ ID NO: 924502 - RNA, 19 nt, Homo sapiens
gcacaaauucucucuuagu

SEQ ID NO: 924503 - RNA, 19 nt, Homo sapiens
guagugucaucuucauaaa

SEQ ID NO: 924504 - RNA, 19 nt, Homo sapiens
cuaaauacaucagaagugu

SEQ ID NO: 924505 - RNA, 19 nt, Homo sapiens
ucagaaauguugucaaagg

SEQ ID NO: 924506 - RNA, 19 nt, Homo sapiens
ggagaucaguagugucauc

SEQ ID NO: 924507 - RNA, 19 nt, Homo sapiens
ucaaggauccucaaguuug

SEQ ID NO: 924508 - RNA, 19 nt, Homo sapiens
gauggaaauugcccagaug

SEQ ID NO: 924509 - RNA, 19 nt, Homo sapiens
gaagcagaccgaagguaaa

SEQ ID NO: 924510 - RNA, 19 nt, Homo sapiens
cagcugccaucacaaagaa

SEQ ID NO: 924511 - RNA, 19 nt, Homo sapiens
ggagaaauacaagaacauu

SEQ ID NO: 924512 - RNA, 19 nt, Homo sapiens
ucauguaccuggagaagga

SEQ ID NO: 924513 - RNA, 19 nt, Homo sapiens
gugagaugguugcauugua

SEQ ID NO: 924514 - RNA, 19 nt, Homo sapiens
ugaauuacacaccuacuuu

SEQ ID NO: 924515 - RNA, 19 nt, Homo sapiens
acacucacgugaagaaguu

SEQ ID NO: 924516 - RNA, 19 nt, Homo sapiens
caccaaaucccacaaaugu

SEQ ID NO: 924517 - RNA, 19 nt, Homo sapiens
uaugauccauccagacauu

SEQ ID NO: 924518 - RNA, 19 nt, Homo sapiens
gggcacuucuggcaacuug

SEQ ID NO: 924519 - RNA, 19 nt, Homo sapiens
guagaggcacugaaagaaa

SEQ ID NO: 924520 - RNA, 19 nt, Homo sapiens
ggaccugucagaaauguug

SEQ ID NO: 924521 - RNA, 19 nt, Homo sapiens
aagaaacagccaacaauaa

SEQ ID NO: 924522 - RNA, 19 nt, Homo sapiens
ggagaaggaggcuuuggaa

SEQ ID NO: 924523 - RNA, 19 nt, Homo sapiens
gcacuacuuauuuaucuug

SEQ ID NO: 924524 - RNA, 19 nt, Homo sapiens
cagacaugcugaaaguaaa

SEQ ID NO: 924525 - RNA, 19 nt, Homo sapiens
ggaaacuggaccauuuaaa

SEQ ID NO: 924526 - RNA, 19 nt, Homo sapiens
ugagaugguugcauuguag

SEQ ID NO: 924527 - RNA, 19 nt, Homo sapiens
gcucacaacucugauaacu

SEQ ID NO: 924528 - RNA, 19 nt, Homo sapiens
gauuggagaucaguagugu

SEQ ID NO: 924529 - RNA, 19 nt, Homo sapiens
ccacauaagaaguuaguau

SEQ ID NO: 924530 - RNA, 19 nt, Homo sapiens
aaagaauaaugaccugguu

SEQ ID NO: 924531 - RNA, 19 nt, Homo sapiens
agaaagaccagacacagaa

SEQ ID NO: 924532 - RNA, 19 nt, Homo sapiens
ugaccuagauccugagagu

SEQ ID NO: 924533 - RNA, 19 nt, Homo sapiens
gccuaucucuguuuacaug

SEQ ID NO: 924534 - RNA, 19 nt, Homo sapiens
ugaagcagaccgaagguaa

SEQ ID NO: 924535 - RNA, 19 nt, Homo sapiens
caggaaacuggaccauuua

SEQ ID NO: 924536 - RNA, 19 nt, Homo sapiens
gagaaauacaagaacauug

SEQ ID NO: 924537 - RNA, 19 nt, Homo sapiens
caaauggaccgaugcagau

SEQ ID NO: 924538 - RNA, 19 nt, Homo sapiens
gauaccaguuuaccaagca

SEQ ID NO: 924539 - RNA, 19 nt, Homo sapiens
ccagcuggauuucgacaga

SEQ ID NO: 924540 - RNA, 19 nt, Homo sapiens
gcacggacgguauucugaa

SEQ ID NO: 924541 - RNA, 19 nt, Homo sapiens
caaggauccucaaguuugg

SEQ ID NO: 924542 - RNA, 19 nt, Homo sapiens
acaccgaacucuaugaucu

SEQ ID NO: 924543 - RNA, 19 nt, Homo sapiens
caagccagacucacaggua

SEQ ID NO: 924544 - RNA, 19 nt, Homo sapiens
gacaacauuaugacacuuu

SEQ ID NO: 924545 - RNA, 19 nt, Homo sapiens
caaguuuggauaccaguuu

SEQ ID NO: 924546 - RNA, 19 nt, Homo sapiens
gaaacagccaacaauaaag

SEQ ID NO: 924547 - RNA, 19 nt, Homo sapiens
ugaagaaacagccaacaau

SEQ ID NO: 924548 - RNA, 19 nt, Homo sapiens
ucuggcaacuugacaaaug

SEQ ID NO: 924549 - RNA, 19 nt, Homo sapiens
guucguucauuuccguuaa

SEQ ID NO: 924550 - RNA, 19 nt, Homo sapiens
auucaaggauccucaaguu

SEQ ID NO: 924551 - RNA, 19 nt, Homo sapiens
caaagccugugaaaguaca

SEQ ID NO: 924552 - RNA, 19 nt, Homo sapiens
guagcaaagaagucuauuu

SEQ ID NO: 924553 - RNA, 19 nt, Homo sapiens
cauaagaaguuaguauugc

SEQ ID NO: 924554 - RNA, 19 nt, Homo sapiens
cauaaagcaagacaacauu

SEQ ID NO: 924555 - RNA, 19 nt, Homo sapiens
ggguugucuugcuuucuua

SEQ ID NO: 924556 - RNA, 19 nt, Homo sapiens
gcagaccgaagguaaacuu

SEQ ID NO: 924557 - RNA, 19 nt, Homo sapiens
uagaaacucguaaagaaga

SEQ ID NO: 924558 - RNA, 19 nt, Homo sapiens
aaaaugcagugcuaaacua

SEQ ID NO: 924559 - RNA, 19 nt, Homo sapiens
uaagaaaccuucacaguua

SEQ ID NO: 924560 - RNA, 19 nt, Homo sapiens
gcaacagacucaugacaaa

SEQ ID NO: 924561 - RNA, 19 nt, Homo sapiens
gacaaaggauucaagauug

SEQ ID NO: 924562 - RNA, 19 nt, Homo sapiens
ccaaguggcauuuaaauaa

SEQ ID NO: 924563 - RNA, 19 nt, Homo sapiens
gaugugauuuggcucuuua

SEQ ID NO: 924564 - RNA, 19 nt, Homo sapiens
ggaagcaaaugaauucuca

SEQ ID NO: 924565 - RNA, 19 nt, Homo sapiens
aaucagggauguucauuaa

SEQ ID NO: 924566 - RNA, 19 nt, Homo sapiens
ugaagauccugauaaauga

SEQ ID NO: 924567 - RNA, 19 nt, Homo sapiens
ggguagaacucgucaguga

SEQ ID NO: 924568 - RNA, 19 nt, Homo sapiens
guaagaaaccuucacaguu

SEQ ID NO: 924569 - RNA, 19 nt, Homo sapiens
gaccauaaauuuccaggau

SEQ ID NO: 924570 - RNA, 19 nt, Homo sapiens
uaaagggcauggccauuga

SEQ ID NO: 924571 - RNA, 19 nt, Homo sapiens
ugacaaaggauucaagauu

SEQ ID NO: 924572 - RNA, 19 nt, Homo sapiens
gaacaaggcauggcacuuc

SEQ ID NO: 924573 - RNA, 19 nt, Homo sapiens
ugauuuggcucuuuaggaa

SEQ ID NO: 924574 - RNA, 19 nt, Homo sapiens
gcccagaggucagaaauca

SEQ ID NO: 924575 - RNA, 19 nt, Homo sapiens
gacaccaaguggcauuuaa

SEQ ID NO: 924576 - RNA, 19 nt, Homo sapiens
acacacauccgacgaauga

SEQ ID NO: 924577 - RNA, 19 nt, Homo sapiens
gauggaggcccuucacauu

SEQ ID NO: 924578 - RNA, 19 nt, Homo sapiens
gcagcggccuccuugaaga

SEQ ID NO: 924579 - RNA, 19 nt, Homo sapiens
ggaaagagcacggaaaugc

SEQ ID NO: 924580 - RNA, 19 nt, Homo sapiens
ggucaggucauguuugaaa

SEQ ID NO: 924581 - RNA, 19 nt, Homo sapiens
ggaucagacuaacggcuaa

SEQ ID NO: 924582 - RNA, 19 nt, Homo sapiens
ccauaaauuuccaggauca

SEQ ID NO: 924583 - RNA, 19 nt, Homo sapiens
ugcaugaacugcucucaaa

SEQ ID NO: 924584 - RNA, 19 nt, Homo sapiens
acacaggacacuagaguaa

SEQ ID NO: 924585 - RNA, 19 nt, Homo sapiens
ccuugaagauccugauaaa

SEQ ID NO: 924586 - RNA, 19 nt, Homo sapiens
ccacugcacugagaacaug

SEQ ID NO: 924587 - RNA, 19 nt, Homo sapiens
cuaagaagguuuuccauga

SEQ ID NO: 924588 - RNA, 19 nt, Homo sapiens
gaaaugcagcggccuccuu

SEQ ID NO: 924589 - RNA, 19 nt, Homo sapiens
gcagaacuuaagaauauug

SEQ ID NO: 924590 - RNA, 19 nt, Homo sapiens
ggaugugauuuggcucuuu

SEQ ID NO: 924591 - RNA, 19 nt, Homo sapiens
acaggacacuagaguaaga

SEQ ID NO: 924592 - RNA, 19 nt, Homo sapiens
gggcagcagugcacaugga

SEQ ID NO: 924593 - RNA, 19 nt, Homo sapiens
ggaaaacuguaaagacuuc

SEQ ID NO: 924594 - RNA, 19 nt, Homo sapiens
gcaaaucuggaugccauaa

SEQ ID NO: 924595 - RNA, 19 nt, Homo sapiens
ggaaacugaauuugcagaa

SEQ ID NO: 924596 - RNA, 19 nt, Homo sapiens
uuaggaaacugaauuugca

SEQ ID NO: 924597 - RNA, 19 nt, Homo sapiens
uugaagauccugauaaaug

SEQ ID NO: 924598 - RNA, 19 nt, Homo sapiens
gaaagagcacggaaaugca

SEQ ID NO: 924599 - RNA, 19 nt, Homo sapiens
gaaacugaauuugcagaac

SEQ ID NO: 924600 - RNA, 19 nt, Homo sapiens
agacaacucuaagaagguu

SEQ ID NO: 924601 - RNA, 19 nt, Homo sapiens
uaacacacauccgacgaau

SEQ ID NO: 924602 - RNA, 19 nt, Homo sapiens
ucagggauguucauuaaaa

SEQ ID NO: 924603 - RNA, 19 nt, Homo sapiens
aaaucuggaugccauaaau

SEQ ID NO: 924604 - RNA, 19 nt, Homo sapiens
agaaaguccuggaaaagua

SEQ ID NO: 924605 - RNA, 19 nt, Homo sapiens
gggauccugccuucaauuu

SEQ ID NO: 924606 - RNA, 19 nt, Homo sapiens
gugcggaggccuuaacuug

SEQ ID NO: 924607 - RNA, 19 nt, Homo sapiens
gcacgggaagggcaucuga

SEQ ID NO: 924608 - RNA, 19 nt, Homo sapiens
ggaaugacuccuccacauc

SEQ ID NO: 924609 - RNA, 19 nt, Homo sapiens
cuggaugccauaaauaaua

SEQ ID NO: 924610 - RNA, 19 nt, Homo sapiens
aaacugaauuugcagaacu

SEQ ID NO: 924611 - RNA, 19 nt, Homo sapiens
ggauuuaccagcacaucaa

SEQ ID NO: 924612 - RNA, 19 nt, Homo sapiens
gaaaagacacagagaagga

SEQ ID NO: 924613 - RNA, 19 nt, Homo sapiens
gaagauccugauaaaugaa

SEQ ID NO: 924614 - RNA, 19 nt, Homo sapiens
ccagauagagacuucagaa

SEQ ID NO: 924615 - RNA, 19 nt, Homo sapiens
gcagaaaccacccaagacu

SEQ ID NO: 924616 - RNA, 19 nt, Homo sapiens
gagcagggaggcagaaagu

SEQ ID NO: 924617 - RNA, 19 nt, Homo sapiens
gcggaggccuuaacuugag

SEQ ID NO: 924618 - RNA, 19 nt, Homo sapiens
gaaggaggacagcagacuu

SEQ ID NO: 924619 - RNA, 19 nt, Homo sapiens
agaaaccacccaagacuga

SEQ ID NO: 924620 - RNA, 19 nt, Homo sapiens
cagagaauaaagcagauuu

SEQ ID NO: 924621 - RNA, 19 nt, Homo sapiens
gaauuugcagaacuuaaga

SEQ ID NO: 924622 - RNA, 19 nt, Homo sapiens
ggagugagggacacaagga

SEQ ID NO: 924623 - RNA, 19 nt, Homo sapiens
ccagaggucagaaaucaga

SEQ ID NO: 924624 - RNA, 19 nt, Homo sapiens
ccaagagaauccuggugau

SEQ ID NO: 924625 - RNA, 19 nt, Homo sapiens
gaauccuggugaucagaga

SEQ ID NO: 924626 - RNA, 19 nt, Homo sapiens
uacauaugccacacucuua

SEQ ID NO: 924627 - RNA, 19 nt, Homo sapiens
caacaccaggcagagaaua

SEQ ID NO: 924628 - RNA, 19 nt, Homo sapiens
gaagaaaagacacagagaa

SEQ ID NO: 924629 - RNA, 19 nt, Homo sapiens
uggaggcccuucacauuuc

SEQ ID NO: 924630 - RNA, 19 nt, Homo sapiens
gaugcugccaccucccuua

SEQ ID NO: 924631 - RNA, 19 nt, Homo sapiens
gagcuucuaggaacuugaa

SEQ ID NO: 924632 - RNA, 19 nt, Homo sapiens
gcugaugaguaggauguga

SEQ ID NO: 924633 - RNA, 19 nt, Homo sapiens
ggaggccugucuaagucaa

SEQ ID NO: 924634 - RNA, 19 nt, Homo sapiens
gaaucacacaugaccuuug

SEQ ID NO: 924635 - RNA, 19 nt, Homo sapiens
gcgaaucacacaugaccuu

SEQ ID NO: 924636 - RNA, 19 nt, Homo sapiens
gguaccgggucacuguuga

SEQ ID NO: 924637 - RNA, 19 nt, Homo sapiens
gcgcuuagaggaagaccaa

SEQ ID NO: 924638 - RNA, 19 nt, Homo sapiens
gggcccagauagagacuuc

SEQ ID NO: 924639 - RNA, 19 nt, Homo sapiens
caaaucuggaugccauaaa

SEQ ID NO: 924640 - RNA, 19 nt, Homo sapiens
gucaagacaacucuaagaa

SEQ ID NO: 924641 - RNA, 19 nt, Homo sapiens
ggcaacagacucaugacaa

SEQ ID NO: 924642 - RNA, 19 nt, Homo sapiens
ggauuacauuccagcaucu

SEQ ID NO: 924643 - RNA, 19 nt, Homo sapiens
gcccaguacacacaaguuu

SEQ ID NO: 924644 - RNA, 19 nt, Homo sapiens
ugaggacggugacgaaggu

SEQ ID NO: 924645 - RNA, 19 nt, Homo sapiens
guagaacucgucagugaag

SEQ ID NO: 924646 - RNA, 19 nt, Homo sapiens
ccugccaccucuucugauu

SEQ ID NO: 924647 - RNA, 19 nt, Homo sapiens
gagagcuucuaggaacuug

SEQ ID NO: 924648 - RNA, 19 nt, Homo sapiens
gaaaguccuggaaaaguaa

SEQ ID NO: 924649 - RNA, 19 nt, Homo sapiens
gaggucagaaaucagauau

SEQ ID NO: 924650 - RNA, 19 nt, Homo sapiens
ucuuagcaauggacaauuc

SEQ ID NO: 924651 - RNA, 19 nt, Homo sapiens
gaggacagcagacuuuagg

SEQ ID NO: 924652 - RNA, 19 nt, Homo sapiens
agggucaggucauguuuga

SEQ ID NO: 924653 - RNA, 19 nt, Homo sapiens
gacuaagggucaggucaug

SEQ ID NO: 924654 - RNA, 19 nt, Homo sapiens
gcagagaauaaagcagauu

SEQ ID NO: 924655 - RNA, 19 nt, Homo sapiens
ccacacaggacacuagagu

SEQ ID NO: 924656 - RNA, 19 nt, Homo sapiens
gacccuggcugugcugcaa

SEQ ID NO: 924657 - RNA, 19 nt, Homo sapiens
uaaagcacccaguauggau

SEQ ID NO: 924658 - RNA, 19 nt, Homo sapiens
caguccaucuuaugcaaau

SEQ ID NO: 924659 - RNA, 19 nt, Homo sapiens
gcaguaaucugaagaagag

SEQ ID NO: 924660 - RNA, 19 nt, Homo sapiens
gaaccuugcucuggaauca

SEQ ID NO: 924661 - RNA, 19 nt, Homo sapiens
caacaggucucuggcuauu

SEQ ID NO: 924662 - RNA, 19 nt, Homo sapiens
cuuagaagcugcacauuau

SEQ ID NO: 924663 - RNA, 19 nt, Homo sapiens
gagaagaacucggcuguac

SEQ ID NO: 924664 - RNA, 19 nt, Homo sapiens
gaagaacucggcuguacuu

SEQ ID NO: 924665 - RNA, 19 nt, Homo sapiens
gggaugagcugcugacaac

SEQ ID NO: 924666 - RNA, 19 nt, Homo sapiens
gugguucucuccuguguaa

SEQ ID NO: 924667 - RNA, 19 nt, Homo sapiens
gaaggacugugaccuguac

SEQ ID NO: 924668 - RNA, 19 nt, Homo sapiens
cagaggagcuggccaaggu

SEQ ID NO: 924669 - RNA, 19 nt, Homo sapiens
ggaggugacugagaagaau

SEQ ID NO: 924670 - RNA, 19 nt, Homo sapiens
cagauggacugucguuuua

SEQ ID NO: 924671 - RNA, 19 nt, Homo sapiens
gcucauccguaaccugcua

SEQ ID NO: 924672 - RNA, 19 nt, Homo sapiens
uggaggagauugagaagga

SEQ ID NO: 924673 - RNA, 19 nt, Homo sapiens
uggaagcccuggaguucua

SEQ ID NO: 924674 - RNA, 19 nt, Homo sapiens
gccgagcccuucuacauuc

SEQ ID NO: 924675 - RNA, 19 nt, Homo sapiens
ggacaagggaccagaugga

SEQ ID NO: 924676 - RNA, 19 nt, Homo sapiens
ggaggaagccacagacagu

SEQ ID NO: 924677 - RNA, 19 nt, Homo sapiens
agaaggagccagacaaugu

SEQ ID NO: 924678 - RNA, 19 nt, Homo sapiens
gggcagaggagaaggagaa

SEQ ID NO: 924679 - RNA, 19 nt, Homo sapiens
ggagaaggagccagacaau

SEQ ID NO: 924680 - RNA, 19 nt, Homo sapiens
ugagucggcuggaggaaga

SEQ ID NO: 924681 - RNA, 19 nt, Homo sapiens
gcgcagguuugcacacuca

SEQ ID NO: 924682 - RNA, 19 nt, Homo sapiens
ccucagacccuacaguuug

SEQ ID NO: 924683 - RNA, 19 nt, Homo sapiens
cacagagccucaucgagaa

SEQ ID NO: 924684 - RNA, 19 nt, Homo sapiens
gcuccaugauccucgauga

SEQ ID NO: 924685 - RNA, 19 nt, Homo sapiens
cggcugcucugucaugaga

SEQ ID NO: 924686 - RNA, 19 nt, Homo sapiens
ccuagaaguucaggagaaa

SEQ ID NO: 924687 - RNA, 19 nt, Homo sapiens
gaaggagccagacaaugug

SEQ ID NO: 924688 - RNA, 19 nt, Homo sapiens
ccucgugucuccucacaug

SEQ ID NO: 924689 - RNA, 19 nt, Homo sapiens
gcucugucaugagaaugua

SEQ ID NO: 924690 - RNA, 19 nt, Homo sapiens
ggccuggacuuccucaaca

SEQ ID NO: 924691 - RNA, 19 nt, Homo sapiens
cgugaaagcccaagagauc

SEQ ID NO: 924692 - RNA, 19 nt, Homo sapiens
ggagaagaacucggcugua

SEQ ID NO: 924693 - RNA, 19 nt, Homo sapiens
cugagggccugacccaauu

SEQ ID NO: 924694 - RNA, 19 nt, Homo sapiens
cguggacccuggugucuau

SEQ ID NO: 924695 - RNA, 19 nt, Homo sapiens
gcacauuauggagcauuaa

SEQ ID NO: 924696 - RNA, 19 nt, Homo sapiens
acuuagaagcugcacauua

SEQ ID NO: 924697 - RNA, 19 nt, Homo sapiens
gggccugacccaauucuug

SEQ ID NO: 924698 - RNA, 19 nt, Homo sapiens
gucugugucuucuccuuaa

SEQ ID NO: 924699 - RNA, 19 nt, Homo sapiens
ggaagccacagacagugaa

SEQ ID NO: 924700 - RNA, 19 nt, Homo sapiens
agaaggagaaggagaagga

SEQ ID NO: 924701 - RNA, 19 nt, Homo sapiens
agaaggagaaggagaagga

SEQ ID NO: 924702 - RNA, 19 nt, Homo sapiens
agaaggagaaggagaagga

SEQ ID NO: 924703 - RNA, 19 nt, Homo sapiens
cagaggagaaggagaagga

SEQ ID NO: 924704 - RNA, 19 nt, Homo sapiens
acuagugggucuuaugugu

SEQ ID NO: 924705 - RNA, 19 nt, Homo sapiens
uauggagcauuaaacacuu

SEQ ID NO: 924706 - RNA, 19 nt, Homo sapiens
ggccugacccaauucuuga

SEQ ID NO: 924707 - RNA, 19 nt, Homo sapiens
ucugauaccugcaccuucu

SEQ ID NO: 924708 - RNA, 19 nt, Homo sapiens
gagaaggagccagacaaug

SEQ ID NO: 924709 - RNA, 19 nt, Homo sapiens
uagugggucuuaugugugu

SEQ ID NO: 924710 - RNA, 19 nt, Homo sapiens
cccagcagcuccuagaagu

SEQ ID NO: 924711 - RNA, 19 nt, Homo sapiens
gcugcucugucaugagaau

SEQ ID NO: 924712 - RNA, 19 nt, Homo sapiens
gcguguggccuuugggaaa

SEQ ID NO: 924713 - RNA, 19 nt, Homo sapiens
gaagccacagacagugaaa

SEQ ID NO: 924714 - RNA, 19 nt, Homo sapiens
ccuggagucuguucucaca

SEQ ID NO: 924715 - RNA, 19 nt, Homo sapiens
uagaaguucaggagaaaug

SEQ ID NO: 924716 - RNA, 19 nt, Homo sapiens
gauggaaccaagagagcaa

SEQ ID NO: 924717 - RNA, 19 nt, Homo sapiens
acugugaccuguacaagca

SEQ ID NO: 924718 - RNA, 19 nt, Homo sapiens
ggaugagaacuacaugauc

SEQ ID NO: 924719 - RNA, 19 nt, Homo sapiens
ugcacauuauggagcauua

SEQ ID NO: 924720 - RNA, 19 nt, Homo sapiens
gcacacucaaguucucaug

SEQ ID NO: 924721 - RNA, 19 nt, Homo sapiens
agaagaauguccgggaagu

SEQ ID NO: 924722 - RNA, 19 nt, Homo sapiens
cagcagcuccuagaaguuc

SEQ ID NO: 924723 - RNA, 19 nt, Homo sapiens
gaccagauggacugucguu

SEQ ID NO: 924724 - RNA, 19 nt, Homo sapiens
caacuggaggagauugaga

SEQ ID NO: 924725 - RNA, 19 nt, Homo sapiens
ggucuccacauucccacua

SEQ ID NO: 924726 - RNA, 19 nt, Homo sapiens
gccugugccuccucccauu

SEQ ID NO: 924727 - RNA, 19 nt, Homo sapiens
ccacuguccuggcccaacu

SEQ ID NO: 924728 - RNA, 19 nt, Homo sapiens
uggaagaccugcggcucaa

SEQ ID NO: 924729 - RNA, 19 nt, Homo sapiens
ucacuuagaagcugcacau

SEQ ID NO: 924730 - RNA, 19 nt, Homo sapiens
guucucuccuguguaaaug

SEQ ID NO: 924731 - RNA, 19 nt, Homo sapiens
ucaaggaugagaacuacau

SEQ ID NO: 924732 - RNA, 19 nt, Homo sapiens
caagugugcccagcggaaa

SEQ ID NO: 924733 - RNA, 19 nt, Homo sapiens
gugccgagcccuucuacau

SEQ ID NO: 924734 - RNA, 19 nt, Homo sapiens
cuagaagccugggcaaagg

SEQ ID NO: 924735 - RNA, 19 nt, Homo sapiens
ggauccaguugcaguacuc

SEQ ID NO: 924736 - RNA, 19 nt, Homo sapiens
cauuauggagcauuaaaca

SEQ ID NO: 924737 - RNA, 19 nt, Homo sapiens
ggacccuggugucuauggu

SEQ ID NO: 924738 - RNA, 19 nt, Homo sapiens
gauggacugucguuuuaug

SEQ ID NO: 924739 - RNA, 19 nt, Homo sapiens
auguggaccuugucucuga

SEQ ID NO: 924740 - RNA, 19 nt, Homo sapiens
gcauuaaacacuuuuguca

SEQ ID NO: 924741 - RNA, 19 nt, Homo sapiens
cacauuauggagcauuaaa

SEQ ID NO: 924742 - RNA, 19 nt, Homo sapiens
gaagaauguccgggaaguc

SEQ ID NO: 924743 - RNA, 19 nt, Homo sapiens
acguggaggugacugagaa

SEQ ID NO: 924744 - RNA, 19 nt, Homo sapiens
acaggucucuggcuauucg

SEQ ID NO: 924745 - RNA, 19 nt, Homo sapiens
caauguggaccuugucucu

SEQ ID NO: 924746 - RNA, 19 nt, Homo sapiens
ccaugcccuuugcgugaaa

SEQ ID NO: 924747 - RNA, 19 nt, Homo sapiens
ucaaucggcucuccauccu

SEQ ID NO: 924748 - RNA, 19 nt, Homo sapiens
ucaucgagaaggaccagua

SEQ ID NO: 924749 - RNA, 19 nt, Homo sapiens
accaguaccugcaggagau

SEQ ID NO: 924750 - RNA, 19 nt, Homo sapiens
gguucucuccuguguaaau

SEQ ID NO: 924751 - RNA, 19 nt, Homo sapiens
gcccuggagucuguucuca

SEQ ID NO: 924752 - RNA, 19 nt, Homo sapiens
cuagacccuuggacucuca

SEQ ID NO: 924753 - RNA, 19 nt, Homo sapiens
ccagauggacugucguuuu

SEQ ID NO: 924754 - RNA, 19 nt, Homo sapiens
gacagcguguggccuuugg

SEQ ID NO: 924755 - RNA, 19 nt, Homo sapiens
ggacugugaccuguacaag

SEQ ID NO: 924756 - RNA, 19 nt, Homo sapiens
ugucugugucuucuccuua

SEQ ID NO: 924757 - RNA, 19 nt, Homo sapiens
ccuuggcucuggccucuca

SEQ ID NO: 924758 - RNA, 19 nt, Homo sapiens
agaaggacugugaccugua

SEQ ID NO: 924759 - RNA, 19 nt, Homo sapiens
aaaccuaggugucacaaua

SEQ ID NO: 924760 - RNA, 19 nt, Homo sapiens
gaucauuccuacaaaguaa

SEQ ID NO: 924761 - RNA, 19 nt, Homo sapiens
aaaguaaacugggagaaua

SEQ ID NO: 924762 - RNA, 19 nt, Homo sapiens
ccacccaccuuacuguuua

SEQ ID NO: 924763 - RNA, 19 nt, Homo sapiens
gacaauagguaauaacaca

SEQ ID NO: 924764 - RNA, 19 nt, Homo sapiens
ggacagaacagacacuaga

SEQ ID NO: 924765 - RNA, 19 nt, Homo sapiens
gcuguugcaugaagugaua

SEQ ID NO: 924766 - RNA, 19 nt, Homo sapiens
ggcaaucuuucucuguuua

SEQ ID NO: 924767 - RNA, 19 nt, Homo sapiens
gaguggauuugucuacuuu

SEQ ID NO: 924768 - RNA, 19 nt, Homo sapiens
cgugguagaugcauauaaa

SEQ ID NO: 924769 - RNA, 19 nt, Homo sapiens
uaagauaggcaucguggua

SEQ ID NO: 924770 - RNA, 19 nt, Homo sapiens
ggacuggguugggaagaaa

SEQ ID NO: 924771 - RNA, 19 nt, Homo sapiens
ggaggucauuggacaaguu

SEQ ID NO: 924772 - RNA, 19 nt, Homo sapiens
gaagugauagaguaugauu

SEQ ID NO: 924773 - RNA, 19 nt, Homo sapiens
gaccaagugucuacugaug

SEQ ID NO: 924774 - RNA, 19 nt, Homo sapiens
gaaacagugacaauaggua

SEQ ID NO: 924775 - RNA, 19 nt, Homo sapiens
caacuuucaucuuguguuc

SEQ ID NO: 924776 - RNA, 19 nt, Homo sapiens
gggcaaagccuaguagaga

SEQ ID NO: 924777 - RNA, 19 nt, Homo sapiens
aaaaggaacugaaaaccua

SEQ ID NO: 924778 - RNA, 19 nt, Homo sapiens
uuacaggccacuaguauaa

SEQ ID NO: 924779 - RNA, 19 nt, Homo sapiens
ggcaaagccuaguagagaa

SEQ ID NO: 924780 - RNA, 19 nt, Homo sapiens
caacauggaggcagaggaa

SEQ ID NO: 924781 - RNA, 19 nt, Homo sapiens
gguaauaacacaucuuagu

SEQ ID NO: 924782 - RNA, 19 nt, Homo sapiens
gagaccgacuucuaucuuc

SEQ ID NO: 924783 - RNA, 19 nt, Homo sapiens
ggucggacgcgucuucuuu

SEQ ID NO: 924784 - RNA, 19 nt, Homo sapiens
guaaacugggagaauaaua

SEQ ID NO: 924785 - RNA, 19 nt, Homo sapiens
gaggaaacagugacaauag

SEQ ID NO: 924786 - RNA, 19 nt, Homo sapiens
ccuaauucauacugucaua

SEQ ID NO: 924787 - RNA, 19 nt, Homo sapiens
ucaaugugaugaucugugu

SEQ ID NO: 924788 - RNA, 19 nt, Homo sapiens
cuucaaagaaucaguguaa

SEQ ID NO: 924789 - RNA, 19 nt, Homo sapiens
ccuguaggcuucaaagaau

SEQ ID NO: 924790 - RNA, 19 nt, Homo sapiens
gggagaauaauaagucuga

SEQ ID NO: 924791 - RNA, 19 nt, Homo sapiens
ugcaugaagugauagagua

SEQ ID NO: 924792 - RNA, 19 nt, Homo sapiens
gcaggaggaauccgaagaa

SEQ ID NO: 924793 - RNA, 19 nt, Homo sapiens
gcauauaaaggguggaaug

SEQ ID NO: 924794 - RNA, 19 nt, Homo sapiens
caggugcacuuacauaugg

SEQ ID NO: 924795 - RNA, 19 nt, Homo sapiens
caggcaaucuuucucuguu

SEQ ID NO: 924796 - RNA, 19 nt, Homo sapiens
gauggcuccuggacauuug

SEQ ID NO: 924797 - RNA, 19 nt, Homo sapiens
aaacagugacaauagguaa

SEQ ID NO: 924798 - RNA, 19 nt, Homo sapiens
gggccuuuauuuccaacua

SEQ ID NO: 924799 - RNA, 19 nt, Homo sapiens
gcauaugcuuguuuuguuu

SEQ ID NO: 924800 - RNA, 19 nt, Homo sapiens
gaugaucuguguuuuauag

SEQ ID NO: 924801 - RNA, 19 nt, Homo sapiens
caaaguaaacugggagaau

SEQ ID NO: 924802 - RNA, 19 nt, Homo sapiens
ugaggaaacagugacaaua

SEQ ID NO: 924803 - RNA, 19 nt, Homo sapiens
ggaagggacagaacagaca

SEQ ID NO: 924804 - RNA, 19 nt, Homo sapiens
uaaacagucuacacagucu

SEQ ID NO: 924805 - RNA, 19 nt, Homo sapiens
ugaguuggaaccauuguaa

SEQ ID NO: 924806 - RNA, 19 nt, Homo sapiens
cugagucaccuaauucaua

SEQ ID NO: 924807 - RNA, 19 nt, Homo sapiens
aauaaacagucuacacagu

SEQ ID NO: 924808 - RNA, 19 nt, Homo sapiens
ccagaucauuccuacaaag

SEQ ID NO: 924809 - RNA, 19 nt, Homo sapiens
uagcccaguuuaucaauca

SEQ ID NO: 924810 - RNA, 19 nt, Homo sapiens
acuccgaacuccuguaugu

SEQ ID NO: 924811 - RNA, 19 nt, Homo sapiens
uuuccaggcuguugcauga

SEQ ID NO: 924812 - RNA, 19 nt, Homo sapiens
ggagaauaauaagucugaa

SEQ ID NO: 924813 - RNA, 19 nt, Homo sapiens
agucaguccucaccaaguu

SEQ ID NO: 924814 - RNA, 19 nt, Homo sapiens
augggaaccugauugauga

SEQ ID NO: 924815 - RNA, 19 nt, Homo sapiens
ugagucaccuaauucauac

SEQ ID NO: 924816 - RNA, 19 nt, Homo sapiens
uuuggaaccucaaguacuu

SEQ ID NO: 924817 - RNA, 19 nt, Homo sapiens
gaucuugacaggugcacuu

SEQ ID NO: 924818 - RNA, 19 nt, Homo sapiens
acaauaaacagucuacaca

SEQ ID NO: 924819 - RNA, 19 nt, Homo sapiens
guguugaguuggaaccauu

SEQ ID NO: 924820 - RNA, 19 nt, Homo sapiens
gaugaucacagucuucagu

SEQ ID NO: 924821 - RNA, 19 nt, Homo sapiens
uuucuaagccauuguuuga

SEQ ID NO: 924822 - RNA, 19 nt, Homo sapiens
gguggaguguugaguugga

SEQ ID NO: 924823 - RNA, 19 nt, Homo sapiens
acaggccacuaguauaaga

SEQ ID NO: 924824 - RNA, 19 nt, Homo sapiens
gcaugaagugauagaguau

SEQ ID NO: 924825 - RNA, 19 nt, Homo sapiens
acagugacaauagguaaua

SEQ ID NO: 924826 - RNA, 19 nt, Homo sapiens
ggaaacagugacaauaggu

SEQ ID NO: 924827 - RNA, 19 nt, Homo sapiens
cuagaaugaucgugacuac

SEQ ID NO: 924828 - RNA, 19 nt, Homo sapiens
ccucaggugcacuuacaua

SEQ ID NO: 924829 - RNA, 19 nt, Homo sapiens
uaucuuagcccaguuuauc

SEQ ID NO: 924830 - RNA, 19 nt, Homo sapiens
gcucgugucagucaacaug

SEQ ID NO: 924831 - RNA, 19 nt, Homo sapiens
cagugacaauagguaauaa

SEQ ID NO: 924832 - RNA, 19 nt, Homo sapiens
cuucauauccugaucuuag

SEQ ID NO: 924833 - RNA, 19 nt, Homo sapiens
augaagugauagaguauga

SEQ ID NO: 924834 - RNA, 19 nt, Homo sapiens
uaauaucuuagcccaguuu

SEQ ID NO: 924835 - RNA, 19 nt, Homo sapiens
agaguggauuugucuacuu

SEQ ID NO: 924836 - RNA, 19 nt, Homo sapiens
gaccaaaauucugaucauu

SEQ ID NO: 924837 - RNA, 19 nt, Homo sapiens
ccaguuuaucaaucaguua

SEQ ID NO: 924838 - RNA, 19 nt, Homo sapiens
aggcaaucuuucucuguuu

SEQ ID NO: 924839 - RNA, 19 nt, Homo sapiens
gcagacauuuuacuguguu

SEQ ID NO: 924840 - RNA, 19 nt, Homo sapiens
gugaugaucuguguuuuau

SEQ ID NO: 924841 - RNA, 19 nt, Homo sapiens
gaguuggaaccauuguaaa

SEQ ID NO: 924842 - RNA, 19 nt, Homo sapiens
aaugggaaccugauugaug

SEQ ID NO: 924843 - RNA, 19 nt, Homo sapiens
auacugucauacuagcaua

SEQ ID NO: 924844 - RNA, 19 nt, Homo sapiens
cuacacaacacgccuaugg

SEQ ID NO: 924845 - RNA, 19 nt, Homo sapiens
aaugugaugaucuguguuu

SEQ ID NO: 924846 - RNA, 19 nt, Homo sapiens
guuccaacuuucaucuugu

SEQ ID NO: 924847 - RNA, 19 nt, Homo sapiens
agaccgacuucuaucuuca

SEQ ID NO: 924848 - RNA, 19 nt, Homo sapiens
guuaugaucuuuggaaccu

SEQ ID NO: 924849 - RNA, 19 nt, Homo sapiens
ugucuacuuuggcuguaaa

SEQ ID NO: 924850 - RNA, 19 nt, Homo sapiens
caauagguaauaacacauc

SEQ ID NO: 924851 - RNA, 19 nt, Homo sapiens
ucuguuugcuugugcuguu

SEQ ID NO: 924852 - RNA, 19 nt, Homo sapiens
uaauuucuguuugcuugug

SEQ ID NO: 924853 - RNA, 19 nt, Homo sapiens
uggguggaguguugaguug

SEQ ID NO: 924854 - RNA, 19 nt, Homo sapiens
cuuccuggguggaguguug

SEQ ID NO: 924855 - RNA, 19 nt, Homo sapiens
agauaggcaucgugguaga

SEQ ID NO: 924856 - RNA, 19 nt, Homo sapiens
ccaacuaggaggauaaugc

SEQ ID NO: 924857 - RNA, 19 nt, Homo sapiens
ccacuccgaacuccuguau

SEQ ID NO: 924858 - RNA, 19 nt, Homo sapiens
gcgugagaccgacuucuau

SEQ ID NO: 924859 - RNA, 19 nt, Homo sapiens
gaagugaggccuuuuauua

SEQ ID NO: 924860 - RNA, 19 nt, Homo sapiens
gaagaagucucucaucacu

SEQ ID NO: 924861 - RNA, 19 nt, Homo sapiens
ggacggaggccucaagaaa

SEQ ID NO: 924862 - RNA, 19 nt, Homo sapiens
ugaacaagcugaauuugga

SEQ ID NO: 924863 - RNA, 19 nt, Homo sapiens
ugaagcagcuggaggaaga

SEQ ID NO: 924864 - RNA, 19 nt, Homo sapiens
gggaaggccugcugcauuc

SEQ ID NO: 924865 - RNA, 19 nt, Homo sapiens
gaaauagggcagaaacaga

SEQ ID NO: 924866 - RNA, 19 nt, Homo sapiens
gugaagaagucucucauca

SEQ ID NO: 924867 - RNA, 19 nt, Homo sapiens
ugagugaccugcaggaaga

SEQ ID NO: 924868 - RNA, 19 nt, Homo sapiens
gaccacaacuacagagaug

SEQ ID NO: 924869 - RNA, 19 nt, Homo sapiens
gaggagaggaucauuguga

SEQ ID NO: 924870 - RNA, 19 nt, Homo sapiens
ucaaggaacuggucaaggu

SEQ ID NO: 924871 - RNA, 19 nt, Homo sapiens
gaauguggcugaggugaca

SEQ ID NO: 924872 - RNA, 19 nt, Homo sapiens
gacccaggcuugacgauuc

SEQ ID NO: 924873 - RNA, 19 nt, Homo sapiens
gaugaugaguccguuguug

SEQ ID NO: 924874 - RNA, 19 nt, Homo sapiens
gaggagcgcacgaugauug

SEQ ID NO: 924875 - RNA, 19 nt, Homo sapiens
gaucagaagguccacaaug

SEQ ID NO: 924876 - RNA, 19 nt, Homo sapiens
ccggaaagcuucgaucaga

SEQ ID NO: 924877 - RNA, 19 nt, Homo sapiens
acacccagcuugaggagaa

SEQ ID NO: 924878 - RNA, 19 nt, Homo sapiens
gcaggaagaaggcaagaau

SEQ ID NO: 924879 - RNA, 19 nt, Homo sapiens
ggugacacaguccgaaaua

SEQ ID NO: 924880 - RNA, 19 nt, Homo sapiens
gcaagaaugccaucaacuc

SEQ ID NO: 924881 - RNA, 19 nt, Homo sapiens
gcaagagccuuugaaaaug

SEQ ID NO: 924882 - RNA, 19 nt, Homo sapiens
cugaagacgugguuaacuu

SEQ ID NO: 924883 - RNA, 19 nt, Homo sapiens
gcucaugggccuucuggaa

SEQ ID NO: 924884 - RNA, 19 nt, Homo sapiens
caauguguccuucgccuuu

SEQ ID NO: 924885 - RNA, 19 nt, Homo sapiens
caagaaugccaucaacuca

SEQ ID NO: 924886 - RNA, 19 nt, Homo sapiens
gaacaagcaccugaacaag

SEQ ID NO: 924887 - RNA, 19 nt, Homo sapiens
ugaacaagcaccugaacaa

SEQ ID NO: 924888 - RNA, 19 nt, Homo sapiens
uuaaucuccucuccaugua

SEQ ID NO: 924889 - RNA, 19 nt, Homo sapiens
guacaagaacguggaguga

SEQ ID NO: 924890 - RNA, 19 nt, Homo sapiens
cggaggagcugaccacaac

SEQ ID NO: 924891 - RNA, 19 nt, Homo sapiens
guugagagcacccugcauu

SEQ ID NO: 924892 - RNA, 19 nt, Homo sapiens
gaggagcugaccacaacua

SEQ ID NO: 924893 - RNA, 19 nt, Homo sapiens
aaauagggcagaaacagaa

SEQ ID NO: 924894 - RNA, 19 nt, Homo sapiens
gaaaaugcaggauucuaaa

SEQ ID NO: 924895 - RNA, 19 nt, Homo sapiens
cggaaagcuucgaucagaa

SEQ ID NO: 924896 - RNA, 19 nt, Homo sapiens
ggcaagagccuuugaaaau

SEQ ID NO: 924897 - RNA, 19 nt, Homo sapiens
gguccaagcuguguugacu

SEQ ID NO: 924898 - RNA, 19 nt, Homo sapiens
ggagugucccagcaagaaa

SEQ ID NO: 924899 - RNA, 19 nt, Homo sapiens
ccaaggcucguccugaaga

SEQ ID NO: 924900 - RNA, 19 nt, Homo sapiens
acaagcaccugaacaagcu

SEQ ID NO: 924901 - RNA, 19 nt, Homo sapiens
gguggagcguggacucaau

SEQ ID NO: 924902 - RNA, 19 nt, Homo sapiens
gagcugaccacaacuacag

SEQ ID NO: 924903 - RNA, 19 nt, Homo sapiens
gagagcacccugcauucug

SEQ ID NO: 924904 - RNA, 19 nt, Homo sapiens
guaccugguucugcucaug

SEQ ID NO: 924905 - RNA, 19 nt, Homo sapiens
ugaagacgugguuaacuug

SEQ ID NO: 924906 - RNA, 19 nt, Homo sapiens
gaggugacacaguccgaaa

SEQ ID NO: 924907 - RNA, 19 nt, Homo sapiens
ggacccaggcuugacgauu

SEQ ID NO: 924908 - RNA, 19 nt, Homo sapiens
ccagugggcaagagccuuu

SEQ ID NO: 924909 - RNA, 19 nt, Homo sapiens
acaaccuguucaccaagua

SEQ ID NO: 924910 - RNA, 19 nt, Homo sapiens
uuuacaaccuguucaccaa

SEQ ID NO: 924911 - RNA, 19 nt, Homo sapiens
uaacuuggaccucaaaucc

SEQ ID NO: 924912 - RNA, 19 nt, Homo sapiens
acccaaggcucguccugaa

SEQ ID NO: 924913 - RNA, 19 nt, Homo sapiens
cuggaagacuacuuuguuc

SEQ ID NO: 924914 - RNA, 19 nt, Homo sapiens
caacuacagagaugaugau

SEQ ID NO: 924915 - RNA, 19 nt, Homo sapiens
ugcagaagcucuuggaaaa

SEQ ID NO: 924916 - RNA, 19 nt, Homo sapiens
aggagaggaucauugugaa

SEQ ID NO: 924917 - RNA, 19 nt, Homo sapiens
gggcucuccuuggaaguga

SEQ ID NO: 924918 - RNA, 19 nt, Homo sapiens
ugaaaaugcaggauucuaa

SEQ ID NO: 924919 - RNA, 19 nt, Homo sapiens
cgggaaggccugcugcauu

SEQ ID NO: 924920 - RNA, 19 nt, Homo sapiens
aucagaagguccacaaugu

SEQ ID NO: 924921 - RNA, 19 nt, Homo sapiens
ucuggaagacuacuuuguu

SEQ ID NO: 924922 - RNA, 19 nt, Homo sapiens
caccugaacaagcugaauu

SEQ ID NO: 924923 - RNA, 19 nt, Homo sapiens
ugccuuggccgaaagauga

SEQ ID NO: 924924 - RNA, 19 nt, Homo sapiens
cuuaaucuccucuccaugu

SEQ ID NO: 924925 - RNA, 19 nt, Homo sapiens
ccacaacuacagagaugau

SEQ ID NO: 924926 - RNA, 19 nt, Homo sapiens
gcagggugcaagcugaaug

SEQ ID NO: 924927 - RNA, 19 nt, Homo sapiens
uggaggaagaccuguauga

SEQ ID NO: 924928 - RNA, 19 nt, Homo sapiens
cugcagaagcucuuggaaa

SEQ ID NO: 924929 - RNA, 19 nt, Homo sapiens
gcuggaggaagaccuguau

SEQ ID NO: 924930 - RNA, 19 nt, Homo sapiens
uccaagcuguguugacugu

SEQ ID NO: 924931 - RNA, 19 nt, Homo sapiens
cgaaauagggcagaaacag

SEQ ID NO: 924932 - RNA, 19 nt, Homo sapiens
cugaagacacccagcuuga

SEQ ID NO: 924933 - RNA, 19 nt, Homo sapiens
gagacccaguuugcagaug

SEQ ID NO: 924934 - RNA, 19 nt, Homo sapiens
cuccucgacuggauuaaug

SEQ ID NO: 924935 - RNA, 19 nt, Homo sapiens
caaggaagaccccaaguuc

SEQ ID NO: 924936 - RNA, 19 nt, Homo sapiens
ggagaggaucauugugaag

SEQ ID NO: 924937 - RNA, 19 nt, Homo sapiens
gccaggugcugcagaagcu

SEQ ID NO: 924938 - RNA, 19 nt, Homo sapiens
ggaagugaggccuuuuauu

SEQ ID NO: 924939 - RNA, 19 nt, Homo sapiens
ggaugaugaguccguuguu

SEQ ID NO: 924940 - RNA, 19 nt, Homo sapiens
ggaggaagaccuguaugac

SEQ ID NO: 924941 - RNA, 19 nt, Homo sapiens
gggaugaugaguccguugu

SEQ ID NO: 924942 - RNA, 19 nt, Homo sapiens
gcgaucacaggccuucaga

SEQ ID NO: 924943 - RNA, 19 nt, Homo sapiens
aaaugcaggauucuaaaca

SEQ ID NO: 924944 - RNA, 19 nt, Homo sapiens
ccugaggguucuuuacaac

SEQ ID NO: 924945 - RNA, 19 nt, Homo sapiens
guccugaagacgugguuaa

SEQ ID NO: 924946 - RNA, 19 nt, Homo sapiens
gacggaggccucaagaaac

SEQ ID NO: 924947 - RNA, 19 nt, Homo sapiens
ggagacccaguuugcagau

SEQ ID NO: 924948 - RNA, 19 nt, Homo sapiens
gugacacaguccgaaauag

SEQ ID NO: 924949 - RNA, 19 nt, Homo sapiens
ugacacaguccgaaauagg

SEQ ID NO: 924950 - RNA, 19 nt, Homo sapiens
ccuuggaagugaggccuuu

SEQ ID NO: 924951 - RNA, 19 nt, Homo sapiens
cacucgugcuugcguuuga

SEQ ID NO: 924952 - RNA, 19 nt, Homo sapiens
aaucuccucuccauguagu

SEQ ID NO: 924953 - RNA, 19 nt, Homo sapiens
uacaaccuguucaccaagu

SEQ ID NO: 924954 - RNA, 19 nt, Homo sapiens
guuugcagauggcguguac

SEQ ID NO: 924955 - RNA, 19 nt, Homo sapiens
acaacuacagagaugauga

SEQ ID NO: 924956 - RNA, 19 nt, Homo sapiens
gcuggaagcaguacaugac

SEQ ID NO: 924957 - RNA, 19 nt, Homo sapiens
gccaagaaauccuuccuuu

SEQ ID NO: 924958 - RNA, 19 nt, Homo sapiens
uaacguggaucucaagaau

SEQ ID NO: 924959 - RNA, 19 nt, Homo sapiens
ggacuaacguggaucucaa

SEQ ID NO: 924960 - RNA, 19 nt, Homo sapiens
guagugggcuggcguccaa

SEQ ID NO: 924961 - RNA, 19 nt, Homo sapiens
gaaggcaagaccacaauga

SEQ ID NO: 924962 - RNA, 19 nt, Homo sapiens
aagagcagcuucuguguuc

SEQ ID NO: 924963 - RNA, 19 nt, Homo sapiens
cugaugaaauggagaagaa

SEQ ID NO: 924964 - RNA, 19 nt, Homo sapiens
acaguaagaagguggaaua

SEQ ID NO: 924965 - RNA, 19 nt, Homo sapiens
uggaggagcuggaucagau

SEQ ID NO: 924966 - RNA, 19 nt, Homo sapiens
gaacaacaauccccuguac

SEQ ID NO: 924967 - RNA, 19 nt, Homo sapiens
ggacugaggagcagccaau

SEQ ID NO: 924968 - RNA, 19 nt, Homo sapiens
caaaauggcgccagaacua

SEQ ID NO: 924969 - RNA, 19 nt, Homo sapiens
cggaaggauuucaggauga

SEQ ID NO: 924970 - RNA, 19 nt, Homo sapiens
acguggaucucaagaauga

SEQ ID NO: 924971 - RNA, 19 nt, Homo sapiens
gggcuggcguccaaggauu

SEQ ID NO: 924972 - RNA, 19 nt, Homo sapiens
gcaagaccacaaugaacuu

SEQ ID NO: 924973 - RNA, 19 nt, Homo sapiens
gaaccugagcugugaacug

SEQ ID NO: 924974 - RNA, 19 nt, Homo sapiens
gagcagccaauggaaguuu

SEQ ID NO: 924975 - RNA, 19 nt, Homo sapiens
gaaauggagaagaacaaca

SEQ ID NO: 924976 - RNA, 19 nt, Homo sapiens
cagaagcccaccugucuug

SEQ ID NO: 924977 - RNA, 19 nt, Homo sapiens
gggccaagcagcucucuuc

SEQ ID NO: 924978 - RNA, 19 nt, Homo sapiens
gcagaagcccaccugucuu

SEQ ID NO: 924979 - RNA, 19 nt, Homo sapiens
ggcagaagcccaccugucu

SEQ ID NO: 924980 - RNA, 19 nt, Homo sapiens
ugcagaaccugagcuguga

SEQ ID NO: 924981 - RNA, 19 nt, Homo sapiens
aaauggagaagaacaacaa

SEQ ID NO: 924982 - RNA, 19 nt, Homo sapiens
gaugaaauggagaagaaca

SEQ ID NO: 924983 - RNA, 19 nt, Homo sapiens
ggaggcagagaaugaguuc

SEQ ID NO: 924984 - RNA, 19 nt, Homo sapiens
cuaccaggcccuugauuuc

SEQ ID NO: 924985 - RNA, 19 nt, Homo sapiens
cugccugcgucuacaguaa

SEQ ID NO: 924986 - RNA, 19 nt, Homo sapiens
caaggaggacagugguaug

SEQ ID NO: 924987 - RNA, 19 nt, Homo sapiens
ggaugcagaggaggcagua

SEQ ID NO: 924988 - RNA, 19 nt, Homo sapiens
cccaggaggcagagaauga

SEQ ID NO: 924989 - RNA, 19 nt, Homo sapiens
uccgcgaccucaccaagaa

SEQ ID NO: 924990 - RNA, 19 nt, Homo sapiens
ggcaagaccacaaugaacu

SEQ ID NO: 924991 - RNA, 19 nt, Homo sapiens
cagccuagagccaagaaau

SEQ ID NO: 924992 - RNA, 19 nt, Homo sapiens
ucuaccaggcccuugauuu

SEQ ID NO: 924993 - RNA, 19 nt, Homo sapiens
gacgaaggcaagaccacaa

SEQ ID NO: 924994 - RNA, 19 nt, Homo sapiens
gaagcccaccugucuugca

SEQ ID NO: 924995 - RNA, 19 nt, Homo sapiens
caacuguacccagccuaga

SEQ ID NO: 924996 - RNA, 19 nt, Homo sapiens
ccaagaaauccuuccuuuu

SEQ ID NO: 924997 - RNA, 19 nt, Homo sapiens
ucauugaggcagcguuguu

SEQ ID NO: 924998 - RNA, 19 nt, Homo sapiens
gccugcgucuacaguaaga

SEQ ID NO: 924999 - RNA, 19 nt, Homo sapiens
uaacguggaucucaagaau

SEQ ID NO: 925000 - RNA, 19 nt, Homo sapiens
ggacuaacguggaucucaa

SEQ ID NO: 925001 - RNA, 19 nt, Homo sapiens
gaaggaauguggagcucuu

SEQ ID NO: 925002 - RNA, 19 nt, Homo sapiens
gaaggcaagaccacaauga

SEQ ID NO: 925003 - RNA, 19 nt, Homo sapiens
ggcagcagaugacuuucua

SEQ ID NO: 925004 - RNA, 19 nt, Homo sapiens
gacagaagcgcaagaggaa

SEQ ID NO: 925005 - RNA, 19 nt, Homo sapiens
cugaugaaauggagaagaa

SEQ ID NO: 925006 - RNA, 19 nt, Homo sapiens
acaguaagaagguggaaua

SEQ ID NO: 925007 - RNA, 19 nt, Homo sapiens
ggaagccgcugaccuugac

SEQ ID NO: 925008 - RNA, 19 nt, Homo sapiens
uggaggagcuggaucagau

SEQ ID NO: 925009 - RNA, 19 nt, Homo sapiens
gaacaacaauccccuguac

SEQ ID NO: 925010 - RNA, 19 nt, Homo sapiens
agucuaagcccuucaagaa

SEQ ID NO: 925011 - RNA, 19 nt, Homo sapiens
ggacugaggagcagccaau

SEQ ID NO: 925012 - RNA, 19 nt, Homo sapiens
cggaaggauuucaggauga

SEQ ID NO: 925013 - RNA, 19 nt, Homo sapiens
acguggaucucaagaauga

SEQ ID NO: 925014 - RNA, 19 nt, Homo sapiens
gcaagaccacaaugaacuu

SEQ ID NO: 925015 - RNA, 19 nt, Homo sapiens
ucuaagcccuucaagaaag

SEQ ID NO: 925016 - RNA, 19 nt, Homo sapiens
ggagcagcaugugcccuuu

SEQ ID NO: 925017 - RNA, 19 nt, Homo sapiens
ggagcugguucgaaggaau

SEQ ID NO: 925018 - RNA, 19 nt, Homo sapiens
gagcagccaauggaaguuu

SEQ ID NO: 925019 - RNA, 19 nt, Homo sapiens
gcaguguugccaucucaaa

SEQ ID NO: 925020 - RNA, 19 nt, Homo sapiens
gaaauggagaagaacaaca

SEQ ID NO: 925021 - RNA, 19 nt, Homo sapiens
ugacuacacaguggagaua

SEQ ID NO: 925022 - RNA, 19 nt, Homo sapiens
gaauguggagcucuucauc

SEQ ID NO: 925023 - RNA, 19 nt, Homo sapiens
gggccaagcagcucucuuc

SEQ ID NO: 925024 - RNA, 19 nt, Homo sapiens
cccugcagcuggccaauga

SEQ ID NO: 925025 - RNA, 19 nt, Homo sapiens
ccuuugacauccacaccua

SEQ ID NO: 925026 - RNA, 19 nt, Homo sapiens
gggaagccgcugaccuuga

SEQ ID NO: 925027 - RNA, 19 nt, Homo sapiens
ugaaggagcaguuggaaac

SEQ ID NO: 925028 - RNA, 19 nt, Homo sapiens
acauggagguccuguacug

SEQ ID NO: 925029 - RNA, 19 nt, Homo sapiens
cagggaagccgcugaccuu

SEQ ID NO: 925030 - RNA, 19 nt, Homo sapiens
cagcagaugacuuucuaga

SEQ ID NO: 925031 - RNA, 19 nt, Homo sapiens
aaauggagaagaacaacaa

SEQ ID NO: 925032 - RNA, 19 nt, Homo sapiens
gaugaaauggagaagaaca

SEQ ID NO: 925033 - RNA, 19 nt, Homo sapiens
ggaggcagagaaugaguuc

SEQ ID NO: 925034 - RNA, 19 nt, Homo sapiens
cuaccaggcccuugauuuc

SEQ ID NO: 925035 - RNA, 19 nt, Homo sapiens
aaugaguggugucccuuug

SEQ ID NO: 925036 - RNA, 19 nt, Homo sapiens
gagcugguucgaaggaaug

SEQ ID NO: 925037 - RNA, 19 nt, Homo sapiens
guacuggacacacgugaag

SEQ ID NO: 925038 - RNA, 19 nt, Homo sapiens
gaggagcugguucgaagga

SEQ ID NO: 925039 - RNA, 19 nt, Homo sapiens
aagcaguguugccaucuca

SEQ ID NO: 925040 - RNA, 19 nt, Homo sapiens
gcagcuggccaaugacuac

SEQ ID NO: 925041 - RNA, 19 nt, Homo sapiens
cugccugcgucuacaguaa

SEQ ID NO: 925042 - RNA, 19 nt, Homo sapiens
gagcagcaugugcccuuug

SEQ ID NO: 925043 - RNA, 19 nt, Homo sapiens
caaugaguggugucccuuu

SEQ ID NO: 925044 - RNA, 19 nt, Homo sapiens
ggaugcagaggaggcagua

SEQ ID NO: 925045 - RNA, 19 nt, Homo sapiens
cccaggaggcagagaauga

SEQ ID NO: 925046 - RNA, 19 nt, Homo sapiens
acaagcgcuuccagaccua

SEQ ID NO: 925047 - RNA, 19 nt, Homo sapiens
ggcaagaccacaaugaacu

SEQ ID NO: 925048 - RNA, 19 nt, Homo sapiens
uccgcgaccucaccaagaa

SEQ ID NO: 925049 - RNA, 19 nt, Homo sapiens
gagucuaagcccuucaaga

SEQ ID NO: 925050 - RNA, 19 nt, Homo sapiens
gcuggccaaugacuacaca

SEQ ID NO: 925051 - RNA, 19 nt, Homo sapiens
cagcaugugcccuuugaca

SEQ ID NO: 925052 - RNA, 19 nt, Homo sapiens
gucuaagcccuucaagaaa

SEQ ID NO: 925053 - RNA, 19 nt, Homo sapiens
gacgaaggcaagaccacaa

SEQ ID NO: 925054 - RNA, 19 nt, Homo sapiens
ucuaccaggcccuugauuu

SEQ ID NO: 925055 - RNA, 19 nt, Homo sapiens
cgaugucccugagcuacga

SEQ ID NO: 925056 - RNA, 19 nt, Homo sapiens
gaggaccaccuggaggauu

SEQ ID NO: 925057 - RNA, 19 nt, Homo sapiens
ccaccucccagaaguuugu

SEQ ID NO: 925058 - RNA, 19 nt, Homo sapiens
ggaauguggagcucuucau

SEQ ID NO: 925059 - RNA, 19 nt, Homo sapiens
uucuagagccugaggagua

SEQ ID NO: 925060 - RNA, 19 nt, Homo sapiens
gugaaggagcaguuggaaa

SEQ ID NO: 925061 - RNA, 19 nt, Homo sapiens
gccugcgucuacaguaaga

SEQ ID NO: 925062 - RNA, 19 nt, Homo sapiens
ucauugaggcagcguuguu

SEQ ID NO: 925063 - RNA, 19 nt, Homo sapiens
aggaccaccuggaggauuc

SEQ ID NO: 925064 - RNA, 19 nt, Homo sapiens
agacauggagguccuguac

SEQ ID NO: 925065 - RNA, 19 nt, Homo sapiens
gaaauacccucauguccaa

SEQ ID NO: 925066 - RNA, 19 nt, Homo sapiens
gcacagaauucaccaacaa

SEQ ID NO: 925067 - RNA, 19 nt, Homo sapiens
ccacacagcuacccacgua

SEQ ID NO: 925068 - RNA, 19 nt, Homo sapiens
cagaguaucuucccacuga

SEQ ID NO: 925069 - RNA, 19 nt, Homo sapiens
gcacacccauacacaacua

SEQ ID NO: 925070 - RNA, 19 nt, Homo sapiens
ggaggcagcugaggaaguu

SEQ ID NO: 925071 - RNA, 19 nt, Homo sapiens
gcacagagacuuuggacau

SEQ ID NO: 925072 - RNA, 19 nt, Homo sapiens
ccacagacauaaauauagu

SEQ ID NO: 925073 - RNA, 19 nt, Homo sapiens
gaaggaaggcaacuuggaa

SEQ ID NO: 925074 - RNA, 19 nt, Homo sapiens
guuaaugucuccagagugu

SEQ ID NO: 925075 - RNA, 19 nt, Homo sapiens
gcacaaccgcacacccaua

SEQ ID NO: 925076 - RNA, 19 nt, Homo sapiens
gaagauggcacaggaggaa

SEQ ID NO: 925077 - RNA, 19 nt, Homo sapiens
uggguuagcuuuccacaga

SEQ ID NO: 925078 - RNA, 19 nt, Homo sapiens
cacagagacuuuggacaua

SEQ ID NO: 925079 - RNA, 19 nt, Homo sapiens
gcacccugauucuaccaaa

SEQ ID NO: 925080 - RNA, 19 nt, Homo sapiens
gaaacggccacacauguuc

SEQ ID NO: 925081 - RNA, 19 nt, Homo sapiens
gaugaaggaaggcaacuug

SEQ ID NO: 925082 - RNA, 19 nt, Homo sapiens
uuacacgccugcaguuguu

SEQ ID NO: 925083 - RNA, 19 nt, Homo sapiens
aagcggagcucuuccucuu

SEQ ID NO: 925084 - RNA, 19 nt, Homo sapiens
gaccaccgauguccacaca

SEQ ID NO: 925085 - RNA, 19 nt, Homo sapiens
acaagcacauagccaggua

SEQ ID NO: 925086 - RNA, 19 nt, Homo sapiens
caacugcuggguuagcuuu

SEQ ID NO: 925087 - RNA, 19 nt, Homo sapiens
caacuacaagggccacaaa

SEQ ID NO: 925088 - RNA, 19 nt, Homo sapiens
gcaccacggucggcuauac

SEQ ID NO: 925089 - RNA, 19 nt, Homo sapiens
ucaucgaacuucucagugu

SEQ ID NO: 925090 - RNA, 19 nt, Homo sapiens
gcaggcagccacauuuaca

SEQ ID NO: 925091 - RNA, 19 nt, Homo sapiens
caccuuggcugccuucaca

SEQ ID NO: 925092 - RNA, 19 nt, Homo sapiens
gauuaugcacagagacuuu

SEQ ID NO: 925093 - RNA, 19 nt, Homo sapiens
ccacagaaacggccacaca

SEQ ID NO: 925094 - RNA, 19 nt, Homo sapiens
ccacuuguccacacagcua

SEQ ID NO: 925095 - RNA, 19 nt, Homo sapiens
gcauggacaggguuaaugu

SEQ ID NO: 925096 - RNA, 19 nt, Homo sapiens
gcggagcucuuccucuucu

SEQ ID NO: 925097 - RNA, 19 nt, Homo sapiens
guuccugcccuucuccuua

SEQ ID NO: 925098 - RNA, 19 nt, Homo sapiens
cagaaacggccacacaugu

SEQ ID NO: 925099 - RNA, 19 nt, Homo sapiens
aacaagaacaugcugauga

SEQ ID NO: 925100 - RNA, 19 nt, Homo sapiens
gaggaaguuuaccaugcuu

SEQ ID NO: 925101 - RNA, 19 nt, Homo sapiens
ggccuccgcuucuccuaug

SEQ ID NO: 925102 - RNA, 19 nt, Homo sapiens
uauaguccaucugcaauca

SEQ ID NO: 925103 - RNA, 19 nt, Homo sapiens
ccgacgcgguucugcauga

SEQ ID NO: 925104 - RNA, 19 nt, Homo sapiens
cagaauucaccaacaagaa

SEQ ID NO: 925105 - RNA, 19 nt, Homo sapiens
gacagaaggacgcccauuc

SEQ ID NO: 925106 - RNA, 19 nt, Homo sapiens
aaauauaguccaucugcaa

SEQ ID NO: 925107 - RNA, 19 nt, Homo sapiens
ggguuaaugucuccagagu

SEQ ID NO: 925108 - RNA, 19 nt, Homo sapiens
acaucugggucugcgauua

SEQ ID NO: 925109 - RNA, 19 nt, Homo sapiens
ucaugcggcugaguaagaa

SEQ ID NO: 925110 - RNA, 19 nt, Homo sapiens
agaacaugcugaugacagu

SEQ ID NO: 925111 - RNA, 19 nt, Homo sapiens
ucacacgcccucuccauuc

SEQ ID NO: 925112 - RNA, 19 nt, Homo sapiens
gaaguacggaccgguguuc

SEQ ID NO: 925113 - RNA, 19 nt, Homo sapiens
cuacaagggccacaaagca

SEQ ID NO: 925114 - RNA, 19 nt, Homo sapiens
acaagaacaugcugaugac

SEQ ID NO: 925115 - RNA, 19 nt, Homo sapiens
caacaagaacaugcugaug

SEQ ID NO: 925116 - RNA, 19 nt, Homo sapiens
gaauucaccaacaagaaca

SEQ ID NO: 925117 - RNA, 19 nt, Homo sapiens
ccuaugaggauaaggaguu

SEQ ID NO: 925118 - RNA, 19 nt, Homo sapiens
ccaggccaccuccaacgua

SEQ ID NO: 925119 - RNA, 19 nt, Homo sapiens
ggacagaaggacgcccauu

SEQ ID NO: 925120 - RNA, 19 nt, Homo sapiens
agaaacggccacacauguu

SEQ ID NO: 925121 - RNA, 19 nt, Homo sapiens
gacucaugcugcuaagaug

SEQ ID NO: 925122 - RNA, 19 nt, Homo sapiens
ucaagcacccagaagaguu

SEQ ID NO: 925123 - RNA, 19 nt, Homo sapiens
caacucaugcucccucucu

SEQ ID NO: 925124 - RNA, 19 nt, Homo sapiens
ccagguaacccaccaacuc

SEQ ID NO: 925125 - RNA, 19 nt, Homo sapiens
caucugggucugcgauuau

SEQ ID NO: 925126 - RNA, 19 nt, Homo sapiens
cacacgcccucuccauuca

SEQ ID NO: 925127 - RNA, 19 nt, Homo sapiens
ugacucaugcugcuaagau

SEQ ID NO: 925128 - RNA, 19 nt, Homo sapiens
ccaccacgcagaccagaug

SEQ ID NO: 925129 - RNA, 19 nt, Homo sapiens
gguggaggcagcugaggaa

SEQ ID NO: 925130 - RNA, 19 nt, Homo sapiens
ugaggaaguuuaccaugcu

SEQ ID NO: 925131 - RNA, 19 nt, Homo sapiens
cagauggacgguucaggaa

SEQ ID NO: 925132 - RNA, 19 nt, Homo sapiens
agucugcucccuccucuuu

SEQ ID NO: 925133 - RNA, 19 nt, Homo sapiens
aaacccaggcacagaauuc

SEQ ID NO: 925134 - RNA, 19 nt, Homo sapiens
ccaaccacuuguccacaca

SEQ ID NO: 925135 - RNA, 19 nt, Homo sapiens
gguuagcuuuccacagaca

SEQ ID NO: 925136 - RNA, 19 nt, Homo sapiens
cacgcucacuugacucaug

SEQ ID NO: 925137 - RNA, 19 nt, Homo sapiens
ugaaggaaggcaacuugga

SEQ ID NO: 925138 - RNA, 19 nt, Homo sapiens
caagcacccagaagaguuc

SEQ ID NO: 925139 - RNA, 19 nt, Homo sapiens
ggcacagaauucaccaaca

SEQ ID NO: 925140 - RNA, 19 nt, Homo sapiens
gaguaucuucccacugaga

SEQ ID NO: 925141 - RNA, 19 nt, Homo sapiens
acgcagaccagaugaagga

SEQ ID NO: 925142 - RNA, 19 nt, Homo sapiens
gcuggugcccaugggaaua

SEQ ID NO: 925143 - RNA, 19 nt, Homo sapiens
ucauuuauuugcuguuugc

SEQ ID NO: 925144 - RNA, 19 nt, Homo sapiens
acagagacuuuggacauac

SEQ ID NO: 925145 - RNA, 19 nt, Homo sapiens
uuaagcacccugauucuac

SEQ ID NO: 925146 - RNA, 19 nt, Homo sapiens
acagaaacggccacacaug

SEQ ID NO: 925147 - RNA, 19 nt, Homo sapiens
gagcucuuccucuucuuca

SEQ ID NO: 925148 - RNA, 19 nt, Homo sapiens
guucaacccagaccguuuc

SEQ ID NO: 925149 - RNA, 19 nt, Homo sapiens
ccaacaagaacaugcugau

SEQ ID NO: 925150 - RNA, 19 nt, Homo sapiens
uacaagggccacaaagcaa

SEQ ID NO: 925151 - RNA, 19 nt, Homo sapiens
ggagcucuuccucuucuuc

SEQ ID NO: 925152 - RNA, 19 nt, Homo sapiens
aggcagcugaggaaguuua

SEQ ID NO: 925153 - RNA, 19 nt, Homo sapiens
agaaggacgcccauucgau

SEQ ID NO: 925154 - RNA, 19 nt, Homo sapiens
acagaauucaccaacaaga

SEQ ID NO: 925155 - RNA, 19 nt, Homo sapiens
ccucaacagugggcaugga

SEQ ID NO: 925156 - RNA, 19 nt, Homo sapiens
caucuucaagcacccagaa

SEQ ID NO: 925157 - RNA, 19 nt, Homo sapiens
gucauuuauuugcuguuug

SEQ ID NO: 925158 - RNA, 19 nt, Homo sapiens
gaacauaggcaauugcuuu

SEQ ID NO: 925159 - RNA, 19 nt, Homo sapiens
auacguagccuaacacuua

SEQ ID NO: 925160 - RNA, 19 nt, Homo sapiens
gaagcaaugugaacucuca

SEQ ID NO: 925161 - RNA, 19 nt, Homo sapiens
uguguuagcugguagauuu

SEQ ID NO: 925162 - RNA, 19 nt, Homo sapiens
gcuuugagauucuuggaua

SEQ ID NO: 925163 - RNA, 19 nt, Homo sapiens
gguuagcucuauauaagua

SEQ ID NO: 925164 - RNA, 19 nt, Homo sapiens
ggacugacuuggcugagaa

SEQ ID NO: 925165 - RNA, 19 nt, Homo sapiens
gaguuuaucauccuucuua

SEQ ID NO: 925166 - RNA, 19 nt, Homo sapiens
ggacuacauuauagcuuaa

SEQ ID NO: 925167 - RNA, 19 nt, Homo sapiens
gaaauaaaacugcggaaua

SEQ ID NO: 925168 - RNA, 19 nt, Homo sapiens
ccuaauaaauuccagaguu

SEQ ID NO: 925169 - RNA, 19 nt, Homo sapiens
gauagaagaggacaacauu

SEQ ID NO: 925170 - RNA, 19 nt, Homo sapiens
ccagagaccugcuguccuu

SEQ ID NO: 925171 - RNA, 19 nt, Homo sapiens
uaaagagucccaaguuauu

SEQ ID NO: 925172 - RNA, 19 nt, Homo sapiens
gagaaugauaggagacuua

SEQ ID NO: 925173 - RNA, 19 nt, Homo sapiens
uuuaaagagucccaaguua

SEQ ID NO: 925174 - RNA, 19 nt, Homo sapiens
guguuuaccuuuacauuug

SEQ ID NO: 925175 - RNA, 19 nt, Homo sapiens
uggacuacauuauagcuua

SEQ ID NO: 925176 - RNA, 19 nt, Homo sapiens
cauaaaguguggaacauag

SEQ ID NO: 925177 - RNA, 19 nt, Homo sapiens
guaacagcaucuucuacuu

SEQ ID NO: 925178 - RNA, 19 nt, Homo sapiens
gcaauugcuuugagauucu

SEQ ID NO: 925179 - RNA, 19 nt, Homo sapiens
gaaggcaaaugaguuuauc

SEQ ID NO: 925180 - RNA, 19 nt, Homo sapiens
auaaacaucuccuuuccaa

SEQ ID NO: 925181 - RNA, 19 nt, Homo sapiens
guccacaacuugccuucua

SEQ ID NO: 925182 - RNA, 19 nt, Homo sapiens
aauacaauguccuuccaua

SEQ ID NO: 925183 - RNA, 19 nt, Homo sapiens
uacgagugcuuaucaacua

SEQ ID NO: 925184 - RNA, 19 nt, Homo sapiens
gagugcuuaucaacuaaua

SEQ ID NO: 925185 - RNA, 19 nt, Homo sapiens
gagcaucucuuuuaacugu

SEQ ID NO: 925186 - RNA, 19 nt, Homo sapiens
ggaaggcaaaugaguuuau

SEQ ID NO: 925187 - RNA, 19 nt, Homo sapiens
gaaucagucaccagucuuu

SEQ ID NO: 925188 - RNA, 19 nt, Homo sapiens
ggaucaccuuguagucuuu

SEQ ID NO: 925189 - RNA, 19 nt, Homo sapiens
acauuuggaucaccuugua

SEQ ID NO: 925190 - RNA, 19 nt, Homo sapiens
gaagcucaaguuuaaagaa

SEQ ID NO: 925191 - RNA, 19 nt, Homo sapiens
uagcuuaacuagauuguac

SEQ ID NO: 925192 - RNA, 19 nt, Homo sapiens
gagcugaagaugacaguau

SEQ ID NO: 925193 - RNA, 19 nt, Homo sapiens
caucaagguuagcaaacuu

SEQ ID NO: 925194 - RNA, 19 nt, Homo sapiens
ggcaauugcuuugagauuc

SEQ ID NO: 925195 - RNA, 19 nt, Homo sapiens
gguguuuaccuuuacauuu

SEQ ID NO: 925196 - RNA, 19 nt, Homo sapiens
gugggaggguucuguaaau

SEQ ID NO: 925197 - RNA, 19 nt, Homo sapiens
gaaguccucagaaccagaa

SEQ ID NO: 925198 - RNA, 19 nt, Homo sapiens
uaaggaaggcaaaugaguu

SEQ ID NO: 925199 - RNA, 19 nt, Homo sapiens
gauacuuccuugggacuga

SEQ ID NO: 925200 - RNA, 19 nt, Homo sapiens
caugcuugguuaugacuuu

SEQ ID NO: 925201 - RNA, 19 nt, Homo sapiens
uaaguugaguguaauuguc

SEQ ID NO: 925202 - RNA, 19 nt, Homo sapiens
caaaugcacaguagguguu

SEQ ID NO: 925203 - RNA, 19 nt, Homo sapiens
ugggaggguucuguaaaua

SEQ ID NO: 925204 - RNA, 19 nt, Homo sapiens
uaacagcaucuucuacuuc

SEQ ID NO: 925205 - RNA, 19 nt, Homo sapiens
gcugccaucuuccucauca

SEQ ID NO: 925206 - RNA, 19 nt, Homo sapiens
uuaaagagucccaaguuau

SEQ ID NO: 925207 - RNA, 19 nt, Homo sapiens
uugguuagcucuauauaag

SEQ ID NO: 925208 - RNA, 19 nt, Homo sapiens
agugagacccuauuucaaa

SEQ ID NO: 925209 - RNA, 19 nt, Homo sapiens
ggagaaugauaggagacuu

SEQ ID NO: 925210 - RNA, 19 nt, Homo sapiens
gucagaggauuuguuagaa

SEQ ID NO: 925211 - RNA, 19 nt, Homo sapiens
guggauguguuagcuggua

SEQ ID NO: 925212 - RNA, 19 nt, Homo sapiens
ccaucuuccucaucauaaa

SEQ ID NO: 925213 - RNA, 19 nt, Homo sapiens
gaaccagaagcaaugugaa

SEQ ID NO: 925214 - RNA, 19 nt, Homo sapiens
ccagagagguggguuccau

SEQ ID NO: 925215 - RNA, 19 nt, Homo sapiens
uguuagaacucugcccuuu

SEQ ID NO: 925216 - RNA, 19 nt, Homo sapiens
aagagucccaaguuauuua

SEQ ID NO: 925217 - RNA, 19 nt, Homo sapiens
acaauguccuuccauagca

SEQ ID NO: 925218 - RNA, 19 nt, Homo sapiens
ugucuugguuagcucuaua

SEQ ID NO: 925219 - RNA, 19 nt, Homo sapiens
gucccaaguuauuuaaguu

SEQ ID NO: 925220 - RNA, 19 nt, Homo sapiens
uaagaaguccucagaacca

SEQ ID NO: 925221 - RNA, 19 nt, Homo sapiens
guaaguggccagaauacca

SEQ ID NO: 925222 - RNA, 19 nt, Homo sapiens
ugucagaggauuuguuaga

SEQ ID NO: 925223 - RNA, 19 nt, Homo sapiens
ucaagguuagcaaacuuua

SEQ ID NO: 925224 - RNA, 19 nt, Homo sapiens
agagugagacccuauuuca

SEQ ID NO: 925225 - RNA, 19 nt, Homo sapiens
ucaaggccaaggagaauga

SEQ ID NO: 925226 - RNA, 19 nt, Homo sapiens
gggacugacuuggcugaga

SEQ ID NO: 925227 - RNA, 19 nt, Homo sapiens
aaagagucccaaguuauuu

SEQ ID NO: 925228 - RNA, 19 nt, Homo sapiens
uacguagccuaacacuuaa

SEQ ID NO: 925229 - RNA, 19 nt, Homo sapiens
ggauagaagaggacaacau

SEQ ID NO: 925230 - RNA, 19 nt, Homo sapiens
caucauaaaguguggaaca

SEQ ID NO: 925231 - RNA, 19 nt, Homo sapiens
aaauaaacaucuccuuucc

SEQ ID NO: 925232 - RNA, 19 nt, Homo sapiens
aaggaaggcaaaugaguuu

SEQ ID NO: 925233 - RNA, 19 nt, Homo sapiens
cagaggauuuguuagaacu

SEQ ID NO: 925234 - RNA, 19 nt, Homo sapiens
ggugggaggguucuguaaa

SEQ ID NO: 925235 - RNA, 19 nt, Homo sapiens
ucauaaaguguggaacaua

SEQ ID NO: 925236 - RNA, 19 nt, Homo sapiens
cccaaguuauuuaaguuga

SEQ ID NO: 925237 - RNA, 19 nt, Homo sapiens
gaggugggaggguucugua

SEQ ID NO: 925238 - RNA, 19 nt, Homo sapiens
aaaaugagcugaagaugac

SEQ ID NO: 925239 - RNA, 19 nt, Homo sapiens
gugcuuaucaacuaauaug

SEQ ID NO: 925240 - RNA, 19 nt, Homo sapiens
gaucaccuuguagucuuua

SEQ ID NO: 925241 - RNA, 19 nt, Homo sapiens
ggucaaaugcacaguaggu

SEQ ID NO: 925242 - RNA, 19 nt, Homo sapiens
aagcucaaguuuaaagaag

SEQ ID NO: 925243 - RNA, 19 nt, Homo sapiens
gcugaagaugacaguauuu

SEQ ID NO: 925244 - RNA, 19 nt, Homo sapiens
cauaggcaauugcuuugag

SEQ ID NO: 925245 - RNA, 19 nt, Homo sapiens
aaacugcggaauacaaugu

SEQ ID NO: 925246 - RNA, 19 nt, Homo sapiens
ccgcaguggugguggaugu

SEQ ID NO: 925247 - RNA, 19 nt, Homo sapiens
cuuaagaaguccucagaac

SEQ ID NO: 925248 - RNA, 19 nt, Homo sapiens
uggaucaccuuguagucuu

SEQ ID NO: 925249 - RNA, 19 nt, Homo sapiens
uuagaugccacuuacugua

SEQ ID NO: 925250 - RNA, 19 nt, Homo sapiens
aaugauaggagacuuagga

SEQ ID NO: 925251 - RNA, 19 nt, Homo sapiens
gagugagacccuauuucaa

SEQ ID NO: 925252 - RNA, 19 nt, Homo sapiens
cagaagcaaugugaacucu

SEQ ID NO: 925253 - RNA, 19 nt, Homo sapiens
uagauuguacgagugcuua

SEQ ID NO: 925254 - RNA, 19 nt, Homo sapiens
agucaccagucuuucugua

SEQ ID NO: 925255 - RNA, 19 nt, Homo sapiens
ccggccaccuguccauauu

SEQ ID NO: 925256 - RNA, 19 nt, Homo sapiens
cugccuuccuguucaguaa

SEQ ID NO: 925257 - RNA, 19 nt, Homo sapiens
ggggaaagaugaguaacuu

SEQ ID NO: 925258 - RNA, 19 nt, Homo sapiens
caacaaggcagaaauuaua

SEQ ID NO: 925259 - RNA, 19 nt, Homo sapiens
gaagaaagauuguaauagc

SEQ ID NO: 925260 - RNA, 19 nt, Homo sapiens
gaaacaucaucucuacaua

SEQ ID NO: 925261 - RNA, 19 nt, Homo sapiens
guagauuaguggauuguua

SEQ ID NO: 925262 - RNA, 19 nt, Homo sapiens
aaacuaggcuacagguaua

SEQ ID NO: 925263 - RNA, 19 nt, Homo sapiens
cagcugcaauuguaucuua

SEQ ID NO: 925264 - RNA, 19 nt, Homo sapiens
ugagguaacugcauucauu

SEQ ID NO: 925265 - RNA, 19 nt, Homo sapiens
gaacacacacaaacuuaaa

SEQ ID NO: 925266 - RNA, 19 nt, Homo sapiens
ggagacccuuugccacuua

SEQ ID NO: 925267 - RNA, 19 nt, Homo sapiens
caauguggcuugcuccuuu

SEQ ID NO: 925268 - RNA, 19 nt, Homo sapiens
gaaagauucacacagauuu

SEQ ID NO: 925269 - RNA, 19 nt, Homo sapiens
acaaagagauugaaguguu

SEQ ID NO: 925270 - RNA, 19 nt, Homo sapiens
aaagggaggugauggaauu

SEQ ID NO: 925271 - RNA, 19 nt, Homo sapiens
gcccaaagcuugaagaaag

SEQ ID NO: 925272 - RNA, 19 nt, Homo sapiens
gcaacagaaccauuaauaa

SEQ ID NO: 925273 - RNA, 19 nt, Homo sapiens
ccauauuacucucaugaua

SEQ ID NO: 925274 - RNA, 19 nt, Homo sapiens
caaggaagcacaaauaguu

SEQ ID NO: 925275 - RNA, 19 nt, Homo sapiens
gaaaagggauucauuaugg

SEQ ID NO: 925276 - RNA, 19 nt, Homo sapiens
caggaaagauucacacaga

SEQ ID NO: 925277 - RNA, 19 nt, Homo sapiens
caaagagauugaaguguug

SEQ ID NO: 925278 - RNA, 19 nt, Homo sapiens
gaaagacuagaacaaauug

SEQ ID NO: 925279 - RNA, 19 nt, Homo sapiens
gaaagaugauagcaaugau

SEQ ID NO: 925280 - RNA, 19 nt, Homo sapiens
ggaaucagaagaauaguau

SEQ ID NO: 925281 - RNA, 19 nt, Homo sapiens
gaagcgaacaugacacaaa

SEQ ID NO: 925282 - RNA, 19 nt, Homo sapiens
uggcugaaguaaugaaaua

SEQ ID NO: 925283 - RNA, 19 nt, Homo sapiens
ggaaagauucacacagauu

SEQ ID NO: 925284 - RNA, 19 nt, Homo sapiens
guaauagcauuuaguugug

SEQ ID NO: 925285 - RNA, 19 nt, Homo sapiens
uccaagaacuguuacauau

SEQ ID NO: 925286 - RNA, 19 nt, Homo sapiens
cuuuaaagaugcagaagua

SEQ ID NO: 925287 - RNA, 19 nt, Homo sapiens
cagcagagaaauaagaaua

SEQ ID NO: 925288 - RNA, 19 nt, Homo sapiens
uuuagaagcucuccaguga

SEQ ID NO: 925289 - RNA, 19 nt, Homo sapiens
aaaccaaugcgacaaauaa

SEQ ID NO: 925290 - RNA, 19 nt, Homo sapiens
gaccaaguuugcugugaaa

SEQ ID NO: 925291 - RNA, 19 nt, Homo sapiens
gagauugaaguguugaaua

SEQ ID NO: 925292 - RNA, 19 nt, Homo sapiens
gcuuaaagaugaggaaaug

SEQ ID NO: 925293 - RNA, 19 nt, Homo sapiens
ccuauaaucccaacacuuu

SEQ ID NO: 925294 - RNA, 19 nt, Homo sapiens
cuucuaaugugguaaauug

SEQ ID NO: 925295 - RNA, 19 nt, Homo sapiens
gggaggugauggaauuaaa

SEQ ID NO: 925296 - RNA, 19 nt, Homo sapiens
ggauauugcuggccuugug

SEQ ID NO: 925297 - RNA, 19 nt, Homo sapiens
uaaauugcauggacuucuu

SEQ ID NO: 925298 - RNA, 19 nt, Homo sapiens
gcagaaaauuccaaaagaa

SEQ ID NO: 925299 - RNA, 19 nt, Homo sapiens
gguaguauggguaaauuaa

SEQ ID NO: 925300 - RNA, 19 nt, Homo sapiens
ucauuaaucuccaucaugu

SEQ ID NO: 925301 - RNA, 19 nt, Homo sapiens
gaaaugcagguucacuaaa

SEQ ID NO: 925302 - RNA, 19 nt, Homo sapiens
ccacaaaccagcaagcaaa

SEQ ID NO: 925303 - RNA, 19 nt, Homo sapiens
gagguaacugcauucauua

SEQ ID NO: 925304 - RNA, 19 nt, Homo sapiens
cuacagauaaugcauguuu

SEQ ID NO: 925305 - RNA, 19 nt, Homo sapiens
gagguugagucgugaguau

SEQ ID NO: 925306 - RNA, 19 nt, Homo sapiens
ccagaugucuacacucaau

SEQ ID NO: 925307 - RNA, 19 nt, Homo sapiens
ggaaugacaaagagauuga

SEQ ID NO: 925308 - RNA, 19 nt, Homo sapiens
ccaagaacuguuacauaua

SEQ ID NO: 925309 - RNA, 19 nt, Homo sapiens
gcagaaguauuagaacaca

SEQ ID NO: 925310 - RNA, 19 nt, Homo sapiens
gaagugguaguauggguaa

SEQ ID NO: 925311 - RNA, 19 nt, Homo sapiens
gcaacaucaugaaacauca

SEQ ID NO: 925312 - RNA, 19 nt, Homo sapiens
agguauagcugaccaaguu

SEQ ID NO: 925313 - RNA, 19 nt, Homo sapiens
aaacuacagcagagaaaua

SEQ ID NO: 925314 - RNA, 19 nt, Homo sapiens
ggugguugcugauuacaga

SEQ ID NO: 925315 - RNA, 19 nt, Homo sapiens
ggaugucuguauugacuga

SEQ ID NO: 925316 - RNA, 19 nt, Homo sapiens
gacaacaaggcagaaauua

SEQ ID NO: 925317 - RNA, 19 nt, Homo sapiens
ugccaagccugacacauuu

SEQ ID NO: 925318 - RNA, 19 nt, Homo sapiens
aaaugcagguucacuaaau

SEQ ID NO: 925319 - RNA, 19 nt, Homo sapiens
gaaaccuguucgcuucuau

SEQ ID NO: 925320 - RNA, 19 nt, Homo sapiens
gauuucagcaguauaagaa

SEQ ID NO: 925321 - RNA, 19 nt, Homo sapiens
ggaaaguuaccaaauguag

SEQ ID NO: 925322 - RNA, 19 nt, Homo sapiens
uagaacacacacaaacuua

SEQ ID NO: 925323 - RNA, 19 nt, Homo sapiens
gcacuauugauccuaauga

SEQ ID NO: 925324 - RNA, 19 nt, Homo sapiens
ucuguucacuuauaacuug

SEQ ID NO: 925325 - RNA, 19 nt, Homo sapiens
aauggaaaguuaccaaaug

SEQ ID NO: 925326 - RNA, 19 nt, Homo sapiens
gagagcagucgaaguggua

SEQ ID NO: 925327 - RNA, 19 nt, Homo sapiens
ggcagaaauuauauuguug

SEQ ID NO: 925328 - RNA, 19 nt, Homo sapiens
ccuguucgcuucuaucaug

SEQ ID NO: 925329 - RNA, 19 nt, Homo sapiens
aaaguaaaauccuggguua

SEQ ID NO: 925330 - RNA, 19 nt, Homo sapiens
caaaauuccugccuuucua

SEQ ID NO: 925331 - RNA, 19 nt, Homo sapiens
ccuccugccucuucuauug

SEQ ID NO: 925332 - RNA, 19 nt, Homo sapiens
acauuaggaucaugcaauu

SEQ ID NO: 925333 - RNA, 19 nt, Homo sapiens
caaggcagaaauuauauug

SEQ ID NO: 925334 - RNA, 19 nt, Homo sapiens
gugcuuuggucauuccuuu

SEQ ID NO: 925335 - RNA, 19 nt, Homo sapiens
guucugauuagucuacuua

SEQ ID NO: 925336 - RNA, 19 nt, Homo sapiens
agaauuccaagaacuguua

SEQ ID NO: 925337 - RNA, 19 nt, Homo sapiens
uagaagcucuccagugagu

SEQ ID NO: 925338 - RNA, 19 nt, Homo sapiens
ugaaagaugauagcaauga

SEQ ID NO: 925339 - RNA, 19 nt, Homo sapiens
cagauaaacauacaacuuc

SEQ ID NO: 925340 - RNA, 19 nt, Homo sapiens
ccuaauggcaaacuacuuu

SEQ ID NO: 925341 - RNA, 19 nt, Homo sapiens
gaaaauugguauuguugga

SEQ ID NO: 925342 - RNA, 19 nt, Homo sapiens
gaaagagaaacuugagaag

SEQ ID NO: 925343 - RNA, 19 nt, Homo sapiens
guuagggauuucagcagua

SEQ ID NO: 925344 - RNA, 19 nt, Homo sapiens
ugaccaaguuugcugugaa

SEQ ID NO: 925345 - RNA, 19 nt, Homo sapiens
gaagcucuccagugaguau

SEQ ID NO: 925346 - RNA, 19 nt, Homo sapiens
auacuaagaucagacuuug

SEQ ID NO: 925347 - RNA, 19 nt, Homo sapiens
auugaugucugguggguua

SEQ ID NO: 925348 - RNA, 19 nt, Homo sapiens
ugacugaccacaaagaaga

SEQ ID NO: 925349 - RNA, 19 nt, Homo sapiens
gggaaucagaagaauagua

SEQ ID NO: 925350 - RNA, 19 nt, Homo sapiens
uguugaagauggagauauu

SEQ ID NO: 925351 - RNA, 19 nt, Homo sapiens
gaguaccugugccagauga

SEQ ID NO: 925352 - RNA, 19 nt, Homo sapiens
guagauccuauucgagaua

SEQ ID NO: 925353 - RNA, 19 nt, Homo sapiens
aagccucuguucacuuaua

SEQ ID NO: 925354 - RNA, 19 nt, Homo sapiens
auaggugacugaccacaaa

SEQ ID NO: 925355 - RNA, 19 nt, Homo sapiens
ugacaaagagauugaagug

SEQ ID NO: 925356 - RNA, 19 nt, Homo sapiens
aaaauacacuguggugaua

SEQ ID NO: 925357 - RNA, 19 nt, Homo sapiens
gagaaggcuugugcccaaa

SEQ ID NO: 925358 - RNA, 19 nt, Homo sapiens
caagaaacggcuuuacuua

SEQ ID NO: 925359 - RNA, 19 nt, Homo sapiens
ggaaacacaucaagcacaa

SEQ ID NO: 925360 - RNA, 19 nt, Homo sapiens
ggaaauaaaugugaauugc

SEQ ID NO: 925361 - RNA, 19 nt, Homo sapiens
gcaagaaacggcuuuacuu

SEQ ID NO: 925362 - RNA, 19 nt, Homo sapiens
gaaacggcuuuacuuacaa

SEQ ID NO: 925363 - RNA, 19 nt, Homo sapiens
agaaacggcuuuacuuaca

SEQ ID NO: 925364 - RNA, 19 nt, Homo sapiens
gcacaaguaugagaacaag

SEQ ID NO: 925365 - RNA, 19 nt, Homo sapiens
gaagaugaugcucaaggua

SEQ ID NO: 925366 - RNA, 19 nt, Homo sapiens
gacguugacuucgaaauug

SEQ ID NO: 925367 - RNA, 19 nt, Homo sapiens
ucagcaugcucaggaaaua

SEQ ID NO: 925368 - RNA, 19 nt, Homo sapiens
acaaguaugagaacaagua

SEQ ID NO: 925369 - RNA, 19 nt, Homo sapiens
cgacguugacuucgaaauu

SEQ ID NO: 925370 - RNA, 19 nt, Homo sapiens
aaacggcuuuacuuacaaa

SEQ ID NO: 925371 - RNA, 19 nt, Homo sapiens
ggaccaccauucgcuguug

SEQ ID NO: 925372 - RNA, 19 nt, Homo sapiens
gcucaggaaauaaauguga

SEQ ID NO: 925373 - RNA, 19 nt, Homo sapiens
ucaagguacucuucaugga

SEQ ID NO: 925374 - RNA, 19 nt, Homo sapiens
agccucagcuugaagauga

SEQ ID NO: 925375 - RNA, 19 nt, Homo sapiens
aaaugugaauugcccuuga

SEQ ID NO: 925376 - RNA, 19 nt, Homo sapiens
ugaagaugaugcucaaggu

SEQ ID NO: 925377 - RNA, 19 nt, Homo sapiens
acaucaagcacaaguauga

SEQ ID NO: 925378 - RNA, 19 nt, Homo sapiens
ccgcgacguugacuucgaa

SEQ ID NO: 925379 - RNA, 19 nt, Homo sapiens
gcucaagguacucuucaug

SEQ ID NO: 925380 - RNA, 19 nt, Homo sapiens
acacaucaagcacaaguau

SEQ ID NO: 925381 - RNA, 19 nt, Homo sapiens
aaugugaauugcccuugaa

SEQ ID NO: 925382 - RNA, 19 nt, Homo sapiens
aguaugagaacaaguaguu

SEQ ID NO: 925383 - RNA, 19 nt, Homo sapiens
caucgugggcgucauguuc

SEQ ID NO: 925384 - RNA, 19 nt, Homo sapiens
gcgcggacgcuaucuacga

SEQ ID NO: 925385 - RNA, 19 nt, Homo sapiens
ucaagcacaaguaugagaa

SEQ ID NO: 925386 - RNA, 19 nt, Homo sapiens
aaacacaucaagcacaagu

SEQ ID NO: 925387 - RNA, 19 nt, Homo sapiens
cagcaugcucaggaaauaa

SEQ ID NO: 925388 - RNA, 19 nt, Homo sapiens
aaaacagacucuuuaccuu

SEQ ID NO: 925389 - RNA, 19 nt, Homo sapiens
ggcaagaaacggcuuuacu

SEQ ID NO: 925390 - RNA, 19 nt, Homo sapiens
aacagacucuuuaccuucu

SEQ ID NO: 925391 - RNA, 19 nt, Homo sapiens
caucaucgugggcgucaug

SEQ ID NO: 925392 - RNA, 19 nt, Homo sapiens
cucaggaaauaaaugugaa

SEQ ID NO: 925393 - RNA, 19 nt, Homo sapiens
uaccuucugcuguguuuga

SEQ ID NO: 925394 - RNA, 19 nt, Homo sapiens
aagaaacggcuuuacuuac

SEQ ID NO: 925395 - RNA, 19 nt, Homo sapiens
gcaaguagcauuaccuuua

SEQ ID NO: 925396 - RNA, 19 nt, Homo sapiens
cagaguaccuucaaguuua

SEQ ID NO: 925397 - RNA, 19 nt, Homo sapiens
ggacagcgcuggagcuaga

SEQ ID NO: 925398 - RNA, 19 nt, Homo sapiens
gcccaaggauuuauucaua

SEQ ID NO: 925399 - RNA, 19 nt, Homo sapiens
gaaauagggagcauguuua

SEQ ID NO: 925400 - RNA, 19 nt, Homo sapiens
gcagaguaccuucaaguuu

SEQ ID NO: 925401 - RNA, 19 nt, Homo sapiens
ccauaacacugaauaaagu

SEQ ID NO: 925402 - RNA, 19 nt, Homo sapiens
uuacagccauucuaugaaa

SEQ ID NO: 925403 - RNA, 19 nt, Homo sapiens
gugaggagcugccugacuu

SEQ ID NO: 925404 - RNA, 19 nt, Homo sapiens
gcucaacucugccuggaau

SEQ ID NO: 925405 - RNA, 19 nt, Homo sapiens
gaaaaugagugcuguagau

SEQ ID NO: 925406 - RNA, 19 nt, Homo sapiens
ggagcugccugacuucaug

SEQ ID NO: 925407 - RNA, 19 nt, Homo sapiens
uuagagcacugugauguaa

SEQ ID NO: 925408 - RNA, 19 nt, Homo sapiens
gugcagaaauacagcgauu

SEQ ID NO: 925409 - RNA, 19 nt, Homo sapiens
gagcauguuuacagccauu

SEQ ID NO: 925410 - RNA, 19 nt, Homo sapiens
agaaauagggagcauguuu

SEQ ID NO: 925411 - RNA, 19 nt, Homo sapiens
gcagaaauagggagcaugu

SEQ ID NO: 925412 - RNA, 19 nt, Homo sapiens
caaguagcauuaccuuuac

SEQ ID NO: 925413 - RNA, 19 nt, Homo sapiens
ugagagugauauucauuug

SEQ ID NO: 925414 - RNA, 19 nt, Homo sapiens
ccaacaugcucuaaugcuu

SEQ ID NO: 925415 - RNA, 19 nt, Homo sapiens
gcaccugcccaaggauuua

SEQ ID NO: 925416 - RNA, 19 nt, Homo sapiens
gauaaucggcagcucaaug

SEQ ID NO: 925417 - RNA, 19 nt, Homo sapiens
gcauuaccuuuacauauac

SEQ ID NO: 925418 - RNA, 19 nt, Homo sapiens
agaguaccuucaaguuuaa

SEQ ID NO: 925419 - RNA, 19 nt, Homo sapiens
gcucuaaugcuucagauuc

SEQ ID NO: 925420 - RNA, 19 nt, Homo sapiens
uguaacaugucaagcagaa

SEQ ID NO: 925421 - RNA, 19 nt, Homo sapiens
ugcuguagaugacaugaua

SEQ ID NO: 925422 - RNA, 19 nt, Homo sapiens
guuuacagccauucuauga

SEQ ID NO: 925423 - RNA, 19 nt, Homo sapiens
uaacaugucaagcagaaau

SEQ ID NO: 925424 - RNA, 19 nt, Homo sapiens
gaccaggguuugcaaucug

SEQ ID NO: 925425 - RNA, 19 nt, Homo sapiens
gaaaguguggcuggagcua

SEQ ID NO: 925426 - RNA, 19 nt, Homo sapiens
ggcagaacaucauaaacag

SEQ ID NO: 925427 - RNA, 19 nt, Homo sapiens
gauagcagaguaccuucaa

SEQ ID NO: 925428 - RNA, 19 nt, Homo sapiens
ugcuucaggugcagaaaua

SEQ ID NO: 925429 - RNA, 19 nt, Homo sapiens
caaaagagaaugcaucaau

SEQ ID NO: 925430 - RNA, 19 nt, Homo sapiens
uaaggccacugaugcucaa

SEQ ID NO: 925431 - RNA, 19 nt, Homo sapiens
guagcauuaccuuuacaua

SEQ ID NO: 925432 - RNA, 19 nt, Homo sapiens
ccuucaaguuuaaaucuga

SEQ ID NO: 925433 - RNA, 19 nt, Homo sapiens
uggcagaacaucauaaaca

SEQ ID NO: 925434 - RNA, 19 nt, Homo sapiens
cauggcaccuccuguagag

SEQ ID NO: 925435 - RNA, 19 nt, Homo sapiens
aaucugagagugauauuca

SEQ ID NO: 925436 - RNA, 19 nt, Homo sapiens
guacagacuagcacagaag

SEQ ID NO: 925437 - RNA, 19 nt, Homo sapiens
auaaucggcagcucaauga

SEQ ID NO: 925438 - RNA, 19 nt, Homo sapiens
guuuaaaucugagagugau

SEQ ID NO: 925439 - RNA, 19 nt, Homo sapiens
cccaaggauuuauucauag

SEQ ID NO: 925440 - RNA, 19 nt, Homo sapiens
caugauagcagaguaccuu

SEQ ID NO: 925441 - RNA, 19 nt, Homo sapiens
ccaaggauuuauucauagc

SEQ ID NO: 925442 - RNA, 19 nt, Homo sapiens
gcagagaccaggguuugca

SEQ ID NO: 925443 - RNA, 19 nt, Homo sapiens
gcacaguggaagcuaugga

SEQ ID NO: 925444 - RNA, 19 nt, Homo sapiens
cuucauggcaccuccugua

SEQ ID NO: 925445 - RNA, 19 nt, Homo sapiens
aaaugagugcuguagauga

SEQ ID NO: 925446 - RNA, 19 nt, Homo sapiens
gauauucauuuggcagaac

SEQ ID NO: 925447 - RNA, 19 nt, Homo sapiens
aaguguggcuggagcuaga

SEQ ID NO: 925448 - RNA, 19 nt, Homo sapiens
agagcacugugauguaaca

SEQ ID NO: 925449 - RNA, 19 nt, Homo sapiens
uguacagacuagcacagaa

SEQ ID NO: 925450 - RNA, 19 nt, Homo sapiens
cuaccauaacacugaauaa

SEQ ID NO: 925451 - RNA, 19 nt, Homo sapiens
cugggcaucugggccauuu

SEQ ID NO: 925452 - RNA, 19 nt, Homo sapiens
gagggacuucucucauuca

SEQ ID NO: 925453 - RNA, 19 nt, Homo sapiens
gagaccaggguuugcaauc

SEQ ID NO: 925454 - RNA, 19 nt, Homo sapiens
guucggaauguacagacua

SEQ ID NO: 925455 - RNA, 19 nt, Homo sapiens
ugauauucauuuggcagaa

SEQ ID NO: 925456 - RNA, 19 nt, Homo sapiens
agaccaggguuugcaaucu

SEQ ID NO: 925457 - RNA, 19 nt, Homo sapiens
aacaugcucuaaugcuuca

SEQ ID NO: 925458 - RNA, 19 nt, Homo sapiens
uagcagaguaccuucaagu

SEQ ID NO: 925459 - RNA, 19 nt, Homo sapiens
gggcacaguggaagcuaug

SEQ ID NO: 925460 - RNA, 19 nt, Homo sapiens
acagucaaguggaaacaac

SEQ ID NO: 925461 - RNA, 19 nt, Homo sapiens
cugagagugauauucauuu

SEQ ID NO: 925462 - RNA, 19 nt, Homo sapiens
aaugagugcuguagaugac

SEQ ID NO: 925463 - RNA, 19 nt, Homo sapiens
agaacaucauaaacagguu

SEQ ID NO: 925464 - RNA, 19 nt, Homo sapiens
gagagugauauucauuugg

SEQ ID NO: 925465 - RNA, 19 nt, Homo sapiens
gaaagaaacugugaaugua

SEQ ID NO: 925466 - RNA, 19 nt, Homo sapiens
gagcacaccuggccaauca

SEQ ID NO: 925467 - RNA, 19 nt, Homo sapiens
ggaguaaugugcgaacuuu

SEQ ID NO: 925468 - RNA, 19 nt, Homo sapiens
uuaaccaacugaugacuua

SEQ ID NO: 925469 - RNA, 19 nt, Homo sapiens
gaaauacgagcaugccuuu

SEQ ID NO: 925470 - RNA, 19 nt, Homo sapiens
gcgcauagcucuugacacu

SEQ ID NO: 925471 - RNA, 19 nt, Homo sapiens
guacacaguuguuucugaa

SEQ ID NO: 925472 - RNA, 19 nt, Homo sapiens
gaaggaaaauucaucauug

SEQ ID NO: 925473 - RNA, 19 nt, Homo sapiens
gcgccuaccucuucaauuc

SEQ ID NO: 925474 - RNA, 19 nt, Homo sapiens
gaucuguccucuucgugua

SEQ ID NO: 925475 - RNA, 19 nt, Homo sapiens
ugaaagaaacugugaaugu

SEQ ID NO: 925476 - RNA, 19 nt, Homo sapiens
gaaagaauuaaccaacuga

SEQ ID NO: 925477 - RNA, 19 nt, Homo sapiens
gagaaagaauuaaccaacu

SEQ ID NO: 925478 - RNA, 19 nt, Homo sapiens
ugaauguaauggaaacgua

SEQ ID NO: 925479 - RNA, 19 nt, Homo sapiens
gacaauggcugggaguaau

SEQ ID NO: 925480 - RNA, 19 nt, Homo sapiens
gagagcagucagaaauaua

SEQ ID NO: 925481 - RNA, 19 nt, Homo sapiens
ccucggaucuguccucuuc

SEQ ID NO: 925482 - RNA, 19 nt, Homo sapiens
agaauuaaccaacugauga

SEQ ID NO: 925483 - RNA, 19 nt, Homo sapiens
ugagagcagucagaaauau

SEQ ID NO: 925484 - RNA, 19 nt, Homo sapiens
ucagaaauauaaggaagga

SEQ ID NO: 925485 - RNA, 19 nt, Homo sapiens
ggacgcgccuaccucuuca

SEQ ID NO: 925486 - RNA, 19 nt, Homo sapiens
agaaagaauuaaccaacug

SEQ ID NO: 925487 - RNA, 19 nt, Homo sapiens
aagcguaucugccgaacug

SEQ ID NO: 925488 - RNA, 19 nt, Homo sapiens
ggagagauggugaaaauga

SEQ ID NO: 925489 - RNA, 19 nt, Homo sapiens
gcucauaugaucaaagaca

SEQ ID NO: 925490 - RNA, 19 nt, Homo sapiens
gcagucagaaauauaagga

SEQ ID NO: 925491 - RNA, 19 nt, Homo sapiens
caggagagauggugaaaau

SEQ ID NO: 925492 - RNA, 19 nt, Homo sapiens
cgaaugcuguuuugugaaa

SEQ ID NO: 925493 - RNA, 19 nt, Homo sapiens
ggaaggaaaauucaucauu

SEQ ID NO: 925494 - RNA, 19 nt, Homo sapiens
ggagugcccaggagagaug

SEQ ID NO: 925495 - RNA, 19 nt, Homo sapiens
agagcagucagaaauauaa

SEQ ID NO: 925496 - RNA, 19 nt, Homo sapiens
uugcucauaugaucaaaga

SEQ ID NO: 925497 - RNA, 19 nt, Homo sapiens
gcucaucuccaaguccuuu

SEQ ID NO: 925498 - RNA, 19 nt, Homo sapiens
gcacaccuggccaaucaug

SEQ ID NO: 925499 - RNA, 19 nt, Homo sapiens
uguacacaguuguuucuga

SEQ ID NO: 925500 - RNA, 19 nt, Homo sapiens
aauacgagcaugccuuuga

SEQ ID NO: 925501 - RNA, 19 nt, Homo sapiens
ucaauuccguggugaacgu

SEQ ID NO: 925502 - RNA, 19 nt, Homo sapiens
caaaggcuagcugcgcaua

SEQ ID NO: 925503 - RNA, 19 nt, Homo sapiens
agacaauggcugggaguaa

SEQ ID NO: 925504 - RNA, 19 nt, Homo sapiens
gaggagugcccaggagaga

SEQ ID NO: 925505 - RNA, 19 nt, Homo sapiens
guaggagcaucuggugaca

SEQ ID NO: 925506 - RNA, 19 nt, Homo sapiens
cagcagagccacgguucuu

SEQ ID NO: 925507 - RNA, 19 nt, Homo sapiens
gcaugcgguugccgacauc

SEQ ID NO: 925508 - RNA, 19 nt, Homo sapiens
gaauuaaccaacugaugac

SEQ ID NO: 925509 - RNA, 19 nt, Homo sapiens
uaaggugucccucggaucu

SEQ ID NO: 925510 - RNA, 19 nt, Homo sapiens
gggaguaaugugcgaacuu

SEQ ID NO: 925511 - RNA, 19 nt, Homo sapiens
gaaaaugacaaaguccaaa

SEQ ID NO: 925512 - RNA, 19 nt, Homo sapiens
ggccaucucuguggguaag

SEQ ID NO: 925513 - RNA, 19 nt, Homo sapiens
cgacaucuacugcgagaac

SEQ ID NO: 925514 - RNA, 19 nt, Homo sapiens
cauaugaucaaagacaaug

SEQ ID NO: 925515 - RNA, 19 nt, Homo sapiens
uuugagagcagucagaaau

SEQ ID NO: 925516 - RNA, 19 nt, Homo sapiens
aaacugugaauguaaugga

SEQ ID NO: 925517 - RNA, 19 nt, Homo sapiens
cgaacugucaccgaacgua

SEQ ID NO: 925518 - RNA, 19 nt, Homo sapiens
uugagagcagucagaaaua

SEQ ID NO: 925519 - RNA, 19 nt, Homo sapiens
gacgagcucaucuccaagu

SEQ ID NO: 925520 - RNA, 19 nt, Homo sapiens
gaaacugugaauguaaugg

SEQ ID NO: 925521 - RNA, 19 nt, Homo sapiens
ggaagaggcgcguguauaa

SEQ ID NO: 925522 - RNA, 19 nt, Homo sapiens
gcaaguggcucaacaacug

SEQ ID NO: 925523 - RNA, 19 nt, Homo sapiens
gcacgcacaugucauugaa

SEQ ID NO: 925524 - RNA, 19 nt, Homo sapiens
gcaacaagcccuccaacaa

SEQ ID NO: 925525 - RNA, 19 nt, Homo sapiens
ggcacaagcucaccaccua

SEQ ID NO: 925526 - RNA, 19 nt, Homo sapiens
acagggagcucgagucaug

SEQ ID NO: 925527 - RNA, 19 nt, Homo sapiens
gcaaacauuuacugaggau

SEQ ID NO: 925528 - RNA, 19 nt, Homo sapiens
gaacuaccggcucuuucua

SEQ ID NO: 925529 - RNA, 19 nt, Homo sapiens
ggagauggaguucuacaug

SEQ ID NO: 925530 - RNA, 19 nt, Homo sapiens
gaagaggcgcguguauaaa

SEQ ID NO: 925531 - RNA, 19 nt, Homo sapiens
ggagugggauagaaagaag

SEQ ID NO: 925532 - RNA, 19 nt, Homo sapiens
augcggaccuucagacaua

SEQ ID NO: 925533 - RNA, 19 nt, Homo sapiens
ucaagucagcaaacauuua

SEQ ID NO: 925534 - RNA, 19 nt, Homo sapiens
caacaagcccuccaacaag

SEQ ID NO: 925535 - RNA, 19 nt, Homo sapiens
cggcugugaugcuccaaua

SEQ ID NO: 925536 - RNA, 19 nt, Homo sapiens
gcaccaaccgacacuuuga

SEQ ID NO: 925537 - RNA, 19 nt, Homo sapiens
gaggaucuacuauguacaa

SEQ ID NO: 925538 - RNA, 19 nt, Homo sapiens
gcugugaugcuccaauaaa

SEQ ID NO: 925539 - RNA, 19 nt, Homo sapiens
gaagccagcacgcacaugu

SEQ ID NO: 925540 - RNA, 19 nt, Homo sapiens
caucuuugcuggccaccuu

SEQ ID NO: 925541 - RNA, 19 nt, Homo sapiens
aacaagcccuccaacaaga

SEQ ID NO: 925542 - RNA, 19 nt, Homo sapiens
ugaagaaucacacggaugu

SEQ ID NO: 925543 - RNA, 19 nt, Homo sapiens
gcgcaccaaccgacacuuu

SEQ ID NO: 925544 - RNA, 19 nt, Homo sapiens
ggaacuaccggcucuuucu

SEQ ID NO: 925545 - RNA, 19 nt, Homo sapiens
cugcucugcuuccacauuu

SEQ ID NO: 925546 - RNA, 19 nt, Homo sapiens
uugaaguccugaagaauca

SEQ ID NO: 925547 - RNA, 19 nt, Homo sapiens
ucuacuauguacaagauga

SEQ ID NO: 925548 - RNA, 19 nt, Homo sapiens
acgcacaugucauugaaga

SEQ ID NO: 925549 - RNA, 19 nt, Homo sapiens
gggaggcuggucuggcuua

SEQ ID NO: 925550 - RNA, 19 nt, Homo sapiens
uucaggagauggaguucua

SEQ ID NO: 925551 - RNA, 19 nt, Homo sapiens
gcacaagcucaccaccuau

SEQ ID NO: 925552 - RNA, 19 nt, Homo sapiens
ccgaaccucuggcugacuu

SEQ ID NO: 925553 - RNA, 19 nt, Homo sapiens
caagucagcaaacauuuac

SEQ ID NO: 925554 - RNA, 19 nt, Homo sapiens
acaagugcgugugcgguuu

SEQ ID NO: 925555 - RNA, 19 nt, Homo sapiens
ccagcacgcacaugucauu

SEQ ID NO: 925556 - RNA, 19 nt, Homo sapiens
ucacagggagcucgaguca

SEQ ID NO: 925557 - RNA, 19 nt, Homo sapiens
uaccggcucuuucuacaca

SEQ ID NO: 925558 - RNA, 19 nt, Homo sapiens
gaggaagaggcgcguguau

SEQ ID NO: 925559 - RNA, 19 nt, Homo sapiens
cugaggaucuacuauguac

SEQ ID NO: 925560 - RNA, 19 nt, Homo sapiens
gcucugcuuccacauuuau

SEQ ID NO: 925561 - RNA, 19 nt, Homo sapiens
gugaugcuccaauaaacuu

SEQ ID NO: 925562 - RNA, 19 nt, Homo sapiens
uacugaggaucuacuaugu

SEQ ID NO: 925563 - RNA, 19 nt, Homo sapiens
gcugcuguaccucuucuuu

SEQ ID NO: 925564 - RNA, 19 nt, Homo sapiens
cagguggagugggauagaa

SEQ ID NO: 925565 - RNA, 19 nt, Homo sapiens
gucauguccucccaagaug

SEQ ID NO: 925566 - RNA, 19 nt, Homo sapiens
cauaugucuucguggaguu

SEQ ID NO: 925567 - RNA, 19 nt, Homo sapiens
uuacugaggaucuacuaug

SEQ ID NO: 925568 - RNA, 19 nt, Homo sapiens
gcucgccucugcuucuuuu

SEQ ID NO: 925569 - RNA, 19 nt, Homo sapiens
gcgcgcagcuguuuucaag

SEQ ID NO: 925570 - RNA, 19 nt, Homo sapiens
gcggaacuaccggcucuuu

SEQ ID NO: 925571 - RNA, 19 nt, Homo sapiens
uuucaagucagcaaacauu

SEQ ID NO: 925572 - RNA, 19 nt, Homo sapiens
aggaagaggcgcguguaua

SEQ ID NO: 925573 - RNA, 19 nt, Homo sapiens
aaagugcgaacgucugaga

SEQ ID NO: 925574 - RNA, 19 nt, Homo sapiens
gaaccucuggcugacuuug

SEQ ID NO: 925575 - RNA, 19 nt, Homo sapiens
aaacauuuacugaggaucu

SEQ ID NO: 925576 - RNA, 19 nt, Homo sapiens
caguguugcauccgcuuua

SEQ ID NO: 925577 - RNA, 19 nt, Homo sapiens
caacuugugcaacguggau

SEQ ID NO: 925578 - RNA, 19 nt, Homo sapiens
gcgcucgccucugcuucuu

SEQ ID NO: 925579 - RNA, 19 nt, Homo sapiens
ggaugugugguucguguuc

SEQ ID NO: 925580 - RNA, 19 nt, Homo sapiens
ggaucuacuauguacaaga

SEQ ID NO: 925581 - RNA, 19 nt, Homo sapiens
auaaagugcgaacgucuga

SEQ ID NO: 925582 - RNA, 19 nt, Homo sapiens
aagaggcgcguguauaaag

SEQ ID NO: 925583 - RNA, 19 nt, Homo sapiens
ccucuucuuugcugugauc

SEQ ID NO: 925584 - RNA, 19 nt, Homo sapiens
agaggcgcguguauaaagu

SEQ ID NO: 925585 - RNA, 19 nt, Homo sapiens
gcgcagcuguuuucaaguc

SEQ ID NO: 925586 - RNA, 19 nt, Homo sapiens
cagcagugaaugccaaaca

SEQ ID NO: 925587 - RNA, 19 nt, Homo sapiens
agucauguccucccaagau

SEQ ID NO: 925588 - RNA, 19 nt, Homo sapiens
cuccaucgauccagcagau

SEQ ID NO: 925589 - RNA, 19 nt, Homo sapiens
aacauuuacugaggaucua

SEQ ID NO: 925590 - RNA, 19 nt, Homo sapiens
cucgauaucuccucuacua

SEQ ID NO: 925591 - RNA, 19 nt, Homo sapiens
gauuacuacugcucuguug

SEQ ID NO: 925592 - RNA, 19 nt, Homo sapiens
ggaccuuccugucaguuuc

SEQ ID NO: 925593 - RNA, 19 nt, Homo sapiens
cugaagacgacgcggauua

SEQ ID NO: 925594 - RNA, 19 nt, Homo sapiens
gccuguguccucaccauua

SEQ ID NO: 925595 - RNA, 19 nt, Homo sapiens
ucuguuggcuacggcuuua

SEQ ID NO: 925596 - RNA, 19 nt, Homo sapiens
ggauuacuacugcucuguu

SEQ ID NO: 925597 - RNA, 19 nt, Homo sapiens
ggucuucccaggccaagug

SEQ ID NO: 925598 - RNA, 19 nt, Homo sapiens
ccaaggaugaggcccacaa

SEQ ID NO: 925599 - RNA, 19 nt, Homo sapiens
uggaugcacugcuggucuu

SEQ ID NO: 925600 - RNA, 19 nt, Homo sapiens
aagacgacgcggauuacua

SEQ ID NO: 925601 - RNA, 19 nt, Homo sapiens
agacgacgcggauuacuac

SEQ ID NO: 925602 - RNA, 19 nt, Homo sapiens
gggaccuuccugucaguuu

SEQ ID NO: 925603 - RNA, 19 nt, Homo sapiens
acuacgguguguccuggua

SEQ ID NO: 925604 - RNA, 19 nt, Homo sapiens
ccuguguccucaccauuag

SEQ ID NO: 925605 - RNA, 19 nt, Homo sapiens
gggaagcgcuuuaccaaua

SEQ ID NO: 925606 - RNA, 19 nt, Homo sapiens
ggaaguugcuggugaguuu

SEQ ID NO: 925607 - RNA, 19 nt, Homo sapiens
gaauucugcuuuccuauaa

SEQ ID NO: 925608 - RNA, 19 nt, Homo sapiens
ggaagcgcuuuaccaauaa

SEQ ID NO: 925609 - RNA, 19 nt, Homo sapiens
gagcagaucccaaggcauu

SEQ ID NO: 925610 - RNA, 19 nt, Homo sapiens
gaagaagcacgaugucuga

SEQ ID NO: 925611 - RNA, 19 nt, Homo sapiens
agacagaacuugggccuuu

SEQ ID NO: 925612 - RNA, 19 nt, Homo sapiens
guagaguccuguaaaugaa

SEQ ID NO: 925613 - RNA, 19 nt, Homo sapiens
gaacuaaacagaacaacca

SEQ ID NO: 925614 - RNA, 19 nt, Homo sapiens
uguuagaaauccuuccuua

SEQ ID NO: 925615 - RNA, 19 nt, Homo sapiens
gcucggauguggcauagga

SEQ ID NO: 925616 - RNA, 19 nt, Homo sapiens
cuaaacagaacaaccauuu

SEQ ID NO: 925617 - RNA, 19 nt, Homo sapiens
gaaauccuuccuuauaaug

SEQ ID NO: 925618 - RNA, 19 nt, Homo sapiens
gaaccugcuggccuuguua

SEQ ID NO: 925619 - RNA, 19 nt, Homo sapiens
gcaaagccuucagccagaa

SEQ ID NO: 925620 - RNA, 19 nt, Homo sapiens
gaguuuccuuucuccauuu

SEQ ID NO: 925621 - RNA, 19 nt, Homo sapiens
gcagaucccaaggcauuua

SEQ ID NO: 925622 - RNA, 19 nt, Homo sapiens
ccauucagcugcaaagcaa

SEQ ID NO: 925623 - RNA, 19 nt, Homo sapiens
ugaauucugcuuuccuaua

SEQ ID NO: 925624 - RNA, 19 nt, Homo sapiens
ugaguuuccuuucuccauu

SEQ ID NO: 925625 - RNA, 19 nt, Homo sapiens
uguccaggcucuugucuga

SEQ ID NO: 925626 - RNA, 19 nt, Homo sapiens
aaugaauucugcuuuccua

SEQ ID NO: 925627 - RNA, 19 nt, Homo sapiens
ccuccauccucugguauua

SEQ ID NO: 925628 - RNA, 19 nt, Homo sapiens
ugaaugcucugggcuagau

SEQ ID NO: 925629 - RNA, 19 nt, Homo sapiens
cgucugcuguuaauacuuc

SEQ ID NO: 925630 - RNA, 19 nt, Homo sapiens
aauaagcccuaucugacuu

SEQ ID NO: 925631 - RNA, 19 nt, Homo sapiens
acccaucgcuugucccaaa

SEQ ID NO: 925632 - RNA, 19 nt, Homo sapiens
aaacagaacaaccauuuac

SEQ ID NO: 925633 - RNA, 19 nt, Homo sapiens
gcagcucggauguggcaua

SEQ ID NO: 925634 - RNA, 19 nt, Homo sapiens
ggaagaaccgaugcuggaa

SEQ ID NO: 925635 - RNA, 19 nt, Homo sapiens
cuuggucugucucgcuuua

SEQ ID NO: 925636 - RNA, 19 nt, Homo sapiens
ugaagcgaagccacucuua

SEQ ID NO: 925637 - RNA, 19 nt, Homo sapiens
gcgggaagcgcuuuaccaa

SEQ ID NO: 925638 - RNA, 19 nt, Homo sapiens
gacagaacuugggccuuug

SEQ ID NO: 925639 - RNA, 19 nt, Homo sapiens
cuccauuucuagcauauga

SEQ ID NO: 925640 - RNA, 19 nt, Homo sapiens
gaagcgcuuuaccaauaag

SEQ ID NO: 925641 - RNA, 19 nt, Homo sapiens
gggagcaguggccacauuu

SEQ ID NO: 925642 - RNA, 19 nt, Homo sapiens
ggacaaugggaauccuaga

SEQ ID NO: 925643 - RNA, 19 nt, Homo sapiens
gcaaggccuuccgccacaa

SEQ ID NO: 925644 - RNA, 19 nt, Homo sapiens
acagggagagggcagcaua

SEQ ID NO: 925645 - RNA, 19 nt, Homo sapiens
cugaggcccuggaugauuc

SEQ ID NO: 925646 - RNA, 19 nt, Homo sapiens
gcuggugaguuuccuuucu

SEQ ID NO: 925647 - RNA, 19 nt, Homo sapiens
gcacccagacuuggagaga

SEQ ID NO: 925648 - RNA, 19 nt, Homo sapiens
gaagcgaagccacucuuac

SEQ ID NO: 925649 - RNA, 19 nt, Homo sapiens
cuagauacagcuuggagaa

SEQ ID NO: 925650 - RNA, 19 nt, Homo sapiens
ccagcuaguugcccacaag

SEQ ID NO: 925651 - RNA, 19 nt, Homo sapiens
ggcccuggaugauucuaau

SEQ ID NO: 925652 - RNA, 19 nt, Homo sapiens
aacccaaccugcugucuca

SEQ ID NO: 925653 - RNA, 19 nt, Homo sapiens
caauaagcccuaucugacu

SEQ ID NO: 925654 - RNA, 19 nt, Homo sapiens
guuagaaauccuuccuuau

SEQ ID NO: 925655 - RNA, 19 nt, Homo sapiens
ccuggaugauucuaauugu

SEQ ID NO: 925656 - RNA, 19 nt, Homo sapiens
acaccuggccucugcuuga

SEQ ID NO: 925657 - RNA, 19 nt, Homo sapiens
ggauguggcauaggaaaca

SEQ ID NO: 925658 - RNA, 19 nt, Homo sapiens
uuaaugccccugucuuuua

SEQ ID NO: 925659 - RNA, 19 nt, Homo sapiens
caacuguggccggagcuuu

SEQ ID NO: 925660 - RNA, 19 nt, Homo sapiens
uauugggccuuguucuguu

SEQ ID NO: 925661 - RNA, 19 nt, Homo sapiens
ccagaaguccaaccucauc

SEQ ID NO: 925662 - RNA, 19 nt, Homo sapiens
gaguguggccgucgcuuuc

SEQ ID NO: 925663 - RNA, 19 nt, Homo sapiens
cugcuggccuuguuagaca

SEQ ID NO: 925664 - RNA, 19 nt, Homo sapiens
agaaccugcuggccuuguu

SEQ ID NO: 925665 - RNA, 19 nt, Homo sapiens
agacgcuucuggcgacgaa

SEQ ID NO: 925666 - RNA, 19 nt, Homo sapiens
cuggaugauucuaauuguu

SEQ ID NO: 925667 - RNA, 19 nt, Homo sapiens
accaauaagcccuaucuga

SEQ ID NO: 925668 - RNA, 19 nt, Homo sapiens
ccacaagcgggugcacgua

SEQ ID NO: 925669 - RNA, 19 nt, Homo sapiens
agggagcaguggccacauu

SEQ ID NO: 925670 - RNA, 19 nt, Homo sapiens
ccagugggaccagcuaguu

SEQ ID NO: 925671 - RNA, 19 nt, Homo sapiens
cuuguucuguucucuggaa

SEQ ID NO: 925672 - RNA, 19 nt, Homo sapiens
gcaagcgcuuccggcacaa

SEQ ID NO: 925673 - RNA, 19 nt, Homo sapiens
cuucauaugcggcaacugu

SEQ ID NO: 925674 - RNA, 19 nt, Homo sapiens
guaggcacccagacuugga

SEQ ID NO: 925675 - RNA, 19 nt, Homo sapiens
gcguaggcacccagacuug

SEQ ID NO: 925676 - RNA, 19 nt, Homo sapiens
cagcucggauguggcauag

SEQ ID NO: 925677 - RNA, 19 nt, Homo sapiens
uuucuccauuucuagcaua

SEQ ID NO: 925678 - RNA, 19 nt, Homo sapiens
uuuccuuucuccauuucua

SEQ ID NO: 925679 - RNA, 19 nt, Homo sapiens
agaguccuguaaaugaaug

SEQ ID NO: 925680 - RNA, 19 nt, Homo sapiens
cuucugcugugccaucugu

SEQ ID NO: 925681 - RNA, 19 nt, Homo sapiens
gaaugcucugggcuagaua

SEQ ID NO: 925682 - RNA, 19 nt, Homo sapiens
gacaaugggaauccuagag

SEQ ID NO: 925683 - RNA, 19 nt, Homo sapiens
ugaguguggccgucgcuuu

SEQ ID NO: 925684 - RNA, 19 nt, Homo sapiens
gggaagcgcuuuaccaaua

SEQ ID NO: 925685 - RNA, 19 nt, Homo sapiens
ggaaguugcuggugaguuu

SEQ ID NO: 925686 - RNA, 19 nt, Homo sapiens
gaauucugcuuuccuauaa

SEQ ID NO: 925687 - RNA, 19 nt, Homo sapiens
ggaagcgcuuuaccaauaa

SEQ ID NO: 925688 - RNA, 19 nt, Homo sapiens
gagcagaucccaaggcauu

SEQ ID NO: 925689 - RNA, 19 nt, Homo sapiens
gaagaagcacgaugucuga

SEQ ID NO: 925690 - RNA, 19 nt, Homo sapiens
gcccaucgcuugucccaaa

SEQ ID NO: 925691 - RNA, 19 nt, Homo sapiens
guagaguccuguaaaugaa

SEQ ID NO: 925692 - RNA, 19 nt, Homo sapiens
gaacuaaacagaacaacca

SEQ ID NO: 925693 - RNA, 19 nt, Homo sapiens
ggcaaagccuucagacaga

SEQ ID NO: 925694 - RNA, 19 nt, Homo sapiens
uguuagaaauccuuccuua

SEQ ID NO: 925695 - RNA, 19 nt, Homo sapiens
guuccaggcucuugucuga

SEQ ID NO: 925696 - RNA, 19 nt, Homo sapiens
gcaaagccuucagacagaa

SEQ ID NO: 925697 - RNA, 19 nt, Homo sapiens
cuaaacagaacaaccauuu

SEQ ID NO: 925698 - RNA, 19 nt, Homo sapiens
gaaauccuuccuuauaaug

SEQ ID NO: 925699 - RNA, 19 nt, Homo sapiens
gaaccugcuggccuuguua

SEQ ID NO: 925700 - RNA, 19 nt, Homo sapiens
gcagaucccaaggcauuua

SEQ ID NO: 925701 - RNA, 19 nt, Homo sapiens
agacagcacuugggccuuu

SEQ ID NO: 925702 - RNA, 19 nt, Homo sapiens
ugaauucugcuuuccuaua

SEQ ID NO: 925703 - RNA, 19 nt, Homo sapiens
gacccuccauccucuggua

SEQ ID NO: 925704 - RNA, 19 nt, Homo sapiens
aaugaauucugcuuuccua

SEQ ID NO: 925705 - RNA, 19 nt, Homo sapiens
gaguuggucucuggaguga

SEQ ID NO: 925706 - RNA, 19 nt, Homo sapiens
ccuccauccucugguauua

SEQ ID NO: 925707 - RNA, 19 nt, Homo sapiens
ugaaugcucugggcuagau

SEQ ID NO: 925708 - RNA, 19 nt, Homo sapiens
cgucugcuguuaauacuuc

SEQ ID NO: 925709 - RNA, 19 nt, Homo sapiens
aauaagcccuaucugacuu

SEQ ID NO: 925710 - RNA, 19 nt, Homo sapiens
aaacagaacaaccauuuac

SEQ ID NO: 925711 - RNA, 19 nt, Homo sapiens
ggaagaaccgaugcuggaa

SEQ ID NO: 925712 - RNA, 19 nt, Homo sapiens
ugaagcgaagccacucuua

SEQ ID NO: 925713 - RNA, 19 nt, Homo sapiens
gcgggaagcgcuuuaccaa

SEQ ID NO: 925714 - RNA, 19 nt, Homo sapiens
gaagcgcuuuaccaauaag

SEQ ID NO: 925715 - RNA, 19 nt, Homo sapiens
ggacaaugggaauccuaga

SEQ ID NO: 925716 - RNA, 19 nt, Homo sapiens
gcaaggccuuccgccacaa

SEQ ID NO: 925717 - RNA, 19 nt, Homo sapiens
cugaggcccuggaugauuc

SEQ ID NO: 925718 - RNA, 19 nt, Homo sapiens
gcacccagacuuggagaga

SEQ ID NO: 925719 - RNA, 19 nt, Homo sapiens
gaagcgaagccacucuuac

SEQ ID NO: 925720 - RNA, 19 nt, Homo sapiens
cuagauacagcuuggagaa

SEQ ID NO: 925721 - RNA, 19 nt, Homo sapiens
ccagcuaguugcccacaag

SEQ ID NO: 925722 - RNA, 19 nt, Homo sapiens
ggcccuggaugauucuaau

SEQ ID NO: 925723 - RNA, 19 nt, Homo sapiens
aacccaaccugcugucuca

SEQ ID NO: 925724 - RNA, 19 nt, Homo sapiens
caauaagcccuaucugacu

SEQ ID NO: 925725 - RNA, 19 nt, Homo sapiens
guuagaaauccuuccuuau

SEQ ID NO: 925726 - RNA, 19 nt, Homo sapiens
ccuggaugauucuaauugu

SEQ ID NO: 925727 - RNA, 19 nt, Homo sapiens
acaccuggccucugcuuga

SEQ ID NO: 925728 - RNA, 19 nt, Homo sapiens
uugggucugucucgcuuua

SEQ ID NO: 925729 - RNA, 19 nt, Homo sapiens
uuaaugccccugucuuuua

SEQ ID NO: 925730 - RNA, 19 nt, Homo sapiens
uauugggccuuguucuguu

SEQ ID NO: 925731 - RNA, 19 nt, Homo sapiens
gaguguggccgucgcuuuc

SEQ ID NO: 925732 - RNA, 19 nt, Homo sapiens
ccagaaguccaaccucauc

SEQ ID NO: 925733 - RNA, 19 nt, Homo sapiens
cugcuggccuuguuagaca

SEQ ID NO: 925734 - RNA, 19 nt, Homo sapiens
agaaccugcuggccuuguu

SEQ ID NO: 925735 - RNA, 19 nt, Homo sapiens
agacgcuucuggcgacgaa

SEQ ID NO: 925736 - RNA, 19 nt, Homo sapiens
cuggaugauucuaauuguu

SEQ ID NO: 925737 - RNA, 19 nt, Homo sapiens
cuucauaugcggaaacugu

SEQ ID NO: 925738 - RNA, 19 nt, Homo sapiens
ggacaccuggccucugcuu

SEQ ID NO: 925739 - RNA, 19 nt, Homo sapiens
gggucugucucgcuuuauc

SEQ ID NO: 925740 - RNA, 19 nt, Homo sapiens
accaauaagcccuaucuga

SEQ ID NO: 925741 - RNA, 19 nt, Homo sapiens
ccacaagcgggugcacgua

SEQ ID NO: 925742 - RNA, 19 nt, Homo sapiens
ccagugggaccagcuaguu

SEQ ID NO: 925743 - RNA, 19 nt, Homo sapiens
cuuguucuguucucuggaa

SEQ ID NO: 925744 - RNA, 19 nt, Homo sapiens
guuggucucuggagugacu

SEQ ID NO: 925745 - RNA, 19 nt, Homo sapiens
gcaagcgcuuccggcacaa

SEQ ID NO: 925746 - RNA, 19 nt, Homo sapiens
guaggcacccagacuugga

SEQ ID NO: 925747 - RNA, 19 nt, Homo sapiens
gcguaggcacccagacuug

SEQ ID NO: 925748 - RNA, 19 nt, Homo sapiens
gacagcacuugggccuuug

SEQ ID NO: 925749 - RNA, 19 nt, Homo sapiens
ggaaaggaagacccuccau

SEQ ID NO: 925750 - RNA, 19 nt, Homo sapiens
uuucuccauuucuagcaua

SEQ ID NO: 925751 - RNA, 19 nt, Homo sapiens
agaguccuguaaaugaaug

SEQ ID NO: 925752 - RNA, 19 nt, Homo sapiens
cuucugcugugccaucugu

SEQ ID NO: 925753 - RNA, 19 nt, Homo sapiens
ugaguguggccgucgcuuu

SEQ ID NO: 925754 - RNA, 19 nt, Homo sapiens
gaaugcucugggcuagaua

SEQ ID NO: 925755 - RNA, 19 nt, Homo sapiens
gacaaugggaauccuagag

SEQ ID NO: 925756 - RNA, 19 nt, Homo sapiens
aaagaaagcuucaacacua

SEQ ID NO: 925757 - RNA, 19 nt, Homo sapiens
gaacauggacgacaacauu

SEQ ID NO: 925758 - RNA, 19 nt, Homo sapiens
gcacaccgcuaaacaaaga

SEQ ID NO: 925759 - RNA, 19 nt, Homo sapiens
gaagaucaguuaaggcauu

SEQ ID NO: 925760 - RNA, 19 nt, Homo sapiens
gggaacaacuuugaauaua

SEQ ID NO: 925761 - RNA, 19 nt, Homo sapiens
aaacaaagaugcauugaca

SEQ ID NO: 925762 - RNA, 19 nt, Homo sapiens
ucgaggagauugcguauaa

SEQ ID NO: 925763 - RNA, 19 nt, Homo sapiens
gaagcuaucucagacaaau

SEQ ID NO: 925764 - RNA, 19 nt, Homo sapiens
ugaaggcucugucuugaaa

SEQ ID NO: 925765 - RNA, 19 nt, Homo sapiens
gauaagagaggccaucuga

SEQ ID NO: 925766 - RNA, 19 nt, Homo sapiens
gcaaccagcugggcauuga

SEQ ID NO: 925767 - RNA, 19 nt, Homo sapiens
caagggagcugagcggaaa

SEQ ID NO: 925768 - RNA, 19 nt, Homo sapiens
ggaacaacuuugaauauac

SEQ ID NO: 925769 - RNA, 19 nt, Homo sapiens
gaugaaagagaaauccaua

SEQ ID NO: 925770 - RNA, 19 nt, Homo sapiens
gcgaauggauaucacaguu

SEQ ID NO: 925771 - RNA, 19 nt, Homo sapiens
gagagaaggucaucaacag

SEQ ID NO: 925772 - RNA, 19 nt, Homo sapiens
aagcagagaagaucaguua

SEQ ID NO: 925773 - RNA, 19 nt, Homo sapiens
agaaacagcauaccaauug

SEQ ID NO: 925774 - RNA, 19 nt, Homo sapiens
gaaacagcauaccaauugu

SEQ ID NO: 925775 - RNA, 19 nt, Homo sapiens
gcauugacauagcugacua

SEQ ID NO: 925776 - RNA, 19 nt, Homo sapiens
ugacguaccugaacaaagg

SEQ ID NO: 925777 - RNA, 19 nt, Homo sapiens
gauagaagaaccaaagaga

SEQ ID NO: 925778 - RNA, 19 nt, Homo sapiens
gagcagcagugaaggaauc

SEQ ID NO: 925779 - RNA, 19 nt, Homo sapiens
acaaagaugcauugacaua

SEQ ID NO: 925780 - RNA, 19 nt, Homo sapiens
ggugaaggcucugucuuga

SEQ ID NO: 925781 - RNA, 19 nt, Homo sapiens
ucauugaucucgauacuca

SEQ ID NO: 925782 - RNA, 19 nt, Homo sapiens
gaaagagaaauccauauac

SEQ ID NO: 925783 - RNA, 19 nt, Homo sapiens
gguagcauuuaaucuauug

SEQ ID NO: 925784 - RNA, 19 nt, Homo sapiens
ggugguagcauuuaaucua

SEQ ID NO: 925785 - RNA, 19 nt, Homo sapiens
gaauggauaucacaguuuu

SEQ ID NO: 925786 - RNA, 19 nt, Homo sapiens
gaauauacccuagaagcuu

SEQ ID NO: 925787 - RNA, 19 nt, Homo sapiens
ccaaagcgaugaugagcau

SEQ ID NO: 925788 - RNA, 19 nt, Homo sapiens
gcauaccaauugugacaga

SEQ ID NO: 925789 - RNA, 19 nt, Homo sapiens
gaacaacuuugaauauacc

SEQ ID NO: 925790 - RNA, 19 nt, Homo sapiens
ggaguucagugcagguguu

SEQ ID NO: 925791 - RNA, 19 nt, Homo sapiens
gaaaggagucagaagaagu

SEQ ID NO: 925792 - RNA, 19 nt, Homo sapiens
gaucggguguacuguccua

SEQ ID NO: 925793 - RNA, 19 nt, Homo sapiens
ggaaggcguucaggagguu

SEQ ID NO: 925794 - RNA, 19 nt, Homo sapiens
gugaagggguugccucuua

SEQ ID NO: 925795 - RNA, 19 nt, Homo sapiens
guacuguccuaacccgaaa

SEQ ID NO: 925796 - RNA, 19 nt, Homo sapiens
gagaaauccauauaccauu

SEQ ID NO: 925797 - RNA, 19 nt, Homo sapiens
gcagguguuucuagaucuu

SEQ ID NO: 925798 - RNA, 19 nt, Homo sapiens
gaugaagaacgaaagcaaa

SEQ ID NO: 925799 - RNA, 19 nt, Homo sapiens
ccuagaagcuucaaaauca

SEQ ID NO: 925800 - RNA, 19 nt, Homo sapiens
uaagagaggccaucugaca

SEQ ID NO: 925801 - RNA, 19 nt, Homo sapiens
gaauucagaggacuauguu

SEQ ID NO: 925802 - RNA, 19 nt, Homo sapiens
aaucagggaugaagaacga

SEQ ID NO: 925803 - RNA, 19 nt, Homo sapiens
gaaugaagcacuuuaucca

SEQ ID NO: 925804 - RNA, 19 nt, Homo sapiens
gugguagcauuuaaucuau

SEQ ID NO: 925805 - RNA, 19 nt, Homo sapiens
gcuaaacaaagaugcauug

SEQ ID NO: 925806 - RNA, 19 nt, Homo sapiens
caaaaucacuucgacagaa

SEQ ID NO: 925807 - RNA, 19 nt, Homo sapiens
cauugccucugaagaauug

SEQ ID NO: 925808 - RNA, 19 nt, Homo sapiens
gaagaacgaaagcaaagca

SEQ ID NO: 925809 - RNA, 19 nt, Homo sapiens
agaucaaggucuucuguga

SEQ ID NO: 925810 - RNA, 19 nt, Homo sapiens
cagcacaccgcuaaacaaa

SEQ ID NO: 925811 - RNA, 19 nt, Homo sapiens
gcagagaagaucaguuaag

SEQ ID NO: 925812 - RNA, 19 nt, Homo sapiens
guucagcucuggugcucaa

SEQ ID NO: 925813 - RNA, 19 nt, Homo sapiens
gcacagaagaugacuuugc

SEQ ID NO: 925814 - RNA, 19 nt, Homo sapiens
ucaguaacaucgaggagau

SEQ ID NO: 925815 - RNA, 19 nt, Homo sapiens
aagaaagcuucaacacuau

SEQ ID NO: 925816 - RNA, 19 nt, Homo sapiens
cagagaagaucaguuaagg

SEQ ID NO: 925817 - RNA, 19 nt, Homo sapiens
gugcagguguuucuagauc

SEQ ID NO: 925818 - RNA, 19 nt, Homo sapiens
gaacgaaagcaaagcaaaa

SEQ ID NO: 925819 - RNA, 19 nt, Homo sapiens
gaaaaucagggaugaagaa

SEQ ID NO: 925820 - RNA, 19 nt, Homo sapiens
gagacaguaccaugacgua

SEQ ID NO: 925821 - RNA, 19 nt, Homo sapiens
gcagcacaccgcuaaacaa

SEQ ID NO: 925822 - RNA, 19 nt, Homo sapiens
uguuggcucuucagaauga

SEQ ID NO: 925823 - RNA, 19 nt, Homo sapiens
ggaugaagaacgaaagcaa

SEQ ID NO: 925824 - RNA, 19 nt, Homo sapiens
gaaagcuucaacacuauca

SEQ ID NO: 925825 - RNA, 19 nt, Homo sapiens
ugagccagaucacagcaaa

SEQ ID NO: 925826 - RNA, 19 nt, Homo sapiens
gggaaaauauucaagaagu

SEQ ID NO: 925827 - RNA, 19 nt, Homo sapiens
cgaaaggagucagaagaag

SEQ ID NO: 925828 - RNA, 19 nt, Homo sapiens
cggcacagaagaugacuuu

SEQ ID NO: 925829 - RNA, 19 nt, Homo sapiens
gaggugagcagcagugaag

SEQ ID NO: 925830 - RNA, 19 nt, Homo sapiens
gaucggaaucucaauacug

SEQ ID NO: 925831 - RNA, 19 nt, Homo sapiens
gcuuggugguagcauuuaa

SEQ ID NO: 925832 - RNA, 19 nt, Homo sapiens
acuacaagguuccaagaga

SEQ ID NO: 925833 - RNA, 19 nt, Homo sapiens
cgaauggauaucacaguuu

SEQ ID NO: 925834 - RNA, 19 nt, Homo sapiens
gaaagcaaagcaaaagaaa

SEQ ID NO: 925835 - RNA, 19 nt, Homo sapiens
uaaagaaagcuucaacacu

SEQ ID NO: 925836 - RNA, 19 nt, Homo sapiens
aaacagagugcaaguacug

SEQ ID NO: 925837 - RNA, 19 nt, Homo sapiens
aaagagaaauccauauacc

SEQ ID NO: 925838 - RNA, 19 nt, Homo sapiens
ggaaaauauucaagaagug

SEQ ID NO: 925839 - RNA, 19 nt, Homo sapiens
gguugccucuuaacauuca

SEQ ID NO: 925840 - RNA, 19 nt, Homo sapiens
gcugggcauugauaagaga

SEQ ID NO: 925841 - RNA, 19 nt, Homo sapiens
gaaggucaucaacagcaaa

SEQ ID NO: 925842 - RNA, 19 nt, Homo sapiens
gaugaggccuggaaauccu

SEQ ID NO: 925843 - RNA, 19 nt, Homo sapiens
ugacaagauugggaaaaua

SEQ ID NO: 925844 - RNA, 19 nt, Homo sapiens
uggaagcuaucucagacaa

SEQ ID NO: 925845 - RNA, 19 nt, Homo sapiens
gggugaaggcucugucuug

SEQ ID NO: 925846 - RNA, 19 nt, Homo sapiens
aguguuggcucuucagaau

SEQ ID NO: 925847 - RNA, 19 nt, Homo sapiens
caacgaugaagcaaagguu

SEQ ID NO: 925848 - RNA, 19 nt, Homo sapiens
gcuucaacacuaucaguaa

SEQ ID NO: 925849 - RNA, 19 nt, Homo sapiens
ggccaguucuaucccauca

SEQ ID NO: 925850 - RNA, 19 nt, Homo sapiens
ccaggagacaguaccauga

SEQ ID NO: 925851 - RNA, 19 nt, Homo sapiens
uagaagaaccaaagagagu

SEQ ID NO: 925852 - RNA, 19 nt, Homo sapiens
gcagugaaggaauccauca

SEQ ID NO: 925853 - RNA, 19 nt, Homo sapiens
ccuuccagcugcagauuga

SEQ ID NO: 925854 - RNA, 19 nt, Homo sapiens
ucucacaagcgaauggaua

SEQ ID NO: 925855 - RNA, 19 nt, Homo sapiens
gacaacaaacggccagugu

SEQ ID NO: 925856 - RNA, 19 nt, Homo sapiens
ggccaaagaugaccauuua

SEQ ID NO: 925857 - RNA, 19 nt, Homo sapiens
gaccaaugauuuccuguua

SEQ ID NO: 925858 - RNA, 19 nt, Homo sapiens
gaaaugcuaucuugugguu

SEQ ID NO: 925859 - RNA, 19 nt, Homo sapiens
gaaacugaaucaccuagaa

SEQ ID NO: 925860 - RNA, 19 nt, Homo sapiens
uauagcagcuguaccauuu

SEQ ID NO: 925861 - RNA, 19 nt, Homo sapiens
gcaacgagauggugcagaa

SEQ ID NO: 925862 - RNA, 19 nt, Homo sapiens
gaccaggacuagaccuuua

SEQ ID NO: 925863 - RNA, 19 nt, Homo sapiens
gaagggagccgaucggaaa

SEQ ID NO: 925864 - RNA, 19 nt, Homo sapiens
caucaacacuugcuauuau

SEQ ID NO: 925865 - RNA, 19 nt, Homo sapiens
ggagacgucugcucugaaa

SEQ ID NO: 925866 - RNA, 19 nt, Homo sapiens
ggguagcgauauaaauuua

SEQ ID NO: 925867 - RNA, 19 nt, Homo sapiens
ggaggaagguugagaccaa

SEQ ID NO: 925868 - RNA, 19 nt, Homo sapiens
gaaauucgucuuugucuug

SEQ ID NO: 925869 - RNA, 19 nt, Homo sapiens
ugucauagcuucuaaaugg

SEQ ID NO: 925870 - RNA, 19 nt, Homo sapiens
gaaauuugagugucaguaa

SEQ ID NO: 925871 - RNA, 19 nt, Homo sapiens
gugcagaacuuccaagaug

SEQ ID NO: 925872 - RNA, 19 nt, Homo sapiens
ucauauaucuggaaucaug

SEQ ID NO: 925873 - RNA, 19 nt, Homo sapiens
caaggucagucuuaugaaa

SEQ ID NO: 925874 - RNA, 19 nt, Homo sapiens
gaaaagaacugcccaagag

SEQ ID NO: 925875 - RNA, 19 nt, Homo sapiens
ggacauauguuuucauuuc

SEQ ID NO: 925876 - RNA, 19 nt, Homo sapiens
caaagucaccugcauggua

SEQ ID NO: 925877 - RNA, 19 nt, Homo sapiens
aaauggagcuucuguggaa

SEQ ID NO: 925878 - RNA, 19 nt, Homo sapiens
gaagauuaaugccuguguu

SEQ ID NO: 925879 - RNA, 19 nt, Homo sapiens
gaccacauuuguuuauuga

SEQ ID NO: 925880 - RNA, 19 nt, Homo sapiens
ggggagaacuuguuuuaua

SEQ ID NO: 925881 - RNA, 19 nt, Homo sapiens
ccucuuggauggacuuaua

SEQ ID NO: 925882 - RNA, 19 nt, Homo sapiens
ucagguauaugacugguaa

SEQ ID NO: 925883 - RNA, 19 nt, Homo sapiens
gaaccaccaucaauucaca

SEQ ID NO: 925884 - RNA, 19 nt, Homo sapiens
uaaggaggauuaggaauga

SEQ ID NO: 925885 - RNA, 19 nt, Homo sapiens
gauggacauuuguguguuu

SEQ ID NO: 925886 - RNA, 19 nt, Homo sapiens
ucacaugccauucaguuua

SEQ ID NO: 925887 - RNA, 19 nt, Homo sapiens
acuaacagcuuuauugaga

SEQ ID NO: 925888 - RNA, 19 nt, Homo sapiens
ccaaugauuuccuguuaug

SEQ ID NO: 925889 - RNA, 19 nt, Homo sapiens
gaggcuauguuuaggauau

SEQ ID NO: 925890 - RNA, 19 nt, Homo sapiens
ccaugaaucuacuuucuau

SEQ ID NO: 925891 - RNA, 19 nt, Homo sapiens
gugauaggguagcgauaua

SEQ ID NO: 925892 - RNA, 19 nt, Homo sapiens
gaagaugucccgagaugau

SEQ ID NO: 925893 - RNA, 19 nt, Homo sapiens
ugggugagcuauuuguaua

SEQ ID NO: 925894 - RNA, 19 nt, Homo sapiens
uggaagagcugaccaccuu

SEQ ID NO: 925895 - RNA, 19 nt, Homo sapiens
gagagcuucugcauucauu

SEQ ID NO: 925896 - RNA, 19 nt, Homo sapiens
ggguccagcuucauucuuu

SEQ ID NO: 925897 - RNA, 19 nt, Homo sapiens
ugaguugggugagcuauuu

SEQ ID NO: 925898 - RNA, 19 nt, Homo sapiens
ccagguccuuugccuauuu

SEQ ID NO: 925899 - RNA, 19 nt, Homo sapiens
gauagaccacauuuguuua

SEQ ID NO: 925900 - RNA, 19 nt, Homo sapiens
gcaacagguucucgcaguu

SEQ ID NO: 925901 - RNA, 19 nt, Homo sapiens
caaccaaggucagucuuau

SEQ ID NO: 925902 - RNA, 19 nt, Homo sapiens
gugcuagacugaaggacua

SEQ ID NO: 925903 - RNA, 19 nt, Homo sapiens
caugguagaugccacaaug

SEQ ID NO: 925904 - RNA, 19 nt, Homo sapiens
guucuuggaugaauugaug

SEQ ID NO: 925905 - RNA, 19 nt, Homo sapiens
gucaggagcuggagcagaa

SEQ ID NO: 925906 - RNA, 19 nt, Homo sapiens
uaaaggccucugcuucuua

SEQ ID NO: 925907 - RNA, 19 nt, Homo sapiens
cugaaggacuaccagaaua

SEQ ID NO: 925908 - RNA, 19 nt, Homo sapiens
ccugaaauguggacucuga

SEQ ID NO: 925909 - RNA, 19 nt, Homo sapiens
gaaugaugcugcuaugaac

SEQ ID NO: 925910 - RNA, 19 nt, Homo sapiens
uaacagcuuuauugagaug

SEQ ID NO: 925911 - RNA, 19 nt, Homo sapiens
gaaugaagugcuagacuga

SEQ ID NO: 925912 - RNA, 19 nt, Homo sapiens
gagaugauuugguccagau

SEQ ID NO: 925913 - RNA, 19 nt, Homo sapiens
guaaggaggauuaggaaug

SEQ ID NO: 925914 - RNA, 19 nt, Homo sapiens
caaagaugaccauuuaugu

SEQ ID NO: 925915 - RNA, 19 nt, Homo sapiens
ggugagcuauuuguauauu

SEQ ID NO: 925916 - RNA, 19 nt, Homo sapiens
guauccagguuucaauuug

SEQ ID NO: 925917 - RNA, 19 nt, Homo sapiens
cccaagagaaggagaaaua

SEQ ID NO: 925918 - RNA, 19 nt, Homo sapiens
agucaacguugguacauuu

SEQ ID NO: 925919 - RNA, 19 nt, Homo sapiens
caggacaucucggaauaaa

SEQ ID NO: 925920 - RNA, 19 nt, Homo sapiens
ggcuucagcucuugguuaa

SEQ ID NO: 925921 - RNA, 19 nt, Homo sapiens
gauauuccacugucuguug

SEQ ID NO: 925922 - RNA, 19 nt, Homo sapiens
guaggaggcuaauauuguc

SEQ ID NO: 925923 - RNA, 19 nt, Homo sapiens
aguaugaaaugcuaucuug

SEQ ID NO: 925924 - RNA, 19 nt, Homo sapiens
ugauuccucuuccuucuuu

SEQ ID NO: 925925 - RNA, 19 nt, Homo sapiens
cagaaugggugcaucaucu

SEQ ID NO: 925926 - RNA, 19 nt, Homo sapiens
guccaacccugacguucua

SEQ ID NO: 925927 - RNA, 19 nt, Homo sapiens
ccuuggagcugauugagaa

SEQ ID NO: 925928 - RNA, 19 nt, Homo sapiens
ccaaagaugaccauuuaug

SEQ ID NO: 925929 - RNA, 19 nt, Homo sapiens
gaggauguaucaguacuuc

SEQ ID NO: 925930 - RNA, 19 nt, Homo sapiens
gaaggacuaccagaauaaa

SEQ ID NO: 925931 - RNA, 19 nt, Homo sapiens
cuucagcucuugguuaauu

SEQ ID NO: 925932 - RNA, 19 nt, Homo sapiens
gaccuugaccaccacaaua

SEQ ID NO: 925933 - RNA, 19 nt, Homo sapiens
gaacugcccaagagaagga

SEQ ID NO: 925934 - RNA, 19 nt, Homo sapiens
gggcuucagcucuugguua

SEQ ID NO: 925935 - RNA, 19 nt, Homo sapiens
ccucuuggccuccagauuu

SEQ ID NO: 925936 - RNA, 19 nt, Homo sapiens
agauagaccacauuuguuu

SEQ ID NO: 925937 - RNA, 19 nt, Homo sapiens
ucacagaaccaccaucaau

SEQ ID NO: 925938 - RNA, 19 nt, Homo sapiens
ccauucaguuuacccauug

SEQ ID NO: 925939 - RNA, 19 nt, Homo sapiens
gguaauagccauggcauuc

SEQ ID NO: 925940 - RNA, 19 nt, Homo sapiens
ugaaggacuaccagaauaa

SEQ ID NO: 925941 - RNA, 19 nt, Homo sapiens
gggaugucauagcuucuaa

SEQ ID NO: 925942 - RNA, 19 nt, Homo sapiens
uaacugugguagacucaga

SEQ ID NO: 925943 - RNA, 19 nt, Homo sapiens
gaaugggugcaucaucuuu

SEQ ID NO: 925944 - RNA, 19 nt, Homo sapiens
ccgugaagcugcaugaaga

SEQ ID NO: 925945 - RNA, 19 nt, Homo sapiens
agaaauaccagccguccua

SEQ ID NO: 925946 - RNA, 19 nt, Homo sapiens
aggcuaauauugucuucua

SEQ ID NO: 925947 - RNA, 19 nt, Homo sapiens
ugcaucaucuuucuuaaug

SEQ ID NO: 925948 - RNA, 19 nt, Homo sapiens
ggagcaguuugcccucauu

SEQ ID NO: 925949 - RNA, 19 nt, Homo sapiens
ugaaugaugcugcuaugaa

SEQ ID NO: 925950 - RNA, 19 nt, Homo sapiens
agaccacauuuguuuauug

SEQ ID NO: 925951 - RNA, 19 nt, Homo sapiens
gccauucaguuuacccauu

SEQ ID NO: 925952 - RNA, 19 nt, Homo sapiens
gauaggguagcgauauaaa

SEQ ID NO: 925953 - RNA, 19 nt, Homo sapiens
gaaugguuccuuguucuuu

SEQ ID NO: 925954 - RNA, 19 nt, Homo sapiens
caagaugaauccuguuuug

SEQ ID NO: 925955 - RNA, 19 nt, Homo sapiens
gcagaacuuccaagaugaa

SEQ ID NO: 925956 - RNA, 19 nt, Homo sapiens
gcagaauacucuugcaaua

SEQ ID NO: 925957 - RNA, 19 nt, Homo sapiens
ggaaagaguuugacaccaa

SEQ ID NO: 925958 - RNA, 19 nt, Homo sapiens
gcaaagauauucaaacucu

SEQ ID NO: 925959 - RNA, 19 nt, Homo sapiens
ggaaauggagaaagaaaua

SEQ ID NO: 925960 - RNA, 19 nt, Homo sapiens
gcaaauaugcugacuguau

SEQ ID NO: 925961 - RNA, 19 nt, Homo sapiens
gaucaucaauuucuacaug

SEQ ID NO: 925962 - RNA, 19 nt, Homo sapiens
gcauuucgccugaccauua

SEQ ID NO: 925963 - RNA, 19 nt, Homo sapiens
caaugaagccugcagaaua

SEQ ID NO: 925964 - RNA, 19 nt, Homo sapiens
cgaaagaccucaaguggau

SEQ ID NO: 925965 - RNA, 19 nt, Homo sapiens
aaagagagauuuacagaca

SEQ ID NO: 925966 - RNA, 19 nt, Homo sapiens
gcaaauggccaauggagaa

SEQ ID NO: 925967 - RNA, 19 nt, Homo sapiens
gaggauggaugcuggagaa

SEQ ID NO: 925968 - RNA, 19 nt, Homo sapiens
agaaacagccgaagucuuu

SEQ ID NO: 925969 - RNA, 19 nt, Homo sapiens
gaaagaguuugacaccaau

SEQ ID NO: 925970 - RNA, 19 nt, Homo sapiens
cagaggaaauggagaaaga

SEQ ID NO: 925971 - RNA, 19 nt, Homo sapiens
ggagauuccuguuacuguu

SEQ ID NO: 925972 - RNA, 19 nt, Homo sapiens
ccacaacuccguauucaaa

SEQ ID NO: 925973 - RNA, 19 nt, Homo sapiens
uugaaagacucacuguuua

SEQ ID NO: 925974 - RNA, 19 nt, Homo sapiens
ccauguaucugcauaugaa

SEQ ID NO: 925975 - RNA, 19 nt, Homo sapiens
ucaaguggauuaucaaaca

SEQ ID NO: 925976 - RNA, 19 nt, Homo sapiens
uaacuuagcagcuucaaau

SEQ ID NO: 925977 - RNA, 19 nt, Homo sapiens
ggacaaagaaaguagaugu

SEQ ID NO: 925978 - RNA, 19 nt, Homo sapiens
gaacauucaguacaugauu

SEQ ID NO: 925979 - RNA, 19 nt, Homo sapiens
gaaagacucacuguuuaaa

SEQ ID NO: 925980 - RNA, 19 nt, Homo sapiens
ggaagugacugugggaugu

SEQ ID NO: 925981 - RNA, 19 nt, Homo sapiens
gaagaaagagagauuuaca

SEQ ID NO: 925982 - RNA, 19 nt, Homo sapiens
caagaagugcagcuuauaa

SEQ ID NO: 925983 - RNA, 19 nt, Homo sapiens
gugaaacguuggacaaaga

SEQ ID NO: 925984 - RNA, 19 nt, Homo sapiens
ggaugaaguucucagugaa

SEQ ID NO: 925985 - RNA, 19 nt, Homo sapiens
caagaaagcauugacaaga

SEQ ID NO: 925986 - RNA, 19 nt, Homo sapiens
ccagauaacuuagcagcuu

SEQ ID NO: 925987 - RNA, 19 nt, Homo sapiens
gaagaagaaagagagauuu

SEQ ID NO: 925988 - RNA, 19 nt, Homo sapiens
gaccucaaguggauuauca

SEQ ID NO: 925989 - RNA, 19 nt, Homo sapiens
agaaagcauugacaagaaa

SEQ ID NO: 925990 - RNA, 19 nt, Homo sapiens
gcagagcuguggaucaaag

SEQ ID NO: 925991 - RNA, 19 nt, Homo sapiens
gauggaugcuggagaagug

SEQ ID NO: 925992 - RNA, 19 nt, Homo sapiens
aagaaagcauugacaagaa

SEQ ID NO: 925993 - RNA, 19 nt, Homo sapiens
uaacugauagugaagauga

SEQ ID NO: 925994 - RNA, 19 nt, Homo sapiens
acucagaggcgacauguua

SEQ ID NO: 925995 - RNA, 19 nt, Homo sapiens
gaaccacaacuccguauuc

SEQ ID NO: 925996 - RNA, 19 nt, Homo sapiens
agagacaguucaagaagaa

SEQ ID NO: 925997 - RNA, 19 nt, Homo sapiens
caagugugcaugcauuuaa

SEQ ID NO: 925998 - RNA, 19 nt, Homo sapiens
gaaagauugcgccagauug

SEQ ID NO: 925999 - RNA, 19 nt, Homo sapiens
gaagagacaguucaagaag

SEQ ID NO: 926000 - RNA, 19 nt, Homo sapiens
gauaauccuuccucagaca

SEQ ID NO: 926001 - RNA, 19 nt, Homo sapiens
ccacaagaagugcagcuua

SEQ ID NO: 926002 - RNA, 19 nt, Homo sapiens
acagacagcugcuacagau

SEQ ID NO: 926003 - RNA, 19 nt, Homo sapiens
cacaagaagugcagcuuau

SEQ ID NO: 926004 - RNA, 19 nt, Homo sapiens
guaaugggaaucaggauga

SEQ ID NO: 926005 - RNA, 19 nt, Homo sapiens
cagauaauccuuccucaga

SEQ ID NO: 926006 - RNA, 19 nt, Homo sapiens
ggaccgaucuuuuacaugu

SEQ ID NO: 926007 - RNA, 19 nt, Homo sapiens
ugaaagacucacuguuuaa

SEQ ID NO: 926008 - RNA, 19 nt, Homo sapiens
gacaaagaaaguagaugua

SEQ ID NO: 926009 - RNA, 19 nt, Homo sapiens
gcaugcauuuaauaccuuu

SEQ ID NO: 926010 - RNA, 19 nt, Homo sapiens
uauuaaaccuguuccaagu

SEQ ID NO: 926011 - RNA, 19 nt, Homo sapiens
gaaacagccgaagucuuua

SEQ ID NO: 926012 - RNA, 19 nt, Homo sapiens
gcagugaaacguuggacaa

SEQ ID NO: 926013 - RNA, 19 nt, Homo sapiens
ccaaacccaccacacauuu

SEQ ID NO: 926014 - RNA, 19 nt, Homo sapiens
cagaagagacaguucaaga

SEQ ID NO: 926015 - RNA, 19 nt, Homo sapiens
aaccaucacugccauguau

SEQ ID NO: 926016 - RNA, 19 nt, Homo sapiens
ugcaauaccuaaagcaaga

SEQ ID NO: 926017 - RNA, 19 nt, Homo sapiens
gaggaaauggagaaagaaa

SEQ ID NO: 926018 - RNA, 19 nt, Homo sapiens
guagauguauuuucuguug

SEQ ID NO: 926019 - RNA, 19 nt, Homo sapiens
aggaugaaguucucaguga

SEQ ID NO: 926020 - RNA, 19 nt, Homo sapiens
cugcaaauaugcugacugu

SEQ ID NO: 926021 - RNA, 19 nt, Homo sapiens
gcaagaaagcauugacaag

SEQ ID NO: 926022 - RNA, 19 nt, Homo sapiens
uacacaaucugaaggauca

SEQ ID NO: 926023 - RNA, 19 nt, Homo sapiens
gcgggaacauucaguacau

SEQ ID NO: 926024 - RNA, 19 nt, Homo sapiens
cuuagcagcuucaaauaca

SEQ ID NO: 926025 - RNA, 19 nt, Homo sapiens
aaagaccucaaguggauua

SEQ ID NO: 926026 - RNA, 19 nt, Homo sapiens
aaugaagccugcagaauac

SEQ ID NO: 926027 - RNA, 19 nt, Homo sapiens
ggagcgaaguaaagagaag

SEQ ID NO: 926028 - RNA, 19 nt, Homo sapiens
gcuguggaucaaagaauua

SEQ ID NO: 926029 - RNA, 19 nt, Homo sapiens
agaaagagagauuuacaga

SEQ ID NO: 926030 - RNA, 19 nt, Homo sapiens
ucaagcucaucuuuacaaa

SEQ ID NO: 926031 - RNA, 19 nt, Homo sapiens
gaaucaggaugaaguucuc

SEQ ID NO: 926032 - RNA, 19 nt, Homo sapiens
ggagcgggaacauucagua

SEQ ID NO: 926033 - RNA, 19 nt, Homo sapiens
aaagauugcgccagauuga

SEQ ID NO: 926034 - RNA, 19 nt, Homo sapiens
uuugaaagacucacuguuu

SEQ ID NO: 926035 - RNA, 19 nt, Homo sapiens
caagcuauuacucagauaa

SEQ ID NO: 926036 - RNA, 19 nt, Homo sapiens
gaaauuacagaggaaaugg

SEQ ID NO: 926037 - RNA, 19 nt, Homo sapiens
uggaaacucuugugcaucu

SEQ ID NO: 926038 - RNA, 19 nt, Homo sapiens
cgaagucuuuaccucgaaa

SEQ ID NO: 926039 - RNA, 19 nt, Homo sapiens
uucaguacaugauucagua

SEQ ID NO: 926040 - RNA, 19 nt, Homo sapiens
aagagacaguucaagaaga

SEQ ID NO: 926041 - RNA, 19 nt, Homo sapiens
ugggugggauaaacaauga

SEQ ID NO: 926042 - RNA, 19 nt, Homo sapiens
ccaagugugcaugcauuua

SEQ ID NO: 926043 - RNA, 19 nt, Homo sapiens
aggcagagcuguggaucaa

SEQ ID NO: 926044 - RNA, 19 nt, Homo sapiens
agaagaagaaagagagauu

SEQ ID NO: 926045 - RNA, 19 nt, Homo sapiens
agaagagacaguucaagaa

SEQ ID NO: 926046 - RNA, 19 nt, Homo sapiens
ccagauuccucagcagaug

SEQ ID NO: 926047 - RNA, 19 nt, Homo sapiens
acgcaaagauauucaaacu

SEQ ID NO: 926048 - RNA, 19 nt, Homo sapiens
caguguauauucccuaucu

SEQ ID NO: 926049 - RNA, 19 nt, Homo sapiens
gaggcgacauguuaguaca

SEQ ID NO: 926050 - RNA, 19 nt, Homo sapiens
ccaagcuauuacucagaua

SEQ ID NO: 926051 - RNA, 19 nt, Homo sapiens
agacagaccaaucaacuuc

SEQ ID NO: 926052 - RNA, 19 nt, Homo sapiens
ugacuuuagugaaccacaa

SEQ ID NO: 926053 - RNA, 19 nt, Homo sapiens
ucaaauacacaaucugaag

SEQ ID NO: 926054 - RNA, 19 nt, Homo sapiens
caccacacauuuuccuuua

SEQ ID NO: 926055 - RNA, 19 nt, Homo sapiens
gccaaacccaccacacauu

SEQ ID NO: 926056 - RNA, 19 nt, Homo sapiens
gaaugagccuccagagaaa

SEQ ID NO: 926057 - RNA, 19 nt, Homo sapiens
ggaauuaaaucgcagaaag

SEQ ID NO: 926058 - RNA, 19 nt, Homo sapiens
ggagcgagaugaagaggaa

SEQ ID NO: 926059 - RNA, 19 nt, Homo sapiens
ggaagacuuuggcuuugaa

SEQ ID NO: 926060 - RNA, 19 nt, Homo sapiens
gaggaagacuuuggcuuug

SEQ ID NO: 926061 - RNA, 19 nt, Homo sapiens
agaaugagccuccagagaa

SEQ ID NO: 926062 - RNA, 19 nt, Homo sapiens
ggaaguggaguuuguguca

SEQ ID NO: 926063 - RNA, 19 nt, Homo sapiens
ugaggaagacuuuggcuuu

SEQ ID NO: 926064 - RNA, 19 nt, Homo sapiens
agauuaagguugaggaaga

SEQ ID NO: 926065 - RNA, 19 nt, Homo sapiens
ccauugugcuggaggauga

SEQ ID NO: 926066 - RNA, 19 nt, Homo sapiens
agacggaaguggaguuugu

SEQ ID NO: 926067 - RNA, 19 nt, Homo sapiens
gagaaugagccuccagaga

SEQ ID NO: 926068 - RNA, 19 nt, Homo sapiens
gaauuaaaucgcagaaagu

SEQ ID NO: 926069 - RNA, 19 nt, Homo sapiens
cggcuuaaccuacugauug

SEQ ID NO: 926070 - RNA, 19 nt, Homo sapiens
ggcuuaaccuacugauuga

SEQ ID NO: 926071 - RNA, 19 nt, Homo sapiens
gcgaacggcuuaaccuacu

SEQ ID NO: 926072 - RNA, 19 nt, Homo sapiens
ucgcggagauggaauugga

SEQ ID NO: 926073 - RNA, 19 nt, Homo sapiens
cagaugaggcccuggauuc

SEQ ID NO: 926074 - RNA, 19 nt, Homo sapiens
ggaauuggagcagagagaa

SEQ ID NO: 926075 - RNA, 19 nt, Homo sapiens
gaacggcuuaaccuacuga

SEQ ID NO: 926076 - RNA, 19 nt, Homo sapiens
gacugacgcaugcccaaua

SEQ ID NO: 926077 - RNA, 19 nt, Homo sapiens
caucaggugcagaggauaa

SEQ ID NO: 926078 - RNA, 19 nt, Homo sapiens
gcagaugaggcccuggauu

SEQ ID NO: 926079 - RNA, 19 nt, Homo sapiens
uaagguugaggaagacuuu

SEQ ID NO: 926080 - RNA, 19 nt, Homo sapiens
ggagacggaaguggaguuu

SEQ ID NO: 926081 - RNA, 19 nt, Homo sapiens
cagcccagccucugacuga

SEQ ID NO: 926082 - RNA, 19 nt, Homo sapiens
gcagauuaagguugaggaa

SEQ ID NO: 926083 - RNA, 19 nt, Homo sapiens
acugacgcaugcccaauaa

SEQ ID NO: 926084 - RNA, 19 nt, Homo sapiens
gccagccaguucaccauug

SEQ ID NO: 926085 - RNA, 19 nt, Homo sapiens
ggaggucgcggagauggaa

SEQ ID NO: 926086 - RNA, 19 nt, Homo sapiens
gauggacgccgagcaggaa

SEQ ID NO: 926087 - RNA, 19 nt, Homo sapiens
ccagccaguucaccauugu

SEQ ID NO: 926088 - RNA, 19 nt, Homo sapiens
aggaagacuuuggcuuuga

SEQ ID NO: 926089 - RNA, 19 nt, Homo sapiens
cggugcagauuaagguuga

SEQ ID NO: 926090 - RNA, 19 nt, Homo sapiens
caggcaaugcggagaauga

SEQ ID NO: 926091 - RNA, 19 nt, Homo sapiens
ugaacgagcggguccugaa

SEQ ID NO: 926092 - RNA, 19 nt, Homo sapiens
gagccugaugggacaagua

SEQ ID NO: 926093 - RNA, 19 nt, Homo sapiens
ggcguugccuccccuauuu

SEQ ID NO: 926094 - RNA, 19 nt, Homo sapiens
uuaaccuacugauugaaga

SEQ ID NO: 926095 - RNA, 19 nt, Homo sapiens
ggacgccgagcaggaaaug

SEQ ID NO: 926096 - RNA, 19 nt, Homo sapiens
ccagagaaagagacacugu

SEQ ID NO: 926097 - RNA, 19 nt, Homo sapiens
gaacgagcggguccugaac

SEQ ID NO: 926098 - RNA, 19 nt, Homo sapiens
ccugaugggacaaguaguu

SEQ ID NO: 926099 - RNA, 19 nt, Homo sapiens
cagaaaguaccaggcacua

SEQ ID NO: 926100 - RNA, 19 nt, Homo sapiens
ccuauuugguggccacauc

SEQ ID NO: 926101 - RNA, 19 nt, Homo sapiens
aaacugaccccacaccaaa

SEQ ID NO: 926102 - RNA, 19 nt, Homo sapiens
gucgagacaagaagaaaga

SEQ ID NO: 926103 - RNA, 19 nt, Homo sapiens
gauuaagguugaggaagac

SEQ ID NO: 926104 - RNA, 19 nt, Homo sapiens
gaauuggagcagagagaag

SEQ ID NO: 926105 - RNA, 19 nt, Homo sapiens
gggcgucgagacaagaaga

SEQ ID NO: 926106 - RNA, 19 nt, Homo sapiens
agacaagaagaaagacguu

SEQ ID NO: 926107 - RNA, 19 nt, Homo sapiens
gggaauuaaaucgcagaaa

SEQ ID NO: 926108 - RNA, 19 nt, Homo sapiens
gguaagccgcgaggaggaa

SEQ ID NO: 926109 - RNA, 19 nt, Homo sapiens
gagaagagcccgcuguaug

SEQ ID NO: 926110 - RNA, 19 nt, Homo sapiens
ccaaugugcugcucaugaa

SEQ ID NO: 926111 - RNA, 19 nt, Homo sapiens
gaagaagcgaggcaaguuu

SEQ ID NO: 926112 - RNA, 19 nt, Homo sapiens
ccacagacccucacccaaa

SEQ ID NO: 926113 - RNA, 19 nt, Homo sapiens
gaaggaggcugagcacaag

SEQ ID NO: 926114 - RNA, 19 nt, Homo sapiens
guacuucgccuuccucuuc

SEQ ID NO: 926115 - RNA, 19 nt, Homo sapiens
ggaacguggucauguacuu

SEQ ID NO: 926116 - RNA, 19 nt, Homo sapiens
gggagcaccuggagagaga

SEQ ID NO: 926117 - RNA, 19 nt, Homo sapiens
agagugagaucuucaaugg

SEQ ID NO: 926118 - RNA, 19 nt, Homo sapiens
ggccaccucucuucaguug

SEQ ID NO: 926119 - RNA, 19 nt, Homo sapiens
ggaagaagcgaggcaaguu

SEQ ID NO: 926120 - RNA, 19 nt, Homo sapiens
ucaagugucuggagucaca

SEQ ID NO: 926121 - RNA, 19 nt, Homo sapiens
gaagaaguucacacuguau

SEQ ID NO: 926122 - RNA, 19 nt, Homo sapiens
agaagcaguuuaaggagaa

SEQ ID NO: 926123 - RNA, 19 nt, Homo sapiens
gccaggagccucaggacua

SEQ ID NO: 926124 - RNA, 19 nt, Homo sapiens
gggagacaguccagaagga

SEQ ID NO: 926125 - RNA, 19 nt, Homo sapiens
gagcagccuuucgccauga

SEQ ID NO: 926126 - RNA, 19 nt, Homo sapiens
gggcaacgcagacauguuc

SEQ ID NO: 926127 - RNA, 19 nt, Homo sapiens
gaagcgaggcaaguuugua

SEQ ID NO: 926128 - RNA, 19 nt, Homo sapiens
ugaaggcgcuggugaaagc

SEQ ID NO: 926129 - RNA, 19 nt, Homo sapiens
gcaaaauccucaaagagau

SEQ ID NO: 926130 - RNA, 19 nt, Homo sapiens
gcagaaccgccacgagaug

SEQ ID NO: 926131 - RNA, 19 nt, Homo sapiens
ccgcaucccuaccuggaaa

SEQ ID NO: 926132 - RNA, 19 nt, Homo sapiens
ccaggagccucaggacuau

SEQ ID NO: 926133 - RNA, 19 nt, Homo sapiens
ugacuuguguugccugaca

SEQ ID NO: 926134 - RNA, 19 nt, Homo sapiens
cgagauggccaccuacuuc

SEQ ID NO: 926135 - RNA, 19 nt, Homo sapiens
ccgagaagcaguuuaagga

SEQ ID NO: 926136 - RNA, 19 nt, Homo sapiens
gagaacuuccugagcaaga

SEQ ID NO: 926137 - RNA, 19 nt, Homo sapiens
ggcccuaccugcagaucuu

SEQ ID NO: 926138 - RNA, 19 nt, Homo sapiens
caucaagugucuggaguca

SEQ ID NO: 926139 - RNA, 19 nt, Homo sapiens
gggcugagagagcaagaaa

SEQ ID NO: 926140 - RNA, 19 nt, Homo sapiens
ggacaacuggaacaagugu

SEQ ID NO: 926141 - RNA, 19 nt, Homo sapiens
auaccaaccucaucaccuu

SEQ ID NO: 926142 - RNA, 19 nt, Homo sapiens
agucacagaucaacuacug

SEQ ID NO: 926143 - RNA, 19 nt, Homo sapiens
gcuggucaccuuccuguug

SEQ ID NO: 926144 - RNA, 19 nt, Homo sapiens
ccaagaucaucgugguaga

SEQ ID NO: 926145 - RNA, 19 nt, Homo sapiens
cagcaacaagcccgaguuu

SEQ ID NO: 926146 - RNA, 19 nt, Homo sapiens
gaacguggucauguacuuc

SEQ ID NO: 926147 - RNA, 19 nt, Homo sapiens
caaccucucccacuucauc

SEQ ID NO: 926148 - RNA, 19 nt, Homo sapiens
acagcaaccucucccacuu

SEQ ID NO: 926149 - RNA, 19 nt, Homo sapiens
uguguugccugacaagaga

SEQ ID NO: 926150 - RNA, 19 nt, Homo sapiens
gcagggcaacgcagacaug

SEQ ID NO: 926151 - RNA, 19 nt, Homo sapiens
ggagaagagcccgcuguau

SEQ ID NO: 926152 - RNA, 19 nt, Homo sapiens
agaaggaggcugagcacaa

SEQ ID NO: 926153 - RNA, 19 nt, Homo sapiens
gaacuuccugagcaagaug

SEQ ID NO: 926154 - RNA, 19 nt, Homo sapiens
ccacgcgcgaggcgaaaua

SEQ ID NO: 926155 - RNA, 19 nt, Homo sapiens
cacagacccucacccaaag

SEQ ID NO: 926156 - RNA, 19 nt, Homo sapiens
uagagcgcaugaugaagga

SEQ ID NO: 926157 - RNA, 19 nt, Homo sapiens
cggcugauccauaucuuug

SEQ ID NO: 926158 - RNA, 19 nt, Homo sapiens
ggcagggcuucuucacaga

SEQ ID NO: 926159 - RNA, 19 nt, Homo sapiens
gauccauaucuuugccaua

SEQ ID NO: 926160 - RNA, 19 nt, Homo sapiens
ucacagacgaggacacaca

SEQ ID NO: 926161 - RNA, 19 nt, Homo sapiens
gcacuggcagcaucgagau

SEQ ID NO: 926162 - RNA, 19 nt, Homo sapiens
ggcugaggcuggagaagca

SEQ ID NO: 926163 - RNA, 19 nt, Homo sapiens
uuagauggcugggaacaac

SEQ ID NO: 926164 - RNA, 19 nt, Homo sapiens
uggagucacagaucaacua

SEQ ID NO: 926165 - RNA, 19 nt, Homo sapiens
ccaacuggcuggucauccu

SEQ ID NO: 926166 - RNA, 19 nt, Homo sapiens
ccacuggacgagauugaug

SEQ ID NO: 926167 - RNA, 19 nt, Homo sapiens
ggaacaagugugacauggu

SEQ ID NO: 926168 - RNA, 19 nt, Homo sapiens
gcgcucccgugacuguguu

SEQ ID NO: 926169 - RNA, 19 nt, Homo sapiens
uggccgacuuccugacgua

SEQ ID NO: 926170 - RNA, 19 nt, Homo sapiens
agaagagcccgcuguaugg

SEQ ID NO: 926171 - RNA, 19 nt, Homo sapiens
gcguggacaucgccaagag

SEQ ID NO: 926172 - RNA, 19 nt, Homo sapiens
guugugcacugaccuuugc

SEQ ID NO: 926173 - RNA, 19 nt, Homo sapiens
ucaucgccauguucagcua

SEQ ID NO: 926174 - RNA, 19 nt, Homo sapiens
ucaccaaugugcugcucau

SEQ ID NO: 926175 - RNA, 19 nt, Homo sapiens
acaacuggaacaaguguga

SEQ ID NO: 926176 - RNA, 19 nt, Homo sapiens
cggagaagagcccgcugua

SEQ ID NO: 926177 - RNA, 19 nt, Homo sapiens
uggccgagaagcaguuuaa

SEQ ID NO: 926178 - RNA, 19 nt, Homo sapiens
gaaguuccagcgcuacaac

SEQ ID NO: 926179 - RNA, 19 nt, Homo sapiens
ugguagagcgcaugaugaa

SEQ ID NO: 926180 - RNA, 19 nt, Homo sapiens
guggccaucuuccuguuca

SEQ ID NO: 926181 - RNA, 19 nt, Homo sapiens
gcucuaccgcuccguguca

SEQ ID NO: 926182 - RNA, 19 nt, Homo sapiens
ggacacggucauccugaag

SEQ ID NO: 926183 - RNA, 19 nt, Homo sapiens
aucccuaccuggaaacuga

SEQ ID NO: 926184 - RNA, 19 nt, Homo sapiens
ccggagcucucagcacugu

SEQ ID NO: 926185 - RNA, 19 nt, Homo sapiens
agacaguccagaaggagaa

SEQ ID NO: 926186 - RNA, 19 nt, Homo sapiens
aagaagcgaggcaaguuug

SEQ ID NO: 926187 - RNA, 19 nt, Homo sapiens
ccacuacccugaggaugac

SEQ ID NO: 926188 - RNA, 19 nt, Homo sapiens
ugcagaacaucaccucaca

SEQ ID NO: 926189 - RNA, 19 nt, Homo sapiens
ugaugaagcccgugugaac

SEQ ID NO: 926190 - RNA, 19 nt, Homo sapiens
gggaagaagcgaggcaagu

SEQ ID NO: 926191 - RNA, 19 nt, Homo sapiens
ugcccaagguggccgagaa

SEQ ID NO: 926192 - RNA, 19 nt, Homo sapiens
ugacgccaaggccuucuuu

SEQ ID NO: 926193 - RNA, 19 nt, Homo sapiens
gagauggccaccuacuucu

SEQ ID NO: 926194 - RNA, 19 nt, Homo sapiens
caaccugauuguggaguac

SEQ ID NO: 926195 - RNA, 19 nt, Homo sapiens
ggggacaacuggaacaagu

SEQ ID NO: 926196 - RNA, 19 nt, Homo sapiens
gaguuugugcgccucuuug

SEQ ID NO: 926197 - RNA, 19 nt, Homo sapiens
uggacacggucauccugaa

SEQ ID NO: 926198 - RNA, 19 nt, Homo sapiens
gcucaccguguaugacuuc

SEQ ID NO: 926199 - RNA, 19 nt, Homo sapiens
gaagcaguuuaaggagaag

SEQ ID NO: 926200 - RNA, 19 nt, Homo sapiens
gugguagagcgcaugauga

SEQ ID NO: 926201 - RNA, 19 nt, Homo sapiens
cagcaaccucucccacuuc

SEQ ID NO: 926202 - RNA, 19 nt, Homo sapiens
gcggcugauccauaucuuu

SEQ ID NO: 926203 - RNA, 19 nt, Homo sapiens
acgcugcggcugauccaua

SEQ ID NO: 926204 - RNA, 19 nt, Homo sapiens
gaggaggcccaggaggauu

SEQ ID NO: 926205 - RNA, 19 nt, Homo sapiens
gcucacacgcuggcggaaa

SEQ ID NO: 926206 - RNA, 19 nt, Homo sapiens
gcaccugcucaccguguau

SEQ ID NO: 926207 - RNA, 19 nt, Homo sapiens
caacggagguguacaaauu

SEQ ID NO: 926208 - RNA, 19 nt, Homo sapiens
gggauuauguuguaguuua

SEQ ID NO: 926209 - RNA, 19 nt, Homo sapiens
gcaaauauccugacauugu

SEQ ID NO: 926210 - RNA, 19 nt, Homo sapiens
guaagaaggcaaagaauaa

SEQ ID NO: 926211 - RNA, 19 nt, Homo sapiens
aaacugggauuauguugua

SEQ ID NO: 926212 - RNA, 19 nt, Homo sapiens
gcacaauucccucucauaa

SEQ ID NO: 926213 - RNA, 19 nt, Homo sapiens
gcaaccagcuuuggagaaa

SEQ ID NO: 926214 - RNA, 19 nt, Homo sapiens
gcauuucacuaucauacua

SEQ ID NO: 926215 - RNA, 19 nt, Homo sapiens
gaagcacguuggccaguuu

SEQ ID NO: 926216 - RNA, 19 nt, Homo sapiens
gcuuauaguuuacaaguga

SEQ ID NO: 926217 - RNA, 19 nt, Homo sapiens
gaaagcugcaguuacuaua

SEQ ID NO: 926218 - RNA, 19 nt, Homo sapiens
gacuuuagaugcuuucuug

SEQ ID NO: 926219 - RNA, 19 nt, Homo sapiens
caagggagaugcuucaaag

SEQ ID NO: 926220 - RNA, 19 nt, Homo sapiens
ucaguacucuccuucaauu

SEQ ID NO: 926221 - RNA, 19 nt, Homo sapiens
gaugagaauuccucuuuua

SEQ ID NO: 926222 - RNA, 19 nt, Homo sapiens
cauaggaugugcagccuuu

SEQ ID NO: 926223 - RNA, 19 nt, Homo sapiens
caaauacucugcgaucuca

SEQ ID NO: 926224 - RNA, 19 nt, Homo sapiens
ggacaccucaagaugaaua

SEQ ID NO: 926225 - RNA, 19 nt, Homo sapiens
gaauaugauuuggcuagaa

SEQ ID NO: 926226 - RNA, 19 nt, Homo sapiens
ugacuuaacuacauacauc

SEQ ID NO: 926227 - RNA, 19 nt, Homo sapiens
ccacacagccuggaaauug

SEQ ID NO: 926228 - RNA, 19 nt, Homo sapiens
gggaugagaauuccucuuu

SEQ ID NO: 926229 - RNA, 19 nt, Homo sapiens
gaugugacccuauaauaug

SEQ ID NO: 926230 - RNA, 19 nt, Homo sapiens
gcacgacccuaacggugaa

SEQ ID NO: 926231 - RNA, 19 nt, Homo sapiens
gaugcauacuuauuuguug

SEQ ID NO: 926232 - RNA, 19 nt, Homo sapiens
gaaguucugguuacccaua

SEQ ID NO: 926233 - RNA, 19 nt, Homo sapiens
ucaaugguucugccaauua

SEQ ID NO: 926234 - RNA, 19 nt, Homo sapiens
guaguaagaaggcaaagaa

SEQ ID NO: 926235 - RNA, 19 nt, Homo sapiens
ugauuuggcuagaaagauu

SEQ ID NO: 926236 - RNA, 19 nt, Homo sapiens
caacagccacucucaauag

SEQ ID NO: 926237 - RNA, 19 nt, Homo sapiens
gguguucccugaguuguuu

SEQ ID NO: 926238 - RNA, 19 nt, Homo sapiens
gaagucaggccucugguau

SEQ ID NO: 926239 - RNA, 19 nt, Homo sapiens
caacaacagugucucuuuu

SEQ ID NO: 926240 - RNA, 19 nt, Homo sapiens
cuaguaugguguucuguuu

SEQ ID NO: 926241 - RNA, 19 nt, Homo sapiens
gacccgauaugucauuaug

SEQ ID NO: 926242 - RNA, 19 nt, Homo sapiens
gagacccgauaugucauua

SEQ ID NO: 926243 - RNA, 19 nt, Homo sapiens
uuaacagacugccuuggua

SEQ ID NO: 926244 - RNA, 19 nt, Homo sapiens
cagaugugacccuauaaua

SEQ ID NO: 926245 - RNA, 19 nt, Homo sapiens
caaugguucugccaauuau

SEQ ID NO: 926246 - RNA, 19 nt, Homo sapiens
gcauacauauauacacaca

SEQ ID NO: 926247 - RNA, 19 nt, Homo sapiens
acugugugcuuauaguuua

SEQ ID NO: 926248 - RNA, 19 nt, Homo sapiens
gaagucacccugggaauca

SEQ ID NO: 926249 - RNA, 19 nt, Homo sapiens
acaggaggauauuugcaua

SEQ ID NO: 926250 - RNA, 19 nt, Homo sapiens
ccauuaagagucugaaauu

SEQ ID NO: 926251 - RNA, 19 nt, Homo sapiens
caaugucgaugcaacaaca

SEQ ID NO: 926252 - RNA, 19 nt, Homo sapiens
ccaagacuuuagaugcuuu

SEQ ID NO: 926253 - RNA, 19 nt, Homo sapiens
cauacuaccucuucuuucu

SEQ ID NO: 926254 - RNA, 19 nt, Homo sapiens
ggaaacauugcccggaauu

SEQ ID NO: 926255 - RNA, 19 nt, Homo sapiens
agucaggccucugguauuu

SEQ ID NO: 926256 - RNA, 19 nt, Homo sapiens
ccugaaagcugcaguuacu

SEQ ID NO: 926257 - RNA, 19 nt, Homo sapiens
gcaaaugagcagccaagga

SEQ ID NO: 926258 - RNA, 19 nt, Homo sapiens
ccacuuaucaaagagauuu

SEQ ID NO: 926259 - RNA, 19 nt, Homo sapiens
caaccugacuggcuuugca

SEQ ID NO: 926260 - RNA, 19 nt, Homo sapiens
guguaaugcuggaugugua

SEQ ID NO: 926261 - RNA, 19 nt, Homo sapiens
cuaccugcauucauaauuc

SEQ ID NO: 926262 - RNA, 19 nt, Homo sapiens
gagcagaauauucauuuag

SEQ ID NO: 926263 - RNA, 19 nt, Homo sapiens
ugugaacuguacauuagua

SEQ ID NO: 926264 - RNA, 19 nt, Homo sapiens
augcaaauauccugacauu

SEQ ID NO: 926265 - RNA, 19 nt, Homo sapiens
gcccuggcccuucaagaua

SEQ ID NO: 926266 - RNA, 19 nt, Homo sapiens
acaauucccucucauaaaa

SEQ ID NO: 926267 - RNA, 19 nt, Homo sapiens
ggguagagcagaauauuca

SEQ ID NO: 926268 - RNA, 19 nt, Homo sapiens
ccaacagccacucucaaua

SEQ ID NO: 926269 - RNA, 19 nt, Homo sapiens
gagaauuccucuuuuaauc

SEQ ID NO: 926270 - RNA, 19 nt, Homo sapiens
caagugagacccgauaugu

SEQ ID NO: 926271 - RNA, 19 nt, Homo sapiens
guaacugugugcuuauagu

SEQ ID NO: 926272 - RNA, 19 nt, Homo sapiens
gcccggaauugaaagcaaa

SEQ ID NO: 926273 - RNA, 19 nt, Homo sapiens
ccaacaacagugucucuuu

SEQ ID NO: 926274 - RNA, 19 nt, Homo sapiens
uggucuaccugcauucaua

SEQ ID NO: 926275 - RNA, 19 nt, Homo sapiens
aaacauugcccggaauuga

SEQ ID NO: 926276 - RNA, 19 nt, Homo sapiens
ucaaguuagugguaggaaa

SEQ ID NO: 926277 - RNA, 19 nt, Homo sapiens
auucugccauucucaguua

SEQ ID NO: 926278 - RNA, 19 nt, Homo sapiens
uuaagagucugaaauucug

SEQ ID NO: 926279 - RNA, 19 nt, Homo sapiens
uagguaaacugggauuaug

SEQ ID NO: 926280 - RNA, 19 nt, Homo sapiens
aguaagaaggcaaagaaua

SEQ ID NO: 926281 - RNA, 19 nt, Homo sapiens
ugggacaccucaagaugaa

SEQ ID NO: 926282 - RNA, 19 nt, Homo sapiens
caacauuuguaacuuuagg

SEQ ID NO: 926283 - RNA, 19 nt, Homo sapiens
gaaccccaguugaccauuu

SEQ ID NO: 926284 - RNA, 19 nt, Homo sapiens
ggaugcauacuuauuuguu

SEQ ID NO: 926285 - RNA, 19 nt, Homo sapiens
ucugagauguugaugugaa

SEQ ID NO: 926286 - RNA, 19 nt, Homo sapiens
ggagcuauuuuauuucuga

SEQ ID NO: 926287 - RNA, 19 nt, Homo sapiens
agucugaaauucugccauu

SEQ ID NO: 926288 - RNA, 19 nt, Homo sapiens
caccucaagaugaauaaua

SEQ ID NO: 926289 - RNA, 19 nt, Homo sapiens
gcaaauacucugcgaucuc

SEQ ID NO: 926290 - RNA, 19 nt, Homo sapiens
gguaaacugggauuauguu

SEQ ID NO: 926291 - RNA, 19 nt, Homo sapiens
auagguugcugucagacua

SEQ ID NO: 926292 - RNA, 19 nt, Homo sapiens
cagcugaaguucugguuac

SEQ ID NO: 926293 - RNA, 19 nt, Homo sapiens
ucacaacggagguguacaa

SEQ ID NO: 926294 - RNA, 19 nt, Homo sapiens
uuucugagauguugaugug

SEQ ID NO: 926295 - RNA, 19 nt, Homo sapiens
aaacaaacacccucuugca

SEQ ID NO: 926296 - RNA, 19 nt, Homo sapiens
cuauacaacuuggaccauu

SEQ ID NO: 926297 - RNA, 19 nt, Homo sapiens
ggacaaccugacuggcuuu

SEQ ID NO: 926298 - RNA, 19 nt, Homo sapiens
ugaaagcugcaguuacuau

SEQ ID NO: 926299 - RNA, 19 nt, Homo sapiens
guagagcagaauauucauu

SEQ ID NO: 926300 - RNA, 19 nt, Homo sapiens
gaaacauugcccggaauug

SEQ ID NO: 926301 - RNA, 19 nt, Homo sapiens
guacugaaucugcaaagca

SEQ ID NO: 926302 - RNA, 19 nt, Homo sapiens
cauuaagagucugaaauuc

SEQ ID NO: 926303 - RNA, 19 nt, Homo sapiens
aggagccacuuaucaaaga

SEQ ID NO: 926304 - RNA, 19 nt, Homo sapiens
cacaauucccucucauaaa

SEQ ID NO: 926305 - RNA, 19 nt, Homo sapiens
acaguggucuaccugcauu

SEQ ID NO: 926306 - RNA, 19 nt, Homo sapiens
gacauguucuuuucucaaa

SEQ ID NO: 926307 - RNA, 19 nt, Homo sapiens
ggaauuggcugcauugaau

SEQ ID NO: 926308 - RNA, 19 nt, Homo sapiens
gcacuugccugucuuguga

SEQ ID NO: 926309 - RNA, 19 nt, Homo sapiens
caaauuccaugucccuuua

SEQ ID NO: 926310 - RNA, 19 nt, Homo sapiens
gaaggaagguggugagaag

SEQ ID NO: 926311 - RNA, 19 nt, Homo sapiens
guacaucaguccaaagcua

SEQ ID NO: 926312 - RNA, 19 nt, Homo sapiens
cuaaagcccucugcaguua

SEQ ID NO: 926313 - RNA, 19 nt, Homo sapiens
gcacugucccugcgaaaua

SEQ ID NO: 926314 - RNA, 19 nt, Homo sapiens
ggaagguggugagaagaua

SEQ ID NO: 926315 - RNA, 19 nt, Homo sapiens
caaagaagcggaaguugaa

SEQ ID NO: 926316 - RNA, 19 nt, Homo sapiens
gaaagggccugcuguacca

SEQ ID NO: 926317 - RNA, 19 nt, Homo sapiens
cagagcagauggccaagua

SEQ ID NO: 926318 - RNA, 19 nt, Homo sapiens
auacaggacuugaucgaua

SEQ ID NO: 926319 - RNA, 19 nt, Homo sapiens
gugagaagauaaagaagaa

SEQ ID NO: 926320 - RNA, 19 nt, Homo sapiens
gaaauacuaagaacaccua

SEQ ID NO: 926321 - RNA, 19 nt, Homo sapiens
guaaggagaagaagaagaa

SEQ ID NO: 926322 - RNA, 19 nt, Homo sapiens
ggacuguucuucacacauc

SEQ ID NO: 926323 - RNA, 19 nt, Homo sapiens
ggaaaggcauaaaguagag

SEQ ID NO: 926324 - RNA, 19 nt, Homo sapiens
ugaaagagcgaaugacuga

SEQ ID NO: 926325 - RNA, 19 nt, Homo sapiens
cugcagagcuccuaaguca

SEQ ID NO: 926326 - RNA, 19 nt, Homo sapiens
caaagaagccaugcaguga

SEQ ID NO: 926327 - RNA, 19 nt, Homo sapiens
gagcagaauacccucauuu

SEQ ID NO: 926328 - RNA, 19 nt, Homo sapiens
gaaagccaguuuugaguuu

SEQ ID NO: 926329 - RNA, 19 nt, Homo sapiens
gagcagagggaccggauuu

SEQ ID NO: 926330 - RNA, 19 nt, Homo sapiens
ggaaacuucaccucuauga

SEQ ID NO: 926331 - RNA, 19 nt, Homo sapiens
gaaauauucuggggcuuua

SEQ ID NO: 926332 - RNA, 19 nt, Homo sapiens
gcucaagcgugcucggaaa

SEQ ID NO: 926333 - RNA, 19 nt, Homo sapiens
ccaaagaagcggaaguuga

SEQ ID NO: 926334 - RNA, 19 nt, Homo sapiens
agaguagucuuagguagua

SEQ ID NO: 926335 - RNA, 19 nt, Homo sapiens
gaacuccuugggaauuaua

SEQ ID NO: 926336 - RNA, 19 nt, Homo sapiens
gaacugacugcuccagcua

SEQ ID NO: 926337 - RNA, 19 nt, Homo sapiens
gauagacauuccaguuugu

SEQ ID NO: 926338 - RNA, 19 nt, Homo sapiens
gaucugagacgaagaccuu

SEQ ID NO: 926339 - RNA, 19 nt, Homo sapiens
guaaugaaagagcgaauga

SEQ ID NO: 926340 - RNA, 19 nt, Homo sapiens
ccaguuuguuuacagagua

SEQ ID NO: 926341 - RNA, 19 nt, Homo sapiens
caucuccauuugccaauaa

SEQ ID NO: 926342 - RNA, 19 nt, Homo sapiens
agagaguucuggcuacaaa

SEQ ID NO: 926343 - RNA, 19 nt, Homo sapiens
ccaauggaaugaugagauc

SEQ ID NO: 926344 - RNA, 19 nt, Homo sapiens
aaaggaaaggcauaaagua

SEQ ID NO: 926345 - RNA, 19 nt, Homo sapiens
uggacucgcugacggauuu

SEQ ID NO: 926346 - RNA, 19 nt, Homo sapiens
gagaagauaaagaagaaga

SEQ ID NO: 926347 - RNA, 19 nt, Homo sapiens
gaagguggugagaagauaa

SEQ ID NO: 926348 - RNA, 19 nt, Homo sapiens
caaggugagucugaacuga

SEQ ID NO: 926349 - RNA, 19 nt, Homo sapiens
ggauuacacucacccucuu

SEQ ID NO: 926350 - RNA, 19 nt, Homo sapiens
gcugggaacucugaauuca

SEQ ID NO: 926351 - RNA, 19 nt, Homo sapiens
ggagcagaauacccucauu

SEQ ID NO: 926352 - RNA, 19 nt, Homo sapiens
gcuccuaagucaccacuca

SEQ ID NO: 926353 - RNA, 19 nt, Homo sapiens
agauagacauuccaguuug

SEQ ID NO: 926354 - RNA, 19 nt, Homo sapiens
gcaaagccacauucaguca

SEQ ID NO: 926355 - RNA, 19 nt, Homo sapiens
ccaguaaggagaagaagaa

SEQ ID NO: 926356 - RNA, 19 nt, Homo sapiens
cagauagacauuccaguuu

SEQ ID NO: 926357 - RNA, 19 nt, Homo sapiens
cacaaacgcugcccagagu

SEQ ID NO: 926358 - RNA, 19 nt, Homo sapiens
gaauuggcugcauugaaua

SEQ ID NO: 926359 - RNA, 19 nt, Homo sapiens
aaagggaggaggagcauaa

SEQ ID NO: 926360 - RNA, 19 nt, Homo sapiens
uacgaaguauggaggauuu

SEQ ID NO: 926361 - RNA, 19 nt, Homo sapiens
gcgugcagcuggagcagaa

SEQ ID NO: 926362 - RNA, 19 nt, Homo sapiens
agaaauaggccuugaaguc

SEQ ID NO: 926363 - RNA, 19 nt, Homo sapiens
ucgaacuccuugggaauua

SEQ ID NO: 926364 - RNA, 19 nt, Homo sapiens
gcucugcaggcucaucuua

SEQ ID NO: 926365 - RNA, 19 nt, Homo sapiens
gcccucagaucaccaaaca

SEQ ID NO: 926366 - RNA, 19 nt, Homo sapiens
gagcagaauucgacaacac

SEQ ID NO: 926367 - RNA, 19 nt, Homo sapiens
agaaguacaucaguccaaa

SEQ ID NO: 926368 - RNA, 19 nt, Homo sapiens
ccaaguaccaggacgaaug

SEQ ID NO: 926369 - RNA, 19 nt, Homo sapiens
gagaagaagaagaagaaau

SEQ ID NO: 926370 - RNA, 19 nt, Homo sapiens
aaaauacgguggaaagaaa

SEQ ID NO: 926371 - RNA, 19 nt, Homo sapiens
ccaaauuccaugucccuuu

SEQ ID NO: 926372 - RNA, 19 nt, Homo sapiens
ccucggaacaugacaauga

SEQ ID NO: 926373 - RNA, 19 nt, Homo sapiens
gcaggucucccaggaugua

SEQ ID NO: 926374 - RNA, 19 nt, Homo sapiens
cagcaaagccacauucagu

SEQ ID NO: 926375 - RNA, 19 nt, Homo sapiens
cagagcuggugaagaauau

SEQ ID NO: 926376 - RNA, 19 nt, Homo sapiens
ugaggaagaagaugaagaa

SEQ ID NO: 926377 - RNA, 19 nt, Homo sapiens
agagaaagaggcucagaaa

SEQ ID NO: 926378 - RNA, 19 nt, Homo sapiens
gaaagaaacguagaaaaga

SEQ ID NO: 926379 - RNA, 19 nt, Homo sapiens
uagaggcccuugcccgaaa

SEQ ID NO: 926380 - RNA, 19 nt, Homo sapiens
gaccguuucuuagguguga

SEQ ID NO: 926381 - RNA, 19 nt, Homo sapiens
ucaggcacguugagaguau

SEQ ID NO: 926382 - RNA, 19 nt, Homo sapiens
caaaagcaccugcagaaaa

SEQ ID NO: 926383 - RNA, 19 nt, Homo sapiens
gagcagcugggaacucuga

SEQ ID NO: 926384 - RNA, 19 nt, Homo sapiens
aaagguuucugucccauca

SEQ ID NO: 926385 - RNA, 19 nt, Homo sapiens
ugacggauuuggacuugga

SEQ ID NO: 926386 - RNA, 19 nt, Homo sapiens
ccuuaucccuuuguuauau

SEQ ID NO: 926387 - RNA, 19 nt, Homo sapiens
agagagacuaggacaguua

SEQ ID NO: 926388 - RNA, 19 nt, Homo sapiens
agauaugucuguauugaag

SEQ ID NO: 926389 - RNA, 19 nt, Homo sapiens
gcaaggaugcccugcucaa

SEQ ID NO: 926390 - RNA, 19 nt, Homo sapiens
aggcuucucugcccauaaa

SEQ ID NO: 926391 - RNA, 19 nt, Homo sapiens
ggagauaagaagaaagauc

SEQ ID NO: 926392 - RNA, 19 nt, Homo sapiens
ggugggaggcacaguguuu

SEQ ID NO: 926393 - RNA, 19 nt, Homo sapiens
gcugacggauuuggacuug

SEQ ID NO: 926394 - RNA, 19 nt, Homo sapiens
ggugagaagauaaagaaga

SEQ ID NO: 926395 - RNA, 19 nt, Homo sapiens
ggaaagaaacguagaaaag

SEQ ID NO: 926396 - RNA, 19 nt, Homo sapiens
cccaguaacucauccuuca

SEQ ID NO: 926397 - RNA, 19 nt, Homo sapiens
gaagggugaugugcagaag

SEQ ID NO: 926398 - RNA, 19 nt, Homo sapiens
gaagagaaagccaguuuug

SEQ ID NO: 926399 - RNA, 19 nt, Homo sapiens
cuucaauccuggccaagaa

SEQ ID NO: 926400 - RNA, 19 nt, Homo sapiens
acaaggagaagaaaucgaa

SEQ ID NO: 926401 - RNA, 19 nt, Homo sapiens
gcagugacacccgcuaaga

SEQ ID NO: 926402 - RNA, 19 nt, Homo sapiens
caaccuggaggacucauug

SEQ ID NO: 926403 - RNA, 19 nt, Homo sapiens
cgauaacucugaggcguau

SEQ ID NO: 926404 - RNA, 19 nt, Homo sapiens
gaauacaggacuugaucga

SEQ ID NO: 926405 - RNA, 19 nt, Homo sapiens
cagcgacuauguugguguu

SEQ ID NO: 926406 - RNA, 19 nt, Homo sapiens
gaagaaaaggaaaggcaua

SEQ ID NO: 926407 - RNA, 19 nt, Homo sapiens
guacauagcacaguucuuu

SEQ ID NO: 926408 - RNA, 19 nt, Homo sapiens
ccacaaaguuuccagaugu

SEQ ID NO: 926409 - RNA, 19 nt, Homo sapiens
guaaagaucagaccucaaa

SEQ ID NO: 926410 - RNA, 19 nt, Homo sapiens
ggacucaccuaccaaacaa

SEQ ID NO: 926411 - RNA, 19 nt, Homo sapiens
ucaaauggcuauagcaugu

SEQ ID NO: 926412 - RNA, 19 nt, Homo sapiens
gcacaguucuuuaaaauuc

SEQ ID NO: 926413 - RNA, 19 nt, Homo sapiens
ugacaaaguacgugugaua

SEQ ID NO: 926414 - RNA, 19 nt, Homo sapiens
caaacaacuuucugucguu

SEQ ID NO: 926415 - RNA, 19 nt, Homo sapiens
acaaauggguaaagaccua

SEQ ID NO: 926416 - RNA, 19 nt, Homo sapiens
ugauaacccuggugaagaa

SEQ ID NO: 926417 - RNA, 19 nt, Homo sapiens
ggcauuugauguagaacua

SEQ ID NO: 926418 - RNA, 19 nt, Homo sapiens
gagauccugcguucacuua

SEQ ID NO: 926419 - RNA, 19 nt, Homo sapiens
gaaauauggaagugacaaa

SEQ ID NO: 926420 - RNA, 19 nt, Homo sapiens
caacuggacagaaauugaa

SEQ ID NO: 926421 - RNA, 19 nt, Homo sapiens
auauggaagugacaaagua

SEQ ID NO: 926422 - RNA, 19 nt, Homo sapiens
gauccugcguucacuuaug

SEQ ID NO: 926423 - RNA, 19 nt, Homo sapiens
gaacgaugggcauuugaug

SEQ ID NO: 926424 - RNA, 19 nt, Homo sapiens
guacucuucucauguaugg

SEQ ID NO: 926425 - RNA, 19 nt, Homo sapiens
uuccagauguugagaaauu

SEQ ID NO: 926426 - RNA, 19 nt, Homo sapiens
gaugauggcaguaaagauc

SEQ ID NO: 926427 - RNA, 19 nt, Homo sapiens
gccaaaggccagaaagaaa

SEQ ID NO: 926428 - RNA, 19 nt, Homo sapiens
ugauggagccacaaaguuu

SEQ ID NO: 926429 - RNA, 19 nt, Homo sapiens
gaaacuuuacccagcauau

SEQ ID NO: 926430 - RNA, 19 nt, Homo sapiens
gacaaaguacgugugauaa

SEQ ID NO: 926431 - RNA, 19 nt, Homo sapiens
gaagugauaguaguugaug

SEQ ID NO: 926432 - RNA, 19 nt, Homo sapiens
uauacgacuucgauauuug

SEQ ID NO: 926433 - RNA, 19 nt, Homo sapiens
caguguggguucaaauuau

SEQ ID NO: 926434 - RNA, 19 nt, Homo sapiens
gcgauuagaauggguauau

SEQ ID NO: 926435 - RNA, 19 nt, Homo sapiens
gaagagacagaaacgagau

SEQ ID NO: 926436 - RNA, 19 nt, Homo sapiens
gacaugaagaagagaaauu

SEQ ID NO: 926437 - RNA, 19 nt, Homo sapiens
guugaacgaugggcauuug

SEQ ID NO: 926438 - RNA, 19 nt, Homo sapiens
gaaaaggggcuaaaugauc

SEQ ID NO: 926439 - RNA, 19 nt, Homo sapiens
gaauggcuccgcuucuguu

SEQ ID NO: 926440 - RNA, 19 nt, Homo sapiens
gccacaaaguuuccagaug

SEQ ID NO: 926441 - RNA, 19 nt, Homo sapiens
caauugcucagcguucuua

SEQ ID NO: 926442 - RNA, 19 nt, Homo sapiens
gaugggcauuugauguaga

SEQ ID NO: 926443 - RNA, 19 nt, Homo sapiens
acaguguggguucaaauua

SEQ ID NO: 926444 - RNA, 19 nt, Homo sapiens
caaaguuuccagauguuga

SEQ ID NO: 926445 - RNA, 19 nt, Homo sapiens
ucaccuaccaaacaacuuu

SEQ ID NO: 926446 - RNA, 19 nt, Homo sapiens
cuacagccuuggccuaauc

SEQ ID NO: 926447 - RNA, 19 nt, Homo sapiens
cacaaaguuuccagauguu

SEQ ID NO: 926448 - RNA, 19 nt, Homo sapiens
gagcaaacucggaaaauga

SEQ ID NO: 926449 - RNA, 19 nt, Homo sapiens
acauagcacaguucuuuaa

SEQ ID NO: 926450 - RNA, 19 nt, Homo sapiens
cgauuagaauggguauauu

SEQ ID NO: 926451 - RNA, 19 nt, Homo sapiens
uccguacucuucucaugua

SEQ ID NO: 926452 - RNA, 19 nt, Homo sapiens
caaaguacgugugauaacc

SEQ ID NO: 926453 - RNA, 19 nt, Homo sapiens
gcagcccucguacugauuu

SEQ ID NO: 926454 - RNA, 19 nt, Homo sapiens
ugauuuccaucguugcauu

SEQ ID NO: 926455 - RNA, 19 nt, Homo sapiens
uuucaucucuacacguuga

SEQ ID NO: 926456 - RNA, 19 nt, Homo sapiens
gaucucgagcucauuuaga

SEQ ID NO: 926457 - RNA, 19 nt, Homo sapiens
aaagguggagcgauuagaa

SEQ ID NO: 926458 - RNA, 19 nt, Homo sapiens
ugagcuaucuagagaagag

SEQ ID NO: 926459 - RNA, 19 nt, Homo sapiens
cauagcacaguucuuuaaa

SEQ ID NO: 926460 - RNA, 19 nt, Homo sapiens
uccagauguugagaaauua

SEQ ID NO: 926461 - RNA, 19 nt, Homo sapiens
uauggcagaugcugaugga

SEQ ID NO: 926462 - RNA, 19 nt, Homo sapiens
augcuucagugucacauuu

SEQ ID NO: 926463 - RNA, 19 nt, Homo sapiens
ggugaagaaucguggaaaa

SEQ ID NO: 926464 - RNA, 19 nt, Homo sapiens
gccuuggccuaaucaaaug

SEQ ID NO: 926465 - RNA, 19 nt, Homo sapiens
ggaaaagguggagcgauua

SEQ ID NO: 926466 - RNA, 19 nt, Homo sapiens
guuguguucuuaugcuuca

SEQ ID NO: 926467 - RNA, 19 nt, Homo sapiens
aguguggguucaaauuauu

SEQ ID NO: 926468 - RNA, 19 nt, Homo sapiens
ccgcagcccucguacugau

SEQ ID NO: 926469 - RNA, 19 nt, Homo sapiens
gugauaacccuggugaaga

SEQ ID NO: 926470 - RNA, 19 nt, Homo sapiens
gucuucaguuguguucuua

SEQ ID NO: 926471 - RNA, 19 nt, Homo sapiens
acgaugggcauuugaugua

SEQ ID NO: 926472 - RNA, 19 nt, Homo sapiens
ggaaucagggacacacagu

SEQ ID NO: 926473 - RNA, 19 nt, Homo sapiens
uuucuggugugguuccuuu

SEQ ID NO: 926474 - RNA, 19 nt, Homo sapiens
ccaaaggccagaaagaaac

SEQ ID NO: 926475 - RNA, 19 nt, Homo sapiens
gaagaaucguggaaaaggu

SEQ ID NO: 926476 - RNA, 19 nt, Homo sapiens
gggacucaccuaccaaaca

SEQ ID NO: 926477 - RNA, 19 nt, Homo sapiens
ggcuacaaauggguaaaga

SEQ ID NO: 926478 - RNA, 19 nt, Homo sapiens
uucuggagcuggcuacaaa

SEQ ID NO: 926479 - RNA, 19 nt, Homo sapiens
guggaucucgagcucauuu

SEQ ID NO: 926480 - RNA, 19 nt, Homo sapiens
uagaaaaggggcuaaauga

SEQ ID NO: 926481 - RNA, 19 nt, Homo sapiens
gauggagccacaaaguuuc

SEQ ID NO: 926482 - RNA, 19 nt, Homo sapiens
cuuaugaagugauaguagu

SEQ ID NO: 926483 - RNA, 19 nt, Homo sapiens
cuucaguuguguucuuaug

SEQ ID NO: 926484 - RNA, 19 nt, Homo sapiens
ccaucgacaugaagaagag

SEQ ID NO: 926485 - RNA, 19 nt, Homo sapiens
gcugauggagccacaaagu

SEQ ID NO: 926486 - RNA, 19 nt, Homo sapiens
uggaaaagguggagcgauu

SEQ ID NO: 926487 - RNA, 19 nt, Homo sapiens
ccuggaggcuugagcaaac

SEQ ID NO: 926488 - RNA, 19 nt, Homo sapiens
cuaaucaaauggcuauagc

SEQ ID NO: 926489 - RNA, 19 nt, Homo sapiens
gcauuuacaacugcuacaa

SEQ ID NO: 926490 - RNA, 19 nt, Homo sapiens
gcuucagugucacauuuca

SEQ ID NO: 926491 - RNA, 19 nt, Homo sapiens
uacauagcacaguucuuua

SEQ ID NO: 926492 - RNA, 19 nt, Homo sapiens
ugccugugaugauggauga

SEQ ID NO: 926493 - RNA, 19 nt, Homo sapiens
ggccuaaucaaauggcuau

SEQ ID NO: 926494 - RNA, 19 nt, Homo sapiens
uagguuguuugcagucuuc

SEQ ID NO: 926495 - RNA, 19 nt, Homo sapiens
aaaaggggcuaaaugaucu

SEQ ID NO: 926496 - RNA, 19 nt, Homo sapiens
cauuuacaacugcuacaaa

SEQ ID NO: 926497 - RNA, 19 nt, Homo sapiens
gcugaaauaaacuucuugu

SEQ ID NO: 926498 - RNA, 19 nt, Homo sapiens
agugucacauuucauuuca

SEQ ID NO: 926499 - RNA, 19 nt, Homo sapiens
gcagucuucaguuguguuc

SEQ ID NO: 926500 - RNA, 19 nt, Homo sapiens
gauuuccaucguugcauuu

SEQ ID NO: 926501 - RNA, 19 nt, Homo sapiens
cauguauggguuccacuuu

SEQ ID NO: 926502 - RNA, 19 nt, Homo sapiens
ucugagcuaucuagagaag

SEQ ID NO: 926503 - RNA, 19 nt, Homo sapiens
agucuucaguuguguucuu

SEQ ID NO: 926504 - RNA, 19 nt, Homo sapiens
uguuugcagucuucaguug

SEQ ID NO: 926505 - RNA, 19 nt, Homo sapiens
ggcuauagcauguggaucu

SEQ ID NO: 926506 - RNA, 19 nt, Homo sapiens
ggagaaaagauccuuaugg

SEQ ID NO: 926507 - RNA, 19 nt, Homo sapiens
gcacauagguguuuaauaa

SEQ ID NO: 926508 - RNA, 19 nt, Homo sapiens
gauaacaucuucaucuuug

SEQ ID NO: 926509 - RNA, 19 nt, Homo sapiens
gcaccuuggucauggauua

SEQ ID NO: 926510 - RNA, 19 nt, Homo sapiens
gaacugcaguggagaugaa

SEQ ID NO: 926511 - RNA, 19 nt, Homo sapiens
caggaaggaugcucucaua

SEQ ID NO: 926512 - RNA, 19 nt, Homo sapiens
caggaaggaugcucucaua

SEQ ID NO: 926513 - RNA, 19 nt, Homo sapiens
gaaggaugcucucauaagg

SEQ ID NO: 926514 - RNA, 19 nt, Homo sapiens
gggcaugucuguggaguuu

SEQ ID NO: 926515 - RNA, 19 nt, Homo sapiens
gaacagacacacuccaugu

SEQ ID NO: 926516 - RNA, 19 nt, Homo sapiens
gcagaggcccugaucauga

SEQ ID NO: 926517 - RNA, 19 nt, Homo sapiens
gaacagacccggcuuuuga

SEQ ID NO: 926518 - RNA, 19 nt, Homo sapiens
gaaggaugcucucauaagc

SEQ ID NO: 926519 - RNA, 19 nt, Homo sapiens
ucucugaacugccuaaaga

SEQ ID NO: 926520 - RNA, 19 nt, Homo sapiens
gcaccagccucucugacaa

SEQ ID NO: 926521 - RNA, 19 nt, Homo sapiens
auaaguaucuucccugguu

SEQ ID NO: 926522 - RNA, 19 nt, Homo sapiens
ccagcuacauugucauauu

SEQ ID NO: 926523 - RNA, 19 nt, Homo sapiens
ucaacagccuccugcagua

SEQ ID NO: 926524 - RNA, 19 nt, Homo sapiens
gaggauggccugcucuuga

SEQ ID NO: 926525 - RNA, 19 nt, Homo sapiens
ggaaaaugguguuggguuu

SEQ ID NO: 926526 - RNA, 19 nt, Homo sapiens
ucgaaagucuuaauucugu

SEQ ID NO: 926527 - RNA, 19 nt, Homo sapiens
ccacuucucauccaacuuu

SEQ ID NO: 926528 - RNA, 19 nt, Homo sapiens
gcuugacuauuuccucuuu

SEQ ID NO: 926529 - RNA, 19 nt, Homo sapiens
cguucucccucaacaauua

SEQ ID NO: 926530 - RNA, 19 nt, Homo sapiens
ccaagcagcugguaucacu

SEQ ID NO: 926531 - RNA, 19 nt, Homo sapiens
ggaguacaguggcacaauc

SEQ ID NO: 926532 - RNA, 19 nt, Homo sapiens
ggaaagugccuggaacaga

SEQ ID NO: 926533 - RNA, 19 nt, Homo sapiens
ggaaggaugcucucauaag

SEQ ID NO: 926534 - RNA, 19 nt, Homo sapiens
ggaaggaugcucucauaag

SEQ ID NO: 926535 - RNA, 19 nt, Homo sapiens
cagcugugguggccuauga

SEQ ID NO: 926536 - RNA, 19 nt, Homo sapiens
acucguaccugcuugacua

SEQ ID NO: 926537 - RNA, 19 nt, Homo sapiens
gcaugucuguggaguuugu

SEQ ID NO: 926538 - RNA, 19 nt, Homo sapiens
cagcuacauugucauauuc

SEQ ID NO: 926539 - RNA, 19 nt, Homo sapiens
gagaagggcccaggaagga

SEQ ID NO: 926540 - RNA, 19 nt, Homo sapiens
ccacauuacccgcuccuuu

SEQ ID NO: 926541 - RNA, 19 nt, Homo sapiens
cguaccugcuugacuauuu

SEQ ID NO: 926542 - RNA, 19 nt, Homo sapiens
ggaggaggccuucuuagag

SEQ ID NO: 926543 - RNA, 19 nt, Homo sapiens
gaagcgagucugucgauca

SEQ ID NO: 926544 - RNA, 19 nt, Homo sapiens
cagacacacuccauguuug

SEQ ID NO: 926545 - RNA, 19 nt, Homo sapiens
gggaggaggccuucuuaga

SEQ ID NO: 926546 - RNA, 19 nt, Homo sapiens
cagcaccucugugaacuug

SEQ ID NO: 926547 - RNA, 19 nt, Homo sapiens
ucggauggcuggcauguuc

SEQ ID NO: 926548 - RNA, 19 nt, Homo sapiens
gcagaugucagccuuugug

SEQ ID NO: 926549 - RNA, 19 nt, Homo sapiens
guacaaaggaaaggacuau

SEQ ID NO: 926550 - RNA, 19 nt, Homo sapiens
caccauguguggcguguau

SEQ ID NO: 926551 - RNA, 19 nt, Homo sapiens
gacacacgcccuccucaaa

SEQ ID NO: 926552 - RNA, 19 nt, Homo sapiens
guaccugcuugacuauuuc

SEQ ID NO: 926553 - RNA, 19 nt, Homo sapiens
caagagaagggcccaggaa

SEQ ID NO: 926554 - RNA, 19 nt, Homo sapiens
ccuaggagcccacuucuca

SEQ ID NO: 926555 - RNA, 19 nt, Homo sapiens
ucaccaauguguuuuauga

SEQ ID NO: 926556 - RNA, 19 nt, Homo sapiens
caccugauccuauuacaga

SEQ ID NO: 926557 - RNA, 19 nt, Homo sapiens
guguauggcucugcccuuu

SEQ ID NO: 926558 - RNA, 19 nt, Homo sapiens
ucauucagaucuucuucuu

SEQ ID NO: 926559 - RNA, 19 nt, Homo sapiens
guucauggccuaucacaag

SEQ ID NO: 926560 - RNA, 19 nt, Homo sapiens
ggaaggaccauuuucugua

SEQ ID NO: 926561 - RNA, 19 nt, Homo sapiens
acacagacaaugaccacua

SEQ ID NO: 926562 - RNA, 19 nt, Homo sapiens
guagcagugucccugagaa

SEQ ID NO: 926563 - RNA, 19 nt, Homo sapiens
acagacacacuccauguuu

SEQ ID NO: 926564 - RNA, 19 nt, Homo sapiens
uaugggaagugcgguguuu

SEQ ID NO: 926565 - RNA, 19 nt, Homo sapiens
ccuacacgaucaccaaugu

SEQ ID NO: 926566 - RNA, 19 nt, Homo sapiens
gcugauaacaucuucaucu

SEQ ID NO: 926567 - RNA, 19 nt, Homo sapiens
caaaggaaaggacuauucu

SEQ ID NO: 926568 - RNA, 19 nt, Homo sapiens
ggaggccauucccaugaga

SEQ ID NO: 926569 - RNA, 19 nt, Homo sapiens
ccacagcugacaacaucua

SEQ ID NO: 926570 - RNA, 19 nt, Homo sapiens
gacuucagauggccagguu

SEQ ID NO: 926571 - RNA, 19 nt, Homo sapiens
cacgagagguccacauugg

SEQ ID NO: 926572 - RNA, 19 nt, Homo sapiens
gccaccagcuacauuguca

SEQ ID NO: 926573 - RNA, 19 nt, Homo sapiens
ggacaauaccagucucuac

SEQ ID NO: 926574 - RNA, 19 nt, Homo sapiens
gaaagucuuaauucugugu

SEQ ID NO: 926575 - RNA, 19 nt, Homo sapiens
ccagguucauggccuauca

SEQ ID NO: 926576 - RNA, 19 nt, Homo sapiens
cugauaacaucuucaucuu

SEQ ID NO: 926577 - RNA, 19 nt, Homo sapiens
aaggaaaggacuauucuga

SEQ ID NO: 926578 - RNA, 19 nt, Homo sapiens
gcucacagccaaccagaca

SEQ ID NO: 926579 - RNA, 19 nt, Homo sapiens
ucucgaaagucuuaauucu

SEQ ID NO: 926580 - RNA, 19 nt, Homo sapiens
uggcuccucugcucccaua

SEQ ID NO: 926581 - RNA, 19 nt, Homo sapiens
ccaaagaggccaccaucuc

SEQ ID NO: 926582 - RNA, 19 nt, Homo sapiens
agacacaguugccauucug

SEQ ID NO: 926583 - RNA, 19 nt, Homo sapiens
gcaguuccauaaguaucuu

SEQ ID NO: 926584 - RNA, 19 nt, Homo sapiens
ccacagcuuugaagguucu

SEQ ID NO: 926585 - RNA, 19 nt, Homo sapiens
gguggccucuugcccaaau

SEQ ID NO: 926586 - RNA, 19 nt, Homo sapiens
ugaacugccuaaagaacug

SEQ ID NO: 926587 - RNA, 19 nt, Homo sapiens
ccaauaaggacaaguucug

SEQ ID NO: 926588 - RNA, 19 nt, Homo sapiens
gggccugggucuggaaguu

SEQ ID NO: 926589 - RNA, 19 nt, Homo sapiens
cuccacagcugacaacauc

SEQ ID NO: 926590 - RNA, 19 nt, Homo sapiens
cacauuacccgcuccuuug

SEQ ID NO: 926591 - RNA, 19 nt, Homo sapiens
ugcaacaacuucuccuuca

SEQ ID NO: 926592 - RNA, 19 nt, Homo sapiens
gacuauuuccucuuucuga

SEQ ID NO: 926593 - RNA, 19 nt, Homo sapiens
gcuacugcgccuucuauga

SEQ ID NO: 926594 - RNA, 19 nt, Homo sapiens
caccagcuacauugucaua

SEQ ID NO: 926595 - RNA, 19 nt, Homo sapiens
acaaaggaaaggacuauuc

SEQ ID NO: 926596 - RNA, 19 nt, Homo sapiens
ggccugcucuugagguauc

SEQ ID NO: 926597 - RNA, 19 nt, Homo sapiens
ugaagguucuaucaaaggu

SEQ ID NO: 926598 - RNA, 19 nt, Homo sapiens
cacgaucaccaauguguuu

SEQ ID NO: 926599 - RNA, 19 nt, Homo sapiens
gcaccucugugaacuugac

SEQ ID NO: 926600 - RNA, 19 nt, Homo sapiens
cccagaagauccaguaugc

SEQ ID NO: 926601 - RNA, 19 nt, Homo sapiens
gacgucugcugcuguguca

SEQ ID NO: 926602 - RNA, 19 nt, Homo sapiens
gugggaggaggccuucuua

SEQ ID NO: 926603 - RNA, 19 nt, Homo sapiens
gaaggaccauuuucuguac

SEQ ID NO: 926604 - RNA, 19 nt, Homo sapiens
ggccuggucuuuacagaac

SEQ ID NO: 926605 - RNA, 19 nt, Homo sapiens
gcucugcccuuugcaaugc

SEQ ID NO: 926606 - RNA, 19 nt, Homo sapiens
gagcccacuucucauccaa

SEQ ID NO: 926607 - RNA, 19 nt, Homo sapiens
gcaaggaccucuucaucaa

SEQ ID NO: 926608 - RNA, 19 nt, Homo sapiens
gagaagaaguccacacuau

SEQ ID NO: 926609 - RNA, 19 nt, Homo sapiens
ggaaugccaucucccaaug

SEQ ID NO: 926610 - RNA, 19 nt, Homo sapiens
gaagaaguccacacuaugu

SEQ ID NO: 926611 - RNA, 19 nt, Homo sapiens
gcggugaucuugcuguauu

SEQ ID NO: 926612 - RNA, 19 nt, Homo sapiens
gagucuauaugcagaguaa

SEQ ID NO: 926613 - RNA, 19 nt, Homo sapiens
gccuagagcugcuggagaa

SEQ ID NO: 926614 - RNA, 19 nt, Homo sapiens
caacacgugugacaucauc

SEQ ID NO: 926615 - RNA, 19 nt, Homo sapiens
gaacugcagcugacacauc

SEQ ID NO: 926616 - RNA, 19 nt, Homo sapiens
cgcggagucuuguucuuua

SEQ ID NO: 926617 - RNA, 19 nt, Homo sapiens
gacaucaucacccucuaua

SEQ ID NO: 926618 - RNA, 19 nt, Homo sapiens
gagaugauccagcgucugu

SEQ ID NO: 926619 - RNA, 19 nt, Homo sapiens
cccagaaccuuccaagaga

SEQ ID NO: 926620 - RNA, 19 nt, Homo sapiens
uagagcugcuggagaaaug

SEQ ID NO: 926621 - RNA, 19 nt, Homo sapiens
uaaagcaagucagaucauc

SEQ ID NO: 926622 - RNA, 19 nt, Homo sapiens
gauuaaagcaagucagauc

SEQ ID NO: 926623 - RNA, 19 nt, Homo sapiens
caucaucacccucuauauc

SEQ ID NO: 926624 - RNA, 19 nt, Homo sapiens
ucgaggagcucuucagcau

SEQ ID NO: 926625 - RNA, 19 nt, Homo sapiens
gugcagcagugacaagcaa

SEQ ID NO: 926626 - RNA, 19 nt, Homo sapiens
acaacauggugcucauuga

SEQ ID NO: 926627 - RNA, 19 nt, Homo sapiens
gcgcggagucuuguucuuu

SEQ ID NO: 926628 - RNA, 19 nt, Homo sapiens
gacaacauggugcucauug

SEQ ID NO: 926629 - RNA, 19 nt, Homo sapiens
gugaagucaugcugaagga

SEQ ID NO: 926630 - RNA, 19 nt, Homo sapiens
cuauaucucugccaucaag

SEQ ID NO: 926631 - RNA, 19 nt, Homo sapiens
ggacacagugcggcagauu

SEQ ID NO: 926632 - RNA, 19 nt, Homo sapiens
aaggaccucuucaucaaug

SEQ ID NO: 926633 - RNA, 19 nt, Homo sapiens
gaugauccagcgucuguau

SEQ ID NO: 926634 - RNA, 19 nt, Homo sapiens
ccagaaccuuccaagagau

SEQ ID NO: 926635 - RNA, 19 nt, Homo sapiens
gcgagaacucugcggauga

SEQ ID NO: 926636 - RNA, 19 nt, Homo sapiens
cagauuaaagcaagucaga

SEQ ID NO: 926637 - RNA, 19 nt, Homo sapiens
agacaggccaggacaguga

SEQ ID NO: 926638 - RNA, 19 nt, Homo sapiens
ggagucuuguucuuuagca

SEQ ID NO: 926639 - RNA, 19 nt, Homo sapiens
ggacaacauggugcucauu

SEQ ID NO: 926640 - RNA, 19 nt, Homo sapiens
cagcaaggaccucuucauc

SEQ ID NO: 926641 - RNA, 19 nt, Homo sapiens
cgagaagaaguccacacua

SEQ ID NO: 926642 - RNA, 19 nt, Homo sapiens
agggcuaccugcagaagaa

SEQ ID NO: 926643 - RNA, 19 nt, Homo sapiens
gaggcuuacugcaagaagu

SEQ ID NO: 926644 - RNA, 19 nt, Homo sapiens
caacaucuccccugaguuc

SEQ ID NO: 926645 - RNA, 19 nt, Homo sapiens
cgagaacucugcggaugag

SEQ ID NO: 926646 - RNA, 19 nt, Homo sapiens
caccuucucugucauugag

SEQ ID NO: 926647 - RNA, 19 nt, Homo sapiens
ucugugaagucaugcugaa

SEQ ID NO: 926648 - RNA, 19 nt, Homo sapiens
gcccggacaggaguuguua

SEQ ID NO: 926649 - RNA, 19 nt, Homo sapiens
gagagucuauaugcagagu

SEQ ID NO: 926650 - RNA, 19 nt, Homo sapiens
agaagaaguccacacuaug

SEQ ID NO: 926651 - RNA, 19 nt, Homo sapiens
cagcaucguccgagacuuc

SEQ ID NO: 926652 - RNA, 19 nt, Homo sapiens
gcugccacgugcaaagguu

SEQ ID NO: 926653 - RNA, 19 nt, Homo sapiens
gcaccuucucugucauuga

SEQ ID NO: 926654 - RNA, 19 nt, Homo sapiens
gcuggacccuggaggaacu

SEQ ID NO: 926655 - RNA, 19 nt, Homo sapiens
gccaggacagugaggauga

SEQ ID NO: 926656 - RNA, 19 nt, Homo sapiens
ggagacaggccaggacagu

SEQ ID NO: 926657 - RNA, 19 nt, Homo sapiens
gcggagucuuguucuuuag

SEQ ID NO: 926658 - RNA, 19 nt, Homo sapiens
caaggaccucuucaucaau

SEQ ID NO: 926659 - RNA, 19 nt, Homo sapiens
cuguaugggugcuucuuga

SEQ ID NO: 926660 - RNA, 19 nt, Homo sapiens
uggaggugcugcagaacga

SEQ ID NO: 926661 - RNA, 19 nt, Homo sapiens
ucguggaggugcugcagaa

SEQ ID NO: 926662 - RNA, 19 nt, Homo sapiens
gcagugugcagauuaaagc

SEQ ID NO: 926663 - RNA, 19 nt, Homo sapiens
gggacaacauggugcucau

SEQ ID NO: 926664 - RNA, 19 nt, Homo sapiens
gcagggugcagcagugaca

SEQ ID NO: 926665 - RNA, 19 nt, Homo sapiens
acacagugcggcagauugu

SEQ ID NO: 926666 - RNA, 19 nt, Homo sapiens
ugacaucaucacccucuau

SEQ ID NO: 926667 - RNA, 19 nt, Homo sapiens
gcuguugagcuguccaaga

SEQ ID NO: 926668 - RNA, 19 nt, Homo sapiens
guaugggugcuucuugaga

SEQ ID NO: 926669 - RNA, 19 nt, Homo sapiens
agaaguccacacuauguug

SEQ ID NO: 926670 - RNA, 19 nt, Homo sapiens
ucuaccgccugcccaagaa

SEQ ID NO: 926671 - RNA, 19 nt, Homo sapiens
gggaccagcagcucgucua

SEQ ID NO: 926672 - RNA, 19 nt, Homo sapiens
aggcggugaucuugcugua

SEQ ID NO: 926673 - RNA, 19 nt, Homo sapiens
gcagcaaggaccucuucau

SEQ ID NO: 926674 - RNA, 19 nt, Homo sapiens
gacacagugcggcagauug

SEQ ID NO: 926675 - RNA, 19 nt, Homo sapiens
gcgagaagaaguccacacu

SEQ ID NO: 926676 - RNA, 19 nt, Homo sapiens
gcuccuuccugcgugaguu

SEQ ID NO: 926677 - RNA, 19 nt, Homo sapiens
gugcagucccgccaaagga

SEQ ID NO: 926678 - RNA, 19 nt, Homo sapiens
gaaccuuccaagagaugau

SEQ ID NO: 926679 - RNA, 19 nt, Homo sapiens
caacauggugcucauugac

SEQ ID NO: 926680 - RNA, 19 nt, Homo sapiens
cccggcaccuucucuguca

SEQ ID NO: 926681 - RNA, 19 nt, Homo sapiens
gagcaaggcggugaaaaug

SEQ ID NO: 926682 - RNA, 19 nt, Homo sapiens
cggugaucuugcuguauuu

SEQ ID NO: 926683 - RNA, 19 nt, Homo sapiens
uccuggagguggccuguga

SEQ ID NO: 926684 - RNA, 19 nt, Homo sapiens
cccgcagugugcagauuaa

SEQ ID NO: 926685 - RNA, 19 nt, Homo sapiens
gccucucacuggaucguau

SEQ ID NO: 926686 - RNA, 19 nt, Homo sapiens
gcgcaucgaggagcucuuc

SEQ ID NO: 926687 - RNA, 19 nt, Homo sapiens
ugcgugaguuccacaagug

SEQ ID NO: 926688 - RNA, 19 nt, Homo sapiens
gaucauagccaaagaauuu

SEQ ID NO: 926689 - RNA, 19 nt, Homo sapiens
gaacuugacuucuuugaga

SEQ ID NO: 926690 - RNA, 19 nt, Homo sapiens
cgacacaaguacauaaaua

SEQ ID NO: 926691 - RNA, 19 nt, Homo sapiens
uaacuugccugaagaagaa

SEQ ID NO: 926692 - RNA, 19 nt, Homo sapiens
uagcaaaucuccaaauguu

SEQ ID NO: 926693 - RNA, 19 nt, Homo sapiens
ggagguggcagaacaguua

SEQ ID NO: 926694 - RNA, 19 nt, Homo sapiens
caacuuggaugaagagaug

SEQ ID NO: 926695 - RNA, 19 nt, Homo sapiens
caaaagagacugugaaaua

SEQ ID NO: 926696 - RNA, 19 nt, Homo sapiens
gcacagggaaugcauauga

SEQ ID NO: 926697 - RNA, 19 nt, Homo sapiens
ggcaggaucugauucauug

SEQ ID NO: 926698 - RNA, 19 nt, Homo sapiens
cagaggguauuauuuguuu

SEQ ID NO: 926699 - RNA, 19 nt, Homo sapiens
cuacaaagguaaauaaugg

SEQ ID NO: 926700 - RNA, 19 nt, Homo sapiens
gcucuugauuuguugguua

SEQ ID NO: 926701 - RNA, 19 nt, Homo sapiens
gaaugcauaugaagaggaa

SEQ ID NO: 926702 - RNA, 19 nt, Homo sapiens
aaacagaggguauuauuug

SEQ ID NO: 926703 - RNA, 19 nt, Homo sapiens
gcaaugcugacuaucaaua

SEQ ID NO: 926704 - RNA, 19 nt, Homo sapiens
gaagaaaauucgucaaguu

SEQ ID NO: 926705 - RNA, 19 nt, Homo sapiens
gguaaauaauggagagauu

SEQ ID NO: 926706 - RNA, 19 nt, Homo sapiens
gaucguggaccaucaguuu

SEQ ID NO: 926707 - RNA, 19 nt, Homo sapiens
gaugugaaguaccucauga

SEQ ID NO: 926708 - RNA, 19 nt, Homo sapiens
ucauagcgguuacgacuuu

SEQ ID NO: 926709 - RNA, 19 nt, Homo sapiens
gugauuggauguuuacuau

SEQ ID NO: 926710 - RNA, 19 nt, Homo sapiens
ugaaguaccucaugaagag

SEQ ID NO: 926711 - RNA, 19 nt, Homo sapiens
uugaaucccucgaacaaua

SEQ ID NO: 926712 - RNA, 19 nt, Homo sapiens
cagcuaggacugacauuua

SEQ ID NO: 926713 - RNA, 19 nt, Homo sapiens
cauaguugcuacaaaggua

SEQ ID NO: 926714 - RNA, 19 nt, Homo sapiens
gcacugacuguaauuuauu

SEQ ID NO: 926715 - RNA, 19 nt, Homo sapiens
ugagauccuucgauuguuu

SEQ ID NO: 926716 - RNA, 19 nt, Homo sapiens
uuacgacuuuggcuacuua

SEQ ID NO: 926717 - RNA, 19 nt, Homo sapiens
uaacuagcacugacuguaa

SEQ ID NO: 926718 - RNA, 19 nt, Homo sapiens
cagguuaaauuuggccuua

SEQ ID NO: 926719 - RNA, 19 nt, Homo sapiens
gcauucagguuaaauuugg

SEQ ID NO: 926720 - RNA, 19 nt, Homo sapiens
gagcucagcgacacaagua

SEQ ID NO: 926721 - RNA, 19 nt, Homo sapiens
gcaaaucuccaaauguuag

SEQ ID NO: 926722 - RNA, 19 nt, Homo sapiens
gaauugaaacccaguacuu

SEQ ID NO: 926723 - RNA, 19 nt, Homo sapiens
ggacuacaaguuauaaugu

SEQ ID NO: 926724 - RNA, 19 nt, Homo sapiens
aaugauggacuacaaguua

SEQ ID NO: 926725 - RNA, 19 nt, Homo sapiens
gauguugaagcuacaguua

SEQ ID NO: 926726 - RNA, 19 nt, Homo sapiens
gauuggauguuuacuaucu

SEQ ID NO: 926727 - RNA, 19 nt, Homo sapiens
ggaaagcuacaucauugaa

SEQ ID NO: 926728 - RNA, 19 nt, Homo sapiens
ggaaacugguacucaagau

SEQ ID NO: 926729 - RNA, 19 nt, Homo sapiens
gacuuuggcuacuuaauca

SEQ ID NO: 926730 - RNA, 19 nt, Homo sapiens
gcacaucuagugucuguca

SEQ ID NO: 926731 - RNA, 19 nt, Homo sapiens
cgacuugaguuugguuuau

SEQ ID NO: 926732 - RNA, 19 nt, Homo sapiens
ggggaaagcuacaucauug

SEQ ID NO: 926733 - RNA, 19 nt, Homo sapiens
ugaaugagcaaggagaaua

SEQ ID NO: 926734 - RNA, 19 nt, Homo sapiens
gguguaauguagacuuguu

SEQ ID NO: 926735 - RNA, 19 nt, Homo sapiens
caagacccauuggagaauu

SEQ ID NO: 926736 - RNA, 19 nt, Homo sapiens
gaaaugauggacuacaagu

SEQ ID NO: 926737 - RNA, 19 nt, Homo sapiens
uguguaggcugcucuguga

SEQ ID NO: 926738 - RNA, 19 nt, Homo sapiens
aaagauaauucagcuagga

SEQ ID NO: 926739 - RNA, 19 nt, Homo sapiens
uguugaagcuacaguuauu

SEQ ID NO: 926740 - RNA, 19 nt, Homo sapiens
uagcacugacuguaauuua

SEQ ID NO: 926741 - RNA, 19 nt, Homo sapiens
ccgaaaugauggacuacaa

SEQ ID NO: 926742 - RNA, 19 nt, Homo sapiens
gaaaauucgucaaguuauc

SEQ ID NO: 926743 - RNA, 19 nt, Homo sapiens
ccuuguacauucuuuauuc

SEQ ID NO: 926744 - RNA, 19 nt, Homo sapiens
gaaagcuacaucauugaau

SEQ ID NO: 926745 - RNA, 19 nt, Homo sapiens
auaauuacguugcuaugga

SEQ ID NO: 926746 - RNA, 19 nt, Homo sapiens
gaaacugguacucaagaug

SEQ ID NO: 926747 - RNA, 19 nt, Homo sapiens
ccaagcacaucuagugucu

SEQ ID NO: 926748 - RNA, 19 nt, Homo sapiens
guacguaguguuuaaucuu

SEQ ID NO: 926749 - RNA, 19 nt, Homo sapiens
ucucaaagguggauuacag

SEQ ID NO: 926750 - RNA, 19 nt, Homo sapiens
gaggaggaaggaauugaaa

SEQ ID NO: 926751 - RNA, 19 nt, Homo sapiens
cuacuaacaacaucuggua

SEQ ID NO: 926752 - RNA, 19 nt, Homo sapiens
cuauagagcuacuaacaac

SEQ ID NO: 926753 - RNA, 19 nt, Homo sapiens
uaccaacuauugcggugua

SEQ ID NO: 926754 - RNA, 19 nt, Homo sapiens
gacuacaaguuauaaugug

SEQ ID NO: 926755 - RNA, 19 nt, Homo sapiens
uuaugaugcucuugauuug

SEQ ID NO: 926756 - RNA, 19 nt, Homo sapiens
gauagcacacuucccuuga

SEQ ID NO: 926757 - RNA, 19 nt, Homo sapiens
gacuugaguuugguuuauu

SEQ ID NO: 926758 - RNA, 19 nt, Homo sapiens
cacacaugcuuguauauag

SEQ ID NO: 926759 - RNA, 19 nt, Homo sapiens
acacacaugcuuguauaua

SEQ ID NO: 926760 - RNA, 19 nt, Homo sapiens
gacuaucaauaccaacuau

SEQ ID NO: 926761 - RNA, 19 nt, Homo sapiens
gcauguguaggaagacuuu

SEQ ID NO: 926762 - RNA, 19 nt, Homo sapiens
guguauaucuuugcaaucu

SEQ ID NO: 926763 - RNA, 19 nt, Homo sapiens
ggaguguaaugcuuauuuu

SEQ ID NO: 926764 - RNA, 19 nt, Homo sapiens
aagcacaucuagugucugu

SEQ ID NO: 926765 - RNA, 19 nt, Homo sapiens
ggauaggaccacaacauca

SEQ ID NO: 926766 - RNA, 19 nt, Homo sapiens
gaacggauaggaccacaac

SEQ ID NO: 926767 - RNA, 19 nt, Homo sapiens
caacuauugcgguguaaug

SEQ ID NO: 926768 - RNA, 19 nt, Homo sapiens
ggagaauucaggagcaaug

SEQ ID NO: 926769 - RNA, 19 nt, Homo sapiens
aagagacugugaaauacuu

SEQ ID NO: 926770 - RNA, 19 nt, Homo sapiens
gcuacaaagguaaauaaug

SEQ ID NO: 926771 - RNA, 19 nt, Homo sapiens
aguaacugcuguuucugua

SEQ ID NO: 926772 - RNA, 19 nt, Homo sapiens
cuuaguaacugcuguuucu

SEQ ID NO: 926773 - RNA, 19 nt, Homo sapiens
ccaguacuuugcagaacuu

SEQ ID NO: 926774 - RNA, 19 nt, Homo sapiens
cuuaugaugcucuugauuu

SEQ ID NO: 926775 - RNA, 19 nt, Homo sapiens
gcucugugacugaagaauu

SEQ ID NO: 926776 - RNA, 19 nt, Homo sapiens
gaaacuacugaggagcuua

SEQ ID NO: 926777 - RNA, 19 nt, Homo sapiens
ucacgucucucccuuccau

SEQ ID NO: 926778 - RNA, 19 nt, Homo sapiens
ccaacaagcagucaugaca

SEQ ID NO: 926779 - RNA, 19 nt, Homo sapiens
gcgguguaauguagacuug

SEQ ID NO: 926780 - RNA, 19 nt, Homo sapiens
gauggacuacaaguuauaa

SEQ ID NO: 926781 - RNA, 19 nt, Homo sapiens
ugaaauacuuagccaugca

SEQ ID NO: 926782 - RNA, 19 nt, Homo sapiens
cacagggaaugcauaugaa

SEQ ID NO: 926783 - RNA, 19 nt, Homo sapiens
ggagugguccucugugaag

SEQ ID NO: 926784 - RNA, 19 nt, Homo sapiens
caaaacagaggguauuauu

SEQ ID NO: 926785 - RNA, 19 nt, Homo sapiens
ccaucaccauuuacccuuu

SEQ ID NO: 926786 - RNA, 19 nt, Homo sapiens
uuuacuaucugccaggaaa

SEQ ID NO: 926787 - RNA, 19 nt, Homo sapiens
ucuagugucugucaguuuc

SEQ ID NO: 926788 - RNA, 19 nt, Homo sapiens
gaucauagccaaagaauuu

SEQ ID NO: 926789 - RNA, 19 nt, Homo sapiens
gcuaauaacuuccaugauu

SEQ ID NO: 926790 - RNA, 19 nt, Homo sapiens
gaacuugacuucuuugaga

SEQ ID NO: 926791 - RNA, 19 nt, Homo sapiens
uaagugaugugcacagaua

SEQ ID NO: 926792 - RNA, 19 nt, Homo sapiens
uaacuugccugaagaagaa

SEQ ID NO: 926793 - RNA, 19 nt, Homo sapiens
gacauuaaauugagacuga

SEQ ID NO: 926794 - RNA, 19 nt, Homo sapiens
ggagguggcagaacaguua

SEQ ID NO: 926795 - RNA, 19 nt, Homo sapiens
caacuuggaugaagagaug

SEQ ID NO: 926796 - RNA, 19 nt, Homo sapiens
gagaucaguuccuugagua

SEQ ID NO: 926797 - RNA, 19 nt, Homo sapiens
gaaauguaguucagaagga

SEQ ID NO: 926798 - RNA, 19 nt, Homo sapiens
ggcaggaucugauucauug

SEQ ID NO: 926799 - RNA, 19 nt, Homo sapiens
gaaaauugguugugcaaaa

SEQ ID NO: 926800 - RNA, 19 nt, Homo sapiens
gauggaagaaugaaacuaa

SEQ ID NO: 926801 - RNA, 19 nt, Homo sapiens
gcaaugcugacuaucaaua

SEQ ID NO: 926802 - RNA, 19 nt, Homo sapiens
gcagagaucaguuccuuga

SEQ ID NO: 926803 - RNA, 19 nt, Homo sapiens
ggcaaggaaucuuuauauu

SEQ ID NO: 926804 - RNA, 19 nt, Homo sapiens
gaagaaaauucgucaaguu

SEQ ID NO: 926805 - RNA, 19 nt, Homo sapiens
gcacagauacaccuagcua

SEQ ID NO: 926806 - RNA, 19 nt, Homo sapiens
ucauguagguccaaccaua

SEQ ID NO: 926807 - RNA, 19 nt, Homo sapiens
gaugugaaguaccucauga

SEQ ID NO: 926808 - RNA, 19 nt, Homo sapiens
ucauagcgguuacgacuuu

SEQ ID NO: 926809 - RNA, 19 nt, Homo sapiens
ccgaagggaucaaauaaau

SEQ ID NO: 926810 - RNA, 19 nt, Homo sapiens
ugaaguaccucaugaagag

SEQ ID NO: 926811 - RNA, 19 nt, Homo sapiens
cagcuaggacugacauuua

SEQ ID NO: 926812 - RNA, 19 nt, Homo sapiens
gagcucagcgauacaagua

SEQ ID NO: 926813 - RNA, 19 nt, Homo sapiens
aaacauaaacuaccugaga

SEQ ID NO: 926814 - RNA, 19 nt, Homo sapiens
caucauagaaccaacaauu

SEQ ID NO: 926815 - RNA, 19 nt, Homo sapiens
uaaacuaccugagaaguca

SEQ ID NO: 926816 - RNA, 19 nt, Homo sapiens
ugagauccuucgauuguuu

SEQ ID NO: 926817 - RNA, 19 nt, Homo sapiens
uuacgacuuuggcuacuua

SEQ ID NO: 926818 - RNA, 19 nt, Homo sapiens
ggaagaaugaaacuaaaug

SEQ ID NO: 926819 - RNA, 19 nt, Homo sapiens
gaauugaaacccaguacuu

SEQ ID NO: 926820 - RNA, 19 nt, Homo sapiens
gaaaacaggcuaauaacuu

SEQ ID NO: 926821 - RNA, 19 nt, Homo sapiens
cagaaaccauauuaggaaa

SEQ ID NO: 926822 - RNA, 19 nt, Homo sapiens
ccaaccauauuauuucuca

SEQ ID NO: 926823 - RNA, 19 nt, Homo sapiens
gacuuuggcuacuuaauca

SEQ ID NO: 926824 - RNA, 19 nt, Homo sapiens
ucagaaaccauauuaggaa

SEQ ID NO: 926825 - RNA, 19 nt, Homo sapiens
cguaguaguugcaucagaa

SEQ ID NO: 926826 - RNA, 19 nt, Homo sapiens
gcuguggauuugaguauau

SEQ ID NO: 926827 - RNA, 19 nt, Homo sapiens
gaucaguuccuugaguaua

SEQ ID NO: 926828 - RNA, 19 nt, Homo sapiens
acagauacaccuagcuaua

SEQ ID NO: 926829 - RNA, 19 nt, Homo sapiens
ugaaugagcaaggagaaua

SEQ ID NO: 926830 - RNA, 19 nt, Homo sapiens
gguguaauguagacuuguu

SEQ ID NO: 926831 - RNA, 19 nt, Homo sapiens
cauuaaagcuguuuugcua

SEQ ID NO: 926832 - RNA, 19 nt, Homo sapiens
caagacccauuggagaauu

SEQ ID NO: 926833 - RNA, 19 nt, Homo sapiens
ucacauccaccacacuuaa

SEQ ID NO: 926834 - RNA, 19 nt, Homo sapiens
aaagauaauucagcuagga

SEQ ID NO: 926835 - RNA, 19 nt, Homo sapiens
gaaaauucgucaaguuauc

SEQ ID NO: 926836 - RNA, 19 nt, Homo sapiens
gcucagcgauacaaguaca

SEQ ID NO: 926837 - RNA, 19 nt, Homo sapiens
auaauuacguugcuaugga

SEQ ID NO: 926838 - RNA, 19 nt, Homo sapiens
aacauaaacuaccugagaa

SEQ ID NO: 926839 - RNA, 19 nt, Homo sapiens
ucucaaagguggauuacag

SEQ ID NO: 926840 - RNA, 19 nt, Homo sapiens
gaggaggaaggaauugaaa

SEQ ID NO: 926841 - RNA, 19 nt, Homo sapiens
cuacuaacaacaucuggua

SEQ ID NO: 926842 - RNA, 19 nt, Homo sapiens
cuauagagcuacuaacaac

SEQ ID NO: 926843 - RNA, 19 nt, Homo sapiens
uaccaacuauugcggugua

SEQ ID NO: 926844 - RNA, 19 nt, Homo sapiens
ccuaaguaauuaagugaug

SEQ ID NO: 926845 - RNA, 19 nt, Homo sapiens
ccuugaguauaaaguguua

SEQ ID NO: 926846 - RNA, 19 nt, Homo sapiens
uaaauccaacguaguaguu

SEQ ID NO: 926847 - RNA, 19 nt, Homo sapiens
uuuacugcauugagucuua

SEQ ID NO: 926848 - RNA, 19 nt, Homo sapiens
gacuaucaauaccaacuau

SEQ ID NO: 926849 - RNA, 19 nt, Homo sapiens
agaaggaacugggagaaca

SEQ ID NO: 926850 - RNA, 19 nt, Homo sapiens
agagaaguaugaagacauc

SEQ ID NO: 926851 - RNA, 19 nt, Homo sapiens
ggauaggaccacaacauca

SEQ ID NO: 926852 - RNA, 19 nt, Homo sapiens
gaacggauaggaccacaac

SEQ ID NO: 926853 - RNA, 19 nt, Homo sapiens
caacuauugcgguguaaug

SEQ ID NO: 926854 - RNA, 19 nt, Homo sapiens
ggagaauucaggagcaaug

SEQ ID NO: 926855 - RNA, 19 nt, Homo sapiens
ggaaaacccuccuuaaacg

SEQ ID NO: 926856 - RNA, 19 nt, Homo sapiens
ugagaaaacaggcuaauaa

SEQ ID NO: 926857 - RNA, 19 nt, Homo sapiens
gguccaaccauauuauuuc

SEQ ID NO: 926858 - RNA, 19 nt, Homo sapiens
ggaacugggagaacauguu

SEQ ID NO: 926859 - RNA, 19 nt, Homo sapiens
agagauaccauaugaguca

SEQ ID NO: 926860 - RNA, 19 nt, Homo sapiens
ccaguacuuugcagaacuu

SEQ ID NO: 926861 - RNA, 19 nt, Homo sapiens
gaaagcauuaaagcuguuu

SEQ ID NO: 926862 - RNA, 19 nt, Homo sapiens
gcgguguaauguagacuug

SEQ ID NO: 926863 - RNA, 19 nt, Homo sapiens
acaaggcaaggaaucuuua

SEQ ID NO: 926864 - RNA, 19 nt, Homo sapiens
aaauguaguucagaaggaa

SEQ ID NO: 926865 - RNA, 19 nt, Homo sapiens
ggagugguccucugugaag

SEQ ID NO: 926866 - RNA, 19 nt, Homo sapiens
caaauaaauccaacguagu

SEQ ID NO: 926867 - RNA, 19 nt, Homo sapiens
ccugagaagucauguaggu

SEQ ID NO: 926868 - RNA, 19 nt, Homo sapiens
gccgagugcugucucuaug

SEQ ID NO: 926869 - RNA, 19 nt, Homo sapiens
ucuuugagauccuucgauu

SEQ ID NO: 926870 - RNA, 19 nt, Homo sapiens
gacuauaaguuuucccuuu

SEQ ID NO: 926871 - RNA, 19 nt, Homo sapiens
gcucaugucauucuucagu

SEQ ID NO: 926872 - RNA, 19 nt, Homo sapiens
caaaaugagagaaguauga

SEQ ID NO: 926873 - RNA, 19 nt, Homo sapiens
uacaggagguggcagaaca

SEQ ID NO: 926874 - RNA, 19 nt, Homo sapiens
gcgauacaaguacauaaau

SEQ ID NO: 926875 - RNA, 19 nt, Homo sapiens
agagaucaguuccuugagu

SEQ ID NO: 926876 - RNA, 19 nt, Homo sapiens
cgacuuuggcuacuuaauc

SEQ ID NO: 926877 - RNA, 19 nt, Homo sapiens
guagaucauagccaaagaa

SEQ ID NO: 926878 - RNA, 19 nt, Homo sapiens
cuauugcgguguaauguag

SEQ ID NO: 926879 - RNA, 19 nt, Homo sapiens
gaagagaugaagaaaauuc

SEQ ID NO: 926880 - RNA, 19 nt, Homo sapiens
gcaagacccauuggagaau

SEQ ID NO: 926881 - RNA, 19 nt, Homo sapiens
agaauacccuccaggaacu

SEQ ID NO: 926882 - RNA, 19 nt, Homo sapiens
agaaagcauuaaagcuguu

SEQ ID NO: 926883 - RNA, 19 nt, Homo sapiens
caucagaaaccauauuagg

SEQ ID NO: 926884 - RNA, 19 nt, Homo sapiens
gaaggaacugggagaacau

SEQ ID NO: 926885 - RNA, 19 nt, Homo sapiens
aaugagagaaguaugaaga

SEQ ID NO: 926886 - RNA, 19 nt, Homo sapiens
ggaugaagagaugaagaaa

SEQ ID NO: 926887 - RNA, 19 nt, Homo sapiens
gugaaguaccucaugaaga

SEQ ID NO: 926888 - RNA, 19 nt, Homo sapiens
cggcagaucuucucauauu

SEQ ID NO: 926889 - RNA, 19 nt, Homo sapiens
gaacaucuacaauagcuuu

SEQ ID NO: 926890 - RNA, 19 nt, Homo sapiens
ggaaggagcuaagugcaau

SEQ ID NO: 926891 - RNA, 19 nt, Homo sapiens
ggaacuacuucucccugua

SEQ ID NO: 926892 - RNA, 19 nt, Homo sapiens
ugaagcauguggaguauga

SEQ ID NO: 926893 - RNA, 19 nt, Homo sapiens
cgacaaggcugcacaacag

SEQ ID NO: 926894 - RNA, 19 nt, Homo sapiens
gcucggaugugcagaacaa

SEQ ID NO: 926895 - RNA, 19 nt, Homo sapiens
cgauggagcugcggaacua

SEQ ID NO: 926896 - RNA, 19 nt, Homo sapiens
acgaauuccugaacuguaa

SEQ ID NO: 926897 - RNA, 19 nt, Homo sapiens
gagcugauccggaacaucu

SEQ ID NO: 926898 - RNA, 19 nt, Homo sapiens
gcacaaguacagccugaug

SEQ ID NO: 926899 - RNA, 19 nt, Homo sapiens
uggagaagcugaaccucuu

SEQ ID NO: 926900 - RNA, 19 nt, Homo sapiens
gaaggagcuaagugcaaua

SEQ ID NO: 926901 - RNA, 19 nt, Homo sapiens
ugacauccaggcucaguuu

SEQ ID NO: 926902 - RNA, 19 nt, Homo sapiens
ggaugugcagaacaaguua

SEQ ID NO: 926903 - RNA, 19 nt, Homo sapiens
guauacagacgguacaaug

SEQ ID NO: 926904 - RNA, 19 nt, Homo sapiens
gaacuacuucucccuguac

SEQ ID NO: 926905 - RNA, 19 nt, Homo sapiens
agaacgacgugguggagaa

SEQ ID NO: 926906 - RNA, 19 nt, Homo sapiens
gaaaggccugucuguggaa

SEQ ID NO: 926907 - RNA, 19 nt, Homo sapiens
gagaugcuccugcacaagu

SEQ ID NO: 926908 - RNA, 19 nt, Homo sapiens
ugcggcagaucuucucaua

SEQ ID NO: 926909 - RNA, 19 nt, Homo sapiens
acaaggagaugagcaaggu

SEQ ID NO: 926910 - RNA, 19 nt, Homo sapiens
caggagaacgcgauucaga

SEQ ID NO: 926911 - RNA, 19 nt, Homo sapiens
gacgaauuccugaacugua

SEQ ID NO: 926912 - RNA, 19 nt, Homo sapiens
cgucaacucucagauccaa

SEQ ID NO: 926913 - RNA, 19 nt, Homo sapiens
uaagugcaauagggucuga

SEQ ID NO: 926914 - RNA, 19 nt, Homo sapiens
ggacgaauuccugaacugu

SEQ ID NO: 926915 - RNA, 19 nt, Homo sapiens
gcauguggaguaugagguu

SEQ ID NO: 926916 - RNA, 19 nt, Homo sapiens
acuaaaaccucuuuccaaa

SEQ ID NO: 926917 - RNA, 19 nt, Homo sapiens
agaagggcguguugcacaa

SEQ ID NO: 926918 - RNA, 19 nt, Homo sapiens
cgacaaugcggcagaucuu

SEQ ID NO: 926919 - RNA, 19 nt, Homo sapiens
gggacgaauuccugaacug

SEQ ID NO: 926920 - RNA, 19 nt, Homo sapiens
gggaaggagcuaagugcaa

SEQ ID NO: 926921 - RNA, 19 nt, Homo sapiens
acaaugacuucguggucuu

SEQ ID NO: 926922 - RNA, 19 nt, Homo sapiens
uauacagacgguacaauga

SEQ ID NO: 926923 - RNA, 19 nt, Homo sapiens
agaacgcgauucagacgau

SEQ ID NO: 926924 - RNA, 19 nt, Homo sapiens
caaguccucgguauacaga

SEQ ID NO: 926925 - RNA, 19 nt, Homo sapiens
ggcagaucuucucauauuc

SEQ ID NO: 926926 - RNA, 19 nt, Homo sapiens
cggaacaucuacaauagcu

SEQ ID NO: 926927 - RNA, 19 nt, Homo sapiens
gaacaaguuaaaggaguca

SEQ ID NO: 926928 - RNA, 19 nt, Homo sapiens
acaaguacagccugaugaa

SEQ ID NO: 926929 - RNA, 19 nt, Homo sapiens
uccggaacaucuacaauag

SEQ ID NO: 926930 - RNA, 19 nt, Homo sapiens
aaguacagccugaugaaga

SEQ ID NO: 926931 - RNA, 19 nt, Homo sapiens
gaugugcagaacaaguuaa

SEQ ID NO: 926932 - RNA, 19 nt, Homo sapiens
ugagcaagguguggaacga

SEQ ID NO: 926933 - RNA, 19 nt, Homo sapiens
gcaugagaagggcguguug

SEQ ID NO: 926934 - RNA, 19 nt, Homo sapiens
ccugaagcauguggaguau

SEQ ID NO: 926935 - RNA, 19 nt, Homo sapiens
gcagaucuucucauauucg

SEQ ID NO: 926936 - RNA, 19 nt, Homo sapiens
ugaagcaggcucugaaagg

SEQ ID NO: 926937 - RNA, 19 nt, Homo sapiens
gcuucaaguccucgguaua

SEQ ID NO: 926938 - RNA, 19 nt, Homo sapiens
gugcagaacaaguuaaagg

SEQ ID NO: 926939 - RNA, 19 nt, Homo sapiens
guaagcaggaagagaacga

SEQ ID NO: 926940 - RNA, 19 nt, Homo sapiens
uuaaaggagucagcacagu

SEQ ID NO: 926941 - RNA, 19 nt, Homo sapiens
gcgccuucgucaacucuca

SEQ ID NO: 926942 - RNA, 19 nt, Homo sapiens
cauguggaguaugagguuu

SEQ ID NO: 926943 - RNA, 19 nt, Homo sapiens
ugaagaggcagaugaugag

SEQ ID NO: 926944 - RNA, 19 nt, Homo sapiens
cggaugugcagaacaaguu

SEQ ID NO: 926945 - RNA, 19 nt, Homo sapiens
augaagaggcagaugauga

SEQ ID NO: 926946 - RNA, 19 nt, Homo sapiens
cacaaguacagccugauga

SEQ ID NO: 926947 - RNA, 19 nt, Homo sapiens
gagcugacagggaguucau

SEQ ID NO: 926948 - RNA, 19 nt, Homo sapiens
gaacgacgugguggagaag

SEQ ID NO: 926949 - RNA, 19 nt, Homo sapiens
gauccggaacaucuacaau

SEQ ID NO: 926950 - RNA, 19 nt, Homo sapiens
caagggcacaaggagauga

SEQ ID NO: 926951 - RNA, 19 nt, Homo sapiens
gaugaagaggcagaugaug

SEQ ID NO: 926952 - RNA, 19 nt, Homo sapiens
aggguaagcaggaagagaa

SEQ ID NO: 926953 - RNA, 19 nt, Homo sapiens
agaugcuccugcacaaguu

SEQ ID NO: 926954 - RNA, 19 nt, Homo sapiens
auccggaacaucuacaaua

SEQ ID NO: 926955 - RNA, 19 nt, Homo sapiens
gauguuggguuguuuauua

SEQ ID NO: 926956 - RNA, 19 nt, Homo sapiens
uagguaagcuucuguguaa

SEQ ID NO: 926957 - RNA, 19 nt, Homo sapiens
gaugucgacuugcuaauuu

SEQ ID NO: 926958 - RNA, 19 nt, Homo sapiens
ggugguuacuuauuacuua

SEQ ID NO: 926959 - RNA, 19 nt, Homo sapiens
uaggauaacuuguugcuuu

SEQ ID NO: 926960 - RNA, 19 nt, Homo sapiens
gaauagacguuucccugaa

SEQ ID NO: 926961 - RNA, 19 nt, Homo sapiens
ugaagaagaugaagaagga

SEQ ID NO: 926962 - RNA, 19 nt, Homo sapiens
ccucaucccuucagcaaua

SEQ ID NO: 926963 - RNA, 19 nt, Homo sapiens
gaaacuaacaggaagauau

SEQ ID NO: 926964 - RNA, 19 nt, Homo sapiens
uaucaguggugguuacuua

SEQ ID NO: 926965 - RNA, 19 nt, Homo sapiens
uaacuaggauaacuuguug

SEQ ID NO: 926966 - RNA, 19 nt, Homo sapiens
gauagagcauuccuucuug

SEQ ID NO: 926967 - RNA, 19 nt, Homo sapiens
cgaagaagauauagagaau

SEQ ID NO: 926968 - RNA, 19 nt, Homo sapiens
uaaagcaucuacuugaaga

SEQ ID NO: 926969 - RNA, 19 nt, Homo sapiens
ggcagagacuccaaaguaa

SEQ ID NO: 926970 - RNA, 19 nt, Homo sapiens
ugccagaacuuccaucuaa

SEQ ID NO: 926971 - RNA, 19 nt, Homo sapiens
gaaagaggaauuuguaagu

SEQ ID NO: 926972 - RNA, 19 nt, Homo sapiens
guauuuaaccuuuccagua

SEQ ID NO: 926973 - RNA, 19 nt, Homo sapiens
ccaaugaaaugacuuacau

SEQ ID NO: 926974 - RNA, 19 nt, Homo sapiens
ugucuuagauccucauuau

SEQ ID NO: 926975 - RNA, 19 nt, Homo sapiens
caguggugguuacuuauua

SEQ ID NO: 926976 - RNA, 19 nt, Homo sapiens
gccaccaauugucauauua

SEQ ID NO: 926977 - RNA, 19 nt, Homo sapiens
aaacauagauagugcuagu

SEQ ID NO: 926978 - RNA, 19 nt, Homo sapiens
acgcuuagauggaaaugua

SEQ ID NO: 926979 - RNA, 19 nt, Homo sapiens
uaaacccuaugaagaguaa

SEQ ID NO: 926980 - RNA, 19 nt, Homo sapiens
ucacaaguuugccuuaaug

SEQ ID NO: 926981 - RNA, 19 nt, Homo sapiens
gguguuagacugaaauauu

SEQ ID NO: 926982 - RNA, 19 nt, Homo sapiens
uaaguacucuguggaagaa

SEQ ID NO: 926983 - RNA, 19 nt, Homo sapiens
gagcauuccuucuuguauc

SEQ ID NO: 926984 - RNA, 19 nt, Homo sapiens
aggcagacauuauugguaa

SEQ ID NO: 926985 - RNA, 19 nt, Homo sapiens
gauaauuacccaaguuuca

SEQ ID NO: 926986 - RNA, 19 nt, Homo sapiens
gagauaauuacccaaguuu

SEQ ID NO: 926987 - RNA, 19 nt, Homo sapiens
gucaugauguuagguauuu

SEQ ID NO: 926988 - RNA, 19 nt, Homo sapiens
agaagcaauucacaaguuu

SEQ ID NO: 926989 - RNA, 19 nt, Homo sapiens
aagaagcaauucacaaguu

SEQ ID NO: 926990 - RNA, 19 nt, Homo sapiens
ggaagaagcaauucacaag

SEQ ID NO: 926991 - RNA, 19 nt, Homo sapiens
gauaacuuguugcuuuguu

SEQ ID NO: 926992 - RNA, 19 nt, Homo sapiens
ugagauaauuacccaaguu

SEQ ID NO: 926993 - RNA, 19 nt, Homo sapiens
guauuugaguucacacuau

SEQ ID NO: 926994 - RNA, 19 nt, Homo sapiens
acagaaagaggaauuugua

SEQ ID NO: 926995 - RNA, 19 nt, Homo sapiens
gaucuugcccuccaaugaa

SEQ ID NO: 926996 - RNA, 19 nt, Homo sapiens
uaaagauguuggguuguuu

SEQ ID NO: 926997 - RNA, 19 nt, Homo sapiens
caaguuucauccauguuga

SEQ ID NO: 926998 - RNA, 19 nt, Homo sapiens
uuaaagauguuggguuguu

SEQ ID NO: 926999 - RNA, 19 nt, Homo sapiens
caaguuugccuuaaugaau

SEQ ID NO: 927000 - RNA, 19 nt, Homo sapiens
aggcagagacuccaaagua

SEQ ID NO: 927001 - RNA, 19 nt, Homo sapiens
gaaguucagauuucagaug

SEQ ID NO: 927002 - RNA, 19 nt, Homo sapiens
aaauacagcuccgcaggaa

SEQ ID NO: 927003 - RNA, 19 nt, Homo sapiens
aaagcucacugucaugaug

SEQ ID NO: 927004 - RNA, 19 nt, Homo sapiens
gaagaagcaauucacaagu

SEQ ID NO: 927005 - RNA, 19 nt, Homo sapiens
gccagaacuuccaucuaaa

SEQ ID NO: 927006 - RNA, 19 nt, Homo sapiens
guacgaagaagauauagag

SEQ ID NO: 927007 - RNA, 19 nt, Homo sapiens
uggcagaggcuacuacaaa

SEQ ID NO: 927008 - RNA, 19 nt, Homo sapiens
aaagaggaauuuguaagug

SEQ ID NO: 927009 - RNA, 19 nt, Homo sapiens
gaaaacauccuguguacga

SEQ ID NO: 927010 - RNA, 19 nt, Homo sapiens
gaggaaggauuuuauaaag

SEQ ID NO: 927011 - RNA, 19 nt, Homo sapiens
cgguguauauguuguuaaa

SEQ ID NO: 927012 - RNA, 19 nt, Homo sapiens
guaaugcguugcugguaca

SEQ ID NO: 927013 - RNA, 19 nt, Homo sapiens
gcagagacuccaaaguaau

SEQ ID NO: 927014 - RNA, 19 nt, Homo sapiens
ggaugucgacuugcuaauu

SEQ ID NO: 927015 - RNA, 19 nt, Homo sapiens
guauucuguuucacgcuua

SEQ ID NO: 927016 - RNA, 19 nt, Homo sapiens
gaucguguccugugcugaa

SEQ ID NO: 927017 - RNA, 19 nt, Homo sapiens
aaggaggacuucuggcauu

SEQ ID NO: 927018 - RNA, 19 nt, Homo sapiens
gcaauuucuuaucacuaga

SEQ ID NO: 927019 - RNA, 19 nt, Homo sapiens
caacagaaagaggaauuug

SEQ ID NO: 927020 - RNA, 19 nt, Homo sapiens
gaggacuucuggcauucuu

SEQ ID NO: 927021 - RNA, 19 nt, Homo sapiens
ucagauaacuaggauaacu

SEQ ID NO: 927022 - RNA, 19 nt, Homo sapiens
uaugaagaguaacagugua

SEQ ID NO: 927023 - RNA, 19 nt, Homo sapiens
aaguucagauuucagauga

SEQ ID NO: 927024 - RNA, 19 nt, Homo sapiens
aaaucaagauagagcauuc

SEQ ID NO: 927025 - RNA, 19 nt, Homo sapiens
aaagauguuggguuguuua

SEQ ID NO: 927026 - RNA, 19 nt, Homo sapiens
caaugcuuguuucaaagaa

SEQ ID NO: 927027 - RNA, 19 nt, Homo sapiens
agaaaaggaugucgacuug

SEQ ID NO: 927028 - RNA, 19 nt, Homo sapiens
cagaaagaggaauuuguaa

SEQ ID NO: 927029 - RNA, 19 nt, Homo sapiens
aagaggaauuuguaagugu

SEQ ID NO: 927030 - RNA, 19 nt, Homo sapiens
cuucaccucuucuuacaga

SEQ ID NO: 927031 - RNA, 19 nt, Homo sapiens
guaaaugucacgagaucau

SEQ ID NO: 927032 - RNA, 19 nt, Homo sapiens
guccugugcugaagauguu

SEQ ID NO: 927033 - RNA, 19 nt, Homo sapiens
caaaaucagcuucaacaaa

SEQ ID NO: 927034 - RNA, 19 nt, Homo sapiens
acauagauagugcuaguaa

SEQ ID NO: 927035 - RNA, 19 nt, Homo sapiens
cuucuggcauucuuacauu

SEQ ID NO: 927036 - RNA, 19 nt, Homo sapiens
gaagcaauucacaaguuug

SEQ ID NO: 927037 - RNA, 19 nt, Homo sapiens
gaaaaguccuacagaaugc

SEQ ID NO: 927038 - RNA, 19 nt, Homo sapiens
ggaacaacagaaagaggaa

SEQ ID NO: 927039 - RNA, 19 nt, Homo sapiens
ccaaguuucauccauguug

SEQ ID NO: 927040 - RNA, 19 nt, Homo sapiens
aaugguuucuggagacaaa

SEQ ID NO: 927041 - RNA, 19 nt, Homo sapiens
gacugccucucucagauau

SEQ ID NO: 927042 - RNA, 19 nt, Homo sapiens
gacauugaggcguguguuu

SEQ ID NO: 927043 - RNA, 19 nt, Homo sapiens
gaagauauagagaauucgu

SEQ ID NO: 927044 - RNA, 19 nt, Homo sapiens
cagagacuccaaaguaaug

SEQ ID NO: 927045 - RNA, 19 nt, Homo sapiens
gcaacauuuucuugagaua

SEQ ID NO: 927046 - RNA, 19 nt, Homo sapiens
caaaugguuucuggagaca

SEQ ID NO: 927047 - RNA, 19 nt, Homo sapiens
ucagaaaaguccuacagaa

SEQ ID NO: 927048 - RNA, 19 nt, Homo sapiens
guucacacuauuucuguuu

SEQ ID NO: 927049 - RNA, 19 nt, Homo sapiens
ucaaagaaccaacagaaaa

SEQ ID NO: 927050 - RNA, 19 nt, Homo sapiens
gauggaaauguaucuuaug

SEQ ID NO: 927051 - RNA, 19 nt, Homo sapiens
acaauacuauccuuuacag

SEQ ID NO: 927052 - RNA, 19 nt, Homo sapiens
uagcagccuucaccucuuc

SEQ ID NO: 927053 - RNA, 19 nt, Homo sapiens
guacaacugccagaacuuc

SEQ ID NO: 927054 - RNA, 19 nt, Homo sapiens
ugcaauuucuuaucacuag

SEQ ID NO: 927055 - RNA, 19 nt, Homo sapiens
gaagaaagcagauguguca

SEQ ID NO: 927056 - RNA, 19 nt, Homo sapiens
gaaagcagaugugucagaa

SEQ ID NO: 927057 - RNA, 19 nt, Homo sapiens
ggaucaagaugcuagagua

SEQ ID NO: 927058 - RNA, 19 nt, Homo sapiens
gaaagggccaaauaucaua

SEQ ID NO: 927059 - RNA, 19 nt, Homo sapiens
caauaaacccuuuggagua

SEQ ID NO: 927060 - RNA, 19 nt, Homo sapiens
ggaaagccgucgggucaaa

SEQ ID NO: 927061 - RNA, 19 nt, Homo sapiens
ggaaagggcaggagaaucu

SEQ ID NO: 927062 - RNA, 19 nt, Homo sapiens
aauaaacccuuuggaguaa

SEQ ID NO: 927063 - RNA, 19 nt, Homo sapiens
ggccaaauaucauaaacug

SEQ ID NO: 927064 - RNA, 19 nt, Homo sapiens
gggagucgcugcuggugaa

SEQ ID NO: 927065 - RNA, 19 nt, Homo sapiens
ggaaagggccaaauaucau

SEQ ID NO: 927066 - RNA, 19 nt, Homo sapiens
gcaggaaagggccaaauau

SEQ ID NO: 927067 - RNA, 19 nt, Homo sapiens
gcgacaccgucuuguauga

SEQ ID NO: 927068 - RNA, 19 nt, Homo sapiens
caacccagaucaaccaagu

SEQ ID NO: 927069 - RNA, 19 nt, Homo sapiens
cagcauggaucccuaugau

SEQ ID NO: 927070 - RNA, 19 nt, Homo sapiens
ggaagacgaggaugaggaa

SEQ ID NO: 927071 - RNA, 19 nt, Homo sapiens
gaacgcggcaggcaaagau

SEQ ID NO: 927072 - RNA, 19 nt, Homo sapiens
cagaacaagucuccaaugg

SEQ ID NO: 927073 - RNA, 19 nt, Homo sapiens
caacggcgcauuccugaug

SEQ ID NO: 927074 - RNA, 19 nt, Homo sapiens
gaggugggcuacacagaca

SEQ ID NO: 927075 - RNA, 19 nt, Homo sapiens
gaccucagcugcgaucugu

SEQ ID NO: 927076 - RNA, 19 nt, Homo sapiens
ggaagacgacucugaggau

SEQ ID NO: 927077 - RNA, 19 nt, Homo sapiens
gugaaaacuugucucaaua

SEQ ID NO: 927078 - RNA, 19 nt, Homo sapiens
gcagaugugucagaacaag

SEQ ID NO: 927079 - RNA, 19 nt, Homo sapiens
gaggaacgcggcaggcaaa

SEQ ID NO: 927080 - RNA, 19 nt, Homo sapiens
aagcagaugugucagaaca

SEQ ID NO: 927081 - RNA, 19 nt, Homo sapiens
aaacuugucucaauaaacc

SEQ ID NO: 927082 - RNA, 19 nt, Homo sapiens
gugugaagcucccauccaa

SEQ ID NO: 927083 - RNA, 19 nt, Homo sapiens
ggccagggauugcccaaca

SEQ ID NO: 927084 - RNA, 19 nt, Homo sapiens
ggccaaggucuucguauga

SEQ ID NO: 927085 - RNA, 19 nt, Homo sapiens
aggcaaagauggcaaagag

SEQ ID NO: 927086 - RNA, 19 nt, Homo sapiens
gaucaagaugcuagaguau

SEQ ID NO: 927087 - RNA, 19 nt, Homo sapiens
gguagagacggcuuucuug

SEQ ID NO: 927088 - RNA, 19 nt, Homo sapiens
gaaagggcaggagaaucua

SEQ ID NO: 927089 - RNA, 19 nt, Homo sapiens
ucaagaugcuagaguaugc

SEQ ID NO: 927090 - RNA, 19 nt, Homo sapiens
ugaacucccuguauaucug

SEQ ID NO: 927091 - RNA, 19 nt, Homo sapiens
gagcugugcugggagaaag

SEQ ID NO: 927092 - RNA, 19 nt, Homo sapiens
gacagccgcuccugguauc

SEQ ID NO: 927093 - RNA, 19 nt, Homo sapiens
aaacgugcgugcaggagau

SEQ ID NO: 927094 - RNA, 19 nt, Homo sapiens
gaacugcgaggacgaagac

SEQ ID NO: 927095 - RNA, 19 nt, Homo sapiens
gagaagaaagcagaugugu

SEQ ID NO: 927096 - RNA, 19 nt, Homo sapiens
gccaaggucuucguaugau

SEQ ID NO: 927097 - RNA, 19 nt, Homo sapiens
guaagccggugcacuccau

SEQ ID NO: 927098 - RNA, 19 nt, Homo sapiens
ggagaagaaagcagaugug

SEQ ID NO: 927099 - RNA, 19 nt, Homo sapiens
ccaaggucuucguaugaug

SEQ ID NO: 927100 - RNA, 19 nt, Homo sapiens
caaaccagccucucaccau

SEQ ID NO: 927101 - RNA, 19 nt, Homo sapiens
cugaggaugcuaucaauga

SEQ ID NO: 927102 - RNA, 19 nt, Homo sapiens
cgaaauggaagacgaggau

SEQ ID NO: 927103 - RNA, 19 nt, Homo sapiens
gacaccgucuuguaugaca

SEQ ID NO: 927104 - RNA, 19 nt, Homo sapiens
gaacucccuguauaucugu

SEQ ID NO: 927105 - RNA, 19 nt, Homo sapiens
guagagacggcuuucuugu

SEQ ID NO: 927106 - RNA, 19 nt, Homo sapiens
ggguagagacggcuuucuu

SEQ ID NO: 927107 - RNA, 19 nt, Homo sapiens
gaggaaagggcaggagaau

SEQ ID NO: 927108 - RNA, 19 nt, Homo sapiens
uggaaccuauacaugcuuu

SEQ ID NO: 927109 - RNA, 19 nt, Homo sapiens
gggagaagaaagcagaugu

SEQ ID NO: 927110 - RNA, 19 nt, Homo sapiens
ucuggagccuggacaacaa

SEQ ID NO: 927111 - RNA, 19 nt, Homo sapiens
aggaugcuaucaaugaguu

SEQ ID NO: 927112 - RNA, 19 nt, Homo sapiens
aggaaagggccaaauauca

SEQ ID NO: 927113 - RNA, 19 nt, Homo sapiens
ccacccgcauuaucacugu

SEQ ID NO: 927114 - RNA, 19 nt, Homo sapiens
uggccaaggucuucguaug

SEQ ID NO: 927115 - RNA, 19 nt, Homo sapiens
caggaaagggccaaauauc

SEQ ID NO: 927116 - RNA, 19 nt, Homo sapiens
gggcaggagaaucuaaaga

SEQ ID NO: 927117 - RNA, 19 nt, Homo sapiens
ggaagaggugggcuacaca

SEQ ID NO: 927118 - RNA, 19 nt, Homo sapiens
ucuccacucuuucccucua

SEQ ID NO: 927119 - RNA, 19 nt, Homo sapiens
ugacagccgcuccugguau

SEQ ID NO: 927120 - RNA, 19 nt, Homo sapiens
ccacucuuucccucuauuu

SEQ ID NO: 927121 - RNA, 19 nt, Homo sapiens
cucccugucuccacucuuu

SEQ ID NO: 927122 - RNA, 19 nt, Homo sapiens
aaagggccaaauaucauaa

SEQ ID NO: 927123 - RNA, 19 nt, Homo sapiens
aggagcagauaaagaggaa

SEQ ID NO: 927124 - RNA, 19 nt, Homo sapiens
acagaucgaggagcagaua

SEQ ID NO: 927125 - RNA, 19 nt, Homo sapiens
ugugaaaacuugucucaau

SEQ ID NO: 927126 - RNA, 19 nt, Homo sapiens
ggauugcccaacacuccua

SEQ ID NO: 927127 - RNA, 19 nt, Homo sapiens
gcuagauguggaaccuaua

SEQ ID NO: 927128 - RNA, 19 nt, Homo sapiens
agaaagcagaugugucaga

SEQ ID NO: 927129 - RNA, 19 nt, Homo sapiens
cuguauaaauaacgggauu

SEQ ID NO: 927130 - RNA, 19 nt, Homo sapiens
ccccugaacucccuguaua

SEQ ID NO: 927131 - RNA, 19 nt, Homo sapiens
gcuagaguaugcgcugaag

SEQ ID NO: 927132 - RNA, 19 nt, Homo sapiens
uggcugaccugcgggaugu

SEQ ID NO: 927133 - RNA, 19 nt, Homo sapiens
aaauggaagacgaggauga

SEQ ID NO: 927134 - RNA, 19 nt, Homo sapiens
ccacugcuuuccagacacu

SEQ ID NO: 927135 - RNA, 19 nt, Homo sapiens
ccuggccucugucuguuug

SEQ ID NO: 927136 - RNA, 19 nt, Homo sapiens
ucagaacaagucuccaaug

SEQ ID NO: 927137 - RNA, 19 nt, Homo sapiens
gggcagcaacagugaauac

SEQ ID NO: 927138 - RNA, 19 nt, Homo sapiens
cgcuagauguggaaccuau

SEQ ID NO: 927139 - RNA, 19 nt, Homo sapiens
ugaggaugcuaucaaugag

SEQ ID NO: 927140 - RNA, 19 nt, Homo sapiens
acaagaagcagcgugugaa

SEQ ID NO: 927141 - RNA, 19 nt, Homo sapiens
ggaacgcggcaggcaaaga

SEQ ID NO: 927142 - RNA, 19 nt, Homo sapiens
gaucgaggagcagauaaag

SEQ ID NO: 927143 - RNA, 19 nt, Homo sapiens
gcaguggagccgagugaag

SEQ ID NO: 927144 - RNA, 19 nt, Homo sapiens
cucuuucccucuauuuauu

SEQ ID NO: 927145 - RNA, 19 nt, Homo sapiens
cauccaaaccagccucuca

SEQ ID NO: 927146 - RNA, 19 nt, Homo sapiens
caagaagcagcgugugaag

SEQ ID NO: 927147 - RNA, 19 nt, Homo sapiens
uggacaaucggacagguaa

SEQ ID NO: 927148 - RNA, 19 nt, Homo sapiens
uggcgacaccgucuuguau

SEQ ID NO: 927149 - RNA, 19 nt, Homo sapiens
ggcagcuucuccgacagua

SEQ ID NO: 927150 - RNA, 19 nt, Homo sapiens
aaagggcaggagaaucuaa

SEQ ID NO: 927151 - RNA, 19 nt, Homo sapiens
ucgaggagcagauaaagag

SEQ ID NO: 927152 - RNA, 19 nt, Homo sapiens
uagagacggcuuucuugug

SEQ ID NO: 927153 - RNA, 19 nt, Homo sapiens
uagaguaugcgcugaagca

SEQ ID NO: 927154 - RNA, 19 nt, Homo sapiens
caaguggugagucauccaa

SEQ ID NO: 927155 - RNA, 19 nt, Homo sapiens
gaacaggaacauucaaaua

SEQ ID NO: 927156 - RNA, 19 nt, Homo sapiens
gagcaaagccagaauauau

SEQ ID NO: 927157 - RNA, 19 nt, Homo sapiens
ggaaauggauacaguuaug

SEQ ID NO: 927158 - RNA, 19 nt, Homo sapiens
ggcaagagcucugugauaa

SEQ ID NO: 927159 - RNA, 19 nt, Homo sapiens
gaaacgaccaaacuuauuu

SEQ ID NO: 927160 - RNA, 19 nt, Homo sapiens
aaacuuaccugaagaagga

SEQ ID NO: 927161 - RNA, 19 nt, Homo sapiens
ggagaaugcugaggacuuu

SEQ ID NO: 927162 - RNA, 19 nt, Homo sapiens
aaacaaaggucuggcagua

SEQ ID NO: 927163 - RNA, 19 nt, Homo sapiens
gaaaugaagcucaagaaga

SEQ ID NO: 927164 - RNA, 19 nt, Homo sapiens
gaucgaauccggccucaua

SEQ ID NO: 927165 - RNA, 19 nt, Homo sapiens
acaaaggucuggcaguaua

SEQ ID NO: 927166 - RNA, 19 nt, Homo sapiens
guaagaugguccucaauga

SEQ ID NO: 927167 - RNA, 19 nt, Homo sapiens
gaguagagccaaauauuaa

SEQ ID NO: 927168 - RNA, 19 nt, Homo sapiens
gaacagucgugguaaaaua

SEQ ID NO: 927169 - RNA, 19 nt, Homo sapiens
gggcaaggaucgugauuug

SEQ ID NO: 927170 - RNA, 19 nt, Homo sapiens
caaagcaaguuaccaaugu

SEQ ID NO: 927171 - RNA, 19 nt, Homo sapiens
ccagggcgcuuacaucaaa

SEQ ID NO: 927172 - RNA, 19 nt, Homo sapiens
gaggaaacgaccaaacuua

SEQ ID NO: 927173 - RNA, 19 nt, Homo sapiens
ggaagaagauguagaugac

SEQ ID NO: 927174 - RNA, 19 nt, Homo sapiens
caagagcucugugauaaau

SEQ ID NO: 927175 - RNA, 19 nt, Homo sapiens
caaugucucuucuccauga

SEQ ID NO: 927176 - RNA, 19 nt, Homo sapiens
caccaaagccguuauuaaa

SEQ ID NO: 927177 - RNA, 19 nt, Homo sapiens
agacagacauugugcuaaa

SEQ ID NO: 927178 - RNA, 19 nt, Homo sapiens
augagaagauugccaaaua

SEQ ID NO: 927179 - RNA, 19 nt, Homo sapiens
gcugaggacuuucuugaga

SEQ ID NO: 927180 - RNA, 19 nt, Homo sapiens
uuaaagcacuggaugagaa

SEQ ID NO: 927181 - RNA, 19 nt, Homo sapiens
gcugaaauguccacugaga

SEQ ID NO: 927182 - RNA, 19 nt, Homo sapiens
gaggaaauggauacaguua

SEQ ID NO: 927183 - RNA, 19 nt, Homo sapiens
caacguggcucccauugca

SEQ ID NO: 927184 - RNA, 19 nt, Homo sapiens
ggugugcgcuacuaugaaa

SEQ ID NO: 927185 - RNA, 19 nt, Homo sapiens
ggucagaauccaucauuaa

SEQ ID NO: 927186 - RNA, 19 nt, Homo sapiens
ggaaacgaccaaacuuauu

SEQ ID NO: 927187 - RNA, 19 nt, Homo sapiens
cagaauccaucauuaagga

SEQ ID NO: 927188 - RNA, 19 nt, Homo sapiens
ugacagagcaccuuccaaa

SEQ ID NO: 927189 - RNA, 19 nt, Homo sapiens
acacagagaugcagcagau

SEQ ID NO: 927190 - RNA, 19 nt, Homo sapiens
ccacauuggugcuguacuu

SEQ ID NO: 927191 - RNA, 19 nt, Homo sapiens
gcaagaguagagccaaaua

SEQ ID NO: 927192 - RNA, 19 nt, Homo sapiens
aaaugaagcucaagaagag

SEQ ID NO: 927193 - RNA, 19 nt, Homo sapiens
ugagaagauugccaaauau

SEQ ID NO: 927194 - RNA, 19 nt, Homo sapiens
caaggaucgugauuuggua

SEQ ID NO: 927195 - RNA, 19 nt, Homo sapiens
gcacauucuugauacugaa

SEQ ID NO: 927196 - RNA, 19 nt, Homo sapiens
aaaaggaguuguucaagua

SEQ ID NO: 927197 - RNA, 19 nt, Homo sapiens
caagugauaugcagucucu

SEQ ID NO: 927198 - RNA, 19 nt, Homo sapiens
gauuaagcagucaucauua

SEQ ID NO: 927199 - RNA, 19 nt, Homo sapiens
agacaaagccaaagccaaa

SEQ ID NO: 927200 - RNA, 19 nt, Homo sapiens
gaaaguugcacacugacaa

SEQ ID NO: 927201 - RNA, 19 nt, Homo sapiens
ggugucagaucuugaggaa

SEQ ID NO: 927202 - RNA, 19 nt, Homo sapiens
ggacugggaaguuacuaaa

SEQ ID NO: 927203 - RNA, 19 nt, Homo sapiens
cgucggauauuccugauug

SEQ ID NO: 927204 - RNA, 19 nt, Homo sapiens
gcucugugauaaauacauu

SEQ ID NO: 927205 - RNA, 19 nt, Homo sapiens
gcaaagcaaguuaccaaug

SEQ ID NO: 927206 - RNA, 19 nt, Homo sapiens
agaguagagccaaauauua

SEQ ID NO: 927207 - RNA, 19 nt, Homo sapiens
gaaggauccauacaaaguu

SEQ ID NO: 927208 - RNA, 19 nt, Homo sapiens
gacaaaagcaguaauguuu

SEQ ID NO: 927209 - RNA, 19 nt, Homo sapiens
gcaaagccagaauauauca

SEQ ID NO: 927210 - RNA, 19 nt, Homo sapiens
gggucagaauccaucauua

SEQ ID NO: 927211 - RNA, 19 nt, Homo sapiens
gcaagagcucugugauaaa

SEQ ID NO: 927212 - RNA, 19 nt, Homo sapiens
gaucaguguuggguucauu

SEQ ID NO: 927213 - RNA, 19 nt, Homo sapiens
cacagaaacugcaggugaa

SEQ ID NO: 927214 - RNA, 19 nt, Homo sapiens
gagaaaugaagcucaagaa

SEQ ID NO: 927215 - RNA, 19 nt, Homo sapiens
gaaauggauacaguuauga

SEQ ID NO: 927216 - RNA, 19 nt, Homo sapiens
ccaaagccguuauuaaagc

SEQ ID NO: 927217 - RNA, 19 nt, Homo sapiens
ggaacaggagcaacaaaga

SEQ ID NO: 927218 - RNA, 19 nt, Homo sapiens
ggaagaaacagaagagaac

SEQ ID NO: 927219 - RNA, 19 nt, Homo sapiens
gccagaauauaucagcaaa

SEQ ID NO: 927220 - RNA, 19 nt, Homo sapiens
gaacaggagcaacaaagag

SEQ ID NO: 927221 - RNA, 19 nt, Homo sapiens
gcaaggaucgugauuuggu

SEQ ID NO: 927222 - RNA, 19 nt, Homo sapiens
ugccaaauaucagaaguuu

SEQ ID NO: 927223 - RNA, 19 nt, Homo sapiens
caacguggugccucaguuu

SEQ ID NO: 927224 - RNA, 19 nt, Homo sapiens
gaacggaggcgagcaguac

SEQ ID NO: 927225 - RNA, 19 nt, Homo sapiens
aaacagaagagaacaguca

SEQ ID NO: 927226 - RNA, 19 nt, Homo sapiens
caggaacagucgugguaaa

SEQ ID NO: 927227 - RNA, 19 nt, Homo sapiens
gaagaggaacaggaacauu

SEQ ID NO: 927228 - RNA, 19 nt, Homo sapiens
cugaauauguauaggcaaa

SEQ ID NO: 927229 - RNA, 19 nt, Homo sapiens
guugcacacugacaagaaa

SEQ ID NO: 927230 - RNA, 19 nt, Homo sapiens
cauugaaacuuaccugaag

SEQ ID NO: 927231 - RNA, 19 nt, Homo sapiens
aagcagucaucauuacaaa

SEQ ID NO: 927232 - RNA, 19 nt, Homo sapiens
ggaacaggaacauucaaau

SEQ ID NO: 927233 - RNA, 19 nt, Homo sapiens
gguaagaugguccucaaug

SEQ ID NO: 927234 - RNA, 19 nt, Homo sapiens
acaccaaagccguuauuaa

SEQ ID NO: 927235 - RNA, 19 nt, Homo sapiens
gggaggaagucacagaaac

SEQ ID NO: 927236 - RNA, 19 nt, Homo sapiens
ugaaggauccauacaaagu

SEQ ID NO: 927237 - RNA, 19 nt, Homo sapiens
gcaguaauguuuaaaaggu

SEQ ID NO: 927238 - RNA, 19 nt, Homo sapiens
caggaacauucaaauaaag

SEQ ID NO: 927239 - RNA, 19 nt, Homo sapiens
caaagccguuauuaaagca

SEQ ID NO: 927240 - RNA, 19 nt, Homo sapiens
aaacuacauuuggcccuaa

SEQ ID NO: 927241 - RNA, 19 nt, Homo sapiens
ugaaacacacaacgugaaa

SEQ ID NO: 927242 - RNA, 19 nt, Homo sapiens
gagaagauugccaaauauc

SEQ ID NO: 927243 - RNA, 19 nt, Homo sapiens
uuggaaaguugcacacuga

SEQ ID NO: 927244 - RNA, 19 nt, Homo sapiens
gagcauucauucagcuucu

SEQ ID NO: 927245 - RNA, 19 nt, Homo sapiens
aauccggccucauaacuug

SEQ ID NO: 927246 - RNA, 19 nt, Homo sapiens
gaauccggccucauaacuu

SEQ ID NO: 927247 - RNA, 19 nt, Homo sapiens
gaagauugccaaauaucag

SEQ ID NO: 927248 - RNA, 19 nt, Homo sapiens
cgagacagacauugugcua

SEQ ID NO: 927249 - RNA, 19 nt, Homo sapiens
gcaagggagcauucauuca

SEQ ID NO: 927250 - RNA, 19 nt, Homo sapiens
gcucaagaagagaucuaua

SEQ ID NO: 927251 - RNA, 19 nt, Homo sapiens
caagaguagagccaaauau

SEQ ID NO: 927252 - RNA, 19 nt, Homo sapiens
cggcagaacuuugguaaaa

SEQ ID NO: 927253 - RNA, 19 nt, Homo sapiens
cauuggugcuguacuugaa

SEQ ID NO: 927254 - RNA, 19 nt, Homo sapiens
acaagaaacagaucagugu

SEQ ID NO: 927255 - RNA, 19 nt, Homo sapiens
ggagauagcuuugcccaua

SEQ ID NO: 927256 - RNA, 19 nt, Homo sapiens
ugaauuaucuccuggguua

SEQ ID NO: 927257 - RNA, 19 nt, Homo sapiens
ggagaagccuuuccaguga

SEQ ID NO: 927258 - RNA, 19 nt, Homo sapiens
ggaaugggcuucugguguu

SEQ ID NO: 927259 - RNA, 19 nt, Homo sapiens
gaucagcagucuccucaaa

SEQ ID NO: 927260 - RNA, 19 nt, Homo sapiens
uauggaaaguugucaguaa

SEQ ID NO: 927261 - RNA, 19 nt, Homo sapiens
gauacugucugcugugguu

SEQ ID NO: 927262 - RNA, 19 nt, Homo sapiens
ggaauccgguuauguugau

SEQ ID NO: 927263 - RNA, 19 nt, Homo sapiens
gaacacauggugauaguca

SEQ ID NO: 927264 - RNA, 19 nt, Homo sapiens
cgagaaauauggcaucauc

SEQ ID NO: 927265 - RNA, 19 nt, Homo sapiens
gagauagcuuugcccauau

SEQ ID NO: 927266 - RNA, 19 nt, Homo sapiens
ccacgaggcugcagacucu

SEQ ID NO: 927267 - RNA, 19 nt, Homo sapiens
gaaccuggucuccuacuug

SEQ ID NO: 927268 - RNA, 19 nt, Homo sapiens
ccacuuugguuugaauuau

SEQ ID NO: 927269 - RNA, 19 nt, Homo sapiens
gcaaucaccggaccacaga

SEQ ID NO: 927270 - RNA, 19 nt, Homo sapiens
ccgguuauguugauuucua

SEQ ID NO: 927271 - RNA, 19 nt, Homo sapiens
ucagcagucuccucaaaga

SEQ ID NO: 927272 - RNA, 19 nt, Homo sapiens
gggcuaagguggccauguc

SEQ ID NO: 927273 - RNA, 19 nt, Homo sapiens
gaagaacacauggugauag

SEQ ID NO: 927274 - RNA, 19 nt, Homo sapiens
cgcaaccucuucauuggua

SEQ ID NO: 927275 - RNA, 19 nt, Homo sapiens
gcuagaagaagaacacaug

SEQ ID NO: 927276 - RNA, 19 nt, Homo sapiens
gcagugggcagcagucaga

SEQ ID NO: 927277 - RNA, 19 nt, Homo sapiens
cugcugugguucuguauuu

SEQ ID NO: 927278 - RNA, 19 nt, Homo sapiens
gagaagggaauccgguuau

SEQ ID NO: 927279 - RNA, 19 nt, Homo sapiens
agaguacgcucagacacua

SEQ ID NO: 927280 - RNA, 19 nt, Homo sapiens
ccaaggcccugggaagaga

SEQ ID NO: 927281 - RNA, 19 nt, Homo sapiens
ggaaccuggucuccuacuu

SEQ ID NO: 927282 - RNA, 19 nt, Homo sapiens
ccgaggauuugaccgcuuu

SEQ ID NO: 927283 - RNA, 19 nt, Homo sapiens
gaagggaauccgguuaugu

SEQ ID NO: 927284 - RNA, 19 nt, Homo sapiens
gggagcagucggcgaagua

SEQ ID NO: 927285 - RNA, 19 nt, Homo sapiens
gaaugggcuucugguguug

SEQ ID NO: 927286 - RNA, 19 nt, Homo sapiens
gcaaccucuucauugguaa

SEQ ID NO: 927287 - RNA, 19 nt, Homo sapiens
guugauuucuaguguacaa

SEQ ID NO: 927288 - RNA, 19 nt, Homo sapiens
ggacauugggcaagcuaga

SEQ ID NO: 927289 - RNA, 19 nt, Homo sapiens
agaggcggcuucucaggaa

SEQ ID NO: 927290 - RNA, 19 nt, Homo sapiens
ucgaggagguggucaucaa

SEQ ID NO: 927291 - RNA, 19 nt, Homo sapiens
ugagaagggaauccgguua

SEQ ID NO: 927292 - RNA, 19 nt, Homo sapiens
gaucacgucaaaggagaua

SEQ ID NO: 927293 - RNA, 19 nt, Homo sapiens
cggcuaugcgguccucuua

SEQ ID NO: 927294 - RNA, 19 nt, Homo sapiens
gaggaacggaggaguagga

SEQ ID NO: 927295 - RNA, 19 nt, Homo sapiens
gcagauggagaccgugguu

SEQ ID NO: 927296 - RNA, 19 nt, Homo sapiens
aagaacacauggugauagu

SEQ ID NO: 927297 - RNA, 19 nt, Homo sapiens
ugucugcugugguucugua

SEQ ID NO: 927298 - RNA, 19 nt, Homo sapiens
gggaauccgguuauguuga

SEQ ID NO: 927299 - RNA, 19 nt, Homo sapiens
ggugauagucaucgucaga

SEQ ID NO: 927300 - RNA, 19 nt, Homo sapiens
aaccuggucuccuacuuga

SEQ ID NO: 927301 - RNA, 19 nt, Homo sapiens
ggacacacgacgcaucaag

SEQ ID NO: 927302 - RNA, 19 nt, Homo sapiens
gaggacacacgacgcauca

SEQ ID NO: 927303 - RNA, 19 nt, Homo sapiens
gcaacucccucagcaacag

SEQ ID NO: 927304 - RNA, 19 nt, Homo sapiens
agauagcuuugcccauauu

SEQ ID NO: 927305 - RNA, 19 nt, Homo sapiens
ccuaugccuuccucaaguu

SEQ ID NO: 927306 - RNA, 19 nt, Homo sapiens
gaccaacuguauggaaagu

SEQ ID NO: 927307 - RNA, 19 nt, Homo sapiens
ugggcaagcuagaagaaga

SEQ ID NO: 927308 - RNA, 19 nt, Homo sapiens
auggaaaguugucaguaaa

SEQ ID NO: 927309 - RNA, 19 nt, Homo sapiens
agaagaacacauggugaua

SEQ ID NO: 927310 - RNA, 19 nt, Homo sapiens
gggaagaaggcaagagaca

SEQ ID NO: 927311 - RNA, 19 nt, Homo sapiens
ucucuacccuaccacuuug

SEQ ID NO: 927312 - RNA, 19 nt, Homo sapiens
gcuuugcccauauucagua

SEQ ID NO: 927313 - RNA, 19 nt, Homo sapiens
gcauucggaccauugauca

SEQ ID NO: 927314 - RNA, 19 nt, Homo sapiens
caagguagagcccguguac

SEQ ID NO: 927315 - RNA, 19 nt, Homo sapiens
gaggagguggucaucaaga

SEQ ID NO: 927316 - RNA, 19 nt, Homo sapiens
ugauagucaucgucagaga

SEQ ID NO: 927317 - RNA, 19 nt, Homo sapiens
gggcaagcuagaagaagaa

SEQ ID NO: 927318 - RNA, 19 nt, Homo sapiens
uaugaggaacggaggagua

SEQ ID NO: 927319 - RNA, 19 nt, Homo sapiens
cggaaacggagaagccuuu

SEQ ID NO: 927320 - RNA, 19 nt, Homo sapiens
gccuaugccuuccucaagu

SEQ ID NO: 927321 - RNA, 19 nt, Homo sapiens
cacuacagcuggguuggaa

SEQ ID NO: 927322 - RNA, 19 nt, Homo sapiens
aagggaauccgguuauguu

SEQ ID NO: 927323 - RNA, 19 nt, Homo sapiens
ucuccuacuugaaacagaa

SEQ ID NO: 927324 - RNA, 19 nt, Homo sapiens
ccuggucuccuacuugaaa

SEQ ID NO: 927325 - RNA, 19 nt, Homo sapiens
gccacucccugugcauuau

SEQ ID NO: 927326 - RNA, 19 nt, Homo sapiens
ggagcauucggaccauuga

SEQ ID NO: 927327 - RNA, 19 nt, Homo sapiens
guauggaaaguugucagua

SEQ ID NO: 927328 - RNA, 19 nt, Homo sapiens
uugaccaacuguauggaaa

SEQ ID NO: 927329 - RNA, 19 nt, Homo sapiens
agaagggaauccgguuaug

SEQ ID NO: 927330 - RNA, 19 nt, Homo sapiens
gcucuggcccgaggauuug

SEQ ID NO: 927331 - RNA, 19 nt, Homo sapiens
agaaauauggcaucaucga

SEQ ID NO: 927332 - RNA, 19 nt, Homo sapiens
ccucaaagaccacacuucu

SEQ ID NO: 927333 - RNA, 19 nt, Homo sapiens
acacggaggcuaccaguac

SEQ ID NO: 927334 - RNA, 19 nt, Homo sapiens
gagaggcggaaacggagaa

SEQ ID NO: 927335 - RNA, 19 nt, Homo sapiens
gauuucuaguguacaagau

SEQ ID NO: 927336 - RNA, 19 nt, Homo sapiens
ccagugaagggaccaagga

SEQ ID NO: 927337 - RNA, 19 nt, Homo sapiens
gggagcauucggaccauug

SEQ ID NO: 927338 - RNA, 19 nt, Homo sapiens
gaggcuaccaguacaagca

SEQ ID NO: 927339 - RNA, 19 nt, Homo sapiens
uaaacgaugagaagggaau

SEQ ID NO: 927340 - RNA, 19 nt, Homo sapiens
cugcagaggcggcuucuca

SEQ ID NO: 927341 - RNA, 19 nt, Homo sapiens
gacauugggcaagcuagaa

SEQ ID NO: 927342 - RNA, 19 nt, Homo sapiens
guaccuccagucugcacua

SEQ ID NO: 927343 - RNA, 19 nt, Homo sapiens
cgccacucccugugcauua

SEQ ID NO: 927344 - RNA, 19 nt, Homo sapiens
uaaaaccuuugacgagaga

SEQ ID NO: 927345 - RNA, 19 nt, Homo sapiens
aagaagaacacauggugau

SEQ ID NO: 927346 - RNA, 19 nt, Homo sapiens
ccuccagucugcacuaagg

SEQ ID NO: 927347 - RNA, 19 nt, Homo sapiens
ccacgucuaugcauauccu

SEQ ID NO: 927348 - RNA, 19 nt, Homo sapiens
cuacagcuggguuggaaug

SEQ ID NO: 927349 - RNA, 19 nt, Homo sapiens
gcagcaacucccucagcaa

SEQ ID NO: 927350 - RNA, 19 nt, Homo sapiens
ggacuacuacgggcuguac

SEQ ID NO: 927351 - RNA, 19 nt, Homo sapiens
agauggagaccgugguuug

SEQ ID NO: 927352 - RNA, 19 nt, Homo sapiens
acgcgcaaccucuucauug

SEQ ID NO: 927353 - RNA, 19 nt, Homo sapiens
agucugcacuaaggacauu

SEQ ID NO: 927354 - RNA, 19 nt, Homo sapiens
ccaaggaguccagcagcaa

SEQ ID NO: 927355 - RNA, 19 nt, Homo sapiens
ggacuaagcgcuucuaauu

SEQ ID NO: 927356 - RNA, 19 nt, Homo sapiens
gaugaugccuuggacauua

SEQ ID NO: 927357 - RNA, 19 nt, Homo sapiens
acuaagcgcuucuaauuua

SEQ ID NO: 927358 - RNA, 19 nt, Homo sapiens
gagaugacccguugaauuu

SEQ ID NO: 927359 - RNA, 19 nt, Homo sapiens
ucagauaagucaaccaauu

SEQ ID NO: 927360 - RNA, 19 nt, Homo sapiens
gcacaauugucaaaccaaa

SEQ ID NO: 927361 - RNA, 19 nt, Homo sapiens
gaaagcgacaguaauauug

SEQ ID NO: 927362 - RNA, 19 nt, Homo sapiens
gucacuaucugcuguguua

SEQ ID NO: 927363 - RNA, 19 nt, Homo sapiens
ggaaagcgacaguaauauu

SEQ ID NO: 927364 - RNA, 19 nt, Homo sapiens
gaauguaggucacuaucug

SEQ ID NO: 927365 - RNA, 19 nt, Homo sapiens
ggacagagacguuguuuac

SEQ ID NO: 927366 - RNA, 19 nt, Homo sapiens
caacaacagccgacaauga

SEQ ID NO: 927367 - RNA, 19 nt, Homo sapiens
gagccacguucaaugauuu

SEQ ID NO: 927368 - RNA, 19 nt, Homo sapiens
gaucgagguuauuggcaua

SEQ ID NO: 927369 - RNA, 19 nt, Homo sapiens
gguaagcaaugcguuguaa

SEQ ID NO: 927370 - RNA, 19 nt, Homo sapiens
uaguugagaugcuugauaa

SEQ ID NO: 927371 - RNA, 19 nt, Homo sapiens
ggcaauggcuugugauaag

SEQ ID NO: 927372 - RNA, 19 nt, Homo sapiens
gcagucaaaugguaagcaa

SEQ ID NO: 927373 - RNA, 19 nt, Homo sapiens
ccauaaauuucgacaaugu

SEQ ID NO: 927374 - RNA, 19 nt, Homo sapiens
gggugcgacuugauaauaa

SEQ ID NO: 927375 - RNA, 19 nt, Homo sapiens
ggucuuaucaucacuuuga

SEQ ID NO: 927376 - RNA, 19 nt, Homo sapiens
ccaaauauucugguaagua

SEQ ID NO: 927377 - RNA, 19 nt, Homo sapiens
agcgguaacuggccaauua

SEQ ID NO: 927378 - RNA, 19 nt, Homo sapiens
guuacgaucuguauaaagu

SEQ ID NO: 927379 - RNA, 19 nt, Homo sapiens
caacaaugccguaaacauc

SEQ ID NO: 927380 - RNA, 19 nt, Homo sapiens
gggcaaagauaucuaacag

SEQ ID NO: 927381 - RNA, 19 nt, Homo sapiens
gcaauaauggguugacuca

SEQ ID NO: 927382 - RNA, 19 nt, Homo sapiens
ucaaggagcucagccacuu

SEQ ID NO: 927383 - RNA, 19 nt, Homo sapiens
gcaccugaauaaccaacaa

SEQ ID NO: 927384 - RNA, 19 nt, Homo sapiens
uggguugacucauucauuu

SEQ ID NO: 927385 - RNA, 19 nt, Homo sapiens
uaaguauggugaagcaguu

SEQ ID NO: 927386 - RNA, 19 nt, Homo sapiens
caacagccgacaaugauga

SEQ ID NO: 927387 - RNA, 19 nt, Homo sapiens
caacauggacagagacguu

SEQ ID NO: 927388 - RNA, 19 nt, Homo sapiens
gcauaaaucguugccauug

SEQ ID NO: 927389 - RNA, 19 nt, Homo sapiens
gaucagauaagucaaccaa

SEQ ID NO: 927390 - RNA, 19 nt, Homo sapiens
agacaauugugauggauau

SEQ ID NO: 927391 - RNA, 19 nt, Homo sapiens
ggacaucauagugguuaua

SEQ ID NO: 927392 - RNA, 19 nt, Homo sapiens
caaagccgcauaaaucguu

SEQ ID NO: 927393 - RNA, 19 nt, Homo sapiens
cgccauaaauuucgacaau

SEQ ID NO: 927394 - RNA, 19 nt, Homo sapiens
gguuggaaauacaagguuu

SEQ ID NO: 927395 - RNA, 19 nt, Homo sapiens
ccacgggugcgacuugaua

SEQ ID NO: 927396 - RNA, 19 nt, Homo sapiens
gagcacaauugucaaacca

SEQ ID NO: 927397 - RNA, 19 nt, Homo sapiens
gauaggagccgagucaaca

SEQ ID NO: 927398 - RNA, 19 nt, Homo sapiens
guuaauuguuccuuugguu

SEQ ID NO: 927399 - RNA, 19 nt, Homo sapiens
gacuaagcgcuucuaauuu

SEQ ID NO: 927400 - RNA, 19 nt, Homo sapiens
gaugagcacaauugucaaa

SEQ ID NO: 927401 - RNA, 19 nt, Homo sapiens
uguuagcgguuaauucaaa

SEQ ID NO: 927402 - RNA, 19 nt, Homo sapiens
cacuaaaucuucucguguu

SEQ ID NO: 927403 - RNA, 19 nt, Homo sapiens
gaugcuugauaacucuuaa

SEQ ID NO: 927404 - RNA, 19 nt, Homo sapiens
guacuaauguugauuuacc

SEQ ID NO: 927405 - RNA, 19 nt, Homo sapiens
gugaugagcacaauuguca

SEQ ID NO: 927406 - RNA, 19 nt, Homo sapiens
acuaaaucuucucguguua

SEQ ID NO: 927407 - RNA, 19 nt, Homo sapiens
cugcaaagccgcauaaauc

SEQ ID NO: 927408 - RNA, 19 nt, Homo sapiens
agagaugacccguugaauu

SEQ ID NO: 927409 - RNA, 19 nt, Homo sapiens
uuaaugacacguacuaaug

SEQ ID NO: 927410 - RNA, 19 nt, Homo sapiens
ggucacaaucccuuuauuc

SEQ ID NO: 927411 - RNA, 19 nt, Homo sapiens
gauagugggcuguguugga

SEQ ID NO: 927412 - RNA, 19 nt, Homo sapiens
ccgguaagguuuggucauu

SEQ ID NO: 927413 - RNA, 19 nt, Homo sapiens
gcgaugguguuaguauguu

SEQ ID NO: 927414 - RNA, 19 nt, Homo sapiens
caaagauaucuaacaguga

SEQ ID NO: 927415 - RNA, 19 nt, Homo sapiens
gaugacccguugaauuucu

SEQ ID NO: 927416 - RNA, 19 nt, Homo sapiens
gguaagguuuggucauuuu

SEQ ID NO: 927417 - RNA, 19 nt, Homo sapiens
gccguuacgaucuguauaa

SEQ ID NO: 927418 - RNA, 19 nt, Homo sapiens
ugagccacguucaaugauu

SEQ ID NO: 927419 - RNA, 19 nt, Homo sapiens
auaaaucguugccauugga

SEQ ID NO: 927420 - RNA, 19 nt, Homo sapiens
gacaucauagugguuauaa

SEQ ID NO: 927421 - RNA, 19 nt, Homo sapiens
gcaugaccgcgacuuuauu

SEQ ID NO: 927422 - RNA, 19 nt, Homo sapiens
cagauaagucaaccaauuc

SEQ ID NO: 927423 - RNA, 19 nt, Homo sapiens
ccgcaguaaucguccguuu

SEQ ID NO: 927424 - RNA, 19 nt, Homo sapiens
uagacgcgcaguuaaauug

SEQ ID NO: 927425 - RNA, 19 nt, Homo sapiens
cgacuuuauuggcgauuuc

SEQ ID NO: 927426 - RNA, 19 nt, Homo sapiens
gccauaaauuucgacaaug

SEQ ID NO: 927427 - RNA, 19 nt, Homo sapiens
ggucaaauaaugcggcaau

SEQ ID NO: 927428 - RNA, 19 nt, Homo sapiens
aauaagcuuuggccacaga

SEQ ID NO: 927429 - RNA, 19 nt, Homo sapiens
gaccacgggugcgacuuga

SEQ ID NO: 927430 - RNA, 19 nt, Homo sapiens
ggguugacucauucauuua

SEQ ID NO: 927431 - RNA, 19 nt, Homo sapiens
auggaaagcgacaguaaua

SEQ ID NO: 927432 - RNA, 19 nt, Homo sapiens
gauggaaagcgacaguaau

SEQ ID NO: 927433 - RNA, 19 nt, Homo sapiens
cgaugguguuaguauguuu

SEQ ID NO: 927434 - RNA, 19 nt, Homo sapiens
cauuaaggguugguuggaa

SEQ ID NO: 927435 - RNA, 19 nt, Homo sapiens
gagaugaugccuuggacau

SEQ ID NO: 927436 - RNA, 19 nt, Homo sapiens
cauaaaucguugccauugg

SEQ ID NO: 927437 - RNA, 19 nt, Homo sapiens
gcaucaauauguuggucau

SEQ ID NO: 927438 - RNA, 19 nt, Homo sapiens
cgauggaaagcgacaguaa

SEQ ID NO: 927439 - RNA, 19 nt, Homo sapiens
gacguuguuuaccgcagua

SEQ ID NO: 927440 - RNA, 19 nt, Homo sapiens
uaaccaacaaugccguaaa

SEQ ID NO: 927441 - RNA, 19 nt, Homo sapiens
ugacacguacuaauguuga

SEQ ID NO: 927442 - RNA, 19 nt, Homo sapiens
uaaugacacguacuaaugu

SEQ ID NO: 927443 - RNA, 19 nt, Homo sapiens
gcuagacgcgcaguuaaau

SEQ ID NO: 927444 - RNA, 19 nt, Homo sapiens
gggauccagugccgaagug

SEQ ID NO: 927445 - RNA, 19 nt, Homo sapiens
gcggauaggagccgaguca

SEQ ID NO: 927446 - RNA, 19 nt, Homo sapiens
cauaaucaaccaaacgaau

SEQ ID NO: 927447 - RNA, 19 nt, Homo sapiens
ugagaugcuugauaacucu

SEQ ID NO: 927448 - RNA, 19 nt, Homo sapiens
cauuauacccugagaugau

SEQ ID NO: 927449 - RNA, 19 nt, Homo sapiens
cuugugcagucaaauggua

SEQ ID NO: 927450 - RNA, 19 nt, Homo sapiens
gcgacuuuauuggcgauuu

SEQ ID NO: 927451 - RNA, 19 nt, Homo sapiens
gcguucguuuagcaaguua

SEQ ID NO: 927452 - RNA, 19 nt, Homo sapiens
gcggcaauggcuugugaua

SEQ ID NO: 927453 - RNA, 19 nt, Homo sapiens
gcgguaacuggccaauuaa

SEQ ID NO: 927454 - RNA, 19 nt, Homo sapiens
caugaccgcgacuuuauug

SEQ ID NO: 927455 - RNA, 19 nt, Homo sapiens
ggaaugcgcuggcuacaga

SEQ ID NO: 927456 - RNA, 19 nt, Homo sapiens
gaaagcauuuggcaauauu

SEQ ID NO: 927457 - RNA, 19 nt, Homo sapiens
gaacaaugcuaaaggaaag

SEQ ID NO: 927458 - RNA, 19 nt, Homo sapiens
ggaagaggauggcuacaga

SEQ ID NO: 927459 - RNA, 19 nt, Homo sapiens
gaaagaaauccaggaguua

SEQ ID NO: 927460 - RNA, 19 nt, Homo sapiens
gcaagcagaagaucuauuu

SEQ ID NO: 927461 - RNA, 19 nt, Homo sapiens
agagagagguugcuauaaa

SEQ ID NO: 927462 - RNA, 19 nt, Homo sapiens
ggaaagcauuuggcaauau

SEQ ID NO: 927463 - RNA, 19 nt, Homo sapiens
caccagagaugcagaaaga

SEQ ID NO: 927464 - RNA, 19 nt, Homo sapiens
agaaagaaauccaggaguu

SEQ ID NO: 927465 - RNA, 19 nt, Homo sapiens
guagagagagguugcuaua

SEQ ID NO: 927466 - RNA, 19 nt, Homo sapiens
gcaaggcggugguggugaa

SEQ ID NO: 927467 - RNA, 19 nt, Homo sapiens
gaaaggcgaugaguaaagg

SEQ ID NO: 927468 - RNA, 19 nt, Homo sapiens
ggauagagacggaugaaga

SEQ ID NO: 927469 - RNA, 19 nt, Homo sapiens
ugcaguagcuugagguuaa

SEQ ID NO: 927470 - RNA, 19 nt, Homo sapiens
aggcugagcucaaggaauu

SEQ ID NO: 927471 - RNA, 19 nt, Homo sapiens
gaaaugcaggcaacacuga

SEQ ID NO: 927472 - RNA, 19 nt, Homo sapiens
agucaaaccugccagauau

SEQ ID NO: 927473 - RNA, 19 nt, Homo sapiens
gagcugucuugaugcaaua

SEQ ID NO: 927474 - RNA, 19 nt, Homo sapiens
agagagagauugaagaaca

SEQ ID NO: 927475 - RNA, 19 nt, Homo sapiens
ggaacaaugcuaaaggaaa

SEQ ID NO: 927476 - RNA, 19 nt, Homo sapiens
aagauaugcuugacagaaa

SEQ ID NO: 927477 - RNA, 19 nt, Homo sapiens
gagcagguguacagagaga

SEQ ID NO: 927478 - RNA, 19 nt, Homo sapiens
uagcaaaacugcauuggua

SEQ ID NO: 927479 - RNA, 19 nt, Homo sapiens
ggaaggcagaagugaauuu

SEQ ID NO: 927480 - RNA, 19 nt, Homo sapiens
uaaagcagcuaccaaucau

SEQ ID NO: 927481 - RNA, 19 nt, Homo sapiens
acagagagaggcagaagua

SEQ ID NO: 927482 - RNA, 19 nt, Homo sapiens
gagagagguugcuauaaaa

SEQ ID NO: 927483 - RNA, 19 nt, Homo sapiens
uagagacggaugaagauua

SEQ ID NO: 927484 - RNA, 19 nt, Homo sapiens
gaggaaggcagaagugaau

SEQ ID NO: 927485 - RNA, 19 nt, Homo sapiens
gcaguucuuugaggaaguu

SEQ ID NO: 927486 - RNA, 19 nt, Homo sapiens
cgggaaaggcgaugaguaa

SEQ ID NO: 927487 - RNA, 19 nt, Homo sapiens
gaggcucaguuaauauuuc

SEQ ID NO: 927488 - RNA, 19 nt, Homo sapiens
gagguuaacauuuagacuu

SEQ ID NO: 927489 - RNA, 19 nt, Homo sapiens
agcuugagguuaacauuua

SEQ ID NO: 927490 - RNA, 19 nt, Homo sapiens
aaacugcauugguauuuag

SEQ ID NO: 927491 - RNA, 19 nt, Homo sapiens
gaaggcagaagugaauuug

SEQ ID NO: 927492 - RNA, 19 nt, Homo sapiens
ccacgcauuucauugucua

SEQ ID NO: 927493 - RNA, 19 nt, Homo sapiens
gagagagauugaagaacau

SEQ ID NO: 927494 - RNA, 19 nt, Homo sapiens
ccagagaugcagaaagaaa

SEQ ID NO: 927495 - RNA, 19 nt, Homo sapiens
caacaaggcaagaucaaag

SEQ ID NO: 927496 - RNA, 19 nt, Homo sapiens
ggaaaggcgaugaguaaag

SEQ ID NO: 927497 - RNA, 19 nt, Homo sapiens
gcaacaaggcaagaucaaa

SEQ ID NO: 927498 - RNA, 19 nt, Homo sapiens
gaagugaauuuggagaacu

SEQ ID NO: 927499 - RNA, 19 nt, Homo sapiens
ugaguuggguggcgggaaa

SEQ ID NO: 927500 - RNA, 19 nt, Homo sapiens
gaaauccaggaguuaaaga

SEQ ID NO: 927501 - RNA, 19 nt, Homo sapiens
aaagaaauccaggaguuaa

SEQ ID NO: 927502 - RNA, 19 nt, Homo sapiens
caugggagaggccaagaua

SEQ ID NO: 927503 - RNA, 19 nt, Homo sapiens
gauagagacggaugaagau

SEQ ID NO: 927504 - RNA, 19 nt, Homo sapiens
gcagcuaccaaucauguga

SEQ ID NO: 927505 - RNA, 19 nt, Homo sapiens
gagagauugaagaacauua

SEQ ID NO: 927506 - RNA, 19 nt, Homo sapiens
gagugaugcugaccuucaa

SEQ ID NO: 927507 - RNA, 19 nt, Homo sapiens
gcagagcagucaggagaca

SEQ ID NO: 927508 - RNA, 19 nt, Homo sapiens
gagagaggcagaaguacug

SEQ ID NO: 927509 - RNA, 19 nt, Homo sapiens
aagagcagguguacagaga

SEQ ID NO: 927510 - RNA, 19 nt, Homo sapiens
gaucaggaccaguuugaca

SEQ ID NO: 927511 - RNA, 19 nt, Homo sapiens
aggaaagcauuuggcaaua

SEQ ID NO: 927512 - RNA, 19 nt, Homo sapiens
augcaauacuugaaggaua

SEQ ID NO: 927513 - RNA, 19 nt, Homo sapiens
aaggcaagaucaaagagaa

SEQ ID NO: 927514 - RNA, 19 nt, Homo sapiens
aggcagaagugaauuugga

SEQ ID NO: 927515 - RNA, 19 nt, Homo sapiens
cuaaauugcaguagcuuga

SEQ ID NO: 927516 - RNA, 19 nt, Homo sapiens
cagcagacgugccgcuaca

SEQ ID NO: 927517 - RNA, 19 nt, Homo sapiens
ggugagugaugcugaccuu

SEQ ID NO: 927518 - RNA, 19 nt, Homo sapiens
gaaagagcagguguacaga

SEQ ID NO: 927519 - RNA, 19 nt, Homo sapiens
cugcauugguauuuagaaa

SEQ ID NO: 927520 - RNA, 19 nt, Homo sapiens
agacuuggaacaaugcuaa

SEQ ID NO: 927521 - RNA, 19 nt, Homo sapiens
uuaaagcagcuaccaauca

SEQ ID NO: 927522 - RNA, 19 nt, Homo sapiens
acagagagagauugaagaa

SEQ ID NO: 927523 - RNA, 19 nt, Homo sapiens
aaaccugccagauaucaaa

SEQ ID NO: 927524 - RNA, 19 nt, Homo sapiens
caggaugucagaagaguga

SEQ ID NO: 927525 - RNA, 19 nt, Homo sapiens
gaagcaguucuuugaggaa

SEQ ID NO: 927526 - RNA, 19 nt, Homo sapiens
agaaagagcagguguacag

SEQ ID NO: 927527 - RNA, 19 nt, Homo sapiens
aagugaauuuggagaacua

SEQ ID NO: 927528 - RNA, 19 nt, Homo sapiens
ccucuuacuuuucacuuua

SEQ ID NO: 927529 - RNA, 19 nt, Homo sapiens
guuaacauuuagacuugga

SEQ ID NO: 927530 - RNA, 19 nt, Homo sapiens
uagcuugagguuaacauuu

SEQ ID NO: 927531 - RNA, 19 nt, Homo sapiens
ugcacuggcuaccuuguuu

SEQ ID NO: 927532 - RNA, 19 nt, Homo sapiens
agagacggaugaagauuac

SEQ ID NO: 927533 - RNA, 19 nt, Homo sapiens
uggagcagcuggcgcaaca

SEQ ID NO: 927534 - RNA, 19 nt, Homo sapiens
cauuaaagcagcuaccaau

SEQ ID NO: 927535 - RNA, 19 nt, Homo sapiens
caggagcccuuuuaaguau

SEQ ID NO: 927536 - RNA, 19 nt, Homo sapiens
uagucaaaccugccagaua

SEQ ID NO: 927537 - RNA, 19 nt, Homo sapiens
gaucaaagagaagauguac

SEQ ID NO: 927538 - RNA, 19 nt, Homo sapiens
agguuaacauuuagacuug

SEQ ID NO: 927539 - RNA, 19 nt, Homo sapiens
gcgggaaaggcgaugagua

SEQ ID NO: 927540 - RNA, 19 nt, Homo sapiens
agaggcagaaguacuguaa

SEQ ID NO: 927541 - RNA, 19 nt, Homo sapiens
gagcucaaggaauuaucua

SEQ ID NO: 927542 - RNA, 19 nt, Homo sapiens
gcagacgugccgcuacaug

SEQ ID NO: 927543 - RNA, 19 nt, Homo sapiens
gagggaagaggaagaggau

SEQ ID NO: 927544 - RNA, 19 nt, Homo sapiens
ucaugugacuccagaagag

SEQ ID NO: 927545 - RNA, 19 nt, Homo sapiens
caaggcaagaucaaagaga

SEQ ID NO: 927546 - RNA, 19 nt, Homo sapiens
aaggaaagcauuuggcaau

SEQ ID NO: 927547 - RNA, 19 nt, Homo sapiens
ggaguggagggaagaggaa

SEQ ID NO: 927548 - RNA, 19 nt, Homo sapiens
cucaaggaauuaucuagug

SEQ ID NO: 927549 - RNA, 19 nt, Homo sapiens
gcucaaggaauuaucuagu

SEQ ID NO: 927550 - RNA, 19 nt, Homo sapiens
gagaaaugcaggcaacacu

SEQ ID NO: 927551 - RNA, 19 nt, Homo sapiens
cagaagugaauuuggagaa

SEQ ID NO: 927552 - RNA, 19 nt, Homo sapiens
cauuuagacuuggaacaau

SEQ ID NO: 927553 - RNA, 19 nt, Homo sapiens
gcgcaacaaggcaagauca

SEQ ID NO: 927554 - RNA, 19 nt, Homo sapiens
gggaaaggcgaugaguaaa

SEQ ID NO: 927555 - RNA, 19 nt, Homo sapiens
ggaaugcgcuggcuacaga

SEQ ID NO: 927556 - RNA, 19 nt, Homo sapiens
gaaagcauuuggcaauauu

SEQ ID NO: 927557 - RNA, 19 nt, Homo sapiens
gaacaaugcuaaaggaaag

SEQ ID NO: 927558 - RNA, 19 nt, Homo sapiens
ggaagaggauggcuacaga

SEQ ID NO: 927559 - RNA, 19 nt, Homo sapiens
gaaagaaauccaggaguua

SEQ ID NO: 927560 - RNA, 19 nt, Homo sapiens
gcaagcagaagaucuauuu

SEQ ID NO: 927561 - RNA, 19 nt, Homo sapiens
agagagagguugcuauaaa

SEQ ID NO: 927562 - RNA, 19 nt, Homo sapiens
ggaaagcauuuggcaauau

SEQ ID NO: 927563 - RNA, 19 nt, Homo sapiens
caccagagaugcagaaaga

SEQ ID NO: 927564 - RNA, 19 nt, Homo sapiens
agaaagaaauccaggaguu

SEQ ID NO: 927565 - RNA, 19 nt, Homo sapiens
guagagagagguugcuaua

SEQ ID NO: 927566 - RNA, 19 nt, Homo sapiens
gcaaggcggugguggugaa

SEQ ID NO: 927567 - RNA, 19 nt, Homo sapiens
gaaaggcgaugaguaaagg

SEQ ID NO: 927568 - RNA, 19 nt, Homo sapiens
ggauagagacggaugaaga

SEQ ID NO: 927569 - RNA, 19 nt, Homo sapiens
ugcaguagcuugagguuaa

SEQ ID NO: 927570 - RNA, 19 nt, Homo sapiens
aggcugagcucaaggaauu

SEQ ID NO: 927571 - RNA, 19 nt, Homo sapiens
gaaaugcaggcaacacuga

SEQ ID NO: 927572 - RNA, 19 nt, Homo sapiens
agucaaaccugccagauau

SEQ ID NO: 927573 - RNA, 19 nt, Homo sapiens
agagagagauugaagaaca

SEQ ID NO: 927574 - RNA, 19 nt, Homo sapiens
ggaacaaugcuaaaggaaa

SEQ ID NO: 927575 - RNA, 19 nt, Homo sapiens
aagauaugcuugacagaaa

SEQ ID NO: 927576 - RNA, 19 nt, Homo sapiens
gagcagguguacagagaga

SEQ ID NO: 927577 - RNA, 19 nt, Homo sapiens
agagcugucugaugcaaua

SEQ ID NO: 927578 - RNA, 19 nt, Homo sapiens
uagcaaaacugcauuggua

SEQ ID NO: 927579 - RNA, 19 nt, Homo sapiens
ggaaggcagaagugaauuu

SEQ ID NO: 927580 - RNA, 19 nt, Homo sapiens
uaaagcagcuaccaaucau

SEQ ID NO: 927581 - RNA, 19 nt, Homo sapiens
acagagagaggcagaagua

SEQ ID NO: 927582 - RNA, 19 nt, Homo sapiens
ugagguaccugcaggaaca

SEQ ID NO: 927583 - RNA, 19 nt, Homo sapiens
gagagagguugcuauaaaa

SEQ ID NO: 927584 - RNA, 19 nt, Homo sapiens
uagagacggaugaagauua

SEQ ID NO: 927585 - RNA, 19 nt, Homo sapiens
gaggaaggcagaagugaau

SEQ ID NO: 927586 - RNA, 19 nt, Homo sapiens
cgggaaaggcgaugaguaa

SEQ ID NO: 927587 - RNA, 19 nt, Homo sapiens
gcaguucuuugaggaaguu

SEQ ID NO: 927588 - RNA, 19 nt, Homo sapiens
gaggcucaguuaauauuuc

SEQ ID NO: 927589 - RNA, 19 nt, Homo sapiens
gagguuaacauuuagacuu

SEQ ID NO: 927590 - RNA, 19 nt, Homo sapiens
agcuugagguuaacauuua

SEQ ID NO: 927591 - RNA, 19 nt, Homo sapiens
aaacugcauugguauuuag

SEQ ID NO: 927592 - RNA, 19 nt, Homo sapiens
gaaggcagaagugaauuug

SEQ ID NO: 927593 - RNA, 19 nt, Homo sapiens
ccacgcauuucauugucua

SEQ ID NO: 927594 - RNA, 19 nt, Homo sapiens
gagagagauugaagaacau

SEQ ID NO: 927595 - RNA, 19 nt, Homo sapiens
ccagagaugcagaaagaaa

SEQ ID NO: 927596 - RNA, 19 nt, Homo sapiens
ggaaaggcgaugaguaaag

SEQ ID NO: 927597 - RNA, 19 nt, Homo sapiens
caacaaggcaagaucaaag

SEQ ID NO: 927598 - RNA, 19 nt, Homo sapiens
gcaacaaggcaagaucaaa

SEQ ID NO: 927599 - RNA, 19 nt, Homo sapiens
ugaguuggguggcgggaaa

SEQ ID NO: 927600 - RNA, 19 nt, Homo sapiens
gaagugaauuuggagaacu

SEQ ID NO: 927601 - RNA, 19 nt, Homo sapiens
gaaauccaggaguuaaaga

SEQ ID NO: 927602 - RNA, 19 nt, Homo sapiens
aaagaaauccaggaguuaa

SEQ ID NO: 927603 - RNA, 19 nt, Homo sapiens
caugggagaggccaagaua

SEQ ID NO: 927604 - RNA, 19 nt, Homo sapiens
gauagagacggaugaagau

SEQ ID NO: 927605 - RNA, 19 nt, Homo sapiens
gcagcuaccaaucauguga

SEQ ID NO: 927606 - RNA, 19 nt, Homo sapiens
gagagauugaagaacauua

SEQ ID NO: 927607 - RNA, 19 nt, Homo sapiens
gagugaugcugaccuucaa

SEQ ID NO: 927608 - RNA, 19 nt, Homo sapiens
gcagagcagucaggagaca

SEQ ID NO: 927609 - RNA, 19 nt, Homo sapiens
gagagaggcagaaguacug

SEQ ID NO: 927610 - RNA, 19 nt, Homo sapiens
aagagcagguguacagaga

SEQ ID NO: 927611 - RNA, 19 nt, Homo sapiens
gaucaggaccaguuugaca

SEQ ID NO: 927612 - RNA, 19 nt, Homo sapiens
aggaaagcauuuggcaaua

SEQ ID NO: 927613 - RNA, 19 nt, Homo sapiens
ggaggaagaggaagaggau

SEQ ID NO: 927614 - RNA, 19 nt, Homo sapiens
augcaauacuugaaggaua

SEQ ID NO: 927615 - RNA, 19 nt, Homo sapiens
aaggcaagaucaaagagaa

SEQ ID NO: 927616 - RNA, 19 nt, Homo sapiens
aggcagaagugaauuugga

SEQ ID NO: 927617 - RNA, 19 nt, Homo sapiens
cuaaauugcaguagcuuga

SEQ ID NO: 927618 - RNA, 19 nt, Homo sapiens
uguaaggaguggaggaaga

SEQ ID NO: 927619 - RNA, 19 nt, Homo sapiens
ggugagugaugcugaccuu

SEQ ID NO: 927620 - RNA, 19 nt, Homo sapiens
gaaagagcagguguacaga

SEQ ID NO: 927621 - RNA, 19 nt, Homo sapiens
cugcauugguauuuagaaa

SEQ ID NO: 927622 - RNA, 19 nt, Homo sapiens
agacuuggaacaaugcuaa

SEQ ID NO: 927623 - RNA, 19 nt, Homo sapiens
uuaaagcagcuaccaauca

SEQ ID NO: 927624 - RNA, 19 nt, Homo sapiens
acagagagagauugaagaa

SEQ ID NO: 927625 - RNA, 19 nt, Homo sapiens
aaaccugccagauaucaaa

SEQ ID NO: 927626 - RNA, 19 nt, Homo sapiens
caggaugucagaagaguga

SEQ ID NO: 927627 - RNA, 19 nt, Homo sapiens
gaagcaguucuuugaggaa

SEQ ID NO: 927628 - RNA, 19 nt, Homo sapiens
agaaagagcagguguacag

SEQ ID NO: 927629 - RNA, 19 nt, Homo sapiens
aagugaauuuggagaacua

SEQ ID NO: 927630 - RNA, 19 nt, Homo sapiens
ccucuuacuuuucacuuua

SEQ ID NO: 927631 - RNA, 19 nt, Homo sapiens
guuaacauuuagacuugga

SEQ ID NO: 927632 - RNA, 19 nt, Homo sapiens
uggagcagcuggcgcaaca

SEQ ID NO: 927633 - RNA, 19 nt, Homo sapiens
uagcuugagguuaacauuu

SEQ ID NO: 927634 - RNA, 19 nt, Homo sapiens
ugcacuggcuaccuuguuu

SEQ ID NO: 927635 - RNA, 19 nt, Homo sapiens
agagacggaugaagauuac

SEQ ID NO: 927636 - RNA, 19 nt, Homo sapiens
gcugucugaugcaauacuu

SEQ ID NO: 927637 - RNA, 19 nt, Homo sapiens
cauuaaagcagcuaccaau

SEQ ID NO: 927638 - RNA, 19 nt, Homo sapiens
gcgggaaaggcgaugagua

SEQ ID NO: 927639 - RNA, 19 nt, Homo sapiens
caggagcccuuuuaaguau

SEQ ID NO: 927640 - RNA, 19 nt, Homo sapiens
uagucaaaccugccagaua

SEQ ID NO: 927641 - RNA, 19 nt, Homo sapiens
agguuaacauuuagacuug

SEQ ID NO: 927642 - RNA, 19 nt, Homo sapiens
agaggcagaaguacuguaa

SEQ ID NO: 927643 - RNA, 19 nt, Homo sapiens
gaucaaagagaagauguac

SEQ ID NO: 927644 - RNA, 19 nt, Homo sapiens
gagcucaaggaauuaucua

SEQ ID NO: 927645 - RNA, 19 nt, Homo sapiens
ucaugugacuccagaagag

SEQ ID NO: 927646 - RNA, 19 nt, Homo sapiens
caaggcaagaucaaagaga

SEQ ID NO: 927647 - RNA, 19 nt, Homo sapiens
aaggaaagcauuuggcaau

SEQ ID NO: 927648 - RNA, 19 nt, Homo sapiens
cucaaggaauuaucuagug

SEQ ID NO: 927649 - RNA, 19 nt, Homo sapiens
gcucaaggaauuaucuagu

SEQ ID NO: 927650 - RNA, 19 nt, Homo sapiens
gagaaaugcaggcaacacu

SEQ ID NO: 927651 - RNA, 19 nt, Homo sapiens
cagaagugaauuuggagaa

SEQ ID NO: 927652 - RNA, 19 nt, Homo sapiens
cauuuagacuuggaacaau

SEQ ID NO: 927653 - RNA, 19 nt, Homo sapiens
gggaaaggcgaugaguaaa

SEQ ID NO: 927654 - RNA, 19 nt, Homo sapiens
gcgcaacaaggcaagauca

SEQ ID NO: 927655 - RNA, 19 nt, Homo sapiens
gaacacagcuggccaccua

SEQ ID NO: 927656 - RNA, 19 nt, Homo sapiens
gcagcgagcuagccaagaa

SEQ ID NO: 927657 - RNA, 19 nt, Homo sapiens
gaaggucccucacaacauc

SEQ ID NO: 927658 - RNA, 19 nt, Homo sapiens
ggaagagccucccucaaag

SEQ ID NO: 927659 - RNA, 19 nt, Homo sapiens
gcaauucccuccuccucaa

SEQ ID NO: 927660 - RNA, 19 nt, Homo sapiens
ccaaagccauccaagaaga

SEQ ID NO: 927661 - RNA, 19 nt, Homo sapiens
gagccucccucaaagaaga

SEQ ID NO: 927662 - RNA, 19 nt, Homo sapiens
accaagagcugcuuaucua

SEQ ID NO: 927663 - RNA, 19 nt, Homo sapiens
ccucgcagcucuacgugua

SEQ ID NO: 927664 - RNA, 19 nt, Homo sapiens
gaagagccucccucaaaga

SEQ ID NO: 927665 - RNA, 19 nt, Homo sapiens
acacgcagcucuacauaca

SEQ ID NO: 927666 - RNA, 19 nt, Homo sapiens
ggauauuuauggcuacuca

SEQ ID NO: 927667 - RNA, 19 nt, Homo sapiens
uuaagaaggucccucacaa

SEQ ID NO: 927668 - RNA, 19 nt, Homo sapiens
ggacgagauugaaguguac

SEQ ID NO: 927669 - RNA, 19 nt, Homo sapiens
cgggaagacuccaccauga

SEQ ID NO: 927670 - RNA, 19 nt, Homo sapiens
ucaccagccugcccuuuga

SEQ ID NO: 927671 - RNA, 19 nt, Homo sapiens
agacacggauuccugauuc

SEQ ID NO: 927672 - RNA, 19 nt, Homo sapiens
gacagcauccugaacauug

SEQ ID NO: 927673 - RNA, 19 nt, Homo sapiens
ccgaggcucugaccaagaa

SEQ ID NO: 927674 - RNA, 19 nt, Homo sapiens
cugccuaccuguccuauga

SEQ ID NO: 927675 - RNA, 19 nt, Homo sapiens
gagaagcugcucaacauca

SEQ ID NO: 927676 - RNA, 19 nt, Homo sapiens
gcgaggagaaggaguuuga

SEQ ID NO: 927677 - RNA, 19 nt, Homo sapiens
aggaagagccucccucaaa

SEQ ID NO: 927678 - RNA, 19 nt, Homo sapiens
guacaaaacacaaggaaaa

SEQ ID NO: 927679 - RNA, 19 nt, Homo sapiens
uggacgagauugaagugua

SEQ ID NO: 927680 - RNA, 19 nt, Homo sapiens
caggacacgugcuccauug

SEQ ID NO: 927681 - RNA, 19 nt, Homo sapiens
ccacaggaaccacggcuuu

SEQ ID NO: 927682 - RNA, 19 nt, Homo sapiens
ggccugggcucagagacua

SEQ ID NO: 927683 - RNA, 19 nt, Homo sapiens
acgagaagcugcucaacau

SEQ ID NO: 927684 - RNA, 19 nt, Homo sapiens
gugcagccaugcuugucua

SEQ ID NO: 927685 - RNA, 19 nt, Homo sapiens
ggaagacuccaccaugauc

SEQ ID NO: 927686 - RNA, 19 nt, Homo sapiens
guaaggaggaggaggacaa

SEQ ID NO: 927687 - RNA, 19 nt, Homo sapiens
cgacacgcagcucuacaua

SEQ ID NO: 927688 - RNA, 19 nt, Homo sapiens
ugauuacgcugugccugua

SEQ ID NO: 927689 - RNA, 19 nt, Homo sapiens
gcaggacacgugcuccauu

SEQ ID NO: 927690 - RNA, 19 nt, Homo sapiens
ggacggguuugugcagaau

SEQ ID NO: 927691 - RNA, 19 nt, Homo sapiens
agaaggaguuugagaccau

SEQ ID NO: 927692 - RNA, 19 nt, Homo sapiens
gauucgggcucccucuuca

SEQ ID NO: 927693 - RNA, 19 nt, Homo sapiens
gcuaugacauguggacagu

SEQ ID NO: 927694 - RNA, 19 nt, Homo sapiens
gcaccacaccagacauaau

SEQ ID NO: 927695 - RNA, 19 nt, Homo sapiens
guacagcguggacuucaug

SEQ ID NO: 927696 - RNA, 19 nt, Homo sapiens
cuacuucgaggauauuuau

SEQ ID NO: 927697 - RNA, 19 nt, Homo sapiens
aacaucaacuuccgugaga

SEQ ID NO: 927698 - RNA, 19 nt, Homo sapiens
ccagggcaaucucaaaguc

SEQ ID NO: 927699 - RNA, 19 nt, Homo sapiens
aggaggagaugcuguaugg

SEQ ID NO: 927700 - RNA, 19 nt, Homo sapiens
ggugacaaccuuugagcuu

SEQ ID NO: 927701 - RNA, 19 nt, Homo sapiens
gggacggguuugugcagaa

SEQ ID NO: 927702 - RNA, 19 nt, Homo sapiens
gggaugcccugcuccuaag

SEQ ID NO: 927703 - RNA, 19 nt, Homo sapiens
ggucuuugcugggaacauc

SEQ ID NO: 927704 - RNA, 19 nt, Homo sapiens
ggacacgugcuccauugug

SEQ ID NO: 927705 - RNA, 19 nt, Homo sapiens
caaagccauccaagaagaa

SEQ ID NO: 927706 - RNA, 19 nt, Homo sapiens
gaggaggcccgaagaagca

SEQ ID NO: 927707 - RNA, 19 nt, Homo sapiens
auaagcacaucacgugguu

SEQ ID NO: 927708 - RNA, 19 nt, Homo sapiens
gaggagaaggaguuugaga

SEQ ID NO: 927709 - RNA, 19 nt, Homo sapiens
uggcguggcucucaacagu

SEQ ID NO: 927710 - RNA, 19 nt, Homo sapiens
gccaucggccagaagauuu

SEQ ID NO: 927711 - RNA, 19 nt, Homo sapiens
gaccaagagcugcuuaucu

SEQ ID NO: 927712 - RNA, 19 nt, Homo sapiens
uguccgagcguuccacuuu

SEQ ID NO: 927713 - RNA, 19 nt, Homo sapiens
gaccgugucgggccucaaa

SEQ ID NO: 927714 - RNA, 19 nt, Homo sapiens
gcuacuucgaggauauuua

SEQ ID NO: 927715 - RNA, 19 nt, Homo sapiens
gggcacccaugaccugaag

SEQ ID NO: 927716 - RNA, 19 nt, Homo sapiens
cuuaccacguggagucuaa

SEQ ID NO: 927717 - RNA, 19 nt, Homo sapiens
agccaaagccauccaagaa

SEQ ID NO: 927718 - RNA, 19 nt, Homo sapiens
aggaugagguggacgagau

SEQ ID NO: 927719 - RNA, 19 nt, Homo sapiens
gacgagaagcugcucaaca

SEQ ID NO: 927720 - RNA, 19 nt, Homo sapiens
cggcaccacaccagacaua

SEQ ID NO: 927721 - RNA, 19 nt, Homo sapiens
agaacgcgcugaccaccau

SEQ ID NO: 927722 - RNA, 19 nt, Homo sapiens
cagccgacgucaugaagag

SEQ ID NO: 927723 - RNA, 19 nt, Homo sapiens
gggagcaugugaccugcau

SEQ ID NO: 927724 - RNA, 19 nt, Homo sapiens
caaggaggaggcccgaaga

SEQ ID NO: 927725 - RNA, 19 nt, Homo sapiens
gaccucagcggcauguuca

SEQ ID NO: 927726 - RNA, 19 nt, Homo sapiens
ggaccuggagauugugguu

SEQ ID NO: 927727 - RNA, 19 nt, Homo sapiens
ugaccugcaugaagacagu

SEQ ID NO: 927728 - RNA, 19 nt, Homo sapiens
caagaagaaagcagaaggu

SEQ ID NO: 927729 - RNA, 19 nt, Homo sapiens
gggaagacuccaccaugau

SEQ ID NO: 927730 - RNA, 19 nt, Homo sapiens
gagcuucccggcugcuaug

SEQ ID NO: 927731 - RNA, 19 nt, Homo sapiens
ggaugagguggacgagauu

SEQ ID NO: 927732 - RNA, 19 nt, Homo sapiens
guucucgccugggcaauuc

SEQ ID NO: 927733 - RNA, 19 nt, Homo sapiens
cgggaugcccugcuccuaa

SEQ ID NO: 927734 - RNA, 19 nt, Homo sapiens
cacugaacaucacgcagaa

SEQ ID NO: 927735 - RNA, 19 nt, Homo sapiens
acauaauccuggacgacuu

SEQ ID NO: 927736 - RNA, 19 nt, Homo sapiens
ccgaagccaaggagaguuu

SEQ ID NO: 927737 - RNA, 19 nt, Homo sapiens
gcaaccucaugguguacau

SEQ ID NO: 927738 - RNA, 19 nt, Homo sapiens
aagagcugcuuaucuacga

SEQ ID NO: 927739 - RNA, 19 nt, Homo sapiens
ggaccaagagcugcuuauc

SEQ ID NO: 927740 - RNA, 19 nt, Homo sapiens
gcucugaccaagaaugaca

SEQ ID NO: 927741 - RNA, 19 nt, Homo sapiens
gcuggccaccuacuccuuu

SEQ ID NO: 927742 - RNA, 19 nt, Homo sapiens
gcguggcucucaacagucu

SEQ ID NO: 927743 - RNA, 19 nt, Homo sapiens
cagugucucugcgcaguga

SEQ ID NO: 927744 - RNA, 19 nt, Homo sapiens
gagccggaccuggagauug

SEQ ID NO: 927745 - RNA, 19 nt, Homo sapiens
guacugcaacuucuucaac

SEQ ID NO: 927746 - RNA, 19 nt, Homo sapiens
ggaccucgcagcucuacgu

SEQ ID NO: 927747 - RNA, 19 nt, Homo sapiens
caucaucgaccugcaguuc

SEQ ID NO: 927748 - RNA, 19 nt, Homo sapiens
caccacaccagacauaauc

SEQ ID NO: 927749 - RNA, 19 nt, Homo sapiens
gcucaaccgcuaccuguac

SEQ ID NO: 927750 - RNA, 19 nt, Homo sapiens
gaucagcgucaagaacuuc

SEQ ID NO: 927751 - RNA, 19 nt, Homo sapiens
cagaugaucagcgucaaga

SEQ ID NO: 927752 - RNA, 19 nt, Homo sapiens
cuacauacaccagaugauc

SEQ ID NO: 927753 - RNA, 19 nt, Homo sapiens
ccgcuacauuguccaagug

SEQ ID NO: 927754 - RNA, 19 nt, Homo sapiens
agccggaccuggagauugu

SEQ ID NO: 927755 - RNA, 19 nt, Homo sapiens
gaaccgugaugguauuaua

SEQ ID NO: 927756 - RNA, 19 nt, Homo sapiens
ggaaagggcaccaucaaga

SEQ ID NO: 927757 - RNA, 19 nt, Homo sapiens
ggaguuggaugccaugaug

SEQ ID NO: 927758 - RNA, 19 nt, Homo sapiens
gaaagggcaccaucaagaa

SEQ ID NO: 927759 - RNA, 19 nt, Homo sapiens
ccagaaccgugaugguauu

SEQ ID NO: 927760 - RNA, 19 nt, Homo sapiens
ucaaagaggccuucacugu

SEQ ID NO: 927761 - RNA, 19 nt, Homo sapiens
uaacugaucuuuguuucuc

SEQ ID NO: 927762 - RNA, 19 nt, Homo sapiens
gaagacauggcacccaaga

SEQ ID NO: 927763 - RNA, 19 nt, Homo sapiens
gugaugguauuauagacaa

SEQ ID NO: 927764 - RNA, 19 nt, Homo sapiens
gaggagaucaagaacaugu

SEQ ID NO: 927765 - RNA, 19 nt, Homo sapiens
gaagccagcggucccauca

SEQ ID NO: 927766 - RNA, 19 nt, Homo sapiens
gccucaaugugaagaauga

SEQ ID NO: 927767 - RNA, 19 nt, Homo sapiens
gcggcaacgucgacuacaa

SEQ ID NO: 927768 - RNA, 19 nt, Homo sapiens
aaacaucugcuacgucauc

SEQ ID NO: 927769 - RNA, 19 nt, Homo sapiens
aggaggagaucaagaacau

SEQ ID NO: 927770 - RNA, 19 nt, Homo sapiens
gccaagagaaggacaguag

SEQ ID NO: 927771 - RNA, 19 nt, Homo sapiens
uggaugccaugaugaagga

SEQ ID NO: 927772 - RNA, 19 nt, Homo sapiens
cggcaacgucgacuacaaa

SEQ ID NO: 927773 - RNA, 19 nt, Homo sapiens
gcaccaucaagaagaaguu

SEQ ID NO: 927774 - RNA, 19 nt, Homo sapiens
ccaagagggccaagagaag

SEQ ID NO: 927775 - RNA, 19 nt, Homo sapiens
gagggaaagggcaccauca

SEQ ID NO: 927776 - RNA, 19 nt, Homo sapiens
gaagaaugaggaguuggau

SEQ ID NO: 927777 - RNA, 19 nt, Homo sapiens
ugaagaaugaggaguugga

SEQ ID NO: 927778 - RNA, 19 nt, Homo sapiens
caagagaaggacaguagag

SEQ ID NO: 927779 - RNA, 19 nt, Homo sapiens
ugugaagaaugaggaguug

SEQ ID NO: 927780 - RNA, 19 nt, Homo sapiens
cagaaccgugaugguauua

SEQ ID NO: 927781 - RNA, 19 nt, Homo sapiens
cccggagacugaagacaug

SEQ ID NO: 927782 - RNA, 19 nt, Homo sapiens
gggaaagggcaccaucaag

SEQ ID NO: 927783 - RNA, 19 nt, Homo sapiens
gaucaccggagccuucaag

SEQ ID NO: 927784 - RNA, 19 nt, Homo sapiens
cccaagagggccaagagaa

SEQ ID NO: 927785 - RNA, 19 nt, Homo sapiens
ccaagagaaggacaguaga

SEQ ID NO: 927786 - RNA, 19 nt, Homo sapiens
cccaggaggagaucaagaa

SEQ ID NO: 927787 - RNA, 19 nt, Homo sapiens
ccagcggucccaucaacuu

SEQ ID NO: 927788 - RNA, 19 nt, Homo sapiens
guucaaagaggccuucacu

SEQ ID NO: 927789 - RNA, 19 nt, Homo sapiens
gauccaggaguucaaagag

SEQ ID NO: 927790 - RNA, 19 nt, Homo sapiens
gugccgacccugaggaugu

SEQ ID NO: 927791 - RNA, 19 nt, Homo sapiens
gcuccagcgucuucuccau

SEQ ID NO: 927792 - RNA, 19 nt, Homo sapiens
gaaaguaacacaugaagua

SEQ ID NO: 927793 - RNA, 19 nt, Homo sapiens
gagaauagaugacucaaag

SEQ ID NO: 927794 - RNA, 19 nt, Homo sapiens
ugacagauaugaagacuau

SEQ ID NO: 927795 - RNA, 19 nt, Homo sapiens
gaagaauucggguggauua

SEQ ID NO: 927796 - RNA, 19 nt, Homo sapiens
gaucauauacaccagaaua

SEQ ID NO: 927797 - RNA, 19 nt, Homo sapiens
ccagucagcggguuaauua

SEQ ID NO: 927798 - RNA, 19 nt, Homo sapiens
gaucaccuucuccuuauua

SEQ ID NO: 927799 - RNA, 19 nt, Homo sapiens
gacgaucaccuucuccuua

SEQ ID NO: 927800 - RNA, 19 nt, Homo sapiens
ggaaagggcaaauggaaug

SEQ ID NO: 927801 - RNA, 19 nt, Homo sapiens
cgaaggagccgaagccauu

SEQ ID NO: 927802 - RNA, 19 nt, Homo sapiens
uuagagaucugcauuuauc

SEQ ID NO: 927803 - RNA, 19 nt, Homo sapiens
ggagcuggaugguagaaga

SEQ ID NO: 927804 - RNA, 19 nt, Homo sapiens
gaaccccaauguuauguua

SEQ ID NO: 927805 - RNA, 19 nt, Homo sapiens
gcagacgucgagauucuua

SEQ ID NO: 927806 - RNA, 19 nt, Homo sapiens
gauaugaucguggguauga

SEQ ID NO: 927807 - RNA, 19 nt, Homo sapiens
gaauagaugacucaaagga

SEQ ID NO: 927808 - RNA, 19 nt, Homo sapiens
cgaaguagaucauauacac

SEQ ID NO: 927809 - RNA, 19 nt, Homo sapiens
caaaggaggcuauggaaag

SEQ ID NO: 927810 - RNA, 19 nt, Homo sapiens
ucaaugugguuuaugauca

SEQ ID NO: 927811 - RNA, 19 nt, Homo sapiens
ggaauggaacagucaggua

SEQ ID NO: 927812 - RNA, 19 nt, Homo sapiens
gcccaagacgcuauugaua

SEQ ID NO: 927813 - RNA, 19 nt, Homo sapiens
gaacagucagguaguugaa

SEQ ID NO: 927814 - RNA, 19 nt, Homo sapiens
ccaagacgcuauugauaac

SEQ ID NO: 927815 - RNA, 19 nt, Homo sapiens
cgagauucuuacuaugaua

SEQ ID NO: 927816 - RNA, 19 nt, Homo sapiens
guucagucaugucagguuu

SEQ ID NO: 927817 - RNA, 19 nt, Homo sapiens
aguaacacaugaaguaguu

SEQ ID NO: 927818 - RNA, 19 nt, Homo sapiens
ucggguggauuauucuaua

SEQ ID NO: 927819 - RNA, 19 nt, Homo sapiens
gaacaguuaaacaucuuga

SEQ ID NO: 927820 - RNA, 19 nt, Homo sapiens
ccaauguuauguuaugcuu

SEQ ID NO: 927821 - RNA, 19 nt, Homo sapiens
ggaauggagcuggauggua

SEQ ID NO: 927822 - RNA, 19 nt, Homo sapiens
agagagggaucuucgugaa

SEQ ID NO: 927823 - RNA, 19 nt, Homo sapiens
ggaacagucagguaguuga

SEQ ID NO: 927824 - RNA, 19 nt, Homo sapiens
cguaguccaucaaggguuu

SEQ ID NO: 927825 - RNA, 19 nt, Homo sapiens
ggauucuuccuacuccuua

SEQ ID NO: 927826 - RNA, 19 nt, Homo sapiens
cccaagacgcuauugauaa

SEQ ID NO: 927827 - RNA, 19 nt, Homo sapiens
ugggcgaucucgaggauuu

SEQ ID NO: 927828 - RNA, 19 nt, Homo sapiens
gugucaaugugguuuauga

SEQ ID NO: 927829 - RNA, 19 nt, Homo sapiens
gacauucucauagacguua

SEQ ID NO: 927830 - RNA, 19 nt, Homo sapiens
uaacggaaugguugcaauu

SEQ ID NO: 927831 - RNA, 19 nt, Homo sapiens
gaucugcauuuaucaugag

SEQ ID NO: 927832 - RNA, 19 nt, Homo sapiens
caguuaaacaucuugagua

SEQ ID NO: 927833 - RNA, 19 nt, Homo sapiens
acggaaugguugcaauuaa

SEQ ID NO: 927834 - RNA, 19 nt, Homo sapiens
gcuggaugguagaagaauu

SEQ ID NO: 927835 - RNA, 19 nt, Homo sapiens
gucagguaguugaaaguuu

SEQ ID NO: 927836 - RNA, 19 nt, Homo sapiens
uagaucauauacaccagaa

SEQ ID NO: 927837 - RNA, 19 nt, Homo sapiens
cggaaugguugcaauuaag

SEQ ID NO: 927838 - RNA, 19 nt, Homo sapiens
acagauaugaagacuauga

SEQ ID NO: 927839 - RNA, 19 nt, Homo sapiens
ucucgaaguagaucauaua

SEQ ID NO: 927840 - RNA, 19 nt, Homo sapiens
gaguggagcggcugugguu

SEQ ID NO: 927841 - RNA, 19 nt, Homo sapiens
gagaucugcauuuaucaug

SEQ ID NO: 927842 - RNA, 19 nt, Homo sapiens
gagucucgcucucagucaa

SEQ ID NO: 927843 - RNA, 19 nt, Homo sapiens
caccuucuccuuauuauag

SEQ ID NO: 927844 - RNA, 19 nt, Homo sapiens
ucagguaguugaaaguuuu

SEQ ID NO: 927845 - RNA, 19 nt, Homo sapiens
gaacuccugcucguguaaa

SEQ ID NO: 927846 - RNA, 19 nt, Homo sapiens
guauuagagaucugcauuu

SEQ ID NO: 927847 - RNA, 19 nt, Homo sapiens
agacuaugauuaccgauac

SEQ ID NO: 927848 - RNA, 19 nt, Homo sapiens
gaucguggguaugacagau

SEQ ID NO: 927849 - RNA, 19 nt, Homo sapiens
gauaaacuucuagcuaauc

SEQ ID NO: 927850 - RNA, 19 nt, Homo sapiens
gauucuuccuacuccuuaa

SEQ ID NO: 927851 - RNA, 19 nt, Homo sapiens
acgaucaccuucuccuuau

SEQ ID NO: 927852 - RNA, 19 nt, Homo sapiens
gguggcagacgucgagauu

SEQ ID NO: 927853 - RNA, 19 nt, Homo sapiens
ggaaaguaacacaugaagu

SEQ ID NO: 927854 - RNA, 19 nt, Homo sapiens
gucgagauucuuacuauga

SEQ ID NO: 927855 - RNA, 19 nt, Homo sapiens
ucaaaggaggcuauggaaa

SEQ ID NO: 927856 - RNA, 19 nt, Homo sapiens
gcaaauccagaucccaaca

SEQ ID NO: 927857 - RNA, 19 nt, Homo sapiens
caaauaaggaaagaaacug

SEQ ID NO: 927858 - RNA, 19 nt, Homo sapiens
cccaagcuguggauucuuc

SEQ ID NO: 927859 - RNA, 19 nt, Homo sapiens
gguaugacagauaugaaga

SEQ ID NO: 927860 - RNA, 19 nt, Homo sapiens
uaugauagaggauaugauc

SEQ ID NO: 927861 - RNA, 19 nt, Homo sapiens
uggcagacgucgagauucu

SEQ ID NO: 927862 - RNA, 19 nt, Homo sapiens
agaucugcauuuaucauga

SEQ ID NO: 927863 - RNA, 19 nt, Homo sapiens
gcuaaucaaauaaggaaag

SEQ ID NO: 927864 - RNA, 19 nt, Homo sapiens
gagcuggaugguagaagaa

SEQ ID NO: 927865 - RNA, 19 nt, Homo sapiens
ugagugauguggaggaaaa

SEQ ID NO: 927866 - RNA, 19 nt, Homo sapiens
caagaucucguuccuacag

SEQ ID NO: 927867 - RNA, 19 nt, Homo sapiens
gggcagaccaacucauagu

SEQ ID NO: 927868 - RNA, 19 nt, Homo sapiens
caugagugauguggaggaa

SEQ ID NO: 927869 - RNA, 19 nt, Homo sapiens
ucuaaccggagaagacaua

SEQ ID NO: 927870 - RNA, 19 nt, Homo sapiens
cuugugaacuccuguaaaa

SEQ ID NO: 927871 - RNA, 19 nt, Homo sapiens
cugcauuuaucaugaguuc

SEQ ID NO: 927872 - RNA, 19 nt, Homo sapiens
uaugauuaccgauacagaa

SEQ ID NO: 927873 - RNA, 19 nt, Homo sapiens
ugccgacucuuuccucuuc

SEQ ID NO: 927874 - RNA, 19 nt, Homo sapiens
aaaggaggcuauggaaagg

SEQ ID NO: 927875 - RNA, 19 nt, Homo sapiens
cauagacguuacacucgau

SEQ ID NO: 927876 - RNA, 19 nt, Homo sapiens
aaaagaaccccaauguuau

SEQ ID NO: 927877 - RNA, 19 nt, Homo sapiens
ggaaugguugcaauuaagg

SEQ ID NO: 927878 - RNA, 19 nt, Homo sapiens
ucgagauucuuacuaugau

SEQ ID NO: 927879 - RNA, 19 nt, Homo sapiens
caaugugguuuaugaucag

SEQ ID NO: 927880 - RNA, 19 nt, Homo sapiens
gaaguauuuucucgauaug

SEQ ID NO: 927881 - RNA, 19 nt, Homo sapiens
acagucagguaguugaaag

SEQ ID NO: 927882 - RNA, 19 nt, Homo sapiens
gaaugguugcaauuaagga

SEQ ID NO: 927883 - RNA, 19 nt, Homo sapiens
cgaucaccuucuccuuauu

SEQ ID NO: 927884 - RNA, 19 nt, Homo sapiens
uagaagaauucggguggau

SEQ ID NO: 927885 - RNA, 19 nt, Homo sapiens
ucagucaugucagguuugu

SEQ ID NO: 927886 - RNA, 19 nt, Homo sapiens
gggaaaguaacacaugaag

SEQ ID NO: 927887 - RNA, 19 nt, Homo sapiens
uugggaaaguaacacauga

SEQ ID NO: 927888 - RNA, 19 nt, Homo sapiens
ggagagcaggucaggaucu

SEQ ID NO: 927889 - RNA, 19 nt, Homo sapiens
gauuaccgauacagaagac

SEQ ID NO: 927890 - RNA, 19 nt, Homo sapiens
uacagaagacgaucaccuu

SEQ ID NO: 927891 - RNA, 19 nt, Homo sapiens
aagacuaugauuaccgaua

SEQ ID NO: 927892 - RNA, 19 nt, Homo sapiens
gaacuaacagcacgacuua

SEQ ID NO: 927893 - RNA, 19 nt, Homo sapiens
gaaguuaagugaaucauag

SEQ ID NO: 927894 - RNA, 19 nt, Homo sapiens
uaaagcagcugaaagaaga

SEQ ID NO: 927895 - RNA, 19 nt, Homo sapiens
caaagaggcugaugaagau

SEQ ID NO: 927896 - RNA, 19 nt, Homo sapiens
ccagagagcuuaaugacaa

SEQ ID NO: 927897 - RNA, 19 nt, Homo sapiens
gagaauggaugaacagaga

SEQ ID NO: 927898 - RNA, 19 nt, Homo sapiens
gcaauaggauggaugauca

SEQ ID NO: 927899 - RNA, 19 nt, Homo sapiens
gaaaagcacuuggaaauuu

SEQ ID NO: 927900 - RNA, 19 nt, Homo sapiens
cagauuagaugaucaaaga

SEQ ID NO: 927901 - RNA, 19 nt, Homo sapiens
gggcaaugcuuauuucuau

SEQ ID NO: 927902 - RNA, 19 nt, Homo sapiens
gaaagagaauggaugaaca

SEQ ID NO: 927903 - RNA, 19 nt, Homo sapiens
caagagcacuuuacaaucu

SEQ ID NO: 927904 - RNA, 19 nt, Homo sapiens
gaucagagauguugcuuac

SEQ ID NO: 927905 - RNA, 19 nt, Homo sapiens
ggagaaauguugcugaagu

SEQ ID NO: 927906 - RNA, 19 nt, Homo sapiens
ccacuaaaguucuccaaga

SEQ ID NO: 927907 - RNA, 19 nt, Homo sapiens
guacuuagccaccugauga

SEQ ID NO: 927908 - RNA, 19 nt, Homo sapiens
gaaagaagagcauauagca

SEQ ID NO: 927909 - RNA, 19 nt, Homo sapiens
ugaccuccuuucauuauua

SEQ ID NO: 927910 - RNA, 19 nt, Homo sapiens
gagauuacuuuaccuagug

SEQ ID NO: 927911 - RNA, 19 nt, Homo sapiens
aaacagagacacugacuuu

SEQ ID NO: 927912 - RNA, 19 nt, Homo sapiens
gaauguguaucaugccaaa

SEQ ID NO: 927913 - RNA, 19 nt, Homo sapiens
caacaaagaggcugaugaa

SEQ ID NO: 927914 - RNA, 19 nt, Homo sapiens
ggccagagaugcaaggauu

SEQ ID NO: 927915 - RNA, 19 nt, Homo sapiens
ggaaacaccuuaaaaguuc

SEQ ID NO: 927916 - RNA, 19 nt, Homo sapiens
ucagagauguugcuuacaa

SEQ ID NO: 927917 - RNA, 19 nt, Homo sapiens
gcacaaauaacuccauaau

SEQ ID NO: 927918 - RNA, 19 nt, Homo sapiens
gaaaagaacugccauacag

SEQ ID NO: 927919 - RNA, 19 nt, Homo sapiens
ggucugagcuacagcacaa

SEQ ID NO: 927920 - RNA, 19 nt, Homo sapiens
ggacgugccuuuggaaauc

SEQ ID NO: 927921 - RNA, 19 nt, Homo sapiens
gaaaaccuaucauuaguga

SEQ ID NO: 927922 - RNA, 19 nt, Homo sapiens
cuucagggaugcaguuaua

SEQ ID NO: 927923 - RNA, 19 nt, Homo sapiens
acagugaaauucuugcuaa

SEQ ID NO: 927924 - RNA, 19 nt, Homo sapiens
ccauacagcuucaacaaca

SEQ ID NO: 927925 - RNA, 19 nt, Homo sapiens
gaacugccauacagcuuca

SEQ ID NO: 927926 - RNA, 19 nt, Homo sapiens
cagcacaaauaacuccaua

SEQ ID NO: 927927 - RNA, 19 nt, Homo sapiens
gaacgucuauguaaaucag

SEQ ID NO: 927928 - RNA, 19 nt, Homo sapiens
gagaauuuauagcacugua

SEQ ID NO: 927929 - RNA, 19 nt, Homo sapiens
gagaaauguugcugaagug

SEQ ID NO: 927930 - RNA, 19 nt, Homo sapiens
uagaagcacagucuuguua

SEQ ID NO: 927931 - RNA, 19 nt, Homo sapiens
gagcagcgucuccuuauug

SEQ ID NO: 927932 - RNA, 19 nt, Homo sapiens
ccaaagcauuagaauauca

SEQ ID NO: 927933 - RNA, 19 nt, Homo sapiens
ggaaguuaagugaaucaua

SEQ ID NO: 927934 - RNA, 19 nt, Homo sapiens
acauugaccuccuuucauu

SEQ ID NO: 927935 - RNA, 19 nt, Homo sapiens
gaaggguucuuugacuuau

SEQ ID NO: 927936 - RNA, 19 nt, Homo sapiens
gaaauugauagcaguuuga

SEQ ID NO: 927937 - RNA, 19 nt, Homo sapiens
aaacacacauuaccuccuu

SEQ ID NO: 927938 - RNA, 19 nt, Homo sapiens
ggauaaaaguggugaacua

SEQ ID NO: 927939 - RNA, 19 nt, Homo sapiens
gaaggaagagcauguugga

SEQ ID NO: 927940 - RNA, 19 nt, Homo sapiens
caagaagacacuacuguug

SEQ ID NO: 927941 - RNA, 19 nt, Homo sapiens
gcauauagcaaccuuggaa

SEQ ID NO: 927942 - RNA, 19 nt, Homo sapiens
uagaauaucaccaucauga

SEQ ID NO: 927943 - RNA, 19 nt, Homo sapiens
caagaugccaguaauucua

SEQ ID NO: 927944 - RNA, 19 nt, Homo sapiens
acaaagaggcugaugaaga

SEQ ID NO: 927945 - RNA, 19 nt, Homo sapiens
gaugacuaaugacaacaaa

SEQ ID NO: 927946 - RNA, 19 nt, Homo sapiens
gggcuaguuucaguaauuu

SEQ ID NO: 927947 - RNA, 19 nt, Homo sapiens
cucaagagcugaaugauag

SEQ ID NO: 927948 - RNA, 19 nt, Homo sapiens
gaagcacagucuuguuaca

SEQ ID NO: 927949 - RNA, 19 nt, Homo sapiens
ccuuggaaaugcauauaua

SEQ ID NO: 927950 - RNA, 19 nt, Homo sapiens
gaagcgaaagcuaguggua

SEQ ID NO: 927951 - RNA, 19 nt, Homo sapiens
gaugaaggguucuuugacu

SEQ ID NO: 927952 - RNA, 19 nt, Homo sapiens
gagaugaaggguucuuuga

SEQ ID NO: 927953 - RNA, 19 nt, Homo sapiens
gaccuccuuucauuauuaa

SEQ ID NO: 927954 - RNA, 19 nt, Homo sapiens
guaaauaguuaaccuucag

SEQ ID NO: 927955 - RNA, 19 nt, Homo sapiens
ccagagggcuaguuucagu

SEQ ID NO: 927956 - RNA, 19 nt, Homo sapiens
aaacgaauuccuccacuaa

SEQ ID NO: 927957 - RNA, 19 nt, Homo sapiens
ugaaauugauagcaguuug

SEQ ID NO: 927958 - RNA, 19 nt, Homo sapiens
caagagagguuggggauaa

SEQ ID NO: 927959 - RNA, 19 nt, Homo sapiens
aaccuucaguagucuauua

SEQ ID NO: 927960 - RNA, 19 nt, Homo sapiens
uaggauggaugaucagaga

SEQ ID NO: 927961 - RNA, 19 nt, Homo sapiens
agaccgagcuguagaagca

SEQ ID NO: 927962 - RNA, 19 nt, Homo sapiens
gcugaaagaagagcauaua

SEQ ID NO: 927963 - RNA, 19 nt, Homo sapiens
gagaagcaagagcacuuua

SEQ ID NO: 927964 - RNA, 19 nt, Homo sapiens
ugaaggguucuuugacuua

SEQ ID NO: 927965 - RNA, 19 nt, Homo sapiens
uagaauuggugaaggaaga

SEQ ID NO: 927966 - RNA, 19 nt, Homo sapiens
uaucauuagugacugcuuu

SEQ ID NO: 927967 - RNA, 19 nt, Homo sapiens
acaaagagaucaaaacaga

SEQ ID NO: 927968 - RNA, 19 nt, Homo sapiens
gcaaggauuugggauacau

SEQ ID NO: 927969 - RNA, 19 nt, Homo sapiens
caaaccuucugcaaagcua

SEQ ID NO: 927970 - RNA, 19 nt, Homo sapiens
gaaaucaugaucaagcaau

SEQ ID NO: 927971 - RNA, 19 nt, Homo sapiens
ggagauaaagcagcugaaa

SEQ ID NO: 927972 - RNA, 19 nt, Homo sapiens
agauguugcuuacaagaaa

SEQ ID NO: 927973 - RNA, 19 nt, Homo sapiens
ugacgaagccauaguuugu

SEQ ID NO: 927974 - RNA, 19 nt, Homo sapiens
ugccaaagcauuagaauau

SEQ ID NO: 927975 - RNA, 19 nt, Homo sapiens
guauuaacaccaacucauu

SEQ ID NO: 927976 - RNA, 19 nt, Homo sapiens
gaugcaaggauuugggaua

SEQ ID NO: 927977 - RNA, 19 nt, Homo sapiens
cugaagcacuuagcaauug

SEQ ID NO: 927978 - RNA, 19 nt, Homo sapiens
agauaaagcagcugaaaga

SEQ ID NO: 927979 - RNA, 19 nt, Homo sapiens
gcaagagcacuuuacaauc

SEQ ID NO: 927980 - RNA, 19 nt, Homo sapiens
gccuagagcuggccuugga

SEQ ID NO: 927981 - RNA, 19 nt, Homo sapiens
uaaaguaggaaguuaagug

SEQ ID NO: 927982 - RNA, 19 nt, Homo sapiens
cacaaaggguccgacagua

SEQ ID NO: 927983 - RNA, 19 nt, Homo sapiens
ugucaaggauccagauuag

SEQ ID NO: 927984 - RNA, 19 nt, Homo sapiens
ugacuaaugacaacaaaga

SEQ ID NO: 927985 - RNA, 19 nt, Homo sapiens
aggguucuuugacuuauua

SEQ ID NO: 927986 - RNA, 19 nt, Homo sapiens
ugauagaauuggugaagga

SEQ ID NO: 927987 - RNA, 19 nt, Homo sapiens
gcuuaaagaccgagcugua

SEQ ID NO: 927988 - RNA, 19 nt, Homo sapiens
uaggagaauuuccagaaga

SEQ ID NO: 927989 - RNA, 19 nt, Homo sapiens
gaagcaagagcacuuuaca

SEQ ID NO: 927990 - RNA, 19 nt, Homo sapiens
ggaagcuucuugccuagag

SEQ ID NO: 927991 - RNA, 19 nt, Homo sapiens
gacacugacuuugggcuaa

SEQ ID NO: 927992 - RNA, 19 nt, Homo sapiens
ggacaggagcccaccauga

SEQ ID NO: 927993 - RNA, 19 nt, Homo sapiens
gaacuuguuuuguugguaa

SEQ ID NO: 927994 - RNA, 19 nt, Homo sapiens
ggccagagcacuuagguuu

SEQ ID NO: 927995 - RNA, 19 nt, Homo sapiens
ccgcuucgcucgugccuuu

SEQ ID NO: 927996 - RNA, 19 nt, Homo sapiens
ggacggagaggagagaguu

SEQ ID NO: 927997 - RNA, 19 nt, Homo sapiens
ccagagcacuuagguuucu

SEQ ID NO: 927998 - RNA, 19 nt, Homo sapiens
gccucuuucugcucuauaa

SEQ ID NO: 927999 - RNA, 19 nt, Homo sapiens
gagaggagagaguuguguu

SEQ ID NO: 928000 - RNA, 19 nt, Homo sapiens
uggcagaggaggaagauga

SEQ ID NO: 928001 - RNA, 19 nt, Homo sapiens
ggucauggcagaggaggaa

SEQ ID NO: 928002 - RNA, 19 nt, Homo sapiens
ugcccuaccugccaaguug

SEQ ID NO: 928003 - RNA, 19 nt, Homo sapiens
ggacuacaacgcagugcau

SEQ ID NO: 928004 - RNA, 19 nt, Homo sapiens
aaaggaacuuguuuuguug

SEQ ID NO: 928005 - RNA, 19 nt, Homo sapiens
uuccaugguuuccagguaa

SEQ ID NO: 928006 - RNA, 19 nt, Homo sapiens
gacaggagcccaccaugac

SEQ ID NO: 928007 - RNA, 19 nt, Homo sapiens
ggagaggagagaguugugu

SEQ ID NO: 928008 - RNA, 19 nt, Homo sapiens
ggaacuuguuuuguuggua

SEQ ID NO: 928009 - RNA, 19 nt, Homo sapiens
uuuccaugguuuccaggua

SEQ ID NO: 928010 - RNA, 19 nt, Homo sapiens
guacgugcaagguguuagu

SEQ ID NO: 928011 - RNA, 19 nt, Homo sapiens
gggccucuuucugcucuau

SEQ ID NO: 928012 - RNA, 19 nt, Homo sapiens
caugguuuccagguaauaa

SEQ ID NO: 928013 - RNA, 19 nt, Homo sapiens
gauguuaacuugacagucu

SEQ ID NO: 928014 - RNA, 19 nt, Homo sapiens
gaacagggagaacaucuga

SEQ ID NO: 928015 - RNA, 19 nt, Homo sapiens
aaagauggauacaaaguga

SEQ ID NO: 928016 - RNA, 19 nt, Homo sapiens
uaauuggucugauguaguu

SEQ ID NO: 928017 - RNA, 19 nt, Homo sapiens
caaggaaacuguucaugca

SEQ ID NO: 928018 - RNA, 19 nt, Homo sapiens
gacaucaacuggagagaga

SEQ ID NO: 928019 - RNA, 19 nt, Homo sapiens
guaagucacugaagauuuu

SEQ ID NO: 928020 - RNA, 19 nt, Homo sapiens
ccacaggccagaagcguua

SEQ ID NO: 928021 - RNA, 19 nt, Homo sapiens
gagaaacaaagaagggaua

SEQ ID NO: 928022 - RNA, 19 nt, Homo sapiens
gaaggcaccucuuguuuug

SEQ ID NO: 928023 - RNA, 19 nt, Homo sapiens
guuguguccuguauguuua

SEQ ID NO: 928024 - RNA, 19 nt, Homo sapiens
uuggauaccugaguaauaa

SEQ ID NO: 928025 - RNA, 19 nt, Homo sapiens
guaguuccauguaccaaug

SEQ ID NO: 928026 - RNA, 19 nt, Homo sapiens
cugaagauguuaaugaaga

SEQ ID NO: 928027 - RNA, 19 nt, Homo sapiens
gcagacguuugaccuguau

SEQ ID NO: 928028 - RNA, 19 nt, Homo sapiens
uaauaacggacaacagaua

SEQ ID NO: 928029 - RNA, 19 nt, Homo sapiens
gaucuggaauacugaagug

SEQ ID NO: 928030 - RNA, 19 nt, Homo sapiens
agucuugucucguguauug

SEQ ID NO: 928031 - RNA, 19 nt, Homo sapiens
guauugaauucgugccaaa

SEQ ID NO: 928032 - RNA, 19 nt, Homo sapiens
caucacagaagccgccuua

SEQ ID NO: 928033 - RNA, 19 nt, Homo sapiens
ccaccucucuaaaucaaug

SEQ ID NO: 928034 - RNA, 19 nt, Homo sapiens
aaacaauccaccucucuaa

SEQ ID NO: 928035 - RNA, 19 nt, Homo sapiens
gugcugaggaucuggaaua

SEQ ID NO: 928036 - RNA, 19 nt, Homo sapiens
gcauuacccuugcacuaca

SEQ ID NO: 928037 - RNA, 19 nt, Homo sapiens
caauccaccucucuaaauc

SEQ ID NO: 928038 - RNA, 19 nt, Homo sapiens
ggaaaacuccccaaaauca

SEQ ID NO: 928039 - RNA, 19 nt, Homo sapiens
gcaaaugugcugaggaucu

SEQ ID NO: 928040 - RNA, 19 nt, Homo sapiens
ugaguuguguccuguaugu

SEQ ID NO: 928041 - RNA, 19 nt, Homo sapiens
caaacaauccaccucucua

SEQ ID NO: 928042 - RNA, 19 nt, Homo sapiens
gguaagggguugugaguug

SEQ ID NO: 928043 - RNA, 19 nt, Homo sapiens
uaccagaauuccaaagguu

SEQ ID NO: 928044 - RNA, 19 nt, Homo sapiens
caaaugugcugaggaucug

SEQ ID NO: 928045 - RNA, 19 nt, Homo sapiens
cauguaccaaugauaguua

SEQ ID NO: 928046 - RNA, 19 nt, Homo sapiens
ggaaacuguucaugcaaac

SEQ ID NO: 928047 - RNA, 19 nt, Homo sapiens
uuccaaagguucugauaga

SEQ ID NO: 928048 - RNA, 19 nt, Homo sapiens
cggaucagcuggauacucu

SEQ ID NO: 928049 - RNA, 19 nt, Homo sapiens
agauguaagucacugaaga

SEQ ID NO: 928050 - RNA, 19 nt, Homo sapiens
gaaacaaagaagggauaaa

SEQ ID NO: 928051 - RNA, 19 nt, Homo sapiens
guauauuucccuccuguga

SEQ ID NO: 928052 - RNA, 19 nt, Homo sapiens
cugaggaucuggaauacug

SEQ ID NO: 928053 - RNA, 19 nt, Homo sapiens
aggaaacuguucaugcaaa

SEQ ID NO: 928054 - RNA, 19 nt, Homo sapiens
ggauaugcaucuaaaacaa

SEQ ID NO: 928055 - RNA, 19 nt, Homo sapiens
caccugaaaugcucauaca

SEQ ID NO: 928056 - RNA, 19 nt, Homo sapiens
caaagauggauacaaagug

SEQ ID NO: 928057 - RNA, 19 nt, Homo sapiens
gaucagcuggauacucuug

SEQ ID NO: 928058 - RNA, 19 nt, Homo sapiens
ggaaggcaccucuuguuuu

SEQ ID NO: 928059 - RNA, 19 nt, Homo sapiens
gaagaccaaggaaacuguu

SEQ ID NO: 928060 - RNA, 19 nt, Homo sapiens
cagcauuacccuugcacua

SEQ ID NO: 928061 - RNA, 19 nt, Homo sapiens
gugcuucgguccgugguuu

SEQ ID NO: 928062 - RNA, 19 nt, Homo sapiens
aaacuggauaugcaucuaa

SEQ ID NO: 928063 - RNA, 19 nt, Homo sapiens
gauguaagucacugaagau

SEQ ID NO: 928064 - RNA, 19 nt, Homo sapiens
caagauguaagucacugaa

SEQ ID NO: 928065 - RNA, 19 nt, Homo sapiens
aaugcaaacuaucugaaga

SEQ ID NO: 928066 - RNA, 19 nt, Homo sapiens
gaacucacacauagcuaag

SEQ ID NO: 928067 - RNA, 19 nt, Homo sapiens
ugaacucacacauagcuaa

SEQ ID NO: 928068 - RNA, 19 nt, Homo sapiens
cagcuggauacucuuguua

SEQ ID NO: 928069 - RNA, 19 nt, Homo sapiens
ucaaagauggauacaaagu

SEQ ID NO: 928070 - RNA, 19 nt, Homo sapiens
aauaacggacaacagauaa

SEQ ID NO: 928071 - RNA, 19 nt, Homo sapiens
gauaaagcuccgcauccuu

SEQ ID NO: 928072 - RNA, 19 nt, Homo sapiens
ucauacagcauucccuuug

SEQ ID NO: 928073 - RNA, 19 nt, Homo sapiens
acucacagaaacagcauua

SEQ ID NO: 928074 - RNA, 19 nt, Homo sapiens
aguaauaacggacaacaga

SEQ ID NO: 928075 - RNA, 19 nt, Homo sapiens
uggaaggcaccucuuguuu

SEQ ID NO: 928076 - RNA, 19 nt, Homo sapiens
uguccucacucaucacaga

SEQ ID NO: 928077 - RNA, 19 nt, Homo sapiens
cagguguccucacucauca

SEQ ID NO: 928078 - RNA, 19 nt, Homo sapiens
acaauccaccucucuaaau

SEQ ID NO: 928079 - RNA, 19 nt, Homo sapiens
cgccuuagcucccguuacu

SEQ ID NO: 928080 - RNA, 19 nt, Homo sapiens
ucagcuggauacucuuguu

SEQ ID NO: 928081 - RNA, 19 nt, Homo sapiens
ccaaugauaguuauguaag

SEQ ID NO: 928082 - RNA, 19 nt, Homo sapiens
gaagaacagggagaacauc

SEQ ID NO: 928083 - RNA, 19 nt, Homo sapiens
uugcaaaugugcugaggau

SEQ ID NO: 928084 - RNA, 19 nt, Homo sapiens
gcugcaagaguuauggaaa

SEQ ID NO: 928085 - RNA, 19 nt, Homo sapiens
gagccgccucuccggaaua

SEQ ID NO: 928086 - RNA, 19 nt, Homo sapiens
guaccaaugauaguuaugu

SEQ ID NO: 928087 - RNA, 19 nt, Homo sapiens
guaauuggucugauguagu

SEQ ID NO: 928088 - RNA, 19 nt, Homo sapiens
uguuuaggaugguauuguu

SEQ ID NO: 928089 - RNA, 19 nt, Homo sapiens
uguaagucacugaagauuu

SEQ ID NO: 928090 - RNA, 19 nt, Homo sapiens
guggaaggcaccucuuguu

SEQ ID NO: 928091 - RNA, 19 nt, Homo sapiens
cuggaauacugaaguggaa

SEQ ID NO: 928092 - RNA, 19 nt, Homo sapiens
guuuaggaugguauuguua

SEQ ID NO: 928093 - RNA, 19 nt, Homo sapiens
guaauaacggacaacagau

SEQ ID NO: 928094 - RNA, 19 nt, Homo sapiens
gauagaaucaaagauggau

SEQ ID NO: 928095 - RNA, 19 nt, Homo sapiens
cuuggauaccugaguaaua

SEQ ID NO: 928096 - RNA, 19 nt, Homo sapiens
aaacagcauuacccuugca

SEQ ID NO: 928097 - RNA, 19 nt, Homo sapiens
gaaucaaagauggauacaa

SEQ ID NO: 928098 - RNA, 19 nt, Homo sapiens
ccagguguccucacucauc

SEQ ID NO: 928099 - RNA, 19 nt, Homo sapiens
gaaguggaaggcaccucuu

SEQ ID NO: 928100 - RNA, 19 nt, Homo sapiens
uaacggacaacagauaaag

SEQ ID NO: 928101 - RNA, 19 nt, Homo sapiens
auacuuguacuucuagcua

SEQ ID NO: 928102 - RNA, 19 nt, Homo sapiens
cauacagcauucccuuugg

SEQ ID NO: 928103 - RNA, 19 nt, Homo sapiens
ugaagaggcaguacaugca

SEQ ID NO: 928104 - RNA, 19 nt, Homo sapiens
uaaugaagaggcaguacau

SEQ ID NO: 928105 - RNA, 19 nt, Homo sapiens
ugaagauguuaaugaagag

SEQ ID NO: 928106 - RNA, 19 nt, Homo sapiens
gaaaacuccccaaaaucaa

SEQ ID NO: 928107 - RNA, 19 nt, Homo sapiens
uguaauuggucugauguag

SEQ ID NO: 928108 - RNA, 19 nt, Homo sapiens
ugugaguuguguccuguau

SEQ ID NO: 928109 - RNA, 19 nt, Homo sapiens
ugcagacguuugaccugua

SEQ ID NO: 928110 - RNA, 19 nt, Homo sapiens
cuucagcacagcucacaaa

SEQ ID NO: 928111 - RNA, 19 nt, Homo sapiens
ugaagaacagggagaacau

SEQ ID NO: 928112 - RNA, 19 nt, Homo sapiens
uggugacccucgcgauuug

SEQ ID NO: 928113 - RNA, 19 nt, Homo sapiens
ggugccagcuggacaaauu

SEQ ID NO: 928114 - RNA, 19 nt, Homo sapiens
gaggaccacugccggauga

SEQ ID NO: 928115 - RNA, 19 nt, Homo sapiens
gaugagaccuucgagaucu

SEQ ID NO: 928116 - RNA, 19 nt, Homo sapiens
ggacaaugaaggacgauga

SEQ ID NO: 928117 - RNA, 19 nt, Homo sapiens
ggacagaccuccccaacuc

SEQ ID NO: 928118 - RNA, 19 nt, Homo sapiens
ucgaggaccuggaggaaga

SEQ ID NO: 928119 - RNA, 19 nt, Homo sapiens
caacuccgcgugagacaga

SEQ ID NO: 928120 - RNA, 19 nt, Homo sapiens
cgcgugagacagagaauua

SEQ ID NO: 928121 - RNA, 19 nt, Homo sapiens
ggacaaauucaucucuucu

SEQ ID NO: 928122 - RNA, 19 nt, Homo sapiens
aaaacgacgugaaaauuug

SEQ ID NO: 928123 - RNA, 19 nt, Homo sapiens
ccaccuagacccacagauc

SEQ ID NO: 928124 - RNA, 19 nt, Homo sapiens
agucggaggcggacaauga

SEQ ID NO: 928125 - RNA, 19 nt, Homo sapiens
acgagacgcucaagaaggu

SEQ ID NO: 928126 - RNA, 19 nt, Homo sapiens
gaucuccauucccuucgau

SEQ ID NO: 928127 - RNA, 19 nt, Homo sapiens
gcagaagggaggugcuagu

SEQ ID NO: 928128 - RNA, 19 nt, Homo sapiens
ggaggcggacaaugaagga

SEQ ID NO: 928129 - RNA, 19 nt, Homo sapiens
uggacaaauucaucucuuc

SEQ ID NO: 928130 - RNA, 19 nt, Homo sapiens
ggagcugcccaccugauuc

SEQ ID NO: 928131 - RNA, 19 nt, Homo sapiens
gugcaggcgcucaagaaga

SEQ ID NO: 928132 - RNA, 19 nt, Homo sapiens
ugcaggcgcucaagaagag

SEQ ID NO: 928133 - RNA, 19 nt, Homo sapiens
ggagaggcagcgagugaag

SEQ ID NO: 928134 - RNA, 19 nt, Homo sapiens
gcuagucggaggcgcuuug

SEQ ID NO: 928135 - RNA, 19 nt, Homo sapiens
cgacgagacgcucaagaag

SEQ ID NO: 928136 - RNA, 19 nt, Homo sapiens
gaccuucgagaucuccauu

SEQ ID NO: 928137 - RNA, 19 nt, Homo sapiens
cgugagacagagaauuauu

SEQ ID NO: 928138 - RNA, 19 nt, Homo sapiens
gacaaauucaucucuucug

SEQ ID NO: 928139 - RNA, 19 nt, Homo sapiens
cgaugagaccuucgagauc

SEQ ID NO: 928140 - RNA, 19 nt, Homo sapiens
ggaacuccuggcugcagaa

SEQ ID NO: 928141 - RNA, 19 nt, Homo sapiens
ccuagacccacagaucuuu

SEQ ID NO: 928142 - RNA, 19 nt, Homo sapiens
gggaauggcuggaugauga

SEQ ID NO: 928143 - RNA, 19 nt, Homo sapiens
cgaagaagcucuccaacuu

SEQ ID NO: 928144 - RNA, 19 nt, Homo sapiens
gaacauggcagacgaagau

SEQ ID NO: 928145 - RNA, 19 nt, Homo sapiens
ggagagggaugcagugaau

SEQ ID NO: 928146 - RNA, 19 nt, Homo sapiens
ggauggcgcucuucuucua

SEQ ID NO: 928147 - RNA, 19 nt, Homo sapiens
gaacaaaaccaaaggauuu

SEQ ID NO: 928148 - RNA, 19 nt, Homo sapiens
aaucaagccucacguaauu

SEQ ID NO: 928149 - RNA, 19 nt, Homo sapiens
gaacauggccacucauaca

SEQ ID NO: 928150 - RNA, 19 nt, Homo sapiens
ugaagaagcagccuaauga

SEQ ID NO: 928151 - RNA, 19 nt, Homo sapiens
ugacuuaucucuucacagu

SEQ ID NO: 928152 - RNA, 19 nt, Homo sapiens
guaguuggcuuguguuaca

SEQ ID NO: 928153 - RNA, 19 nt, Homo sapiens
gcaguugccucaucacauc

SEQ ID NO: 928154 - RNA, 19 nt, Homo sapiens
ggacagcgacgaugaggaa

SEQ ID NO: 928155 - RNA, 19 nt, Homo sapiens
gaacaaugaagcagguaaa

SEQ ID NO: 928156 - RNA, 19 nt, Homo sapiens
gaccuucgccucugcauuu

SEQ ID NO: 928157 - RNA, 19 nt, Homo sapiens
gcaaacuccuuccacuuca

SEQ ID NO: 928158 - RNA, 19 nt, Homo sapiens
gggcuaggaggaaagauua

SEQ ID NO: 928159 - RNA, 19 nt, Homo sapiens
gagaacauggccacucaua

SEQ ID NO: 928160 - RNA, 19 nt, Homo sapiens
ccaaagcgcugggauuaca

SEQ ID NO: 928161 - RNA, 19 nt, Homo sapiens
gacacuacaugaacacgaa

SEQ ID NO: 928162 - RNA, 19 nt, Homo sapiens
ccaccacacucagcuaauu

SEQ ID NO: 928163 - RNA, 19 nt, Homo sapiens
gaagaagcagccuaaugaa

SEQ ID NO: 928164 - RNA, 19 nt, Homo sapiens
gcuacgggcuggagaagga

SEQ ID NO: 928165 - RNA, 19 nt, Homo sapiens
uagaggcccugcacuggua

SEQ ID NO: 928166 - RNA, 19 nt, Homo sapiens
ggacggguauguguagaga

SEQ ID NO: 928167 - RNA, 19 nt, Homo sapiens
gguagaaagugaagauuuu

SEQ ID NO: 928168 - RNA, 19 nt, Homo sapiens
gggcccagauggaggagua

SEQ ID NO: 928169 - RNA, 19 nt, Homo sapiens
gaaguggaaucuccucaac

SEQ ID NO: 928170 - RNA, 19 nt, Homo sapiens
gaaguacgagucugacgaa

SEQ ID NO: 928171 - RNA, 19 nt, Homo sapiens
ucagugaccucgauaacau

SEQ ID NO: 928172 - RNA, 19 nt, Homo sapiens
gggaugcagugaaucagaa

SEQ ID NO: 928173 - RNA, 19 nt, Homo sapiens
gcccugcuguuguaaugua

SEQ ID NO: 928174 - RNA, 19 nt, Homo sapiens
gcaggaauuggcaaacuuu

SEQ ID NO: 928175 - RNA, 19 nt, Homo sapiens
ggagugcagugacaugauc

SEQ ID NO: 928176 - RNA, 19 nt, Homo sapiens
acaccaagcugcugcaauc

SEQ ID NO: 928177 - RNA, 19 nt, Homo sapiens
ggacgaagaagcucuccaa

SEQ ID NO: 928178 - RNA, 19 nt, Homo sapiens
guaaucaagccucacguaa

SEQ ID NO: 928179 - RNA, 19 nt, Homo sapiens
gaagugcaaaggcuuaaug

SEQ ID NO: 928180 - RNA, 19 nt, Homo sapiens
cagagaccaugaucaucua

SEQ ID NO: 928181 - RNA, 19 nt, Homo sapiens
cauggccacucauacagua

SEQ ID NO: 928182 - RNA, 19 nt, Homo sapiens
acuuaucucuucacaguaa

SEQ ID NO: 928183 - RNA, 19 nt, Homo sapiens
gcagugacaugaucuuagc

SEQ ID NO: 928184 - RNA, 19 nt, Homo sapiens
guaaagggguagaaaguga

SEQ ID NO: 928185 - RNA, 19 nt, Homo sapiens
ccugaucacucguuuaagu

SEQ ID NO: 928186 - RNA, 19 nt, Homo sapiens
acccuuaaaugaacaauga

SEQ ID NO: 928187 - RNA, 19 nt, Homo sapiens
gaaccaacauaccguuuug

SEQ ID NO: 928188 - RNA, 19 nt, Homo sapiens
caaacgggcuaggaggaaa

SEQ ID NO: 928189 - RNA, 19 nt, Homo sapiens
ggagacagaagagaacaaa

SEQ ID NO: 928190 - RNA, 19 nt, Homo sapiens
ggagacgggcacugacuuu

SEQ ID NO: 928191 - RNA, 19 nt, Homo sapiens
gaagcagccuaaugaacca

SEQ ID NO: 928192 - RNA, 19 nt, Homo sapiens
ggguagaaagugaagauuu

SEQ ID NO: 928193 - RNA, 19 nt, Homo sapiens
ugucaucucuucucuagca

SEQ ID NO: 928194 - RNA, 19 nt, Homo sapiens
uaugucaucucuucucuag

SEQ ID NO: 928195 - RNA, 19 nt, Homo sapiens
ccacugagcccagccaaga

SEQ ID NO: 928196 - RNA, 19 nt, Homo sapiens
gagaaggacccgcagagau

SEQ ID NO: 928197 - RNA, 19 nt, Homo sapiens
cauaaaugacagugacuuu

SEQ ID NO: 928198 - RNA, 19 nt, Homo sapiens
ccaagcagguggacaucau

SEQ ID NO: 928199 - RNA, 19 nt, Homo sapiens
ugaaggagacagaagagaa

SEQ ID NO: 928200 - RNA, 19 nt, Homo sapiens
aaugucaauuccaagguua

SEQ ID NO: 928201 - RNA, 19 nt, Homo sapiens
guuccaaaguucagugugu

SEQ ID NO: 928202 - RNA, 19 nt, Homo sapiens
gacaugaucuuagcucacu

SEQ ID NO: 928203 - RNA, 19 nt, Homo sapiens
gacgggcacugacuuugga

SEQ ID NO: 928204 - RNA, 19 nt, Homo sapiens
caacuccaacucuggcuuu

SEQ ID NO: 928205 - RNA, 19 nt, Homo sapiens
gaacugaucacccuuuugu

SEQ ID NO: 928206 - RNA, 19 nt, Homo sapiens
agccaagacuucaguguug

SEQ ID NO: 928207 - RNA, 19 nt, Homo sapiens
ccgagaacauggccacuca

SEQ ID NO: 928208 - RNA, 19 nt, Homo sapiens
gaagcuagaccaccuccau

SEQ ID NO: 928209 - RNA, 19 nt, Homo sapiens
agaccgggauguguacuuu

SEQ ID NO: 928210 - RNA, 19 nt, Homo sapiens
caaacuccuuccacuucaa

SEQ ID NO: 928211 - RNA, 19 nt, Homo sapiens
uggcugguguuccaauaaa

SEQ ID NO: 928212 - RNA, 19 nt, Homo sapiens
gcgacgaugaggaagguua

SEQ ID NO: 928213 - RNA, 19 nt, Homo sapiens
ggacucaucauagccaguu

SEQ ID NO: 928214 - RNA, 19 nt, Homo sapiens
ccucugcauuuguccagua

SEQ ID NO: 928215 - RNA, 19 nt, Homo sapiens
gcaaacgggcuaggaggaa

SEQ ID NO: 928216 - RNA, 19 nt, Homo sapiens
gcccugcacugguacaaca

SEQ ID NO: 928217 - RNA, 19 nt, Homo sapiens
gaugaaguucugaucaaga

SEQ ID NO: 928218 - RNA, 19 nt, Homo sapiens
ggaagcacgcaauccagaa

SEQ ID NO: 928219 - RNA, 19 nt, Homo sapiens
ggcaaacuccuuccacuuc

SEQ ID NO: 928220 - RNA, 19 nt, Homo sapiens
uauagccucugcugcaaau

SEQ ID NO: 928221 - RNA, 19 nt, Homo sapiens
caaugaagcagguaaaauu

SEQ ID NO: 928222 - RNA, 19 nt, Homo sapiens
gccaagacuucaguguuga

SEQ ID NO: 928223 - RNA, 19 nt, Homo sapiens
ggagaaggacccgcagaga

SEQ ID NO: 928224 - RNA, 19 nt, Homo sapiens
ccacagacacuacaugaac

SEQ ID NO: 928225 - RNA, 19 nt, Homo sapiens
uaauuuguguucccugauc

SEQ ID NO: 928226 - RNA, 19 nt, Homo sapiens
cauauagccucugcugcaa

SEQ ID NO: 928227 - RNA, 19 nt, Homo sapiens
guucuuaguuguaugucau

SEQ ID NO: 928228 - RNA, 19 nt, Homo sapiens
gaaggagacagaagagaac

SEQ ID NO: 928229 - RNA, 19 nt, Homo sapiens
ccagagaccaugaucaucu

SEQ ID NO: 928230 - RNA, 19 nt, Homo sapiens
gaucaguaguuggcuugug

SEQ ID NO: 928231 - RNA, 19 nt, Homo sapiens
ggaccacccauaaaugaca

SEQ ID NO: 928232 - RNA, 19 nt, Homo sapiens
caccgggagucugagaaua

SEQ ID NO: 928233 - RNA, 19 nt, Homo sapiens
gaguguggcugguguucca

SEQ ID NO: 928234 - RNA, 19 nt, Homo sapiens
ccaagguuaauaaguacua

SEQ ID NO: 928235 - RNA, 19 nt, Homo sapiens
ucacguaauucaugcuuuu

SEQ ID NO: 928236 - RNA, 19 nt, Homo sapiens
uaaucaagccucacguaau

SEQ ID NO: 928237 - RNA, 19 nt, Homo sapiens
ggagaugacggacugugau

SEQ ID NO: 928238 - RNA, 19 nt, Homo sapiens
ggaauggcuggaugaugaa

SEQ ID NO: 928239 - RNA, 19 nt, Homo sapiens
gaucacucguuuaaguucu

SEQ ID NO: 928240 - RNA, 19 nt, Homo sapiens
ggaguaaccaggaaaauca

SEQ ID NO: 928241 - RNA, 19 nt, Homo sapiens
gaaggacccgcagagauca

SEQ ID NO: 928242 - RNA, 19 nt, Homo sapiens
ggacaacaauaccacauuu

SEQ ID NO: 928243 - RNA, 19 nt, Homo sapiens
caaauaaagugacugaacu

SEQ ID NO: 928244 - RNA, 19 nt, Homo sapiens
gaaccuguccuucuuuguu

SEQ ID NO: 928245 - RNA, 19 nt, Homo sapiens
gacguuagucuuccaaaua

SEQ ID NO: 928246 - RNA, 19 nt, Homo sapiens
cagaacggcuguaccagaa

SEQ ID NO: 928247 - RNA, 19 nt, Homo sapiens
gcaaagaauguuguaguuu

SEQ ID NO: 928248 - RNA, 19 nt, Homo sapiens
aaagaacuguggacaacaa

SEQ ID NO: 928249 - RNA, 19 nt, Homo sapiens
ucgagaagcugcugcauca

SEQ ID NO: 928250 - RNA, 19 nt, Homo sapiens
aaagucugauguagaagua

SEQ ID NO: 928251 - RNA, 19 nt, Homo sapiens
gcacgcagguggaagaacu

SEQ ID NO: 928252 - RNA, 19 nt, Homo sapiens
gacaacaauaccacauuua

SEQ ID NO: 928253 - RNA, 19 nt, Homo sapiens
cuucauauauguagugguu

SEQ ID NO: 928254 - RNA, 19 nt, Homo sapiens
ggcggaagguggagaaguu

SEQ ID NO: 928255 - RNA, 19 nt, Homo sapiens
uaucagacguacuacaaug

SEQ ID NO: 928256 - RNA, 19 nt, Homo sapiens
auagacaaguggaccauuu

SEQ ID NO: 928257 - RNA, 19 nt, Homo sapiens
ucaacaagaucaagcuauc

SEQ ID NO: 928258 - RNA, 19 nt, Homo sapiens
gaacuguggacaacaauac

SEQ ID NO: 928259 - RNA, 19 nt, Homo sapiens
acguuagucuuccaaauaa

SEQ ID NO: 928260 - RNA, 19 nt, Homo sapiens
ugggagaaaugaagauaau

SEQ ID NO: 928261 - RNA, 19 nt, Homo sapiens
ggaagaacucaguaaaaua

SEQ ID NO: 928262 - RNA, 19 nt, Homo sapiens
ugcaaagaauguuguaguu

SEQ ID NO: 928263 - RNA, 19 nt, Homo sapiens
caagaucaagcuaucgaaa

SEQ ID NO: 928264 - RNA, 19 nt, Homo sapiens
gcuaucgaaacuucuauuu

SEQ ID NO: 928265 - RNA, 19 nt, Homo sapiens
caacaauaccacauuuaca

SEQ ID NO: 928266 - RNA, 19 nt, Homo sapiens
caagcuaucgaaacuucua

SEQ ID NO: 928267 - RNA, 19 nt, Homo sapiens
ugacguuagucuuccaaau

SEQ ID NO: 928268 - RNA, 19 nt, Homo sapiens
gguggaagaacucaguaaa

SEQ ID NO: 928269 - RNA, 19 nt, Homo sapiens
gagaagcugcugcaucaca

SEQ ID NO: 928270 - RNA, 19 nt, Homo sapiens
aaagaccauuuacaaguag

SEQ ID NO: 928271 - RNA, 19 nt, Homo sapiens
guagaaguacaaacagaga

SEQ ID NO: 928272 - RNA, 19 nt, Homo sapiens
guccuucuuuguuguuauu

SEQ ID NO: 928273 - RNA, 19 nt, Homo sapiens
gaagaacucaguaaaauac

SEQ ID NO: 928274 - RNA, 19 nt, Homo sapiens
aauaccacauuuacaccua

SEQ ID NO: 928275 - RNA, 19 nt, Homo sapiens
aaaccagaauuagaacuuc

SEQ ID NO: 928276 - RNA, 19 nt, Homo sapiens
ccaaauaaagugacugaac

SEQ ID NO: 928277 - RNA, 19 nt, Homo sapiens
caaaagaacuguggacaac

SEQ ID NO: 928278 - RNA, 19 nt, Homo sapiens
ugccucaaauucacaggua

SEQ ID NO: 928279 - RNA, 19 nt, Homo sapiens
gggagaaaugaagauaaua

SEQ ID NO: 928280 - RNA, 19 nt, Homo sapiens
caacgugggagaaaugaag

SEQ ID NO: 928281 - RNA, 19 nt, Homo sapiens
guccagauauuuugacuga

SEQ ID NO: 928282 - RNA, 19 nt, Homo sapiens
guccgucacagcauauaua

SEQ ID NO: 928283 - RNA, 19 nt, Homo sapiens
gaacgcagaaagcaacaac

SEQ ID NO: 928284 - RNA, 19 nt, Homo sapiens
gcugcugcaucacacagaa

SEQ ID NO: 928285 - RNA, 19 nt, Homo sapiens
aaccuguccuucuuuguug

SEQ ID NO: 928286 - RNA, 19 nt, Homo sapiens
ggaagguggagaaguugga

SEQ ID NO: 928287 - RNA, 19 nt, Homo sapiens
cgucacagcauauauaagg

SEQ ID NO: 928288 - RNA, 19 nt, Homo sapiens
gcagguggaagaacucagu

SEQ ID NO: 928289 - RNA, 19 nt, Homo sapiens
auaccacauuuacaccuaa

SEQ ID NO: 928290 - RNA, 19 nt, Homo sapiens
gaagguggagaaguuggaa

SEQ ID NO: 928291 - RNA, 19 nt, Homo sapiens
ggagaaguuggaacgugaa

SEQ ID NO: 928292 - RNA, 19 nt, Homo sapiens
agaucaagcuaucgaaacu

SEQ ID NO: 928293 - RNA, 19 nt, Homo sapiens
acugucagaucaacaagau

SEQ ID NO: 928294 - RNA, 19 nt, Homo sapiens
ugaacugucagaucaacaa

SEQ ID NO: 928295 - RNA, 19 nt, Homo sapiens
gccucaaauucacagguaa

SEQ ID NO: 928296 - RNA, 19 nt, Homo sapiens
uacaaugacguuagucuuc

SEQ ID NO: 928297 - RNA, 19 nt, Homo sapiens
uggaagaacucaguaaaau

SEQ ID NO: 928298 - RNA, 19 nt, Homo sapiens
gugggagaaaugaagauaa

SEQ ID NO: 928299 - RNA, 19 nt, Homo sapiens
uuugguccgucacagcaua

SEQ ID NO: 928300 - RNA, 19 nt, Homo sapiens
gaucaagcuaucgaaacuu

SEQ ID NO: 928301 - RNA, 19 nt, Homo sapiens
gaacugucagaucaacaag

SEQ ID NO: 928302 - RNA, 19 nt, Homo sapiens
cuacaaugacguuagucuu

SEQ ID NO: 928303 - RNA, 19 nt, Homo sapiens
acaacaauaccacauuuac

SEQ ID NO: 928304 - RNA, 19 nt, Homo sapiens
cuacuacauuguguuccaa

SEQ ID NO: 928305 - RNA, 19 nt, Homo sapiens
cguuagucuuccaaauaaa

SEQ ID NO: 928306 - RNA, 19 nt, Homo sapiens
gaccauuuacaaguagaaa

SEQ ID NO: 928307 - RNA, 19 nt, Homo sapiens
ggacaaagcucaaguauga

SEQ ID NO: 928308 - RNA, 19 nt, Homo sapiens
gaauauaacuccacaagau

SEQ ID NO: 928309 - RNA, 19 nt, Homo sapiens
ggaacuacauuaagaggua

SEQ ID NO: 928310 - RNA, 19 nt, Homo sapiens
gaacuuugcucuucaucuu

SEQ ID NO: 928311 - RNA, 19 nt, Homo sapiens
gcuaugaauugcuaucuaa

SEQ ID NO: 928312 - RNA, 19 nt, Homo sapiens
ccaaggacaugcccuacua

SEQ ID NO: 928313 - RNA, 19 nt, Homo sapiens
gcacauuuccacccaauuu

SEQ ID NO: 928314 - RNA, 19 nt, Homo sapiens
gcaauuggcuuccucuuuu

SEQ ID NO: 928315 - RNA, 19 nt, Homo sapiens
ggaagagccuccagaugug

SEQ ID NO: 928316 - RNA, 19 nt, Homo sapiens
ggaagacccuacagagaau

SEQ ID NO: 928317 - RNA, 19 nt, Homo sapiens
ggacacacaugcggucuug

SEQ ID NO: 928318 - RNA, 19 nt, Homo sapiens
ggcaggaacuacauuaaga

SEQ ID NO: 928319 - RNA, 19 nt, Homo sapiens
caggagaucuuccgcaugu

SEQ ID NO: 928320 - RNA, 19 nt, Homo sapiens
uaagaagugugcuguagug

SEQ ID NO: 928321 - RNA, 19 nt, Homo sapiens
gaagaaagugaucucaaga

SEQ ID NO: 928322 - RNA, 19 nt, Homo sapiens
ccucugagaucuucaacuu

SEQ ID NO: 928323 - RNA, 19 nt, Homo sapiens
gagaagcaccacauccuuu

SEQ ID NO: 928324 - RNA, 19 nt, Homo sapiens
gcaaaugggcgaugaacau

SEQ ID NO: 928325 - RNA, 19 nt, Homo sapiens
gacuagaccuuccagugaa

SEQ ID NO: 928326 - RNA, 19 nt, Homo sapiens
ggagaucuuccgcauguuu

SEQ ID NO: 928327 - RNA, 19 nt, Homo sapiens
ugaagaaagugaucucaag

SEQ ID NO: 928328 - RNA, 19 nt, Homo sapiens
guucagcucuguacuugga

SEQ ID NO: 928329 - RNA, 19 nt, Homo sapiens
cuacaucacucaccacuac

SEQ ID NO: 928330 - RNA, 19 nt, Homo sapiens
ggacaccaguggcaucuac

SEQ ID NO: 928331 - RNA, 19 nt, Homo sapiens
gagaaggaaauaaaccaaa

SEQ ID NO: 928332 - RNA, 19 nt, Homo sapiens
gcaagugaauaaagcacau

SEQ ID NO: 928333 - RNA, 19 nt, Homo sapiens
ugacuagaccuuccaguga

SEQ ID NO: 928334 - RNA, 19 nt, Homo sapiens
gaauugcuaucuaaaucuc

SEQ ID NO: 928335 - RNA, 19 nt, Homo sapiens
ucacucaccacuacuauga

SEQ ID NO: 928336 - RNA, 19 nt, Homo sapiens
aggccuggguuaugucuua

SEQ ID NO: 928337 - RNA, 19 nt, Homo sapiens
ccacauccuuucagacaca

SEQ ID NO: 928338 - RNA, 19 nt, Homo sapiens
agacggauguggucacugu

SEQ ID NO: 928339 - RNA, 19 nt, Homo sapiens
gcugaggcacgaaauauug

SEQ ID NO: 928340 - RNA, 19 nt, Homo sapiens
caucagcaccggccucauu

SEQ ID NO: 928341 - RNA, 19 nt, Homo sapiens
cacgaaauauuggaaguga

SEQ ID NO: 928342 - RNA, 19 nt, Homo sapiens
gagcugaggcacgaaauau

SEQ ID NO: 928343 - RNA, 19 nt, Homo sapiens
ggagcugaggcacgaaaua

SEQ ID NO: 928344 - RNA, 19 nt, Homo sapiens
ccauuuaaaccaggaguua

SEQ ID NO: 928345 - RNA, 19 nt, Homo sapiens
gaagacuuagcuaugaauu

SEQ ID NO: 928346 - RNA, 19 nt, Homo sapiens
gaucaacagcgccgacuuc

SEQ ID NO: 928347 - RNA, 19 nt, Homo sapiens
gagacaucaucaucugaga

SEQ ID NO: 928348 - RNA, 19 nt, Homo sapiens
cuacagagaauggaauuga

SEQ ID NO: 928349 - RNA, 19 nt, Homo sapiens
ucacagagagguuccacaa

SEQ ID NO: 928350 - RNA, 19 nt, Homo sapiens
ggucccaguuuaagaagug

SEQ ID NO: 928351 - RNA, 19 nt, Homo sapiens
gaagacggauguggucacu

SEQ ID NO: 928352 - RNA, 19 nt, Homo sapiens
ggagacaggacacuucaca

SEQ ID NO: 928353 - RNA, 19 nt, Homo sapiens
caacggaggcaucuugaag

SEQ ID NO: 928354 - RNA, 19 nt, Homo sapiens
aaaccaaaccagccacuug

SEQ ID NO: 928355 - RNA, 19 nt, Homo sapiens
gaagccaacccagugacua

SEQ ID NO: 928356 - RNA, 19 nt, Homo sapiens
ggacggcaagugaauaaag

SEQ ID NO: 928357 - RNA, 19 nt, Homo sapiens
gggcaacggaggcaucuug

SEQ ID NO: 928358 - RNA, 19 nt, Homo sapiens
gccgcaagcugucuacuac

SEQ ID NO: 928359 - RNA, 19 nt, Homo sapiens
agacuuagcuaugaauugc

SEQ ID NO: 928360 - RNA, 19 nt, Homo sapiens
uaucgaagacuuagcuaug

SEQ ID NO: 928361 - RNA, 19 nt, Homo sapiens
cgagagagagcacaaacug

SEQ ID NO: 928362 - RNA, 19 nt, Homo sapiens
gccaaccaguucaagucua

SEQ ID NO: 928363 - RNA, 19 nt, Homo sapiens
ccacaccacccgacagguu

SEQ ID NO: 928364 - RNA, 19 nt, Homo sapiens
ugaaggugcuguccauggu

SEQ ID NO: 928365 - RNA, 19 nt, Homo sapiens
ucgaagacuuagcuaugaa

SEQ ID NO: 928366 - RNA, 19 nt, Homo sapiens
aggaagacccuacagagaa

SEQ ID NO: 928367 - RNA, 19 nt, Homo sapiens
ccaaccaguucaagucuac

SEQ ID NO: 928368 - RNA, 19 nt, Homo sapiens
agaaggaaauaaaccaaac

SEQ ID NO: 928369 - RNA, 19 nt, Homo sapiens
cgcaagcugucuacuacuu

SEQ ID NO: 928370 - RNA, 19 nt, Homo sapiens
uacuaccggucccaguuua

SEQ ID NO: 928371 - RNA, 19 nt, Homo sapiens
ugaggggccuuuugaauau

SEQ ID NO: 928372 - RNA, 19 nt, Homo sapiens
uguugcagcugaaggaaga

SEQ ID NO: 928373 - RNA, 19 nt, Homo sapiens
ggguagggaggcaggguua

SEQ ID NO: 928374 - RNA, 19 nt, Homo sapiens
agaaguacaccauggaugu

SEQ ID NO: 928375 - RNA, 19 nt, Homo sapiens
cgaaauauuggaagugaag

SEQ ID NO: 928376 - RNA, 19 nt, Homo sapiens
acauuaagagguacuuuga

SEQ ID NO: 928377 - RNA, 19 nt, Homo sapiens
acacuucacaggacacuug

SEQ ID NO: 928378 - RNA, 19 nt, Homo sapiens
gcgccaaccagaaacuuug

SEQ ID NO: 928379 - RNA, 19 nt, Homo sapiens
gcacgaaauauuggaagug

SEQ ID NO: 928380 - RNA, 19 nt, Homo sapiens
uauggcaggaacuacauua

SEQ ID NO: 928381 - RNA, 19 nt, Homo sapiens
ugaaggaagacccuacaga

SEQ ID NO: 928382 - RNA, 19 nt, Homo sapiens
gaaguacaccauggaugug

SEQ ID NO: 928383 - RNA, 19 nt, Homo sapiens
gcaacggaggcaucuugaa

SEQ ID NO: 928384 - RNA, 19 nt, Homo sapiens
gaagcaccacauccuuuca

SEQ ID NO: 928385 - RNA, 19 nt, Homo sapiens
gcgccuggagguaaaggua

SEQ ID NO: 928386 - RNA, 19 nt, Homo sapiens
ggcugucucucccuccauu

SEQ ID NO: 928387 - RNA, 19 nt, Homo sapiens
gcaagcugucuacuacuuc

SEQ ID NO: 928388 - RNA, 19 nt, Homo sapiens
cuuccaagccaauguuauu

SEQ ID NO: 928389 - RNA, 19 nt, Homo sapiens
gcaggaacuacauuaagag

SEQ ID NO: 928390 - RNA, 19 nt, Homo sapiens
aaaccagccacuugcacua

SEQ ID NO: 928391 - RNA, 19 nt, Homo sapiens
caccacauccuuucagaca

SEQ ID NO: 928392 - RNA, 19 nt, Homo sapiens
gucgagacaucaucaucug

SEQ ID NO: 928393 - RNA, 19 nt, Homo sapiens
aucuaaaucucagagcuua

SEQ ID NO: 928394 - RNA, 19 nt, Homo sapiens
aaacugcaggcccuuguug

SEQ ID NO: 928395 - RNA, 19 nt, Homo sapiens
ugaauauaacuccacaaga

SEQ ID NO: 928396 - RNA, 19 nt, Homo sapiens
cuacuaccggucccaguuu

SEQ ID NO: 928397 - RNA, 19 nt, Homo sapiens
caguucaagucuacucugu

SEQ ID NO: 928398 - RNA, 19 nt, Homo sapiens
ucucugaggccaaccaguu

SEQ ID NO: 928399 - RNA, 19 nt, Homo sapiens
gacaucaucaucugagaag

SEQ ID NO: 928400 - RNA, 19 nt, Homo sapiens
gcugcugccugccuucuac

SEQ ID NO: 928401 - RNA, 19 nt, Homo sapiens
uuuaagaagugugcuguag

SEQ ID NO: 928402 - RNA, 19 nt, Homo sapiens
gaagcagucagagcuguuc

SEQ ID NO: 928403 - RNA, 19 nt, Homo sapiens
gggacaaagcucaaguaug

SEQ ID NO: 928404 - RNA, 19 nt, Homo sapiens
gugaagaaagugaucucaa

SEQ ID NO: 928405 - RNA, 19 nt, Homo sapiens
aaggaagacccuacagaga

SEQ ID NO: 928406 - RNA, 19 nt, Homo sapiens
gacggcaagugaauaaagc

SEQ ID NO: 928407 - RNA, 19 nt, Homo sapiens
ggacaaugcuggaaagaca

SEQ ID NO: 928408 - RNA, 19 nt, Homo sapiens
ugaagaagaugaagcagaa

SEQ ID NO: 928409 - RNA, 19 nt, Homo sapiens
auucuuagcucccugauua

SEQ ID NO: 928410 - RNA, 19 nt, Homo sapiens
guagguaacuggaccaaga

SEQ ID NO: 928411 - RNA, 19 nt, Homo sapiens
gcacauaccugcgcucaac

SEQ ID NO: 928412 - RNA, 19 nt, Homo sapiens
caaccauccugaagaaguu

SEQ ID NO: 928413 - RNA, 19 nt, Homo sapiens
agacaaccauccugaagaa

SEQ ID NO: 928414 - RNA, 19 nt, Homo sapiens
gacaaugacaggugaaauu

SEQ ID NO: 928415 - RNA, 19 nt, Homo sapiens
gaagaaggcagcugaguac

SEQ ID NO: 928416 - RNA, 19 nt, Homo sapiens
guaacuggaccaagaauga

SEQ ID NO: 928417 - RNA, 19 nt, Homo sapiens
gaaagacaaccauccugaa

SEQ ID NO: 928418 - RNA, 19 nt, Homo sapiens
ccaaagugcugagauuaca

SEQ ID NO: 928419 - RNA, 19 nt, Homo sapiens
caaugacaggugaaauuua

SEQ ID NO: 928420 - RNA, 19 nt, Homo sapiens
caggugaaauuuauaugug

SEQ ID NO: 928421 - RNA, 19 nt, Homo sapiens
ccaccacgcccagcuaaua

SEQ ID NO: 928422 - RNA, 19 nt, Homo sapiens
ggcccuggaucuccucuuu

SEQ ID NO: 928423 - RNA, 19 nt, Homo sapiens
caaaguaaccgcgcaguuc

SEQ ID NO: 928424 - RNA, 19 nt, Homo sapiens
guaauuacaggagccauuu

SEQ ID NO: 928425 - RNA, 19 nt, Homo sapiens
ggacccagaggaugucaaa

SEQ ID NO: 928426 - RNA, 19 nt, Homo sapiens
gcccaugucugucugucuu

SEQ ID NO: 928427 - RNA, 19 nt, Homo sapiens
uggcugagcuggcaacgau

SEQ ID NO: 928428 - RNA, 19 nt, Homo sapiens
ucgcuucacugugcacaua

SEQ ID NO: 928429 - RNA, 19 nt, Homo sapiens
ucgaggaguucccugcuuu

SEQ ID NO: 928430 - RNA, 19 nt, Homo sapiens
cuacaccgaguacaaagua

SEQ ID NO: 928431 - RNA, 19 nt, Homo sapiens
agaagaaggcagcugagua

SEQ ID NO: 928432 - RNA, 19 nt, Homo sapiens
cccuggaucuccucuuuaa

SEQ ID NO: 928433 - RNA, 19 nt, Homo sapiens
aggaaggugugaagaagaa

SEQ ID NO: 928434 - RNA, 19 nt, Homo sapiens
uggcggaacuacuuugaga

SEQ ID NO: 928435 - RNA, 19 nt, Homo sapiens
ggauguggguggccagaag

SEQ ID NO: 928436 - RNA, 19 nt, Homo sapiens
ccgcgcaguucaucucaaa

SEQ ID NO: 928437 - RNA, 19 nt, Homo sapiens
ggagccauuucuguaggua

SEQ ID NO: 928438 - RNA, 19 nt, Homo sapiens
acgcugggcuucaacauca

SEQ ID NO: 928439 - RNA, 19 nt, Homo sapiens
acaaugacaggugaaauuu

SEQ ID NO: 928440 - RNA, 19 nt, Homo sapiens
ccaggaaggugugaagaag

SEQ ID NO: 928441 - RNA, 19 nt, Homo sapiens
ccagguguuuggccgguuu

SEQ ID NO: 928442 - RNA, 19 nt, Homo sapiens
gaccuggguuuacgcuuca

SEQ ID NO: 928443 - RNA, 19 nt, Homo sapiens
gggaggacaucgacaccau

SEQ ID NO: 928444 - RNA, 19 nt, Homo sapiens
uuacaggcaugagucacua

SEQ ID NO: 928445 - RNA, 19 nt, Homo sapiens
aagcaguucuccugucuca

SEQ ID NO: 928446 - RNA, 19 nt, Homo sapiens
gcgcaguucaucucaaaga

SEQ ID NO: 928447 - RNA, 19 nt, Homo sapiens
gaggagugaccuggguuua

SEQ ID NO: 928448 - RNA, 19 nt, Homo sapiens
gaacuccugaccucaagug

SEQ ID NO: 928449 - RNA, 19 nt, Homo sapiens
ccacgcccagcuaauauuu

SEQ ID NO: 928450 - RNA, 19 nt, Homo sapiens
ggagugaccuggguuuacg

SEQ ID NO: 928451 - RNA, 19 nt, Homo sapiens
agaagucccugcgguccua

SEQ ID NO: 928452 - RNA, 19 nt, Homo sapiens
ucaagcaguucuccugucu

SEQ ID NO: 928453 - RNA, 19 nt, Homo sapiens
ggucauuaaaccauuaguu

SEQ ID NO: 928454 - RNA, 19 nt, Homo sapiens
ggaggagugaccuggguuu

SEQ ID NO: 928455 - RNA, 19 nt, Homo sapiens
aggcugagcuugcccucuu

SEQ ID NO: 928456 - RNA, 19 nt, Homo sapiens
gggcuacaccgaguacaaa

SEQ ID NO: 928457 - RNA, 19 nt, Homo sapiens
ccacagagaaggaacuuuu

SEQ ID NO: 928458 - RNA, 19 nt, Homo sapiens
gaagaagaugaagcagaaa

SEQ ID NO: 928459 - RNA, 19 nt, Homo sapiens
ggcccuaccuccuggucuu

SEQ ID NO: 928460 - RNA, 19 nt, Homo sapiens
ggaagaggauggggaagga

SEQ ID NO: 928461 - RNA, 19 nt, Homo sapiens
aaagaaggacccagaggau

SEQ ID NO: 928462 - RNA, 19 nt, Homo sapiens
gaagaugaagcagaaagag

SEQ ID NO: 928463 - RNA, 19 nt, Homo sapiens
gccaggaaggugugaagaa

SEQ ID NO: 928464 - RNA, 19 nt, Homo sapiens
gcaggaggaggaagaggau

SEQ ID NO: 928465 - RNA, 19 nt, Homo sapiens
gcccuggaucuccucuuua

SEQ ID NO: 928466 - RNA, 19 nt, Homo sapiens
uaccugcgcucaacaacag

SEQ ID NO: 928467 - RNA, 19 nt, Homo sapiens
agaaggacccagaggaugu

SEQ ID NO: 928468 - RNA, 19 nt, Homo sapiens
aaaguaaccgcgcaguuca

SEQ ID NO: 928469 - RNA, 19 nt, Homo sapiens
gaacuggggucugcaaacu

SEQ ID NO: 928470 - RNA, 19 nt, Homo sapiens
cuccugaccucaagugauc

SEQ ID NO: 928471 - RNA, 19 nt, Homo sapiens
ccuccuggucuuguaauua

SEQ ID NO: 928472 - RNA, 19 nt, Homo sapiens
guuugaagccucagugauc

SEQ ID NO: 928473 - RNA, 19 nt, Homo sapiens
aagaggugguggucuggaa

SEQ ID NO: 928474 - RNA, 19 nt, Homo sapiens
gcaguucaucucaaagaag

SEQ ID NO: 928475 - RNA, 19 nt, Homo sapiens
ggaccugcuucgcuucacu

SEQ ID NO: 928476 - RNA, 19 nt, Homo sapiens
uaauguaagggcugugaga

SEQ ID NO: 928477 - RNA, 19 nt, Homo sapiens
cccaguagcugagauugca

SEQ ID NO: 928478 - RNA, 19 nt, Homo sapiens
aaagacaaccauccugaag

SEQ ID NO: 928479 - RNA, 19 nt, Homo sapiens
gagggcaggaggaggaaga

SEQ ID NO: 928480 - RNA, 19 nt, Homo sapiens
cgcaguucaucucaaagaa

SEQ ID NO: 928481 - RNA, 19 nt, Homo sapiens
ccaugucugucugucuuga

SEQ ID NO: 928482 - RNA, 19 nt, Homo sapiens
ucccaaagugcugagauua

SEQ ID NO: 928483 - RNA, 19 nt, Homo sapiens
agaagaugaagcagaaaga

SEQ ID NO: 928484 - RNA, 19 nt, Homo sapiens
ccuaccuccuggucuugua

SEQ ID NO: 928485 - RNA, 19 nt, Homo sapiens
cccagaggaugucaaagag

SEQ ID NO: 928486 - RNA, 19 nt, Homo sapiens
ccaagggcuacaccgagua

SEQ ID NO: 928487 - RNA, 19 nt, Homo sapiens
cucccaaagugcugagauu

SEQ ID NO: 928488 - RNA, 19 nt, Homo sapiens
gaagcgggcagaggagauc

SEQ ID NO: 928489 - RNA, 19 nt, Homo sapiens
ggacgggguuacaccaugu

SEQ ID NO: 928490 - RNA, 19 nt, Homo sapiens
caccacgcccagcuaauau

SEQ ID NO: 928491 - RNA, 19 nt, Homo sapiens
gagccauuucuguagguaa

SEQ ID NO: 928492 - RNA, 19 nt, Homo sapiens
acucccaccugcagccaaa

SEQ ID NO: 928493 - RNA, 19 nt, Homo sapiens
ugucugucuugauguguga

SEQ ID NO: 928494 - RNA, 19 nt, Homo sapiens
cuacuggcggaacuacuuu

SEQ ID NO: 928495 - RNA, 19 nt, Homo sapiens
gcgugcacgucuugcuuca

SEQ ID NO: 928496 - RNA, 19 nt, Homo sapiens
acccagaggaugucaaaga

SEQ ID NO: 928497 - RNA, 19 nt, Homo sapiens
aagacaaccauccugaaga

SEQ ID NO: 928498 - RNA, 19 nt, Homo sapiens
gcugagauuacaggcauga

SEQ ID NO: 928499 - RNA, 19 nt, Homo sapiens
gccucagucucccaaagug

SEQ ID NO: 928500 - RNA, 19 nt, Homo sapiens
gaggacaucgacaccaucu

SEQ ID NO: 928501 - RNA, 19 nt, Homo sapiens
gguaacuggaccaagaaug

SEQ ID NO: 928502 - RNA, 19 nt, Homo sapiens
cuccuggucuuguaauuac

SEQ ID NO: 928503 - RNA, 19 nt, Homo sapiens
gacaaugcuggaaagacaa

SEQ ID NO: 928504 - RNA, 19 nt, Homo sapiens
caggaaggugugaagaaga

SEQ ID NO: 928505 - RNA, 19 nt, Homo sapiens
ccagggaccuacacauccu

SEQ ID NO: 928506 - RNA, 19 nt, Homo sapiens
gaaggacccagaggauguc

SEQ ID NO: 928507 - RNA, 19 nt, Homo sapiens
ggacaaugcuggaaagaca

SEQ ID NO: 928508 - RNA, 19 nt, Homo sapiens
ugaagaagaugaagcagaa

SEQ ID NO: 928509 - RNA, 19 nt, Homo sapiens
auucuuagcucccugauua

SEQ ID NO: 928510 - RNA, 19 nt, Homo sapiens
guagguaacuggaccaaga

SEQ ID NO: 928511 - RNA, 19 nt, Homo sapiens
gcacauaccugcgcucaac

SEQ ID NO: 928512 - RNA, 19 nt, Homo sapiens
caaccauccugaagaaguu

SEQ ID NO: 928513 - RNA, 19 nt, Homo sapiens
agacaaccauccugaagaa

SEQ ID NO: 928514 - RNA, 19 nt, Homo sapiens
gacaaugacaggugaaauu

SEQ ID NO: 928515 - RNA, 19 nt, Homo sapiens
gaagaaggcagcugaguac

SEQ ID NO: 928516 - RNA, 19 nt, Homo sapiens
guaacuggaccaagaauga

SEQ ID NO: 928517 - RNA, 19 nt, Homo sapiens
gaaagacaaccauccugaa

SEQ ID NO: 928518 - RNA, 19 nt, Homo sapiens
ccaaagugcugagauuaca

SEQ ID NO: 928519 - RNA, 19 nt, Homo sapiens
caaugacaggugaaauuua

SEQ ID NO: 928520 - RNA, 19 nt, Homo sapiens
caggugaaauuuauaugug

SEQ ID NO: 928521 - RNA, 19 nt, Homo sapiens
ccaccacgcccagcuaaua

SEQ ID NO: 928522 - RNA, 19 nt, Homo sapiens
ggcccuggaucuccucuuu

SEQ ID NO: 928523 - RNA, 19 nt, Homo sapiens
caaaguaaccgcgcaguuc

SEQ ID NO: 928524 - RNA, 19 nt, Homo sapiens
guaauuacaggagccauuu

SEQ ID NO: 928525 - RNA, 19 nt, Homo sapiens
ggacccagaggaugucaaa

SEQ ID NO: 928526 - RNA, 19 nt, Homo sapiens
gcccaugucugucugucuu

SEQ ID NO: 928527 - RNA, 19 nt, Homo sapiens
ucgcuucacugugcacaua

SEQ ID NO: 928528 - RNA, 19 nt, Homo sapiens
ucgaggaguucccugcuuu

SEQ ID NO: 928529 - RNA, 19 nt, Homo sapiens
cuacaccgaguacaaagua

SEQ ID NO: 928530 - RNA, 19 nt, Homo sapiens
agaagaaggcagcugagua

SEQ ID NO: 928531 - RNA, 19 nt, Homo sapiens
cccuggaucuccucuuuaa

SEQ ID NO: 928532 - RNA, 19 nt, Homo sapiens
aggaaggugugaagaagaa

SEQ ID NO: 928533 - RNA, 19 nt, Homo sapiens
uggcggaacuacuuugaga

SEQ ID NO: 928534 - RNA, 19 nt, Homo sapiens
ggauguggguggccagaag

SEQ ID NO: 928535 - RNA, 19 nt, Homo sapiens
ccgcgcaguucaucucaaa

SEQ ID NO: 928536 - RNA, 19 nt, Homo sapiens
ggagccauuucuguaggua

SEQ ID NO: 928537 - RNA, 19 nt, Homo sapiens
acgcugggcuucaacauca

SEQ ID NO: 928538 - RNA, 19 nt, Homo sapiens
acaaugacaggugaaauuu

SEQ ID NO: 928539 - RNA, 19 nt, Homo sapiens
ccaggaaggugugaagaag

SEQ ID NO: 928540 - RNA, 19 nt, Homo sapiens
ccagguguuuggccgguuu

SEQ ID NO: 928541 - RNA, 19 nt, Homo sapiens
gaccuggguuuacgcuuca

SEQ ID NO: 928542 - RNA, 19 nt, Homo sapiens
gggaggacaucgacaccau

SEQ ID NO: 928543 - RNA, 19 nt, Homo sapiens
uuacaggcaugagucacua

SEQ ID NO: 928544 - RNA, 19 nt, Homo sapiens
aagcaguucuccugucuca

SEQ ID NO: 928545 - RNA, 19 nt, Homo sapiens
gcgcaguucaucucaaaga

SEQ ID NO: 928546 - RNA, 19 nt, Homo sapiens
gaggagugaccuggguuua

SEQ ID NO: 928547 - RNA, 19 nt, Homo sapiens
gaacuccugaccucaagug

SEQ ID NO: 928548 - RNA, 19 nt, Homo sapiens
ccacgcccagcuaauauuu

SEQ ID NO: 928549 - RNA, 19 nt, Homo sapiens
ggagugaccuggguuuacg

SEQ ID NO: 928550 - RNA, 19 nt, Homo sapiens
agaagucccugcgguccua

SEQ ID NO: 928551 - RNA, 19 nt, Homo sapiens
ucaagcaguucuccugucu

SEQ ID NO: 928552 - RNA, 19 nt, Homo sapiens
ggucauuaaaccauuaguu

SEQ ID NO: 928553 - RNA, 19 nt, Homo sapiens
ggaggagugaccuggguuu

SEQ ID NO: 928554 - RNA, 19 nt, Homo sapiens
aggcugagcuugcccucuu

SEQ ID NO: 928555 - RNA, 19 nt, Homo sapiens
gggcuacaccgaguacaaa

SEQ ID NO: 928556 - RNA, 19 nt, Homo sapiens
ccacagagaaggaacuuuu

SEQ ID NO: 928557 - RNA, 19 nt, Homo sapiens
gaagaagaugaagcagaaa

SEQ ID NO: 928558 - RNA, 19 nt, Homo sapiens
gaagaugaagcagaaagag

SEQ ID NO: 928559 - RNA, 19 nt, Homo sapiens
ggcccuaccuccuggucuu

SEQ ID NO: 928560 - RNA, 19 nt, Homo sapiens
aaagaaggacccagaggau

SEQ ID NO: 928561 - RNA, 19 nt, Homo sapiens
gccaggaaggugugaagaa

SEQ ID NO: 928562 - RNA, 19 nt, Homo sapiens
gcccuggaucuccucuuua

SEQ ID NO: 928563 - RNA, 19 nt, Homo sapiens
uaccugcgcucaacaacag

SEQ ID NO: 928564 - RNA, 19 nt, Homo sapiens
agaaggacccagaggaugu

SEQ ID NO: 928565 - RNA, 19 nt, Homo sapiens
aaaguaaccgcgcaguuca

SEQ ID NO: 928566 - RNA, 19 nt, Homo sapiens
gaacuggggucugcaaacu

SEQ ID NO: 928567 - RNA, 19 nt, Homo sapiens
cuccugaccucaagugauc

SEQ ID NO: 928568 - RNA, 19 nt, Homo sapiens
ccuccuggucuuguaauua

SEQ ID NO: 928569 - RNA, 19 nt, Homo sapiens
guuugaagccucagugauc

SEQ ID NO: 928570 - RNA, 19 nt, Homo sapiens
aagaggugguggucuggaa

SEQ ID NO: 928571 - RNA, 19 nt, Homo sapiens
gcaguucaucucaaagaag

SEQ ID NO: 928572 - RNA, 19 nt, Homo sapiens
ggaccugcuucgcuucacu

SEQ ID NO: 928573 - RNA, 19 nt, Homo sapiens
uaauguaagggcugugaga

SEQ ID NO: 928574 - RNA, 19 nt, Homo sapiens
cccaguagcugagauugca

SEQ ID NO: 928575 - RNA, 19 nt, Homo sapiens
cgcaguucaucucaaagaa

SEQ ID NO: 928576 - RNA, 19 nt, Homo sapiens
aaagacaaccauccugaag

SEQ ID NO: 928577 - RNA, 19 nt, Homo sapiens
ccaugucugucugucuuga

SEQ ID NO: 928578 - RNA, 19 nt, Homo sapiens
ucccaaagugcugagauua

SEQ ID NO: 928579 - RNA, 19 nt, Homo sapiens
agaagaugaagcagaaaga

SEQ ID NO: 928580 - RNA, 19 nt, Homo sapiens
ccuaccuccuggucuugua

SEQ ID NO: 928581 - RNA, 19 nt, Homo sapiens
cccagaggaugucaaagag

SEQ ID NO: 928582 - RNA, 19 nt, Homo sapiens
ccaagggcuacaccgagua

SEQ ID NO: 928583 - RNA, 19 nt, Homo sapiens
cucccaaagugcugagauu

SEQ ID NO: 928584 - RNA, 19 nt, Homo sapiens
gaagcgggcagaggagauc

SEQ ID NO: 928585 - RNA, 19 nt, Homo sapiens
ggacgggguuacaccaugu

SEQ ID NO: 928586 - RNA, 19 nt, Homo sapiens
caccacgcccagcuaauau

SEQ ID NO: 928587 - RNA, 19 nt, Homo sapiens
gagccauuucuguagguaa

SEQ ID NO: 928588 - RNA, 19 nt, Homo sapiens
acucccaccugcagccaaa

SEQ ID NO: 928589 - RNA, 19 nt, Homo sapiens
ugucugucuugauguguga

SEQ ID NO: 928590 - RNA, 19 nt, Homo sapiens
cuacuggcggaacuacuuu

SEQ ID NO: 928591 - RNA, 19 nt, Homo sapiens
acccagaggaugucaaaga

SEQ ID NO: 928592 - RNA, 19 nt, Homo sapiens
aagacaaccauccugaaga

SEQ ID NO: 928593 - RNA, 19 nt, Homo sapiens
gcugagauuacaggcauga

SEQ ID NO: 928594 - RNA, 19 nt, Homo sapiens
gccucagucucccaaagug

SEQ ID NO: 928595 - RNA, 19 nt, Homo sapiens
gaggacaucgacaccaucu

SEQ ID NO: 928596 - RNA, 19 nt, Homo sapiens
gguaacuggaccaagaaug

SEQ ID NO: 928597 - RNA, 19 nt, Homo sapiens
cuccuggucuuguaauuac

SEQ ID NO: 928598 - RNA, 19 nt, Homo sapiens
caggaaggugugaagaaga

SEQ ID NO: 928599 - RNA, 19 nt, Homo sapiens
gacaaugcuggaaagacaa

SEQ ID NO: 928600 - RNA, 19 nt, Homo sapiens
ccagggaccuacacauccu

SEQ ID NO: 928601 - RNA, 19 nt, Homo sapiens
gaaggacccagaggauguc

SEQ ID NO: 928602 - RNA, 19 nt, Homo sapiens
acaaaguaaccgcgcaguu

SEQ ID NO: 928603 - RNA, 19 nt, Homo sapiens
gaacugacuucuugauaaa

SEQ ID NO: 928604 - RNA, 19 nt, Homo sapiens
ggaacugacuucuugauaa

SEQ ID NO: 928605 - RNA, 19 nt, Homo sapiens
gugagcaucuacuuaauua

SEQ ID NO: 928606 - RNA, 19 nt, Homo sapiens
caaagguauucaugaguua

SEQ ID NO: 928607 - RNA, 19 nt, Homo sapiens
gcaaauauggacagguuua

SEQ ID NO: 928608 - RNA, 19 nt, Homo sapiens
agacagaagucauaacuga

SEQ ID NO: 928609 - RNA, 19 nt, Homo sapiens
ggacagguuuacuuagaaa

SEQ ID NO: 928610 - RNA, 19 nt, Homo sapiens
acaguuagcuagcaaauau

SEQ ID NO: 928611 - RNA, 19 nt, Homo sapiens
gaagauagccccaguguuu

SEQ ID NO: 928612 - RNA, 19 nt, Homo sapiens
gaccaaggcucagaaagaa

SEQ ID NO: 928613 - RNA, 19 nt, Homo sapiens
ugacauagacccaaaggua

SEQ ID NO: 928614 - RNA, 19 nt, Homo sapiens
ccaaagguauucaugaguu

SEQ ID NO: 928615 - RNA, 19 nt, Homo sapiens
acacaaccuuggagucuua

SEQ ID NO: 928616 - RNA, 19 nt, Homo sapiens
gguaaucuuucaacucauu

SEQ ID NO: 928617 - RNA, 19 nt, Homo sapiens
auaaagaucuggagccauu

SEQ ID NO: 928618 - RNA, 19 nt, Homo sapiens
cuaaugguccuucuuauaa

SEQ ID NO: 928619 - RNA, 19 nt, Homo sapiens
ccaaacagcucaugcuucu

SEQ ID NO: 928620 - RNA, 19 nt, Homo sapiens
gcugacaaauuucauaugu

SEQ ID NO: 928621 - RNA, 19 nt, Homo sapiens
gagcuggaauccuggcuuu

SEQ ID NO: 928622 - RNA, 19 nt, Homo sapiens
gcuaaugguccuucuuaua

SEQ ID NO: 928623 - RNA, 19 nt, Homo sapiens
uagcaaauauggacagguu

SEQ ID NO: 928624 - RNA, 19 nt, Homo sapiens
cgacagcucuacagaaaca

SEQ ID NO: 928625 - RNA, 19 nt, Homo sapiens
gauauuccacugccaagua

SEQ ID NO: 928626 - RNA, 19 nt, Homo sapiens
gaaaauuguuguugacuug

SEQ ID NO: 928627 - RNA, 19 nt, Homo sapiens
cuuggaagcugaagauauu

SEQ ID NO: 928628 - RNA, 19 nt, Homo sapiens
aaaugcaagucaagcuuua

SEQ ID NO: 928629 - RNA, 19 nt, Homo sapiens
acacacagcugcaagaucu

SEQ ID NO: 928630 - RNA, 19 nt, Homo sapiens
ucauaugcuuuguuccuua

SEQ ID NO: 928631 - RNA, 19 nt, Homo sapiens
cagccugccucaucuauau

SEQ ID NO: 928632 - RNA, 19 nt, Homo sapiens
ccagaaagcccaccagcaa

SEQ ID NO: 928633 - RNA, 19 nt, Homo sapiens
gcaauauccuugaaaucca

SEQ ID NO: 928634 - RNA, 19 nt, Homo sapiens
gaaaauuacccaaauguga

SEQ ID NO: 928635 - RNA, 19 nt, Homo sapiens
uuacuggaccauaaaguua

SEQ ID NO: 928636 - RNA, 19 nt, Homo sapiens
gaccacgggcuacaucaua

SEQ ID NO: 928637 - RNA, 19 nt, Homo sapiens
ucaaagacaucaaggaaaa

SEQ ID NO: 928638 - RNA, 19 nt, Homo sapiens
ggaauuauuggaaguuguu

SEQ ID NO: 928639 - RNA, 19 nt, Homo sapiens
caaccaggauuucacucuu

SEQ ID NO: 928640 - RNA, 19 nt, Homo sapiens
caucaaagacaucaaggaa

SEQ ID NO: 928641 - RNA, 19 nt, Homo sapiens
caagaucuaccgaauacaa

SEQ ID NO: 928642 - RNA, 19 nt, Homo sapiens
cuuuauaucuuaccagcua

SEQ ID NO: 928643 - RNA, 19 nt, Homo sapiens
gccuggaacugacuucuug

SEQ ID NO: 928644 - RNA, 19 nt, Homo sapiens
ggauuucacucuucaaagc

SEQ ID NO: 928645 - RNA, 19 nt, Homo sapiens
ucaauaagcagucauccuu

SEQ ID NO: 928646 - RNA, 19 nt, Homo sapiens
gcuuacauauaacaacuug

SEQ ID NO: 928647 - RNA, 19 nt, Homo sapiens
aaacuaaagagucucauug

SEQ ID NO: 928648 - RNA, 19 nt, Homo sapiens
caauauccuugaaauccaa

SEQ ID NO: 928649 - RNA, 19 nt, Homo sapiens
ugccucaucuauaucaaua

SEQ ID NO: 928650 - RNA, 19 nt, Homo sapiens
gacaaacaguucguucuuc

SEQ ID NO: 928651 - RNA, 19 nt, Homo sapiens
aagcagucauccuuacuuu

SEQ ID NO: 928652 - RNA, 19 nt, Homo sapiens
caaaagagguccaugacau

SEQ ID NO: 928653 - RNA, 19 nt, Homo sapiens
gcaagucaagcuuuauugu

SEQ ID NO: 928654 - RNA, 19 nt, Homo sapiens
uaaaugcaagucaagcuuu

SEQ ID NO: 928655 - RNA, 19 nt, Homo sapiens
guaacagccugccucaucu

SEQ ID NO: 928656 - RNA, 19 nt, Homo sapiens
caagucaagcuuuauuguu

SEQ ID NO: 928657 - RNA, 19 nt, Homo sapiens
ugucgaaccugugcuuuga

SEQ ID NO: 928658 - RNA, 19 nt, Homo sapiens
cagaagucauaacugauug

SEQ ID NO: 928659 - RNA, 19 nt, Homo sapiens
gcucucaucaacauacuuu

SEQ ID NO: 928660 - RNA, 19 nt, Homo sapiens
cuggaauccuggcuuuaua

SEQ ID NO: 928661 - RNA, 19 nt, Homo sapiens
aauccuggcuuuauaucuu

SEQ ID NO: 928662 - RNA, 19 nt, Homo sapiens
gcugcaagaucuaccgaau

SEQ ID NO: 928663 - RNA, 19 nt, Homo sapiens
cuuggagucuuagaaauuu

SEQ ID NO: 928664 - RNA, 19 nt, Homo sapiens
gacauagacccaaagguau

SEQ ID NO: 928665 - RNA, 19 nt, Homo sapiens
acuaaagagucucauugaa

SEQ ID NO: 928666 - RNA, 19 nt, Homo sapiens
aauauccaauugccuugua

SEQ ID NO: 928667 - RNA, 19 nt, Homo sapiens
uggguuguauggaguuuaa

SEQ ID NO: 928668 - RNA, 19 nt, Homo sapiens
cuuauaauggugccaaaua

SEQ ID NO: 928669 - RNA, 19 nt, Homo sapiens
gcuuugauccuguccugua

SEQ ID NO: 928670 - RNA, 19 nt, Homo sapiens
acagaagucauaacugauu

SEQ ID NO: 928671 - RNA, 19 nt, Homo sapiens
uggcuaaugguccuucuua

SEQ ID NO: 928672 - RNA, 19 nt, Homo sapiens
agaccaaggcucagaaaga

SEQ ID NO: 928673 - RNA, 19 nt, Homo sapiens
uucgacagcucuacagaaa

SEQ ID NO: 928674 - RNA, 19 nt, Homo sapiens
gcuugcugcuacucauuaa

SEQ ID NO: 928675 - RNA, 19 nt, Homo sapiens
uuaaauuucucagccauca

SEQ ID NO: 928676 - RNA, 19 nt, Homo sapiens
ugcaagaucuaccgaauac

SEQ ID NO: 928677 - RNA, 19 nt, Homo sapiens
gcuaccaauucuggccuua

SEQ ID NO: 928678 - RNA, 19 nt, Homo sapiens
uacaucauaugcuuuguuc

SEQ ID NO: 928679 - RNA, 19 nt, Homo sapiens
agucaaauguggguuguau

SEQ ID NO: 928680 - RNA, 19 nt, Homo sapiens
ugugugagcaucuacuuaa

SEQ ID NO: 928681 - RNA, 19 nt, Homo sapiens
acaaacaguucguucuucu

SEQ ID NO: 928682 - RNA, 19 nt, Homo sapiens
ugacaaacaguucguucuu

SEQ ID NO: 928683 - RNA, 19 nt, Homo sapiens
cagcuuacauauaacaacu

SEQ ID NO: 928684 - RNA, 19 nt, Homo sapiens
cagccagacagaagucaua

SEQ ID NO: 928685 - RNA, 19 nt, Homo sapiens
auaauggugccaaauauga

SEQ ID NO: 928686 - RNA, 19 nt, Homo sapiens
gaucuaccgaauacaagaa

SEQ ID NO: 928687 - RNA, 19 nt, Homo sapiens
augguaaucuuucaacuca

SEQ ID NO: 928688 - RNA, 19 nt, Homo sapiens
gacccaaagguauucauga

SEQ ID NO: 928689 - RNA, 19 nt, Homo sapiens
ggagugguuuugaauguga

SEQ ID NO: 928690 - RNA, 19 nt, Homo sapiens
gcuggaauccuggcuuuau

SEQ ID NO: 928691 - RNA, 19 nt, Homo sapiens
auauuccacugccaaguaa

SEQ ID NO: 928692 - RNA, 19 nt, Homo sapiens
uggacagguuuacuuagaa

SEQ ID NO: 928693 - RNA, 19 nt, Homo sapiens
aaauacaguuagcuagcaa

SEQ ID NO: 928694 - RNA, 19 nt, Homo sapiens
uggccuuacuggaccauaa

SEQ ID NO: 928695 - RNA, 19 nt, Homo sapiens
gaauacaagaacccggauu

SEQ ID NO: 928696 - RNA, 19 nt, Homo sapiens
uagcauuugucagcauuga

SEQ ID NO: 928697 - RNA, 19 nt, Homo sapiens
uacagaagaauacgaauca

SEQ ID NO: 928698 - RNA, 19 nt, Homo sapiens
uggagccauucacguauuu

SEQ ID NO: 928699 - RNA, 19 nt, Homo sapiens
cuaaagagucucauugaac

SEQ ID NO: 928700 - RNA, 19 nt, Homo sapiens
caaccuuggagucuuagaa

SEQ ID NO: 928701 - RNA, 19 nt, Homo sapiens
aaacagcucaugcuucucu

SEQ ID NO: 928702 - RNA, 19 nt, Homo sapiens
aauacaagaacccggauuu

SEQ ID NO: 928703 - RNA, 19 nt, Homo sapiens
gaagaugccauuuccauuu

SEQ ID NO: 928704 - RNA, 19 nt, Homo sapiens
cagcauaacuugcagaaga

SEQ ID NO: 928705 - RNA, 19 nt, Homo sapiens
ugacagaccucacaaucaa

SEQ ID NO: 928706 - RNA, 19 nt, Homo sapiens
ucgaggagcugcagcauaa

SEQ ID NO: 928707 - RNA, 19 nt, Homo sapiens
ggagauggacuuugagaaa

SEQ ID NO: 928708 - RNA, 19 nt, Homo sapiens
aaaggaagcuggaggaaca

SEQ ID NO: 928709 - RNA, 19 nt, Homo sapiens
gcaaugugauucuuguugu

SEQ ID NO: 928710 - RNA, 19 nt, Homo sapiens
uaacuuagccgcagagauc

SEQ ID NO: 928711 - RNA, 19 nt, Homo sapiens
gguacuauuuccuaaguga

SEQ ID NO: 928712 - RNA, 19 nt, Homo sapiens
gaagaaggacgcggacuug

SEQ ID NO: 928713 - RNA, 19 nt, Homo sapiens
gcucaucagugccugguau

SEQ ID NO: 928714 - RNA, 19 nt, Homo sapiens
uccaagagcucaugaccaa

SEQ ID NO: 928715 - RNA, 19 nt, Homo sapiens
aagaaucgguucagcaugu

SEQ ID NO: 928716 - RNA, 19 nt, Homo sapiens
ggaggaacauuugcagaag

SEQ ID NO: 928717 - RNA, 19 nt, Homo sapiens
gaagcuggaggaacauuug

SEQ ID NO: 928718 - RNA, 19 nt, Homo sapiens
agagacguauggcaacuuu

SEQ ID NO: 928719 - RNA, 19 nt, Homo sapiens
gcucuucccucucccagau

SEQ ID NO: 928720 - RNA, 19 nt, Homo sapiens
ggaagaaucgguucagcau

SEQ ID NO: 928721 - RNA, 19 nt, Homo sapiens
gccaugaucucugcucuuc

SEQ ID NO: 928722 - RNA, 19 nt, Homo sapiens
ggaagcgggaguacauuga

SEQ ID NO: 928723 - RNA, 19 nt, Homo sapiens
gaccacauccagagaauca

SEQ ID NO: 928724 - RNA, 19 nt, Homo sapiens
caaugugauucuuguuguu

SEQ ID NO: 928725 - RNA, 19 nt, Homo sapiens
ggucucugcucaccugguu

SEQ ID NO: 928726 - RNA, 19 nt, Homo sapiens
aaauaaaggcguucaaucu

SEQ ID NO: 928727 - RNA, 19 nt, Homo sapiens
gauauaggccuguucuuuu

SEQ ID NO: 928728 - RNA, 19 nt, Homo sapiens
aucagugccugguauaaua

SEQ ID NO: 928729 - RNA, 19 nt, Homo sapiens
ucaugacgcuggaagaauc

SEQ ID NO: 928730 - RNA, 19 nt, Homo sapiens
ggaagcuggaggaacauuu

SEQ ID NO: 928731 - RNA, 19 nt, Homo sapiens
gaagaaaagcugcucauca

SEQ ID NO: 928732 - RNA, 19 nt, Homo sapiens
ggcuucagcuggagaacaa

SEQ ID NO: 928733 - RNA, 19 nt, Homo sapiens
ugaaggaugagauggauga

SEQ ID NO: 928734 - RNA, 19 nt, Homo sapiens
gagauggacuuugagaaaa

SEQ ID NO: 928735 - RNA, 19 nt, Homo sapiens
ccaugaaggccgagaaaug

SEQ ID NO: 928736 - RNA, 19 nt, Homo sapiens
cgcgacaacuggaggauga

SEQ ID NO: 928737 - RNA, 19 nt, Homo sapiens
ugaggcagaucuggaguug

SEQ ID NO: 928738 - RNA, 19 nt, Homo sapiens
aaucccagcuggagcaguu

SEQ ID NO: 928739 - RNA, 19 nt, Homo sapiens
cagguacuauuuccuaagu

SEQ ID NO: 928740 - RNA, 19 nt, Homo sapiens
ggucuuacggagccuagua

SEQ ID NO: 928741 - RNA, 19 nt, Homo sapiens
ggaaccaggcgcugacuag

SEQ ID NO: 928742 - RNA, 19 nt, Homo sapiens
gagccucauuggagaguuc

SEQ ID NO: 928743 - RNA, 19 nt, Homo sapiens
agauauaggccuguucuuu

SEQ ID NO: 928744 - RNA, 19 nt, Homo sapiens
gugcugggcugugccauca

SEQ ID NO: 928745 - RNA, 19 nt, Homo sapiens
ggagaaggagcggcuguug

SEQ ID NO: 928746 - RNA, 19 nt, Homo sapiens
caagagcucaugaccaaag

SEQ ID NO: 928747 - RNA, 19 nt, Homo sapiens
cugcucaccugguuacaga

SEQ ID NO: 928748 - RNA, 19 nt, Homo sapiens
ccuaugugcugaaccagau

SEQ ID NO: 928749 - RNA, 19 nt, Homo sapiens
aggcagaucuggaguugca

SEQ ID NO: 928750 - RNA, 19 nt, Homo sapiens
agacguauggcaacuuuga

SEQ ID NO: 928751 - RNA, 19 nt, Homo sapiens
ugccaucaguugcgagaaa

SEQ ID NO: 928752 - RNA, 19 nt, Homo sapiens
gcacugacagaccucacaa

SEQ ID NO: 928753 - RNA, 19 nt, Homo sapiens
ugaagaugccauuuccauu

SEQ ID NO: 928754 - RNA, 19 nt, Homo sapiens
gagccuggcgcaagagaau

SEQ ID NO: 928755 - RNA, 19 nt, Homo sapiens
ggacgccuggcaucucuga

SEQ ID NO: 928756 - RNA, 19 nt, Homo sapiens
uacggagccuaguagagua

SEQ ID NO: 928757 - RNA, 19 nt, Homo sapiens
aggccacgcugaccaguug

SEQ ID NO: 928758 - RNA, 19 nt, Homo sapiens
aggagacucugauuuuaua

SEQ ID NO: 928759 - RNA, 19 nt, Homo sapiens
ccgcagguacuauuuccua

SEQ ID NO: 928760 - RNA, 19 nt, Homo sapiens
gauucucucucuggaguuc

SEQ ID NO: 928761 - RNA, 19 nt, Homo sapiens
ggagcugcagcauaacuug

SEQ ID NO: 928762 - RNA, 19 nt, Homo sapiens
ggaugagauggaugaacua

SEQ ID NO: 928763 - RNA, 19 nt, Homo sapiens
gaagauccaggucccaacu

SEQ ID NO: 928764 - RNA, 19 nt, Homo sapiens
gaaucaugacgcuggaaga

SEQ ID NO: 928765 - RNA, 19 nt, Homo sapiens
uuagcaaugugauucuugu

SEQ ID NO: 928766 - RNA, 19 nt, Homo sapiens
gaggacacagcuccgagaa

SEQ ID NO: 928767 - RNA, 19 nt, Homo sapiens
agcauaacuugcagaagaa

SEQ ID NO: 928768 - RNA, 19 nt, Homo sapiens
uggaggaccugcagaaagc

SEQ ID NO: 928769 - RNA, 19 nt, Homo sapiens
ucaccugguuacagacguu

SEQ ID NO: 928770 - RNA, 19 nt, Homo sapiens
gcaggaccacauccagaga

SEQ ID NO: 928771 - RNA, 19 nt, Homo sapiens
uggaggaacauuugcagaa

SEQ ID NO: 928772 - RNA, 19 nt, Homo sapiens
gaugaacuacggcagucuu

SEQ ID NO: 928773 - RNA, 19 nt, Homo sapiens
aggaugagauggaugaacu

SEQ ID NO: 928774 - RNA, 19 nt, Homo sapiens
cgcagguacuauuuccuaa

SEQ ID NO: 928775 - RNA, 19 nt, Homo sapiens
guagauauaggccuguucu

SEQ ID NO: 928776 - RNA, 19 nt, Homo sapiens
ccacugacaagcacugaca

SEQ ID NO: 928777 - RNA, 19 nt, Homo sapiens
caucagugccugguauaau

SEQ ID NO: 928778 - RNA, 19 nt, Homo sapiens
agacugaagaugccauuuc

SEQ ID NO: 928779 - RNA, 19 nt, Homo sapiens
caugaaggccgagaaaugg

SEQ ID NO: 928780 - RNA, 19 nt, Homo sapiens
ccacauccagagaaucaug

SEQ ID NO: 928781 - RNA, 19 nt, Homo sapiens
aauaaaggcguucaaucug

SEQ ID NO: 928782 - RNA, 19 nt, Homo sapiens
gcugggcugugccaucagu

SEQ ID NO: 928783 - RNA, 19 nt, Homo sapiens
gacugaagaugccauuucc

SEQ ID NO: 928784 - RNA, 19 nt, Homo sapiens
caagacugaagaugccauu

SEQ ID NO: 928785 - RNA, 19 nt, Homo sapiens
aguaugagucggugacaaa

SEQ ID NO: 928786 - RNA, 19 nt, Homo sapiens
gcaggaggaggccaugaag

SEQ ID NO: 928787 - RNA, 19 nt, Homo sapiens
uuacggagccuaguagagu

SEQ ID NO: 928788 - RNA, 19 nt, Homo sapiens
gaagcuucaugaggcagau

SEQ ID NO: 928789 - RNA, 19 nt, Homo sapiens
gagcucaugaccaaagaca

SEQ ID NO: 928790 - RNA, 19 nt, Homo sapiens
uagccuaugugcugaacca

SEQ ID NO: 928791 - RNA, 19 nt, Homo sapiens
agaagaaggacgcggacuu

SEQ ID NO: 928792 - RNA, 19 nt, Homo sapiens
agaggaagcgggaguacau

SEQ ID NO: 928793 - RNA, 19 nt, Homo sapiens
aagaugccauuuccauuuu

SEQ ID NO: 928794 - RNA, 19 nt, Homo sapiens
augagucggugacaaagga

SEQ ID NO: 928795 - RNA, 19 nt, Homo sapiens
gcucaugaccaaagacacu

SEQ ID NO: 928796 - RNA, 19 nt, Homo sapiens
accuggagauggacuuuga

SEQ ID NO: 928797 - RNA, 19 nt, Homo sapiens
gaagcgggaguacauugag

SEQ ID NO: 928798 - RNA, 19 nt, Homo sapiens
gaggaagcgggaguacauu

SEQ ID NO: 928799 - RNA, 19 nt, Homo sapiens
ccugaaggaugagauggau

SEQ ID NO: 928800 - RNA, 19 nt, Homo sapiens
gguggaggaccugcagaaa

SEQ ID NO: 928801 - RNA, 19 nt, Homo sapiens
gcagguacuauuuccuaag

SEQ ID NO: 928802 - RNA, 19 nt, Homo sapiens
ggcgggagguagauauagg

SEQ ID NO: 928803 - RNA, 19 nt, Homo sapiens
gcacugaugucaacguuua

SEQ ID NO: 928804 - RNA, 19 nt, Homo sapiens
ggaaagagcuaguacaauc

SEQ ID NO: 928805 - RNA, 19 nt, Homo sapiens
gaagagagcuggcuuucug

SEQ ID NO: 928806 - RNA, 19 nt, Homo sapiens
gaaggcagauccagaagau

SEQ ID NO: 928807 - RNA, 19 nt, Homo sapiens
ggagaauucuuucauaugg

SEQ ID NO: 928808 - RNA, 19 nt, Homo sapiens
uaaacaagcugcacauuac

SEQ ID NO: 928809 - RNA, 19 nt, Homo sapiens
gaacugaacugauuuucuu

SEQ ID NO: 928810 - RNA, 19 nt, Homo sapiens
caaauaugcuggucuacau

SEQ ID NO: 928811 - RNA, 19 nt, Homo sapiens
ggagagcacugaugucaac

SEQ ID NO: 928812 - RNA, 19 nt, Homo sapiens
gggagaagccaacaguuaa

SEQ ID NO: 928813 - RNA, 19 nt, Homo sapiens
cgucugcccuuucaaauau

SEQ ID NO: 928814 - RNA, 19 nt, Homo sapiens
guacugaaccggagggaaa

SEQ ID NO: 928815 - RNA, 19 nt, Homo sapiens
gaacugauuuucuugaaug

SEQ ID NO: 928816 - RNA, 19 nt, Homo sapiens
gagaaacaauagguacuga

SEQ ID NO: 928817 - RNA, 19 nt, Homo sapiens
gaagaccaccagccaacua

SEQ ID NO: 928818 - RNA, 19 nt, Homo sapiens
gaagccaacaguuaagaaa

SEQ ID NO: 928819 - RNA, 19 nt, Homo sapiens
ggagaaaggcguccacaca

SEQ ID NO: 928820 - RNA, 19 nt, Homo sapiens
gagcacugaugucaacguu

SEQ ID NO: 928821 - RNA, 19 nt, Homo sapiens
cuggaugacuuccugcuua

SEQ ID NO: 928822 - RNA, 19 nt, Homo sapiens
gaaaggagaaacaauaggu

SEQ ID NO: 928823 - RNA, 19 nt, Homo sapiens
gaaccuagagccagagugu

SEQ ID NO: 928824 - RNA, 19 nt, Homo sapiens
gaccacagcuuuggaacug

SEQ ID NO: 928825 - RNA, 19 nt, Homo sapiens
gagcuaguacaaucacaua

SEQ ID NO: 928826 - RNA, 19 nt, Homo sapiens
auaaacaagcugcacauua

SEQ ID NO: 928827 - RNA, 19 nt, Homo sapiens
gaaagagcuaguacaauca

SEQ ID NO: 928828 - RNA, 19 nt, Homo sapiens
gccagagugucuaugaauu

SEQ ID NO: 928829 - RNA, 19 nt, Homo sapiens
gagccagagugucuaugaa

SEQ ID NO: 928830 - RNA, 19 nt, Homo sapiens
gagaauucuuucauaugga

SEQ ID NO: 928831 - RNA, 19 nt, Homo sapiens
gaggaaaggccaaaacaua

SEQ ID NO: 928832 - RNA, 19 nt, Homo sapiens
ccacagcuuuggaacugaa

SEQ ID NO: 928833 - RNA, 19 nt, Homo sapiens
gaagagcaggucucacaug

SEQ ID NO: 928834 - RNA, 19 nt, Homo sapiens
agaaaggcguccacacaga

SEQ ID NO: 928835 - RNA, 19 nt, Homo sapiens
gcuaguacaaucacauauu

SEQ ID NO: 928836 - RNA, 19 nt, Homo sapiens
caagguaaguuucccaaaa

SEQ ID NO: 928837 - RNA, 19 nt, Homo sapiens
gcuuagguccgucacauuu

SEQ ID NO: 928838 - RNA, 19 nt, Homo sapiens
ggucucacaugcccgaaga

SEQ ID NO: 928839 - RNA, 19 nt, Homo sapiens
gucuaugaauuccaaguuu

SEQ ID NO: 928840 - RNA, 19 nt, Homo sapiens
gaaaagggacaaaugaaga

SEQ ID NO: 928841 - RNA, 19 nt, Homo sapiens
ggaaagacaaagaggaaag

SEQ ID NO: 928842 - RNA, 19 nt, Homo sapiens
uuucaaauaugcuggucua

SEQ ID NO: 928843 - RNA, 19 nt, Homo sapiens
gauuucccauccaagguaa

SEQ ID NO: 928844 - RNA, 19 nt, Homo sapiens
gagugucuaugaauuccaa

SEQ ID NO: 928845 - RNA, 19 nt, Homo sapiens
cuuuggaacugaacugauu

SEQ ID NO: 928846 - RNA, 19 nt, Homo sapiens
ucuaugaauuccaaguuug

SEQ ID NO: 928847 - RNA, 19 nt, Homo sapiens
gaaacaauagguacugaac

SEQ ID NO: 928848 - RNA, 19 nt, Homo sapiens
ucacagaacacgacagagu

SEQ ID NO: 928849 - RNA, 19 nt, Homo sapiens
ggacuucaucccacucuag

SEQ ID NO: 928850 - RNA, 19 nt, Homo sapiens
gagaagccaacaguuaaga

SEQ ID NO: 928851 - RNA, 19 nt, Homo sapiens
cacaaggcaugaggucaaa

SEQ ID NO: 928852 - RNA, 19 nt, Homo sapiens
cuacauggaaagacaaaga

SEQ ID NO: 928853 - RNA, 19 nt, Homo sapiens
caucacagaacacgacaga

SEQ ID NO: 928854 - RNA, 19 nt, Homo sapiens
ggggagaagccaacaguua

SEQ ID NO: 928855 - RNA, 19 nt, Homo sapiens
ggagaaacaauagguacug

SEQ ID NO: 928856 - RNA, 19 nt, Homo sapiens
ugucaacguuuaacaaggu

SEQ ID NO: 928857 - RNA, 19 nt, Homo sapiens
aaaggagaaacaauaggua

SEQ ID NO: 928858 - RNA, 19 nt, Homo sapiens
ucuaguggaugguggacaa

SEQ ID NO: 928859 - RNA, 19 nt, Homo sapiens
ccagagugucuaugaauuc

SEQ ID NO: 928860 - RNA, 19 nt, Homo sapiens
ggaaggaccacagcuuugg

SEQ ID NO: 928861 - RNA, 19 nt, Homo sapiens
ggaaaggccaaaacauaaa

SEQ ID NO: 928862 - RNA, 19 nt, Homo sapiens
ggagaagccaacaguuaag

SEQ ID NO: 928863 - RNA, 19 nt, Homo sapiens
gaaggaccacagcuuugga

SEQ ID NO: 928864 - RNA, 19 nt, Homo sapiens
gaugucaacguuuaacaag

SEQ ID NO: 928865 - RNA, 19 nt, Homo sapiens
aagccuacguuucccauuc

SEQ ID NO: 928866 - RNA, 19 nt, Homo sapiens
uaacaagguuccccagugu

SEQ ID NO: 928867 - RNA, 19 nt, Homo sapiens
cgauuucccauccaaggua

SEQ ID NO: 928868 - RNA, 19 nt, Homo sapiens
gauucgauuucccauccaa

SEQ ID NO: 928869 - RNA, 19 nt, Homo sapiens
uuagguccgucacauuuca

SEQ ID NO: 928870 - RNA, 19 nt, Homo sapiens
cacagagccuuagcaggaa

SEQ ID NO: 928871 - RNA, 19 nt, Homo sapiens
acacaaggcaugaggucaa

SEQ ID NO: 928872 - RNA, 19 nt, Homo sapiens
ggccaaaacauaaacaaaa

SEQ ID NO: 928873 - RNA, 19 nt, Homo sapiens
gaaagacaaagaggaaagg

SEQ ID NO: 928874 - RNA, 19 nt, Homo sapiens
ggaaagggcgagggugagu

SEQ ID NO: 928875 - RNA, 19 nt, Homo sapiens
ucagaagagagcuggcuuu

SEQ ID NO: 928876 - RNA, 19 nt, Homo sapiens
cauauggaaagagcuagua

SEQ ID NO: 928877 - RNA, 19 nt, Homo sapiens
cuacguuucccauucauca

SEQ ID NO: 928878 - RNA, 19 nt, Homo sapiens
gagagcuggcuuucuggaa

SEQ ID NO: 928879 - RNA, 19 nt, Homo sapiens
cgucacauuucagaagaga

SEQ ID NO: 928880 - RNA, 19 nt, Homo sapiens
cgaaggcagauccagaaga

SEQ ID NO: 928881 - RNA, 19 nt, Homo sapiens
gcucugagggugccacuac

SEQ ID NO: 928882 - RNA, 19 nt, Homo sapiens
gccaaaacauaaacaaaag

SEQ ID NO: 928883 - RNA, 19 nt, Homo sapiens
ucaaauaugcuggucuaca

SEQ ID NO: 928884 - RNA, 19 nt, Homo sapiens
cuaugaauuccaaguuuga

SEQ ID NO: 928885 - RNA, 19 nt, Homo sapiens
gccgucgucugcccuuuca

SEQ ID NO: 928886 - RNA, 19 nt, Homo sapiens
ggcaugaggucaaaagcuu

SEQ ID NO: 928887 - RNA, 19 nt, Homo sapiens
ggucuucaaaggccauuuc

SEQ ID NO: 928888 - RNA, 19 nt, Homo sapiens
cuauagaucacgggagaaa

SEQ ID NO: 928889 - RNA, 19 nt, Homo sapiens
gaagccuacguuucccauu

SEQ ID NO: 928890 - RNA, 19 nt, Homo sapiens
cgucgucugcccuuucaaa

SEQ ID NO: 928891 - RNA, 19 nt, Homo sapiens
aggcagauccagaagauag

SEQ ID NO: 928892 - RNA, 19 nt, Homo sapiens
acaaagaggaaaggccaaa

SEQ ID NO: 928893 - RNA, 19 nt, Homo sapiens
gagugcacacauccuggua

SEQ ID NO: 928894 - RNA, 19 nt, Homo sapiens
cagaagagagcuggcuuuc

SEQ ID NO: 928895 - RNA, 19 nt, Homo sapiens
uggaugacuuccugcuuag

SEQ ID NO: 928896 - RNA, 19 nt, Homo sapiens
caccagccaacuacacauu

SEQ ID NO: 928897 - RNA, 19 nt, Homo sapiens
caagugggguggaaacagu

SEQ ID NO: 928898 - RNA, 19 nt, Homo sapiens
ccaagguaaguuucccaaa

SEQ ID NO: 928899 - RNA, 19 nt, Homo sapiens
guauaaacaagcugcacau

SEQ ID NO: 928900 - RNA, 19 nt, Homo sapiens
agagccagagugucuauga

SEQ ID NO: 928901 - RNA, 19 nt, Homo sapiens
cuggaaggaccacagcuuu

SEQ ID NO: 928902 - RNA, 19 nt, Homo sapiens
uauaaacaagcugcacauu

SEQ ID NO: 928903 - RNA, 19 nt, Homo sapiens
guaauuuggucaacacuua

SEQ ID NO: 928904 - RNA, 19 nt, Homo sapiens
gcacuuggcucuuaucuac

SEQ ID NO: 928905 - RNA, 19 nt, Homo sapiens
ggugggaacuccugccuua

SEQ ID NO: 928906 - RNA, 19 nt, Homo sapiens
gggaacuccugccuuauaa

SEQ ID NO: 928907 - RNA, 19 nt, Homo sapiens
cgacaugucucccuuucuu

SEQ ID NO: 928908 - RNA, 19 nt, Homo sapiens
gaacgacugucccgagcaa

SEQ ID NO: 928909 - RNA, 19 nt, Homo sapiens
caagggcauugaccacaaa

SEQ ID NO: 928910 - RNA, 19 nt, Homo sapiens
caacacuuacuaugacuuu

SEQ ID NO: 928911 - RNA, 19 nt, Homo sapiens
gaggaaggaaugugauuug

SEQ ID NO: 928912 - RNA, 19 nt, Homo sapiens
gcagugcccuugccuacag

SEQ ID NO: 928913 - RNA, 19 nt, Homo sapiens
ccaagggcauugaccacaa

SEQ ID NO: 928914 - RNA, 19 nt, Homo sapiens
ggacacuuguggaccgaau

SEQ ID NO: 928915 - RNA, 19 nt, Homo sapiens
gggagagacugucaaagcu

SEQ ID NO: 928916 - RNA, 19 nt, Homo sapiens
gggagaagauuaacauccu

SEQ ID NO: 928917 - RNA, 19 nt, Homo sapiens
gaaugugauuuggcaguca

SEQ ID NO: 928918 - RNA, 19 nt, Homo sapiens
gaacuccugccuuauaaaa

SEQ ID NO: 928919 - RNA, 19 nt, Homo sapiens
ugggaacuccugccuuaua

SEQ ID NO: 928920 - RNA, 19 nt, Homo sapiens
ucaucauccucaucacuuu

SEQ ID NO: 928921 - RNA, 19 nt, Homo sapiens
gacaugucucccuuucuua

SEQ ID NO: 928922 - RNA, 19 nt, Homo sapiens
gccacacacugcaccauca

SEQ ID NO: 928923 - RNA, 19 nt, Homo sapiens
ucuccuacauucucuacaa

SEQ ID NO: 928924 - RNA, 19 nt, Homo sapiens
caacaacaccagggacaug

SEQ ID NO: 928925 - RNA, 19 nt, Homo sapiens
guaagacccacuugcuguu

SEQ ID NO: 928926 - RNA, 19 nt, Homo sapiens
ggaacuccugccuuauaaa

SEQ ID NO: 928927 - RNA, 19 nt, Homo sapiens
gcagucaggguacuaagca

SEQ ID NO: 928928 - RNA, 19 nt, Homo sapiens
gaccucaucauccucauca

SEQ ID NO: 928929 - RNA, 19 nt, Homo sapiens
ccgaggccauucuccauuc

SEQ ID NO: 928930 - RNA, 19 nt, Homo sapiens
gagucuuccucuacacguu

SEQ ID NO: 928931 - RNA, 19 nt, Homo sapiens
aagccaggccuucaacaaa

SEQ ID NO: 928932 - RNA, 19 nt, Homo sapiens
cuaugucuuuggcaucauu

SEQ ID NO: 928933 - RNA, 19 nt, Homo sapiens
cuacacaggaggaauugga

SEQ ID NO: 928934 - RNA, 19 nt, Homo sapiens
ugaggaaggaaugugauuu

SEQ ID NO: 928935 - RNA, 19 nt, Homo sapiens
aggccugucuggcuccuuu

SEQ ID NO: 928936 - RNA, 19 nt, Homo sapiens
cacgacaugucucccuuuc

SEQ ID NO: 928937 - RNA, 19 nt, Homo sapiens
gugcguggcucacuuuuag

SEQ ID NO: 928938 - RNA, 19 nt, Homo sapiens
ccacgacaugucucccuuu

SEQ ID NO: 928939 - RNA, 19 nt, Homo sapiens
ccauggccuucucccuuga

SEQ ID NO: 928940 - RNA, 19 nt, Homo sapiens
ucucuacacaggaggaauu

SEQ ID NO: 928941 - RNA, 19 nt, Homo sapiens
acuuggcucuuaucuacuu

SEQ ID NO: 928942 - RNA, 19 nt, Homo sapiens
ggacuuuucuaugucuuug

SEQ ID NO: 928943 - RNA, 19 nt, Homo sapiens
cuacaacacacugcucuuc

SEQ ID NO: 928944 - RNA, 19 nt, Homo sapiens
cuugagagacaguuucgaa

SEQ ID NO: 928945 - RNA, 19 nt, Homo sapiens
gacugucccgagcaagaua

SEQ ID NO: 928946 - RNA, 19 nt, Homo sapiens
gguaauuuggucaacacuu

SEQ ID NO: 928947 - RNA, 19 nt, Homo sapiens
uaagacccacuugcuguug

SEQ ID NO: 928948 - RNA, 19 nt, Homo sapiens
cugaggcccuggagcuuca

SEQ ID NO: 928949 - RNA, 19 nt, Homo sapiens
guucggagucuuccucuac

SEQ ID NO: 928950 - RNA, 19 nt, Homo sapiens
ggacauagcuucucuuuau

SEQ ID NO: 928951 - RNA, 19 nt, Homo sapiens
ccacacagcuguuauauau

SEQ ID NO: 928952 - RNA, 19 nt, Homo sapiens
guaauaacaucguuccuaa

SEQ ID NO: 928953 - RNA, 19 nt, Homo sapiens
gaauggagauguaccaguu

SEQ ID NO: 928954 - RNA, 19 nt, Homo sapiens
caaagaauguugaagguau

SEQ ID NO: 928955 - RNA, 19 nt, Homo sapiens
gcaaugaguuauaugaguu

SEQ ID NO: 928956 - RNA, 19 nt, Homo sapiens
gaacgacaauggugugaug

SEQ ID NO: 928957 - RNA, 19 nt, Homo sapiens
acaauaauguucccagaua

SEQ ID NO: 928958 - RNA, 19 nt, Homo sapiens
gguaggaaaugcagaugua

SEQ ID NO: 928959 - RNA, 19 nt, Homo sapiens
gcaaggaucuuugguaucu

SEQ ID NO: 928960 - RNA, 19 nt, Homo sapiens
cagcacagauacaagauaa

SEQ ID NO: 928961 - RNA, 19 nt, Homo sapiens
uaaagagacuccuucaaau

SEQ ID NO: 928962 - RNA, 19 nt, Homo sapiens
ggaaacaagauguacauuu

SEQ ID NO: 928963 - RNA, 19 nt, Homo sapiens
acacagcuguuauauauug

SEQ ID NO: 928964 - RNA, 19 nt, Homo sapiens
gaaacuaugucauggucaa

SEQ ID NO: 928965 - RNA, 19 nt, Homo sapiens
gacuacagcuugcuuaaga

SEQ ID NO: 928966 - RNA, 19 nt, Homo sapiens
gaugaagugucuacaguug

SEQ ID NO: 928967 - RNA, 19 nt, Homo sapiens
uggaagagauggcuacaaa

SEQ ID NO: 928968 - RNA, 19 nt, Homo sapiens
gaagauacagcaaugaguu

SEQ ID NO: 928969 - RNA, 19 nt, Homo sapiens
gacauagcuucucuuuaua

SEQ ID NO: 928970 - RNA, 19 nt, Homo sapiens
cuaaagagacuccuucaaa

SEQ ID NO: 928971 - RNA, 19 nt, Homo sapiens
gcaaaugcacauauugauu

SEQ ID NO: 928972 - RNA, 19 nt, Homo sapiens
gcaaagcaucucaaaggua

SEQ ID NO: 928973 - RNA, 19 nt, Homo sapiens
gcaagucguugguuaugga

SEQ ID NO: 928974 - RNA, 19 nt, Homo sapiens
gauagguccuuucagcaaa

SEQ ID NO: 928975 - RNA, 19 nt, Homo sapiens
gaacaguaauuccugaaac

SEQ ID NO: 928976 - RNA, 19 nt, Homo sapiens
acaagcaagucguugguua

SEQ ID NO: 928977 - RNA, 19 nt, Homo sapiens
ggauuugucugugauggua

SEQ ID NO: 928978 - RNA, 19 nt, Homo sapiens
gcacagcacagauacaaga

SEQ ID NO: 928979 - RNA, 19 nt, Homo sapiens
gcacugaauagucaaguuu

SEQ ID NO: 928980 - RNA, 19 nt, Homo sapiens
gcgaagauucaaacaauaa

SEQ ID NO: 928981 - RNA, 19 nt, Homo sapiens
uaacaucguuccuaacagu

SEQ ID NO: 928982 - RNA, 19 nt, Homo sapiens
cagcauggcucugguguug

SEQ ID NO: 928983 - RNA, 19 nt, Homo sapiens
gggcaguuguuaaagauga

SEQ ID NO: 928984 - RNA, 19 nt, Homo sapiens
uuaaagcacugacggauuc

SEQ ID NO: 928985 - RNA, 19 nt, Homo sapiens
gcaguugaguacagacuug

SEQ ID NO: 928986 - RNA, 19 nt, Homo sapiens
ggaccacccuaguaucaga

SEQ ID NO: 928987 - RNA, 19 nt, Homo sapiens
gauacaagauaauccaagu

SEQ ID NO: 928988 - RNA, 19 nt, Homo sapiens
cggaugagcugcacgucua

SEQ ID NO: 928989 - RNA, 19 nt, Homo sapiens
caucaaaugcuucuaauca

SEQ ID NO: 928990 - RNA, 19 nt, Homo sapiens
gauugugaauggagaugua

SEQ ID NO: 928991 - RNA, 19 nt, Homo sapiens
cagcuugacuuagaaacua

SEQ ID NO: 928992 - RNA, 19 nt, Homo sapiens
gcuauugugaugaugauua

SEQ ID NO: 928993 - RNA, 19 nt, Homo sapiens
gaucagccguguagagaca

SEQ ID NO: 928994 - RNA, 19 nt, Homo sapiens
gcaaauguagguguucuaa

SEQ ID NO: 928995 - RNA, 19 nt, Homo sapiens
gggaaugguugaauaugga

SEQ ID NO: 928996 - RNA, 19 nt, Homo sapiens
gcagucagaauuucaaaga

SEQ ID NO: 928997 - RNA, 19 nt, Homo sapiens
aaauguagguguucuaagu

SEQ ID NO: 928998 - RNA, 19 nt, Homo sapiens
aagcgaagauucaaacaau

SEQ ID NO: 928999 - RNA, 19 nt, Homo sapiens
uaccaaaucugaaguugau

SEQ ID NO: 929000 - RNA, 19 nt, Homo sapiens
aaucaaugguugugggaua

SEQ ID NO: 929001 - RNA, 19 nt, Homo sapiens
uaacccagcagaccauuaa

SEQ ID NO: 929002 - RNA, 19 nt, Homo sapiens
gauggacccucacagacaa

SEQ ID NO: 929003 - RNA, 19 nt, Homo sapiens
caagcugcaucaucagauu

SEQ ID NO: 929004 - RNA, 19 nt, Homo sapiens
aagcaaagacucucugaaa

SEQ ID NO: 929005 - RNA, 19 nt, Homo sapiens
ggaagcaaagcaucucaaa

SEQ ID NO: 929006 - RNA, 19 nt, Homo sapiens
auaccaagcugcaucauca

SEQ ID NO: 929007 - RNA, 19 nt, Homo sapiens
guacagacuugccauacca

SEQ ID NO: 929008 - RNA, 19 nt, Homo sapiens
ccacugugcuguugcaauc

SEQ ID NO: 929009 - RNA, 19 nt, Homo sapiens
uauggcagcuugacuuaga

SEQ ID NO: 929010 - RNA, 19 nt, Homo sapiens
caauaauguucccagauau

SEQ ID NO: 929011 - RNA, 19 nt, Homo sapiens
gggaugaagugucuacagu

SEQ ID NO: 929012 - RNA, 19 nt, Homo sapiens
caagugggaugaagugucu

SEQ ID NO: 929013 - RNA, 19 nt, Homo sapiens
caaguucgguggcuucaag

SEQ ID NO: 929014 - RNA, 19 nt, Homo sapiens
ggauaucagcaaagaauga

SEQ ID NO: 929015 - RNA, 19 nt, Homo sapiens
ggaauauucagccuacuug

SEQ ID NO: 929016 - RNA, 19 nt, Homo sapiens
ucauacagccaguguuaua

SEQ ID NO: 929017 - RNA, 19 nt, Homo sapiens
gcacagauacaagauaauc

SEQ ID NO: 929018 - RNA, 19 nt, Homo sapiens
ucacuaacaacauucagua

SEQ ID NO: 929019 - RNA, 19 nt, Homo sapiens
gcauggcucugguguugug

SEQ ID NO: 929020 - RNA, 19 nt, Homo sapiens
gcacugacggauucuaaug

SEQ ID NO: 929021 - RNA, 19 nt, Homo sapiens
gagauguaccaguucauuu

SEQ ID NO: 929022 - RNA, 19 nt, Homo sapiens
gaagcuauugugaugauga

SEQ ID NO: 929023 - RNA, 19 nt, Homo sapiens
gccauuguguucaggauau

SEQ ID NO: 929024 - RNA, 19 nt, Homo sapiens
cagauucucaggaagauaa

SEQ ID NO: 929025 - RNA, 19 nt, Homo sapiens
gaugguaccagaauauuag

SEQ ID NO: 929026 - RNA, 19 nt, Homo sapiens
gauacagcaaugaguuaua

SEQ ID NO: 929027 - RNA, 19 nt, Homo sapiens
caaccucaccuucuggaaa

SEQ ID NO: 929028 - RNA, 19 nt, Homo sapiens
ggauagguccuuucagcaa

SEQ ID NO: 929029 - RNA, 19 nt, Homo sapiens
gaagaucagccguguagag

SEQ ID NO: 929030 - RNA, 19 nt, Homo sapiens
agacaaggcaguaauaaca

SEQ ID NO: 929031 - RNA, 19 nt, Homo sapiens
ggagauguaccaguucauu

SEQ ID NO: 929032 - RNA, 19 nt, Homo sapiens
ggauguaagaacaguaauu

SEQ ID NO: 929033 - RNA, 19 nt, Homo sapiens
guaguugccuggauguaag

SEQ ID NO: 929034 - RNA, 19 nt, Homo sapiens
uauggaagauacagcaaug

SEQ ID NO: 929035 - RNA, 19 nt, Homo sapiens
guucccagauauuuaaaug

SEQ ID NO: 929036 - RNA, 19 nt, Homo sapiens
aaacgaaagcgaagauuca

SEQ ID NO: 929037 - RNA, 19 nt, Homo sapiens
uaacaacauucaguaccaa

SEQ ID NO: 929038 - RNA, 19 nt, Homo sapiens
aaacaucuguauccaguac

SEQ ID NO: 929039 - RNA, 19 nt, Homo sapiens
gauguaagaacaguaauuc

SEQ ID NO: 929040 - RNA, 19 nt, Homo sapiens
agacuucaccucaugauug

SEQ ID NO: 929041 - RNA, 19 nt, Homo sapiens
cuucauacagccaguguua

SEQ ID NO: 929042 - RNA, 19 nt, Homo sapiens
cugcaaggaucuuugguau

SEQ ID NO: 929043 - RNA, 19 nt, Homo sapiens
accaagagcuggccacugu

SEQ ID NO: 929044 - RNA, 19 nt, Homo sapiens
gguugugccuucuccaaga

SEQ ID NO: 929045 - RNA, 19 nt, Homo sapiens
ggaggcgaguuucuuccuu

SEQ ID NO: 929046 - RNA, 19 nt, Homo sapiens
gacuucaccucaugauugu

SEQ ID NO: 929047 - RNA, 19 nt, Homo sapiens
ggucaaaaccagaaacuaa

SEQ ID NO: 929048 - RNA, 19 nt, Homo sapiens
gucagaauuucaaagaaug

SEQ ID NO: 929049 - RNA, 19 nt, Homo sapiens
caaaccagacuuuaaagca

SEQ ID NO: 929050 - RNA, 19 nt, Homo sapiens
gaaagcagcuacagagaaa

SEQ ID NO: 929051 - RNA, 19 nt, Homo sapiens
gaacagaacccuauauuac

SEQ ID NO: 929052 - RNA, 19 nt, Homo sapiens
gcagauguuuguaaguuaa

SEQ ID NO: 929053 - RNA, 19 nt, Homo sapiens
gaacaaauacugugcagau

SEQ ID NO: 929054 - RNA, 19 nt, Homo sapiens
caaauacugugcagauguu

SEQ ID NO: 929055 - RNA, 19 nt, Homo sapiens
agagugggcuccuuucuuu

SEQ ID NO: 929056 - RNA, 19 nt, Homo sapiens
auucuaagcugccauauug

SEQ ID NO: 929057 - RNA, 19 nt, Homo sapiens
ggauggagaugagaaacaa

SEQ ID NO: 929058 - RNA, 19 nt, Homo sapiens
gcagacauguggccaucuu

SEQ ID NO: 929059 - RNA, 19 nt, Homo sapiens
gauaugcuaugucaaacug

SEQ ID NO: 929060 - RNA, 19 nt, Homo sapiens
gacaaggucugcagcacuu

SEQ ID NO: 929061 - RNA, 19 nt, Homo sapiens
gaacaggaggaggugauua

SEQ ID NO: 929062 - RNA, 19 nt, Homo sapiens
ugaacagaacccuauauua

SEQ ID NO: 929063 - RNA, 19 nt, Homo sapiens
gugcagauguuuguaaguu

SEQ ID NO: 929064 - RNA, 19 nt, Homo sapiens
gagaccagccuaagaguug

SEQ ID NO: 929065 - RNA, 19 nt, Homo sapiens
acagagaaaugcugguuug

SEQ ID NO: 929066 - RNA, 19 nt, Homo sapiens
ggacugucauggcauuuag

SEQ ID NO: 929067 - RNA, 19 nt, Homo sapiens
gcaggucauuuguauguag

SEQ ID NO: 929068 - RNA, 19 nt, Homo sapiens
gaacucuuauguggauuau

SEQ ID NO: 929069 - RNA, 19 nt, Homo sapiens
ggaacucuuauguggauua

SEQ ID NO: 929070 - RNA, 19 nt, Homo sapiens
gaaacaacacgcucuccuu

SEQ ID NO: 929071 - RNA, 19 nt, Homo sapiens
caucuuggcuggcuucagu

SEQ ID NO: 929072 - RNA, 19 nt, Homo sapiens
caaauucuaagcugccaua

SEQ ID NO: 929073 - RNA, 19 nt, Homo sapiens
cugcagcacuuccuugaaa

SEQ ID NO: 929074 - RNA, 19 nt, Homo sapiens
gccgugaucuggcuauaug

SEQ ID NO: 929075 - RNA, 19 nt, Homo sapiens
gguguaggaugucggagaa

SEQ ID NO: 929076 - RNA, 19 nt, Homo sapiens
gcucuacucuuagguuugu

SEQ ID NO: 929077 - RNA, 19 nt, Homo sapiens
ggaaggagaagccgugauc

SEQ ID NO: 929078 - RNA, 19 nt, Homo sapiens
gagaucaugcugugccuuu

SEQ ID NO: 929079 - RNA, 19 nt, Homo sapiens
aaaggaccauuuagaagug

SEQ ID NO: 929080 - RNA, 19 nt, Homo sapiens
ccuaagaguugcugcuuuc

SEQ ID NO: 929081 - RNA, 19 nt, Homo sapiens
guuacugucucuucugguu

SEQ ID NO: 929082 - RNA, 19 nt, Homo sapiens
ggaugaauauuuacuuucc

SEQ ID NO: 929083 - RNA, 19 nt, Homo sapiens
cgaaguaccaugacugugu

SEQ ID NO: 929084 - RNA, 19 nt, Homo sapiens
guauguaggaccaggagua

SEQ ID NO: 929085 - RNA, 19 nt, Homo sapiens
gacugugucugaugccauu

SEQ ID NO: 929086 - RNA, 19 nt, Homo sapiens
ucacugauaccacugaaug

SEQ ID NO: 929087 - RNA, 19 nt, Homo sapiens
gagaaagcagcuacagaga

SEQ ID NO: 929088 - RNA, 19 nt, Homo sapiens
gugcuguucucagauguuu

SEQ ID NO: 929089 - RNA, 19 nt, Homo sapiens
ugcagauguuuguaaguua

SEQ ID NO: 929090 - RNA, 19 nt, Homo sapiens
gaagugugggcuccaguug

SEQ ID NO: 929091 - RNA, 19 nt, Homo sapiens
ugggagugguuauguugua

SEQ ID NO: 929092 - RNA, 19 nt, Homo sapiens
gcucuggguucugcucuga

SEQ ID NO: 929093 - RNA, 19 nt, Homo sapiens
gcucuucucaccuggcuaa

SEQ ID NO: 929094 - RNA, 19 nt, Homo sapiens
cugaugccauucuucgaua

SEQ ID NO: 929095 - RNA, 19 nt, Homo sapiens
cacaacagcucauggucau

SEQ ID NO: 929096 - RNA, 19 nt, Homo sapiens
aaagugagcucuggguucu

SEQ ID NO: 929097 - RNA, 19 nt, Homo sapiens
gccuaagaguugcugcuuu

SEQ ID NO: 929098 - RNA, 19 nt, Homo sapiens
ggagaccagccuaagaguu

SEQ ID NO: 929099 - RNA, 19 nt, Homo sapiens
gagugugguucuccuguca

SEQ ID NO: 929100 - RNA, 19 nt, Homo sapiens
cuagagcacuuuguuugug

SEQ ID NO: 929101 - RNA, 19 nt, Homo sapiens
gggcuuuggccugaaauaa

SEQ ID NO: 929102 - RNA, 19 nt, Homo sapiens
gcauugcucuacucuuagg

SEQ ID NO: 929103 - RNA, 19 nt, Homo sapiens
gcugccauauugaacauca

SEQ ID NO: 929104 - RNA, 19 nt, Homo sapiens
acucugagguuccuuccuu

SEQ ID NO: 929105 - RNA, 19 nt, Homo sapiens
ucagauguuuccuuccaau

SEQ ID NO: 929106 - RNA, 19 nt, Homo sapiens
ccugagaccugcacaacag

SEQ ID NO: 929107 - RNA, 19 nt, Homo sapiens
cuccucaggugaccaguuu

SEQ ID NO: 929108 - RNA, 19 nt, Homo sapiens
acagaacccuauauuacuc

SEQ ID NO: 929109 - RNA, 19 nt, Homo sapiens
aggcugggcugcuuagugu

SEQ ID NO: 929110 - RNA, 19 nt, Homo sapiens
guaccaugacugugucuga

SEQ ID NO: 929111 - RNA, 19 nt, Homo sapiens
agaaagcagcuacagagaa

SEQ ID NO: 929112 - RNA, 19 nt, Homo sapiens
gcuuuggccugaaauaaaa

SEQ ID NO: 929113 - RNA, 19 nt, Homo sapiens
ggcuuuggccugaaauaaa

SEQ ID NO: 929114 - RNA, 19 nt, Homo sapiens
gggacugucauggcauuua

SEQ ID NO: 929115 - RNA, 19 nt, Homo sapiens
ugucucuucugguuauaaa

SEQ ID NO: 929116 - RNA, 19 nt, Homo sapiens
ggggaugaauauuuacuuu

SEQ ID NO: 929117 - RNA, 19 nt, Homo sapiens
gggagugguuauguuguau

SEQ ID NO: 929118 - RNA, 19 nt, Homo sapiens
gaaaaggaccauuuagaag

SEQ ID NO: 929119 - RNA, 19 nt, Homo sapiens
gacagccaguugcaccuau

SEQ ID NO: 929120 - RNA, 19 nt, Homo sapiens
aggaggaggugauuacagu

SEQ ID NO: 929121 - RNA, 19 nt, Homo sapiens
ugaagaaaaggaccauuua

SEQ ID NO: 929122 - RNA, 19 nt, Homo sapiens
agaaugagggcuccuggaa

SEQ ID NO: 929123 - RNA, 19 nt, Homo sapiens
ccuccacucuucagucugu

SEQ ID NO: 929124 - RNA, 19 nt, Homo sapiens
agugugggcuccaguuguu

SEQ ID NO: 929125 - RNA, 19 nt, Homo sapiens
cuaaaggagaccagccuaa

SEQ ID NO: 929126 - RNA, 19 nt, Homo sapiens
caacacgcucuccuucaga

SEQ ID NO: 929127 - RNA, 19 nt, Homo sapiens
ggaugucggagaaccaaga

SEQ ID NO: 929128 - RNA, 19 nt, Homo sapiens
aaaggagaccagccuaaga

SEQ ID NO: 929129 - RNA, 19 nt, Homo sapiens
agauauuccuccauaccaa

SEQ ID NO: 929130 - RNA, 19 nt, Homo sapiens
gugggacugucauggcauu

SEQ ID NO: 929131 - RNA, 19 nt, Homo sapiens
cuggaacucuuauguggau

SEQ ID NO: 929132 - RNA, 19 nt, Homo sapiens
acccguauguggcaaauuc

SEQ ID NO: 929133 - RNA, 19 nt, Homo sapiens
aaugagggcuccuggaacu

SEQ ID NO: 929134 - RNA, 19 nt, Homo sapiens
gaguucguguggcugagaa

SEQ ID NO: 929135 - RNA, 19 nt, Homo sapiens
gguuagagugggcuccuuu

SEQ ID NO: 929136 - RNA, 19 nt, Homo sapiens
ucucagauguuuccuucca

SEQ ID NO: 929137 - RNA, 19 nt, Homo sapiens
ggacccguauguggcaaau

SEQ ID NO: 929138 - RNA, 19 nt, Homo sapiens
gagauggucagagaagaug

SEQ ID NO: 929139 - RNA, 19 nt, Homo sapiens
ugucauggcauuuaguuca

SEQ ID NO: 929140 - RNA, 19 nt, Homo sapiens
uuucccaccuccuugcuuu

SEQ ID NO: 929141 - RNA, 19 nt, Homo sapiens
gggaugaauauuuacuuuc

SEQ ID NO: 929142 - RNA, 19 nt, Homo sapiens
acaaauacugugcagaugu

SEQ ID NO: 929143 - RNA, 19 nt, Homo sapiens
gugcaagggcuuuguuucu

SEQ ID NO: 929144 - RNA, 19 nt, Homo sapiens
gcuccuggaacucuuaugu

SEQ ID NO: 929145 - RNA, 19 nt, Homo sapiens
gcccuagagcacuuuguuu

SEQ ID NO: 929146 - RNA, 19 nt, Homo sapiens
agaaaaggaccauuuagaa

SEQ ID NO: 929147 - RNA, 19 nt, Homo sapiens
ucugugggcucuuuuacua

SEQ ID NO: 929148 - RNA, 19 nt, Homo sapiens
acaacacgcucuccuucag

SEQ ID NO: 929149 - RNA, 19 nt, Homo sapiens
ucuaagcugccauauugaa

SEQ ID NO: 929150 - RNA, 19 nt, Homo sapiens
gaaagcagcuacagagaaa

SEQ ID NO: 929151 - RNA, 19 nt, Homo sapiens
gaacagaacccuauauuac

SEQ ID NO: 929152 - RNA, 19 nt, Homo sapiens
gcagauguuuguaaguuaa

SEQ ID NO: 929153 - RNA, 19 nt, Homo sapiens
gaacaaauacugugcagau

SEQ ID NO: 929154 - RNA, 19 nt, Homo sapiens
caaauacugugcagauguu

SEQ ID NO: 929155 - RNA, 19 nt, Homo sapiens
agagugggcuccuuucuuu

SEQ ID NO: 929156 - RNA, 19 nt, Homo sapiens
auucuaagcugccauauug

SEQ ID NO: 929157 - RNA, 19 nt, Homo sapiens
ggauggagaugagaaacaa

SEQ ID NO: 929158 - RNA, 19 nt, Homo sapiens
gcagacauguggccaucuu

SEQ ID NO: 929159 - RNA, 19 nt, Homo sapiens
gauaugcuaugucaaacug

SEQ ID NO: 929160 - RNA, 19 nt, Homo sapiens
gacaaggucugcagcacuu

SEQ ID NO: 929161 - RNA, 19 nt, Homo sapiens
gaacaggaggaggugauua

SEQ ID NO: 929162 - RNA, 19 nt, Homo sapiens
ugaacagaacccuauauua

SEQ ID NO: 929163 - RNA, 19 nt, Homo sapiens
gugcagauguuuguaaguu

SEQ ID NO: 929164 - RNA, 19 nt, Homo sapiens
gagaccagccuaagaguug

SEQ ID NO: 929165 - RNA, 19 nt, Homo sapiens
acagagaaaugcugguuug

SEQ ID NO: 929166 - RNA, 19 nt, Homo sapiens
ggacugucauggcauuuag

SEQ ID NO: 929167 - RNA, 19 nt, Homo sapiens
gcaggucauuuguauguag

SEQ ID NO: 929168 - RNA, 19 nt, Homo sapiens
gaacucuuauguggauuau

SEQ ID NO: 929169 - RNA, 19 nt, Homo sapiens
ggaacucuuauguggauua

SEQ ID NO: 929170 - RNA, 19 nt, Homo sapiens
gaaacaacacgcucuccuu

SEQ ID NO: 929171 - RNA, 19 nt, Homo sapiens
caucuuggcuggcuucagu

SEQ ID NO: 929172 - RNA, 19 nt, Homo sapiens
caaauucuaagcugccaua

SEQ ID NO: 929173 - RNA, 19 nt, Homo sapiens
cugcagcacuuccuugaaa

SEQ ID NO: 929174 - RNA, 19 nt, Homo sapiens
cagccuggaucauuuguug

SEQ ID NO: 929175 - RNA, 19 nt, Homo sapiens
gccgugaucuggcuauaug

SEQ ID NO: 929176 - RNA, 19 nt, Homo sapiens
gguguaggaugucggagaa

SEQ ID NO: 929177 - RNA, 19 nt, Homo sapiens
caagauguuuccuuccaau

SEQ ID NO: 929178 - RNA, 19 nt, Homo sapiens
gcucuacucuuagguuugu

SEQ ID NO: 929179 - RNA, 19 nt, Homo sapiens
ggaaggagaagccgugauc

SEQ ID NO: 929180 - RNA, 19 nt, Homo sapiens
gagaucaugcugugccuuu

SEQ ID NO: 929181 - RNA, 19 nt, Homo sapiens
aaaggaccauuuagaagug

SEQ ID NO: 929182 - RNA, 19 nt, Homo sapiens
ccuaagaguugcugcuuuc

SEQ ID NO: 929183 - RNA, 19 nt, Homo sapiens
gaagucaguuuucauuuca

SEQ ID NO: 929184 - RNA, 19 nt, Homo sapiens
guuacugucucuucugguu

SEQ ID NO: 929185 - RNA, 19 nt, Homo sapiens
ggaugaauauuuacuuucc

SEQ ID NO: 929186 - RNA, 19 nt, Homo sapiens
cgaaguaccaugacugugu

SEQ ID NO: 929187 - RNA, 19 nt, Homo sapiens
guauguaggaccaggagua

SEQ ID NO: 929188 - RNA, 19 nt, Homo sapiens
gacugugucugaugccauu

SEQ ID NO: 929189 - RNA, 19 nt, Homo sapiens
ucacugauaccacugaaug

SEQ ID NO: 929190 - RNA, 19 nt, Homo sapiens
gagaaagcagcuacagaga

SEQ ID NO: 929191 - RNA, 19 nt, Homo sapiens
ugcagauguuuguaaguua

SEQ ID NO: 929192 - RNA, 19 nt, Homo sapiens
gaagugugggcuccaguug

SEQ ID NO: 929193 - RNA, 19 nt, Homo sapiens
ugggagugguuauguugua

SEQ ID NO: 929194 - RNA, 19 nt, Homo sapiens
gcucuggguucugcucuga

SEQ ID NO: 929195 - RNA, 19 nt, Homo sapiens
gcucuucucaccuggcuaa

SEQ ID NO: 929196 - RNA, 19 nt, Homo sapiens
cugaugccauucuucgaua

SEQ ID NO: 929197 - RNA, 19 nt, Homo sapiens
cacaacagcucauggucau

SEQ ID NO: 929198 - RNA, 19 nt, Homo sapiens
aaagugagcucuggguucu

SEQ ID NO: 929199 - RNA, 19 nt, Homo sapiens
gccuaagaguugcugcuuu

SEQ ID NO: 929200 - RNA, 19 nt, Homo sapiens
ggagaccagccuaagaguu

SEQ ID NO: 929201 - RNA, 19 nt, Homo sapiens
gagugugguucuccuguca

SEQ ID NO: 929202 - RNA, 19 nt, Homo sapiens
cuagagcacuuuguuugug

SEQ ID NO: 929203 - RNA, 19 nt, Homo sapiens
guacauauuggcugaaguc

SEQ ID NO: 929204 - RNA, 19 nt, Homo sapiens
gggcuuuggccugaaauaa

SEQ ID NO: 929205 - RNA, 19 nt, Homo sapiens
gcauugcucuacucuuagg

SEQ ID NO: 929206 - RNA, 19 nt, Homo sapiens
gcugccauauugaacauca

SEQ ID NO: 929207 - RNA, 19 nt, Homo sapiens
acucugagguuccuuccuu

SEQ ID NO: 929208 - RNA, 19 nt, Homo sapiens
ucaagauguuuccuuccaa

SEQ ID NO: 929209 - RNA, 19 nt, Homo sapiens
ccugagaccugcacaacag

SEQ ID NO: 929210 - RNA, 19 nt, Homo sapiens
cuccucaggugaccaguuu

SEQ ID NO: 929211 - RNA, 19 nt, Homo sapiens
acagaacccuauauuacuc

SEQ ID NO: 929212 - RNA, 19 nt, Homo sapiens
aggcugggcugcuuagugu

SEQ ID NO: 929213 - RNA, 19 nt, Homo sapiens
guaccaugacugugucuga

SEQ ID NO: 929214 - RNA, 19 nt, Homo sapiens
agaaagcagcuacagagaa

SEQ ID NO: 929215 - RNA, 19 nt, Homo sapiens
gaucauuuguuggcaguac

SEQ ID NO: 929216 - RNA, 19 nt, Homo sapiens
gcuuuggccugaaauaaaa

SEQ ID NO: 929217 - RNA, 19 nt, Homo sapiens
ggcuuuggccugaaauaaa

SEQ ID NO: 929218 - RNA, 19 nt, Homo sapiens
gggacugucauggcauuua

SEQ ID NO: 929219 - RNA, 19 nt, Homo sapiens
ugucucuucugguuauaaa

SEQ ID NO: 929220 - RNA, 19 nt, Homo sapiens
ggggaugaauauuuacuuu

SEQ ID NO: 929221 - RNA, 19 nt, Homo sapiens
gggagugguuauguuguau

SEQ ID NO: 929222 - RNA, 19 nt, Homo sapiens
gaaaaggaccauuuagaag

SEQ ID NO: 929223 - RNA, 19 nt, Homo sapiens
gacagccaguugcaccuau

SEQ ID NO: 929224 - RNA, 19 nt, Homo sapiens
aggaggaggugauuacagu

SEQ ID NO: 929225 - RNA, 19 nt, Homo sapiens
ugaagaaaaggaccauuua

SEQ ID NO: 929226 - RNA, 19 nt, Homo sapiens
ccuccacucuucagucugu

SEQ ID NO: 929227 - RNA, 19 nt, Homo sapiens
agugugggcuccaguuguu

SEQ ID NO: 929228 - RNA, 19 nt, Homo sapiens
agaaugagggcuccuggaa

SEQ ID NO: 929229 - RNA, 19 nt, Homo sapiens
cuaaaggagaccagccuaa

SEQ ID NO: 929230 - RNA, 19 nt, Homo sapiens
caacacgcucuccuucaga

SEQ ID NO: 929231 - RNA, 19 nt, Homo sapiens
ggaugucggagaaccaaga

SEQ ID NO: 929232 - RNA, 19 nt, Homo sapiens
aaaggagaccagccuaaga

SEQ ID NO: 929233 - RNA, 19 nt, Homo sapiens
agauauuccuccauaccaa

SEQ ID NO: 929234 - RNA, 19 nt, Homo sapiens
gugggacugucauggcauu

SEQ ID NO: 929235 - RNA, 19 nt, Homo sapiens
acccguauguggcaaauuc

SEQ ID NO: 929236 - RNA, 19 nt, Homo sapiens
cuggaacucuuauguggau

SEQ ID NO: 929237 - RNA, 19 nt, Homo sapiens
aaugagggcuccuggaacu

SEQ ID NO: 929238 - RNA, 19 nt, Homo sapiens
gaguucguguggcugagaa

SEQ ID NO: 929239 - RNA, 19 nt, Homo sapiens
gguuagagugggcuccuuu

SEQ ID NO: 929240 - RNA, 19 nt, Homo sapiens
ggacccguauguggcaaau

SEQ ID NO: 929241 - RNA, 19 nt, Homo sapiens
gagauggucagagaagaug

SEQ ID NO: 929242 - RNA, 19 nt, Homo sapiens
ugucauggcauuuaguuca

SEQ ID NO: 929243 - RNA, 19 nt, Homo sapiens
uuucccaccuccuugcuuu

SEQ ID NO: 929244 - RNA, 19 nt, Homo sapiens
gggaugaauauuuacuuuc

SEQ ID NO: 929245 - RNA, 19 nt, Homo sapiens
acaaauacugugcagaugu

SEQ ID NO: 929246 - RNA, 19 nt, Homo sapiens
gcuccuggaacucuuaugu

SEQ ID NO: 929247 - RNA, 19 nt, Homo sapiens
gugcaagggcuuuguuucu

SEQ ID NO: 929248 - RNA, 19 nt, Homo sapiens
gcccuagagcacuuuguuu

SEQ ID NO: 929249 - RNA, 19 nt, Homo sapiens
agaaaaggaccauuuagaa

SEQ ID NO: 929250 - RNA, 19 nt, Homo sapiens
ggagaugccucauaaauuu

SEQ ID NO: 929251 - RNA, 19 nt, Homo sapiens
gaagugaagugcauuaagu

SEQ ID NO: 929252 - RNA, 19 nt, Homo sapiens
gaaauugucuucauaacag

SEQ ID NO: 929253 - RNA, 19 nt, Homo sapiens
agaaggagaugccucauaa

SEQ ID NO: 929254 - RNA, 19 nt, Homo sapiens
cauguaaacucuauucuuc

SEQ ID NO: 929255 - RNA, 19 nt, Homo sapiens
ugucgaagcugcccaaguu

SEQ ID NO: 929256 - RNA, 19 nt, Homo sapiens
gagcaucgcugcccgugau

SEQ ID NO: 929257 - RNA, 19 nt, Homo sapiens
uagaauggaugacaaagga

SEQ ID NO: 929258 - RNA, 19 nt, Homo sapiens
cauaacagaucaaggaauc

SEQ ID NO: 929259 - RNA, 19 nt, Homo sapiens
ccucaaagacuguggauuu

SEQ ID NO: 929260 - RNA, 19 nt, Homo sapiens
ggagaagugaagugcauua

SEQ ID NO: 929261 - RNA, 19 nt, Homo sapiens
ggaaucccaucucauuuag

SEQ ID NO: 929262 - RNA, 19 nt, Homo sapiens
gaaacuugagcccauagua

SEQ ID NO: 929263 - RNA, 19 nt, Homo sapiens
caucuuggauugucuuuca

SEQ ID NO: 929264 - RNA, 19 nt, Homo sapiens
ggauucugcuggacuaguu

SEQ ID NO: 929265 - RNA, 19 nt, Homo sapiens
guuaaaggcccagaugaua

SEQ ID NO: 929266 - RNA, 19 nt, Homo sapiens
gugaagaacauguugcuuu

SEQ ID NO: 929267 - RNA, 19 nt, Homo sapiens
acacaggagugcaagacua

SEQ ID NO: 929268 - RNA, 19 nt, Homo sapiens
uuagcugccuuaagguuua

SEQ ID NO: 929269 - RNA, 19 nt, Homo sapiens
uagccgugcugauggaaua

SEQ ID NO: 929270 - RNA, 19 nt, Homo sapiens
guacacccauguccuguca

SEQ ID NO: 929271 - RNA, 19 nt, Homo sapiens
acagagacaucgguaauau

SEQ ID NO: 929272 - RNA, 19 nt, Homo sapiens
cgaaagagacaucgcaaug

SEQ ID NO: 929273 - RNA, 19 nt, Homo sapiens
ugaaaucacuugcuguuuu

SEQ ID NO: 929274 - RNA, 19 nt, Homo sapiens
ggaacacugugaagaacau

SEQ ID NO: 929275 - RNA, 19 nt, Homo sapiens
gagaaaggaaugcaagaug

SEQ ID NO: 929276 - RNA, 19 nt, Homo sapiens
gcccauaguaaaucucuua

SEQ ID NO: 929277 - RNA, 19 nt, Homo sapiens
gcagcuguauguucucuuc

SEQ ID NO: 929278 - RNA, 19 nt, Homo sapiens
guacagcauuaccuacaug

SEQ ID NO: 929279 - RNA, 19 nt, Homo sapiens
aaacuugagcccauaguaa

SEQ ID NO: 929280 - RNA, 19 nt, Homo sapiens
ccacgguccuggagaaugu

SEQ ID NO: 929281 - RNA, 19 nt, Homo sapiens
caaagcagacugaagacaa

SEQ ID NO: 929282 - RNA, 19 nt, Homo sapiens
gccgugaucuugcugucua

SEQ ID NO: 929283 - RNA, 19 nt, Homo sapiens
aaucccaucucauuuagaa

SEQ ID NO: 929284 - RNA, 19 nt, Homo sapiens
gaaguucuccuuuccaaac

SEQ ID NO: 929285 - RNA, 19 nt, Homo sapiens
caacagcaaaugaugaaau

SEQ ID NO: 929286 - RNA, 19 nt, Homo sapiens
agaauguccugcagccuuu

SEQ ID NO: 929287 - RNA, 19 nt, Homo sapiens
gaagagccacaaucucaau

SEQ ID NO: 929288 - RNA, 19 nt, Homo sapiens
ggagaccaagcucuaauga

SEQ ID NO: 929289 - RNA, 19 nt, Homo sapiens
ccucauaaauuugugauag

SEQ ID NO: 929290 - RNA, 19 nt, Homo sapiens
caaccugacaucauuauca

SEQ ID NO: 929291 - RNA, 19 nt, Homo sapiens
gaagacucauggacuuucu

SEQ ID NO: 929292 - RNA, 19 nt, Homo sapiens
uuaccuacaugaacuuguu

SEQ ID NO: 929293 - RNA, 19 nt, Homo sapiens
agauugcaguacagcauua

SEQ ID NO: 929294 - RNA, 19 nt, Homo sapiens
uaaauaggacgggaaaguu

SEQ ID NO: 929295 - RNA, 19 nt, Homo sapiens
gaaagagacaucgcaaugg

SEQ ID NO: 929296 - RNA, 19 nt, Homo sapiens
caacuaaacccagccuuuc

SEQ ID NO: 929297 - RNA, 19 nt, Homo sapiens
aggaaucccaucucauuua

SEQ ID NO: 929298 - RNA, 19 nt, Homo sapiens
cuacaacauucugaaauca

SEQ ID NO: 929299 - RNA, 19 nt, Homo sapiens
ugaagaacauguugcuuuu

SEQ ID NO: 929300 - RNA, 19 nt, Homo sapiens
gaaggagaugccucauaaa

SEQ ID NO: 929301 - RNA, 19 nt, Homo sapiens
aaauaggacgggaaaguuu

SEQ ID NO: 929302 - RNA, 19 nt, Homo sapiens
acgagaaggugccuguaaa

SEQ ID NO: 929303 - RNA, 19 nt, Homo sapiens
ccuacaacauucugaaauc

SEQ ID NO: 929304 - RNA, 19 nt, Homo sapiens
agacaucgguaauauucga

SEQ ID NO: 929305 - RNA, 19 nt, Homo sapiens
gcuguauguucucuucuug

SEQ ID NO: 929306 - RNA, 19 nt, Homo sapiens
gagaagugaagugcauuaa

SEQ ID NO: 929307 - RNA, 19 nt, Homo sapiens
gcgccuaagucaacuaaac

SEQ ID NO: 929308 - RNA, 19 nt, Homo sapiens
uguuaucccuagagaguuu

SEQ ID NO: 929309 - RNA, 19 nt, Homo sapiens
ugauaggaaucccaucuca

SEQ ID NO: 929310 - RNA, 19 nt, Homo sapiens
ugacaaaggagaagugaag

SEQ ID NO: 929311 - RNA, 19 nt, Homo sapiens
gacaacauuucugcacgaa

SEQ ID NO: 929312 - RNA, 19 nt, Homo sapiens
aaggaagacucauggacuu

SEQ ID NO: 929313 - RNA, 19 nt, Homo sapiens
ucaacuaaacccagccuuu

SEQ ID NO: 929314 - RNA, 19 nt, Homo sapiens
cuaggauucugcuggacua

SEQ ID NO: 929315 - RNA, 19 nt, Homo sapiens
gaugaaauaguagaaguuc

SEQ ID NO: 929316 - RNA, 19 nt, Homo sapiens
gcaaaugaugaaauaguag

SEQ ID NO: 929317 - RNA, 19 nt, Homo sapiens
cauccugucugucuguuca

SEQ ID NO: 929318 - RNA, 19 nt, Homo sapiens
gaaaggaaugcaagauggu

SEQ ID NO: 929319 - RNA, 19 nt, Homo sapiens
agagacaucgguaauauuc

SEQ ID NO: 929320 - RNA, 19 nt, Homo sapiens
cgggaaaguuugcccugaa

SEQ ID NO: 929321 - RNA, 19 nt, Homo sapiens
cgaagcugcccaaguuuga

SEQ ID NO: 929322 - RNA, 19 nt, Homo sapiens
cuaccacgguccuggagaa

SEQ ID NO: 929323 - RNA, 19 nt, Homo sapiens
ucagcuaucucuggacaug

SEQ ID NO: 929324 - RNA, 19 nt, Homo sapiens
cagcacaaccucuuuuaua

SEQ ID NO: 929325 - RNA, 19 nt, Homo sapiens
cuuaaccaguuucagauug

SEQ ID NO: 929326 - RNA, 19 nt, Homo sapiens
auaggaaucccaucucauu

SEQ ID NO: 929327 - RNA, 19 nt, Homo sapiens
cuaaugaggccuacaacau

SEQ ID NO: 929328 - RNA, 19 nt, Homo sapiens
aguguuagcugccuuaagg

SEQ ID NO: 929329 - RNA, 19 nt, Homo sapiens
ccaaguguuagcugccuua

SEQ ID NO: 929330 - RNA, 19 nt, Homo sapiens
gcuguuaucccuagagagu

SEQ ID NO: 929331 - RNA, 19 nt, Homo sapiens
gcucuaaugaggccuacaa

SEQ ID NO: 929332 - RNA, 19 nt, Homo sapiens
gagaugccucauaaauuug

SEQ ID NO: 929333 - RNA, 19 nt, Homo sapiens
agacaaaggaagacucaug

SEQ ID NO: 929334 - RNA, 19 nt, Homo sapiens
guaguuaaaggcccagaug

SEQ ID NO: 929335 - RNA, 19 nt, Homo sapiens
caacugcgucuucuucgau

SEQ ID NO: 929336 - RNA, 19 nt, Homo sapiens
gcgaggaggacuacuaucu

SEQ ID NO: 929337 - RNA, 19 nt, Homo sapiens
cuucauaacagaucaagga

SEQ ID NO: 929338 - RNA, 19 nt, Homo sapiens
cagcaaaugaugaaauagu

SEQ ID NO: 929339 - RNA, 19 nt, Homo sapiens
uggcuugucugcuguuauc

SEQ ID NO: 929340 - RNA, 19 nt, Homo sapiens
cuacaugaacuuguuauca

SEQ ID NO: 929341 - RNA, 19 nt, Homo sapiens
gaucgauccagcccuauca

SEQ ID NO: 929342 - RNA, 19 nt, Homo sapiens
gauacagagacaucgguaa

SEQ ID NO: 929343 - RNA, 19 nt, Homo sapiens
caacaugcuuuucuauaca

SEQ ID NO: 929344 - RNA, 19 nt, Homo sapiens
aagaaggagaugccucaua

SEQ ID NO: 929345 - RNA, 19 nt, Homo sapiens
ggaagacucauggacuuuc

SEQ ID NO: 929346 - RNA, 19 nt, Homo sapiens
gagaaacggagucugaaac

SEQ ID NO: 929347 - RNA, 19 nt, Homo sapiens
cacaggagugcaagacuaa

SEQ ID NO: 929348 - RNA, 19 nt, Homo sapiens
aggagaugccucauaaauu

SEQ ID NO: 929349 - RNA, 19 nt, Homo sapiens
aaggagaugccucauaaau

SEQ ID NO: 929350 - RNA, 19 nt, Homo sapiens
ucacaaguguacaggauua

SEQ ID NO: 929351 - RNA, 19 nt, Homo sapiens
agaagaagcugauggcauu

SEQ ID NO: 929352 - RNA, 19 nt, Homo sapiens
cuucauagguguaccauuu

SEQ ID NO: 929353 - RNA, 19 nt, Homo sapiens
ggauuagacuggguuuaua

SEQ ID NO: 929354 - RNA, 19 nt, Homo sapiens
gcaaaguggugaggagaaa

SEQ ID NO: 929355 - RNA, 19 nt, Homo sapiens
gauaaaaccuccuuaaauc

SEQ ID NO: 929356 - RNA, 19 nt, Homo sapiens
gcugggagcugccaagaug

SEQ ID NO: 929357 - RNA, 19 nt, Homo sapiens
gggaggaucugcagcugaa

SEQ ID NO: 929358 - RNA, 19 nt, Homo sapiens
gggaagcuccucacaagaa

SEQ ID NO: 929359 - RNA, 19 nt, Homo sapiens
gugagcaacuuaagauugu

SEQ ID NO: 929360 - RNA, 19 nt, Homo sapiens
ggacuaaggcagcaucugu

SEQ ID NO: 929361 - RNA, 19 nt, Homo sapiens
ccugucggcucacaagaua

SEQ ID NO: 929362 - RNA, 19 nt, Homo sapiens
cagggaagcuccucacaag

SEQ ID NO: 929363 - RNA, 19 nt, Homo sapiens
gcccugcacuuucuagaga

SEQ ID NO: 929364 - RNA, 19 nt, Homo sapiens
ucauagguguaccauuuaa

SEQ ID NO: 929365 - RNA, 19 nt, Homo sapiens
ggcuuucucugaauuggua

SEQ ID NO: 929366 - RNA, 19 nt, Homo sapiens
ucagagcccuuaguugaga

SEQ ID NO: 929367 - RNA, 19 nt, Homo sapiens
ggaagcuccucacaagaag

SEQ ID NO: 929368 - RNA, 19 nt, Homo sapiens
gauuagacuggguuuauau

SEQ ID NO: 929369 - RNA, 19 nt, Homo sapiens
gcaacaaggagacggugaa

SEQ ID NO: 929370 - RNA, 19 nt, Homo sapiens
guccauggccgaccaagaa

SEQ ID NO: 929371 - RNA, 19 nt, Homo sapiens
caugccagcuuaaggacaa

SEQ ID NO: 929372 - RNA, 19 nt, Homo sapiens
gguguaccauuuaaagagu

SEQ ID NO: 929373 - RNA, 19 nt, Homo sapiens
aaacgggcuuucucugaau

SEQ ID NO: 929374 - RNA, 19 nt, Homo sapiens
ucaggaagaugggugugaa

SEQ ID NO: 929375 - RNA, 19 nt, Homo sapiens
guaaaugggaaagaaguga

SEQ ID NO: 929376 - RNA, 19 nt, Homo sapiens
ucauggcucuggacgcauu

SEQ ID NO: 929377 - RNA, 19 nt, Homo sapiens
caauuaaucacaaguguac

SEQ ID NO: 929378 - RNA, 19 nt, Homo sapiens
cacaauuaaucacaagugu

SEQ ID NO: 929379 - RNA, 19 nt, Homo sapiens
gcucucugcucaucaaugc

SEQ ID NO: 929380 - RNA, 19 nt, Homo sapiens
ucagcucuguggagaagaa

SEQ ID NO: 929381 - RNA, 19 nt, Homo sapiens
caucagcucuguggagaag

SEQ ID NO: 929382 - RNA, 19 nt, Homo sapiens
aaucacaaguguacaggau

SEQ ID NO: 929383 - RNA, 19 nt, Homo sapiens
auucagagcccuuaguuga

SEQ ID NO: 929384 - RNA, 19 nt, Homo sapiens
cagcugcccuuaagaagac

SEQ ID NO: 929385 - RNA, 19 nt, Homo sapiens
cacgagagcuacaguccau

SEQ ID NO: 929386 - RNA, 19 nt, Homo sapiens
aaagugauucgcugcauga

SEQ ID NO: 929387 - RNA, 19 nt, Homo sapiens
ucucugaauugguaaaugg

SEQ ID NO: 929388 - RNA, 19 nt, Homo sapiens
ugcguacgcugcucaguug

SEQ ID NO: 929389 - RNA, 19 nt, Homo sapiens
guuggaaguugcucugaag

SEQ ID NO: 929390 - RNA, 19 nt, Homo sapiens
gcaguugaggccuccugua

SEQ ID NO: 929391 - RNA, 19 nt, Homo sapiens
acaaggagacggugaagca

SEQ ID NO: 929392 - RNA, 19 nt, Homo sapiens
cauccacgcccugcacuuu

SEQ ID NO: 929393 - RNA, 19 nt, Homo sapiens
caggaaggcgcuacagugu

SEQ ID NO: 929394 - RNA, 19 nt, Homo sapiens
ccaaagugauucgcugcau

SEQ ID NO: 929395 - RNA, 19 nt, Homo sapiens
ccucuccugucccauguug

SEQ ID NO: 929396 - RNA, 19 nt, Homo sapiens
ccagcugcccuuaagaaga

SEQ ID NO: 929397 - RNA, 19 nt, Homo sapiens
guugaggccuccuguaucc

SEQ ID NO: 929398 - RNA, 19 nt, Homo sapiens
caguugaggccuccuguau

SEQ ID NO: 929399 - RNA, 19 nt, Homo sapiens
cccagaagcugcuguuagc

SEQ ID NO: 929400 - RNA, 19 nt, Homo sapiens
gagcaacuuaagauuguca

SEQ ID NO: 929401 - RNA, 19 nt, Homo sapiens
ccagggaagcuccucacaa

SEQ ID NO: 929402 - RNA, 19 nt, Homo sapiens
ucacaauuaaucacaagug

SEQ ID NO: 929403 - RNA, 19 nt, Homo sapiens
uuucagguccuugugauaa

SEQ ID NO: 929404 - RNA, 19 nt, Homo sapiens
uauccgaacacgagagcua

SEQ ID NO: 929405 - RNA, 19 nt, Homo sapiens
gguaaaugggaaagaagug

SEQ ID NO: 929406 - RNA, 19 nt, Homo sapiens
aaaccuccuuaaaucuguu

SEQ ID NO: 929407 - RNA, 19 nt, Homo sapiens
ggcaaaguggugaggagaa

SEQ ID NO: 929408 - RNA, 19 nt, Homo sapiens
ugauucagagcccuuaguu

SEQ ID NO: 929409 - RNA, 19 nt, Homo sapiens
gggccugccuaugcauuca

SEQ ID NO: 929410 - RNA, 19 nt, Homo sapiens
cuucugcacugagguggaa

SEQ ID NO: 929411 - RNA, 19 nt, Homo sapiens
cauagguguaccauuuaaa

SEQ ID NO: 929412 - RNA, 19 nt, Homo sapiens
ugaauugguaaaugggaaa

SEQ ID NO: 929413 - RNA, 19 nt, Homo sapiens
uucagguccuugugauaaa

SEQ ID NO: 929414 - RNA, 19 nt, Homo sapiens
gauucagagcccuuaguug

SEQ ID NO: 929415 - RNA, 19 nt, Homo sapiens
gaggcaagaaggacuaagg

SEQ ID NO: 929416 - RNA, 19 nt, Homo sapiens
uguuggaaguugcucugaa

SEQ ID NO: 929417 - RNA, 19 nt, Homo sapiens
gagcugauccaguuuauua

SEQ ID NO: 929418 - RNA, 19 nt, Homo sapiens
ggcaaacacugcuaaauuu

SEQ ID NO: 929419 - RNA, 19 nt, Homo sapiens
gaacagauggcauaagaaa

SEQ ID NO: 929420 - RNA, 19 nt, Homo sapiens
ggauggaucuguugaaaug

SEQ ID NO: 929421 - RNA, 19 nt, Homo sapiens
ucaaugagcugauccaguu

SEQ ID NO: 929422 - RNA, 19 nt, Homo sapiens
gcacuuggaagauuuauuu

SEQ ID NO: 929423 - RNA, 19 nt, Homo sapiens
ggaaagaagcauuggauuu

SEQ ID NO: 929424 - RNA, 19 nt, Homo sapiens
gaaagauccugauggcuau

SEQ ID NO: 929425 - RNA, 19 nt, Homo sapiens
aaacaaagcuggauuuacu

SEQ ID NO: 929426 - RNA, 19 nt, Homo sapiens
gcaaacacugcuaaauuua

SEQ ID NO: 929427 - RNA, 19 nt, Homo sapiens
caauggagauucaacagaa

SEQ ID NO: 929428 - RNA, 19 nt, Homo sapiens
uaaaccagaugcaauauca

SEQ ID NO: 929429 - RNA, 19 nt, Homo sapiens
gaauaaugcuacaaagaca

SEQ ID NO: 929430 - RNA, 19 nt, Homo sapiens
ccagagaaauggaguuguu

SEQ ID NO: 929431 - RNA, 19 nt, Homo sapiens
aaacuaagauccagaaugc

SEQ ID NO: 929432 - RNA, 19 nt, Homo sapiens
acaaagacauuucgagaau

SEQ ID NO: 929433 - RNA, 19 nt, Homo sapiens
gagaugaugcuauauguga

SEQ ID NO: 929434 - RNA, 19 nt, Homo sapiens
gauaauuagugguguggaa

SEQ ID NO: 929435 - RNA, 19 nt, Homo sapiens
gaaggacuguugggaaaga

SEQ ID NO: 929436 - RNA, 19 nt, Homo sapiens
ucagagcaaucuuugguaa

SEQ ID NO: 929437 - RNA, 19 nt, Homo sapiens
gcaacaaagugaaugucuu

SEQ ID NO: 929438 - RNA, 19 nt, Homo sapiens
gugaaggacuguugggaaa

SEQ ID NO: 929439 - RNA, 19 nt, Homo sapiens
ugaaaugcaugauguaaag

SEQ ID NO: 929440 - RNA, 19 nt, Homo sapiens
ccagaaugcuguucacugu

SEQ ID NO: 929441 - RNA, 19 nt, Homo sapiens
aucaaaggcuggagaaaua

SEQ ID NO: 929442 - RNA, 19 nt, Homo sapiens
gcacuguagacaacauuua

SEQ ID NO: 929443 - RNA, 19 nt, Homo sapiens
guacuccuggcaauuauua

SEQ ID NO: 929444 - RNA, 19 nt, Homo sapiens
gaggaauucuaugaaguuu

SEQ ID NO: 929445 - RNA, 19 nt, Homo sapiens
uggaacagauggcauaaga

SEQ ID NO: 929446 - RNA, 19 nt, Homo sapiens
gaaagaagcauuggauuuu

SEQ ID NO: 929447 - RNA, 19 nt, Homo sapiens
ccaaaugcuucacuucuuc

SEQ ID NO: 929448 - RNA, 19 nt, Homo sapiens
gcacuguacuccuggcaau

SEQ ID NO: 929449 - RNA, 19 nt, Homo sapiens
ggguuaauguugaggaauu

SEQ ID NO: 929450 - RNA, 19 nt, Homo sapiens
uaaagcggaccaaauauga

SEQ ID NO: 929451 - RNA, 19 nt, Homo sapiens
caaagacauuucgagaauu

SEQ ID NO: 929452 - RNA, 19 nt, Homo sapiens
cgacaacugguauuaauug

SEQ ID NO: 929453 - RNA, 19 nt, Homo sapiens
uaaccugacugaauacaag

SEQ ID NO: 929454 - RNA, 19 nt, Homo sapiens
cuaugcagauguucaauau

SEQ ID NO: 929455 - RNA, 19 nt, Homo sapiens
caacugguauuaauugacu

SEQ ID NO: 929456 - RNA, 19 nt, Homo sapiens
cggcaaacacugcuaaauu

SEQ ID NO: 929457 - RNA, 19 nt, Homo sapiens
ucauguagaucaccaguca

SEQ ID NO: 929458 - RNA, 19 nt, Homo sapiens
gacaacugguauuaauuga

SEQ ID NO: 929459 - RNA, 19 nt, Homo sapiens
gaauacaagaucaacaaga

SEQ ID NO: 929460 - RNA, 19 nt, Homo sapiens
gcugagauccugagacaau

SEQ ID NO: 929461 - RNA, 19 nt, Homo sapiens
gugcugagauccugagaca

SEQ ID NO: 929462 - RNA, 19 nt, Homo sapiens
uuagugguguggaaaguaa

SEQ ID NO: 929463 - RNA, 19 nt, Homo sapiens
caauauggaucggguuaau

SEQ ID NO: 929464 - RNA, 19 nt, Homo sapiens
gcuguucacuguacugauc

SEQ ID NO: 929465 - RNA, 19 nt, Homo sapiens
aauuguaccuguugcauug

SEQ ID NO: 929466 - RNA, 19 nt, Homo sapiens
gcuaugcagauguucaaua

SEQ ID NO: 929467 - RNA, 19 nt, Homo sapiens
gcugggaccugcaaacucu

SEQ ID NO: 929468 - RNA, 19 nt, Homo sapiens
uauuacaacugguccuauu

SEQ ID NO: 929469 - RNA, 19 nt, Homo sapiens
ucacagguugggacauuua

SEQ ID NO: 929470 - RNA, 19 nt, Homo sapiens
gcaauggagauucaacaga

SEQ ID NO: 929471 - RNA, 19 nt, Homo sapiens
acagauggcauaagaaaug

SEQ ID NO: 929472 - RNA, 19 nt, Homo sapiens
uaagagaugaugcuauaug

SEQ ID NO: 929473 - RNA, 19 nt, Homo sapiens
ugaugaugcuuucaaggaa

SEQ ID NO: 929474 - RNA, 19 nt, Homo sapiens
cagaauaaugcuacaaaga

SEQ ID NO: 929475 - RNA, 19 nt, Homo sapiens
aagagaugaugcuauaugu

SEQ ID NO: 929476 - RNA, 19 nt, Homo sapiens
caacugguccuauuauugc

SEQ ID NO: 929477 - RNA, 19 nt, Homo sapiens
caaagcuggauuuacuaua

SEQ ID NO: 929478 - RNA, 19 nt, Homo sapiens
aauacaagaucaacaagag

SEQ ID NO: 929479 - RNA, 19 nt, Homo sapiens
guuuuaaccugacugaaua

SEQ ID NO: 929480 - RNA, 19 nt, Homo sapiens
gagguucaauacuucuuca

SEQ ID NO: 929481 - RNA, 19 nt, Homo sapiens
aaggaguagugaccgaaua

SEQ ID NO: 929482 - RNA, 19 nt, Homo sapiens
ucucagcuaugcagauguu

SEQ ID NO: 929483 - RNA, 19 nt, Homo sapiens
gcauggcccugauucuuuu

SEQ ID NO: 929484 - RNA, 19 nt, Homo sapiens
gaucaacaagagcacugua

SEQ ID NO: 929485 - RNA, 19 nt, Homo sapiens
guagugaccgaauaucaug

SEQ ID NO: 929486 - RNA, 19 nt, Homo sapiens
gaugcuauaugugaaugga

SEQ ID NO: 929487 - RNA, 19 nt, Homo sapiens
aagcggaccaaauaugaua

SEQ ID NO: 929488 - RNA, 19 nt, Homo sapiens
ugaggaauucuaugaaguu

SEQ ID NO: 929489 - RNA, 19 nt, Homo sapiens
guugaggaauucuaugaag

SEQ ID NO: 929490 - RNA, 19 nt, Homo sapiens
uacaacugguccuauuauu

SEQ ID NO: 929491 - RNA, 19 nt, Homo sapiens
gcagagugguaugauccaa

SEQ ID NO: 929492 - RNA, 19 nt, Homo sapiens
guugggacauuuagacaag

SEQ ID NO: 929493 - RNA, 19 nt, Homo sapiens
ggaaaguaaagaagucaca

SEQ ID NO: 929494 - RNA, 19 nt, Homo sapiens
agagugguaugauccaaau

SEQ ID NO: 929495 - RNA, 19 nt, Homo sapiens
gaguagugaccgaauauca

SEQ ID NO: 929496 - RNA, 19 nt, Homo sapiens
agaaugcuguucacuguac

SEQ ID NO: 929497 - RNA, 19 nt, Homo sapiens
uccaaaugcuucacuucuu

SEQ ID NO: 929498 - RNA, 19 nt, Homo sapiens
augcagauguucaauaugg

SEQ ID NO: 929499 - RNA, 19 nt, Homo sapiens
ccugauggcuauccgagau

SEQ ID NO: 929500 - RNA, 19 nt, Homo sapiens
ggaacagauggcauaagaa

SEQ ID NO: 929501 - RNA, 19 nt, Homo sapiens
ggaguggcacgcacagaug

SEQ ID NO: 929502 - RNA, 19 nt, Homo sapiens
uaucaaaggcuggagaaau

SEQ ID NO: 929503 - RNA, 19 nt, Homo sapiens
uaaagaaucaucgcaccuu

SEQ ID NO: 929504 - RNA, 19 nt, Homo sapiens
gaaaugcaugauguaaaga

SEQ ID NO: 929505 - RNA, 19 nt, Homo sapiens
gaaucacacacgaggaaug

SEQ ID NO: 929506 - RNA, 19 nt, Homo sapiens
agucacagguugggacauu

SEQ ID NO: 929507 - RNA, 19 nt, Homo sapiens
uggaucggguuaauguuga

SEQ ID NO: 929508 - RNA, 19 nt, Homo sapiens
gcgcauggcccugauucuu

SEQ ID NO: 929509 - RNA, 19 nt, Homo sapiens
ccauggagauuuuaagaga

SEQ ID NO: 929510 - RNA, 19 nt, Homo sapiens
guguagcaauggagauuca

SEQ ID NO: 929511 - RNA, 19 nt, Homo sapiens
caaacacugcuaaauuuac

SEQ ID NO: 929512 - RNA, 19 nt, Homo sapiens
acaacugguccuauuauug

SEQ ID NO: 929513 - RNA, 19 nt, Homo sapiens
gcuggagaaauaauugaaa

SEQ ID NO: 929514 - RNA, 19 nt, Homo sapiens
ucaaaggcuggagaaauaa

SEQ ID NO: 929515 - RNA, 19 nt, Homo sapiens
augauaaccugcacuugga

SEQ ID NO: 929516 - RNA, 19 nt, Homo sapiens
uuaaagcggaccaaauaug

SEQ ID NO: 929517 - RNA, 19 nt, Homo sapiens
gauaagaccuccuuccaua

SEQ ID NO: 929518 - RNA, 19 nt, Homo sapiens
ggacggagguugcagugaa

SEQ ID NO: 929519 - RNA, 19 nt, Homo sapiens
gcucaugccuguaauccua

SEQ ID NO: 929520 - RNA, 19 nt, Homo sapiens
ggagaaggcagcucuguuu

SEQ ID NO: 929521 - RNA, 19 nt, Homo sapiens
ccauguggcuuaaaugauu

SEQ ID NO: 929522 - RNA, 19 nt, Homo sapiens
caagagcuccuccauguuu

SEQ ID NO: 929523 - RNA, 19 nt, Homo sapiens
cacaagagcuccuccaugu

SEQ ID NO: 929524 - RNA, 19 nt, Homo sapiens
ugaagaaccugucuaacug

SEQ ID NO: 929525 - RNA, 19 nt, Homo sapiens
gccaaagccugcucaaguu

SEQ ID NO: 929526 - RNA, 19 nt, Homo sapiens
gauagcaguugaagagguu

SEQ ID NO: 929527 - RNA, 19 nt, Homo sapiens
guugggagauggugauauu

SEQ ID NO: 929528 - RNA, 19 nt, Homo sapiens
gaacacugaccuagacaug

SEQ ID NO: 929529 - RNA, 19 nt, Homo sapiens
gaaggcagcucuguuucuc

SEQ ID NO: 929530 - RNA, 19 nt, Homo sapiens
ccaaagccugcucaaguua

SEQ ID NO: 929531 - RNA, 19 nt, Homo sapiens
uaaagucguuccuccaaca

SEQ ID NO: 929532 - RNA, 19 nt, Homo sapiens
ccagaagcaugugauaaga

SEQ ID NO: 929533 - RNA, 19 nt, Homo sapiens
guggauugcuuauggcuau

SEQ ID NO: 929534 - RNA, 19 nt, Homo sapiens
gagugaggauggaguguuc

SEQ ID NO: 929535 - RNA, 19 nt, Homo sapiens
gugaguggauugcuuaugg

SEQ ID NO: 929536 - RNA, 19 nt, Homo sapiens
gugcaagacuccaucucaa

SEQ ID NO: 929537 - RNA, 19 nt, Homo sapiens
gaccauccauccagaagca

SEQ ID NO: 929538 - RNA, 19 nt, Homo sapiens
ggugugaguggauugcuua

SEQ ID NO: 929539 - RNA, 19 nt, Homo sapiens
gaaaccccaucucuacuaa

SEQ ID NO: 929540 - RNA, 19 nt, Homo sapiens
caacauaguguguauuggu

SEQ ID NO: 929541 - RNA, 19 nt, Homo sapiens
caacccuacuuccuaaaca

SEQ ID NO: 929542 - RNA, 19 nt, Homo sapiens
uuucaacccuacuuccuaa

SEQ ID NO: 929543 - RNA, 19 nt, Homo sapiens
guauggcucugacaucucu

SEQ ID NO: 929544 - RNA, 19 nt, Homo sapiens
aaccagagaacuauuacua

SEQ ID NO: 929545 - RNA, 19 nt, Homo sapiens
guugaaccucuaccuguua

SEQ ID NO: 929546 - RNA, 19 nt, Homo sapiens
uguaaccagagaacuauua

SEQ ID NO: 929547 - RNA, 19 nt, Homo sapiens
acacugaccuagacauguc

SEQ ID NO: 929548 - RNA, 19 nt, Homo sapiens
guucagugcccauuucuca

SEQ ID NO: 929549 - RNA, 19 nt, Homo sapiens
guccagaggccuuucagaa

SEQ ID NO: 929550 - RNA, 19 nt, Homo sapiens
gcaccguuguaaccagaga

SEQ ID NO: 929551 - RNA, 19 nt, Homo sapiens
aagcugagcaccguuguaa

SEQ ID NO: 929552 - RNA, 19 nt, Homo sapiens
gaagccaacuagccaacac

SEQ ID NO: 929553 - RNA, 19 nt, Homo sapiens
caccauguggcuuaaauga

SEQ ID NO: 929554 - RNA, 19 nt, Homo sapiens
caaagccugcucaaguuau

SEQ ID NO: 929555 - RNA, 19 nt, Homo sapiens
ccuccaacauaguguguau

SEQ ID NO: 929556 - RNA, 19 nt, Homo sapiens
cagugcccauuucucauuu

SEQ ID NO: 929557 - RNA, 19 nt, Homo sapiens
ucuuagaugucccaacuuc

SEQ ID NO: 929558 - RNA, 19 nt, Homo sapiens
ucucuuagaugucccaacu

SEQ ID NO: 929559 - RNA, 19 nt, Homo sapiens
ccuguaauccuagcacuuu

SEQ ID NO: 929560 - RNA, 19 nt, Homo sapiens
aaagccugcucaaguuaug

SEQ ID NO: 929561 - RNA, 19 nt, Homo sapiens
ucagugcccauuucucauu

SEQ ID NO: 929562 - RNA, 19 nt, Homo sapiens
gcaagacuccaucucaaaa

SEQ ID NO: 929563 - RNA, 19 nt, Homo sapiens
gagaaggcagcucuguuuc

SEQ ID NO: 929564 - RNA, 19 nt, Homo sapiens
cuucugcgcuggugcuuag

SEQ ID NO: 929565 - RNA, 19 nt, Homo sapiens
gcaguauggcucugacauc

SEQ ID NO: 929566 - RNA, 19 nt, Homo sapiens
ggagucccuagaaggcuua

SEQ ID NO: 929567 - RNA, 19 nt, Homo sapiens
uguugaaccucuaccuguu

SEQ ID NO: 929568 - RNA, 19 nt, Homo sapiens
ggagugaggauggaguguu

SEQ ID NO: 929569 - RNA, 19 nt, Homo sapiens
ggugggcuguugggaguga

SEQ ID NO: 929570 - RNA, 19 nt, Homo sapiens
caguauggcucugacaucu

SEQ ID NO: 929571 - RNA, 19 nt, Homo sapiens
gugcuuaguaaccgacuuu

SEQ ID NO: 929572 - RNA, 19 nt, Homo sapiens
cauccagaagcaugugaua

SEQ ID NO: 929573 - RNA, 19 nt, Homo sapiens
gugauggagucccuagaag

SEQ ID NO: 929574 - RNA, 19 nt, Homo sapiens
ccuugaagaaccugucuaa

SEQ ID NO: 929575 - RNA, 19 nt, Homo sapiens
ugccaaagccugcucaagu

SEQ ID NO: 929576 - RNA, 19 nt, Homo sapiens
agaccagccucgccaacau

SEQ ID NO: 929577 - RNA, 19 nt, Homo sapiens
cuaacuggaugcucauugc

SEQ ID NO: 929578 - RNA, 19 nt, Homo sapiens
cuacucuccaucuucguua

SEQ ID NO: 929579 - RNA, 19 nt, Homo sapiens
ugaagcauguguugaaccu

SEQ ID NO: 929580 - RNA, 19 nt, Homo sapiens
ccuguuaggugugguacug

SEQ ID NO: 929581 - RNA, 19 nt, Homo sapiens
ccuuuagucuugaaugucu

SEQ ID NO: 929582 - RNA, 19 nt, Homo sapiens
ugucccaacuucagcuguu

SEQ ID NO: 929583 - RNA, 19 nt, Homo sapiens
cugcgcuggugcuuaguaa

SEQ ID NO: 929584 - RNA, 19 nt, Homo sapiens
gcgggagaauugcuugaac

SEQ ID NO: 929585 - RNA, 19 nt, Homo sapiens
cguuguaaccagagaacua

SEQ ID NO: 929586 - RNA, 19 nt, Homo sapiens
caagcugagcaccguugua

SEQ ID NO: 929587 - RNA, 19 nt, Homo sapiens
gaccuagacauguccagau

SEQ ID NO: 929588 - RNA, 19 nt, Homo sapiens
cuuccauacuggccauauu

SEQ ID NO: 929589 - RNA, 19 nt, Homo sapiens
uugaagaaccugucuaacu

SEQ ID NO: 929590 - RNA, 19 nt, Homo sapiens
gucccuagaaggcuuacua

SEQ ID NO: 929591 - RNA, 19 nt, Homo sapiens
gugcccauuucucauuuua

SEQ ID NO: 929592 - RNA, 19 nt, Homo sapiens
aagagcuccuccauguuug

SEQ ID NO: 929593 - RNA, 19 nt, Homo sapiens
gggagauggugauauuuuc

SEQ ID NO: 929594 - RNA, 19 nt, Homo sapiens
ggcugaggcgggagaauug

SEQ ID NO: 929595 - RNA, 19 nt, Homo sapiens
gaccagccucgccaacaug

SEQ ID NO: 929596 - RNA, 19 nt, Homo sapiens
guuguaaccagagaacuau

SEQ ID NO: 929597 - RNA, 19 nt, Homo sapiens
uaagaccuccuuccauacu

SEQ ID NO: 929598 - RNA, 19 nt, Homo sapiens
uccaacauaguguguauug

SEQ ID NO: 929599 - RNA, 19 nt, Homo sapiens
agucguuccuccaacauag

SEQ ID NO: 929600 - RNA, 19 nt, Homo sapiens
ugcaagacuccaucucaaa

SEQ ID NO: 929601 - RNA, 19 nt, Homo sapiens
gagaccagccucgccaaca

SEQ ID NO: 929602 - RNA, 19 nt, Homo sapiens
gcucaaguuauggacauug

SEQ ID NO: 929603 - RNA, 19 nt, Homo sapiens
ugacccuacucuccaucuu

SEQ ID NO: 929604 - RNA, 19 nt, Homo sapiens
gauccacucccggcuguuc

SEQ ID NO: 929605 - RNA, 19 nt, Homo sapiens
gacggagguugcagugaac

SEQ ID NO: 929606 - RNA, 19 nt, Homo sapiens
gacccuacucuccaucuuc

SEQ ID NO: 929607 - RNA, 19 nt, Homo sapiens
gugauaagaccuccuucca

SEQ ID NO: 929608 - RNA, 19 nt, Homo sapiens
caucaucucuucaucuuaa

SEQ ID NO: 929609 - RNA, 19 nt, Homo sapiens
ggaagacgccggagucauu

SEQ ID NO: 929610 - RNA, 19 nt, Homo sapiens
gaacuggcgucacguuuac

SEQ ID NO: 929611 - RNA, 19 nt, Homo sapiens
ggaccuugcugacgucuuc

SEQ ID NO: 929612 - RNA, 19 nt, Homo sapiens
ggagaucaguguugugagu

SEQ ID NO: 929613 - RNA, 19 nt, Homo sapiens
gcuguuagguuccuuaucu

SEQ ID NO: 929614 - RNA, 19 nt, Homo sapiens
gaacugucuucuauuucuu

SEQ ID NO: 929615 - RNA, 19 nt, Homo sapiens
gaacaucguccacaacuac

SEQ ID NO: 929616 - RNA, 19 nt, Homo sapiens
ugaagaacaucguccacaa

SEQ ID NO: 929617 - RNA, 19 nt, Homo sapiens
guaaggagcccagucuuug

SEQ ID NO: 929618 - RNA, 19 nt, Homo sapiens
gaacccacauuuuauauuc

SEQ ID NO: 929619 - RNA, 19 nt, Homo sapiens
ccgcauagaugggugauca

SEQ ID NO: 929620 - RNA, 19 nt, Homo sapiens
gauuugaacccacauuuua

SEQ ID NO: 929621 - RNA, 19 nt, Homo sapiens
acacggagcccgacgaguu

SEQ ID NO: 929622 - RNA, 19 nt, Homo sapiens
acuaaucccuuccuccuau

SEQ ID NO: 929623 - RNA, 19 nt, Homo sapiens
ccagcucccucaugucaga

SEQ ID NO: 929624 - RNA, 19 nt, Homo sapiens
gaacgugcgugagaaagcu

SEQ ID NO: 929625 - RNA, 19 nt, Homo sapiens
agaacuggcgucacguuua

SEQ ID NO: 929626 - RNA, 19 nt, Homo sapiens
cgacgaguucucugacuuu

SEQ ID NO: 929627 - RNA, 19 nt, Homo sapiens
uacaucaucucuucaucuu

SEQ ID NO: 929628 - RNA, 19 nt, Homo sapiens
cuaaucccuuccuccuaua

SEQ ID NO: 929629 - RNA, 19 nt, Homo sapiens
ccauccagcucccucaugu

SEQ ID NO: 929630 - RNA, 19 nt, Homo sapiens
ugucuucuauuucuucuca

SEQ ID NO: 929631 - RNA, 19 nt, Homo sapiens
ucaaugaccauggcaagaa

SEQ ID NO: 929632 - RNA, 19 nt, Homo sapiens
ucuggaagcggcucaauga

SEQ ID NO: 929633 - RNA, 19 nt, Homo sapiens
uagcugauguggccaggau

SEQ ID NO: 929634 - RNA, 19 nt, Homo sapiens
gacgaguucucugacuuug

SEQ ID NO: 929635 - RNA, 19 nt, Homo sapiens
gcugauguggccaggauuu

SEQ ID NO: 929636 - RNA, 19 nt, Homo sapiens
gagaggccacgagcaauga

SEQ ID NO: 929637 - RNA, 19 nt, Homo sapiens
ggaguaaggagcccagucu

SEQ ID NO: 929638 - RNA, 19 nt, Homo sapiens
gauguggccaggauuugaa

SEQ ID NO: 929639 - RNA, 19 nt, Homo sapiens
cgaguucucugacuuugac

SEQ ID NO: 929640 - RNA, 19 nt, Homo sapiens
gcaaggaccagggcgugaa

SEQ ID NO: 929641 - RNA, 19 nt, Homo sapiens
uggaguaccucaucaagac

SEQ ID NO: 929642 - RNA, 19 nt, Homo sapiens
cgaccucaccuacaacguu

SEQ ID NO: 929643 - RNA, 19 nt, Homo sapiens
caagaacuggcgucacguu

SEQ ID NO: 929644 - RNA, 19 nt, Homo sapiens
agaacaucguccacaacua

SEQ ID NO: 929645 - RNA, 19 nt, Homo sapiens
gaagaacaucguccacaac

SEQ ID NO: 929646 - RNA, 19 nt, Homo sapiens
gaagacgccggagucauuc

SEQ ID NO: 929647 - RNA, 19 nt, Homo sapiens
cagcaccaauggcacaaca

SEQ ID NO: 929648 - RNA, 19 nt, Homo sapiens
gagcaaacugugucucaag

SEQ ID NO: 929649 - RNA, 19 nt, Homo sapiens
ugcagacgcugaaggacuu

SEQ ID NO: 929650 - RNA, 19 nt, Homo sapiens
gcaaacugugucucaagga

SEQ ID NO: 929651 - RNA, 19 nt, Homo sapiens
gcauagaugggugaucaga

SEQ ID NO: 929652 - RNA, 19 nt, Homo sapiens
uuuguuacaucaucucuuc

SEQ ID NO: 929653 - RNA, 19 nt, Homo sapiens
cgagaggccacgagcaaug

SEQ ID NO: 929654 - RNA, 19 nt, Homo sapiens
caaugaccauggcaagaac

SEQ ID NO: 929655 - RNA, 19 nt, Homo sapiens
ccgacgaguucucugacuu

SEQ ID NO: 929656 - RNA, 19 nt, Homo sapiens
uugccgaccucaccuacaa

SEQ ID NO: 929657 - RNA, 19 nt, Homo sapiens
aagguaaugucccucuugu

SEQ ID NO: 929658 - RNA, 19 nt, Homo sapiens
guugugagugcaugugaaa

SEQ ID NO: 929659 - RNA, 19 nt, Homo sapiens
aaagguaaugucccucuug

SEQ ID NO: 929660 - RNA, 19 nt, Homo sapiens
aguaaggagcccagucuuu

SEQ ID NO: 929661 - RNA, 19 nt, Homo sapiens
gcgugaacgugcgugagaa

SEQ ID NO: 929662 - RNA, 19 nt, Homo sapiens
gugagugcaugugaaaugg

SEQ ID NO: 929663 - RNA, 19 nt, Homo sapiens
gaaccagcuccgucucagu

SEQ ID NO: 929664 - RNA, 19 nt, Homo sapiens
gccaagcccagcaccaaug

SEQ ID NO: 929665 - RNA, 19 nt, Homo sapiens
gagcgccacccacguacau

SEQ ID NO: 929666 - RNA, 19 nt, Homo sapiens
gcgcucaagaccaaggaaa

SEQ ID NO: 929667 - RNA, 19 nt, Homo sapiens
cgcacgcgcucaagaccaa

SEQ ID NO: 929668 - RNA, 19 nt, Homo sapiens
acaaggccaugacgcugau

SEQ ID NO: 929669 - RNA, 19 nt, Homo sapiens
acucagaggcggagaucaa

SEQ ID NO: 929670 - RNA, 19 nt, Homo sapiens
guuucuaugugucucuuuc

SEQ ID NO: 929671 - RNA, 19 nt, Homo sapiens
ccugggagaucaguguugu

SEQ ID NO: 929672 - RNA, 19 nt, Homo sapiens
cugcaggacccucaguuga

SEQ ID NO: 929673 - RNA, 19 nt, Homo sapiens
gcaaucgaggagagcaaga

SEQ ID NO: 929674 - RNA, 19 nt, Homo sapiens
ggauuugaacccacauuuu

SEQ ID NO: 929675 - RNA, 19 nt, Homo sapiens
gaggugugcgcugcaggua

SEQ ID NO: 929676 - RNA, 19 nt, Homo sapiens
gccuugggcuuccgcuauc

SEQ ID NO: 929677 - RNA, 19 nt, Homo sapiens
cugcauuuguuacaucauc

SEQ ID NO: 929678 - RNA, 19 nt, Homo sapiens
ggcgugaacgugcgugaga

SEQ ID NO: 929679 - RNA, 19 nt, Homo sapiens
ccucugcccagguuucuau

SEQ ID NO: 929680 - RNA, 19 nt, Homo sapiens
gucuuugcaugcaguguug

SEQ ID NO: 929681 - RNA, 19 nt, Homo sapiens
uuucugggccucuuucuuc

SEQ ID NO: 929682 - RNA, 19 nt, Homo sapiens
ucuuggagccgcauagaug

SEQ ID NO: 929683 - RNA, 19 nt, Homo sapiens
ucucugcauuuguuacauc

SEQ ID NO: 929684 - RNA, 19 nt, Homo sapiens
ugugagugcaugugaaaug

SEQ ID NO: 929685 - RNA, 19 nt, Homo sapiens
ggcgccagaugaagaacau

SEQ ID NO: 929686 - RNA, 19 nt, Homo sapiens
ggccagaacugcagcauug

SEQ ID NO: 929687 - RNA, 19 nt, Homo sapiens
ggucgaagauggugugugu

SEQ ID NO: 929688 - RNA, 19 nt, Homo sapiens
gaugaaggcacugaucuua

SEQ ID NO: 929689 - RNA, 19 nt, Homo sapiens
gugaggacgucauaguuaa

SEQ ID NO: 929690 - RNA, 19 nt, Homo sapiens
ggugaggacgucauaguua

SEQ ID NO: 929691 - RNA, 19 nt, Homo sapiens
ggccagggcuguauggaau

SEQ ID NO: 929692 - RNA, 19 nt, Homo sapiens
ugaaggcacugaucuuagu

SEQ ID NO: 929693 - RNA, 19 nt, Homo sapiens
ggagaagccacagguguuu

SEQ ID NO: 929694 - RNA, 19 nt, Homo sapiens
gaucaacgcaggcauguac

SEQ ID NO: 929695 - RNA, 19 nt, Homo sapiens
cugguggacuucugcaaua

SEQ ID NO: 929696 - RNA, 19 nt, Homo sapiens
ggacuugucauuauuuguc

SEQ ID NO: 929697 - RNA, 19 nt, Homo sapiens
gugcuggccugacacauca

SEQ ID NO: 929698 - RNA, 19 nt, Homo sapiens
cuacguccauugagaagga

SEQ ID NO: 929699 - RNA, 19 nt, Homo sapiens
gcuauaugccauggaguua

SEQ ID NO: 929700 - RNA, 19 nt, Homo sapiens
ccagggcuguauggaauaa

SEQ ID NO: 929701 - RNA, 19 nt, Homo sapiens
cagccuacguccauugaga

SEQ ID NO: 929702 - RNA, 19 nt, Homo sapiens
gacccuggacuugucauua

SEQ ID NO: 929703 - RNA, 19 nt, Homo sapiens
gccagagccucguaucauc

SEQ ID NO: 929704 - RNA, 19 nt, Homo sapiens
ggaauccgaaucuccaugu

SEQ ID NO: 929705 - RNA, 19 nt, Homo sapiens
aaggaggucuuccccauua

SEQ ID NO: 929706 - RNA, 19 nt, Homo sapiens
agaagacccuggacuuguc

SEQ ID NO: 929707 - RNA, 19 nt, Homo sapiens
guguuuguguccaauaaga

SEQ ID NO: 929708 - RNA, 19 nt, Homo sapiens
agggcuguauggaauaaua

SEQ ID NO: 929709 - RNA, 19 nt, Homo sapiens
ggugucgcguucuguguug

SEQ ID NO: 929710 - RNA, 19 nt, Homo sapiens
gcccggauccguucccauu

SEQ ID NO: 929711 - RNA, 19 nt, Homo sapiens
uauaugccauggaguuaca

SEQ ID NO: 929712 - RNA, 19 nt, Homo sapiens
ccucaacagugacgugauc

SEQ ID NO: 929713 - RNA, 19 nt, Homo sapiens
uggcuugaguccugcauug

SEQ ID NO: 929714 - RNA, 19 nt, Homo sapiens
ugucgcaggugcuggagaa

SEQ ID NO: 929715 - RNA, 19 nt, Homo sapiens
gaagaugguguguguaucc

SEQ ID NO: 929716 - RNA, 19 nt, Homo sapiens
cccgugaccuacucucuga

SEQ ID NO: 929717 - RNA, 19 nt, Homo sapiens
gggcuguauggaauaauaa

SEQ ID NO: 929718 - RNA, 19 nt, Homo sapiens
acccuggacuugucauuau

SEQ ID NO: 929719 - RNA, 19 nt, Homo sapiens
ucagaagacccuggacuug

SEQ ID NO: 929720 - RNA, 19 nt, Homo sapiens
gcauggagaacgugacagu

SEQ ID NO: 929721 - RNA, 19 nt, Homo sapiens
ggcacugggugaagcugaa

SEQ ID NO: 929722 - RNA, 19 nt, Homo sapiens
gaagacccuggacuuguca

SEQ ID NO: 929723 - RNA, 19 nt, Homo sapiens
cagaagacccuggacuugu

SEQ ID NO: 929724 - RNA, 19 nt, Homo sapiens
gaggacgucauaguuaaug

SEQ ID NO: 929725 - RNA, 19 nt, Homo sapiens
gggugaggacgucauaguu

SEQ ID NO: 929726 - RNA, 19 nt, Homo sapiens
cgcaggugcuggagaagga

SEQ ID NO: 929727 - RNA, 19 nt, Homo sapiens
gugccugccucccugacaa

SEQ ID NO: 929728 - RNA, 19 nt, Homo sapiens
ucgaagaugguguguguau

SEQ ID NO: 929729 - RNA, 19 nt, Homo sapiens
gugacgugaucugcgauuu

SEQ ID NO: 929730 - RNA, 19 nt, Homo sapiens
gaauccgaaucuccauguc

SEQ ID NO: 929731 - RNA, 19 nt, Homo sapiens
gagcagaggcugggaaucc

SEQ ID NO: 929732 - RNA, 19 nt, Homo sapiens
gcugggugaggacgucaua

SEQ ID NO: 929733 - RNA, 19 nt, Homo sapiens
uccaagccauggugcaguu

SEQ ID NO: 929734 - RNA, 19 nt, Homo sapiens
gggccagggcuguauggaa

SEQ ID NO: 929735 - RNA, 19 nt, Homo sapiens
cgaagaugguguguguauc

SEQ ID NO: 929736 - RNA, 19 nt, Homo sapiens
ggacaucaucuggcaggau

SEQ ID NO: 929737 - RNA, 19 nt, Homo sapiens
ccagagccucguaucauca

SEQ ID NO: 929738 - RNA, 19 nt, Homo sapiens
caagucuauuggcgaguca

SEQ ID NO: 929739 - RNA, 19 nt, Homo sapiens
ugguggacuucugcaauaa

SEQ ID NO: 929740 - RNA, 19 nt, Homo sapiens
gagaagccacagguguuug

SEQ ID NO: 929741 - RNA, 19 nt, Homo sapiens
ccaaggaggggcagcuaua

SEQ ID NO: 929742 - RNA, 19 nt, Homo sapiens
uggagaagccacagguguu

SEQ ID NO: 929743 - RNA, 19 nt, Homo sapiens
gccagggcuguauggaaua

SEQ ID NO: 929744 - RNA, 19 nt, Homo sapiens
gcgaugaaggcacugaucu

SEQ ID NO: 929745 - RNA, 19 nt, Homo sapiens
gcuucuggauggacauugg

SEQ ID NO: 929746 - RNA, 19 nt, Homo sapiens
agguguuuguguccaauaa

SEQ ID NO: 929747 - RNA, 19 nt, Homo sapiens
gacgugaucugcgauuucc

SEQ ID NO: 929748 - RNA, 19 nt, Homo sapiens
gagccucguaucaucaugu

SEQ ID NO: 929749 - RNA, 19 nt, Homo sapiens
cgaugaaggcacugaucuu

SEQ ID NO: 929750 - RNA, 19 nt, Homo sapiens
caacgcaggcauguacauc

SEQ ID NO: 929751 - RNA, 19 nt, Homo sapiens
ugacgugaucugcgauuuc

SEQ ID NO: 929752 - RNA, 19 nt, Homo sapiens
gacugcagacccuuucuuc

SEQ ID NO: 929753 - RNA, 19 nt, Homo sapiens
ggccagaacugcagcauug

SEQ ID NO: 929754 - RNA, 19 nt, Homo sapiens
ggucgaagauggugugugu

SEQ ID NO: 929755 - RNA, 19 nt, Homo sapiens
gaugaaggcacugaucuua

SEQ ID NO: 929756 - RNA, 19 nt, Homo sapiens
gugaggacgucauaguuaa

SEQ ID NO: 929757 - RNA, 19 nt, Homo sapiens
ggugaggacgucauaguua

SEQ ID NO: 929758 - RNA, 19 nt, Homo sapiens
ggccagggcuguauggaau

SEQ ID NO: 929759 - RNA, 19 nt, Homo sapiens
ugaaggcacugaucuuagu

SEQ ID NO: 929760 - RNA, 19 nt, Homo sapiens
ggagaagccacagguguuu

SEQ ID NO: 929761 - RNA, 19 nt, Homo sapiens
gaucaacgcaggcauguac

SEQ ID NO: 929762 - RNA, 19 nt, Homo sapiens
cugguggacuucugcaaua

SEQ ID NO: 929763 - RNA, 19 nt, Homo sapiens
ggacuugucauuauuuguc

SEQ ID NO: 929764 - RNA, 19 nt, Homo sapiens
gugcuggccugacacauca

SEQ ID NO: 929765 - RNA, 19 nt, Homo sapiens
cuacguccauugagaagga

SEQ ID NO: 929766 - RNA, 19 nt, Homo sapiens
gcuauaugccauggaguua

SEQ ID NO: 929767 - RNA, 19 nt, Homo sapiens
ccagggcuguauggaauaa

SEQ ID NO: 929768 - RNA, 19 nt, Homo sapiens
cagccuacguccauugaga

SEQ ID NO: 929769 - RNA, 19 nt, Homo sapiens
gacccuggacuugucauua

SEQ ID NO: 929770 - RNA, 19 nt, Homo sapiens
gccagagccucguaucauc

SEQ ID NO: 929771 - RNA, 19 nt, Homo sapiens
ggaauccgaaucuccaugu

SEQ ID NO: 929772 - RNA, 19 nt, Homo sapiens
aaggaggucuuccccauua

SEQ ID NO: 929773 - RNA, 19 nt, Homo sapiens
agaagacccuggacuuguc

SEQ ID NO: 929774 - RNA, 19 nt, Homo sapiens
guguuuguguccaauaaga

SEQ ID NO: 929775 - RNA, 19 nt, Homo sapiens
agggcuguauggaauaaua

SEQ ID NO: 929776 - RNA, 19 nt, Homo sapiens
ggugucgcguucuguguug

SEQ ID NO: 929777 - RNA, 19 nt, Homo sapiens
gcccggauccguucccauu

SEQ ID NO: 929778 - RNA, 19 nt, Homo sapiens
uauaugccauggaguuaca

SEQ ID NO: 929779 - RNA, 19 nt, Homo sapiens
ccucaacagugacgugauc

SEQ ID NO: 929780 - RNA, 19 nt, Homo sapiens
uggcuugaguccugcauug

SEQ ID NO: 929781 - RNA, 19 nt, Homo sapiens
ugucgcaggugcuggagaa

SEQ ID NO: 929782 - RNA, 19 nt, Homo sapiens
gaagaugguguguguaucc

SEQ ID NO: 929783 - RNA, 19 nt, Homo sapiens
cccgugaccuacucucuga

SEQ ID NO: 929784 - RNA, 19 nt, Homo sapiens
gggcuguauggaauaauaa

SEQ ID NO: 929785 - RNA, 19 nt, Homo sapiens
acccuggacuugucauuau

SEQ ID NO: 929786 - RNA, 19 nt, Homo sapiens
ucagaagacccuggacuug

SEQ ID NO: 929787 - RNA, 19 nt, Homo sapiens
gcauggagaacgugacagu

SEQ ID NO: 929788 - RNA, 19 nt, Homo sapiens
ggcacugggugaagcugaa

SEQ ID NO: 929789 - RNA, 19 nt, Homo sapiens
gaagacccuggacuuguca

SEQ ID NO: 929790 - RNA, 19 nt, Homo sapiens
cagaagacccuggacuugu

SEQ ID NO: 929791 - RNA, 19 nt, Homo sapiens
gaggacgucauaguuaaug

SEQ ID NO: 929792 - RNA, 19 nt, Homo sapiens
gggugaggacgucauaguu

SEQ ID NO: 929793 - RNA, 19 nt, Homo sapiens
cgcaggugcuggagaagga

SEQ ID NO: 929794 - RNA, 19 nt, Homo sapiens
ucgaagaugguguguguau

SEQ ID NO: 929795 - RNA, 19 nt, Homo sapiens
gugacgugaucugcgauuu

SEQ ID NO: 929796 - RNA, 19 nt, Homo sapiens
gaauccgaaucuccauguc

SEQ ID NO: 929797 - RNA, 19 nt, Homo sapiens
gagcagaggcugggaaucc

SEQ ID NO: 929798 - RNA, 19 nt, Homo sapiens
gcugggugaggacgucaua

SEQ ID NO: 929799 - RNA, 19 nt, Homo sapiens
uccaagccauggugcaguu

SEQ ID NO: 929800 - RNA, 19 nt, Homo sapiens
gggccagggcuguauggaa

SEQ ID NO: 929801 - RNA, 19 nt, Homo sapiens
cgaagaugguguguguauc

SEQ ID NO: 929802 - RNA, 19 nt, Homo sapiens
ggacaucaucuggcaggau

SEQ ID NO: 929803 - RNA, 19 nt, Homo sapiens
ccagagccucguaucauca

SEQ ID NO: 929804 - RNA, 19 nt, Homo sapiens
caagucuauuggcgaguca

SEQ ID NO: 929805 - RNA, 19 nt, Homo sapiens
ugguggacuucugcaauaa

SEQ ID NO: 929806 - RNA, 19 nt, Homo sapiens
gagaagccacagguguuug

SEQ ID NO: 929807 - RNA, 19 nt, Homo sapiens
ccaaggaggggcagcuaua

SEQ ID NO: 929808 - RNA, 19 nt, Homo sapiens
uggagaagccacagguguu

SEQ ID NO: 929809 - RNA, 19 nt, Homo sapiens
gccagggcuguauggaaua

SEQ ID NO: 929810 - RNA, 19 nt, Homo sapiens
gcgaugaaggcacugaucu

SEQ ID NO: 929811 - RNA, 19 nt, Homo sapiens
gcuucuggauggacauugg

SEQ ID NO: 929812 - RNA, 19 nt, Homo sapiens
agguguuuguguccaauaa

SEQ ID NO: 929813 - RNA, 19 nt, Homo sapiens
gacgugaucugcgauuucc

SEQ ID NO: 929814 - RNA, 19 nt, Homo sapiens
gagccucguaucaucaugu

SEQ ID NO: 929815 - RNA, 19 nt, Homo sapiens
cgaugaaggcacugaucuu

SEQ ID NO: 929816 - RNA, 19 nt, Homo sapiens
caacgcaggcauguacauc

SEQ ID NO: 929817 - RNA, 19 nt, Homo sapiens
ugacgugaucugcgauuuc

SEQ ID NO: 929818 - RNA, 19 nt, Homo sapiens
gacugcagacccuuucuuc

SEQ ID NO: 929819 - RNA, 19 nt, Homo sapiens
gagaaacccagcacauuua

SEQ ID NO: 929820 - RNA, 19 nt, Homo sapiens
ggagaaacccagcacauuu

SEQ ID NO: 929821 - RNA, 19 nt, Homo sapiens
ggaacucgcuucagaccuu

SEQ ID NO: 929822 - RNA, 19 nt, Homo sapiens
aaagggaacucgcuucaga

SEQ ID NO: 929823 - RNA, 19 nt, Homo sapiens
ggaagcugcugccugcuau

SEQ ID NO: 929824 - RNA, 19 nt, Homo sapiens
gacgggagcuaguguuuag

SEQ ID NO: 929825 - RNA, 19 nt, Homo sapiens
ccagaaaggaccagagaaa

SEQ ID NO: 929826 - RNA, 19 nt, Homo sapiens
ccaggacacucacccagaa

SEQ ID NO: 929827 - RNA, 19 nt, Homo sapiens
gaacucgcuucagaccuuu

SEQ ID NO: 929828 - RNA, 19 nt, Homo sapiens
caacuacggcugcaucguu

SEQ ID NO: 929829 - RNA, 19 nt, Homo sapiens
gaucaaguccgcagguuca

SEQ ID NO: 929830 - RNA, 19 nt, Homo sapiens
ggacgcaaucccucaacua

SEQ ID NO: 929831 - RNA, 19 nt, Homo sapiens
ucaaagcggugauccugau

SEQ ID NO: 929832 - RNA, 19 nt, Homo sapiens
gauccaacaccauauugaa

SEQ ID NO: 929833 - RNA, 19 nt, Homo sapiens
cagaacggcuggccaagca

SEQ ID NO: 929834 - RNA, 19 nt, Homo sapiens
gaguuuaaccuuccaguca

SEQ ID NO: 929835 - RNA, 19 nt, Homo sapiens
ccucccgacucccuaauaa

SEQ ID NO: 929836 - RNA, 19 nt, Homo sapiens
aaacccagcacauuuauca

SEQ ID NO: 929837 - RNA, 19 nt, Homo sapiens
gggagcuaguguuuaggua

SEQ ID NO: 929838 - RNA, 19 nt, Homo sapiens
gcacauuuaucagugacau

SEQ ID NO: 929839 - RNA, 19 nt, Homo sapiens
gagcccgcauggacaguga

SEQ ID NO: 929840 - RNA, 19 nt, Homo sapiens
ccagcacauuuaucaguga

SEQ ID NO: 929841 - RNA, 19 nt, Homo sapiens
cacacgagguauugcacua

SEQ ID NO: 929842 - RNA, 19 nt, Homo sapiens
gagcaucguccuccaugga

SEQ ID NO: 929843 - RNA, 19 nt, Homo sapiens
gggaagcugcugccugcua

SEQ ID NO: 929844 - RNA, 19 nt, Homo sapiens
gggaugucuuccagcguaa

SEQ ID NO: 929845 - RNA, 19 nt, Homo sapiens
ucagcaggaugggcaauug

SEQ ID NO: 929846 - RNA, 19 nt, Homo sapiens
caggagauucugcucauug

SEQ ID NO: 929847 - RNA, 19 nt, Homo sapiens
uuagguagcagucaccauu

SEQ ID NO: 929848 - RNA, 19 nt, Homo sapiens
ccgaggugcucauccugaa

SEQ ID NO: 929849 - RNA, 19 nt, Homo sapiens
ugacgggagcuaguguuua

SEQ ID NO: 929850 - RNA, 19 nt, Homo sapiens
caggcuggaucgucacaug

SEQ ID NO: 929851 - RNA, 19 nt, Homo sapiens
uagguagcagucaccauua

SEQ ID NO: 929852 - RNA, 19 nt, Homo sapiens
cagggcagggccagauaua

SEQ ID NO: 929853 - RNA, 19 nt, Homo sapiens
gcagggcagggccagauau

SEQ ID NO: 929854 - RNA, 19 nt, Homo sapiens
gccgauaccaggacacuca

SEQ ID NO: 929855 - RNA, 19 nt, Homo sapiens
cagaucaaguccgcagguu

SEQ ID NO: 929856 - RNA, 19 nt, Homo sapiens
cacgagguauugcacuaug

SEQ ID NO: 929857 - RNA, 19 nt, Homo sapiens
ccagcgucacccuuucuua

SEQ ID NO: 929858 - RNA, 19 nt, Homo sapiens
gccucuaccugagccgaua

SEQ ID NO: 929859 - RNA, 19 nt, Homo sapiens
ugaggugcccaaaccauug

SEQ ID NO: 929860 - RNA, 19 nt, Homo sapiens
ccgcccagcaggaguuuaa

SEQ ID NO: 929861 - RNA, 19 nt, Homo sapiens
gccuagagcaggauguguu

SEQ ID NO: 929862 - RNA, 19 nt, Homo sapiens
gaaacccagcacauuuauc

SEQ ID NO: 929863 - RNA, 19 nt, Homo sapiens
uggagaaacccagcacauu

SEQ ID NO: 929864 - RNA, 19 nt, Homo sapiens
ccacagacacacgagguau

SEQ ID NO: 929865 - RNA, 19 nt, Homo sapiens
gugacgggagcuaguguuu

SEQ ID NO: 929866 - RNA, 19 nt, Homo sapiens
ccuagagcaggauguguuu

SEQ ID NO: 929867 - RNA, 19 nt, Homo sapiens
gguagcagucaccauuaug

SEQ ID NO: 929868 - RNA, 19 nt, Homo sapiens
ggagugacgggagcuagug

SEQ ID NO: 929869 - RNA, 19 nt, Homo sapiens
caaagcggugauccugauu

SEQ ID NO: 929870 - RNA, 19 nt, Homo sapiens
acagacacacgagguauug

SEQ ID NO: 929871 - RNA, 19 nt, Homo sapiens
caucaacugcggcaucuac

SEQ ID NO: 929872 - RNA, 19 nt, Homo sapiens
agaaacccagcacauuuau

SEQ ID NO: 929873 - RNA, 19 nt, Homo sapiens
gacgcaaucccucaacuac

SEQ ID NO: 929874 - RNA, 19 nt, Homo sapiens
gcaggaguuuaaccuucca

SEQ ID NO: 929875 - RNA, 19 nt, Homo sapiens
cagaaaggaccagagaaag

SEQ ID NO: 929876 - RNA, 19 nt, Homo sapiens
gaagcuucaccaaccagau

SEQ ID NO: 929877 - RNA, 19 nt, Homo sapiens
gauccgagggaauguguac

SEQ ID NO: 929878 - RNA, 19 nt, Homo sapiens
ccauggauccgagggaaug

SEQ ID NO: 929879 - RNA, 19 nt, Homo sapiens
uauacgugcaucucacuga

SEQ ID NO: 929880 - RNA, 19 nt, Homo sapiens
agguagcagucaccauuau

SEQ ID NO: 929881 - RNA, 19 nt, Homo sapiens
gagauaaggugaauaagug

SEQ ID NO: 929882 - RNA, 19 nt, Homo sapiens
gggagcagaucauguauuu

SEQ ID NO: 929883 - RNA, 19 nt, Homo sapiens
gaucaugucuucagauuca

SEQ ID NO: 929884 - RNA, 19 nt, Homo sapiens
gggaauaucuggcuuagga

SEQ ID NO: 929885 - RNA, 19 nt, Homo sapiens
gaaauaagaagacucaugu

SEQ ID NO: 929886 - RNA, 19 nt, Homo sapiens
agaggaagauucaguuuaa

SEQ ID NO: 929887 - RNA, 19 nt, Homo sapiens
gacagaaacugacuuagug

SEQ ID NO: 929888 - RNA, 19 nt, Homo sapiens
ugaaaugggugcuggaauu

SEQ ID NO: 929889 - RNA, 19 nt, Homo sapiens
uaucagacauggacagaaa

SEQ ID NO: 929890 - RNA, 19 nt, Homo sapiens
ggacagacccuugcaguga

SEQ ID NO: 929891 - RNA, 19 nt, Homo sapiens
ugaggaagcugcuccagaa

SEQ ID NO: 929892 - RNA, 19 nt, Homo sapiens
ccaaagauguugcaaagca

SEQ ID NO: 929893 - RNA, 19 nt, Homo sapiens
caacggagcccaaaaguua

SEQ ID NO: 929894 - RNA, 19 nt, Homo sapiens
ggaauuugccugcuaauca

SEQ ID NO: 929895 - RNA, 19 nt, Homo sapiens
gcaacuaacaucugugaaa

SEQ ID NO: 929896 - RNA, 19 nt, Homo sapiens
ggaauaaguucuguuugug

SEQ ID NO: 929897 - RNA, 19 nt, Homo sapiens
gagaggaagauucaguuua

SEQ ID NO: 929898 - RNA, 19 nt, Homo sapiens
ggccuuggcucugguauuu

SEQ ID NO: 929899 - RNA, 19 nt, Homo sapiens
cgagcuggcuuuagacauu

SEQ ID NO: 929900 - RNA, 19 nt, Homo sapiens
ggacagaaacugacuuagu

SEQ ID NO: 929901 - RNA, 19 nt, Homo sapiens
ucacaaucaucuaccagua

SEQ ID NO: 929902 - RNA, 19 nt, Homo sapiens
gggaucaugucuucagauu

SEQ ID NO: 929903 - RNA, 19 nt, Homo sapiens
gcagccgucucaccuguuu

SEQ ID NO: 929904 - RNA, 19 nt, Homo sapiens
gguccuggcugacuuccua

SEQ ID NO: 929905 - RNA, 19 nt, Homo sapiens
ccaugcaguuguauacaua

SEQ ID NO: 929906 - RNA, 19 nt, Homo sapiens
cagcugacccuuucuauug

SEQ ID NO: 929907 - RNA, 19 nt, Homo sapiens
ccagcuguguucagaauuu

SEQ ID NO: 929908 - RNA, 19 nt, Homo sapiens
acacugaaaugucuacguu

SEQ ID NO: 929909 - RNA, 19 nt, Homo sapiens
gcacaaacacugaaauguc

SEQ ID NO: 929910 - RNA, 19 nt, Homo sapiens
gcucuuuguugcuggcuua

SEQ ID NO: 929911 - RNA, 19 nt, Homo sapiens
uaacagaggcacauugaug

SEQ ID NO: 929912 - RNA, 19 nt, Homo sapiens
uaacugagauaaggugaau

SEQ ID NO: 929913 - RNA, 19 nt, Homo sapiens
guaaagugcuagacauuuu

SEQ ID NO: 929914 - RNA, 19 nt, Homo sapiens
gcucucagcucgcuucagu

SEQ ID NO: 929915 - RNA, 19 nt, Homo sapiens
ccaucaagcucuucuauac

SEQ ID NO: 929916 - RNA, 19 nt, Homo sapiens
caagauaauugaaguuggu

SEQ ID NO: 929917 - RNA, 19 nt, Homo sapiens
gcaguuguauacauagugu

SEQ ID NO: 929918 - RNA, 19 nt, Homo sapiens
gcacgugcuuauccaguug

SEQ ID NO: 929919 - RNA, 19 nt, Homo sapiens
ugucacgucuggccuuaua

SEQ ID NO: 929920 - RNA, 19 nt, Homo sapiens
gcuccaguguuugaaauaa

SEQ ID NO: 929921 - RNA, 19 nt, Homo sapiens
gcucaagguugguagugaa

SEQ ID NO: 929922 - RNA, 19 nt, Homo sapiens
uggaauaaguucuguuugu

SEQ ID NO: 929923 - RNA, 19 nt, Homo sapiens
ggauuugucugugcaccua

SEQ ID NO: 929924 - RNA, 19 nt, Homo sapiens
gcugggagcagaucaugua

SEQ ID NO: 929925 - RNA, 19 nt, Homo sapiens
gaguggaccugccaaucaa

SEQ ID NO: 929926 - RNA, 19 nt, Homo sapiens
gcuggaauuugccugcuaa

SEQ ID NO: 929927 - RNA, 19 nt, Homo sapiens
gaagggacuugccuaaagc

SEQ ID NO: 929928 - RNA, 19 nt, Homo sapiens
caacaccuaucccaucaag

SEQ ID NO: 929929 - RNA, 19 nt, Homo sapiens
ugacaaauaaagccaguuu

SEQ ID NO: 929930 - RNA, 19 nt, Homo sapiens
gaagaucacccagcugugu

SEQ ID NO: 929931 - RNA, 19 nt, Homo sapiens
ggaccuugcuggcaugucu

SEQ ID NO: 929932 - RNA, 19 nt, Homo sapiens
agaagggacuugccuaaag

SEQ ID NO: 929933 - RNA, 19 nt, Homo sapiens
uugcaguggucaucuauuu

SEQ ID NO: 929934 - RNA, 19 nt, Homo sapiens
gccgaggaauggaauuuga

SEQ ID NO: 929935 - RNA, 19 nt, Homo sapiens
ggaagauucaguuuaagga

SEQ ID NO: 929936 - RNA, 19 nt, Homo sapiens
gaagacucauguuuauguc

SEQ ID NO: 929937 - RNA, 19 nt, Homo sapiens
cacaaacacugaaaugucu

SEQ ID NO: 929938 - RNA, 19 nt, Homo sapiens
caacuaacaucugugaaac

SEQ ID NO: 929939 - RNA, 19 nt, Homo sapiens
gagugauucuagccucuaa

SEQ ID NO: 929940 - RNA, 19 nt, Homo sapiens
ccacaaagggaauuucuca

SEQ ID NO: 929941 - RNA, 19 nt, Homo sapiens
gauucuagccucuaacaga

SEQ ID NO: 929942 - RNA, 19 nt, Homo sapiens
gagcagacaccaccgacuu

SEQ ID NO: 929943 - RNA, 19 nt, Homo sapiens
gcuuagagucugccuguuu

SEQ ID NO: 929944 - RNA, 19 nt, Homo sapiens
ggugaauaagugacaaaua

SEQ ID NO: 929945 - RNA, 19 nt, Homo sapiens
ucugcuagcuccguguuua

SEQ ID NO: 929946 - RNA, 19 nt, Homo sapiens
gccagucuaucguguaugu

SEQ ID NO: 929947 - RNA, 19 nt, Homo sapiens
aaaguuauuuggcaugauc

SEQ ID NO: 929948 - RNA, 19 nt, Homo sapiens
gagcuggcuuuagacauug

SEQ ID NO: 929949 - RNA, 19 nt, Homo sapiens
gaaauucagaagccagaga

SEQ ID NO: 929950 - RNA, 19 nt, Homo sapiens
gcgccaagauaauugaagu

SEQ ID NO: 929951 - RNA, 19 nt, Homo sapiens
guuucgagcuggcuuuaga

SEQ ID NO: 929952 - RNA, 19 nt, Homo sapiens
cugaggagcucgagguuuc

SEQ ID NO: 929953 - RNA, 19 nt, Homo sapiens
uggcaugucuccuucacaa

SEQ ID NO: 929954 - RNA, 19 nt, Homo sapiens
gcccugguguccaaccuuu

SEQ ID NO: 929955 - RNA, 19 nt, Homo sapiens
gaauuugccugcuaaucac

SEQ ID NO: 929956 - RNA, 19 nt, Homo sapiens
gcugacagguggccuaggu

SEQ ID NO: 929957 - RNA, 19 nt, Homo sapiens
gcacgcaagugagcagaca

SEQ ID NO: 929958 - RNA, 19 nt, Homo sapiens
ucacccagcuguguucaga

SEQ ID NO: 929959 - RNA, 19 nt, Homo sapiens
ggaagcacaaacacugaaa

SEQ ID NO: 929960 - RNA, 19 nt, Homo sapiens
ucucaucgccaccaucuuu

SEQ ID NO: 929961 - RNA, 19 nt, Homo sapiens
agaccgagcucucuucaac

SEQ ID NO: 929962 - RNA, 19 nt, Homo sapiens
gcuaucacccucuuuaucu

SEQ ID NO: 929963 - RNA, 19 nt, Homo sapiens
agacauggacagaaacuga

SEQ ID NO: 929964 - RNA, 19 nt, Homo sapiens
gcagugauguccguuuguc

SEQ ID NO: 929965 - RNA, 19 nt, Homo sapiens
gacagacccuugcagugau

SEQ ID NO: 929966 - RNA, 19 nt, Homo sapiens
ggauggcuuucccagaaga

SEQ ID NO: 929967 - RNA, 19 nt, Homo sapiens
gagaagugggaaugguaua

SEQ ID NO: 929968 - RNA, 19 nt, Homo sapiens
gcuagacauuuuccaauuu

SEQ ID NO: 929969 - RNA, 19 nt, Homo sapiens
acuuugagaucuucguuaa

SEQ ID NO: 929970 - RNA, 19 nt, Homo sapiens
uugguggccuuugcuauua

SEQ ID NO: 929971 - RNA, 19 nt, Homo sapiens
guauuucucucuucauugc

SEQ ID NO: 929972 - RNA, 19 nt, Homo sapiens
gcucugguauuucucucuu

SEQ ID NO: 929973 - RNA, 19 nt, Homo sapiens
caaaauggcauaacugaga

SEQ ID NO: 929974 - RNA, 19 nt, Homo sapiens
ggacuguuucucucuaaga

SEQ ID NO: 929975 - RNA, 19 nt, Homo sapiens
ugccaaagauguugcaaag

SEQ ID NO: 929976 - RNA, 19 nt, Homo sapiens
ucaaauuucuggaagucau

SEQ ID NO: 929977 - RNA, 19 nt, Homo sapiens
ggaccgcuaucacccucuu

SEQ ID NO: 929978 - RNA, 19 nt, Homo sapiens
gacccuuucuauuggauga

SEQ ID NO: 929979 - RNA, 19 nt, Homo sapiens
cgccauggcaaucaaauuu

SEQ ID NO: 929980 - RNA, 19 nt, Homo sapiens
cagagaagugggaauggua

SEQ ID NO: 929981 - RNA, 19 nt, Homo sapiens
ccaauuaucucacuuguuu

SEQ ID NO: 929982 - RNA, 19 nt, Homo sapiens
gauaacaucugaagggaaa

SEQ ID NO: 929983 - RNA, 19 nt, Homo sapiens
guucagagcuggcuuaaag

SEQ ID NO: 929984 - RNA, 19 nt, Homo sapiens
gaaagaacaugggcagaga

SEQ ID NO: 929985 - RNA, 19 nt, Homo sapiens
cugcugcgauugauuauua

SEQ ID NO: 929986 - RNA, 19 nt, Homo sapiens
gaagaacagugucaucagu

SEQ ID NO: 929987 - RNA, 19 nt, Homo sapiens
gaacaucagacuugaagaa

SEQ ID NO: 929988 - RNA, 19 nt, Homo sapiens
gaccacagcuggcccucua

SEQ ID NO: 929989 - RNA, 19 nt, Homo sapiens
ucaccaagcucauuacauc

SEQ ID NO: 929990 - RNA, 19 nt, Homo sapiens
gguguuugauagaaucuua

SEQ ID NO: 929991 - RNA, 19 nt, Homo sapiens
gaacaugggcagagaggaa

SEQ ID NO: 929992 - RNA, 19 nt, Homo sapiens
caaaagaagugcugaaaga

SEQ ID NO: 929993 - RNA, 19 nt, Homo sapiens
gaauucagcuccacaaagc

SEQ ID NO: 929994 - RNA, 19 nt, Homo sapiens
gaagggaaagaaugagaaa

SEQ ID NO: 929995 - RNA, 19 nt, Homo sapiens
gacuugaccuugugguauu

SEQ ID NO: 929996 - RNA, 19 nt, Homo sapiens
gcagugaaaucccauccau

SEQ ID NO: 929997 - RNA, 19 nt, Homo sapiens
caacuauccgucucgaaua

SEQ ID NO: 929998 - RNA, 19 nt, Homo sapiens
gggaggauuugucuuagga

SEQ ID NO: 929999 - RNA, 19 nt, Homo sapiens
gaaaucccauccaugaacu

SEQ ID NO: 930000 - RNA, 19 nt, Homo sapiens
gcaacuauccgucucgaau

SEQ ID NO: 930001 - RNA, 19 nt, Homo sapiens
ggaggagccuauugguuca

SEQ ID NO: 930002 - RNA, 19 nt, Homo sapiens
ugugugccauggauauuua

SEQ ID NO: 930003 - RNA, 19 nt, Homo sapiens
ggacgucccgugccagauu

SEQ ID NO: 930004 - RNA, 19 nt, Homo sapiens
caaauucccuauuccaaaa

SEQ ID NO: 930005 - RNA, 19 nt, Homo sapiens
ucaaauucccuauuccaaa

SEQ ID NO: 930006 - RNA, 19 nt, Homo sapiens
ggaacuccaugcaacuauc

SEQ ID NO: 930007 - RNA, 19 nt, Homo sapiens
aagaagugcugaaagaaca

SEQ ID NO: 930008 - RNA, 19 nt, Homo sapiens
gaugccguccaaccaauua

SEQ ID NO: 930009 - RNA, 19 nt, Homo sapiens
ucaggaagcuguucuaccu

SEQ ID NO: 930010 - RNA, 19 nt, Homo sapiens
ucuuguaccugguguuuga

SEQ ID NO: 930011 - RNA, 19 nt, Homo sapiens
ggagcugccuggcuucucu

SEQ ID NO: 930012 - RNA, 19 nt, Homo sapiens
ggaauucagcuccacaaag

SEQ ID NO: 930013 - RNA, 19 nt, Homo sapiens
caucagacuugaagaacag

SEQ ID NO: 930014 - RNA, 19 nt, Homo sapiens
ccgaagcuccgcugcagua

SEQ ID NO: 930015 - RNA, 19 nt, Homo sapiens
caaccaauuaucucacuug

SEQ ID NO: 930016 - RNA, 19 nt, Homo sapiens
ccggguggcccaaagauaa

SEQ ID NO: 930017 - RNA, 19 nt, Homo sapiens
ucucugcugcgauugauua

SEQ ID NO: 930018 - RNA, 19 nt, Homo sapiens
agugaaaucccauccauga

SEQ ID NO: 930019 - RNA, 19 nt, Homo sapiens
agcagaagaugaucgagaa

SEQ ID NO: 930020 - RNA, 19 nt, Homo sapiens
ugucuuaggaggugcauuu

SEQ ID NO: 930021 - RNA, 19 nt, Homo sapiens
ggagccauguuuucuugua

SEQ ID NO: 930022 - RNA, 19 nt, Homo sapiens
gugaggagcagaagaugau

SEQ ID NO: 930023 - RNA, 19 nt, Homo sapiens
caucugaagggaaagaaug

SEQ ID NO: 930024 - RNA, 19 nt, Homo sapiens
caaguccagccaagaguga

SEQ ID NO: 930025 - RNA, 19 nt, Homo sapiens
cgacuugaccuugugguau

SEQ ID NO: 930026 - RNA, 19 nt, Homo sapiens
gggaaagaaugagaaagcu

SEQ ID NO: 930027 - RNA, 19 nt, Homo sapiens
gaagcccagcccagccuuu

SEQ ID NO: 930028 - RNA, 19 nt, Homo sapiens
guuuaccgcuggcaucgau

SEQ ID NO: 930029 - RNA, 19 nt, Homo sapiens
ugaagggaaagaaugagaa

SEQ ID NO: 930030 - RNA, 19 nt, Homo sapiens
uaccugguguuugauagaa

SEQ ID NO: 930031 - RNA, 19 nt, Homo sapiens
cuaguugugugccauggau

SEQ ID NO: 930032 - RNA, 19 nt, Homo sapiens
gaagcuguucuaccuugga

SEQ ID NO: 930033 - RNA, 19 nt, Homo sapiens
gcagaucgggagacaggau

SEQ ID NO: 930034 - RNA, 19 nt, Homo sapiens
ugaaaucccauccaugaac

SEQ ID NO: 930035 - RNA, 19 nt, Homo sapiens
uuccugggaugcagugaaa

SEQ ID NO: 930036 - RNA, 19 nt, Homo sapiens
ccaagagugaggagcagaa

SEQ ID NO: 930037 - RNA, 19 nt, Homo sapiens
uaacaucugaagggaaaga

SEQ ID NO: 930038 - RNA, 19 nt, Homo sapiens
ccaaccaauuaucucacuu

SEQ ID NO: 930039 - RNA, 19 nt, Homo sapiens
aagcuguucuaccuuggaa

SEQ ID NO: 930040 - RNA, 19 nt, Homo sapiens
guaccugguguuugauaga

SEQ ID NO: 930041 - RNA, 19 nt, Homo sapiens
ccgcuggcaucgauaccaa

SEQ ID NO: 930042 - RNA, 19 nt, Homo sapiens
ggaauguccuaugccaaaa

SEQ ID NO: 930043 - RNA, 19 nt, Homo sapiens
auaccaacgugggcuuuga

SEQ ID NO: 930044 - RNA, 19 nt, Homo sapiens
guuagaggacugugucauc

SEQ ID NO: 930045 - RNA, 19 nt, Homo sapiens
guacaccgacugcaaaaga

SEQ ID NO: 930046 - RNA, 19 nt, Homo sapiens
guugacauauaggaauuca

SEQ ID NO: 930047 - RNA, 19 nt, Homo sapiens
auuauuaccuccggugaga

SEQ ID NO: 930048 - RNA, 19 nt, Homo sapiens
cagggucaaggaaguguuu

SEQ ID NO: 930049 - RNA, 19 nt, Homo sapiens
gacgucccgugccagauuc

SEQ ID NO: 930050 - RNA, 19 nt, Homo sapiens
acaucagacuugaagaaca

SEQ ID NO: 930051 - RNA, 19 nt, Homo sapiens
gugaaaucccauccaugaa

SEQ ID NO: 930052 - RNA, 19 nt, Homo sapiens
agagugaggagcagaagau

SEQ ID NO: 930053 - RNA, 19 nt, Homo sapiens
ccucaugucguugguauuc

SEQ ID NO: 930054 - RNA, 19 nt, Homo sapiens
gcucucuggaggacaguuu

SEQ ID NO: 930055 - RNA, 19 nt, Homo sapiens
gaagugcugaaagaacaug

SEQ ID NO: 930056 - RNA, 19 nt, Homo sapiens
cauugugggagccauguuu

SEQ ID NO: 930057 - RNA, 19 nt, Homo sapiens
guccugcuguggucaucuu

SEQ ID NO: 930058 - RNA, 19 nt, Homo sapiens
gagcuugaggccacaugug

SEQ ID NO: 930059 - RNA, 19 nt, Homo sapiens
gccggguggcccaaagaua

SEQ ID NO: 930060 - RNA, 19 nt, Homo sapiens
aaagaagugcugaaagaac

SEQ ID NO: 930061 - RNA, 19 nt, Homo sapiens
gaagcuccgcugcaguaca

SEQ ID NO: 930062 - RNA, 19 nt, Homo sapiens
aagcuccgcugcaguacag

SEQ ID NO: 930063 - RNA, 19 nt, Homo sapiens
gcacucaggaagcuguucu

SEQ ID NO: 930064 - RNA, 19 nt, Homo sapiens
acagcuggcccucuagguu

SEQ ID NO: 930065 - RNA, 19 nt, Homo sapiens
ucaugucguugguauucug

SEQ ID NO: 930066 - RNA, 19 nt, Homo sapiens
gaacagugcugaaagguuu

SEQ ID NO: 930067 - RNA, 19 nt, Homo sapiens
gaagaacuauggagaaaug

SEQ ID NO: 930068 - RNA, 19 nt, Homo sapiens
cagcagugauaacaauuua

SEQ ID NO: 930069 - RNA, 19 nt, Homo sapiens
cagugucucuuaauucuua

SEQ ID NO: 930070 - RNA, 19 nt, Homo sapiens
uuacauaccugcagugguu

SEQ ID NO: 930071 - RNA, 19 nt, Homo sapiens
uugcugaucugcugauuua

SEQ ID NO: 930072 - RNA, 19 nt, Homo sapiens
uaacagcagugauaacaau

SEQ ID NO: 930073 - RNA, 19 nt, Homo sapiens
gagaaaugguacuugauga

SEQ ID NO: 930074 - RNA, 19 nt, Homo sapiens
gugcauauguggcaaaguu

SEQ ID NO: 930075 - RNA, 19 nt, Homo sapiens
gauaacauuucaagaagug

SEQ ID NO: 930076 - RNA, 19 nt, Homo sapiens
gaacuauggagaaauggua

SEQ ID NO: 930077 - RNA, 19 nt, Homo sapiens
cagagacacuggcaagaaa

SEQ ID NO: 930078 - RNA, 19 nt, Homo sapiens
cuaccagucugcuuaguuu

SEQ ID NO: 930079 - RNA, 19 nt, Homo sapiens
ggguuuguguugcuaguua

SEQ ID NO: 930080 - RNA, 19 nt, Homo sapiens
cgaagaaucgauaacauuu

SEQ ID NO: 930081 - RNA, 19 nt, Homo sapiens
gaaaggaaauggugaaaag

SEQ ID NO: 930082 - RNA, 19 nt, Homo sapiens
uaugcuaccucuucuauug

SEQ ID NO: 930083 - RNA, 19 nt, Homo sapiens
ggaaaccaagcaucauuaa

SEQ ID NO: 930084 - RNA, 19 nt, Homo sapiens
gauaacauuucucugaaca

SEQ ID NO: 930085 - RNA, 19 nt, Homo sapiens
uauccaggccuuauucuua

SEQ ID NO: 930086 - RNA, 19 nt, Homo sapiens
cgucacauccaauuaauaa

SEQ ID NO: 930087 - RNA, 19 nt, Homo sapiens
ggauaaaguagccaauauu

SEQ ID NO: 930088 - RNA, 19 nt, Homo sapiens
ggauugcucuccauacauc

SEQ ID NO: 930089 - RNA, 19 nt, Homo sapiens
gcauauguggcaaaguuua

SEQ ID NO: 930090 - RNA, 19 nt, Homo sapiens
ggagaaaugguacuugaug

SEQ ID NO: 930091 - RNA, 19 nt, Homo sapiens
ccacgucacauccaauuaa

SEQ ID NO: 930092 - RNA, 19 nt, Homo sapiens
gaaaccaagcaucauuaaa

SEQ ID NO: 930093 - RNA, 19 nt, Homo sapiens
gugauaacauuucucugaa

SEQ ID NO: 930094 - RNA, 19 nt, Homo sapiens
gcgaagaaucgauaacauu

SEQ ID NO: 930095 - RNA, 19 nt, Homo sapiens
ccaaaggauucaaauuuac

SEQ ID NO: 930096 - RNA, 19 nt, Homo sapiens
gaggauaaaguagccaaua

SEQ ID NO: 930097 - RNA, 19 nt, Homo sapiens
gaaaagucauuguugucua

SEQ ID NO: 930098 - RNA, 19 nt, Homo sapiens
uggaagaaaucagaagaaa

SEQ ID NO: 930099 - RNA, 19 nt, Homo sapiens
ggacuuguuuucuguauug

SEQ ID NO: 930100 - RNA, 19 nt, Homo sapiens
cuaaugcccucuguuguga

SEQ ID NO: 930101 - RNA, 19 nt, Homo sapiens
gagacacuggcaagaaaua

SEQ ID NO: 930102 - RNA, 19 nt, Homo sapiens
gaagugauaacauuucucu

SEQ ID NO: 930103 - RNA, 19 nt, Homo sapiens
uaacauuucucugaacaag

SEQ ID NO: 930104 - RNA, 19 nt, Homo sapiens
gguugaucguggauuauuu

SEQ ID NO: 930105 - RNA, 19 nt, Homo sapiens
ggacuaacaguacgaugga

SEQ ID NO: 930106 - RNA, 19 nt, Homo sapiens
gcugugcgcuaucauucuu

SEQ ID NO: 930107 - RNA, 19 nt, Homo sapiens
gaagaaucgauaacauuuc

SEQ ID NO: 930108 - RNA, 19 nt, Homo sapiens
aaauguauauggagaccaa

SEQ ID NO: 930109 - RNA, 19 nt, Homo sapiens
gcauuuugcuuagcuauaa

SEQ ID NO: 930110 - RNA, 19 nt, Homo sapiens
cauuaugcaucuugcugua

SEQ ID NO: 930111 - RNA, 19 nt, Homo sapiens
gcagugauaacaauuuaca

SEQ ID NO: 930112 - RNA, 19 nt, Homo sapiens
gaagugauugaccacguuu

SEQ ID NO: 930113 - RNA, 19 nt, Homo sapiens
caagaagugauaacauuuc

SEQ ID NO: 930114 - RNA, 19 nt, Homo sapiens
ccucuuacagcuuaucaua

SEQ ID NO: 930115 - RNA, 19 nt, Homo sapiens
gaaaugguacuugaugaca

SEQ ID NO: 930116 - RNA, 19 nt, Homo sapiens
aggauaaaguagccaauau

SEQ ID NO: 930117 - RNA, 19 nt, Homo sapiens
guggcaaaguuuauaaauc

SEQ ID NO: 930118 - RNA, 19 nt, Homo sapiens
acccaccucuuacagcuua

SEQ ID NO: 930119 - RNA, 19 nt, Homo sapiens
cuacauagacauaaucaag

SEQ ID NO: 930120 - RNA, 19 nt, Homo sapiens
uaauuuaccggucaaacaa

SEQ ID NO: 930121 - RNA, 19 nt, Homo sapiens
uggaaaccaagcaucauua

SEQ ID NO: 930122 - RNA, 19 nt, Homo sapiens
acaguacgauggacagugu

SEQ ID NO: 930123 - RNA, 19 nt, Homo sapiens
uugaagaacuauggagaaa

SEQ ID NO: 930124 - RNA, 19 nt, Homo sapiens
ucgauaacauuucaagaag

SEQ ID NO: 930125 - RNA, 19 nt, Homo sapiens
guacuguuguugcuuaaaa

SEQ ID NO: 930126 - RNA, 19 nt, Homo sapiens
uaauugcgaagaaucgaua

SEQ ID NO: 930127 - RNA, 19 nt, Homo sapiens
uuuguacuguuguugcuua

SEQ ID NO: 930128 - RNA, 19 nt, Homo sapiens
uggcaaaguuuauaaaucc

SEQ ID NO: 930129 - RNA, 19 nt, Homo sapiens
ucuuacagcuuaucauagu

SEQ ID NO: 930130 - RNA, 19 nt, Homo sapiens
cccgguugaucguggauua

SEQ ID NO: 930131 - RNA, 19 nt, Homo sapiens
cccuaaauuugaagaacua

SEQ ID NO: 930132 - RNA, 19 nt, Homo sapiens
gccuuauucuuauagacua

SEQ ID NO: 930133 - RNA, 19 nt, Homo sapiens
agaagugauugaccacguu

SEQ ID NO: 930134 - RNA, 19 nt, Homo sapiens
cgauaacauuucaagaagu

SEQ ID NO: 930135 - RNA, 19 nt, Homo sapiens
gguuuguguugcuaguuaa

SEQ ID NO: 930136 - RNA, 19 nt, Homo sapiens
gcugguaaaccgccuaugu

SEQ ID NO: 930137 - RNA, 19 nt, Homo sapiens
gacaguagugguuuuaaua

SEQ ID NO: 930138 - RNA, 19 nt, Homo sapiens
ggaaccacaggaaaggaaa

SEQ ID NO: 930139 - RNA, 19 nt, Homo sapiens
cuauggugcuucugacguu

SEQ ID NO: 930140 - RNA, 19 nt, Homo sapiens
uuucuuaucucagucauca

SEQ ID NO: 930141 - RNA, 19 nt, Homo sapiens
gagcuuuuguuuuacguuu

SEQ ID NO: 930142 - RNA, 19 nt, Homo sapiens
cagcuucaaugucuuucug

SEQ ID NO: 930143 - RNA, 19 nt, Homo sapiens
agugauaacauuucucuga

SEQ ID NO: 930144 - RNA, 19 nt, Homo sapiens
ccauacaucacguggauau

SEQ ID NO: 930145 - RNA, 19 nt, Homo sapiens
ugaccacguuuuaaaagua

SEQ ID NO: 930146 - RNA, 19 nt, Homo sapiens
uuauucaggugcugguaaa

SEQ ID NO: 930147 - RNA, 19 nt, Homo sapiens
gucaacauuuaguaugcua

SEQ ID NO: 930148 - RNA, 19 nt, Homo sapiens
gucacuaccagucugcuua

SEQ ID NO: 930149 - RNA, 19 nt, Homo sapiens
cuucagcccucuuccaaag

SEQ ID NO: 930150 - RNA, 19 nt, Homo sapiens
uguuguggcuuccuucguu

SEQ ID NO: 930151 - RNA, 19 nt, Homo sapiens
ucagagacacuggcaagaa

SEQ ID NO: 930152 - RNA, 19 nt, Homo sapiens
gaaucgauaacauuucaag

SEQ ID NO: 930153 - RNA, 19 nt, Homo sapiens
gccuauguuuggugauuau

SEQ ID NO: 930154 - RNA, 19 nt, Homo sapiens
gaaccacaggaaaggaaau

SEQ ID NO: 930155 - RNA, 19 nt, Homo sapiens
cuagcuguauuccuaaaca

SEQ ID NO: 930156 - RNA, 19 nt, Homo sapiens
ucucucaaacugcuaauug

SEQ ID NO: 930157 - RNA, 19 nt, Homo sapiens
auggagaaaugguacuuga

SEQ ID NO: 930158 - RNA, 19 nt, Homo sapiens
gcuguauuccuaaacaaau

SEQ ID NO: 930159 - RNA, 19 nt, Homo sapiens
ucagcccucuuccaaagga

SEQ ID NO: 930160 - RNA, 19 nt, Homo sapiens
agucuuggcuuugcuuugu

SEQ ID NO: 930161 - RNA, 19 nt, Homo sapiens
guacaacaguuuuaauugc

SEQ ID NO: 930162 - RNA, 19 nt, Homo sapiens
auacaucacguggauauga

SEQ ID NO: 930163 - RNA, 19 nt, Homo sapiens
ccgccuauguuuggugauu

SEQ ID NO: 930164 - RNA, 19 nt, Homo sapiens
ggugaaaagucauuguugu

SEQ ID NO: 930165 - RNA, 19 nt, Homo sapiens
ggaagaaaucagaagaaaa

SEQ ID NO: 930166 - RNA, 19 nt, Homo sapiens
ggagaaauccauacauuaa

SEQ ID NO: 930167 - RNA, 19 nt, Homo sapiens
ugacaauccuccaauauuu

SEQ ID NO: 930168 - RNA, 19 nt, Homo sapiens
guaaauccauccacuaaau

SEQ ID NO: 930169 - RNA, 19 nt, Homo sapiens
ccagguaucugaugacuau

SEQ ID NO: 930170 - RNA, 19 nt, Homo sapiens
caacguagcuaaggaccua

SEQ ID NO: 930171 - RNA, 19 nt, Homo sapiens
gcagagagcgcgcuuguga

SEQ ID NO: 930172 - RNA, 19 nt, Homo sapiens
ggucagaauucuuggcuuu

SEQ ID NO: 930173 - RNA, 19 nt, Homo sapiens
gcagaaaagugaaaguaua

SEQ ID NO: 930174 - RNA, 19 nt, Homo sapiens
caaccaagcauucuagaaa

SEQ ID NO: 930175 - RNA, 19 nt, Homo sapiens
ugagaaccauggauuauga

SEQ ID NO: 930176 - RNA, 19 nt, Homo sapiens
ccacugaccuuggguuauu

SEQ ID NO: 930177 - RNA, 19 nt, Homo sapiens
gcuauaauaucaccauugu

SEQ ID NO: 930178 - RNA, 19 nt, Homo sapiens
gcaaaguccugguagaagu

SEQ ID NO: 930179 - RNA, 19 nt, Homo sapiens
ccaacaaagcgauaacuua

SEQ ID NO: 930180 - RNA, 19 nt, Homo sapiens
guacagagcccagguauca

SEQ ID NO: 930181 - RNA, 19 nt, Homo sapiens
uaaugacaauccuccaaua

SEQ ID NO: 930182 - RNA, 19 nt, Homo sapiens
gaggaggucucaggcuaua

SEQ ID NO: 930183 - RNA, 19 nt, Homo sapiens
gcuaauauccgacguuaau

SEQ ID NO: 930184 - RNA, 19 nt, Homo sapiens
agcgauaacuuacucuuua

SEQ ID NO: 930185 - RNA, 19 nt, Homo sapiens
caagagcauuucuaugaug

SEQ ID NO: 930186 - RNA, 19 nt, Homo sapiens
gaaaguauauccgcaacag

SEQ ID NO: 930187 - RNA, 19 nt, Homo sapiens
gaaacuggaucgggaguca

SEQ ID NO: 930188 - RNA, 19 nt, Homo sapiens
gugcuaauauccgacguua

SEQ ID NO: 930189 - RNA, 19 nt, Homo sapiens
ucacugaguagccaaguua

SEQ ID NO: 930190 - RNA, 19 nt, Homo sapiens
gggugagaaugcccaaaua

SEQ ID NO: 930191 - RNA, 19 nt, Homo sapiens
uaucuugacuguucgagaa

SEQ ID NO: 930192 - RNA, 19 nt, Homo sapiens
gcauuucuaugaugacugu

SEQ ID NO: 930193 - RNA, 19 nt, Homo sapiens
gagaaaaguucacaauuca

SEQ ID NO: 930194 - RNA, 19 nt, Homo sapiens
gagauuuguuugugaagga

SEQ ID NO: 930195 - RNA, 19 nt, Homo sapiens
cgacaacuauccgcuauuc

SEQ ID NO: 930196 - RNA, 19 nt, Homo sapiens
gaggcaggcuaccuaguga

SEQ ID NO: 930197 - RNA, 19 nt, Homo sapiens
gaggucaggguauuugaua

SEQ ID NO: 930198 - RNA, 19 nt, Homo sapiens
caaaguccaugcugaggau

SEQ ID NO: 930199 - RNA, 19 nt, Homo sapiens
uugaagccauugaaacaua

SEQ ID NO: 930200 - RNA, 19 nt, Homo sapiens
caacaaagcgauaacuuac

SEQ ID NO: 930201 - RNA, 19 nt, Homo sapiens
ugacaauccucccgaagug

SEQ ID NO: 930202 - RNA, 19 nt, Homo sapiens
caagcauucuagaaaggua

SEQ ID NO: 930203 - RNA, 19 nt, Homo sapiens
aaaccuacauuugggaauu

SEQ ID NO: 930204 - RNA, 19 nt, Homo sapiens
uuaacggucuccagaacua

SEQ ID NO: 930205 - RNA, 19 nt, Homo sapiens
caacuucccuuucccucau

SEQ ID NO: 930206 - RNA, 19 nt, Homo sapiens
ggagaucuuucagucuuug

SEQ ID NO: 930207 - RNA, 19 nt, Homo sapiens
uggagaaguucgacuaaga

SEQ ID NO: 930208 - RNA, 19 nt, Homo sapiens
gaucgggagucacuuugug

SEQ ID NO: 930209 - RNA, 19 nt, Homo sapiens
caagacgggagauuuguuu

SEQ ID NO: 930210 - RNA, 19 nt, Homo sapiens
ggugagaaugcccaaauaa

SEQ ID NO: 930211 - RNA, 19 nt, Homo sapiens
cauacgacauugacauuca

SEQ ID NO: 930212 - RNA, 19 nt, Homo sapiens
cauuauacaugucuaccaa

SEQ ID NO: 930213 - RNA, 19 nt, Homo sapiens
caaugacaaucguccaaug

SEQ ID NO: 930214 - RNA, 19 nt, Homo sapiens
uaugauagaggugcuaaua

SEQ ID NO: 930215 - RNA, 19 nt, Homo sapiens
auucuuggcuuucauauca

SEQ ID NO: 930216 - RNA, 19 nt, Homo sapiens
gagcccagguaucagagaa

SEQ ID NO: 930217 - RNA, 19 nt, Homo sapiens
ucaagagcauuucuaugau

SEQ ID NO: 930218 - RNA, 19 nt, Homo sapiens
cuacauuugggaauucuua

SEQ ID NO: 930219 - RNA, 19 nt, Homo sapiens
gugauggucuccucugugu

SEQ ID NO: 930220 - RNA, 19 nt, Homo sapiens
gagaggagcagccugaagu

SEQ ID NO: 930221 - RNA, 19 nt, Homo sapiens
gagaaugcccaaauaacau

SEQ ID NO: 930222 - RNA, 19 nt, Homo sapiens
aagcaauucucaagacguu

SEQ ID NO: 930223 - RNA, 19 nt, Homo sapiens
gcgauaacuuacucuuuag

SEQ ID NO: 930224 - RNA, 19 nt, Homo sapiens
gguaucugaugacuauaug

SEQ ID NO: 930225 - RNA, 19 nt, Homo sapiens
cucaagacguuucagauug

SEQ ID NO: 930226 - RNA, 19 nt, Homo sapiens
gaucauucuuguucaggau

SEQ ID NO: 930227 - RNA, 19 nt, Homo sapiens
ccacagcaaaguccuggua

SEQ ID NO: 930228 - RNA, 19 nt, Homo sapiens
uucaagagcauuucuauga

SEQ ID NO: 930229 - RNA, 19 nt, Homo sapiens
ccacuacugucucacucaa

SEQ ID NO: 930230 - RNA, 19 nt, Homo sapiens
gcuuucauaucaucuacuu

SEQ ID NO: 930231 - RNA, 19 nt, Homo sapiens
gcagccacgggccuaaaua

SEQ ID NO: 930232 - RNA, 19 nt, Homo sapiens
gaucuggacgugggccuua

SEQ ID NO: 930233 - RNA, 19 nt, Homo sapiens
cagagugguuguccuagau

SEQ ID NO: 930234 - RNA, 19 nt, Homo sapiens
agaaugcccaaauaacaua

SEQ ID NO: 930235 - RNA, 19 nt, Homo sapiens
ugagaaugcccaaauaaca

SEQ ID NO: 930236 - RNA, 19 nt, Homo sapiens
gaucuugauuugggugaga

SEQ ID NO: 930237 - RNA, 19 nt, Homo sapiens
uaauauccgacguuaauga

SEQ ID NO: 930238 - RNA, 19 nt, Homo sapiens
acaaagcgauaacuuacuc

SEQ ID NO: 930239 - RNA, 19 nt, Homo sapiens
gcaaagccgacccuugugu

SEQ ID NO: 930240 - RNA, 19 nt, Homo sapiens
gcaagacgggagauuuguu

SEQ ID NO: 930241 - RNA, 19 nt, Homo sapiens
gccaugaccagguaucuga

SEQ ID NO: 930242 - RNA, 19 nt, Homo sapiens
gacuguaauuucucuaaca

SEQ ID NO: 930243 - RNA, 19 nt, Homo sapiens
aagagcauuucuaugauga

SEQ ID NO: 930244 - RNA, 19 nt, Homo sapiens
augcagaaauugaucauuc

SEQ ID NO: 930245 - RNA, 19 nt, Homo sapiens
ugacaaucguccaaugauc

SEQ ID NO: 930246 - RNA, 19 nt, Homo sapiens
gcgcugagaaccauggauu

SEQ ID NO: 930247 - RNA, 19 nt, Homo sapiens
ggaggucucaggcuauaau

SEQ ID NO: 930248 - RNA, 19 nt, Homo sapiens
uagaagugguggaugugaa

SEQ ID NO: 930249 - RNA, 19 nt, Homo sapiens
ggagcagccugaagucaac

SEQ ID NO: 930250 - RNA, 19 nt, Homo sapiens
gacgggagauuuguuugug

SEQ ID NO: 930251 - RNA, 19 nt, Homo sapiens
agagggccaugaccaggua

SEQ ID NO: 930252 - RNA, 19 nt, Homo sapiens
ucacaauucaagagcauuu

SEQ ID NO: 930253 - RNA, 19 nt, Homo sapiens
gauccaaccaagcauucua

SEQ ID NO: 930254 - RNA, 19 nt, Homo sapiens
agaaauccauacauuaagg

SEQ ID NO: 930255 - RNA, 19 nt, Homo sapiens
ucagagugguuguccuaga

SEQ ID NO: 930256 - RNA, 19 nt, Homo sapiens
gaaaaucuuugcaaaacag

SEQ ID NO: 930257 - RNA, 19 nt, Homo sapiens
gcaauucucaagacguuuc

SEQ ID NO: 930258 - RNA, 19 nt, Homo sapiens
ggcaauggauccuuaucuc

SEQ ID NO: 930259 - RNA, 19 nt, Homo sapiens
ggucauuucucuggucauc

SEQ ID NO: 930260 - RNA, 19 nt, Homo sapiens
gagugguuguccuagauga

SEQ ID NO: 930261 - RNA, 19 nt, Homo sapiens
uauccgacguuaaugacaa

SEQ ID NO: 930262 - RNA, 19 nt, Homo sapiens
uaucagagaccgggacauu

SEQ ID NO: 930263 - RNA, 19 nt, Homo sapiens
gcagaaaaucuuugcaaaa

SEQ ID NO: 930264 - RNA, 19 nt, Homo sapiens
agagaaaaguucacaauuc

SEQ ID NO: 930265 - RNA, 19 nt, Homo sapiens
gguaaauccauccacuaaa

SEQ ID NO: 930266 - RNA, 19 nt, Homo sapiens
gaauuacacuuccuaguuu

SEQ ID NO: 930267 - RNA, 19 nt, Homo sapiens
gcagacagaagcaauauua

SEQ ID NO: 930268 - RNA, 19 nt, Homo sapiens
ccaauaagcuuuccaugau

SEQ ID NO: 930269 - RNA, 19 nt, Homo sapiens
gguauaacauugcuugaaa

SEQ ID NO: 930270 - RNA, 19 nt, Homo sapiens
ccacagaagugauguuguu

SEQ ID NO: 930271 - RNA, 19 nt, Homo sapiens
caagauguuucauguugua

SEQ ID NO: 930272 - RNA, 19 nt, Homo sapiens
gagcccagguacuaaguua

SEQ ID NO: 930273 - RNA, 19 nt, Homo sapiens
caagcuaacauauccauua

SEQ ID NO: 930274 - RNA, 19 nt, Homo sapiens
gaaaguauuuggacaugca

SEQ ID NO: 930275 - RNA, 19 nt, Homo sapiens
uuacugaucggacuaauua

SEQ ID NO: 930276 - RNA, 19 nt, Homo sapiens
aaagaaagcuccuucaaac

SEQ ID NO: 930277 - RNA, 19 nt, Homo sapiens
caaagaaagcuccuucaaa

SEQ ID NO: 930278 - RNA, 19 nt, Homo sapiens
agauucagcuuaugcauuu

SEQ ID NO: 930279 - RNA, 19 nt, Homo sapiens
caugaaagaugaaacuaug

SEQ ID NO: 930280 - RNA, 19 nt, Homo sapiens
ugagggaaauccaauuaaa

SEQ ID NO: 930281 - RNA, 19 nt, Homo sapiens
aaacagagcccagguacua

SEQ ID NO: 930282 - RNA, 19 nt, Homo sapiens
ggugguacauuuccucauu

SEQ ID NO: 930283 - RNA, 19 nt, Homo sapiens
gcaaggaucagcauaaagu

SEQ ID NO: 930284 - RNA, 19 nt, Homo sapiens
caaauuauggccaaagaaa

SEQ ID NO: 930285 - RNA, 19 nt, Homo sapiens
ggucagauucuacuaguuu

SEQ ID NO: 930286 - RNA, 19 nt, Homo sapiens
cacaauaacgugcuacaua

SEQ ID NO: 930287 - RNA, 19 nt, Homo sapiens
uaugauaguugccaaaugu

SEQ ID NO: 930288 - RNA, 19 nt, Homo sapiens
gguacuaaguuaugucaug

SEQ ID NO: 930289 - RNA, 19 nt, Homo sapiens
cccaagauguuucauguug

SEQ ID NO: 930290 - RNA, 19 nt, Homo sapiens
gaaggaauaccacagaagu

SEQ ID NO: 930291 - RNA, 19 nt, Homo sapiens
ugaauuacacuuccuaguu

SEQ ID NO: 930292 - RNA, 19 nt, Homo sapiens
uccauuaccucacauaguu

SEQ ID NO: 930293 - RNA, 19 nt, Homo sapiens
gccaauaagcuuuccauga

SEQ ID NO: 930294 - RNA, 19 nt, Homo sapiens
gaagugauguuguuuucuu

SEQ ID NO: 930295 - RNA, 19 nt, Homo sapiens
cgaaauuagauucagcuua

SEQ ID NO: 930296 - RNA, 19 nt, Homo sapiens
caauaagcuuuccaugaug

SEQ ID NO: 930297 - RNA, 19 nt, Homo sapiens
ugacguugguauaacauug

SEQ ID NO: 930298 - RNA, 19 nt, Homo sapiens
acaauaacgugcuacauac

SEQ ID NO: 930299 - RNA, 19 nt, Homo sapiens
gccaguaucagccagauuu

SEQ ID NO: 930300 - RNA, 19 nt, Homo sapiens
caagugauauuugccuuag

SEQ ID NO: 930301 - RNA, 19 nt, Homo sapiens
gucagauucuacuaguuua

SEQ ID NO: 930302 - RNA, 19 nt, Homo sapiens
gcuaaaucaagcuaacaua

SEQ ID NO: 930303 - RNA, 19 nt, Homo sapiens
agacacaacgcaauaguga

SEQ ID NO: 930304 - RNA, 19 nt, Homo sapiens
gcccaucauucuuuaaaca

SEQ ID NO: 930305 - RNA, 19 nt, Homo sapiens
gaauaccacagaagugaug

SEQ ID NO: 930306 - RNA, 19 nt, Homo sapiens
uaaucuggcuguuguugug

SEQ ID NO: 930307 - RNA, 19 nt, Homo sapiens
gauacaggauuuugauuug

SEQ ID NO: 930308 - RNA, 19 nt, Homo sapiens
gugguacauuuccucauuu

SEQ ID NO: 930309 - RNA, 19 nt, Homo sapiens
uaaaucagccauucucaag

SEQ ID NO: 930310 - RNA, 19 nt, Homo sapiens
ccauuacuguugacaugaa

SEQ ID NO: 930311 - RNA, 19 nt, Homo sapiens
auucaggucuuccuuguug

SEQ ID NO: 930312 - RNA, 19 nt, Homo sapiens
ugaaggaagaaauguguuu

SEQ ID NO: 930313 - RNA, 19 nt, Homo sapiens
guaccaucuuagaaccuua

SEQ ID NO: 930314 - RNA, 19 nt, Homo sapiens
ccaaagaaagcuccuucaa

SEQ ID NO: 930315 - RNA, 19 nt, Homo sapiens
uuacaucagcuuggaguua

SEQ ID NO: 930316 - RNA, 19 nt, Homo sapiens
gcauucuacuauaaggaaa

SEQ ID NO: 930317 - RNA, 19 nt, Homo sapiens
gaaagaugaaacuaugcaa

SEQ ID NO: 930318 - RNA, 19 nt, Homo sapiens
gcuaacauauccauuaccu

SEQ ID NO: 930319 - RNA, 19 nt, Homo sapiens
uacccaagauguuucaugu

SEQ ID NO: 930320 - RNA, 19 nt, Homo sapiens
guggggauuuugucaauua

SEQ ID NO: 930321 - RNA, 19 nt, Homo sapiens
caagcgaaccaagccaaua

SEQ ID NO: 930322 - RNA, 19 nt, Homo sapiens
ccaagauguuucauguugu

SEQ ID NO: 930323 - RNA, 19 nt, Homo sapiens
cuacaugagacaauugauu

SEQ ID NO: 930324 - RNA, 19 nt, Homo sapiens
gcuuggaguuauugauuuc

SEQ ID NO: 930325 - RNA, 19 nt, Homo sapiens
cagcuuggaguuauugauu

SEQ ID NO: 930326 - RNA, 19 nt, Homo sapiens
ucauugacguuuacugauc

SEQ ID NO: 930327 - RNA, 19 nt, Homo sapiens
aaauuccacucacucauuc

SEQ ID NO: 930328 - RNA, 19 nt, Homo sapiens
uuagggacuuugagacuau

SEQ ID NO: 930329 - RNA, 19 nt, Homo sapiens
cugcaaggaucagcauaaa

SEQ ID NO: 930330 - RNA, 19 nt, Homo sapiens
ucaagugauauuugccuua

SEQ ID NO: 930331 - RNA, 19 nt, Homo sapiens
aagcgaaccaagccaauaa

SEQ ID NO: 930332 - RNA, 19 nt, Homo sapiens
agaaagcuccuucaaacug

SEQ ID NO: 930333 - RNA, 19 nt, Homo sapiens
gcaagugagggaaauccaa

SEQ ID NO: 930334 - RNA, 19 nt, Homo sapiens
uccuuugggucucuaauaa

SEQ ID NO: 930335 - RNA, 19 nt, Homo sapiens
caugguguuucaauauaug

SEQ ID NO: 930336 - RNA, 19 nt, Homo sapiens
ugacggauacccaagaugu

SEQ ID NO: 930337 - RNA, 19 nt, Homo sapiens
uacaucagcuuggaguuau

SEQ ID NO: 930338 - RNA, 19 nt, Homo sapiens
ccuuuguccuuuguauuua

SEQ ID NO: 930339 - RNA, 19 nt, Homo sapiens
ggaucagcauaaaguguuc

SEQ ID NO: 930340 - RNA, 19 nt, Homo sapiens
gcauggcuguuggucauuc

SEQ ID NO: 930341 - RNA, 19 nt, Homo sapiens
gaugcugcuuagaguuaaa

SEQ ID NO: 930342 - RNA, 19 nt, Homo sapiens
ccaugaugcugcuuagagu

SEQ ID NO: 930343 - RNA, 19 nt, Homo sapiens
gguaccaucuuagaaccuu

SEQ ID NO: 930344 - RNA, 19 nt, Homo sapiens
ucacucauucuuaguauuc

SEQ ID NO: 930345 - RNA, 19 nt, Homo sapiens
ucaauguccuguucuucau

SEQ ID NO: 930346 - RNA, 19 nt, Homo sapiens
cuccuggucugauuccuuu

SEQ ID NO: 930347 - RNA, 19 nt, Homo sapiens
ggaaggaauaccacagaag

SEQ ID NO: 930348 - RNA, 19 nt, Homo sapiens
guacauuuccucauuuuga

SEQ ID NO: 930349 - RNA, 19 nt, Homo sapiens
ucauggagacagugaacua

SEQ ID NO: 930350 - RNA, 19 nt, Homo sapiens
gaacuccugguaccaucuu

SEQ ID NO: 930351 - RNA, 19 nt, Homo sapiens
cccaaauuauggccaaaga

SEQ ID NO: 930352 - RNA, 19 nt, Homo sapiens
gugagggaaauccaauuaa

SEQ ID NO: 930353 - RNA, 19 nt, Homo sapiens
aagaugaaacuaugcaaug

SEQ ID NO: 930354 - RNA, 19 nt, Homo sapiens
aaaucaagcuaacauaucc

SEQ ID NO: 930355 - RNA, 19 nt, Homo sapiens
gaauggcuaaaucaagcua

SEQ ID NO: 930356 - RNA, 19 nt, Homo sapiens
guuaaacagagcccaggua

SEQ ID NO: 930357 - RNA, 19 nt, Homo sapiens
ucaaacugguugcuauguc

SEQ ID NO: 930358 - RNA, 19 nt, Homo sapiens
ggacuuugagacuauguca

SEQ ID NO: 930359 - RNA, 19 nt, Homo sapiens
uggaaggaauaccacagaa

SEQ ID NO: 930360 - RNA, 19 nt, Homo sapiens
agugagggaaauccaauua

SEQ ID NO: 930361 - RNA, 19 nt, Homo sapiens
cuuugggucucuaauaaug

SEQ ID NO: 930362 - RNA, 19 nt, Homo sapiens
ugccuuaggucagauucua

SEQ ID NO: 930363 - RNA, 19 nt, Homo sapiens
uggcauggcuguuggucau

SEQ ID NO: 930364 - RNA, 19 nt, Homo sapiens
gagacacaacgcaauagug

SEQ ID NO: 930365 - RNA, 19 nt, Homo sapiens
ggagacacaacgcaauagu

SEQ ID NO: 930366 - RNA, 19 nt, Homo sapiens
gaagacaaacuaccaauuu

SEQ ID NO: 930367 - RNA, 19 nt, Homo sapiens
ggaauaccaucccgccuuu

SEQ ID NO: 930368 - RNA, 19 nt, Homo sapiens
gaacaguggcaccaucaua

SEQ ID NO: 930369 - RNA, 19 nt, Homo sapiens
gcacagagacaaaguggaa

SEQ ID NO: 930370 - RNA, 19 nt, Homo sapiens
gcacaguggaauauauaua

SEQ ID NO: 930371 - RNA, 19 nt, Homo sapiens
ggaaagagugguccaugaa

SEQ ID NO: 930372 - RNA, 19 nt, Homo sapiens
ggcaaaaucuugucucuuu

SEQ ID NO: 930373 - RNA, 19 nt, Homo sapiens
gccaagaaguguccagaau

SEQ ID NO: 930374 - RNA, 19 nt, Homo sapiens
gcaacgugcuggccgucua

SEQ ID NO: 930375 - RNA, 19 nt, Homo sapiens
gaaguguccagaauccaua

SEQ ID NO: 930376 - RNA, 19 nt, Homo sapiens
ggaagggcacaguggaaua

SEQ ID NO: 930377 - RNA, 19 nt, Homo sapiens
caguugcucuuccuuguuu

SEQ ID NO: 930378 - RNA, 19 nt, Homo sapiens
ggaagacaaacuaccaauu

SEQ ID NO: 930379 - RNA, 19 nt, Homo sapiens
gcaacaacguguccuucga

SEQ ID NO: 930380 - RNA, 19 nt, Homo sapiens
gcagaagaaugugaaugug

SEQ ID NO: 930381 - RNA, 19 nt, Homo sapiens
gggcacaguggaauauaua

SEQ ID NO: 930382 - RNA, 19 nt, Homo sapiens
aaagagugguccaugaaga

SEQ ID NO: 930383 - RNA, 19 nt, Homo sapiens
gaaggacacacgcugaaga

SEQ ID NO: 930384 - RNA, 19 nt, Homo sapiens
gaagggcacaguggaauau

SEQ ID NO: 930385 - RNA, 19 nt, Homo sapiens
gcagauggacagcaggauu

SEQ ID NO: 930386 - RNA, 19 nt, Homo sapiens
caggauugcucaagaugga

SEQ ID NO: 930387 - RNA, 19 nt, Homo sapiens
gccgugagauccagcaaug

SEQ ID NO: 930388 - RNA, 19 nt, Homo sapiens
cagagugaacgucuugaua

SEQ ID NO: 930389 - RNA, 19 nt, Homo sapiens
ggcgaugguugcagaagaa

SEQ ID NO: 930390 - RNA, 19 nt, Homo sapiens
gcaagggacacgacacuca

SEQ ID NO: 930391 - RNA, 19 nt, Homo sapiens
caguugaggucaggaguuu

SEQ ID NO: 930392 - RNA, 19 nt, Homo sapiens
aaggagaccugcuuugaca

SEQ ID NO: 930393 - RNA, 19 nt, Homo sapiens
caacaacguguccuucgaa

SEQ ID NO: 930394 - RNA, 19 nt, Homo sapiens
caguggcgaugacuuuauu

SEQ ID NO: 930395 - RNA, 19 nt, Homo sapiens
caagaaguguccagaaucc

SEQ ID NO: 930396 - RNA, 19 nt, Homo sapiens
ggaccgacaagacgcauga

SEQ ID NO: 930397 - RNA, 19 nt, Homo sapiens
gaggacacacugaauacaa

SEQ ID NO: 930398 - RNA, 19 nt, Homo sapiens
gugaacagcccuccucaug

SEQ ID NO: 930399 - RNA, 19 nt, Homo sapiens
guacuuagaaagcuuaucu

SEQ ID NO: 930400 - RNA, 19 nt, Homo sapiens
caacguguccuucgaagag

SEQ ID NO: 930401 - RNA, 19 nt, Homo sapiens
ugaauacaauggaauacca

SEQ ID NO: 930402 - RNA, 19 nt, Homo sapiens
aagacaaacuaccaauuuc

SEQ ID NO: 930403 - RNA, 19 nt, Homo sapiens
gaaagagugguccaugaag

SEQ ID NO: 930404 - RNA, 19 nt, Homo sapiens
ggaccauucccgccaagaa

SEQ ID NO: 930405 - RNA, 19 nt, Homo sapiens
uaucuuagagccacacuga

SEQ ID NO: 930406 - RNA, 19 nt, Homo sapiens
ucaggcagcuaugcaguug

SEQ ID NO: 930407 - RNA, 19 nt, Homo sapiens
ucacacugaugcccugguu

SEQ ID NO: 930408 - RNA, 19 nt, Homo sapiens
gauuggaacccgcaaaaua

SEQ ID NO: 930409 - RNA, 19 nt, Homo sapiens
gcagaccacuacaccuucu

SEQ ID NO: 930410 - RNA, 19 nt, Homo sapiens
gaaugugaaugugcccaau

SEQ ID NO: 930411 - RNA, 19 nt, Homo sapiens
gagccacacugagauugga

SEQ ID NO: 930412 - RNA, 19 nt, Homo sapiens
cuuaagcgcugcccagaag

SEQ ID NO: 930413 - RNA, 19 nt, Homo sapiens
ggagaccugcuuugacaug

SEQ ID NO: 930414 - RNA, 19 nt, Homo sapiens
gaugguugcagaagaaugu

SEQ ID NO: 930415 - RNA, 19 nt, Homo sapiens
gagaacaguggcaccauca

SEQ ID NO: 930416 - RNA, 19 nt, Homo sapiens
ggugaccgccuacaucuuc

SEQ ID NO: 930417 - RNA, 19 nt, Homo sapiens
gcaacaggagggagcuuga

SEQ ID NO: 930418 - RNA, 19 nt, Homo sapiens
gaucugggucugccgcaaa

SEQ ID NO: 930419 - RNA, 19 nt, Homo sapiens
gugcaggauugcucaagau

SEQ ID NO: 930420 - RNA, 19 nt, Homo sapiens
gcagugcucacgccuguca

SEQ ID NO: 930421 - RNA, 19 nt, Homo sapiens
guugucaucuuccuagucu

SEQ ID NO: 930422 - RNA, 19 nt, Homo sapiens
acaaggagaccugcuuuga

SEQ ID NO: 930423 - RNA, 19 nt, Homo sapiens
gagugaacgucuugauagg

SEQ ID NO: 930424 - RNA, 19 nt, Homo sapiens
ggacacacugaauacaaug

SEQ ID NO: 930425 - RNA, 19 nt, Homo sapiens
gcuuugacaugcugcagau

SEQ ID NO: 930426 - RNA, 19 nt, Homo sapiens
caaggugaccgccuacauc

SEQ ID NO: 930427 - RNA, 19 nt, Homo sapiens
gugaaugugcccaaugcua

SEQ ID NO: 930428 - RNA, 19 nt, Homo sapiens
gagacgggaggaucaguug

SEQ ID NO: 930429 - RNA, 19 nt, Homo sapiens
gcaguugcucuuccuuguu

SEQ ID NO: 930430 - RNA, 19 nt, Homo sapiens
cugcaaagaggcugauuga

SEQ ID NO: 930431 - RNA, 19 nt, Homo sapiens
cagguucaccguuggcuuu

SEQ ID NO: 930432 - RNA, 19 nt, Homo sapiens
cgccacacgugcaggauug

SEQ ID NO: 930433 - RNA, 19 nt, Homo sapiens
cugcuugucuggcggagaa

SEQ ID NO: 930434 - RNA, 19 nt, Homo sapiens
caaauguccacgcccagaa

SEQ ID NO: 930435 - RNA, 19 nt, Homo sapiens
ggauugccggguacuacua

SEQ ID NO: 930436 - RNA, 19 nt, Homo sapiens
cagauggacagcaggauug

SEQ ID NO: 930437 - RNA, 19 nt, Homo sapiens
gggcagagucuccguuugg

SEQ ID NO: 930438 - RNA, 19 nt, Homo sapiens
guugaggucaggaguuuga

SEQ ID NO: 930439 - RNA, 19 nt, Homo sapiens
aaacuaccaauuucucguu

SEQ ID NO: 930440 - RNA, 19 nt, Homo sapiens
ccaagaaguguccagaauc

SEQ ID NO: 930441 - RNA, 19 nt, Homo sapiens
gcaaggugaccgccuacau

SEQ ID NO: 930442 - RNA, 19 nt, Homo sapiens
caucuccgccugcaucuuc

SEQ ID NO: 930443 - RNA, 19 nt, Homo sapiens
ggaccgccauccucaucuc

SEQ ID NO: 930444 - RNA, 19 nt, Homo sapiens
gaguggagcacgugagaca

SEQ ID NO: 930445 - RNA, 19 nt, Homo sapiens
ccuugagagucaucagaaa

SEQ ID NO: 930446 - RNA, 19 nt, Homo sapiens
gaaugucagugagcaccau

SEQ ID NO: 930447 - RNA, 19 nt, Homo sapiens
agacaaggagaccugcuuu

SEQ ID NO: 930448 - RNA, 19 nt, Homo sapiens
ggaggucacccagcacugu

SEQ ID NO: 930449 - RNA, 19 nt, Homo sapiens
agagugaacgucuugauag

SEQ ID NO: 930450 - RNA, 19 nt, Homo sapiens
ggaaagcagggacgugaac

SEQ ID NO: 930451 - RNA, 19 nt, Homo sapiens
cacucugggucaucuauau

SEQ ID NO: 930452 - RNA, 19 nt, Homo sapiens
cauguacuuagaaagcuua

SEQ ID NO: 930453 - RNA, 19 nt, Homo sapiens
gacaaggagaccugcuuug

SEQ ID NO: 930454 - RNA, 19 nt, Homo sapiens
uaccaucccgccuuugaaa

SEQ ID NO: 930455 - RNA, 19 nt, Homo sapiens
aggacacacugaauacaau

SEQ ID NO: 930456 - RNA, 19 nt, Homo sapiens
ugacauguacuuagaaagc

SEQ ID NO: 930457 - RNA, 19 nt, Homo sapiens
uagaaagcuuaucuuagag

SEQ ID NO: 930458 - RNA, 19 nt, Homo sapiens
cuggaggacacacugaaua

SEQ ID NO: 930459 - RNA, 19 nt, Homo sapiens
cgugcaggauugcucaaga

SEQ ID NO: 930460 - RNA, 19 nt, Homo sapiens
gaaagcagggacgugaaca

SEQ ID NO: 930461 - RNA, 19 nt, Homo sapiens
ccacucugggucaucuaua

SEQ ID NO: 930462 - RNA, 19 nt, Homo sapiens
uggcgaugguugcagaaga

SEQ ID NO: 930463 - RNA, 19 nt, Homo sapiens
gagcaagggacacgacacu

SEQ ID NO: 930464 - RNA, 19 nt, Homo sapiens
ugaacagcccuccucaugu

SEQ ID NO: 930465 - RNA, 19 nt, Homo sapiens
gacaaacuaccaauuucuc

SEQ ID NO: 930466 - RNA, 19 nt, Homo sapiens
ggagagagauagcaagauu

SEQ ID NO: 930467 - RNA, 19 nt, Homo sapiens
ggacaaaccuaccuaucuu

SEQ ID NO: 930468 - RNA, 19 nt, Homo sapiens
cuaccuaucuucaagcuaa

SEQ ID NO: 930469 - RNA, 19 nt, Homo sapiens
ugaggagucuuucaucgaa

SEQ ID NO: 930470 - RNA, 19 nt, Homo sapiens
aaaaugagcuggagagaga

SEQ ID NO: 930471 - RNA, 19 nt, Homo sapiens
gaacgcugccuacacaugu

SEQ ID NO: 930472 - RNA, 19 nt, Homo sapiens
acacuaagccucucucugu

SEQ ID NO: 930473 - RNA, 19 nt, Homo sapiens
aaaccuaccuaucuucaag

SEQ ID NO: 930474 - RNA, 19 nt, Homo sapiens
aaugaacgcugccuacaca

SEQ ID NO: 930475 - RNA, 19 nt, Homo sapiens
ggaaggugcgccaguagga

SEQ ID NO: 930476 - RNA, 19 nt, Homo sapiens
ucgagcaguuuauuaacaa

SEQ ID NO: 930477 - RNA, 19 nt, Homo sapiens
ggacacggcaguagcugau

SEQ ID NO: 930478 - RNA, 19 nt, Homo sapiens
agagauagcaagauuguag

SEQ ID NO: 930479 - RNA, 19 nt, Homo sapiens
guaacuuccuggagaucga

SEQ ID NO: 930480 - RNA, 19 nt, Homo sapiens
cgagcaguuuauuaacaaa

SEQ ID NO: 930481 - RNA, 19 nt, Homo sapiens
ggccucgagcaguuuauua

SEQ ID NO: 930482 - RNA, 19 nt, Homo sapiens
gagagagauagcaagauug

SEQ ID NO: 930483 - RNA, 19 nt, Homo sapiens
gccucgagcaguuuauuaa

SEQ ID NO: 930484 - RNA, 19 nt, Homo sapiens
gcgcuacagugacuuugag

SEQ ID NO: 930485 - RNA, 19 nt, Homo sapiens
gagguucgcaugcggacaa

SEQ ID NO: 930486 - RNA, 19 nt, Homo sapiens
cuaagccucucucugucuu

SEQ ID NO: 930487 - RNA, 19 nt, Homo sapiens
ugaagcggcagcucccuuu

SEQ ID NO: 930488 - RNA, 19 nt, Homo sapiens
caagaggaggcaauugaca

SEQ ID NO: 930489 - RNA, 19 nt, Homo sapiens
uagcaagauuguaguacca

SEQ ID NO: 930490 - RNA, 19 nt, Homo sapiens
agagagauagcaagauugu

SEQ ID NO: 930491 - RNA, 19 nt, Homo sapiens
ugcaagaggaggcaauuga

SEQ ID NO: 930492 - RNA, 19 nt, Homo sapiens
ggaccugaccgacgcuuac

SEQ ID NO: 930493 - RNA, 19 nt, Homo sapiens
aggaggcaauugacaggaa

SEQ ID NO: 930494 - RNA, 19 nt, Homo sapiens
gcaagaggaggcaauugac

SEQ ID NO: 930495 - RNA, 19 nt, Homo sapiens
ggcacccacuggcucagaa

SEQ ID NO: 930496 - RNA, 19 nt, Homo sapiens
ccaccugcccucuacuuuc

SEQ ID NO: 930497 - RNA, 19 nt, Homo sapiens
gaaugaacgcugccuacac

SEQ ID NO: 930498 - RNA, 19 nt, Homo sapiens
gcagggccucgagcaguuu

SEQ ID NO: 930499 - RNA, 19 nt, Homo sapiens
gacaaaccuaccuaucuuc

SEQ ID NO: 930500 - RNA, 19 nt, Homo sapiens
cggacaaaccuaccuaucu

SEQ ID NO: 930501 - RNA, 19 nt, Homo sapiens
ccucuacuuuccugcugaa

SEQ ID NO: 930502 - RNA, 19 nt, Homo sapiens
caaaccuaccuaucuucaa

SEQ ID NO: 930503 - RNA, 19 nt, Homo sapiens
agauagcaagauuguagua

SEQ ID NO: 930504 - RNA, 19 nt, Homo sapiens
gagauagcaagauuguagu

SEQ ID NO: 930505 - RNA, 19 nt, Homo sapiens
gagagauagcaagauugua

SEQ ID NO: 930506 - RNA, 19 nt, Homo sapiens
cccacuggcucagaaugaa

SEQ ID NO: 930507 - RNA, 19 nt, Homo sapiens
cucgagcaguuuauuaaca

SEQ ID NO: 930508 - RNA, 19 nt, Homo sapiens
aagccucucucugucuuug

SEQ ID NO: 930509 - RNA, 19 nt, Homo sapiens
acacggcaguagcugauac

SEQ ID NO: 930510 - RNA, 19 nt, Homo sapiens
acaaaccuaccuaucuuca

SEQ ID NO: 930511 - RNA, 19 nt, Homo sapiens
ggaaaggcuucuugaaauu

SEQ ID NO: 930512 - RNA, 19 nt, Homo sapiens
ugacaacucuguaggauuu

SEQ ID NO: 930513 - RNA, 19 nt, Homo sapiens
gagagacggugauggauaa

SEQ ID NO: 930514 - RNA, 19 nt, Homo sapiens
gggaaaggcuucuugaaau

SEQ ID NO: 930515 - RNA, 19 nt, Homo sapiens
gauaaagcccgucgugaua

SEQ ID NO: 930516 - RNA, 19 nt, Homo sapiens
caaagagccuugagguauu

SEQ ID NO: 930517 - RNA, 19 nt, Homo sapiens
gaaaggcuucuugaaauua

SEQ ID NO: 930518 - RNA, 19 nt, Homo sapiens
gcucagcucugcgaccuua

SEQ ID NO: 930519 - RNA, 19 nt, Homo sapiens
gaguauaugucaaaguguu

SEQ ID NO: 930520 - RNA, 19 nt, Homo sapiens
gcacacaugaugcuggaua

SEQ ID NO: 930521 - RNA, 19 nt, Homo sapiens
gacccuguguucaagguua

SEQ ID NO: 930522 - RNA, 19 nt, Homo sapiens
agacggugauggauaaauu

SEQ ID NO: 930523 - RNA, 19 nt, Homo sapiens
caaguggcauucuuuguca

SEQ ID NO: 930524 - RNA, 19 nt, Homo sapiens
ucaagcaggugacuccauu

SEQ ID NO: 930525 - RNA, 19 nt, Homo sapiens
caaggaagcgauugauuau

SEQ ID NO: 930526 - RNA, 19 nt, Homo sapiens
uuauagagauguugggaaa

SEQ ID NO: 930527 - RNA, 19 nt, Homo sapiens
ucucagcucuacuguguuu

SEQ ID NO: 930528 - RNA, 19 nt, Homo sapiens
gcuaauggaaacaugauuu

SEQ ID NO: 930529 - RNA, 19 nt, Homo sapiens
gcaagcuaauggaaacaug

SEQ ID NO: 930530 - RNA, 19 nt, Homo sapiens
gaagugcugcguuugauuc

SEQ ID NO: 930531 - RNA, 19 nt, Homo sapiens
ggauaaagcccgucgugau

SEQ ID NO: 930532 - RNA, 19 nt, Homo sapiens
uagaggacaugaacgaguu

SEQ ID NO: 930533 - RNA, 19 nt, Homo sapiens
gaaauuacacgugggacuu

SEQ ID NO: 930534 - RNA, 19 nt, Homo sapiens
gagagucaccgcaauuuca

SEQ ID NO: 930535 - RNA, 19 nt, Homo sapiens
cggaguauaugucaaagug

SEQ ID NO: 930536 - RNA, 19 nt, Homo sapiens
ggugauggauaaauugaca

SEQ ID NO: 930537 - RNA, 19 nt, Homo sapiens
guugauugguccacaggua

SEQ ID NO: 930538 - RNA, 19 nt, Homo sapiens
gauaugaccgcgaaaccaa

SEQ ID NO: 930539 - RNA, 19 nt, Homo sapiens
uugauuaucugaccguuga

SEQ ID NO: 930540 - RNA, 19 nt, Homo sapiens
gaugagagucaccgcaauu

SEQ ID NO: 930541 - RNA, 19 nt, Homo sapiens
acaaagagccuugagguau

SEQ ID NO: 930542 - RNA, 19 nt, Homo sapiens
gcccgacagugguuuggua

SEQ ID NO: 930543 - RNA, 19 nt, Homo sapiens
gaugcauucugguaguuga

SEQ ID NO: 930544 - RNA, 19 nt, Homo sapiens
ucuaacugcuuugaacuuu

SEQ ID NO: 930545 - RNA, 19 nt, Homo sapiens
aaagagccuugagguauug

SEQ ID NO: 930546 - RNA, 19 nt, Homo sapiens
cuucucagcucuacugugu

SEQ ID NO: 930547 - RNA, 19 nt, Homo sapiens
gaugcaacuccugcuauua

SEQ ID NO: 930548 - RNA, 19 nt, Homo sapiens
gcuggaagcagaugcauuc

SEQ ID NO: 930549 - RNA, 19 nt, Homo sapiens
aggaagcgauugauuaucu

SEQ ID NO: 930550 - RNA, 19 nt, Homo sapiens
gugcugcguuugauucaug

SEQ ID NO: 930551 - RNA, 19 nt, Homo sapiens
ugauaccacuguagaaagu

SEQ ID NO: 930552 - RNA, 19 nt, Homo sapiens
ggaagcgauugauuaucug

SEQ ID NO: 930553 - RNA, 19 nt, Homo sapiens
ggucaaugcacacaugaug

SEQ ID NO: 930554 - RNA, 19 nt, Homo sapiens
gaaaauucauguccuagag

SEQ ID NO: 930555 - RNA, 19 nt, Homo sapiens
ugggaaaggcuucuugaaa

SEQ ID NO: 930556 - RNA, 19 nt, Homo sapiens
guagaaagugugccugugu

SEQ ID NO: 930557 - RNA, 19 nt, Homo sapiens
cacacaugaugcuggauaa

SEQ ID NO: 930558 - RNA, 19 nt, Homo sapiens
gcauucugguaguugauug

SEQ ID NO: 930559 - RNA, 19 nt, Homo sapiens
uuuaauagauaggcgcuuu

SEQ ID NO: 930560 - RNA, 19 nt, Homo sapiens
gaagcgauugauuaucuga

SEQ ID NO: 930561 - RNA, 19 nt, Homo sapiens
gagaugcaacuccugcuau

SEQ ID NO: 930562 - RNA, 19 nt, Homo sapiens
gcauccagcugugaguaau

SEQ ID NO: 930563 - RNA, 19 nt, Homo sapiens
gacagugguuugguagaga

SEQ ID NO: 930564 - RNA, 19 nt, Homo sapiens
agaugcaacuccugcuauu

SEQ ID NO: 930565 - RNA, 19 nt, Homo sapiens
agagagacggugauggaua

SEQ ID NO: 930566 - RNA, 19 nt, Homo sapiens
uaaauugacaacucuguag

SEQ ID NO: 930567 - RNA, 19 nt, Homo sapiens
gacgaagugcugcguuuga

SEQ ID NO: 930568 - RNA, 19 nt, Homo sapiens
guagagagaaagucaagca

SEQ ID NO: 930569 - RNA, 19 nt, Homo sapiens
gacacgcagggaaggauua

SEQ ID NO: 930570 - RNA, 19 nt, Homo sapiens
gauaaauugacaacucugu

SEQ ID NO: 930571 - RNA, 19 nt, Homo sapiens
ucaacucgcugcuuuucua

SEQ ID NO: 930572 - RNA, 19 nt, Homo sapiens
cgucaaggccaucaaggaa

SEQ ID NO: 930573 - RNA, 19 nt, Homo sapiens
gcaacuccugcuauuaaga

SEQ ID NO: 930574 - RNA, 19 nt, Homo sapiens
gcauucaaucguagccuuu

SEQ ID NO: 930575 - RNA, 19 nt, Homo sapiens
caagcuaauggaaacauga

SEQ ID NO: 930576 - RNA, 19 nt, Homo sapiens
agagagagacggugaugga

SEQ ID NO: 930577 - RNA, 19 nt, Homo sapiens
ggacgaagugcugcguuug

SEQ ID NO: 930578 - RNA, 19 nt, Homo sapiens
gggauaacgaugagaguca

SEQ ID NO: 930579 - RNA, 19 nt, Homo sapiens
gccugugucuccaucagaa

SEQ ID NO: 930580 - RNA, 19 nt, Homo sapiens
cgacagugguuugguagag

SEQ ID NO: 930581 - RNA, 19 nt, Homo sapiens
uuugucaacucgcugcuuu

SEQ ID NO: 930582 - RNA, 19 nt, Homo sapiens
gaguucaccgugcauauuc

SEQ ID NO: 930583 - RNA, 19 nt, Homo sapiens
augcaacuccugcuauuaa

SEQ ID NO: 930584 - RNA, 19 nt, Homo sapiens
gcuuugaacuuuucggauu

SEQ ID NO: 930585 - RNA, 19 nt, Homo sapiens
agccugagcugucuugaag

SEQ ID NO: 930586 - RNA, 19 nt, Homo sapiens
aaucucaaguggcauucuu

SEQ ID NO: 930587 - RNA, 19 nt, Homo sapiens
cgaguucaccgugcauauu

SEQ ID NO: 930588 - RNA, 19 nt, Homo sapiens
gagccuugagguauugaaa

SEQ ID NO: 930589 - RNA, 19 nt, Homo sapiens
gugguuugguagagagaaa

SEQ ID NO: 930590 - RNA, 19 nt, Homo sapiens
ucuguaggauuuacuagca

SEQ ID NO: 930591 - RNA, 19 nt, Homo sapiens
aaaggcuucuugaaauuac

SEQ ID NO: 930592 - RNA, 19 nt, Homo sapiens
ucaaguggcauucuuuguc

SEQ ID NO: 930593 - RNA, 19 nt, Homo sapiens
uggauaaauugacaacucu

SEQ ID NO: 930594 - RNA, 19 nt, Homo sapiens
aggacgaagugcugcguuu

SEQ ID NO: 930595 - RNA, 19 nt, Homo sapiens
uaauagauaggcgcuuuga

SEQ ID NO: 930596 - RNA, 19 nt, Homo sapiens
ugggagcuauggcagcauu

SEQ ID NO: 930597 - RNA, 19 nt, Homo sapiens
gggaaggauuaugcgauca

SEQ ID NO: 930598 - RNA, 19 nt, Homo sapiens
cgugauaccacuguagaaa

SEQ ID NO: 930599 - RNA, 19 nt, Homo sapiens
caccgugcauauucuggaa

SEQ ID NO: 930600 - RNA, 19 nt, Homo sapiens
cauugucagucggaguaua

SEQ ID NO: 930601 - RNA, 19 nt, Homo sapiens
uaacugcuuugaacuuuuc

SEQ ID NO: 930602 - RNA, 19 nt, Homo sapiens
gcguuugauucaugagugu

SEQ ID NO: 930603 - RNA, 19 nt, Homo sapiens
cgaagugcugcguuugauu

SEQ ID NO: 930604 - RNA, 19 nt, Homo sapiens
aacaaagagccuugaggua

SEQ ID NO: 930605 - RNA, 19 nt, Homo sapiens
aagggaagagcauccauga

SEQ ID NO: 930606 - RNA, 19 nt, Homo sapiens
cgaugagagucaccgcaau

SEQ ID NO: 930607 - RNA, 19 nt, Homo sapiens
auuaagacccaaagaccua

SEQ ID NO: 930608 - RNA, 19 nt, Homo sapiens
gacggugauggauaaauug

SEQ ID NO: 930609 - RNA, 19 nt, Homo sapiens
auccagcugugaguaauuu

SEQ ID NO: 930610 - RNA, 19 nt, Homo sapiens
acacgugggacuuuuaaua

SEQ ID NO: 930611 - RNA, 19 nt, Homo sapiens
gagcgaccuuuacuuuaua

SEQ ID NO: 930612 - RNA, 19 nt, Homo sapiens
gcaaaugccuccuguuguc

SEQ ID NO: 930613 - RNA, 19 nt, Homo sapiens
gagcaaaugccuccuguug

SEQ ID NO: 930614 - RNA, 19 nt, Homo sapiens
gcacaccagggaucaauaa

SEQ ID NO: 930615 - RNA, 19 nt, Homo sapiens
gaugaggucuucaccaaag

SEQ ID NO: 930616 - RNA, 19 nt, Homo sapiens
ugagcgaccuuuacuuuau

SEQ ID NO: 930617 - RNA, 19 nt, Homo sapiens
cugcagaccucacccauga

SEQ ID NO: 930618 - RNA, 19 nt, Homo sapiens
gggaaggacuccacuagag

SEQ ID NO: 930619 - RNA, 19 nt, Homo sapiens
ugaagggagugguguuuga

SEQ ID NO: 930620 - RNA, 19 nt, Homo sapiens
gacacuaggugcugaaucu

SEQ ID NO: 930621 - RNA, 19 nt, Homo sapiens
gcccuaaccuggacuucaa

SEQ ID NO: 930622 - RNA, 19 nt, Homo sapiens
ugaccauguucacuuuaua

SEQ ID NO: 930623 - RNA, 19 nt, Homo sapiens
gaccauguucacuuuauaa

SEQ ID NO: 930624 - RNA, 19 nt, Homo sapiens
ccacccagaucugaauaaa

SEQ ID NO: 930625 - RNA, 19 nt, Homo sapiens
ggagugguguuugauguca

SEQ ID NO: 930626 - RNA, 19 nt, Homo sapiens
caaagugggacaccuccua

SEQ ID NO: 930627 - RNA, 19 nt, Homo sapiens
uggaugaggucuucaccaa

SEQ ID NO: 930628 - RNA, 19 nt, Homo sapiens
caccagggaucaauaagag

SEQ ID NO: 930629 - RNA, 19 nt, Homo sapiens
caaaguguacaaagccaaa

SEQ ID NO: 930630 - RNA, 19 nt, Homo sapiens
aaggaugaguucugauguu

SEQ ID NO: 930631 - RNA, 19 nt, Homo sapiens
ugggacaccuccuagaugu

SEQ ID NO: 930632 - RNA, 19 nt, Homo sapiens
gaagacacuaggugcugaa

SEQ ID NO: 930633 - RNA, 19 nt, Homo sapiens
ucaccaaaguguacaaagc

SEQ ID NO: 930634 - RNA, 19 nt, Homo sapiens
ggaugaggucuucaccaaa

SEQ ID NO: 930635 - RNA, 19 nt, Homo sapiens
gaugucaccuccggaaagg

SEQ ID NO: 930636 - RNA, 19 nt, Homo sapiens
ucaaggaugaguucugaug

SEQ ID NO: 930637 - RNA, 19 nt, Homo sapiens
ccuccuagaugucaguauc

SEQ ID NO: 930638 - RNA, 19 nt, Homo sapiens
gcagaccucacccaugaca

SEQ ID NO: 930639 - RNA, 19 nt, Homo sapiens
uuugagcgaccuuuacuuu

SEQ ID NO: 930640 - RNA, 19 nt, Homo sapiens
gaagggagugguguuugau

SEQ ID NO: 930641 - RNA, 19 nt, Homo sapiens
gagccacccagaucugaau

SEQ ID NO: 930642 - RNA, 19 nt, Homo sapiens
ggugcugaaucuccugcaa

SEQ ID NO: 930643 - RNA, 19 nt, Homo sapiens
caaggaugaguucugaugu

SEQ ID NO: 930644 - RNA, 19 nt, Homo sapiens
uugagcgaccuuuacuuua

SEQ ID NO: 930645 - RNA, 19 nt, Homo sapiens
uggcugggcaguggaauuu

SEQ ID NO: 930646 - RNA, 19 nt, Homo sapiens
acagaugcuuacccuggaa

SEQ ID NO: 930647 - RNA, 19 nt, Homo sapiens
gugcugaaucuccugcaaa

SEQ ID NO: 930648 - RNA, 19 nt, Homo sapiens
ggucuucaccaaaguguac

SEQ ID NO: 930649 - RNA, 19 nt, Homo sapiens
gaauuuugagcgaccuuua

SEQ ID NO: 930650 - RNA, 19 nt, Homo sapiens
acaccagggaucaauaaga

SEQ ID NO: 930651 - RNA, 19 nt, Homo sapiens
ggucagggguucugucuac

SEQ ID NO: 930652 - RNA, 19 nt, Homo sapiens
gaauaaaacagaugcuuac

SEQ ID NO: 930653 - RNA, 19 nt, Homo sapiens
aggaugaguucugauguuc

SEQ ID NO: 930654 - RNA, 19 nt, Homo sapiens
ggaacuggaggcccuggau

SEQ ID NO: 930655 - RNA, 19 nt, Homo sapiens
cgaccuuuacuuuauacuu

SEQ ID NO: 930656 - RNA, 19 nt, Homo sapiens
gaagaccagccccauuuug

SEQ ID NO: 930657 - RNA, 19 nt, Homo sapiens
ccaucuacuuggcagugaa

SEQ ID NO: 930658 - RNA, 19 nt, Homo sapiens
gaucaauaagagccaaagu

SEQ ID NO: 930659 - RNA, 19 nt, Homo sapiens
cuacacugcccggagaauu

SEQ ID NO: 930660 - RNA, 19 nt, Homo sapiens
gugggacaccuccuagaug

SEQ ID NO: 930661 - RNA, 19 nt, Homo sapiens
aaugccuccuguugucuuu

SEQ ID NO: 930662 - RNA, 19 nt, Homo sapiens
gaccucacccaugacacua

SEQ ID NO: 930663 - RNA, 19 nt, Homo sapiens
gaacagaacuugcagcauu

SEQ ID NO: 930664 - RNA, 19 nt, Homo sapiens
gcacugaagcuauaaauua

SEQ ID NO: 930665 - RNA, 19 nt, Homo sapiens
gcacacauaugcuugguua

SEQ ID NO: 930666 - RNA, 19 nt, Homo sapiens
gcagcgagcuucuuccaua

SEQ ID NO: 930667 - RNA, 19 nt, Homo sapiens
caaugcaacugacuuauuu

SEQ ID NO: 930668 - RNA, 19 nt, Homo sapiens
gaacacagcuagcuuuagg

SEQ ID NO: 930669 - RNA, 19 nt, Homo sapiens
cuagaucacucuuccaaua

SEQ ID NO: 930670 - RNA, 19 nt, Homo sapiens
uaagugagaugauuacaga

SEQ ID NO: 930671 - RNA, 19 nt, Homo sapiens
gaauuucucugguaugaug

SEQ ID NO: 930672 - RNA, 19 nt, Homo sapiens
gcaacuggauguguucaua

SEQ ID NO: 930673 - RNA, 19 nt, Homo sapiens
caaagaagauggagagucu

SEQ ID NO: 930674 - RNA, 19 nt, Homo sapiens
gaaggacuaugcugcuauu

SEQ ID NO: 930675 - RNA, 19 nt, Homo sapiens
ggacuaugcugcuauugug

SEQ ID NO: 930676 - RNA, 19 nt, Homo sapiens
caauuaguguuccuugaua

SEQ ID NO: 930677 - RNA, 19 nt, Homo sapiens
gcuggucucugcacacaua

SEQ ID NO: 930678 - RNA, 19 nt, Homo sapiens
gagaaggugugggagcuua

SEQ ID NO: 930679 - RNA, 19 nt, Homo sapiens
agaaagaacuacccauaga

SEQ ID NO: 930680 - RNA, 19 nt, Homo sapiens
uaauugagcaguccauaua

SEQ ID NO: 930681 - RNA, 19 nt, Homo sapiens
gagccuacauggccaaaga

SEQ ID NO: 930682 - RNA, 19 nt, Homo sapiens
gcaaagcaagucaaagaaa

SEQ ID NO: 930683 - RNA, 19 nt, Homo sapiens
gaaguuucuugaagugauu

SEQ ID NO: 930684 - RNA, 19 nt, Homo sapiens
gauagcagaagaucauuaa

SEQ ID NO: 930685 - RNA, 19 nt, Homo sapiens
ucacaagagucuaugcaaa

SEQ ID NO: 930686 - RNA, 19 nt, Homo sapiens
gcaaugcaacugacuuauu

SEQ ID NO: 930687 - RNA, 19 nt, Homo sapiens
gacgagaacccagaaguua

SEQ ID NO: 930688 - RNA, 19 nt, Homo sapiens
gugagaugauuacagauaa

SEQ ID NO: 930689 - RNA, 19 nt, Homo sapiens
ggaaaagacugaagaauac

SEQ ID NO: 930690 - RNA, 19 nt, Homo sapiens
caagaagccuacuuaugga

SEQ ID NO: 930691 - RNA, 19 nt, Homo sapiens
gaacccagaaguuaugauu

SEQ ID NO: 930692 - RNA, 19 nt, Homo sapiens
gcacggauggugacaacua

SEQ ID NO: 930693 - RNA, 19 nt, Homo sapiens
ggacaaacuaugugaaugu

SEQ ID NO: 930694 - RNA, 19 nt, Homo sapiens
ccacagaaacaaauacaaa

SEQ ID NO: 930695 - RNA, 19 nt, Homo sapiens
gcuaaguccugguaugaug

SEQ ID NO: 930696 - RNA, 19 nt, Homo sapiens
ucaagaagccuacuuaugg

SEQ ID NO: 930697 - RNA, 19 nt, Homo sapiens
agaugaagaugaagaaaug

SEQ ID NO: 930698 - RNA, 19 nt, Homo sapiens
acagcuagcuuuaggaaga

SEQ ID NO: 930699 - RNA, 19 nt, Homo sapiens
gcaugaacauccugaucaa

SEQ ID NO: 930700 - RNA, 19 nt, Homo sapiens
gaucuuuccuuuccuucaa

SEQ ID NO: 930701 - RNA, 19 nt, Homo sapiens
gcaguucuucucauagaua

SEQ ID NO: 930702 - RNA, 19 nt, Homo sapiens
cuggauggcuauucagaua

SEQ ID NO: 930703 - RNA, 19 nt, Homo sapiens
ccagaaagccaauuagugu

SEQ ID NO: 930704 - RNA, 19 nt, Homo sapiens
ucucauagauagcuguauu

SEQ ID NO: 930705 - RNA, 19 nt, Homo sapiens
cagcaaagcaagucaaaga

SEQ ID NO: 930706 - RNA, 19 nt, Homo sapiens
ucaaaggacuguggcuauu

SEQ ID NO: 930707 - RNA, 19 nt, Homo sapiens
cagaggcacuucaacauca

SEQ ID NO: 930708 - RNA, 19 nt, Homo sapiens
gaagacugcucaucaaaau

SEQ ID NO: 930709 - RNA, 19 nt, Homo sapiens
caauagaucuuuccuuucc

SEQ ID NO: 930710 - RNA, 19 nt, Homo sapiens
gcagaaaucaauagaucuu

SEQ ID NO: 930711 - RNA, 19 nt, Homo sapiens
gccaaugccucaggguaua

SEQ ID NO: 930712 - RNA, 19 nt, Homo sapiens
gaaagaacuacccauagau

SEQ ID NO: 930713 - RNA, 19 nt, Homo sapiens
caaaguacaccuucuucaa

SEQ ID NO: 930714 - RNA, 19 nt, Homo sapiens
uuacuugcaugcauucauu

SEQ ID NO: 930715 - RNA, 19 nt, Homo sapiens
agacagaaagcucagauuu

SEQ ID NO: 930716 - RNA, 19 nt, Homo sapiens
aggcaaacgcuauaaauuu

SEQ ID NO: 930717 - RNA, 19 nt, Homo sapiens
guucauagccaccagcaaa

SEQ ID NO: 930718 - RNA, 19 nt, Homo sapiens
cagggcagcuuaccucuuc

SEQ ID NO: 930719 - RNA, 19 nt, Homo sapiens
gauggagagucuaaaauuu

SEQ ID NO: 930720 - RNA, 19 nt, Homo sapiens
acagaaagaacuacccaua

SEQ ID NO: 930721 - RNA, 19 nt, Homo sapiens
cagcgagcuucuuccauaa

SEQ ID NO: 930722 - RNA, 19 nt, Homo sapiens
caaagcaagucaaagaaaa

SEQ ID NO: 930723 - RNA, 19 nt, Homo sapiens
cagcuuaccucuucauagg

SEQ ID NO: 930724 - RNA, 19 nt, Homo sapiens
acagaagacugcucaucaa

SEQ ID NO: 930725 - RNA, 19 nt, Homo sapiens
ccaaacaaguucugaccau

SEQ ID NO: 930726 - RNA, 19 nt, Homo sapiens
uucaauaccugcacaauca

SEQ ID NO: 930727 - RNA, 19 nt, Homo sapiens
ggaaguauuuggcauugcu

SEQ ID NO: 930728 - RNA, 19 nt, Homo sapiens
gaagauauuuugacacaag

SEQ ID NO: 930729 - RNA, 19 nt, Homo sapiens
gcaggcaaacgcuauaaau

SEQ ID NO: 930730 - RNA, 19 nt, Homo sapiens
gaagaauguucagaggaau

SEQ ID NO: 930731 - RNA, 19 nt, Homo sapiens
acccauagaugaagaugaa

SEQ ID NO: 930732 - RNA, 19 nt, Homo sapiens
gcgagcuucuuccauaaug

SEQ ID NO: 930733 - RNA, 19 nt, Homo sapiens
gaucaaaggauggagaaau

SEQ ID NO: 930734 - RNA, 19 nt, Homo sapiens
gcauuuauguauagaacca

SEQ ID NO: 930735 - RNA, 19 nt, Homo sapiens
cuaguugguuggugaaaga

SEQ ID NO: 930736 - RNA, 19 nt, Homo sapiens
gaaggugugggagcuuaua

SEQ ID NO: 930737 - RNA, 19 nt, Homo sapiens
agauaaauguugcuaaguc

SEQ ID NO: 930738 - RNA, 19 nt, Homo sapiens
uauggcagcuacaccacua

SEQ ID NO: 930739 - RNA, 19 nt, Homo sapiens
gcaagacacaacaggagaa

SEQ ID NO: 930740 - RNA, 19 nt, Homo sapiens
gcuuaugacuucuuguaca

SEQ ID NO: 930741 - RNA, 19 nt, Homo sapiens
guauacucauguugaaaga

SEQ ID NO: 930742 - RNA, 19 nt, Homo sapiens
cuauagauguucagagcuu

SEQ ID NO: 930743 - RNA, 19 nt, Homo sapiens
cugcagaaaucaauagauc

SEQ ID NO: 930744 - RNA, 19 nt, Homo sapiens
cuauugcggacucaaauua

SEQ ID NO: 930745 - RNA, 19 nt, Homo sapiens
gaaucaaggauaucuucaa

SEQ ID NO: 930746 - RNA, 19 nt, Homo sapiens
uauuuggcauugcuaauug

SEQ ID NO: 930747 - RNA, 19 nt, Homo sapiens
gaugcugucccugauauuu

SEQ ID NO: 930748 - RNA, 19 nt, Homo sapiens
aacagaacuugcagcauuu

SEQ ID NO: 930749 - RNA, 19 nt, Homo sapiens
gggacaaacuaugugaaug

SEQ ID NO: 930750 - RNA, 19 nt, Homo sapiens
gccaauuaguguuccuuga

SEQ ID NO: 930751 - RNA, 19 nt, Homo sapiens
agacacaacaggagaaguu

SEQ ID NO: 930752 - RNA, 19 nt, Homo sapiens
ggaauucagccaucaagag

SEQ ID NO: 930753 - RNA, 19 nt, Homo sapiens
aucaaaggauggagaaauu

SEQ ID NO: 930754 - RNA, 19 nt, Homo sapiens
ggauggcucccucuaugaa

SEQ ID NO: 930755 - RNA, 19 nt, Homo sapiens
guauuuggcauugcuaauu

SEQ ID NO: 930756 - RNA, 19 nt, Homo sapiens
gaagaugaagaaaugaaag

SEQ ID NO: 930757 - RNA, 19 nt, Homo sapiens
gaacuacccauagaugaag

SEQ ID NO: 930758 - RNA, 19 nt, Homo sapiens
acagaaagcucagauuuug

SEQ ID NO: 930759 - RNA, 19 nt, Homo sapiens
ggaggccauugacaggauu

SEQ ID NO: 930760 - RNA, 19 nt, Homo sapiens
gugaaggacuaugcugcua

SEQ ID NO: 930761 - RNA, 19 nt, Homo sapiens
ucccugaggugaaggacua

SEQ ID NO: 930762 - RNA, 19 nt, Homo sapiens
gagaggagagucccuugga

SEQ ID NO: 930763 - RNA, 19 nt, Homo sapiens
gaacgcaucuucucuaaac

SEQ ID NO: 930764 - RNA, 19 nt, Homo sapiens
agaaagagcugaagaucaa

SEQ ID NO: 930765 - RNA, 19 nt, Homo sapiens
gaaauacuacgccaucaaa

SEQ ID NO: 930766 - RNA, 19 nt, Homo sapiens
gaggcgagcuugccaguga

SEQ ID NO: 930767 - RNA, 19 nt, Homo sapiens
guaauuuccugcccaagaa

SEQ ID NO: 930768 - RNA, 19 nt, Homo sapiens
gaagaucgcagacuuugga

SEQ ID NO: 930769 - RNA, 19 nt, Homo sapiens
ucaaagcacugaagaagca

SEQ ID NO: 930770 - RNA, 19 nt, Homo sapiens
ggacuucgacuuuguguca

SEQ ID NO: 930771 - RNA, 19 nt, Homo sapiens
gggcuugaguucauucaga

SEQ ID NO: 930772 - RNA, 19 nt, Homo sapiens
agaagaagaucauuuacag

SEQ ID NO: 930773 - RNA, 19 nt, Homo sapiens
ccaagaacguggugaaacu

SEQ ID NO: 930774 - RNA, 19 nt, Homo sapiens
gagaagaagaucauuuaca

SEQ ID NO: 930775 - RNA, 19 nt, Homo sapiens
acgagaagaagaucauuua

SEQ ID NO: 930776 - RNA, 19 nt, Homo sapiens
cuacguggcuuguguuguc

SEQ ID NO: 930777 - RNA, 19 nt, Homo sapiens
ggaaauacuacgccaucaa

SEQ ID NO: 930778 - RNA, 19 nt, Homo sapiens
guggugaaacugcuuagua

SEQ ID NO: 930779 - RNA, 19 nt, Homo sapiens
ggaccagaccuuugucauc

SEQ ID NO: 930780 - RNA, 19 nt, Homo sapiens
gcucagccgggacgagaua

SEQ ID NO: 930781 - RNA, 19 nt, Homo sapiens
cuucugcgauccugucauu

SEQ ID NO: 930782 - RNA, 19 nt, Homo sapiens
uucagaagcuccuccagaa

SEQ ID NO: 930783 - RNA, 19 nt, Homo sapiens
aggaacgcaucuucucuaa

SEQ ID NO: 930784 - RNA, 19 nt, Homo sapiens
ggaguccucucagaaacug

SEQ ID NO: 930785 - RNA, 19 nt, Homo sapiens
ggcuugaguucauucagaa

SEQ ID NO: 930786 - RNA, 19 nt, Homo sapiens
cagagugacccgagaguug

SEQ ID NO: 930787 - RNA, 19 nt, Homo sapiens
cagaaagagcugaagauca

SEQ ID NO: 930788 - RNA, 19 nt, Homo sapiens
guggugaccucaugaugca

SEQ ID NO: 930789 - RNA, 19 nt, Homo sapiens
ggaacgcaucuucucuaaa

SEQ ID NO: 930790 - RNA, 19 nt, Homo sapiens
cagaggaagagguguuuga

SEQ ID NO: 930791 - RNA, 19 nt, Homo sapiens
caucaaagcacugaagaag

SEQ ID NO: 930792 - RNA, 19 nt, Homo sapiens
gggaaauacuacgccauca

SEQ ID NO: 930793 - RNA, 19 nt, Homo sapiens
caggaacgcaucuucucua

SEQ ID NO: 930794 - RNA, 19 nt, Homo sapiens
gaacguggugaaacugcuu

SEQ ID NO: 930795 - RNA, 19 nt, Homo sapiens
agaucaagguccagccauu

SEQ ID NO: 930796 - RNA, 19 nt, Homo sapiens
uggugaaacugcuuaguag

SEQ ID NO: 930797 - RNA, 19 nt, Homo sapiens
gaucaagguccagccauuc

SEQ ID NO: 930798 - RNA, 19 nt, Homo sapiens
cagaagcuccuccagaagu

SEQ ID NO: 930799 - RNA, 19 nt, Homo sapiens
gaagcccaccgcccuaaca

SEQ ID NO: 930800 - RNA, 19 nt, Homo sapiens
cccgugagcuggagauugg

SEQ ID NO: 930801 - RNA, 19 nt, Homo sapiens
ggugcuggcugugcuaaag

SEQ ID NO: 930802 - RNA, 19 nt, Homo sapiens
agaagcuccuccagaagug

SEQ ID NO: 930803 - RNA, 19 nt, Homo sapiens
gcuucuacguggcuugugu

SEQ ID NO: 930804 - RNA, 19 nt, Homo sapiens
cugaggcguucgcagauga

SEQ ID NO: 930805 - RNA, 19 nt, Homo sapiens
gcaggaacgcaucuucucu

SEQ ID NO: 930806 - RNA, 19 nt, Homo sapiens
gcagagugacccgagaguu

SEQ ID NO: 930807 - RNA, 19 nt, Homo sapiens
ggauaaccuucugcuggau

SEQ ID NO: 930808 - RNA, 19 nt, Homo sapiens
ucaggacuuccgcugcuua

SEQ ID NO: 930809 - RNA, 19 nt, Homo sapiens
ccagaaagagcugaagauc

SEQ ID NO: 930810 - RNA, 19 nt, Homo sapiens
cacgagaagaagaucauuu

SEQ ID NO: 930811 - RNA, 19 nt, Homo sapiens
ggacuuccgcugcuuagcu

SEQ ID NO: 930812 - RNA, 19 nt, Homo sapiens
caagguccagccauucuuc

SEQ ID NO: 930813 - RNA, 19 nt, Homo sapiens
gacccugccacucccagua

SEQ ID NO: 930814 - RNA, 19 nt, Homo sapiens
caaugccugucaccaacug

SEQ ID NO: 930815 - RNA, 19 nt, Homo sapiens
cgagauagagagccuguac

SEQ ID NO: 930816 - RNA, 19 nt, Homo sapiens
gcaccaaacguccccauau

SEQ ID NO: 930817 - RNA, 19 nt, Homo sapiens
cugcggaccugcgcuacuu

SEQ ID NO: 930818 - RNA, 19 nt, Homo sapiens
uggcguggccuuccugaga

SEQ ID NO: 930819 - RNA, 19 nt, Homo sapiens
ggacuggcggcagcuaugu

SEQ ID NO: 930820 - RNA, 19 nt, Homo sapiens
ccugaagaucgcagacuuu

SEQ ID NO: 930821 - RNA, 19 nt, Homo sapiens
cuccagccaugcccgcuuu

SEQ ID NO: 930822 - RNA, 19 nt, Homo sapiens
gcaggaugccgaggagauc

SEQ ID NO: 930823 - RNA, 19 nt, Homo sapiens
ucugcgauccugucauuga

SEQ ID NO: 930824 - RNA, 19 nt, Homo sapiens
gcgccaagaacguggugaa

SEQ ID NO: 930825 - RNA, 19 nt, Homo sapiens
gaccugaaguuggauaacc

SEQ ID NO: 930826 - RNA, 19 nt, Homo sapiens
auguggagcugaaggugaa

SEQ ID NO: 930827 - RNA, 19 nt, Homo sapiens
caccaaacguccccauaug

SEQ ID NO: 930828 - RNA, 19 nt, Homo sapiens
ggacuggcaugauagguua

SEQ ID NO: 930829 - RNA, 19 nt, Homo sapiens
gaaauugaccuccgguaua

SEQ ID NO: 930830 - RNA, 19 nt, Homo sapiens
gaugugggcucuaauaaau

SEQ ID NO: 930831 - RNA, 19 nt, Homo sapiens
aguaauaccucuaguaguu

SEQ ID NO: 930832 - RNA, 19 nt, Homo sapiens
ucccagagcuaaauaguuu

SEQ ID NO: 930833 - RNA, 19 nt, Homo sapiens
gagaauggauggcagaaag

SEQ ID NO: 930834 - RNA, 19 nt, Homo sapiens
gaagguaagugaggugaga

SEQ ID NO: 930835 - RNA, 19 nt, Homo sapiens
gcuccagacuauugaagua

SEQ ID NO: 930836 - RNA, 19 nt, Homo sapiens
gaagucugauucucauguu

SEQ ID NO: 930837 - RNA, 19 nt, Homo sapiens
cgacuagagugaaauugaa

SEQ ID NO: 930838 - RNA, 19 nt, Homo sapiens
gaauauaccaucaaaggau

SEQ ID NO: 930839 - RNA, 19 nt, Homo sapiens
gaaauauuaccuagaccua

SEQ ID NO: 930840 - RNA, 19 nt, Homo sapiens
caacugcuccagacuauug

SEQ ID NO: 930841 - RNA, 19 nt, Homo sapiens
gaagagaugaggaaaauuu

SEQ ID NO: 930842 - RNA, 19 nt, Homo sapiens
gacaacaucagaaagagua

SEQ ID NO: 930843 - RNA, 19 nt, Homo sapiens
ccacagaaacagaaauuga

SEQ ID NO: 930844 - RNA, 19 nt, Homo sapiens
gauuuacauugcacuauga

SEQ ID NO: 930845 - RNA, 19 nt, Homo sapiens
ggacucaagguguuauaaa

SEQ ID NO: 930846 - RNA, 19 nt, Homo sapiens
cgaaggagacauagaagaa

SEQ ID NO: 930847 - RNA, 19 nt, Homo sapiens
aaauugaccuccgguauau

SEQ ID NO: 930848 - RNA, 19 nt, Homo sapiens
cugcuaagcuuaccuguag

SEQ ID NO: 930849 - RNA, 19 nt, Homo sapiens
gcacaaggaaugauugagu

SEQ ID NO: 930850 - RNA, 19 nt, Homo sapiens
gaccuccgguauauauaaa

SEQ ID NO: 930851 - RNA, 19 nt, Homo sapiens
guacugauccauuauccuu

SEQ ID NO: 930852 - RNA, 19 nt, Homo sapiens
ccuccgguauauauaaaua

SEQ ID NO: 930853 - RNA, 19 nt, Homo sapiens
guagggcaguuaccacaga

SEQ ID NO: 930854 - RNA, 19 nt, Homo sapiens
gggagaauuuuaucaagua

SEQ ID NO: 930855 - RNA, 19 nt, Homo sapiens
ugaagacuauggcgaagga

SEQ ID NO: 930856 - RNA, 19 nt, Homo sapiens
cacaaggaaugauugaguu

SEQ ID NO: 930857 - RNA, 19 nt, Homo sapiens
agacauagaagaacgaaga

SEQ ID NO: 930858 - RNA, 19 nt, Homo sapiens
uaauaccucuaguaguuga

SEQ ID NO: 930859 - RNA, 19 nt, Homo sapiens
gaagagguggagacgauga

SEQ ID NO: 930860 - RNA, 19 nt, Homo sapiens
caucaaaggaucaaaucuu

SEQ ID NO: 930861 - RNA, 19 nt, Homo sapiens
uaucaaguaugaagaagag

SEQ ID NO: 930862 - RNA, 19 nt, Homo sapiens
uccaaaguuucaggaauua

SEQ ID NO: 930863 - RNA, 19 nt, Homo sapiens
ggccaguggugaagaacaa

SEQ ID NO: 930864 - RNA, 19 nt, Homo sapiens
ggucgcuuccuacggauua

SEQ ID NO: 930865 - RNA, 19 nt, Homo sapiens
gagggacaauaggaaauau

SEQ ID NO: 930866 - RNA, 19 nt, Homo sapiens
gagcauggccacagcaaag

SEQ ID NO: 930867 - RNA, 19 nt, Homo sapiens
uaguuacaaucccuucuuu

SEQ ID NO: 930868 - RNA, 19 nt, Homo sapiens
ucaaagccaugggagaguu

SEQ ID NO: 930869 - RNA, 19 nt, Homo sapiens
ggaagucugauucucaugu

SEQ ID NO: 930870 - RNA, 19 nt, Homo sapiens
gccaagaacagacuauugu

SEQ ID NO: 930871 - RNA, 19 nt, Homo sapiens
gauagccgaagucuggaua

SEQ ID NO: 930872 - RNA, 19 nt, Homo sapiens
cgaagagcauccucacagu

SEQ ID NO: 930873 - RNA, 19 nt, Homo sapiens
aagaaugccucgacuagag

SEQ ID NO: 930874 - RNA, 19 nt, Homo sapiens
ugugggcucuaauaaauau

SEQ ID NO: 930875 - RNA, 19 nt, Homo sapiens
caauggcuuugcuauggaa

SEQ ID NO: 930876 - RNA, 19 nt, Homo sapiens
ccaauggcuuugcuaugga

SEQ ID NO: 930877 - RNA, 19 nt, Homo sapiens
gugggaggcuucauccaau

SEQ ID NO: 930878 - RNA, 19 nt, Homo sapiens
guaugcaaaucagcacaaa

SEQ ID NO: 930879 - RNA, 19 nt, Homo sapiens
gugacauucugacauucua

SEQ ID NO: 930880 - RNA, 19 nt, Homo sapiens
aaaggccaguggugaagaa

SEQ ID NO: 930881 - RNA, 19 nt, Homo sapiens
uccauuauccuuugaagaa

SEQ ID NO: 930882 - RNA, 19 nt, Homo sapiens
acgaagagguggagacgau

SEQ ID NO: 930883 - RNA, 19 nt, Homo sapiens
cggauuagacaaaccauga

SEQ ID NO: 930884 - RNA, 19 nt, Homo sapiens
caggacaacaucagaaaga

SEQ ID NO: 930885 - RNA, 19 nt, Homo sapiens
ugaccuccgguauauauaa

SEQ ID NO: 930886 - RNA, 19 nt, Homo sapiens
ggcccguuguuauuaguaa

SEQ ID NO: 930887 - RNA, 19 nt, Homo sapiens
ggagaguuuuaauucguua

SEQ ID NO: 930888 - RNA, 19 nt, Homo sapiens
agauuuacauugcacuaug

SEQ ID NO: 930889 - RNA, 19 nt, Homo sapiens
cgagagggacaauaggaaa

SEQ ID NO: 930890 - RNA, 19 nt, Homo sapiens
caggaagucugauucucau

SEQ ID NO: 930891 - RNA, 19 nt, Homo sapiens
gaaaggccaguggugaaga

SEQ ID NO: 930892 - RNA, 19 nt, Homo sapiens
cagaaaggccaguggugaa

SEQ ID NO: 930893 - RNA, 19 nt, Homo sapiens
gugguaacccuacauuuua

SEQ ID NO: 930894 - RNA, 19 nt, Homo sapiens
gauccauuauccuuugaag

SEQ ID NO: 930895 - RNA, 19 nt, Homo sapiens
ggccaagaacagacuauug

SEQ ID NO: 930896 - RNA, 19 nt, Homo sapiens
uuaccuagaccuaaaggaa

SEQ ID NO: 930897 - RNA, 19 nt, Homo sapiens
gacucaagguguuauaaaa

SEQ ID NO: 930898 - RNA, 19 nt, Homo sapiens
uuacgggaauuccaaccuu

SEQ ID NO: 930899 - RNA, 19 nt, Homo sapiens
caacagccauaaagaaaag

SEQ ID NO: 930900 - RNA, 19 nt, Homo sapiens
gaagaagagaugaggaaaa

SEQ ID NO: 930901 - RNA, 19 nt, Homo sapiens
ggacaacaucagaaagagu

SEQ ID NO: 930902 - RNA, 19 nt, Homo sapiens
gcgaaggagacauagaaga

SEQ ID NO: 930903 - RNA, 19 nt, Homo sapiens
gcuuugcuauggaaaucuu

SEQ ID NO: 930904 - RNA, 19 nt, Homo sapiens
caagaaugccucgacuaga

SEQ ID NO: 930905 - RNA, 19 nt, Homo sapiens
ugcaacagccauaaagaaa

SEQ ID NO: 930906 - RNA, 19 nt, Homo sapiens
ggacaagguuuggggagaa

SEQ ID NO: 930907 - RNA, 19 nt, Homo sapiens
ugaugugggcucuaauaaa

SEQ ID NO: 930908 - RNA, 19 nt, Homo sapiens
gagagggacaauaggaaau

SEQ ID NO: 930909 - RNA, 19 nt, Homo sapiens
uccaauggcuuugcuaugg

SEQ ID NO: 930910 - RNA, 19 nt, Homo sapiens
gggacuucaucgagcacua

SEQ ID NO: 930911 - RNA, 19 nt, Homo sapiens
caaguagacguauauuguc

SEQ ID NO: 930912 - RNA, 19 nt, Homo sapiens
aaguacaaguagacguaua

SEQ ID NO: 930913 - RNA, 19 nt, Homo sapiens
gacauucugacauucuaaa

SEQ ID NO: 930914 - RNA, 19 nt, Homo sapiens
ggacuucaucgagcacuau

SEQ ID NO: 930915 - RNA, 19 nt, Homo sapiens
ggcaggacaacaucagaaa

SEQ ID NO: 930916 - RNA, 19 nt, Homo sapiens
gggacuggcaugauagguu

SEQ ID NO: 930917 - RNA, 19 nt, Homo sapiens
agagggacaauaggaaaua

SEQ ID NO: 930918 - RNA, 19 nt, Homo sapiens
caaagccaugggagaguuu

SEQ ID NO: 930919 - RNA, 19 nt, Homo sapiens
guacaaguagacguauauu

SEQ ID NO: 930920 - RNA, 19 nt, Homo sapiens
guaauaccucuaguaguug

SEQ ID NO: 930921 - RNA, 19 nt, Homo sapiens
acugauccauuauccuuug

SEQ ID NO: 930922 - RNA, 19 nt, Homo sapiens
acaagaaugccucgacuag

SEQ ID NO: 930923 - RNA, 19 nt, Homo sapiens
caaguaugaagaagagaug

SEQ ID NO: 930924 - RNA, 19 nt, Homo sapiens
ucagcugauugaagacuau

SEQ ID NO: 930925 - RNA, 19 nt, Homo sapiens
gcugcuaagcuuaccugua

SEQ ID NO: 930926 - RNA, 19 nt, Homo sapiens
uuaaagauugcaagagguu

SEQ ID NO: 930927 - RNA, 19 nt, Homo sapiens
caacaucagaaagaguaaa

SEQ ID NO: 930928 - RNA, 19 nt, Homo sapiens
gaacaaggauaaugacuuu

SEQ ID NO: 930929 - RNA, 19 nt, Homo sapiens
ggaauucucucucggacua

SEQ ID NO: 930930 - RNA, 19 nt, Homo sapiens
gcacagaaaugcauugacu

SEQ ID NO: 930931 - RNA, 19 nt, Homo sapiens
gaggacaugucuuaucuga

SEQ ID NO: 930932 - RNA, 19 nt, Homo sapiens
ggacaaacaaggacagaaa

SEQ ID NO: 930933 - RNA, 19 nt, Homo sapiens
gauccuggguccugacuuu

SEQ ID NO: 930934 - RNA, 19 nt, Homo sapiens
ccaagggccaauuuaaaua

SEQ ID NO: 930935 - RNA, 19 nt, Homo sapiens
gauaaugacuuugcaucug

SEQ ID NO: 930936 - RNA, 19 nt, Homo sapiens
agaaaugcauugacuggaa

SEQ ID NO: 930937 - RNA, 19 nt, Homo sapiens
gaagaaagaagaggguuau

SEQ ID NO: 930938 - RNA, 19 nt, Homo sapiens
gcacagccaguaaggaauu

SEQ ID NO: 930939 - RNA, 19 nt, Homo sapiens
ggacgaguuucugaccuuu

SEQ ID NO: 930940 - RNA, 19 nt, Homo sapiens
guaaggaauuaaaggacuu

SEQ ID NO: 930941 - RNA, 19 nt, Homo sapiens
acagacaccuccagagaga

SEQ ID NO: 930942 - RNA, 19 nt, Homo sapiens
ggaacaaggauaaugacuu

SEQ ID NO: 930943 - RNA, 19 nt, Homo sapiens
gggccaauuuaaauagaaa

SEQ ID NO: 930944 - RNA, 19 nt, Homo sapiens
cccagugucuguccuauga

SEQ ID NO: 930945 - RNA, 19 nt, Homo sapiens
gugagggucuccuacuuug

SEQ ID NO: 930946 - RNA, 19 nt, Homo sapiens
ggaauuaaaggacuucaag

SEQ ID NO: 930947 - RNA, 19 nt, Homo sapiens
gagagacaaucuucaugca

SEQ ID NO: 930948 - RNA, 19 nt, Homo sapiens
cauccucucugcccucuug

SEQ ID NO: 930949 - RNA, 19 nt, Homo sapiens
ucacuggcgucgauauuuc

SEQ ID NO: 930950 - RNA, 19 nt, Homo sapiens
gggcacagccaguaaggaa

SEQ ID NO: 930951 - RNA, 19 nt, Homo sapiens
guuagcauguuccagaaug

SEQ ID NO: 930952 - RNA, 19 nt, Homo sapiens
gugcagcugucccugaaga

SEQ ID NO: 930953 - RNA, 19 nt, Homo sapiens
ggacacucauggcuccaau

SEQ ID NO: 930954 - RNA, 19 nt, Homo sapiens
ggugagggucuccuacuuu

SEQ ID NO: 930955 - RNA, 19 nt, Homo sapiens
gaccaucugcccucaaguu

SEQ ID NO: 930956 - RNA, 19 nt, Homo sapiens
cuagguuucuucucccaaa

SEQ ID NO: 930957 - RNA, 19 nt, Homo sapiens
ggcucuagaucaacaaugu

SEQ ID NO: 930958 - RNA, 19 nt, Homo sapiens
agacagacaccuccagaga

SEQ ID NO: 930959 - RNA, 19 nt, Homo sapiens
ggagaucaaguucuaugug

SEQ ID NO: 930960 - RNA, 19 nt, Homo sapiens
agcaggagaucaaguucua

SEQ ID NO: 930961 - RNA, 19 nt, Homo sapiens
guccaagggccaauuuaaa

SEQ ID NO: 930962 - RNA, 19 nt, Homo sapiens
agaagaaagaagaggguua

SEQ ID NO: 930963 - RNA, 19 nt, Homo sapiens
gguccugacuuuggauaug

SEQ ID NO: 930964 - RNA, 19 nt, Homo sapiens
auucuucccuggccucuuu

SEQ ID NO: 930965 - RNA, 19 nt, Homo sapiens
gcugcugccuggaggagaa

SEQ ID NO: 930966 - RNA, 19 nt, Homo sapiens
uggaggacaugucuuaucu

SEQ ID NO: 930967 - RNA, 19 nt, Homo sapiens
agacacugaugcagacaug

SEQ ID NO: 930968 - RNA, 19 nt, Homo sapiens
caagggccaauuuaaauag

SEQ ID NO: 930969 - RNA, 19 nt, Homo sapiens
caaucuucaugcacagaaa

SEQ ID NO: 930970 - RNA, 19 nt, Homo sapiens
gggagcaggagaucaaguu

SEQ ID NO: 930971 - RNA, 19 nt, Homo sapiens
ccaaggcugugacacuuac

SEQ ID NO: 930972 - RNA, 19 nt, Homo sapiens
guuggccgcuagacacuga

SEQ ID NO: 930973 - RNA, 19 nt, Homo sapiens
gaaaggggaucagaaacau

SEQ ID NO: 930974 - RNA, 19 nt, Homo sapiens
gaacugugaccgggacaau

SEQ ID NO: 930975 - RNA, 19 nt, Homo sapiens
gcgucgauauuucccuuga

SEQ ID NO: 930976 - RNA, 19 nt, Homo sapiens
ccaguaaggaauuaaagga

SEQ ID NO: 930977 - RNA, 19 nt, Homo sapiens
caaggauaaugacuuugca

SEQ ID NO: 930978 - RNA, 19 nt, Homo sapiens
gcacugcaucuucauugau

SEQ ID NO: 930979 - RNA, 19 nt, Homo sapiens
gcauugacuggaaccguaa

SEQ ID NO: 930980 - RNA, 19 nt, Homo sapiens
gcacaggcaaggugaagag

SEQ ID NO: 930981 - RNA, 19 nt, Homo sapiens
cacagccaguaaggaauua

SEQ ID NO: 930982 - RNA, 19 nt, Homo sapiens
gaaaugaccgcuggaucca

SEQ ID NO: 930983 - RNA, 19 nt, Homo sapiens
ggauaaugacuuugcaucu

SEQ ID NO: 930984 - RNA, 19 nt, Homo sapiens
caaacauccuggccaccau

SEQ ID NO: 930985 - RNA, 19 nt, Homo sapiens
gaaccguaaugugcugaag

SEQ ID NO: 930986 - RNA, 19 nt, Homo sapiens
ggaggcagcccaguuugau

SEQ ID NO: 930987 - RNA, 19 nt, Homo sapiens
cgagaagaaugcaccucau

SEQ ID NO: 930988 - RNA, 19 nt, Homo sapiens
gggaggcagcccaguuuga

SEQ ID NO: 930989 - RNA, 19 nt, Homo sapiens
gagauggaguuuggcuaca

SEQ ID NO: 930990 - RNA, 19 nt, Homo sapiens
auauuucccuugagguuga

SEQ ID NO: 930991 - RNA, 19 nt, Homo sapiens
ggguggaggucuucauggu

SEQ ID NO: 930992 - RNA, 19 nt, Homo sapiens
cuacccaacccgagaagaa

SEQ ID NO: 930993 - RNA, 19 nt, Homo sapiens
ucccagacaugguuaacau

SEQ ID NO: 930994 - RNA, 19 nt, Homo sapiens
ccagagagacaaucuucau

SEQ ID NO: 930995 - RNA, 19 nt, Homo sapiens
aagaagcauuaaugagaug

SEQ ID NO: 930996 - RNA, 19 nt, Homo sapiens
gaucaugacgcccaacacu

SEQ ID NO: 930997 - RNA, 19 nt, Homo sapiens
uguccaagggccaauuuaa

SEQ ID NO: 930998 - RNA, 19 nt, Homo sapiens
caccuggccuccauucucu

SEQ ID NO: 930999 - RNA, 19 nt, Homo sapiens
uggcugaccugcaggacau

SEQ ID NO: 931000 - RNA, 19 nt, Homo sapiens
cgauauuucccuugagguu

SEQ ID NO: 931001 - RNA, 19 nt, Homo sapiens
uccaagggccaauuuaaau

SEQ ID NO: 931002 - RNA, 19 nt, Homo sapiens
ggaaaggggaucagaaaca

SEQ ID NO: 931003 - RNA, 19 nt, Homo sapiens
agagugacaucguggacau

SEQ ID NO: 931004 - RNA, 19 nt, Homo sapiens
ucaugacgcccaacacuca

SEQ ID NO: 931005 - RNA, 19 nt, Homo sapiens
caggacacagggauggaua

SEQ ID NO: 931006 - RNA, 19 nt, Homo sapiens
uccaagagaagaaagaaga

SEQ ID NO: 931007 - RNA, 19 nt, Homo sapiens
ccuccagccuugacuccuu

SEQ ID NO: 931008 - RNA, 19 nt, Homo sapiens
uuaccucacuggcgucgau

SEQ ID NO: 931009 - RNA, 19 nt, Homo sapiens
gcagcugucccugaagaug

SEQ ID NO: 931010 - RNA, 19 nt, Homo sapiens
guccugacuuuggauaugu

SEQ ID NO: 931011 - RNA, 19 nt, Homo sapiens
cuguaugugugcagaguga

SEQ ID NO: 931012 - RNA, 19 nt, Homo sapiens
caggagaucaaguucuaug

SEQ ID NO: 931013 - RNA, 19 nt, Homo sapiens
aagggccaauuuaaauaga

SEQ ID NO: 931014 - RNA, 19 nt, Homo sapiens
ucagcuguguguggacaaa

SEQ ID NO: 931015 - RNA, 19 nt, Homo sapiens
ccaagggugccaacagcuu

SEQ ID NO: 931016 - RNA, 19 nt, Homo sapiens
uggacgaguuucugaccuu

SEQ ID NO: 931017 - RNA, 19 nt, Homo sapiens
ccagggcagugcggaacuu

SEQ ID NO: 931018 - RNA, 19 nt, Homo sapiens
gaacgugcccuuuucugau

SEQ ID NO: 931019 - RNA, 19 nt, Homo sapiens
ugacuggaaccguaaugug

SEQ ID NO: 931020 - RNA, 19 nt, Homo sapiens
acgaguuucugaccuuugu

SEQ ID NO: 931021 - RNA, 19 nt, Homo sapiens
gggcuaucuugcuggugaa

SEQ ID NO: 931022 - RNA, 19 nt, Homo sapiens
cagagagacaaucuucaug

SEQ ID NO: 931023 - RNA, 19 nt, Homo sapiens
gagcaggagaucaaguucu

SEQ ID NO: 931024 - RNA, 19 nt, Homo sapiens
ggagcaggagaucaaguuc

SEQ ID NO: 931025 - RNA, 19 nt, Homo sapiens
cccaaggcugugacacuua

SEQ ID NO: 931026 - RNA, 19 nt, Homo sapiens
agucuuggcacuuugcaaa

SEQ ID NO: 931027 - RNA, 19 nt, Homo sapiens
acaaccaccuggccuccau

SEQ ID NO: 931028 - RNA, 19 nt, Homo sapiens
gaccaaagauugaugagaa

SEQ ID NO: 931029 - RNA, 19 nt, Homo sapiens
gcaaggagaccaaagauug

SEQ ID NO: 931030 - RNA, 19 nt, Homo sapiens
gaaacaggcugcaguugag

SEQ ID NO: 931031 - RNA, 19 nt, Homo sapiens
ggaaugggaggccacuuua

SEQ ID NO: 931032 - RNA, 19 nt, Homo sapiens
gcacaccacugagaugcua

SEQ ID NO: 931033 - RNA, 19 nt, Homo sapiens
ccacugagaugcuacagau

SEQ ID NO: 931034 - RNA, 19 nt, Homo sapiens
gaaguuguguaaagccuau

SEQ ID NO: 931035 - RNA, 19 nt, Homo sapiens
caaagaagcagaagcugaa

SEQ ID NO: 931036 - RNA, 19 nt, Homo sapiens
gaagaaacaggcugcaguu

SEQ ID NO: 931037 - RNA, 19 nt, Homo sapiens
gagagaaaguaucuagcuu

SEQ ID NO: 931038 - RNA, 19 nt, Homo sapiens
caagggaaauaccaggaaa

SEQ ID NO: 931039 - RNA, 19 nt, Homo sapiens
ggaaagagaagcccagaca

SEQ ID NO: 931040 - RNA, 19 nt, Homo sapiens
ggagaacagggcaacauuu

SEQ ID NO: 931041 - RNA, 19 nt, Homo sapiens
ccaaagagcuguagaaaac

SEQ ID NO: 931042 - RNA, 19 nt, Homo sapiens
ggaccaggguggcugugaa

SEQ ID NO: 931043 - RNA, 19 nt, Homo sapiens
ccagugcccucacaguuga

SEQ ID NO: 931044 - RNA, 19 nt, Homo sapiens
gugauuggcaggauguuua

SEQ ID NO: 931045 - RNA, 19 nt, Homo sapiens
acaaacagcagaugaguug

SEQ ID NO: 931046 - RNA, 19 nt, Homo sapiens
aaagagaagcccagacaaa

SEQ ID NO: 931047 - RNA, 19 nt, Homo sapiens
gaaaagggaggacuuggua

SEQ ID NO: 931048 - RNA, 19 nt, Homo sapiens
gagaacagggcaacauuuc

SEQ ID NO: 931049 - RNA, 19 nt, Homo sapiens
caggugcacuggccuuuga

SEQ ID NO: 931050 - RNA, 19 nt, Homo sapiens
caaggagaccaaagauuga

SEQ ID NO: 931051 - RNA, 19 nt, Homo sapiens
gaauuucucaacagacuga

SEQ ID NO: 931052 - RNA, 19 nt, Homo sapiens
ggcacaagauaucgacuau

SEQ ID NO: 931053 - RNA, 19 nt, Homo sapiens
gaucaucuacacugcacua

SEQ ID NO: 931054 - RNA, 19 nt, Homo sapiens
gacaagagccaucccaagu

SEQ ID NO: 931055 - RNA, 19 nt, Homo sapiens
caggugaaguuguguaaag

SEQ ID NO: 931056 - RNA, 19 nt, Homo sapiens
gcuccaagagugacuauau

SEQ ID NO: 931057 - RNA, 19 nt, Homo sapiens
uaacucagauggggaauuu

SEQ ID NO: 931058 - RNA, 19 nt, Homo sapiens
caagauaucgacuaugcuu

SEQ ID NO: 931059 - RNA, 19 nt, Homo sapiens
cacaagauaucgacuaugc

SEQ ID NO: 931060 - RNA, 19 nt, Homo sapiens
gaaagagaagcccagacaa

SEQ ID NO: 931061 - RNA, 19 nt, Homo sapiens
cgccacacauucugcuaua

SEQ ID NO: 931062 - RNA, 19 nt, Homo sapiens
ggcggaggcugauggaaug

SEQ ID NO: 931063 - RNA, 19 nt, Homo sapiens
ggagaccaaagauugauga

SEQ ID NO: 931064 - RNA, 19 nt, Homo sapiens
ggaggcaggagagaaagua

SEQ ID NO: 931065 - RNA, 19 nt, Homo sapiens
gggaauuucucaacagacu

SEQ ID NO: 931066 - RNA, 19 nt, Homo sapiens
gcaaugcuuccauaacugu

SEQ ID NO: 931067 - RNA, 19 nt, Homo sapiens
ccugggaagugauuguaaa

SEQ ID NO: 931068 - RNA, 19 nt, Homo sapiens
ccaaguccaaggccaagua

SEQ ID NO: 931069 - RNA, 19 nt, Homo sapiens
agaaacaggcugcaguuga

SEQ ID NO: 931070 - RNA, 19 nt, Homo sapiens
gcugugaagggaagucuuu

SEQ ID NO: 931071 - RNA, 19 nt, Homo sapiens
gcagauacagggugauugg

SEQ ID NO: 931072 - RNA, 19 nt, Homo sapiens
cugacaaacuccgagauaa

SEQ ID NO: 931073 - RNA, 19 nt, Homo sapiens
ggucggacaccaauuguuc

SEQ ID NO: 931074 - RNA, 19 nt, Homo sapiens
cagacugaaccgcuucuua

SEQ ID NO: 931075 - RNA, 19 nt, Homo sapiens
ggaggcugauggaaugcuu

SEQ ID NO: 931076 - RNA, 19 nt, Homo sapiens
aagaggugcuggagaggaa

SEQ ID NO: 931077 - RNA, 19 nt, Homo sapiens
gggagaacagggcaacauu

SEQ ID NO: 931078 - RNA, 19 nt, Homo sapiens
caaguaggcucgggagaac

SEQ ID NO: 931079 - RNA, 19 nt, Homo sapiens
gggccacccuuccugacaa

SEQ ID NO: 931080 - RNA, 19 nt, Homo sapiens
uacuggagcuggcacaaga

SEQ ID NO: 931081 - RNA, 19 nt, Homo sapiens
gacaugccguugaccuugu

SEQ ID NO: 931082 - RNA, 19 nt, Homo sapiens
aaugugguaucacguagaa

SEQ ID NO: 931083 - RNA, 19 nt, Homo sapiens
ggagagaaaguaucuagcu

SEQ ID NO: 931084 - RNA, 19 nt, Homo sapiens
ccaaguaggcucgggagaa

SEQ ID NO: 931085 - RNA, 19 nt, Homo sapiens
aaacuccgagauaagcuua

SEQ ID NO: 931086 - RNA, 19 nt, Homo sapiens
guaucuagcuuuguguuac

SEQ ID NO: 931087 - RNA, 19 nt, Homo sapiens
ucaggaggcaggagagaaa

SEQ ID NO: 931088 - RNA, 19 nt, Homo sapiens
gacuauaucaccagaguuc

SEQ ID NO: 931089 - RNA, 19 nt, Homo sapiens
gaacagggcaacauuuccu

SEQ ID NO: 931090 - RNA, 19 nt, Homo sapiens
ccugacaaacuccgagaua

SEQ ID NO: 931091 - RNA, 19 nt, Homo sapiens
cguagaaacgugaaucaga

SEQ ID NO: 931092 - RNA, 19 nt, Homo sapiens
gcagagauucgaggacaug

SEQ ID NO: 931093 - RNA, 19 nt, Homo sapiens
agcagaagcugaagaaggu

SEQ ID NO: 931094 - RNA, 19 nt, Homo sapiens
ccagacaaacagcagauga

SEQ ID NO: 931095 - RNA, 19 nt, Homo sapiens
ggaaacgccacacauucug

SEQ ID NO: 931096 - RNA, 19 nt, Homo sapiens
agacugaaccgcuucuuag

SEQ ID NO: 931097 - RNA, 19 nt, Homo sapiens
agaagcagaagcugaagaa

SEQ ID NO: 931098 - RNA, 19 nt, Homo sapiens
ggagcuggcacaagauauc

SEQ ID NO: 931099 - RNA, 19 nt, Homo sapiens
gugaagggaagucuuuguu

SEQ ID NO: 931100 - RNA, 19 nt, Homo sapiens
gccagugcccucacaguug

SEQ ID NO: 931101 - RNA, 19 nt, Homo sapiens
ggacuuucagcaaccaaga

SEQ ID NO: 931102 - RNA, 19 nt, Homo sapiens
gacaaacagcagaugaguu

SEQ ID NO: 931103 - RNA, 19 nt, Homo sapiens
ggccacccuuccugacaaa

SEQ ID NO: 931104 - RNA, 19 nt, Homo sapiens
gaacuaagaguguuuucug

SEQ ID NO: 931105 - RNA, 19 nt, Homo sapiens
ugaagggaagucuuuguug

SEQ ID NO: 931106 - RNA, 19 nt, Homo sapiens
gagaagcccagacaaacag

SEQ ID NO: 931107 - RNA, 19 nt, Homo sapiens
ggcggaccgugucagauau

SEQ ID NO: 931108 - RNA, 19 nt, Homo sapiens
ggaggacuugguaggguuu

SEQ ID NO: 931109 - RNA, 19 nt, Homo sapiens
ggccagugcccucacaguu

SEQ ID NO: 931110 - RNA, 19 nt, Homo sapiens
gggcagauacagggugauu

SEQ ID NO: 931111 - RNA, 19 nt, Homo sapiens
ugacaaacuccgagauaag

SEQ ID NO: 931112 - RNA, 19 nt, Homo sapiens
aggcggaccgugucagaua

SEQ ID NO: 931113 - RNA, 19 nt, Homo sapiens
ggcaaggagaccaaagauu

SEQ ID NO: 931114 - RNA, 19 nt, Homo sapiens
caggguccaucccgucuuc

SEQ ID NO: 931115 - RNA, 19 nt, Homo sapiens
cgaggacuguggcgaggau

SEQ ID NO: 931116 - RNA, 19 nt, Homo sapiens
ccaagggaaauaccaggaa

SEQ ID NO: 931117 - RNA, 19 nt, Homo sapiens
guggagagccauaaaauug

SEQ ID NO: 931118 - RNA, 19 nt, Homo sapiens
ggaccuguggagagccaua

SEQ ID NO: 931119 - RNA, 19 nt, Homo sapiens
ggcuugagcacaccacuga

SEQ ID NO: 931120 - RNA, 19 nt, Homo sapiens
agauaucgacuaugcuuug

SEQ ID NO: 931121 - RNA, 19 nt, Homo sapiens
cuagcuuuguguuacguuu

SEQ ID NO: 931122 - RNA, 19 nt, Homo sapiens
caaauguuguaccgagaac

SEQ ID NO: 931123 - RNA, 19 nt, Homo sapiens
ggacuuugagcugaacaug

SEQ ID NO: 931124 - RNA, 19 nt, Homo sapiens
ugguaaagcagaagaaaca

SEQ ID NO: 931125 - RNA, 19 nt, Homo sapiens
gaaugggaggccacuuuag

SEQ ID NO: 931126 - RNA, 19 nt, Homo sapiens
caggagagaaaguaucuag

SEQ ID NO: 931127 - RNA, 19 nt, Homo sapiens
gacugaaccgcuucuuaga

SEQ ID NO: 931128 - RNA, 19 nt, Homo sapiens
ggaggaagcucuggauuua

SEQ ID NO: 931129 - RNA, 19 nt, Homo sapiens
ggacauagaugaugaaugg

SEQ ID NO: 931130 - RNA, 19 nt, Homo sapiens
gaagaagcaucuacaguug

SEQ ID NO: 931131 - RNA, 19 nt, Homo sapiens
caacacagcuggcgagguu

SEQ ID NO: 931132 - RNA, 19 nt, Homo sapiens
gaaaggaggugacgugucu

SEQ ID NO: 931133 - RNA, 19 nt, Homo sapiens
ugaauaagaugacucagaa

SEQ ID NO: 931134 - RNA, 19 nt, Homo sapiens
ccagaaaguuuacucauau

SEQ ID NO: 931135 - RNA, 19 nt, Homo sapiens
gccagaaaguuuacucaua

SEQ ID NO: 931136 - RNA, 19 nt, Homo sapiens
guacuugucuugcauuaug

SEQ ID NO: 931137 - RNA, 19 nt, Homo sapiens
gcaguguucucacaucauu

SEQ ID NO: 931138 - RNA, 19 nt, Homo sapiens
caaaucuucucuuaccuaa

SEQ ID NO: 931139 - RNA, 19 nt, Homo sapiens
gagaagcacuggagauuac

SEQ ID NO: 931140 - RNA, 19 nt, Homo sapiens
gcucaaaucuucgucaugu

SEQ ID NO: 931141 - RNA, 19 nt, Homo sapiens
gaugaacaguguagugcua

SEQ ID NO: 931142 - RNA, 19 nt, Homo sapiens
guaauggacuaauugcuau

SEQ ID NO: 931143 - RNA, 19 nt, Homo sapiens
acacguagauuguucaaau

SEQ ID NO: 931144 - RNA, 19 nt, Homo sapiens
aaacuaaucuguuguacuc

SEQ ID NO: 931145 - RNA, 19 nt, Homo sapiens
ggagacgucaggcuuaaua

SEQ ID NO: 931146 - RNA, 19 nt, Homo sapiens
gaggaugaaucaaaucuuc

SEQ ID NO: 931147 - RNA, 19 nt, Homo sapiens
gcucggagucuuuauuaua

SEQ ID NO: 931148 - RNA, 19 nt, Homo sapiens
caaaauagcagccaccuua

SEQ ID NO: 931149 - RNA, 19 nt, Homo sapiens
ucacagaagucucuaccaa

SEQ ID NO: 931150 - RNA, 19 nt, Homo sapiens
ggucaguacuugaaagaug

SEQ ID NO: 931151 - RNA, 19 nt, Homo sapiens
uaacucggauggccagaaa

SEQ ID NO: 931152 - RNA, 19 nt, Homo sapiens
ggacgugaaggaagagaua

SEQ ID NO: 931153 - RNA, 19 nt, Homo sapiens
cagcagauguaauuggaaa

SEQ ID NO: 931154 - RNA, 19 nt, Homo sapiens
guccuuugcuguuuccuua

SEQ ID NO: 931155 - RNA, 19 nt, Homo sapiens
uaaugcagauggauucuug

SEQ ID NO: 931156 - RNA, 19 nt, Homo sapiens
guguuaagcucaaaucuuc

SEQ ID NO: 931157 - RNA, 19 nt, Homo sapiens
ugaaagaguuggucaguac

SEQ ID NO: 931158 - RNA, 19 nt, Homo sapiens
ucacauuuguugcugaauu

SEQ ID NO: 931159 - RNA, 19 nt, Homo sapiens
ggucauaagucauuuacag

SEQ ID NO: 931160 - RNA, 19 nt, Homo sapiens
uaagaugacucagaaagau

SEQ ID NO: 931161 - RNA, 19 nt, Homo sapiens
uaacugcuguggguucuuu

SEQ ID NO: 931162 - RNA, 19 nt, Homo sapiens
gcuugaaacuaaucuguug

SEQ ID NO: 931163 - RNA, 19 nt, Homo sapiens
gagaccagauggcaaacuu

SEQ ID NO: 931164 - RNA, 19 nt, Homo sapiens
cuacaaggcuagaugaaca

SEQ ID NO: 931165 - RNA, 19 nt, Homo sapiens
cgcuuuagcuccagagaua

SEQ ID NO: 931166 - RNA, 19 nt, Homo sapiens
ggagacauacugauauuuc

SEQ ID NO: 931167 - RNA, 19 nt, Homo sapiens
acagaagucucuaccaaug

SEQ ID NO: 931168 - RNA, 19 nt, Homo sapiens
ggauggaagugacaguaga

SEQ ID NO: 931169 - RNA, 19 nt, Homo sapiens
caagcaaucuguauuccau

SEQ ID NO: 931170 - RNA, 19 nt, Homo sapiens
caaugaggcuccagaccuu

SEQ ID NO: 931171 - RNA, 19 nt, Homo sapiens
gaacuucagacucucuuga

SEQ ID NO: 931172 - RNA, 19 nt, Homo sapiens
aggaagcucuggauuuauu

SEQ ID NO: 931173 - RNA, 19 nt, Homo sapiens
gaggaggaggccaguaaua

SEQ ID NO: 931174 - RNA, 19 nt, Homo sapiens
gaaauggacauagaugaug

SEQ ID NO: 931175 - RNA, 19 nt, Homo sapiens
gccuuugucuuuaguauau

SEQ ID NO: 931176 - RNA, 19 nt, Homo sapiens
uuaaggagacauacugaua

SEQ ID NO: 931177 - RNA, 19 nt, Homo sapiens
aaaggcggauggagaauau

SEQ ID NO: 931178 - RNA, 19 nt, Homo sapiens
gcagccaccuuaaagaaag

SEQ ID NO: 931179 - RNA, 19 nt, Homo sapiens
caaggcaaaugaacuucuu

SEQ ID NO: 931180 - RNA, 19 nt, Homo sapiens
ccauuugagugaauugaaa

SEQ ID NO: 931181 - RNA, 19 nt, Homo sapiens
cuccagagauagucauuaa

SEQ ID NO: 931182 - RNA, 19 nt, Homo sapiens
guucaugcacuugcuauua

SEQ ID NO: 931183 - RNA, 19 nt, Homo sapiens
gaaaggacacaaccacauc

SEQ ID NO: 931184 - RNA, 19 nt, Homo sapiens
gauagucauuaaaguggaa

SEQ ID NO: 931185 - RNA, 19 nt, Homo sapiens
ccagcugccuuugucuuua

SEQ ID NO: 931186 - RNA, 19 nt, Homo sapiens
cacauuuguugcugaauuu

SEQ ID NO: 931187 - RNA, 19 nt, Homo sapiens
gggaagaaauacuaaugca

SEQ ID NO: 931188 - RNA, 19 nt, Homo sapiens
agaagaagcaucuacaguu

SEQ ID NO: 931189 - RNA, 19 nt, Homo sapiens
gaaucaagcaaucuguauu

SEQ ID NO: 931190 - RNA, 19 nt, Homo sapiens
guggcaauguugagaauga

SEQ ID NO: 931191 - RNA, 19 nt, Homo sapiens
ugaagcaugggaagaaaua

SEQ ID NO: 931192 - RNA, 19 nt, Homo sapiens
aaauggacauagaugauga

SEQ ID NO: 931193 - RNA, 19 nt, Homo sapiens
gcauuauguuuaucaagug

SEQ ID NO: 931194 - RNA, 19 nt, Homo sapiens
ccaguuuccuguaugcauu

SEQ ID NO: 931195 - RNA, 19 nt, Homo sapiens
agaagcaucuacaguuguu

SEQ ID NO: 931196 - RNA, 19 nt, Homo sapiens
gcuuuaugcuuauggaaug

SEQ ID NO: 931197 - RNA, 19 nt, Homo sapiens
ugguaugacuuucuucaaa

SEQ ID NO: 931198 - RNA, 19 nt, Homo sapiens
uuugggagcuuuacauaug

SEQ ID NO: 931199 - RNA, 19 nt, Homo sapiens
aaggagacauacugauauu

SEQ ID NO: 931200 - RNA, 19 nt, Homo sapiens
gucaguacuugaaagauga

SEQ ID NO: 931201 - RNA, 19 nt, Homo sapiens
caugugagaguauuugaaa

SEQ ID NO: 931202 - RNA, 19 nt, Homo sapiens
gagacauacugauauuucu

SEQ ID NO: 931203 - RNA, 19 nt, Homo sapiens
gccagcagauguaauugga

SEQ ID NO: 931204 - RNA, 19 nt, Homo sapiens
gaaagaugaagaugaugau

SEQ ID NO: 931205 - RNA, 19 nt, Homo sapiens
ugaaagaugaagaugauga

SEQ ID NO: 931206 - RNA, 19 nt, Homo sapiens
auaugaaccucuuggacua

SEQ ID NO: 931207 - RNA, 19 nt, Homo sapiens
ggaaaggacacaaccacau

SEQ ID NO: 931208 - RNA, 19 nt, Homo sapiens
ccaaguuugugcagggaaa

SEQ ID NO: 931209 - RNA, 19 nt, Homo sapiens
cuaaucuguuguacucuuu

SEQ ID NO: 931210 - RNA, 19 nt, Homo sapiens
gcacuggagauuacuggaa

SEQ ID NO: 931211 - RNA, 19 nt, Homo sapiens
uuacauaugccacaacaga

SEQ ID NO: 931212 - RNA, 19 nt, Homo sapiens
uaaggagacauacugauau

SEQ ID NO: 931213 - RNA, 19 nt, Homo sapiens
cuugaaagaugaagaugau

SEQ ID NO: 931214 - RNA, 19 nt, Homo sapiens
gacagaagaccaugugcuu

SEQ ID NO: 931215 - RNA, 19 nt, Homo sapiens
ucaaaucuucgucauguga

SEQ ID NO: 931216 - RNA, 19 nt, Homo sapiens
aaaaguguccuguguguua

SEQ ID NO: 931217 - RNA, 19 nt, Homo sapiens
ugagaagcacuggagauua

SEQ ID NO: 931218 - RNA, 19 nt, Homo sapiens
uuguuuagaugcacaguuu

SEQ ID NO: 931219 - RNA, 19 nt, Homo sapiens
aaagccagcagauguaauu

SEQ ID NO: 931220 - RNA, 19 nt, Homo sapiens
ccagugguaugacuuucuu

SEQ ID NO: 931221 - RNA, 19 nt, Homo sapiens
cagacucucuugaugaauc

SEQ ID NO: 931222 - RNA, 19 nt, Homo sapiens
ucauauuucagcucuguua

SEQ ID NO: 931223 - RNA, 19 nt, Homo sapiens
gaacaguguagugcuauuc

SEQ ID NO: 931224 - RNA, 19 nt, Homo sapiens
uguaggacgugaaggaaga

SEQ ID NO: 931225 - RNA, 19 nt, Homo sapiens
gcaaaagccagcagaugua

SEQ ID NO: 931226 - RNA, 19 nt, Homo sapiens
gaugaaucaguuaacagua

SEQ ID NO: 931227 - RNA, 19 nt, Homo sapiens
gacgucaggcuuaauauuc

SEQ ID NO: 931228 - RNA, 19 nt, Homo sapiens
gaaacacucugauuuggaa

SEQ ID NO: 931229 - RNA, 19 nt, Homo sapiens
ggauguaaauucacuguuu

SEQ ID NO: 931230 - RNA, 19 nt, Homo sapiens
ggaaugaacuggaucacau

SEQ ID NO: 931231 - RNA, 19 nt, Homo sapiens
ggaaauugauucucaugga

SEQ ID NO: 931232 - RNA, 19 nt, Homo sapiens
gcaauaggguggaaaccaa

SEQ ID NO: 931233 - RNA, 19 nt, Homo sapiens
gaaauugauucucauggau

SEQ ID NO: 931234 - RNA, 19 nt, Homo sapiens
caaacugucuugcaugugu

SEQ ID NO: 931235 - RNA, 19 nt, Homo sapiens
ucacgcagcugagcaguuu

SEQ ID NO: 931236 - RNA, 19 nt, Homo sapiens
acacauuucuuccaccuuu

SEQ ID NO: 931237 - RNA, 19 nt, Homo sapiens
cagcaggccuucagagcua

SEQ ID NO: 931238 - RNA, 19 nt, Homo sapiens
gauguaaauucacuguuug

SEQ ID NO: 931239 - RNA, 19 nt, Homo sapiens
ugacacaucugcgguagaa

SEQ ID NO: 931240 - RNA, 19 nt, Homo sapiens
gaggaaacacucugauuug

SEQ ID NO: 931241 - RNA, 19 nt, Homo sapiens
gcagccuccugauuucaua

SEQ ID NO: 931242 - RNA, 19 nt, Homo sapiens
gaucgauccuuccucaugu

SEQ ID NO: 931243 - RNA, 19 nt, Homo sapiens
ggcauguccucauccauaa

SEQ ID NO: 931244 - RNA, 19 nt, Homo sapiens
ucucauggauguaaauuca

SEQ ID NO: 931245 - RNA, 19 nt, Homo sapiens
ggugggucuuccugaauua

SEQ ID NO: 931246 - RNA, 19 nt, Homo sapiens
ggaguggaaugaacuggau

SEQ ID NO: 931247 - RNA, 19 nt, Homo sapiens
guacuuggcagaugaggaa

SEQ ID NO: 931248 - RNA, 19 nt, Homo sapiens
ugaacuggaucacaucaug

SEQ ID NO: 931249 - RNA, 19 nt, Homo sapiens
gaucacaucauggaaauca

SEQ ID NO: 931250 - RNA, 19 nt, Homo sapiens
gcugagcaguuuccaauac

SEQ ID NO: 931251 - RNA, 19 nt, Homo sapiens
ggaaacacucugauuugga

SEQ ID NO: 931252 - RNA, 19 nt, Homo sapiens
aaacugaggcccugagaau

SEQ ID NO: 931253 - RNA, 19 nt, Homo sapiens
gcagaugaggaaauugauu

SEQ ID NO: 931254 - RNA, 19 nt, Homo sapiens
gaguuaggauccguacuug

SEQ ID NO: 931255 - RNA, 19 nt, Homo sapiens
ggccggaccacgugcaaua

SEQ ID NO: 931256 - RNA, 19 nt, Homo sapiens
cacaaacugucuugcaugu

SEQ ID NO: 931257 - RNA, 19 nt, Homo sapiens
aaagaaaggcagaguuugu

SEQ ID NO: 931258 - RNA, 19 nt, Homo sapiens
uaacgagacucuguuucug

SEQ ID NO: 931259 - RNA, 19 nt, Homo sapiens
gauccuuccucaugucauc

SEQ ID NO: 931260 - RNA, 19 nt, Homo sapiens
caccagagccuccucacaa

SEQ ID NO: 931261 - RNA, 19 nt, Homo sapiens
uggccuggaugacuucuuu

SEQ ID NO: 931262 - RNA, 19 nt, Homo sapiens
gggucuuccugaauuaauu

SEQ ID NO: 931263 - RNA, 19 nt, Homo sapiens
gugugugugugucugguua

SEQ ID NO: 931264 - RNA, 19 nt, Homo sapiens
ccgcaucucccuagacaaa

SEQ ID NO: 931265 - RNA, 19 nt, Homo sapiens
cagaguuugugguggcuuu

SEQ ID NO: 931266 - RNA, 19 nt, Homo sapiens
gcugccagguugcuauaga

SEQ ID NO: 931267 - RNA, 19 nt, Homo sapiens
gacuauggccuccuuuguu

SEQ ID NO: 931268 - RNA, 19 nt, Homo sapiens
uaaaagaaaggcagaguuu

SEQ ID NO: 931269 - RNA, 19 nt, Homo sapiens
gaaacugaggcccugagaa

SEQ ID NO: 931270 - RNA, 19 nt, Homo sapiens
gcaucucccuagacaaagu

SEQ ID NO: 931271 - RNA, 19 nt, Homo sapiens
caucuucgguggccuggau

SEQ ID NO: 931272 - RNA, 19 nt, Homo sapiens
ugacuucuuucuggacauu

SEQ ID NO: 931273 - RNA, 19 nt, Homo sapiens
cagcugagcaguuuccaau

SEQ ID NO: 931274 - RNA, 19 nt, Homo sapiens
ccucagggaagauaaagaa

SEQ ID NO: 931275 - RNA, 19 nt, Homo sapiens
caacucuggguguguguuu

SEQ ID NO: 931276 - RNA, 19 nt, Homo sapiens
cuccauguuugaagaaauu

SEQ ID NO: 931277 - RNA, 19 nt, Homo sapiens
acuauggccuccuuuguuc

SEQ ID NO: 931278 - RNA, 19 nt, Homo sapiens
ucacaucauggaaaucauu

SEQ ID NO: 931279 - RNA, 19 nt, Homo sapiens
aggcauguccucauccaua

SEQ ID NO: 931280 - RNA, 19 nt, Homo sapiens
ggucuuccugaauuaauuu

SEQ ID NO: 931281 - RNA, 19 nt, Homo sapiens
gcaggcauguccucaucca

SEQ ID NO: 931282 - RNA, 19 nt, Homo sapiens
guacuagaauaggaaacug

SEQ ID NO: 931283 - RNA, 19 nt, Homo sapiens
gaaagcugggccugucgaa

SEQ ID NO: 931284 - RNA, 19 nt, Homo sapiens
ggaaacugaggcccugaga

SEQ ID NO: 931285 - RNA, 19 nt, Homo sapiens
ugaguuaggauccguacuu

SEQ ID NO: 931286 - RNA, 19 nt, Homo sapiens
ccaauacagaauucagauu

SEQ ID NO: 931287 - RNA, 19 nt, Homo sapiens
cagggaagauaaagaaagc

SEQ ID NO: 931288 - RNA, 19 nt, Homo sapiens
gagcaguuuccaauacaga

SEQ ID NO: 931289 - RNA, 19 nt, Homo sapiens
uggaucacaucauggaaau

SEQ ID NO: 931290 - RNA, 19 nt, Homo sapiens
cagaugaggaaauugauuc

SEQ ID NO: 931291 - RNA, 19 nt, Homo sapiens
gauccguacuuggcagaug

SEQ ID NO: 931292 - RNA, 19 nt, Homo sapiens
gcuccauguuugaagaaau

SEQ ID NO: 931293 - RNA, 19 nt, Homo sapiens
gcuccacacuugucuuucg

SEQ ID NO: 931294 - RNA, 19 nt, Homo sapiens
caauaggguggaaaccaaa

SEQ ID NO: 931295 - RNA, 19 nt, Homo sapiens
gcucgaagcagugacuaug

SEQ ID NO: 931296 - RNA, 19 nt, Homo sapiens
gaaugaacuggaucacauc

SEQ ID NO: 931297 - RNA, 19 nt, Homo sapiens
gaggaaauugauucucaug

SEQ ID NO: 931298 - RNA, 19 nt, Homo sapiens
uggcagaugaggaaauuga

SEQ ID NO: 931299 - RNA, 19 nt, Homo sapiens
ccgcaggcauguccucauc

SEQ ID NO: 931300 - RNA, 19 nt, Homo sapiens
caaaugccuuaacgagacu

SEQ ID NO: 931301 - RNA, 19 nt, Homo sapiens
cccuuggccuccagaauga

SEQ ID NO: 931302 - RNA, 19 nt, Homo sapiens
cuuggcagaugaggaaauu

SEQ ID NO: 931303 - RNA, 19 nt, Homo sapiens
cugaggcccugagaauuga

SEQ ID NO: 931304 - RNA, 19 nt, Homo sapiens
gugcuccacacuugucuuu

SEQ ID NO: 931305 - RNA, 19 nt, Homo sapiens
acugaggcccugagaauug

SEQ ID NO: 931306 - RNA, 19 nt, Homo sapiens
auacagaauucagauuugg

SEQ ID NO: 931307 - RNA, 19 nt, Homo sapiens
gcaguuuccaauacagaau

SEQ ID NO: 931308 - RNA, 19 nt, Homo sapiens
acucuggccuggaugacuu

SEQ ID NO: 931309 - RNA, 19 nt, Homo sapiens
cugccagguugcuauagaa

SEQ ID NO: 931310 - RNA, 19 nt, Homo sapiens
gagucugauuuuccacuua

SEQ ID NO: 931311 - RNA, 19 nt, Homo sapiens
aggugggucuuccugaauu

SEQ ID NO: 931312 - RNA, 19 nt, Homo sapiens
uggccuggaucccugaaug

SEQ ID NO: 931313 - RNA, 19 nt, Homo sapiens
uauuguggaagaacaguuu

SEQ ID NO: 931314 - RNA, 19 nt, Homo sapiens
ccaccuuuccugcuaguuc

SEQ ID NO: 931315 - RNA, 19 nt, Homo sapiens
ugacuauggccuccuuugu

SEQ ID NO: 931316 - RNA, 19 nt, Homo sapiens
guucuugggaguggaauga

SEQ ID NO: 931317 - RNA, 19 nt, Homo sapiens
aggaaacacucugauuugg

SEQ ID NO: 931318 - RNA, 19 nt, Homo sapiens
gugcugccagguugcuaua

SEQ ID NO: 931319 - RNA, 19 nt, Homo sapiens
gauuugggguucccuacuu

SEQ ID NO: 931320 - RNA, 19 nt, Homo sapiens
cugagcaguuuccaauaca

SEQ ID NO: 931321 - RNA, 19 nt, Homo sapiens
uuaacgagacucuguuucu

SEQ ID NO: 931322 - RNA, 19 nt, Homo sapiens
ggccuccuuuguucccauu

SEQ ID NO: 931323 - RNA, 19 nt, Homo sapiens
cgugcuccauguuugaaga

SEQ ID NO: 931324 - RNA, 19 nt, Homo sapiens
ucauggauguaaauucacu

SEQ ID NO: 931325 - RNA, 19 nt, Homo sapiens
cauuucaggguuccacaaa

SEQ ID NO: 931326 - RNA, 19 nt, Homo sapiens
cugauccagucuucuuaga

SEQ ID NO: 931327 - RNA, 19 nt, Homo sapiens
gccugauccagucuucuua

SEQ ID NO: 931328 - RNA, 19 nt, Homo sapiens
gcagagaucuuauugcaua

SEQ ID NO: 931329 - RNA, 19 nt, Homo sapiens
agaaagagcugacgaguuu

SEQ ID NO: 931330 - RNA, 19 nt, Homo sapiens
gaacucacuuccucuuuau

SEQ ID NO: 931331 - RNA, 19 nt, Homo sapiens
cauaugaagucaaggcuaa

SEQ ID NO: 931332 - RNA, 19 nt, Homo sapiens
agaacucacuuccucuuua

SEQ ID NO: 931333 - RNA, 19 nt, Homo sapiens
gagaucuuauugcauauga

SEQ ID NO: 931334 - RNA, 19 nt, Homo sapiens
gagagacgcugcucaucug

SEQ ID NO: 931335 - RNA, 19 nt, Homo sapiens
ggacacgcccagauucuuu

SEQ ID NO: 931336 - RNA, 19 nt, Homo sapiens
gcggaagucuccagguuca

SEQ ID NO: 931337 - RNA, 19 nt, Homo sapiens
gcacugggcucugguuucg

SEQ ID NO: 931338 - RNA, 19 nt, Homo sapiens
gagcaacaucccagccaua

SEQ ID NO: 931339 - RNA, 19 nt, Homo sapiens
ugaagcaugugguugaugu

SEQ ID NO: 931340 - RNA, 19 nt, Homo sapiens
ggagagacgcugcucaucu

SEQ ID NO: 931341 - RNA, 19 nt, Homo sapiens
cgggacaacugaagcaugu

SEQ ID NO: 931342 - RNA, 19 nt, Homo sapiens
uggaugcccucuuccugua

SEQ ID NO: 931343 - RNA, 19 nt, Homo sapiens
caacaucccagccauaagg

SEQ ID NO: 931344 - RNA, 19 nt, Homo sapiens
gggacaggcagagaucuua

SEQ ID NO: 931345 - RNA, 19 nt, Homo sapiens
uaaaugagucacuauacug

SEQ ID NO: 931346 - RNA, 19 nt, Homo sapiens
aggcagagaucuuauugca

SEQ ID NO: 931347 - RNA, 19 nt, Homo sapiens
gaaccccacuccccacuga

SEQ ID NO: 931348 - RNA, 19 nt, Homo sapiens
gcuaaccagcgaaauauag

SEQ ID NO: 931349 - RNA, 19 nt, Homo sapiens
ggacaggcagagaucuuau

SEQ ID NO: 931350 - RNA, 19 nt, Homo sapiens
ccuaagagaauauuucaag

SEQ ID NO: 931351 - RNA, 19 nt, Homo sapiens
uggacaaucuggugcugaa

SEQ ID NO: 931352 - RNA, 19 nt, Homo sapiens
gggcucugguuucggaaga

SEQ ID NO: 931353 - RNA, 19 nt, Homo sapiens
ggauguucguggacaaucu

SEQ ID NO: 931354 - RNA, 19 nt, Homo sapiens
guuccuggaugcccucuuc

SEQ ID NO: 931355 - RNA, 19 nt, Homo sapiens
cacuuccucuuuauaaaug

SEQ ID NO: 931356 - RNA, 19 nt, Homo sapiens
gaucuuauugcauaugaag

SEQ ID NO: 931357 - RNA, 19 nt, Homo sapiens
ccaagcuggugaagaacug

SEQ ID NO: 931358 - RNA, 19 nt, Homo sapiens
acaaucuggugcugaacaa

SEQ ID NO: 931359 - RNA, 19 nt, Homo sapiens
gcugacgaguuugggcuuu

SEQ ID NO: 931360 - RNA, 19 nt, Homo sapiens
aaggcuaaccagcgaaaua

SEQ ID NO: 931361 - RNA, 19 nt, Homo sapiens
acucacuuccucuuuauaa

SEQ ID NO: 931362 - RNA, 19 nt, Homo sapiens
uagaagacaucugcaucug

SEQ ID NO: 931363 - RNA, 19 nt, Homo sapiens
cugcggaagucuccagguu

SEQ ID NO: 931364 - RNA, 19 nt, Homo sapiens
gacaggcagagaucuuauu

SEQ ID NO: 931365 - RNA, 19 nt, Homo sapiens
ccuuccagcucauucuuug

SEQ ID NO: 931366 - RNA, 19 nt, Homo sapiens
cagaacucacuuccucuuu

SEQ ID NO: 931367 - RNA, 19 nt, Homo sapiens
gcucucaagcuccguuuca

SEQ ID NO: 931368 - RNA, 19 nt, Homo sapiens
gcggauccuugcagaaugc

SEQ ID NO: 931369 - RNA, 19 nt, Homo sapiens
ggcggauccuugcagaaug

SEQ ID NO: 931370 - RNA, 19 nt, Homo sapiens
gcuacugcuucgagugugu

SEQ ID NO: 931371 - RNA, 19 nt, Homo sapiens
ggaagucuccagguucaca

SEQ ID NO: 931372 - RNA, 19 nt, Homo sapiens
cagagaucuuauugcauau

SEQ ID NO: 931373 - RNA, 19 nt, Homo sapiens
aagaaagagcugacgaguu

SEQ ID NO: 931374 - RNA, 19 nt, Homo sapiens
ggaaggugcacgccaugag

SEQ ID NO: 931375 - RNA, 19 nt, Homo sapiens
uaaccagcgaaauauagaa

SEQ ID NO: 931376 - RNA, 19 nt, Homo sapiens
ggcuaaccagcgaaauaua

SEQ ID NO: 931377 - RNA, 19 nt, Homo sapiens
gacaaucuggugcugaaca

SEQ ID NO: 931378 - RNA, 19 nt, Homo sapiens
gcaacugggugugcuaccu

SEQ ID NO: 931379 - RNA, 19 nt, Homo sapiens
gaaauauagaagacaucug

SEQ ID NO: 931380 - RNA, 19 nt, Homo sapiens
ccagcgaaauauagaagac

SEQ ID NO: 931381 - RNA, 19 nt, Homo sapiens
cuaaccagcgaaauauaga

SEQ ID NO: 931382 - RNA, 19 nt, Homo sapiens
uccaccggcuccugcagua

SEQ ID NO: 931383 - RNA, 19 nt, Homo sapiens
acaggcagagaucuuauug

SEQ ID NO: 931384 - RNA, 19 nt, Homo sapiens
aaaugagucacuauacugu

SEQ ID NO: 931385 - RNA, 19 nt, Homo sapiens
agaacaagcagagcucgaa

SEQ ID NO: 931386 - RNA, 19 nt, Homo sapiens
gguuucggaagaagaauug

SEQ ID NO: 931387 - RNA, 19 nt, Homo sapiens
gacgaugacggguaccaau

SEQ ID NO: 931388 - RNA, 19 nt, Homo sapiens
ucaaggcuaaccagcgaaa

SEQ ID NO: 931389 - RNA, 19 nt, Homo sapiens
cucacuuccucuuuauaaa

SEQ ID NO: 931390 - RNA, 19 nt, Homo sapiens
gacacgcccagauucuuug

SEQ ID NO: 931391 - RNA, 19 nt, Homo sapiens
ggaccacuggaaccuugaa

SEQ ID NO: 931392 - RNA, 19 nt, Homo sapiens
cagacacagugaggaagga

SEQ ID NO: 931393 - RNA, 19 nt, Homo sapiens
uauugcauaugaagucaag

SEQ ID NO: 931394 - RNA, 19 nt, Homo sapiens
cgaaauauagaagacaucu

SEQ ID NO: 931395 - RNA, 19 nt, Homo sapiens
agaagcaggucccaaauaa

SEQ ID NO: 931396 - RNA, 19 nt, Homo sapiens
ggacaucgcccacuacuac

SEQ ID NO: 931397 - RNA, 19 nt, Homo sapiens
gggcagggcugacuuugca

SEQ ID NO: 931398 - RNA, 19 nt, Homo sapiens
gggacuacguggucaagaa

SEQ ID NO: 931399 - RNA, 19 nt, Homo sapiens
gcucuuugaugcccuucua

SEQ ID NO: 931400 - RNA, 19 nt, Homo sapiens
ucaaccagcugcccaagau

SEQ ID NO: 931401 - RNA, 19 nt, Homo sapiens
gaagcaggucccaaauaaa

SEQ ID NO: 931402 - RNA, 19 nt, Homo sapiens
cagaagcaggucccaaaua

SEQ ID NO: 931403 - RNA, 19 nt, Homo sapiens
ccacguugcuggccuuugg

SEQ ID NO: 931404 - RNA, 19 nt, Homo sapiens
ggacaacuucgugagguuu

SEQ ID NO: 931405 - RNA, 19 nt, Homo sapiens
guggccagcucccugcuaa

SEQ ID NO: 931406 - RNA, 19 nt, Homo sapiens
ccaggaagccacccuaaca

SEQ ID NO: 931407 - RNA, 19 nt, Homo sapiens
gggacaacuucgugagguu

SEQ ID NO: 931408 - RNA, 19 nt, Homo sapiens
cuaagaaggagaccaggaa

SEQ ID NO: 931409 - RNA, 19 nt, Homo sapiens
gacccuguccucaucauug

SEQ ID NO: 931410 - RNA, 19 nt, Homo sapiens
gaccaggaagccacccuaa

SEQ ID NO: 931411 - RNA, 19 nt, Homo sapiens
gccuagaccugggauuugu

SEQ ID NO: 931412 - RNA, 19 nt, Homo sapiens
ccagcucccugcuaagaag

SEQ ID NO: 931413 - RNA, 19 nt, Homo sapiens
aagcaggucccaaauaaag

SEQ ID NO: 931414 - RNA, 19 nt, Homo sapiens
ccacaaggugcaccagaug

SEQ ID NO: 931415 - RNA, 19 nt, Homo sapiens
ggacuacguggucaagaag

SEQ ID NO: 931416 - RNA, 19 nt, Homo sapiens
aggacuggaugcagaagaa

SEQ ID NO: 931417 - RNA, 19 nt, Homo sapiens
aggcugcccuggacuuaga

SEQ ID NO: 931418 - RNA, 19 nt, Homo sapiens
ccguggcccugcucuuuga

SEQ ID NO: 931419 - RNA, 19 nt, Homo sapiens
ggccagcucccugcuaaga

SEQ ID NO: 931420 - RNA, 19 nt, Homo sapiens
guccggugcuguagucaca

SEQ ID NO: 931421 - RNA, 19 nt, Homo sapiens
gugugagguuggacuuaga

SEQ ID NO: 931422 - RNA, 19 nt, Homo sapiens
ucaaggacuggaugcagaa

SEQ ID NO: 931423 - RNA, 19 nt, Homo sapiens
gacuuagaccaguguguga

SEQ ID NO: 931424 - RNA, 19 nt, Homo sapiens
gacuuagaccaguguguga

SEQ ID NO: 931425 - RNA, 19 nt, Homo sapiens
ccagaagcaggucccaaau

SEQ ID NO: 931426 - RNA, 19 nt, Homo sapiens
caacaucccggugauccau

SEQ ID NO: 931427 - RNA, 19 nt, Homo sapiens
uccagaagcaggucccaaa

SEQ ID NO: 931428 - RNA, 19 nt, Homo sapiens
ggccuagaccugggauuug

SEQ ID NO: 931429 - RNA, 19 nt, Homo sapiens
gagccuggcacuccaucga

SEQ ID NO: 931430 - RNA, 19 nt, Homo sapiens
gacaacuucgugagguuug

SEQ ID NO: 931431 - RNA, 19 nt, Homo sapiens
agaagggucuggggcauaa

SEQ ID NO: 931432 - RNA, 19 nt, Homo sapiens
ccugagaggacagagauga

SEQ ID NO: 931433 - RNA, 19 nt, Homo sapiens
caaggugcaccagaugaug

SEQ ID NO: 931434 - RNA, 19 nt, Homo sapiens
cacaaggugcaccagauga

SEQ ID NO: 931435 - RNA, 19 nt, Homo sapiens
ggaaauagaugaugugcaa

SEQ ID NO: 931436 - RNA, 19 nt, Homo sapiens
caagugauauccuguagua

SEQ ID NO: 931437 - RNA, 19 nt, Homo sapiens
caaggaaccuguauaguga

SEQ ID NO: 931438 - RNA, 19 nt, Homo sapiens
gaaguaauguucucagcuu

SEQ ID NO: 931439 - RNA, 19 nt, Homo sapiens
ggagugcaauggugaaauu

SEQ ID NO: 931440 - RNA, 19 nt, Homo sapiens
ccacagacaugcaccauau

SEQ ID NO: 931441 - RNA, 19 nt, Homo sapiens
gaccagcccuuuccaaaug

SEQ ID NO: 931442 - RNA, 19 nt, Homo sapiens
gugcaauggugaaauuaua

SEQ ID NO: 931443 - RNA, 19 nt, Homo sapiens
gaaagugaccuaaguugga

SEQ ID NO: 931444 - RNA, 19 nt, Homo sapiens
ggagacagcccaccuugaa

SEQ ID NO: 931445 - RNA, 19 nt, Homo sapiens
agaaauccuugcuuuauga

SEQ ID NO: 931446 - RNA, 19 nt, Homo sapiens
uagaugaugugcaaagaaa

SEQ ID NO: 931447 - RNA, 19 nt, Homo sapiens
uuucuagccuggauuaaua

SEQ ID NO: 931448 - RNA, 19 nt, Homo sapiens
gauguggucucgcuuuguu

SEQ ID NO: 931449 - RNA, 19 nt, Homo sapiens
aaagagccauccaagcuaa

SEQ ID NO: 931450 - RNA, 19 nt, Homo sapiens
guucucagcuugaugacaa

SEQ ID NO: 931451 - RNA, 19 nt, Homo sapiens
cagcaaaccuugacagcau

SEQ ID NO: 931452 - RNA, 19 nt, Homo sapiens
ccacgcugcugccauuaaa

SEQ ID NO: 931453 - RNA, 19 nt, Homo sapiens
ucacuauccuguccacauu

SEQ ID NO: 931454 - RNA, 19 nt, Homo sapiens
agaagagaguuuccaagaa

SEQ ID NO: 931455 - RNA, 19 nt, Homo sapiens
ccuagaagcugcaugucaa

SEQ ID NO: 931456 - RNA, 19 nt, Homo sapiens
uagccuggauuaauaagaa

SEQ ID NO: 931457 - RNA, 19 nt, Homo sapiens
gguccacgcugcugccauu

SEQ ID NO: 931458 - RNA, 19 nt, Homo sapiens
ccacagcucucaggaaagu

SEQ ID NO: 931459 - RNA, 19 nt, Homo sapiens
gcaugaaguuacagugugu

SEQ ID NO: 931460 - RNA, 19 nt, Homo sapiens
gggcugccuucccaucuaa

SEQ ID NO: 931461 - RNA, 19 nt, Homo sapiens
ccucuuauccaccugaaua

SEQ ID NO: 931462 - RNA, 19 nt, Homo sapiens
ugacagcauuuccucuuau

SEQ ID NO: 931463 - RNA, 19 nt, Homo sapiens
ucaggaaagugaccuaagu

SEQ ID NO: 931464 - RNA, 19 nt, Homo sapiens
uaaacucuaucugcugaaa

SEQ ID NO: 931465 - RNA, 19 nt, Homo sapiens
gagacucugcagaucauua

SEQ ID NO: 931466 - RNA, 19 nt, Homo sapiens
guaaagcaguuagcuagca

SEQ ID NO: 931467 - RNA, 19 nt, Homo sapiens
acaaggaaccuguauagug

SEQ ID NO: 931468 - RNA, 19 nt, Homo sapiens
aagaaauccuugcuuuaug

SEQ ID NO: 931469 - RNA, 19 nt, Homo sapiens
ugccacagcucucaggaaa

SEQ ID NO: 931470 - RNA, 19 nt, Homo sapiens
gaugugagccaagugauau

SEQ ID NO: 931471 - RNA, 19 nt, Homo sapiens
aaagucuacugugguauuu

SEQ ID NO: 931472 - RNA, 19 nt, Homo sapiens
uagaagagaguuuccaaga

SEQ ID NO: 931473 - RNA, 19 nt, Homo sapiens
guccaugucugugauguga

SEQ ID NO: 931474 - RNA, 19 nt, Homo sapiens
agacaugcaccauauagaa

SEQ ID NO: 931475 - RNA, 19 nt, Homo sapiens
ugacaaggaaccuguauag

SEQ ID NO: 931476 - RNA, 19 nt, Homo sapiens
cuccugaccucaagcaauu

SEQ ID NO: 931477 - RNA, 19 nt, Homo sapiens
gcacauggcagacacucau

SEQ ID NO: 931478 - RNA, 19 nt, Homo sapiens
ugagaggcaugaaguuaca

SEQ ID NO: 931479 - RNA, 19 nt, Homo sapiens
acacuggucucaaacucuu

SEQ ID NO: 931480 - RNA, 19 nt, Homo sapiens
ucaagacccagaagaaaga

SEQ ID NO: 931481 - RNA, 19 nt, Homo sapiens
ugggagagcucgacgucuu

SEQ ID NO: 931482 - RNA, 19 nt, Homo sapiens
gcauggacauagaauugca

SEQ ID NO: 931483 - RNA, 19 nt, Homo sapiens
cuucccaucuaauuuauug

SEQ ID NO: 931484 - RNA, 19 nt, Homo sapiens
gaaccuguauagugaucca

SEQ ID NO: 931485 - RNA, 19 nt, Homo sapiens
guaauguucucagcuugau

SEQ ID NO: 931486 - RNA, 19 nt, Homo sapiens
gcacugagaggagacacaa

SEQ ID NO: 931487 - RNA, 19 nt, Homo sapiens
uugacagcauuuccucuua

SEQ ID NO: 931488 - RNA, 19 nt, Homo sapiens
aaagucauauaguccaugu

SEQ ID NO: 931489 - RNA, 19 nt, Homo sapiens
ugccuacacuggucucaaa

SEQ ID NO: 931490 - RNA, 19 nt, Homo sapiens
ggacaggguguucaaggau

SEQ ID NO: 931491 - RNA, 19 nt, Homo sapiens
gcaaaccuugacagcauuu

SEQ ID NO: 931492 - RNA, 19 nt, Homo sapiens
guaaagucauauaguccau

SEQ ID NO: 931493 - RNA, 19 nt, Homo sapiens
caagugagaggcaugaagu

SEQ ID NO: 931494 - RNA, 19 nt, Homo sapiens
gcauggagauggggaguuu

SEQ ID NO: 931495 - RNA, 19 nt, Homo sapiens
gacagcauuuccucuuauc

SEQ ID NO: 931496 - RNA, 19 nt, Homo sapiens
gaugaugugcaaagaaauc

SEQ ID NO: 931497 - RNA, 19 nt, Homo sapiens
caccucggcuucccaaagu

SEQ ID NO: 931498 - RNA, 19 nt, Homo sapiens
aaagugaccuaaguuggau

SEQ ID NO: 931499 - RNA, 19 nt, Homo sapiens
gccaagugauauccuguag

SEQ ID NO: 931500 - RNA, 19 nt, Homo sapiens
gcagcauugccaacucuuu

SEQ ID NO: 931501 - RNA, 19 nt, Homo sapiens
ggagauggggaguuuauuu

SEQ ID NO: 931502 - RNA, 19 nt, Homo sapiens
ucauauaguccaugucugu

SEQ ID NO: 931503 - RNA, 19 nt, Homo sapiens
ugccuucccaucuaauuua

SEQ ID NO: 931504 - RNA, 19 nt, Homo sapiens
ugaugcagguaaagcaguu

SEQ ID NO: 931505 - RNA, 19 nt, Homo sapiens
ugaugugagccaagugaua

SEQ ID NO: 931506 - RNA, 19 nt, Homo sapiens
cuccucaacuuccugacua

SEQ ID NO: 931507 - RNA, 19 nt, Homo sapiens
gggagagcucgacgucuuu

SEQ ID NO: 931508 - RNA, 19 nt, Homo sapiens
agacucugcagaucauuaa

SEQ ID NO: 931509 - RNA, 19 nt, Homo sapiens
gcuccuggguacaauacug

SEQ ID NO: 931510 - RNA, 19 nt, Homo sapiens
uacaguguguuucccuuug

SEQ ID NO: 931511 - RNA, 19 nt, Homo sapiens
aauagaugaugugcaaaga

SEQ ID NO: 931512 - RNA, 19 nt, Homo sapiens
gaaguuacaguguguuucc

SEQ ID NO: 931513 - RNA, 19 nt, Homo sapiens
cugcauggacauagaauug

SEQ ID NO: 931514 - RNA, 19 nt, Homo sapiens
ugacuacaggugugcauga

SEQ ID NO: 931515 - RNA, 19 nt, Homo sapiens
cuacugugguauuuguaau

SEQ ID NO: 931516 - RNA, 19 nt, Homo sapiens
gaugacaaggaaccuguau

SEQ ID NO: 931517 - RNA, 19 nt, Homo sapiens
ugccaacucuuuccucuac

SEQ ID NO: 931518 - RNA, 19 nt, Homo sapiens
cagcagcauugccaacucu

SEQ ID NO: 931519 - RNA, 19 nt, Homo sapiens
ccagaagaaagaggcauuu

SEQ ID NO: 931520 - RNA, 19 nt, Homo sapiens
gagauggggaguuuauuuu

SEQ ID NO: 931521 - RNA, 19 nt, Homo sapiens
gagugcaauggugaaauua

SEQ ID NO: 931522 - RNA, 19 nt, Homo sapiens
gaaucaugaaguaauguuc

SEQ ID NO: 931523 - RNA, 19 nt, Homo sapiens
gagcucgacgucuuucuag

SEQ ID NO: 931524 - RNA, 19 nt, Homo sapiens
ccaacucuuuccucuacau

SEQ ID NO: 931525 - RNA, 19 nt, Homo sapiens
cuaaggcauuggagaacug

SEQ ID NO: 931526 - RNA, 19 nt, Homo sapiens
gaaauagaugaugugcaaa

SEQ ID NO: 931527 - RNA, 19 nt, Homo sapiens
uauaguccaugucugugau

SEQ ID NO: 931528 - RNA, 19 nt, Homo sapiens
ucucugcauuaaucaagaa

SEQ ID NO: 931529 - RNA, 19 nt, Homo sapiens
uguccugccuccucaacuu

SEQ ID NO: 931530 - RNA, 19 nt, Homo sapiens
uggacaggguguucaagga

SEQ ID NO: 931531 - RNA, 19 nt, Homo sapiens
gauauugugcucaguagac

SEQ ID NO: 931532 - RNA, 19 nt, Homo sapiens
agugagaggcaugaaguua

SEQ ID NO: 931533 - RNA, 19 nt, Homo sapiens
caggaaagugaccuaaguu

SEQ ID NO: 931534 - RNA, 19 nt, Homo sapiens
agucuacugugguauuugu

SEQ ID NO: 931535 - RNA, 19 nt, Homo sapiens
caguguggcugacaacuua

SEQ ID NO: 931536 - RNA, 19 nt, Homo sapiens
ggucauagcuugggcuguu

SEQ ID NO: 931537 - RNA, 19 nt, Homo sapiens
acagcuggcuucccuagua

SEQ ID NO: 931538 - RNA, 19 nt, Homo sapiens
gauauugacaccucuaugu

SEQ ID NO: 931539 - RNA, 19 nt, Homo sapiens
cgaauuggacuaccucaug

SEQ ID NO: 931540 - RNA, 19 nt, Homo sapiens
gaagagaccccaaucagau

SEQ ID NO: 931541 - RNA, 19 nt, Homo sapiens
ggcuguuccuucucugaua

SEQ ID NO: 931542 - RNA, 19 nt, Homo sapiens
uggaaugguugucugguau

SEQ ID NO: 931543 - RNA, 19 nt, Homo sapiens
uggacuaccucauggaugu

SEQ ID NO: 931544 - RNA, 19 nt, Homo sapiens
gccucuagcucccucuuug

SEQ ID NO: 931545 - RNA, 19 nt, Homo sapiens
guaugacaaugaacuuugg

SEQ ID NO: 931546 - RNA, 19 nt, Homo sapiens
ggagagacagaaucuaguc

SEQ ID NO: 931547 - RNA, 19 nt, Homo sapiens
gagggccuguuugaggaua

SEQ ID NO: 931548 - RNA, 19 nt, Homo sapiens
gaccaacuguccucgaaaa

SEQ ID NO: 931549 - RNA, 19 nt, Homo sapiens
gggaggaggaggaggagaa

SEQ ID NO: 931550 - RNA, 19 nt, Homo sapiens
cuggaaugguugucuggua

SEQ ID NO: 931551 - RNA, 19 nt, Homo sapiens
acaccucuauguaugacaa

SEQ ID NO: 931552 - RNA, 19 nt, Homo sapiens
gaaugguugucugguaucu

SEQ ID NO: 931553 - RNA, 19 nt, Homo sapiens
ggaagagaccccaaucaga

SEQ ID NO: 931554 - RNA, 19 nt, Homo sapiens
gcuggacgaggccgaauug

SEQ ID NO: 931555 - RNA, 19 nt, Homo sapiens
cauccguccuccugucuca

SEQ ID NO: 931556 - RNA, 19 nt, Homo sapiens
gggcuugggccacuuugga

SEQ ID NO: 931557 - RNA, 19 nt, Homo sapiens
ugucugguaucugaacuga

SEQ ID NO: 931558 - RNA, 19 nt, Homo sapiens
augguugucugguaucuga

SEQ ID NO: 931559 - RNA, 19 nt, Homo sapiens
gcuguuccuucucugauac

SEQ ID NO: 931560 - RNA, 19 nt, Homo sapiens
ggaggaggaggagaaggaa

SEQ ID NO: 931561 - RNA, 19 nt, Homo sapiens
ggcuaccucuucguucuga

SEQ ID NO: 931562 - RNA, 19 nt, Homo sapiens
uauugacaccucuauguau

SEQ ID NO: 931563 - RNA, 19 nt, Homo sapiens
ggauauugacaccucuaug

SEQ ID NO: 931564 - RNA, 19 nt, Homo sapiens
gggccuguuugaggauauu

SEQ ID NO: 931565 - RNA, 19 nt, Homo sapiens
auugacaccucuauguaug

SEQ ID NO: 931566 - RNA, 19 nt, Homo sapiens
auauugacaccucuaugua

SEQ ID NO: 931567 - RNA, 19 nt, Homo sapiens
guggcuaccucuucguucu

SEQ ID NO: 931568 - RNA, 19 nt, Homo sapiens
uguaugacaaugaacuuug

SEQ ID NO: 931569 - RNA, 19 nt, Homo sapiens
ccaguguggcugacaacuu

SEQ ID NO: 931570 - RNA, 19 nt, Homo sapiens
cagcuggcuucccuaguac

SEQ ID NO: 931571 - RNA, 19 nt, Homo sapiens
ggaaugguugucugguauc

SEQ ID NO: 931572 - RNA, 19 nt, Homo sapiens
gggccacuuuggagagaca

SEQ ID NO: 931573 - RNA, 19 nt, Homo sapiens
gagcccucgugcuggaaug

SEQ ID NO: 931574 - RNA, 19 nt, Homo sapiens
gaacgugccuuaaagauca

SEQ ID NO: 931575 - RNA, 19 nt, Homo sapiens
caucuugucuuacacauaa

SEQ ID NO: 931576 - RNA, 19 nt, Homo sapiens
ggacaaucuuccugugaua

SEQ ID NO: 931577 - RNA, 19 nt, Homo sapiens
gcaagaaggagaucaauau

SEQ ID NO: 931578 - RNA, 19 nt, Homo sapiens
ccaauuaauuuccuacuuc

SEQ ID NO: 931579 - RNA, 19 nt, Homo sapiens
ucaaaccuguucguaauaa

SEQ ID NO: 931580 - RNA, 19 nt, Homo sapiens
aaucaaaccuguucguaau

SEQ ID NO: 931581 - RNA, 19 nt, Homo sapiens
gaaugcaugcgacugauuu

SEQ ID NO: 931582 - RNA, 19 nt, Homo sapiens
gcacgagaguccauaaugc

SEQ ID NO: 931583 - RNA, 19 nt, Homo sapiens
gaaagcagcaccugguuag

SEQ ID NO: 931584 - RNA, 19 nt, Homo sapiens
cauaaaugguguuaacauc

SEQ ID NO: 931585 - RNA, 19 nt, Homo sapiens
cugaggagccaauuaauuu

SEQ ID NO: 931586 - RNA, 19 nt, Homo sapiens
gaauggaaggugaaaauua

SEQ ID NO: 931587 - RNA, 19 nt, Homo sapiens
agaaggagaucaauaucau

SEQ ID NO: 931588 - RNA, 19 nt, Homo sapiens
ggaggaugcuaccaguuuc

SEQ ID NO: 931589 - RNA, 19 nt, Homo sapiens
guguuaacaucccauugua

SEQ ID NO: 931590 - RNA, 19 nt, Homo sapiens
gcagugagggcaagaagga

SEQ ID NO: 931591 - RNA, 19 nt, Homo sapiens
uaacaucccauuguacauu

SEQ ID NO: 931592 - RNA, 19 nt, Homo sapiens
uaacaucccauuguacauu

SEQ ID NO: 931593 - RNA, 19 nt, Homo sapiens
ggacacgguacaucacaaa

SEQ ID NO: 931594 - RNA, 19 nt, Homo sapiens
gaaggagaucaauaucauu

SEQ ID NO: 931595 - RNA, 19 nt, Homo sapiens
gcaaagaggagagaaagca

SEQ ID NO: 931596 - RNA, 19 nt, Homo sapiens
gaagagcggaguggcauga

SEQ ID NO: 931597 - RNA, 19 nt, Homo sapiens
caaaccuguucguaauaaa

SEQ ID NO: 931598 - RNA, 19 nt, Homo sapiens
gccaauuaauuuccuacuu

SEQ ID NO: 931599 - RNA, 19 nt, Homo sapiens
uaaaucaaaccuguucgua

SEQ ID NO: 931600 - RNA, 19 nt, Homo sapiens
uuucuaugcuuguuucuug

SEQ ID NO: 931601 - RNA, 19 nt, Homo sapiens
ggagccaauuaauuuccua

SEQ ID NO: 931602 - RNA, 19 nt, Homo sapiens
caguuucgguagaguauga

SEQ ID NO: 931603 - RNA, 19 nt, Homo sapiens
ggcaagaaggagaucaaua

SEQ ID NO: 931604 - RNA, 19 nt, Homo sapiens
guagcuagauaauuauggu

SEQ ID NO: 931605 - RNA, 19 nt, Homo sapiens
ggaacgugccuuaaagauc

SEQ ID NO: 931606 - RNA, 19 nt, Homo sapiens
aaaucaaaccuguucguaa

SEQ ID NO: 931607 - RNA, 19 nt, Homo sapiens
auacugaggagccaauuaa

SEQ ID NO: 931608 - RNA, 19 nt, Homo sapiens
ggagcaaagaggagagaaa

SEQ ID NO: 931609 - RNA, 19 nt, Homo sapiens
ggaaugcaugcgacugauu

SEQ ID NO: 931610 - RNA, 19 nt, Homo sapiens
agaaagcagcaccugguua

SEQ ID NO: 931611 - RNA, 19 nt, Homo sapiens
gcugagaucuuucuuuuac

SEQ ID NO: 931612 - RNA, 19 nt, Homo sapiens
gaagcagguuagagugucu

SEQ ID NO: 931613 - RNA, 19 nt, Homo sapiens
gagaaagcagcaccugguu

SEQ ID NO: 931614 - RNA, 19 nt, Homo sapiens
ucauugaacugagucacaa

SEQ ID NO: 931615 - RNA, 19 nt, Homo sapiens
gguguuaacaucccauugu

SEQ ID NO: 931616 - RNA, 19 nt, Homo sapiens
ccauaaugccuucuuguca

SEQ ID NO: 931617 - RNA, 19 nt, Homo sapiens
gagcaaagaggagagaaag

SEQ ID NO: 931618 - RNA, 19 nt, Homo sapiens
cauugucuuugucucagua

SEQ ID NO: 931619 - RNA, 19 nt, Homo sapiens
ggucauguagcuagauaau

SEQ ID NO: 931620 - RNA, 19 nt, Homo sapiens
ccugugauauguagugaca

SEQ ID NO: 931621 - RNA, 19 nt, Homo sapiens
aacaucccauuguacauuu

SEQ ID NO: 931622 - RNA, 19 nt, Homo sapiens
aacaucccauuguacauuu

SEQ ID NO: 931623 - RNA, 19 nt, Homo sapiens
agaguaugauugccucguu

SEQ ID NO: 931624 - RNA, 19 nt, Homo sapiens
ugccacaucuugucuuaca

SEQ ID NO: 931625 - RNA, 19 nt, Homo sapiens
gacaauccaagaacugaug

SEQ ID NO: 931626 - RNA, 19 nt, Homo sapiens
caagaaggagaucaauauc

SEQ ID NO: 931627 - RNA, 19 nt, Homo sapiens
gggacacgguacaucacaa

SEQ ID NO: 931628 - RNA, 19 nt, Homo sapiens
guuaacaucccauuguaca

SEQ ID NO: 931629 - RNA, 19 nt, Homo sapiens
uggcugagaucuuucuuuu

SEQ ID NO: 931630 - RNA, 19 nt, Homo sapiens
ccgaaugaauggaaugcau

SEQ ID NO: 931631 - RNA, 19 nt, Homo sapiens
gcaccugguuagggccaaa

SEQ ID NO: 931632 - RNA, 19 nt, Homo sapiens
aaguguagguggacaaucu

SEQ ID NO: 931633 - RNA, 19 nt, Homo sapiens
caaucuuccugugauaugu

SEQ ID NO: 931634 - RNA, 19 nt, Homo sapiens
cuuguuucuuggcauaaua

SEQ ID NO: 931635 - RNA, 19 nt, Homo sapiens
gcaugaccacagacgauga

SEQ ID NO: 931636 - RNA, 19 nt, Homo sapiens
aggaggaugcuaccaguuu

SEQ ID NO: 931637 - RNA, 19 nt, Homo sapiens
gaugacaauccaagaacug

SEQ ID NO: 931638 - RNA, 19 nt, Homo sapiens
uggacaaucuuccugugau

SEQ ID NO: 931639 - RNA, 19 nt, Homo sapiens
acaucccauuguacauuua

SEQ ID NO: 931640 - RNA, 19 nt, Homo sapiens
acaucccauuguacauuua

SEQ ID NO: 931641 - RNA, 19 nt, Homo sapiens
cacgguacaucacaaagag

SEQ ID NO: 931642 - RNA, 19 nt, Homo sapiens
ggcacgagaguccauaaug

SEQ ID NO: 931643 - RNA, 19 nt, Homo sapiens
uuggacaacuggaugacaa

SEQ ID NO: 931644 - RNA, 19 nt, Homo sapiens
gcgaagcagguuagagugu

SEQ ID NO: 931645 - RNA, 19 nt, Homo sapiens
gacgggacacgguacauca

SEQ ID NO: 931646 - RNA, 19 nt, Homo sapiens
aagaaggagaucaauauca

SEQ ID NO: 931647 - RNA, 19 nt, Homo sapiens
gguuagagugucucaagga

SEQ ID NO: 931648 - RNA, 19 nt, Homo sapiens
gacaaucuuccugugauau

SEQ ID NO: 931649 - RNA, 19 nt, Homo sapiens
ccacagacgaugacaccau

SEQ ID NO: 931650 - RNA, 19 nt, Homo sapiens
caugaugcgaagcagguua

SEQ ID NO: 931651 - RNA, 19 nt, Homo sapiens
agcccaagauggaauggaa

SEQ ID NO: 931652 - RNA, 19 nt, Homo sapiens
uuggucauguagcuagaua

SEQ ID NO: 931653 - RNA, 19 nt, Homo sapiens
guaaaguguagguggacaa

SEQ ID NO: 931654 - RNA, 19 nt, Homo sapiens
acugaggagccaauuaauu

SEQ ID NO: 931655 - RNA, 19 nt, Homo sapiens
acacgguacaucacaaaga

SEQ ID NO: 931656 - RNA, 19 nt, Homo sapiens
ccacaucuugucuuacaca

SEQ ID NO: 931657 - RNA, 19 nt, Homo sapiens
gggcgcuacuggagcaaag

SEQ ID NO: 931658 - RNA, 19 nt, Homo sapiens
guggacaaucuuccuguga

SEQ ID NO: 931659 - RNA, 19 nt, Homo sapiens
caucccauuguacauuuaa

SEQ ID NO: 931660 - RNA, 19 nt, Homo sapiens
caucccauuguacauuuaa

SEQ ID NO: 931661 - RNA, 19 nt, Homo sapiens
aauacugaggagccaauua

SEQ ID NO: 931662 - RNA, 19 nt, Homo sapiens
gauggaauggaaggugaaa

SEQ ID NO: 931663 - RNA, 19 nt, Homo sapiens
gcuuguuucuuggcauaau

SEQ ID NO: 931664 - RNA, 19 nt, Homo sapiens
auauacugguaccuucuuu

SEQ ID NO: 931665 - RNA, 19 nt, Homo sapiens
ggacaacuggaugacaauc

SEQ ID NO: 931666 - RNA, 19 nt, Homo sapiens
cagguuagagugucucaag

SEQ ID NO: 931667 - RNA, 19 nt, Homo sapiens
gcaacaaugugaccgauau

SEQ ID NO: 931668 - RNA, 19 nt, Homo sapiens
ugacccagcucuucauguu

SEQ ID NO: 931669 - RNA, 19 nt, Homo sapiens
gugaucggcugcugaguga

SEQ ID NO: 931670 - RNA, 19 nt, Homo sapiens
uggcagggcuggucuacaa

SEQ ID NO: 931671 - RNA, 19 nt, Homo sapiens
gcaacaucaucuucuccaa

SEQ ID NO: 931672 - RNA, 19 nt, Homo sapiens
ggacgucacggcggacuuu

SEQ ID NO: 931673 - RNA, 19 nt, Homo sapiens
caaugugaccgauauguuc

SEQ ID NO: 931674 - RNA, 19 nt, Homo sapiens
gcacugcuacgacaucuac

SEQ ID NO: 931675 - RNA, 19 nt, Homo sapiens
gaagcguuccgacagauca

SEQ ID NO: 931676 - RNA, 19 nt, Homo sapiens
gugccuaccugaggaugaa

SEQ ID NO: 931677 - RNA, 19 nt, Homo sapiens
gaccuucgccagcaacaau

SEQ ID NO: 931678 - RNA, 19 nt, Homo sapiens
gggcccaccuucuucuaca

SEQ ID NO: 931679 - RNA, 19 nt, Homo sapiens
ucaccgugcuggccaugau

SEQ ID NO: 931680 - RNA, 19 nt, Homo sapiens
ggaccugacccagcucuuc

SEQ ID NO: 931681 - RNA, 19 nt, Homo sapiens
gaccugacccagcucuuca

SEQ ID NO: 931682 - RNA, 19 nt, Homo sapiens
ccagcaacaucaucuucuc

SEQ ID NO: 931683 - RNA, 19 nt, Homo sapiens
gagccucccacccagaaga

SEQ ID NO: 931684 - RNA, 19 nt, Homo sapiens
acaaugugaccgauauguu

SEQ ID NO: 931685 - RNA, 19 nt, Homo sapiens
gcaccaccucgaccucaga

SEQ ID NO: 931686 - RNA, 19 nt, Homo sapiens
caacaaugugaccgauaug

SEQ ID NO: 931687 - RNA, 19 nt, Homo sapiens
ugagugaggcccagaggau

SEQ ID NO: 931688 - RNA, 19 nt, Homo sapiens
ggacuuugagggccagagu

SEQ ID NO: 931689 - RNA, 19 nt, Homo sapiens
gggccagagucccaaaugc

SEQ ID NO: 931690 - RNA, 19 nt, Homo sapiens
uccgacagaucaaggacuu

SEQ ID NO: 931691 - RNA, 19 nt, Homo sapiens
gccaucgccuucgguggaa

SEQ ID NO: 931692 - RNA, 19 nt, Homo sapiens
ggccagagucccaaaugca

SEQ ID NO: 931693 - RNA, 19 nt, Homo sapiens
gcuggaggccaccaucauc

SEQ ID NO: 931694 - RNA, 19 nt, Homo sapiens
cagagccucccacccagaa

SEQ ID NO: 931695 - RNA, 19 nt, Homo sapiens
caacaggcaucaacacuua

SEQ ID NO: 931696 - RNA, 19 nt, Homo sapiens
uaagaaugcuggcuaauuu

SEQ ID NO: 931697 - RNA, 19 nt, Homo sapiens
ucaaagagcucaagaacuu

SEQ ID NO: 931698 - RNA, 19 nt, Homo sapiens
ggagaagcauuguuuauga

SEQ ID NO: 931699 - RNA, 19 nt, Homo sapiens
ccacugaauucauguaaua

SEQ ID NO: 931700 - RNA, 19 nt, Homo sapiens
gcacuuaaacuucagaaua

SEQ ID NO: 931701 - RNA, 19 nt, Homo sapiens
gaaaugaucucuggaauac

SEQ ID NO: 931702 - RNA, 19 nt, Homo sapiens
ccaaauauguggucuauca

SEQ ID NO: 931703 - RNA, 19 nt, Homo sapiens
gauaguguaugcauaugua

SEQ ID NO: 931704 - RNA, 19 nt, Homo sapiens
caccaaaucuuacaaauca

SEQ ID NO: 931705 - RNA, 19 nt, Homo sapiens
cuacaaggcuacuuucaaa

SEQ ID NO: 931706 - RNA, 19 nt, Homo sapiens
caucaacacuuauuucaga

SEQ ID NO: 931707 - RNA, 19 nt, Homo sapiens
cuaaggaacuggagauuau

SEQ ID NO: 931708 - RNA, 19 nt, Homo sapiens
gaacagaauaccacuaaau

SEQ ID NO: 931709 - RNA, 19 nt, Homo sapiens
uaaacaggcuucuaaaucu

SEQ ID NO: 931710 - RNA, 19 nt, Homo sapiens
ggaaauagaagccaugugu

SEQ ID NO: 931711 - RNA, 19 nt, Homo sapiens
gagaagcauuguuuaugaa

SEQ ID NO: 931712 - RNA, 19 nt, Homo sapiens
aaccagagccauagaauua

SEQ ID NO: 931713 - RNA, 19 nt, Homo sapiens
gcucuaagacacuaauaua

SEQ ID NO: 931714 - RNA, 19 nt, Homo sapiens
cuaaaucugucacugaauu

SEQ ID NO: 931715 - RNA, 19 nt, Homo sapiens
cagauuccauuaacuauug

SEQ ID NO: 931716 - RNA, 19 nt, Homo sapiens
guuuguaaaucacgucuua

SEQ ID NO: 931717 - RNA, 19 nt, Homo sapiens
caacacuuauuucagauug

SEQ ID NO: 931718 - RNA, 19 nt, Homo sapiens
gaauauuccucuggagauu

SEQ ID NO: 931719 - RNA, 19 nt, Homo sapiens
gcucaacaguauaguggua

SEQ ID NO: 931720 - RNA, 19 nt, Homo sapiens
cuaaagcacuuaaacuuca

SEQ ID NO: 931721 - RNA, 19 nt, Homo sapiens
ggaaaaugcuuuaccaaga

SEQ ID NO: 931722 - RNA, 19 nt, Homo sapiens
uaauaagaaugcuggcuaa

SEQ ID NO: 931723 - RNA, 19 nt, Homo sapiens
guaguacgauuauaugcaa

SEQ ID NO: 931724 - RNA, 19 nt, Homo sapiens
gcaucaagcaaccuauuua

SEQ ID NO: 931725 - RNA, 19 nt, Homo sapiens
uaccacauauucacguuua

SEQ ID NO: 931726 - RNA, 19 nt, Homo sapiens
ggucuauucugcuacauga

SEQ ID NO: 931727 - RNA, 19 nt, Homo sapiens
cagauggguuauccuguua

SEQ ID NO: 931728 - RNA, 19 nt, Homo sapiens
gaacgccacccgcuacgua

SEQ ID NO: 931729 - RNA, 19 nt, Homo sapiens
gcaaaaggcuucaaggaau

SEQ ID NO: 931730 - RNA, 19 nt, Homo sapiens
uaauggaucucuuguucaa

SEQ ID NO: 931731 - RNA, 19 nt, Homo sapiens
gaccaaauaugauagugau

SEQ ID NO: 931732 - RNA, 19 nt, Homo sapiens
caugauugcuucagcugua

SEQ ID NO: 931733 - RNA, 19 nt, Homo sapiens
cuaccaacaugaagaacua

SEQ ID NO: 931734 - RNA, 19 nt, Homo sapiens
gcaauuauuugggugucua

SEQ ID NO: 931735 - RNA, 19 nt, Homo sapiens
agagguggaugucuuguuu

SEQ ID NO: 931736 - RNA, 19 nt, Homo sapiens
gaauaaaguaccaccuaaa

SEQ ID NO: 931737 - RNA, 19 nt, Homo sapiens
agaauaaaguaccaccuaa

SEQ ID NO: 931738 - RNA, 19 nt, Homo sapiens
gaaccagagccauagaauu

SEQ ID NO: 931739 - RNA, 19 nt, Homo sapiens
ccagcaugcuuauuucaaa

SEQ ID NO: 931740 - RNA, 19 nt, Homo sapiens
gaauaggcaugauaauacu

SEQ ID NO: 931741 - RNA, 19 nt, Homo sapiens
gugaauaggcaugauaaua

SEQ ID NO: 931742 - RNA, 19 nt, Homo sapiens
ccagauggguuauccuguu

SEQ ID NO: 931743 - RNA, 19 nt, Homo sapiens
caagcaaccuauuuaucuu

SEQ ID NO: 931744 - RNA, 19 nt, Homo sapiens
ccagagccauagaauuauu

SEQ ID NO: 931745 - RNA, 19 nt, Homo sapiens
ggaacagaauaccacuaaa

SEQ ID NO: 931746 - RNA, 19 nt, Homo sapiens
ugaccgauguucugcauga

SEQ ID NO: 931747 - RNA, 19 nt, Homo sapiens
gaacaacugguuuaucuac

SEQ ID NO: 931748 - RNA, 19 nt, Homo sapiens
ugaagccgcugcacuacaa

SEQ ID NO: 931749 - RNA, 19 nt, Homo sapiens
ggccagcucuccaaacguu

SEQ ID NO: 931750 - RNA, 19 nt, Homo sapiens
gaggaugucugggaauuca

SEQ ID NO: 931751 - RNA, 19 nt, Homo sapiens
ucuacaaucucaaauccua

SEQ ID NO: 931752 - RNA, 19 nt, Homo sapiens
gcucaagaacuucaugaaa

SEQ ID NO: 931753 - RNA, 19 nt, Homo sapiens
cagaauaccacuaaauguu

SEQ ID NO: 931754 - RNA, 19 nt, Homo sapiens
uaacuauugugguaggaaa

SEQ ID NO: 931755 - RNA, 19 nt, Homo sapiens
ggacacuccagauggguua

SEQ ID NO: 931756 - RNA, 19 nt, Homo sapiens
ggaauaaucuguaaaacgu

SEQ ID NO: 931757 - RNA, 19 nt, Homo sapiens
uaucaccacugaauucaug

SEQ ID NO: 931758 - RNA, 19 nt, Homo sapiens
gaggagcuauuuccgaauc

SEQ ID NO: 931759 - RNA, 19 nt, Homo sapiens
gaaaauguacuaccuagaa

SEQ ID NO: 931760 - RNA, 19 nt, Homo sapiens
gaaaagcucuaagacacua

SEQ ID NO: 931761 - RNA, 19 nt, Homo sapiens
gagcgggcuugaucgauga

SEQ ID NO: 931762 - RNA, 19 nt, Homo sapiens
caauuaauccggaaucaug

SEQ ID NO: 931763 - RNA, 19 nt, Homo sapiens
ucagagcaccacagaauaa

SEQ ID NO: 931764 - RNA, 19 nt, Homo sapiens
caacuucacauacagagaa

SEQ ID NO: 931765 - RNA, 19 nt, Homo sapiens
ucucaaauccuaaguguau

SEQ ID NO: 931766 - RNA, 19 nt, Homo sapiens
ucaagugggucuauuagca

SEQ ID NO: 931767 - RNA, 19 nt, Homo sapiens
gcagugaugacaggaauuu

SEQ ID NO: 931768 - RNA, 19 nt, Homo sapiens
guagagaaguuauaaugcu

SEQ ID NO: 931769 - RNA, 19 nt, Homo sapiens
gaagaacuacguagagaag

SEQ ID NO: 931770 - RNA, 19 nt, Homo sapiens
uaaaauagcccuugacaug

SEQ ID NO: 931771 - RNA, 19 nt, Homo sapiens
acaaacaauucaacucaga

SEQ ID NO: 931772 - RNA, 19 nt, Homo sapiens
caucaguggugucacagaa

SEQ ID NO: 931773 - RNA, 19 nt, Homo sapiens
guauggagaagcauuguuu

SEQ ID NO: 931774 - RNA, 19 nt, Homo sapiens
caacaugaagaacuacgua

SEQ ID NO: 931775 - RNA, 19 nt, Homo sapiens
uccauuaacuauuguggua

SEQ ID NO: 931776 - RNA, 19 nt, Homo sapiens
acaacgcgcucaucgagaa

SEQ ID NO: 931777 - RNA, 19 nt, Homo sapiens
caacugguuuaucuacaau

SEQ ID NO: 931778 - RNA, 19 nt, Homo sapiens
ugaguaguccagagaguua

SEQ ID NO: 931779 - RNA, 19 nt, Homo sapiens
ucaguggugucacagaauu

SEQ ID NO: 931780 - RNA, 19 nt, Homo sapiens
gcagauuccauuaacuauu

SEQ ID NO: 931781 - RNA, 19 nt, Homo sapiens
gaagauuccuugguguuac

SEQ ID NO: 931782 - RNA, 19 nt, Homo sapiens
ccacaucgccguacacaag

SEQ ID NO: 931783 - RNA, 19 nt, Homo sapiens
gaugugaauaggcaugaua

SEQ ID NO: 931784 - RNA, 19 nt, Homo sapiens
gugggucuauuagcauuua

SEQ ID NO: 931785 - RNA, 19 nt, Homo sapiens
ucacuuauuucagcacuug

SEQ ID NO: 931786 - RNA, 19 nt, Homo sapiens
uaacaugugggaggaauuu

SEQ ID NO: 931787 - RNA, 19 nt, Homo sapiens
ggccagauuuucaguguua

SEQ ID NO: 931788 - RNA, 19 nt, Homo sapiens
agaaaugaucucuggaaua

SEQ ID NO: 931789 - RNA, 19 nt, Homo sapiens
ggaaggguuugcucacuac

SEQ ID NO: 931790 - RNA, 19 nt, Homo sapiens
uaucaggcuuuaccgguuu

SEQ ID NO: 931791 - RNA, 19 nt, Homo sapiens
caaggaauuuaucucaaca

SEQ ID NO: 931792 - RNA, 19 nt, Homo sapiens
uuucaaacguccaguguug

SEQ ID NO: 931793 - RNA, 19 nt, Homo sapiens
ggaccaaauaugauaguga

SEQ ID NO: 931794 - RNA, 19 nt, Homo sapiens
gucgagaccuugccuggaa

SEQ ID NO: 931795 - RNA, 19 nt, Homo sapiens
cgaauucgcuucauccauu

SEQ ID NO: 931796 - RNA, 19 nt, Homo sapiens
gcacuggccuaucaacuau

SEQ ID NO: 931797 - RNA, 19 nt, Homo sapiens
gaaagguucugcccaagug

SEQ ID NO: 931798 - RNA, 19 nt, Homo sapiens
ugaggaagcugccuaagga

SEQ ID NO: 931799 - RNA, 19 nt, Homo sapiens
ggaacaaccugcacaaugc

SEQ ID NO: 931800 - RNA, 19 nt, Homo sapiens
ggucugugcuuggcucuua

SEQ ID NO: 931801 - RNA, 19 nt, Homo sapiens
gaccaaccaucauuaaugu

SEQ ID NO: 931802 - RNA, 19 nt, Homo sapiens
ggucagaucucuuuaaagc

SEQ ID NO: 931803 - RNA, 19 nt, Homo sapiens
agaauucccugcccacuuu

SEQ ID NO: 931804 - RNA, 19 nt, Homo sapiens
caaggcagguugguuaauu

SEQ ID NO: 931805 - RNA, 19 nt, Homo sapiens
uaagguggcuggacucaug

SEQ ID NO: 931806 - RNA, 19 nt, Homo sapiens
cggaauugcuuucuucuga

SEQ ID NO: 931807 - RNA, 19 nt, Homo sapiens
gcagguugguuaauuagau

SEQ ID NO: 931808 - RNA, 19 nt, Homo sapiens
ccaaccaucauuaauguua

SEQ ID NO: 931809 - RNA, 19 nt, Homo sapiens
gagugcagcuggaauggaa

SEQ ID NO: 931810 - RNA, 19 nt, Homo sapiens
gaauucgcuucauccauuu

SEQ ID NO: 931811 - RNA, 19 nt, Homo sapiens
uguaagacauggagacauu

SEQ ID NO: 931812 - RNA, 19 nt, Homo sapiens
gaacaccauugcagaccuu

SEQ ID NO: 931813 - RNA, 19 nt, Homo sapiens
aauaugggcuucagcugua

SEQ ID NO: 931814 - RNA, 19 nt, Homo sapiens
gaaaugcagcaacgucaaa

SEQ ID NO: 931815 - RNA, 19 nt, Homo sapiens
caaguuuguuggccucuuu

SEQ ID NO: 931816 - RNA, 19 nt, Homo sapiens
uacaacaaccuguggauua

SEQ ID NO: 931817 - RNA, 19 nt, Homo sapiens
gagggcauguuguccauau

SEQ ID NO: 931818 - RNA, 19 nt, Homo sapiens
ccauaucaaucccaaguug

SEQ ID NO: 931819 - RNA, 19 nt, Homo sapiens
gaacuugcacagucacuau

SEQ ID NO: 931820 - RNA, 19 nt, Homo sapiens
caagaaacauaacacaaac

SEQ ID NO: 931821 - RNA, 19 nt, Homo sapiens
ggauugaggucguaaacag

SEQ ID NO: 931822 - RNA, 19 nt, Homo sapiens
gcagguagcuggacuuccu

SEQ ID NO: 931823 - RNA, 19 nt, Homo sapiens
aguccaggcuauaguaaua

SEQ ID NO: 931824 - RNA, 19 nt, Homo sapiens
ggccaggucucuccaagug

SEQ ID NO: 931825 - RNA, 19 nt, Homo sapiens
gcauacggcucugugauca

SEQ ID NO: 931826 - RNA, 19 nt, Homo sapiens
ccacggagacuggauauug

SEQ ID NO: 931827 - RNA, 19 nt, Homo sapiens
ucagaucucuuuaaagcau

SEQ ID NO: 931828 - RNA, 19 nt, Homo sapiens
gaacaggggacucaaauga

SEQ ID NO: 931829 - RNA, 19 nt, Homo sapiens
gcacaaggacuacaacaac

SEQ ID NO: 931830 - RNA, 19 nt, Homo sapiens
aaggcagguugguuaauua

SEQ ID NO: 931831 - RNA, 19 nt, Homo sapiens
aagcaaggcagguugguua

SEQ ID NO: 931832 - RNA, 19 nt, Homo sapiens
uccaggagguggcugauuu

SEQ ID NO: 931833 - RNA, 19 nt, Homo sapiens
acaaugaguucacguccaa

SEQ ID NO: 931834 - RNA, 19 nt, Homo sapiens
gggaacaaccugcacaaug

SEQ ID NO: 931835 - RNA, 19 nt, Homo sapiens
cagggugcuucuaugaaua

SEQ ID NO: 931836 - RNA, 19 nt, Homo sapiens
ccugagaucuugcuggaau

SEQ ID NO: 931837 - RNA, 19 nt, Homo sapiens
guaaacaggaaauuuggaa

SEQ ID NO: 931838 - RNA, 19 nt, Homo sapiens
ucagggugcuucuaugaau

SEQ ID NO: 931839 - RNA, 19 nt, Homo sapiens
ugaggccacugcaaagauu

SEQ ID NO: 931840 - RNA, 19 nt, Homo sapiens
gcauacauguggcgggaau

SEQ ID NO: 931841 - RNA, 19 nt, Homo sapiens
acaacaaccuguggauuau

SEQ ID NO: 931842 - RNA, 19 nt, Homo sapiens
ccaccuauuugcacaagga

SEQ ID NO: 931843 - RNA, 19 nt, Homo sapiens
gagcugcccucuugugacu

SEQ ID NO: 931844 - RNA, 19 nt, Homo sapiens
gacagggucagaucucuuu

SEQ ID NO: 931845 - RNA, 19 nt, Homo sapiens
gggcaaggcagaugcauuc

SEQ ID NO: 931846 - RNA, 19 nt, Homo sapiens
caaaagggaugaagaaaac

SEQ ID NO: 931847 - RNA, 19 nt, Homo sapiens
agacauuauucgacuagaa

SEQ ID NO: 931848 - RNA, 19 nt, Homo sapiens
gaggagggauggagaagcu

SEQ ID NO: 931849 - RNA, 19 nt, Homo sapiens
agaugggacugucaaaguu

SEQ ID NO: 931850 - RNA, 19 nt, Homo sapiens
gaacccagcauuggagaga

SEQ ID NO: 931851 - RNA, 19 nt, Homo sapiens
aauaugagcaucacagcua

SEQ ID NO: 931852 - RNA, 19 nt, Homo sapiens
ggucguaaacaggaaauuu

SEQ ID NO: 931853 - RNA, 19 nt, Homo sapiens
gagccuauuugguuuaaaa

SEQ ID NO: 931854 - RNA, 19 nt, Homo sapiens
caccuuugcuguucacuuc

SEQ ID NO: 931855 - RNA, 19 nt, Homo sapiens
ccacuugcuuaauugcauu

SEQ ID NO: 931856 - RNA, 19 nt, Homo sapiens
ggaauguggaggaccauau

SEQ ID NO: 931857 - RNA, 19 nt, Homo sapiens
ggaucaaagugcugagaag

SEQ ID NO: 931858 - RNA, 19 nt, Homo sapiens
ggugacgguuucuucaguu

SEQ ID NO: 931859 - RNA, 19 nt, Homo sapiens
gagaggauucugugcauuc

SEQ ID NO: 931860 - RNA, 19 nt, Homo sapiens
ucagaggacuuugaugcuu

SEQ ID NO: 931861 - RNA, 19 nt, Homo sapiens
aaugauuucuggcggauug

SEQ ID NO: 931862 - RNA, 19 nt, Homo sapiens
uggauaugaugguaccuuu

SEQ ID NO: 931863 - RNA, 19 nt, Homo sapiens
ggcacuggccuaucaacua

SEQ ID NO: 931864 - RNA, 19 nt, Homo sapiens
ugggagcaguuggaaguua

SEQ ID NO: 931865 - RNA, 19 nt, Homo sapiens
cagcugcccuccucaccuu

SEQ ID NO: 931866 - RNA, 19 nt, Homo sapiens
gaagggaagagcucugaag

SEQ ID NO: 931867 - RNA, 19 nt, Homo sapiens
ggaacugccuacagcuucu

SEQ ID NO: 931868 - RNA, 19 nt, Homo sapiens
cgacuagaacacaaagaaa

SEQ ID NO: 931869 - RNA, 19 nt, Homo sapiens
guaagacauggagacauua

SEQ ID NO: 931870 - RNA, 19 nt, Homo sapiens
agaagccacugauuuuaua

SEQ ID NO: 931871 - RNA, 19 nt, Homo sapiens
gagaauucccugcccacuu

SEQ ID NO: 931872 - RNA, 19 nt, Homo sapiens
ggagaggagggauggagaa

SEQ ID NO: 931873 - RNA, 19 nt, Homo sapiens
ggaaaugcagcaacgucaa

SEQ ID NO: 931874 - RNA, 19 nt, Homo sapiens
ucagaccaaccaucauuaa

SEQ ID NO: 931875 - RNA, 19 nt, Homo sapiens
ccauaucccuguggaauac

SEQ ID NO: 931876 - RNA, 19 nt, Homo sapiens
gugcugagaagucgaauuc

SEQ ID NO: 931877 - RNA, 19 nt, Homo sapiens
uagucuugcuggugcuuua

SEQ ID NO: 931878 - RNA, 19 nt, Homo sapiens
agaccaaccaucauuaaug

SEQ ID NO: 931879 - RNA, 19 nt, Homo sapiens
agggucagaucucuuuaaa

SEQ ID NO: 931880 - RNA, 19 nt, Homo sapiens
acacagauuuccgagucua

SEQ ID NO: 931881 - RNA, 19 nt, Homo sapiens
cuauaucaaccguacauuu

SEQ ID NO: 931882 - RNA, 19 nt, Homo sapiens
aagaaacccucaacuccau

SEQ ID NO: 931883 - RNA, 19 nt, Homo sapiens
ggaaagguucugcccaagu

SEQ ID NO: 931884 - RNA, 19 nt, Homo sapiens
ggccaugcuuggacauuca

SEQ ID NO: 931885 - RNA, 19 nt, Homo sapiens
uaacuggacagcugagugu

SEQ ID NO: 931886 - RNA, 19 nt, Homo sapiens
ugaaagaaacccucaacuc

SEQ ID NO: 931887 - RNA, 19 nt, Homo sapiens
cuaccucacuguacuggau

SEQ ID NO: 931888 - RNA, 19 nt, Homo sapiens
gagcagaugggacugucaa

SEQ ID NO: 931889 - RNA, 19 nt, Homo sapiens
ucaaacccaaggacaauga

SEQ ID NO: 931890 - RNA, 19 nt, Homo sapiens
aaugggaaguuacuauauc

SEQ ID NO: 931891 - RNA, 19 nt, Homo sapiens
gaaacauaacacaaacuca

SEQ ID NO: 931892 - RNA, 19 nt, Homo sapiens
cccaguacauccuccuuga

SEQ ID NO: 931893 - RNA, 19 nt, Homo sapiens
ggcuucagcuguagcacuu

SEQ ID NO: 931894 - RNA, 19 nt, Homo sapiens
gggcagucaccuuacauga

SEQ ID NO: 931895 - RNA, 19 nt, Homo sapiens
ggaguagaauggcaacuaa

SEQ ID NO: 931896 - RNA, 19 nt, Homo sapiens
ucacauuccuuuauucuga

SEQ ID NO: 931897 - RNA, 19 nt, Homo sapiens
cagccaagauguuuaacua

SEQ ID NO: 931898 - RNA, 19 nt, Homo sapiens
uaacaaccaucguaagaau

SEQ ID NO: 931899 - RNA, 19 nt, Homo sapiens
gcuauuacuucuucaauuc

SEQ ID NO: 931900 - RNA, 19 nt, Homo sapiens
gaaagcugguagaagauga

SEQ ID NO: 931901 - RNA, 19 nt, Homo sapiens
gcucccagauuaaugcaua

SEQ ID NO: 931902 - RNA, 19 nt, Homo sapiens
gcucuauccugccuucuuu

SEQ ID NO: 931903 - RNA, 19 nt, Homo sapiens
ugauugaacuuuccuucua

SEQ ID NO: 931904 - RNA, 19 nt, Homo sapiens
cggaugaucuuucuuagug

SEQ ID NO: 931905 - RNA, 19 nt, Homo sapiens
gcucggaugaucuuucuua

SEQ ID NO: 931906 - RNA, 19 nt, Homo sapiens
uuucuaaccucccuaaauu

SEQ ID NO: 931907 - RNA, 19 nt, Homo sapiens
gcauaaagccaaggaacua

SEQ ID NO: 931908 - RNA, 19 nt, Homo sapiens
cgacaggucuaagaucuga

SEQ ID NO: 931909 - RNA, 19 nt, Homo sapiens
gcacuaucccuucccagua

SEQ ID NO: 931910 - RNA, 19 nt, Homo sapiens
cuggaaagcugguagaaga

SEQ ID NO: 931911 - RNA, 19 nt, Homo sapiens
ggacguugguuauauucug

SEQ ID NO: 931912 - RNA, 19 nt, Homo sapiens
ccaguugccuuuaaaccaa

SEQ ID NO: 931913 - RNA, 19 nt, Homo sapiens
gaagaacaccugcaacaac

SEQ ID NO: 931914 - RNA, 19 nt, Homo sapiens
gcgcauggcccacaaguuc

SEQ ID NO: 931915 - RNA, 19 nt, Homo sapiens
ggagucagccaagauguuu

SEQ ID NO: 931916 - RNA, 19 nt, Homo sapiens
gcaugacucuuccgauuac

SEQ ID NO: 931917 - RNA, 19 nt, Homo sapiens
gcaacaacaucuucaucgu

SEQ ID NO: 931918 - RNA, 19 nt, Homo sapiens
ccucugaugucaagcgaaa

SEQ ID NO: 931919 - RNA, 19 nt, Homo sapiens
ggaggagggugcacauaac

SEQ ID NO: 931920 - RNA, 19 nt, Homo sapiens
ucacccaguugccuuuaaa

SEQ ID NO: 931921 - RNA, 19 nt, Homo sapiens
ucaauaacaaccaucguaa

SEQ ID NO: 931922 - RNA, 19 nt, Homo sapiens
ggaagaacaccugcaacaa

SEQ ID NO: 931923 - RNA, 19 nt, Homo sapiens
ggcuauuacuucuucaauu

SEQ ID NO: 931924 - RNA, 19 nt, Homo sapiens
aagaacaccugcaacaaca

SEQ ID NO: 931925 - RNA, 19 nt, Homo sapiens
agaccaaaauguacuguua

SEQ ID NO: 931926 - RNA, 19 nt, Homo sapiens
ucuaugacaugaagaaagu

SEQ ID NO: 931927 - RNA, 19 nt, Homo sapiens
cugcaugacucuuccgauu

SEQ ID NO: 931928 - RNA, 19 nt, Homo sapiens
uuuccugguuugccaauua

SEQ ID NO: 931929 - RNA, 19 nt, Homo sapiens
augacugacugaaccauua

SEQ ID NO: 931930 - RNA, 19 nt, Homo sapiens
ggacugcucggaugaucuu

SEQ ID NO: 931931 - RNA, 19 nt, Homo sapiens
caagucauccuuucuacug

SEQ ID NO: 931932 - RNA, 19 nt, Homo sapiens
cauccgagcugggacucua

SEQ ID NO: 931933 - RNA, 19 nt, Homo sapiens
gaauuacggcuagcaccua

SEQ ID NO: 931934 - RNA, 19 nt, Homo sapiens
gaacaccugcaacaacauc

SEQ ID NO: 931935 - RNA, 19 nt, Homo sapiens
uagcugguuuggaguagaa

SEQ ID NO: 931936 - RNA, 19 nt, Homo sapiens
cacuaucccuucccaguau

SEQ ID NO: 931937 - RNA, 19 nt, Homo sapiens
gguacuacaugauugaacu

SEQ ID NO: 931938 - RNA, 19 nt, Homo sapiens
gauugaacuuuccuucuac

SEQ ID NO: 931939 - RNA, 19 nt, Homo sapiens
caaauucuaaccagccuau

SEQ ID NO: 931940 - RNA, 19 nt, Homo sapiens
aauaacaaccaucguaaga

SEQ ID NO: 931941 - RNA, 19 nt, Homo sapiens
gccuuaaggucccaucugu

SEQ ID NO: 931942 - RNA, 19 nt, Homo sapiens
gaaaggagaggagaguucu

SEQ ID NO: 931943 - RNA, 19 nt, Homo sapiens
guauugguacuacaugauu

SEQ ID NO: 931944 - RNA, 19 nt, Homo sapiens
ggaaagcugguagaagaug

SEQ ID NO: 931945 - RNA, 19 nt, Homo sapiens
gauggaagaacaccugcaa

SEQ ID NO: 931946 - RNA, 19 nt, Homo sapiens
ucuuucagcugucccugua

SEQ ID NO: 931947 - RNA, 19 nt, Homo sapiens
uaacuuucucccucuauga

SEQ ID NO: 931948 - RNA, 19 nt, Homo sapiens
acaaccaucguaagaauga

SEQ ID NO: 931949 - RNA, 19 nt, Homo sapiens
caacaucuucaucgucuuc

SEQ ID NO: 931950 - RNA, 19 nt, Homo sapiens
gaugucaagcgaaaggauu

SEQ ID NO: 931951 - RNA, 19 nt, Homo sapiens
ucccugaacuccaaagcaa

SEQ ID NO: 931952 - RNA, 19 nt, Homo sapiens
gacguugguuauauucugu

SEQ ID NO: 931953 - RNA, 19 nt, Homo sapiens
ggagaaaggagaggagagu

SEQ ID NO: 931954 - RNA, 19 nt, Homo sapiens
agaucugacugccuccuuu

SEQ ID NO: 931955 - RNA, 19 nt, Homo sapiens
ccagauuaaugcauaaagc

SEQ ID NO: 931956 - RNA, 19 nt, Homo sapiens
cuucuucaauuccaugaug

SEQ ID NO: 931957 - RNA, 19 nt, Homo sapiens
gagcugggacucuaaucau

SEQ ID NO: 931958 - RNA, 19 nt, Homo sapiens
cccagcaguuugccuuuga

SEQ ID NO: 931959 - RNA, 19 nt, Homo sapiens
gaaaguuugggagggauau

SEQ ID NO: 931960 - RNA, 19 nt, Homo sapiens
ccauguggccaccaucauu

SEQ ID NO: 931961 - RNA, 19 nt, Homo sapiens
gcagagggaccauuuuaga

SEQ ID NO: 931962 - RNA, 19 nt, Homo sapiens
aaagcuggaccaaggcuaa

SEQ ID NO: 931963 - RNA, 19 nt, Homo sapiens
cguugguuauauucuguua

SEQ ID NO: 931964 - RNA, 19 nt, Homo sapiens
gcgcuauagggucacuuua

SEQ ID NO: 931965 - RNA, 19 nt, Homo sapiens
cuucugggccuaccucauu

SEQ ID NO: 931966 - RNA, 19 nt, Homo sapiens
ugcaugacucuuccgauua

SEQ ID NO: 931967 - RNA, 19 nt, Homo sapiens
caaaauguacuguuaaugg

SEQ ID NO: 931968 - RNA, 19 nt, Homo sapiens
cagcagagggaccauuuua

SEQ ID NO: 931969 - RNA, 19 nt, Homo sapiens
aguagaauggcaacuaauu

SEQ ID NO: 931970 - RNA, 19 nt, Homo sapiens
gaauuuggccccagcaguu

SEQ ID NO: 931971 - RNA, 19 nt, Homo sapiens
gccaagucauccuuucuac

SEQ ID NO: 931972 - RNA, 19 nt, Homo sapiens
aggaggagggugcacauaa

SEQ ID NO: 931973 - RNA, 19 nt, Homo sapiens
gccuuuaaaccaaauucua

SEQ ID NO: 931974 - RNA, 19 nt, Homo sapiens
guaagaaugacugacugaa

SEQ ID NO: 931975 - RNA, 19 nt, Homo sapiens
ggcugucacuguggauaaa

SEQ ID NO: 931976 - RNA, 19 nt, Homo sapiens
gguuuuaaagccagaauua

SEQ ID NO: 931977 - RNA, 19 nt, Homo sapiens
gagaaaggagaggagaguu

SEQ ID NO: 931978 - RNA, 19 nt, Homo sapiens
gcagugaccgggaaguaac

SEQ ID NO: 931979 - RNA, 19 nt, Homo sapiens
uauugguacuacaugauug

SEQ ID NO: 931980 - RNA, 19 nt, Homo sapiens
uuaacuuucucccucuaug

SEQ ID NO: 931981 - RNA, 19 nt, Homo sapiens
caguugccuuuaaaccaaa

SEQ ID NO: 931982 - RNA, 19 nt, Homo sapiens
uaacuggaaagcugguaga

SEQ ID NO: 931983 - RNA, 19 nt, Homo sapiens
cagcauugccucugauguc

SEQ ID NO: 931984 - RNA, 19 nt, Homo sapiens
gagucagccaagauguuua

SEQ ID NO: 931985 - RNA, 19 nt, Homo sapiens
gacugcgccuguccugguu

SEQ ID NO: 931986 - RNA, 19 nt, Homo sapiens
gaucugacugccuccuuuc

SEQ ID NO: 931987 - RNA, 19 nt, Homo sapiens
gucacccaguugccuuuaa

SEQ ID NO: 931988 - RNA, 19 nt, Homo sapiens
ugacugaaccauuauucca

SEQ ID NO: 931989 - RNA, 19 nt, Homo sapiens
cucaauaacaaccaucgua

SEQ ID NO: 931990 - RNA, 19 nt, Homo sapiens
caucagcuuuuccugguuu

SEQ ID NO: 931991 - RNA, 19 nt, Homo sapiens
uaagaaugacugacugaac

SEQ ID NO: 931992 - RNA, 19 nt, Homo sapiens
caauaacaaccaucguaag

SEQ ID NO: 931993 - RNA, 19 nt, Homo sapiens
cuacaugauugaacuuucc

SEQ ID NO: 931994 - RNA, 19 nt, Homo sapiens
uggaagaacaccugcaaca

SEQ ID NO: 931995 - RNA, 19 nt, Homo sapiens
gaagggaagugaugaaauu

SEQ ID NO: 931996 - RNA, 19 nt, Homo sapiens
gaaccuaccucuuuuauuu

SEQ ID NO: 931997 - RNA, 19 nt, Homo sapiens
ggugagagauacauauuaa

SEQ ID NO: 931998 - RNA, 19 nt, Homo sapiens
gggaagugaugaaauuaua

SEQ ID NO: 931999 - RNA, 19 nt, Homo sapiens
gcacaaaggugagagauac

SEQ ID NO: 932000 - RNA, 19 nt, Homo sapiens
ggauauaggagacuuaauu

SEQ ID NO: 932001 - RNA, 19 nt, Homo sapiens
ugaaguggauugaucauga

SEQ ID NO: 932002 - RNA, 19 nt, Homo sapiens
gaaauccuuugacuuguau

SEQ ID NO: 932003 - RNA, 19 nt, Homo sapiens
gaucagcucuuucuauuuu

SEQ ID NO: 932004 - RNA, 19 nt, Homo sapiens
cgaaauccuuugacuugua

SEQ ID NO: 932005 - RNA, 19 nt, Homo sapiens
gaaacgaaauccuuugacu

SEQ ID NO: 932006 - RNA, 19 nt, Homo sapiens
uuaggaacauguuaggaua

SEQ ID NO: 932007 - RNA, 19 nt, Homo sapiens
ugaaaggcccaauuuguaa

SEQ ID NO: 932008 - RNA, 19 nt, Homo sapiens
caacacaaggcaauuuauu

SEQ ID NO: 932009 - RNA, 19 nt, Homo sapiens
gaaaggcccaauuuguaaa

SEQ ID NO: 932010 - RNA, 19 nt, Homo sapiens
ggcccaauuuguaaacaua

SEQ ID NO: 932011 - RNA, 19 nt, Homo sapiens
cugcagagcaucuuuguuu

SEQ ID NO: 932012 - RNA, 19 nt, Homo sapiens
guuauaaauugccagcauu

SEQ ID NO: 932013 - RNA, 19 nt, Homo sapiens
gaaagauggacugguguuu

SEQ ID NO: 932014 - RNA, 19 nt, Homo sapiens
gagaguugaagauaguaua

SEQ ID NO: 932015 - RNA, 19 nt, Homo sapiens
guaugaaugugauuugucu

SEQ ID NO: 932016 - RNA, 19 nt, Homo sapiens
gaaugugauuugucuguac

SEQ ID NO: 932017 - RNA, 19 nt, Homo sapiens
ggauugaucaugagcaaau

SEQ ID NO: 932018 - RNA, 19 nt, Homo sapiens
gaaguggauugaucaugag

SEQ ID NO: 932019 - RNA, 19 nt, Homo sapiens
acacaaggcaauuuauuug

SEQ ID NO: 932020 - RNA, 19 nt, Homo sapiens
caaaggugagagauacaua

SEQ ID NO: 932021 - RNA, 19 nt, Homo sapiens
ugaaugugauuugucugua

SEQ ID NO: 932022 - RNA, 19 nt, Homo sapiens
uauuugaaccuaccucuuu

SEQ ID NO: 932023 - RNA, 19 nt, Homo sapiens
aggaacauguuaggauaua

SEQ ID NO: 932024 - RNA, 19 nt, Homo sapiens
ugauuugucuguacaucuu

SEQ ID NO: 932025 - RNA, 19 nt, Homo sapiens
aagauggacugguguuugu

SEQ ID NO: 932026 - RNA, 19 nt, Homo sapiens
gaauaucuuugaacuugcu

SEQ ID NO: 932027 - RNA, 19 nt, Homo sapiens
gccgagaguugaagauagu

SEQ ID NO: 932028 - RNA, 19 nt, Homo sapiens
augaucagcucuuucuauu

SEQ ID NO: 932029 - RNA, 19 nt, Homo sapiens
gguacaugaucagcucuuu

SEQ ID NO: 932030 - RNA, 19 nt, Homo sapiens
ugauaagccugggauucua

SEQ ID NO: 932031 - RNA, 19 nt, Homo sapiens
acauucauauucucucuug

SEQ ID NO: 932032 - RNA, 19 nt, Homo sapiens
gaacauguuaggauauagg

SEQ ID NO: 932033 - RNA, 19 nt, Homo sapiens
augaaaggcccaauuugua

SEQ ID NO: 932034 - RNA, 19 nt, Homo sapiens
gaacuugcuguuuucaaua

SEQ ID NO: 932035 - RNA, 19 nt, Homo sapiens
gcaugaaguggauugauca

SEQ ID NO: 932036 - RNA, 19 nt, Homo sapiens
aacgaaauccuuugacuug

SEQ ID NO: 932037 - RNA, 19 nt, Homo sapiens
uuaauugcaugaaguggau

SEQ ID NO: 932038 - RNA, 19 nt, Homo sapiens
cuuaguaaccugaaauuuc

SEQ ID NO: 932039 - RNA, 19 nt, Homo sapiens
caugaucagcucuuucuau

SEQ ID NO: 932040 - RNA, 19 nt, Homo sapiens
gugacaauauuaagguaca

SEQ ID NO: 932041 - RNA, 19 nt, Homo sapiens
guggauugaucaugagcaa

SEQ ID NO: 932042 - RNA, 19 nt, Homo sapiens
aaugaaaggcccaauuugu

SEQ ID NO: 932043 - RNA, 19 nt, Homo sapiens
cuucuugggaccauucuua

SEQ ID NO: 932044 - RNA, 19 nt, Homo sapiens
aaacgaaauccuuugacuu

SEQ ID NO: 932045 - RNA, 19 nt, Homo sapiens
gauggacugguguuuguga

SEQ ID NO: 932046 - RNA, 19 nt, Homo sapiens
ggaacauguuaggauauag

SEQ ID NO: 932047 - RNA, 19 nt, Homo sapiens
uuugguuccuggaguuaua

SEQ ID NO: 932048 - RNA, 19 nt, Homo sapiens
uuaaaugaaaggcccaauu

SEQ ID NO: 932049 - RNA, 19 nt, Homo sapiens
guauauuucugguaguacu

SEQ ID NO: 932050 - RNA, 19 nt, Homo sapiens
uuaccacuguaccauuauu

SEQ ID NO: 932051 - RNA, 19 nt, Homo sapiens
cacaaggcaauuuauuuga

SEQ ID NO: 932052 - RNA, 19 nt, Homo sapiens
gaaagauuccguuuauccu

SEQ ID NO: 932053 - RNA, 19 nt, Homo sapiens
uugggaccauucuuaguaa

SEQ ID NO: 932054 - RNA, 19 nt, Homo sapiens
cuugggaccauucuuagua

SEQ ID NO: 932055 - RNA, 19 nt, Homo sapiens
uguaagguaugaaugugau

SEQ ID NO: 932056 - RNA, 19 nt, Homo sapiens
gauucuacuuuuaggguua

SEQ ID NO: 932057 - RNA, 19 nt, Homo sapiens
aaagauggacugguguuug

SEQ ID NO: 932058 - RNA, 19 nt, Homo sapiens
cucccucacuguugaauau

SEQ ID NO: 932059 - RNA, 19 nt, Homo sapiens
gauugaucaugagcaaaug

SEQ ID NO: 932060 - RNA, 19 nt, Homo sapiens
gagcaucuuuguuuuccuu

SEQ ID NO: 932061 - RNA, 19 nt, Homo sapiens
cugguaguacugaauauuu

SEQ ID NO: 932062 - RNA, 19 nt, Homo sapiens
cuuaaacucauuucacuuc

SEQ ID NO: 932063 - RNA, 19 nt, Homo sapiens
guuaggauauaggagacuu

SEQ ID NO: 932064 - RNA, 19 nt, Homo sapiens
ccaacacaaggcaauuuau

SEQ ID NO: 932065 - RNA, 19 nt, Homo sapiens
aaaggugagagauacauau

SEQ ID NO: 932066 - RNA, 19 nt, Homo sapiens
ugcaugaaguggauugauc

SEQ ID NO: 932067 - RNA, 19 nt, Homo sapiens
ugaaagauuccguuuaucc

SEQ ID NO: 932068 - RNA, 19 nt, Homo sapiens
guacaugaucagcucuuuc

SEQ ID NO: 932069 - RNA, 19 nt, Homo sapiens
uuauuugguuccuggaguu

SEQ ID NO: 932070 - RNA, 19 nt, Homo sapiens
cuggaguuauacacuaauu

SEQ ID NO: 932071 - RNA, 19 nt, Homo sapiens
ugaagggaagugaugaaau

SEQ ID NO: 932072 - RNA, 19 nt, Homo sapiens
uaggauauaggagacuuaa

SEQ ID NO: 932073 - RNA, 19 nt, Homo sapiens
caauaugggcagcacaaag

SEQ ID NO: 932074 - RNA, 19 nt, Homo sapiens
accaacacaaggcaauuua

SEQ ID NO: 932075 - RNA, 19 nt, Homo sapiens
ugacuuguaucagcuucug

SEQ ID NO: 932076 - RNA, 19 nt, Homo sapiens
gauaagccugggauucuac

SEQ ID NO: 932077 - RNA, 19 nt, Homo sapiens
uguuauaaauugccagcau

SEQ ID NO: 932078 - RNA, 19 nt, Homo sapiens
aagggaagugaugaaauua

SEQ ID NO: 932079 - RNA, 19 nt, Homo sapiens
gcagcacaaaggugagaga

SEQ ID NO: 932080 - RNA, 19 nt, Homo sapiens
uccuggaguuauacacuaa

SEQ ID NO: 932081 - RNA, 19 nt, Homo sapiens
ggaccauucuuaguaaccu

SEQ ID NO: 932082 - RNA, 19 nt, Homo sapiens
ccucacuguugaauaucuu

SEQ ID NO: 932083 - RNA, 19 nt, Homo sapiens
aagccgagaguugaagaua

SEQ ID NO: 932084 - RNA, 19 nt, Homo sapiens
ugaucagcucuuucuauuu

SEQ ID NO: 932085 - RNA, 19 nt, Homo sapiens
uaccaacacaaggcaauuu

SEQ ID NO: 932086 - RNA, 19 nt, Homo sapiens
aaggugagagauacauauu

SEQ ID NO: 932087 - RNA, 19 nt, Homo sapiens
aaugugauuugucuguaca

SEQ ID NO: 932088 - RNA, 19 nt, Homo sapiens
aagccugggauucuacuuu

SEQ ID NO: 932089 - RNA, 19 nt, Homo sapiens
ggaaacgaaauccuuugac

SEQ ID NO: 932090 - RNA, 19 nt, Homo sapiens
agaaagauggacugguguu

SEQ ID NO: 932091 - RNA, 19 nt, Homo sapiens
uuccuggaguuauacacua

SEQ ID NO: 932092 - RNA, 19 nt, Homo sapiens
uuuccuuuguccuuuguuu

SEQ ID NO: 932093 - RNA, 19 nt, Homo sapiens
gaaagcaucugguacaaug

SEQ ID NO: 932094 - RNA, 19 nt, Homo sapiens
caucaaagcugccauggaa

SEQ ID NO: 932095 - RNA, 19 nt, Homo sapiens
aaacauaacugaugagcuu

SEQ ID NO: 932096 - RNA, 19 nt, Homo sapiens
gaaaugaaagcaucuggua

SEQ ID NO: 932097 - RNA, 19 nt, Homo sapiens
gacuauaucugaagugaaa

SEQ ID NO: 932098 - RNA, 19 nt, Homo sapiens
gcuaaugacuguccuugaa

SEQ ID NO: 932099 - RNA, 19 nt, Homo sapiens
gagaugaacugugauacaa

SEQ ID NO: 932100 - RNA, 19 nt, Homo sapiens
uaacugaccuaucaccauu

SEQ ID NO: 932101 - RNA, 19 nt, Homo sapiens
gcaucaaacuuuaugagaa

SEQ ID NO: 932102 - RNA, 19 nt, Homo sapiens
gguuagagaugaacuguga

SEQ ID NO: 932103 - RNA, 19 nt, Homo sapiens
gcagaaacagugauaauug

SEQ ID NO: 932104 - RNA, 19 nt, Homo sapiens
gaaauguggugcccuuuua

SEQ ID NO: 932105 - RNA, 19 nt, Homo sapiens
acaagaaccuuugguauug

SEQ ID NO: 932106 - RNA, 19 nt, Homo sapiens
aagcuggacuggaauauuu

SEQ ID NO: 932107 - RNA, 19 nt, Homo sapiens
gcaagagaaucauauggau

SEQ ID NO: 932108 - RNA, 19 nt, Homo sapiens
gaaacacaauggaaagaca

SEQ ID NO: 932109 - RNA, 19 nt, Homo sapiens
gaugaacugugauacaaau

SEQ ID NO: 932110 - RNA, 19 nt, Homo sapiens
caagagauguucccuuuac

SEQ ID NO: 932111 - RNA, 19 nt, Homo sapiens
gaccaucucuuugcaaaug

SEQ ID NO: 932112 - RNA, 19 nt, Homo sapiens
uaucugaagugaaagcuuu

SEQ ID NO: 932113 - RNA, 19 nt, Homo sapiens
gcaaauagaauugugaaug

SEQ ID NO: 932114 - RNA, 19 nt, Homo sapiens
cagcagguuuaacaacuua

SEQ ID NO: 932115 - RNA, 19 nt, Homo sapiens
caaauagaauugugaaugc

SEQ ID NO: 932116 - RNA, 19 nt, Homo sapiens
guuguuacaucgacuauau

SEQ ID NO: 932117 - RNA, 19 nt, Homo sapiens
gcuauaggcuuuggauaug

SEQ ID NO: 932118 - RNA, 19 nt, Homo sapiens
gaaacugaccucugaagau

SEQ ID NO: 932119 - RNA, 19 nt, Homo sapiens
ugacuguccuugaaauuau

SEQ ID NO: 932120 - RNA, 19 nt, Homo sapiens
cagcagacuucauaggaaa

SEQ ID NO: 932121 - RNA, 19 nt, Homo sapiens
caucaucaauguugucaau

SEQ ID NO: 932122 - RNA, 19 nt, Homo sapiens
ccacauuacccaaucagua

SEQ ID NO: 932123 - RNA, 19 nt, Homo sapiens
gcacgcagcagguuuaaca

SEQ ID NO: 932124 - RNA, 19 nt, Homo sapiens
uaaauaagccagcagacuu

SEQ ID NO: 932125 - RNA, 19 nt, Homo sapiens
uuagauggauugaagaaga

SEQ ID NO: 932126 - RNA, 19 nt, Homo sapiens
ugauagaauuggauccuaa

SEQ ID NO: 932127 - RNA, 19 nt, Homo sapiens
gagucuggcuuucgcauau

SEQ ID NO: 932128 - RNA, 19 nt, Homo sapiens
cugaagaucuuagugauga

SEQ ID NO: 932129 - RNA, 19 nt, Homo sapiens
ucaaugguccuaucacgua

SEQ ID NO: 932130 - RNA, 19 nt, Homo sapiens
ugugaaugcugcaggauuu

SEQ ID NO: 932131 - RNA, 19 nt, Homo sapiens
gcagcagguuuaacaacuu

SEQ ID NO: 932132 - RNA, 19 nt, Homo sapiens
gaauagaggaaaccaggaa

SEQ ID NO: 932133 - RNA, 19 nt, Homo sapiens
caagaaccuuugguauuga

SEQ ID NO: 932134 - RNA, 19 nt, Homo sapiens
gcacugaaacagauuaaag

SEQ ID NO: 932135 - RNA, 19 nt, Homo sapiens
aaacugaccucugaagauc

SEQ ID NO: 932136 - RNA, 19 nt, Homo sapiens
ugaagaagaagcagucaaa

SEQ ID NO: 932137 - RNA, 19 nt, Homo sapiens
uuacaucgacuauaucuga

SEQ ID NO: 932138 - RNA, 19 nt, Homo sapiens
gguaguaucagacuugcua

SEQ ID NO: 932139 - RNA, 19 nt, Homo sapiens
gacagcaaguggaaguuga

SEQ ID NO: 932140 - RNA, 19 nt, Homo sapiens
gaaagacagagcagaaaca

SEQ ID NO: 932141 - RNA, 19 nt, Homo sapiens
uuacuuucauccuggaaua

SEQ ID NO: 932142 - RNA, 19 nt, Homo sapiens
caaaugcauucgguucuug

SEQ ID NO: 932143 - RNA, 19 nt, Homo sapiens
gagcagaaacagugauaau

SEQ ID NO: 932144 - RNA, 19 nt, Homo sapiens
ggaaaccaggaauucauuu

SEQ ID NO: 932145 - RNA, 19 nt, Homo sapiens
gaaagcaagcacugaaaca

SEQ ID NO: 932146 - RNA, 19 nt, Homo sapiens
uaagccagcagacuucaua

SEQ ID NO: 932147 - RNA, 19 nt, Homo sapiens
ucagugggcucuaucaaag

SEQ ID NO: 932148 - RNA, 19 nt, Homo sapiens
gaacaugggacguugaaac

SEQ ID NO: 932149 - RNA, 19 nt, Homo sapiens
ccagcagacuucauaggaa

SEQ ID NO: 932150 - RNA, 19 nt, Homo sapiens
aagcagggaugaaagaugu

SEQ ID NO: 932151 - RNA, 19 nt, Homo sapiens
gaaccuaugccaugaaugc

SEQ ID NO: 932152 - RNA, 19 nt, Homo sapiens
cuuaaagguuuccaacauu

SEQ ID NO: 932153 - RNA, 19 nt, Homo sapiens
cagaaacagugauaauugg

SEQ ID NO: 932154 - RNA, 19 nt, Homo sapiens
ccaaagcaagagaaucaua

SEQ ID NO: 932155 - RNA, 19 nt, Homo sapiens
gagagcaaauagaauugug

SEQ ID NO: 932156 - RNA, 19 nt, Homo sapiens
ucacauugauccuuauucu

SEQ ID NO: 932157 - RNA, 19 nt, Homo sapiens
gauguucccuuuacucaac

SEQ ID NO: 932158 - RNA, 19 nt, Homo sapiens
uucaagagauguucccuuu

SEQ ID NO: 932159 - RNA, 19 nt, Homo sapiens
aucaaaggcuggagucuaa

SEQ ID NO: 932160 - RNA, 19 nt, Homo sapiens
ggaaggaucauauuaucuc

SEQ ID NO: 932161 - RNA, 19 nt, Homo sapiens
accaguaacuucucugaaa

SEQ ID NO: 932162 - RNA, 19 nt, Homo sapiens
gauccuuauucucuaacua

SEQ ID NO: 932163 - RNA, 19 nt, Homo sapiens
ccagaaaccggcuucagaa

SEQ ID NO: 932164 - RNA, 19 nt, Homo sapiens
caaagcaagagaaucauau

SEQ ID NO: 932165 - RNA, 19 nt, Homo sapiens
ggccaaagcaagagaauca

SEQ ID NO: 932166 - RNA, 19 nt, Homo sapiens
uacaagaaccuuugguauu

SEQ ID NO: 932167 - RNA, 19 nt, Homo sapiens
aggagggaaucgacaauuu

SEQ ID NO: 932168 - RNA, 19 nt, Homo sapiens
agucaaagguggauaugau

SEQ ID NO: 932169 - RNA, 19 nt, Homo sapiens
acuagaacauccucucauu

SEQ ID NO: 932170 - RNA, 19 nt, Homo sapiens
caacagaacaguaucucau

SEQ ID NO: 932171 - RNA, 19 nt, Homo sapiens
aaaccuuucuguuaagugu

SEQ ID NO: 932172 - RNA, 19 nt, Homo sapiens
cagcagucaucauacaaga

SEQ ID NO: 932173 - RNA, 19 nt, Homo sapiens
uuaaagguuuccaacauuc

SEQ ID NO: 932174 - RNA, 19 nt, Homo sapiens
uagauggauugaagaagaa

SEQ ID NO: 932175 - RNA, 19 nt, Homo sapiens
acagaacaguaucucauug

SEQ ID NO: 932176 - RNA, 19 nt, Homo sapiens
ggacuggaauauuuuguga

SEQ ID NO: 932177 - RNA, 19 nt, Homo sapiens
gaagcuggacuggaauauu

SEQ ID NO: 932178 - RNA, 19 nt, Homo sapiens
gcuuggaguucuuggaguu

SEQ ID NO: 932179 - RNA, 19 nt, Homo sapiens
gcagaaacacaauggaaag

SEQ ID NO: 932180 - RNA, 19 nt, Homo sapiens
gagcaaauagaauugugaa

SEQ ID NO: 932181 - RNA, 19 nt, Homo sapiens
uaaugacuguccuugaaau

SEQ ID NO: 932182 - RNA, 19 nt, Homo sapiens
cauacaagaaccuuuggua

SEQ ID NO: 932183 - RNA, 19 nt, Homo sapiens
cacgacaucuggaagcuau

SEQ ID NO: 932184 - RNA, 19 nt, Homo sapiens
ccaaagcagggaugaaaga

SEQ ID NO: 932185 - RNA, 19 nt, Homo sapiens
ugucacugcuauuaggaua

SEQ ID NO: 932186 - RNA, 19 nt, Homo sapiens
guggugcccuuuuaaaaua

SEQ ID NO: 932187 - RNA, 19 nt, Homo sapiens
gguuuuagcuggauuguau

SEQ ID NO: 932188 - RNA, 19 nt, Homo sapiens
ggccaaagcagggaugaaa

SEQ ID NO: 932189 - RNA, 19 nt, Homo sapiens
uuuggaagcuggacuggaa

SEQ ID NO: 932190 - RNA, 19 nt, Homo sapiens
gaagugaaagcuuugaaac

SEQ ID NO: 932191 - RNA, 19 nt, Homo sapiens
gagauguucccuuuacuca

SEQ ID NO: 932192 - RNA, 19 nt, Homo sapiens
gaaacuggaagaagaaacu

SEQ ID NO: 932193 - RNA, 19 nt, Homo sapiens
gaagaugagucugagauuu

SEQ ID NO: 932194 - RNA, 19 nt, Homo sapiens
gcacuuuguuuacuuguuu

SEQ ID NO: 932195 - RNA, 19 nt, Homo sapiens
caacagcaguggacaucua

SEQ ID NO: 932196 - RNA, 19 nt, Homo sapiens
gagaagagcagaagaaucu

SEQ ID NO: 932197 - RNA, 19 nt, Homo sapiens
gaacaaggccagggucauu

SEQ ID NO: 932198 - RNA, 19 nt, Homo sapiens
gggcugacauuaaagagaa

SEQ ID NO: 932199 - RNA, 19 nt, Homo sapiens
gaacaguacccucaacuca

SEQ ID NO: 932200 - RNA, 19 nt, Homo sapiens
gcugugaccugaugccaaa

SEQ ID NO: 932201 - RNA, 19 nt, Homo sapiens
cagcugggcuucauuagug

SEQ ID NO: 932202 - RNA, 19 nt, Homo sapiens
ggaagaagaagaaagugaa

SEQ ID NO: 932203 - RNA, 19 nt, Homo sapiens
gcaauggagaguccucaua

SEQ ID NO: 932204 - RNA, 19 nt, Homo sapiens
gaagugcccucgcucaaac

SEQ ID NO: 932205 - RNA, 19 nt, Homo sapiens
caaauccucucugcccuaa

SEQ ID NO: 932206 - RNA, 19 nt, Homo sapiens
ggaaugagguacaguucuc

SEQ ID NO: 932207 - RNA, 19 nt, Homo sapiens
gugcauaccuggccaugga

SEQ ID NO: 932208 - RNA, 19 nt, Homo sapiens
gaccagagccgguugacuu

SEQ ID NO: 932209 - RNA, 19 nt, Homo sapiens
cagagggaguucauucaaa

SEQ ID NO: 932210 - RNA, 19 nt, Homo sapiens
acaaucaugugaagacuug

SEQ ID NO: 932211 - RNA, 19 nt, Homo sapiens
guucugagcaucauccuuu

SEQ ID NO: 932212 - RNA, 19 nt, Homo sapiens
agaggaagguguagagguu

SEQ ID NO: 932213 - RNA, 19 nt, Homo sapiens
uagaagagaccuugaacaa

SEQ ID NO: 932214 - RNA, 19 nt, Homo sapiens
guguagagguuguguggaa

SEQ ID NO: 932215 - RNA, 19 nt, Homo sapiens
cucaguugcugcuguaaua

SEQ ID NO: 932216 - RNA, 19 nt, Homo sapiens
gcucuggaauuagauaaau

SEQ ID NO: 932217 - RNA, 19 nt, Homo sapiens
gguagaauccucaucuuca

SEQ ID NO: 932218 - RNA, 19 nt, Homo sapiens
auauugggcugacauuaaa

SEQ ID NO: 932219 - RNA, 19 nt, Homo sapiens
ggccauggauacagaggaa

SEQ ID NO: 932220 - RNA, 19 nt, Homo sapiens
gcaagguggugcugaugca

SEQ ID NO: 932221 - RNA, 19 nt, Homo sapiens
gaagacuugucgagaagag

SEQ ID NO: 932222 - RNA, 19 nt, Homo sapiens
gcacaacggacucaucaag

SEQ ID NO: 932223 - RNA, 19 nt, Homo sapiens
aaagguucgugcuguguuu

SEQ ID NO: 932224 - RNA, 19 nt, Homo sapiens
ugugaagacuugucgagaa

SEQ ID NO: 932225 - RNA, 19 nt, Homo sapiens
uaucaacaaucaugugaag

SEQ ID NO: 932226 - RNA, 19 nt, Homo sapiens
caacacaugaucccagaga

SEQ ID NO: 932227 - RNA, 19 nt, Homo sapiens
caacggacucaucaagauu

SEQ ID NO: 932228 - RNA, 19 nt, Homo sapiens
aauauugggcugacauuaa

SEQ ID NO: 932229 - RNA, 19 nt, Homo sapiens
gugcagcugggcuucauua

SEQ ID NO: 932230 - RNA, 19 nt, Homo sapiens
gauaaauuccuugaagaug

SEQ ID NO: 932231 - RNA, 19 nt, Homo sapiens
gcucagacccaaagguaga

SEQ ID NO: 932232 - RNA, 19 nt, Homo sapiens
caauggagaguccucauau

SEQ ID NO: 932233 - RNA, 19 nt, Homo sapiens
uggagcaucuuaacauugu

SEQ ID NO: 932234 - RNA, 19 nt, Homo sapiens
gaccugaugccaaaugaga

SEQ ID NO: 932235 - RNA, 19 nt, Homo sapiens
uaaauuccuugaagauguc

SEQ ID NO: 932236 - RNA, 19 nt, Homo sapiens
guggacaucuacuccuuug

SEQ ID NO: 932237 - RNA, 19 nt, Homo sapiens
acaacggacucaucaagau

SEQ ID NO: 932238 - RNA, 19 nt, Homo sapiens
gaagaagaaagugaagaug

SEQ ID NO: 932239 - RNA, 19 nt, Homo sapiens
ccgguugacuucucugcua

SEQ ID NO: 932240 - RNA, 19 nt, Homo sapiens
uggcagugcuggagauuca

SEQ ID NO: 932241 - RNA, 19 nt, Homo sapiens
cugaagcaauuucugaaga

SEQ ID NO: 932242 - RNA, 19 nt, Homo sapiens
agaagaaagugaagaugag

SEQ ID NO: 932243 - RNA, 19 nt, Homo sapiens
aaacaccaccugacacuuc

SEQ ID NO: 932244 - RNA, 19 nt, Homo sapiens
cuagaagacccauuacaga

SEQ ID NO: 932245 - RNA, 19 nt, Homo sapiens
gugaagacuugucgagaag

SEQ ID NO: 932246 - RNA, 19 nt, Homo sapiens
aagaagaaagugaagauga

SEQ ID NO: 932247 - RNA, 19 nt, Homo sapiens
aaaagugccugcagucuga

SEQ ID NO: 932248 - RNA, 19 nt, Homo sapiens
cacaagacgaugaaugaaa

SEQ ID NO: 932249 - RNA, 19 nt, Homo sapiens
aaagugaagaugagucuga

SEQ ID NO: 932250 - RNA, 19 nt, Homo sapiens
gcagugccauccagcuucu

SEQ ID NO: 932251 - RNA, 19 nt, Homo sapiens
acaagacgaugaaugaaaa

SEQ ID NO: 932252 - RNA, 19 nt, Homo sapiens
gaagaagaagaaagugaag

SEQ ID NO: 932253 - RNA, 19 nt, Homo sapiens
guagaauccucaucuucag

SEQ ID NO: 932254 - RNA, 19 nt, Homo sapiens
ucucugaacgcaagaacua

SEQ ID NO: 932255 - RNA, 19 nt, Homo sapiens
aagcguuggugcacacaaa

SEQ ID NO: 932256 - RNA, 19 nt, Homo sapiens
caaauauugggcugacauu

SEQ ID NO: 932257 - RNA, 19 nt, Homo sapiens
ggagccgaauucuacaauc

SEQ ID NO: 932258 - RNA, 19 nt, Homo sapiens
cugggagucugaagcaauu

SEQ ID NO: 932259 - RNA, 19 nt, Homo sapiens
uaucacagaauacauguca

SEQ ID NO: 932260 - RNA, 19 nt, Homo sapiens
cagcagccgccuucuaguu

SEQ ID NO: 932261 - RNA, 19 nt, Homo sapiens
ugugggcgcuggcagaaga

SEQ ID NO: 932262 - RNA, 19 nt, Homo sapiens
gaagaaagugaagaugagu

SEQ ID NO: 932263 - RNA, 19 nt, Homo sapiens
gaagagcagaagaaucuac

SEQ ID NO: 932264 - RNA, 19 nt, Homo sapiens
cagcacaacggacucauca

SEQ ID NO: 932265 - RNA, 19 nt, Homo sapiens
gagccgaauucuacaaucc

SEQ ID NO: 932266 - RNA, 19 nt, Homo sapiens
gugaccugaugccaaauga

SEQ ID NO: 932267 - RNA, 19 nt, Homo sapiens
auggagaagucacuaaugu

SEQ ID NO: 932268 - RNA, 19 nt, Homo sapiens
gaaucuacacuucuuugca

SEQ ID NO: 932269 - RNA, 19 nt, Homo sapiens
caacaaucaugugaagacu

SEQ ID NO: 932270 - RNA, 19 nt, Homo sapiens
ccugagcugugaccugaug

SEQ ID NO: 932271 - RNA, 19 nt, Homo sapiens
ccuugaagaugucaggaau

SEQ ID NO: 932272 - RNA, 19 nt, Homo sapiens
augggaaccugaccuguga

SEQ ID NO: 932273 - RNA, 19 nt, Homo sapiens
gcauaccuggccauggaua

SEQ ID NO: 932274 - RNA, 19 nt, Homo sapiens
ugucaggaaugggaucuau

SEQ ID NO: 932275 - RNA, 19 nt, Homo sapiens
ugaagugcccucgcucaaa

SEQ ID NO: 932276 - RNA, 19 nt, Homo sapiens
uuacagagggaguucauuc

SEQ ID NO: 932277 - RNA, 19 nt, Homo sapiens
caguggacaucuacuccuu

SEQ ID NO: 932278 - RNA, 19 nt, Homo sapiens
ugaagaugagucugagauu

SEQ ID NO: 932279 - RNA, 19 nt, Homo sapiens
gacacuaucaacaaucaug

SEQ ID NO: 932280 - RNA, 19 nt, Homo sapiens
aaauauugggcugacauua

SEQ ID NO: 932281 - RNA, 19 nt, Homo sapiens
gugcuguguuugauaaucu

SEQ ID NO: 932282 - RNA, 19 nt, Homo sapiens
uagagguuguguggaauga

SEQ ID NO: 932283 - RNA, 19 nt, Homo sapiens
uggcucagacccaaaggua

SEQ ID NO: 932284 - RNA, 19 nt, Homo sapiens
gcagcugggcuucauuagu

SEQ ID NO: 932285 - RNA, 19 nt, Homo sapiens
agaagaagaaagugaagau

SEQ ID NO: 932286 - RNA, 19 nt, Homo sapiens
ggauacuagugccguacug

SEQ ID NO: 932287 - RNA, 19 nt, Homo sapiens
ucacagaauacaugucauc

SEQ ID NO: 932288 - RNA, 19 nt, Homo sapiens
agaggugaaucaacggaau

SEQ ID NO: 932289 - RNA, 19 nt, Homo sapiens
gcagaagaggcgagaagag

SEQ ID NO: 932290 - RNA, 19 nt, Homo sapiens
gguggaggagggagucaaa

SEQ ID NO: 932291 - RNA, 19 nt, Homo sapiens
guuccacccagcauuguuu

SEQ ID NO: 932292 - RNA, 19 nt, Homo sapiens
agagggaguucauucaaaa

SEQ ID NO: 932293 - RNA, 19 nt, Homo sapiens
gggauuaacuucugucuuu

SEQ ID NO: 932294 - RNA, 19 nt, Homo sapiens
gcacagauuuccaguucuu

SEQ ID NO: 932295 - RNA, 19 nt, Homo sapiens
gaagagaaaguuaucaaga

SEQ ID NO: 932296 - RNA, 19 nt, Homo sapiens
gaucccagcucuccuguug

SEQ ID NO: 932297 - RNA, 19 nt, Homo sapiens
cugcgaagguggagaguua

SEQ ID NO: 932298 - RNA, 19 nt, Homo sapiens
gaaagagucaucagaagug

SEQ ID NO: 932299 - RNA, 19 nt, Homo sapiens
gacgggacuucaucuuaua

SEQ ID NO: 932300 - RNA, 19 nt, Homo sapiens
gaggauuucuugugccauu

SEQ ID NO: 932301 - RNA, 19 nt, Homo sapiens
gggagucgcugcaagaauc

SEQ ID NO: 932302 - RNA, 19 nt, Homo sapiens
ugacgggacuucaucuuau

SEQ ID NO: 932303 - RNA, 19 nt, Homo sapiens
ggugaacaauauagcaauu

SEQ ID NO: 932304 - RNA, 19 nt, Homo sapiens
ggaaggaucagaaggaauc

SEQ ID NO: 932305 - RNA, 19 nt, Homo sapiens
aaaguccgcuauauuguga

SEQ ID NO: 932306 - RNA, 19 nt, Homo sapiens
ccgagaaccucacagagaa

SEQ ID NO: 932307 - RNA, 19 nt, Homo sapiens
ggaaggaagggcacuguga

SEQ ID NO: 932308 - RNA, 19 nt, Homo sapiens
gacguauggucugaauuua

SEQ ID NO: 932309 - RNA, 19 nt, Homo sapiens
gguagaucuucuucacaua

SEQ ID NO: 932310 - RNA, 19 nt, Homo sapiens
gaacgagaggcaccagauu

SEQ ID NO: 932311 - RNA, 19 nt, Homo sapiens
gaaggaagggcacugugaa

SEQ ID NO: 932312 - RNA, 19 nt, Homo sapiens
caggagagcagaugugauu

SEQ ID NO: 932313 - RNA, 19 nt, Homo sapiens
gagcaccacgcacagauuu

SEQ ID NO: 932314 - RNA, 19 nt, Homo sapiens
agagaaaguuaucaagaga

SEQ ID NO: 932315 - RNA, 19 nt, Homo sapiens
ggaaagagucaucagaagu

SEQ ID NO: 932316 - RNA, 19 nt, Homo sapiens
gcugguguguguuuccuuu

SEQ ID NO: 932317 - RNA, 19 nt, Homo sapiens
gaagaguuccugggagauu

SEQ ID NO: 932318 - RNA, 19 nt, Homo sapiens
gcaauucacgcauucuuca

SEQ ID NO: 932319 - RNA, 19 nt, Homo sapiens
guuaaacugucacacacaa

SEQ ID NO: 932320 - RNA, 19 nt, Homo sapiens
agaaagaggugaggaugga

SEQ ID NO: 932321 - RNA, 19 nt, Homo sapiens
gaauguaaggaucaucaaa

SEQ ID NO: 932322 - RNA, 19 nt, Homo sapiens
ggguagaucuucuucacau

SEQ ID NO: 932323 - RNA, 19 nt, Homo sapiens
cguauggucugaauuuauc

SEQ ID NO: 932324 - RNA, 19 nt, Homo sapiens
gggagucucucucucucuu

SEQ ID NO: 932325 - RNA, 19 nt, Homo sapiens
gcagugaggauuucuugug

SEQ ID NO: 932326 - RNA, 19 nt, Homo sapiens
gcaggaaagagucaucaga

SEQ ID NO: 932327 - RNA, 19 nt, Homo sapiens
gcuggaaauuuauaucagu

SEQ ID NO: 932328 - RNA, 19 nt, Homo sapiens
guagaucuucuucacauau

SEQ ID NO: 932329 - RNA, 19 nt, Homo sapiens
uaguguggcuguuuaaagu

SEQ ID NO: 932330 - RNA, 19 nt, Homo sapiens
gauuugagcugauuuugga

SEQ ID NO: 932331 - RNA, 19 nt, Homo sapiens
acgcacagauuuccaguuc

SEQ ID NO: 932332 - RNA, 19 nt, Homo sapiens
gagaaaguuaucaagagaa

SEQ ID NO: 932333 - RNA, 19 nt, Homo sapiens
aagagaaaguuaucaagag

SEQ ID NO: 932334 - RNA, 19 nt, Homo sapiens
caggaaagagucaucagaa

SEQ ID NO: 932335 - RNA, 19 nt, Homo sapiens
ugacagaggaauuccagaa

SEQ ID NO: 932336 - RNA, 19 nt, Homo sapiens
gggaagagaaaguuaucaa

SEQ ID NO: 932337 - RNA, 19 nt, Homo sapiens
cuuauagacuguuaaacug

SEQ ID NO: 932338 - RNA, 19 nt, Homo sapiens
gaagccagcaggaaagagu

SEQ ID NO: 932339 - RNA, 19 nt, Homo sapiens
ggauuaacuucugucuuuc

SEQ ID NO: 932340 - RNA, 19 nt, Homo sapiens
gagaguuaccggugucgaa

SEQ ID NO: 932341 - RNA, 19 nt, Homo sapiens
ggaagagaaaguuaucaag

SEQ ID NO: 932342 - RNA, 19 nt, Homo sapiens
aaucugaaauuuccaucug

SEQ ID NO: 932343 - RNA, 19 nt, Homo sapiens
ggaagggcacugugaagca

SEQ ID NO: 932344 - RNA, 19 nt, Homo sapiens
uaaauguaauugccaaagc

SEQ ID NO: 932345 - RNA, 19 nt, Homo sapiens
gaccaaccugggcaacaua

SEQ ID NO: 932346 - RNA, 19 nt, Homo sapiens
gagucucucucucucuuuc

SEQ ID NO: 932347 - RNA, 19 nt, Homo sapiens
cagugggucugcuuugguu

SEQ ID NO: 932348 - RNA, 19 nt, Homo sapiens
uauagcaauucacgcauuc

SEQ ID NO: 932349 - RNA, 19 nt, Homo sapiens
gucaggaguucaagaccaa

SEQ ID NO: 932350 - RNA, 19 nt, Homo sapiens
gauuuccaguucuuagugu

SEQ ID NO: 932351 - RNA, 19 nt, Homo sapiens
uccgggaccucgaucauga

SEQ ID NO: 932352 - RNA, 19 nt, Homo sapiens
aaauguaauugccaaagca

SEQ ID NO: 932353 - RNA, 19 nt, Homo sapiens
gaagucaggaguucaagac

SEQ ID NO: 932354 - RNA, 19 nt, Homo sapiens
gugaagcagugaggauuuc

SEQ ID NO: 932355 - RNA, 19 nt, Homo sapiens
ggagacugacagaggaauu

SEQ ID NO: 932356 - RNA, 19 nt, Homo sapiens
acuugaagcuggugugugu

SEQ ID NO: 932357 - RNA, 19 nt, Homo sapiens
aagaguuccugggagauuu

SEQ ID NO: 932358 - RNA, 19 nt, Homo sapiens
gucaaggguuccacacugu

SEQ ID NO: 932359 - RNA, 19 nt, Homo sapiens
caaagccgucgguuacaga

SEQ ID NO: 932360 - RNA, 19 nt, Homo sapiens
auauagcaauucacgcauu

SEQ ID NO: 932361 - RNA, 19 nt, Homo sapiens
cagaauguaaggaucauca

SEQ ID NO: 932362 - RNA, 19 nt, Homo sapiens
ggacuucaucuuauagacu

SEQ ID NO: 932363 - RNA, 19 nt, Homo sapiens
caaggguuccacacuguug

SEQ ID NO: 932364 - RNA, 19 nt, Homo sapiens
ggagagcagaugugauucu

SEQ ID NO: 932365 - RNA, 19 nt, Homo sapiens
ucacacacaaacaggcuuu

SEQ ID NO: 932366 - RNA, 19 nt, Homo sapiens
gaaagaggugaggauggaa

SEQ ID NO: 932367 - RNA, 19 nt, Homo sapiens
agccugagcuccugaagag

SEQ ID NO: 932368 - RNA, 19 nt, Homo sapiens
ggacauuccuuuguaaaac

SEQ ID NO: 932369 - RNA, 19 nt, Homo sapiens
gagagcaccacgcacagau

SEQ ID NO: 932370 - RNA, 19 nt, Homo sapiens
gaagcagugaggauuucuu

SEQ ID NO: 932371 - RNA, 19 nt, Homo sapiens
aaagagucaucagaagugu

SEQ ID NO: 932372 - RNA, 19 nt, Homo sapiens
caacgccgcaggcacagau

SEQ ID NO: 932373 - RNA, 19 nt, Homo sapiens
ucagggacccauuugugaa

SEQ ID NO: 932374 - RNA, 19 nt, Homo sapiens
guucuuaguguggcuguuu

SEQ ID NO: 932375 - RNA, 19 nt, Homo sapiens
uugacgggacuucaucuua

SEQ ID NO: 932376 - RNA, 19 nt, Homo sapiens
ugggaaggaucagaaggaa

SEQ ID NO: 932377 - RNA, 19 nt, Homo sapiens
ugggagauuugagcugauu

SEQ ID NO: 932378 - RNA, 19 nt, Homo sapiens
ccugagcuccugaagaguu

SEQ ID NO: 932379 - RNA, 19 nt, Homo sapiens
gucauuagcuccuuuuaag

SEQ ID NO: 932380 - RNA, 19 nt, Homo sapiens
aaccugggcuggaagucaa

SEQ ID NO: 932381 - RNA, 19 nt, Homo sapiens
gacccgagaaccucacaga

SEQ ID NO: 932382 - RNA, 19 nt, Homo sapiens
agaccaaccugggcaacau

SEQ ID NO: 932383 - RNA, 19 nt, Homo sapiens
ggccacucaugccuguaaa

SEQ ID NO: 932384 - RNA, 19 nt, Homo sapiens
ggagucucucucucucuuu

SEQ ID NO: 932385 - RNA, 19 nt, Homo sapiens
uggcugacccgacaucuca

SEQ ID NO: 932386 - RNA, 19 nt, Homo sapiens
aggaaagagucaucagaag

SEQ ID NO: 932387 - RNA, 19 nt, Homo sapiens
gagacugacagaggaauuc

SEQ ID NO: 932388 - RNA, 19 nt, Homo sapiens
ccggaacaauuagggaaga

SEQ ID NO: 932389 - RNA, 19 nt, Homo sapiens
uccgcuauauugugauuug

SEQ ID NO: 932390 - RNA, 19 nt, Homo sapiens
cccgagaaccucacagaga

SEQ ID NO: 932391 - RNA, 19 nt, Homo sapiens
guguggcuguuuaaaguag

SEQ ID NO: 932392 - RNA, 19 nt, Homo sapiens
agauggagcaggacaagug

SEQ ID NO: 932393 - RNA, 19 nt, Homo sapiens
ugacaauacugcugccuua

SEQ ID NO: 932394 - RNA, 19 nt, Homo sapiens
guacuaaggagcaugauuu

SEQ ID NO: 932395 - RNA, 19 nt, Homo sapiens
gaagcuucaugccagguua

SEQ ID NO: 932396 - RNA, 19 nt, Homo sapiens
gaguaaacccuaucuguga

SEQ ID NO: 932397 - RNA, 19 nt, Homo sapiens
gacaauaguuaugccugua

SEQ ID NO: 932398 - RNA, 19 nt, Homo sapiens
gaccucaacuaacccuaaa

SEQ ID NO: 932399 - RNA, 19 nt, Homo sapiens
gaaacagggacaaagaaau

SEQ ID NO: 932400 - RNA, 19 nt, Homo sapiens
uaaaugaaguguguuaagg

SEQ ID NO: 932401 - RNA, 19 nt, Homo sapiens
gcagcacugacaauaguua

SEQ ID NO: 932402 - RNA, 19 nt, Homo sapiens
gcaaauauuagcaaagaag

SEQ ID NO: 932403 - RNA, 19 nt, Homo sapiens
ggaccucaacuaacccuaa

SEQ ID NO: 932404 - RNA, 19 nt, Homo sapiens
ugacaauacggcugccuua

SEQ ID NO: 932405 - RNA, 19 nt, Homo sapiens
cugcaaauauuagcaaaga

SEQ ID NO: 932406 - RNA, 19 nt, Homo sapiens
ccagaaacagggacaaaga

SEQ ID NO: 932407 - RNA, 19 nt, Homo sapiens
ccugugcccugcaaauauu

SEQ ID NO: 932408 - RNA, 19 nt, Homo sapiens
gcccagugcuucuccaaca

SEQ ID NO: 932409 - RNA, 19 nt, Homo sapiens
aaacagggacaaagaaauc

SEQ ID NO: 932410 - RNA, 19 nt, Homo sapiens
cugaagugcuugcagauca

SEQ ID NO: 932411 - RNA, 19 nt, Homo sapiens
cuaaggagcaugauuuuaa

SEQ ID NO: 932412 - RNA, 19 nt, Homo sapiens
gcacacuauuucccucuac

SEQ ID NO: 932413 - RNA, 19 nt, Homo sapiens
gagucuaccugagcauuca

SEQ ID NO: 932414 - RNA, 19 nt, Homo sapiens
cagaaacagggacaaagaa

SEQ ID NO: 932415 - RNA, 19 nt, Homo sapiens
agaaacagggacaaagaaa

SEQ ID NO: 932416 - RNA, 19 nt, Homo sapiens
gaaggcagcauuccaugac

SEQ ID NO: 932417 - RNA, 19 nt, Homo sapiens
cugagucccuccaugcaaa

SEQ ID NO: 932418 - RNA, 19 nt, Homo sapiens
gcacaccucaggagucuac

SEQ ID NO: 932419 - RNA, 19 nt, Homo sapiens
ggcuaaaugaaguguguua

SEQ ID NO: 932420 - RNA, 19 nt, Homo sapiens
gaccagaaacagggacaaa

SEQ ID NO: 932421 - RNA, 19 nt, Homo sapiens
guaaacccuaucugugauu

SEQ ID NO: 932422 - RNA, 19 nt, Homo sapiens
ucggcuaagugggacauua

SEQ ID NO: 932423 - RNA, 19 nt, Homo sapiens
aggcagcacugacaauagu

SEQ ID NO: 932424 - RNA, 19 nt, Homo sapiens
gcuaaaugaaguguguuaa

SEQ ID NO: 932425 - RNA, 19 nt, Homo sapiens
gcacugacaauaguuaugc

SEQ ID NO: 932426 - RNA, 19 nt, Homo sapiens
cuauuucccucuacugagu

SEQ ID NO: 932427 - RNA, 19 nt, Homo sapiens
ggagucuaccugagcauuc

SEQ ID NO: 932428 - RNA, 19 nt, Homo sapiens
uaaacccuaucugugauuc

SEQ ID NO: 932429 - RNA, 19 nt, Homo sapiens
caaaaguggggcuaaauga

SEQ ID NO: 932430 - RNA, 19 nt, Homo sapiens
gcaaaaguggggcuaaaug

SEQ ID NO: 932431 - RNA, 19 nt, Homo sapiens
cagcauuccaugaccagaa

SEQ ID NO: 932432 - RNA, 19 nt, Homo sapiens
ugaagugcuugcagaucau

SEQ ID NO: 932433 - RNA, 19 nt, Homo sapiens
agcauuccaugaccagaaa

SEQ ID NO: 932434 - RNA, 19 nt, Homo sapiens
caccggaccucaacuaacc

SEQ ID NO: 932435 - RNA, 19 nt, Homo sapiens
gugcaggugcugacaauac

SEQ ID NO: 932436 - RNA, 19 nt, Homo sapiens
ugguuugaauggagauuau

SEQ ID NO: 932437 - RNA, 19 nt, Homo sapiens
cuaaaugaaguguguuaag

SEQ ID NO: 932438 - RNA, 19 nt, Homo sapiens
gauccucaccggaccucaa

SEQ ID NO: 932439 - RNA, 19 nt, Homo sapiens
gccuuacccgccauacaua

SEQ ID NO: 932440 - RNA, 19 nt, Homo sapiens
aguaaacccuaucugugau

SEQ ID NO: 932441 - RNA, 19 nt, Homo sapiens
uggcauggcucccuuuugu

SEQ ID NO: 932442 - RNA, 19 nt, Homo sapiens
caauaguuaugccuguacu

SEQ ID NO: 932443 - RNA, 19 nt, Homo sapiens
gagccucccgaaggauuaa

SEQ ID NO: 932444 - RNA, 19 nt, Homo sapiens
ccucaccggaccucaacua

SEQ ID NO: 932445 - RNA, 19 nt, Homo sapiens
gcugagucccuccaugcaa

SEQ ID NO: 932446 - RNA, 19 nt, Homo sapiens
guuugaauggagauuauga

SEQ ID NO: 932447 - RNA, 19 nt, Homo sapiens
cggaggaacuugauacuaa

SEQ ID NO: 932448 - RNA, 19 nt, Homo sapiens
ggaggaacuugauacuaaa

SEQ ID NO: 932449 - RNA, 19 nt, Homo sapiens
gaacuugagugacauugac

SEQ ID NO: 932450 - RNA, 19 nt, Homo sapiens
gcugcuggcucggcuaaua

SEQ ID NO: 932451 - RNA, 19 nt, Homo sapiens
gcaaguagacaaauggaau

SEQ ID NO: 932452 - RNA, 19 nt, Homo sapiens
caugcgaacuuuccacuau

SEQ ID NO: 932453 - RNA, 19 nt, Homo sapiens
gccaggaacuugagugaca

SEQ ID NO: 932454 - RNA, 19 nt, Homo sapiens
gugcugaacccgaaucuuc

SEQ ID NO: 932455 - RNA, 19 nt, Homo sapiens
ggaacuugagugacauuga

SEQ ID NO: 932456 - RNA, 19 nt, Homo sapiens
gaacccgaaucuuccaaaa

SEQ ID NO: 932457 - RNA, 19 nt, Homo sapiens
ggacaacgugggagauugg

SEQ ID NO: 932458 - RNA, 19 nt, Homo sapiens
ccacugauaggaaugacuu

SEQ ID NO: 932459 - RNA, 19 nt, Homo sapiens
gagugacauugaccucaug

SEQ ID NO: 932460 - RNA, 19 nt, Homo sapiens
uguagcaaguagacaaaug

SEQ ID NO: 932461 - RNA, 19 nt, Homo sapiens
cgaggcccaugcgaacuuu

SEQ ID NO: 932462 - RNA, 19 nt, Homo sapiens
caaguagacaaauggaauc

SEQ ID NO: 932463 - RNA, 19 nt, Homo sapiens
gguguagcaaguagacaaa

SEQ ID NO: 932464 - RNA, 19 nt, Homo sapiens
gaggaacuugauacuaaau

SEQ ID NO: 932465 - RNA, 19 nt, Homo sapiens
cggacaacgugggagauug

SEQ ID NO: 932466 - RNA, 19 nt, Homo sapiens
aauggaauccugugcugaa

SEQ ID NO: 932467 - RNA, 19 nt, Homo sapiens
guagcaaguagacaaaugg

SEQ ID NO: 932468 - RNA, 19 nt, Homo sapiens
ggguguagcaaguagacaa

SEQ ID NO: 932469 - RNA, 19 nt, Homo sapiens
cuaaauuugggacucuuug

SEQ ID NO: 932470 - RNA, 19 nt, Homo sapiens
gcuaauaaaacucccgaaa

SEQ ID NO: 932471 - RNA, 19 nt, Homo sapiens
uaaugaaacucccgaaaua

SEQ ID NO: 932472 - RNA, 19 nt, Homo sapiens
ggacagcgcuggcaugaga

SEQ ID NO: 932473 - RNA, 19 nt, Homo sapiens
gauggcagcugaaguuuga

SEQ ID NO: 932474 - RNA, 19 nt, Homo sapiens
gaaagaaggagaaaggaaa

SEQ ID NO: 932475 - RNA, 19 nt, Homo sapiens
gagaagagguggcaaugau

SEQ ID NO: 932476 - RNA, 19 nt, Homo sapiens
cggaggaacuugauacuaa

SEQ ID NO: 932477 - RNA, 19 nt, Homo sapiens
guacauaguucccaagcuu

SEQ ID NO: 932478 - RNA, 19 nt, Homo sapiens
gcucuuguccugagaaaua

SEQ ID NO: 932479 - RNA, 19 nt, Homo sapiens
gcuaaaguauugccucuau

SEQ ID NO: 932480 - RNA, 19 nt, Homo sapiens
ggaggaacuugauacuaaa

SEQ ID NO: 932481 - RNA, 19 nt, Homo sapiens
gcagacaggcuuaagcuaa

SEQ ID NO: 932482 - RNA, 19 nt, Homo sapiens
ugauaaaccucaucuacuu

SEQ ID NO: 932483 - RNA, 19 nt, Homo sapiens
guaaaguucuguacauagu

SEQ ID NO: 932484 - RNA, 19 nt, Homo sapiens
ggcuuaagcuaaaguauug

SEQ ID NO: 932485 - RNA, 19 nt, Homo sapiens
gcggcgaggugacaaguuu

SEQ ID NO: 932486 - RNA, 19 nt, Homo sapiens
uaacaauccuagacugaga

SEQ ID NO: 932487 - RNA, 19 nt, Homo sapiens
gaagagguggcaaugauga

SEQ ID NO: 932488 - RNA, 19 nt, Homo sapiens
cagacaggcuuaagcuaaa

SEQ ID NO: 932489 - RNA, 19 nt, Homo sapiens
gaacuugagugacauugac

SEQ ID NO: 932490 - RNA, 19 nt, Homo sapiens
gaaggagaaaggaaagaaa

SEQ ID NO: 932491 - RNA, 19 nt, Homo sapiens
ggaaagaaggagaaaggaa

SEQ ID NO: 932492 - RNA, 19 nt, Homo sapiens
caaauggagggcaugcuua

SEQ ID NO: 932493 - RNA, 19 nt, Homo sapiens
gccaggaacuugagugaca

SEQ ID NO: 932494 - RNA, 19 nt, Homo sapiens
aaugccaccugucgucuua

SEQ ID NO: 932495 - RNA, 19 nt, Homo sapiens
augcgaagcuuuccacuau

SEQ ID NO: 932496 - RNA, 19 nt, Homo sapiens
ccaaagggcaggagcaaug

SEQ ID NO: 932497 - RNA, 19 nt, Homo sapiens
guuaagaagggaaagcaua

SEQ ID NO: 932498 - RNA, 19 nt, Homo sapiens
ggauacccaugcucaggaa

SEQ ID NO: 932499 - RNA, 19 nt, Homo sapiens
caacuggacuggacuucag

SEQ ID NO: 932500 - RNA, 19 nt, Homo sapiens
gaccggaggugcgucauuc

SEQ ID NO: 932501 - RNA, 19 nt, Homo sapiens
gaaccgaccuggggacaaa

SEQ ID NO: 932502 - RNA, 19 nt, Homo sapiens
gagcuuggguucccuuugc

SEQ ID NO: 932503 - RNA, 19 nt, Homo sapiens
gaagggaaagcauaagaag

SEQ ID NO: 932504 - RNA, 19 nt, Homo sapiens
uaaaguauugccucuauuc

SEQ ID NO: 932505 - RNA, 19 nt, Homo sapiens
gcgaagcuuuccacuaugg

SEQ ID NO: 932506 - RNA, 19 nt, Homo sapiens
ccaagccaauuaaaugauc

SEQ ID NO: 932507 - RNA, 19 nt, Homo sapiens
gaccaaaccucggugaacu

SEQ ID NO: 932508 - RNA, 19 nt, Homo sapiens
ccucuauucuguaaaguuc

SEQ ID NO: 932509 - RNA, 19 nt, Homo sapiens
cucggaaccugaaggauuu

SEQ ID NO: 932510 - RNA, 19 nt, Homo sapiens
uuaagaagggaaagcauaa

SEQ ID NO: 932511 - RNA, 19 nt, Homo sapiens
caacucagacagugacuca

SEQ ID NO: 932512 - RNA, 19 nt, Homo sapiens
aaaguucuguacauaguuc

SEQ ID NO: 932513 - RNA, 19 nt, Homo sapiens
ugauucagaugggcacuuu

SEQ ID NO: 932514 - RNA, 19 nt, Homo sapiens
cagagucgguccagaacug

SEQ ID NO: 932515 - RNA, 19 nt, Homo sapiens
cagccucccucaaggaaga

SEQ ID NO: 932516 - RNA, 19 nt, Homo sapiens
gugcugaacccgaaucuuc

SEQ ID NO: 932517 - RNA, 19 nt, Homo sapiens
ggaacuugagugacauuga

SEQ ID NO: 932518 - RNA, 19 nt, Homo sapiens
ggagaagagguggcaauga

SEQ ID NO: 932519 - RNA, 19 nt, Homo sapiens
cuaaaguauugccucuauu

SEQ ID NO: 932520 - RNA, 19 nt, Homo sapiens
gcaggcaucagucagcuau

SEQ ID NO: 932521 - RNA, 19 nt, Homo sapiens
aguauugccucuauucugu

SEQ ID NO: 932522 - RNA, 19 nt, Homo sapiens
gaacccgaaucuuccaaaa

SEQ ID NO: 932523 - RNA, 19 nt, Homo sapiens
ggaaaccugaccugaagga

SEQ ID NO: 932524 - RNA, 19 nt, Homo sapiens
acagcacgcgugacaguua

SEQ ID NO: 932525 - RNA, 19 nt, Homo sapiens
gacagcaacgccucuaaga

SEQ ID NO: 932526 - RNA, 19 nt, Homo sapiens
guuccagccugcaaacuca

SEQ ID NO: 932527 - RNA, 19 nt, Homo sapiens
cuaaugaaacucccgaaau

SEQ ID NO: 932528 - RNA, 19 nt, Homo sapiens
gcugcuggcucggcuaaug

SEQ ID NO: 932529 - RNA, 19 nt, Homo sapiens
aauaaauaccgcacacaaa

SEQ ID NO: 932530 - RNA, 19 nt, Homo sapiens
gcuaaugaaacucccgaaa

SEQ ID NO: 932531 - RNA, 19 nt, Homo sapiens
ggaugugagugggaggaaa

SEQ ID NO: 932532 - RNA, 19 nt, Homo sapiens
ggacagcaacgccucuaag

SEQ ID NO: 932533 - RNA, 19 nt, Homo sapiens
ggacucgaccgaacugaag

SEQ ID NO: 932534 - RNA, 19 nt, Homo sapiens
uaaaccucaucuacuucua

SEQ ID NO: 932535 - RNA, 19 nt, Homo sapiens
gauaaaccucaucuacuuc

SEQ ID NO: 932536 - RNA, 19 nt, Homo sapiens
gggaggacccugaggauac

SEQ ID NO: 932537 - RNA, 19 nt, Homo sapiens
gaaauaaauaccgcacaca

SEQ ID NO: 932538 - RNA, 19 nt, Homo sapiens
ggacaacgugggagauugg

SEQ ID NO: 932539 - RNA, 19 nt, Homo sapiens
ccaaauggagggcaugcuu

SEQ ID NO: 932540 - RNA, 19 nt, Homo sapiens
ucagucagcuauccuugca

SEQ ID NO: 932541 - RNA, 19 nt, Homo sapiens
aaauaaauaccgcacacaa

SEQ ID NO: 932542 - RNA, 19 nt, Homo sapiens
uauugccucuauucuguaa

SEQ ID NO: 932543 - RNA, 19 nt, Homo sapiens
ccacugauaggaaugacuu

SEQ ID NO: 932544 - RNA, 19 nt, Homo sapiens
caagccaauuaaaugauca

SEQ ID NO: 932545 - RNA, 19 nt, Homo sapiens
gaacaugggguuuugacuu

SEQ ID NO: 932546 - RNA, 19 nt, Homo sapiens
gagugacauugaccucaug

SEQ ID NO: 932547 - RNA, 19 nt, Homo sapiens
ccugauggcagcugaaguu

SEQ ID NO: 932548 - RNA, 19 nt, Homo sapiens
gcaaaacccauuccccaaa

SEQ ID NO: 932549 - RNA, 19 nt, Homo sapiens
guacugcgcguucuaagac

SEQ ID NO: 932550 - RNA, 19 nt, Homo sapiens
cauaagaagggaagcuguu

SEQ ID NO: 932551 - RNA, 19 nt, Homo sapiens
ugagaaguguagggaguug

SEQ ID NO: 932552 - RNA, 19 nt, Homo sapiens
caaagcggaggcacccaaa

SEQ ID NO: 932553 - RNA, 19 nt, Homo sapiens
agaagcugcucuagauugg

SEQ ID NO: 932554 - RNA, 19 nt, Homo sapiens
ucaaggaagaccacacaug

SEQ ID NO: 932555 - RNA, 19 nt, Homo sapiens
auaaauaccgcacacaaag

SEQ ID NO: 932556 - RNA, 19 nt, Homo sapiens
ucucugcaccugcuuagaa

SEQ ID NO: 932557 - RNA, 19 nt, Homo sapiens
cggagacuuucuuggcaaa

SEQ ID NO: 932558 - RNA, 19 nt, Homo sapiens
cggcagagucgguccagaa

SEQ ID NO: 932559 - RNA, 19 nt, Homo sapiens
ccuaacaauccuagacuga

SEQ ID NO: 932560 - RNA, 19 nt, Homo sapiens
gcaacccucucccgaacac

SEQ ID NO: 932561 - RNA, 19 nt, Homo sapiens
ccuccucccaagccaauua

SEQ ID NO: 932562 - RNA, 19 nt, Homo sapiens
aagacgcacugcaccaugu

SEQ ID NO: 932563 - RNA, 19 nt, Homo sapiens
gugaccagcugaucuucuc

SEQ ID NO: 932564 - RNA, 19 nt, Homo sapiens
agaagggaaagcauaagaa

SEQ ID NO: 932565 - RNA, 19 nt, Homo sapiens
aaauaccgcacacaaagga

SEQ ID NO: 932566 - RNA, 19 nt, Homo sapiens
guagccaaguaguucuaau

SEQ ID NO: 932567 - RNA, 19 nt, Homo sapiens
ggaggaaaggggucuguaa

SEQ ID NO: 932568 - RNA, 19 nt, Homo sapiens
acucggaaccugaaggauu

SEQ ID NO: 932569 - RNA, 19 nt, Homo sapiens
gaggaacuugauacuaaau

SEQ ID NO: 932570 - RNA, 19 nt, Homo sapiens
ggaccaaaccucggugaac

SEQ ID NO: 932571 - RNA, 19 nt, Homo sapiens
gcaaugagcuuguguguug

SEQ ID NO: 932572 - RNA, 19 nt, Homo sapiens
gagauuggcuugaugaauu

SEQ ID NO: 932573 - RNA, 19 nt, Homo sapiens
ggacaacaccaacacguaa

SEQ ID NO: 932574 - RNA, 19 nt, Homo sapiens
uuaaagaguuucccuacuu

SEQ ID NO: 932575 - RNA, 19 nt, Homo sapiens
ccucagaacucucagguau

SEQ ID NO: 932576 - RNA, 19 nt, Homo sapiens
cagagcaguuagccaguua

SEQ ID NO: 932577 - RNA, 19 nt, Homo sapiens
aaagcuacaucuacacgua

SEQ ID NO: 932578 - RNA, 19 nt, Homo sapiens
gaucagacccugguagcua

SEQ ID NO: 932579 - RNA, 19 nt, Homo sapiens
guaccugggugaaugauca

SEQ ID NO: 932580 - RNA, 19 nt, Homo sapiens
caugguggcuggaaguaaa

SEQ ID NO: 932581 - RNA, 19 nt, Homo sapiens
caaacaagguacagguuca

SEQ ID NO: 932582 - RNA, 19 nt, Homo sapiens
ggaaggagcagccacaagu

SEQ ID NO: 932583 - RNA, 19 nt, Homo sapiens
ccaccaagaucuccuacga

SEQ ID NO: 932584 - RNA, 19 nt, Homo sapiens
gcacuaacucaucugaauu

SEQ ID NO: 932585 - RNA, 19 nt, Homo sapiens
gggaggaacugugugguau

SEQ ID NO: 932586 - RNA, 19 nt, Homo sapiens
ucaaugacuucaaggaugu

SEQ ID NO: 932587 - RNA, 19 nt, Homo sapiens
acacguaaggaccuaauua

SEQ ID NO: 932588 - RNA, 19 nt, Homo sapiens
ucagaacucucagguauag

SEQ ID NO: 932589 - RNA, 19 nt, Homo sapiens
gucaguaguuuaaagaguu

SEQ ID NO: 932590 - RNA, 19 nt, Homo sapiens
guaaggaccuaauuaaacc

SEQ ID NO: 932591 - RNA, 19 nt, Homo sapiens
gcagagccuucuccaugga

SEQ ID NO: 932592 - RNA, 19 nt, Homo sapiens
ggagaagccggauguggaa

SEQ ID NO: 932593 - RNA, 19 nt, Homo sapiens
cacuaacucaucugaauua

SEQ ID NO: 932594 - RNA, 19 nt, Homo sapiens
ugaauuucgugcuggguuu

SEQ ID NO: 932595 - RNA, 19 nt, Homo sapiens
ggccaucucugcacuaacu

SEQ ID NO: 932596 - RNA, 19 nt, Homo sapiens
ggucaguaguuuaaagagu

SEQ ID NO: 932597 - RNA, 19 nt, Homo sapiens
gagaauggguaaguugucu

SEQ ID NO: 932598 - RNA, 19 nt, Homo sapiens
gcacggauuugaggagaag

SEQ ID NO: 932599 - RNA, 19 nt, Homo sapiens
gagcuuguguguuguuggu

SEQ ID NO: 932600 - RNA, 19 nt, Homo sapiens
agauuggcuugaugaauuu

SEQ ID NO: 932601 - RNA, 19 nt, Homo sapiens
uugccuggcuuccuucuuu

SEQ ID NO: 932602 - RNA, 19 nt, Homo sapiens
cugcaaagcuacaucuaca

SEQ ID NO: 932603 - RNA, 19 nt, Homo sapiens
gggacaacaccaacacgua

SEQ ID NO: 932604 - RNA, 19 nt, Homo sapiens
ggaccuaauuaaaccaaac

SEQ ID NO: 932605 - RNA, 19 nt, Homo sapiens
cugaaugguuugugaacuu

SEQ ID NO: 932606 - RNA, 19 nt, Homo sapiens
guacaagcgccugugcuaa

SEQ ID NO: 932607 - RNA, 19 nt, Homo sapiens
ugaaugguuugugaacuug

SEQ ID NO: 932608 - RNA, 19 nt, Homo sapiens
ccagagcaguuagccaguu

SEQ ID NO: 932609 - RNA, 19 nt, Homo sapiens
cacguaaggaccuaauuaa

SEQ ID NO: 932610 - RNA, 19 nt, Homo sapiens
gaaggagcagccacaagug

SEQ ID NO: 932611 - RNA, 19 nt, Homo sapiens
guauagaagcccaggaugu

SEQ ID NO: 932612 - RNA, 19 nt, Homo sapiens
ggucacaaagccuggguuu

SEQ ID NO: 932613 - RNA, 19 nt, Homo sapiens
ggagaagcagcgaagaugu

SEQ ID NO: 932614 - RNA, 19 nt, Homo sapiens
ggcccagucucaguuugua

SEQ ID NO: 932615 - RNA, 19 nt, Homo sapiens
ccugguagcuaagaaggaa

SEQ ID NO: 932616 - RNA, 19 nt, Homo sapiens
cuacaugccuccggguuuc

SEQ ID NO: 932617 - RNA, 19 nt, Homo sapiens
uggccagagugacagcuua

SEQ ID NO: 932618 - RNA, 19 nt, Homo sapiens
ugaugccucuguuuccaaa

SEQ ID NO: 932619 - RNA, 19 nt, Homo sapiens
cuacgagauuggcuugaug

SEQ ID NO: 932620 - RNA, 19 nt, Homo sapiens
gaggagaagcagcgaagau

SEQ ID NO: 932621 - RNA, 19 nt, Homo sapiens
gugcuggguuucuucuguu

SEQ ID NO: 932622 - RNA, 19 nt, Homo sapiens
ugcacuaacucaucugaau

SEQ ID NO: 932623 - RNA, 19 nt, Homo sapiens
gcugacaggcagaagacua

SEQ ID NO: 932624 - RNA, 19 nt, Homo sapiens
cagccucgcccugucuuua

SEQ ID NO: 932625 - RNA, 19 nt, Homo sapiens
gguaaguugucuggaguca

SEQ ID NO: 932626 - RNA, 19 nt, Homo sapiens
ugugugaucgggaagauaa

SEQ ID NO: 932627 - RNA, 19 nt, Homo sapiens
gaggaacugugugguaugc

SEQ ID NO: 932628 - RNA, 19 nt, Homo sapiens
cguaaggaccuaauuaaac

SEQ ID NO: 932629 - RNA, 19 nt, Homo sapiens
gagaagcagcgaagauguc

SEQ ID NO: 932630 - RNA, 19 nt, Homo sapiens
ucaccugccucccuucucu

SEQ ID NO: 932631 - RNA, 19 nt, Homo sapiens
ucucuugccuggcuuccuu

SEQ ID NO: 932632 - RNA, 19 nt, Homo sapiens
ggccgagaauggguaaguu

SEQ ID NO: 932633 - RNA, 19 nt, Homo sapiens
agugacagcuuagggagaa

SEQ ID NO: 932634 - RNA, 19 nt, Homo sapiens
ggcgcacccuuaagcaaga

SEQ ID NO: 932635 - RNA, 19 nt, Homo sapiens
ucauuaaauuggcccuuuc

SEQ ID NO: 932636 - RNA, 19 nt, Homo sapiens
aagcccaggaugucuaaua

SEQ ID NO: 932637 - RNA, 19 nt, Homo sapiens
guggcagucuuggucagua

SEQ ID NO: 932638 - RNA, 19 nt, Homo sapiens
ccaacugccugggacaaca

SEQ ID NO: 932639 - RNA, 19 nt, Homo sapiens
agaacucucagguauagaa

SEQ ID NO: 932640 - RNA, 19 nt, Homo sapiens
cguacaagcgccugugcua

SEQ ID NO: 932641 - RNA, 19 nt, Homo sapiens
uuaugaagguggcagucuu

SEQ ID NO: 932642 - RNA, 19 nt, Homo sapiens
gccucgcccugucuuuauu

SEQ ID NO: 932643 - RNA, 19 nt, Homo sapiens
gcaugguggcuggaaguaa

SEQ ID NO: 932644 - RNA, 19 nt, Homo sapiens
guuuguuucuggguacuuu

SEQ ID NO: 932645 - RNA, 19 nt, Homo sapiens
caucaaugacuucaaggau

SEQ ID NO: 932646 - RNA, 19 nt, Homo sapiens
ggaggaacugugugguaug

SEQ ID NO: 932647 - RNA, 19 nt, Homo sapiens
caacacguaaggaccuaau

SEQ ID NO: 932648 - RNA, 19 nt, Homo sapiens
cucauuaaauuggcccuuu

SEQ ID NO: 932649 - RNA, 19 nt, Homo sapiens
uagcuaagaaggaacuugu

SEQ ID NO: 932650 - RNA, 19 nt, Homo sapiens
uuucuucuguugcuucaug

SEQ ID NO: 932651 - RNA, 19 nt, Homo sapiens
gcagggagagaucuuugag

SEQ ID NO: 932652 - RNA, 19 nt, Homo sapiens
cguaggacagggucacaaa

SEQ ID NO: 932653 - RNA, 19 nt, Homo sapiens
caccuuccuuccucugaug

SEQ ID NO: 932654 - RNA, 19 nt, Homo sapiens
agucucaguuuguaguuuc

SEQ ID NO: 932655 - RNA, 19 nt, Homo sapiens
uuuccugaaugguuuguga

SEQ ID NO: 932656 - RNA, 19 nt, Homo sapiens
gagccuucuccauggauuu

SEQ ID NO: 932657 - RNA, 19 nt, Homo sapiens
ucucugcacuaacucaucu

SEQ ID NO: 932658 - RNA, 19 nt, Homo sapiens
cugacaggcagaagacuaa

SEQ ID NO: 932659 - RNA, 19 nt, Homo sapiens
gaggcgcacccuuaagcaa

SEQ ID NO: 932660 - RNA, 19 nt, Homo sapiens
caaaccagagucgggugua

SEQ ID NO: 932661 - RNA, 19 nt, Homo sapiens
gcugaugccaugccaacug

SEQ ID NO: 932662 - RNA, 19 nt, Homo sapiens
cagucucaguuuguaguuu

SEQ ID NO: 932663 - RNA, 19 nt, Homo sapiens
aucagacccugguagcuaa

SEQ ID NO: 932664 - RNA, 19 nt, Homo sapiens
gaaugaucagacccuggua

SEQ ID NO: 932665 - RNA, 19 nt, Homo sapiens
gaacucucagguauagaag

SEQ ID NO: 932666 - RNA, 19 nt, Homo sapiens
cuagaaguccuguccucuu

SEQ ID NO: 932667 - RNA, 19 nt, Homo sapiens
cgugcuggguuucuucugu

SEQ ID NO: 932668 - RNA, 19 nt, Homo sapiens
ccuacgagauuggcuugau

SEQ ID NO: 932669 - RNA, 19 nt, Homo sapiens
gaaucguggcccagucuca

SEQ ID NO: 932670 - RNA, 19 nt, Homo sapiens
ccugguggcugguguaucc

SEQ ID NO: 932671 - RNA, 19 nt, Homo sapiens
gaagugagcuccaagagua

SEQ ID NO: 932672 - RNA, 19 nt, Homo sapiens
ggaggcaagucauuuauua

SEQ ID NO: 932673 - RNA, 19 nt, Homo sapiens
gagccuaucuacacauuua

SEQ ID NO: 932674 - RNA, 19 nt, Homo sapiens
gaaguagguuauacagaua

SEQ ID NO: 932675 - RNA, 19 nt, Homo sapiens
ggaaguagguuauacagau

SEQ ID NO: 932676 - RNA, 19 nt, Homo sapiens
agaaugggcugaaccaaua

SEQ ID NO: 932677 - RNA, 19 nt, Homo sapiens
gaacugagcguauaucugu

SEQ ID NO: 932678 - RNA, 19 nt, Homo sapiens
gaaagaaauuggaugaauc

SEQ ID NO: 932679 - RNA, 19 nt, Homo sapiens
caacagugcucaagauugu

SEQ ID NO: 932680 - RNA, 19 nt, Homo sapiens
gauguuagaguaugcauua

SEQ ID NO: 932681 - RNA, 19 nt, Homo sapiens
acagguagauucugguuua

SEQ ID NO: 932682 - RNA, 19 nt, Homo sapiens
gaccauacccugaaacuuu

SEQ ID NO: 932683 - RNA, 19 nt, Homo sapiens
aaaggaaccuguauaucua

SEQ ID NO: 932684 - RNA, 19 nt, Homo sapiens
gaagauagacacaucaaau

SEQ ID NO: 932685 - RNA, 19 nt, Homo sapiens
gaugugaacugagcguaua

SEQ ID NO: 932686 - RNA, 19 nt, Homo sapiens
ccaaauggaucaguagaaa

SEQ ID NO: 932687 - RNA, 19 nt, Homo sapiens
gaaauaacagcucacagaa

SEQ ID NO: 932688 - RNA, 19 nt, Homo sapiens
caaggacuauuaaguguau

SEQ ID NO: 932689 - RNA, 19 nt, Homo sapiens
ggaggaggcaagucauuua

SEQ ID NO: 932690 - RNA, 19 nt, Homo sapiens
ugaaggagcuggagaagca

SEQ ID NO: 932691 - RNA, 19 nt, Homo sapiens
ggaauguggugcucuuguu

SEQ ID NO: 932692 - RNA, 19 nt, Homo sapiens
uacaauaacugcucaugaa

SEQ ID NO: 932693 - RNA, 19 nt, Homo sapiens
gauaugacacuacauguga

SEQ ID NO: 932694 - RNA, 19 nt, Homo sapiens
cauaaaccaaggacuauua

SEQ ID NO: 932695 - RNA, 19 nt, Homo sapiens
guagugcaguaauuuauga

SEQ ID NO: 932696 - RNA, 19 nt, Homo sapiens
cuacaucaguugacuuuau

SEQ ID NO: 932697 - RNA, 19 nt, Homo sapiens
uaaaggaaccuguauaucu

SEQ ID NO: 932698 - RNA, 19 nt, Homo sapiens
caagacaugugugcaagaa

SEQ ID NO: 932699 - RNA, 19 nt, Homo sapiens
uaacaaaugaugcagacua

SEQ ID NO: 932700 - RNA, 19 nt, Homo sapiens
gcuaaguccuuccauaaag

SEQ ID NO: 932701 - RNA, 19 nt, Homo sapiens
gcacuuacaauggagauaa

SEQ ID NO: 932702 - RNA, 19 nt, Homo sapiens
gcacugaaagaauuugauu

SEQ ID NO: 932703 - RNA, 19 nt, Homo sapiens
gcaaaagggacaagaaaua

SEQ ID NO: 932704 - RNA, 19 nt, Homo sapiens
gguagauucugguuuacaa

SEQ ID NO: 932705 - RNA, 19 nt, Homo sapiens
aagagaaccugaagaagga

SEQ ID NO: 932706 - RNA, 19 nt, Homo sapiens
gcuaaaggaaccuguauau

SEQ ID NO: 932707 - RNA, 19 nt, Homo sapiens
aauaacagcucacagaaag

SEQ ID NO: 932708 - RNA, 19 nt, Homo sapiens
agauggcacuguuagguua

SEQ ID NO: 932709 - RNA, 19 nt, Homo sapiens
gagugccucuuuagaugua

SEQ ID NO: 932710 - RNA, 19 nt, Homo sapiens
ugauuugccugcuaauaaa

SEQ ID NO: 932711 - RNA, 19 nt, Homo sapiens
guuaugauuugccugcuaa

SEQ ID NO: 932712 - RNA, 19 nt, Homo sapiens
gugcuuaauuuauggugua

SEQ ID NO: 932713 - RNA, 19 nt, Homo sapiens
ucacaacagugcucaagau

SEQ ID NO: 932714 - RNA, 19 nt, Homo sapiens
uggaauaccuacaucaguu

SEQ ID NO: 932715 - RNA, 19 nt, Homo sapiens
aggaagcacugaaagaauu

SEQ ID NO: 932716 - RNA, 19 nt, Homo sapiens
uagaacagauccugaaugg

SEQ ID NO: 932717 - RNA, 19 nt, Homo sapiens
gcagacagcuuuuaagaca

SEQ ID NO: 932718 - RNA, 19 nt, Homo sapiens
ccacagcaccucagaauag

SEQ ID NO: 932719 - RNA, 19 nt, Homo sapiens
gaaucaggauacagaaauc

SEQ ID NO: 932720 - RNA, 19 nt, Homo sapiens
ucagcuaaguccuuccaua

SEQ ID NO: 932721 - RNA, 19 nt, Homo sapiens
ugauccagcucauauggua

SEQ ID NO: 932722 - RNA, 19 nt, Homo sapiens
guucugucauuagcuauua

SEQ ID NO: 932723 - RNA, 19 nt, Homo sapiens
ccaauaacguuuccaucug

SEQ ID NO: 932724 - RNA, 19 nt, Homo sapiens
cagcuaaguccuuccauaa

SEQ ID NO: 932725 - RNA, 19 nt, Homo sapiens
ccacuuucuuuccuucuuu

SEQ ID NO: 932726 - RNA, 19 nt, Homo sapiens
uaugguagcucacuuggau

SEQ ID NO: 932727 - RNA, 19 nt, Homo sapiens
gacauggagucccaaguau

SEQ ID NO: 932728 - RNA, 19 nt, Homo sapiens
caaaugaugcagacuauag

SEQ ID NO: 932729 - RNA, 19 nt, Homo sapiens
ugguggaaaucacaucuua

SEQ ID NO: 932730 - RNA, 19 nt, Homo sapiens
agacaugugugcaagaaau

SEQ ID NO: 932731 - RNA, 19 nt, Homo sapiens
uguucuagcuggcacuuua

SEQ ID NO: 932732 - RNA, 19 nt, Homo sapiens
ucacuuggaugcuguuaca

SEQ ID NO: 932733 - RNA, 19 nt, Homo sapiens
agaaauaacagcucacaga

SEQ ID NO: 932734 - RNA, 19 nt, Homo sapiens
caucggcccuguucuguca

SEQ ID NO: 932735 - RNA, 19 nt, Homo sapiens
agacauggagucccaagua

SEQ ID NO: 932736 - RNA, 19 nt, Homo sapiens
ggaagcacugaaagaauuu

SEQ ID NO: 932737 - RNA, 19 nt, Homo sapiens
agaaccaaauggaucagua

SEQ ID NO: 932738 - RNA, 19 nt, Homo sapiens
cuaaguccuuccauaaaga

SEQ ID NO: 932739 - RNA, 19 nt, Homo sapiens
cagaaagguuacugauaug

SEQ ID NO: 932740 - RNA, 19 nt, Homo sapiens
gaauuuagacagcaagaca

SEQ ID NO: 932741 - RNA, 19 nt, Homo sapiens
ugacuguuccaucagauua

SEQ ID NO: 932742 - RNA, 19 nt, Homo sapiens
gaugcagacuauaguuaug

SEQ ID NO: 932743 - RNA, 19 nt, Homo sapiens
gaucgaaggcaucccagaa

SEQ ID NO: 932744 - RNA, 19 nt, Homo sapiens
gauggaggagggauuguaa

SEQ ID NO: 932745 - RNA, 19 nt, Homo sapiens
cacacuuccuguuacaaua

SEQ ID NO: 932746 - RNA, 19 nt, Homo sapiens
uaacagcucacagaaagaa

SEQ ID NO: 932747 - RNA, 19 nt, Homo sapiens
gaaggcaucccagaaggaa

SEQ ID NO: 932748 - RNA, 19 nt, Homo sapiens
gaaaucugcuguguuuuga

SEQ ID NO: 932749 - RNA, 19 nt, Homo sapiens
ggaacucuuugaauagucu

SEQ ID NO: 932750 - RNA, 19 nt, Homo sapiens
gguaaccucuuucaacacu

SEQ ID NO: 932751 - RNA, 19 nt, Homo sapiens
ugccauguauuugcacuua

SEQ ID NO: 932752 - RNA, 19 nt, Homo sapiens
gaaccugaagaaggacuua

SEQ ID NO: 932753 - RNA, 19 nt, Homo sapiens
gggcugaaccaauaacguu

SEQ ID NO: 932754 - RNA, 19 nt, Homo sapiens
gauccugaauggaggugaa

SEQ ID NO: 932755 - RNA, 19 nt, Homo sapiens
uaccaugauuccaaacaaa

SEQ ID NO: 932756 - RNA, 19 nt, Homo sapiens
cugcaucacugccaucaga

SEQ ID NO: 932757 - RNA, 19 nt, Homo sapiens
aauaacugcucaugaagau

SEQ ID NO: 932758 - RNA, 19 nt, Homo sapiens
ggaauaccuacaucaguug

SEQ ID NO: 932759 - RNA, 19 nt, Homo sapiens
gugauguucuugagacguu

SEQ ID NO: 932760 - RNA, 19 nt, Homo sapiens
gauuguaccacauagcaaa

SEQ ID NO: 932761 - RNA, 19 nt, Homo sapiens
cugaucaguuugcgaguuu

SEQ ID NO: 932762 - RNA, 19 nt, Homo sapiens
aaagguuacugauaugaca

SEQ ID NO: 932763 - RNA, 19 nt, Homo sapiens
ccuaauggaaucuauuuga

SEQ ID NO: 932764 - RNA, 19 nt, Homo sapiens
uaacugcucaugaagauag

SEQ ID NO: 932765 - RNA, 19 nt, Homo sapiens
gaaccaaauggaucaguag

SEQ ID NO: 932766 - RNA, 19 nt, Homo sapiens
ccacauagcaaacauacag

SEQ ID NO: 932767 - RNA, 19 nt, Homo sapiens
gguuuaccaugauuccaaa

SEQ ID NO: 932768 - RNA, 19 nt, Homo sapiens
uuacugauaugacacuaca

SEQ ID NO: 932769 - RNA, 19 nt, Homo sapiens
agaaagagggucugcauca

SEQ ID NO: 932770 - RNA, 19 nt, Homo sapiens
caauaacugcucaugaaga

SEQ ID NO: 932771 - RNA, 19 nt, Homo sapiens
caacacaucuuguaacuua

SEQ ID NO: 932772 - RNA, 19 nt, Homo sapiens
gcagggugauuucuuauua

SEQ ID NO: 932773 - RNA, 19 nt, Homo sapiens
gaaauugcuuugcugguuu

SEQ ID NO: 932774 - RNA, 19 nt, Homo sapiens
ggaugaagauauucuacua

SEQ ID NO: 932775 - RNA, 19 nt, Homo sapiens
gagaugagauagacuguga

SEQ ID NO: 932776 - RNA, 19 nt, Homo sapiens
ccaaauggcucagaugaaa

SEQ ID NO: 932777 - RNA, 19 nt, Homo sapiens
guaauaacauggaugaaug

SEQ ID NO: 932778 - RNA, 19 nt, Homo sapiens
gaagggaugugacaagugu

SEQ ID NO: 932779 - RNA, 19 nt, Homo sapiens
gaagcagaauuguuaagaa

SEQ ID NO: 932780 - RNA, 19 nt, Homo sapiens
gcacaagcacuaucacuuu

SEQ ID NO: 932781 - RNA, 19 nt, Homo sapiens
gaagagaucugugccaaag

SEQ ID NO: 932782 - RNA, 19 nt, Homo sapiens
guaguucacuguagaaaug

SEQ ID NO: 932783 - RNA, 19 nt, Homo sapiens
gaagagaagaugaugauga

SEQ ID NO: 932784 - RNA, 19 nt, Homo sapiens
gcauugggauguacuugua

SEQ ID NO: 932785 - RNA, 19 nt, Homo sapiens
ccacagcaacuauauauuu

SEQ ID NO: 932786 - RNA, 19 nt, Homo sapiens
guagagaaccugagagaaa

SEQ ID NO: 932787 - RNA, 19 nt, Homo sapiens
guaaugucuuucccuaaua

SEQ ID NO: 932788 - RNA, 19 nt, Homo sapiens
gaugaggcuuuguuacuuu

SEQ ID NO: 932789 - RNA, 19 nt, Homo sapiens
ugauggaucuucagacuuu

SEQ ID NO: 932790 - RNA, 19 nt, Homo sapiens
gaagaucauuugaaacaca

SEQ ID NO: 932791 - RNA, 19 nt, Homo sapiens
gaaccagaguccuuugaga

SEQ ID NO: 932792 - RNA, 19 nt, Homo sapiens
gagaauguuugaaagaaga

SEQ ID NO: 932793 - RNA, 19 nt, Homo sapiens
gaagaaaauugcccaguaa

SEQ ID NO: 932794 - RNA, 19 nt, Homo sapiens
cacaagcacuaucacuuua

SEQ ID NO: 932795 - RNA, 19 nt, Homo sapiens
gaaacucauuugauuguca

SEQ ID NO: 932796 - RNA, 19 nt, Homo sapiens
ggaacugacuaagauguuu

SEQ ID NO: 932797 - RNA, 19 nt, Homo sapiens
gguaaugucuuucccuaau

SEQ ID NO: 932798 - RNA, 19 nt, Homo sapiens
ggauguacuuguaagcuuu

SEQ ID NO: 932799 - RNA, 19 nt, Homo sapiens
ccucaucuguggccuguua

SEQ ID NO: 932800 - RNA, 19 nt, Homo sapiens
gagaagcuccucccucgua

SEQ ID NO: 932801 - RNA, 19 nt, Homo sapiens
caucacugcugccgucaua

SEQ ID NO: 932802 - RNA, 19 nt, Homo sapiens
uauacaaguuggagcaaua

SEQ ID NO: 932803 - RNA, 19 nt, Homo sapiens
ggcgaaaucauuacuauaa

SEQ ID NO: 932804 - RNA, 19 nt, Homo sapiens
gaaccugagagaaaucaua

SEQ ID NO: 932805 - RNA, 19 nt, Homo sapiens
gcaacuaccagaaucauug

SEQ ID NO: 932806 - RNA, 19 nt, Homo sapiens
caagaccacaucuggauua

SEQ ID NO: 932807 - RNA, 19 nt, Homo sapiens
agaauuaaguggaugaaga

SEQ ID NO: 932808 - RNA, 19 nt, Homo sapiens
ugagacaacuugauaaugg

SEQ ID NO: 932809 - RNA, 19 nt, Homo sapiens
gaaaccaauuguaccaugu

SEQ ID NO: 932810 - RNA, 19 nt, Homo sapiens
gacaacaucucuagaaagg

SEQ ID NO: 932811 - RNA, 19 nt, Homo sapiens
ggaguaaggccaaguaauc

SEQ ID NO: 932812 - RNA, 19 nt, Homo sapiens
gggcuuagacaaccauaua

SEQ ID NO: 932813 - RNA, 19 nt, Homo sapiens
gaaacacaguugucaagag

SEQ ID NO: 932814 - RNA, 19 nt, Homo sapiens
caagcacuaucacuuuaaa

SEQ ID NO: 932815 - RNA, 19 nt, Homo sapiens
aggcagaguucgauaaauu

SEQ ID NO: 932816 - RNA, 19 nt, Homo sapiens
gcaggcagaucaagcaaca

SEQ ID NO: 932817 - RNA, 19 nt, Homo sapiens
caagaugacuguggugaug

SEQ ID NO: 932818 - RNA, 19 nt, Homo sapiens
ucacugacuuuaaacuuga

SEQ ID NO: 932819 - RNA, 19 nt, Homo sapiens
gaccacaucuggauuaggu

SEQ ID NO: 932820 - RNA, 19 nt, Homo sapiens
gaucucagcuuggauuuac

SEQ ID NO: 932821 - RNA, 19 nt, Homo sapiens
gaagggaugaaaccaauug

SEQ ID NO: 932822 - RNA, 19 nt, Homo sapiens
ggcaauggcuaaaauauuu

SEQ ID NO: 932823 - RNA, 19 nt, Homo sapiens
gaaaguugggugugugauu

SEQ ID NO: 932824 - RNA, 19 nt, Homo sapiens
ccaaguagauggguucugu

SEQ ID NO: 932825 - RNA, 19 nt, Homo sapiens
ugaaauugcuuugcugguu

SEQ ID NO: 932826 - RNA, 19 nt, Homo sapiens
gcaacagaauuaaguggau

SEQ ID NO: 932827 - RNA, 19 nt, Homo sapiens
gcaaggggauuuaaugcua

SEQ ID NO: 932828 - RNA, 19 nt, Homo sapiens
ggagauaguuccgaugaag

SEQ ID NO: 932829 - RNA, 19 nt, Homo sapiens
gaaaucauacucacagaag

SEQ ID NO: 932830 - RNA, 19 nt, Homo sapiens
guacggaaauggugcucuu

SEQ ID NO: 932831 - RNA, 19 nt, Homo sapiens
ggacagauaaggguacauu

SEQ ID NO: 932832 - RNA, 19 nt, Homo sapiens
gaagauauucuacuaugca

SEQ ID NO: 932833 - RNA, 19 nt, Homo sapiens
gaaaaugagagaagagaua

SEQ ID NO: 932834 - RNA, 19 nt, Homo sapiens
gcagaauuguuaagaagag

SEQ ID NO: 932835 - RNA, 19 nt, Homo sapiens
aaacacaguugucaagagu

SEQ ID NO: 932836 - RNA, 19 nt, Homo sapiens
ggaugaauguggagauagu

SEQ ID NO: 932837 - RNA, 19 nt, Homo sapiens
ggaaaucugaggaaccaaa

SEQ ID NO: 932838 - RNA, 19 nt, Homo sapiens
aacuguagcugguucauaa

SEQ ID NO: 932839 - RNA, 19 nt, Homo sapiens
guauuugucuguguuaaug

SEQ ID NO: 932840 - RNA, 19 nt, Homo sapiens
aaugcagggugauuucuua

SEQ ID NO: 932841 - RNA, 19 nt, Homo sapiens
gagaagaugaugaugaugu

SEQ ID NO: 932842 - RNA, 19 nt, Homo sapiens
gagaaaucauacucacaga

SEQ ID NO: 932843 - RNA, 19 nt, Homo sapiens
ggaaccaaauugugcuugu

SEQ ID NO: 932844 - RNA, 19 nt, Homo sapiens
gaucaaggacaagggcuua

SEQ ID NO: 932845 - RNA, 19 nt, Homo sapiens
gcagaucaagcaacauuug

SEQ ID NO: 932846 - RNA, 19 nt, Homo sapiens
caauugcaccugguuaaua

SEQ ID NO: 932847 - RNA, 19 nt, Homo sapiens
agagaucugugccaaagaa

SEQ ID NO: 932848 - RNA, 19 nt, Homo sapiens
uaaguacuuugcugaaugu

SEQ ID NO: 932849 - RNA, 19 nt, Homo sapiens
uaaguagugugaauugcaa

SEQ ID NO: 932850 - RNA, 19 nt, Homo sapiens
ggaaacaaacugucuaaaa

SEQ ID NO: 932851 - RNA, 19 nt, Homo sapiens
gauaccagacacuugcuua

SEQ ID NO: 932852 - RNA, 19 nt, Homo sapiens
guagauggguucuguuugc

SEQ ID NO: 932853 - RNA, 19 nt, Homo sapiens
gaaccaaauugugcuugug

SEQ ID NO: 932854 - RNA, 19 nt, Homo sapiens
caguugcgguuuauuuauu

SEQ ID NO: 932855 - RNA, 19 nt, Homo sapiens
uugcuuugcugguuucaua

SEQ ID NO: 932856 - RNA, 19 nt, Homo sapiens
ggcagaguucgauaaauua

SEQ ID NO: 932857 - RNA, 19 nt, Homo sapiens
ggaagcagaauuguuaaga

SEQ ID NO: 932858 - RNA, 19 nt, Homo sapiens
gcaaauacgagcaccaagu

SEQ ID NO: 932859 - RNA, 19 nt, Homo sapiens
gguugacaauagaaacaua

SEQ ID NO: 932860 - RNA, 19 nt, Homo sapiens
guacuuugcugaaugucau

SEQ ID NO: 932861 - RNA, 19 nt, Homo sapiens
gauaaguuccaccugguaa

SEQ ID NO: 932862 - RNA, 19 nt, Homo sapiens
aagagaagaugaugaugau

SEQ ID NO: 932863 - RNA, 19 nt, Homo sapiens
gggcuacgcuggguacguu

SEQ ID NO: 932864 - RNA, 19 nt, Homo sapiens
caagugcacucagucguau

SEQ ID NO: 932865 - RNA, 19 nt, Homo sapiens
gcacgucaccagcuuacaa

SEQ ID NO: 932866 - RNA, 19 nt, Homo sapiens
gagguggucaugcagauaa

SEQ ID NO: 932867 - RNA, 19 nt, Homo sapiens
gagaauccacacaagcuuu

SEQ ID NO: 932868 - RNA, 19 nt, Homo sapiens
ccaauuauccagacuuuua

SEQ ID NO: 932869 - RNA, 19 nt, Homo sapiens
ugaccuaggagaugagaua

SEQ ID NO: 932870 - RNA, 19 nt, Homo sapiens
guuucagacuggcauauuu

SEQ ID NO: 932871 - RNA, 19 nt, Homo sapiens
ggaaacagcuccuuguaca

SEQ ID NO: 932872 - RNA, 19 nt, Homo sapiens
gauauacucuguucuugaa

SEQ ID NO: 932873 - RNA, 19 nt, Homo sapiens
gagcaguacugguuuguga

SEQ ID NO: 932874 - RNA, 19 nt, Homo sapiens
aaacuugccuguggacuua

SEQ ID NO: 932875 - RNA, 19 nt, Homo sapiens
guauaaugcugucacaauu

SEQ ID NO: 932876 - RNA, 19 nt, Homo sapiens
ggagaugcaucagcuauga

SEQ ID NO: 932877 - RNA, 19 nt, Homo sapiens
uaaauuacccuauccuuug

SEQ ID NO: 932878 - RNA, 19 nt, Homo sapiens
gaaaguugauugguugguu

SEQ ID NO: 932879 - RNA, 19 nt, Homo sapiens
gaacauguuuauugcagau

SEQ ID NO: 932880 - RNA, 19 nt, Homo sapiens
caaaggaguuggcauuagu

SEQ ID NO: 932881 - RNA, 19 nt, Homo sapiens
gaccuaaugucaccuuaau

SEQ ID NO: 932882 - RNA, 19 nt, Homo sapiens
uaaauaucguucacccuaa

SEQ ID NO: 932883 - RNA, 19 nt, Homo sapiens
gcauuaguguucuugaaau

SEQ ID NO: 932884 - RNA, 19 nt, Homo sapiens
gacuugaacuggaagcauu

SEQ ID NO: 932885 - RNA, 19 nt, Homo sapiens
caagaaguuugggacuaua

SEQ ID NO: 932886 - RNA, 19 nt, Homo sapiens
caagggagcaguacugguu

SEQ ID NO: 932887 - RNA, 19 nt, Homo sapiens
gaagaagccaagaaguuug

SEQ ID NO: 932888 - RNA, 19 nt, Homo sapiens
ggaguuggcauuaguguuc

SEQ ID NO: 932889 - RNA, 19 nt, Homo sapiens
ccuccuacguguauuauug

SEQ ID NO: 932890 - RNA, 19 nt, Homo sapiens
cagaagaagccaagaaguu

SEQ ID NO: 932891 - RNA, 19 nt, Homo sapiens
aaugucaccuuaauucuga

SEQ ID NO: 932892 - RNA, 19 nt, Homo sapiens
aagagaaaguugauugguu

SEQ ID NO: 932893 - RNA, 19 nt, Homo sapiens
ugacauguccucaaacuuc

SEQ ID NO: 932894 - RNA, 19 nt, Homo sapiens
uccuugaccuugugcauua

SEQ ID NO: 932895 - RNA, 19 nt, Homo sapiens
gguguggaguuugacuuua

SEQ ID NO: 932896 - RNA, 19 nt, Homo sapiens
agucacaggucaucagauu

SEQ ID NO: 932897 - RNA, 19 nt, Homo sapiens
ggauauacucuguucuuga

SEQ ID NO: 932898 - RNA, 19 nt, Homo sapiens
caucagcuaugaacacauc

SEQ ID NO: 932899 - RNA, 19 nt, Homo sapiens
ccaggcagguggucaacuu

SEQ ID NO: 932900 - RNA, 19 nt, Homo sapiens
aaauaucguucacccuaaa

SEQ ID NO: 932901 - RNA, 19 nt, Homo sapiens
uaaccaggauauacucugu

SEQ ID NO: 932902 - RNA, 19 nt, Homo sapiens
agaagaagccaagaaguuu

SEQ ID NO: 932903 - RNA, 19 nt, Homo sapiens
cuacgagagugauacuuug

SEQ ID NO: 932904 - RNA, 19 nt, Homo sapiens
auaaugcugucacaauuga

SEQ ID NO: 932905 - RNA, 19 nt, Homo sapiens
ugauaauucucaaggauuc

SEQ ID NO: 932906 - RNA, 19 nt, Homo sapiens
cuacaaaggaguuggcauu

SEQ ID NO: 932907 - RNA, 19 nt, Homo sapiens
guacaacacgccuccaugu

SEQ ID NO: 932908 - RNA, 19 nt, Homo sapiens
gcauuauagcauuccauua

SEQ ID NO: 932909 - RNA, 19 nt, Homo sapiens
ggaccuaaugucaccuuaa

SEQ ID NO: 932910 - RNA, 19 nt, Homo sapiens
aaaccucauuggcuugaaa

SEQ ID NO: 932911 - RNA, 19 nt, Homo sapiens
guugauugguugguuguuu

SEQ ID NO: 932912 - RNA, 19 nt, Homo sapiens
uagaagagaaaguugauug

SEQ ID NO: 932913 - RNA, 19 nt, Homo sapiens
gaaacagcuccuuguacaa

SEQ ID NO: 932914 - RNA, 19 nt, Homo sapiens
cauuauagcauuccauuag

SEQ ID NO: 932915 - RNA, 19 nt, Homo sapiens
guucagugcuguccccuua

SEQ ID NO: 932916 - RNA, 19 nt, Homo sapiens
guguggaguuugacuuuau

SEQ ID NO: 932917 - RNA, 19 nt, Homo sapiens
gaaguuugggacuauaaau

SEQ ID NO: 932918 - RNA, 19 nt, Homo sapiens
agacaacuauaaggugauu

SEQ ID NO: 932919 - RNA, 19 nt, Homo sapiens
gagugauacuuugcugaaa

SEQ ID NO: 932920 - RNA, 19 nt, Homo sapiens
ccuaaugucaccuuaauuc

SEQ ID NO: 932921 - RNA, 19 nt, Homo sapiens
gggccucucuguauaaugc

SEQ ID NO: 932922 - RNA, 19 nt, Homo sapiens
ccucaaacuuccuguccaa

SEQ ID NO: 932923 - RNA, 19 nt, Homo sapiens
cagcuaaggccgcagaaga

SEQ ID NO: 932924 - RNA, 19 nt, Homo sapiens
ucaccuuaauucugacuug

SEQ ID NO: 932925 - RNA, 19 nt, Homo sapiens
aaacauccacaacucugua

SEQ ID NO: 932926 - RNA, 19 nt, Homo sapiens
aaauuacccuauccuuugu

SEQ ID NO: 932927 - RNA, 19 nt, Homo sapiens
agucuucgccuuccucuuu

SEQ ID NO: 932928 - RNA, 19 nt, Homo sapiens
gaucgaucuuuaugcuguu

SEQ ID NO: 932929 - RNA, 19 nt, Homo sapiens
gggaccuaaugucaccuua

SEQ ID NO: 932930 - RNA, 19 nt, Homo sapiens
ggcauuaguguucuugaaa

SEQ ID NO: 932931 - RNA, 19 nt, Homo sapiens
uguggaguuugacuuuaua

SEQ ID NO: 932932 - RNA, 19 nt, Homo sapiens
ccuuuguucucuacuguuu

SEQ ID NO: 932933 - RNA, 19 nt, Homo sapiens
uaacaaauucccgcguauu

SEQ ID NO: 932934 - RNA, 19 nt, Homo sapiens
uaaagcuggugggaccuaa

SEQ ID NO: 932935 - RNA, 19 nt, Homo sapiens
gaagagaaaguugauuggu

SEQ ID NO: 932936 - RNA, 19 nt, Homo sapiens
guacugguuugugacaugu

SEQ ID NO: 932937 - RNA, 19 nt, Homo sapiens
uuaaauccuugaccuugug

SEQ ID NO: 932938 - RNA, 19 nt, Homo sapiens
ucacugauauauguagaca

SEQ ID NO: 932939 - RNA, 19 nt, Homo sapiens
caaacuugccuguggacuu

SEQ ID NO: 932940 - RNA, 19 nt, Homo sapiens
cuaacaaauucccgcguau

SEQ ID NO: 932941 - RNA, 19 nt, Homo sapiens
ugucacaauugaagacguu

SEQ ID NO: 932942 - RNA, 19 nt, Homo sapiens
ccaagccaguggauguuuc

SEQ ID NO: 932943 - RNA, 19 nt, Homo sapiens
acaaaggaguuggcauuag

SEQ ID NO: 932944 - RNA, 19 nt, Homo sapiens
caggauauacucuguucuu

SEQ ID NO: 932945 - RNA, 19 nt, Homo sapiens
uacaaaggaguuggcauua

SEQ ID NO: 932946 - RNA, 19 nt, Homo sapiens
uuccauagguagaagagaa

SEQ ID NO: 932947 - RNA, 19 nt, Homo sapiens
gcgaagggcaaacuguaga

SEQ ID NO: 932948 - RNA, 19 nt, Homo sapiens
ccuguggacuuaauaaugc

SEQ ID NO: 932949 - RNA, 19 nt, Homo sapiens
ccucgguccuggaauacaa

SEQ ID NO: 932950 - RNA, 19 nt, Homo sapiens
gcagaagaagccaagaagu

SEQ ID NO: 932951 - RNA, 19 nt, Homo sapiens
uauaaugcugucacaauug

SEQ ID NO: 932952 - RNA, 19 nt, Homo sapiens
uggcauuaguguucuugaa

SEQ ID NO: 932953 - RNA, 19 nt, Homo sapiens
ggacuauaaauaucguuca

SEQ ID NO: 932954 - RNA, 19 nt, Homo sapiens
uuacaggagaagugacaua

SEQ ID NO: 932955 - RNA, 19 nt, Homo sapiens
aauuauuucuggagucaug

SEQ ID NO: 932956 - RNA, 19 nt, Homo sapiens
guucuggaguggauuaaaa

SEQ ID NO: 932957 - RNA, 19 nt, Homo sapiens
gguagaagagaaaguugau

SEQ ID NO: 932958 - RNA, 19 nt, Homo sapiens
cgaucuuuaugcuguuauu

SEQ ID NO: 932959 - RNA, 19 nt, Homo sapiens
uuggaggagugguuuaaga

SEQ ID NO: 932960 - RNA, 19 nt, Homo sapiens
caccuuaauucugacuuga

SEQ ID NO: 932961 - RNA, 19 nt, Homo sapiens
uccaucaaaucucaaacaa

SEQ ID NO: 932962 - RNA, 19 nt, Homo sapiens
uccauuagcaagaguugua

SEQ ID NO: 932963 - RNA, 19 nt, Homo sapiens
cccuauuguuuaucuauug

SEQ ID NO: 932964 - RNA, 19 nt, Homo sapiens
ucuguuaaauuacccuauc

SEQ ID NO: 932965 - RNA, 19 nt, Homo sapiens
ucacaggucaucagauuuu

SEQ ID NO: 932966 - RNA, 19 nt, Homo sapiens
ggugcugaaucuacacauc

SEQ ID NO: 932967 - RNA, 19 nt, Homo sapiens
guaaagcuggugggaccua

SEQ ID NO: 932968 - RNA, 19 nt, Homo sapiens
gcaguacugguuugugaca

SEQ ID NO: 932969 - RNA, 19 nt, Homo sapiens
ugcaugguguggaguuuga

SEQ ID NO: 932970 - RNA, 19 nt, Homo sapiens
ggugcaugguguggaguuu

SEQ ID NO: 932971 - RNA, 19 nt, Homo sapiens
ggaaacagcuccuuguaca

SEQ ID NO: 932972 - RNA, 19 nt, Homo sapiens
gauauacucuguucuugaa

SEQ ID NO: 932973 - RNA, 19 nt, Homo sapiens
gagcaguacugguuuguga

SEQ ID NO: 932974 - RNA, 19 nt, Homo sapiens
aaacuugccuguggacuua

SEQ ID NO: 932975 - RNA, 19 nt, Homo sapiens
guauaaugcugucacaauu

SEQ ID NO: 932976 - RNA, 19 nt, Homo sapiens
ggagaugcaucagcuauga

SEQ ID NO: 932977 - RNA, 19 nt, Homo sapiens
uaaauuacccuauccuuug

SEQ ID NO: 932978 - RNA, 19 nt, Homo sapiens
gaaaguugauugguugguu

SEQ ID NO: 932979 - RNA, 19 nt, Homo sapiens
gaacauguuuauugcagau

SEQ ID NO: 932980 - RNA, 19 nt, Homo sapiens
caaaggaguuggcauuagu

SEQ ID NO: 932981 - RNA, 19 nt, Homo sapiens
gaccuaaugucaccuuaau

SEQ ID NO: 932982 - RNA, 19 nt, Homo sapiens
uaaauaucguucacccuaa

SEQ ID NO: 932983 - RNA, 19 nt, Homo sapiens
ugauaaagcucuugaacuc

SEQ ID NO: 932984 - RNA, 19 nt, Homo sapiens
ucucaaggauucuacguuu

SEQ ID NO: 932985 - RNA, 19 nt, Homo sapiens
gaagcaagaugaauauucc

SEQ ID NO: 932986 - RNA, 19 nt, Homo sapiens
gcauuaguguucuugaaau

SEQ ID NO: 932987 - RNA, 19 nt, Homo sapiens
gacuugaacuggaagcauu

SEQ ID NO: 932988 - RNA, 19 nt, Homo sapiens
caagaaguuugggacuaua

SEQ ID NO: 932989 - RNA, 19 nt, Homo sapiens
caagggagcaguacugguu

SEQ ID NO: 932990 - RNA, 19 nt, Homo sapiens
gaagaagccaagaaguuug

SEQ ID NO: 932991 - RNA, 19 nt, Homo sapiens
ggaguuggcauuaguguuc

SEQ ID NO: 932992 - RNA, 19 nt, Homo sapiens
ccuccuacguguauuauug

SEQ ID NO: 932993 - RNA, 19 nt, Homo sapiens
cagaagaagccaagaaguu

SEQ ID NO: 932994 - RNA, 19 nt, Homo sapiens
aaugucaccuuaauucuga

SEQ ID NO: 932995 - RNA, 19 nt, Homo sapiens
aagagaaaguugauugguu

SEQ ID NO: 932996 - RNA, 19 nt, Homo sapiens
ugacauguccucaaacuuc

SEQ ID NO: 932997 - RNA, 19 nt, Homo sapiens
uccuugaccuugugcauua

SEQ ID NO: 932998 - RNA, 19 nt, Homo sapiens
gguguggaguuugacuuua

SEQ ID NO: 932999 - RNA, 19 nt, Homo sapiens
agucacaggucaucagauu

SEQ ID NO: 933000 - RNA, 19 nt, Homo sapiens
ggauauacucuguucuuga

SEQ ID NO: 933001 - RNA, 19 nt, Homo sapiens
caucagcuaugaacacauc

SEQ ID NO: 933002 - RNA, 19 nt, Homo sapiens
ccaggcagguggucaacuu

SEQ ID NO: 933003 - RNA, 19 nt, Homo sapiens
caaaauagaagcaagauga

SEQ ID NO: 933004 - RNA, 19 nt, Homo sapiens
aaauaucguucacccuaaa

SEQ ID NO: 933005 - RNA, 19 nt, Homo sapiens
uaaccaggauauacucugu

SEQ ID NO: 933006 - RNA, 19 nt, Homo sapiens
gcaagaugaauauuccauu

SEQ ID NO: 933007 - RNA, 19 nt, Homo sapiens
agaagaagccaagaaguuu

SEQ ID NO: 933008 - RNA, 19 nt, Homo sapiens
cuacgagagugauacuuug

SEQ ID NO: 933009 - RNA, 19 nt, Homo sapiens
auaaugcugucacaauuga

SEQ ID NO: 933010 - RNA, 19 nt, Homo sapiens
ggagaugaugcuuuagaaa

SEQ ID NO: 933011 - RNA, 19 nt, Homo sapiens
ugauaauucucaaggauuc

SEQ ID NO: 933012 - RNA, 19 nt, Homo sapiens
cuacaaaggaguuggcauu

SEQ ID NO: 933013 - RNA, 19 nt, Homo sapiens
aauauuccauuccgcauug

SEQ ID NO: 933014 - RNA, 19 nt, Homo sapiens
guacaacacgccuccaugu

SEQ ID NO: 933015 - RNA, 19 nt, Homo sapiens
gcauuauagcauuccauua

SEQ ID NO: 933016 - RNA, 19 nt, Homo sapiens
ggaccuaaugucaccuuaa

SEQ ID NO: 933017 - RNA, 19 nt, Homo sapiens
aaaccucauuggcuugaaa

SEQ ID NO: 933018 - RNA, 19 nt, Homo sapiens
guugauugguugguuguuu

SEQ ID NO: 933019 - RNA, 19 nt, Homo sapiens
uagaagagaaaguugauug

SEQ ID NO: 933020 - RNA, 19 nt, Homo sapiens
gaaacagcuccuuguacaa

SEQ ID NO: 933021 - RNA, 19 nt, Homo sapiens
cauuauagcauuccauuag

SEQ ID NO: 933022 - RNA, 19 nt, Homo sapiens
guucagugcuguccccuua

SEQ ID NO: 933023 - RNA, 19 nt, Homo sapiens
guguggaguuugacuuuau

SEQ ID NO: 933024 - RNA, 19 nt, Homo sapiens
gaaguuugggacuauaaau

SEQ ID NO: 933025 - RNA, 19 nt, Homo sapiens
agacaacuauaaggugauu

SEQ ID NO: 933026 - RNA, 19 nt, Homo sapiens
gagugauacuuugcugaaa

SEQ ID NO: 933027 - RNA, 19 nt, Homo sapiens
ccuaaugucaccuuaauuc

SEQ ID NO: 933028 - RNA, 19 nt, Homo sapiens
gggccucucuguauaaugc

SEQ ID NO: 933029 - RNA, 19 nt, Homo sapiens
ccucaaacuuccuguccaa

SEQ ID NO: 933030 - RNA, 19 nt, Homo sapiens
cagcuaaggccgcagaaga

SEQ ID NO: 933031 - RNA, 19 nt, Homo sapiens
ucaccuuaauucugacuug

SEQ ID NO: 933032 - RNA, 19 nt, Homo sapiens
aaacauccacaacucugua

SEQ ID NO: 933033 - RNA, 19 nt, Homo sapiens
aaauuacccuauccuuugu

SEQ ID NO: 933034 - RNA, 19 nt, Homo sapiens
agucuucgccuuccucuuu

SEQ ID NO: 933035 - RNA, 19 nt, Homo sapiens
gaucgaucuuuaugcuguu

SEQ ID NO: 933036 - RNA, 19 nt, Homo sapiens
gggaccuaaugucaccuua

SEQ ID NO: 933037 - RNA, 19 nt, Homo sapiens
ggcauuaguguucuugaaa

SEQ ID NO: 933038 - RNA, 19 nt, Homo sapiens
uguggaguuugacuuuaua

SEQ ID NO: 933039 - RNA, 19 nt, Homo sapiens
ccuuuguucucuacuguuu

SEQ ID NO: 933040 - RNA, 19 nt, Homo sapiens
uaacaaauucccgcguauu

SEQ ID NO: 933041 - RNA, 19 nt, Homo sapiens
uaaagcuggugggaccuaa

SEQ ID NO: 933042 - RNA, 19 nt, Homo sapiens
gagaugaugcuuuagaaaa

SEQ ID NO: 933043 - RNA, 19 nt, Homo sapiens
gaagagaaaguugauuggu

SEQ ID NO: 933044 - RNA, 19 nt, Homo sapiens
guacugguuugugacaugu

SEQ ID NO: 933045 - RNA, 19 nt, Homo sapiens
uuaaauccuugaccuugug

SEQ ID NO: 933046 - RNA, 19 nt, Homo sapiens
ucacugauauauguagaca

SEQ ID NO: 933047 - RNA, 19 nt, Homo sapiens
caaacuugccuguggacuu

SEQ ID NO: 933048 - RNA, 19 nt, Homo sapiens
cuaacaaauucccgcguau

SEQ ID NO: 933049 - RNA, 19 nt, Homo sapiens
ugucacaauugaagacguu

SEQ ID NO: 933050 - RNA, 19 nt, Homo sapiens
ccaagccaguggauguuuc

SEQ ID NO: 933051 - RNA, 19 nt, Homo sapiens
acaaaggaguuggcauuag

SEQ ID NO: 933052 - RNA, 19 nt, Homo sapiens
caggauauacucuguucuu

SEQ ID NO: 933053 - RNA, 19 nt, Homo sapiens
aggagaugaugcuuuagaa

SEQ ID NO: 933054 - RNA, 19 nt, Homo sapiens
uacaaaggaguuggcauua

SEQ ID NO: 933055 - RNA, 19 nt, Homo sapiens
uuccauagguagaagagaa

SEQ ID NO: 933056 - RNA, 19 nt, Homo sapiens
gcgaagggcaaacuguaga

SEQ ID NO: 933057 - RNA, 19 nt, Homo sapiens
ccuguggacuuaauaaugc

SEQ ID NO: 933058 - RNA, 19 nt, Homo sapiens
caauauguuguccuugaaa

SEQ ID NO: 933059 - RNA, 19 nt, Homo sapiens
ccucgguccuggaauacaa

SEQ ID NO: 933060 - RNA, 19 nt, Homo sapiens
gcagaagaagccaagaagu

SEQ ID NO: 933061 - RNA, 19 nt, Homo sapiens
uggcauuaguguucuugaa

SEQ ID NO: 933062 - RNA, 19 nt, Homo sapiens
uauaaugcugucacaauug

SEQ ID NO: 933063 - RNA, 19 nt, Homo sapiens
ucaaggauucuacguuugu

SEQ ID NO: 933064 - RNA, 19 nt, Homo sapiens
ugaaagggcauaggucugu

SEQ ID NO: 933065 - RNA, 19 nt, Homo sapiens
gauaaagcucuugaacuca

SEQ ID NO: 933066 - RNA, 19 nt, Homo sapiens
ggacuauaaauaucguuca

SEQ ID NO: 933067 - RNA, 19 nt, Homo sapiens
uuacaggagaagugacaua

SEQ ID NO: 933068 - RNA, 19 nt, Homo sapiens
aauuauuucuggagucaug

SEQ ID NO: 933069 - RNA, 19 nt, Homo sapiens
guucuggaguggauuaaaa

SEQ ID NO: 933070 - RNA, 19 nt, Homo sapiens
gguagaagagaaaguugau

SEQ ID NO: 933071 - RNA, 19 nt, Homo sapiens
gauaaugucugaagcuuaa

SEQ ID NO: 933072 - RNA, 19 nt, Homo sapiens
gagaugagcugcacacaga

SEQ ID NO: 933073 - RNA, 19 nt, Homo sapiens
gggaugaacuugcagauau

SEQ ID NO: 933074 - RNA, 19 nt, Homo sapiens
gaaaaugccugcaaaguga

SEQ ID NO: 933075 - RNA, 19 nt, Homo sapiens
aaacagaguucuuccuauu

SEQ ID NO: 933076 - RNA, 19 nt, Homo sapiens
ggccuuugcuucuuaauuu

SEQ ID NO: 933077 - RNA, 19 nt, Homo sapiens
agaagaaggugauugauga

SEQ ID NO: 933078 - RNA, 19 nt, Homo sapiens
ccacaaaucaugguuaaua

SEQ ID NO: 933079 - RNA, 19 nt, Homo sapiens
aaacaacucuucccucuca

SEQ ID NO: 933080 - RNA, 19 nt, Homo sapiens
gaggguuccuugaaaguuu

SEQ ID NO: 933081 - RNA, 19 nt, Homo sapiens
gagaacaagcuagaauuua

SEQ ID NO: 933082 - RNA, 19 nt, Homo sapiens
ccacacaugccucauauaa

SEQ ID NO: 933083 - RNA, 19 nt, Homo sapiens
gcaaacagaguucuuccua

SEQ ID NO: 933084 - RNA, 19 nt, Homo sapiens
gaugauggcccaggaauuu

SEQ ID NO: 933085 - RNA, 19 nt, Homo sapiens
gaccagacaugcugaaagu

SEQ ID NO: 933086 - RNA, 19 nt, Homo sapiens
gacauggacuuccuuacaa

SEQ ID NO: 933087 - RNA, 19 nt, Homo sapiens
acacaugccucauauaagu

SEQ ID NO: 933088 - RNA, 19 nt, Homo sapiens
gauuggccuuugcuucuua

SEQ ID NO: 933089 - RNA, 19 nt, Homo sapiens
auagaaagcuugaaugaag

SEQ ID NO: 933090 - RNA, 19 nt, Homo sapiens
gaagcuuaauguccaguga

SEQ ID NO: 933091 - RNA, 19 nt, Homo sapiens
guacugacaccaccacaaa

SEQ ID NO: 933092 - RNA, 19 nt, Homo sapiens
gcaaguagaaguggagaaa

SEQ ID NO: 933093 - RNA, 19 nt, Homo sapiens
caaacagaguucuuccuau

SEQ ID NO: 933094 - RNA, 19 nt, Homo sapiens
ggaugaacuugcagauaug

SEQ ID NO: 933095 - RNA, 19 nt, Homo sapiens
gaacuugcagauaugcuuu

SEQ ID NO: 933096 - RNA, 19 nt, Homo sapiens
ggauggaucuaggcaguga

SEQ ID NO: 933097 - RNA, 19 nt, Homo sapiens
gcagugauaaggacaguga

SEQ ID NO: 933098 - RNA, 19 nt, Homo sapiens
ugagagacaugacuauugg

SEQ ID NO: 933099 - RNA, 19 nt, Homo sapiens
cuuggaagcuucuuugaug

SEQ ID NO: 933100 - RNA, 19 nt, Homo sapiens
gcacuuggaagcuucuuug

SEQ ID NO: 933101 - RNA, 19 nt, Homo sapiens
uuacuugugccacuuaaua

SEQ ID NO: 933102 - RNA, 19 nt, Homo sapiens
gauagucaaugaucuccau

SEQ ID NO: 933103 - RNA, 19 nt, Homo sapiens
gaacaguauuuucccauug

SEQ ID NO: 933104 - RNA, 19 nt, Homo sapiens
auaagugaaugcuugauga

SEQ ID NO: 933105 - RNA, 19 nt, Homo sapiens
ggacagugaugcugaugac

SEQ ID NO: 933106 - RNA, 19 nt, Homo sapiens
ggaagcuucuuugaugaug

SEQ ID NO: 933107 - RNA, 19 nt, Homo sapiens
aaaugacggugcuauacaa

SEQ ID NO: 933108 - RNA, 19 nt, Homo sapiens
gccuuugcuucuuaauuua

SEQ ID NO: 933109 - RNA, 19 nt, Homo sapiens
uagaaagcuugaaugaaga

SEQ ID NO: 933110 - RNA, 19 nt, Homo sapiens
ggagaaacagaacaggaaa

SEQ ID NO: 933111 - RNA, 19 nt, Homo sapiens
gcagauaugcuuugucaac

SEQ ID NO: 933112 - RNA, 19 nt, Homo sapiens
aagaagaacuguaaaugac

SEQ ID NO: 933113 - RNA, 19 nt, Homo sapiens
gauagaaagcuugaaugaa

SEQ ID NO: 933114 - RNA, 19 nt, Homo sapiens
uacaagugauagucaauga

SEQ ID NO: 933115 - RNA, 19 nt, Homo sapiens
aagcuugaaugaagaguug

SEQ ID NO: 933116 - RNA, 19 nt, Homo sapiens
gaugacauggacuuccuua

SEQ ID NO: 933117 - RNA, 19 nt, Homo sapiens
ugagagagagucuaucaga

SEQ ID NO: 933118 - RNA, 19 nt, Homo sapiens
agagaacaagcuagaauuu

SEQ ID NO: 933119 - RNA, 19 nt, Homo sapiens
agaagcacauggcagagaa

SEQ ID NO: 933120 - RNA, 19 nt, Homo sapiens
caacgacaguggcagugau

SEQ ID NO: 933121 - RNA, 19 nt, Homo sapiens
gguggacauugaagacuug

SEQ ID NO: 933122 - RNA, 19 nt, Homo sapiens
uugcagauaugcuuuguca

SEQ ID NO: 933123 - RNA, 19 nt, Homo sapiens
uaucaguguuagucauuga

SEQ ID NO: 933124 - RNA, 19 nt, Homo sapiens
ugacauggacuuccuuaca

SEQ ID NO: 933125 - RNA, 19 nt, Homo sapiens
gaauuuauaccagcuguag

SEQ ID NO: 933126 - RNA, 19 nt, Homo sapiens
guagcucuccguaauaugu

SEQ ID NO: 933127 - RNA, 19 nt, Homo sapiens
ugacggugcuauacaaguc

SEQ ID NO: 933128 - RNA, 19 nt, Homo sapiens
cagagaacaagcuagaauu

SEQ ID NO: 933129 - RNA, 19 nt, Homo sapiens
ugucugcccuggaggacua

SEQ ID NO: 933130 - RNA, 19 nt, Homo sapiens
cagaagaaggugauugaug

SEQ ID NO: 933131 - RNA, 19 nt, Homo sapiens
ucagaggguuccuugaaag

SEQ ID NO: 933132 - RNA, 19 nt, Homo sapiens
caguguuagucauugauaa

SEQ ID NO: 933133 - RNA, 19 nt, Homo sapiens
agauagaaagcuugaauga

SEQ ID NO: 933134 - RNA, 19 nt, Homo sapiens
ccagauagaaagcuugaau

SEQ ID NO: 933135 - RNA, 19 nt, Homo sapiens
ccagagaacaagcuagaau

SEQ ID NO: 933136 - RNA, 19 nt, Homo sapiens
caagugauagucaaugauc

SEQ ID NO: 933137 - RNA, 19 nt, Homo sapiens
uaaaugacggugcuauaca

SEQ ID NO: 933138 - RNA, 19 nt, Homo sapiens
guaaaugacggugcuauac

SEQ ID NO: 933139 - RNA, 19 nt, Homo sapiens
gaccugagagacaugacua

SEQ ID NO: 933140 - RNA, 19 nt, Homo sapiens
aaguagaaguggagaaaca

SEQ ID NO: 933141 - RNA, 19 nt, Homo sapiens
gauagagacacuacugaag

SEQ ID NO: 933142 - RNA, 19 nt, Homo sapiens
cacuuaauaucaggcauuu

SEQ ID NO: 933143 - RNA, 19 nt, Homo sapiens
ccagacaugcugaaaguca

SEQ ID NO: 933144 - RNA, 19 nt, Homo sapiens
ucucaaaugggcaagagua

SEQ ID NO: 933145 - RNA, 19 nt, Homo sapiens
caaaugggcaagaguaacu

SEQ ID NO: 933146 - RNA, 19 nt, Homo sapiens
ccacuuaauaucaggcauu

SEQ ID NO: 933147 - RNA, 19 nt, Homo sapiens
ugauaaugucugaagcuua

SEQ ID NO: 933148 - RNA, 19 nt, Homo sapiens
cuacugaagaggagucuga

SEQ ID NO: 933149 - RNA, 19 nt, Homo sapiens
acagaguucuuccuauucu

SEQ ID NO: 933150 - RNA, 19 nt, Homo sapiens
uaaggacagugaugcugau

SEQ ID NO: 933151 - RNA, 19 nt, Homo sapiens
gauggcccaggaauuuaua

SEQ ID NO: 933152 - RNA, 19 nt, Homo sapiens
acucuucccucucaaaugg

SEQ ID NO: 933153 - RNA, 19 nt, Homo sapiens
uguaaaugacggugcuaua

SEQ ID NO: 933154 - RNA, 19 nt, Homo sapiens
caaauaucaguguuaguca

SEQ ID NO: 933155 - RNA, 19 nt, Homo sapiens
uaaagguggcgcagaaaca

SEQ ID NO: 933156 - RNA, 19 nt, Homo sapiens
gcacauggcagagaaaaug

SEQ ID NO: 933157 - RNA, 19 nt, Homo sapiens
uagagacacuacugaagag

SEQ ID NO: 933158 - RNA, 19 nt, Homo sapiens
caacucuucccucucaaau

SEQ ID NO: 933159 - RNA, 19 nt, Homo sapiens
gaauguugacuaccugaag

SEQ ID NO: 933160 - RNA, 19 nt, Homo sapiens
guuguagcucuccguaaua

SEQ ID NO: 933161 - RNA, 19 nt, Homo sapiens
acaaauaucaguguuaguc

SEQ ID NO: 933162 - RNA, 19 nt, Homo sapiens
cagaaacaaauaucagugu

SEQ ID NO: 933163 - RNA, 19 nt, Homo sapiens
gaagcacauggcagagaaa

SEQ ID NO: 933164 - RNA, 19 nt, Homo sapiens
uaagugaaugcuugaugaa

SEQ ID NO: 933165 - RNA, 19 nt, Homo sapiens
ugccacacaugccucauau

SEQ ID NO: 933166 - RNA, 19 nt, Homo sapiens
uauaccagcuguagcaaaa

SEQ ID NO: 933167 - RNA, 19 nt, Homo sapiens
ggaauuuauaccagcugua

SEQ ID NO: 933168 - RNA, 19 nt, Homo sapiens
gugaugcugaugacaguaa

SEQ ID NO: 933169 - RNA, 19 nt, Homo sapiens
cagagaaaaugccugcaaa

SEQ ID NO: 933170 - RNA, 19 nt, Homo sapiens
ccaccgaccugagagacau

SEQ ID NO: 933171 - RNA, 19 nt, Homo sapiens
ggacaacugccgauuauuu

SEQ ID NO: 933172 - RNA, 19 nt, Homo sapiens
gauaaucacucucaaugga

SEQ ID NO: 933173 - RNA, 19 nt, Homo sapiens
gaaaggggcugugaaauuu

SEQ ID NO: 933174 - RNA, 19 nt, Homo sapiens
gauacaaugucuucaguga

SEQ ID NO: 933175 - RNA, 19 nt, Homo sapiens
gcaaucaagcaacuuaaua

SEQ ID NO: 933176 - RNA, 19 nt, Homo sapiens
gacaaggacaguuauguua

SEQ ID NO: 933177 - RNA, 19 nt, Homo sapiens
ggacaguuauguuagguau

SEQ ID NO: 933178 - RNA, 19 nt, Homo sapiens
gacaaacucuaugacauuu

SEQ ID NO: 933179 - RNA, 19 nt, Homo sapiens
uagaggauaugcauuugua

SEQ ID NO: 933180 - RNA, 19 nt, Homo sapiens
ugagaaugaugauggauuu

SEQ ID NO: 933181 - RNA, 19 nt, Homo sapiens
caauagaggauaugcauuu

SEQ ID NO: 933182 - RNA, 19 nt, Homo sapiens
gaagagauuugucagaaaa

SEQ ID NO: 933183 - RNA, 19 nt, Homo sapiens
gacaagacuuagcagcaua

SEQ ID NO: 933184 - RNA, 19 nt, Homo sapiens
ggaugagcuuauaccauua

SEQ ID NO: 933185 - RNA, 19 nt, Homo sapiens
gcaauucccagucuucauu

SEQ ID NO: 933186 - RNA, 19 nt, Homo sapiens
uagaagagauuugucagaa

SEQ ID NO: 933187 - RNA, 19 nt, Homo sapiens
gcacuucaguaaccgagaa

SEQ ID NO: 933188 - RNA, 19 nt, Homo sapiens
gaagaaaauucgagacuau

SEQ ID NO: 933189 - RNA, 19 nt, Homo sapiens
gagaagacaaacucuauga

SEQ ID NO: 933190 - RNA, 19 nt, Homo sapiens
ggacaaggacaguuauguu

SEQ ID NO: 933191 - RNA, 19 nt, Homo sapiens
aggaugagcuuauaccauu

SEQ ID NO: 933192 - RNA, 19 nt, Homo sapiens
gagcauaacccgagugaca

SEQ ID NO: 933193 - RNA, 19 nt, Homo sapiens
ggacaagacuuagcagcau

SEQ ID NO: 933194 - RNA, 19 nt, Homo sapiens
cccaagcgcugcagauaaa

SEQ ID NO: 933195 - RNA, 19 nt, Homo sapiens
gaagacaaacucuaugaca

SEQ ID NO: 933196 - RNA, 19 nt, Homo sapiens
ggaaucaaaucacaaaucc

SEQ ID NO: 933197 - RNA, 19 nt, Homo sapiens
guggacaacugccgauuau

SEQ ID NO: 933198 - RNA, 19 nt, Homo sapiens
uaaacucgcuccccagaua

SEQ ID NO: 933199 - RNA, 19 nt, Homo sapiens
ugaauccugucacauuaaa

SEQ ID NO: 933200 - RNA, 19 nt, Homo sapiens
gcacucugcuauuggacaa

SEQ ID NO: 933201 - RNA, 19 nt, Homo sapiens
cagcugcacucugcuauug

SEQ ID NO: 933202 - RNA, 19 nt, Homo sapiens
gaaaucuuaugcugucuac

SEQ ID NO: 933203 - RNA, 19 nt, Homo sapiens
gagcggcacucagaaggaa

SEQ ID NO: 933204 - RNA, 19 nt, Homo sapiens
ccagaccuaugcagcaauu

SEQ ID NO: 933205 - RNA, 19 nt, Homo sapiens
ccagagacuguauagcuua

SEQ ID NO: 933206 - RNA, 19 nt, Homo sapiens
gauaugcugucccuaaugc

SEQ ID NO: 933207 - RNA, 19 nt, Homo sapiens
gcuaugaaagcuuuaaaug

SEQ ID NO: 933208 - RNA, 19 nt, Homo sapiens
caggaagaauucaguuaug

SEQ ID NO: 933209 - RNA, 19 nt, Homo sapiens
gagcuuauaccauuaugug

SEQ ID NO: 933210 - RNA, 19 nt, Homo sapiens
agaagagauuugucagaaa

SEQ ID NO: 933211 - RNA, 19 nt, Homo sapiens
gggcagagccagaaguaga

SEQ ID NO: 933212 - RNA, 19 nt, Homo sapiens
ucaauggaaucaaaucaca

SEQ ID NO: 933213 - RNA, 19 nt, Homo sapiens
agacaaacucuaugacauu

SEQ ID NO: 933214 - RNA, 19 nt, Homo sapiens
gacaugguauugcaguaga

SEQ ID NO: 933215 - RNA, 19 nt, Homo sapiens
ggauauggcaccuucugaa

SEQ ID NO: 933216 - RNA, 19 nt, Homo sapiens
cuacugcuuucccaggaua

SEQ ID NO: 933217 - RNA, 19 nt, Homo sapiens
gacaacugccgauuauuug

SEQ ID NO: 933218 - RNA, 19 nt, Homo sapiens
gagcaacccuaauuaaccu

SEQ ID NO: 933219 - RNA, 19 nt, Homo sapiens
caggauaugcugucccuaa

SEQ ID NO: 933220 - RNA, 19 nt, Homo sapiens
ggauaugcauuuguaacau

SEQ ID NO: 933221 - RNA, 19 nt, Homo sapiens
cgagugacacguugaauuc

SEQ ID NO: 933222 - RNA, 19 nt, Homo sapiens
ccagauauuagaagagauu

SEQ ID NO: 933223 - RNA, 19 nt, Homo sapiens
guggggaucucugaaauua

SEQ ID NO: 933224 - RNA, 19 nt, Homo sapiens
aaguagaaguugaugaaga

SEQ ID NO: 933225 - RNA, 19 nt, Homo sapiens
agaaguagaaguugaugaa

SEQ ID NO: 933226 - RNA, 19 nt, Homo sapiens
gaaauuacucagauaacag

SEQ ID NO: 933227 - RNA, 19 nt, Homo sapiens
uaugaggucuacccaacuu

SEQ ID NO: 933228 - RNA, 19 nt, Homo sapiens
agacuuagcagcauauaca

SEQ ID NO: 933229 - RNA, 19 nt, Homo sapiens
agacagcuauucuuguaca

SEQ ID NO: 933230 - RNA, 19 nt, Homo sapiens
caaggacaguuauguuagg

SEQ ID NO: 933231 - RNA, 19 nt, Homo sapiens
agacguaugcagccgaaua

SEQ ID NO: 933232 - RNA, 19 nt, Homo sapiens
gaggauaccaggucaaagg

SEQ ID NO: 933233 - RNA, 19 nt, Homo sapiens
ccaaaggacaucucagcaa

SEQ ID NO: 933234 - RNA, 19 nt, Homo sapiens
uaaccgagaagaugcaguu

SEQ ID NO: 933235 - RNA, 19 nt, Homo sapiens
gggacaugguauugcagua

SEQ ID NO: 933236 - RNA, 19 nt, Homo sapiens
ccaggaagaauucaguuau

SEQ ID NO: 933237 - RNA, 19 nt, Homo sapiens
aaagguuacugaagguguu

SEQ ID NO: 933238 - RNA, 19 nt, Homo sapiens
caacugccgauuauuuguu

SEQ ID NO: 933239 - RNA, 19 nt, Homo sapiens
ugagugccuuuguggauga

SEQ ID NO: 933240 - RNA, 19 nt, Homo sapiens
cugaagagaugauugaaaa

SEQ ID NO: 933241 - RNA, 19 nt, Homo sapiens
agaaguugaugaagauaca

SEQ ID NO: 933242 - RNA, 19 nt, Homo sapiens
aguagaaguugaugaagau

SEQ ID NO: 933243 - RNA, 19 nt, Homo sapiens
uaaaguggaagccaagaau

SEQ ID NO: 933244 - RNA, 19 nt, Homo sapiens
uaaucacucucaauggaau

SEQ ID NO: 933245 - RNA, 19 nt, Homo sapiens
gaccaaagacagcuauucu

SEQ ID NO: 933246 - RNA, 19 nt, Homo sapiens
gcuuauaccauuaugugaa

SEQ ID NO: 933247 - RNA, 19 nt, Homo sapiens
cagagacuguauagcuuau

SEQ ID NO: 933248 - RNA, 19 nt, Homo sapiens
uggcaacaauagaggauau

SEQ ID NO: 933249 - RNA, 19 nt, Homo sapiens
ccaggaaaauggacaaaga

SEQ ID NO: 933250 - RNA, 19 nt, Homo sapiens
agaaauaaaccucuaacuc

SEQ ID NO: 933251 - RNA, 19 nt, Homo sapiens
gcugcacucugcuauugga

SEQ ID NO: 933252 - RNA, 19 nt, Homo sapiens
ggauggagcucaccccaau

SEQ ID NO: 933253 - RNA, 19 nt, Homo sapiens
ccgagaagaugcaguugag

SEQ ID NO: 933254 - RNA, 19 nt, Homo sapiens
ugaugaagauacaaugucu

SEQ ID NO: 933255 - RNA, 19 nt, Homo sapiens
aagacaaacucuaugacau

SEQ ID NO: 933256 - RNA, 19 nt, Homo sapiens
acaguuauguuagguauac

SEQ ID NO: 933257 - RNA, 19 nt, Homo sapiens
ugaauucgccauaaucaag

SEQ ID NO: 933258 - RNA, 19 nt, Homo sapiens
aaaugagaaugaugaugga

SEQ ID NO: 933259 - RNA, 19 nt, Homo sapiens
gaugagcuuauaccauuau

SEQ ID NO: 933260 - RNA, 19 nt, Homo sapiens
caguggacaaggacaguua

SEQ ID NO: 933261 - RNA, 19 nt, Homo sapiens
ggaaaauggacaaagaaaa

SEQ ID NO: 933262 - RNA, 19 nt, Homo sapiens
ggacaugguauugcaguag

SEQ ID NO: 933263 - RNA, 19 nt, Homo sapiens
gcuuugccuucguggagua

SEQ ID NO: 933264 - RNA, 19 nt, Homo sapiens
caagaaugcaaucaagcaa

SEQ ID NO: 933265 - RNA, 19 nt, Homo sapiens
uuauugagcaacccuaauu

SEQ ID NO: 933266 - RNA, 19 nt, Homo sapiens
caaaaccaguggacaagga

SEQ ID NO: 933267 - RNA, 19 nt, Homo sapiens
uugaggcuaugaaagcuuu

SEQ ID NO: 933268 - RNA, 19 nt, Homo sapiens
aagaugcaguugaggcuau

SEQ ID NO: 933269 - RNA, 19 nt, Homo sapiens
gaaacugcuaccaggaaga

SEQ ID NO: 933270 - RNA, 19 nt, Homo sapiens
aauagaggauaugcauuug

SEQ ID NO: 933271 - RNA, 19 nt, Homo sapiens
ggacaacugccgauuauuu

SEQ ID NO: 933272 - RNA, 19 nt, Homo sapiens
gauaaucacucucaaugga

SEQ ID NO: 933273 - RNA, 19 nt, Homo sapiens
gaaaggggcugugaaauuu

SEQ ID NO: 933274 - RNA, 19 nt, Homo sapiens
gauacaaugucuucaguga

SEQ ID NO: 933275 - RNA, 19 nt, Homo sapiens
gcaaucaagcaacuuaaua

SEQ ID NO: 933276 - RNA, 19 nt, Homo sapiens
gacaaggacaguuauguua

SEQ ID NO: 933277 - RNA, 19 nt, Homo sapiens
ggacaguuauguuagguau

SEQ ID NO: 933278 - RNA, 19 nt, Homo sapiens
gacaaacucuaugacauuu

SEQ ID NO: 933279 - RNA, 19 nt, Homo sapiens
uagaggauaugcauuugua

SEQ ID NO: 933280 - RNA, 19 nt, Homo sapiens
ugagaaugaugauggauuu

SEQ ID NO: 933281 - RNA, 19 nt, Homo sapiens
caauagaggauaugcauuu

SEQ ID NO: 933282 - RNA, 19 nt, Homo sapiens
gaagagauuugucagaaaa

SEQ ID NO: 933283 - RNA, 19 nt, Homo sapiens
gacaagacuuagcagcaua

SEQ ID NO: 933284 - RNA, 19 nt, Homo sapiens
ggaugagcuuauaccauua

SEQ ID NO: 933285 - RNA, 19 nt, Homo sapiens
gcaauucccagucuucauu

SEQ ID NO: 933286 - RNA, 19 nt, Homo sapiens
uagaagagauuugucagaa

SEQ ID NO: 933287 - RNA, 19 nt, Homo sapiens
gcacuucaguaaccgagaa

SEQ ID NO: 933288 - RNA, 19 nt, Homo sapiens
gaagaaaauucgagacuau

SEQ ID NO: 933289 - RNA, 19 nt, Homo sapiens
gagaagacaaacucuauga

SEQ ID NO: 933290 - RNA, 19 nt, Homo sapiens
ggacaaggacaguuauguu

SEQ ID NO: 933291 - RNA, 19 nt, Homo sapiens
aggaugagcuuauaccauu

SEQ ID NO: 933292 - RNA, 19 nt, Homo sapiens
gagcauaacccgagugaca

SEQ ID NO: 933293 - RNA, 19 nt, Homo sapiens
ggacaagacuuagcagcau

SEQ ID NO: 933294 - RNA, 19 nt, Homo sapiens
cccaagcgcugcagauaaa

SEQ ID NO: 933295 - RNA, 19 nt, Homo sapiens
gaagacaaacucuaugaca

SEQ ID NO: 933296 - RNA, 19 nt, Homo sapiens
ggaaucaaaucacaaaucc

SEQ ID NO: 933297 - RNA, 19 nt, Homo sapiens
guggacaacugccgauuau

SEQ ID NO: 933298 - RNA, 19 nt, Homo sapiens
uaaacucgcuccccagaua

SEQ ID NO: 933299 - RNA, 19 nt, Homo sapiens
ugaauccugucacauuaaa

SEQ ID NO: 933300 - RNA, 19 nt, Homo sapiens
gcacucugcuauuggacaa

SEQ ID NO: 933301 - RNA, 19 nt, Homo sapiens
cagcugcacucugcuauug

SEQ ID NO: 933302 - RNA, 19 nt, Homo sapiens
gaaaucuuaugcugucuac

SEQ ID NO: 933303 - RNA, 19 nt, Homo sapiens
gagcggcacucagaaggaa

SEQ ID NO: 933304 - RNA, 19 nt, Homo sapiens
ccagaccuaugcagcaauu

SEQ ID NO: 933305 - RNA, 19 nt, Homo sapiens
ccagagacuguauagcuua

SEQ ID NO: 933306 - RNA, 19 nt, Homo sapiens
gauaugcugucccuaaugc

SEQ ID NO: 933307 - RNA, 19 nt, Homo sapiens
gcuaugaaagcuuuaaaug

SEQ ID NO: 933308 - RNA, 19 nt, Homo sapiens
caggaagaauucaguuaug

SEQ ID NO: 933309 - RNA, 19 nt, Homo sapiens
gagcuuauaccauuaugug

SEQ ID NO: 933310 - RNA, 19 nt, Homo sapiens
agaagagauuugucagaaa

SEQ ID NO: 933311 - RNA, 19 nt, Homo sapiens
gggcagagccagaaguaga

SEQ ID NO: 933312 - RNA, 19 nt, Homo sapiens
ucaauggaaucaaaucaca

SEQ ID NO: 933313 - RNA, 19 nt, Homo sapiens
agacaaacucuaugacauu

SEQ ID NO: 933314 - RNA, 19 nt, Homo sapiens
gacaugguauugcaguaga

SEQ ID NO: 933315 - RNA, 19 nt, Homo sapiens
ggauauggcaccuucugaa

SEQ ID NO: 933316 - RNA, 19 nt, Homo sapiens
cuacugcuuucccaggaua

SEQ ID NO: 933317 - RNA, 19 nt, Homo sapiens
gacaacugccgauuauuug

SEQ ID NO: 933318 - RNA, 19 nt, Homo sapiens
gagcaacccuaauuaaccu

SEQ ID NO: 933319 - RNA, 19 nt, Homo sapiens
caggauaugcugucccuaa

SEQ ID NO: 933320 - RNA, 19 nt, Homo sapiens
ggauaugcauuuguaacau

SEQ ID NO: 933321 - RNA, 19 nt, Homo sapiens
cgagugacacguugaauuc

SEQ ID NO: 933322 - RNA, 19 nt, Homo sapiens
ccagauauuagaagagauu

SEQ ID NO: 933323 - RNA, 19 nt, Homo sapiens
guggggaucucugaaauua

SEQ ID NO: 933324 - RNA, 19 nt, Homo sapiens
aaguagaaguugaugaaga

SEQ ID NO: 933325 - RNA, 19 nt, Homo sapiens
agaaguagaaguugaugaa

SEQ ID NO: 933326 - RNA, 19 nt, Homo sapiens
gaaauuacucagauaacag

SEQ ID NO: 933327 - RNA, 19 nt, Homo sapiens
uaugaggucuacccaacuu

SEQ ID NO: 933328 - RNA, 19 nt, Homo sapiens
agacuuagcagcauauaca

SEQ ID NO: 933329 - RNA, 19 nt, Homo sapiens
agacagcuauucuuguaca

SEQ ID NO: 933330 - RNA, 19 nt, Homo sapiens
caaggacaguuauguuagg

SEQ ID NO: 933331 - RNA, 19 nt, Homo sapiens
agacguaugcagccgaaua

SEQ ID NO: 933332 - RNA, 19 nt, Homo sapiens
gaggauaccaggucaaagg

SEQ ID NO: 933333 - RNA, 19 nt, Homo sapiens
ccaaaggacaucucagcaa

SEQ ID NO: 933334 - RNA, 19 nt, Homo sapiens
uaaccgagaagaugcaguu

SEQ ID NO: 933335 - RNA, 19 nt, Homo sapiens
gggacaugguauugcagua

SEQ ID NO: 933336 - RNA, 19 nt, Homo sapiens
ccaggaagaauucaguuau

SEQ ID NO: 933337 - RNA, 19 nt, Homo sapiens
aaagguuacugaagguguu

SEQ ID NO: 933338 - RNA, 19 nt, Homo sapiens
caacugccgauuauuuguu

SEQ ID NO: 933339 - RNA, 19 nt, Homo sapiens
ugagugccuuuguggauga

SEQ ID NO: 933340 - RNA, 19 nt, Homo sapiens
cugaagagaugauugaaaa

SEQ ID NO: 933341 - RNA, 19 nt, Homo sapiens
agaaguugaugaagauaca

SEQ ID NO: 933342 - RNA, 19 nt, Homo sapiens
aguagaaguugaugaagau

SEQ ID NO: 933343 - RNA, 19 nt, Homo sapiens
uaaaguggaagccaagaau

SEQ ID NO: 933344 - RNA, 19 nt, Homo sapiens
uaaucacucucaauggaau

SEQ ID NO: 933345 - RNA, 19 nt, Homo sapiens
gaccaaagacagcuauucu

SEQ ID NO: 933346 - RNA, 19 nt, Homo sapiens
gcuuauaccauuaugugaa

SEQ ID NO: 933347 - RNA, 19 nt, Homo sapiens
cagagacuguauagcuuau

SEQ ID NO: 933348 - RNA, 19 nt, Homo sapiens
uggcaacaauagaggauau

SEQ ID NO: 933349 - RNA, 19 nt, Homo sapiens
ccaggaaaauggacaaaga

SEQ ID NO: 933350 - RNA, 19 nt, Homo sapiens
agaaauaaaccucuaacuc

SEQ ID NO: 933351 - RNA, 19 nt, Homo sapiens
gcugcacucugcuauugga

SEQ ID NO: 933352 - RNA, 19 nt, Homo sapiens
ggauggagcucaccccaau

SEQ ID NO: 933353 - RNA, 19 nt, Homo sapiens
ccgagaagaugcaguugag

SEQ ID NO: 933354 - RNA, 19 nt, Homo sapiens
ugaugaagauacaaugucu

SEQ ID NO: 933355 - RNA, 19 nt, Homo sapiens
aagacaaacucuaugacau

SEQ ID NO: 933356 - RNA, 19 nt, Homo sapiens
acaguuauguuagguauac

SEQ ID NO: 933357 - RNA, 19 nt, Homo sapiens
ugaauucgccauaaucaag

SEQ ID NO: 933358 - RNA, 19 nt, Homo sapiens
aaaugagaaugaugaugga

SEQ ID NO: 933359 - RNA, 19 nt, Homo sapiens
gaugagcuuauaccauuau

SEQ ID NO: 933360 - RNA, 19 nt, Homo sapiens
caguggacaaggacaguua

SEQ ID NO: 933361 - RNA, 19 nt, Homo sapiens
ggaaaauggacaaagaaaa

SEQ ID NO: 933362 - RNA, 19 nt, Homo sapiens
ggacaugguauugcaguag

SEQ ID NO: 933363 - RNA, 19 nt, Homo sapiens
gcuuugccuucguggagua

SEQ ID NO: 933364 - RNA, 19 nt, Homo sapiens
caagaaugcaaucaagcaa

SEQ ID NO: 933365 - RNA, 19 nt, Homo sapiens
uuauugagcaacccuaauu

SEQ ID NO: 933366 - RNA, 19 nt, Homo sapiens
caaaaccaguggacaagga

SEQ ID NO: 933367 - RNA, 19 nt, Homo sapiens
uugaggcuaugaaagcuuu

SEQ ID NO: 933368 - RNA, 19 nt, Homo sapiens
aagaugcaguugaggcuau

SEQ ID NO: 933369 - RNA, 19 nt, Homo sapiens
gaaacugcuaccaggaaga

SEQ ID NO: 933370 - RNA, 19 nt, Homo sapiens
aauagaggauaugcauuug

SEQ ID NO: 933371 - RNA, 19 nt, Homo sapiens
ggacaacugccgauuauuu

SEQ ID NO: 933372 - RNA, 19 nt, Homo sapiens
gauaaucacucucaaugga

SEQ ID NO: 933373 - RNA, 19 nt, Homo sapiens
gaaaggggcugugaaauuu

SEQ ID NO: 933374 - RNA, 19 nt, Homo sapiens
gauacaaugucuucaguga

SEQ ID NO: 933375 - RNA, 19 nt, Homo sapiens
gcaaucaagcaacuuaaua

SEQ ID NO: 933376 - RNA, 19 nt, Homo sapiens
gacaaggacaguuauguua

SEQ ID NO: 933377 - RNA, 19 nt, Homo sapiens
gaauuuagagguuccuaua

SEQ ID NO: 933378 - RNA, 19 nt, Homo sapiens
ggacaguuauguuagguau

SEQ ID NO: 933379 - RNA, 19 nt, Homo sapiens
gacaaacucuaugacauuu

SEQ ID NO: 933380 - RNA, 19 nt, Homo sapiens
uagaggauaugcauuugua

SEQ ID NO: 933381 - RNA, 19 nt, Homo sapiens
ugagaaugaugauggauuu

SEQ ID NO: 933382 - RNA, 19 nt, Homo sapiens
caauagaggauaugcauuu

SEQ ID NO: 933383 - RNA, 19 nt, Homo sapiens
gaagagauuugucagaaaa

SEQ ID NO: 933384 - RNA, 19 nt, Homo sapiens
gacaagacuuagcagcaua

SEQ ID NO: 933385 - RNA, 19 nt, Homo sapiens
ggaugagcuuauaccauua

SEQ ID NO: 933386 - RNA, 19 nt, Homo sapiens
gcaauucccagucuucauu

SEQ ID NO: 933387 - RNA, 19 nt, Homo sapiens
uagaagagauuugucagaa

SEQ ID NO: 933388 - RNA, 19 nt, Homo sapiens
gcacuucaguaaccgagaa

SEQ ID NO: 933389 - RNA, 19 nt, Homo sapiens
gaagaaaauucgagacuau

SEQ ID NO: 933390 - RNA, 19 nt, Homo sapiens
gagaagacaaacucuauga

SEQ ID NO: 933391 - RNA, 19 nt, Homo sapiens
ggacaaggacaguuauguu

SEQ ID NO: 933392 - RNA, 19 nt, Homo sapiens
aggaugagcuuauaccauu

SEQ ID NO: 933393 - RNA, 19 nt, Homo sapiens
gagcauaacccgagugaca

SEQ ID NO: 933394 - RNA, 19 nt, Homo sapiens
ggacaagacuuagcagcau

SEQ ID NO: 933395 - RNA, 19 nt, Homo sapiens
cccaagcgcugcagauaaa

SEQ ID NO: 933396 - RNA, 19 nt, Homo sapiens
gaagacaaacucuaugaca

SEQ ID NO: 933397 - RNA, 19 nt, Homo sapiens
ggaaucaaaucacaaaucc

SEQ ID NO: 933398 - RNA, 19 nt, Homo sapiens
guggacaacugccgauuau

SEQ ID NO: 933399 - RNA, 19 nt, Homo sapiens
uaaacucgcuccccagaua

SEQ ID NO: 933400 - RNA, 19 nt, Homo sapiens
ugaauccugucacauuaaa

SEQ ID NO: 933401 - RNA, 19 nt, Homo sapiens
gcacucugcuauuggacaa

SEQ ID NO: 933402 - RNA, 19 nt, Homo sapiens
cagcugcacucugcuauug

SEQ ID NO: 933403 - RNA, 19 nt, Homo sapiens
gaaaucuuaugcugucuac

SEQ ID NO: 933404 - RNA, 19 nt, Homo sapiens
gagcggcacucagaaggaa

SEQ ID NO: 933405 - RNA, 19 nt, Homo sapiens
ccagaccuaugcagcaauu

SEQ ID NO: 933406 - RNA, 19 nt, Homo sapiens
ccagagacuguauagcuua

SEQ ID NO: 933407 - RNA, 19 nt, Homo sapiens
gauaugcugucccuaaugc

SEQ ID NO: 933408 - RNA, 19 nt, Homo sapiens
gcuaugaaagcuuuaaaug

SEQ ID NO: 933409 - RNA, 19 nt, Homo sapiens
caggaagaauucaguuaug

SEQ ID NO: 933410 - RNA, 19 nt, Homo sapiens
gagcuuauaccauuaugug

SEQ ID NO: 933411 - RNA, 19 nt, Homo sapiens
gcuuugcaguccaucauuu

SEQ ID NO: 933412 - RNA, 19 nt, Homo sapiens
agaagagauuugucagaaa

SEQ ID NO: 933413 - RNA, 19 nt, Homo sapiens
gggcagagccagaaguaga

SEQ ID NO: 933414 - RNA, 19 nt, Homo sapiens
ucaauggaaucaaaucaca

SEQ ID NO: 933415 - RNA, 19 nt, Homo sapiens
agacaaacucuaugacauu

SEQ ID NO: 933416 - RNA, 19 nt, Homo sapiens
ucagugagcaacccuaauu

SEQ ID NO: 933417 - RNA, 19 nt, Homo sapiens
gacaugguauugcaguaga

SEQ ID NO: 933418 - RNA, 19 nt, Homo sapiens
ggauauggcaccuucugaa

SEQ ID NO: 933419 - RNA, 19 nt, Homo sapiens
cuacugcuuucccaggaua

SEQ ID NO: 933420 - RNA, 19 nt, Homo sapiens
gagcaacccuaauuaaccu

SEQ ID NO: 933421 - RNA, 19 nt, Homo sapiens
gacaacugccgauuauuug

SEQ ID NO: 933422 - RNA, 19 nt, Homo sapiens
gagcaugagcacagcaauu

SEQ ID NO: 933423 - RNA, 19 nt, Homo sapiens
caggauaugcugucccuaa

SEQ ID NO: 933424 - RNA, 19 nt, Homo sapiens
ggauaugcauuuguaacau

SEQ ID NO: 933425 - RNA, 19 nt, Homo sapiens
cgagugacacguugaauuc

SEQ ID NO: 933426 - RNA, 19 nt, Homo sapiens
ccagauauuagaagagauu

SEQ ID NO: 933427 - RNA, 19 nt, Homo sapiens
guggggaucucugaaauua

SEQ ID NO: 933428 - RNA, 19 nt, Homo sapiens
aaguagaaguugaugaaga

SEQ ID NO: 933429 - RNA, 19 nt, Homo sapiens
agaaguagaaguugaugaa

SEQ ID NO: 933430 - RNA, 19 nt, Homo sapiens
guccaggaauuuagagguu

SEQ ID NO: 933431 - RNA, 19 nt, Homo sapiens
uaugaggucuacccaacuu

SEQ ID NO: 933432 - RNA, 19 nt, Homo sapiens
agacuuagcagcauauaca

SEQ ID NO: 933433 - RNA, 19 nt, Homo sapiens
agacagcuauucuuguaca

SEQ ID NO: 933434 - RNA, 19 nt, Homo sapiens
caaggacaguuauguuagg

SEQ ID NO: 933435 - RNA, 19 nt, Homo sapiens
agacguaugcagccgaaua

SEQ ID NO: 933436 - RNA, 19 nt, Homo sapiens
gaggauaccaggucaaagg

SEQ ID NO: 933437 - RNA, 19 nt, Homo sapiens
ccaaaggacaucucagcaa

SEQ ID NO: 933438 - RNA, 19 nt, Homo sapiens
uaaccgagaagaugcaguu

SEQ ID NO: 933439 - RNA, 19 nt, Homo sapiens
gggacaugguauugcagua

SEQ ID NO: 933440 - RNA, 19 nt, Homo sapiens
ccaggaagaauucaguuau

SEQ ID NO: 933441 - RNA, 19 nt, Homo sapiens
aaagguuacugaagguguu

SEQ ID NO: 933442 - RNA, 19 nt, Homo sapiens
caacugccgauuauuuguu

SEQ ID NO: 933443 - RNA, 19 nt, Homo sapiens
ugagugccuuuguggauga

SEQ ID NO: 933444 - RNA, 19 nt, Homo sapiens
cugaagagaugauugaaaa

SEQ ID NO: 933445 - RNA, 19 nt, Homo sapiens
agaaguugaugaagauaca

SEQ ID NO: 933446 - RNA, 19 nt, Homo sapiens
aguagaaguugaugaagau

SEQ ID NO: 933447 - RNA, 19 nt, Homo sapiens
uaaaguggaagccaagaau

SEQ ID NO: 933448 - RNA, 19 nt, Homo sapiens
gaccaaagacagcuauucu

SEQ ID NO: 933449 - RNA, 19 nt, Homo sapiens
uaaucacucucaauggaau

SEQ ID NO: 933450 - RNA, 19 nt, Homo sapiens
gcuuauaccauuaugugaa

SEQ ID NO: 933451 - RNA, 19 nt, Homo sapiens
aaaggaaaauggacaaaga

SEQ ID NO: 933452 - RNA, 19 nt, Homo sapiens
cagagacuguauagcuuau

SEQ ID NO: 933453 - RNA, 19 nt, Homo sapiens
uggcaacaauagaggauau

SEQ ID NO: 933454 - RNA, 19 nt, Homo sapiens
agaaauaaaccucuaacuc

SEQ ID NO: 933455 - RNA, 19 nt, Homo sapiens
gcugcacucugcuauugga

SEQ ID NO: 933456 - RNA, 19 nt, Homo sapiens
ggauggagcucaccccaau

SEQ ID NO: 933457 - RNA, 19 nt, Homo sapiens
ccgagaagaugcaguugag

SEQ ID NO: 933458 - RNA, 19 nt, Homo sapiens
ugaugaagauacaaugucu

SEQ ID NO: 933459 - RNA, 19 nt, Homo sapiens
aagacaaacucuaugacau

SEQ ID NO: 933460 - RNA, 19 nt, Homo sapiens
acaguuauguuagguauac

SEQ ID NO: 933461 - RNA, 19 nt, Homo sapiens
ugaauucgccauaaucaag

SEQ ID NO: 933462 - RNA, 19 nt, Homo sapiens
aaaugagaaugaugaugga

SEQ ID NO: 933463 - RNA, 19 nt, Homo sapiens
gaugagcuuauaccauuau

SEQ ID NO: 933464 - RNA, 19 nt, Homo sapiens
caguggacaaggacaguua

SEQ ID NO: 933465 - RNA, 19 nt, Homo sapiens
ggacaugguauugcaguag

SEQ ID NO: 933466 - RNA, 19 nt, Homo sapiens
gcuuugccuucguggagua

SEQ ID NO: 933467 - RNA, 19 nt, Homo sapiens
caagaaugcaaucaagcaa

SEQ ID NO: 933468 - RNA, 19 nt, Homo sapiens
ggaaaauggacaaagaaaa

SEQ ID NO: 933469 - RNA, 19 nt, Homo sapiens
caaaaccaguggacaagga

SEQ ID NO: 933470 - RNA, 19 nt, Homo sapiens
uugaggcuaugaaagcuuu

SEQ ID NO: 933471 - RNA, 19 nt, Homo sapiens
gauaauggcucuuaaaucu

SEQ ID NO: 933472 - RNA, 19 nt, Homo sapiens
gcaaacacuucucuuuauu

SEQ ID NO: 933473 - RNA, 19 nt, Homo sapiens
gcacagaugaugcugaaua

SEQ ID NO: 933474 - RNA, 19 nt, Homo sapiens
cuacagauguccaauuuau

SEQ ID NO: 933475 - RNA, 19 nt, Homo sapiens
gguacgauauugcuuauug

SEQ ID NO: 933476 - RNA, 19 nt, Homo sapiens
gagaugaugauccaaauaa

SEQ ID NO: 933477 - RNA, 19 nt, Homo sapiens
caagagcaaugcaggcuuu

SEQ ID NO: 933478 - RNA, 19 nt, Homo sapiens
gcagauugacuguauauga

SEQ ID NO: 933479 - RNA, 19 nt, Homo sapiens
gaaagugucaugugauguu

SEQ ID NO: 933480 - RNA, 19 nt, Homo sapiens
ccugguaucucuaaguaua

SEQ ID NO: 933481 - RNA, 19 nt, Homo sapiens
caacaacccagacauaaug

SEQ ID NO: 933482 - RNA, 19 nt, Homo sapiens
ccacaccuauuuccacaaa

SEQ ID NO: 933483 - RNA, 19 nt, Homo sapiens
gaaucugaguguaauaugu

SEQ ID NO: 933484 - RNA, 19 nt, Homo sapiens
ugaagcaccuggccugauu

SEQ ID NO: 933485 - RNA, 19 nt, Homo sapiens
cugaauagcccgcuguuua

SEQ ID NO: 933486 - RNA, 19 nt, Homo sapiens
cuaguuaugucucacaauu

SEQ ID NO: 933487 - RNA, 19 nt, Homo sapiens
gggaaucaaugcuguuuca

SEQ ID NO: 933488 - RNA, 19 nt, Homo sapiens
gguagugggucuggcaaua

SEQ ID NO: 933489 - RNA, 19 nt, Homo sapiens
ggcaauaguuccagcaaug

SEQ ID NO: 933490 - RNA, 19 nt, Homo sapiens
ugcaagagaugaugagaaa

SEQ ID NO: 933491 - RNA, 19 nt, Homo sapiens
gaaaaucccuuuguucaga

SEQ ID NO: 933492 - RNA, 19 nt, Homo sapiens
gcucaacaacccagacaua

SEQ ID NO: 933493 - RNA, 19 nt, Homo sapiens
cuucucagcuucucccaua

SEQ ID NO: 933494 - RNA, 19 nt, Homo sapiens
uugauaaacuucucaguga

SEQ ID NO: 933495 - RNA, 19 nt, Homo sapiens
gcucuuagcaaucuagaaa

SEQ ID NO: 933496 - RNA, 19 nt, Homo sapiens
ccauaaagagacccuaaua

SEQ ID NO: 933497 - RNA, 19 nt, Homo sapiens
gauaaacuucucagugaaa

SEQ ID NO: 933498 - RNA, 19 nt, Homo sapiens
uaacugcuauguauaaagg

SEQ ID NO: 933499 - RNA, 19 nt, Homo sapiens
gcuguaagauuuauaccau

SEQ ID NO: 933500 - RNA, 19 nt, Homo sapiens
guaacauugugucaacauu

SEQ ID NO: 933501 - RNA, 19 nt, Homo sapiens
cagcaucuuugauaaacuu

SEQ ID NO: 933502 - RNA, 19 nt, Homo sapiens
agaaauguuuauccuggua

SEQ ID NO: 933503 - RNA, 19 nt, Homo sapiens
ucagucaccugcucaacaa

SEQ ID NO: 933504 - RNA, 19 nt, Homo sapiens
ccacagaugcagcaauuga

SEQ ID NO: 933505 - RNA, 19 nt, Homo sapiens
ugcaaacacuucucuuuau

SEQ ID NO: 933506 - RNA, 19 nt, Homo sapiens
ccagguggcuauaaugcuu

SEQ ID NO: 933507 - RNA, 19 nt, Homo sapiens
caagagaugaugagaaauc

SEQ ID NO: 933508 - RNA, 19 nt, Homo sapiens
ggugaagacucccaaagag

SEQ ID NO: 933509 - RNA, 19 nt, Homo sapiens
aaacuugcaggcccuaaua

SEQ ID NO: 933510 - RNA, 19 nt, Homo sapiens
cuaggcaaguucaguuaaa

SEQ ID NO: 933511 - RNA, 19 nt, Homo sapiens
uggaacagcucaacgcaau

SEQ ID NO: 933512 - RNA, 19 nt, Homo sapiens
gaagacucccaaagagaaa

SEQ ID NO: 933513 - RNA, 19 nt, Homo sapiens
uaaggaagcgauuucgaaa

SEQ ID NO: 933514 - RNA, 19 nt, Homo sapiens
auaaagagacccuaauaug

SEQ ID NO: 933515 - RNA, 19 nt, Homo sapiens
ugaaggaucaguguaguaa

SEQ ID NO: 933516 - RNA, 19 nt, Homo sapiens
ccaaagagaaagaggaguu

SEQ ID NO: 933517 - RNA, 19 nt, Homo sapiens
gguaucaaccuucacaguu

SEQ ID NO: 933518 - RNA, 19 nt, Homo sapiens
gaugaugauccaaauaaug

SEQ ID NO: 933519 - RNA, 19 nt, Homo sapiens
gacuguauaugaccuuaau

SEQ ID NO: 933520 - RNA, 19 nt, Homo sapiens
ucuaauuugugguacgaua

SEQ ID NO: 933521 - RNA, 19 nt, Homo sapiens
gagcaaugcaggcuuuaau

SEQ ID NO: 933522 - RNA, 19 nt, Homo sapiens
ccacgaguccuacaucaga

SEQ ID NO: 933523 - RNA, 19 nt, Homo sapiens
gcagaauccagacacacua

SEQ ID NO: 933524 - RNA, 19 nt, Homo sapiens
ccaaaccgaucagcuagug

SEQ ID NO: 933525 - RNA, 19 nt, Homo sapiens
uaaagagacccuaauaugc

SEQ ID NO: 933526 - RNA, 19 nt, Homo sapiens
aaggaucaguguaguaaug

SEQ ID NO: 933527 - RNA, 19 nt, Homo sapiens
uccuacagauguccaauuu

SEQ ID NO: 933528 - RNA, 19 nt, Homo sapiens
ugaagacucccaaagagaa

SEQ ID NO: 933529 - RNA, 19 nt, Homo sapiens
agauuuggcugcacagaug

SEQ ID NO: 933530 - RNA, 19 nt, Homo sapiens
gagaaacccagaaaucagu

SEQ ID NO: 933531 - RNA, 19 nt, Homo sapiens
aaagagacccuaauaugca

SEQ ID NO: 933532 - RNA, 19 nt, Homo sapiens
cauaaagagacccuaauau

SEQ ID NO: 933533 - RNA, 19 nt, Homo sapiens
guacgauauugcuuauugu

SEQ ID NO: 933534 - RNA, 19 nt, Homo sapiens
uugaagcucucuaauuugu

SEQ ID NO: 933535 - RNA, 19 nt, Homo sapiens
acaguugggugaacaagug

SEQ ID NO: 933536 - RNA, 19 nt, Homo sapiens
gacauuagccacugaagca

SEQ ID NO: 933537 - RNA, 19 nt, Homo sapiens
ugucaacauuugcagauug

SEQ ID NO: 933538 - RNA, 19 nt, Homo sapiens
ugauaaacuucucagugaa

SEQ ID NO: 933539 - RNA, 19 nt, Homo sapiens
agaccuggcucuuagcaau

SEQ ID NO: 933540 - RNA, 19 nt, Homo sapiens
ucaaugcuguuucacucaa

SEQ ID NO: 933541 - RNA, 19 nt, Homo sapiens
cagagaaacccagaaauca

SEQ ID NO: 933542 - RNA, 19 nt, Homo sapiens
ucagagaaacccagaaauc

SEQ ID NO: 933543 - RNA, 19 nt, Homo sapiens
caucaguuauuucucuugu

SEQ ID NO: 933544 - RNA, 19 nt, Homo sapiens
ccagggaaccgcagucuuc

SEQ ID NO: 933545 - RNA, 19 nt, Homo sapiens
caaacacuucucuuuauuc

SEQ ID NO: 933546 - RNA, 19 nt, Homo sapiens
cuaauuaugucgccagcau

SEQ ID NO: 933547 - RNA, 19 nt, Homo sapiens
cugaugaggcagcugauua

SEQ ID NO: 933548 - RNA, 19 nt, Homo sapiens
cuuacagcaucuuugauaa

SEQ ID NO: 933549 - RNA, 19 nt, Homo sapiens
caugcaaacacuucucuuu

SEQ ID NO: 933550 - RNA, 19 nt, Homo sapiens
gaacagcucaacgcaaugg

SEQ ID NO: 933551 - RNA, 19 nt, Homo sapiens
ggcccuggcuggagcaaau

SEQ ID NO: 933552 - RNA, 19 nt, Homo sapiens
caucccagguggcuauaau

SEQ ID NO: 933553 - RNA, 19 nt, Homo sapiens
aaagugucaugugauguuu

SEQ ID NO: 933554 - RNA, 19 nt, Homo sapiens
cagauugacuguauaugac

SEQ ID NO: 933555 - RNA, 19 nt, Homo sapiens
ucuuacagcaucuuugaua

SEQ ID NO: 933556 - RNA, 19 nt, Homo sapiens
aagcacaauuggcacugua

SEQ ID NO: 933557 - RNA, 19 nt, Homo sapiens
augcaaacacuucucuuua

SEQ ID NO: 933558 - RNA, 19 nt, Homo sapiens
gaauccagacacacuauca

SEQ ID NO: 933559 - RNA, 19 nt, Homo sapiens
cacagaugaugcugaauag

SEQ ID NO: 933560 - RNA, 19 nt, Homo sapiens
guucagagcaugcuuucga

SEQ ID NO: 933561 - RNA, 19 nt, Homo sapiens
ggccagcccugagaugaug

SEQ ID NO: 933562 - RNA, 19 nt, Homo sapiens
cugaaagugucaugugaug

SEQ ID NO: 933563 - RNA, 19 nt, Homo sapiens
aacauugugucaacauuug

SEQ ID NO: 933564 - RNA, 19 nt, Homo sapiens
caguagaaucugaguguaa

SEQ ID NO: 933565 - RNA, 19 nt, Homo sapiens
cugcacagaugaugcugaa

SEQ ID NO: 933566 - RNA, 19 nt, Homo sapiens
gaggcagacacucgaaauu

SEQ ID NO: 933567 - RNA, 19 nt, Homo sapiens
ggcagcugauuauggcuaa

SEQ ID NO: 933568 - RNA, 19 nt, Homo sapiens
gauguccaauuuauuugca

SEQ ID NO: 933569 - RNA, 19 nt, Homo sapiens
caaguguuguccuacagau

SEQ ID NO: 933570 - RNA, 19 nt, Homo sapiens
gcucgguucagcaguuuaa

SEQ ID NO: 933571 - RNA, 19 nt, Homo sapiens
gaagaaaucucuaaacguu

SEQ ID NO: 933572 - RNA, 19 nt, Homo sapiens
ggaauucugugcuguuaua

SEQ ID NO: 933573 - RNA, 19 nt, Homo sapiens
gacaacagcucccaacuuu

SEQ ID NO: 933574 - RNA, 19 nt, Homo sapiens
gauaacggcucuuaaacuu

SEQ ID NO: 933575 - RNA, 19 nt, Homo sapiens
gcacagaugaugcugaaua

SEQ ID NO: 933576 - RNA, 19 nt, Homo sapiens
gaaggaacacuguaguaua

SEQ ID NO: 933577 - RNA, 19 nt, Homo sapiens
gcagaauccugauacacua

SEQ ID NO: 933578 - RNA, 19 nt, Homo sapiens
caacauucauucacagauu

SEQ ID NO: 933579 - RNA, 19 nt, Homo sapiens
guacacagauauucaggaa

SEQ ID NO: 933580 - RNA, 19 nt, Homo sapiens
acagagaaauccagaaauu

SEQ ID NO: 933581 - RNA, 19 nt, Homo sapiens
caucaacuccuaauaguaa

SEQ ID NO: 933582 - RNA, 19 nt, Homo sapiens
acaaacaucucccagcaaa

SEQ ID NO: 933583 - RNA, 19 nt, Homo sapiens
caacuuuccuccaacaaau

SEQ ID NO: 933584 - RNA, 19 nt, Homo sapiens
gcuguaagauuuauacuac

SEQ ID NO: 933585 - RNA, 19 nt, Homo sapiens
guacuacugcgccaaauuu

SEQ ID NO: 933586 - RNA, 19 nt, Homo sapiens
caaaacaccuguaacuaaa

SEQ ID NO: 933587 - RNA, 19 nt, Homo sapiens
gguacaguauugcuuauug

SEQ ID NO: 933588 - RNA, 19 nt, Homo sapiens
ccacagacuucccagaguu

SEQ ID NO: 933589 - RNA, 19 nt, Homo sapiens
gcaaaacaccuguaacuaa

SEQ ID NO: 933590 - RNA, 19 nt, Homo sapiens
caagagcaguuugguggua

SEQ ID NO: 933591 - RNA, 19 nt, Homo sapiens
gaaaaucccuuuguucaga

SEQ ID NO: 933592 - RNA, 19 nt, Homo sapiens
caacuucucugaacuacag

SEQ ID NO: 933593 - RNA, 19 nt, Homo sapiens
caaacaaugcuguaagauu

SEQ ID NO: 933594 - RNA, 19 nt, Homo sapiens
aaacaaacccaauaugaug

SEQ ID NO: 933595 - RNA, 19 nt, Homo sapiens
cagcauuucuguaucuuga

SEQ ID NO: 933596 - RNA, 19 nt, Homo sapiens
ggacaucagcaguuuauuc

SEQ ID NO: 933597 - RNA, 19 nt, Homo sapiens
cacagaugaugcugaauaa

SEQ ID NO: 933598 - RNA, 19 nt, Homo sapiens
cuucucagcuucucccaua

SEQ ID NO: 933599 - RNA, 19 nt, Homo sapiens
caucacuucugcauuuauu

SEQ ID NO: 933600 - RNA, 19 nt, Homo sapiens
agacaaacguuggaacuug

SEQ ID NO: 933601 - RNA, 19 nt, Homo sapiens
aaauacagcuggaagcaau

SEQ ID NO: 933602 - RNA, 19 nt, Homo sapiens
gaaauccucagcuucaaga

SEQ ID NO: 933603 - RNA, 19 nt, Homo sapiens
cugaugagacaguuaauua

SEQ ID NO: 933604 - RNA, 19 nt, Homo sapiens
aaacuugcaagcucuaaua

SEQ ID NO: 933605 - RNA, 19 nt, Homo sapiens
uauagaguaugcacauuug

SEQ ID NO: 933606 - RNA, 19 nt, Homo sapiens
ccagauauaaugagacaaa

SEQ ID NO: 933607 - RNA, 19 nt, Homo sapiens
guaacauugucucaacauu

SEQ ID NO: 933608 - RNA, 19 nt, Homo sapiens
gaaaagcugauucugguua

SEQ ID NO: 933609 - RNA, 19 nt, Homo sapiens
gaacaacucagugcaaugg

SEQ ID NO: 933610 - RNA, 19 nt, Homo sapiens
gaaccaggaccgagcuuug

SEQ ID NO: 933611 - RNA, 19 nt, Homo sapiens
cagagaaauccagaaauua

SEQ ID NO: 933612 - RNA, 19 nt, Homo sapiens
guacaguauugcuuauugu

SEQ ID NO: 933613 - RNA, 19 nt, Homo sapiens
gaugagacaguuaauuaug

SEQ ID NO: 933614 - RNA, 19 nt, Homo sapiens
ggacuugcaggucugagua

SEQ ID NO: 933615 - RNA, 19 nt, Homo sapiens
gcugaguauuuccuaauug

SEQ ID NO: 933616 - RNA, 19 nt, Homo sapiens
cuggaaacauacugcaaua

SEQ ID NO: 933617 - RNA, 19 nt, Homo sapiens
gcaucuguccaguuuauuu

SEQ ID NO: 933618 - RNA, 19 nt, Homo sapiens
cugaguagcuuggguuuga

SEQ ID NO: 933619 - RNA, 19 nt, Homo sapiens
uaaaucacauacugaccaa

SEQ ID NO: 933620 - RNA, 19 nt, Homo sapiens
gauucugguuaucucuuua

SEQ ID NO: 933621 - RNA, 19 nt, Homo sapiens
caaaugcagaauccugaua

SEQ ID NO: 933622 - RNA, 19 nt, Homo sapiens
aauaguaacucuacaucug

SEQ ID NO: 933623 - RNA, 19 nt, Homo sapiens
uggaguaaauccucagcua

SEQ ID NO: 933624 - RNA, 19 nt, Homo sapiens
aguaggagcuaguauguuc

SEQ ID NO: 933625 - RNA, 19 nt, Homo sapiens
ggaguaggagcuaguaugu

SEQ ID NO: 933626 - RNA, 19 nt, Homo sapiens
cugguuaucucuuuaagga

SEQ ID NO: 933627 - RNA, 19 nt, Homo sapiens
cauagcagcauuucuguau

SEQ ID NO: 933628 - RNA, 19 nt, Homo sapiens
ugauaucaaugcagcuauu

SEQ ID NO: 933629 - RNA, 19 nt, Homo sapiens
gacaucagcaguuuauuca

SEQ ID NO: 933630 - RNA, 19 nt, Homo sapiens
aaggaacacuguaguauac

SEQ ID NO: 933631 - RNA, 19 nt, Homo sapiens
ggaaacauacugcaauagg

SEQ ID NO: 933632 - RNA, 19 nt, Homo sapiens
gcaaugaugcaggagauga

SEQ ID NO: 933633 - RNA, 19 nt, Homo sapiens
ccacaaaugcagcaguuga

SEQ ID NO: 933634 - RNA, 19 nt, Homo sapiens
ucuuaaagcugaguauuuc

SEQ ID NO: 933635 - RNA, 19 nt, Homo sapiens
aacccaauaugaugcauuu

SEQ ID NO: 933636 - RNA, 19 nt, Homo sapiens
caucauagcagcauuucug

SEQ ID NO: 933637 - RNA, 19 nt, Homo sapiens
gaaccgugaagcaaacuug

SEQ ID NO: 933638 - RNA, 19 nt, Homo sapiens
gagcaaugcaggccuuguu

SEQ ID NO: 933639 - RNA, 19 nt, Homo sapiens
gcucccaacuuuccuccaa

SEQ ID NO: 933640 - RNA, 19 nt, Homo sapiens
aacaggaggugauaucaau

SEQ ID NO: 933641 - RNA, 19 nt, Homo sapiens
ugaccuugcugcacagaug

SEQ ID NO: 933642 - RNA, 19 nt, Homo sapiens
caucaucaacuccuaauag

SEQ ID NO: 933643 - RNA, 19 nt, Homo sapiens
uaacauugucucaacauuc

SEQ ID NO: 933644 - RNA, 19 nt, Homo sapiens
caauacauccucuggugaa

SEQ ID NO: 933645 - RNA, 19 nt, Homo sapiens
gaccugaugagacaguuaa

SEQ ID NO: 933646 - RNA, 19 nt, Homo sapiens
ucccauagguaguuuaaca

SEQ ID NO: 933647 - RNA, 19 nt, Homo sapiens
ugcaaacaaugcuguaaga

SEQ ID NO: 933648 - RNA, 19 nt, Homo sapiens
auaguugggugaccagauu

SEQ ID NO: 933649 - RNA, 19 nt, Homo sapiens
ggaagaaaucucuaaacgu

SEQ ID NO: 933650 - RNA, 19 nt, Homo sapiens
cagaugaugcugaauaauc

SEQ ID NO: 933651 - RNA, 19 nt, Homo sapiens
ugaaagaucaagauaccuu

SEQ ID NO: 933652 - RNA, 19 nt, Homo sapiens
aacauugucucaacauuca

SEQ ID NO: 933653 - RNA, 19 nt, Homo sapiens
uuagucagguuuguugaaa

SEQ ID NO: 933654 - RNA, 19 nt, Homo sapiens
caacaggaggugauaucaa

SEQ ID NO: 933655 - RNA, 19 nt, Homo sapiens
ggaauucaugauggacuua

SEQ ID NO: 933656 - RNA, 19 nt, Homo sapiens
gaguaaauccucagcuaca

SEQ ID NO: 933657 - RNA, 19 nt, Homo sapiens
gucaaacccuagagcaaug

SEQ ID NO: 933658 - RNA, 19 nt, Homo sapiens
caaccuucccguacagaaa

SEQ ID NO: 933659 - RNA, 19 nt, Homo sapiens
ugcaggagaugaugaggaa

SEQ ID NO: 933660 - RNA, 19 nt, Homo sapiens
cagcaaugaugcaggagau

SEQ ID NO: 933661 - RNA, 19 nt, Homo sapiens
ccagaaauuagucauaugu

SEQ ID NO: 933662 - RNA, 19 nt, Homo sapiens
ugauucugguuaucucuuu

SEQ ID NO: 933663 - RNA, 19 nt, Homo sapiens
aaagcugaguauuuccuaa

SEQ ID NO: 933664 - RNA, 19 nt, Homo sapiens
gcacauuugggacugcauu

SEQ ID NO: 933665 - RNA, 19 nt, Homo sapiens
cugcaucuguccaguuuau

SEQ ID NO: 933666 - RNA, 19 nt, Homo sapiens
ggaauuaaggcuacugcau

SEQ ID NO: 933667 - RNA, 19 nt, Homo sapiens
ggcgugcucugcauucuuc

SEQ ID NO: 933668 - RNA, 19 nt, Homo sapiens
ccacugaaccuggacauca

SEQ ID NO: 933669 - RNA, 19 nt, Homo sapiens
guaauccauuugcuuccuu

SEQ ID NO: 933670 - RNA, 19 nt, Homo sapiens
gcgcauguacacagauauu

SEQ ID NO: 933671 - RNA, 19 nt, Homo sapiens
gaagaaaucucuaaacguu

SEQ ID NO: 933672 - RNA, 19 nt, Homo sapiens
ggaauucugugcuguuaua

SEQ ID NO: 933673 - RNA, 19 nt, Homo sapiens
gauaacggcucuuaaacuu

SEQ ID NO: 933674 - RNA, 19 nt, Homo sapiens
gcagaauccugauacacua

SEQ ID NO: 933675 - RNA, 19 nt, Homo sapiens
guacacagauauucaggaa

SEQ ID NO: 933676 - RNA, 19 nt, Homo sapiens
acagagaaauccagaaauu

SEQ ID NO: 933677 - RNA, 19 nt, Homo sapiens
caucaacuccuaauaguaa

SEQ ID NO: 933678 - RNA, 19 nt, Homo sapiens
guacuacugcgccaaauuu

SEQ ID NO: 933679 - RNA, 19 nt, Homo sapiens
ccacagacuucccagaguu

SEQ ID NO: 933680 - RNA, 19 nt, Homo sapiens
caagagcaguuugguggua

SEQ ID NO: 933681 - RNA, 19 nt, Homo sapiens
gaaaaucccuuuguucaga

SEQ ID NO: 933682 - RNA, 19 nt, Homo sapiens
caacuucucugaacuacag

SEQ ID NO: 933683 - RNA, 19 nt, Homo sapiens
aaacaaacccaauaugaug

SEQ ID NO: 933684 - RNA, 19 nt, Homo sapiens
cagcauuucuguaucuuga

SEQ ID NO: 933685 - RNA, 19 nt, Homo sapiens
ggacaucagcaguuuauuc

SEQ ID NO: 933686 - RNA, 19 nt, Homo sapiens
caucacuucugcauuuauu

SEQ ID NO: 933687 - RNA, 19 nt, Homo sapiens
agacaaacguuggaacuug

SEQ ID NO: 933688 - RNA, 19 nt, Homo sapiens
aaauacagcuggaagcaau

SEQ ID NO: 933689 - RNA, 19 nt, Homo sapiens
cugaugagacaguuaauua

SEQ ID NO: 933690 - RNA, 19 nt, Homo sapiens
aaacuugcaagcucuaaua

SEQ ID NO: 933691 - RNA, 19 nt, Homo sapiens
ccagauauaaugagacaaa

SEQ ID NO: 933692 - RNA, 19 nt, Homo sapiens
gaacaacucagugcaaugg

SEQ ID NO: 933693 - RNA, 19 nt, Homo sapiens
gaaccaggaccgagcuuug

SEQ ID NO: 933694 - RNA, 19 nt, Homo sapiens
cagagaaauccagaaauua

SEQ ID NO: 933695 - RNA, 19 nt, Homo sapiens
gaugagacaguuaauuaug

SEQ ID NO: 933696 - RNA, 19 nt, Homo sapiens
ggacuugcaggucugagua

SEQ ID NO: 933697 - RNA, 19 nt, Homo sapiens
gcaucuguccaguuuauuu

SEQ ID NO: 933698 - RNA, 19 nt, Homo sapiens
cugaguagcuuggguuuga

SEQ ID NO: 933699 - RNA, 19 nt, Homo sapiens
uaaaucacauacugaccaa

SEQ ID NO: 933700 - RNA, 19 nt, Homo sapiens
aauaguaacucuacaucug

SEQ ID NO: 933701 - RNA, 19 nt, Homo sapiens
uggaguaaauccucagcua

SEQ ID NO: 933702 - RNA, 19 nt, Homo sapiens
aguaggagcuaguauguuc

SEQ ID NO: 933703 - RNA, 19 nt, Homo sapiens
ggaguaggagcuaguaugu

SEQ ID NO: 933704 - RNA, 19 nt, Homo sapiens
cauagcagcauuucuguau

SEQ ID NO: 933705 - RNA, 19 nt, Homo sapiens
ugauaucaaugcagcuauu

SEQ ID NO: 933706 - RNA, 19 nt, Homo sapiens
gacaucagcaguuuauuca

SEQ ID NO: 933707 - RNA, 19 nt, Homo sapiens
gcaaugaugcaggagauga

SEQ ID NO: 933708 - RNA, 19 nt, Homo sapiens
ccacaaaugcagcaguuga

SEQ ID NO: 933709 - RNA, 19 nt, Homo sapiens
aacccaauaugaugcauuu

SEQ ID NO: 933710 - RNA, 19 nt, Homo sapiens
caucauagcagcauuucug

SEQ ID NO: 933711 - RNA, 19 nt, Homo sapiens
gaaccgugaagcaaacuug

SEQ ID NO: 933712 - RNA, 19 nt, Homo sapiens
gagcaaugcaggccuuguu

SEQ ID NO: 933713 - RNA, 19 nt, Homo sapiens
aacaggaggugauaucaau

SEQ ID NO: 933714 - RNA, 19 nt, Homo sapiens
ugaccuugcugcacagaug

SEQ ID NO: 933715 - RNA, 19 nt, Homo sapiens
caucaucaacuccuaauag

SEQ ID NO: 933716 - RNA, 19 nt, Homo sapiens
caauacauccucuggugaa

SEQ ID NO: 933717 - RNA, 19 nt, Homo sapiens
gaccugaugagacaguuaa

SEQ ID NO: 933718 - RNA, 19 nt, Homo sapiens
auaguugggugaccagauu

SEQ ID NO: 933719 - RNA, 19 nt, Homo sapiens
ugaaagaucaagauaccuu

SEQ ID NO: 933720 - RNA, 19 nt, Homo sapiens
ggaagaaaucucuaaacgu

SEQ ID NO: 933721 - RNA, 19 nt, Homo sapiens
caacaggaggugauaucaa

SEQ ID NO: 933722 - RNA, 19 nt, Homo sapiens
gaguaaauccucagcuaca

SEQ ID NO: 933723 - RNA, 19 nt, Homo sapiens
gucaaacccuagagcaaug

SEQ ID NO: 933724 - RNA, 19 nt, Homo sapiens
caaccuucccguacagaaa

SEQ ID NO: 933725 - RNA, 19 nt, Homo sapiens
ugcaggagaugaugaggaa

SEQ ID NO: 933726 - RNA, 19 nt, Homo sapiens
cagcaaugaugcaggagau

SEQ ID NO: 933727 - RNA, 19 nt, Homo sapiens
ccagaaauuagucauaugu

SEQ ID NO: 933728 - RNA, 19 nt, Homo sapiens
ggaauucaugauggacuua

SEQ ID NO: 933729 - RNA, 19 nt, Homo sapiens
cugcaucuguccaguuuau

SEQ ID NO: 933730 - RNA, 19 nt, Homo sapiens
ggaauuaaggcuacugcau

SEQ ID NO: 933731 - RNA, 19 nt, Homo sapiens
ccacugaaccuggacauca

SEQ ID NO: 933732 - RNA, 19 nt, Homo sapiens
ggcgugcucugcauucuuc

SEQ ID NO: 933733 - RNA, 19 nt, Homo sapiens
guaauccauuugcuuccuu

SEQ ID NO: 933734 - RNA, 19 nt, Homo sapiens
gcgcauguacacagauauu

SEQ ID NO: 933735 - RNA, 19 nt, Homo sapiens
uaaggcgcauguacacaga

SEQ ID NO: 933736 - RNA, 19 nt, Homo sapiens
agagaaauccagaaauuag

SEQ ID NO: 933737 - RNA, 19 nt, Homo sapiens
cagaugcagcgacaacuuu

SEQ ID NO: 933738 - RNA, 19 nt, Homo sapiens
ggaguacaguaagaugugu

SEQ ID NO: 933739 - RNA, 19 nt, Homo sapiens
cguuggaacuugccaggaa

SEQ ID NO: 933740 - RNA, 19 nt, Homo sapiens
gaaauccagaaauuaguca

SEQ ID NO: 933741 - RNA, 19 nt, Homo sapiens
cuguucaccuugucauuaa

SEQ ID NO: 933742 - RNA, 19 nt, Homo sapiens
caugauggacuuacuguuc

SEQ ID NO: 933743 - RNA, 19 nt, Homo sapiens
uagcagcauuucuguaucu

SEQ ID NO: 933744 - RNA, 19 nt, Homo sapiens
ggaucuaacgccacaccua

SEQ ID NO: 933745 - RNA, 19 nt, Homo sapiens
gcaguuuggugguaaucca

SEQ ID NO: 933746 - RNA, 19 nt, Homo sapiens
gcauguacacagauauuca

SEQ ID NO: 933747 - RNA, 19 nt, Homo sapiens
gagaaauccagaaauuagu

SEQ ID NO: 933748 - RNA, 19 nt, Homo sapiens
ucauucagcucagcaaaca

SEQ ID NO: 933749 - RNA, 19 nt, Homo sapiens
aaacaggccucaggaucau

SEQ ID NO: 933750 - RNA, 19 nt, Homo sapiens
caacaacuggaacaacuca

SEQ ID NO: 933751 - RNA, 19 nt, Homo sapiens
uaaauccucagcuacagaa

SEQ ID NO: 933752 - RNA, 19 nt, Homo sapiens
gcaggcucuugcuggagua

SEQ ID NO: 933753 - RNA, 19 nt, Homo sapiens
cagcaggguuuacagacau

SEQ ID NO: 933754 - RNA, 19 nt, Homo sapiens
gaugcagaauccugauaca

SEQ ID NO: 933755 - RNA, 19 nt, Homo sapiens
gggauauaaugcuuuaagg

SEQ ID NO: 933756 - RNA, 19 nt, Homo sapiens
gcuuugagcaaccuagaaa

SEQ ID NO: 933757 - RNA, 19 nt, Homo sapiens
auacagagaaauccagaaa

SEQ ID NO: 933758 - RNA, 19 nt, Homo sapiens
gcuacugcaugcaucacuu

SEQ ID NO: 933759 - RNA, 19 nt, Homo sapiens
gcuacagaauccagaaguc

SEQ ID NO: 933760 - RNA, 19 nt, Homo sapiens
gucuaacccugaaaugaug

SEQ ID NO: 933761 - RNA, 19 nt, Homo sapiens
gcuggaagcaauguuacua

SEQ ID NO: 933762 - RNA, 19 nt, Homo sapiens
acauuagccuaugguagua

SEQ ID NO: 933763 - RNA, 19 nt, Homo sapiens
uuggaauucugugcuguua

SEQ ID NO: 933764 - RNA, 19 nt, Homo sapiens
gaaaauagagauccacuac

SEQ ID NO: 933765 - RNA, 19 nt, Homo sapiens
gauauaaugagacaaacgu

SEQ ID NO: 933766 - RNA, 19 nt, Homo sapiens
agccuaugguaguaauuua

SEQ ID NO: 933767 - RNA, 19 nt, Homo sapiens
gcaacaggaggugauauca

SEQ ID NO: 933768 - RNA, 19 nt, Homo sapiens
cuugcaagcucuaauagca

SEQ ID NO: 933769 - RNA, 19 nt, Homo sapiens
guaaauccucagcuacaga

SEQ ID NO: 933770 - RNA, 19 nt, Homo sapiens
augcaggccuuguuacaga

SEQ ID NO: 933771 - RNA, 19 nt, Homo sapiens
gaaaucaucuuuacggaau

SEQ ID NO: 933772 - RNA, 19 nt, Homo sapiens
gcaaggaaauucaagauuc

SEQ ID NO: 933773 - RNA, 19 nt, Homo sapiens
gaaggaauauacugaaaug

SEQ ID NO: 933774 - RNA, 19 nt, Homo sapiens
ggaaaucacauagcaguua

SEQ ID NO: 933775 - RNA, 19 nt, Homo sapiens
gagcuuuacuucucuauau

SEQ ID NO: 933776 - RNA, 19 nt, Homo sapiens
ggaacaagcuugggauaug

SEQ ID NO: 933777 - RNA, 19 nt, Homo sapiens
gcucaaaucuucacagagu

SEQ ID NO: 933778 - RNA, 19 nt, Homo sapiens
gagaagcuaugagaaauga

SEQ ID NO: 933779 - RNA, 19 nt, Homo sapiens
gcaaaugggaaaucacaua

SEQ ID NO: 933780 - RNA, 19 nt, Homo sapiens
ggagcaacuuagucaaaua

SEQ ID NO: 933781 - RNA, 19 nt, Homo sapiens
ccuguggacuggaguauua

SEQ ID NO: 933782 - RNA, 19 nt, Homo sapiens
cacaagcucuuucuggaua

SEQ ID NO: 933783 - RNA, 19 nt, Homo sapiens
cgagccaacugcuguauuu

SEQ ID NO: 933784 - RNA, 19 nt, Homo sapiens
cagcagagccuuaucuauu

SEQ ID NO: 933785 - RNA, 19 nt, Homo sapiens
ggaauguggugcugagaga

SEQ ID NO: 933786 - RNA, 19 nt, Homo sapiens
ggacaaaguacuugauaug

SEQ ID NO: 933787 - RNA, 19 nt, Homo sapiens
gagcagaaacugaauuaau

SEQ ID NO: 933788 - RNA, 19 nt, Homo sapiens
gcaaauggacaaaguacuu

SEQ ID NO: 933789 - RNA, 19 nt, Homo sapiens
uaagagaagcuaugagaaa

SEQ ID NO: 933790 - RNA, 19 nt, Homo sapiens
gauuacagguccuaucaug

SEQ ID NO: 933791 - RNA, 19 nt, Homo sapiens
gcagguucuuguuucauaa

SEQ ID NO: 933792 - RNA, 19 nt, Homo sapiens
ggauacagagaccaauuua

SEQ ID NO: 933793 - RNA, 19 nt, Homo sapiens
agagaaacaugaaguacaa

SEQ ID NO: 933794 - RNA, 19 nt, Homo sapiens
gcugagagacuacauuuau

SEQ ID NO: 933795 - RNA, 19 nt, Homo sapiens
gaacaagcuugggauaugg

SEQ ID NO: 933796 - RNA, 19 nt, Homo sapiens
aaucacagcucucauaucu

SEQ ID NO: 933797 - RNA, 19 nt, Homo sapiens
guuuguaccuaucaguuua

SEQ ID NO: 933798 - RNA, 19 nt, Homo sapiens
uccaacaacucgagguuua

SEQ ID NO: 933799 - RNA, 19 nt, Homo sapiens
gcacggagugugaauguga

SEQ ID NO: 933800 - RNA, 19 nt, Homo sapiens
gaaaucacauagcaguuac

SEQ ID NO: 933801 - RNA, 19 nt, Homo sapiens
gaaucaacaccuuuacauu

SEQ ID NO: 933802 - RNA, 19 nt, Homo sapiens
gcucucauaucuccaacaa

SEQ ID NO: 933803 - RNA, 19 nt, Homo sapiens
guuccgagcagcaggauua

SEQ ID NO: 933804 - RNA, 19 nt, Homo sapiens
caaggaaauucaagauucu

SEQ ID NO: 933805 - RNA, 19 nt, Homo sapiens
cugagagacuacauuuaua

SEQ ID NO: 933806 - RNA, 19 nt, Homo sapiens
acaaaguacuugauaugga

SEQ ID NO: 933807 - RNA, 19 nt, Homo sapiens
gaaacaugaaguacaaaug

SEQ ID NO: 933808 - RNA, 19 nt, Homo sapiens
ccucagacuucacauguau

SEQ ID NO: 933809 - RNA, 19 nt, Homo sapiens
ugacuggucugugagcuuu

SEQ ID NO: 933810 - RNA, 19 nt, Homo sapiens
caacugcuguauuuaacau

SEQ ID NO: 933811 - RNA, 19 nt, Homo sapiens
gagauuacagguccuauca

SEQ ID NO: 933812 - RNA, 19 nt, Homo sapiens
ggagacagcaucuggaaca

SEQ ID NO: 933813 - RNA, 19 nt, Homo sapiens
agacauacuuucuaucaag

SEQ ID NO: 933814 - RNA, 19 nt, Homo sapiens
gagaugggugugcaagaua

SEQ ID NO: 933815 - RNA, 19 nt, Homo sapiens
cuauaucccuacaaccuaa

SEQ ID NO: 933816 - RNA, 19 nt, Homo sapiens
uuaauaugcuuccuugcaa

SEQ ID NO: 933817 - RNA, 19 nt, Homo sapiens
ucuugaaguugaaggaaua

SEQ ID NO: 933818 - RNA, 19 nt, Homo sapiens
aaucaacaccuuuacauug

SEQ ID NO: 933819 - RNA, 19 nt, Homo sapiens
ggaaucaacaccuuuacau

SEQ ID NO: 933820 - RNA, 19 nt, Homo sapiens
uaauaugcuuccuugcaaa

SEQ ID NO: 933821 - RNA, 19 nt, Homo sapiens
acaguagcaucuaagguuu

SEQ ID NO: 933822 - RNA, 19 nt, Homo sapiens
acagagaccaauuuaguuu

SEQ ID NO: 933823 - RNA, 19 nt, Homo sapiens
guaaagagaaacaugaagu

SEQ ID NO: 933824 - RNA, 19 nt, Homo sapiens
ccagacauacuuucuauca

SEQ ID NO: 933825 - RNA, 19 nt, Homo sapiens
guuagcagguucuuguuuc

SEQ ID NO: 933826 - RNA, 19 nt, Homo sapiens
ccacaaugcaaaugcuuaa

SEQ ID NO: 933827 - RNA, 19 nt, Homo sapiens
aaagaaaguggccauaaga

SEQ ID NO: 933828 - RNA, 19 nt, Homo sapiens
gagaaaugaagguauugaa

SEQ ID NO: 933829 - RNA, 19 nt, Homo sapiens
ucucauaucuccaacaacu

SEQ ID NO: 933830 - RNA, 19 nt, Homo sapiens
uuuaacaucugccugcaaa

SEQ ID NO: 933831 - RNA, 19 nt, Homo sapiens
ugaccaugcugcucaaauc

SEQ ID NO: 933832 - RNA, 19 nt, Homo sapiens
caagcugcguaaagagaaa

SEQ ID NO: 933833 - RNA, 19 nt, Homo sapiens
ccacuguucccucguauug

SEQ ID NO: 933834 - RNA, 19 nt, Homo sapiens
ggucuuguccagcauugua

SEQ ID NO: 933835 - RNA, 19 nt, Homo sapiens
ugaugaggaugaagaggaa

SEQ ID NO: 933836 - RNA, 19 nt, Homo sapiens
aagagaagcuaugagaaau

SEQ ID NO: 933837 - RNA, 19 nt, Homo sapiens
cuaucaagcugcguaaaga

SEQ ID NO: 933838 - RNA, 19 nt, Homo sapiens
cuaccacuguucccucgua

SEQ ID NO: 933839 - RNA, 19 nt, Homo sapiens
cccauggcauugugacuaa

SEQ ID NO: 933840 - RNA, 19 nt, Homo sapiens
gauccugaacaccaaagua

SEQ ID NO: 933841 - RNA, 19 nt, Homo sapiens
gguccuaucaugccucauu

SEQ ID NO: 933842 - RNA, 19 nt, Homo sapiens
agaugggugugcaagauaa

SEQ ID NO: 933843 - RNA, 19 nt, Homo sapiens
gcagagccuuaucuauugg

SEQ ID NO: 933844 - RNA, 19 nt, Homo sapiens
agcagagccuuaucuauug

SEQ ID NO: 933845 - RNA, 19 nt, Homo sapiens
uaacaucugccugcaaaug

SEQ ID NO: 933846 - RNA, 19 nt, Homo sapiens
agacuucacauguaucauu

SEQ ID NO: 933847 - RNA, 19 nt, Homo sapiens
cuuaaucacagcucucaua

SEQ ID NO: 933848 - RNA, 19 nt, Homo sapiens
gugcugagagacuacauuu

SEQ ID NO: 933849 - RNA, 19 nt, Homo sapiens
gacuucacauguaucauuc

SEQ ID NO: 933850 - RNA, 19 nt, Homo sapiens
gaagcuaugagaaaugaag

SEQ ID NO: 933851 - RNA, 19 nt, Homo sapiens
caaaugggaaaucacauag

SEQ ID NO: 933852 - RNA, 19 nt, Homo sapiens
acucagauaacucaaauga

SEQ ID NO: 933853 - RNA, 19 nt, Homo sapiens
auacagagaccaauuuagu

SEQ ID NO: 933854 - RNA, 19 nt, Homo sapiens
aaacaugaaguacaaaugg

SEQ ID NO: 933855 - RNA, 19 nt, Homo sapiens
cugggcagaucauuugaaa

SEQ ID NO: 933856 - RNA, 19 nt, Homo sapiens
ccucugagcuccguuguac

SEQ ID NO: 933857 - RNA, 19 nt, Homo sapiens
agcagguucuuguuucaua

SEQ ID NO: 933858 - RNA, 19 nt, Homo sapiens
uacaguagcaucuaagguu

SEQ ID NO: 933859 - RNA, 19 nt, Homo sapiens
agucaaauaccguuacuug

SEQ ID NO: 933860 - RNA, 19 nt, Homo sapiens
gagccaacugcuguauuua

SEQ ID NO: 933861 - RNA, 19 nt, Homo sapiens
gggcagaucauuugaaagc

SEQ ID NO: 933862 - RNA, 19 nt, Homo sapiens
cagacauacuuucuaucaa

SEQ ID NO: 933863 - RNA, 19 nt, Homo sapiens
gagacagcaucuggaacaa

SEQ ID NO: 933864 - RNA, 19 nt, Homo sapiens
gcuaugagaaaugaaggua

SEQ ID NO: 933865 - RNA, 19 nt, Homo sapiens
uauuggagcugauagaaaa

SEQ ID NO: 933866 - RNA, 19 nt, Homo sapiens
caaauggacaaaguacuug

SEQ ID NO: 933867 - RNA, 19 nt, Homo sapiens
gcuaugggaagagaaguuu

SEQ ID NO: 933868 - RNA, 19 nt, Homo sapiens
ccaugcugcucaaaucuuc

SEQ ID NO: 933869 - RNA, 19 nt, Homo sapiens
guauuggagcugauagaaa

SEQ ID NO: 933870 - RNA, 19 nt, Homo sapiens
gcuccacccugcuuugucu

SEQ ID NO: 933871 - RNA, 19 nt, Homo sapiens
gaaaucaucuuuacggaau

SEQ ID NO: 933872 - RNA, 19 nt, Homo sapiens
gcaaggaaauucaagauuc

SEQ ID NO: 933873 - RNA, 19 nt, Homo sapiens
gaaggaauauacugaaaug

SEQ ID NO: 933874 - RNA, 19 nt, Homo sapiens
ggaaaucacauagcaguua

SEQ ID NO: 933875 - RNA, 19 nt, Homo sapiens
ggaacaagcuugggauaug

SEQ ID NO: 933876 - RNA, 19 nt, Homo sapiens
gcucaaaucuucacagagu

SEQ ID NO: 933877 - RNA, 19 nt, Homo sapiens
gcaaaugggaaaucacaua

SEQ ID NO: 933878 - RNA, 19 nt, Homo sapiens
ggagcaacuuagucaaaua

SEQ ID NO: 933879 - RNA, 19 nt, Homo sapiens
ccuguggacuggaguauua

SEQ ID NO: 933880 - RNA, 19 nt, Homo sapiens
cacaagcucuuucuggaua

SEQ ID NO: 933881 - RNA, 19 nt, Homo sapiens
cgagccaacugcuguauuu

SEQ ID NO: 933882 - RNA, 19 nt, Homo sapiens
cagcagagccuuaucuauu

SEQ ID NO: 933883 - RNA, 19 nt, Homo sapiens
ggaauguggugcugagaga

SEQ ID NO: 933884 - RNA, 19 nt, Homo sapiens
ggacaaaguacuugauaug

SEQ ID NO: 933885 - RNA, 19 nt, Homo sapiens
gagcagaaacugaauuaau

SEQ ID NO: 933886 - RNA, 19 nt, Homo sapiens
gcaaauggacaaaguacuu

SEQ ID NO: 933887 - RNA, 19 nt, Homo sapiens
gauuacagguccuaucaug

SEQ ID NO: 933888 - RNA, 19 nt, Homo sapiens
gcagguucuuguuucauaa

SEQ ID NO: 933889 - RNA, 19 nt, Homo sapiens
ggauacagagaccaauuua

SEQ ID NO: 933890 - RNA, 19 nt, Homo sapiens
agagaaacaugaaguacaa

SEQ ID NO: 933891 - RNA, 19 nt, Homo sapiens
gcugagagacuacauuuau

SEQ ID NO: 933892 - RNA, 19 nt, Homo sapiens
gaacaagcuugggauaugg

SEQ ID NO: 933893 - RNA, 19 nt, Homo sapiens
gcacggagugugaauguga

SEQ ID NO: 933894 - RNA, 19 nt, Homo sapiens
gaaaucacauagcaguuac

SEQ ID NO: 933895 - RNA, 19 nt, Homo sapiens
gaaucaacaccuuuacauu

SEQ ID NO: 933896 - RNA, 19 nt, Homo sapiens
caaggaaauucaagauucu

SEQ ID NO: 933897 - RNA, 19 nt, Homo sapiens
cugagagacuacauuuaua

SEQ ID NO: 933898 - RNA, 19 nt, Homo sapiens
acaaaguacuugauaugga

SEQ ID NO: 933899 - RNA, 19 nt, Homo sapiens
ccucagacuucacauguau

SEQ ID NO: 933900 - RNA, 19 nt, Homo sapiens
gaaacaugaaguacaaaug

SEQ ID NO: 933901 - RNA, 19 nt, Homo sapiens
caacugcuguauuuaacau

SEQ ID NO: 933902 - RNA, 19 nt, Homo sapiens
gagauuacagguccuauca

SEQ ID NO: 933903 - RNA, 19 nt, Homo sapiens
ggagacagcaucuggaaca

SEQ ID NO: 933904 - RNA, 19 nt, Homo sapiens
agacauacuuucuaucaag

SEQ ID NO: 933905 - RNA, 19 nt, Homo sapiens
gagaugggugugcaagaua

SEQ ID NO: 933906 - RNA, 19 nt, Homo sapiens
cuauaucccuacaaccuaa

SEQ ID NO: 933907 - RNA, 19 nt, Homo sapiens
uuaauaugcuuccuugcaa

SEQ ID NO: 933908 - RNA, 19 nt, Homo sapiens
ucuugaaguugaaggaaua

SEQ ID NO: 933909 - RNA, 19 nt, Homo sapiens
aaucaacaccuuuacauug

SEQ ID NO: 933910 - RNA, 19 nt, Homo sapiens
ggaaucaacaccuuuacau

SEQ ID NO: 933911 - RNA, 19 nt, Homo sapiens
uaauaugcuuccuugcaaa

SEQ ID NO: 933912 - RNA, 19 nt, Homo sapiens
acaguagcaucuaagguuu

SEQ ID NO: 933913 - RNA, 19 nt, Homo sapiens
acagagaccaauuuaguuu

SEQ ID NO: 933914 - RNA, 19 nt, Homo sapiens
guaaagagaaacaugaagu

SEQ ID NO: 933915 - RNA, 19 nt, Homo sapiens
ccagacauacuuucuauca

SEQ ID NO: 933916 - RNA, 19 nt, Homo sapiens
guuagcagguucuuguuuc

SEQ ID NO: 933917 - RNA, 19 nt, Homo sapiens
ccacaaugcaaaugcuuaa

SEQ ID NO: 933918 - RNA, 19 nt, Homo sapiens
aaagaaaguggccauaaga

SEQ ID NO: 933919 - RNA, 19 nt, Homo sapiens
uuuaacaucugccugcaaa

SEQ ID NO: 933920 - RNA, 19 nt, Homo sapiens
ugaccaugcugcucaaauc

SEQ ID NO: 933921 - RNA, 19 nt, Homo sapiens
caagcugcguaaagagaaa

SEQ ID NO: 933922 - RNA, 19 nt, Homo sapiens
ccacuguucccucguauug

SEQ ID NO: 933923 - RNA, 19 nt, Homo sapiens
ggucuuguccagcauugua

SEQ ID NO: 933924 - RNA, 19 nt, Homo sapiens
ugaugaggaugaagaggaa

SEQ ID NO: 933925 - RNA, 19 nt, Homo sapiens
cuaucaagcugcguaaaga

SEQ ID NO: 933926 - RNA, 19 nt, Homo sapiens
cuaccacuguucccucgua

SEQ ID NO: 933927 - RNA, 19 nt, Homo sapiens
cccauggcauugugacuaa

SEQ ID NO: 933928 - RNA, 19 nt, Homo sapiens
gauccugaacaccaaagua

SEQ ID NO: 933929 - RNA, 19 nt, Homo sapiens
gguccuaucaugccucauu

SEQ ID NO: 933930 - RNA, 19 nt, Homo sapiens
agaugggugugcaagauaa

SEQ ID NO: 933931 - RNA, 19 nt, Homo sapiens
gcagagccuuaucuauugg

SEQ ID NO: 933932 - RNA, 19 nt, Homo sapiens
agcagagccuuaucuauug

SEQ ID NO: 933933 - RNA, 19 nt, Homo sapiens
uaacaucugccugcaaaug

SEQ ID NO: 933934 - RNA, 19 nt, Homo sapiens
agacuucacauguaucauu

SEQ ID NO: 933935 - RNA, 19 nt, Homo sapiens
gugcugagagacuacauuu

SEQ ID NO: 933936 - RNA, 19 nt, Homo sapiens
gacuucacauguaucauuc

SEQ ID NO: 933937 - RNA, 19 nt, Homo sapiens
caaaugggaaaucacauag

SEQ ID NO: 933938 - RNA, 19 nt, Homo sapiens
acucagauaacucaaauga

SEQ ID NO: 933939 - RNA, 19 nt, Homo sapiens
auacagagaccaauuuagu

SEQ ID NO: 933940 - RNA, 19 nt, Homo sapiens
aaacaugaaguacaaaugg

SEQ ID NO: 933941 - RNA, 19 nt, Homo sapiens
ccucugagcuccguuguac

SEQ ID NO: 933942 - RNA, 19 nt, Homo sapiens
cugggcagaucauuugaaa

SEQ ID NO: 933943 - RNA, 19 nt, Homo sapiens
agcagguucuuguuucaua

SEQ ID NO: 933944 - RNA, 19 nt, Homo sapiens
uacaguagcaucuaagguu

SEQ ID NO: 933945 - RNA, 19 nt, Homo sapiens
agucaaauaccguuacuug

SEQ ID NO: 933946 - RNA, 19 nt, Homo sapiens
gagccaacugcuguauuua

SEQ ID NO: 933947 - RNA, 19 nt, Homo sapiens
gggcagaucauuugaaagc

SEQ ID NO: 933948 - RNA, 19 nt, Homo sapiens
cagacauacuuucuaucaa

SEQ ID NO: 933949 - RNA, 19 nt, Homo sapiens
gagacagcaucuggaacaa

SEQ ID NO: 933950 - RNA, 19 nt, Homo sapiens
uauuggagcugauagaaaa

SEQ ID NO: 933951 - RNA, 19 nt, Homo sapiens
gcuaugggaagagaaguuu

SEQ ID NO: 933952 - RNA, 19 nt, Homo sapiens
caaauggacaaaguacuug

SEQ ID NO: 933953 - RNA, 19 nt, Homo sapiens
ccaugcugcucaaaucuuc

SEQ ID NO: 933954 - RNA, 19 nt, Homo sapiens
guauuggagcugauagaaa

SEQ ID NO: 933955 - RNA, 19 nt, Homo sapiens
gcuccacccugcuuugucu

SEQ ID NO: 933956 - RNA, 19 nt, Homo sapiens
gccacaaugcaaaugcuua

SEQ ID NO: 933957 - RNA, 19 nt, Homo sapiens
aaaguaagccuaaaaggaa

SEQ ID NO: 933958 - RNA, 19 nt, Homo sapiens
gagcaacuuagucaaauac

SEQ ID NO: 933959 - RNA, 19 nt, Homo sapiens
gccaacugcuguauuuaac

SEQ ID NO: 933960 - RNA, 19 nt, Homo sapiens
agagaugggugugcaagau

SEQ ID NO: 933961 - RNA, 19 nt, Homo sapiens
uuuaaugagugacugguau

SEQ ID NO: 933962 - RNA, 19 nt, Homo sapiens
ugucuuggcuaccacuguu

SEQ ID NO: 933963 - RNA, 19 nt, Homo sapiens
aaugggaaaucacauagca

SEQ ID NO: 933964 - RNA, 19 nt, Homo sapiens
gaaguugaaggaauauacu

SEQ ID NO: 933965 - RNA, 19 nt, Homo sapiens
gauuugcuaugggaagaga

SEQ ID NO: 933966 - RNA, 19 nt, Homo sapiens
uggacaaaguacuugauau

SEQ ID NO: 933967 - RNA, 19 nt, Homo sapiens
gaaagcacaggaagaagcu

SEQ ID NO: 933968 - RNA, 19 nt, Homo sapiens
guucuuguuucauaaaggu

SEQ ID NO: 933969 - RNA, 19 nt, Homo sapiens
cuaauggcaucagggcaaa

SEQ ID NO: 933970 - RNA, 19 nt, Homo sapiens
gcaguuaccccauggcauu

SEQ ID NO: 933971 - RNA, 19 nt, Homo sapiens
gaaaucaucuuuacggaau

SEQ ID NO: 933972 - RNA, 19 nt, Homo sapiens
gcaaggaaauucaagauuc

SEQ ID NO: 933973 - RNA, 19 nt, Homo sapiens
gaaggaauauacugaaaug

SEQ ID NO: 933974 - RNA, 19 nt, Homo sapiens
ggaaaucacauagcaguua

SEQ ID NO: 933975 - RNA, 19 nt, Homo sapiens
gcucaaaucuucacagagu

SEQ ID NO: 933976 - RNA, 19 nt, Homo sapiens
gcaaaugggaaaucacaua

SEQ ID NO: 933977 - RNA, 19 nt, Homo sapiens
ggagcaacuuagucaaaua

SEQ ID NO: 933978 - RNA, 19 nt, Homo sapiens
ccuguggacuggaguauua

SEQ ID NO: 933979 - RNA, 19 nt, Homo sapiens
cacaagcucuuucuggaua

SEQ ID NO: 933980 - RNA, 19 nt, Homo sapiens
cgagccaacugcuguauuu

SEQ ID NO: 933981 - RNA, 19 nt, Homo sapiens
cagcagagccuuaucuauu

SEQ ID NO: 933982 - RNA, 19 nt, Homo sapiens
ggaauguggugcugagaga

SEQ ID NO: 933983 - RNA, 19 nt, Homo sapiens
ggacaaaguacuugauaug

SEQ ID NO: 933984 - RNA, 19 nt, Homo sapiens
gagcagaaacugaauuaau

SEQ ID NO: 933985 - RNA, 19 nt, Homo sapiens
gcaaauggacaaaguacuu

SEQ ID NO: 933986 - RNA, 19 nt, Homo sapiens
gauuacagguccuaucaug

SEQ ID NO: 933987 - RNA, 19 nt, Homo sapiens
gcagguucuuguuucauaa

SEQ ID NO: 933988 - RNA, 19 nt, Homo sapiens
ggauacagagaccaauuua

SEQ ID NO: 933989 - RNA, 19 nt, Homo sapiens
gcugagagacuacauuuau

SEQ ID NO: 933990 - RNA, 19 nt, Homo sapiens
gcacggagugugaauguga

SEQ ID NO: 933991 - RNA, 19 nt, Homo sapiens
gaaaucacauagcaguuac

SEQ ID NO: 933992 - RNA, 19 nt, Homo sapiens
caaggaaauucaagauucu

SEQ ID NO: 933993 - RNA, 19 nt, Homo sapiens
cugagagacuacauuuaua

SEQ ID NO: 933994 - RNA, 19 nt, Homo sapiens
acaaaguacuugauaugga

SEQ ID NO: 933995 - RNA, 19 nt, Homo sapiens
ccucagacuucacauguau

SEQ ID NO: 933996 - RNA, 19 nt, Homo sapiens
caacugcuguauuuaacau

SEQ ID NO: 933997 - RNA, 19 nt, Homo sapiens
gagauuacagguccuauca

SEQ ID NO: 933998 - RNA, 19 nt, Homo sapiens
cuauaucccuacaaccuaa

SEQ ID NO: 933999 - RNA, 19 nt, Homo sapiens
uuaauaugcuuccuugcaa

SEQ ID NO: 934000 - RNA, 19 nt, Homo sapiens
ucuugaaguugaaggaaua

SEQ ID NO: 934001 - RNA, 19 nt, Homo sapiens
uaauaugcuuccuugcaaa

SEQ ID NO: 934002 - RNA, 19 nt, Homo sapiens
acaguagcaucuaagguuu

SEQ ID NO: 934003 - RNA, 19 nt, Homo sapiens
acagagaccaauuuaguuu

SEQ ID NO: 934004 - RNA, 19 nt, Homo sapiens
guuagcagguucuuguuuc

SEQ ID NO: 934005 - RNA, 19 nt, Homo sapiens
uuuaacaucugccugcaaa

SEQ ID NO: 934006 - RNA, 19 nt, Homo sapiens
ugaccaugcugcucaaauc

SEQ ID NO: 934007 - RNA, 19 nt, Homo sapiens
ccacuguucccucguauug

SEQ ID NO: 934008 - RNA, 19 nt, Homo sapiens
ggucuuguccagcauugua

SEQ ID NO: 934009 - RNA, 19 nt, Homo sapiens
cuaccacuguucccucgua

SEQ ID NO: 934010 - RNA, 19 nt, Homo sapiens
cccauggcauugugacuaa

SEQ ID NO: 934011 - RNA, 19 nt, Homo sapiens
gauccugaacaccaaagua

SEQ ID NO: 934012 - RNA, 19 nt, Homo sapiens
gguccuaucaugccucauu

SEQ ID NO: 934013 - RNA, 19 nt, Homo sapiens
gcagagccuuaucuauugg

SEQ ID NO: 934014 - RNA, 19 nt, Homo sapiens
agcagagccuuaucuauug

SEQ ID NO: 934015 - RNA, 19 nt, Homo sapiens
agacuucacauguaucauu

SEQ ID NO: 934016 - RNA, 19 nt, Homo sapiens
uaacaucugccugcaaaug

SEQ ID NO: 934017 - RNA, 19 nt, Homo sapiens
gugcugagagacuacauuu

SEQ ID NO: 934018 - RNA, 19 nt, Homo sapiens
gacuucacauguaucauuc

SEQ ID NO: 934019 - RNA, 19 nt, Homo sapiens
caaaugggaaaucacauag

SEQ ID NO: 934020 - RNA, 19 nt, Homo sapiens
acucagauaacucaaauga

SEQ ID NO: 934021 - RNA, 19 nt, Homo sapiens
auacagagaccaauuuagu

SEQ ID NO: 934022 - RNA, 19 nt, Homo sapiens
ccucugagcuccguuguac

SEQ ID NO: 934023 - RNA, 19 nt, Homo sapiens
cugggcagaucauuugaaa

SEQ ID NO: 934024 - RNA, 19 nt, Homo sapiens
agcagguucuuguuucaua

SEQ ID NO: 934025 - RNA, 19 nt, Homo sapiens
uacaguagcaucuaagguu

SEQ ID NO: 934026 - RNA, 19 nt, Homo sapiens
agucaaauaccguuacuug

SEQ ID NO: 934027 - RNA, 19 nt, Homo sapiens
gagccaacugcuguauuua

SEQ ID NO: 934028 - RNA, 19 nt, Homo sapiens
uauuggagcugauagaaaa

SEQ ID NO: 934029 - RNA, 19 nt, Homo sapiens
gggcagaucauuugaaagc

SEQ ID NO: 934030 - RNA, 19 nt, Homo sapiens
gcuaugggaagagaaguuu

SEQ ID NO: 934031 - RNA, 19 nt, Homo sapiens
caaauggacaaaguacuug

SEQ ID NO: 934032 - RNA, 19 nt, Homo sapiens
ccaugcugcucaaaucuuc

SEQ ID NO: 934033 - RNA, 19 nt, Homo sapiens
guauuggagcugauagaaa

SEQ ID NO: 934034 - RNA, 19 nt, Homo sapiens
gcuccacccugcuuugucu

SEQ ID NO: 934035 - RNA, 19 nt, Homo sapiens
aaaguaagccuaaaaggaa

SEQ ID NO: 934036 - RNA, 19 nt, Homo sapiens
gagcaacuuagucaaauac

SEQ ID NO: 934037 - RNA, 19 nt, Homo sapiens
gccaacugcuguauuuaac

SEQ ID NO: 934038 - RNA, 19 nt, Homo sapiens
ugucuuggcuaccacuguu

SEQ ID NO: 934039 - RNA, 19 nt, Homo sapiens
aaugggaaaucacauagca

SEQ ID NO: 934040 - RNA, 19 nt, Homo sapiens
gaaguugaaggaauauacu

SEQ ID NO: 934041 - RNA, 19 nt, Homo sapiens
uggacaaaguacuugauau

SEQ ID NO: 934042 - RNA, 19 nt, Homo sapiens
gauuugcuaugggaagaga

SEQ ID NO: 934043 - RNA, 19 nt, Homo sapiens
gaaagcacaggaagaagcu

SEQ ID NO: 934044 - RNA, 19 nt, Homo sapiens
guucuuguuucauaaaggu

SEQ ID NO: 934045 - RNA, 19 nt, Homo sapiens
cuaauggcaucagggcaaa

SEQ ID NO: 934046 - RNA, 19 nt, Homo sapiens
gcaguuaccccauggcauu

SEQ ID NO: 934047 - RNA, 19 nt, Homo sapiens
caaaguaagccuaaaagga

SEQ ID NO: 934048 - RNA, 19 nt, Homo sapiens
caccucuucucaacccuuu

SEQ ID NO: 934049 - RNA, 19 nt, Homo sapiens
ugacuggcacggaguguga

SEQ ID NO: 934050 - RNA, 19 nt, Homo sapiens
gcaacccugcagcauguuu

SEQ ID NO: 934051 - RNA, 19 nt, Homo sapiens
cuuuacgauuuaccuguua

SEQ ID NO: 934052 - RNA, 19 nt, Homo sapiens
cugcucaaaucuucacaga

SEQ ID NO: 934053 - RNA, 19 nt, Homo sapiens
uugagcagaaacugaauua

SEQ ID NO: 934054 - RNA, 19 nt, Homo sapiens
uggagcaacuuagucaaau

SEQ ID NO: 934055 - RNA, 19 nt, Homo sapiens
ucacagaguggaucuuucu

SEQ ID NO: 934056 - RNA, 19 nt, Homo sapiens
gacaaaguacuugauaugg

SEQ ID NO: 934057 - RNA, 19 nt, Homo sapiens
ggagauuacagguccuauc

SEQ ID NO: 934058 - RNA, 19 nt, Homo sapiens
uggauacagagaccaauuu

SEQ ID NO: 934059 - RNA, 19 nt, Homo sapiens
uauauugagcagaaacuga

SEQ ID NO: 934060 - RNA, 19 nt, Homo sapiens
cuaacacucuggagcaacu

SEQ ID NO: 934061 - RNA, 19 nt, Homo sapiens
gagcuuacuaacugugguu

SEQ ID NO: 934062 - RNA, 19 nt, Homo sapiens
uaccugggcagaucauuug

SEQ ID NO: 934063 - RNA, 19 nt, Homo sapiens
uauacaggaucccaaacuc

SEQ ID NO: 934064 - RNA, 19 nt, Homo sapiens
guugaaggaauauacugaa

SEQ ID NO: 934065 - RNA, 19 nt, Homo sapiens
ggagauccugaacaccaaa

SEQ ID NO: 934066 - RNA, 19 nt, Homo sapiens
uacagagaccaauuuaguu

SEQ ID NO: 934067 - RNA, 19 nt, Homo sapiens
acaccaaaguaagccuaaa

SEQ ID NO: 934068 - RNA, 19 nt, Homo sapiens
gauacagagaccaauuuag

SEQ ID NO: 934069 - RNA, 19 nt, Homo sapiens
uuagcagguucuuguuuca

SEQ ID NO: 934070 - RNA, 19 nt, Homo sapiens
uuaccugggcagaucauuu

SEQ ID NO: 934071 - RNA, 19 nt, Homo sapiens
gaagaaaggaaccaaauua

SEQ ID NO: 934072 - RNA, 19 nt, Homo sapiens
gcaaagggauagccauaug

SEQ ID NO: 934073 - RNA, 19 nt, Homo sapiens
gcagagccauguauuggaa

SEQ ID NO: 934074 - RNA, 19 nt, Homo sapiens
gaggaaauacccuuuguuu

SEQ ID NO: 934075 - RNA, 19 nt, Homo sapiens
gaagaggcauguggaauuc

SEQ ID NO: 934076 - RNA, 19 nt, Homo sapiens
uuucuuaucuucaggguua

SEQ ID NO: 934077 - RNA, 19 nt, Homo sapiens
guucuaacuucguuuauug

SEQ ID NO: 934078 - RNA, 19 nt, Homo sapiens
cagacacacuacuuuauuu

SEQ ID NO: 934079 - RNA, 19 nt, Homo sapiens
gaaaugcgcugcguaucuc

SEQ ID NO: 934080 - RNA, 19 nt, Homo sapiens
ggauguagaugcugauuuu

SEQ ID NO: 934081 - RNA, 19 nt, Homo sapiens
uaucaugcauugacuguau

SEQ ID NO: 934082 - RNA, 19 nt, Homo sapiens
guagaaacgucagaguuau

SEQ ID NO: 934083 - RNA, 19 nt, Homo sapiens
auacacaccuuucuagaug

SEQ ID NO: 934084 - RNA, 19 nt, Homo sapiens
gaaaaggccagacuucuaa

SEQ ID NO: 934085 - RNA, 19 nt, Homo sapiens
uuuauuagcugcaggcaaa

SEQ ID NO: 934086 - RNA, 19 nt, Homo sapiens
gagaaaugccugccugaga

SEQ ID NO: 934087 - RNA, 19 nt, Homo sapiens
gaaggguaaucccggaaau

SEQ ID NO: 934088 - RNA, 19 nt, Homo sapiens
gggaaaagaggaaauaaua

SEQ ID NO: 934089 - RNA, 19 nt, Homo sapiens
ggagcucucugaggauauu

SEQ ID NO: 934090 - RNA, 19 nt, Homo sapiens
uguagaaacgucagaguua

SEQ ID NO: 934091 - RNA, 19 nt, Homo sapiens
ggcugagaaugaaagauua

SEQ ID NO: 934092 - RNA, 19 nt, Homo sapiens
ugacagggauccagacaca

SEQ ID NO: 934093 - RNA, 19 nt, Homo sapiens
caaccuggcucaucaacag

SEQ ID NO: 934094 - RNA, 19 nt, Homo sapiens
gaauuucuuucaagcaaca

SEQ ID NO: 934095 - RNA, 19 nt, Homo sapiens
ugaaacagcuccuccucau

SEQ ID NO: 934096 - RNA, 19 nt, Homo sapiens
agaaaugccugccugagau

SEQ ID NO: 934097 - RNA, 19 nt, Homo sapiens
cagacgagcagaccguuua

SEQ ID NO: 934098 - RNA, 19 nt, Homo sapiens
ucaagacuaucagaagaaa

SEQ ID NO: 934099 - RNA, 19 nt, Homo sapiens
ccucaagacuaucagaaga

SEQ ID NO: 934100 - RNA, 19 nt, Homo sapiens
gaaaagggaaaaccacaua

SEQ ID NO: 934101 - RNA, 19 nt, Homo sapiens
cugaaaggacuuaugaaua

SEQ ID NO: 934102 - RNA, 19 nt, Homo sapiens
ggcagaaguucgcagcaaa

SEQ ID NO: 934103 - RNA, 19 nt, Homo sapiens
gagaaugaaagauuaagga

SEQ ID NO: 934104 - RNA, 19 nt, Homo sapiens
gcaaauacgaagaggcuau

SEQ ID NO: 934105 - RNA, 19 nt, Homo sapiens
ggcagacgcuaaacucaug

SEQ ID NO: 934106 - RNA, 19 nt, Homo sapiens
ugaagaggcauguggaauu

SEQ ID NO: 934107 - RNA, 19 nt, Homo sapiens
gauccagacacacuacuuu

SEQ ID NO: 934108 - RNA, 19 nt, Homo sapiens
gaaaugccugccugagauu

SEQ ID NO: 934109 - RNA, 19 nt, Homo sapiens
aaugauaaccucaagacua

SEQ ID NO: 934110 - RNA, 19 nt, Homo sapiens
aaaaggagcuggauguaga

SEQ ID NO: 934111 - RNA, 19 nt, Homo sapiens
ccagacacacuacuuuauu

SEQ ID NO: 934112 - RNA, 19 nt, Homo sapiens
acgagcagaccguuuauua

SEQ ID NO: 934113 - RNA, 19 nt, Homo sapiens
augauaaccucaagacuau

SEQ ID NO: 934114 - RNA, 19 nt, Homo sapiens
acacuuugcacuacucaua

SEQ ID NO: 934115 - RNA, 19 nt, Homo sapiens
gaaguucgcagcaaauacu

SEQ ID NO: 934116 - RNA, 19 nt, Homo sapiens
gauacacaccuuucuagau

SEQ ID NO: 934117 - RNA, 19 nt, Homo sapiens
cgacuuggcagacgcuaaa

SEQ ID NO: 934118 - RNA, 19 nt, Homo sapiens
cuccagaacuuccucuuau

SEQ ID NO: 934119 - RNA, 19 nt, Homo sapiens
gcucaucuuucacuggaau

SEQ ID NO: 934120 - RNA, 19 nt, Homo sapiens
ggaaccaaauuauuaugcu

SEQ ID NO: 934121 - RNA, 19 nt, Homo sapiens
gagauacacaccuuucuag

SEQ ID NO: 934122 - RNA, 19 nt, Homo sapiens
gcagaacacagacaaggau

SEQ ID NO: 934123 - RNA, 19 nt, Homo sapiens
caaagggauagccauauga

SEQ ID NO: 934124 - RNA, 19 nt, Homo sapiens
ugaagaaaggaaccaaauu

SEQ ID NO: 934125 - RNA, 19 nt, Homo sapiens
gauauucugaaaggacuua

SEQ ID NO: 934126 - RNA, 19 nt, Homo sapiens
ugagauacacaccuuucua

SEQ ID NO: 934127 - RNA, 19 nt, Homo sapiens
gagcagaccguuuauuagc

SEQ ID NO: 934128 - RNA, 19 nt, Homo sapiens
gcagaaguucgcagcaaau

SEQ ID NO: 934129 - RNA, 19 nt, Homo sapiens
gcugagaaugaaagauuaa

SEQ ID NO: 934130 - RNA, 19 nt, Homo sapiens
gaggcuauuucuugucaca

SEQ ID NO: 934131 - RNA, 19 nt, Homo sapiens
gcaaagccccaaaagauga

SEQ ID NO: 934132 - RNA, 19 nt, Homo sapiens
ggaggaaauacccuuuguu

SEQ ID NO: 934133 - RNA, 19 nt, Homo sapiens
acacaccuuucuagaugaa

SEQ ID NO: 934134 - RNA, 19 nt, Homo sapiens
gguaaucccggaaaugcuu

SEQ ID NO: 934135 - RNA, 19 nt, Homo sapiens
cagaaguucgcagcaaaua

SEQ ID NO: 934136 - RNA, 19 nt, Homo sapiens
gaacacagacaaggaugca

SEQ ID NO: 934137 - RNA, 19 nt, Homo sapiens
gggcugccuuauauuugaa

SEQ ID NO: 934138 - RNA, 19 nt, Homo sapiens
gggauagccauaugaaaca

SEQ ID NO: 934139 - RNA, 19 nt, Homo sapiens
ucacucacuucagcuaaug

SEQ ID NO: 934140 - RNA, 19 nt, Homo sapiens
ggaaauaauacaguaaucg

SEQ ID NO: 934141 - RNA, 19 nt, Homo sapiens
gauugaaagcccagcagaa

SEQ ID NO: 934142 - RNA, 19 nt, Homo sapiens
uggcugagaaugaaagauu

SEQ ID NO: 934143 - RNA, 19 nt, Homo sapiens
ggcccagcgugaagaaaga

SEQ ID NO: 934144 - RNA, 19 nt, Homo sapiens
guaaugcuaguuggcagua

SEQ ID NO: 934145 - RNA, 19 nt, Homo sapiens
gaaaauaccaaggaggaaa

SEQ ID NO: 934146 - RNA, 19 nt, Homo sapiens
ugccauaaaugauaaugca

SEQ ID NO: 934147 - RNA, 19 nt, Homo sapiens
gguucgguuucuccugaua

SEQ ID NO: 934148 - RNA, 19 nt, Homo sapiens
ggagcuggauguagaugcu

SEQ ID NO: 934149 - RNA, 19 nt, Homo sapiens
gcagacgagcagaccguuu

SEQ ID NO: 934150 - RNA, 19 nt, Homo sapiens
aggaggaaguggugagguu

SEQ ID NO: 934151 - RNA, 19 nt, Homo sapiens
ugaaaugcgcugcguaucu

SEQ ID NO: 934152 - RNA, 19 nt, Homo sapiens
gaaaaggggaaaagaggaa

SEQ ID NO: 934153 - RNA, 19 nt, Homo sapiens
uagaggagcaggcaaccaa

SEQ ID NO: 934154 - RNA, 19 nt, Homo sapiens
cccaaaagaugauaaaaca

SEQ ID NO: 934155 - RNA, 19 nt, Homo sapiens
gaaaagggcccagcgugaa

SEQ ID NO: 934156 - RNA, 19 nt, Homo sapiens
aaagggauagccauaugaa

SEQ ID NO: 934157 - RNA, 19 nt, Homo sapiens
cggaggggcugccuuauau

SEQ ID NO: 934158 - RNA, 19 nt, Homo sapiens
cuucagacaucucacaaac

SEQ ID NO: 934159 - RNA, 19 nt, Homo sapiens
gaaacagcuccuccucauc

SEQ ID NO: 934160 - RNA, 19 nt, Homo sapiens
aaugcuaguuggcaguauu

SEQ ID NO: 934161 - RNA, 19 nt, Homo sapiens
aagaguggacguaaugcua

SEQ ID NO: 934162 - RNA, 19 nt, Homo sapiens
uaaucagggugcauuuuaa

SEQ ID NO: 934163 - RNA, 19 nt, Homo sapiens
cugaggauauucugaaagg

SEQ ID NO: 934164 - RNA, 19 nt, Homo sapiens
gcagcugcccaucuucaga

SEQ ID NO: 934165 - RNA, 19 nt, Homo sapiens
gaugcaagaguggacguaa

SEQ ID NO: 934166 - RNA, 19 nt, Homo sapiens
ucuccagaacuuccucuua

SEQ ID NO: 934167 - RNA, 19 nt, Homo sapiens
gaagcaaagccccaaaaga

SEQ ID NO: 934168 - RNA, 19 nt, Homo sapiens
ccagcagagccauguauug

SEQ ID NO: 934169 - RNA, 19 nt, Homo sapiens
gcgugaagaaagauugaaa

SEQ ID NO: 934170 - RNA, 19 nt, Homo sapiens
guuuaaggugugugagaua

SEQ ID NO: 934171 - RNA, 19 nt, Homo sapiens
gaacagcuuugacaacauc

SEQ ID NO: 934172 - RNA, 19 nt, Homo sapiens
ugaacaagcuccgaagaaa

SEQ ID NO: 934173 - RNA, 19 nt, Homo sapiens
gcaagaagguacccaucau

SEQ ID NO: 934174 - RNA, 19 nt, Homo sapiens
gauuggagccugugaccua

SEQ ID NO: 934175 - RNA, 19 nt, Homo sapiens
acccagaagugaaucauuu

SEQ ID NO: 934176 - RNA, 19 nt, Homo sapiens
gugaaucauuucugcaaga

SEQ ID NO: 934177 - RNA, 19 nt, Homo sapiens
ggacacagcagggcaagau

SEQ ID NO: 934178 - RNA, 19 nt, Homo sapiens
gccaggaccuaauguucuu

SEQ ID NO: 934179 - RNA, 19 nt, Homo sapiens
acugguaacuguaacaaga

SEQ ID NO: 934180 - RNA, 19 nt, Homo sapiens
agacugaccugcgcaagga

SEQ ID NO: 934181 - RNA, 19 nt, Homo sapiens
ccgaacagcuuugacaaca

SEQ ID NO: 934182 - RNA, 19 nt, Homo sapiens
gaacaagcuccgaagaaac

SEQ ID NO: 934183 - RNA, 19 nt, Homo sapiens
agacgucgcugcugauggu

SEQ ID NO: 934184 - RNA, 19 nt, Homo sapiens
gcuuugacaacaucuuuaa

SEQ ID NO: 934185 - RNA, 19 nt, Homo sapiens
gugaacaagcuccgaagaa

SEQ ID NO: 934186 - RNA, 19 nt, Homo sapiens
ccaccugucauacugguaa

SEQ ID NO: 934187 - RNA, 19 nt, Homo sapiens
cagcagggcaagaugacua

SEQ ID NO: 934188 - RNA, 19 nt, Homo sapiens
caacguccacgccgucuuc

SEQ ID NO: 934189 - RNA, 19 nt, Homo sapiens
ccgccgaacuccacugcaa

SEQ ID NO: 934190 - RNA, 19 nt, Homo sapiens
cggcucggcuccaugacaa

SEQ ID NO: 934191 - RNA, 19 nt, Homo sapiens
gaagacgucgcugcugaug

SEQ ID NO: 934192 - RNA, 19 nt, Homo sapiens
guacauggucaaccugcaa

SEQ ID NO: 934193 - RNA, 19 nt, Homo sapiens
cagcuuugacaacaucuuu

SEQ ID NO: 934194 - RNA, 19 nt, Homo sapiens
ggucaaccugcaagugaaa

SEQ ID NO: 934195 - RNA, 19 nt, Homo sapiens
caagaagguacccaucauc

SEQ ID NO: 934196 - RNA, 19 nt, Homo sapiens
ggaagacgucgcugcugau

SEQ ID NO: 934197 - RNA, 19 nt, Homo sapiens
cgaacagcuuugacaacau

SEQ ID NO: 934198 - RNA, 19 nt, Homo sapiens
acacagcagggcaagauga

SEQ ID NO: 934199 - RNA, 19 nt, Homo sapiens
ggugguacccagaagugaa

SEQ ID NO: 934200 - RNA, 19 nt, Homo sapiens
ugguaacuguaacaagaaa

SEQ ID NO: 934201 - RNA, 19 nt, Homo sapiens
gucauacugguaacuguaa

SEQ ID NO: 934202 - RNA, 19 nt, Homo sapiens
cgaacuccacugcaacaga

SEQ ID NO: 934203 - RNA, 19 nt, Homo sapiens
ggugaacaagcuccgaaga

SEQ ID NO: 934204 - RNA, 19 nt, Homo sapiens
cagggcaagaugacuauga

SEQ ID NO: 934205 - RNA, 19 nt, Homo sapiens
ugucauacugguaacugua

SEQ ID NO: 934206 - RNA, 19 nt, Homo sapiens
gaugucaccagcccgaaca

SEQ ID NO: 934207 - RNA, 19 nt, Homo sapiens
gcggauuacccagggcuuu

SEQ ID NO: 934208 - RNA, 19 nt, Homo sapiens
cugcuuugcuucgauguca

SEQ ID NO: 934209 - RNA, 19 nt, Homo sapiens
gaaaguaggaagugaauuu

SEQ ID NO: 934210 - RNA, 19 nt, Homo sapiens
ccucuaagcucaugugguu

SEQ ID NO: 934211 - RNA, 19 nt, Homo sapiens
gaagcaaguucaaguccuu

SEQ ID NO: 934212 - RNA, 19 nt, Homo sapiens
gaccgaaggugucuguuug

SEQ ID NO: 934213 - RNA, 19 nt, Homo sapiens
caacacugaugccaaguuc

SEQ ID NO: 934214 - RNA, 19 nt, Homo sapiens
gaucaacgucugucucuug

SEQ ID NO: 934215 - RNA, 19 nt, Homo sapiens
cuacagacguuuaucaucu

SEQ ID NO: 934216 - RNA, 19 nt, Homo sapiens
ggaagugaauuugcugugu

SEQ ID NO: 934217 - RNA, 19 nt, Homo sapiens
gggaguugcuggacugaga

SEQ ID NO: 934218 - RNA, 19 nt, Homo sapiens
ggucucaucucaacguuca

SEQ ID NO: 934219 - RNA, 19 nt, Homo sapiens
ugaauuugcugugugauug

SEQ ID NO: 934220 - RNA, 19 nt, Homo sapiens
gacaugagccuccaacugu

SEQ ID NO: 934221 - RNA, 19 nt, Homo sapiens
gaaggcccaucgcucgaaa

SEQ ID NO: 934222 - RNA, 19 nt, Homo sapiens
caucugagccuguuagugu

SEQ ID NO: 934223 - RNA, 19 nt, Homo sapiens
uaaaucaucugagccuguu

SEQ ID NO: 934224 - RNA, 19 nt, Homo sapiens
aagggacucugaugcauuu

SEQ ID NO: 934225 - RNA, 19 nt, Homo sapiens
gcuguugucugggauuaaa

SEQ ID NO: 934226 - RNA, 19 nt, Homo sapiens
ggacuacagacguuuauca

SEQ ID NO: 934227 - RNA, 19 nt, Homo sapiens
uagcuagaguuccucauga

SEQ ID NO: 934228 - RNA, 19 nt, Homo sapiens
ccucaucucuccugaucaa

SEQ ID NO: 934229 - RNA, 19 nt, Homo sapiens
gaaagcauggccucucuuc

SEQ ID NO: 934230 - RNA, 19 nt, Homo sapiens
auugugaacugguuacuuu

SEQ ID NO: 934231 - RNA, 19 nt, Homo sapiens
ggauggagaucuuggucau

SEQ ID NO: 934232 - RNA, 19 nt, Homo sapiens
gggcuguugucugggauua

SEQ ID NO: 934233 - RNA, 19 nt, Homo sapiens
guucacagcucccgugcau

SEQ ID NO: 934234 - RNA, 19 nt, Homo sapiens
cugcugaccuguuccuuga

SEQ ID NO: 934235 - RNA, 19 nt, Homo sapiens
gaauuuguguugguuacau

SEQ ID NO: 934236 - RNA, 19 nt, Homo sapiens
cagguucaguuccucauug

SEQ ID NO: 934237 - RNA, 19 nt, Homo sapiens
ugaaggccuugaugcugua

SEQ ID NO: 934238 - RNA, 19 nt, Homo sapiens
uuacauacuugguggagau

SEQ ID NO: 934239 - RNA, 19 nt, Homo sapiens
gggcuguggucucaucuca

SEQ ID NO: 934240 - RNA, 19 nt, Homo sapiens
ugacauugaauuuguguug

SEQ ID NO: 934241 - RNA, 19 nt, Homo sapiens
ugaagaucaucgagacaga

SEQ ID NO: 934242 - RNA, 19 nt, Homo sapiens
gcgugucacuccugccauu

SEQ ID NO: 934243 - RNA, 19 nt, Homo sapiens
gguuagcgcugaguucauc

SEQ ID NO: 934244 - RNA, 19 nt, Homo sapiens
gggaugggucggccucuaa

SEQ ID NO: 934245 - RNA, 19 nt, Homo sapiens
ucacaaggcagcagucaca

SEQ ID NO: 934246 - RNA, 19 nt, Homo sapiens
caagggacucugaugcauu

SEQ ID NO: 934247 - RNA, 19 nt, Homo sapiens
gggaguagcuagaguuccu

SEQ ID NO: 934248 - RNA, 19 nt, Homo sapiens
gcacugcgaggauggagau

SEQ ID NO: 934249 - RNA, 19 nt, Homo sapiens
agucugcauucguucguua

SEQ ID NO: 934250 - RNA, 19 nt, Homo sapiens
gacggaaaguaggaaguga

SEQ ID NO: 934251 - RNA, 19 nt, Homo sapiens
gaaagcauggaagcccuaa

SEQ ID NO: 934252 - RNA, 19 nt, Homo sapiens
gcuguggucucaucucaac

SEQ ID NO: 934253 - RNA, 19 nt, Homo sapiens
ugucgguugucaccugaua

SEQ ID NO: 934254 - RNA, 19 nt, Homo sapiens
ucucuucgguuccuauauc

SEQ ID NO: 934255 - RNA, 19 nt, Homo sapiens
agaccagacuacccaccua

SEQ ID NO: 934256 - RNA, 19 nt, Homo sapiens
gcugugugauugugaacug

SEQ ID NO: 934257 - RNA, 19 nt, Homo sapiens
guaagggugacggaaagua

SEQ ID NO: 934258 - RNA, 19 nt, Homo sapiens
gcuguaagggugacggaaa

SEQ ID NO: 934259 - RNA, 19 nt, Homo sapiens
cagcagcccuuggcaccuu

SEQ ID NO: 934260 - RNA, 19 nt, Homo sapiens
uagaguuccucaugagcuu

SEQ ID NO: 934261 - RNA, 19 nt, Homo sapiens
guagcuagaguuccucaug

SEQ ID NO: 934262 - RNA, 19 nt, Homo sapiens
gauaaucagaccagacuac

SEQ ID NO: 934263 - RNA, 19 nt, Homo sapiens
ggcugagucugcauucguu

SEQ ID NO: 934264 - RNA, 19 nt, Homo sapiens
guucaguuccucauugguu

SEQ ID NO: 934265 - RNA, 19 nt, Homo sapiens
uuuaucaucucacaguuuc

SEQ ID NO: 934266 - RNA, 19 nt, Homo sapiens
ccaagggacucugaugcau

SEQ ID NO: 934267 - RNA, 19 nt, Homo sapiens
ucacaguggccuucucaug

SEQ ID NO: 934268 - RNA, 19 nt, Homo sapiens
gagccgagacaccgcauuc

SEQ ID NO: 934269 - RNA, 19 nt, Homo sapiens
gaaauugcuaguggccaaa

SEQ ID NO: 934270 - RNA, 19 nt, Homo sapiens
guucaaguccuucccauac

SEQ ID NO: 934271 - RNA, 19 nt, Homo sapiens
gccaugacucuguguaaga

SEQ ID NO: 934272 - RNA, 19 nt, Homo sapiens
uagcaaacugagcaccuua

SEQ ID NO: 934273 - RNA, 19 nt, Homo sapiens
ugaacugguuacuuucugu

SEQ ID NO: 934274 - RNA, 19 nt, Homo sapiens
ucacagcucccgugcaucu

SEQ ID NO: 934275 - RNA, 19 nt, Homo sapiens
gugaauuugcugugugauu

SEQ ID NO: 934276 - RNA, 19 nt, Homo sapiens
ucauggcacccaaaccuuu

SEQ ID NO: 934277 - RNA, 19 nt, Homo sapiens
gaagaucaucgagacagau

SEQ ID NO: 934278 - RNA, 19 nt, Homo sapiens
ggauguugcagcugugaug

SEQ ID NO: 934279 - RNA, 19 nt, Homo sapiens
guuagaagcaaguucaagu

SEQ ID NO: 934280 - RNA, 19 nt, Homo sapiens
aagugaauuugcuguguga

SEQ ID NO: 934281 - RNA, 19 nt, Homo sapiens
gcgcugaguucaucaaaag

SEQ ID NO: 934282 - RNA, 19 nt, Homo sapiens
ucaguuccuucaucagcaa

SEQ ID NO: 934283 - RNA, 19 nt, Homo sapiens
agacguuuaucaucucaca

SEQ ID NO: 934284 - RNA, 19 nt, Homo sapiens
ccuuaggacuacagacguu

SEQ ID NO: 934285 - RNA, 19 nt, Homo sapiens
gucagcuacuguugcguaa

SEQ ID NO: 934286 - RNA, 19 nt, Homo sapiens
ggacucugaugcauuuuca

SEQ ID NO: 934287 - RNA, 19 nt, Homo sapiens
gaucaucgagacagauuuu

SEQ ID NO: 934288 - RNA, 19 nt, Homo sapiens
accaggagguggacucuuc

SEQ ID NO: 934289 - RNA, 19 nt, Homo sapiens
ggccaugacucuguguaag

SEQ ID NO: 934290 - RNA, 19 nt, Homo sapiens
cgagacagauuuugagaag

SEQ ID NO: 934291 - RNA, 19 nt, Homo sapiens
ggcacacucuguccugaag

SEQ ID NO: 934292 - RNA, 19 nt, Homo sapiens
ggaaaguaggaagugaauu

SEQ ID NO: 934293 - RNA, 19 nt, Homo sapiens
ugucacuccugccauuaug

SEQ ID NO: 934294 - RNA, 19 nt, Homo sapiens
gaauuugcugugugauugu

SEQ ID NO: 934295 - RNA, 19 nt, Homo sapiens
uguguugguuacauacuug

SEQ ID NO: 934296 - RNA, 19 nt, Homo sapiens
ucaaguccuucccauacuc

SEQ ID NO: 934297 - RNA, 19 nt, Homo sapiens
guuuaucaucucacaguuu

SEQ ID NO: 934298 - RNA, 19 nt, Homo sapiens
caaacugagcaccuuagga

SEQ ID NO: 934299 - RNA, 19 nt, Homo sapiens
ggaaagcauggccucucuu

SEQ ID NO: 934300 - RNA, 19 nt, Homo sapiens
gugaacugguuacuuucug

SEQ ID NO: 934301 - RNA, 19 nt, Homo sapiens
gguggucagugagggaguu

SEQ ID NO: 934302 - RNA, 19 nt, Homo sapiens
uugcuggacugagacauga

SEQ ID NO: 934303 - RNA, 19 nt, Homo sapiens
cugcgaggauggagaucuu

SEQ ID NO: 934304 - RNA, 19 nt, Homo sapiens
guuacgcggugugugaaga

SEQ ID NO: 934305 - RNA, 19 nt, Homo sapiens
cauaucagcagcccagagu

SEQ ID NO: 934306 - RNA, 19 nt, Homo sapiens
cccaacagguggacuuguc

SEQ ID NO: 934307 - RNA, 19 nt, Homo sapiens
aaaguaggaagugaauuug

SEQ ID NO: 934308 - RNA, 19 nt, Homo sapiens
ucucugacaucuccugcau

SEQ ID NO: 934309 - RNA, 19 nt, Homo sapiens
ccacagccauggacauuua

SEQ ID NO: 934310 - RNA, 19 nt, Homo sapiens
ggacuaagacaaagauauu

SEQ ID NO: 934311 - RNA, 19 nt, Homo sapiens
gagcaggguucaugcauau

SEQ ID NO: 934312 - RNA, 19 nt, Homo sapiens
ggagcaggguucaugcaua

SEQ ID NO: 934313 - RNA, 19 nt, Homo sapiens
gauuacagcucccuuguca

SEQ ID NO: 934314 - RNA, 19 nt, Homo sapiens
gcaguguucuccauacuau

SEQ ID NO: 934315 - RNA, 19 nt, Homo sapiens
uaaauagcauucaguagga

SEQ ID NO: 934316 - RNA, 19 nt, Homo sapiens
gagcaacuacuaggaauaa

SEQ ID NO: 934317 - RNA, 19 nt, Homo sapiens
agacauuucuuuacucaga

SEQ ID NO: 934318 - RNA, 19 nt, Homo sapiens
gcugguaccuuccuguaug

SEQ ID NO: 934319 - RNA, 19 nt, Homo sapiens
guacagagacgcuccagau

SEQ ID NO: 934320 - RNA, 19 nt, Homo sapiens
uaugucaccuuccuagaaa

SEQ ID NO: 934321 - RNA, 19 nt, Homo sapiens
gaucagcaagugagagaaa

SEQ ID NO: 934322 - RNA, 19 nt, Homo sapiens
cagaacagaucagcaagug

SEQ ID NO: 934323 - RNA, 19 nt, Homo sapiens
cagagacgcuccagauuuu

SEQ ID NO: 934324 - RNA, 19 nt, Homo sapiens
ucagacauuucuuuacuca

SEQ ID NO: 934325 - RNA, 19 nt, Homo sapiens
acagagacgcuccagauuu

SEQ ID NO: 934326 - RNA, 19 nt, Homo sapiens
uuacagcucccuugucauu

SEQ ID NO: 934327 - RNA, 19 nt, Homo sapiens
ggagcaacuacuaggaaua

SEQ ID NO: 934328 - RNA, 19 nt, Homo sapiens
ucccugggcuucuuucuug

SEQ ID NO: 934329 - RNA, 19 nt, Homo sapiens
gacuaaauagcauucagua

SEQ ID NO: 934330 - RNA, 19 nt, Homo sapiens
guaugucaccuuccuagaa

SEQ ID NO: 934331 - RNA, 19 nt, Homo sapiens
gggcuucuuucuugucuuc

SEQ ID NO: 934332 - RNA, 19 nt, Homo sapiens
gcuuugacccucagacauu

SEQ ID NO: 934333 - RNA, 19 nt, Homo sapiens
acucugggcuguggccuua

SEQ ID NO: 934334 - RNA, 19 nt, Homo sapiens
guugagcagcuauuaauug

SEQ ID NO: 934335 - RNA, 19 nt, Homo sapiens
ccucagacauuucuuuacu

SEQ ID NO: 934336 - RNA, 19 nt, Homo sapiens
gguguuugguguaggaaug

SEQ ID NO: 934337 - RNA, 19 nt, Homo sapiens
uacaugagaucccauuucu

SEQ ID NO: 934338 - RNA, 19 nt, Homo sapiens
ccaacagccuccugaaacu

SEQ ID NO: 934339 - RNA, 19 nt, Homo sapiens
ccagguuuccuuuacauga

SEQ ID NO: 934340 - RNA, 19 nt, Homo sapiens
cgacagugcaggacgaaga

SEQ ID NO: 934341 - RNA, 19 nt, Homo sapiens
uggaggaaauugaaucaca

SEQ ID NO: 934342 - RNA, 19 nt, Homo sapiens
cugaagcccuggaggaaau

SEQ ID NO: 934343 - RNA, 19 nt, Homo sapiens
aguguucuccauacuauua

SEQ ID NO: 934344 - RNA, 19 nt, Homo sapiens
agagauggagcaacuacua

SEQ ID NO: 934345 - RNA, 19 nt, Homo sapiens
gcuccagauuuuauucuua

SEQ ID NO: 934346 - RNA, 19 nt, Homo sapiens
guguugaccaccuaagaua

SEQ ID NO: 934347 - RNA, 19 nt, Homo sapiens
gugcagaacagaucagcaa

SEQ ID NO: 934348 - RNA, 19 nt, Homo sapiens
gcuacuguguguaauaaaa

SEQ ID NO: 934349 - RNA, 19 nt, Homo sapiens
agaaguucauggugcagaa

SEQ ID NO: 934350 - RNA, 19 nt, Homo sapiens
gggcucauaucuucgaacu

SEQ ID NO: 934351 - RNA, 19 nt, Homo sapiens
uugcuguccuggcucauaa

SEQ ID NO: 934352 - RNA, 19 nt, Homo sapiens
gcagaacagaucagcaagu

SEQ ID NO: 934353 - RNA, 19 nt, Homo sapiens
gaggaaauugaaucacaga

SEQ ID NO: 934354 - RNA, 19 nt, Homo sapiens
uggagucgcuggcauugca

SEQ ID NO: 934355 - RNA, 19 nt, Homo sapiens
cuucaaaugguuccagauu

SEQ ID NO: 934356 - RNA, 19 nt, Homo sapiens
augcuacuguguguaauaa

SEQ ID NO: 934357 - RNA, 19 nt, Homo sapiens
cauuuaugcuacugugugu

SEQ ID NO: 934358 - RNA, 19 nt, Homo sapiens
uuacucagacuaaauagca

SEQ ID NO: 934359 - RNA, 19 nt, Homo sapiens
gagauggagcaacuacuag

SEQ ID NO: 934360 - RNA, 19 nt, Homo sapiens
gacccucagacauuucuuu

SEQ ID NO: 934361 - RNA, 19 nt, Homo sapiens
cagaucagcaagugagaga

SEQ ID NO: 934362 - RNA, 19 nt, Homo sapiens
cagcugguaccuuccugua

SEQ ID NO: 934363 - RNA, 19 nt, Homo sapiens
gacagugcaggacgaagaa

SEQ ID NO: 934364 - RNA, 19 nt, Homo sapiens
cuucuuucuugucuucuuu

SEQ ID NO: 934365 - RNA, 19 nt, Homo sapiens
uauggaguaucccuaugga

SEQ ID NO: 934366 - RNA, 19 nt, Homo sapiens
uucaaaugguuccagauug

SEQ ID NO: 934367 - RNA, 19 nt, Homo sapiens
uaugcuacuguguguaaua

SEQ ID NO: 934368 - RNA, 19 nt, Homo sapiens
cagcucauauggaguaucc

SEQ ID NO: 934369 - RNA, 19 nt, Homo sapiens
ucacagauucagaaguuca

SEQ ID NO: 934370 - RNA, 19 nt, Homo sapiens
uugagcagcuauuaauugg

SEQ ID NO: 934371 - RNA, 19 nt, Homo sapiens
gguugagcagcuauuaauu

SEQ ID NO: 934372 - RNA, 19 nt, Homo sapiens
gauggagcaacuacuagga

SEQ ID NO: 934373 - RNA, 19 nt, Homo sapiens
gggcaguguucuccauacu

SEQ ID NO: 934374 - RNA, 19 nt, Homo sapiens
cauuuacccucacccucaa

SEQ ID NO: 934375 - RNA, 19 nt, Homo sapiens
gcaacuacuaggaauaaaa

SEQ ID NO: 934376 - RNA, 19 nt, Homo sapiens
gcugaagcccuggaggaaa

SEQ ID NO: 934377 - RNA, 19 nt, Homo sapiens
uaccaacagccuccugaaa

SEQ ID NO: 934378 - RNA, 19 nt, Homo sapiens
uuucugauggaccuauuua

SEQ ID NO: 934379 - RNA, 19 nt, Homo sapiens
cugagagauuccuggcuuu

SEQ ID NO: 934380 - RNA, 19 nt, Homo sapiens
ggcaguguucuccauacua

SEQ ID NO: 934381 - RNA, 19 nt, Homo sapiens
uggagcaacuacuaggaau

SEQ ID NO: 934382 - RNA, 19 nt, Homo sapiens
agacuccugggcuguauuu

SEQ ID NO: 934383 - RNA, 19 nt, Homo sapiens
acucccaucugcuucaaau

SEQ ID NO: 934384 - RNA, 19 nt, Homo sapiens
uuuaugcuacuguguguaa

SEQ ID NO: 934385 - RNA, 19 nt, Homo sapiens
gcuaaguggagcuguguag

SEQ ID NO: 934386 - RNA, 19 nt, Homo sapiens
ucauauggaguaucccuau

SEQ ID NO: 934387 - RNA, 19 nt, Homo sapiens
ucagacuccugggcuguau

SEQ ID NO: 934388 - RNA, 19 nt, Homo sapiens
gcagcuauuaauuggagaa

SEQ ID NO: 934389 - RNA, 19 nt, Homo sapiens
cacccuggacuaagacaaa

SEQ ID NO: 934390 - RNA, 19 nt, Homo sapiens
uuacaugagaucccauuuc

SEQ ID NO: 934391 - RNA, 19 nt, Homo sapiens
cagguuuccuuuacaugag

SEQ ID NO: 934392 - RNA, 19 nt, Homo sapiens
cuugugggccugagagauu

SEQ ID NO: 934393 - RNA, 19 nt, Homo sapiens
acagcucccuugucauucu

SEQ ID NO: 934394 - RNA, 19 nt, Homo sapiens
uuagguugagcagcuauua

SEQ ID NO: 934395 - RNA, 19 nt, Homo sapiens
cuuugacccucagacauuu

SEQ ID NO: 934396 - RNA, 19 nt, Homo sapiens
gcuucuuucuugucuucuu

SEQ ID NO: 934397 - RNA, 19 nt, Homo sapiens
auucagcucauauggagua

SEQ ID NO: 934398 - RNA, 19 nt, Homo sapiens
ucagcaagugagagaaauu

SEQ ID NO: 934399 - RNA, 19 nt, Homo sapiens
uagguugagcagcuauuaa

SEQ ID NO: 934400 - RNA, 19 nt, Homo sapiens
caaagauauuuagguugag

SEQ ID NO: 934401 - RNA, 19 nt, Homo sapiens
cagcaagugagagaaauuc

SEQ ID NO: 934402 - RNA, 19 nt, Homo sapiens
cggcuagugcauuuaggua

SEQ ID NO: 934403 - RNA, 19 nt, Homo sapiens
ccacuccugcuccaaagau

SEQ ID NO: 934404 - RNA, 19 nt, Homo sapiens
cuccugggcuguauuucug

SEQ ID NO: 934405 - RNA, 19 nt, Homo sapiens
gaaagacucuggaacaaau

SEQ ID NO: 934406 - RNA, 19 nt, Homo sapiens
gaacaaaucacagcccauu

SEQ ID NO: 934407 - RNA, 19 nt, Homo sapiens
caucagccaucaaaucuug

SEQ ID NO: 934408 - RNA, 19 nt, Homo sapiens
aauaaagacugacacagaa

SEQ ID NO: 934409 - RNA, 19 nt, Homo sapiens
ggaaagacucuggaacaaa

SEQ ID NO: 934410 - RNA, 19 nt, Homo sapiens
ggucaacgccgucauguuc

SEQ ID NO: 934411 - RNA, 19 nt, Homo sapiens
cagccaagcuuacccuuca

SEQ ID NO: 934412 - RNA, 19 nt, Homo sapiens
gcagagaccaucuuugaag

SEQ ID NO: 934413 - RNA, 19 nt, Homo sapiens
aaauaaagacugacacaga

SEQ ID NO: 934414 - RNA, 19 nt, Homo sapiens
ggaacaccuucgagcuuug

SEQ ID NO: 934415 - RNA, 19 nt, Homo sapiens
ggauggagcaagccuguga

SEQ ID NO: 934416 - RNA, 19 nt, Homo sapiens
gaugacagccacucacuag

SEQ ID NO: 934417 - RNA, 19 nt, Homo sapiens
ucaacgccgucauguucua

SEQ ID NO: 934418 - RNA, 19 nt, Homo sapiens
ggucaucagccaucaaauc

SEQ ID NO: 934419 - RNA, 19 nt, Homo sapiens
gaucuucccucugcauguc

SEQ ID NO: 934420 - RNA, 19 nt, Homo sapiens
ucacgcggcugccuuaucg

SEQ ID NO: 934421 - RNA, 19 nt, Homo sapiens
cuacaagcccuucaucauc

SEQ ID NO: 934422 - RNA, 19 nt, Homo sapiens
aggaacaccuucgagcuuu

SEQ ID NO: 934423 - RNA, 19 nt, Homo sapiens
uaaaggaaagacucuggaa

SEQ ID NO: 934424 - RNA, 19 nt, Homo sapiens
ccucuaggaucuuugucuu

SEQ ID NO: 934425 - RNA, 19 nt, Homo sapiens
agucauuucuggcuacuuc

SEQ ID NO: 934426 - RNA, 19 nt, Homo sapiens
ccaaauaaagacugacaca

SEQ ID NO: 934427 - RNA, 19 nt, Homo sapiens
ucaguucccugggucauca

SEQ ID NO: 934428 - RNA, 19 nt, Homo sapiens
gucagugucucugggcuuu

SEQ ID NO: 934429 - RNA, 19 nt, Homo sapiens
aggaaagacucuggaacaa

SEQ ID NO: 934430 - RNA, 19 nt, Homo sapiens
gggcugagcagagcuuuca

SEQ ID NO: 934431 - RNA, 19 nt, Homo sapiens
ugugcaagcucaguuugaa

SEQ ID NO: 934432 - RNA, 19 nt, Homo sapiens
augcagagaccaucuuuga

SEQ ID NO: 934433 - RNA, 19 nt, Homo sapiens
gcaucugcguccucaccaa

SEQ ID NO: 934434 - RNA, 19 nt, Homo sapiens
uggcggcucucaucaugga

SEQ ID NO: 934435 - RNA, 19 nt, Homo sapiens
gcuccugugugcagcuaau

SEQ ID NO: 934436 - RNA, 19 nt, Homo sapiens
caggaacaccuucgagcuu

SEQ ID NO: 934437 - RNA, 19 nt, Homo sapiens
aaggaaagacucuggaaca

SEQ ID NO: 934438 - RNA, 19 nt, Homo sapiens
ggaguucagcagccucaug

SEQ ID NO: 934439 - RNA, 19 nt, Homo sapiens
uguggcggcucucaucaug

SEQ ID NO: 934440 - RNA, 19 nt, Homo sapiens
aggacacccuguggcuuua

SEQ ID NO: 934441 - RNA, 19 nt, Homo sapiens
gaagucauuucuggcuacu

SEQ ID NO: 934442 - RNA, 19 nt, Homo sapiens
ucuaggaucuuugucuucu

SEQ ID NO: 934443 - RNA, 19 nt, Homo sapiens
agacuaaagcagcggaaga

SEQ ID NO: 934444 - RNA, 19 nt, Homo sapiens
cagcaugugccucuucauc

SEQ ID NO: 934445 - RNA, 19 nt, Homo sapiens
cagguguggucaugguguu

SEQ ID NO: 934446 - RNA, 19 nt, Homo sapiens
ggucuacaucuccgaaauc

SEQ ID NO: 934447 - RNA, 19 nt, Homo sapiens
ucgggaaggaaauuuguuu

SEQ ID NO: 934448 - RNA, 19 nt, Homo sapiens
cugugucccugaaacuaaa

SEQ ID NO: 934449 - RNA, 19 nt, Homo sapiens
gugcaagcucaguuugaaa

SEQ ID NO: 934450 - RNA, 19 nt, Homo sapiens
gaaaaucaggucagugucu

SEQ ID NO: 934451 - RNA, 19 nt, Homo sapiens
gugggccucuaggaucuuu

SEQ ID NO: 934452 - RNA, 19 nt, Homo sapiens
aaacuaaaggaaagacucu

SEQ ID NO: 934453 - RNA, 19 nt, Homo sapiens
gucaucagccaucaaaucu

SEQ ID NO: 934454 - RNA, 19 nt, Homo sapiens
auaaagacugacacagaaa

SEQ ID NO: 934455 - RNA, 19 nt, Homo sapiens
guugggugcugggcauuca

SEQ ID NO: 934456 - RNA, 19 nt, Homo sapiens
ccuccaugcgcaagacuaa

SEQ ID NO: 934457 - RNA, 19 nt, Homo sapiens
cgaugacagccacucacua

SEQ ID NO: 934458 - RNA, 19 nt, Homo sapiens
ucugugucccugaaacuaa

SEQ ID NO: 934459 - RNA, 19 nt, Homo sapiens
ccaccugacuccaaauaaa

SEQ ID NO: 934460 - RNA, 19 nt, Homo sapiens
gggaggcccuggaagaauu

SEQ ID NO: 934461 - RNA, 19 nt, Homo sapiens
gcaggaagcucauguaccu

SEQ ID NO: 934462 - RNA, 19 nt, Homo sapiens
ggaggagccuggcaaauac

SEQ ID NO: 934463 - RNA, 19 nt, Homo sapiens
gcaaauacagcgccuaugg

SEQ ID NO: 934464 - RNA, 19 nt, Homo sapiens
ccacccaccugacuccaaa

SEQ ID NO: 934465 - RNA, 19 nt, Homo sapiens
cggaggagccuggcaaaua

SEQ ID NO: 934466 - RNA, 19 nt, Homo sapiens
gagggaccacuacaucuuu

SEQ ID NO: 934467 - RNA, 19 nt, Homo sapiens
ggagggaccacuacaucuu

SEQ ID NO: 934468 - RNA, 19 nt, Homo sapiens
gaaagcuuguggguaggaa

SEQ ID NO: 934469 - RNA, 19 nt, Homo sapiens
gguggucgauaaggacuuu

SEQ ID NO: 934470 - RNA, 19 nt, Homo sapiens
gaucggugcauccagaaga

SEQ ID NO: 934471 - RNA, 19 nt, Homo sapiens
ccuggaagaauuuaagaaa

SEQ ID NO: 934472 - RNA, 19 nt, Homo sapiens
guggguaggaauucugaua

SEQ ID NO: 934473 - RNA, 19 nt, Homo sapiens
guaggaauucugauaccaa

SEQ ID NO: 934474 - RNA, 19 nt, Homo sapiens
ggaggaggaggauaucaca

SEQ ID NO: 934475 - RNA, 19 nt, Homo sapiens
ggaggcccuggaagaauuu

SEQ ID NO: 934476 - RNA, 19 nt, Homo sapiens
ccaugguggucgauaagga

SEQ ID NO: 934477 - RNA, 19 nt, Homo sapiens
ggagaugaagacccuguuc

SEQ ID NO: 934478 - RNA, 19 nt, Homo sapiens
ggaaagcuuguggguagga

SEQ ID NO: 934479 - RNA, 19 nt, Homo sapiens
ggaaguuggaagccacguu

SEQ ID NO: 934480 - RNA, 19 nt, Homo sapiens
cuacaucuuuuacugcaaa

SEQ ID NO: 934481 - RNA, 19 nt, Homo sapiens
aggccaugguggucgauaa

SEQ ID NO: 934482 - RNA, 19 nt, Homo sapiens
caggagggaccacuacauc

SEQ ID NO: 934483 - RNA, 19 nt, Homo sapiens
gguguuaucuccugaguua

SEQ ID NO: 934484 - RNA, 19 nt, Homo sapiens
ggagaagggauguguauua

SEQ ID NO: 934485 - RNA, 19 nt, Homo sapiens
gaaagggucccaaguggua

SEQ ID NO: 934486 - RNA, 19 nt, Homo sapiens
gaacuccacugaauuaaac

SEQ ID NO: 934487 - RNA, 19 nt, Homo sapiens
agaauggacucuacgcuua

SEQ ID NO: 934488 - RNA, 19 nt, Homo sapiens
gggaauaaauagcgugaaa

SEQ ID NO: 934489 - RNA, 19 nt, Homo sapiens
gauagggucucaccauguu

SEQ ID NO: 934490 - RNA, 19 nt, Homo sapiens
ggucugaacuccacugaau

SEQ ID NO: 934491 - RNA, 19 nt, Homo sapiens
gaauaaauagcgugaaaug

SEQ ID NO: 934492 - RNA, 19 nt, Homo sapiens
cauccacacugcaaugaua

SEQ ID NO: 934493 - RNA, 19 nt, Homo sapiens
cgucauagcuggaaacagu

SEQ ID NO: 934494 - RNA, 19 nt, Homo sapiens
ggauuucccugacugaaga

SEQ ID NO: 934495 - RNA, 19 nt, Homo sapiens
caacacaguuccucugaca

SEQ ID NO: 934496 - RNA, 19 nt, Homo sapiens
ggaggagaguuaccuacaa

SEQ ID NO: 934497 - RNA, 19 nt, Homo sapiens
gagaagggauguguauuag

SEQ ID NO: 934498 - RNA, 19 nt, Homo sapiens
gcccacagcugccuacaga

SEQ ID NO: 934499 - RNA, 19 nt, Homo sapiens
gguccaagcuaccuuuaug

SEQ ID NO: 934500 - RNA, 19 nt, Homo sapiens
gcaaagggcacucagaauc

SEQ ID NO: 934501 - RNA, 19 nt, Homo sapiens
gaauuaaaccacuggcauu

SEQ ID NO: 934502 - RNA, 19 nt, Homo sapiens
ggcccucacugucacuuua

SEQ ID NO: 934503 - RNA, 19 nt, Homo sapiens
uaugguggcugucuucuau

SEQ ID NO: 934504 - RNA, 19 nt, Homo sapiens
ggaccagucuguguauuuc

SEQ ID NO: 934505 - RNA, 19 nt, Homo sapiens
cuaaagugcuggccucuca

SEQ ID NO: 934506 - RNA, 19 nt, Homo sapiens
gccaagcagugacuucuga

SEQ ID NO: 934507 - RNA, 19 nt, Homo sapiens
gcacauggcagcuuugucu

SEQ ID NO: 934508 - RNA, 19 nt, Homo sapiens
gaagggaaucagccacuuu

SEQ ID NO: 934509 - RNA, 19 nt, Homo sapiens
cuccaaaucuugcugcuuu

SEQ ID NO: 934510 - RNA, 19 nt, Homo sapiens
ggaccagucuguguacuuc

SEQ ID NO: 934511 - RNA, 19 nt, Homo sapiens
ggaaggaggaccagucugu

SEQ ID NO: 934512 - RNA, 19 nt, Homo sapiens
ggaaggaggaccagucugu

SEQ ID NO: 934513 - RNA, 19 nt, Homo sapiens
agaaggaaguggcuguuug

SEQ ID NO: 934514 - RNA, 19 nt, Homo sapiens
gaggagaguuaccuacaag

SEQ ID NO: 934515 - RNA, 19 nt, Homo sapiens
agacaucugugccucauuc

SEQ ID NO: 934516 - RNA, 19 nt, Homo sapiens
gguccuggccucacucuuu

SEQ ID NO: 934517 - RNA, 19 nt, Homo sapiens
gagcaggcccucacuguca

SEQ ID NO: 934518 - RNA, 19 nt, Homo sapiens
acacugcaaugauauagga

SEQ ID NO: 934519 - RNA, 19 nt, Homo sapiens
caaagggcacucagaauca

SEQ ID NO: 934520 - RNA, 19 nt, Homo sapiens
ucugaacuccacugaauua

SEQ ID NO: 934521 - RNA, 19 nt, Homo sapiens
ucagaaucauggcaccuaa

SEQ ID NO: 934522 - RNA, 19 nt, Homo sapiens
ggaccaaacucaccaucac

SEQ ID NO: 934523 - RNA, 19 nt, Homo sapiens
caagugguacaucgucaua

SEQ ID NO: 934524 - RNA, 19 nt, Homo sapiens
gcaaugauauaggaaugag

SEQ ID NO: 934525 - RNA, 19 nt, Homo sapiens
ggcaagggccagccuguuu

SEQ ID NO: 934526 - RNA, 19 nt, Homo sapiens
ugaagaagaaagcaacaaa

SEQ ID NO: 934527 - RNA, 19 nt, Homo sapiens
gaucagggaggcagcaguu

SEQ ID NO: 934528 - RNA, 19 nt, Homo sapiens
ucucaaaccugcggaagga

SEQ ID NO: 934529 - RNA, 19 nt, Homo sapiens
ggcaaaacauccaaagaaa

SEQ ID NO: 934530 - RNA, 19 nt, Homo sapiens
cggaggacgugaugugaga

SEQ ID NO: 934531 - RNA, 19 nt, Homo sapiens
ugaaccggcucuuucugaa

SEQ ID NO: 934532 - RNA, 19 nt, Homo sapiens
gcagacaagaagacaagaa

SEQ ID NO: 934533 - RNA, 19 nt, Homo sapiens
ccaaugaucuuuucaaugc

SEQ ID NO: 934534 - RNA, 19 nt, Homo sapiens
aaagaaagggucccaagug

SEQ ID NO: 934535 - RNA, 19 nt, Homo sapiens
ucaaugagagagaccauga

SEQ ID NO: 934536 - RNA, 19 nt, Homo sapiens
gcagcuuugucucuguuga

SEQ ID NO: 934537 - RNA, 19 nt, Homo sapiens
gaagaaagcaacaaaacga

SEQ ID NO: 934538 - RNA, 19 nt, Homo sapiens
ggaggugugaguacaaguu

SEQ ID NO: 934539 - RNA, 19 nt, Homo sapiens
gaaggaaguggcuguuugg

SEQ ID NO: 934540 - RNA, 19 nt, Homo sapiens
gagaaggaaguggcuguuu

SEQ ID NO: 934541 - RNA, 19 nt, Homo sapiens
caugaggucugccggaagu

SEQ ID NO: 934542 - RNA, 19 nt, Homo sapiens
uuaaaccacuggcauuugg

SEQ ID NO: 934543 - RNA, 19 nt, Homo sapiens
gcacugagagcacgagcau

SEQ ID NO: 934544 - RNA, 19 nt, Homo sapiens
cagacaagaagacaagaaa

SEQ ID NO: 934545 - RNA, 19 nt, Homo sapiens
aaaccuauucugagcgaua

SEQ ID NO: 934546 - RNA, 19 nt, Homo sapiens
acagaaccgucccaaaaua

SEQ ID NO: 934547 - RNA, 19 nt, Homo sapiens
guuaaaaugugaagggauu

SEQ ID NO: 934548 - RNA, 19 nt, Homo sapiens
gcaagggccagccuguuuc

SEQ ID NO: 934549 - RNA, 19 nt, Homo sapiens
gagcauccacacugcaaug

SEQ ID NO: 934550 - RNA, 19 nt, Homo sapiens
gaagaagaaagcaacaaaa

SEQ ID NO: 934551 - RNA, 19 nt, Homo sapiens
caaagaaagggucccaagu

SEQ ID NO: 934552 - RNA, 19 nt, Homo sapiens
gaggcugggucccugaauc

SEQ ID NO: 934553 - RNA, 19 nt, Homo sapiens
gaggaccagucuguguauu

SEQ ID NO: 934554 - RNA, 19 nt, Homo sapiens
ggaggaccagucuguguau

SEQ ID NO: 934555 - RNA, 19 nt, Homo sapiens
ggaauaaauagcgugaaau

SEQ ID NO: 934556 - RNA, 19 nt, Homo sapiens
ugaacuccacugaauuaaa

SEQ ID NO: 934557 - RNA, 19 nt, Homo sapiens
gcaccuaagucuggacacu

SEQ ID NO: 934558 - RNA, 19 nt, Homo sapiens
cagcagcacaaccaccaua

SEQ ID NO: 934559 - RNA, 19 nt, Homo sapiens
gugaaccggcucuuucuga

SEQ ID NO: 934560 - RNA, 19 nt, Homo sapiens
ccucauuccugaucucaag

SEQ ID NO: 934561 - RNA, 19 nt, Homo sapiens
ggacuccaguaccgugaag

SEQ ID NO: 934562 - RNA, 19 nt, Homo sapiens
ggccuuggcugugcuucuu

SEQ ID NO: 934563 - RNA, 19 nt, Homo sapiens
acucggcacuggccacuug

SEQ ID NO: 934564 - RNA, 19 nt, Homo sapiens
aagcaaagggcacucagaa

SEQ ID NO: 934565 - RNA, 19 nt, Homo sapiens
uaagucagcaacacaguuc

SEQ ID NO: 934566 - RNA, 19 nt, Homo sapiens
uauuauagcagugcaaaga

SEQ ID NO: 934567 - RNA, 19 nt, Homo sapiens
uggaggagaaggaaaggua

SEQ ID NO: 934568 - RNA, 19 nt, Homo sapiens
ucucgaaccugcggaagga

SEQ ID NO: 934569 - RNA, 19 nt, Homo sapiens
gaauggacucuacgcuuag

SEQ ID NO: 934570 - RNA, 19 nt, Homo sapiens
ggcugucgcugugcucaaa

SEQ ID NO: 934571 - RNA, 19 nt, Homo sapiens
ggacccaccucaccaucac

SEQ ID NO: 934572 - RNA, 19 nt, Homo sapiens
ccuuaggaguucaaugaga

SEQ ID NO: 934573 - RNA, 19 nt, Homo sapiens
guuggugucuggcgguuuc

SEQ ID NO: 934574 - RNA, 19 nt, Homo sapiens
gcugacaacaugaagacuu

SEQ ID NO: 934575 - RNA, 19 nt, Homo sapiens
gggaaucagccacuuugug

SEQ ID NO: 934576 - RNA, 19 nt, Homo sapiens
cuacagaaccgucccaaaa

SEQ ID NO: 934577 - RNA, 19 nt, Homo sapiens
gcaaagccgcaaggcagaa

SEQ ID NO: 934578 - RNA, 19 nt, Homo sapiens
gcacccugaggaccuuuaa

SEQ ID NO: 934579 - RNA, 19 nt, Homo sapiens
gaaauccccuucuccuucu

SEQ ID NO: 934580 - RNA, 19 nt, Homo sapiens
acacaguuccucugacaug

SEQ ID NO: 934581 - RNA, 19 nt, Homo sapiens
gagcagcaucucucucauc

SEQ ID NO: 934582 - RNA, 19 nt, Homo sapiens
gaguacaaguucggaugga

SEQ ID NO: 934583 - RNA, 19 nt, Homo sapiens
gguguuaucuccugaguua

SEQ ID NO: 934584 - RNA, 19 nt, Homo sapiens
ggagaagggauguguauua

SEQ ID NO: 934585 - RNA, 19 nt, Homo sapiens
gaaagggucccaaguggua

SEQ ID NO: 934586 - RNA, 19 nt, Homo sapiens
gaacuccacugaauuaaac

SEQ ID NO: 934587 - RNA, 19 nt, Homo sapiens
gggaauaaauagcgugaaa

SEQ ID NO: 934588 - RNA, 19 nt, Homo sapiens
gauagggucucaccauguu

SEQ ID NO: 934589 - RNA, 19 nt, Homo sapiens
ggucugaacuccacugaau

SEQ ID NO: 934590 - RNA, 19 nt, Homo sapiens
gaauaaauagcgugaaaug

SEQ ID NO: 934591 - RNA, 19 nt, Homo sapiens
cauccacacugcaaugaua

SEQ ID NO: 934592 - RNA, 19 nt, Homo sapiens
cgucauagcuggaaacagu

SEQ ID NO: 934593 - RNA, 19 nt, Homo sapiens
ggaccacgcuggcuguguu

SEQ ID NO: 934594 - RNA, 19 nt, Homo sapiens
ggauuucccugacugaaga

SEQ ID NO: 934595 - RNA, 19 nt, Homo sapiens
ggaggagaguuaccuacaa

SEQ ID NO: 934596 - RNA, 19 nt, Homo sapiens
gagaagggauguguauuag

SEQ ID NO: 934597 - RNA, 19 nt, Homo sapiens
gcccacagcugccuacaga

SEQ ID NO: 934598 - RNA, 19 nt, Homo sapiens
gcaaagggcacucagaauc

SEQ ID NO: 934599 - RNA, 19 nt, Homo sapiens
gaacuuggcauccagcaau

SEQ ID NO: 934600 - RNA, 19 nt, Homo sapiens
gaauuaaaccacuggcauu

SEQ ID NO: 934601 - RNA, 19 nt, Homo sapiens
uaugguggcugucuucuau

SEQ ID NO: 934602 - RNA, 19 nt, Homo sapiens
ggaccagucuguguauuuc

SEQ ID NO: 934603 - RNA, 19 nt, Homo sapiens
cuaaagugcuggccucuca

SEQ ID NO: 934604 - RNA, 19 nt, Homo sapiens
gccaagcagugacuucuga

SEQ ID NO: 934605 - RNA, 19 nt, Homo sapiens
gaagggaaucagccacuuu

SEQ ID NO: 934606 - RNA, 19 nt, Homo sapiens
cuccaaaucuugcugcuuu

SEQ ID NO: 934607 - RNA, 19 nt, Homo sapiens
ggaccagucuguguacuuc

SEQ ID NO: 934608 - RNA, 19 nt, Homo sapiens
ggaaggaggaccagucugu

SEQ ID NO: 934609 - RNA, 19 nt, Homo sapiens
ggaaggaggaccagucugu

SEQ ID NO: 934610 - RNA, 19 nt, Homo sapiens
agaaggaaguggcuguuug

SEQ ID NO: 934611 - RNA, 19 nt, Homo sapiens
gaggagaguuaccuacaag

SEQ ID NO: 934612 - RNA, 19 nt, Homo sapiens
agacaucugugccucauuc

SEQ ID NO: 934613 - RNA, 19 nt, Homo sapiens
acacugcaaugauauagga

SEQ ID NO: 934614 - RNA, 19 nt, Homo sapiens
caaagggcacucagaauca

SEQ ID NO: 934615 - RNA, 19 nt, Homo sapiens
ucugaacuccacugaauua

SEQ ID NO: 934616 - RNA, 19 nt, Homo sapiens
ucagaaucauggcaccuaa

SEQ ID NO: 934617 - RNA, 19 nt, Homo sapiens
ggaccaaacucaccaucac

SEQ ID NO: 934618 - RNA, 19 nt, Homo sapiens
caagugguacaucgucaua

SEQ ID NO: 934619 - RNA, 19 nt, Homo sapiens
gcaaugauauaggaaugag

SEQ ID NO: 934620 - RNA, 19 nt, Homo sapiens
ggcaagggccagccuguuu

SEQ ID NO: 934621 - RNA, 19 nt, Homo sapiens
ugaagaagaaagcaacaaa

SEQ ID NO: 934622 - RNA, 19 nt, Homo sapiens
gaucagggaggcagcaguu

SEQ ID NO: 934623 - RNA, 19 nt, Homo sapiens
ucucaaaccugcggaagga

SEQ ID NO: 934624 - RNA, 19 nt, Homo sapiens
ggcaaaacauccaaagaaa

SEQ ID NO: 934625 - RNA, 19 nt, Homo sapiens
cggaggacgugaugugaga

SEQ ID NO: 934626 - RNA, 19 nt, Homo sapiens
ugaaccggcucuuucugaa

SEQ ID NO: 934627 - RNA, 19 nt, Homo sapiens
gcagacaagaagacaagaa

SEQ ID NO: 934628 - RNA, 19 nt, Homo sapiens
ccaaugaucuuuucaaugc

SEQ ID NO: 934629 - RNA, 19 nt, Homo sapiens
aaagaaagggucccaagug

SEQ ID NO: 934630 - RNA, 19 nt, Homo sapiens
ggaggugugaguacaaguu

SEQ ID NO: 934631 - RNA, 19 nt, Homo sapiens
gaaggaaguggcuguuugg

SEQ ID NO: 934632 - RNA, 19 nt, Homo sapiens
gaagaaagcaacaaaacga

SEQ ID NO: 934633 - RNA, 19 nt, Homo sapiens
gagaaggaaguggcuguuu

SEQ ID NO: 934634 - RNA, 19 nt, Homo sapiens
caugaggucugccggaagu

SEQ ID NO: 934635 - RNA, 19 nt, Homo sapiens
uuaaaccacuggcauuugg

SEQ ID NO: 934636 - RNA, 19 nt, Homo sapiens
cagacaagaagacaagaaa

SEQ ID NO: 934637 - RNA, 19 nt, Homo sapiens
gcacugagagcacgagcau

SEQ ID NO: 934638 - RNA, 19 nt, Homo sapiens
aaaccuauucugagcgaua

SEQ ID NO: 934639 - RNA, 19 nt, Homo sapiens
acagaaccgucccaaaaua

SEQ ID NO: 934640 - RNA, 19 nt, Homo sapiens
guuaaaaugugaagggauu

SEQ ID NO: 934641 - RNA, 19 nt, Homo sapiens
gcaagggccagccuguuuc

SEQ ID NO: 934642 - RNA, 19 nt, Homo sapiens
gagcauccacacugcaaug

SEQ ID NO: 934643 - RNA, 19 nt, Homo sapiens
gaagaagaaagcaacaaaa

SEQ ID NO: 934644 - RNA, 19 nt, Homo sapiens
caaagaaagggucccaagu

SEQ ID NO: 934645 - RNA, 19 nt, Homo sapiens
gaggcugggucccugaauc

SEQ ID NO: 934646 - RNA, 19 nt, Homo sapiens
gaggaccagucuguguauu

SEQ ID NO: 934647 - RNA, 19 nt, Homo sapiens
ggaggaccagucuguguau

SEQ ID NO: 934648 - RNA, 19 nt, Homo sapiens
ggaauaaauagcgugaaau

SEQ ID NO: 934649 - RNA, 19 nt, Homo sapiens
ugaacuccacugaauuaaa

SEQ ID NO: 934650 - RNA, 19 nt, Homo sapiens
gcaccuaagucuggacacu

SEQ ID NO: 934651 - RNA, 19 nt, Homo sapiens
cagcagcacaaccaccaua

SEQ ID NO: 934652 - RNA, 19 nt, Homo sapiens
gugaaccggcucuuucuga

SEQ ID NO: 934653 - RNA, 19 nt, Homo sapiens
ccucauuccugaucucaag

SEQ ID NO: 934654 - RNA, 19 nt, Homo sapiens
ggacuccaguaccgugaag

SEQ ID NO: 934655 - RNA, 19 nt, Homo sapiens
acucggcacuggccacuug

SEQ ID NO: 934656 - RNA, 19 nt, Homo sapiens
aagcaaagggcacucagaa

SEQ ID NO: 934657 - RNA, 19 nt, Homo sapiens
uauuauagcagugcaaaga

SEQ ID NO: 934658 - RNA, 19 nt, Homo sapiens
uggaggagaaggaaaggua

SEQ ID NO: 934659 - RNA, 19 nt, Homo sapiens
ucucgaaccugcggaagga

SEQ ID NO: 934660 - RNA, 19 nt, Homo sapiens
guuggugucuggcgguuuc

SEQ ID NO: 934661 - RNA, 19 nt, Homo sapiens
ggcugucgcugugcucaaa

SEQ ID NO: 934662 - RNA, 19 nt, Homo sapiens
ggacccaccucaccaucac

SEQ ID NO: 934663 - RNA, 19 nt, Homo sapiens
gcugacaacaugaagacuu

SEQ ID NO: 934664 - RNA, 19 nt, Homo sapiens
gggaaucagccacuuugug

SEQ ID NO: 934665 - RNA, 19 nt, Homo sapiens
cuacagaaccgucccaaaa

SEQ ID NO: 934666 - RNA, 19 nt, Homo sapiens
gcaaagccgcaaggcagaa

SEQ ID NO: 934667 - RNA, 19 nt, Homo sapiens
gcacccugaggaccuuuaa

SEQ ID NO: 934668 - RNA, 19 nt, Homo sapiens
gagcagcaucucucucauc

SEQ ID NO: 934669 - RNA, 19 nt, Homo sapiens
gaguacaaguucggaugga

SEQ ID NO: 934670 - RNA, 19 nt, Homo sapiens
ggagaguuaccuacaagag

SEQ ID NO: 934671 - RNA, 19 nt, Homo sapiens
caagaagacaagaaaauga

SEQ ID NO: 934672 - RNA, 19 nt, Homo sapiens
guggcuaccuccuucaucu

SEQ ID NO: 934673 - RNA, 19 nt, Homo sapiens
caccuucugcugcaaguuu

SEQ ID NO: 934674 - RNA, 19 nt, Homo sapiens
ccaucucccuggugacugu

SEQ ID NO: 934675 - RNA, 19 nt, Homo sapiens
gcaacaaaacgaccacuga

SEQ ID NO: 934676 - RNA, 19 nt, Homo sapiens
ccggucaccuccaaaucuu

SEQ ID NO: 934677 - RNA, 19 nt, Homo sapiens
gagcccaccugcauguacu

SEQ ID NO: 934678 - RNA, 19 nt, Homo sapiens
ugagagucuucaguuacua

SEQ ID NO: 934679 - RNA, 19 nt, Homo sapiens
cccaaaauauggcaaagaa

SEQ ID NO: 934680 - RNA, 19 nt, Homo sapiens
cugcaaugauauaggaaug

SEQ ID NO: 934681 - RNA, 19 nt, Homo sapiens
cagccuggauuaugugaac

SEQ ID NO: 934682 - RNA, 19 nt, Homo sapiens
cagcuggacauacagauca

SEQ ID NO: 934683 - RNA, 19 nt, Homo sapiens
ggaggagccuggcaaauuc

SEQ ID NO: 934684 - RNA, 19 nt, Homo sapiens
gcaggaagcucauauaccu

SEQ ID NO: 934685 - RNA, 19 nt, Homo sapiens
ccaccugacuccaaauaaa

SEQ ID NO: 934686 - RNA, 19 nt, Homo sapiens
ccacccaccugacuccaaa

SEQ ID NO: 934687 - RNA, 19 nt, Homo sapiens
uggaggcccuggaagaauu

SEQ ID NO: 934688 - RNA, 19 nt, Homo sapiens
gaaagcuuguggguaggaa

SEQ ID NO: 934689 - RNA, 19 nt, Homo sapiens
gguggucgauaaggacuuu

SEQ ID NO: 934690 - RNA, 19 nt, Homo sapiens
cggaggagccuggcaaauu

SEQ ID NO: 934691 - RNA, 19 nt, Homo sapiens
gaucggugcauccagaaga

SEQ ID NO: 934692 - RNA, 19 nt, Homo sapiens
gggaagcugcguucucgaa

SEQ ID NO: 934693 - RNA, 19 nt, Homo sapiens
ccuggaagaauuuaagaaa

SEQ ID NO: 934694 - RNA, 19 nt, Homo sapiens
gcaaauucagcgccuaugg

SEQ ID NO: 934695 - RNA, 19 nt, Homo sapiens
ggaggaggaggauaucaca

SEQ ID NO: 934696 - RNA, 19 nt, Homo sapiens
ggaggcccuggaagaauuu

SEQ ID NO: 934697 - RNA, 19 nt, Homo sapiens
ccaugguggucgauaagga

SEQ ID NO: 934698 - RNA, 19 nt, Homo sapiens
ggagaugaagacccuguuc

SEQ ID NO: 934699 - RNA, 19 nt, Homo sapiens
caaccuggaggcccuggaa

SEQ ID NO: 934700 - RNA, 19 nt, Homo sapiens
ggaaagcuuguggguagga

SEQ ID NO: 934701 - RNA, 19 nt, Homo sapiens
gggcaggaagcucauauac

SEQ ID NO: 934702 - RNA, 19 nt, Homo sapiens
aggccaugguggucgauaa

SEQ ID NO: 934703 - RNA, 19 nt, Homo sapiens
gaggagccuggcaaauuca

SEQ ID NO: 934704 - RNA, 19 nt, Homo sapiens
ggacagcccucucaagacu

SEQ ID NO: 934705 - RNA, 19 nt, Homo sapiens
gguccaagcuaccuuuaug

SEQ ID NO: 934706 - RNA, 19 nt, Homo sapiens
aaauacagaucccaagcua

SEQ ID NO: 934707 - RNA, 19 nt, Homo sapiens
gagaauaucaggaaugaag

SEQ ID NO: 934708 - RNA, 19 nt, Homo sapiens
gaggagccauaugagaaua

SEQ ID NO: 934709 - RNA, 19 nt, Homo sapiens
ggaccagucuguguauuuc

SEQ ID NO: 934710 - RNA, 19 nt, Homo sapiens
acacagaggagccauauga

SEQ ID NO: 934711 - RNA, 19 nt, Homo sapiens
ggacagagggucagaagag

SEQ ID NO: 934712 - RNA, 19 nt, Homo sapiens
auacagaucccaagcuaaa

SEQ ID NO: 934713 - RNA, 19 nt, Homo sapiens
cagaggagccauaugagaa

SEQ ID NO: 934714 - RNA, 19 nt, Homo sapiens
ggaccaaacucuccaucac

SEQ ID NO: 934715 - RNA, 19 nt, Homo sapiens
ccagauggauaaaggaagu

SEQ ID NO: 934716 - RNA, 19 nt, Homo sapiens
caagugagcccaggaguuc

SEQ ID NO: 934717 - RNA, 19 nt, Homo sapiens
uuaaaggccuaaccaaugg

SEQ ID NO: 934718 - RNA, 19 nt, Homo sapiens
uaucaggaaugaaggacaa

SEQ ID NO: 934719 - RNA, 19 nt, Homo sapiens
aaauaagccagauggauaa

SEQ ID NO: 934720 - RNA, 19 nt, Homo sapiens
gacccuguacucugucuua

SEQ ID NO: 934721 - RNA, 19 nt, Homo sapiens
aaacgacgcucagacucuu

SEQ ID NO: 934722 - RNA, 19 nt, Homo sapiens
ugaaccggcucuuucugaa

SEQ ID NO: 934723 - RNA, 19 nt, Homo sapiens
gaacgagacccuguacucu

SEQ ID NO: 934724 - RNA, 19 nt, Homo sapiens
aaaauaagccagauggaua

SEQ ID NO: 934725 - RNA, 19 nt, Homo sapiens
uaagccagauggauaaagg

SEQ ID NO: 934726 - RNA, 19 nt, Homo sapiens
ccuguacucugucuuaaag

SEQ ID NO: 934727 - RNA, 19 nt, Homo sapiens
cuuaaaggccuaaccaaug

SEQ ID NO: 934728 - RNA, 19 nt, Homo sapiens
gaauaucaggaaugaagga

SEQ ID NO: 934729 - RNA, 19 nt, Homo sapiens
guguauuucugccgaguug

SEQ ID NO: 934730 - RNA, 19 nt, Homo sapiens
ggaguucagggccagcuuu

SEQ ID NO: 934731 - RNA, 19 nt, Homo sapiens
ggccagcuuugauaaugga

SEQ ID NO: 934732 - RNA, 19 nt, Homo sapiens
gcaggaccagucuguguau

SEQ ID NO: 934733 - RNA, 19 nt, Homo sapiens
ucagacucuuggcacauaa

SEQ ID NO: 934734 - RNA, 19 nt, Homo sapiens
gugaaccggcucuuucuga

SEQ ID NO: 934735 - RNA, 19 nt, Homo sapiens
augagaauaucaggaauga

SEQ ID NO: 934736 - RNA, 19 nt, Homo sapiens
aaacacagaggagccauau

SEQ ID NO: 934737 - RNA, 19 nt, Homo sapiens
ccaauggacagcccucuca

SEQ ID NO: 934738 - RNA, 19 nt, Homo sapiens
ggucagcagcggacuaaag

SEQ ID NO: 934739 - RNA, 19 nt, Homo sapiens
guaaucccagcuacucuga

SEQ ID NO: 934740 - RNA, 19 nt, Homo sapiens
acagcccucucaagacuga

SEQ ID NO: 934741 - RNA, 19 nt, Homo sapiens
cucagacucuuggcacaua

SEQ ID NO: 934742 - RNA, 19 nt, Homo sapiens
ucuccaaccugcagaagca

SEQ ID NO: 934743 - RNA, 19 nt, Homo sapiens
gaaauccccuucuccuucu

SEQ ID NO: 934744 - RNA, 19 nt, Homo sapiens
acgagacccuguacucugu

SEQ ID NO: 934745 - RNA, 19 nt, Homo sapiens
gaaaauaagccagauggau

SEQ ID NO: 934746 - RNA, 19 nt, Homo sapiens
caaacgacgcucagacucu

SEQ ID NO: 934747 - RNA, 19 nt, Homo sapiens
ugaauggugaggccaggua

SEQ ID NO: 934748 - RNA, 19 nt, Homo sapiens
gggccagcuuugauaaugg

SEQ ID NO: 934749 - RNA, 19 nt, Homo sapiens
ucagggccagcuuugauaa

SEQ ID NO: 934750 - RNA, 19 nt, Homo sapiens
caguggcgcacaccuguaa

SEQ ID NO: 934751 - RNA, 19 nt, Homo sapiens
cagaggcccagcagcauga

SEQ ID NO: 934752 - RNA, 19 nt, Homo sapiens
guucagggccagcuuugau

SEQ ID NO: 934753 - RNA, 19 nt, Homo sapiens
ucaagugagcccaggaguu

SEQ ID NO: 934754 - RNA, 19 nt, Homo sapiens
gcagaagcaggaccagucu

SEQ ID NO: 934755 - RNA, 19 nt, Homo sapiens
uaugugaaccggcucuuuc

SEQ ID NO: 934756 - RNA, 19 nt, Homo sapiens
acagaggagccauaugaga

SEQ ID NO: 934757 - RNA, 19 nt, Homo sapiens
ucacugugcucggaaucau

SEQ ID NO: 934758 - RNA, 19 nt, Homo sapiens
ggguggcucuguggaaauc

SEQ ID NO: 934759 - RNA, 19 nt, Homo sapiens
aaucccagcuacucugaag

SEQ ID NO: 934760 - RNA, 19 nt, Homo sapiens
gcucccgacgugagaauau

SEQ ID NO: 934761 - RNA, 19 nt, Homo sapiens
gaaugaaggacaaaauaca

SEQ ID NO: 934762 - RNA, 19 nt, Homo sapiens
ggucacacagggcaaacga

SEQ ID NO: 934763 - RNA, 19 nt, Homo sapiens
gcauuucugcagccuagug

SEQ ID NO: 934764 - RNA, 19 nt, Homo sapiens
uaugagaauaucaggaaug

SEQ ID NO: 934765 - RNA, 19 nt, Homo sapiens
caggaccagucuguguauu

SEQ ID NO: 934766 - RNA, 19 nt, Homo sapiens
gaaccggcucuuucugaac

SEQ ID NO: 934767 - RNA, 19 nt, Homo sapiens
ccacaggcaguccuucuac

SEQ ID NO: 934768 - RNA, 19 nt, Homo sapiens
cccuggaggugcacugguu

SEQ ID NO: 934769 - RNA, 19 nt, Homo sapiens
caggaucugguccaagcua

SEQ ID NO: 934770 - RNA, 19 nt, Homo sapiens
gggaccaaacucuccauca

SEQ ID NO: 934771 - RNA, 19 nt, Homo sapiens
ggaagaagauagucacaug

SEQ ID NO: 934772 - RNA, 19 nt, Homo sapiens
ccauagaguuccagacaua

SEQ ID NO: 934773 - RNA, 19 nt, Homo sapiens
agaacaaucugcugaauga

SEQ ID NO: 934774 - RNA, 19 nt, Homo sapiens
gcaacgaccugaugaacug

SEQ ID NO: 934775 - RNA, 19 nt, Homo sapiens
gcucugaccuucuucaugu

SEQ ID NO: 934776 - RNA, 19 nt, Homo sapiens
caagaaggccuaccauuug

SEQ ID NO: 934777 - RNA, 19 nt, Homo sapiens
ccaagaaggccuaccauuu

SEQ ID NO: 934778 - RNA, 19 nt, Homo sapiens
gaagaacaaucugcugaau

SEQ ID NO: 934779 - RNA, 19 nt, Homo sapiens
gaucauggguggcuucaag

SEQ ID NO: 934780 - RNA, 19 nt, Homo sapiens
ggagaaguaugagaaagug

SEQ ID NO: 934781 - RNA, 19 nt, Homo sapiens
gagaaaggcccacaguaug

SEQ ID NO: 934782 - RNA, 19 nt, Homo sapiens
agaaagugcuggaagaugu

SEQ ID NO: 934783 - RNA, 19 nt, Homo sapiens
gaaggacgccuaucacaag

SEQ ID NO: 934784 - RNA, 19 nt, Homo sapiens
ccaccacccugcucucaaa

SEQ ID NO: 934785 - RNA, 19 nt, Homo sapiens
ccucaucgcuuaccuugga

SEQ ID NO: 934786 - RNA, 19 nt, Homo sapiens
cgagaaaggcccacaguau

SEQ ID NO: 934787 - RNA, 19 nt, Homo sapiens
gagcaaugccagcaauuug

SEQ ID NO: 934788 - RNA, 19 nt, Homo sapiens
agaagauagucacauguuu

SEQ ID NO: 934789 - RNA, 19 nt, Homo sapiens
gcucuuggccuaaccauuc

SEQ ID NO: 934790 - RNA, 19 nt, Homo sapiens
gagcacccuucuacuccua

SEQ ID NO: 934791 - RNA, 19 nt, Homo sapiens
gaacagcagcuacauccau

SEQ ID NO: 934792 - RNA, 19 nt, Homo sapiens
ccaacuacguggaggcuau

SEQ ID NO: 934793 - RNA, 19 nt, Homo sapiens
gagacgaacucaccaagcu

SEQ ID NO: 934794 - RNA, 19 nt, Homo sapiens
gcaagcaggaugugcagaa

SEQ ID NO: 934795 - RNA, 19 nt, Homo sapiens
guagguaacagucuuagga

SEQ ID NO: 934796 - RNA, 19 nt, Homo sapiens
caaaguaugcagagacaga

SEQ ID NO: 934797 - RNA, 19 nt, Homo sapiens
agacacaggagaaguauga

SEQ ID NO: 934798 - RNA, 19 nt, Homo sapiens
ggacuuagcccaacaucac

SEQ ID NO: 934799 - RNA, 19 nt, Homo sapiens
aaaagaagcugcaggacaa

SEQ ID NO: 934800 - RNA, 19 nt, Homo sapiens
gcaaugcaccuguuuugua

SEQ ID NO: 934801 - RNA, 19 nt, Homo sapiens
gcggggagcuggaagaaaa

SEQ ID NO: 934802 - RNA, 19 nt, Homo sapiens
gcaaagccagcaacaguag

SEQ ID NO: 934803 - RNA, 19 nt, Homo sapiens
agaagacacaggagaagua

SEQ ID NO: 934804 - RNA, 19 nt, Homo sapiens
ggucacaccugagcagcaa

SEQ ID NO: 934805 - RNA, 19 nt, Homo sapiens
gaagauagucacauguuuu

SEQ ID NO: 934806 - RNA, 19 nt, Homo sapiens
gaagaagauagucacaugu

SEQ ID NO: 934807 - RNA, 19 nt, Homo sapiens
gagcagguguuugagcaau

SEQ ID NO: 934808 - RNA, 19 nt, Homo sapiens
gugggaagcuggcaaucug

SEQ ID NO: 934809 - RNA, 19 nt, Homo sapiens
ggugagacuugcuuacagu

SEQ ID NO: 934810 - RNA, 19 nt, Homo sapiens
caucggcucuucagcagau

SEQ ID NO: 934811 - RNA, 19 nt, Homo sapiens
gaguggcgcugaccaaugc

SEQ ID NO: 934812 - RNA, 19 nt, Homo sapiens
ggagaaacagccuaagaag

SEQ ID NO: 934813 - RNA, 19 nt, Homo sapiens
gaagacacaggagaaguau

SEQ ID NO: 934814 - RNA, 19 nt, Homo sapiens
uggagaaggugaagaacug

SEQ ID NO: 934815 - RNA, 19 nt, Homo sapiens
ggcaaagccagcaacagua

SEQ ID NO: 934816 - RNA, 19 nt, Homo sapiens
gcccuuccaugucuccaaa

SEQ ID NO: 934817 - RNA, 19 nt, Homo sapiens
ugaaugaggaccuggagaa

SEQ ID NO: 934818 - RNA, 19 nt, Homo sapiens
gagggucuccuaccuggaa

SEQ ID NO: 934819 - RNA, 19 nt, Homo sapiens
aggaagaccucagaugguu

SEQ ID NO: 934820 - RNA, 19 nt, Homo sapiens
uagaguuccagacauauuu

SEQ ID NO: 934821 - RNA, 19 nt, Homo sapiens
cacgggagaugaacagcaa

SEQ ID NO: 934822 - RNA, 19 nt, Homo sapiens
cuuccugacuccauuaguu

SEQ ID NO: 934823 - RNA, 19 nt, Homo sapiens
ggcgccagcucaucgagaa

SEQ ID NO: 934824 - RNA, 19 nt, Homo sapiens
ccauuccucuguccucuuc

SEQ ID NO: 934825 - RNA, 19 nt, Homo sapiens
gguacaggagggugaauga

SEQ ID NO: 934826 - RNA, 19 nt, Homo sapiens
gaaagugcuggaagaugug

SEQ ID NO: 934827 - RNA, 19 nt, Homo sapiens
gagaaagugcuggaagaug

SEQ ID NO: 934828 - RNA, 19 nt, Homo sapiens
ggaguggcgcugaccaaug

SEQ ID NO: 934829 - RNA, 19 nt, Homo sapiens
agaaggagaaacagccuaa

SEQ ID NO: 934830 - RNA, 19 nt, Homo sapiens
ccaccaagaaggagaaaca

SEQ ID NO: 934831 - RNA, 19 nt, Homo sapiens
ugacagaggcagacaaggu

SEQ ID NO: 934832 - RNA, 19 nt, Homo sapiens
acauggagcagguguuuga

SEQ ID NO: 934833 - RNA, 19 nt, Homo sapiens
accaggaggugaagaacaa

SEQ ID NO: 934834 - RNA, 19 nt, Homo sapiens
gcaccuguuuuguacauga

SEQ ID NO: 934835 - RNA, 19 nt, Homo sapiens
caggguagguaacagucuu

SEQ ID NO: 934836 - RNA, 19 nt, Homo sapiens
ccucuacccugccaacuac

SEQ ID NO: 934837 - RNA, 19 nt, Homo sapiens
ggcagaaggacgccuauca

SEQ ID NO: 934838 - RNA, 19 nt, Homo sapiens
ucucagcaaugcaccuguu

SEQ ID NO: 934839 - RNA, 19 nt, Homo sapiens
uggcagcccuuccaugucu

SEQ ID NO: 934840 - RNA, 19 nt, Homo sapiens
aagaagauagucacauguu

SEQ ID NO: 934841 - RNA, 19 nt, Homo sapiens
aagaaggccuaccauuugg

SEQ ID NO: 934842 - RNA, 19 nt, Homo sapiens
gggccaagaagaugaagga

SEQ ID NO: 934843 - RNA, 19 nt, Homo sapiens
agacgaaggaggcugaaga

SEQ ID NO: 934844 - RNA, 19 nt, Homo sapiens
cggcaaagccagcaacagu

SEQ ID NO: 934845 - RNA, 19 nt, Homo sapiens
ugaagaacaaucugcugaa

SEQ ID NO: 934846 - RNA, 19 nt, Homo sapiens
ggaguggaacccagaccuu

SEQ ID NO: 934847 - RNA, 19 nt, Homo sapiens
cacaggagaaguaugagaa

SEQ ID NO: 934848 - RNA, 19 nt, Homo sapiens
gaagcugcaggacaaagug

SEQ ID NO: 934849 - RNA, 19 nt, Homo sapiens
gccaagaaggccuaccauu

SEQ ID NO: 934850 - RNA, 19 nt, Homo sapiens
aaaccugggucagagugaa

SEQ ID NO: 934851 - RNA, 19 nt, Homo sapiens
ggccuaaccauuccucugu

SEQ ID NO: 934852 - RNA, 19 nt, Homo sapiens
ucccuggccugguuuccua

SEQ ID NO: 934853 - RNA, 19 nt, Homo sapiens
cccauucccuggccugguu

SEQ ID NO: 934854 - RNA, 19 nt, Homo sapiens
ugagcaaugccagcaauuu

SEQ ID NO: 934855 - RNA, 19 nt, Homo sapiens
ccagcuaucagcacuuuca

SEQ ID NO: 934856 - RNA, 19 nt, Homo sapiens
ggaccaagacgcuguuacg

SEQ ID NO: 934857 - RNA, 19 nt, Homo sapiens
aacaaaguaugcagagaca

SEQ ID NO: 934858 - RNA, 19 nt, Homo sapiens
gauuguaugacuguggaua

SEQ ID NO: 934859 - RNA, 19 nt, Homo sapiens
aggagaaacagccuaagaa

SEQ ID NO: 934860 - RNA, 19 nt, Homo sapiens
augagaaagugcuggaaga

SEQ ID NO: 934861 - RNA, 19 nt, Homo sapiens
caagcaggaugugcagaag

SEQ ID NO: 934862 - RNA, 19 nt, Homo sapiens
agaaggacgccuaucacaa

SEQ ID NO: 934863 - RNA, 19 nt, Homo sapiens
gccucucucuccagccuuu

SEQ ID NO: 934864 - RNA, 19 nt, Homo sapiens
agaaaggcccacaguaugg

SEQ ID NO: 934865 - RNA, 19 nt, Homo sapiens
guacaggagggugaaugaa

SEQ ID NO: 934866 - RNA, 19 nt, Homo sapiens
aaccgcagcuccgcacuug

SEQ ID NO: 934867 - RNA, 19 nt, Homo sapiens
gcaaugccagcaauuugag

SEQ ID NO: 934868 - RNA, 19 nt, Homo sapiens
gcagguguuugagcaaugc

SEQ ID NO: 934869 - RNA, 19 nt, Homo sapiens
cccaguacauggagaacau

SEQ ID NO: 934870 - RNA, 19 nt, Homo sapiens
gcagaagacacaggagaag

SEQ ID NO: 934871 - RNA, 19 nt, Homo sapiens
gaaagaaacuuaggcagua

SEQ ID NO: 934872 - RNA, 19 nt, Homo sapiens
caagagggauugcuaaaua

SEQ ID NO: 934873 - RNA, 19 nt, Homo sapiens
gcacauacauaaugacuuu

SEQ ID NO: 934874 - RNA, 19 nt, Homo sapiens
gcaguacccugaaguaaua

SEQ ID NO: 934875 - RNA, 19 nt, Homo sapiens
aaagugagcugaaguuaua

SEQ ID NO: 934876 - RNA, 19 nt, Homo sapiens
gaaaugcaguggugucuuu

SEQ ID NO: 934877 - RNA, 19 nt, Homo sapiens
guaaaugggucaauaaaug

SEQ ID NO: 934878 - RNA, 19 nt, Homo sapiens
ccaaguaacucgagauauu

SEQ ID NO: 934879 - RNA, 19 nt, Homo sapiens
gaaagaagaggaugucauu

SEQ ID NO: 934880 - RNA, 19 nt, Homo sapiens
gaagaagaguaacagauga

SEQ ID NO: 934881 - RNA, 19 nt, Homo sapiens
ggaagaugaugaagaagaa

SEQ ID NO: 934882 - RNA, 19 nt, Homo sapiens
uaaaguaucucagcagaaa

SEQ ID NO: 934883 - RNA, 19 nt, Homo sapiens
ggaggaaucugugaacaaa

SEQ ID NO: 934884 - RNA, 19 nt, Homo sapiens
ugacaacugugaaacauuu

SEQ ID NO: 934885 - RNA, 19 nt, Homo sapiens
uaaagaagccuaaugaaga

SEQ ID NO: 934886 - RNA, 19 nt, Homo sapiens
gcaguuagcaauaauguaa

SEQ ID NO: 934887 - RNA, 19 nt, Homo sapiens
agaagaagaugaagaagaa

SEQ ID NO: 934888 - RNA, 19 nt, Homo sapiens
gaagaaauguuugagacuu

SEQ ID NO: 934889 - RNA, 19 nt, Homo sapiens
gaacuggcaugcagcaaga

SEQ ID NO: 934890 - RNA, 19 nt, Homo sapiens
aaacugagcuuacugaaag

SEQ ID NO: 934891 - RNA, 19 nt, Homo sapiens
gggaggacuugguauauuu

SEQ ID NO: 934892 - RNA, 19 nt, Homo sapiens
gcaagaguguggucaguga

SEQ ID NO: 934893 - RNA, 19 nt, Homo sapiens
uaacgcagaugcaaaguug

SEQ ID NO: 934894 - RNA, 19 nt, Homo sapiens
cagcagaaauggaauaaug

SEQ ID NO: 934895 - RNA, 19 nt, Homo sapiens
gcaaaugggugcacguugu

SEQ ID NO: 934896 - RNA, 19 nt, Homo sapiens
gcagagagagacaagaaua

SEQ ID NO: 934897 - RNA, 19 nt, Homo sapiens
gggccuaaauuaaaguaua

SEQ ID NO: 934898 - RNA, 19 nt, Homo sapiens
aaacaaagaccuccagaaa

SEQ ID NO: 934899 - RNA, 19 nt, Homo sapiens
ggagcaugauggagaauuu

SEQ ID NO: 934900 - RNA, 19 nt, Homo sapiens
aaggagaaguagcauauua

SEQ ID NO: 934901 - RNA, 19 nt, Homo sapiens
ggacagaaagcaacugaaa

SEQ ID NO: 934902 - RNA, 19 nt, Homo sapiens
uuaagaagccuauggauuu

SEQ ID NO: 934903 - RNA, 19 nt, Homo sapiens
gcagcgaagauuagaauua

SEQ ID NO: 934904 - RNA, 19 nt, Homo sapiens
ucaagaagcuccucuagca

SEQ ID NO: 934905 - RNA, 19 nt, Homo sapiens
gccauuaccucuugcguuu

SEQ ID NO: 934906 - RNA, 19 nt, Homo sapiens
gcuauuacaugguauuuca

SEQ ID NO: 934907 - RNA, 19 nt, Homo sapiens
caaaggaaaggguguuaua

SEQ ID NO: 934908 - RNA, 19 nt, Homo sapiens
ucagaauccuguuggcuua

SEQ ID NO: 934909 - RNA, 19 nt, Homo sapiens
ggagaguggugaaggacua

SEQ ID NO: 934910 - RNA, 19 nt, Homo sapiens
gaagaugauucugauauag

SEQ ID NO: 934911 - RNA, 19 nt, Homo sapiens
gcaagaagguaacuuuaac

SEQ ID NO: 934912 - RNA, 19 nt, Homo sapiens
aaagggagauaaugaagaa

SEQ ID NO: 934913 - RNA, 19 nt, Homo sapiens
cgacaacacaugaugcuua

SEQ ID NO: 934914 - RNA, 19 nt, Homo sapiens
gaagaagaagaucaaagua

SEQ ID NO: 934915 - RNA, 19 nt, Homo sapiens
uaucaaaucgcacugaaua

SEQ ID NO: 934916 - RNA, 19 nt, Homo sapiens
uaagaugccuccugaguca

SEQ ID NO: 934917 - RNA, 19 nt, Homo sapiens
agaggaagaugaugaagaa

SEQ ID NO: 934918 - RNA, 19 nt, Homo sapiens
gauaagaaaccaaggaaga

SEQ ID NO: 934919 - RNA, 19 nt, Homo sapiens
caacacaucuguacuaucc

SEQ ID NO: 934920 - RNA, 19 nt, Homo sapiens
caaggcacauacauaauga

SEQ ID NO: 934921 - RNA, 19 nt, Homo sapiens
gaagaaaugcaguuugguu

SEQ ID NO: 934922 - RNA, 19 nt, Homo sapiens
ggugaaagguggaguaucu

SEQ ID NO: 934923 - RNA, 19 nt, Homo sapiens
gaaaugagaagacaacaag

SEQ ID NO: 934924 - RNA, 19 nt, Homo sapiens
acugcaagcucaagaaaua

SEQ ID NO: 934925 - RNA, 19 nt, Homo sapiens
gaacgugaacugcguauuc

SEQ ID NO: 934926 - RNA, 19 nt, Homo sapiens
aaacaagagucaucgaaga

SEQ ID NO: 934927 - RNA, 19 nt, Homo sapiens
gagaagggcauuaucagaa

SEQ ID NO: 934928 - RNA, 19 nt, Homo sapiens
ggaugaagaugaugaggau

SEQ ID NO: 934929 - RNA, 19 nt, Homo sapiens
gauccaaacgggaacaaua

SEQ ID NO: 934930 - RNA, 19 nt, Homo sapiens
ccucaugccuuugaauaua

SEQ ID NO: 934931 - RNA, 19 nt, Homo sapiens
ccuguaaacuugaaacuug

SEQ ID NO: 934932 - RNA, 19 nt, Homo sapiens
ugacugaaauggaaacuca

SEQ ID NO: 934933 - RNA, 19 nt, Homo sapiens
ccaaggaccuagcucuuug

SEQ ID NO: 934934 - RNA, 19 nt, Homo sapiens
ugucauaccuacugccaua

SEQ ID NO: 934935 - RNA, 19 nt, Homo sapiens
ucagugaaaucgacaagaa

SEQ ID NO: 934936 - RNA, 19 nt, Homo sapiens
caacacaugaugcuuauga

SEQ ID NO: 934937 - RNA, 19 nt, Homo sapiens
ccaaauccauucuugacaa

SEQ ID NO: 934938 - RNA, 19 nt, Homo sapiens
ucacagcagcuuccauuua

SEQ ID NO: 934939 - RNA, 19 nt, Homo sapiens
gcaaggcacauacauaaug

SEQ ID NO: 934940 - RNA, 19 nt, Homo sapiens
gaggaaaacacuucuauua

SEQ ID NO: 934941 - RNA, 19 nt, Homo sapiens
caauguugcuucaaguaaa

SEQ ID NO: 934942 - RNA, 19 nt, Homo sapiens
acacaaaucuauuccuuca

SEQ ID NO: 934943 - RNA, 19 nt, Homo sapiens
cagcaugggugaaguacaa

SEQ ID NO: 934944 - RNA, 19 nt, Homo sapiens
gaacuaaagaagccuaaug

SEQ ID NO: 934945 - RNA, 19 nt, Homo sapiens
ggaagaugaugaagaugau

SEQ ID NO: 934946 - RNA, 19 nt, Homo sapiens
caaauggaguuauucaaag

SEQ ID NO: 934947 - RNA, 19 nt, Homo sapiens
gaagaagaucaaaguauug

SEQ ID NO: 934948 - RNA, 19 nt, Homo sapiens
caacagugauagugauuca

SEQ ID NO: 934949 - RNA, 19 nt, Homo sapiens
guacaguaauuauccucua

SEQ ID NO: 934950 - RNA, 19 nt, Homo sapiens
gaagcacacccaaagaauu

SEQ ID NO: 934951 - RNA, 19 nt, Homo sapiens
gacccaagauuacaacaau

SEQ ID NO: 934952 - RNA, 19 nt, Homo sapiens
uaaaacagcucuuggagaa

SEQ ID NO: 934953 - RNA, 19 nt, Homo sapiens
gaacuucgagcucagcaaa

SEQ ID NO: 934954 - RNA, 19 nt, Homo sapiens
gcaagcagcacaaauaaag

SEQ ID NO: 934955 - RNA, 19 nt, Homo sapiens
ugaggaagaugaugaagau

SEQ ID NO: 934956 - RNA, 19 nt, Homo sapiens
ccaaauggaguuauucaaa

SEQ ID NO: 934957 - RNA, 19 nt, Homo sapiens
caaaugcacuuuuagguaa

SEQ ID NO: 934958 - RNA, 19 nt, Homo sapiens
gguagugccugccuuugaa

SEQ ID NO: 934959 - RNA, 19 nt, Homo sapiens
uuuaaaggcuucauuccua

SEQ ID NO: 934960 - RNA, 19 nt, Homo sapiens
aaagaagaauugaggaaga

SEQ ID NO: 934961 - RNA, 19 nt, Homo sapiens
acaaaucuauuccuucaga

SEQ ID NO: 934962 - RNA, 19 nt, Homo sapiens
ggaugaaggugaccaagca

SEQ ID NO: 934963 - RNA, 19 nt, Homo sapiens
gaggagacagugauuauga

SEQ ID NO: 934964 - RNA, 19 nt, Homo sapiens
gcauugaucugggagaaga

SEQ ID NO: 934965 - RNA, 19 nt, Homo sapiens
gcuuugaugugaauauuga

SEQ ID NO: 934966 - RNA, 19 nt, Homo sapiens
gacaacacaugaugcuuau

SEQ ID NO: 934967 - RNA, 19 nt, Homo sapiens
caaauccauucuugacaaa

SEQ ID NO: 934968 - RNA, 19 nt, Homo sapiens
ugugaaaccuuuaucuuug

SEQ ID NO: 934969 - RNA, 19 nt, Homo sapiens
cacagcagcuuccauuuau

SEQ ID NO: 934970 - RNA, 19 nt, Homo sapiens
ggaaaguucuagcaacagu

SEQ ID NO: 934971 - RNA, 19 nt, Homo sapiens
caagagguguggcauguuu

SEQ ID NO: 934972 - RNA, 19 nt, Homo sapiens
ucgcauagcuguagaaugu

SEQ ID NO: 934973 - RNA, 19 nt, Homo sapiens
ggaagaauuugucaagcaa

SEQ ID NO: 934974 - RNA, 19 nt, Homo sapiens
ccuaacaucugaccuagaa

SEQ ID NO: 934975 - RNA, 19 nt, Homo sapiens
gcaagcaagugaaauaaac

SEQ ID NO: 934976 - RNA, 19 nt, Homo sapiens
gaaacugauggaagaauuu

SEQ ID NO: 934977 - RNA, 19 nt, Homo sapiens
ccaaagaaguggaauacgu

SEQ ID NO: 934978 - RNA, 19 nt, Homo sapiens
ugaaacugauggaagaauu

SEQ ID NO: 934979 - RNA, 19 nt, Homo sapiens
cggcugcgaugagauaaua

SEQ ID NO: 934980 - RNA, 19 nt, Homo sapiens
uggcaaagguggcuaagga

SEQ ID NO: 934981 - RNA, 19 nt, Homo sapiens
gcaaaucgcauagcuguag

SEQ ID NO: 934982 - RNA, 19 nt, Homo sapiens
gagggucaguaguuucaaa

SEQ ID NO: 934983 - RNA, 19 nt, Homo sapiens
gaucaugaccaacccuauu

SEQ ID NO: 934984 - RNA, 19 nt, Homo sapiens
gcaagugaaauaaacaaug

SEQ ID NO: 934985 - RNA, 19 nt, Homo sapiens
cgagugagcaaaucgcaua

SEQ ID NO: 934986 - RNA, 19 nt, Homo sapiens
gggcguacaucgucaccaa

SEQ ID NO: 934987 - RNA, 19 nt, Homo sapiens
caagaggaccacugccuaa

SEQ ID NO: 934988 - RNA, 19 nt, Homo sapiens
gaccucaacccaggaguua

SEQ ID NO: 934989 - RNA, 19 nt, Homo sapiens
caacuaaagacacaaaugg

SEQ ID NO: 934990 - RNA, 19 nt, Homo sapiens
gaggaccacugccuaacau

SEQ ID NO: 934991 - RNA, 19 nt, Homo sapiens
ucagugacccguccaaaga

SEQ ID NO: 934992 - RNA, 19 nt, Homo sapiens
acagcaagcaagugaaaua

SEQ ID NO: 934993 - RNA, 19 nt, Homo sapiens
gggacggcauccggauuua

SEQ ID NO: 934994 - RNA, 19 nt, Homo sapiens
ggacagggcaggcuacaac

SEQ ID NO: 934995 - RNA, 19 nt, Homo sapiens
uaacaucugaccuagaaga

SEQ ID NO: 934996 - RNA, 19 nt, Homo sapiens
gaucccaacuaucgcuugu

SEQ ID NO: 934997 - RNA, 19 nt, Homo sapiens
agaagaggauggcaaaggu

SEQ ID NO: 934998 - RNA, 19 nt, Homo sapiens
cagcuucugugcccaacuu

SEQ ID NO: 934999 - RNA, 19 nt, Homo sapiens
caaaucgcauagcuguaga

SEQ ID NO: 935000 - RNA, 19 nt, Homo sapiens
ugacagcaagcaagugaaa

SEQ ID NO: 935001 - RNA, 19 nt, Homo sapiens
gauggaagaauuugucaag

SEQ ID NO: 935002 - RNA, 19 nt, Homo sapiens
ggacuaccagcguguggaa

SEQ ID NO: 935003 - RNA, 19 nt, Homo sapiens
ccuagaagacgaucggaaa

SEQ ID NO: 935004 - RNA, 19 nt, Homo sapiens
cagcaagcaagugaaauaa

SEQ ID NO: 935005 - RNA, 19 nt, Homo sapiens
uggaagaauuugucaagca

SEQ ID NO: 935006 - RNA, 19 nt, Homo sapiens
uguagaaugugcgugcuuu

SEQ ID NO: 935007 - RNA, 19 nt, Homo sapiens
agacacaaauggcguucug

SEQ ID NO: 935008 - RNA, 19 nt, Homo sapiens
ggaccucaacccaggaguu

SEQ ID NO: 935009 - RNA, 19 nt, Homo sapiens
ccucaacccaggaguuaaa

SEQ ID NO: 935010 - RNA, 19 nt, Homo sapiens
gaccaacccuauugcuacu

SEQ ID NO: 935011 - RNA, 19 nt, Homo sapiens
aagaggaaccggaugauca

SEQ ID NO: 935012 - RNA, 19 nt, Homo sapiens
uaucgcuuguugccucuuu

SEQ ID NO: 935013 - RNA, 19 nt, Homo sapiens
cacaggaucccaccgagaa

SEQ ID NO: 935014 - RNA, 19 nt, Homo sapiens
ugguggaccucaucuacuu

SEQ ID NO: 935015 - RNA, 19 nt, Homo sapiens
ggaaccggaugaucaugac

SEQ ID NO: 935016 - RNA, 19 nt, Homo sapiens
acaaccaacuaaagacaca

SEQ ID NO: 935017 - RNA, 19 nt, Homo sapiens
ccacauucauggaggaaaa

SEQ ID NO: 935018 - RNA, 19 nt, Homo sapiens
aauauucgcugaggacuac

SEQ ID NO: 935019 - RNA, 19 nt, Homo sapiens
gcauccggauuuacaagag

SEQ ID NO: 935020 - RNA, 19 nt, Homo sapiens
ccgcgaacuuggccauuca

SEQ ID NO: 935021 - RNA, 19 nt, Homo sapiens
ccaacuaaagacacaaaug

SEQ ID NO: 935022 - RNA, 19 nt, Homo sapiens
uagguuggguggugguaga

SEQ ID NO: 935023 - RNA, 19 nt, Homo sapiens
gcaauuccgagugagcaaa

SEQ ID NO: 935024 - RNA, 19 nt, Homo sapiens
ggauggcaaagguggcuaa

SEQ ID NO: 935025 - RNA, 19 nt, Homo sapiens
gaagaauuugucaagcaau

SEQ ID NO: 935026 - RNA, 19 nt, Homo sapiens
ggagaagcagccagugaca

SEQ ID NO: 935027 - RNA, 19 nt, Homo sapiens
gggaggaguuuuccagaau

SEQ ID NO: 935028 - RNA, 19 nt, Homo sapiens
ggauggaguuccuuuucuu

SEQ ID NO: 935029 - RNA, 19 nt, Homo sapiens
ccuugagggucaguaguuu

SEQ ID NO: 935030 - RNA, 19 nt, Homo sapiens
gcugcgaugagauaauauu

SEQ ID NO: 935031 - RNA, 19 nt, Homo sapiens
ggaccacugccuaacaucu

SEQ ID NO: 935032 - RNA, 19 nt, Homo sapiens
gaagacgaucggaaaauug

SEQ ID NO: 935033 - RNA, 19 nt, Homo sapiens
cagcuacaaccaacuaaag

SEQ ID NO: 935034 - RNA, 19 nt, Homo sapiens
caagcaagugaaauaaaca

SEQ ID NO: 935035 - RNA, 19 nt, Homo sapiens
agaagacgaucggaaaauu

SEQ ID NO: 935036 - RNA, 19 nt, Homo sapiens
gaugugacagcaagcaagu

SEQ ID NO: 935037 - RNA, 19 nt, Homo sapiens
cuaaggguccgaugugaca

SEQ ID NO: 935038 - RNA, 19 nt, Homo sapiens
uaauauucgcugaggacua

SEQ ID NO: 935039 - RNA, 19 nt, Homo sapiens
uacaagaggaaccggauga

SEQ ID NO: 935040 - RNA, 19 nt, Homo sapiens
gcaagagguguggcauguu

SEQ ID NO: 935041 - RNA, 19 nt, Homo sapiens
gaagucuuaggauggaguu

SEQ ID NO: 935042 - RNA, 19 nt, Homo sapiens
ccacugcugcuaccaccaa

SEQ ID NO: 935043 - RNA, 19 nt, Homo sapiens
aaacugauggaagaauuug

SEQ ID NO: 935044 - RNA, 19 nt, Homo sapiens
ggaggaguuuuccagaaug

SEQ ID NO: 935045 - RNA, 19 nt, Homo sapiens
ucgcgccucugccugagaa

SEQ ID NO: 935046 - RNA, 19 nt, Homo sapiens
gugagcaaaucgcauagcu

SEQ ID NO: 935047 - RNA, 19 nt, Homo sapiens
cuacaaccaacuaaagaca

SEQ ID NO: 935048 - RNA, 19 nt, Homo sapiens
ccagcuacaaccaacuaaa

SEQ ID NO: 935049 - RNA, 19 nt, Homo sapiens
gcuucgagccacauucaug

SEQ ID NO: 935050 - RNA, 19 nt, Homo sapiens
gacggcauccggauuuaca

SEQ ID NO: 935051 - RNA, 19 nt, Homo sapiens
agcaagagguguggcaugu

SEQ ID NO: 935052 - RNA, 19 nt, Homo sapiens
gaccacugccuaacaucug

SEQ ID NO: 935053 - RNA, 19 nt, Homo sapiens
ugugacagcaagcaaguga

SEQ ID NO: 935054 - RNA, 19 nt, Homo sapiens
caagaggaaccggaugauc

SEQ ID NO: 935055 - RNA, 19 nt, Homo sapiens
ccaacggcagucucaguga

SEQ ID NO: 935056 - RNA, 19 nt, Homo sapiens
gcgcugccguggacuuuug

SEQ ID NO: 935057 - RNA, 19 nt, Homo sapiens
gaaccaaaguccagaagaa

SEQ ID NO: 935058 - RNA, 19 nt, Homo sapiens
gagacucgcccuucaauaa

SEQ ID NO: 935059 - RNA, 19 nt, Homo sapiens
gggagaagcuggccaagca

SEQ ID NO: 935060 - RNA, 19 nt, Homo sapiens
gacacuggcuccaaggaaa

SEQ ID NO: 935061 - RNA, 19 nt, Homo sapiens
cggcgaggcccaagaaaua

SEQ ID NO: 935062 - RNA, 19 nt, Homo sapiens
caaagaagagaaccaaagu

SEQ ID NO: 935063 - RNA, 19 nt, Homo sapiens
ccucaacccuucugcaaca

SEQ ID NO: 935064 - RNA, 19 nt, Homo sapiens
ggagacucgcccuucaaua

SEQ ID NO: 935065 - RNA, 19 nt, Homo sapiens
ugccggagcuuccuacaau

SEQ ID NO: 935066 - RNA, 19 nt, Homo sapiens
cacgagcgguggcuuguug

SEQ ID NO: 935067 - RNA, 19 nt, Homo sapiens
uccgugagauccaguugua

SEQ ID NO: 935068 - RNA, 19 nt, Homo sapiens
gagcagaccaagaagaaag

SEQ ID NO: 935069 - RNA, 19 nt, Homo sapiens
ggacacuggcuccaaggaa

SEQ ID NO: 935070 - RNA, 19 nt, Homo sapiens
agagagagccaaguucaaa

SEQ ID NO: 935071 - RNA, 19 nt, Homo sapiens
cagcacgccugcacaccaa

SEQ ID NO: 935072 - RNA, 19 nt, Homo sapiens
aguuguagcugccaucaga

SEQ ID NO: 935073 - RNA, 19 nt, Homo sapiens
cgagagagagccaaguuca

SEQ ID NO: 935074 - RNA, 19 nt, Homo sapiens
aggugaagcugguggagaa

SEQ ID NO: 935075 - RNA, 19 nt, Homo sapiens
gagagagagccaaguucaa

SEQ ID NO: 935076 - RNA, 19 nt, Homo sapiens
agacucgcccuucaauaaa

SEQ ID NO: 935077 - RNA, 19 nt, Homo sapiens
gcaaguacaaggugaagcu

SEQ ID NO: 935078 - RNA, 19 nt, Homo sapiens
ugacaaagaagagaaccaa

SEQ ID NO: 935079 - RNA, 19 nt, Homo sapiens
uacaauccauccuuugaag

SEQ ID NO: 935080 - RNA, 19 nt, Homo sapiens
cgagaacacauccaaaguc

SEQ ID NO: 935081 - RNA, 19 nt, Homo sapiens
gagaccgguucaagagcuu

SEQ ID NO: 935082 - RNA, 19 nt, Homo sapiens
gcgguggcuuguugucaga

SEQ ID NO: 935083 - RNA, 19 nt, Homo sapiens
cuacaauccauccuuugaa

SEQ ID NO: 935084 - RNA, 19 nt, Homo sapiens
ccuacaauccauccuuuga

SEQ ID NO: 935085 - RNA, 19 nt, Homo sapiens
caagaagaaaggagugaag

SEQ ID NO: 935086 - RNA, 19 nt, Homo sapiens
acaaagaagagaaccaaag

SEQ ID NO: 935087 - RNA, 19 nt, Homo sapiens
gacaaagaagagaaccaaa

SEQ ID NO: 935088 - RNA, 19 nt, Homo sapiens
ggagcagaccaagaagaaa

SEQ ID NO: 935089 - RNA, 19 nt, Homo sapiens
uggagcagaccaagaagaa

SEQ ID NO: 935090 - RNA, 19 nt, Homo sapiens
ccaaaguccagaagaaguc

SEQ ID NO: 935091 - RNA, 19 nt, Homo sapiens
ggcgaggcccaagaaauaa

SEQ ID NO: 935092 - RNA, 19 nt, Homo sapiens
ccacccaggaguccacauu

SEQ ID NO: 935093 - RNA, 19 nt, Homo sapiens
ggcagaaggaggcggagaa

SEQ ID NO: 935094 - RNA, 19 nt, Homo sapiens
gggcugacaaagaagagaa

SEQ ID NO: 935095 - RNA, 19 nt, Homo sapiens
ggagcuuccuacaauccau

SEQ ID NO: 935096 - RNA, 19 nt, Homo sapiens
gggaagcgcagcucgaaaa

SEQ ID NO: 935097 - RNA, 19 nt, Homo sapiens
uuccuacaauccauccuuu

SEQ ID NO: 935098 - RNA, 19 nt, Homo sapiens
gcggcgaggcccaagaaau

SEQ ID NO: 935099 - RNA, 19 nt, Homo sapiens
ccagaagaagucacugcuu

SEQ ID NO: 935100 - RNA, 19 nt, Homo sapiens
caaguucaaacgcaaguac

SEQ ID NO: 935101 - RNA, 19 nt, Homo sapiens
gagaaccaaaguccagaag

SEQ ID NO: 935102 - RNA, 19 nt, Homo sapiens
gacucgcccuucaauaaaa

SEQ ID NO: 935103 - RNA, 19 nt, Homo sapiens
gcacgagcgguggcuuguu

SEQ ID NO: 935104 - RNA, 19 nt, Homo sapiens
ugucagaggccccaaauga

SEQ ID NO: 935105 - RNA, 19 nt, Homo sapiens
gcagaaggaggcggagaag

SEQ ID NO: 935106 - RNA, 19 nt, Homo sapiens
ccaagaagaaaggagugaa

SEQ ID NO: 935107 - RNA, 19 nt, Homo sapiens
gaacguggcugcccuguca

SEQ ID NO: 935108 - RNA, 19 nt, Homo sapiens
gcaaagugcugugucaguu

SEQ ID NO: 935109 - RNA, 19 nt, Homo sapiens
gagggaauguucuuucuug

SEQ ID NO: 935110 - RNA, 19 nt, Homo sapiens
ccaggacguugaccagaua

SEQ ID NO: 935111 - RNA, 19 nt, Homo sapiens
auaaacagcuggccaagga

SEQ ID NO: 935112 - RNA, 19 nt, Homo sapiens
ggaaucauccuccagaaca

SEQ ID NO: 935113 - RNA, 19 nt, Homo sapiens
cagcggagaugguaaugau

SEQ ID NO: 935114 - RNA, 19 nt, Homo sapiens
caaaguggacgaggaguuu

SEQ ID NO: 935115 - RNA, 19 nt, Homo sapiens
ccuccgggcugcaguauga

SEQ ID NO: 935116 - RNA, 19 nt, Homo sapiens
gaaucauccuccagaacaa

SEQ ID NO: 935117 - RNA, 19 nt, Homo sapiens
aggccaugcucaauaaaua

SEQ ID NO: 935118 - RNA, 19 nt, Homo sapiens
ccaaagugcugagauuaca

SEQ ID NO: 935119 - RNA, 19 nt, Homo sapiens
cagcuagucuucccucugu

SEQ ID NO: 935120 - RNA, 19 nt, Homo sapiens
guaaugaucgaccgaaugu

SEQ ID NO: 935121 - RNA, 19 nt, Homo sapiens
acaagugagugagagauuu

SEQ ID NO: 935122 - RNA, 19 nt, Homo sapiens
caccucagccucccaagua

SEQ ID NO: 935123 - RNA, 19 nt, Homo sapiens
ccacggccauccucacuca

SEQ ID NO: 935124 - RNA, 19 nt, Homo sapiens
agacaaaacuaguacugua

SEQ ID NO: 935125 - RNA, 19 nt, Homo sapiens
cccaggccaugcucaauaa

SEQ ID NO: 935126 - RNA, 19 nt, Homo sapiens
gcaucgggcucaagcucaa

SEQ ID NO: 935127 - RNA, 19 nt, Homo sapiens
gcagcuccaugugcaagaa

SEQ ID NO: 935128 - RNA, 19 nt, Homo sapiens
uugcuaaccucagcucuuu

SEQ ID NO: 935129 - RNA, 19 nt, Homo sapiens
ccuguuuccuggagcauuu

SEQ ID NO: 935130 - RNA, 19 nt, Homo sapiens
gcucuuuccuucccaccuu

SEQ ID NO: 935131 - RNA, 19 nt, Homo sapiens
ucagcaaggucgugcacaa

SEQ ID NO: 935132 - RNA, 19 nt, Homo sapiens
aggagaagccggacgagua

SEQ ID NO: 935133 - RNA, 19 nt, Homo sapiens
caaacugaguggccugaag

SEQ ID NO: 935134 - RNA, 19 nt, Homo sapiens
ccucgacuuugaaaucuga

SEQ ID NO: 935135 - RNA, 19 nt, Homo sapiens
gggaauguucuuucuugaa

SEQ ID NO: 935136 - RNA, 19 nt, Homo sapiens
ggcucaagcucaagaucaa

SEQ ID NO: 935137 - RNA, 19 nt, Homo sapiens
gugccugucuugucugugu

SEQ ID NO: 935138 - RNA, 19 nt, Homo sapiens
gccaggacguugaccagau

SEQ ID NO: 935139 - RNA, 19 nt, Homo sapiens
gcccugagcaaacccauga

SEQ ID NO: 935140 - RNA, 19 nt, Homo sapiens
ggagaagccggacgaguac

SEQ ID NO: 935141 - RNA, 19 nt, Homo sapiens
aaacugaguggccugaaga

SEQ ID NO: 935142 - RNA, 19 nt, Homo sapiens
aagcgaacgucuucaagca

SEQ ID NO: 935143 - RNA, 19 nt, Homo sapiens
ggacguugaccagauaaca

SEQ ID NO: 935144 - RNA, 19 nt, Homo sapiens
gguaaugaucgaccgaaug

SEQ ID NO: 935145 - RNA, 19 nt, Homo sapiens
ucaacaaggcccugagugu

SEQ ID NO: 935146 - RNA, 19 nt, Homo sapiens
agaccacccuugccuugga

SEQ ID NO: 935147 - RNA, 19 nt, Homo sapiens
cccaggacguggucaacaa

SEQ ID NO: 935148 - RNA, 19 nt, Homo sapiens
ggagggaauguucuuucuu

SEQ ID NO: 935149 - RNA, 19 nt, Homo sapiens
caagugagugagagauuuc

SEQ ID NO: 935150 - RNA, 19 nt, Homo sapiens
gggcucaagcucaagauca

SEQ ID NO: 935151 - RNA, 19 nt, Homo sapiens
gcaaggucgugcacaacac

SEQ ID NO: 935152 - RNA, 19 nt, Homo sapiens
gcacccaggccaugcucaa

SEQ ID NO: 935153 - RNA, 19 nt, Homo sapiens
ccagcaaggaagccuguuu

SEQ ID NO: 935154 - RNA, 19 nt, Homo sapiens
gcaagcgaacgucuucaag

SEQ ID NO: 935155 - RNA, 19 nt, Homo sapiens
caagccauccauccuccua

SEQ ID NO: 935156 - RNA, 19 nt, Homo sapiens
caaagugcugugucaguuc

SEQ ID NO: 935157 - RNA, 19 nt, Homo sapiens
ggccaugcucaauaaauau

SEQ ID NO: 935158 - RNA, 19 nt, Homo sapiens
uccaaggccugcccaaugg

SEQ ID NO: 935159 - RNA, 19 nt, Homo sapiens
ugucaccucagcauucuuu

SEQ ID NO: 935160 - RNA, 19 nt, Homo sapiens
uggcaucuuugucauccaa

SEQ ID NO: 935161 - RNA, 19 nt, Homo sapiens
caaaacuaguacuguaaga

SEQ ID NO: 935162 - RNA, 19 nt, Homo sapiens
cuguguggcuucucagaug

SEQ ID NO: 935163 - RNA, 19 nt, Homo sapiens
guuccuguuucuucccauu

SEQ ID NO: 935164 - RNA, 19 nt, Homo sapiens
aaugaucgaccgaauguuc

SEQ ID NO: 935165 - RNA, 19 nt, Homo sapiens
ucaaugggaacucuguguu

SEQ ID NO: 935166 - RNA, 19 nt, Homo sapiens
gacaaaacuaguacuguaa

SEQ ID NO: 935167 - RNA, 19 nt, Homo sapiens
cuaaguuauuugagucaca

SEQ ID NO: 935168 - RNA, 19 nt, Homo sapiens
ucccaaagugcugagauua

SEQ ID NO: 935169 - RNA, 19 nt, Homo sapiens
cagcaaggaagccuguuuc

SEQ ID NO: 935170 - RNA, 19 nt, Homo sapiens
gggauccccugacgguuuu

SEQ ID NO: 935171 - RNA, 19 nt, Homo sapiens
gaccacccuugccuuggau

SEQ ID NO: 935172 - RNA, 19 nt, Homo sapiens
ccggaaucauccuccagaa

SEQ ID NO: 935173 - RNA, 19 nt, Homo sapiens
caaagugcugagauuacaa

SEQ ID NO: 935174 - RNA, 19 nt, Homo sapiens
uaaccucagcucuuuccuu

SEQ ID NO: 935175 - RNA, 19 nt, Homo sapiens
cucccaaagugcugagauu

SEQ ID NO: 935176 - RNA, 19 nt, Homo sapiens
cgacuuccagcuccaguuc

SEQ ID NO: 935177 - RNA, 19 nt, Homo sapiens
ccucagagccacccuugca

SEQ ID NO: 935178 - RNA, 19 nt, Homo sapiens
uaccucagccucccaaagu

SEQ ID NO: 935179 - RNA, 19 nt, Homo sapiens
agucuucccucuguucuuc

SEQ ID NO: 935180 - RNA, 19 nt, Homo sapiens
gcuagucuucccucuguuc

SEQ ID NO: 935181 - RNA, 19 nt, Homo sapiens
ugucaguuccuguuucuuc

SEQ ID NO: 935182 - RNA, 19 nt, Homo sapiens
aggcuggucucaaacucuu

SEQ ID NO: 935183 - RNA, 19 nt, Homo sapiens
gcugcaguaugagagcaaa

SEQ ID NO: 935184 - RNA, 19 nt, Homo sapiens
aggacucccugcagauguu

SEQ ID NO: 935185 - RNA, 19 nt, Homo sapiens
gcugcaagcgaacgucuuc

SEQ ID NO: 935186 - RNA, 19 nt, Homo sapiens
cuccacaccugcccaccaa

SEQ ID NO: 935187 - RNA, 19 nt, Homo sapiens
caggagggaauguucuuuc

SEQ ID NO: 935188 - RNA, 19 nt, Homo sapiens
gcccaccccucgacuuuga

SEQ ID NO: 935189 - RNA, 19 nt, Homo sapiens
ccgggugccugucuugucu

SEQ ID NO: 935190 - RNA, 19 nt, Homo sapiens
acccaggccaugcucaaua

SEQ ID NO: 935191 - RNA, 19 nt, Homo sapiens
gcuaagaccacaggcacau

SEQ ID NO: 935192 - RNA, 19 nt, Homo sapiens
acaaaguggacgaggaguu

SEQ ID NO: 935193 - RNA, 19 nt, Homo sapiens
caggugccguccggaauca

SEQ ID NO: 935194 - RNA, 19 nt, Homo sapiens
cgucuagcccggagaagau

SEQ ID NO: 935195 - RNA, 19 nt, Homo sapiens
agggaauguucuuucuuga

SEQ ID NO: 935196 - RNA, 19 nt, Homo sapiens
gaaccuaccucaccuuuga

SEQ ID NO: 935197 - RNA, 19 nt, Homo sapiens
gcaaugagcaugagacaca

SEQ ID NO: 935198 - RNA, 19 nt, Homo sapiens
gugaagacauuaccagaga

SEQ ID NO: 935199 - RNA, 19 nt, Homo sapiens
gagaaggaggcauguuaua

SEQ ID NO: 935200 - RNA, 19 nt, Homo sapiens
gaaggaggcauguuauauc

SEQ ID NO: 935201 - RNA, 19 nt, Homo sapiens
gagucaagauccaagagaa

SEQ ID NO: 935202 - RNA, 19 nt, Homo sapiens
gagaguguaucugggaauu

SEQ ID NO: 935203 - RNA, 19 nt, Homo sapiens
ccuaaucucuggucguuau

SEQ ID NO: 935204 - RNA, 19 nt, Homo sapiens
gaacaucugguggguacua

SEQ ID NO: 935205 - RNA, 19 nt, Homo sapiens
ggauccuucuggucaauaa

SEQ ID NO: 935206 - RNA, 19 nt, Homo sapiens
gaauguccuuguuccaguu

SEQ ID NO: 935207 - RNA, 19 nt, Homo sapiens
ccucucagcuuaccacaug

SEQ ID NO: 935208 - RNA, 19 nt, Homo sapiens
caacuucuguaucgagcuu

SEQ ID NO: 935209 - RNA, 19 nt, Homo sapiens
ggcagacagugaagacauu

SEQ ID NO: 935210 - RNA, 19 nt, Homo sapiens
ggagaaggaggcauguuau

SEQ ID NO: 935211 - RNA, 19 nt, Homo sapiens
gcagacagugaagacauua

SEQ ID NO: 935212 - RNA, 19 nt, Homo sapiens
cgaccgcauucaucuacua

SEQ ID NO: 935213 - RNA, 19 nt, Homo sapiens
uggagaaggaggcauguua

SEQ ID NO: 935214 - RNA, 19 nt, Homo sapiens
gugauggcaccguguguua

SEQ ID NO: 935215 - RNA, 19 nt, Homo sapiens
agacagaccugggagaucu

SEQ ID NO: 935216 - RNA, 19 nt, Homo sapiens
uuugaggcaugcaagaaua

SEQ ID NO: 935217 - RNA, 19 nt, Homo sapiens
gagacagaguggauacaca

SEQ ID NO: 935218 - RNA, 19 nt, Homo sapiens
uaaaccgaauguccuuguu

SEQ ID NO: 935219 - RNA, 19 nt, Homo sapiens
ggaguguggcuuccuguug

SEQ ID NO: 935220 - RNA, 19 nt, Homo sapiens
ggagcaacuuacucacugu

SEQ ID NO: 935221 - RNA, 19 nt, Homo sapiens
aaugaggaauuugggauuu

SEQ ID NO: 935222 - RNA, 19 nt, Homo sapiens
gcaacaauacaucacaaca

SEQ ID NO: 935223 - RNA, 19 nt, Homo sapiens
ccaggaaccucagagucaa

SEQ ID NO: 935224 - RNA, 19 nt, Homo sapiens
gagcaacuuacucacugua

SEQ ID NO: 935225 - RNA, 19 nt, Homo sapiens
gcccucaacuucuguaucg

SEQ ID NO: 935226 - RNA, 19 nt, Homo sapiens
gaguguaucugggaauuuu

SEQ ID NO: 935227 - RNA, 19 nt, Homo sapiens
uaacauccuuuggcaccuu

SEQ ID NO: 935228 - RNA, 19 nt, Homo sapiens
caaucgcuccuuccuugua

SEQ ID NO: 935229 - RNA, 19 nt, Homo sapiens
ucccaacccucaucacaga

SEQ ID NO: 935230 - RNA, 19 nt, Homo sapiens
gccucuaccugcuguguga

SEQ ID NO: 935231 - RNA, 19 nt, Homo sapiens
gacauuaccagagagugua

SEQ ID NO: 935232 - RNA, 19 nt, Homo sapiens
gcaacuuacucacuguacu

SEQ ID NO: 935233 - RNA, 19 nt, Homo sapiens
cagaguggauacacagaca

SEQ ID NO: 935234 - RNA, 19 nt, Homo sapiens
acagacagcuuuucacaug

SEQ ID NO: 935235 - RNA, 19 nt, Homo sapiens
ccucaucacagacagcuuu

SEQ ID NO: 935236 - RNA, 19 nt, Homo sapiens
guggcuuccuguugcauuu

SEQ ID NO: 935237 - RNA, 19 nt, Homo sapiens
gaagacauuaccagagagu

SEQ ID NO: 935238 - RNA, 19 nt, Homo sapiens
gcgaggucguuauggcuau

SEQ ID NO: 935239 - RNA, 19 nt, Homo sapiens
gggcacgcaucugcucuug

SEQ ID NO: 935240 - RNA, 19 nt, Homo sapiens
gaaccucagagucaagauc

SEQ ID NO: 935241 - RNA, 19 nt, Homo sapiens
gaucagcccgaccgcauuc

SEQ ID NO: 935242 - RNA, 19 nt, Homo sapiens
agaaggaggcauguuauau

SEQ ID NO: 935243 - RNA, 19 nt, Homo sapiens
ccaaaguggcacccuguug

SEQ ID NO: 935244 - RNA, 19 nt, Homo sapiens
ggaugagacagaguggaua

SEQ ID NO: 935245 - RNA, 19 nt, Homo sapiens
gauggcaccguguguuaug

SEQ ID NO: 935246 - RNA, 19 nt, Homo sapiens
ucccaaggcugaggaccua

SEQ ID NO: 935247 - RNA, 19 nt, Homo sapiens
caacaauacaucacaacag

SEQ ID NO: 935248 - RNA, 19 nt, Homo sapiens
caacuuacucacuguacug

SEQ ID NO: 935249 - RNA, 19 nt, Homo sapiens
cuacagcacugcccaaccu

SEQ ID NO: 935250 - RNA, 19 nt, Homo sapiens
caauggcaaggacguguuu

SEQ ID NO: 935251 - RNA, 19 nt, Homo sapiens
aaucucuggucguuauuug

SEQ ID NO: 935252 - RNA, 19 nt, Homo sapiens
ggcacugugugauggagaa

SEQ ID NO: 935253 - RNA, 19 nt, Homo sapiens
ggugcuuucuacugcguuu

SEQ ID NO: 935254 - RNA, 19 nt, Homo sapiens
gagcaaugagcaugagaca

SEQ ID NO: 935255 - RNA, 19 nt, Homo sapiens
ggagacagaccugggagau

SEQ ID NO: 935256 - RNA, 19 nt, Homo sapiens
ugaggaauuugggauuuua

SEQ ID NO: 935257 - RNA, 19 nt, Homo sapiens
ccacuucuugucccaugua

SEQ ID NO: 935258 - RNA, 19 nt, Homo sapiens
caugcgagccgaccaaagu

SEQ ID NO: 935259 - RNA, 19 nt, Homo sapiens
gguacuacaggcccuauuc

SEQ ID NO: 935260 - RNA, 19 nt, Homo sapiens
cagcuucguucagccaaug

SEQ ID NO: 935261 - RNA, 19 nt, Homo sapiens
cccacguccucucagcuua

SEQ ID NO: 935262 - RNA, 19 nt, Homo sapiens
aaacuacuacacuaaaugg

SEQ ID NO: 935263 - RNA, 19 nt, Homo sapiens
ggaaccuaccucaccuuug

SEQ ID NO: 935264 - RNA, 19 nt, Homo sapiens
aaucgcuccuuccuuguau

SEQ ID NO: 935265 - RNA, 19 nt, Homo sapiens
gcagcuucguucagccaau

SEQ ID NO: 935266 - RNA, 19 nt, Homo sapiens
ugccuaaucucuggucguu

SEQ ID NO: 935267 - RNA, 19 nt, Homo sapiens
gacacguucuuccgaaugc

SEQ ID NO: 935268 - RNA, 19 nt, Homo sapiens
ggaccaggaaccucagagu

SEQ ID NO: 935269 - RNA, 19 nt, Homo sapiens
gaugucaccuaccaaaauc

SEQ ID NO: 935270 - RNA, 19 nt, Homo sapiens
ggaucagcccgaccgcauu

SEQ ID NO: 935271 - RNA, 19 nt, Homo sapiens
guucaucucagucaucuac

SEQ ID NO: 935272 - RNA, 19 nt, Homo sapiens
gucaaugggaugucaccua

SEQ ID NO: 935273 - RNA, 19 nt, Homo sapiens
gaugagacagaguggauac

SEQ ID NO: 935274 - RNA, 19 nt, Homo sapiens
ucaagauccaagagaagaa

SEQ ID NO: 935275 - RNA, 19 nt, Homo sapiens
guauugcgaggucguuaug

SEQ ID NO: 935276 - RNA, 19 nt, Homo sapiens
gaacuguggcaggaucauc

SEQ ID NO: 935277 - RNA, 19 nt, Homo sapiens
gcuuaaaccgaauguccuu

SEQ ID NO: 935278 - RNA, 19 nt, Homo sapiens
gggucagccucaggucaaa

SEQ ID NO: 935279 - RNA, 19 nt, Homo sapiens
gggagaucuuggugagcaa

SEQ ID NO: 935280 - RNA, 19 nt, Homo sapiens
gucaagauccaagagaaga

SEQ ID NO: 935281 - RNA, 19 nt, Homo sapiens
cuacacaccacuucuuguc

SEQ ID NO: 935282 - RNA, 19 nt, Homo sapiens
acacuaaauggaccaggaa

SEQ ID NO: 935283 - RNA, 19 nt, Homo sapiens
agacauuaccagagagugu

SEQ ID NO: 935284 - RNA, 19 nt, Homo sapiens
ggaugucaccuaccaaaau

SEQ ID NO: 935285 - RNA, 19 nt, Homo sapiens
aaugggaugucaccuacca

SEQ ID NO: 935286 - RNA, 19 nt, Homo sapiens
ucaaagacugggcgguuca

SEQ ID NO: 935287 - RNA, 19 nt, Homo sapiens
ccuguugcauuuccgagau

SEQ ID NO: 935288 - RNA, 19 nt, Homo sapiens
gggcagagaugcagccuua

SEQ ID NO: 935289 - RNA, 19 nt, Homo sapiens
ggaaauaccagcacaagaa

SEQ ID NO: 935290 - RNA, 19 nt, Homo sapiens
gaagaucugugaagacuca

SEQ ID NO: 935291 - RNA, 19 nt, Homo sapiens
cgacaaggacuuuaugaua

SEQ ID NO: 935292 - RNA, 19 nt, Homo sapiens
gacaaggacuuuaugauag

SEQ ID NO: 935293 - RNA, 19 nt, Homo sapiens
gcagcaacaucaugacauu

SEQ ID NO: 935294 - RNA, 19 nt, Homo sapiens
gcaguucucugagcaauuc

SEQ ID NO: 935295 - RNA, 19 nt, Homo sapiens
gggauaaacucaaacaacu

SEQ ID NO: 935296 - RNA, 19 nt, Homo sapiens
ucaacaaccugguggaaau

SEQ ID NO: 935297 - RNA, 19 nt, Homo sapiens
gcacugcagucccaagauc

SEQ ID NO: 935298 - RNA, 19 nt, Homo sapiens
ggaugacgaugaugaugau

SEQ ID NO: 935299 - RNA, 19 nt, Homo sapiens
gggaugaaguacucggaaa

SEQ ID NO: 935300 - RNA, 19 nt, Homo sapiens
aaacaggagugucucaaca

SEQ ID NO: 935301 - RNA, 19 nt, Homo sapiens
gcaaggaucaagaaaauuu

SEQ ID NO: 935302 - RNA, 19 nt, Homo sapiens
gcacgucccucaggaacau

SEQ ID NO: 935303 - RNA, 19 nt, Homo sapiens
gauaaacucaaacaacuca

SEQ ID NO: 935304 - RNA, 19 nt, Homo sapiens
caaggacuuuaugauagua

SEQ ID NO: 935305 - RNA, 19 nt, Homo sapiens
gcagagaugcagccuuaug

SEQ ID NO: 935306 - RNA, 19 nt, Homo sapiens
gaaguggaaugagcucaag

SEQ ID NO: 935307 - RNA, 19 nt, Homo sapiens
ugaaugggaugaaguacuc

SEQ ID NO: 935308 - RNA, 19 nt, Homo sapiens
ccaaguuccugcaguucuu

SEQ ID NO: 935309 - RNA, 19 nt, Homo sapiens
guaugaggcucccgacaag

SEQ ID NO: 935310 - RNA, 19 nt, Homo sapiens
gaugaaguacucggaaauu

SEQ ID NO: 935311 - RNA, 19 nt, Homo sapiens
ccaagacacugcuggaaaa

SEQ ID NO: 935312 - RNA, 19 nt, Homo sapiens
ugaaguacucggaaauuga

SEQ ID NO: 935313 - RNA, 19 nt, Homo sapiens
ggaccaugaugagaacguu

SEQ ID NO: 935314 - RNA, 19 nt, Homo sapiens
ggacccaggaccaugauga

SEQ ID NO: 935315 - RNA, 19 nt, Homo sapiens
aggagaggcuggcggcuuu

SEQ ID NO: 935316 - RNA, 19 nt, Homo sapiens
uccagugccugucggauaa

SEQ ID NO: 935317 - RNA, 19 nt, Homo sapiens
ucaaaggccuccucuucca

SEQ ID NO: 935318 - RNA, 19 nt, Homo sapiens
gugcaggacuuuauuuuau

SEQ ID NO: 935319 - RNA, 19 nt, Homo sapiens
acaaggacuuuaugauagu

SEQ ID NO: 935320 - RNA, 19 nt, Homo sapiens
agaguggcuuccugccuua

SEQ ID NO: 935321 - RNA, 19 nt, Homo sapiens
uggcagacuucaucaaaca

SEQ ID NO: 935322 - RNA, 19 nt, Homo sapiens
uucaacaacuaccugauuu

SEQ ID NO: 935323 - RNA, 19 nt, Homo sapiens
caacgugaaggcacacuau

SEQ ID NO: 935324 - RNA, 19 nt, Homo sapiens
ccgaguggguggucaagga

SEQ ID NO: 935325 - RNA, 19 nt, Homo sapiens
cuucaucgagcaccuauuu

SEQ ID NO: 935326 - RNA, 19 nt, Homo sapiens
gcgcugauggacaauauug

SEQ ID NO: 935327 - RNA, 19 nt, Homo sapiens
gcucaaggacgaagacaag

SEQ ID NO: 935328 - RNA, 19 nt, Homo sapiens
gaaauaccagcacaagaac

SEQ ID NO: 935329 - RNA, 19 nt, Homo sapiens
acacuucccuaaccuugga

SEQ ID NO: 935330 - RNA, 19 nt, Homo sapiens
cggaauacauccagaagcu

SEQ ID NO: 935331 - RNA, 19 nt, Homo sapiens
caaccugguggaaaucauu

SEQ ID NO: 935332 - RNA, 19 nt, Homo sapiens
uaguagcacuggaucuguu

SEQ ID NO: 935333 - RNA, 19 nt, Homo sapiens
cauccucuaugacgccauu

SEQ ID NO: 935334 - RNA, 19 nt, Homo sapiens
gcacaagaaccugcucauc

SEQ ID NO: 935335 - RNA, 19 nt, Homo sapiens
ucaguggccucauccucaa

SEQ ID NO: 935336 - RNA, 19 nt, Homo sapiens
gggaguggauuuucaugaa

SEQ ID NO: 935337 - RNA, 19 nt, Homo sapiens
gauaguagcacuggaucug

SEQ ID NO: 935338 - RNA, 19 nt, Homo sapiens
gaaccugcucauccucuau

SEQ ID NO: 935339 - RNA, 19 nt, Homo sapiens
gaaguacucggaaauugac

SEQ ID NO: 935340 - RNA, 19 nt, Homo sapiens
ggaugaaguacucggaaau

SEQ ID NO: 935341 - RNA, 19 nt, Homo sapiens
cugcuuaacucggaggauu

SEQ ID NO: 935342 - RNA, 19 nt, Homo sapiens
agggugagcugcagaugug

SEQ ID NO: 935343 - RNA, 19 nt, Homo sapiens
gaggcuggcggcuuucuau

SEQ ID NO: 935344 - RNA, 19 nt, Homo sapiens
gcagacacuucccuaaccu

SEQ ID NO: 935345 - RNA, 19 nt, Homo sapiens
cccaggcgcugauggacaa

SEQ ID NO: 935346 - RNA, 19 nt, Homo sapiens
agauccggcuugcuacaaa

SEQ ID NO: 935347 - RNA, 19 nt, Homo sapiens
gcagaugguccucaacaac

SEQ ID NO: 935348 - RNA, 19 nt, Homo sapiens
cuucagacgucgcaaggau

SEQ ID NO: 935349 - RNA, 19 nt, Homo sapiens
ccagcacccugagcaguau

SEQ ID NO: 935350 - RNA, 19 nt, Homo sapiens
gggaaauaccagcacaaga

SEQ ID NO: 935351 - RNA, 19 nt, Homo sapiens
gaucugugaagacucauca

SEQ ID NO: 935352 - RNA, 19 nt, Homo sapiens
ucaggaacaucagggacaa

SEQ ID NO: 935353 - RNA, 19 nt, Homo sapiens
ggccauuggugaaauuugc

SEQ ID NO: 935354 - RNA, 19 nt, Homo sapiens
acaagaaccugcucauccu

SEQ ID NO: 935355 - RNA, 19 nt, Homo sapiens
ggacagugacgcccucaac

SEQ ID NO: 935356 - RNA, 19 nt, Homo sapiens
gaaccggaaaccuaggaau

SEQ ID NO: 935357 - RNA, 19 nt, Homo sapiens
acucaaaggccuccucuuc

SEQ ID NO: 935358 - RNA, 19 nt, Homo sapiens
ggaggaugacgaugaugau

SEQ ID NO: 935359 - RNA, 19 nt, Homo sapiens
acagugagcaggacaucaa

SEQ ID NO: 935360 - RNA, 19 nt, Homo sapiens
uggacaauauugacaccuu

SEQ ID NO: 935361 - RNA, 19 nt, Homo sapiens
ucaccaccaucgcuuccaa

SEQ ID NO: 935362 - RNA, 19 nt, Homo sapiens
cagcaguucucugagcaau

SEQ ID NO: 935363 - RNA, 19 nt, Homo sapiens
gcaggacuuuauuuuauuc

SEQ ID NO: 935364 - RNA, 19 nt, Homo sapiens
cagagaugcagccuuaugu

SEQ ID NO: 935365 - RNA, 19 nt, Homo sapiens
caucaugacauuguuguuc

SEQ ID NO: 935366 - RNA, 19 nt, Homo sapiens
ucaaccagccggaauacau

SEQ ID NO: 935367 - RNA, 19 nt, Homo sapiens
ugagaacguugcccuugag

SEQ ID NO: 935368 - RNA, 19 nt, Homo sapiens
acugagauccggcuugcua

SEQ ID NO: 935369 - RNA, 19 nt, Homo sapiens
caaccagccggaauacauc

SEQ ID NO: 935370 - RNA, 19 nt, Homo sapiens
agaaccugcucauccucua

SEQ ID NO: 935371 - RNA, 19 nt, Homo sapiens
ccaggaccaugaugagaac

SEQ ID NO: 935372 - RNA, 19 nt, Homo sapiens
gcacagcaucauccaguac

SEQ ID NO: 935373 - RNA, 19 nt, Homo sapiens
ugaagacucaucagagcuu

SEQ ID NO: 935374 - RNA, 19 nt, Homo sapiens
agaauuuccugcgcuguuc

SEQ ID NO: 935375 - RNA, 19 nt, Homo sapiens
aggagugucucaacaacau

SEQ ID NO: 935376 - RNA, 19 nt, Homo sapiens
cuucaacaacuaccugauu

SEQ ID NO: 935377 - RNA, 19 nt, Homo sapiens
gcccgcagcaacaucauga

SEQ ID NO: 935378 - RNA, 19 nt, Homo sapiens
gacuggaauuugaggaagu

SEQ ID NO: 935379 - RNA, 19 nt, Homo sapiens
cagaauuuccugcgcuguu

SEQ ID NO: 935380 - RNA, 19 nt, Homo sapiens
uccugcagcugcucaaaga

SEQ ID NO: 935381 - RNA, 19 nt, Homo sapiens
uuccugacuucaacaacua

SEQ ID NO: 935382 - RNA, 19 nt, Homo sapiens
ccaccaccaccaccacuga

SEQ ID NO: 935383 - RNA, 19 nt, Homo sapiens
gggugagcccgaaggauga

SEQ ID NO: 935384 - RNA, 19 nt, Homo sapiens
ggaguggauuuucaugaau

SEQ ID NO: 935385 - RNA, 19 nt, Homo sapiens
gcucaggccaugauguaca

SEQ ID NO: 935386 - RNA, 19 nt, Homo sapiens
augaaguacucggaaauug

SEQ ID NO: 935387 - RNA, 19 nt, Homo sapiens
ucgcaaggaucaagaaaau

SEQ ID NO: 935388 - RNA, 19 nt, Homo sapiens
caagagaccugguuagaaa

SEQ ID NO: 935389 - RNA, 19 nt, Homo sapiens
caagaaggcuuaagaacuu

SEQ ID NO: 935390 - RNA, 19 nt, Homo sapiens
ggaaauacuucaugaaauc

SEQ ID NO: 935391 - RNA, 19 nt, Homo sapiens
ccacaauucuggaacuaua

SEQ ID NO: 935392 - RNA, 19 nt, Homo sapiens
gguauaacauguugaaaug

SEQ ID NO: 935393 - RNA, 19 nt, Homo sapiens
gaaggucucuguguagaaa

SEQ ID NO: 935394 - RNA, 19 nt, Homo sapiens
gcuagaaggucucugugua

SEQ ID NO: 935395 - RNA, 19 nt, Homo sapiens
gcacugcucugaagaucuu

SEQ ID NO: 935396 - RNA, 19 nt, Homo sapiens
gaaaguggaccuaguuaug

SEQ ID NO: 935397 - RNA, 19 nt, Homo sapiens
caacagcgauuugauggaa

SEQ ID NO: 935398 - RNA, 19 nt, Homo sapiens
aaauaaagauugcccaguu

SEQ ID NO: 935399 - RNA, 19 nt, Homo sapiens
cuacaagugugaaagaauu

SEQ ID NO: 935400 - RNA, 19 nt, Homo sapiens
guagaaacguacaauaaca

SEQ ID NO: 935401 - RNA, 19 nt, Homo sapiens
ugacaagcauuuaauagga

SEQ ID NO: 935402 - RNA, 19 nt, Homo sapiens
caacgcauuuggaagaauu

SEQ ID NO: 935403 - RNA, 19 nt, Homo sapiens
gacacaacauuacagaauu

SEQ ID NO: 935404 - RNA, 19 nt, Homo sapiens
ggagauuucuaaacauugu

SEQ ID NO: 935405 - RNA, 19 nt, Homo sapiens
aauaaagauugcccaguua

SEQ ID NO: 935406 - RNA, 19 nt, Homo sapiens
ugaacaagcugaacgacuu

SEQ ID NO: 935407 - RNA, 19 nt, Homo sapiens
acauaugucuuaucaggua

SEQ ID NO: 935408 - RNA, 19 nt, Homo sapiens
ggacacaacauuacagaau

SEQ ID NO: 935409 - RNA, 19 nt, Homo sapiens
ccaaguagcugggaauaca

SEQ ID NO: 935410 - RNA, 19 nt, Homo sapiens
cgacugggcugaagugauc

SEQ ID NO: 935411 - RNA, 19 nt, Homo sapiens
ggaaugucaucuacgaaga

SEQ ID NO: 935412 - RNA, 19 nt, Homo sapiens
caugaugauucuucagaua

SEQ ID NO: 935413 - RNA, 19 nt, Homo sapiens
ggaccaagcaugaugauuc

SEQ ID NO: 935414 - RNA, 19 nt, Homo sapiens
caggagauuucuaaacauu

SEQ ID NO: 935415 - RNA, 19 nt, Homo sapiens
gcauuugagugcaagauau

SEQ ID NO: 935416 - RNA, 19 nt, Homo sapiens
ccaguuagauuugaauuuc

SEQ ID NO: 935417 - RNA, 19 nt, Homo sapiens
gaagguccaagaaggcuua

SEQ ID NO: 935418 - RNA, 19 nt, Homo sapiens
ggacugugcugucaaacca

SEQ ID NO: 935419 - RNA, 19 nt, Homo sapiens
guucauacgugcuuuaucu

SEQ ID NO: 935420 - RNA, 19 nt, Homo sapiens
gacaagcauuuaauaggaa

SEQ ID NO: 935421 - RNA, 19 nt, Homo sapiens
acuaagggcuuuauccaaa

SEQ ID NO: 935422 - RNA, 19 nt, Homo sapiens
uaauagaacuaagggcuuu

SEQ ID NO: 935423 - RNA, 19 nt, Homo sapiens
gauuguaccugugauguug

SEQ ID NO: 935424 - RNA, 19 nt, Homo sapiens
uaggguaggcuauuuauuu

SEQ ID NO: 935425 - RNA, 19 nt, Homo sapiens
cacaggagauuucuaaaca

SEQ ID NO: 935426 - RNA, 19 nt, Homo sapiens
uaaggaggccucauaaaug

SEQ ID NO: 935427 - RNA, 19 nt, Homo sapiens
gcaaauaugccagaaagug

SEQ ID NO: 935428 - RNA, 19 nt, Homo sapiens
uuacccagauucacuaauu

SEQ ID NO: 935429 - RNA, 19 nt, Homo sapiens
caagaauuauggauugugu

SEQ ID NO: 935430 - RNA, 19 nt, Homo sapiens
gugacuacuuuagguauua

SEQ ID NO: 935431 - RNA, 19 nt, Homo sapiens
ggaacuuguuacagaauau

SEQ ID NO: 935432 - RNA, 19 nt, Homo sapiens
gaagaagccaauaaucuca

SEQ ID NO: 935433 - RNA, 19 nt, Homo sapiens
gcugauaugugccuguuuc

SEQ ID NO: 935434 - RNA, 19 nt, Homo sapiens
caugguaauuguagagaaa

SEQ ID NO: 935435 - RNA, 19 nt, Homo sapiens
gaaguucauuuccuuuguc

SEQ ID NO: 935436 - RNA, 19 nt, Homo sapiens
uaucagguauaacauguug

SEQ ID NO: 935437 - RNA, 19 nt, Homo sapiens
cuaaauacuucagugugua

SEQ ID NO: 935438 - RNA, 19 nt, Homo sapiens
uagcaaauaugccagaaag

SEQ ID NO: 935439 - RNA, 19 nt, Homo sapiens
cccugaagcugaauaugua

SEQ ID NO: 935440 - RNA, 19 nt, Homo sapiens
gaauuaaaucugcgagcua

SEQ ID NO: 935441 - RNA, 19 nt, Homo sapiens
ggacaauggaggcgaaaga

SEQ ID NO: 935442 - RNA, 19 nt, Homo sapiens
caucuaaccagacaagaaa

SEQ ID NO: 935443 - RNA, 19 nt, Homo sapiens
gaacuaagggcuuuaucca

SEQ ID NO: 935444 - RNA, 19 nt, Homo sapiens
gaagcugaauauguagauu

SEQ ID NO: 935445 - RNA, 19 nt, Homo sapiens
gauguugaaaccauugaua

SEQ ID NO: 935446 - RNA, 19 nt, Homo sapiens
gaaggagaagguccaagaa

SEQ ID NO: 935447 - RNA, 19 nt, Homo sapiens
gcgcuacacugguuacaag

SEQ ID NO: 935448 - RNA, 19 nt, Homo sapiens
cuaaggaggccucauaaau

SEQ ID NO: 935449 - RNA, 19 nt, Homo sapiens
gggaccagaugcuuggaaa

SEQ ID NO: 935450 - RNA, 19 nt, Homo sapiens
gaagaggccguguccuuuc

SEQ ID NO: 935451 - RNA, 19 nt, Homo sapiens
gaacuauaauacuguaagc

SEQ ID NO: 935452 - RNA, 19 nt, Homo sapiens
ucaggaacuuguuacagaa

SEQ ID NO: 935453 - RNA, 19 nt, Homo sapiens
ggggaaagcuucagacuca

SEQ ID NO: 935454 - RNA, 19 nt, Homo sapiens
uuucaacucuuuacuggaa

SEQ ID NO: 935455 - RNA, 19 nt, Homo sapiens
gaccaagcaugaugauucu

SEQ ID NO: 935456 - RNA, 19 nt, Homo sapiens
caccucagccucccaagua

SEQ ID NO: 935457 - RNA, 19 nt, Homo sapiens
ccuaaauacuucagugugu

SEQ ID NO: 935458 - RNA, 19 nt, Homo sapiens
cagauucacuaauuguuca

SEQ ID NO: 935459 - RNA, 19 nt, Homo sapiens
uauccaaaguguuaccauu

SEQ ID NO: 935460 - RNA, 19 nt, Homo sapiens
gaacuuguauuuucucuac

SEQ ID NO: 935461 - RNA, 19 nt, Homo sapiens
gaaaagaaauggggacaca

SEQ ID NO: 935462 - RNA, 19 nt, Homo sapiens
cugugaagcugaugacauu

SEQ ID NO: 935463 - RNA, 19 nt, Homo sapiens
gaagcuauauaccucaaaa

SEQ ID NO: 935464 - RNA, 19 nt, Homo sapiens
aaacuucaggaacuuguua

SEQ ID NO: 935465 - RNA, 19 nt, Homo sapiens
cgaaguucauuuccuuugu

SEQ ID NO: 935466 - RNA, 19 nt, Homo sapiens
gaacgacugggcugaagug

SEQ ID NO: 935467 - RNA, 19 nt, Homo sapiens
caaaggcacaggagauuuc

SEQ ID NO: 935468 - RNA, 19 nt, Homo sapiens
ucaaaggcauaauagcaau

SEQ ID NO: 935469 - RNA, 19 nt, Homo sapiens
gaaugucaucuacgaagaa

SEQ ID NO: 935470 - RNA, 19 nt, Homo sapiens
gcaugaugauucuucagau

SEQ ID NO: 935471 - RNA, 19 nt, Homo sapiens
ugaagaaugugaacaagcu

SEQ ID NO: 935472 - RNA, 19 nt, Homo sapiens
caccauacccaguuucauu

SEQ ID NO: 935473 - RNA, 19 nt, Homo sapiens
cuuaaacccuaaauacuuc

SEQ ID NO: 935474 - RNA, 19 nt, Homo sapiens
ccagaaaguggaccuaguu

SEQ ID NO: 935475 - RNA, 19 nt, Homo sapiens
aaagaagcacacaaacuaa

SEQ ID NO: 935476 - RNA, 19 nt, Homo sapiens
gugguuacuuggaugauug

SEQ ID NO: 935477 - RNA, 19 nt, Homo sapiens
ucacauuaguaguaaagug

SEQ ID NO: 935478 - RNA, 19 nt, Homo sapiens
guuccaaucuaaaguucuu

SEQ ID NO: 935479 - RNA, 19 nt, Homo sapiens
uaacugggagucuuguauu

SEQ ID NO: 935480 - RNA, 19 nt, Homo sapiens
cagaaaguggaccuaguua

SEQ ID NO: 935481 - RNA, 19 nt, Homo sapiens
gauagcaaauaugccagaa

SEQ ID NO: 935482 - RNA, 19 nt, Homo sapiens
ucugagaaauugauagcaa

SEQ ID NO: 935483 - RNA, 19 nt, Homo sapiens
ggcuuaagaacuuguauuu

SEQ ID NO: 935484 - RNA, 19 nt, Homo sapiens
gaauuucaacagcgauuug

SEQ ID NO: 935485 - RNA, 19 nt, Homo sapiens
agagcauucuacagacuua

SEQ ID NO: 935486 - RNA, 19 nt, Homo sapiens
caaguuccaaucuaaaguu

SEQ ID NO: 935487 - RNA, 19 nt, Homo sapiens
cauacgugcuuuaucuuuc

SEQ ID NO: 935488 - RNA, 19 nt, Homo sapiens
ugaauucccucaugagcua

SEQ ID NO: 935489 - RNA, 19 nt, Homo sapiens
gcaccugcccugaugguua

SEQ ID NO: 935490 - RNA, 19 nt, Homo sapiens
uaacuugccuggcuccuau

SEQ ID NO: 935491 - RNA, 19 nt, Homo sapiens
gagcagccuucauccauug

SEQ ID NO: 935492 - RNA, 19 nt, Homo sapiens
gcccagagauuuggacuug

SEQ ID NO: 935493 - RNA, 19 nt, Homo sapiens
gcuaugagcccgacgauca

SEQ ID NO: 935494 - RNA, 19 nt, Homo sapiens
ccaaaccugugucaacuuc

SEQ ID NO: 935495 - RNA, 19 nt, Homo sapiens
ccagcuaccucugucagua

SEQ ID NO: 935496 - RNA, 19 nt, Homo sapiens
ggacagcuguguggaugug

SEQ ID NO: 935497 - RNA, 19 nt, Homo sapiens
uggauaagcccuaguaguu

SEQ ID NO: 935498 - RNA, 19 nt, Homo sapiens
ggaaugcacagauggcuau

SEQ ID NO: 935499 - RNA, 19 nt, Homo sapiens
ccaagacauugaugagugu

SEQ ID NO: 935500 - RNA, 19 nt, Homo sapiens
cugaagagcccgacagcua

SEQ ID NO: 935501 - RNA, 19 nt, Homo sapiens
ccacacgccucugccaaga

SEQ ID NO: 935502 - RNA, 19 nt, Homo sapiens
gaggcucaccgucuuugua

SEQ ID NO: 935503 - RNA, 19 nt, Homo sapiens
gagagcagccuucauccau

SEQ ID NO: 935504 - RNA, 19 nt, Homo sapiens
gcccuggguuccauuccua

SEQ ID NO: 935505 - RNA, 19 nt, Homo sapiens
gcccgaguguguggacaua

SEQ ID NO: 935506 - RNA, 19 nt, Homo sapiens
ggauaagcccuaguaguuc

SEQ ID NO: 935507 - RNA, 19 nt, Homo sapiens
cuacaaugccuuucagauc

SEQ ID NO: 935508 - RNA, 19 nt, Homo sapiens
ggaaaugaagugcaucaac

SEQ ID NO: 935509 - RNA, 19 nt, Homo sapiens
gcuccuguguugaugugaa

SEQ ID NO: 935510 - RNA, 19 nt, Homo sapiens
guaguucccugggccuguu

SEQ ID NO: 935511 - RNA, 19 nt, Homo sapiens
uaacucugccucaaacugu

SEQ ID NO: 935512 - RNA, 19 nt, Homo sapiens
gcaccacgagcuucaguca

SEQ ID NO: 935513 - RNA, 19 nt, Homo sapiens
agagcagccuucauccauu

SEQ ID NO: 935514 - RNA, 19 nt, Homo sapiens
gcccaaaccugugucaacu

SEQ ID NO: 935515 - RNA, 19 nt, Homo sapiens
ccgaguguguggacauaga

SEQ ID NO: 935516 - RNA, 19 nt, Homo sapiens
gaugucaacgagugucuga

SEQ ID NO: 935517 - RNA, 19 nt, Homo sapiens
ccaggacugccauaacuug

SEQ ID NO: 935518 - RNA, 19 nt, Homo sapiens
gaagagcccgacagcuaca

SEQ ID NO: 935519 - RNA, 19 nt, Homo sapiens
ccgcugacguguuccagau

SEQ ID NO: 935520 - RNA, 19 nt, Homo sapiens
acacgccucugccaagaca

SEQ ID NO: 935521 - RNA, 19 nt, Homo sapiens
cagugcaccugcccugaug

SEQ ID NO: 935522 - RNA, 19 nt, Homo sapiens
ucugggcgcugcuacuguu

SEQ ID NO: 935523 - RNA, 19 nt, Homo sapiens
ucagauccgugcuggaaac

SEQ ID NO: 935524 - RNA, 19 nt, Homo sapiens
gaugugaacgagugugaca

SEQ ID NO: 935525 - RNA, 19 nt, Homo sapiens
ggcuucuccugcagugaua

SEQ ID NO: 935526 - RNA, 19 nt, Homo sapiens
ccugaugguuaccgcaaga

SEQ ID NO: 935527 - RNA, 19 nt, Homo sapiens
cgggccagcucuguacuga

SEQ ID NO: 935528 - RNA, 19 nt, Homo sapiens
gccacugcccacaggguua

SEQ ID NO: 935529 - RNA, 19 nt, Homo sapiens
caccugcccugaugguuac

SEQ ID NO: 935530 - RNA, 19 nt, Homo sapiens
cuaacaaccgcuccugugu

SEQ ID NO: 935531 - RNA, 19 nt, Homo sapiens
ccgcugccgucaucaacga

SEQ ID NO: 935532 - RNA, 19 nt, Homo sapiens
gcugaggagccuguuguga

SEQ ID NO: 935533 - RNA, 19 nt, Homo sapiens
aaaccugugucaacuucca

SEQ ID NO: 935534 - RNA, 19 nt, Homo sapiens
cccgacagcuacacggaau

SEQ ID NO: 935535 - RNA, 19 nt, Homo sapiens
ugccucaaacuguacauuu

SEQ ID NO: 935536 - RNA, 19 nt, Homo sapiens
gucgagagcagccuucauc

SEQ ID NO: 935537 - RNA, 19 nt, Homo sapiens
uacauuaggcaaaucaaca

SEQ ID NO: 935538 - RNA, 19 nt, Homo sapiens
gaagcaagauauuguuugu

SEQ ID NO: 935539 - RNA, 19 nt, Homo sapiens
ggaggacaccgacuaauuu

SEQ ID NO: 935540 - RNA, 19 nt, Homo sapiens
ggacucaccugacuuugga

SEQ ID NO: 935541 - RNA, 19 nt, Homo sapiens
ggaaaggacucaccugacu

SEQ ID NO: 935542 - RNA, 19 nt, Homo sapiens
caacugagcagaugacaug

SEQ ID NO: 935543 - RNA, 19 nt, Homo sapiens
caagaaacccaguucauug

SEQ ID NO: 935544 - RNA, 19 nt, Homo sapiens
acacgcauaucuuuacuuu

SEQ ID NO: 935545 - RNA, 19 nt, Homo sapiens
caugaagccugcauucuug

SEQ ID NO: 935546 - RNA, 19 nt, Homo sapiens
ucacuacucuccucuccua

SEQ ID NO: 935547 - RNA, 19 nt, Homo sapiens
ugagaguggugucuggaua

SEQ ID NO: 935548 - RNA, 19 nt, Homo sapiens
gcaugaagccugcauucuu

SEQ ID NO: 935549 - RNA, 19 nt, Homo sapiens
gggaauggcccacaucuca

SEQ ID NO: 935550 - RNA, 19 nt, Homo sapiens
gagcagaugacaugaugaa

SEQ ID NO: 935551 - RNA, 19 nt, Homo sapiens
ccaguacccucccaagaug

SEQ ID NO: 935552 - RNA, 19 nt, Homo sapiens
ccaagaaacccaguucauu

SEQ ID NO: 935553 - RNA, 19 nt, Homo sapiens
acaguaacuuucaaccuuu

SEQ ID NO: 935554 - RNA, 19 nt, Homo sapiens
uacaguaacuuucaaccuu

SEQ ID NO: 935555 - RNA, 19 nt, Homo sapiens
aacuaaagcucacaaacaa

SEQ ID NO: 935556 - RNA, 19 nt, Homo sapiens
gcccacaucucaagaagca

SEQ ID NO: 935557 - RNA, 19 nt, Homo sapiens
gcccuucucuguuuaguag

SEQ ID NO: 935558 - RNA, 19 nt, Homo sapiens
cgagauuacucagcugaaa

SEQ ID NO: 935559 - RNA, 19 nt, Homo sapiens
cagaugacaugaugaaagg

SEQ ID NO: 935560 - RNA, 19 nt, Homo sapiens
uccagucccuccauaagua

SEQ ID NO: 935561 - RNA, 19 nt, Homo sapiens
aaacuaaagcucacaaaca

SEQ ID NO: 935562 - RNA, 19 nt, Homo sapiens
gcagaugacaugaugaaag

SEQ ID NO: 935563 - RNA, 19 nt, Homo sapiens
gggaggcuauuuauuguac

SEQ ID NO: 935564 - RNA, 19 nt, Homo sapiens
ucaagaagcaagauauugu

SEQ ID NO: 935565 - RNA, 19 nt, Homo sapiens
gagaaaagaagacaagaaa

SEQ ID NO: 935566 - RNA, 19 nt, Homo sapiens
gaugaaaggaacagaaaca

SEQ ID NO: 935567 - RNA, 19 nt, Homo sapiens
ccaacaaugugacccagau

SEQ ID NO: 935568 - RNA, 19 nt, Homo sapiens
acacguauguuauaaccau

SEQ ID NO: 935569 - RNA, 19 nt, Homo sapiens
gcauaucuuuacuuuccaa

SEQ ID NO: 935570 - RNA, 19 nt, Homo sapiens
gauauuguuuguggugguu

SEQ ID NO: 935571 - RNA, 19 nt, Homo sapiens
caagaagcaagauauuguu

SEQ ID NO: 935572 - RNA, 19 nt, Homo sapiens
gaaaggacucaccugacuu

SEQ ID NO: 935573 - RNA, 19 nt, Homo sapiens
guuaaucccugauccaaaa

SEQ ID NO: 935574 - RNA, 19 nt, Homo sapiens
gaaaagaagacaagaaagu

SEQ ID NO: 935575 - RNA, 19 nt, Homo sapiens
uuacucagcugaaaauuga

SEQ ID NO: 935576 - RNA, 19 nt, Homo sapiens
ggaagcugaaggacaguuu

SEQ ID NO: 935577 - RNA, 19 nt, Homo sapiens
ggacccaacugucaauucc

SEQ ID NO: 935578 - RNA, 19 nt, Homo sapiens
gccaggaaguuucauuugg

SEQ ID NO: 935579 - RNA, 19 nt, Homo sapiens
gcuauuuauuguacugaga

SEQ ID NO: 935580 - RNA, 19 nt, Homo sapiens
gaacuuugaguccauguac

SEQ ID NO: 935581 - RNA, 19 nt, Homo sapiens
ggaaacuaaagcucacaaa

SEQ ID NO: 935582 - RNA, 19 nt, Homo sapiens
gaggacaccgacuaauuug

SEQ ID NO: 935583 - RNA, 19 nt, Homo sapiens
cuaccagaaugccgagauu

SEQ ID NO: 935584 - RNA, 19 nt, Homo sapiens
gaaacuaaagcucacaaac

SEQ ID NO: 935585 - RNA, 19 nt, Homo sapiens
agaguggugucuggauaua

SEQ ID NO: 935586 - RNA, 19 nt, Homo sapiens
agacuccacuuucuuccuu

SEQ ID NO: 935587 - RNA, 19 nt, Homo sapiens
gaugacaugaugaaaggaa

SEQ ID NO: 935588 - RNA, 19 nt, Homo sapiens
aguggugucuggauauauu

SEQ ID NO: 935589 - RNA, 19 nt, Homo sapiens
ccaaaggauuccgggagaa

SEQ ID NO: 935590 - RNA, 19 nt, Homo sapiens
guagaagccaggcgucaga

SEQ ID NO: 935591 - RNA, 19 nt, Homo sapiens
caacacgcauaucuuuacu

SEQ ID NO: 935592 - RNA, 19 nt, Homo sapiens
gagaguggugucuggauau

SEQ ID NO: 935593 - RNA, 19 nt, Homo sapiens
ggaauggcccacaucucaa

SEQ ID NO: 935594 - RNA, 19 nt, Homo sapiens
uaacuacagucguuuaccu

SEQ ID NO: 935595 - RNA, 19 nt, Homo sapiens
ggcccaccauguccuacua

SEQ ID NO: 935596 - RNA, 19 nt, Homo sapiens
gggagaacuuugaguccau

SEQ ID NO: 935597 - RNA, 19 nt, Homo sapiens
gugcuccagucccuccaua

SEQ ID NO: 935598 - RNA, 19 nt, Homo sapiens
gcgccaggaaguuucauuu

SEQ ID NO: 935599 - RNA, 19 nt, Homo sapiens
gacggcggauguucccauu

SEQ ID NO: 935600 - RNA, 19 nt, Homo sapiens
cugagcagaugacaugaug

SEQ ID NO: 935601 - RNA, 19 nt, Homo sapiens
gauguucccauuccuguca

SEQ ID NO: 935602 - RNA, 19 nt, Homo sapiens
uuaaucagcaccagacaga

SEQ ID NO: 935603 - RNA, 19 nt, Homo sapiens
uggaggacaccgacuaauu

SEQ ID NO: 935604 - RNA, 19 nt, Homo sapiens
acgcauaucuuuacuuucc

SEQ ID NO: 935605 - RNA, 19 nt, Homo sapiens
cuaaagcucacaaacaaca

SEQ ID NO: 935606 - RNA, 19 nt, Homo sapiens
gaggcuauuuauuguacug

SEQ ID NO: 935607 - RNA, 19 nt, Homo sapiens
gaaagucuugggcaugaag

SEQ ID NO: 935608 - RNA, 19 nt, Homo sapiens
caaugugacccagaugauu

SEQ ID NO: 935609 - RNA, 19 nt, Homo sapiens
gaauggcccacaucucaag

SEQ ID NO: 935610 - RNA, 19 nt, Homo sapiens
uuucuuccuuuguacagua

SEQ ID NO: 935611 - RNA, 19 nt, Homo sapiens
gcuaugaggcugaguuucg

SEQ ID NO: 935612 - RNA, 19 nt, Homo sapiens
gugacugccuaccagaaug

SEQ ID NO: 935613 - RNA, 19 nt, Homo sapiens
ccaacacgcauaucuuuac

SEQ ID NO: 935614 - RNA, 19 nt, Homo sapiens
gcauaucguugaggugaac

SEQ ID NO: 935615 - RNA, 19 nt, Homo sapiens
ccacuuucuuccuuuguac

SEQ ID NO: 935616 - RNA, 19 nt, Homo sapiens
aaugugacccagaugauug

SEQ ID NO: 935617 - RNA, 19 nt, Homo sapiens
ucucaagaagcaagauauu

SEQ ID NO: 935618 - RNA, 19 nt, Homo sapiens
cuguugugguccaaguuua

SEQ ID NO: 935619 - RNA, 19 nt, Homo sapiens
uccacuuucuuccuuugua

SEQ ID NO: 935620 - RNA, 19 nt, Homo sapiens
ggagaaaagaagacaagaa

SEQ ID NO: 935621 - RNA, 19 nt, Homo sapiens
ccucugcccuaacuacagu

SEQ ID NO: 935622 - RNA, 19 nt, Homo sapiens
guuggaggacaccgacuaa

SEQ ID NO: 935623 - RNA, 19 nt, Homo sapiens
caugaugaaaggaacagaa

SEQ ID NO: 935624 - RNA, 19 nt, Homo sapiens
gcugaaggacaguuuuaua

SEQ ID NO: 935625 - RNA, 19 nt, Homo sapiens
ccauuccugucauuuacug

SEQ ID NO: 935626 - RNA, 19 nt, Homo sapiens
agaagcaagauauuguuug

SEQ ID NO: 935627 - RNA, 19 nt, Homo sapiens
aaucagcaccagacagaga

SEQ ID NO: 935628 - RNA, 19 nt, Homo sapiens
gacuccacuuucuuccuuu

SEQ ID NO: 935629 - RNA, 19 nt, Homo sapiens
uaauuugggaaacggauga

SEQ ID NO: 935630 - RNA, 19 nt, Homo sapiens
gguuggaggacaccgacua

SEQ ID NO: 935631 - RNA, 19 nt, Homo sapiens
ugaaaggaacagaaacagu

SEQ ID NO: 935632 - RNA, 19 nt, Homo sapiens
ugauaaggaagcugaagga

SEQ ID NO: 935633 - RNA, 19 nt, Homo sapiens
cagcaugaagccugcauuc

SEQ ID NO: 935634 - RNA, 19 nt, Homo sapiens
uaccagaaugccgagauua

SEQ ID NO: 935635 - RNA, 19 nt, Homo sapiens
uaacuauuuucccaacuga

SEQ ID NO: 935636 - RNA, 19 nt, Homo sapiens
caacaaugugacccagaug

SEQ ID NO: 935637 - RNA, 19 nt, Homo sapiens
uccaacacgcauaucuuua

SEQ ID NO: 935638 - RNA, 19 nt, Homo sapiens
ggucacaugugccaauuua

SEQ ID NO: 935639 - RNA, 19 nt, Homo sapiens
gaacaaagacucaaagaag

SEQ ID NO: 935640 - RNA, 19 nt, Homo sapiens
gcagacaccauguaaguua

SEQ ID NO: 935641 - RNA, 19 nt, Homo sapiens
gaagacaugcucucacaua

SEQ ID NO: 935642 - RNA, 19 nt, Homo sapiens
guacauaguuuaaccaagu

SEQ ID NO: 935643 - RNA, 19 nt, Homo sapiens
ggaauuaaaggucauauga

SEQ ID NO: 935644 - RNA, 19 nt, Homo sapiens
gcaaagagaaugauacaga

SEQ ID NO: 935645 - RNA, 19 nt, Homo sapiens
ucaauaaucuccacucaug

SEQ ID NO: 935646 - RNA, 19 nt, Homo sapiens
gcuguuaccucaaagaaga

SEQ ID NO: 935647 - RNA, 19 nt, Homo sapiens
caacaaaccgugauugaug

SEQ ID NO: 935648 - RNA, 19 nt, Homo sapiens
gacaugcucucacauauag

SEQ ID NO: 935649 - RNA, 19 nt, Homo sapiens
ggaaaacacucugauguaa

SEQ ID NO: 935650 - RNA, 19 nt, Homo sapiens
guaaagaugagcaaacauu

SEQ ID NO: 935651 - RNA, 19 nt, Homo sapiens
gaacacacucugcaacuau

SEQ ID NO: 935652 - RNA, 19 nt, Homo sapiens
caacuuucaucaccaauca

SEQ ID NO: 935653 - RNA, 19 nt, Homo sapiens
caaagagaaugauacagau

SEQ ID NO: 935654 - RNA, 19 nt, Homo sapiens
agaagaaggucacaucugu

SEQ ID NO: 935655 - RNA, 19 nt, Homo sapiens
gagcaaacccaaagucaug

SEQ ID NO: 935656 - RNA, 19 nt, Homo sapiens
ucucuugccucuuaaguuu

SEQ ID NO: 935657 - RNA, 19 nt, Homo sapiens
gagaaggcccauuguuaaa

SEQ ID NO: 935658 - RNA, 19 nt, Homo sapiens
aagagaaggcccauuguua

SEQ ID NO: 935659 - RNA, 19 nt, Homo sapiens
gagcauuuauucagaucaa

SEQ ID NO: 935660 - RNA, 19 nt, Homo sapiens
uaacaacuuucaucaccaa

SEQ ID NO: 935661 - RNA, 19 nt, Homo sapiens
aggaguaucugcuuguuaa

SEQ ID NO: 935662 - RNA, 19 nt, Homo sapiens
gaguacaugcuaaucaaua

SEQ ID NO: 935663 - RNA, 19 nt, Homo sapiens
ucacaucuguugccuggaa

SEQ ID NO: 935664 - RNA, 19 nt, Homo sapiens
ccgaaaggccagugucuua

SEQ ID NO: 935665 - RNA, 19 nt, Homo sapiens
caaguauuguugaaagcua

SEQ ID NO: 935666 - RNA, 19 nt, Homo sapiens
caaauucaauauccuaguc

SEQ ID NO: 935667 - RNA, 19 nt, Homo sapiens
gaucaacuaucaucaaacg

SEQ ID NO: 935668 - RNA, 19 nt, Homo sapiens
ggaacaaagacucaaagaa

SEQ ID NO: 935669 - RNA, 19 nt, Homo sapiens
gaaggaacaaagacucaaa

SEQ ID NO: 935670 - RNA, 19 nt, Homo sapiens
gaucuauguuucugaagga

SEQ ID NO: 935671 - RNA, 19 nt, Homo sapiens
ugagagggcuuucauuguc

SEQ ID NO: 935672 - RNA, 19 nt, Homo sapiens
acugaagccugaggaauua

SEQ ID NO: 935673 - RNA, 19 nt, Homo sapiens
aagcugaaccuguugauaa

SEQ ID NO: 935674 - RNA, 19 nt, Homo sapiens
ggacagaaagcagcaaaga

SEQ ID NO: 935675 - RNA, 19 nt, Homo sapiens
gaugucagguggaucuaug

SEQ ID NO: 935676 - RNA, 19 nt, Homo sapiens
ugucuuaucucuccacuuc

SEQ ID NO: 935677 - RNA, 19 nt, Homo sapiens
ccauguaaguuauaagugu

SEQ ID NO: 935678 - RNA, 19 nt, Homo sapiens
cagcuugcgucuaucauga

SEQ ID NO: 935679 - RNA, 19 nt, Homo sapiens
cauuucagcuugcgucuau

SEQ ID NO: 935680 - RNA, 19 nt, Homo sapiens
agagaaggcccauuguuaa

SEQ ID NO: 935681 - RNA, 19 nt, Homo sapiens
aagcacauauggacagaaa

SEQ ID NO: 935682 - RNA, 19 nt, Homo sapiens
gaaaucaggaagcagcaaa

SEQ ID NO: 935683 - RNA, 19 nt, Homo sapiens
gcaacuaugacccuucaaa

SEQ ID NO: 935684 - RNA, 19 nt, Homo sapiens
guacagagcauuuauucag

SEQ ID NO: 935685 - RNA, 19 nt, Homo sapiens
caaagaagaaggucacauc

SEQ ID NO: 935686 - RNA, 19 nt, Homo sapiens
cagugaagcugaaccuguu

SEQ ID NO: 935687 - RNA, 19 nt, Homo sapiens
gacugaagccugaggaauu

SEQ ID NO: 935688 - RNA, 19 nt, Homo sapiens
ugacaaggcuaccaagaac

SEQ ID NO: 935689 - RNA, 19 nt, Homo sapiens
gaagcugaaccuguugaua

SEQ ID NO: 935690 - RNA, 19 nt, Homo sapiens
guaugaaugguuuguauug

SEQ ID NO: 935691 - RNA, 19 nt, Homo sapiens
gagcucaguauucuuuauu

SEQ ID NO: 935692 - RNA, 19 nt, Homo sapiens
gaaagugugcccugacuac

SEQ ID NO: 935693 - RNA, 19 nt, Homo sapiens
gacaccauguaaguuauaa

SEQ ID NO: 935694 - RNA, 19 nt, Homo sapiens
acauugggauaacaacuuu

SEQ ID NO: 935695 - RNA, 19 nt, Homo sapiens
gaagaaggucacaucuguu

SEQ ID NO: 935696 - RNA, 19 nt, Homo sapiens
caagagaaggcccauuguu

SEQ ID NO: 935697 - RNA, 19 nt, Homo sapiens
ucagguggaucuauguuuc

SEQ ID NO: 935698 - RNA, 19 nt, Homo sapiens
caguaaagaugagcaaaca

SEQ ID NO: 935699 - RNA, 19 nt, Homo sapiens
ucaucaaacggaaggauua

SEQ ID NO: 935700 - RNA, 19 nt, Homo sapiens
agacaugcucucacauaua

SEQ ID NO: 935701 - RNA, 19 nt, Homo sapiens
gaacuccacagaccuucaa

SEQ ID NO: 935702 - RNA, 19 nt, Homo sapiens
agagaaugauacagauuug

SEQ ID NO: 935703 - RNA, 19 nt, Homo sapiens
gcaaauccacacuaaagca

SEQ ID NO: 935704 - RNA, 19 nt, Homo sapiens
cagcaaauccacacuaaag

SEQ ID NO: 935705 - RNA, 19 nt, Homo sapiens
uucauugucugacucauaa

SEQ ID NO: 935706 - RNA, 19 nt, Homo sapiens
agucacaccugaagacaug

SEQ ID NO: 935707 - RNA, 19 nt, Homo sapiens
gcaaacccaaagucaugua

SEQ ID NO: 935708 - RNA, 19 nt, Homo sapiens
gcacaacaaaccgugauug

SEQ ID NO: 935709 - RNA, 19 nt, Homo sapiens
gaauuugacuuggcacaac

SEQ ID NO: 935710 - RNA, 19 nt, Homo sapiens
gaaaggccagugucuuauc

SEQ ID NO: 935711 - RNA, 19 nt, Homo sapiens
uuagagcucaguauucuuu

SEQ ID NO: 935712 - RNA, 19 nt, Homo sapiens
aggauuaacuagacagaga

SEQ ID NO: 935713 - RNA, 19 nt, Homo sapiens
caaacggaaggauuaacua

SEQ ID NO: 935714 - RNA, 19 nt, Homo sapiens
agaacacacucugcaacua

SEQ ID NO: 935715 - RNA, 19 nt, Homo sapiens
gccaagagaaggcccauug

SEQ ID NO: 935716 - RNA, 19 nt, Homo sapiens
aggaucaacuaucaucaaa

SEQ ID NO: 935717 - RNA, 19 nt, Homo sapiens
gguucaggaucaacuauca

SEQ ID NO: 935718 - RNA, 19 nt, Homo sapiens
guggaucuauguuucugaa

SEQ ID NO: 935719 - RNA, 19 nt, Homo sapiens
ucauaaugguucaggauca

SEQ ID NO: 935720 - RNA, 19 nt, Homo sapiens
guugagagggcuuucauug

SEQ ID NO: 935721 - RNA, 19 nt, Homo sapiens
acauauagagguacacaaa

SEQ ID NO: 935722 - RNA, 19 nt, Homo sapiens
gggauaacaacuuucauca

SEQ ID NO: 935723 - RNA, 19 nt, Homo sapiens
guaggaguaucugcuuguu

SEQ ID NO: 935724 - RNA, 19 nt, Homo sapiens
uagcuguacugguaaauac

SEQ ID NO: 935725 - RNA, 19 nt, Homo sapiens
gagagggcuuucauugucu

SEQ ID NO: 935726 - RNA, 19 nt, Homo sapiens
aagacaugcucucacauau

SEQ ID NO: 935727 - RNA, 19 nt, Homo sapiens
uguaauuucugcccaguca

SEQ ID NO: 935728 - RNA, 19 nt, Homo sapiens
guugauaacugggaaaauu

SEQ ID NO: 935729 - RNA, 19 nt, Homo sapiens
gaaagcagcaaagacuugu

SEQ ID NO: 935730 - RNA, 19 nt, Homo sapiens
uaaagcacauauggacaga

SEQ ID NO: 935731 - RNA, 19 nt, Homo sapiens
uacagagcauuuauucaga

SEQ ID NO: 935732 - RNA, 19 nt, Homo sapiens
ugaaugguuuguauuguac

SEQ ID NO: 935733 - RNA, 19 nt, Homo sapiens
cauaaugguucaggaucaa

SEQ ID NO: 935734 - RNA, 19 nt, Homo sapiens
cucccucucuugccucuua

SEQ ID NO: 935735 - RNA, 19 nt, Homo sapiens
ugccaaagauuccaagucu

SEQ ID NO: 935736 - RNA, 19 nt, Homo sapiens
cagacaccauguaaguuau

SEQ ID NO: 935737 - RNA, 19 nt, Homo sapiens
gcagacauugggauaacaa

SEQ ID NO: 935738 - RNA, 19 nt, Homo sapiens
ggacaaagagcaaggauua

SEQ ID NO: 935739 - RNA, 19 nt, Homo sapiens
aaagaaagcucuacaauca

SEQ ID NO: 935740 - RNA, 19 nt, Homo sapiens
agaaagagaugaagaaaga

SEQ ID NO: 935741 - RNA, 19 nt, Homo sapiens
aaagauaccuccugaaaga

SEQ ID NO: 935742 - RNA, 19 nt, Homo sapiens
gagcaaggauuacugcaaa

SEQ ID NO: 935743 - RNA, 19 nt, Homo sapiens
ggagacagcugugaaguug

SEQ ID NO: 935744 - RNA, 19 nt, Homo sapiens
gaaaguuggcgacaucaua

SEQ ID NO: 935745 - RNA, 19 nt, Homo sapiens
gggaacagcuggacacaga

SEQ ID NO: 935746 - RNA, 19 nt, Homo sapiens
gaccagaaaugcuuccaaa

SEQ ID NO: 935747 - RNA, 19 nt, Homo sapiens
caacacaaauuccauccaa

SEQ ID NO: 935748 - RNA, 19 nt, Homo sapiens
gaaaugucauccugcuuga

SEQ ID NO: 935749 - RNA, 19 nt, Homo sapiens
caacaaagcuccagaaaag

SEQ ID NO: 935750 - RNA, 19 nt, Homo sapiens
agaaagcucuacaaucaaa

SEQ ID NO: 935751 - RNA, 19 nt, Homo sapiens
gaagugaacgacauaaaga

SEQ ID NO: 935752 - RNA, 19 nt, Homo sapiens
gguaucaucuacugagaaa

SEQ ID NO: 935753 - RNA, 19 nt, Homo sapiens
gaaaucaucaccaacauca

SEQ ID NO: 935754 - RNA, 19 nt, Homo sapiens
gggaagaaguuaccugcaa

SEQ ID NO: 935755 - RNA, 19 nt, Homo sapiens
gugaacagaauaugcauua

SEQ ID NO: 935756 - RNA, 19 nt, Homo sapiens
gaaacucuuugcugucuuc

SEQ ID NO: 935757 - RNA, 19 nt, Homo sapiens
acagaaugaugaugaauug

SEQ ID NO: 935758 - RNA, 19 nt, Homo sapiens
cgggaagacuggaauguuu

SEQ ID NO: 935759 - RNA, 19 nt, Homo sapiens
gcaaugaucugugccuucu

SEQ ID NO: 935760 - RNA, 19 nt, Homo sapiens
gaaugaugaugaauugaca

SEQ ID NO: 935761 - RNA, 19 nt, Homo sapiens
cagcagaaacgagagauua

SEQ ID NO: 935762 - RNA, 19 nt, Homo sapiens
gaaaugcuuccaaacagaa

SEQ ID NO: 935763 - RNA, 19 nt, Homo sapiens
gcagcuaccaugauucaaa

SEQ ID NO: 935764 - RNA, 19 nt, Homo sapiens
gccaaaagauuaaagguuu

SEQ ID NO: 935765 - RNA, 19 nt, Homo sapiens
gaaauggacagcaggacaa

SEQ ID NO: 935766 - RNA, 19 nt, Homo sapiens
caaggucaauugaaguaga

SEQ ID NO: 935767 - RNA, 19 nt, Homo sapiens
gagcagcuauccaagucaa

SEQ ID NO: 935768 - RNA, 19 nt, Homo sapiens
gaaugacgaugaacuugag

SEQ ID NO: 935769 - RNA, 19 nt, Homo sapiens
ucacagacuucccuagugu

SEQ ID NO: 935770 - RNA, 19 nt, Homo sapiens
uauagucacucucaucaau

SEQ ID NO: 935771 - RNA, 19 nt, Homo sapiens
ggagugggcuuuggagaca

SEQ ID NO: 935772 - RNA, 19 nt, Homo sapiens
gaggaacacauuucacuug

SEQ ID NO: 935773 - RNA, 19 nt, Homo sapiens
gacauugacuuagaagguu

SEQ ID NO: 935774 - RNA, 19 nt, Homo sapiens
caaagaaggagauauaguc

SEQ ID NO: 935775 - RNA, 19 nt, Homo sapiens
cauaugaggcacagaauga

SEQ ID NO: 935776 - RNA, 19 nt, Homo sapiens
gcugaaaguuggcgacauc

SEQ ID NO: 935777 - RNA, 19 nt, Homo sapiens
aaugaucugugccuucuuu

SEQ ID NO: 935778 - RNA, 19 nt, Homo sapiens
ggauaaggaggaacacauu

SEQ ID NO: 935779 - RNA, 19 nt, Homo sapiens
ggaagugaacgacauaaag

SEQ ID NO: 935780 - RNA, 19 nt, Homo sapiens
aacgagagauuaaacaguu

SEQ ID NO: 935781 - RNA, 19 nt, Homo sapiens
gcagaaacgagagauuaaa

SEQ ID NO: 935782 - RNA, 19 nt, Homo sapiens
ccaagacuguuaccauauc

SEQ ID NO: 935783 - RNA, 19 nt, Homo sapiens
gauaaggaggaacacauuu

SEQ ID NO: 935784 - RNA, 19 nt, Homo sapiens
uagucacucucaucaauaa

SEQ ID NO: 935785 - RNA, 19 nt, Homo sapiens
gacaagccaaucaaacuaa

SEQ ID NO: 935786 - RNA, 19 nt, Homo sapiens
ugaugcagcuaccaugauu

SEQ ID NO: 935787 - RNA, 19 nt, Homo sapiens
uaaagaaagcucuacaauc

SEQ ID NO: 935788 - RNA, 19 nt, Homo sapiens
caaagacaagccaaucaaa

SEQ ID NO: 935789 - RNA, 19 nt, Homo sapiens
cggaugagcuuggcauuuc

SEQ ID NO: 935790 - RNA, 19 nt, Homo sapiens
gauuaaagguuugccucaa

SEQ ID NO: 935791 - RNA, 19 nt, Homo sapiens
agaaaugcuuccaaacaga

SEQ ID NO: 935792 - RNA, 19 nt, Homo sapiens
ugaaagaccagaaaugcuu

SEQ ID NO: 935793 - RNA, 19 nt, Homo sapiens
gauauagucacucucauca

SEQ ID NO: 935794 - RNA, 19 nt, Homo sapiens
ggaguggacgcgucaaaga

SEQ ID NO: 935795 - RNA, 19 nt, Homo sapiens
cagaaaugcuuccaaacag

SEQ ID NO: 935796 - RNA, 19 nt, Homo sapiens
ccagaaaugcuuccaaaca

SEQ ID NO: 935797 - RNA, 19 nt, Homo sapiens
ccauuaggauucuauuaca

SEQ ID NO: 935798 - RNA, 19 nt, Homo sapiens
agaaagacccucucaccaa

SEQ ID NO: 935799 - RNA, 19 nt, Homo sapiens
gauuggagcuuuugugaug

SEQ ID NO: 935800 - RNA, 19 nt, Homo sapiens
gauggaagugaacgacaua

SEQ ID NO: 935801 - RNA, 19 nt, Homo sapiens
aaacaguuauugucugagu

SEQ ID NO: 935802 - RNA, 19 nt, Homo sapiens
uuccaagacuguuaccaua

SEQ ID NO: 935803 - RNA, 19 nt, Homo sapiens
gaauguuuccuuccaacuu

SEQ ID NO: 935804 - RNA, 19 nt, Homo sapiens
gauagcacaacacaaauuc

SEQ ID NO: 935805 - RNA, 19 nt, Homo sapiens
ugucugaguuggaugaaga

SEQ ID NO: 935806 - RNA, 19 nt, Homo sapiens
gaagggaauagacccaaga

SEQ ID NO: 935807 - RNA, 19 nt, Homo sapiens
cagcgugggugaaaucauc

SEQ ID NO: 935808 - RNA, 19 nt, Homo sapiens
ccaaacagaacagaagaaa

SEQ ID NO: 935809 - RNA, 19 nt, Homo sapiens
acucuuugcugucuucuga

SEQ ID NO: 935810 - RNA, 19 nt, Homo sapiens
agaggccacugucuucaaa

SEQ ID NO: 935811 - RNA, 19 nt, Homo sapiens
agacuucccuaguguuugu

SEQ ID NO: 935812 - RNA, 19 nt, Homo sapiens
gucccuguuugaaagauua

SEQ ID NO: 935813 - RNA, 19 nt, Homo sapiens
ugaguuggaugaagagaag

SEQ ID NO: 935814 - RNA, 19 nt, Homo sapiens
gguaggagagguagaggaa

SEQ ID NO: 935815 - RNA, 19 nt, Homo sapiens
acgaugaacuugagcugaa

SEQ ID NO: 935816 - RNA, 19 nt, Homo sapiens
aaucugguauuugcaauga

SEQ ID NO: 935817 - RNA, 19 nt, Homo sapiens
cuugauagcacaacacaaa

SEQ ID NO: 935818 - RNA, 19 nt, Homo sapiens
cgaagaggauaaggaggaa

SEQ ID NO: 935819 - RNA, 19 nt, Homo sapiens
ucaggcaguuuaguccaua

SEQ ID NO: 935820 - RNA, 19 nt, Homo sapiens
uggcacucguugugacuua

SEQ ID NO: 935821 - RNA, 19 nt, Homo sapiens
ggugacaguccaaagauug

SEQ ID NO: 935822 - RNA, 19 nt, Homo sapiens
gggugacaguccaaagauu

SEQ ID NO: 935823 - RNA, 19 nt, Homo sapiens
acacaaauuccauccaaga

SEQ ID NO: 935824 - RNA, 19 nt, Homo sapiens
aaaugucccuguuugaaag

SEQ ID NO: 935825 - RNA, 19 nt, Homo sapiens
cgacauaaagaaagcucua

SEQ ID NO: 935826 - RNA, 19 nt, Homo sapiens
gaaacgagagauuaaacag

SEQ ID NO: 935827 - RNA, 19 nt, Homo sapiens
ggaggaacacauuucacuu

SEQ ID NO: 935828 - RNA, 19 nt, Homo sapiens
agacaagccaaucaaacua

SEQ ID NO: 935829 - RNA, 19 nt, Homo sapiens
gcagcaauccagcccaaga

SEQ ID NO: 935830 - RNA, 19 nt, Homo sapiens
acgagagauuaaacaguua

SEQ ID NO: 935831 - RNA, 19 nt, Homo sapiens
gaccagagagagagccaaa

SEQ ID NO: 935832 - RNA, 19 nt, Homo sapiens
agaaggagauauagucacu

SEQ ID NO: 935833 - RNA, 19 nt, Homo sapiens
uacagcaacuccagacuca

SEQ ID NO: 935834 - RNA, 19 nt, Homo sapiens
cuauccaagucaaguuuaa

SEQ ID NO: 935835 - RNA, 19 nt, Homo sapiens
gcuauccaagucaaguuua

SEQ ID NO: 935836 - RNA, 19 nt, Homo sapiens
gaaguugggcgugcucugu

SEQ ID NO: 935837 - RNA, 19 nt, Homo sapiens
gcacaaaagucuugauagc

SEQ ID NO: 935838 - RNA, 19 nt, Homo sapiens
gcacaacucgucacucuuu

SEQ ID NO: 935839 - RNA, 19 nt, Homo sapiens
ggagagcagucgccgcuuu

SEQ ID NO: 935840 - RNA, 19 nt, Homo sapiens
gucaagaccugguuccaaa

SEQ ID NO: 935841 - RNA, 19 nt, Homo sapiens
ggaggauaguuccaagguu

SEQ ID NO: 935842 - RNA, 19 nt, Homo sapiens
caacacgacgccuuccaaa

SEQ ID NO: 935843 - RNA, 19 nt, Homo sapiens
gcaucgaccagauccuuaa

SEQ ID NO: 935844 - RNA, 19 nt, Homo sapiens
gccuagggcgucucaauuu

SEQ ID NO: 935845 - RNA, 19 nt, Homo sapiens
gcaacacgacgccuuccaa

SEQ ID NO: 935846 - RNA, 19 nt, Homo sapiens
ccuagggcgucucaauuuc

SEQ ID NO: 935847 - RNA, 19 nt, Homo sapiens
gagagcagucgccgcuuug

SEQ ID NO: 935848 - RNA, 19 nt, Homo sapiens
cugcacaacucgucacucu

SEQ ID NO: 935849 - RNA, 19 nt, Homo sapiens
ggcaucgaccagauccuua

SEQ ID NO: 935850 - RNA, 19 nt, Homo sapiens
ggacgcgggaucuuacagu

SEQ ID NO: 935851 - RNA, 19 nt, Homo sapiens
ucgaggacgcgggaucuua

SEQ ID NO: 935852 - RNA, 19 nt, Homo sapiens
gcagucgccgcuuugugaa

SEQ ID NO: 935853 - RNA, 19 nt, Homo sapiens
cacaacucgucacucuuug

SEQ ID NO: 935854 - RNA, 19 nt, Homo sapiens
gagcagucgccgcuuugug

SEQ ID NO: 935855 - RNA, 19 nt, Homo sapiens
gggaggaggauaguuccaa

SEQ ID NO: 935856 - RNA, 19 nt, Homo sapiens
ucuuugcucugcagaaucu

SEQ ID NO: 935857 - RNA, 19 nt, Homo sapiens
gaucuuacagugucaaccu

SEQ ID NO: 935858 - RNA, 19 nt, Homo sapiens
gaaguaugcuggaaaggau

SEQ ID NO: 935859 - RNA, 19 nt, Homo sapiens
uuccuaagcuucaugaaua

SEQ ID NO: 935860 - RNA, 19 nt, Homo sapiens
agacggaguuccuaagcuu

SEQ ID NO: 935861 - RNA, 19 nt, Homo sapiens
uuacaaagaaccagaagga

SEQ ID NO: 935862 - RNA, 19 nt, Homo sapiens
uaagcuucaugaauacaga

SEQ ID NO: 935863 - RNA, 19 nt, Homo sapiens
uggaaaggaugguuacaac

SEQ ID NO: 935864 - RNA, 19 nt, Homo sapiens
agagcuggcugccuuuaca

SEQ ID NO: 935865 - RNA, 19 nt, Homo sapiens
ugcauugagucccugauug

SEQ ID NO: 935866 - RNA, 19 nt, Homo sapiens
gugcauugagucccugauu

SEQ ID NO: 935867 - RNA, 19 nt, Homo sapiens
guuccuaagcuucaugaau

SEQ ID NO: 935868 - RNA, 19 nt, Homo sapiens
gcauugagucccugauugc

SEQ ID NO: 935869 - RNA, 19 nt, Homo sapiens
agaaguaugcuggaaagga

SEQ ID NO: 935870 - RNA, 19 nt, Homo sapiens
gagcuggcugccuuuacaa

SEQ ID NO: 935871 - RNA, 19 nt, Homo sapiens
ugaaauaccugcaaaguag

SEQ ID NO: 935872 - RNA, 19 nt, Homo sapiens
cagaggaacugcugaauga

SEQ ID NO: 935873 - RNA, 19 nt, Homo sapiens
gaaccaauauauacaaugg

SEQ ID NO: 935874 - RNA, 19 nt, Homo sapiens
gaggaggaauucauggaaa

SEQ ID NO: 935875 - RNA, 19 nt, Homo sapiens
aagaacaucuccagaggaa

SEQ ID NO: 935876 - RNA, 19 nt, Homo sapiens
ggaauucauggaaauaaug

SEQ ID NO: 935877 - RNA, 19 nt, Homo sapiens
ggaggaauucauggaaaua

SEQ ID NO: 935878 - RNA, 19 nt, Homo sapiens
gaacaucuccagaggaacu

SEQ ID NO: 935879 - RNA, 19 nt, Homo sapiens
caacgaggccaacgagaug

SEQ ID NO: 935880 - RNA, 19 nt, Homo sapiens
gaggaauucauggaaauaa

SEQ ID NO: 935881 - RNA, 19 nt, Homo sapiens
ggaggaggaauucauggaa

SEQ ID NO: 935882 - RNA, 19 nt, Homo sapiens
ggaggaggaggaauucaug

SEQ ID NO: 935883 - RNA, 19 nt, Homo sapiens
ucauggaaauaaugguuga

SEQ ID NO: 935884 - RNA, 19 nt, Homo sapiens
gcuacaggaggaacuuuaa

SEQ ID NO: 935885 - RNA, 19 nt, Homo sapiens
uugaaauaccugcaaagua

SEQ ID NO: 935886 - RNA, 19 nt, Homo sapiens
ccagaggaacugcugaaug

SEQ ID NO: 935887 - RNA, 19 nt, Homo sapiens
aaauggaggaggaggaauu

SEQ ID NO: 935888 - RNA, 19 nt, Homo sapiens
ucucaaccuugggcaauga

SEQ ID NO: 935889 - RNA, 19 nt, Homo sapiens
gaauucauggaaauaaugg

SEQ ID NO: 935890 - RNA, 19 nt, Homo sapiens
ccaaauggaggaggaggaa

SEQ ID NO: 935891 - RNA, 19 nt, Homo sapiens
ccaacgaggccaacgagau

SEQ ID NO: 935892 - RNA, 19 nt, Homo sapiens
caagaagcuacaucucuca

SEQ ID NO: 935893 - RNA, 19 nt, Homo sapiens
aggaggaauucauggaaau

SEQ ID NO: 935894 - RNA, 19 nt, Homo sapiens
cuacaggaggaacuuuaaa

SEQ ID NO: 935895 - RNA, 19 nt, Homo sapiens
cccgcaaccugcuccuaaa

SEQ ID NO: 935896 - RNA, 19 nt, Homo sapiens
gccugccacugacauugaa

SEQ ID NO: 935897 - RNA, 19 nt, Homo sapiens
guugaaauaccugcaaagu

SEQ ID NO: 935898 - RNA, 19 nt, Homo sapiens
ugguugaaauaccugcaaa

SEQ ID NO: 935899 - RNA, 19 nt, Homo sapiens
gcaaauacaucuguuguuu

SEQ ID NO: 935900 - RNA, 19 nt, Homo sapiens
ggagggaacucaucuaaug

SEQ ID NO: 935901 - RNA, 19 nt, Homo sapiens
gaagcaaacuagcaaauau

SEQ ID NO: 935902 - RNA, 19 nt, Homo sapiens
caacaugucuguaccaaga

SEQ ID NO: 935903 - RNA, 19 nt, Homo sapiens
gggcaagaaucccaauuua

SEQ ID NO: 935904 - RNA, 19 nt, Homo sapiens
caagauaccugaaauuaca

SEQ ID NO: 935905 - RNA, 19 nt, Homo sapiens
gcccaaggcuguuguguuu

SEQ ID NO: 935906 - RNA, 19 nt, Homo sapiens
guucaagacuagcuaauuu

SEQ ID NO: 935907 - RNA, 19 nt, Homo sapiens
cagcagaaauuaacugauu

SEQ ID NO: 935908 - RNA, 19 nt, Homo sapiens
gcuaugagcacuuucuuua

SEQ ID NO: 935909 - RNA, 19 nt, Homo sapiens
ugaaacagcugaauuuaca

SEQ ID NO: 935910 - RNA, 19 nt, Homo sapiens
caagaaugcuagacuuaaa

SEQ ID NO: 935911 - RNA, 19 nt, Homo sapiens
gaagcaaagcuguaaagua

SEQ ID NO: 935912 - RNA, 19 nt, Homo sapiens
gaucaucacuauugcaaau

SEQ ID NO: 935913 - RNA, 19 nt, Homo sapiens
ggacaagaaugcuagacuu

SEQ ID NO: 935914 - RNA, 19 nt, Homo sapiens
aagcaaagcuguaaaguag

SEQ ID NO: 935915 - RNA, 19 nt, Homo sapiens
gaagauauccgaucaaggu

SEQ ID NO: 935916 - RNA, 19 nt, Homo sapiens
guacagaacuccaugaacu

SEQ ID NO: 935917 - RNA, 19 nt, Homo sapiens
ugugaaagcuggucuuaaa

SEQ ID NO: 935918 - RNA, 19 nt, Homo sapiens
gcacuucacagcaugguua

SEQ ID NO: 935919 - RNA, 19 nt, Homo sapiens
agaggaaacugaauugaaa

SEQ ID NO: 935920 - RNA, 19 nt, Homo sapiens
gcaaagcuguaaaguagau

SEQ ID NO: 935921 - RNA, 19 nt, Homo sapiens
acacucagguagaauauuu

SEQ ID NO: 935922 - RNA, 19 nt, Homo sapiens
ccaguuaaccaacaucuua

SEQ ID NO: 935923 - RNA, 19 nt, Homo sapiens
gcauacagacuucaaauau

SEQ ID NO: 935924 - RNA, 19 nt, Homo sapiens
gaaagacucuaacauccau

SEQ ID NO: 935925 - RNA, 19 nt, Homo sapiens
guacuagaauucagauaug

SEQ ID NO: 935926 - RNA, 19 nt, Homo sapiens
gaucggauguggcacuuug

SEQ ID NO: 935927 - RNA, 19 nt, Homo sapiens
ggucuugcuuuccuuuaua

SEQ ID NO: 935928 - RNA, 19 nt, Homo sapiens
ggagacaaguccugaaucu

SEQ ID NO: 935929 - RNA, 19 nt, Homo sapiens
caaagggauuggauuguug

SEQ ID NO: 935930 - RNA, 19 nt, Homo sapiens
gacaagaaugcuagacuua

SEQ ID NO: 935931 - RNA, 19 nt, Homo sapiens
cauguaagcugcagguaga

SEQ ID NO: 935932 - RNA, 19 nt, Homo sapiens
guagaaagcccacacuugu

SEQ ID NO: 935933 - RNA, 19 nt, Homo sapiens
gcaagaaucccaauuuaac

SEQ ID NO: 935934 - RNA, 19 nt, Homo sapiens
ccaaaccgcuuccauaagg

SEQ ID NO: 935935 - RNA, 19 nt, Homo sapiens
guucugcucuggaagguuu

SEQ ID NO: 935936 - RNA, 19 nt, Homo sapiens
gaagacagaagcaaacuag

SEQ ID NO: 935937 - RNA, 19 nt, Homo sapiens
cacaaugacugcauacaga

SEQ ID NO: 935938 - RNA, 19 nt, Homo sapiens
gaacuaucuucuugaucuu

SEQ ID NO: 935939 - RNA, 19 nt, Homo sapiens
ggucuuugguccuuugauu

SEQ ID NO: 935940 - RNA, 19 nt, Homo sapiens
caacugaaauauacauguc

SEQ ID NO: 935941 - RNA, 19 nt, Homo sapiens
gagagcagcagcagcgaua

SEQ ID NO: 935942 - RNA, 19 nt, Homo sapiens
guagauuuaucacacaaug

SEQ ID NO: 935943 - RNA, 19 nt, Homo sapiens
ugaacuaucuucuugaucu

SEQ ID NO: 935944 - RNA, 19 nt, Homo sapiens
uaacauccaugagcuugaa

SEQ ID NO: 935945 - RNA, 19 nt, Homo sapiens
ggaaacagccuccuuuuga

SEQ ID NO: 935946 - RNA, 19 nt, Homo sapiens
gaaggaaaaucaagcaaau

SEQ ID NO: 935947 - RNA, 19 nt, Homo sapiens
uaccugaaauuacaacuga

SEQ ID NO: 935948 - RNA, 19 nt, Homo sapiens
caaguuacauguagaaagc

SEQ ID NO: 935949 - RNA, 19 nt, Homo sapiens
gaauucagauaugucaguu

SEQ ID NO: 935950 - RNA, 19 nt, Homo sapiens
gcuauccuguuacuagauu

SEQ ID NO: 935951 - RNA, 19 nt, Homo sapiens
gauauccgaucaagguuca

SEQ ID NO: 935952 - RNA, 19 nt, Homo sapiens
gggauuggauuguuguugu

SEQ ID NO: 935953 - RNA, 19 nt, Homo sapiens
ggaauaaugggaacuguag

SEQ ID NO: 935954 - RNA, 19 nt, Homo sapiens
ggucuaauucugcuaauau

SEQ ID NO: 935955 - RNA, 19 nt, Homo sapiens
gucauucucucucuacuug

SEQ ID NO: 935956 - RNA, 19 nt, Homo sapiens
gcacuccuguuaacaagca

SEQ ID NO: 935957 - RNA, 19 nt, Homo sapiens
ggcaagaaucccaauuuaa

SEQ ID NO: 935958 - RNA, 19 nt, Homo sapiens
ucugaaagaggcauuauaa

SEQ ID NO: 935959 - RNA, 19 nt, Homo sapiens
uaaagaagaggaaacugaa

SEQ ID NO: 935960 - RNA, 19 nt, Homo sapiens
uaugagcacuuucuuuauc

SEQ ID NO: 935961 - RNA, 19 nt, Homo sapiens
uagcuaaguuuggaaagaa

SEQ ID NO: 935962 - RNA, 19 nt, Homo sapiens
caucggcuguggcuuuauu

SEQ ID NO: 935963 - RNA, 19 nt, Homo sapiens
acgaaggauugaccaguua

SEQ ID NO: 935964 - RNA, 19 nt, Homo sapiens
ggaguuuaauccuuugcuu

SEQ ID NO: 935965 - RNA, 19 nt, Homo sapiens
aaaccuaagucagcagaaa

SEQ ID NO: 935966 - RNA, 19 nt, Homo sapiens
auacaucuguuguuugaga

SEQ ID NO: 935967 - RNA, 19 nt, Homo sapiens
aauuacaccuaccaagaua

SEQ ID NO: 935968 - RNA, 19 nt, Homo sapiens
gaagaggaaacugaauuga

SEQ ID NO: 935969 - RNA, 19 nt, Homo sapiens
gcuguuggccagauuauga

SEQ ID NO: 935970 - RNA, 19 nt, Homo sapiens
aaagucaguuugcaacaug

SEQ ID NO: 935971 - RNA, 19 nt, Homo sapiens
ucaauaguuuggucauaga

SEQ ID NO: 935972 - RNA, 19 nt, Homo sapiens
acaaagauacugagccaaa

SEQ ID NO: 935973 - RNA, 19 nt, Homo sapiens
ggauuggauuguuguuguu

SEQ ID NO: 935974 - RNA, 19 nt, Homo sapiens
gguagaagcaaagcuguaa

SEQ ID NO: 935975 - RNA, 19 nt, Homo sapiens
ugaagcauauguagcacuu

SEQ ID NO: 935976 - RNA, 19 nt, Homo sapiens
gguuuaugguuuagcuuaa

SEQ ID NO: 935977 - RNA, 19 nt, Homo sapiens
uacggagacuauaaugaua

SEQ ID NO: 935978 - RNA, 19 nt, Homo sapiens
ugugaucucuguauucaug

SEQ ID NO: 935979 - RNA, 19 nt, Homo sapiens
uguuugaucuuguguguga

SEQ ID NO: 935980 - RNA, 19 nt, Homo sapiens
ucacgugaauucaguuauc

SEQ ID NO: 935981 - RNA, 19 nt, Homo sapiens
cugcagaauuccaauaaau

SEQ ID NO: 935982 - RNA, 19 nt, Homo sapiens
cgucauugcugcuagaauc

SEQ ID NO: 935983 - RNA, 19 nt, Homo sapiens
ucaauuacaccuaccaaga

SEQ ID NO: 935984 - RNA, 19 nt, Homo sapiens
guacagaauguuucaguca

SEQ ID NO: 935985 - RNA, 19 nt, Homo sapiens
cuaccaagauaccugaaau

SEQ ID NO: 935986 - RNA, 19 nt, Homo sapiens
gauagcagccgcagaagag

SEQ ID NO: 935987 - RNA, 19 nt, Homo sapiens
ggaugggucuccuacuaca

SEQ ID NO: 935988 - RNA, 19 nt, Homo sapiens
guucucacuuccugcuaua

SEQ ID NO: 935989 - RNA, 19 nt, Homo sapiens
aacuucagcuacaguguua

SEQ ID NO: 935990 - RNA, 19 nt, Homo sapiens
guacugcagaauuccaaua

SEQ ID NO: 935991 - RNA, 19 nt, Homo sapiens
caaaagaaguuaggaagga

SEQ ID NO: 935992 - RNA, 19 nt, Homo sapiens
uccaugaacuaucuucuug

SEQ ID NO: 935993 - RNA, 19 nt, Homo sapiens
guaauugaaucugaaagag

SEQ ID NO: 935994 - RNA, 19 nt, Homo sapiens
uuaaagaagaggaaacuga

SEQ ID NO: 935995 - RNA, 19 nt, Homo sapiens
gugacuggguggacaagaa

SEQ ID NO: 935996 - RNA, 19 nt, Homo sapiens
ucaguuaucauuugacaga

SEQ ID NO: 935997 - RNA, 19 nt, Homo sapiens
gcagaauuccaauaaaugg

SEQ ID NO: 935998 - RNA, 19 nt, Homo sapiens
caugaacuaucuucuugau

SEQ ID NO: 935999 - RNA, 19 nt, Homo sapiens
gcacgacuuucaccacgua

SEQ ID NO: 936000 - RNA, 19 nt, Homo sapiens
gaggagaauuaaagacaug

SEQ ID NO: 936001 - RNA, 19 nt, Homo sapiens
ggcugaagcuccuaaacuu

SEQ ID NO: 936002 - RNA, 19 nt, Homo sapiens
ccacguaccagcugcauga

SEQ ID NO: 936003 - RNA, 19 nt, Homo sapiens
gagaggagaauuaaagaca

SEQ ID NO: 936004 - RNA, 19 nt, Homo sapiens
ggaaguguccuccaugaag

SEQ ID NO: 936005 - RNA, 19 nt, Homo sapiens
ggaggaacagcccaagaaa

SEQ ID NO: 936006 - RNA, 19 nt, Homo sapiens
gaauuaaagacaugcuugu

SEQ ID NO: 936007 - RNA, 19 nt, Homo sapiens
gaaacugucagaggaggaa

SEQ ID NO: 936008 - RNA, 19 nt, Homo sapiens
cuauuugagaggagaauua

SEQ ID NO: 936009 - RNA, 19 nt, Homo sapiens
gggagaagggcgacuuuca

SEQ ID NO: 936010 - RNA, 19 nt, Homo sapiens
agacaugcuuguuuuguuu

SEQ ID NO: 936011 - RNA, 19 nt, Homo sapiens
gcugaagcuccuaaacuug

SEQ ID NO: 936012 - RNA, 19 nt, Homo sapiens
gagaauuaaagacaugcuu

SEQ ID NO: 936013 - RNA, 19 nt, Homo sapiens
ggagaagggcgacuuucag

SEQ ID NO: 936014 - RNA, 19 nt, Homo sapiens
gcgaagcgaaacugucaga

SEQ ID NO: 936015 - RNA, 19 nt, Homo sapiens
agaggagaauuaaagacau

SEQ ID NO: 936016 - RNA, 19 nt, Homo sapiens
gaggaggaacagcccaaga

SEQ ID NO: 936017 - RNA, 19 nt, Homo sapiens
cuccuaaacuuggccauuc

SEQ ID NO: 936018 - RNA, 19 nt, Homo sapiens
cggcgaagcgaaacuguca

SEQ ID NO: 936019 - RNA, 19 nt, Homo sapiens
cagccacccgccaagcaua

SEQ ID NO: 936020 - RNA, 19 nt, Homo sapiens
aggaggaacagcccaagaa

SEQ ID NO: 936021 - RNA, 19 nt, Homo sapiens
ccacuacccggacguguac

SEQ ID NO: 936022 - RNA, 19 nt, Homo sapiens
gcuccuaaacuuggccauu

SEQ ID NO: 936023 - RNA, 19 nt, Homo sapiens
gcgaaggagcgggauagga

SEQ ID NO: 936024 - RNA, 19 nt, Homo sapiens
cggaaccgcacgacuuuca

SEQ ID NO: 936025 - RNA, 19 nt, Homo sapiens
gaacucagguuuauucuaa

SEQ ID NO: 936026 - RNA, 19 nt, Homo sapiens
gaacgugacuucuagauuu

SEQ ID NO: 936027 - RNA, 19 nt, Homo sapiens
gaacagagcuccacacauc

SEQ ID NO: 936028 - RNA, 19 nt, Homo sapiens
cuaaguacguugcaaauaa

SEQ ID NO: 936029 - RNA, 19 nt, Homo sapiens
ggaccaagaucaaaccaaa

SEQ ID NO: 936030 - RNA, 19 nt, Homo sapiens
cagaugagcuggcauuuga

SEQ ID NO: 936031 - RNA, 19 nt, Homo sapiens
gaaacaugcuaaugauuga

SEQ ID NO: 936032 - RNA, 19 nt, Homo sapiens
guaagaaucccaacacuuu

SEQ ID NO: 936033 - RNA, 19 nt, Homo sapiens
uagaugaccucuugaaauu

SEQ ID NO: 936034 - RNA, 19 nt, Homo sapiens
ucacucagcuccuugauau

SEQ ID NO: 936035 - RNA, 19 nt, Homo sapiens
gggagaagguggccauaaa

SEQ ID NO: 936036 - RNA, 19 nt, Homo sapiens
gaagauagagaauuugcua

SEQ ID NO: 936037 - RNA, 19 nt, Homo sapiens
ggagcaaacuugaggauca

SEQ ID NO: 936038 - RNA, 19 nt, Homo sapiens
gagaagcaauuccaccaaa

SEQ ID NO: 936039 - RNA, 19 nt, Homo sapiens
gaacaaguaucuaguuuug

SEQ ID NO: 936040 - RNA, 19 nt, Homo sapiens
cuucauaacuguucacaaa

SEQ ID NO: 936041 - RNA, 19 nt, Homo sapiens
gcaaauaauaguacaggua

SEQ ID NO: 936042 - RNA, 19 nt, Homo sapiens
uaagggagcuuuccagaca

SEQ ID NO: 936043 - RNA, 19 nt, Homo sapiens
cacaaugccuagcuaauuu

SEQ ID NO: 936044 - RNA, 19 nt, Homo sapiens
ccacagagacuugaagaua

SEQ ID NO: 936045 - RNA, 19 nt, Homo sapiens
gaagcucacuguucacugu

SEQ ID NO: 936046 - RNA, 19 nt, Homo sapiens
ggaucuagaugaccucuug

SEQ ID NO: 936047 - RNA, 19 nt, Homo sapiens
gacacgagaucuugaauuc

SEQ ID NO: 936048 - RNA, 19 nt, Homo sapiens
gaggagcauuucaggauuu

SEQ ID NO: 936049 - RNA, 19 nt, Homo sapiens
caacagguauuucugaagu

SEQ ID NO: 936050 - RNA, 19 nt, Homo sapiens
caacaggauuucucuggaa

SEQ ID NO: 936051 - RNA, 19 nt, Homo sapiens
caucugagcuggugguguu

SEQ ID NO: 936052 - RNA, 19 nt, Homo sapiens
gggaucagcuguauuugug

SEQ ID NO: 936053 - RNA, 19 nt, Homo sapiens
gagaggcaguucugaauca

SEQ ID NO: 936054 - RNA, 19 nt, Homo sapiens
gauagagaauuugcuacua

SEQ ID NO: 936055 - RNA, 19 nt, Homo sapiens
ggagugcauuuccugagua

SEQ ID NO: 936056 - RNA, 19 nt, Homo sapiens
gagaggagcuucggaccaa

SEQ ID NO: 936057 - RNA, 19 nt, Homo sapiens
gaagcaaauucagaaagaa

SEQ ID NO: 936058 - RNA, 19 nt, Homo sapiens
gaugaccucuugaaauugu

SEQ ID NO: 936059 - RNA, 19 nt, Homo sapiens
gaagaugguagacaaagaa

SEQ ID NO: 936060 - RNA, 19 nt, Homo sapiens
gcuacuagaugaagacaau

SEQ ID NO: 936061 - RNA, 19 nt, Homo sapiens
gcaaagacaaauaggauau

SEQ ID NO: 936062 - RNA, 19 nt, Homo sapiens
gccguuagcuuguggagaa

SEQ ID NO: 936063 - RNA, 19 nt, Homo sapiens
aaacuuggauggagagaug

SEQ ID NO: 936064 - RNA, 19 nt, Homo sapiens
acaguuaucucuaggaguu

SEQ ID NO: 936065 - RNA, 19 nt, Homo sapiens
gaaaauggcacacaaagaa

SEQ ID NO: 936066 - RNA, 19 nt, Homo sapiens
gcaccacaaugccuagcua

SEQ ID NO: 936067 - RNA, 19 nt, Homo sapiens
cagcuuagguggcaaagug

SEQ ID NO: 936068 - RNA, 19 nt, Homo sapiens
ggagagaugagaagcaauu

SEQ ID NO: 936069 - RNA, 19 nt, Homo sapiens
uuaagaggcuauuggguuu

SEQ ID NO: 936070 - RNA, 19 nt, Homo sapiens
caguuucccugccuuauuu

SEQ ID NO: 936071 - RNA, 19 nt, Homo sapiens
caucucagccucccaagua

SEQ ID NO: 936072 - RNA, 19 nt, Homo sapiens
ggagaccaguuacagaaug

SEQ ID NO: 936073 - RNA, 19 nt, Homo sapiens
aaagaugugucuccaguau

SEQ ID NO: 936074 - RNA, 19 nt, Homo sapiens
gcagguggcaguucaagaa

SEQ ID NO: 936075 - RNA, 19 nt, Homo sapiens
cagcuuggcucgcagaaau

SEQ ID NO: 936076 - RNA, 19 nt, Homo sapiens
gugaagaggccaaauauuc

SEQ ID NO: 936077 - RNA, 19 nt, Homo sapiens
ccauaggugugaacaugua

SEQ ID NO: 936078 - RNA, 19 nt, Homo sapiens
acacaaagaauggcaguua

SEQ ID NO: 936079 - RNA, 19 nt, Homo sapiens
gaaccuugccuuugacaug

SEQ ID NO: 936080 - RNA, 19 nt, Homo sapiens
gaacugcucgccaggaaga

SEQ ID NO: 936081 - RNA, 19 nt, Homo sapiens
agaauuugcuacuagauga

SEQ ID NO: 936082 - RNA, 19 nt, Homo sapiens
ggucagauccagcagauga

SEQ ID NO: 936083 - RNA, 19 nt, Homo sapiens
ggaaggauagaauagcuuu

SEQ ID NO: 936084 - RNA, 19 nt, Homo sapiens
ggacccagaugguuuaagg

SEQ ID NO: 936085 - RNA, 19 nt, Homo sapiens
gaaacaagcgggaauugca

SEQ ID NO: 936086 - RNA, 19 nt, Homo sapiens
gaaacuggagcgcuauuug

SEQ ID NO: 936087 - RNA, 19 nt, Homo sapiens
gcaaagugcccuguaaugu

SEQ ID NO: 936088 - RNA, 19 nt, Homo sapiens
ucaagaagaaucaaccuuu

SEQ ID NO: 936089 - RNA, 19 nt, Homo sapiens
ggucauaaguaaggacuau

SEQ ID NO: 936090 - RNA, 19 nt, Homo sapiens
cgaagcauguugucuguuc

SEQ ID NO: 936091 - RNA, 19 nt, Homo sapiens
acacaaaucuagaauugca

SEQ ID NO: 936092 - RNA, 19 nt, Homo sapiens
uaacucagauggcgagaag

SEQ ID NO: 936093 - RNA, 19 nt, Homo sapiens
gaagagaaagacugaagga

SEQ ID NO: 936094 - RNA, 19 nt, Homo sapiens
ccaauuguguggcuucuuc

SEQ ID NO: 936095 - RNA, 19 nt, Homo sapiens
ggccaucuacuuccucuua

SEQ ID NO: 936096 - RNA, 19 nt, Homo sapiens
aaagugcccuguaauguca

SEQ ID NO: 936097 - RNA, 19 nt, Homo sapiens
ggauuucucuggaagaucu

SEQ ID NO: 936098 - RNA, 19 nt, Homo sapiens
ccacaggugccaucaguuu

SEQ ID NO: 936099 - RNA, 19 nt, Homo sapiens
gaugguagacaaagaaaug

SEQ ID NO: 936100 - RNA, 19 nt, Homo sapiens
gcuacuaccuggucaugga

SEQ ID NO: 936101 - RNA, 19 nt, Homo sapiens
gagaaggugaggagcauuu

SEQ ID NO: 936102 - RNA, 19 nt, Homo sapiens
ccaacgaucugcccaccuu

SEQ ID NO: 936103 - RNA, 19 nt, Homo sapiens
ccacaaugccuagcuaauu

SEQ ID NO: 936104 - RNA, 19 nt, Homo sapiens
aagaacagcugcacaugug

SEQ ID NO: 936105 - RNA, 19 nt, Homo sapiens
ugaaacaugcuaaugauug

SEQ ID NO: 936106 - RNA, 19 nt, Homo sapiens
uaagaaucccaacacuuua

SEQ ID NO: 936107 - RNA, 19 nt, Homo sapiens
uggagaagcucacuguuca

SEQ ID NO: 936108 - RNA, 19 nt, Homo sapiens
caaagaauggcaguuauga

SEQ ID NO: 936109 - RNA, 19 nt, Homo sapiens
ugacagagcgggacagaau

SEQ ID NO: 936110 - RNA, 19 nt, Homo sapiens
gcagccaauuccuaucauu

SEQ ID NO: 936111 - RNA, 19 nt, Homo sapiens
gaagcuggguuacaagaac

SEQ ID NO: 936112 - RNA, 19 nt, Homo sapiens
ggaguugagugguuuaaaa

SEQ ID NO: 936113 - RNA, 19 nt, Homo sapiens
ucuggaagccuguugguua

SEQ ID NO: 936114 - RNA, 19 nt, Homo sapiens
gagcagggcgacugucauu

SEQ ID NO: 936115 - RNA, 19 nt, Homo sapiens
gguggcaguucaagaagaa

SEQ ID NO: 936116 - RNA, 19 nt, Homo sapiens
ccaaagugcugagauuaca

SEQ ID NO: 936117 - RNA, 19 nt, Homo sapiens
aaggagaaauguuagauuc

SEQ ID NO: 936118 - RNA, 19 nt, Homo sapiens
uuccagaacuuaccauuga

SEQ ID NO: 936119 - RNA, 19 nt, Homo sapiens
gggacagaauggauauuug

SEQ ID NO: 936120 - RNA, 19 nt, Homo sapiens
gagcgggacagaauggaua

SEQ ID NO: 936121 - RNA, 19 nt, Homo sapiens
agaugugucuccaguauug

SEQ ID NO: 936122 - RNA, 19 nt, Homo sapiens
gaacaauaucacagucauu

SEQ ID NO: 936123 - RNA, 19 nt, Homo sapiens
cgaggccgguucccuauga

SEQ ID NO: 936124 - RNA, 19 nt, Homo sapiens
ggaguugguucaauuucau

SEQ ID NO: 936125 - RNA, 19 nt, Homo sapiens
gagcauagagcauacaaua

SEQ ID NO: 936126 - RNA, 19 nt, Homo sapiens
gaacacaucucucuuuuau

SEQ ID NO: 936127 - RNA, 19 nt, Homo sapiens
guacagaucgauuugauaa

SEQ ID NO: 936128 - RNA, 19 nt, Homo sapiens
ggaaagugguggcuucaga

SEQ ID NO: 936129 - RNA, 19 nt, Homo sapiens
gauaaugccucugcuucua

SEQ ID NO: 936130 - RNA, 19 nt, Homo sapiens
ugacaucucugaucagguu

SEQ ID NO: 936131 - RNA, 19 nt, Homo sapiens
ggaaacuugugccuuuaaa

SEQ ID NO: 936132 - RNA, 19 nt, Homo sapiens
gggcaaagaguagaauuua

SEQ ID NO: 936133 - RNA, 19 nt, Homo sapiens
gaaagcuguuaaagaugua

SEQ ID NO: 936134 - RNA, 19 nt, Homo sapiens
ucugaaagcuguuaaagau

SEQ ID NO: 936135 - RNA, 19 nt, Homo sapiens
cuaccaagcugugaaacua

SEQ ID NO: 936136 - RNA, 19 nt, Homo sapiens
ggcaaagaguagaauuuaa

SEQ ID NO: 936137 - RNA, 19 nt, Homo sapiens
ugaaagcuguuaaagaugu

SEQ ID NO: 936138 - RNA, 19 nt, Homo sapiens
gcugaagucugcagggaaa

SEQ ID NO: 936139 - RNA, 19 nt, Homo sapiens
ggaccugccuugugacauc

SEQ ID NO: 936140 - RNA, 19 nt, Homo sapiens
gcaaagaguagaauuuaag

SEQ ID NO: 936141 - RNA, 19 nt, Homo sapiens
cacggaaacuugugccuuu

SEQ ID NO: 936142 - RNA, 19 nt, Homo sapiens
guaauucgggcaaagagua

SEQ ID NO: 936143 - RNA, 19 nt, Homo sapiens
ggaccugccugucagaucu

SEQ ID NO: 936144 - RNA, 19 nt, Homo sapiens
ccaagugccugcugaaguc

SEQ ID NO: 936145 - RNA, 19 nt, Homo sapiens
aaacacagccgagaaguug

SEQ ID NO: 936146 - RNA, 19 nt, Homo sapiens
gaaagugguggcuucagaa

SEQ ID NO: 936147 - RNA, 19 nt, Homo sapiens
gcaagacgcugggcaagcu

SEQ ID NO: 936148 - RNA, 19 nt, Homo sapiens
gggauuauuccacaaagaa

SEQ ID NO: 936149 - RNA, 19 nt, Homo sapiens
ggacacaggacacaggaau

SEQ ID NO: 936150 - RNA, 19 nt, Homo sapiens
caaagaagggcugccguuu

SEQ ID NO: 936151 - RNA, 19 nt, Homo sapiens
uaaugccucugcuucuauu

SEQ ID NO: 936152 - RNA, 19 nt, Homo sapiens
aagaagggcugccguuugg

SEQ ID NO: 936153 - RNA, 19 nt, Homo sapiens
acuaaaccuucuccacuaa

SEQ ID NO: 936154 - RNA, 19 nt, Homo sapiens
aacuaaaccuucuccacua

SEQ ID NO: 936155 - RNA, 19 nt, Homo sapiens
gcuuaaauguguuucuucu

SEQ ID NO: 936156 - RNA, 19 nt, Homo sapiens
gcaccagcaccuucgcuuu

SEQ ID NO: 936157 - RNA, 19 nt, Homo sapiens
gcauagagcauacaauagc

SEQ ID NO: 936158 - RNA, 19 nt, Homo sapiens
ccacgugguaggacacaua

SEQ ID NO: 936159 - RNA, 19 nt, Homo sapiens
ugccuucacuccuuucuga

SEQ ID NO: 936160 - RNA, 19 nt, Homo sapiens
acuugugccuuuaaacuuu

SEQ ID NO: 936161 - RNA, 19 nt, Homo sapiens
gcucguugcucggcuuaug

SEQ ID NO: 936162 - RNA, 19 nt, Homo sapiens
ggcaggagguggaguugca

SEQ ID NO: 936163 - RNA, 19 nt, Homo sapiens
aaagaagggcugccguuug

SEQ ID NO: 936164 - RNA, 19 nt, Homo sapiens
uaaacacagccgagaaguu

SEQ ID NO: 936165 - RNA, 19 nt, Homo sapiens
uacaauagcgccuacuuca

SEQ ID NO: 936166 - RNA, 19 nt, Homo sapiens
ugauucaccugcacugcuu

SEQ ID NO: 936167 - RNA, 19 nt, Homo sapiens
agacgagucauaccugauu

SEQ ID NO: 936168 - RNA, 19 nt, Homo sapiens
acacauaggacacaggaau

SEQ ID NO: 936169 - RNA, 19 nt, Homo sapiens
gcaggcaggagguggaguu

SEQ ID NO: 936170 - RNA, 19 nt, Homo sapiens
guuagggccucaguucuag

SEQ ID NO: 936171 - RNA, 19 nt, Homo sapiens
gcacagcccaaggaccaaa

SEQ ID NO: 936172 - RNA, 19 nt, Homo sapiens
acggaaacuugugccuuua

SEQ ID NO: 936173 - RNA, 19 nt, Homo sapiens
gcaggccuccagcuacuau

SEQ ID NO: 936174 - RNA, 19 nt, Homo sapiens
uaaaccuucuccacuaaac

SEQ ID NO: 936175 - RNA, 19 nt, Homo sapiens
cuugugacaucucugauca

SEQ ID NO: 936176 - RNA, 19 nt, Homo sapiens
gcucacagggcgacuaugg

SEQ ID NO: 936177 - RNA, 19 nt, Homo sapiens
gaccaagcaacgcuaacuu

SEQ ID NO: 936178 - RNA, 19 nt, Homo sapiens
caccagcaccuucgcuuug

SEQ ID NO: 936179 - RNA, 19 nt, Homo sapiens
gacgagucauaccugauuc

SEQ ID NO: 936180 - RNA, 19 nt, Homo sapiens
cguuagggccucaguucua

SEQ ID NO: 936181 - RNA, 19 nt, Homo sapiens
gcaggaagagcgccaaagc

SEQ ID NO: 936182 - RNA, 19 nt, Homo sapiens
accaagcugugaaacuaaa

SEQ ID NO: 936183 - RNA, 19 nt, Homo sapiens
uccacgaguucgaccagua

SEQ ID NO: 936184 - RNA, 19 nt, Homo sapiens
aaacuugugccuuuaaacu

SEQ ID NO: 936185 - RNA, 19 nt, Homo sapiens
gagguaauucgggcaaaga

SEQ ID NO: 936186 - RNA, 19 nt, Homo sapiens
gacacaggacacaggaauu

SEQ ID NO: 936187 - RNA, 19 nt, Homo sapiens
cagcacccaguaccaguuu

SEQ ID NO: 936188 - RNA, 19 nt, Homo sapiens
cggaaacuugugccuuuaa

SEQ ID NO: 936189 - RNA, 19 nt, Homo sapiens
acacaggacacaggaauuc

SEQ ID NO: 936190 - RNA, 19 nt, Homo sapiens
gccagaacaucgacuucag

SEQ ID NO: 936191 - RNA, 19 nt, Homo sapiens
gaaacuugugccuuuaaac

SEQ ID NO: 936192 - RNA, 19 nt, Homo sapiens
cacauaggacacaggaauu

SEQ ID NO: 936193 - RNA, 19 nt, Homo sapiens
aagccaagccgcaugugaa

SEQ ID NO: 936194 - RNA, 19 nt, Homo sapiens
aaagauaaugccucugcuu

SEQ ID NO: 936195 - RNA, 19 nt, Homo sapiens
cgggcaaagaguagaauuu

SEQ ID NO: 936196 - RNA, 19 nt, Homo sapiens
cccucucccuucuaucuuu

SEQ ID NO: 936197 - RNA, 19 nt, Homo sapiens
aagcaacgcuaacuuuugu

SEQ ID NO: 936198 - RNA, 19 nt, Homo sapiens
gguccuugcccaugacugu

SEQ ID NO: 936199 - RNA, 19 nt, Homo sapiens
ucaaagccaagccgcaugu

SEQ ID NO: 936200 - RNA, 19 nt, Homo sapiens
ugggauuauuccacaaaga

SEQ ID NO: 936201 - RNA, 19 nt, Homo sapiens
cugcugccuucacuccuuu

SEQ ID NO: 936202 - RNA, 19 nt, Homo sapiens
cuacuucacggaaacuugu

SEQ ID NO: 936203 - RNA, 19 nt, Homo sapiens
gcgccuacuucacggaaac

SEQ ID NO: 936204 - RNA, 19 nt, Homo sapiens
cauacaauagcgccuacuu

SEQ ID NO: 936205 - RNA, 19 nt, Homo sapiens
cuaaaccuucuccacuaaa

SEQ ID NO: 936206 - RNA, 19 nt, Homo sapiens
ccagcucccucucccuucu

SEQ ID NO: 936207 - RNA, 19 nt, Homo sapiens
uaccaagcugugaaacuaa

SEQ ID NO: 936208 - RNA, 19 nt, Homo sapiens
accaagcaacgcuaacuuu

SEQ ID NO: 936209 - RNA, 19 nt, Homo sapiens
ccaccuaccaagcugugaa

SEQ ID NO: 936210 - RNA, 19 nt, Homo sapiens
ugagguggugggauuauuc

SEQ ID NO: 936211 - RNA, 19 nt, Homo sapiens
gagaauggcuuggaagaug

SEQ ID NO: 936212 - RNA, 19 nt, Homo sapiens
gaacuuggccuuggauauu

SEQ ID NO: 936213 - RNA, 19 nt, Homo sapiens
gagaaaugcuggcugugaa

SEQ ID NO: 936214 - RNA, 19 nt, Homo sapiens
ccacuacccugauguguau

SEQ ID NO: 936215 - RNA, 19 nt, Homo sapiens
caaagaaacccauacucua

SEQ ID NO: 936216 - RNA, 19 nt, Homo sapiens
agaagaaucugauaucauc

SEQ ID NO: 936217 - RNA, 19 nt, Homo sapiens
ucacagagaggcucagaua

SEQ ID NO: 936218 - RNA, 19 nt, Homo sapiens
auacaggucugguuucaaa

SEQ ID NO: 936219 - RNA, 19 nt, Homo sapiens
uagcaugggaucauauuua

SEQ ID NO: 936220 - RNA, 19 nt, Homo sapiens
ccaguuaacuuggugcaaa

SEQ ID NO: 936221 - RNA, 19 nt, Homo sapiens
uggaagauguggcuauuga

SEQ ID NO: 936222 - RNA, 19 nt, Homo sapiens
acagacacaugaaugaauu

SEQ ID NO: 936223 - RNA, 19 nt, Homo sapiens
ucaauguacuguauagaug

SEQ ID NO: 936224 - RNA, 19 nt, Homo sapiens
gcagggaggauccgaaguu

SEQ ID NO: 936225 - RNA, 19 nt, Homo sapiens
ggauacaggucugguuuca

SEQ ID NO: 936226 - RNA, 19 nt, Homo sapiens
gacauguacucucaguuug

SEQ ID NO: 936227 - RNA, 19 nt, Homo sapiens
gcucugaccacuucaaaga

SEQ ID NO: 936228 - RNA, 19 nt, Homo sapiens
gcguuuccuuugccauuua

SEQ ID NO: 936229 - RNA, 19 nt, Homo sapiens
ugagaugugugguucaaug

SEQ ID NO: 936230 - RNA, 19 nt, Homo sapiens
acagagaggcucagauaaa

SEQ ID NO: 936231 - RNA, 19 nt, Homo sapiens
gcagcgugauggccgagua

SEQ ID NO: 936232 - RNA, 19 nt, Homo sapiens
uaagaggacagaugaguga

SEQ ID NO: 936233 - RNA, 19 nt, Homo sapiens
agacauguacucucaguuu

SEQ ID NO: 936234 - RNA, 19 nt, Homo sapiens
ucuagucguuucugcauuu

SEQ ID NO: 936235 - RNA, 19 nt, Homo sapiens
ggucugauguccucauucu

SEQ ID NO: 936236 - RNA, 19 nt, Homo sapiens
agacaggaaugaccuaaag

SEQ ID NO: 936237 - RNA, 19 nt, Homo sapiens
gcucgcgccuugcuugcua

SEQ ID NO: 936238 - RNA, 19 nt, Homo sapiens
aaacugagcuccccgaaga

SEQ ID NO: 936239 - RNA, 19 nt, Homo sapiens
cagagaggcucagauaaag

SEQ ID NO: 936240 - RNA, 19 nt, Homo sapiens
gaagacaggaaugaccuaa

SEQ ID NO: 936241 - RNA, 19 nt, Homo sapiens
caagacauguacucucagu

SEQ ID NO: 936242 - RNA, 19 nt, Homo sapiens
agcaugggaucauauuuaa

SEQ ID NO: 936243 - RNA, 19 nt, Homo sapiens
aaagaaacccauacucuag

SEQ ID NO: 936244 - RNA, 19 nt, Homo sapiens
ggccuuggauauuucaguu

SEQ ID NO: 936245 - RNA, 19 nt, Homo sapiens
cuguauagaugaauagguu

SEQ ID NO: 936246 - RNA, 19 nt, Homo sapiens
gggaggauccgaaguucaa

SEQ ID NO: 936247 - RNA, 19 nt, Homo sapiens
gaauucaaagaaacccaua

SEQ ID NO: 936248 - RNA, 19 nt, Homo sapiens
gagaggcucagauaaagug

SEQ ID NO: 936249 - RNA, 19 nt, Homo sapiens
uaaggaagccaggaaguga

SEQ ID NO: 936250 - RNA, 19 nt, Homo sapiens
uuggauagcuggaaacagu

SEQ ID NO: 936251 - RNA, 19 nt, Homo sapiens
gugguucaauguacuguau

SEQ ID NO: 936252 - RNA, 19 nt, Homo sapiens
gaugugugguucaauguac

SEQ ID NO: 936253 - RNA, 19 nt, Homo sapiens
guuccuuaauggcacuuua

SEQ ID NO: 936254 - RNA, 19 nt, Homo sapiens
ucaaagaaacccauacucu

SEQ ID NO: 936255 - RNA, 19 nt, Homo sapiens
ggaguaauuuuguguuuuc

SEQ ID NO: 936256 - RNA, 19 nt, Homo sapiens
gauaaagugagcccugaga

SEQ ID NO: 936257 - RNA, 19 nt, Homo sapiens
gccaggaagugaagauaag

SEQ ID NO: 936258 - RNA, 19 nt, Homo sapiens
augaauagguuaggucuga

SEQ ID NO: 936259 - RNA, 19 nt, Homo sapiens
cuauuucacucuagaaugg

SEQ ID NO: 936260 - RNA, 19 nt, Homo sapiens
uccaagacauguacucuca

SEQ ID NO: 936261 - RNA, 19 nt, Homo sapiens
agugaagacuccauacaga

SEQ ID NO: 936262 - RNA, 19 nt, Homo sapiens
gauaucaucauagugaaga

SEQ ID NO: 936263 - RNA, 19 nt, Homo sapiens
gaugagugaccuagggaaa

SEQ ID NO: 936264 - RNA, 19 nt, Homo sapiens
aaagugagcccugagaaug

SEQ ID NO: 936265 - RNA, 19 nt, Homo sapiens
cauacagacacaugaauga

SEQ ID NO: 936266 - RNA, 19 nt, Homo sapiens
caaugccacuugcuuuaag

SEQ ID NO: 936267 - RNA, 19 nt, Homo sapiens
gauguccucauucucaauu

SEQ ID NO: 936268 - RNA, 19 nt, Homo sapiens
cgagaaaugcuggcuguga

SEQ ID NO: 936269 - RNA, 19 nt, Homo sapiens
gcuuuaagaggacagauga

SEQ ID NO: 936270 - RNA, 19 nt, Homo sapiens
caauguacuguauagauga

SEQ ID NO: 936271 - RNA, 19 nt, Homo sapiens
uaaagugagcccugagaau

SEQ ID NO: 936272 - RNA, 19 nt, Homo sapiens
guuucugcauuuccuuuaa

SEQ ID NO: 936273 - RNA, 19 nt, Homo sapiens
gcauauuggaauucaaaga

SEQ ID NO: 936274 - RNA, 19 nt, Homo sapiens
ggcaggagaccaagaaagu

SEQ ID NO: 936275 - RNA, 19 nt, Homo sapiens
gaggacagccagucugaag

SEQ ID NO: 936276 - RNA, 19 nt, Homo sapiens
ggcuaugcauauuggaauu

SEQ ID NO: 936277 - RNA, 19 nt, Homo sapiens
gaauagguuaggucugaug

SEQ ID NO: 936278 - RNA, 19 nt, Homo sapiens
ucacugcugggcaucauuu

SEQ ID NO: 936279 - RNA, 19 nt, Homo sapiens
gguucaauguacuguauag

SEQ ID NO: 936280 - RNA, 19 nt, Homo sapiens
agaauggcuuggaagaugu

SEQ ID NO: 936281 - RNA, 19 nt, Homo sapiens
aaaauagcaugggaucaua

SEQ ID NO: 936282 - RNA, 19 nt, Homo sapiens
ugauguguaugcccgagaa

SEQ ID NO: 936283 - RNA, 19 nt, Homo sapiens
gauaaggaagccaggaagu

SEQ ID NO: 936284 - RNA, 19 nt, Homo sapiens
gcaugggaucauauuuaaa

SEQ ID NO: 936285 - RNA, 19 nt, Homo sapiens
cauguacucucaguuugau

SEQ ID NO: 936286 - RNA, 19 nt, Homo sapiens
caugggaucauauuuaaac

SEQ ID NO: 936287 - RNA, 19 nt, Homo sapiens
cagacacaugaaugaauua

SEQ ID NO: 936288 - RNA, 19 nt, Homo sapiens
ccauacagacacaugaaug

SEQ ID NO: 936289 - RNA, 19 nt, Homo sapiens
gagaugugugguucaaugu

SEQ ID NO: 936290 - RNA, 19 nt, Homo sapiens
gcaggagaccaagaaagug

SEQ ID NO: 936291 - RNA, 19 nt, Homo sapiens
gaagccaggaagugaagau

SEQ ID NO: 936292 - RNA, 19 nt, Homo sapiens
agaaacccauacucuaguc

SEQ ID NO: 936293 - RNA, 19 nt, Homo sapiens
aacuuggccuuggauauuu

SEQ ID NO: 936294 - RNA, 19 nt, Homo sapiens
uaggucugauguccucauu

SEQ ID NO: 936295 - RNA, 19 nt, Homo sapiens
cagggaggauccgaaguuc

SEQ ID NO: 936296 - RNA, 19 nt, Homo sapiens
ugaagacuccauacagaca

SEQ ID NO: 936297 - RNA, 19 nt, Homo sapiens
uguacucucaguuugauuu

SEQ ID NO: 936298 - RNA, 19 nt, Homo sapiens
gucaaaggcugaaaaugug

SEQ ID NO: 936299 - RNA, 19 nt, Homo sapiens
cuuggaagauguggcuauu

SEQ ID NO: 936300 - RNA, 19 nt, Homo sapiens
gggaguaauuuuguguuuu

SEQ ID NO: 936301 - RNA, 19 nt, Homo sapiens
ccggauacaggucugguuu

SEQ ID NO: 936302 - RNA, 19 nt, Homo sapiens
ucauagugaagacuccaua

SEQ ID NO: 936303 - RNA, 19 nt, Homo sapiens
ucugauguccucauucuca

SEQ ID NO: 936304 - RNA, 19 nt, Homo sapiens
gaggcccacuacccugaug

SEQ ID NO: 936305 - RNA, 19 nt, Homo sapiens
agaaaugcuggcugugaaa

SEQ ID NO: 936306 - RNA, 19 nt, Homo sapiens
gaucacagagaggcucaga

SEQ ID NO: 936307 - RNA, 19 nt, Homo sapiens
gggcucugaccacuucaaa

SEQ ID NO: 936308 - RNA, 19 nt, Homo sapiens
cucaccagcuggaagaguu

SEQ ID NO: 936309 - RNA, 19 nt, Homo sapiens
ugaacuuggccuuggauau

SEQ ID NO: 936310 - RNA, 19 nt, Homo sapiens
guacuguauagaugaauag

SEQ ID NO: 936311 - RNA, 19 nt, Homo sapiens
ccgcaaauaugcccauuau

SEQ ID NO: 936312 - RNA, 19 nt, Homo sapiens
gcaaauaugcccauuaucc

SEQ ID NO: 936313 - RNA, 19 nt, Homo sapiens
gcaaguccgcccugcagua

SEQ ID NO: 936314 - RNA, 19 nt, Homo sapiens
gcaccuacaaccgcaaaua

SEQ ID NO: 936315 - RNA, 19 nt, Homo sapiens
uggagaagcugggcuguga

SEQ ID NO: 936316 - RNA, 19 nt, Homo sapiens
caacgacuauggcuguuac

SEQ ID NO: 936317 - RNA, 19 nt, Homo sapiens
gugaugaucgagaagauga

SEQ ID NO: 936318 - RNA, 19 nt, Homo sapiens
gcuuucuucugcugccuuu

SEQ ID NO: 936319 - RNA, 19 nt, Homo sapiens
caccuacaaccgcaaauau

SEQ ID NO: 936320 - RNA, 19 nt, Homo sapiens
gcuacgggcgucuggagaa

SEQ ID NO: 936321 - RNA, 19 nt, Homo sapiens
gggugaugaucgagaagau

SEQ ID NO: 936322 - RNA, 19 nt, Homo sapiens
gagaagaugacaggcaagu

SEQ ID NO: 936323 - RNA, 19 nt, Homo sapiens
cagcgaacguggcauuuuc

SEQ ID NO: 936324 - RNA, 19 nt, Homo sapiens
aguccgcccugcaguacaa

SEQ ID NO: 936325 - RNA, 19 nt, Homo sapiens
gagcaucacugacggcuau

SEQ ID NO: 936326 - RNA, 19 nt, Homo sapiens
guaaugauuuguacaggaa

SEQ ID NO: 936327 - RNA, 19 nt, Homo sapiens
ucaccuacauccagaauga

SEQ ID NO: 936328 - RNA, 19 nt, Homo sapiens
ggagagaaaugaguagcaa

SEQ ID NO: 936329 - RNA, 19 nt, Homo sapiens
gaaaugaguagcaacaaag

SEQ ID NO: 936330 - RNA, 19 nt, Homo sapiens
agaaaugaguagcaacaaa

SEQ ID NO: 936331 - RNA, 19 nt, Homo sapiens
ggaagcauaugccgucucu

SEQ ID NO: 936332 - RNA, 19 nt, Homo sapiens
gagucuaugugguuaauca

SEQ ID NO: 936333 - RNA, 19 nt, Homo sapiens
ggaaucuguuggcgaauca

SEQ ID NO: 936334 - RNA, 19 nt, Homo sapiens
gagcagcggucagcagugu

SEQ ID NO: 936335 - RNA, 19 nt, Homo sapiens
uguaucaggcacuuuauua

SEQ ID NO: 936336 - RNA, 19 nt, Homo sapiens
gacaaaaccuuaagcuguu

SEQ ID NO: 936337 - RNA, 19 nt, Homo sapiens
gcaauuugacgaccucuuc

SEQ ID NO: 936338 - RNA, 19 nt, Homo sapiens
guaucaggcacuuuauuaa

SEQ ID NO: 936339 - RNA, 19 nt, Homo sapiens
ggaaaacuuuaggguauuu

SEQ ID NO: 936340 - RNA, 19 nt, Homo sapiens
cuggaaggcucagcucuuu

SEQ ID NO: 936341 - RNA, 19 nt, Homo sapiens
ccacucugcugggauaaug

SEQ ID NO: 936342 - RNA, 19 nt, Homo sapiens
gaaaccguguucaucuucu

SEQ ID NO: 936343 - RNA, 19 nt, Homo sapiens
gauguauccuccagccaau

SEQ ID NO: 936344 - RNA, 19 nt, Homo sapiens
caagugcccucgggucugu

SEQ ID NO: 936345 - RNA, 19 nt, Homo sapiens
caugaggccuugguucaga

SEQ ID NO: 936346 - RNA, 19 nt, Homo sapiens
gcaaggacagggagaaguc

SEQ ID NO: 936347 - RNA, 19 nt, Homo sapiens
ggucagcaguguucgugau

SEQ ID NO: 936348 - RNA, 19 nt, Homo sapiens
gaaacgggacaaaaccuua

SEQ ID NO: 936349 - RNA, 19 nt, Homo sapiens
ccauuagcuuggcucuuaa

SEQ ID NO: 936350 - RNA, 19 nt, Homo sapiens
cagcugaugugggcaacaa

SEQ ID NO: 936351 - RNA, 19 nt, Homo sapiens
ggaaggcucagcucuuugg

SEQ ID NO: 936352 - RNA, 19 nt, Homo sapiens
ccagaaagagagauugugu

SEQ ID NO: 936353 - RNA, 19 nt, Homo sapiens
gggagucuaugugguuaau

SEQ ID NO: 936354 - RNA, 19 nt, Homo sapiens
gggaaucuguuggcgaauc

SEQ ID NO: 936355 - RNA, 19 nt, Homo sapiens
gcuccaacagugccaauga

SEQ ID NO: 936356 - RNA, 19 nt, Homo sapiens
ucaccauccucauccucua

SEQ ID NO: 936357 - RNA, 19 nt, Homo sapiens
gcgcaugcccuaccacuac

SEQ ID NO: 936358 - RNA, 19 nt, Homo sapiens
cucaagaaguggagcauca

SEQ ID NO: 936359 - RNA, 19 nt, Homo sapiens
gaguguacaauccgcauga

SEQ ID NO: 936360 - RNA, 19 nt, Homo sapiens
ucuggagccuggaaggaaa

SEQ ID NO: 936361 - RNA, 19 nt, Homo sapiens
gagcugggaacuugguguu

SEQ ID NO: 936362 - RNA, 19 nt, Homo sapiens
gauccucuuugcccucauc

SEQ ID NO: 936363 - RNA, 19 nt, Homo sapiens
gcccugagaccuuggacaa

SEQ ID NO: 936364 - RNA, 19 nt, Homo sapiens
caucgugggcccagcugua

SEQ ID NO: 936365 - RNA, 19 nt, Homo sapiens
gagaaaugaguagcaacaa

SEQ ID NO: 936366 - RNA, 19 nt, Homo sapiens
gcagggagguuuuccaacu

SEQ ID NO: 936367 - RNA, 19 nt, Homo sapiens
ggugaucgcgguggaguug

SEQ ID NO: 936368 - RNA, 19 nt, Homo sapiens
guugagcacaggcugguuu

SEQ ID NO: 936369 - RNA, 19 nt, Homo sapiens
agaagucucauucgugguu

SEQ ID NO: 936370 - RNA, 19 nt, Homo sapiens
gccagcagcuagccauugc

SEQ ID NO: 936371 - RNA, 19 nt, Homo sapiens
gcagcggucagcaguguuc

SEQ ID NO: 936372 - RNA, 19 nt, Homo sapiens
ggauuugggagucuaugug

SEQ ID NO: 936373 - RNA, 19 nt, Homo sapiens
gcaccagaaagagagauug

SEQ ID NO: 936374 - RNA, 19 nt, Homo sapiens
gugaccacgugcaugucua

SEQ ID NO: 936375 - RNA, 19 nt, Homo sapiens
uguaucaccuggguucugu

SEQ ID NO: 936376 - RNA, 19 nt, Homo sapiens
ccugagaccuuggacaaac

SEQ ID NO: 936377 - RNA, 19 nt, Homo sapiens
guucagagccccaggaaug

SEQ ID NO: 936378 - RNA, 19 nt, Homo sapiens
ucagggauuugggagucua

SEQ ID NO: 936379 - RNA, 19 nt, Homo sapiens
ccggagaugaggaaacuga

SEQ ID NO: 936380 - RNA, 19 nt, Homo sapiens
gaaggaaacgggacaaaac

SEQ ID NO: 936381 - RNA, 19 nt, Homo sapiens
ucaauuuccagcaccagaa

SEQ ID NO: 936382 - RNA, 19 nt, Homo sapiens
ugagucaaucugaggcuaa

SEQ ID NO: 936383 - RNA, 19 nt, Homo sapiens
ggguauuucugagucaauc

SEQ ID NO: 936384 - RNA, 19 nt, Homo sapiens
gcugaugugggcaacaaga

SEQ ID NO: 936385 - RNA, 19 nt, Homo sapiens
cagcagacgccggagagaa

SEQ ID NO: 936386 - RNA, 19 nt, Homo sapiens
agagaaaugaguagcaaca

SEQ ID NO: 936387 - RNA, 19 nt, Homo sapiens
gagucaaucugaggcuaag

SEQ ID NO: 936388 - RNA, 19 nt, Homo sapiens
agacuugguuuuguaauga

SEQ ID NO: 936389 - RNA, 19 nt, Homo sapiens
aaaugaguagcaacaaaga

SEQ ID NO: 936390 - RNA, 19 nt, Homo sapiens
caaccaccaccgcuucauc

SEQ ID NO: 936391 - RNA, 19 nt, Homo sapiens
gaucgagcgggcugagugu

SEQ ID NO: 936392 - RNA, 19 nt, Homo sapiens
guguuugucuccugcucuu

SEQ ID NO: 936393 - RNA, 19 nt, Homo sapiens
gcagacgccggagagaaau

SEQ ID NO: 936394 - RNA, 19 nt, Homo sapiens
cuggaaaacuuuaggguau

SEQ ID NO: 936395 - RNA, 19 nt, Homo sapiens
acacaccuacgcuccgaaa

SEQ ID NO: 936396 - RNA, 19 nt, Homo sapiens
cugucaaccucaagaagug

SEQ ID NO: 936397 - RNA, 19 nt, Homo sapiens
ccacuaucccuugcuggaa

SEQ ID NO: 936398 - RNA, 19 nt, Homo sapiens
cuucugcccacaccaguuu

SEQ ID NO: 936399 - RNA, 19 nt, Homo sapiens
uugggagucuaugugguua

SEQ ID NO: 936400 - RNA, 19 nt, Homo sapiens
gcccagcuguauggcauca

SEQ ID NO: 936401 - RNA, 19 nt, Homo sapiens
cgagcgggcugaguguaca

SEQ ID NO: 936402 - RNA, 19 nt, Homo sapiens
caagcugggcccugagauc

SEQ ID NO: 936403 - RNA, 19 nt, Homo sapiens
gaagaaugcuguuauuaug

SEQ ID NO: 936404 - RNA, 19 nt, Homo sapiens
caaacuaucucaagaacua

SEQ ID NO: 936405 - RNA, 19 nt, Homo sapiens
gaaguaaucucccaacuca

SEQ ID NO: 936406 - RNA, 19 nt, Homo sapiens
ggagaagacuggcaacuga

SEQ ID NO: 936407 - RNA, 19 nt, Homo sapiens
ggacuuagcccauacgaaa

SEQ ID NO: 936408 - RNA, 19 nt, Homo sapiens
guaaagaaauagccaauca

SEQ ID NO: 936409 - RNA, 19 nt, Homo sapiens
ggacaaugaucgggauaua

SEQ ID NO: 936410 - RNA, 19 nt, Homo sapiens
ucgaagagcuuuagacuug

SEQ ID NO: 936411 - RNA, 19 nt, Homo sapiens
ccaaugaccuugugcuuga

SEQ ID NO: 936412 - RNA, 19 nt, Homo sapiens
gcucacaccugaccaauca

SEQ ID NO: 936413 - RNA, 19 nt, Homo sapiens
ucaagucccuucccucuaa

SEQ ID NO: 936414 - RNA, 19 nt, Homo sapiens
ggaagaaugcuguuauuau

SEQ ID NO: 936415 - RNA, 19 nt, Homo sapiens
ggcacuaguucaugaaaua

SEQ ID NO: 936416 - RNA, 19 nt, Homo sapiens
uaaaggcacuaguucauga

SEQ ID NO: 936417 - RNA, 19 nt, Homo sapiens
gauauaaacccaagucuuc

SEQ ID NO: 936418 - RNA, 19 nt, Homo sapiens
gaauggcucuucagaaucu

SEQ ID NO: 936419 - RNA, 19 nt, Homo sapiens
gcccaaaccucagggauuu

SEQ ID NO: 936420 - RNA, 19 nt, Homo sapiens
gaacaaagaacaggccauu

SEQ ID NO: 936421 - RNA, 19 nt, Homo sapiens
ugaaauaauucccagauuc

SEQ ID NO: 936422 - RNA, 19 nt, Homo sapiens
gaaggacccuacccaguca

SEQ ID NO: 936423 - RNA, 19 nt, Homo sapiens
agaaauagccaaucaucua

SEQ ID NO: 936424 - RNA, 19 nt, Homo sapiens
aacaggagguaaagaaaua

SEQ ID NO: 936425 - RNA, 19 nt, Homo sapiens
gaaauaacccauaccucaa

SEQ ID NO: 936426 - RNA, 19 nt, Homo sapiens
caacuucagcacagaaaua

SEQ ID NO: 936427 - RNA, 19 nt, Homo sapiens
ccucaaaccucaccugugu

SEQ ID NO: 936428 - RNA, 19 nt, Homo sapiens
gaaugaaacacucaaagga

SEQ ID NO: 936429 - RNA, 19 nt, Homo sapiens
gaaacccuccguacccaua

SEQ ID NO: 936430 - RNA, 19 nt, Homo sapiens
gagcagaggagcuucgaaa

SEQ ID NO: 936431 - RNA, 19 nt, Homo sapiens
ccuacuaacuguuggauau

SEQ ID NO: 936432 - RNA, 19 nt, Homo sapiens
gaaccuaucccugagaaga

SEQ ID NO: 936433 - RNA, 19 nt, Homo sapiens
ucagagagcucacuaaaau

SEQ ID NO: 936434 - RNA, 19 nt, Homo sapiens
gggaagaaugcuguuauua

SEQ ID NO: 936435 - RNA, 19 nt, Homo sapiens
gcacuuagguuuuccuguu

SEQ ID NO: 936436 - RNA, 19 nt, Homo sapiens
ggaaaucucagcugcacaa

SEQ ID NO: 936437 - RNA, 19 nt, Homo sapiens
gguaauaaaggcacuaguu

SEQ ID NO: 936438 - RNA, 19 nt, Homo sapiens
ggacuuacuucacccaaac

SEQ ID NO: 936439 - RNA, 19 nt, Homo sapiens
acacggggcuugcaacuua

SEQ ID NO: 936440 - RNA, 19 nt, Homo sapiens
ggacugagagacaggacua

SEQ ID NO: 936441 - RNA, 19 nt, Homo sapiens
gaacuucaggccauauguu

SEQ ID NO: 936442 - RNA, 19 nt, Homo sapiens
gcaugcaaauacucauuau

SEQ ID NO: 936443 - RNA, 19 nt, Homo sapiens
ggagacaacgcuagcuauu

SEQ ID NO: 936444 - RNA, 19 nt, Homo sapiens
gaagacuggcaacugauuu

SEQ ID NO: 936445 - RNA, 19 nt, Homo sapiens
gaacaacuucagcacagaa

SEQ ID NO: 936446 - RNA, 19 nt, Homo sapiens
acaaugaucgggauauaaa

SEQ ID NO: 936447 - RNA, 19 nt, Homo sapiens
agacaggacuagcuggauu

SEQ ID NO: 936448 - RNA, 19 nt, Homo sapiens
aaucgaagcuguaaaacua

SEQ ID NO: 936449 - RNA, 19 nt, Homo sapiens
cgagaucgaauacaacgua

SEQ ID NO: 936450 - RNA, 19 nt, Homo sapiens
cuacucaguucuacuacaa

SEQ ID NO: 936451 - RNA, 19 nt, Homo sapiens
gaguacccauucuuccuuu

SEQ ID NO: 936452 - RNA, 19 nt, Homo sapiens
gaccacauccaccuuuaaa

SEQ ID NO: 936453 - RNA, 19 nt, Homo sapiens
ggaguggagucuuggauac

SEQ ID NO: 936454 - RNA, 19 nt, Homo sapiens
ggcguuagguauacgauau

SEQ ID NO: 936455 - RNA, 19 nt, Homo sapiens
gugaccacauccaccuuua

SEQ ID NO: 936456 - RNA, 19 nt, Homo sapiens
ggaacaacuucagcacaga

SEQ ID NO: 936457 - RNA, 19 nt, Homo sapiens
gaaugcagcgucccggaaa

SEQ ID NO: 936458 - RNA, 19 nt, Homo sapiens
ggcccucccuuaucauauu

SEQ ID NO: 936459 - RNA, 19 nt, Homo sapiens
aagcaggacuuagcccaua

SEQ ID NO: 936460 - RNA, 19 nt, Homo sapiens
guaauaaaggcacuaguuc

SEQ ID NO: 936461 - RNA, 19 nt, Homo sapiens
aaucaucuauugccugaga

SEQ ID NO: 936462 - RNA, 19 nt, Homo sapiens
ccauggcccucccuuauca

SEQ ID NO: 936463 - RNA, 19 nt, Homo sapiens
agccaaauaucaacaaguu

SEQ ID NO: 936464 - RNA, 19 nt, Homo sapiens
cacauggccugcucuguug

SEQ ID NO: 936465 - RNA, 19 nt, Homo sapiens
ucacauggccugcucuguu

SEQ ID NO: 936466 - RNA, 19 nt, Homo sapiens
gaaauaauucccagauucg

SEQ ID NO: 936467 - RNA, 19 nt, Homo sapiens
gcacuaguucaugaaauaa

SEQ ID NO: 936468 - RNA, 19 nt, Homo sapiens
gcagaggccuuccccugua

SEQ ID NO: 936469 - RNA, 19 nt, Homo sapiens
gcagaggagcuucgaaaca

SEQ ID NO: 936470 - RNA, 19 nt, Homo sapiens
ucaaaccucaccuguguaa

SEQ ID NO: 936471 - RNA, 19 nt, Homo sapiens
caagaucaggcaagagaaa

SEQ ID NO: 936472 - RNA, 19 nt, Homo sapiens
ccacauccaccuuuaaaca

SEQ ID NO: 936473 - RNA, 19 nt, Homo sapiens
uuuggacccuguaucuuua

SEQ ID NO: 936474 - RNA, 19 nt, Homo sapiens
ucacugagaaaguuaaaga

SEQ ID NO: 936475 - RNA, 19 nt, Homo sapiens
ucaccuccuuagccaaaua

SEQ ID NO: 936476 - RNA, 19 nt, Homo sapiens
ucuguugccuauagccuua

SEQ ID NO: 936477 - RNA, 19 nt, Homo sapiens
ggccugcucuguugccuau

SEQ ID NO: 936478 - RNA, 19 nt, Homo sapiens
ggauauaaacccaagucuu

SEQ ID NO: 936479 - RNA, 19 nt, Homo sapiens
gccaauggaugcccuggau

SEQ ID NO: 936480 - RNA, 19 nt, Homo sapiens
cuacacugaacaagauuua

SEQ ID NO: 936481 - RNA, 19 nt, Homo sapiens
gaacaauggaacaacuuca

SEQ ID NO: 936482 - RNA, 19 nt, Homo sapiens
ggaggaaaguaacuaaaau

SEQ ID NO: 936483 - RNA, 19 nt, Homo sapiens
gacaaugaucgggauauaa

SEQ ID NO: 936484 - RNA, 19 nt, Homo sapiens
aaucgucacugagaaaguu

SEQ ID NO: 936485 - RNA, 19 nt, Homo sapiens
cuacaaacuaucucaagaa

SEQ ID NO: 936486 - RNA, 19 nt, Homo sapiens
gaacuauuccacccuugug

SEQ ID NO: 936487 - RNA, 19 nt, Homo sapiens
caacagcacuuagguuuuc

SEQ ID NO: 936488 - RNA, 19 nt, Homo sapiens
caaccucuacucaguucua

SEQ ID NO: 936489 - RNA, 19 nt, Homo sapiens
gugcuuccucucauucuua

SEQ ID NO: 936490 - RNA, 19 nt, Homo sapiens
gguaacuccucccacacaa

SEQ ID NO: 936491 - RNA, 19 nt, Homo sapiens
ccucagggauuucaguauc

SEQ ID NO: 936492 - RNA, 19 nt, Homo sapiens
gcagacaucaccuccuuag

SEQ ID NO: 936493 - RNA, 19 nt, Homo sapiens
gguauacgauaucacuuac

SEQ ID NO: 936494 - RNA, 19 nt, Homo sapiens
uuccuaggcugacuaagaa

SEQ ID NO: 936495 - RNA, 19 nt, Homo sapiens
uaauauugcuacuccucuu

SEQ ID NO: 936496 - RNA, 19 nt, Homo sapiens
guacuggcauuggcgguau

SEQ ID NO: 936497 - RNA, 19 nt, Homo sapiens
aaauaacccauaccucaaa

SEQ ID NO: 936498 - RNA, 19 nt, Homo sapiens
cguauaggagucuuucuaa

SEQ ID NO: 936499 - RNA, 19 nt, Homo sapiens
cagcgucccggaaauauug

SEQ ID NO: 936500 - RNA, 19 nt, Homo sapiens
cauaaccaaugaccuugug

SEQ ID NO: 936501 - RNA, 19 nt, Homo sapiens
aaucagagagcucacuaaa

SEQ ID NO: 936502 - RNA, 19 nt, Homo sapiens
ggacuagcuggauuuccua

SEQ ID NO: 936503 - RNA, 19 nt, Homo sapiens
gcacuucacucuacacuaa

SEQ ID NO: 936504 - RNA, 19 nt, Homo sapiens
gaaaggaaugugcuuauua

SEQ ID NO: 936505 - RNA, 19 nt, Homo sapiens
gcaagaaccuuuccaaugg

SEQ ID NO: 936506 - RNA, 19 nt, Homo sapiens
gaacuuccauugugauaug

SEQ ID NO: 936507 - RNA, 19 nt, Homo sapiens
gaaaucuugucucuaguaa

SEQ ID NO: 936508 - RNA, 19 nt, Homo sapiens
uaaagagccugauagugua

SEQ ID NO: 936509 - RNA, 19 nt, Homo sapiens
acacauagaucaagagaga

SEQ ID NO: 936510 - RNA, 19 nt, Homo sapiens
ggaaaggaaugugcuuauu

SEQ ID NO: 936511 - RNA, 19 nt, Homo sapiens
caacucagcugggaacauu

SEQ ID NO: 936512 - RNA, 19 nt, Homo sapiens
caucuucucugugaauuua

SEQ ID NO: 936513 - RNA, 19 nt, Homo sapiens
ccaaugggcuguugaacuu

SEQ ID NO: 936514 - RNA, 19 nt, Homo sapiens
ggugaaaucuugucucuag

SEQ ID NO: 936515 - RNA, 19 nt, Homo sapiens
ccaaagggaucaggaaauu

SEQ ID NO: 936516 - RNA, 19 nt, Homo sapiens
gaauuagguuagagucuuu

SEQ ID NO: 936517 - RNA, 19 nt, Homo sapiens
aaaucgagcugcagacaua

SEQ ID NO: 936518 - RNA, 19 nt, Homo sapiens
gaaaacagcuauagacaau

SEQ ID NO: 936519 - RNA, 19 nt, Homo sapiens
gaaaacagcuauagacaau

SEQ ID NO: 936520 - RNA, 19 nt, Homo sapiens
gaacacgugucaagaugug

SEQ ID NO: 936521 - RNA, 19 nt, Homo sapiens
gcuaggcaauugaaguaua

SEQ ID NO: 936522 - RNA, 19 nt, Homo sapiens
gcaaugugcucaucaaacu

SEQ ID NO: 936523 - RNA, 19 nt, Homo sapiens
gagaacacgugucaagaug

SEQ ID NO: 936524 - RNA, 19 nt, Homo sapiens
gcaccuagccucuauuugu

SEQ ID NO: 936525 - RNA, 19 nt, Homo sapiens
cuacggguuugauuauuua

SEQ ID NO: 936526 - RNA, 19 nt, Homo sapiens
gaauuuaguucucuuucug

SEQ ID NO: 936527 - RNA, 19 nt, Homo sapiens
aaaaguggcuugaugguua

SEQ ID NO: 936528 - RNA, 19 nt, Homo sapiens
gauccugaauguuaaguga

SEQ ID NO: 936529 - RNA, 19 nt, Homo sapiens
caagcauggugaugauaua

SEQ ID NO: 936530 - RNA, 19 nt, Homo sapiens
gcagaaaccggaaaucuuc

SEQ ID NO: 936531 - RNA, 19 nt, Homo sapiens
aaauugagauccugaaugu

SEQ ID NO: 936532 - RNA, 19 nt, Homo sapiens
ugaaaggacuagaauguuc

SEQ ID NO: 936533 - RNA, 19 nt, Homo sapiens
aaacagcuauagacaauca

SEQ ID NO: 936534 - RNA, 19 nt, Homo sapiens
aaacagcuauagacaauca

SEQ ID NO: 936535 - RNA, 19 nt, Homo sapiens
gagggagagugguguguuu

SEQ ID NO: 936536 - RNA, 19 nt, Homo sapiens
gaacuugaacuuccauugu

SEQ ID NO: 936537 - RNA, 19 nt, Homo sapiens
ucucaagccugucuauaaa

SEQ ID NO: 936538 - RNA, 19 nt, Homo sapiens
gaaugcaccuccggacaaa

SEQ ID NO: 936539 - RNA, 19 nt, Homo sapiens
gacacggaaucccgaauaa

SEQ ID NO: 936540 - RNA, 19 nt, Homo sapiens
uuaaagagccugauagugu

SEQ ID NO: 936541 - RNA, 19 nt, Homo sapiens
gcuuuuagcuucccuauuu

SEQ ID NO: 936542 - RNA, 19 nt, Homo sapiens
caacauagugucagccaaa

SEQ ID NO: 936543 - RNA, 19 nt, Homo sapiens
ucaucaaacucucagcaua

SEQ ID NO: 936544 - RNA, 19 nt, Homo sapiens
gcaaauagcaaggguagga

SEQ ID NO: 936545 - RNA, 19 nt, Homo sapiens
cgaucuggauuucuuaauu

SEQ ID NO: 936546 - RNA, 19 nt, Homo sapiens
uaugaaggauguuauggaa

SEQ ID NO: 936547 - RNA, 19 nt, Homo sapiens
gaucauggcuauguuuuaa

SEQ ID NO: 936548 - RNA, 19 nt, Homo sapiens
gaucauggcuauguuuuaa

SEQ ID NO: 936549 - RNA, 19 nt, Homo sapiens
gaaauugagauccugaaug

SEQ ID NO: 936550 - RNA, 19 nt, Homo sapiens
cuaggcaauugaaguauaa

SEQ ID NO: 936551 - RNA, 19 nt, Homo sapiens
cuacaaagacuccuccaaa

SEQ ID NO: 936552 - RNA, 19 nt, Homo sapiens
gccagacgcuuucccgauu

SEQ ID NO: 936553 - RNA, 19 nt, Homo sapiens
gugcaacacugucgaaagu

SEQ ID NO: 936554 - RNA, 19 nt, Homo sapiens
gaaauucuacaugaccaua

SEQ ID NO: 936555 - RNA, 19 nt, Homo sapiens
gcaaaacuccuaaauauuc

SEQ ID NO: 936556 - RNA, 19 nt, Homo sapiens
ggucauggccuaccucuuc

SEQ ID NO: 936557 - RNA, 19 nt, Homo sapiens
caaacaauaccgucuguga

SEQ ID NO: 936558 - RNA, 19 nt, Homo sapiens
gauggugggucagauuuga

SEQ ID NO: 936559 - RNA, 19 nt, Homo sapiens
caagagaccacauaauauc

SEQ ID NO: 936560 - RNA, 19 nt, Homo sapiens
gggugaaguuuggcaguua

SEQ ID NO: 936561 - RNA, 19 nt, Homo sapiens
agacacaccucagagauau

SEQ ID NO: 936562 - RNA, 19 nt, Homo sapiens
gaaugaucauggcuauguu

SEQ ID NO: 936563 - RNA, 19 nt, Homo sapiens
gaaugaucauggcuauguu

SEQ ID NO: 936564 - RNA, 19 nt, Homo sapiens
ccugauaguguauauguua

SEQ ID NO: 936565 - RNA, 19 nt, Homo sapiens
gcccuuugcuugauauaga

SEQ ID NO: 936566 - RNA, 19 nt, Homo sapiens
cuaagaguguuuaaggauu

SEQ ID NO: 936567 - RNA, 19 nt, Homo sapiens
gguuaagacagguuuauuu

SEQ ID NO: 936568 - RNA, 19 nt, Homo sapiens
gaaguccucaguaagguuu

SEQ ID NO: 936569 - RNA, 19 nt, Homo sapiens
gcauggugaugauauagga

SEQ ID NO: 936570 - RNA, 19 nt, Homo sapiens
ucaaaggaaugaccugcaa

SEQ ID NO: 936571 - RNA, 19 nt, Homo sapiens
ccagcacgguuaacuagaa

SEQ ID NO: 936572 - RNA, 19 nt, Homo sapiens
cccaauggcccaaacaaua

SEQ ID NO: 936573 - RNA, 19 nt, Homo sapiens
gcuguucuccuuucucuuu

SEQ ID NO: 936574 - RNA, 19 nt, Homo sapiens
caaagacuccuccaaaucu

SEQ ID NO: 936575 - RNA, 19 nt, Homo sapiens
gaugugaucucugccuuuc

SEQ ID NO: 936576 - RNA, 19 nt, Homo sapiens
ccagccauguguacaguaa

SEQ ID NO: 936577 - RNA, 19 nt, Homo sapiens
ucaguaagguuuuccauuu

SEQ ID NO: 936578 - RNA, 19 nt, Homo sapiens
caacucaaccugguagauu

SEQ ID NO: 936579 - RNA, 19 nt, Homo sapiens
gaacuucauauaucaguca

SEQ ID NO: 936580 - RNA, 19 nt, Homo sapiens
gaacaugugggucccuaug

SEQ ID NO: 936581 - RNA, 19 nt, Homo sapiens
ccacauaauaucugccuuu

SEQ ID NO: 936582 - RNA, 19 nt, Homo sapiens
uucaagagaccacauaaua

SEQ ID NO: 936583 - RNA, 19 nt, Homo sapiens
caaguucccuucucuuugc

SEQ ID NO: 936584 - RNA, 19 nt, Homo sapiens
gaaaggacuagaauguuca

SEQ ID NO: 936585 - RNA, 19 nt, Homo sapiens
uacaaagacuccuccaaau

SEQ ID NO: 936586 - RNA, 19 nt, Homo sapiens
ccaguuaccuucaccuucu

SEQ ID NO: 936587 - RNA, 19 nt, Homo sapiens
ggaaucaggcacagaaauc

SEQ ID NO: 936588 - RNA, 19 nt, Homo sapiens
gucaagauguggacgaaug

SEQ ID NO: 936589 - RNA, 19 nt, Homo sapiens
uaaagcaagucauacacau

SEQ ID NO: 936590 - RNA, 19 nt, Homo sapiens
ucauauaucagucauguga

SEQ ID NO: 936591 - RNA, 19 nt, Homo sapiens
ucaagagaccacauaauau

SEQ ID NO: 936592 - RNA, 19 nt, Homo sapiens
ugaauuagguuagagucuu

SEQ ID NO: 936593 - RNA, 19 nt, Homo sapiens
cuaggucaguguaagaauu

SEQ ID NO: 936594 - RNA, 19 nt, Homo sapiens
auugagauccugaauguua

SEQ ID NO: 936595 - RNA, 19 nt, Homo sapiens
caccuagccucuauuuguu

SEQ ID NO: 936596 - RNA, 19 nt, Homo sapiens
ucaacauggugaaaucuug

SEQ ID NO: 936597 - RNA, 19 nt, Homo sapiens
gaguuaaggagaaaucauu

SEQ ID NO: 936598 - RNA, 19 nt, Homo sapiens
ucuacggguuugauuauuu

SEQ ID NO: 936599 - RNA, 19 nt, Homo sapiens
aaagggaucaggaaauuga

SEQ ID NO: 936600 - RNA, 19 nt, Homo sapiens
agacucuccucccucaaua

SEQ ID NO: 936601 - RNA, 19 nt, Homo sapiens
ugaugcagcucgacuggaa

SEQ ID NO: 936602 - RNA, 19 nt, Homo sapiens
gacuaagaguguuuaagga

SEQ ID NO: 936603 - RNA, 19 nt, Homo sapiens
gcacuucacucuacacuaa

SEQ ID NO: 936604 - RNA, 19 nt, Homo sapiens
gaaaggaaugugcuuauua

SEQ ID NO: 936605 - RNA, 19 nt, Homo sapiens
gcaagaaccuuuccaaugg

SEQ ID NO: 936606 - RNA, 19 nt, Homo sapiens
gaacuuccauugugauaug

SEQ ID NO: 936607 - RNA, 19 nt, Homo sapiens
gaaaucuugucucuaguaa

SEQ ID NO: 936608 - RNA, 19 nt, Homo sapiens
uaaagagccugauagugua

SEQ ID NO: 936609 - RNA, 19 nt, Homo sapiens
acacauagaucaagagaga

SEQ ID NO: 936610 - RNA, 19 nt, Homo sapiens
ggaaaggaaugugcuuauu

SEQ ID NO: 936611 - RNA, 19 nt, Homo sapiens
caacucagcugggaacauu

SEQ ID NO: 936612 - RNA, 19 nt, Homo sapiens
caucuucucugugaauuua

SEQ ID NO: 936613 - RNA, 19 nt, Homo sapiens
ccaaugggcuguugaacuu

SEQ ID NO: 936614 - RNA, 19 nt, Homo sapiens
ggugaaaucuugucucuag

SEQ ID NO: 936615 - RNA, 19 nt, Homo sapiens
ccaaagggaucaggaaauu

SEQ ID NO: 936616 - RNA, 19 nt, Homo sapiens
gaauuagguuagagucuuu

SEQ ID NO: 936617 - RNA, 19 nt, Homo sapiens
aaaucgagcugcagacaua

SEQ ID NO: 936618 - RNA, 19 nt, Homo sapiens
gaaaacagcuauagacaau

SEQ ID NO: 936619 - RNA, 19 nt, Homo sapiens
gaaaacagcuauagacaau

SEQ ID NO: 936620 - RNA, 19 nt, Homo sapiens
gaacacgugucaagaugug

SEQ ID NO: 936621 - RNA, 19 nt, Homo sapiens
gcuaggcaauugaaguaua

SEQ ID NO: 936622 - RNA, 19 nt, Homo sapiens
gcaaugugcucaucaaacu

SEQ ID NO: 936623 - RNA, 19 nt, Homo sapiens
gagaacacgugucaagaug

SEQ ID NO: 936624 - RNA, 19 nt, Homo sapiens
gcaccuagccucuauuugu

SEQ ID NO: 936625 - RNA, 19 nt, Homo sapiens
cuacggguuugauuauuua

SEQ ID NO: 936626 - RNA, 19 nt, Homo sapiens
gaauuuaguucucuuucug

SEQ ID NO: 936627 - RNA, 19 nt, Homo sapiens
aaaaguggcuugaugguua

SEQ ID NO: 936628 - RNA, 19 nt, Homo sapiens
gauccugaauguuaaguga

SEQ ID NO: 936629 - RNA, 19 nt, Homo sapiens
caagcauggugaugauaua

SEQ ID NO: 936630 - RNA, 19 nt, Homo sapiens
gcagaaaccggaaaucuuc

SEQ ID NO: 936631 - RNA, 19 nt, Homo sapiens
aaauugagauccugaaugu

SEQ ID NO: 936632 - RNA, 19 nt, Homo sapiens
ugaaaggacuagaauguuc

SEQ ID NO: 936633 - RNA, 19 nt, Homo sapiens
aaacagcuauagacaauca

SEQ ID NO: 936634 - RNA, 19 nt, Homo sapiens
aaacagcuauagacaauca

SEQ ID NO: 936635 - RNA, 19 nt, Homo sapiens
gagggagagugguguguuu

SEQ ID NO: 936636 - RNA, 19 nt, Homo sapiens
gaacuugaacuuccauugu

SEQ ID NO: 936637 - RNA, 19 nt, Homo sapiens
ucucaagccugucuauaaa

SEQ ID NO: 936638 - RNA, 19 nt, Homo sapiens
gacacggaaucccgaauaa

SEQ ID NO: 936639 - RNA, 19 nt, Homo sapiens
uuaaagagccugauagugu

SEQ ID NO: 936640 - RNA, 19 nt, Homo sapiens
gcuuuuagcuucccuauuu

SEQ ID NO: 936641 - RNA, 19 nt, Homo sapiens
caacauagugucagccaaa

SEQ ID NO: 936642 - RNA, 19 nt, Homo sapiens
ucaucaaacucucagcaua

SEQ ID NO: 936643 - RNA, 19 nt, Homo sapiens
gcaaauagcaaggguagga

SEQ ID NO: 936644 - RNA, 19 nt, Homo sapiens
cgaucuggauuucuuaauu

SEQ ID NO: 936645 - RNA, 19 nt, Homo sapiens
uaugaaggauguuauggaa

SEQ ID NO: 936646 - RNA, 19 nt, Homo sapiens
gaucauggcuauguuuuaa

SEQ ID NO: 936647 - RNA, 19 nt, Homo sapiens
gaucauggcuauguuuuaa

SEQ ID NO: 936648 - RNA, 19 nt, Homo sapiens
gaaauugagauccugaaug

SEQ ID NO: 936649 - RNA, 19 nt, Homo sapiens
cuaggcaauugaaguauaa

SEQ ID NO: 936650 - RNA, 19 nt, Homo sapiens
cuacaaagacuccuccaaa

SEQ ID NO: 936651 - RNA, 19 nt, Homo sapiens
gccagacgcuuucccgauu

SEQ ID NO: 936652 - RNA, 19 nt, Homo sapiens
gugcaacacugucgaaagu

SEQ ID NO: 936653 - RNA, 19 nt, Homo sapiens
gaaauucuacaugaccaua

SEQ ID NO: 936654 - RNA, 19 nt, Homo sapiens
gcaaaacuccuaaauauuc

SEQ ID NO: 936655 - RNA, 19 nt, Homo sapiens
ggucauggccuaccucuuc

SEQ ID NO: 936656 - RNA, 19 nt, Homo sapiens
gauggugggucagauuuga

SEQ ID NO: 936657 - RNA, 19 nt, Homo sapiens
caagagaccacauaauauc

SEQ ID NO: 936658 - RNA, 19 nt, Homo sapiens
gggugaaguuuggcaguua

SEQ ID NO: 936659 - RNA, 19 nt, Homo sapiens
agacacaccucagagauau

SEQ ID NO: 936660 - RNA, 19 nt, Homo sapiens
gaaugaucauggcuauguu

SEQ ID NO: 936661 - RNA, 19 nt, Homo sapiens
gaaugaucauggcuauguu

SEQ ID NO: 936662 - RNA, 19 nt, Homo sapiens
ccugauaguguauauguua

SEQ ID NO: 936663 - RNA, 19 nt, Homo sapiens
gcccuuugcuugauauaga

SEQ ID NO: 936664 - RNA, 19 nt, Homo sapiens
cuaagaguguuuaaggauu

SEQ ID NO: 936665 - RNA, 19 nt, Homo sapiens
gguuaagacagguuuauuu

SEQ ID NO: 936666 - RNA, 19 nt, Homo sapiens
gaaguccucaguaagguuu

SEQ ID NO: 936667 - RNA, 19 nt, Homo sapiens
gcauggugaugauauagga

SEQ ID NO: 936668 - RNA, 19 nt, Homo sapiens
ucaaaggaaugaccugcaa

SEQ ID NO: 936669 - RNA, 19 nt, Homo sapiens
ccagcacgguuaacuagaa

SEQ ID NO: 936670 - RNA, 19 nt, Homo sapiens
gcuguucuccuuucucuuu

SEQ ID NO: 936671 - RNA, 19 nt, Homo sapiens
caaagacuccuccaaaucu

SEQ ID NO: 936672 - RNA, 19 nt, Homo sapiens
gaugugaucucugccuuuc

SEQ ID NO: 936673 - RNA, 19 nt, Homo sapiens
ccagccauguguacaguaa

SEQ ID NO: 936674 - RNA, 19 nt, Homo sapiens
ucaguaagguuuuccauuu

SEQ ID NO: 936675 - RNA, 19 nt, Homo sapiens
caacucaaccugguagauu

SEQ ID NO: 936676 - RNA, 19 nt, Homo sapiens
gaacuucauauaucaguca

SEQ ID NO: 936677 - RNA, 19 nt, Homo sapiens
gaacaugugggucccuaug

SEQ ID NO: 936678 - RNA, 19 nt, Homo sapiens
ccacauaauaucugccuuu

SEQ ID NO: 936679 - RNA, 19 nt, Homo sapiens
uucaagagaccacauaaua

SEQ ID NO: 936680 - RNA, 19 nt, Homo sapiens
caaguucccuucucuuugc

SEQ ID NO: 936681 - RNA, 19 nt, Homo sapiens
gaaaggacuagaauguuca

SEQ ID NO: 936682 - RNA, 19 nt, Homo sapiens
uacaaagacuccuccaaau

SEQ ID NO: 936683 - RNA, 19 nt, Homo sapiens
ccaguuaccuucaccuucu

SEQ ID NO: 936684 - RNA, 19 nt, Homo sapiens
ggaaucaggcacagaaauc

SEQ ID NO: 936685 - RNA, 19 nt, Homo sapiens
gucaagauguggacgaaug

SEQ ID NO: 936686 - RNA, 19 nt, Homo sapiens
uaaagcaagucauacacau

SEQ ID NO: 936687 - RNA, 19 nt, Homo sapiens
ucauauaucagucauguga

SEQ ID NO: 936688 - RNA, 19 nt, Homo sapiens
ucaagagaccacauaauau

SEQ ID NO: 936689 - RNA, 19 nt, Homo sapiens
ugaauuagguuagagucuu

SEQ ID NO: 936690 - RNA, 19 nt, Homo sapiens
cuaggucaguguaagaauu

SEQ ID NO: 936691 - RNA, 19 nt, Homo sapiens
auugagauccugaauguua

SEQ ID NO: 936692 - RNA, 19 nt, Homo sapiens
caccuagccucuauuuguu

SEQ ID NO: 936693 - RNA, 19 nt, Homo sapiens
ucaacauggugaaaucuug

SEQ ID NO: 936694 - RNA, 19 nt, Homo sapiens
gaguuaaggagaaaucauu

SEQ ID NO: 936695 - RNA, 19 nt, Homo sapiens
ucuacggguuugauuauuu

SEQ ID NO: 936696 - RNA, 19 nt, Homo sapiens
aaagggaucaggaaauuga

SEQ ID NO: 936697 - RNA, 19 nt, Homo sapiens
agacucuccucccucaaua

SEQ ID NO: 936698 - RNA, 19 nt, Homo sapiens
ugaugcagcucgacuggaa

SEQ ID NO: 936699 - RNA, 19 nt, Homo sapiens
gacuaagaguguuuaagga

SEQ ID NO: 936700 - RNA, 19 nt, Homo sapiens
gaaagaggaaagaaacaca

SEQ ID NO: 936701 - RNA, 19 nt, Homo sapiens
gagcuguucuccuuucucu

SEQ ID NO: 936702 - RNA, 19 nt, Homo sapiens
agaaccaucucuacccaaa

SEQ ID NO: 936703 - RNA, 19 nt, Homo sapiens
gcacuucacucuacacuaa

SEQ ID NO: 936704 - RNA, 19 nt, Homo sapiens
gaaaggaaugugcuuauua

SEQ ID NO: 936705 - RNA, 19 nt, Homo sapiens
gcaagaaccuuuccaaugg

SEQ ID NO: 936706 - RNA, 19 nt, Homo sapiens
gaacuuccauugugauaug

SEQ ID NO: 936707 - RNA, 19 nt, Homo sapiens
gaaaucuugucucuaguaa

SEQ ID NO: 936708 - RNA, 19 nt, Homo sapiens
uaaagagccugauagugua

SEQ ID NO: 936709 - RNA, 19 nt, Homo sapiens
acacauagaucaagagaga

SEQ ID NO: 936710 - RNA, 19 nt, Homo sapiens
ggaaaggaaugugcuuauu

SEQ ID NO: 936711 - RNA, 19 nt, Homo sapiens
caacucagcugggaacauu

SEQ ID NO: 936712 - RNA, 19 nt, Homo sapiens
caucuucucugugaauuua

SEQ ID NO: 936713 - RNA, 19 nt, Homo sapiens
ccaaugggcuguugaacuu

SEQ ID NO: 936714 - RNA, 19 nt, Homo sapiens
ggugaaaucuugucucuag

SEQ ID NO: 936715 - RNA, 19 nt, Homo sapiens
ccaaagggaucaggaaauu

SEQ ID NO: 936716 - RNA, 19 nt, Homo sapiens
gaauuagguuagagucuuu

SEQ ID NO: 936717 - RNA, 19 nt, Homo sapiens
aaaucgagcugcagacaua

SEQ ID NO: 936718 - RNA, 19 nt, Homo sapiens
gaaaacagcuauagacaau

SEQ ID NO: 936719 - RNA, 19 nt, Homo sapiens
gaaaacagcuauagacaau

SEQ ID NO: 936720 - RNA, 19 nt, Homo sapiens
gaacacgugucaagaugug

SEQ ID NO: 936721 - RNA, 19 nt, Homo sapiens
gcuaggcaauugaaguaua

SEQ ID NO: 936722 - RNA, 19 nt, Homo sapiens
gcaaugugcucaucaaacu

SEQ ID NO: 936723 - RNA, 19 nt, Homo sapiens
gagaacacgugucaagaug

SEQ ID NO: 936724 - RNA, 19 nt, Homo sapiens
gcaccuagccucuauuugu

SEQ ID NO: 936725 - RNA, 19 nt, Homo sapiens
cuacggguuugauuauuua

SEQ ID NO: 936726 - RNA, 19 nt, Homo sapiens
gaauuuaguucucuuucug

SEQ ID NO: 936727 - RNA, 19 nt, Homo sapiens
aaaaguggcuugaugguua

SEQ ID NO: 936728 - RNA, 19 nt, Homo sapiens
gauccugaauguuaaguga

SEQ ID NO: 936729 - RNA, 19 nt, Homo sapiens
caagcauggugaugauaua

SEQ ID NO: 936730 - RNA, 19 nt, Homo sapiens
gcagaaaccggaaaucuuc

SEQ ID NO: 936731 - RNA, 19 nt, Homo sapiens
aaauugagauccugaaugu

SEQ ID NO: 936732 - RNA, 19 nt, Homo sapiens
ugaaaggacuagaauguuc

SEQ ID NO: 936733 - RNA, 19 nt, Homo sapiens
aaacagcuauagacaauca

SEQ ID NO: 936734 - RNA, 19 nt, Homo sapiens
aaacagcuauagacaauca

SEQ ID NO: 936735 - RNA, 19 nt, Homo sapiens
gagggagagugguguguuu

SEQ ID NO: 936736 - RNA, 19 nt, Homo sapiens
gaacuugaacuuccauugu

SEQ ID NO: 936737 - RNA, 19 nt, Homo sapiens
ucucaagccugucuauaaa

SEQ ID NO: 936738 - RNA, 19 nt, Homo sapiens
gacacggaaucccgaauaa

SEQ ID NO: 936739 - RNA, 19 nt, Homo sapiens
uuaaagagccugauagugu

SEQ ID NO: 936740 - RNA, 19 nt, Homo sapiens
gcuuuuagcuucccuauuu

SEQ ID NO: 936741 - RNA, 19 nt, Homo sapiens
caacauagugucagccaaa

SEQ ID NO: 936742 - RNA, 19 nt, Homo sapiens
ucaucaaacucucagcaua

SEQ ID NO: 936743 - RNA, 19 nt, Homo sapiens
gcaaauagcaaggguagga

SEQ ID NO: 936744 - RNA, 19 nt, Homo sapiens
cgaucuggauuucuuaauu

SEQ ID NO: 936745 - RNA, 19 nt, Homo sapiens
uaugaaggauguuauggaa

SEQ ID NO: 936746 - RNA, 19 nt, Homo sapiens
gaucauggcuauguuuuaa

SEQ ID NO: 936747 - RNA, 19 nt, Homo sapiens
gaucauggcuauguuuuaa

SEQ ID NO: 936748 - RNA, 19 nt, Homo sapiens
gaaauugagauccugaaug

SEQ ID NO: 936749 - RNA, 19 nt, Homo sapiens
cuaggcaauugaaguauaa

SEQ ID NO: 936750 - RNA, 19 nt, Homo sapiens
cuacaaagacuccuccaaa

SEQ ID NO: 936751 - RNA, 19 nt, Homo sapiens
gccagacgcuuucccgauu

SEQ ID NO: 936752 - RNA, 19 nt, Homo sapiens
gugcaacacugucgaaagu

SEQ ID NO: 936753 - RNA, 19 nt, Homo sapiens
gaaauucuacaugaccaua

SEQ ID NO: 936754 - RNA, 19 nt, Homo sapiens
gcaaaacuccuaaauauuc

SEQ ID NO: 936755 - RNA, 19 nt, Homo sapiens
ggucauggccuaccucuuc

SEQ ID NO: 936756 - RNA, 19 nt, Homo sapiens
gauggugggucagauuuga

SEQ ID NO: 936757 - RNA, 19 nt, Homo sapiens
caagagaccacauaauauc

SEQ ID NO: 936758 - RNA, 19 nt, Homo sapiens
gggugaaguuuggcaguua

SEQ ID NO: 936759 - RNA, 19 nt, Homo sapiens
agacacaccucagagauau

SEQ ID NO: 936760 - RNA, 19 nt, Homo sapiens
gaaugaucauggcuauguu

SEQ ID NO: 936761 - RNA, 19 nt, Homo sapiens
gaaugaucauggcuauguu

SEQ ID NO: 936762 - RNA, 19 nt, Homo sapiens
ccugauaguguauauguua

SEQ ID NO: 936763 - RNA, 19 nt, Homo sapiens
gcccuuugcuugauauaga

SEQ ID NO: 936764 - RNA, 19 nt, Homo sapiens
cuaagaguguuuaaggauu

SEQ ID NO: 936765 - RNA, 19 nt, Homo sapiens
gguuaagacagguuuauuu

SEQ ID NO: 936766 - RNA, 19 nt, Homo sapiens
gaaguccucaguaagguuu

SEQ ID NO: 936767 - RNA, 19 nt, Homo sapiens
gcauggugaugauauagga

SEQ ID NO: 936768 - RNA, 19 nt, Homo sapiens
ucaaaggaaugaccugcaa

SEQ ID NO: 936769 - RNA, 19 nt, Homo sapiens
ccagcacgguuaacuagaa

SEQ ID NO: 936770 - RNA, 19 nt, Homo sapiens
gcuguucuccuuucucuuu

SEQ ID NO: 936771 - RNA, 19 nt, Homo sapiens
caaagacuccuccaaaucu

SEQ ID NO: 936772 - RNA, 19 nt, Homo sapiens
gaugugaucucugccuuuc

SEQ ID NO: 936773 - RNA, 19 nt, Homo sapiens
ccagccauguguacaguaa

SEQ ID NO: 936774 - RNA, 19 nt, Homo sapiens
ucaguaagguuuuccauuu

SEQ ID NO: 936775 - RNA, 19 nt, Homo sapiens
caacucaaccugguagauu

SEQ ID NO: 936776 - RNA, 19 nt, Homo sapiens
gaacuucauauaucaguca

SEQ ID NO: 936777 - RNA, 19 nt, Homo sapiens
gaacaugugggucccuaug

SEQ ID NO: 936778 - RNA, 19 nt, Homo sapiens
ccacauaauaucugccuuu

SEQ ID NO: 936779 - RNA, 19 nt, Homo sapiens
uucaagagaccacauaaua

SEQ ID NO: 936780 - RNA, 19 nt, Homo sapiens
caaguucccuucucuuugc

SEQ ID NO: 936781 - RNA, 19 nt, Homo sapiens
gaaaggacuagaauguuca

SEQ ID NO: 936782 - RNA, 19 nt, Homo sapiens
uacaaagacuccuccaaau

SEQ ID NO: 936783 - RNA, 19 nt, Homo sapiens
ccaguuaccuucaccuucu

SEQ ID NO: 936784 - RNA, 19 nt, Homo sapiens
ggaaucaggcacagaaauc

SEQ ID NO: 936785 - RNA, 19 nt, Homo sapiens
uaaagcaagucauacacau

SEQ ID NO: 936786 - RNA, 19 nt, Homo sapiens
ucauauaucagucauguga

SEQ ID NO: 936787 - RNA, 19 nt, Homo sapiens
ucaagagaccacauaauau

SEQ ID NO: 936788 - RNA, 19 nt, Homo sapiens
ugaauuagguuagagucuu

SEQ ID NO: 936789 - RNA, 19 nt, Homo sapiens
cuaggucaguguaagaauu

SEQ ID NO: 936790 - RNA, 19 nt, Homo sapiens
auugagauccugaauguua

SEQ ID NO: 936791 - RNA, 19 nt, Homo sapiens
caccuagccucuauuuguu

SEQ ID NO: 936792 - RNA, 19 nt, Homo sapiens
ucaacauggugaaaucuug

SEQ ID NO: 936793 - RNA, 19 nt, Homo sapiens
gaguuaaggagaaaucauu

SEQ ID NO: 936794 - RNA, 19 nt, Homo sapiens
ucuacggguuugauuauuu

SEQ ID NO: 936795 - RNA, 19 nt, Homo sapiens
aaagggaucaggaaauuga

SEQ ID NO: 936796 - RNA, 19 nt, Homo sapiens
agacucuccucccucaaua

SEQ ID NO: 936797 - RNA, 19 nt, Homo sapiens
ugaugcagcucgacuggaa

SEQ ID NO: 936798 - RNA, 19 nt, Homo sapiens
gacuaagaguguuuaagga

SEQ ID NO: 936799 - RNA, 19 nt, Homo sapiens
gaaagaggaaagaaacaca

SEQ ID NO: 936800 - RNA, 19 nt, Homo sapiens
gagcuguucuccuuucucu

SEQ ID NO: 936801 - RNA, 19 nt, Homo sapiens
agaaccaucucuacccaaa

SEQ ID NO: 936802 - RNA, 19 nt, Homo sapiens
ggaaugaccugcaaaacuc

SEQ ID NO: 936803 - RNA, 19 nt, Homo sapiens
gcacuucacucuacacuaa

SEQ ID NO: 936804 - RNA, 19 nt, Homo sapiens
gaaaggaaugugcuuauua

SEQ ID NO: 936805 - RNA, 19 nt, Homo sapiens
gcaagaaccuuuccaaugg

SEQ ID NO: 936806 - RNA, 19 nt, Homo sapiens
gagaacacgugucaagaua

SEQ ID NO: 936807 - RNA, 19 nt, Homo sapiens
gaacuuccauugugauaug

SEQ ID NO: 936808 - RNA, 19 nt, Homo sapiens
gaaaucuugucucuaguaa

SEQ ID NO: 936809 - RNA, 19 nt, Homo sapiens
gaacacgugucaagauaug

SEQ ID NO: 936810 - RNA, 19 nt, Homo sapiens
uaaagagccugauagugua

SEQ ID NO: 936811 - RNA, 19 nt, Homo sapiens
acacauagaucaagagaga

SEQ ID NO: 936812 - RNA, 19 nt, Homo sapiens
ggaaaggaaugugcuuauu

SEQ ID NO: 936813 - RNA, 19 nt, Homo sapiens
caacucagcugggaacauu

SEQ ID NO: 936814 - RNA, 19 nt, Homo sapiens
caucuucucugugaauuua

SEQ ID NO: 936815 - RNA, 19 nt, Homo sapiens
ccaaugggcuguugaacuu

SEQ ID NO: 936816 - RNA, 19 nt, Homo sapiens
ggugaaaucuugucucuag

SEQ ID NO: 936817 - RNA, 19 nt, Homo sapiens
ccaaagggaucaggaaauu

SEQ ID NO: 936818 - RNA, 19 nt, Homo sapiens
gaauuagguuagagucuuu

SEQ ID NO: 936819 - RNA, 19 nt, Homo sapiens
aaaucgagcugcagacaua

SEQ ID NO: 936820 - RNA, 19 nt, Homo sapiens
gaaaacagcuauagacaau

SEQ ID NO: 936821 - RNA, 19 nt, Homo sapiens
gaaaacagcuauagacaau

SEQ ID NO: 936822 - RNA, 19 nt, Homo sapiens
gcuaggcaauugaaguaua

SEQ ID NO: 936823 - RNA, 19 nt, Homo sapiens
gcaaugugcucaucaaacu

SEQ ID NO: 936824 - RNA, 19 nt, Homo sapiens
gcaccuagccucuauuugu

SEQ ID NO: 936825 - RNA, 19 nt, Homo sapiens
cuacggguuugauuauuua

SEQ ID NO: 936826 - RNA, 19 nt, Homo sapiens
gaauuuaguucucuuucug

SEQ ID NO: 936827 - RNA, 19 nt, Homo sapiens
aaaaguggcuugaugguua

SEQ ID NO: 936828 - RNA, 19 nt, Homo sapiens
gauccugaauguuaaguga

SEQ ID NO: 936829 - RNA, 19 nt, Homo sapiens
caagcauggugaugauaua

SEQ ID NO: 936830 - RNA, 19 nt, Homo sapiens
gcagaaaccggaaaucuuc

SEQ ID NO: 936831 - RNA, 19 nt, Homo sapiens
aaauugagauccugaaugu

SEQ ID NO: 936832 - RNA, 19 nt, Homo sapiens
ugaaaggacuagaauguuc

SEQ ID NO: 936833 - RNA, 19 nt, Homo sapiens
aaacagcuauagacaauca

SEQ ID NO: 936834 - RNA, 19 nt, Homo sapiens
aaacagcuauagacaauca

SEQ ID NO: 936835 - RNA, 19 nt, Homo sapiens
gagggagagugguguguuu

SEQ ID NO: 936836 - RNA, 19 nt, Homo sapiens
gaacuugaacuuccauugu

SEQ ID NO: 936837 - RNA, 19 nt, Homo sapiens
ucucaagccugucuauaaa

SEQ ID NO: 936838 - RNA, 19 nt, Homo sapiens
uuaaagagccugauagugu

SEQ ID NO: 936839 - RNA, 19 nt, Homo sapiens
gcuuuuagcuucccuauuu

SEQ ID NO: 936840 - RNA, 19 nt, Homo sapiens
caacauagugucagccaaa

SEQ ID NO: 936841 - RNA, 19 nt, Homo sapiens
ucaucaaacucucagcaua

SEQ ID NO: 936842 - RNA, 19 nt, Homo sapiens
gcaaauagcaaggguagga

SEQ ID NO: 936843 - RNA, 19 nt, Homo sapiens
cgaucuggauuucuuaauu

SEQ ID NO: 936844 - RNA, 19 nt, Homo sapiens
uaugaaggauguuauggaa

SEQ ID NO: 936845 - RNA, 19 nt, Homo sapiens
gaucauggcuauguuuuaa

SEQ ID NO: 936846 - RNA, 19 nt, Homo sapiens
gaucauggcuauguuuuaa

SEQ ID NO: 936847 - RNA, 19 nt, Homo sapiens
gaaauugagauccugaaug

SEQ ID NO: 936848 - RNA, 19 nt, Homo sapiens
cuaggcaauugaaguauaa

SEQ ID NO: 936849 - RNA, 19 nt, Homo sapiens
cuacaaagacuccuccaaa

SEQ ID NO: 936850 - RNA, 19 nt, Homo sapiens
gccagacgcuuucccgauu

SEQ ID NO: 936851 - RNA, 19 nt, Homo sapiens
gugcaacacugucgaaagu

SEQ ID NO: 936852 - RNA, 19 nt, Homo sapiens
gaaauucuacaugaccaua

SEQ ID NO: 936853 - RNA, 19 nt, Homo sapiens
gcaaaacuccuaaauauuc

SEQ ID NO: 936854 - RNA, 19 nt, Homo sapiens
ggucauggccuaccucuuc

SEQ ID NO: 936855 - RNA, 19 nt, Homo sapiens
gauggugggucagauuuga

SEQ ID NO: 936856 - RNA, 19 nt, Homo sapiens
caagagaccacauaauauc

SEQ ID NO: 936857 - RNA, 19 nt, Homo sapiens
gggugaaguuuggcaguua

SEQ ID NO: 936858 - RNA, 19 nt, Homo sapiens
agacacaccucagagauau

SEQ ID NO: 936859 - RNA, 19 nt, Homo sapiens
gaaugaucauggcuauguu

SEQ ID NO: 936860 - RNA, 19 nt, Homo sapiens
gaaugaucauggcuauguu

SEQ ID NO: 936861 - RNA, 19 nt, Homo sapiens
ccugauaguguauauguua

SEQ ID NO: 936862 - RNA, 19 nt, Homo sapiens
gcccuuugcuugauauaga

SEQ ID NO: 936863 - RNA, 19 nt, Homo sapiens
cuaagaguguuuaaggauu

SEQ ID NO: 936864 - RNA, 19 nt, Homo sapiens
gguuaagacagguuuauuu

SEQ ID NO: 936865 - RNA, 19 nt, Homo sapiens
gaaguccucaguaagguuu

SEQ ID NO: 936866 - RNA, 19 nt, Homo sapiens
gcauggugaugauauagga

SEQ ID NO: 936867 - RNA, 19 nt, Homo sapiens
ucaaaggaaugaccugcaa

SEQ ID NO: 936868 - RNA, 19 nt, Homo sapiens
ccagcacgguuaacuagaa

SEQ ID NO: 936869 - RNA, 19 nt, Homo sapiens
gcuguucuccuuucucuuu

SEQ ID NO: 936870 - RNA, 19 nt, Homo sapiens
caaagacuccuccaaaucu

SEQ ID NO: 936871 - RNA, 19 nt, Homo sapiens
gaugugaucucugccuuuc

SEQ ID NO: 936872 - RNA, 19 nt, Homo sapiens
ccagccauguguacaguaa

SEQ ID NO: 936873 - RNA, 19 nt, Homo sapiens
ucaguaagguuuuccauuu

SEQ ID NO: 936874 - RNA, 19 nt, Homo sapiens
caacucaaccugguagauu

SEQ ID NO: 936875 - RNA, 19 nt, Homo sapiens
gaacuucauauaucaguca

SEQ ID NO: 936876 - RNA, 19 nt, Homo sapiens
gaacaugugggucccuaug

SEQ ID NO: 936877 - RNA, 19 nt, Homo sapiens
ccacauaauaucugccuuu

SEQ ID NO: 936878 - RNA, 19 nt, Homo sapiens
uucaagagaccacauaaua

SEQ ID NO: 936879 - RNA, 19 nt, Homo sapiens
caaguucccuucucuuugc

SEQ ID NO: 936880 - RNA, 19 nt, Homo sapiens
gaaaggacuagaauguuca

SEQ ID NO: 936881 - RNA, 19 nt, Homo sapiens
uacaaagacuccuccaaau

SEQ ID NO: 936882 - RNA, 19 nt, Homo sapiens
ccaguuaccuucaccuucu

SEQ ID NO: 936883 - RNA, 19 nt, Homo sapiens
ggaaucaggcacagaaauc

SEQ ID NO: 936884 - RNA, 19 nt, Homo sapiens
uaaagcaagucauacacau

SEQ ID NO: 936885 - RNA, 19 nt, Homo sapiens
ucauauaucagucauguga

SEQ ID NO: 936886 - RNA, 19 nt, Homo sapiens
ucaagagaccacauaauau

SEQ ID NO: 936887 - RNA, 19 nt, Homo sapiens
ugaauuagguuagagucuu

SEQ ID NO: 936888 - RNA, 19 nt, Homo sapiens
cuaggucaguguaagaauu

SEQ ID NO: 936889 - RNA, 19 nt, Homo sapiens
auugagauccugaauguua

SEQ ID NO: 936890 - RNA, 19 nt, Homo sapiens
caccuagccucuauuuguu

SEQ ID NO: 936891 - RNA, 19 nt, Homo sapiens
ucaacauggugaaaucuug

SEQ ID NO: 936892 - RNA, 19 nt, Homo sapiens
gaguuaaggagaaaucauu

SEQ ID NO: 936893 - RNA, 19 nt, Homo sapiens
ucuacggguuugauuauuu

SEQ ID NO: 936894 - RNA, 19 nt, Homo sapiens
aaagggaucaggaaauuga

SEQ ID NO: 936895 - RNA, 19 nt, Homo sapiens
agacucuccucccucaaua

SEQ ID NO: 936896 - RNA, 19 nt, Homo sapiens
ugaugcagcucgacuggaa

SEQ ID NO: 936897 - RNA, 19 nt, Homo sapiens
gacuaagaguguuuaagga

SEQ ID NO: 936898 - RNA, 19 nt, Homo sapiens
gaaagaggaaagaaacaca

SEQ ID NO: 936899 - RNA, 19 nt, Homo sapiens
gagcuguucuccuuucucu

SEQ ID NO: 936900 - RNA, 19 nt, Homo sapiens
agaaccaucucuacccaaa

SEQ ID NO: 936901 - RNA, 19 nt, Homo sapiens
ggaaugaccugcaaaacuc

SEQ ID NO: 936902 - RNA, 19 nt, Homo sapiens
gcacaauauuuaugaagcu

SEQ ID NO: 936903 - RNA, 19 nt, Homo sapiens
gcacuucacucuacacuaa

SEQ ID NO: 936904 - RNA, 19 nt, Homo sapiens
gaaaggaaugugcuuauua

SEQ ID NO: 936905 - RNA, 19 nt, Homo sapiens
gcaagaaccuuuccaaugg

SEQ ID NO: 936906 - RNA, 19 nt, Homo sapiens
gaacuuccauugugauaug

SEQ ID NO: 936907 - RNA, 19 nt, Homo sapiens
gaaaucuugucucuaguaa

SEQ ID NO: 936908 - RNA, 19 nt, Homo sapiens
uaaagagccugauagugua

SEQ ID NO: 936909 - RNA, 19 nt, Homo sapiens
acacauagaucaagagaga

SEQ ID NO: 936910 - RNA, 19 nt, Homo sapiens
ggaaaggaaugugcuuauu

SEQ ID NO: 936911 - RNA, 19 nt, Homo sapiens
caacucagcugggaacauu

SEQ ID NO: 936912 - RNA, 19 nt, Homo sapiens
caucuucucugugaauuua

SEQ ID NO: 936913 - RNA, 19 nt, Homo sapiens
ccaaugggcuguugaacuu

SEQ ID NO: 936914 - RNA, 19 nt, Homo sapiens
ggugaaaucuugucucuag

SEQ ID NO: 936915 - RNA, 19 nt, Homo sapiens
ccaaagggaucaggaaauu

SEQ ID NO: 936916 - RNA, 19 nt, Homo sapiens
gaauuagguuagagucuuu

SEQ ID NO: 936917 - RNA, 19 nt, Homo sapiens
aaaucgagcugcagacaua

SEQ ID NO: 936918 - RNA, 19 nt, Homo sapiens
gaaaacagcuauagacaau

SEQ ID NO: 936919 - RNA, 19 nt, Homo sapiens
gaaaacagcuauagacaau

SEQ ID NO: 936920 - RNA, 19 nt, Homo sapiens
gaacacgugucaagaugug

SEQ ID NO: 936921 - RNA, 19 nt, Homo sapiens
gcuaggcaauugaaguaua

SEQ ID NO: 936922 - RNA, 19 nt, Homo sapiens
gcaaugugcucaucaaacu

SEQ ID NO: 936923 - RNA, 19 nt, Homo sapiens
gagaacacgugucaagaug

SEQ ID NO: 936924 - RNA, 19 nt, Homo sapiens
gcaccuagccucuauuugu

SEQ ID NO: 936925 - RNA, 19 nt, Homo sapiens
cuacggguuugauuauuua

SEQ ID NO: 936926 - RNA, 19 nt, Homo sapiens
gaauuuaguucucuuucug

SEQ ID NO: 936927 - RNA, 19 nt, Homo sapiens
aaaaguggcuugaugguua

SEQ ID NO: 936928 - RNA, 19 nt, Homo sapiens
gauccugaauguuaaguga

SEQ ID NO: 936929 - RNA, 19 nt, Homo sapiens
caagcauggugaugauaua

SEQ ID NO: 936930 - RNA, 19 nt, Homo sapiens
gcagaaaccggaaaucuuc

SEQ ID NO: 936931 - RNA, 19 nt, Homo sapiens
aaauugagauccugaaugu

SEQ ID NO: 936932 - RNA, 19 nt, Homo sapiens
ugaaaggacuagaauguuc

SEQ ID NO: 936933 - RNA, 19 nt, Homo sapiens
aaacagcuauagacaauca

SEQ ID NO: 936934 - RNA, 19 nt, Homo sapiens
aaacagcuauagacaauca

SEQ ID NO: 936935 - RNA, 19 nt, Homo sapiens
gagggagagugguguguuu

SEQ ID NO: 936936 - RNA, 19 nt, Homo sapiens
gaacuugaacuuccauugu

SEQ ID NO: 936937 - RNA, 19 nt, Homo sapiens
ucucaagccugucuauaaa

SEQ ID NO: 936938 - RNA, 19 nt, Homo sapiens
gaaugcaccuccggacaaa

SEQ ID NO: 936939 - RNA, 19 nt, Homo sapiens
gacacggaaucccgaauaa

SEQ ID NO: 936940 - RNA, 19 nt, Homo sapiens
uuaaagagccugauagugu

SEQ ID NO: 936941 - RNA, 19 nt, Homo sapiens
gcuuuuagcuucccuauuu

SEQ ID NO: 936942 - RNA, 19 nt, Homo sapiens
caacauagugucagccaaa

SEQ ID NO: 936943 - RNA, 19 nt, Homo sapiens
ucaucaaacucucagcaua

SEQ ID NO: 936944 - RNA, 19 nt, Homo sapiens
gcaaauagcaaggguagga

SEQ ID NO: 936945 - RNA, 19 nt, Homo sapiens
cgaucuggauuucuuaauu

SEQ ID NO: 936946 - RNA, 19 nt, Homo sapiens
uaugaaggauguuauggaa

SEQ ID NO: 936947 - RNA, 19 nt, Homo sapiens
gaucauggcuauguuuuaa

SEQ ID NO: 936948 - RNA, 19 nt, Homo sapiens
gaucauggcuauguuuuaa

SEQ ID NO: 936949 - RNA, 19 nt, Homo sapiens
gaaauugagauccugaaug

SEQ ID NO: 936950 - RNA, 19 nt, Homo sapiens
cuaggcaauugaaguauaa

SEQ ID NO: 936951 - RNA, 19 nt, Homo sapiens
cuacaaagacuccuccaaa

SEQ ID NO: 936952 - RNA, 19 nt, Homo sapiens
gccagacgcuuucccgauu

SEQ ID NO: 936953 - RNA, 19 nt, Homo sapiens
gugcaacacugucgaaagu

SEQ ID NO: 936954 - RNA, 19 nt, Homo sapiens
gaaauucuacaugaccaua

SEQ ID NO: 936955 - RNA, 19 nt, Homo sapiens
gcaaaacuccuaaauauuc

SEQ ID NO: 936956 - RNA, 19 nt, Homo sapiens
ggucauggccuaccucuuc

SEQ ID NO: 936957 - RNA, 19 nt, Homo sapiens
caaacaauaccgucuguga

SEQ ID NO: 936958 - RNA, 19 nt, Homo sapiens
gauggugggucagauuuga

SEQ ID NO: 936959 - RNA, 19 nt, Homo sapiens
caagagaccacauaauauc

SEQ ID NO: 936960 - RNA, 19 nt, Homo sapiens
gggugaaguuuggcaguua

SEQ ID NO: 936961 - RNA, 19 nt, Homo sapiens
agacacaccucagagauau

SEQ ID NO: 936962 - RNA, 19 nt, Homo sapiens
gaaugaucauggcuauguu

SEQ ID NO: 936963 - RNA, 19 nt, Homo sapiens
gaaugaucauggcuauguu

SEQ ID NO: 936964 - RNA, 19 nt, Homo sapiens
ccugauaguguauauguua

SEQ ID NO: 936965 - RNA, 19 nt, Homo sapiens
gcccuuugcuugauauaga

SEQ ID NO: 936966 - RNA, 19 nt, Homo sapiens
cuaagaguguuuaaggauu

SEQ ID NO: 936967 - RNA, 19 nt, Homo sapiens
gguuaagacagguuuauuu

SEQ ID NO: 936968 - RNA, 19 nt, Homo sapiens
gaaguccucaguaagguuu

SEQ ID NO: 936969 - RNA, 19 nt, Homo sapiens
gcauggugaugauauagga

SEQ ID NO: 936970 - RNA, 19 nt, Homo sapiens
ucaaaggaaugaccugcaa

SEQ ID NO: 936971 - RNA, 19 nt, Homo sapiens
ccagcacgguuaacuagaa

SEQ ID NO: 936972 - RNA, 19 nt, Homo sapiens
cccaauggcccaaacaaua

SEQ ID NO: 936973 - RNA, 19 nt, Homo sapiens
gcuguucuccuuucucuuu

SEQ ID NO: 936974 - RNA, 19 nt, Homo sapiens
caaagacuccuccaaaucu

SEQ ID NO: 936975 - RNA, 19 nt, Homo sapiens
gaugugaucucugccuuuc

SEQ ID NO: 936976 - RNA, 19 nt, Homo sapiens
ccagccauguguacaguaa

SEQ ID NO: 936977 - RNA, 19 nt, Homo sapiens
ucaguaagguuuuccauuu

SEQ ID NO: 936978 - RNA, 19 nt, Homo sapiens
caacucaaccugguagauu

SEQ ID NO: 936979 - RNA, 19 nt, Homo sapiens
gaacuucauauaucaguca

SEQ ID NO: 936980 - RNA, 19 nt, Homo sapiens
gaacaugugggucccuaug

SEQ ID NO: 936981 - RNA, 19 nt, Homo sapiens
ccacauaauaucugccuuu

SEQ ID NO: 936982 - RNA, 19 nt, Homo sapiens
uucaagagaccacauaaua

SEQ ID NO: 936983 - RNA, 19 nt, Homo sapiens
caaguucccuucucuuugc

SEQ ID NO: 936984 - RNA, 19 nt, Homo sapiens
gaaaggacuagaauguuca

SEQ ID NO: 936985 - RNA, 19 nt, Homo sapiens
uacaaagacuccuccaaau

SEQ ID NO: 936986 - RNA, 19 nt, Homo sapiens
ccaguuaccuucaccuucu

SEQ ID NO: 936987 - RNA, 19 nt, Homo sapiens
ggaaucaggcacagaaauc

SEQ ID NO: 936988 - RNA, 19 nt, Homo sapiens
gucaagauguggacgaaug

SEQ ID NO: 936989 - RNA, 19 nt, Homo sapiens
uaaagcaagucauacacau

SEQ ID NO: 936990 - RNA, 19 nt, Homo sapiens
ucauauaucagucauguga

SEQ ID NO: 936991 - RNA, 19 nt, Homo sapiens
ucaagagaccacauaauau

SEQ ID NO: 936992 - RNA, 19 nt, Homo sapiens
ugaauuagguuagagucuu

SEQ ID NO: 936993 - RNA, 19 nt, Homo sapiens
cuaggucaguguaagaauu

SEQ ID NO: 936994 - RNA, 19 nt, Homo sapiens
auugagauccugaauguua

SEQ ID NO: 936995 - RNA, 19 nt, Homo sapiens
caccuagccucuauuuguu

SEQ ID NO: 936996 - RNA, 19 nt, Homo sapiens
ucaacauggugaaaucuug

SEQ ID NO: 936997 - RNA, 19 nt, Homo sapiens
gaguuaaggagaaaucauu

SEQ ID NO: 936998 - RNA, 19 nt, Homo sapiens
ucuacggguuugauuauuu

SEQ ID NO: 936999 - RNA, 19 nt, Homo sapiens
aaagggaucaggaaauuga

SEQ ID NO: 937000 - RNA, 19 nt, Homo sapiens
agacucuccucccucaaua

SEQ ID NO: 937001 - RNA, 19 nt, Homo sapiens
ugaugcagcucgacuggaa

SEQ ID NO: 937002 - RNA, 19 nt, Homo sapiens
gacuaagaguguuuaagga

SEQ ID NO: 937003 - RNA, 19 nt, Homo sapiens
gcacuucacucuacacuaa

SEQ ID NO: 937004 - RNA, 19 nt, Homo sapiens
gaaaggaaugugcuuauua

SEQ ID NO: 937005 - RNA, 19 nt, Homo sapiens
gcaagaaccuuuccaaugg

SEQ ID NO: 937006 - RNA, 19 nt, Homo sapiens
gaacuuccauugugauaug

SEQ ID NO: 937007 - RNA, 19 nt, Homo sapiens
gaaaucuugucucuaguaa

SEQ ID NO: 937008 - RNA, 19 nt, Homo sapiens
uaaagagccugauagugua

SEQ ID NO: 937009 - RNA, 19 nt, Homo sapiens
acacauagaucaagagaga

SEQ ID NO: 937010 - RNA, 19 nt, Homo sapiens
ggaaaggaaugugcuuauu

SEQ ID NO: 937011 - RNA, 19 nt, Homo sapiens
caacucagcugggaacauu

SEQ ID NO: 937012 - RNA, 19 nt, Homo sapiens
caucuucucugugaauuua

SEQ ID NO: 937013 - RNA, 19 nt, Homo sapiens
ccaaugggcuguugaacuu

SEQ ID NO: 937014 - RNA, 19 nt, Homo sapiens
ggugaaaucuugucucuag

SEQ ID NO: 937015 - RNA, 19 nt, Homo sapiens
ccaaagggaucaggaaauu

SEQ ID NO: 937016 - RNA, 19 nt, Homo sapiens
gaauuagguuagagucuuu

SEQ ID NO: 937017 - RNA, 19 nt, Homo sapiens
aaaucgagcugcagacaua

SEQ ID NO: 937018 - RNA, 19 nt, Homo sapiens
gaaaacagcuauagacaau

SEQ ID NO: 937019 - RNA, 19 nt, Homo sapiens
gaaaacagcuauagacaau

SEQ ID NO: 937020 - RNA, 19 nt, Homo sapiens
gaacacgugucaagaugug

SEQ ID NO: 937021 - RNA, 19 nt, Homo sapiens
gcuaggcaauugaaguaua

SEQ ID NO: 937022 - RNA, 19 nt, Homo sapiens
gcaaugugcucaucaaacu

SEQ ID NO: 937023 - RNA, 19 nt, Homo sapiens
gagaacacgugucaagaug

SEQ ID NO: 937024 - RNA, 19 nt, Homo sapiens
gcaccuagccucuauuugu

SEQ ID NO: 937025 - RNA, 19 nt, Homo sapiens
cuacggguuugauuauuua

SEQ ID NO: 937026 - RNA, 19 nt, Homo sapiens
gaauuuaguucucuuucug

SEQ ID NO: 937027 - RNA, 19 nt, Homo sapiens
aaaaguggcuugaugguua

SEQ ID NO: 937028 - RNA, 19 nt, Homo sapiens
gauccugaauguuaaguga

SEQ ID NO: 937029 - RNA, 19 nt, Homo sapiens
caagcauggugaugauaua

SEQ ID NO: 937030 - RNA, 19 nt, Homo sapiens
gcagaaaccggaaaucuuc

SEQ ID NO: 937031 - RNA, 19 nt, Homo sapiens
aaauugagauccugaaugu

SEQ ID NO: 937032 - RNA, 19 nt, Homo sapiens
ugaaaggacuagaauguuc

SEQ ID NO: 937033 - RNA, 19 nt, Homo sapiens
aaacagcuauagacaauca

SEQ ID NO: 937034 - RNA, 19 nt, Homo sapiens
aaacagcuauagacaauca

SEQ ID NO: 937035 - RNA, 19 nt, Homo sapiens
gagggagagugguguguuu

SEQ ID NO: 937036 - RNA, 19 nt, Homo sapiens
gaacuugaacuuccauugu

SEQ ID NO: 937037 - RNA, 19 nt, Homo sapiens
ucucaagccugucuauaaa

SEQ ID NO: 937038 - RNA, 19 nt, Homo sapiens
gacacggaaucccgaauaa

SEQ ID NO: 937039 - RNA, 19 nt, Homo sapiens
uuaaagagccugauagugu

SEQ ID NO: 937040 - RNA, 19 nt, Homo sapiens
gcuuuuagcuucccuauuu

SEQ ID NO: 937041 - RNA, 19 nt, Homo sapiens
caacauagugucagccaaa

SEQ ID NO: 937042 - RNA, 19 nt, Homo sapiens
ucaucaaacucucagcaua

SEQ ID NO: 937043 - RNA, 19 nt, Homo sapiens
gcaaauagcaaggguagga

SEQ ID NO: 937044 - RNA, 19 nt, Homo sapiens
cgaucuggauuucuuaauu

SEQ ID NO: 937045 - RNA, 19 nt, Homo sapiens
uaugaaggauguuauggaa

SEQ ID NO: 937046 - RNA, 19 nt, Homo sapiens
gaucauggcuauguuuuaa

SEQ ID NO: 937047 - RNA, 19 nt, Homo sapiens
gaucauggcuauguuuuaa

SEQ ID NO: 937048 - RNA, 19 nt, Homo sapiens
gaaauugagauccugaaug

SEQ ID NO: 937049 - RNA, 19 nt, Homo sapiens
cuaggcaauugaaguauaa

SEQ ID NO: 937050 - RNA, 19 nt, Homo sapiens
cuacaaagacuccuccaaa

SEQ ID NO: 937051 - RNA, 19 nt, Homo sapiens
gccagacgcuuucccgauu

SEQ ID NO: 937052 - RNA, 19 nt, Homo sapiens
gugcaacacugucgaaagu

SEQ ID NO: 937053 - RNA, 19 nt, Homo sapiens
gaaauucuacaugaccaua

SEQ ID NO: 937054 - RNA, 19 nt, Homo sapiens
gcaaaacuccuaaauauuc

SEQ ID NO: 937055 - RNA, 19 nt, Homo sapiens
ggucauggccuaccucuuc

SEQ ID NO: 937056 - RNA, 19 nt, Homo sapiens
gauggugggucagauuuga

SEQ ID NO: 937057 - RNA, 19 nt, Homo sapiens
caagagaccacauaauauc

SEQ ID NO: 937058 - RNA, 19 nt, Homo sapiens
gggugaaguuuggcaguua

SEQ ID NO: 937059 - RNA, 19 nt, Homo sapiens
agacacaccucagagauau

SEQ ID NO: 937060 - RNA, 19 nt, Homo sapiens
gaaugaucauggcuauguu

SEQ ID NO: 937061 - RNA, 19 nt, Homo sapiens
gaaugaucauggcuauguu

SEQ ID NO: 937062 - RNA, 19 nt, Homo sapiens
ccugauaguguauauguua

SEQ ID NO: 937063 - RNA, 19 nt, Homo sapiens
gcccuuugcuugauauaga

SEQ ID NO: 937064 - RNA, 19 nt, Homo sapiens
cuaagaguguuuaaggauu

SEQ ID NO: 937065 - RNA, 19 nt, Homo sapiens
gguuaagacagguuuauuu

SEQ ID NO: 937066 - RNA, 19 nt, Homo sapiens
gaaguccucaguaagguuu

SEQ ID NO: 937067 - RNA, 19 nt, Homo sapiens
gcauggugaugauauagga

SEQ ID NO: 937068 - RNA, 19 nt, Homo sapiens
ucaaaggaaugaccugcaa

SEQ ID NO: 937069 - RNA, 19 nt, Homo sapiens
ccagcacgguuaacuagaa

SEQ ID NO: 937070 - RNA, 19 nt, Homo sapiens
gcuguucuccuuucucuuu

SEQ ID NO: 937071 - RNA, 19 nt, Homo sapiens
caaagacuccuccaaaucu

SEQ ID NO: 937072 - RNA, 19 nt, Homo sapiens
gaugugaucucugccuuuc

SEQ ID NO: 937073 - RNA, 19 nt, Homo sapiens
ccagccauguguacaguaa

SEQ ID NO: 937074 - RNA, 19 nt, Homo sapiens
ucaguaagguuuuccauuu

SEQ ID NO: 937075 - RNA, 19 nt, Homo sapiens
caacucaaccugguagauu

SEQ ID NO: 937076 - RNA, 19 nt, Homo sapiens
gaacuucauauaucaguca

SEQ ID NO: 937077 - RNA, 19 nt, Homo sapiens
gaacaugugggucccuaug

SEQ ID NO: 937078 - RNA, 19 nt, Homo sapiens
ccacauaauaucugccuuu

SEQ ID NO: 937079 - RNA, 19 nt, Homo sapiens
uucaagagaccacauaaua

SEQ ID NO: 937080 - RNA, 19 nt, Homo sapiens
caaguucccuucucuuugc

SEQ ID NO: 937081 - RNA, 19 nt, Homo sapiens
gaaaggacuagaauguuca

SEQ ID NO: 937082 - RNA, 19 nt, Homo sapiens
uacaaagacuccuccaaau

SEQ ID NO: 937083 - RNA, 19 nt, Homo sapiens
ccaguuaccuucaccuucu

SEQ ID NO: 937084 - RNA, 19 nt, Homo sapiens
ggaaucaggcacagaaauc

SEQ ID NO: 937085 - RNA, 19 nt, Homo sapiens
gucaagauguggacgaaug

SEQ ID NO: 937086 - RNA, 19 nt, Homo sapiens
uaaagcaagucauacacau

SEQ ID NO: 937087 - RNA, 19 nt, Homo sapiens
ucauauaucagucauguga

SEQ ID NO: 937088 - RNA, 19 nt, Homo sapiens
ucaagagaccacauaauau

SEQ ID NO: 937089 - RNA, 19 nt, Homo sapiens
ugaauuagguuagagucuu

SEQ ID NO: 937090 - RNA, 19 nt, Homo sapiens
cuaggucaguguaagaauu

SEQ ID NO: 937091 - RNA, 19 nt, Homo sapiens
auugagauccugaauguua

SEQ ID NO: 937092 - RNA, 19 nt, Homo sapiens
caccuagccucuauuuguu

SEQ ID NO: 937093 - RNA, 19 nt, Homo sapiens
ucaacauggugaaaucuug

SEQ ID NO: 937094 - RNA, 19 nt, Homo sapiens
gaguuaaggagaaaucauu

SEQ ID NO: 937095 - RNA, 19 nt, Homo sapiens
ucuacggguuugauuauuu

SEQ ID NO: 937096 - RNA, 19 nt, Homo sapiens
aaagggaucaggaaauuga

SEQ ID NO: 937097 - RNA, 19 nt, Homo sapiens
agacucuccucccucaaua

SEQ ID NO: 937098 - RNA, 19 nt, Homo sapiens
ugaugcagcucgacuggaa

SEQ ID NO: 937099 - RNA, 19 nt, Homo sapiens
gacuaagaguguuuaagga

SEQ ID NO: 937100 - RNA, 19 nt, Homo sapiens
gaaagaggaaagaaacaca

SEQ ID NO: 937101 - RNA, 19 nt, Homo sapiens
gagcuguucuccuuucucu

SEQ ID NO: 937102 - RNA, 19 nt, Homo sapiens
agaaccaucucuacccaaa

SEQ ID NO: 937103 - RNA, 19 nt, Homo sapiens
gcacuucacucuacacuaa

SEQ ID NO: 937104 - RNA, 19 nt, Homo sapiens
gaaaggaaugugcuuauua

SEQ ID NO: 937105 - RNA, 19 nt, Homo sapiens
gcaagaaccuuuccaaugg

SEQ ID NO: 937106 - RNA, 19 nt, Homo sapiens
gaacuuccauugugauaug

SEQ ID NO: 937107 - RNA, 19 nt, Homo sapiens
gaaaucuugucucuaguaa

SEQ ID NO: 937108 - RNA, 19 nt, Homo sapiens
uaaagagccugauagugua

SEQ ID NO: 937109 - RNA, 19 nt, Homo sapiens
acacauagaucaagagaga

SEQ ID NO: 937110 - RNA, 19 nt, Homo sapiens
ggaaaggaaugugcuuauu

SEQ ID NO: 937111 - RNA, 19 nt, Homo sapiens
caacucagcugggaacauu

SEQ ID NO: 937112 - RNA, 19 nt, Homo sapiens
caucuucucugugaauuua

SEQ ID NO: 937113 - RNA, 19 nt, Homo sapiens
ccaaugggcuguugaacuu

SEQ ID NO: 937114 - RNA, 19 nt, Homo sapiens
ggugaaaucuugucucuag

SEQ ID NO: 937115 - RNA, 19 nt, Homo sapiens
ccaaagggaucaggaaauu

SEQ ID NO: 937116 - RNA, 19 nt, Homo sapiens
gaauuagguuagagucuuu

SEQ ID NO: 937117 - RNA, 19 nt, Homo sapiens
aaaucgagcugcagacaua

SEQ ID NO: 937118 - RNA, 19 nt, Homo sapiens
gaaaacagcuauagacaau

SEQ ID NO: 937119 - RNA, 19 nt, Homo sapiens
gaaaacagcuauagacaau

SEQ ID NO: 937120 - RNA, 19 nt, Homo sapiens
gaacacgugucaagaugug

SEQ ID NO: 937121 - RNA, 19 nt, Homo sapiens
gcuaggcaauugaaguaua

SEQ ID NO: 937122 - RNA, 19 nt, Homo sapiens
gcaaugugcucaucaaacu

SEQ ID NO: 937123 - RNA, 19 nt, Homo sapiens
gagaacacgugucaagaug

SEQ ID NO: 937124 - RNA, 19 nt, Homo sapiens
gcaccuagccucuauuugu

SEQ ID NO: 937125 - RNA, 19 nt, Homo sapiens
cuacggguuugauuauuua

SEQ ID NO: 937126 - RNA, 19 nt, Homo sapiens
gaauuuaguucucuuucug

SEQ ID NO: 937127 - RNA, 19 nt, Homo sapiens
aaaaguggcuugaugguua

SEQ ID NO: 937128 - RNA, 19 nt, Homo sapiens
gauccugaauguuaaguga

SEQ ID NO: 937129 - RNA, 19 nt, Homo sapiens
caagcauggugaugauaua

SEQ ID NO: 937130 - RNA, 19 nt, Homo sapiens
gcagaaaccggaaaucuuc

SEQ ID NO: 937131 - RNA, 19 nt, Homo sapiens
aaauugagauccugaaugu

SEQ ID NO: 937132 - RNA, 19 nt, Homo sapiens
ugaaaggacuagaauguuc

SEQ ID NO: 937133 - RNA, 19 nt, Homo sapiens
aaacagcuauagacaauca

SEQ ID NO: 937134 - RNA, 19 nt, Homo sapiens
aaacagcuauagacaauca

SEQ ID NO: 937135 - RNA, 19 nt, Homo sapiens
gagggagagugguguguuu

SEQ ID NO: 937136 - RNA, 19 nt, Homo sapiens
gaacuugaacuuccauugu

SEQ ID NO: 937137 - RNA, 19 nt, Homo sapiens
ucucaagccugucuauaaa

SEQ ID NO: 937138 - RNA, 19 nt, Homo sapiens
gacacggaaucccgaauaa

SEQ ID NO: 937139 - RNA, 19 nt, Homo sapiens
uuaaagagccugauagugu

SEQ ID NO: 937140 - RNA, 19 nt, Homo sapiens
gcuuuuagcuucccuauuu

SEQ ID NO: 937141 - RNA, 19 nt, Homo sapiens
caacauagugucagccaaa

SEQ ID NO: 937142 - RNA, 19 nt, Homo sapiens
ucaucaaacucucagcaua

SEQ ID NO: 937143 - RNA, 19 nt, Homo sapiens
gcaaauagcaaggguagga

SEQ ID NO: 937144 - RNA, 19 nt, Homo sapiens
cgaucuggauuucuuaauu

SEQ ID NO: 937145 - RNA, 19 nt, Homo sapiens
uaugaaggauguuauggaa

SEQ ID NO: 937146 - RNA, 19 nt, Homo sapiens
gaucauggcuauguuuuaa

SEQ ID NO: 937147 - RNA, 19 nt, Homo sapiens
gaucauggcuauguuuuaa

SEQ ID NO: 937148 - RNA, 19 nt, Homo sapiens
gaaauugagauccugaaug

SEQ ID NO: 937149 - RNA, 19 nt, Homo sapiens
cuaggcaauugaaguauaa

SEQ ID NO: 937150 - RNA, 19 nt, Homo sapiens
cuacaaagacuccuccaaa

SEQ ID NO: 937151 - RNA, 19 nt, Homo sapiens
gccagacgcuuucccgauu

SEQ ID NO: 937152 - RNA, 19 nt, Homo sapiens
gugcaacacugucgaaagu

SEQ ID NO: 937153 - RNA, 19 nt, Homo sapiens
gaaauucuacaugaccaua

SEQ ID NO: 937154 - RNA, 19 nt, Homo sapiens
gcaaaacuccuaaauauuc

SEQ ID NO: 937155 - RNA, 19 nt, Homo sapiens
ggucauggccuaccucuuc

SEQ ID NO: 937156 - RNA, 19 nt, Homo sapiens
gauggugggucagauuuga

SEQ ID NO: 937157 - RNA, 19 nt, Homo sapiens
caagagaccacauaauauc

SEQ ID NO: 937158 - RNA, 19 nt, Homo sapiens
gggugaaguuuggcaguua

SEQ ID NO: 937159 - RNA, 19 nt, Homo sapiens
agacacaccucagagauau

SEQ ID NO: 937160 - RNA, 19 nt, Homo sapiens
gaaugaucauggcuauguu

SEQ ID NO: 937161 - RNA, 19 nt, Homo sapiens
gaaugaucauggcuauguu

SEQ ID NO: 937162 - RNA, 19 nt, Homo sapiens
ccugauaguguauauguua

SEQ ID NO: 937163 - RNA, 19 nt, Homo sapiens
gcccuuugcuugauauaga

SEQ ID NO: 937164 - RNA, 19 nt, Homo sapiens
cuaagaguguuuaaggauu

SEQ ID NO: 937165 - RNA, 19 nt, Homo sapiens
gguuaagacagguuuauuu

SEQ ID NO: 937166 - RNA, 19 nt, Homo sapiens
gaaguccucaguaagguuu

SEQ ID NO: 937167 - RNA, 19 nt, Homo sapiens
gcauggugaugauauagga

SEQ ID NO: 937168 - RNA, 19 nt, Homo sapiens
ucaaaggaaugaccugcaa

SEQ ID NO: 937169 - RNA, 19 nt, Homo sapiens
ccagcacgguuaacuagaa

SEQ ID NO: 937170 - RNA, 19 nt, Homo sapiens
gcuguucuccuuucucuuu

SEQ ID NO: 937171 - RNA, 19 nt, Homo sapiens
caaagacuccuccaaaucu

SEQ ID NO: 937172 - RNA, 19 nt, Homo sapiens
gaugugaucucugccuuuc

SEQ ID NO: 937173 - RNA, 19 nt, Homo sapiens
ccagccauguguacaguaa

SEQ ID NO: 937174 - RNA, 19 nt, Homo sapiens
ucaguaagguuuuccauuu

SEQ ID NO: 937175 - RNA, 19 nt, Homo sapiens
caacucaaccugguagauu

SEQ ID NO: 937176 - RNA, 19 nt, Homo sapiens
gaacuucauauaucaguca

SEQ ID NO: 937177 - RNA, 19 nt, Homo sapiens
gaacaugugggucccuaug

SEQ ID NO: 937178 - RNA, 19 nt, Homo sapiens
ccacauaauaucugccuuu

SEQ ID NO: 937179 - RNA, 19 nt, Homo sapiens
uucaagagaccacauaaua

SEQ ID NO: 937180 - RNA, 19 nt, Homo sapiens
caaguucccuucucuuugc

SEQ ID NO: 937181 - RNA, 19 nt, Homo sapiens
gaaaggacuagaauguuca

SEQ ID NO: 937182 - RNA, 19 nt, Homo sapiens
uacaaagacuccuccaaau

SEQ ID NO: 937183 - RNA, 19 nt, Homo sapiens
ccaguuaccuucaccuucu

SEQ ID NO: 937184 - RNA, 19 nt, Homo sapiens
ggaaucaggcacagaaauc

SEQ ID NO: 937185 - RNA, 19 nt, Homo sapiens
uaaagcaagucauacacau

SEQ ID NO: 937186 - RNA, 19 nt, Homo sapiens
ucauauaucagucauguga

SEQ ID NO: 937187 - RNA, 19 nt, Homo sapiens
ucaagagaccacauaauau

SEQ ID NO: 937188 - RNA, 19 nt, Homo sapiens
ugaauuagguuagagucuu

SEQ ID NO: 937189 - RNA, 19 nt, Homo sapiens
cuaggucaguguaagaauu

SEQ ID NO: 937190 - RNA, 19 nt, Homo sapiens
auugagauccugaauguua

SEQ ID NO: 937191 - RNA, 19 nt, Homo sapiens
caccuagccucuauuuguu

SEQ ID NO: 937192 - RNA, 19 nt, Homo sapiens
ucaacauggugaaaucuug

SEQ ID NO: 937193 - RNA, 19 nt, Homo sapiens
gaguuaaggagaaaucauu

SEQ ID NO: 937194 - RNA, 19 nt, Homo sapiens
ucuacggguuugauuauuu

SEQ ID NO: 937195 - RNA, 19 nt, Homo sapiens
aaagggaucaggaaauuga

SEQ ID NO: 937196 - RNA, 19 nt, Homo sapiens
agacucuccucccucaaua

SEQ ID NO: 937197 - RNA, 19 nt, Homo sapiens
ugaugcagcucgacuggaa

SEQ ID NO: 937198 - RNA, 19 nt, Homo sapiens
gacuaagaguguuuaagga

SEQ ID NO: 937199 - RNA, 19 nt, Homo sapiens
gaaagaggaaagaaacaca

SEQ ID NO: 937200 - RNA, 19 nt, Homo sapiens
gagcuguucuccuuucucu

SEQ ID NO: 937201 - RNA, 19 nt, Homo sapiens
agaaccaucucuacccaaa

SEQ ID NO: 937202 - RNA, 19 nt, Homo sapiens
ggaaugaccugcaaaacuc

SEQ ID NO: 937203 - RNA, 19 nt, Homo sapiens
gcacaagcauuccuuagca

SEQ ID NO: 937204 - RNA, 19 nt, Homo sapiens
cauaauacauuccaucaca

SEQ ID NO: 937205 - RNA, 19 nt, Homo sapiens
gcccaaagcuggagccaau

SEQ ID NO: 937206 - RNA, 19 nt, Homo sapiens
gaacauucccacauaauac

SEQ ID NO: 937207 - RNA, 19 nt, Homo sapiens
ccaugcagcuguuugagaa

SEQ ID NO: 937208 - RNA, 19 nt, Homo sapiens
agaaggagcugcagucucu

SEQ ID NO: 937209 - RNA, 19 nt, Homo sapiens
ccacagggcucagauagca

SEQ ID NO: 937210 - RNA, 19 nt, Homo sapiens
agaccaaguucaccaagaa

SEQ ID NO: 937211 - RNA, 19 nt, Homo sapiens
gauuucaaguuuagggauu

SEQ ID NO: 937212 - RNA, 19 nt, Homo sapiens
gguccaaucuccgguguga

SEQ ID NO: 937213 - RNA, 19 nt, Homo sapiens
gaugcugccuggucaagug

SEQ ID NO: 937214 - RNA, 19 nt, Homo sapiens
acacaccacuuagcaagaa

SEQ ID NO: 937215 - RNA, 19 nt, Homo sapiens
ggaugcagccggcuaagga

SEQ ID NO: 937216 - RNA, 19 nt, Homo sapiens
gagcugcagucucucuaca

SEQ ID NO: 937217 - RNA, 19 nt, Homo sapiens
ggagaugccaccaccuaug

SEQ ID NO: 937218 - RNA, 19 nt, Homo sapiens
gcaagaaggaggguaucaa

SEQ ID NO: 937219 - RNA, 19 nt, Homo sapiens
cagcauccacuaauauuca

SEQ ID NO: 937220 - RNA, 19 nt, Homo sapiens
cuaccuaugcuucuagaaa

SEQ ID NO: 937221 - RNA, 19 nt, Homo sapiens
ugaaguccaucuaugacau

SEQ ID NO: 937222 - RNA, 19 nt, Homo sapiens
ucuacgacauuaacaagga

SEQ ID NO: 937223 - RNA, 19 nt, Homo sapiens
uugagaaugucaucuagga

SEQ ID NO: 937224 - RNA, 19 nt, Homo sapiens
cagaccaaguucaccaaga

SEQ ID NO: 937225 - RNA, 19 nt, Homo sapiens
gaaguccaucuaugacaug

SEQ ID NO: 937226 - RNA, 19 nt, Homo sapiens
caucaugaaguccaucuau

SEQ ID NO: 937227 - RNA, 19 nt, Homo sapiens
caagugggccuuuaaucuc

SEQ ID NO: 937228 - RNA, 19 nt, Homo sapiens
ucaagugggccuuuaaucu

SEQ ID NO: 937229 - RNA, 19 nt, Homo sapiens
aagcucaagugggccuuua

SEQ ID NO: 937230 - RNA, 19 nt, Homo sapiens
caagaaggaggguaucaag

SEQ ID NO: 937231 - RNA, 19 nt, Homo sapiens
ggagggugguuccuguucu

SEQ ID NO: 937232 - RNA, 19 nt, Homo sapiens
agaaggaggguaucaagug

SEQ ID NO: 937233 - RNA, 19 nt, Homo sapiens
ggagaaugccagcccaaag

SEQ ID NO: 937234 - RNA, 19 nt, Homo sapiens
uaccuaugcuucuagaaag

SEQ ID NO: 937235 - RNA, 19 nt, Homo sapiens
gggaggcuggcaacaguuu

SEQ ID NO: 937236 - RNA, 19 nt, Homo sapiens
caccaccuaugcacacuuc

SEQ ID NO: 937237 - RNA, 19 nt, Homo sapiens
gccaggcuuugaugagaug

SEQ ID NO: 937238 - RNA, 19 nt, Homo sapiens
aaagcacaagcauuccuua

SEQ ID NO: 937239 - RNA, 19 nt, Homo sapiens
ucuccauucugcuuucuug

SEQ ID NO: 937240 - RNA, 19 nt, Homo sapiens
ccuuuaaucucuacgacau

SEQ ID NO: 937241 - RNA, 19 nt, Homo sapiens
gcagccggcuaaggaagug

SEQ ID NO: 937242 - RNA, 19 nt, Homo sapiens
ccaggagggcaucagcuuu

SEQ ID NO: 937243 - RNA, 19 nt, Homo sapiens
gagaaugccagcccaaagc

SEQ ID NO: 937244 - RNA, 19 nt, Homo sapiens
guaccaggccacccacugu

SEQ ID NO: 937245 - RNA, 19 nt, Homo sapiens
cggagcacguggagagguu

SEQ ID NO: 937246 - RNA, 19 nt, Homo sapiens
gcucaagugggccuuuaau

SEQ ID NO: 937247 - RNA, 19 nt, Homo sapiens
cauccacuuugaggacuuu

SEQ ID NO: 937248 - RNA, 19 nt, Homo sapiens
ccgccaggcuuugaugaga

SEQ ID NO: 937249 - RNA, 19 nt, Homo sapiens
cuaauauucaguccuguau

SEQ ID NO: 937250 - RNA, 19 nt, Homo sapiens
ggugucacucugccucuaa

SEQ ID NO: 937251 - RNA, 19 nt, Homo sapiens
cggcugaccaacauucaaa

SEQ ID NO: 937252 - RNA, 19 nt, Homo sapiens
gggcacacaccacuuagca

SEQ ID NO: 937253 - RNA, 19 nt, Homo sapiens
gaaccaggaugggguagug

SEQ ID NO: 937254 - RNA, 19 nt, Homo sapiens
guuugagaaugucaucuag

SEQ ID NO: 937255 - RNA, 19 nt, Homo sapiens
gcuccaugcagcuguuuga

SEQ ID NO: 937256 - RNA, 19 nt, Homo sapiens
uagugaccauugaagaguu

SEQ ID NO: 937257 - RNA, 19 nt, Homo sapiens
ccaggaugcagccggcuaa

SEQ ID NO: 937258 - RNA, 19 nt, Homo sapiens
uaugcacacuuccucuuca

SEQ ID NO: 937259 - RNA, 19 nt, Homo sapiens
ucucagcauccacuaauau

SEQ ID NO: 937260 - RNA, 19 nt, Homo sapiens
guucucagcauccacuaau

SEQ ID NO: 937261 - RNA, 19 nt, Homo sapiens
gagggugguuccuguucuc

SEQ ID NO: 937262 - RNA, 19 nt, Homo sapiens
cggcuaaggaagugacaaa

SEQ ID NO: 937263 - RNA, 19 nt, Homo sapiens
gagaugccaccaccuaugc

SEQ ID NO: 937264 - RNA, 19 nt, Homo sapiens
ccaaguucaccaagaagga

SEQ ID NO: 937265 - RNA, 19 nt, Homo sapiens
caggagggcaucagcuuuc

SEQ ID NO: 937266 - RNA, 19 nt, Homo sapiens
cacauaauacauuccauca

SEQ ID NO: 937267 - RNA, 19 nt, Homo sapiens
gccacucucugcccacuac

SEQ ID NO: 937268 - RNA, 19 nt, Homo sapiens
gagcagccuccaagaaacu

SEQ ID NO: 937269 - RNA, 19 nt, Homo sapiens
gguagugaccauugaagag

SEQ ID NO: 937270 - RNA, 19 nt, Homo sapiens
gcacaguccacgagaagcu

SEQ ID NO: 937271 - RNA, 19 nt, Homo sapiens
ccuccaagguccucuuagg

SEQ ID NO: 937272 - RNA, 19 nt, Homo sapiens
gcuaaggaagugacaaagg

SEQ ID NO: 937273 - RNA, 19 nt, Homo sapiens
cagauagcagcgacaguga

SEQ ID NO: 937274 - RNA, 19 nt, Homo sapiens
guagugaccauugaagagu

SEQ ID NO: 937275 - RNA, 19 nt, Homo sapiens
gaagcucaagugggccuuu

SEQ ID NO: 937276 - RNA, 19 nt, Homo sapiens
cagaggaaaggcaguaugg

SEQ ID NO: 937277 - RNA, 19 nt, Homo sapiens
ggaggccugucagaaggau

SEQ ID NO: 937278 - RNA, 19 nt, Homo sapiens
gcacguggagagguucuuc

SEQ ID NO: 937279 - RNA, 19 nt, Homo sapiens
gggcacaguccacgagaag

SEQ ID NO: 937280 - RNA, 19 nt, Homo sapiens
gggagaugccaccaccuau

SEQ ID NO: 937281 - RNA, 19 nt, Homo sapiens
gcagagcucagaggagucu

SEQ ID NO: 937282 - RNA, 19 nt, Homo sapiens
ggguagugaccauugaaga

SEQ ID NO: 937283 - RNA, 19 nt, Homo sapiens
gaugcagccggcuaaggaa

SEQ ID NO: 937284 - RNA, 19 nt, Homo sapiens
cuacgacauuaacaaggau

SEQ ID NO: 937285 - RNA, 19 nt, Homo sapiens
uacaggggcuuuaagaaug

SEQ ID NO: 937286 - RNA, 19 nt, Homo sapiens
ccucccagcuggugucacu

SEQ ID NO: 937287 - RNA, 19 nt, Homo sapiens
ugcuggaugucaccaagaa

SEQ ID NO: 937288 - RNA, 19 nt, Homo sapiens
gaaacacacuagacagaug

SEQ ID NO: 937289 - RNA, 19 nt, Homo sapiens
ggaaaugcuugacaucaug

SEQ ID NO: 937290 - RNA, 19 nt, Homo sapiens
gaccuugucuccuuagaaa

SEQ ID NO: 937291 - RNA, 19 nt, Homo sapiens
gaagacuguugacugcuuu

SEQ ID NO: 937292 - RNA, 19 nt, Homo sapiens
cagauaaccuccucaguuc

SEQ ID NO: 937293 - RNA, 19 nt, Homo sapiens
gcucaggcauaccagguua

SEQ ID NO: 937294 - RNA, 19 nt, Homo sapiens
ucacuagaaucuucaauca

SEQ ID NO: 937295 - RNA, 19 nt, Homo sapiens
guagaugacaggcuuaauu

SEQ ID NO: 937296 - RNA, 19 nt, Homo sapiens
ccagauaaccuccucaguu

SEQ ID NO: 937297 - RNA, 19 nt, Homo sapiens
agaagggccuggacagauu

SEQ ID NO: 937298 - RNA, 19 nt, Homo sapiens
gaagggccuggacagauua

SEQ ID NO: 937299 - RNA, 19 nt, Homo sapiens
cagcguggacgaugaauuu

SEQ ID NO: 937300 - RNA, 19 nt, Homo sapiens
gcucgucccauuuagcuua

SEQ ID NO: 937301 - RNA, 19 nt, Homo sapiens
cacaguggaugccuuagaa

SEQ ID NO: 937302 - RNA, 19 nt, Homo sapiens
cauguucucuauagacuug

SEQ ID NO: 937303 - RNA, 19 nt, Homo sapiens
ccaugcagcucuuugacaa

SEQ ID NO: 937304 - RNA, 19 nt, Homo sapiens
gaagauggacagaaacaag

SEQ ID NO: 937305 - RNA, 19 nt, Homo sapiens
gggccugagucaauggaua

SEQ ID NO: 937306 - RNA, 19 nt, Homo sapiens
gaauguauagggagaaauc

SEQ ID NO: 937307 - RNA, 19 nt, Homo sapiens
caugauggcucggucaguu

SEQ ID NO: 937308 - RNA, 19 nt, Homo sapiens
gggaacacguggagagcuu

SEQ ID NO: 937309 - RNA, 19 nt, Homo sapiens
acagaugucuccugcuaug

SEQ ID NO: 937310 - RNA, 19 nt, Homo sapiens
ggaccucacccuucucuuc

SEQ ID NO: 937311 - RNA, 19 nt, Homo sapiens
gaaaugcuugacaucauga

SEQ ID NO: 937312 - RNA, 19 nt, Homo sapiens
gcugaugccugccaaaauu

SEQ ID NO: 937313 - RNA, 19 nt, Homo sapiens
aaggagaguuuguccgauu

SEQ ID NO: 937314 - RNA, 19 nt, Homo sapiens
uagcuuacccucccaguug

SEQ ID NO: 937315 - RNA, 19 nt, Homo sapiens
ggaauucauugagucuugu

SEQ ID NO: 937316 - RNA, 19 nt, Homo sapiens
gcucaucucuggcauugcu

SEQ ID NO: 937317 - RNA, 19 nt, Homo sapiens
ggcacuggcuggcuucuca

SEQ ID NO: 937318 - RNA, 19 nt, Homo sapiens
cguggacgaugaauuugaa

SEQ ID NO: 937319 - RNA, 19 nt, Homo sapiens
uuugggcucuucuauauau

SEQ ID NO: 937320 - RNA, 19 nt, Homo sapiens
gaccauugaggaauucauu

SEQ ID NO: 937321 - RNA, 19 nt, Homo sapiens
uagaugacaggcuuaauug

SEQ ID NO: 937322 - RNA, 19 nt, Homo sapiens
caccugcucgucccauuua

SEQ ID NO: 937323 - RNA, 19 nt, Homo sapiens
gaggaaaugcuugacauca

SEQ ID NO: 937324 - RNA, 19 nt, Homo sapiens
gauuuacucccaguucuuu

SEQ ID NO: 937325 - RNA, 19 nt, Homo sapiens
gcagauuuacucccaguuc

SEQ ID NO: 937326 - RNA, 19 nt, Homo sapiens
gaaugucccagcggaauug

SEQ ID NO: 937327 - RNA, 19 nt, Homo sapiens
agaagacuguugacugcuu

SEQ ID NO: 937328 - RNA, 19 nt, Homo sapiens
caaccuguaugaccuuaac

SEQ ID NO: 937329 - RNA, 19 nt, Homo sapiens
gagaacuucaagcagauuu

SEQ ID NO: 937330 - RNA, 19 nt, Homo sapiens
ucaaugaggagaacuucaa

SEQ ID NO: 937331 - RNA, 19 nt, Homo sapiens
acuagaaucuucaaucaac

SEQ ID NO: 937332 - RNA, 19 nt, Homo sapiens
ugaaguccaucuaugacau

SEQ ID NO: 937333 - RNA, 19 nt, Homo sapiens
cagacagcguggacgauga

SEQ ID NO: 937334 - RNA, 19 nt, Homo sapiens
uagaaacacacuagacaga

SEQ ID NO: 937335 - RNA, 19 nt, Homo sapiens
ucauaaacauuuccccuaa

SEQ ID NO: 937336 - RNA, 19 nt, Homo sapiens
gaaguccaucuaugacaug

SEQ ID NO: 937337 - RNA, 19 nt, Homo sapiens
caucaugaaguccaucuau

SEQ ID NO: 937338 - RNA, 19 nt, Homo sapiens
guaagaaauauaccagauc

SEQ ID NO: 937339 - RNA, 19 nt, Homo sapiens
gacucaaucuacccagaga

SEQ ID NO: 937340 - RNA, 19 nt, Homo sapiens
ucccuagggucucuucuug

SEQ ID NO: 937341 - RNA, 19 nt, Homo sapiens
gggccuggacagauuauga

SEQ ID NO: 937342 - RNA, 19 nt, Homo sapiens
ucccugaccucauaaacau

SEQ ID NO: 937343 - RNA, 19 nt, Homo sapiens
aggaauucauugagucuug

SEQ ID NO: 937344 - RNA, 19 nt, Homo sapiens
aagaauguauagggagaaa

SEQ ID NO: 937345 - RNA, 19 nt, Homo sapiens
gggauucaguaguccagau

SEQ ID NO: 937346 - RNA, 19 nt, Homo sapiens
gaacuucaagcagauuuac

SEQ ID NO: 937347 - RNA, 19 nt, Homo sapiens
uggcucaucucuggcauug

SEQ ID NO: 937348 - RNA, 19 nt, Homo sapiens
ccauugaggaauucauuga

SEQ ID NO: 937349 - RNA, 19 nt, Homo sapiens
ugagggcuaugacuugagu

SEQ ID NO: 937350 - RNA, 19 nt, Homo sapiens
gcaggagcaaaccaaauuc

SEQ ID NO: 937351 - RNA, 19 nt, Homo sapiens
uugcuuaucgucccuguuu

SEQ ID NO: 937352 - RNA, 19 nt, Homo sapiens
cagguuauagcuccaaguu

SEQ ID NO: 937353 - RNA, 19 nt, Homo sapiens
ccugaccucauaaacauuu

SEQ ID NO: 937354 - RNA, 19 nt, Homo sapiens
ggaggaaaugcuugacauc

SEQ ID NO: 937355 - RNA, 19 nt, Homo sapiens
auauaaguuuccaggcuuu

SEQ ID NO: 937356 - RNA, 19 nt, Homo sapiens
ccacaggccaucaaaauau

SEQ ID NO: 937357 - RNA, 19 nt, Homo sapiens
ggacagaaacaaggauggu

SEQ ID NO: 937358 - RNA, 19 nt, Homo sapiens
aggaaaugcuugacaucau

SEQ ID NO: 937359 - RNA, 19 nt, Homo sapiens
ggacuuuguggcugguuug

SEQ ID NO: 937360 - RNA, 19 nt, Homo sapiens
cagauuuacucccaguucu

SEQ ID NO: 937361 - RNA, 19 nt, Homo sapiens
cgaaugucccagcggaauu

SEQ ID NO: 937362 - RNA, 19 nt, Homo sapiens
cuagagggcagggaccaua

SEQ ID NO: 937363 - RNA, 19 nt, Homo sapiens
aggcaggcauagcaucuga

SEQ ID NO: 937364 - RNA, 19 nt, Homo sapiens
gagggaggcaggcauagca

SEQ ID NO: 937365 - RNA, 19 nt, Homo sapiens
ugcaggagcaaaccaaauu

SEQ ID NO: 937366 - RNA, 19 nt, Homo sapiens
cacaggccaucaaaauaua

SEQ ID NO: 937367 - RNA, 19 nt, Homo sapiens
ccccaucccugaccucaua

SEQ ID NO: 937368 - RNA, 19 nt, Homo sapiens
ugaauuguccaccgugugu

SEQ ID NO: 937369 - RNA, 19 nt, Homo sapiens
cagaagauggacagaaaca

SEQ ID NO: 937370 - RNA, 19 nt, Homo sapiens
ggagaacuucaagcagauu

SEQ ID NO: 937371 - RNA, 19 nt, Homo sapiens
ucaggcauaccagguuaua

SEQ ID NO: 937372 - RNA, 19 nt, Homo sapiens
gguccaugcagcucuuuga

SEQ ID NO: 937373 - RNA, 19 nt, Homo sapiens
uucgcucccuucagcauua

SEQ ID NO: 937374 - RNA, 19 nt, Homo sapiens
gcccucagucagugaaauu

SEQ ID NO: 937375 - RNA, 19 nt, Homo sapiens
ggugaccauugaggaauuc

SEQ ID NO: 937376 - RNA, 19 nt, Homo sapiens
ggaggcaggcauagcaucu

SEQ ID NO: 937377 - RNA, 19 nt, Homo sapiens
uguauagggagaaaucuug

SEQ ID NO: 937378 - RNA, 19 nt, Homo sapiens
aaacacacuagacagaugu

SEQ ID NO: 937379 - RNA, 19 nt, Homo sapiens
agaacuucaagcagauuua

SEQ ID NO: 937380 - RNA, 19 nt, Homo sapiens
ucuauagacuugggaccuu

SEQ ID NO: 937381 - RNA, 19 nt, Homo sapiens
ggcauugcuuccucuccuu

SEQ ID NO: 937382 - RNA, 19 nt, Homo sapiens
uagaaaugccccagaaauu

SEQ ID NO: 937383 - RNA, 19 nt, Homo sapiens
gcguggacgaugaauuuga

SEQ ID NO: 937384 - RNA, 19 nt, Homo sapiens
ugagguccaugcagcucuu

SEQ ID NO: 937385 - RNA, 19 nt, Homo sapiens
aaacacaauggcuaugcaa

SEQ ID NO: 937386 - RNA, 19 nt, Homo sapiens
gggcucuucuauauauuuu

SEQ ID NO: 937387 - RNA, 19 nt, Homo sapiens
ggucucuucuugcuugacu

SEQ ID NO: 937388 - RNA, 19 nt, Homo sapiens
gaaacacacuagacagaug

SEQ ID NO: 937389 - RNA, 19 nt, Homo sapiens
ggaaaugcuugacaucaug

SEQ ID NO: 937390 - RNA, 19 nt, Homo sapiens
gaccuugucuccuuagaaa

SEQ ID NO: 937391 - RNA, 19 nt, Homo sapiens
gaagacuguugacugcuuu

SEQ ID NO: 937392 - RNA, 19 nt, Homo sapiens
cagauaaccuccucaguuc

SEQ ID NO: 937393 - RNA, 19 nt, Homo sapiens
gcucaggcauaccagguua

SEQ ID NO: 937394 - RNA, 19 nt, Homo sapiens
ucacuagaaucuucaauca

SEQ ID NO: 937395 - RNA, 19 nt, Homo sapiens
guagaugacaggcuuaauu

SEQ ID NO: 937396 - RNA, 19 nt, Homo sapiens
ccagauaaccuccucaguu

SEQ ID NO: 937397 - RNA, 19 nt, Homo sapiens
agaagggccuggacagauu

SEQ ID NO: 937398 - RNA, 19 nt, Homo sapiens
gaagggccuggacagauua

SEQ ID NO: 937399 - RNA, 19 nt, Homo sapiens
cagcguggacgaugaauuu

SEQ ID NO: 937400 - RNA, 19 nt, Homo sapiens
gcucgucccauuuagcuua

SEQ ID NO: 937401 - RNA, 19 nt, Homo sapiens
cacaguggaugccuuagaa

SEQ ID NO: 937402 - RNA, 19 nt, Homo sapiens
cauguucucuauagacuug

SEQ ID NO: 937403 - RNA, 19 nt, Homo sapiens
ccaugcagcucuuugacaa

SEQ ID NO: 937404 - RNA, 19 nt, Homo sapiens
gaagauggacagaaacaag

SEQ ID NO: 937405 - RNA, 19 nt, Homo sapiens
gggccugagucaauggaua

SEQ ID NO: 937406 - RNA, 19 nt, Homo sapiens
gaauguauagggagaaauc

SEQ ID NO: 937407 - RNA, 19 nt, Homo sapiens
caugauggcucggucaguu

SEQ ID NO: 937408 - RNA, 19 nt, Homo sapiens
gggaacacguggagagcuu

SEQ ID NO: 937409 - RNA, 19 nt, Homo sapiens
acagaugucuccugcuaug

SEQ ID NO: 937410 - RNA, 19 nt, Homo sapiens
ggaccucacccuucucuuc

SEQ ID NO: 937411 - RNA, 19 nt, Homo sapiens
gaaaugcuugacaucauga

SEQ ID NO: 937412 - RNA, 19 nt, Homo sapiens
cucagucagugaaacauua

SEQ ID NO: 937413 - RNA, 19 nt, Homo sapiens
gcugaugccugccaaaauu

SEQ ID NO: 937414 - RNA, 19 nt, Homo sapiens
aaggagaguuuguccgauu

SEQ ID NO: 937415 - RNA, 19 nt, Homo sapiens
uagcuuacccucccaguug

SEQ ID NO: 937416 - RNA, 19 nt, Homo sapiens
ggaauucauugagucuugu

SEQ ID NO: 937417 - RNA, 19 nt, Homo sapiens
gcucaucucuggcauugcu

SEQ ID NO: 937418 - RNA, 19 nt, Homo sapiens
ggcacuggcuggcuucuca

SEQ ID NO: 937419 - RNA, 19 nt, Homo sapiens
cguggacgaugaauuugaa

SEQ ID NO: 937420 - RNA, 19 nt, Homo sapiens
uuugggcucuucuauauau

SEQ ID NO: 937421 - RNA, 19 nt, Homo sapiens
gaccauugaggaauucauu

SEQ ID NO: 937422 - RNA, 19 nt, Homo sapiens
uagaugacaggcuuaauug

SEQ ID NO: 937423 - RNA, 19 nt, Homo sapiens
caccugcucgucccauuua

SEQ ID NO: 937424 - RNA, 19 nt, Homo sapiens
gaggaaaugcuugacauca

SEQ ID NO: 937425 - RNA, 19 nt, Homo sapiens
gauuuacucccaguucuuu

SEQ ID NO: 937426 - RNA, 19 nt, Homo sapiens
gcagauuuacucccaguuc

SEQ ID NO: 937427 - RNA, 19 nt, Homo sapiens
gaaugucccagcggaauug

SEQ ID NO: 937428 - RNA, 19 nt, Homo sapiens
agaagacuguugacugcuu

SEQ ID NO: 937429 - RNA, 19 nt, Homo sapiens
caaccuguaugaccuuaac

SEQ ID NO: 937430 - RNA, 19 nt, Homo sapiens
gagaacuucaagcagauuu

SEQ ID NO: 937431 - RNA, 19 nt, Homo sapiens
ucaaugaggagaacuucaa

SEQ ID NO: 937432 - RNA, 19 nt, Homo sapiens
acuagaaucuucaaucaac

SEQ ID NO: 937433 - RNA, 19 nt, Homo sapiens
ugaaguccaucuaugacau

SEQ ID NO: 937434 - RNA, 19 nt, Homo sapiens
cagacagcguggacgauga

SEQ ID NO: 937435 - RNA, 19 nt, Homo sapiens
uagaaacacacuagacaga

SEQ ID NO: 937436 - RNA, 19 nt, Homo sapiens
ucauaaacauuuccccuaa

SEQ ID NO: 937437 - RNA, 19 nt, Homo sapiens
gaaguccaucuaugacaug

SEQ ID NO: 937438 - RNA, 19 nt, Homo sapiens
caucaugaaguccaucuau

SEQ ID NO: 937439 - RNA, 19 nt, Homo sapiens
guaagaaauauaccagauc

SEQ ID NO: 937440 - RNA, 19 nt, Homo sapiens
gacucaaucuacccagaga

SEQ ID NO: 937441 - RNA, 19 nt, Homo sapiens
ucccuagggucucuucuug

SEQ ID NO: 937442 - RNA, 19 nt, Homo sapiens
gggccuggacagauuauga

SEQ ID NO: 937443 - RNA, 19 nt, Homo sapiens
ucccugaccucauaaacau

SEQ ID NO: 937444 - RNA, 19 nt, Homo sapiens
aggaauucauugagucuug

SEQ ID NO: 937445 - RNA, 19 nt, Homo sapiens
aagaauguauagggagaaa

SEQ ID NO: 937446 - RNA, 19 nt, Homo sapiens
gggauucaguaguccagau

SEQ ID NO: 937447 - RNA, 19 nt, Homo sapiens
gaacuucaagcagauuuac

SEQ ID NO: 937448 - RNA, 19 nt, Homo sapiens
uggcucaucucuggcauug

SEQ ID NO: 937449 - RNA, 19 nt, Homo sapiens
ccauugaggaauucauuga

SEQ ID NO: 937450 - RNA, 19 nt, Homo sapiens
ugagggcuaugacuugagu

SEQ ID NO: 937451 - RNA, 19 nt, Homo sapiens
gcaggagcaaaccaaauuc

SEQ ID NO: 937452 - RNA, 19 nt, Homo sapiens
uugcuuaucgucccuguuu

SEQ ID NO: 937453 - RNA, 19 nt, Homo sapiens
cagguuauagcuccaaguu

SEQ ID NO: 937454 - RNA, 19 nt, Homo sapiens
ccugaccucauaaacauuu

SEQ ID NO: 937455 - RNA, 19 nt, Homo sapiens
ggaggaaaugcuugacauc

SEQ ID NO: 937456 - RNA, 19 nt, Homo sapiens
auauaaguuuccaggcuuu

SEQ ID NO: 937457 - RNA, 19 nt, Homo sapiens
ccacaggccaucaaaauau

SEQ ID NO: 937458 - RNA, 19 nt, Homo sapiens
cgaaugucccagcggaauu

SEQ ID NO: 937459 - RNA, 19 nt, Homo sapiens
ggacagaaacaaggauggu

SEQ ID NO: 937460 - RNA, 19 nt, Homo sapiens
aggaaaugcuugacaucau

SEQ ID NO: 937461 - RNA, 19 nt, Homo sapiens
ggacuuuguggcugguuug

SEQ ID NO: 937462 - RNA, 19 nt, Homo sapiens
cagauuuacucccaguucu

SEQ ID NO: 937463 - RNA, 19 nt, Homo sapiens
cuagagggcagggaccaua

SEQ ID NO: 937464 - RNA, 19 nt, Homo sapiens
aggcaggcauagcaucuga

SEQ ID NO: 937465 - RNA, 19 nt, Homo sapiens
gagggaggcaggcauagca

SEQ ID NO: 937466 - RNA, 19 nt, Homo sapiens
cacaggccaucaaaauaua

SEQ ID NO: 937467 - RNA, 19 nt, Homo sapiens
ugcaggagcaaaccaaauu

SEQ ID NO: 937468 - RNA, 19 nt, Homo sapiens
ccccaucccugaccucaua

SEQ ID NO: 937469 - RNA, 19 nt, Homo sapiens
ugaauuguccaccgugugu

SEQ ID NO: 937470 - RNA, 19 nt, Homo sapiens
cagaagauggacagaaaca

SEQ ID NO: 937471 - RNA, 19 nt, Homo sapiens
ggagaacuucaagcagauu

SEQ ID NO: 937472 - RNA, 19 nt, Homo sapiens
ucaggcauaccagguuaua

SEQ ID NO: 937473 - RNA, 19 nt, Homo sapiens
gguccaugcagcucuuuga

SEQ ID NO: 937474 - RNA, 19 nt, Homo sapiens
ggugaccauugaggaauuc

SEQ ID NO: 937475 - RNA, 19 nt, Homo sapiens
ggaggcaggcauagcaucu

SEQ ID NO: 937476 - RNA, 19 nt, Homo sapiens
agaacuucaagcagauuua

SEQ ID NO: 937477 - RNA, 19 nt, Homo sapiens
uguauagggagaaaucuug

SEQ ID NO: 937478 - RNA, 19 nt, Homo sapiens
aaacacacuagacagaugu

SEQ ID NO: 937479 - RNA, 19 nt, Homo sapiens
gcguggacgaugaauuuga

SEQ ID NO: 937480 - RNA, 19 nt, Homo sapiens
ucuauagacuugggaccuu

SEQ ID NO: 937481 - RNA, 19 nt, Homo sapiens
ggcauugcuuccucuccuu

SEQ ID NO: 937482 - RNA, 19 nt, Homo sapiens
uagaaaugccccagaaauu

SEQ ID NO: 937483 - RNA, 19 nt, Homo sapiens
ugagguccaugcagcucuu

SEQ ID NO: 937484 - RNA, 19 nt, Homo sapiens
aaacacaauggcuaugcaa

SEQ ID NO: 937485 - RNA, 19 nt, Homo sapiens
gggcucuucuauauauuuu

SEQ ID NO: 937486 - RNA, 19 nt, Homo sapiens
ggucucuucuugcuugacu

SEQ ID NO: 937487 - RNA, 19 nt, Homo sapiens
gcucaccugcugccuagug

SEQ ID NO: 937488 - RNA, 19 nt, Homo sapiens
gaaacacacuagacagaug

SEQ ID NO: 937489 - RNA, 19 nt, Homo sapiens
ggaaaugcuugacaucaug

SEQ ID NO: 937490 - RNA, 19 nt, Homo sapiens
gaccuugucuccuuagaaa

SEQ ID NO: 937491 - RNA, 19 nt, Homo sapiens
gaagacuguugacugcuuu

SEQ ID NO: 937492 - RNA, 19 nt, Homo sapiens
cagauaaccuccucaguuc

SEQ ID NO: 937493 - RNA, 19 nt, Homo sapiens
gcucaggcauaccagguua

SEQ ID NO: 937494 - RNA, 19 nt, Homo sapiens
ucacuagaaucuucaauca

SEQ ID NO: 937495 - RNA, 19 nt, Homo sapiens
guagaugacaggcuuaauu

SEQ ID NO: 937496 - RNA, 19 nt, Homo sapiens
ccagauaaccuccucaguu

SEQ ID NO: 937497 - RNA, 19 nt, Homo sapiens
agaagggccuggacagauu

SEQ ID NO: 937498 - RNA, 19 nt, Homo sapiens
gaagggccuggacagauua

SEQ ID NO: 937499 - RNA, 19 nt, Homo sapiens
cagcguggacgaugaauuu

SEQ ID NO: 937500 - RNA, 19 nt, Homo sapiens
gcucgucccauuuagcuua

SEQ ID NO: 937501 - RNA, 19 nt, Homo sapiens
cacaguggaugccuuagaa

SEQ ID NO: 937502 - RNA, 19 nt, Homo sapiens
cauguucucuauagacuug

SEQ ID NO: 937503 - RNA, 19 nt, Homo sapiens
ccaugcagcucuuugacaa

SEQ ID NO: 937504 - RNA, 19 nt, Homo sapiens
gaagauggacagaaacaag

SEQ ID NO: 937505 - RNA, 19 nt, Homo sapiens
gggccugagucaauggaua

SEQ ID NO: 937506 - RNA, 19 nt, Homo sapiens
gaauguauagggagaaauc

SEQ ID NO: 937507 - RNA, 19 nt, Homo sapiens
caugauggcucggucaguu

SEQ ID NO: 937508 - RNA, 19 nt, Homo sapiens
gggaacacguggagagcuu

SEQ ID NO: 937509 - RNA, 19 nt, Homo sapiens
acagaugucuccugcuaug

SEQ ID NO: 937510 - RNA, 19 nt, Homo sapiens
ggaccucacccuucucuuc

SEQ ID NO: 937511 - RNA, 19 nt, Homo sapiens
gaaaugcuugacaucauga

SEQ ID NO: 937512 - RNA, 19 nt, Homo sapiens
gcugaugccugccaaaauu

SEQ ID NO: 937513 - RNA, 19 nt, Homo sapiens
aaggagaguuuguccgauu

SEQ ID NO: 937514 - RNA, 19 nt, Homo sapiens
uagcuuacccucccaguug

SEQ ID NO: 937515 - RNA, 19 nt, Homo sapiens
ggaauucauugagucuugu

SEQ ID NO: 937516 - RNA, 19 nt, Homo sapiens
gcucaucucuggcauugcu

SEQ ID NO: 937517 - RNA, 19 nt, Homo sapiens
ggcacuggcuggcuucuca

SEQ ID NO: 937518 - RNA, 19 nt, Homo sapiens
cguggacgaugaauuugaa

SEQ ID NO: 937519 - RNA, 19 nt, Homo sapiens
uuugggcucuucuauauau

SEQ ID NO: 937520 - RNA, 19 nt, Homo sapiens
gaccauugaggaauucauu

SEQ ID NO: 937521 - RNA, 19 nt, Homo sapiens
uagaugacaggcuuaauug

SEQ ID NO: 937522 - RNA, 19 nt, Homo sapiens
caccugcucgucccauuua

SEQ ID NO: 937523 - RNA, 19 nt, Homo sapiens
gaggaaaugcuugacauca

SEQ ID NO: 937524 - RNA, 19 nt, Homo sapiens
gauuuacucccaguucuuu

SEQ ID NO: 937525 - RNA, 19 nt, Homo sapiens
gcagauuuacucccaguuc

SEQ ID NO: 937526 - RNA, 19 nt, Homo sapiens
gaaugucccagcggaauug

SEQ ID NO: 937527 - RNA, 19 nt, Homo sapiens
agaagacuguugacugcuu

SEQ ID NO: 937528 - RNA, 19 nt, Homo sapiens
caaccuguaugaccuuaac

SEQ ID NO: 937529 - RNA, 19 nt, Homo sapiens
gagaacuucaagcagauuu

SEQ ID NO: 937530 - RNA, 19 nt, Homo sapiens
ucaaugaggagaacuucaa

SEQ ID NO: 937531 - RNA, 19 nt, Homo sapiens
acuagaaucuucaaucaac

SEQ ID NO: 937532 - RNA, 19 nt, Homo sapiens
ugaaguccaucuaugacau

SEQ ID NO: 937533 - RNA, 19 nt, Homo sapiens
uagaaacacacuagacaga

SEQ ID NO: 937534 - RNA, 19 nt, Homo sapiens
ucauaaacauuuccccuaa

SEQ ID NO: 937535 - RNA, 19 nt, Homo sapiens
gaaguccaucuaugacaug

SEQ ID NO: 937536 - RNA, 19 nt, Homo sapiens
caucaugaaguccaucuau

SEQ ID NO: 937537 - RNA, 19 nt, Homo sapiens
guaagaaauauaccagauc

SEQ ID NO: 937538 - RNA, 19 nt, Homo sapiens
gacucaaucuacccagaga

SEQ ID NO: 937539 - RNA, 19 nt, Homo sapiens
ucccuagggucucuucuug

SEQ ID NO: 937540 - RNA, 19 nt, Homo sapiens
gggccuggacagauuauga

SEQ ID NO: 937541 - RNA, 19 nt, Homo sapiens
ucccugaccucauaaacau

SEQ ID NO: 937542 - RNA, 19 nt, Homo sapiens
aggaauucauugagucuug

SEQ ID NO: 937543 - RNA, 19 nt, Homo sapiens
aagaauguauagggagaaa

SEQ ID NO: 937544 - RNA, 19 nt, Homo sapiens
gggauucaguaguccagau

SEQ ID NO: 937545 - RNA, 19 nt, Homo sapiens
gaacuucaagcagauuuac

SEQ ID NO: 937546 - RNA, 19 nt, Homo sapiens
uggcucaucucuggcauug

SEQ ID NO: 937547 - RNA, 19 nt, Homo sapiens
ccauugaggaauucauuga

SEQ ID NO: 937548 - RNA, 19 nt, Homo sapiens
aaacagcguggacgaugaa

SEQ ID NO: 937549 - RNA, 19 nt, Homo sapiens
ugagggcuaugacuugagu

SEQ ID NO: 937550 - RNA, 19 nt, Homo sapiens
gcaggagcaaaccaaauuc

SEQ ID NO: 937551 - RNA, 19 nt, Homo sapiens
uugcuuaucgucccuguuu

SEQ ID NO: 937552 - RNA, 19 nt, Homo sapiens
cagguuauagcuccaaguu

SEQ ID NO: 937553 - RNA, 19 nt, Homo sapiens
ccugaccucauaaacauuu

SEQ ID NO: 937554 - RNA, 19 nt, Homo sapiens
ggaggaaaugcuugacauc

SEQ ID NO: 937555 - RNA, 19 nt, Homo sapiens
auauaaguuuccaggcuuu

SEQ ID NO: 937556 - RNA, 19 nt, Homo sapiens
ccacaggccaucaaaauau

SEQ ID NO: 937557 - RNA, 19 nt, Homo sapiens
ggacagaaacaaggauggu

SEQ ID NO: 937558 - RNA, 19 nt, Homo sapiens
aggaaaugcuugacaucau

SEQ ID NO: 937559 - RNA, 19 nt, Homo sapiens
cgaaugucccagcggaauu

SEQ ID NO: 937560 - RNA, 19 nt, Homo sapiens
ggacuuuguggcugguuug

SEQ ID NO: 937561 - RNA, 19 nt, Homo sapiens
cagauuuacucccaguucu

SEQ ID NO: 937562 - RNA, 19 nt, Homo sapiens
cuagagggcagggaccaua

SEQ ID NO: 937563 - RNA, 19 nt, Homo sapiens
aggcaggcauagcaucuga

SEQ ID NO: 937564 - RNA, 19 nt, Homo sapiens
gagggaggcaggcauagca

SEQ ID NO: 937565 - RNA, 19 nt, Homo sapiens
cacaggccaucaaaauaua

SEQ ID NO: 937566 - RNA, 19 nt, Homo sapiens
ccccaucccugaccucaua

SEQ ID NO: 937567 - RNA, 19 nt, Homo sapiens
ugcaggagcaaaccaaauu

SEQ ID NO: 937568 - RNA, 19 nt, Homo sapiens
ggagaacuucaagcagauu

SEQ ID NO: 937569 - RNA, 19 nt, Homo sapiens
cagaagauggacagaaaca

SEQ ID NO: 937570 - RNA, 19 nt, Homo sapiens
ugaauuguccaccgugugu

SEQ ID NO: 937571 - RNA, 19 nt, Homo sapiens
ucaggcauaccagguuaua

SEQ ID NO: 937572 - RNA, 19 nt, Homo sapiens
gguccaugcagcucuuuga

SEQ ID NO: 937573 - RNA, 19 nt, Homo sapiens
ggugaccauugaggaauuc

SEQ ID NO: 937574 - RNA, 19 nt, Homo sapiens
ggaggcaggcauagcaucu

SEQ ID NO: 937575 - RNA, 19 nt, Homo sapiens
uguauagggagaaaucuug

SEQ ID NO: 937576 - RNA, 19 nt, Homo sapiens
aaacacacuagacagaugu

SEQ ID NO: 937577 - RNA, 19 nt, Homo sapiens
agaacuucaagcagauuua

SEQ ID NO: 937578 - RNA, 19 nt, Homo sapiens
ucuauagacuugggaccuu

SEQ ID NO: 937579 - RNA, 19 nt, Homo sapiens
ggcauugcuuccucuccuu

SEQ ID NO: 937580 - RNA, 19 nt, Homo sapiens
uagaaaugccccagaaauu

SEQ ID NO: 937581 - RNA, 19 nt, Homo sapiens
ugagguccaugcagcucuu

SEQ ID NO: 937582 - RNA, 19 nt, Homo sapiens
gcguggacgaugaauuuga

SEQ ID NO: 937583 - RNA, 19 nt, Homo sapiens
aaacacaauggcuaugcaa

SEQ ID NO: 937584 - RNA, 19 nt, Homo sapiens
gggcucuucuauauauuuu

SEQ ID NO: 937585 - RNA, 19 nt, Homo sapiens
ggucucuucuugcuugacu

SEQ ID NO: 937586 - RNA, 19 nt, Homo sapiens
gcucaccugcugccuagug

SEQ ID NO: 937587 - RNA, 19 nt, Homo sapiens
cuggacagauuaugauugc

SEQ ID NO: 937588 - RNA, 19 nt, Homo sapiens
gaaacacacuagacagaug

SEQ ID NO: 937589 - RNA, 19 nt, Homo sapiens
ggaaaugcuugacaucaug

SEQ ID NO: 937590 - RNA, 19 nt, Homo sapiens
gaccuugucuccuuagaaa

SEQ ID NO: 937591 - RNA, 19 nt, Homo sapiens
gaagacuguugacugcuuu

SEQ ID NO: 937592 - RNA, 19 nt, Homo sapiens
cagauaaccuccucaguuc

SEQ ID NO: 937593 - RNA, 19 nt, Homo sapiens
gcucaggcauaccagguua

SEQ ID NO: 937594 - RNA, 19 nt, Homo sapiens
ucacuagaaucuucaauca

SEQ ID NO: 937595 - RNA, 19 nt, Homo sapiens
guagaugacaggcuuaauu

SEQ ID NO: 937596 - RNA, 19 nt, Homo sapiens
ccagauaaccuccucaguu

SEQ ID NO: 937597 - RNA, 19 nt, Homo sapiens
agaagggccuggacagauu

SEQ ID NO: 937598 - RNA, 19 nt, Homo sapiens
gaagggccuggacagauua

SEQ ID NO: 937599 - RNA, 19 nt, Homo sapiens
cagcguggacgaugaauuu

SEQ ID NO: 937600 - RNA, 19 nt, Homo sapiens
gcucgucccauuuagcuua

SEQ ID NO: 937601 - RNA, 19 nt, Homo sapiens
cacaguggaugccuuagaa

SEQ ID NO: 937602 - RNA, 19 nt, Homo sapiens
cauguucucuauagacuug

SEQ ID NO: 937603 - RNA, 19 nt, Homo sapiens
ccaugcagcucuuugacaa

SEQ ID NO: 937604 - RNA, 19 nt, Homo sapiens
gaagauggacagaaacaag

SEQ ID NO: 937605 - RNA, 19 nt, Homo sapiens
gggccugagucaauggaua

SEQ ID NO: 937606 - RNA, 19 nt, Homo sapiens
gaauguauagggagaaauc

SEQ ID NO: 937607 - RNA, 19 nt, Homo sapiens
caugauggcucggucaguu

SEQ ID NO: 937608 - RNA, 19 nt, Homo sapiens
gggaacacguggagagcuu

SEQ ID NO: 937609 - RNA, 19 nt, Homo sapiens
acagaugucuccugcuaug

SEQ ID NO: 937610 - RNA, 19 nt, Homo sapiens
ggaccucacccuucucuuc

SEQ ID NO: 937611 - RNA, 19 nt, Homo sapiens
gaaaugcuugacaucauga

SEQ ID NO: 937612 - RNA, 19 nt, Homo sapiens
gcugaugccugccaaaauu

SEQ ID NO: 937613 - RNA, 19 nt, Homo sapiens
ggacagcguggacgaugaa

SEQ ID NO: 937614 - RNA, 19 nt, Homo sapiens
aaggagaguuuguccgauu

SEQ ID NO: 937615 - RNA, 19 nt, Homo sapiens
uagcuuacccucccaguug

SEQ ID NO: 937616 - RNA, 19 nt, Homo sapiens
ggaauucauugagucuugu

SEQ ID NO: 937617 - RNA, 19 nt, Homo sapiens
ggaaugucccagcggaauu

SEQ ID NO: 937618 - RNA, 19 nt, Homo sapiens
gcucaucucuggcauugcu

SEQ ID NO: 937619 - RNA, 19 nt, Homo sapiens
ggcacuggcuggcuucuca

SEQ ID NO: 937620 - RNA, 19 nt, Homo sapiens
cguggacgaugaauuugaa

SEQ ID NO: 937621 - RNA, 19 nt, Homo sapiens
uuugggcucuucuauauau

SEQ ID NO: 937622 - RNA, 19 nt, Homo sapiens
gaccauugaggaauucauu

SEQ ID NO: 937623 - RNA, 19 nt, Homo sapiens
uagaugacaggcuuaauug

SEQ ID NO: 937624 - RNA, 19 nt, Homo sapiens
caccugcucgucccauuua

SEQ ID NO: 937625 - RNA, 19 nt, Homo sapiens
gaggaaaugcuugacauca

SEQ ID NO: 937626 - RNA, 19 nt, Homo sapiens
gauuuacucccaguucuuu

SEQ ID NO: 937627 - RNA, 19 nt, Homo sapiens
gcagauuuacucccaguuc

SEQ ID NO: 937628 - RNA, 19 nt, Homo sapiens
gaaugucccagcggaauug

SEQ ID NO: 937629 - RNA, 19 nt, Homo sapiens
agaagacuguugacugcuu

SEQ ID NO: 937630 - RNA, 19 nt, Homo sapiens
caaccuguaugaccuuaac

SEQ ID NO: 937631 - RNA, 19 nt, Homo sapiens
gagaacuucaagcagauuu

SEQ ID NO: 937632 - RNA, 19 nt, Homo sapiens
ucaaugaggagaacuucaa

SEQ ID NO: 937633 - RNA, 19 nt, Homo sapiens
acuagaaucuucaaucaac

SEQ ID NO: 937634 - RNA, 19 nt, Homo sapiens
ugaaguccaucuaugacau

SEQ ID NO: 937635 - RNA, 19 nt, Homo sapiens
uagaaacacacuagacaga

SEQ ID NO: 937636 - RNA, 19 nt, Homo sapiens
ucauaaacauuuccccuaa

SEQ ID NO: 937637 - RNA, 19 nt, Homo sapiens
gaaguccaucuaugacaug

SEQ ID NO: 937638 - RNA, 19 nt, Homo sapiens
caucaugaaguccaucuau

SEQ ID NO: 937639 - RNA, 19 nt, Homo sapiens
guaagaaauauaccagauc

SEQ ID NO: 937640 - RNA, 19 nt, Homo sapiens
gacucaaucuacccagaga

SEQ ID NO: 937641 - RNA, 19 nt, Homo sapiens
ucccuagggucucuucuug

SEQ ID NO: 937642 - RNA, 19 nt, Homo sapiens
gggccuggacagauuauga

SEQ ID NO: 937643 - RNA, 19 nt, Homo sapiens
ucccugaccucauaaacau

SEQ ID NO: 937644 - RNA, 19 nt, Homo sapiens
aggaauucauugagucuug

SEQ ID NO: 937645 - RNA, 19 nt, Homo sapiens
aagaauguauagggagaaa

SEQ ID NO: 937646 - RNA, 19 nt, Homo sapiens
gggauucaguaguccagau

SEQ ID NO: 937647 - RNA, 19 nt, Homo sapiens
gaacuucaagcagauuuac

SEQ ID NO: 937648 - RNA, 19 nt, Homo sapiens
uggcucaucucuggcauug

SEQ ID NO: 937649 - RNA, 19 nt, Homo sapiens
ccauugaggaauucauuga

SEQ ID NO: 937650 - RNA, 19 nt, Homo sapiens
gcaggagcaaaccaaauuc

SEQ ID NO: 937651 - RNA, 19 nt, Homo sapiens
ugagggcuaugacuugagu

SEQ ID NO: 937652 - RNA, 19 nt, Homo sapiens
uugcuuaucgucccuguuu

SEQ ID NO: 937653 - RNA, 19 nt, Homo sapiens
cagguuauagcuccaaguu

SEQ ID NO: 937654 - RNA, 19 nt, Homo sapiens
ccugaccucauaaacauuu

SEQ ID NO: 937655 - RNA, 19 nt, Homo sapiens
ggaggaaaugcuugacauc

SEQ ID NO: 937656 - RNA, 19 nt, Homo sapiens
auauaaguuuccaggcuuu

SEQ ID NO: 937657 - RNA, 19 nt, Homo sapiens
ccacaggccaucaaaauau

SEQ ID NO: 937658 - RNA, 19 nt, Homo sapiens
ggacagaaacaaggauggu

SEQ ID NO: 937659 - RNA, 19 nt, Homo sapiens
aggaaaugcuugacaucau

SEQ ID NO: 937660 - RNA, 19 nt, Homo sapiens
cagauuuacucccaguucu

SEQ ID NO: 937661 - RNA, 19 nt, Homo sapiens
ggacuuuguggcugguuug

SEQ ID NO: 937662 - RNA, 19 nt, Homo sapiens
ugcaggagcaaaccaaauu

SEQ ID NO: 937663 - RNA, 19 nt, Homo sapiens
cuagagggcagggaccaua

SEQ ID NO: 937664 - RNA, 19 nt, Homo sapiens
aggcaggcauagcaucuga

SEQ ID NO: 937665 - RNA, 19 nt, Homo sapiens
gagggaggcaggcauagca

SEQ ID NO: 937666 - RNA, 19 nt, Homo sapiens
ggagaacuucaagcagauu

SEQ ID NO: 937667 - RNA, 19 nt, Homo sapiens
ugaauuguccaccgugugu

SEQ ID NO: 937668 - RNA, 19 nt, Homo sapiens
cacaggccaucaaaauaua

SEQ ID NO: 937669 - RNA, 19 nt, Homo sapiens
ccccaucccugaccucaua

SEQ ID NO: 937670 - RNA, 19 nt, Homo sapiens
cagaagauggacagaaaca

SEQ ID NO: 937671 - RNA, 19 nt, Homo sapiens
ucaggcauaccagguuaua

SEQ ID NO: 937672 - RNA, 19 nt, Homo sapiens
cggacagcguggacgauga

SEQ ID NO: 937673 - RNA, 19 nt, Homo sapiens
gguccaugcagcucuuuga

SEQ ID NO: 937674 - RNA, 19 nt, Homo sapiens
ggugaccauugaggaauuc

SEQ ID NO: 937675 - RNA, 19 nt, Homo sapiens
ggaggcaggcauagcaucu

SEQ ID NO: 937676 - RNA, 19 nt, Homo sapiens
agaacuucaagcagauuua

SEQ ID NO: 937677 - RNA, 19 nt, Homo sapiens
uguauagggagaaaucuug

SEQ ID NO: 937678 - RNA, 19 nt, Homo sapiens
aaacacacuagacagaugu

SEQ ID NO: 937679 - RNA, 19 nt, Homo sapiens
gcguggacgaugaauuuga

SEQ ID NO: 937680 - RNA, 19 nt, Homo sapiens
ucuauagacuugggaccuu

SEQ ID NO: 937681 - RNA, 19 nt, Homo sapiens
ggcauugcuuccucuccuu

SEQ ID NO: 937682 - RNA, 19 nt, Homo sapiens
uagaaaugccccagaaauu

SEQ ID NO: 937683 - RNA, 19 nt, Homo sapiens
ugagguccaugcagcucuu

SEQ ID NO: 937684 - RNA, 19 nt, Homo sapiens
aaacacaauggcuaugcaa

SEQ ID NO: 937685 - RNA, 19 nt, Homo sapiens
gggcucuucuauauauuuu

SEQ ID NO: 937686 - RNA, 19 nt, Homo sapiens
ggucucuucuugcuugacu

SEQ ID NO: 937687 - RNA, 19 nt, Homo sapiens
gcucaccugcugccuagug

SEQ ID NO: 937688 - RNA, 19 nt, Homo sapiens
gaaacacacuagacagaug

SEQ ID NO: 937689 - RNA, 19 nt, Homo sapiens
ggaaaugcuugacaucaug

SEQ ID NO: 937690 - RNA, 19 nt, Homo sapiens
gaccuugucuccuuagaaa

SEQ ID NO: 937691 - RNA, 19 nt, Homo sapiens
gaagacuguugacugcuuu

SEQ ID NO: 937692 - RNA, 19 nt, Homo sapiens
cagauaaccuccucaguuc

SEQ ID NO: 937693 - RNA, 19 nt, Homo sapiens
gcucaggcauaccagguua

SEQ ID NO: 937694 - RNA, 19 nt, Homo sapiens
ucacuagaaucuucaauca

SEQ ID NO: 937695 - RNA, 19 nt, Homo sapiens
guagaugacaggcuuaauu

SEQ ID NO: 937696 - RNA, 19 nt, Homo sapiens
ccagauaaccuccucaguu

SEQ ID NO: 937697 - RNA, 19 nt, Homo sapiens
agaagggccuggacagauu

SEQ ID NO: 937698 - RNA, 19 nt, Homo sapiens
gaagggccuggacagauua

SEQ ID NO: 937699 - RNA, 19 nt, Homo sapiens
cagcguggacgaugaauuu

SEQ ID NO: 937700 - RNA, 19 nt, Homo sapiens
gcucgucccauuuagcuua

SEQ ID NO: 937701 - RNA, 19 nt, Homo sapiens
cacaguggaugccuuagaa

SEQ ID NO: 937702 - RNA, 19 nt, Homo sapiens
cauguucucuauagacuug

SEQ ID NO: 937703 - RNA, 19 nt, Homo sapiens
ccaugcagcucuuugacaa

SEQ ID NO: 937704 - RNA, 19 nt, Homo sapiens
gaagauggacagaaacaag

SEQ ID NO: 937705 - RNA, 19 nt, Homo sapiens
gggccugagucaauggaua

SEQ ID NO: 937706 - RNA, 19 nt, Homo sapiens
gaauguauagggagaaauc

SEQ ID NO: 937707 - RNA, 19 nt, Homo sapiens
caugauggcucggucaguu

SEQ ID NO: 937708 - RNA, 19 nt, Homo sapiens
gggaacacguggagagcuu

SEQ ID NO: 937709 - RNA, 19 nt, Homo sapiens
acagaugucuccugcuaug

SEQ ID NO: 937710 - RNA, 19 nt, Homo sapiens
ggaccucacccuucucuuc

SEQ ID NO: 937711 - RNA, 19 nt, Homo sapiens
gaaaugcuugacaucauga

SEQ ID NO: 937712 - RNA, 19 nt, Homo sapiens
gcugaugccugccaaaauu

SEQ ID NO: 937713 - RNA, 19 nt, Homo sapiens
uagcuuacccucccaguug

SEQ ID NO: 937714 - RNA, 19 nt, Homo sapiens
ggaauucauugagucuugu

SEQ ID NO: 937715 - RNA, 19 nt, Homo sapiens
gcucaucucuggcauugcu

SEQ ID NO: 937716 - RNA, 19 nt, Homo sapiens
ggcacuggcuggcuucuca

SEQ ID NO: 937717 - RNA, 19 nt, Homo sapiens
cguggacgaugaauuugaa

SEQ ID NO: 937718 - RNA, 19 nt, Homo sapiens
uuugggcucuucuauauau

SEQ ID NO: 937719 - RNA, 19 nt, Homo sapiens
gaccauugaggaauucauu

SEQ ID NO: 937720 - RNA, 19 nt, Homo sapiens
uagaugacaggcuuaauug

SEQ ID NO: 937721 - RNA, 19 nt, Homo sapiens
caccugcucgucccauuua

SEQ ID NO: 937722 - RNA, 19 nt, Homo sapiens
gaggaaaugcuugacauca

SEQ ID NO: 937723 - RNA, 19 nt, Homo sapiens
gauuuacucccaguucuuu

SEQ ID NO: 937724 - RNA, 19 nt, Homo sapiens
gaaugucccagcggaauug

SEQ ID NO: 937725 - RNA, 19 nt, Homo sapiens
gcagauuuacucccaguuc

SEQ ID NO: 937726 - RNA, 19 nt, Homo sapiens
agaagacuguugacugcuu

SEQ ID NO: 937727 - RNA, 19 nt, Homo sapiens
caaccuguaugaccuuaac

SEQ ID NO: 937728 - RNA, 19 nt, Homo sapiens
gagaacuucaagcagauuu

SEQ ID NO: 937729 - RNA, 19 nt, Homo sapiens
ucaaugaggagaacuucaa

SEQ ID NO: 937730 - RNA, 19 nt, Homo sapiens
cagacagcguggacgauga

SEQ ID NO: 937731 - RNA, 19 nt, Homo sapiens
acuagaaucuucaaucaac

SEQ ID NO: 937732 - RNA, 19 nt, Homo sapiens
ugaaguccaucuaugacau

SEQ ID NO: 937733 - RNA, 19 nt, Homo sapiens
uagaaacacacuagacaga

SEQ ID NO: 937734 - RNA, 19 nt, Homo sapiens
ucauaaacauuuccccuaa

SEQ ID NO: 937735 - RNA, 19 nt, Homo sapiens
gaaguccaucuaugacaug

SEQ ID NO: 937736 - RNA, 19 nt, Homo sapiens
caucaugaaguccaucuau

SEQ ID NO: 937737 - RNA, 19 nt, Homo sapiens
guaagaaauauaccagauc

SEQ ID NO: 937738 - RNA, 19 nt, Homo sapiens
gacucaaucuacccagaga

SEQ ID NO: 937739 - RNA, 19 nt, Homo sapiens
ucccuagggucucuucuug

SEQ ID NO: 937740 - RNA, 19 nt, Homo sapiens
gggccuggacagauuauga

SEQ ID NO: 937741 - RNA, 19 nt, Homo sapiens
ucccugaccucauaaacau

SEQ ID NO: 937742 - RNA, 19 nt, Homo sapiens
aggaauucauugagucuug

SEQ ID NO: 937743 - RNA, 19 nt, Homo sapiens
gaacuucaagcagauuuac

SEQ ID NO: 937744 - RNA, 19 nt, Homo sapiens
aagaauguauagggagaaa

SEQ ID NO: 937745 - RNA, 19 nt, Homo sapiens
gggauucaguaguccagau

SEQ ID NO: 937746 - RNA, 19 nt, Homo sapiens
uggcucaucucuggcauug

SEQ ID NO: 937747 - RNA, 19 nt, Homo sapiens
ccauugaggaauucauuga

SEQ ID NO: 937748 - RNA, 19 nt, Homo sapiens
ugagggcuaugacuugagu

SEQ ID NO: 937749 - RNA, 19 nt, Homo sapiens
gcaggagcaaaccaaauuc

SEQ ID NO: 937750 - RNA, 19 nt, Homo sapiens
uugcuuaucgucccuguuu

SEQ ID NO: 937751 - RNA, 19 nt, Homo sapiens
cagguuauagcuccaaguu

SEQ ID NO: 937752 - RNA, 19 nt, Homo sapiens
ccugaccucauaaacauuu

SEQ ID NO: 937753 - RNA, 19 nt, Homo sapiens
ggaggaaaugcuugacauc

SEQ ID NO: 937754 - RNA, 19 nt, Homo sapiens
cagauuuacucccaguucu

SEQ ID NO: 937755 - RNA, 19 nt, Homo sapiens
auauaaguuuccaggcuuu

SEQ ID NO: 937756 - RNA, 19 nt, Homo sapiens
ccacaggccaucaaaauau

SEQ ID NO: 937757 - RNA, 19 nt, Homo sapiens
ggacagaaacaaggauggu

SEQ ID NO: 937758 - RNA, 19 nt, Homo sapiens
aggaaaugcuugacaucau

SEQ ID NO: 937759 - RNA, 19 nt, Homo sapiens
cgaaugucccagcggaauu

SEQ ID NO: 937760 - RNA, 19 nt, Homo sapiens
ggacuuuguggcugguuug

SEQ ID NO: 937761 - RNA, 19 nt, Homo sapiens
ugaauuguccaccgugugu

SEQ ID NO: 937762 - RNA, 19 nt, Homo sapiens
cuagagggcagggaccaua

SEQ ID NO: 937763 - RNA, 19 nt, Homo sapiens
aggcaggcauagcaucuga

SEQ ID NO: 937764 - RNA, 19 nt, Homo sapiens
gagggaggcaggcauagca

SEQ ID NO: 937765 - RNA, 19 nt, Homo sapiens
cacaggccaucaaaauaua

SEQ ID NO: 937766 - RNA, 19 nt, Homo sapiens
ccccaucccugaccucaua

SEQ ID NO: 937767 - RNA, 19 nt, Homo sapiens
ugcaggagcaaaccaaauu

SEQ ID NO: 937768 - RNA, 19 nt, Homo sapiens
cagaagauggacagaaaca

SEQ ID NO: 937769 - RNA, 19 nt, Homo sapiens
ggagaacuucaagcagauu

SEQ ID NO: 937770 - RNA, 19 nt, Homo sapiens
ucaggcauaccagguuaua

SEQ ID NO: 937771 - RNA, 19 nt, Homo sapiens
gguccaugcagcucuuuga

SEQ ID NO: 937772 - RNA, 19 nt, Homo sapiens
ggugaccauugaggaauuc

SEQ ID NO: 937773 - RNA, 19 nt, Homo sapiens
agaacuucaagcagauuua

SEQ ID NO: 937774 - RNA, 19 nt, Homo sapiens
ggaggcaggcauagcaucu

SEQ ID NO: 937775 - RNA, 19 nt, Homo sapiens
uguauagggagaaaucuug

SEQ ID NO: 937776 - RNA, 19 nt, Homo sapiens
aaacacacuagacagaugu

SEQ ID NO: 937777 - RNA, 19 nt, Homo sapiens
ucuauagacuugggaccuu

SEQ ID NO: 937778 - RNA, 19 nt, Homo sapiens
ggcauugcuuccucuccuu

SEQ ID NO: 937779 - RNA, 19 nt, Homo sapiens
uagaaaugccccagaaauu

SEQ ID NO: 937780 - RNA, 19 nt, Homo sapiens
gcguggacgaugaauuuga

SEQ ID NO: 937781 - RNA, 19 nt, Homo sapiens
ugagguccaugcagcucuu

SEQ ID NO: 937782 - RNA, 19 nt, Homo sapiens
aaacacaauggcuaugcaa

SEQ ID NO: 937783 - RNA, 19 nt, Homo sapiens
gggcucuucuauauauuuu

SEQ ID NO: 937784 - RNA, 19 nt, Homo sapiens
ggucucuucuugcuugacu

SEQ ID NO: 937785 - RNA, 19 nt, Homo sapiens
cuggacagauuaugauugc

SEQ ID NO: 937786 - RNA, 19 nt, Homo sapiens
augcagcucuuugacaaug

SEQ ID NO: 937787 - RNA, 19 nt, Homo sapiens
agacagcguggacgaugaa

SEQ ID NO: 937788 - RNA, 19 nt, Homo sapiens
gaaacacacuagacagaug

SEQ ID NO: 937789 - RNA, 19 nt, Homo sapiens
ggaaaugcuugacaucaug

SEQ ID NO: 937790 - RNA, 19 nt, Homo sapiens
gaccuugucuccuuagaaa

SEQ ID NO: 937791 - RNA, 19 nt, Homo sapiens
gaagacuguugacugcuuu

SEQ ID NO: 937792 - RNA, 19 nt, Homo sapiens
cagauaaccuccucaguuc

SEQ ID NO: 937793 - RNA, 19 nt, Homo sapiens
gcucaggcauaccagguua

SEQ ID NO: 937794 - RNA, 19 nt, Homo sapiens
ucacuagaaucuucaauca

SEQ ID NO: 937795 - RNA, 19 nt, Homo sapiens
guagaugacaggcuuaauu

SEQ ID NO: 937796 - RNA, 19 nt, Homo sapiens
ccagauaaccuccucaguu

SEQ ID NO: 937797 - RNA, 19 nt, Homo sapiens
agaagggccuggacagauu

SEQ ID NO: 937798 - RNA, 19 nt, Homo sapiens
gaagggccuggacagauua

SEQ ID NO: 937799 - RNA, 19 nt, Homo sapiens
cagcguggacgaugaauuu

SEQ ID NO: 937800 - RNA, 19 nt, Homo sapiens
gcucgucccauuuagcuua

SEQ ID NO: 937801 - RNA, 19 nt, Homo sapiens
cacaguggaugccuuagaa

SEQ ID NO: 937802 - RNA, 19 nt, Homo sapiens
cauguucucuauagacuug

SEQ ID NO: 937803 - RNA, 19 nt, Homo sapiens
ccaugcagcucuuugacaa

SEQ ID NO: 937804 - RNA, 19 nt, Homo sapiens
gaagauggacagaaacaag

SEQ ID NO: 937805 - RNA, 19 nt, Homo sapiens
gggccugagucaauggaua

SEQ ID NO: 937806 - RNA, 19 nt, Homo sapiens
gaauguauagggagaaauc

SEQ ID NO: 937807 - RNA, 19 nt, Homo sapiens
caugauggcucggucaguu

SEQ ID NO: 937808 - RNA, 19 nt, Homo sapiens
gggaacacguggagagcuu

SEQ ID NO: 937809 - RNA, 19 nt, Homo sapiens
acagaugucuccugcuaug

SEQ ID NO: 937810 - RNA, 19 nt, Homo sapiens
ggaccucacccuucucuuc

SEQ ID NO: 937811 - RNA, 19 nt, Homo sapiens
gaaaugcuugacaucauga

SEQ ID NO: 937812 - RNA, 19 nt, Homo sapiens
gcugaugccugccaaaauu

SEQ ID NO: 937813 - RNA, 19 nt, Homo sapiens
ggacagcguggacgaugaa

SEQ ID NO: 937814 - RNA, 19 nt, Homo sapiens
aaggagaguuuguccgauu

SEQ ID NO: 937815 - RNA, 19 nt, Homo sapiens
uagcuuacccucccaguug

SEQ ID NO: 937816 - RNA, 19 nt, Homo sapiens
ggaauucauugagucuugu

SEQ ID NO: 937817 - RNA, 19 nt, Homo sapiens
gcucaucucuggcauugcu

SEQ ID NO: 937818 - RNA, 19 nt, Homo sapiens
ggcacuggcuggcuucuca

SEQ ID NO: 937819 - RNA, 19 nt, Homo sapiens
cguggacgaugaauuugaa

SEQ ID NO: 937820 - RNA, 19 nt, Homo sapiens
uuugggcucuucuauauau

SEQ ID NO: 937821 - RNA, 19 nt, Homo sapiens
gaccauugaggaauucauu

SEQ ID NO: 937822 - RNA, 19 nt, Homo sapiens
uagaugacaggcuuaauug

SEQ ID NO: 937823 - RNA, 19 nt, Homo sapiens
caccugcucgucccauuua

SEQ ID NO: 937824 - RNA, 19 nt, Homo sapiens
gaggaaaugcuugacauca

SEQ ID NO: 937825 - RNA, 19 nt, Homo sapiens
gauuuacucccaguucuuu

SEQ ID NO: 937826 - RNA, 19 nt, Homo sapiens
gcagauuuacucccaguuc

SEQ ID NO: 937827 - RNA, 19 nt, Homo sapiens
gaaugucccagcggaauug

SEQ ID NO: 937828 - RNA, 19 nt, Homo sapiens
agaagacuguugacugcuu

SEQ ID NO: 937829 - RNA, 19 nt, Homo sapiens
caaccuguaugaccuuaac

SEQ ID NO: 937830 - RNA, 19 nt, Homo sapiens
gagaacuucaagcagauuu

SEQ ID NO: 937831 - RNA, 19 nt, Homo sapiens
ucaaugaggagaacuucaa

SEQ ID NO: 937832 - RNA, 19 nt, Homo sapiens
acuagaaucuucaaucaac

SEQ ID NO: 937833 - RNA, 19 nt, Homo sapiens
ugaaguccaucuaugacau

SEQ ID NO: 937834 - RNA, 19 nt, Homo sapiens
uagaaacacacuagacaga

SEQ ID NO: 937835 - RNA, 19 nt, Homo sapiens
ucauaaacauuuccccuaa

SEQ ID NO: 937836 - RNA, 19 nt, Homo sapiens
gaaguccaucuaugacaug

SEQ ID NO: 937837 - RNA, 19 nt, Homo sapiens
caucaugaaguccaucuau

SEQ ID NO: 937838 - RNA, 19 nt, Homo sapiens
guaagaaauauaccagauc

SEQ ID NO: 937839 - RNA, 19 nt, Homo sapiens
gacucaaucuacccagaga

SEQ ID NO: 937840 - RNA, 19 nt, Homo sapiens
ucccuagggucucuucuug

SEQ ID NO: 937841 - RNA, 19 nt, Homo sapiens
gggccuggacagauuauga

SEQ ID NO: 937842 - RNA, 19 nt, Homo sapiens
ucccugaccucauaaacau

SEQ ID NO: 937843 - RNA, 19 nt, Homo sapiens
aggaauucauugagucuug

SEQ ID NO: 937844 - RNA, 19 nt, Homo sapiens
aagaauguauagggagaaa

SEQ ID NO: 937845 - RNA, 19 nt, Homo sapiens
gggauucaguaguccagau

SEQ ID NO: 937846 - RNA, 19 nt, Homo sapiens
gaacuucaagcagauuuac

SEQ ID NO: 937847 - RNA, 19 nt, Homo sapiens
uggcucaucucuggcauug

SEQ ID NO: 937848 - RNA, 19 nt, Homo sapiens
ccauugaggaauucauuga

SEQ ID NO: 937849 - RNA, 19 nt, Homo sapiens
ugagggcuaugacuugagu

SEQ ID NO: 937850 - RNA, 19 nt, Homo sapiens
gcaggagcaaaccaaauuc

SEQ ID NO: 937851 - RNA, 19 nt, Homo sapiens
uugcuuaucgucccuguuu

SEQ ID NO: 937852 - RNA, 19 nt, Homo sapiens
cagguuauagcuccaaguu

SEQ ID NO: 937853 - RNA, 19 nt, Homo sapiens
ccugaccucauaaacauuu

SEQ ID NO: 937854 - RNA, 19 nt, Homo sapiens
ggaggaaaugcuugacauc

SEQ ID NO: 937855 - RNA, 19 nt, Homo sapiens
cgaaugucccagcggaauu

SEQ ID NO: 937856 - RNA, 19 nt, Homo sapiens
auauaaguuuccaggcuuu

SEQ ID NO: 937857 - RNA, 19 nt, Homo sapiens
ccacaggccaucaaaauau

SEQ ID NO: 937858 - RNA, 19 nt, Homo sapiens
ggacagaaacaaggauggu

SEQ ID NO: 937859 - RNA, 19 nt, Homo sapiens
aggaaaugcuugacaucau

SEQ ID NO: 937860 - RNA, 19 nt, Homo sapiens
ggacuuuguggcugguuug

SEQ ID NO: 937861 - RNA, 19 nt, Homo sapiens
cagauuuacucccaguucu

SEQ ID NO: 937862 - RNA, 19 nt, Homo sapiens
ugcaggagcaaaccaaauu

SEQ ID NO: 937863 - RNA, 19 nt, Homo sapiens
cuagagggcagggaccaua

SEQ ID NO: 937864 - RNA, 19 nt, Homo sapiens
aggcaggcauagcaucuga

SEQ ID NO: 937865 - RNA, 19 nt, Homo sapiens
gagggaggcaggcauagca

SEQ ID NO: 937866 - RNA, 19 nt, Homo sapiens
cacaggccaucaaaauaua

SEQ ID NO: 937867 - RNA, 19 nt, Homo sapiens
ugaauuguccaccgugugu

SEQ ID NO: 937868 - RNA, 19 nt, Homo sapiens
ggagaacuucaagcagauu

SEQ ID NO: 937869 - RNA, 19 nt, Homo sapiens
ccccaucccugaccucaua

SEQ ID NO: 937870 - RNA, 19 nt, Homo sapiens
cagaagauggacagaaaca

SEQ ID NO: 937871 - RNA, 19 nt, Homo sapiens
ucaggcauaccagguuaua

SEQ ID NO: 937872 - RNA, 19 nt, Homo sapiens
cggacagcguggacgauga

SEQ ID NO: 937873 - RNA, 19 nt, Homo sapiens
gguccaugcagcucuuuga

SEQ ID NO: 937874 - RNA, 19 nt, Homo sapiens
ggugaccauugaggaauuc

SEQ ID NO: 937875 - RNA, 19 nt, Homo sapiens
agaacuucaagcagauuua

SEQ ID NO: 937876 - RNA, 19 nt, Homo sapiens
ggaggcaggcauagcaucu

SEQ ID NO: 937877 - RNA, 19 nt, Homo sapiens
uguauagggagaaaucuug

SEQ ID NO: 937878 - RNA, 19 nt, Homo sapiens
aaacacacuagacagaugu

SEQ ID NO: 937879 - RNA, 19 nt, Homo sapiens
gcguggacgaugaauuuga

SEQ ID NO: 937880 - RNA, 19 nt, Homo sapiens
ucuauagacuugggaccuu

SEQ ID NO: 937881 - RNA, 19 nt, Homo sapiens
ggcauugcuuccucuccuu

SEQ ID NO: 937882 - RNA, 19 nt, Homo sapiens
uagaaaugccccagaaauu

SEQ ID NO: 937883 - RNA, 19 nt, Homo sapiens
ugagguccaugcagcucuu

SEQ ID NO: 937884 - RNA, 19 nt, Homo sapiens
aaacacaauggcuaugcaa

SEQ ID NO: 937885 - RNA, 19 nt, Homo sapiens
gggcucuucuauauauuuu

SEQ ID NO: 937886 - RNA, 19 nt, Homo sapiens
ggucucuucuugcuugacu

SEQ ID NO: 937887 - RNA, 19 nt, Homo sapiens
gcucaccugcugccuagug

SEQ ID NO: 937888 - RNA, 19 nt, Homo sapiens
ggaaaugcuugacaucaug

SEQ ID NO: 937889 - RNA, 19 nt, Homo sapiens
cagcguggacgaugaauuu

SEQ ID NO: 937890 - RNA, 19 nt, Homo sapiens
gaagauggacagaaacaag

SEQ ID NO: 937891 - RNA, 19 nt, Homo sapiens
caugauggcucggucaguu

SEQ ID NO: 937892 - RNA, 19 nt, Homo sapiens
gggaacacguggagagcuu

SEQ ID NO: 937893 - RNA, 19 nt, Homo sapiens
gaaaugcuugacaucauga

SEQ ID NO: 937894 - RNA, 19 nt, Homo sapiens
ggacagcguggacgaugaa

SEQ ID NO: 937895 - RNA, 19 nt, Homo sapiens
aaggagaguuuguccgauu

SEQ ID NO: 937896 - RNA, 19 nt, Homo sapiens
ggaauucauugagucuugu

SEQ ID NO: 937897 - RNA, 19 nt, Homo sapiens
cguggacgaugaauuugaa

SEQ ID NO: 937898 - RNA, 19 nt, Homo sapiens
gaccauugaggaauucauu

SEQ ID NO: 937899 - RNA, 19 nt, Homo sapiens
gaggaaaugcuugacauca

SEQ ID NO: 937900 - RNA, 19 nt, Homo sapiens
gauuuacucccaguucuuu

SEQ ID NO: 937901 - RNA, 19 nt, Homo sapiens
gcagauuuacucccaguuc

SEQ ID NO: 937902 - RNA, 19 nt, Homo sapiens
gaaugucccagcggaauug

SEQ ID NO: 937903 - RNA, 19 nt, Homo sapiens
gagaacuucaagcagauuu

SEQ ID NO: 937904 - RNA, 19 nt, Homo sapiens
ucaaugaggagaacuucaa

SEQ ID NO: 937905 - RNA, 19 nt, Homo sapiens
ugaaguccaucuaugacau

SEQ ID NO: 937906 - RNA, 19 nt, Homo sapiens
gaaguccaucuaugacaug

SEQ ID NO: 937907 - RNA, 19 nt, Homo sapiens
caucaugaaguccaucuau

SEQ ID NO: 937908 - RNA, 19 nt, Homo sapiens
aggaauucauugagucuug

SEQ ID NO: 937909 - RNA, 19 nt, Homo sapiens
gaacuucaagcagauuuac

SEQ ID NO: 937910 - RNA, 19 nt, Homo sapiens
ccauugaggaauucauuga

SEQ ID NO: 937911 - RNA, 19 nt, Homo sapiens
gcaggagcaaaccaaauuc

SEQ ID NO: 937912 - RNA, 19 nt, Homo sapiens
ggacagaaacaaggauggu

SEQ ID NO: 937913 - RNA, 19 nt, Homo sapiens
aggaaaugcuugacaucau

SEQ ID NO: 937914 - RNA, 19 nt, Homo sapiens
cagauuuacucccaguucu

SEQ ID NO: 937915 - RNA, 19 nt, Homo sapiens
cgaaugucccagcggaauu

SEQ ID NO: 937916 - RNA, 19 nt, Homo sapiens
cagaagauggacagaaaca

SEQ ID NO: 937917 - RNA, 19 nt, Homo sapiens
ggagaacuucaagcagauu

SEQ ID NO: 937918 - RNA, 19 nt, Homo sapiens
ugcaggagcaaaccaaauu

SEQ ID NO: 937919 - RNA, 19 nt, Homo sapiens
ugaauuguccaccgugugu

SEQ ID NO: 937920 - RNA, 19 nt, Homo sapiens
cggacagcguggacgauga

SEQ ID NO: 937921 - RNA, 19 nt, Homo sapiens
ggugaccauugaggaauuc

SEQ ID NO: 937922 - RNA, 19 nt, Homo sapiens
agaacuucaagcagauuua

SEQ ID NO: 937923 - RNA, 19 nt, Homo sapiens
caggccugauuuaguaaug

SEQ ID NO: 937924 - RNA, 19 nt, Homo sapiens
gcguggacgaugaauuuga

SEQ ID NO: 937925 - RNA, 19 nt, Homo sapiens
gcucaccugcugccuagug

SEQ ID NO: 937926 - RNA, 19 nt, Homo sapiens
ggccugauuuaguaaugca

SEQ ID NO: 937927 - RNA, 19 nt, Homo sapiens
gcucccugcccucuacauu

SEQ ID NO: 937928 - RNA, 19 nt, Homo sapiens
gagcagcugcaggagcaaa

SEQ ID NO: 937929 - RNA, 19 nt, Homo sapiens
cucccugcccucuacauua

SEQ ID NO: 937930 - RNA, 19 nt, Homo sapiens
cagcaccuaugccacuuuu

SEQ ID NO: 937931 - RNA, 19 nt, Homo sapiens
gaaacacacuagacagaug

SEQ ID NO: 937932 - RNA, 19 nt, Homo sapiens
ggaaaugcuugacaucaug

SEQ ID NO: 937933 - RNA, 19 nt, Homo sapiens
gaccuugucuccuuagaaa

SEQ ID NO: 937934 - RNA, 19 nt, Homo sapiens
gaagacuguugacugcuuu

SEQ ID NO: 937935 - RNA, 19 nt, Homo sapiens
cagauaaccuccucaguuc

SEQ ID NO: 937936 - RNA, 19 nt, Homo sapiens
gcucaggcauaccagguua

SEQ ID NO: 937937 - RNA, 19 nt, Homo sapiens
ucacuagaaucuucaauca

SEQ ID NO: 937938 - RNA, 19 nt, Homo sapiens
guagaugacaggcuuaauu

SEQ ID NO: 937939 - RNA, 19 nt, Homo sapiens
ccagauaaccuccucaguu

SEQ ID NO: 937940 - RNA, 19 nt, Homo sapiens
agaagggccuggacagauu

SEQ ID NO: 937941 - RNA, 19 nt, Homo sapiens
gaagggccuggacagauua

SEQ ID NO: 937942 - RNA, 19 nt, Homo sapiens
cagcguggacgaugaauuu

SEQ ID NO: 937943 - RNA, 19 nt, Homo sapiens
gcucgucccauuuagcuua

SEQ ID NO: 937944 - RNA, 19 nt, Homo sapiens
cacaguggaugccuuagaa

SEQ ID NO: 937945 - RNA, 19 nt, Homo sapiens
cauguucucuauagacuug

SEQ ID NO: 937946 - RNA, 19 nt, Homo sapiens
ccaugcagcucuuugacaa

SEQ ID NO: 937947 - RNA, 19 nt, Homo sapiens
gaagauggacagaaacaag

SEQ ID NO: 937948 - RNA, 19 nt, Homo sapiens
gggccugagucaauggaua

SEQ ID NO: 937949 - RNA, 19 nt, Homo sapiens
gaauguauagggagaaauc

SEQ ID NO: 937950 - RNA, 19 nt, Homo sapiens
caugauggcucggucaguu

SEQ ID NO: 937951 - RNA, 19 nt, Homo sapiens
gggaacacguggagagcuu

SEQ ID NO: 937952 - RNA, 19 nt, Homo sapiens
acagaugucuccugcuaug

SEQ ID NO: 937953 - RNA, 19 nt, Homo sapiens
ggaccucacccuucucuuc

SEQ ID NO: 937954 - RNA, 19 nt, Homo sapiens
gaaaugcuugacaucauga

SEQ ID NO: 937955 - RNA, 19 nt, Homo sapiens
gcugaugccugccaaaauu

SEQ ID NO: 937956 - RNA, 19 nt, Homo sapiens
aaggagaguuuguccgauu

SEQ ID NO: 937957 - RNA, 19 nt, Homo sapiens
uagcuuacccucccaguug

SEQ ID NO: 937958 - RNA, 19 nt, Homo sapiens
gaacucuucccucccauca

SEQ ID NO: 937959 - RNA, 19 nt, Homo sapiens
ggaauucauugagucuugu

SEQ ID NO: 937960 - RNA, 19 nt, Homo sapiens
ggaaugucccagcggaauu

SEQ ID NO: 937961 - RNA, 19 nt, Homo sapiens
gcucaucucuggcauugcu

SEQ ID NO: 937962 - RNA, 19 nt, Homo sapiens
ggcacuggcuggcuucuca

SEQ ID NO: 937963 - RNA, 19 nt, Homo sapiens
cguggacgaugaauuugaa

SEQ ID NO: 937964 - RNA, 19 nt, Homo sapiens
uuugggcucuucuauauau

SEQ ID NO: 937965 - RNA, 19 nt, Homo sapiens
gaccauugaggaauucauu

SEQ ID NO: 937966 - RNA, 19 nt, Homo sapiens
uagaugacaggcuuaauug

SEQ ID NO: 937967 - RNA, 19 nt, Homo sapiens
caccugcucgucccauuua

SEQ ID NO: 937968 - RNA, 19 nt, Homo sapiens
gaggaaaugcuugacauca

SEQ ID NO: 937969 - RNA, 19 nt, Homo sapiens
gauuuacucccaguucuuu

SEQ ID NO: 937970 - RNA, 19 nt, Homo sapiens
gcagauuuacucccaguuc

SEQ ID NO: 937971 - RNA, 19 nt, Homo sapiens
gaaugucccagcggaauug

SEQ ID NO: 937972 - RNA, 19 nt, Homo sapiens
agaagacuguugacugcuu

SEQ ID NO: 937973 - RNA, 19 nt, Homo sapiens
caaccuguaugaccuuaac

SEQ ID NO: 937974 - RNA, 19 nt, Homo sapiens
gagaacuucaagcagauuu

SEQ ID NO: 937975 - RNA, 19 nt, Homo sapiens
ucaaugaggagaacuucaa

SEQ ID NO: 937976 - RNA, 19 nt, Homo sapiens
acuagaaucuucaaucaac

SEQ ID NO: 937977 - RNA, 19 nt, Homo sapiens
ugaaguccaucuaugacau

SEQ ID NO: 937978 - RNA, 19 nt, Homo sapiens
cagacagcguggacgauga

SEQ ID NO: 937979 - RNA, 19 nt, Homo sapiens
uagaaacacacuagacaga

SEQ ID NO: 937980 - RNA, 19 nt, Homo sapiens
ucauaaacauuuccccuaa

SEQ ID NO: 937981 - RNA, 19 nt, Homo sapiens
gaaguccaucuaugacaug

SEQ ID NO: 937982 - RNA, 19 nt, Homo sapiens
caucaugaaguccaucuau

SEQ ID NO: 937983 - RNA, 19 nt, Homo sapiens
ucacaugagccacguggaa

SEQ ID NO: 937984 - RNA, 19 nt, Homo sapiens
guaagaaauauaccagauc

SEQ ID NO: 937985 - RNA, 19 nt, Homo sapiens
gacucaaucuacccagaga

SEQ ID NO: 937986 - RNA, 19 nt, Homo sapiens
ucccuagggucucuucuug

SEQ ID NO: 937987 - RNA, 19 nt, Homo sapiens
gggccuggacagauuauga

SEQ ID NO: 937988 - RNA, 19 nt, Homo sapiens
ucccugaccucauaaacau

SEQ ID NO: 937989 - RNA, 19 nt, Homo sapiens
aggaauucauugagucuug

SEQ ID NO: 937990 - RNA, 19 nt, Homo sapiens
aagaauguauagggagaaa

SEQ ID NO: 937991 - RNA, 19 nt, Homo sapiens
gggauucaguaguccagau

SEQ ID NO: 937992 - RNA, 19 nt, Homo sapiens
gaacuucaagcagauuuac

SEQ ID NO: 937993 - RNA, 19 nt, Homo sapiens
uggcucaucucuggcauug

SEQ ID NO: 937994 - RNA, 19 nt, Homo sapiens
ccauugaggaauucauuga

SEQ ID NO: 937995 - RNA, 19 nt, Homo sapiens
ugagggcuaugacuugagu

SEQ ID NO: 937996 - RNA, 19 nt, Homo sapiens
gcaggagcaaaccaaauuc

SEQ ID NO: 937997 - RNA, 19 nt, Homo sapiens
uugcuuaucgucccuguuu

SEQ ID NO: 937998 - RNA, 19 nt, Homo sapiens
cagguuauagcuccaaguu

SEQ ID NO: 937999 - RNA, 19 nt, Homo sapiens
ccugaccucauaaacauuu

SEQ ID NO: 938000 - RNA, 19 nt, Homo sapiens
ggaggaaaugcuugacauc

SEQ ID NO: 938001 - RNA, 19 nt, Homo sapiens
auauaaguuuccaggcuuu

SEQ ID NO: 938002 - RNA, 19 nt, Homo sapiens
ccacaggccaucaaaauau

SEQ ID NO: 938003 - RNA, 19 nt, Homo sapiens
ggacagaaacaaggauggu

SEQ ID NO: 938004 - RNA, 19 nt, Homo sapiens
aggaaaugcuugacaucau

SEQ ID NO: 938005 - RNA, 19 nt, Homo sapiens
ggacuuuguggcugguuug

SEQ ID NO: 938006 - RNA, 19 nt, Homo sapiens
cagauuuacucccaguucu

SEQ ID NO: 938007 - RNA, 19 nt, Homo sapiens
cuagagggcagggaccaua

SEQ ID NO: 938008 - RNA, 19 nt, Homo sapiens
aggcaggcauagcaucuga

SEQ ID NO: 938009 - RNA, 19 nt, Homo sapiens
gagggaggcaggcauagca

SEQ ID NO: 938010 - RNA, 19 nt, Homo sapiens
cacaggccaucaaaauaua

SEQ ID NO: 938011 - RNA, 19 nt, Homo sapiens
ugcaggagcaaaccaaauu

SEQ ID NO: 938012 - RNA, 19 nt, Homo sapiens
ugaauuguccaccgugugu

SEQ ID NO: 938013 - RNA, 19 nt, Homo sapiens
ccccaucccugaccucaua

SEQ ID NO: 938014 - RNA, 19 nt, Homo sapiens
cagaagauggacagaaaca

SEQ ID NO: 938015 - RNA, 19 nt, Homo sapiens
ggagaacuucaagcagauu

SEQ ID NO: 938016 - RNA, 19 nt, Homo sapiens
ucaggcauaccagguuaua

SEQ ID NO: 938017 - RNA, 19 nt, Homo sapiens
gguccaugcagcucuuuga

SEQ ID NO: 938018 - RNA, 19 nt, Homo sapiens
uucgcucccuucagcauua

SEQ ID NO: 938019 - RNA, 19 nt, Homo sapiens
gcccucagucagugaaauu

SEQ ID NO: 938020 - RNA, 19 nt, Homo sapiens
ggugaccauugaggaauuc

SEQ ID NO: 938021 - RNA, 19 nt, Homo sapiens
acucuucccucccaucaca

SEQ ID NO: 938022 - RNA, 19 nt, Homo sapiens
ggaggcaggcauagcaucu

SEQ ID NO: 938023 - RNA, 19 nt, Homo sapiens
uguauagggagaaaucuug

SEQ ID NO: 938024 - RNA, 19 nt, Homo sapiens
aaacacacuagacagaugu

SEQ ID NO: 938025 - RNA, 19 nt, Homo sapiens
agaacuucaagcagauuua

SEQ ID NO: 938026 - RNA, 19 nt, Homo sapiens
gcguggacgaugaauuuga

SEQ ID NO: 938027 - RNA, 19 nt, Homo sapiens
ucuauagacuugggaccuu

SEQ ID NO: 938028 - RNA, 19 nt, Homo sapiens
ggcauugcuuccucuccuu

SEQ ID NO: 938029 - RNA, 19 nt, Homo sapiens
uagaaaugccccagaaauu

SEQ ID NO: 938030 - RNA, 19 nt, Homo sapiens
ugagguccaugcagcucuu

SEQ ID NO: 938031 - RNA, 19 nt, Homo sapiens
ggauaggacugaauuauua

SEQ ID NO: 938032 - RNA, 19 nt, Homo sapiens
aaacuaagguggacauuua

SEQ ID NO: 938033 - RNA, 19 nt, Homo sapiens
gcagaucuaugcucaguuu

SEQ ID NO: 938034 - RNA, 19 nt, Homo sapiens
gagacaagaugaaauuuga

SEQ ID NO: 938035 - RNA, 19 nt, Homo sapiens
caacaaggacggauacaua

SEQ ID NO: 938036 - RNA, 19 nt, Homo sapiens
gaaacgaggaccaauaauu

SEQ ID NO: 938037 - RNA, 19 nt, Homo sapiens
guacaaguccuuuaauaug

SEQ ID NO: 938038 - RNA, 19 nt, Homo sapiens
uaacauaugugggauagga

SEQ ID NO: 938039 - RNA, 19 nt, Homo sapiens
gaaugagaguuauccagaa

SEQ ID NO: 938040 - RNA, 19 nt, Homo sapiens
ucagagacauuguacuaaa

SEQ ID NO: 938041 - RNA, 19 nt, Homo sapiens
guacuaaacaaccaccuua

SEQ ID NO: 938042 - RNA, 19 nt, Homo sapiens
ggacggauacauaaacaaa

SEQ ID NO: 938043 - RNA, 19 nt, Homo sapiens
ccuccacgcuugcugaaua

SEQ ID NO: 938044 - RNA, 19 nt, Homo sapiens
gcugaagacuuucuaugga

SEQ ID NO: 938045 - RNA, 19 nt, Homo sapiens
cagaaacgaggaccaauaa

SEQ ID NO: 938046 - RNA, 19 nt, Homo sapiens
gaggaacuguccacgagaa

SEQ ID NO: 938047 - RNA, 19 nt, Homo sapiens
ccagaaugccugcaaauug

SEQ ID NO: 938048 - RNA, 19 nt, Homo sapiens
gaagaauucucugcugaag

SEQ ID NO: 938049 - RNA, 19 nt, Homo sapiens
gaaacuaagguggacauuu

SEQ ID NO: 938050 - RNA, 19 nt, Homo sapiens
cgaaagauaagauugaaga

SEQ ID NO: 938051 - RNA, 19 nt, Homo sapiens
ccagaaacgaggaccaaua

SEQ ID NO: 938052 - RNA, 19 nt, Homo sapiens
caauuaggaucugucauga

SEQ ID NO: 938053 - RNA, 19 nt, Homo sapiens
gaucugcccuuguucugau

SEQ ID NO: 938054 - RNA, 19 nt, Homo sapiens
gguggacauuuaauuugua

SEQ ID NO: 938055 - RNA, 19 nt, Homo sapiens
gguaguacaaguccuuuaa

SEQ ID NO: 938056 - RNA, 19 nt, Homo sapiens
ggacugaauuauuaagcau

SEQ ID NO: 938057 - RNA, 19 nt, Homo sapiens
gggauaggacugaauuauu

SEQ ID NO: 938058 - RNA, 19 nt, Homo sapiens
gaagaugagcuggagauga

SEQ ID NO: 938059 - RNA, 19 nt, Homo sapiens
aaacgaggaccaauaauuc

SEQ ID NO: 938060 - RNA, 19 nt, Homo sapiens
gaacaauuaggaucuguca

SEQ ID NO: 938061 - RNA, 19 nt, Homo sapiens
gaguuauccagaacaauua

SEQ ID NO: 938062 - RNA, 19 nt, Homo sapiens
gugggaagaaugagaguua

SEQ ID NO: 938063 - RNA, 19 nt, Homo sapiens
gaaacaccuuuuacacuuu

SEQ ID NO: 938064 - RNA, 19 nt, Homo sapiens
ggaagaauucucugcugaa

SEQ ID NO: 938065 - RNA, 19 nt, Homo sapiens
aggcgacccucgaaagaua

SEQ ID NO: 938066 - RNA, 19 nt, Homo sapiens
ccaaacugcccaugucauu

SEQ ID NO: 938067 - RNA, 19 nt, Homo sapiens
gguccgggcucuguucauu

SEQ ID NO: 938068 - RNA, 19 nt, Homo sapiens
gcaugucccucccaagaag

SEQ ID NO: 938069 - RNA, 19 nt, Homo sapiens
uguaugacaucaacaagga

SEQ ID NO: 938070 - RNA, 19 nt, Homo sapiens
cagaccaacuucaccaaga

SEQ ID NO: 938071 - RNA, 19 nt, Homo sapiens
gccagcaccuaacauaugu

SEQ ID NO: 938072 - RNA, 19 nt, Homo sapiens
caacgaagacacauucaag

SEQ ID NO: 938073 - RNA, 19 nt, Homo sapiens
ucucaucucugcaaaccaa

SEQ ID NO: 938074 - RNA, 19 nt, Homo sapiens
caaugugccuguuucucuu

SEQ ID NO: 938075 - RNA, 19 nt, Homo sapiens
gcacaaaauaugcugcuua

SEQ ID NO: 938076 - RNA, 19 nt, Homo sapiens
ucacacugcugcccuaugg

SEQ ID NO: 938077 - RNA, 19 nt, Homo sapiens
agagagacaagaugaaauu

SEQ ID NO: 938078 - RNA, 19 nt, Homo sapiens
cauauccugugcucaaaga

SEQ ID NO: 938079 - RNA, 19 nt, Homo sapiens
ucaaagccaucuaugacau

SEQ ID NO: 938080 - RNA, 19 nt, Homo sapiens
gaccaauaauucucucaca

SEQ ID NO: 938081 - RNA, 19 nt, Homo sapiens
guccauaucuccaccacau

SEQ ID NO: 938082 - RNA, 19 nt, Homo sapiens
aaacugcccaugucauuug

SEQ ID NO: 938083 - RNA, 19 nt, Homo sapiens
ugagaguuauccagaacaa

SEQ ID NO: 938084 - RNA, 19 nt, Homo sapiens
cugaagacuuucuauggaa

SEQ ID NO: 938085 - RNA, 19 nt, Homo sapiens
aaacaaagaggagaugaug

SEQ ID NO: 938086 - RNA, 19 nt, Homo sapiens
uaaccgcucugucgauuuu

SEQ ID NO: 938087 - RNA, 19 nt, Homo sapiens
gacccaaacugcccauguc

SEQ ID NO: 938088 - RNA, 19 nt, Homo sapiens
agaguuauccagaacaauu

SEQ ID NO: 938089 - RNA, 19 nt, Homo sapiens
ugaggucucuccagcuguu

SEQ ID NO: 938090 - RNA, 19 nt, Homo sapiens
ggucaacgaagacacauuc

SEQ ID NO: 938091 - RNA, 19 nt, Homo sapiens
ccaauucagaguagacaaa

SEQ ID NO: 938092 - RNA, 19 nt, Homo sapiens
acggauacauaaacaaaga

SEQ ID NO: 938093 - RNA, 19 nt, Homo sapiens
ggagaugccagcacguaug

SEQ ID NO: 938094 - RNA, 19 nt, Homo sapiens
acaauuaggaucugucaug

SEQ ID NO: 938095 - RNA, 19 nt, Homo sapiens
agaauucucugcugaagac

SEQ ID NO: 938096 - RNA, 19 nt, Homo sapiens
ggaggacgacaacaucaug

SEQ ID NO: 938097 - RNA, 19 nt, Homo sapiens
gcauguggacgucuucuuc

SEQ ID NO: 938098 - RNA, 19 nt, Homo sapiens
cuaaacaaccaccuuaaca

SEQ ID NO: 938099 - RNA, 19 nt, Homo sapiens
acaaagaggagaugaugga

SEQ ID NO: 938100 - RNA, 19 nt, Homo sapiens
aagaugagcuggagaugac

SEQ ID NO: 938101 - RNA, 19 nt, Homo sapiens
caaacugcccaugucauuu

SEQ ID NO: 938102 - RNA, 19 nt, Homo sapiens
gagagacaagaugaaauuu

SEQ ID NO: 938103 - RNA, 19 nt, Homo sapiens
ugagagagacaagaugaaa

SEQ ID NO: 938104 - RNA, 19 nt, Homo sapiens
aagaggagaugauggacau

SEQ ID NO: 938105 - RNA, 19 nt, Homo sapiens
caaaggcgacccucgaaag

SEQ ID NO: 938106 - RNA, 19 nt, Homo sapiens
ccuuuaauauguccaggaa

SEQ ID NO: 938107 - RNA, 19 nt, Homo sapiens
caacucuuccucuuucuuc

SEQ ID NO: 938108 - RNA, 19 nt, Homo sapiens
gaacuguccacgagaaacu

SEQ ID NO: 938109 - RNA, 19 nt, Homo sapiens
gaacuauuucuuacacucu

SEQ ID NO: 938110 - RNA, 19 nt, Homo sapiens
ggagagccagcaccuaaca

SEQ ID NO: 938111 - RNA, 19 nt, Homo sapiens
gagagagacaagaugaaau

SEQ ID NO: 938112 - RNA, 19 nt, Homo sapiens
ucauguaacuggugacacu

SEQ ID NO: 938113 - RNA, 19 nt, Homo sapiens
gaggagaugauggacauug

SEQ ID NO: 938114 - RNA, 19 nt, Homo sapiens
ccagugguguggucaacga

SEQ ID NO: 938115 - RNA, 19 nt, Homo sapiens
guucuaaccaauaaacaga

SEQ ID NO: 938116 - RNA, 19 nt, Homo sapiens
uaccauguucuaaccaaua

SEQ ID NO: 938117 - RNA, 19 nt, Homo sapiens
gagccagcaccuaacauau

SEQ ID NO: 938118 - RNA, 19 nt, Homo sapiens
ggucccaacucgcacucaa

SEQ ID NO: 938119 - RNA, 19 nt, Homo sapiens
aacaaggacggauacauaa

SEQ ID NO: 938120 - RNA, 19 nt, Homo sapiens
cuaagguggacauuuaauu

SEQ ID NO: 938121 - RNA, 19 nt, Homo sapiens
uguaaccgcucugucgauu

SEQ ID NO: 938122 - RNA, 19 nt, Homo sapiens
agagccagcaccuaacaua

SEQ ID NO: 938123 - RNA, 19 nt, Homo sapiens
ugggagagccagcaccuaa

SEQ ID NO: 938124 - RNA, 19 nt, Homo sapiens
agaaacaccuuuuacacuu

SEQ ID NO: 938125 - RNA, 19 nt, Homo sapiens
aaagccaucuaugacauga

SEQ ID NO: 938126 - RNA, 19 nt, Homo sapiens
gggagcugcagguccuuua

SEQ ID NO: 938127 - RNA, 19 nt, Homo sapiens
accauguucuaaccaauaa

SEQ ID NO: 938128 - RNA, 19 nt, Homo sapiens
cccaagaaguccagaaugc

SEQ ID NO: 938129 - RNA, 19 nt, Homo sapiens
cugcccaugucauuuguuu

SEQ ID NO: 938130 - RNA, 19 nt, Homo sapiens
ccucgaaagauaagauuga

SEQ ID NO: 938131 - RNA, 19 nt, Homo sapiens
gcacaaggauaaauggaaa

SEQ ID NO: 938132 - RNA, 19 nt, Homo sapiens
gacaucaacugcuucauga

SEQ ID NO: 938133 - RNA, 19 nt, Homo sapiens
gaagaagucugagaagaag

SEQ ID NO: 938134 - RNA, 19 nt, Homo sapiens
gagaagaagucugagaaga

SEQ ID NO: 938135 - RNA, 19 nt, Homo sapiens
cagcagagcccuugcauug

SEQ ID NO: 938136 - RNA, 19 nt, Homo sapiens
acacagaccugcagaucuu

SEQ ID NO: 938137 - RNA, 19 nt, Homo sapiens
ggacaucaacugcuucaug

SEQ ID NO: 938138 - RNA, 19 nt, Homo sapiens
ggaaauggaacgccgauuc

SEQ ID NO: 938139 - RNA, 19 nt, Homo sapiens
gcaacgagggugacaguga

SEQ ID NO: 938140 - RNA, 19 nt, Homo sapiens
acacgacucuucugugaug

SEQ ID NO: 938141 - RNA, 19 nt, Homo sapiens
ucagaugacuguggcauga

SEQ ID NO: 938142 - RNA, 19 nt, Homo sapiens
gaagagggcagugaaagug

SEQ ID NO: 938143 - RNA, 19 nt, Homo sapiens
caacgagggugacagugau

SEQ ID NO: 938144 - RNA, 19 nt, Homo sapiens
gcacccgccuucaggaaau

SEQ ID NO: 938145 - RNA, 19 nt, Homo sapiens
cagcccagcuccaaguauu

SEQ ID NO: 938146 - RNA, 19 nt, Homo sapiens
caagaggccugucccugau

SEQ ID NO: 938147 - RNA, 19 nt, Homo sapiens
ccacagccaucacagaagu

SEQ ID NO: 938148 - RNA, 19 nt, Homo sapiens
gcagagcccuugcauugcu

SEQ ID NO: 938149 - RNA, 19 nt, Homo sapiens
ccaacaagauccggcagaa

SEQ ID NO: 938150 - RNA, 19 nt, Homo sapiens
agaagaagucugagaagaa

SEQ ID NO: 938151 - RNA, 19 nt, Homo sapiens
ccuuguacgugaugucuuu

SEQ ID NO: 938152 - RNA, 19 nt, Homo sapiens
agaagaaggaggagcgaua

SEQ ID NO: 938153 - RNA, 19 nt, Homo sapiens
gggagaagaagucugagaa

SEQ ID NO: 938154 - RNA, 19 nt, Homo sapiens
gaaagugaagcaugugaag

SEQ ID NO: 938155 - RNA, 19 nt, Homo sapiens
ggaagagggcagugaaagu

SEQ ID NO: 938156 - RNA, 19 nt, Homo sapiens
guauaauccucagagcaaa

SEQ ID NO: 938157 - RNA, 19 nt, Homo sapiens
gcccuugcauugcugaaga

SEQ ID NO: 938158 - RNA, 19 nt, Homo sapiens
ccaaguauugcucagauga

SEQ ID NO: 938159 - RNA, 19 nt, Homo sapiens
gggagaaugcgcccaucua

SEQ ID NO: 938160 - RNA, 19 nt, Homo sapiens
gaaggaggagcgauacaag

SEQ ID NO: 938161 - RNA, 19 nt, Homo sapiens
gcaguggcgucaucaacag

SEQ ID NO: 938162 - RNA, 19 nt, Homo sapiens
gucgggacaugaagaaguu

SEQ ID NO: 938163 - RNA, 19 nt, Homo sapiens
gcauccggaucacugagaa

SEQ ID NO: 938164 - RNA, 19 nt, Homo sapiens
gcaaaccggacaucaacug

SEQ ID NO: 938165 - RNA, 19 nt, Homo sapiens
cgaguggucugugcagguu

SEQ ID NO: 938166 - RNA, 19 nt, Homo sapiens
gaccgcccaucugccuuua

SEQ ID NO: 938167 - RNA, 19 nt, Homo sapiens
cagugaaagugaagcaugu

SEQ ID NO: 938168 - RNA, 19 nt, Homo sapiens
gcugcuacgccaaguauga

SEQ ID NO: 938169 - RNA, 19 nt, Homo sapiens
gcagaagcacaaggauaaa

SEQ ID NO: 938170 - RNA, 19 nt, Homo sapiens
ccgcauguguggugagugu

SEQ ID NO: 938171 - RNA, 19 nt, Homo sapiens
ggagaaugcgcccaucuac

SEQ ID NO: 938172 - RNA, 19 nt, Homo sapiens
aagcagaagcacaaggaua

SEQ ID NO: 938173 - RNA, 19 nt, Homo sapiens
ggcagaagcagaagcacaa

SEQ ID NO: 938174 - RNA, 19 nt, Homo sapiens
ggagcgggauggcaaugag

SEQ ID NO: 938175 - RNA, 19 nt, Homo sapiens
gagcaacgagggugacagu

SEQ ID NO: 938176 - RNA, 19 nt, Homo sapiens
ugaggacuguggucacugu

SEQ ID NO: 938177 - RNA, 19 nt, Homo sapiens
ugugacaacugcaaugagu

SEQ ID NO: 938178 - RNA, 19 nt, Homo sapiens
ccagugcaaucgccauuac

SEQ ID NO: 938179 - RNA, 19 nt, Homo sapiens
acucuucugugauguguau

SEQ ID NO: 938180 - RNA, 19 nt, Homo sapiens
gaagcacaaggauaaaugg

SEQ ID NO: 938181 - RNA, 19 nt, Homo sapiens
agcagaagcacaaggauaa

SEQ ID NO: 938182 - RNA, 19 nt, Homo sapiens
gacagcaaguccgagaaug

SEQ ID NO: 938183 - RNA, 19 nt, Homo sapiens
gaagaaggaggagcgauac

SEQ ID NO: 938184 - RNA, 19 nt, Homo sapiens
ggagaagaagucugagaag

SEQ ID NO: 938185 - RNA, 19 nt, Homo sapiens
agaaugcgcccaucuacug

SEQ ID NO: 938186 - RNA, 19 nt, Homo sapiens
uguauaauccucagagcaa

SEQ ID NO: 938187 - RNA, 19 nt, Homo sapiens
agugccagcugacgaggua

SEQ ID NO: 938188 - RNA, 19 nt, Homo sapiens
gcauggggccugcgcaaua

SEQ ID NO: 938189 - RNA, 19 nt, Homo sapiens
ccggaucacugagaagaug

SEQ ID NO: 938190 - RNA, 19 nt, Homo sapiens
gcgcugcuacgccaaguau

SEQ ID NO: 938191 - RNA, 19 nt, Homo sapiens
gagcuugaggccaucauuc

SEQ ID NO: 938192 - RNA, 19 nt, Homo sapiens
gcauguguggugaguguga

SEQ ID NO: 938193 - RNA, 19 nt, Homo sapiens
ggccugcgcaauaggagua

SEQ ID NO: 938194 - RNA, 19 nt, Homo sapiens
gaagcugcucgaacgcauu

SEQ ID NO: 938195 - RNA, 19 nt, Homo sapiens
ccaaggacccugcgucacu

SEQ ID NO: 938196 - RNA, 19 nt, Homo sapiens
gcuugaggccaucauucua

SEQ ID NO: 938197 - RNA, 19 nt, Homo sapiens
agagggcagugaaagugaa

SEQ ID NO: 938198 - RNA, 19 nt, Homo sapiens
ggaccuaccucuggauccu

SEQ ID NO: 938199 - RNA, 19 nt, Homo sapiens
cgacucuucugugaugugu

SEQ ID NO: 938200 - RNA, 19 nt, Homo sapiens
gcagcagagcccuugcauu

SEQ ID NO: 938201 - RNA, 19 nt, Homo sapiens
agaagucugagaagaagaa

SEQ ID NO: 938202 - RNA, 19 nt, Homo sapiens
gaugagcgacacagaagag

SEQ ID NO: 938203 - RNA, 19 nt, Homo sapiens
caagcuagagauucgcuau

SEQ ID NO: 938204 - RNA, 19 nt, Homo sapiens
uuccuccacucaucuguuu

SEQ ID NO: 938205 - RNA, 19 nt, Homo sapiens
cugaagagcacggcaagaa

SEQ ID NO: 938206 - RNA, 19 nt, Homo sapiens
agaagcacaaggauaaaug

SEQ ID NO: 938207 - RNA, 19 nt, Homo sapiens
ggagauauggagggagaug

SEQ ID NO: 938208 - RNA, 19 nt, Homo sapiens
ugaagcgucgggagaagaa

SEQ ID NO: 938209 - RNA, 19 nt, Homo sapiens
ggugugacaacugcaauga

SEQ ID NO: 938210 - RNA, 19 nt, Homo sapiens
gcggaagagggcagugaaa

SEQ ID NO: 938211 - RNA, 19 nt, Homo sapiens
gcgcccaucuacugcaucu

SEQ ID NO: 938212 - RNA, 19 nt, Homo sapiens
gugacuagaagcggaagua

SEQ ID NO: 938213 - RNA, 19 nt, Homo sapiens
aaccggacaucaacugcuu

SEQ ID NO: 938214 - RNA, 19 nt, Homo sapiens
ugaaagugaagcaugugaa

SEQ ID NO: 938215 - RNA, 19 nt, Homo sapiens
ugucgggagugcagagaga

SEQ ID NO: 938216 - RNA, 19 nt, Homo sapiens
ccgcccaucugccuuuauc

SEQ ID NO: 938217 - RNA, 19 nt, Homo sapiens
guauugcucagaugacugu

SEQ ID NO: 938218 - RNA, 19 nt, Homo sapiens
agaagcagaagcacaagga

SEQ ID NO: 938219 - RNA, 19 nt, Homo sapiens
ucuggauccugaccuguau

SEQ ID NO: 938220 - RNA, 19 nt, Homo sapiens
gcuaucggcacaagaaguc

SEQ ID NO: 938221 - RNA, 19 nt, Homo sapiens
gggugacagugaugacaca

SEQ ID NO: 938222 - RNA, 19 nt, Homo sapiens
gaagcagaagcacaaggau

SEQ ID NO: 938223 - RNA, 19 nt, Homo sapiens
ugaccgcccaucugccuuu

SEQ ID NO: 938224 - RNA, 19 nt, Homo sapiens
ugacacagaccugcagauc

SEQ ID NO: 938225 - RNA, 19 nt, Homo sapiens
gcgaggaugaggagagcaa

SEQ ID NO: 938226 - RNA, 19 nt, Homo sapiens
gugaaagugaagcauguga

SEQ ID NO: 938227 - RNA, 19 nt, Homo sapiens
ggaugagcgacacagaaga

SEQ ID NO: 938228 - RNA, 19 nt, Homo sapiens
aacaagauccggcagaagu

SEQ ID NO: 938229 - RNA, 19 nt, Homo sapiens
gccagugcaaucgccauua

SEQ ID NO: 938230 - RNA, 19 nt, Homo sapiens
ggcaguggcgucaucaaca

SEQ ID NO: 938231 - RNA, 19 nt, Homo sapiens
gacccuggcuggcauggaa

SEQ ID NO: 938232 - RNA, 19 nt, Homo sapiens
gaacgaauuauccugacaa

SEQ ID NO: 938233 - RNA, 19 nt, Homo sapiens
caacuggagggagaucuua

SEQ ID NO: 938234 - RNA, 19 nt, Homo sapiens
gagcaggcagacaccguua

SEQ ID NO: 938235 - RNA, 19 nt, Homo sapiens
gcugggagcacaucuuguu

SEQ ID NO: 938236 - RNA, 19 nt, Homo sapiens
ccagucgggaccuuuaaua

SEQ ID NO: 938237 - RNA, 19 nt, Homo sapiens
aaaccagucgggaccuuua

SEQ ID NO: 938238 - RNA, 19 nt, Homo sapiens
cggauaaaguggccagugu

SEQ ID NO: 938239 - RNA, 19 nt, Homo sapiens
gauaaaguggccagugugu

SEQ ID NO: 938240 - RNA, 19 nt, Homo sapiens
ugaaguaccaccacugugu

SEQ ID NO: 938241 - RNA, 19 nt, Homo sapiens
uaaaguggccaguguguac

SEQ ID NO: 938242 - RNA, 19 nt, Homo sapiens
acacgcaggucuucaucug

SEQ ID NO: 938243 - RNA, 19 nt, Homo sapiens
cgaccuggcggauaaagug

SEQ ID NO: 938244 - RNA, 19 nt, Homo sapiens
cagucgggaccuuuaauaa

SEQ ID NO: 938245 - RNA, 19 nt, Homo sapiens
ggacacgcaggucuucauc

SEQ ID NO: 938246 - RNA, 19 nt, Homo sapiens
gcugaaguaccaccacugu

SEQ ID NO: 938247 - RNA, 19 nt, Homo sapiens
gcaggcagacaccguuaag

SEQ ID NO: 938248 - RNA, 19 nt, Homo sapiens
ugacaaggacacaguucga

SEQ ID NO: 938249 - RNA, 19 nt, Homo sapiens
gaugacaaggacacaguuc

SEQ ID NO: 938250 - RNA, 19 nt, Homo sapiens
gaaaaccagucgggaccuu

SEQ ID NO: 938251 - RNA, 19 nt, Homo sapiens
uggcuggcauggaaauaca

SEQ ID NO: 938252 - RNA, 19 nt, Homo sapiens
agaacgaauuauccugaca

SEQ ID NO: 938253 - RNA, 19 nt, Homo sapiens
ggaccuggauuucuguuca

SEQ ID NO: 938254 - RNA, 19 nt, Homo sapiens
ggugaaggauacuggguuu

SEQ ID NO: 938255 - RNA, 19 nt, Homo sapiens
gaagagaaucagaucauca

SEQ ID NO: 938256 - RNA, 19 nt, Homo sapiens
caucaacguucgggacuuu

SEQ ID NO: 938257 - RNA, 19 nt, Homo sapiens
agaaucagaucaucaugug

SEQ ID NO: 938258 - RNA, 19 nt, Homo sapiens
ucauggaccucgccaauac

SEQ ID NO: 938259 - RNA, 19 nt, Homo sapiens
gguuccaaguccuuuagua

SEQ ID NO: 938260 - RNA, 19 nt, Homo sapiens
ucuauaagacccugacaaa

SEQ ID NO: 938261 - RNA, 19 nt, Homo sapiens
gagaaucagaucaucaugu

SEQ ID NO: 938262 - RNA, 19 nt, Homo sapiens
uacagucccucccuccuuu

SEQ ID NO: 938263 - RNA, 19 nt, Homo sapiens
gcaaguuccaggagaagga

SEQ ID NO: 938264 - RNA, 19 nt, Homo sapiens
uaccauuguuccuggagua

SEQ ID NO: 938265 - RNA, 19 nt, Homo sapiens
guacuccuacccuuaguug

SEQ ID NO: 938266 - RNA, 19 nt, Homo sapiens
cauccugucugguugcaau

SEQ ID NO: 938267 - RNA, 19 nt, Homo sapiens
cagaagagaaucagaucau

SEQ ID NO: 938268 - RNA, 19 nt, Homo sapiens
gcauaccacaccagacaga

SEQ ID NO: 938269 - RNA, 19 nt, Homo sapiens
agacuucgguuguguucca

SEQ ID NO: 938270 - RNA, 19 nt, Homo sapiens
gaugaagggcaaacugucu

SEQ ID NO: 938271 - RNA, 19 nt, Homo sapiens
gauguggucaugaaggaau

SEQ ID NO: 938272 - RNA, 19 nt, Homo sapiens
ucgauguggucaugaagga

SEQ ID NO: 938273 - RNA, 19 nt, Homo sapiens
gcuguggcuucaacaucaa

SEQ ID NO: 938274 - RNA, 19 nt, Homo sapiens
uguauucgcuguggcuuca

SEQ ID NO: 938275 - RNA, 19 nt, Homo sapiens
agucggaccuggauuucug

SEQ ID NO: 938276 - RNA, 19 nt, Homo sapiens
agaagagaaucagaucauc

SEQ ID NO: 938277 - RNA, 19 nt, Homo sapiens
ggcaaacugucuucuacac

SEQ ID NO: 938278 - RNA, 19 nt, Homo sapiens
aauacuugcuccagcuuuc

SEQ ID NO: 938279 - RNA, 19 nt, Homo sapiens
cgcuguggcuucaacauca

SEQ ID NO: 938280 - RNA, 19 nt, Homo sapiens
gucauggaccucgccaaua

SEQ ID NO: 938281 - RNA, 19 nt, Homo sapiens
gggacagccaugccuaugu

SEQ ID NO: 938282 - RNA, 19 nt, Homo sapiens
caauacuugcuccagcuuu

SEQ ID NO: 938283 - RNA, 19 nt, Homo sapiens
uggcauaccacaccagaca

SEQ ID NO: 938284 - RNA, 19 nt, Homo sapiens
acuccuacccuuaguugaa

SEQ ID NO: 938285 - RNA, 19 nt, Homo sapiens
ccagaagagaaucagauca

SEQ ID NO: 938286 - RNA, 19 nt, Homo sapiens
cuacagucccucccuccuu

SEQ ID NO: 938287 - RNA, 19 nt, Homo sapiens
gggcaaacugucuucuaca

SEQ ID NO: 938288 - RNA, 19 nt, Homo sapiens
caggaacucuucucucuuu

SEQ ID NO: 938289 - RNA, 19 nt, Homo sapiens
ggaccuggauuucuguuca

SEQ ID NO: 938290 - RNA, 19 nt, Homo sapiens
gacaggaacucuucucucu

SEQ ID NO: 938291 - RNA, 19 nt, Homo sapiens
ggugaaggauacuggguuu

SEQ ID NO: 938292 - RNA, 19 nt, Homo sapiens
gaagagaaucagaucauca

SEQ ID NO: 938293 - RNA, 19 nt, Homo sapiens
caucaacguucgggacuuu

SEQ ID NO: 938294 - RNA, 19 nt, Homo sapiens
agaaucagaucaucaugug

SEQ ID NO: 938295 - RNA, 19 nt, Homo sapiens
ggaggguucggguuauaua

SEQ ID NO: 938296 - RNA, 19 nt, Homo sapiens
gcaggaggguucggguuau

SEQ ID NO: 938297 - RNA, 19 nt, Homo sapiens
ucauggaccucgccaauac

SEQ ID NO: 938298 - RNA, 19 nt, Homo sapiens
gguuccaaguccuuuagua

SEQ ID NO: 938299 - RNA, 19 nt, Homo sapiens
caggaggguucggguuaua

SEQ ID NO: 938300 - RNA, 19 nt, Homo sapiens
ucuauaagacccugacaaa

SEQ ID NO: 938301 - RNA, 19 nt, Homo sapiens
gagaaucagaucaucaugu

SEQ ID NO: 938302 - RNA, 19 nt, Homo sapiens
uacagucccucccuccuuu

SEQ ID NO: 938303 - RNA, 19 nt, Homo sapiens
ggcaggaggguucggguua

SEQ ID NO: 938304 - RNA, 19 nt, Homo sapiens
gcaaguuccaggagaagga

SEQ ID NO: 938305 - RNA, 19 nt, Homo sapiens
gaacucuucucucuuuugu

SEQ ID NO: 938306 - RNA, 19 nt, Homo sapiens
uaccauuguuccuggagua

SEQ ID NO: 938307 - RNA, 19 nt, Homo sapiens
acucuucucucuuuuguua

SEQ ID NO: 938308 - RNA, 19 nt, Homo sapiens
guacuccuacccuuaguug

SEQ ID NO: 938309 - RNA, 19 nt, Homo sapiens
cauccugucugguugcaau

SEQ ID NO: 938310 - RNA, 19 nt, Homo sapiens
guuaauaaacuuccaacuc

SEQ ID NO: 938311 - RNA, 19 nt, Homo sapiens
cagaagagaaucagaucau

SEQ ID NO: 938312 - RNA, 19 nt, Homo sapiens
gcauaccacaccagacaga

SEQ ID NO: 938313 - RNA, 19 nt, Homo sapiens
agacuucgguuguguucca

SEQ ID NO: 938314 - RNA, 19 nt, Homo sapiens
gaugaagggcaaacugucu

SEQ ID NO: 938315 - RNA, 19 nt, Homo sapiens
gauguggucaugaaggaau

SEQ ID NO: 938316 - RNA, 19 nt, Homo sapiens
ucgauguggucaugaagga

SEQ ID NO: 938317 - RNA, 19 nt, Homo sapiens
gcuguggcuucaacaucaa

SEQ ID NO: 938318 - RNA, 19 nt, Homo sapiens
uguauucgcuguggcuuca

SEQ ID NO: 938319 - RNA, 19 nt, Homo sapiens
agucggaccuggauuucug

SEQ ID NO: 938320 - RNA, 19 nt, Homo sapiens
agaagagaaucagaucauc

SEQ ID NO: 938321 - RNA, 19 nt, Homo sapiens
ggcaaacugucuucuacac

SEQ ID NO: 938322 - RNA, 19 nt, Homo sapiens
aauacuugcuccagcuuuc

SEQ ID NO: 938323 - RNA, 19 nt, Homo sapiens
cgcuguggcuucaacauca

SEQ ID NO: 938324 - RNA, 19 nt, Homo sapiens
gucauggaccucgccaaua

SEQ ID NO: 938325 - RNA, 19 nt, Homo sapiens
gggacagccaugccuaugu

SEQ ID NO: 938326 - RNA, 19 nt, Homo sapiens
caauacuugcuccagcuuu

SEQ ID NO: 938327 - RNA, 19 nt, Homo sapiens
gacccgaccgcaugucugu

SEQ ID NO: 938328 - RNA, 19 nt, Homo sapiens
uggcauaccacaccagaca

SEQ ID NO: 938329 - RNA, 19 nt, Homo sapiens
acuccuacccuuaguugaa

SEQ ID NO: 938330 - RNA, 19 nt, Homo sapiens
ccagaagagaaucagauca

SEQ ID NO: 938331 - RNA, 19 nt, Homo sapiens
cuacagucccucccuccuu

SEQ ID NO: 938332 - RNA, 19 nt, Homo sapiens
gggcaaacugucuucuaca

SEQ ID NO: 938333 - RNA, 19 nt, Homo sapiens
ggguucggguuauauacuc

SEQ ID NO: 938334 - RNA, 19 nt, Homo sapiens
gaagaaaguugcaguguuu

SEQ ID NO: 938335 - RNA, 19 nt, Homo sapiens
gaacaucuaucuccaaauc

SEQ ID NO: 938336 - RNA, 19 nt, Homo sapiens
caacugaccuugaacugaa

SEQ ID NO: 938337 - RNA, 19 nt, Homo sapiens
caaggaaacuguuacuuca

SEQ ID NO: 938338 - RNA, 19 nt, Homo sapiens
ggacauuguuguauuucaa

SEQ ID NO: 938339 - RNA, 19 nt, Homo sapiens
ucacuacccucuguauaua

SEQ ID NO: 938340 - RNA, 19 nt, Homo sapiens
gcugaaggcugcaguggaa

SEQ ID NO: 938341 - RNA, 19 nt, Homo sapiens
ccagcuaauucuuguauuu

SEQ ID NO: 938342 - RNA, 19 nt, Homo sapiens
gaacagggacugaguuaag

SEQ ID NO: 938343 - RNA, 19 nt, Homo sapiens
gacgacaaauguaaucuug

SEQ ID NO: 938344 - RNA, 19 nt, Homo sapiens
caucuuccuuugucuuaua

SEQ ID NO: 938345 - RNA, 19 nt, Homo sapiens
caaauguaaucuugccaaa

SEQ ID NO: 938346 - RNA, 19 nt, Homo sapiens
caggugagguuccaaguug

SEQ ID NO: 938347 - RNA, 19 nt, Homo sapiens
gaaccuaagugcucagacu

SEQ ID NO: 938348 - RNA, 19 nt, Homo sapiens
gaacgaagcgugcaaaucc

SEQ ID NO: 938349 - RNA, 19 nt, Homo sapiens
ggaacgacgacaaauguaa

SEQ ID NO: 938350 - RNA, 19 nt, Homo sapiens
gaugggacuuucagaucua

SEQ ID NO: 938351 - RNA, 19 nt, Homo sapiens
ucucauacaugcaaaccua

SEQ ID NO: 938352 - RNA, 19 nt, Homo sapiens
gaagacugcgcggaauuua

SEQ ID NO: 938353 - RNA, 19 nt, Homo sapiens
gaucaagccuccugaaucc

SEQ ID NO: 938354 - RNA, 19 nt, Homo sapiens
gguucaacuuuguguaaua

SEQ ID NO: 938355 - RNA, 19 nt, Homo sapiens
gugaacaucuaucuccaaa

SEQ ID NO: 938356 - RNA, 19 nt, Homo sapiens
ugaagaaaguugcaguguu

SEQ ID NO: 938357 - RNA, 19 nt, Homo sapiens
gacaugugcuagugagauu

SEQ ID NO: 938358 - RNA, 19 nt, Homo sapiens
gcccauccuuggagcuuua

SEQ ID NO: 938359 - RNA, 19 nt, Homo sapiens
cuagugagauuucuuccuu

SEQ ID NO: 938360 - RNA, 19 nt, Homo sapiens
ucacagaaaucuaggaacu

SEQ ID NO: 938361 - RNA, 19 nt, Homo sapiens
gacugguacugaacauaua

SEQ ID NO: 938362 - RNA, 19 nt, Homo sapiens
gaacgacgacaaauguaau

SEQ ID NO: 938363 - RNA, 19 nt, Homo sapiens
ggaagacugcgcggaauuu

SEQ ID NO: 938364 - RNA, 19 nt, Homo sapiens
guaauaaaauggcgaguug

SEQ ID NO: 938365 - RNA, 19 nt, Homo sapiens
cagcacauccucacagaaa

SEQ ID NO: 938366 - RNA, 19 nt, Homo sapiens
ggaagcaccagggaauuaa

SEQ ID NO: 938367 - RNA, 19 nt, Homo sapiens
gaaccugacccagcuuaaa

SEQ ID NO: 938368 - RNA, 19 nt, Homo sapiens
ggacggcucaccucuguug

SEQ ID NO: 938369 - RNA, 19 nt, Homo sapiens
ggaugggacuuucagaucu

SEQ ID NO: 938370 - RNA, 19 nt, Homo sapiens
ucagauucuuccuccuuua

SEQ ID NO: 938371 - RNA, 19 nt, Homo sapiens
ugggugagcuuccagagaa

SEQ ID NO: 938372 - RNA, 19 nt, Homo sapiens
ugggugagcuuccagagaa

SEQ ID NO: 938373 - RNA, 19 nt, Homo sapiens
ugggugagcuuccagagaa

SEQ ID NO: 938374 - RNA, 19 nt, Homo sapiens
ugggugagcuuccagagaa

SEQ ID NO: 938375 - RNA, 19 nt, Homo sapiens
ugggugagcuuccagagaa

SEQ ID NO: 938376 - RNA, 19 nt, Homo sapiens
ugggugagcuuccagagaa

SEQ ID NO: 938377 - RNA, 19 nt, Homo sapiens
uacauaccaucguccguua

SEQ ID NO: 938378 - RNA, 19 nt, Homo sapiens
gcaaaccuaccaucuguuc

SEQ ID NO: 938379 - RNA, 19 nt, Homo sapiens
ggaaacuguuacuucaugu

SEQ ID NO: 938380 - RNA, 19 nt, Homo sapiens
ccaaggaaacuguuacuuc

SEQ ID NO: 938381 - RNA, 19 nt, Homo sapiens
ccaaagugcugggauuaca

SEQ ID NO: 938382 - RNA, 19 nt, Homo sapiens
acgaguagcuggaauuaca

SEQ ID NO: 938383 - RNA, 19 nt, Homo sapiens
ggacuguucuuugucagau

SEQ ID NO: 938384 - RNA, 19 nt, Homo sapiens
gaggagagcccaacaacgu

SEQ ID NO: 938385 - RNA, 19 nt, Homo sapiens
caucaccgccugcaaagaa

SEQ ID NO: 938386 - RNA, 19 nt, Homo sapiens
gcugagaggccuuggauuc

SEQ ID NO: 938387 - RNA, 19 nt, Homo sapiens
gcaaccacuccucauguaa

SEQ ID NO: 938388 - RNA, 19 nt, Homo sapiens
gcaacugaccuugaacuga

SEQ ID NO: 938389 - RNA, 19 nt, Homo sapiens
ggccuuggauuccgacaga

SEQ ID NO: 938390 - RNA, 19 nt, Homo sapiens
ccaaucugguucaacuuug

SEQ ID NO: 938391 - RNA, 19 nt, Homo sapiens
ccaugacucugaaauccaa

SEQ ID NO: 938392 - RNA, 19 nt, Homo sapiens
uccaaacacuguaaacaug

SEQ ID NO: 938393 - RNA, 19 nt, Homo sapiens
ggacuuacugguugcaaga

SEQ ID NO: 938394 - RNA, 19 nt, Homo sapiens
caacuuggagagacagauu

SEQ ID NO: 938395 - RNA, 19 nt, Homo sapiens
ccccauagcuuuucuaguu

SEQ ID NO: 938396 - RNA, 19 nt, Homo sapiens
ccauuuggcuguuucuaag

SEQ ID NO: 938397 - RNA, 19 nt, Homo sapiens
cagcugcagucuuccagaa

SEQ ID NO: 938398 - RNA, 19 nt, Homo sapiens
gggacugaguuaagaagug

SEQ ID NO: 938399 - RNA, 19 nt, Homo sapiens
gcacugcuccuuuccaaac

SEQ ID NO: 938400 - RNA, 19 nt, Homo sapiens
cgacugguacugaacauau

SEQ ID NO: 938401 - RNA, 19 nt, Homo sapiens
gaaagagcugcuuggcauu

SEQ ID NO: 938402 - RNA, 19 nt, Homo sapiens
gggcccagcucgucguaau

SEQ ID NO: 938403 - RNA, 19 nt, Homo sapiens
gcucuuggcugggcuccuu

SEQ ID NO: 938404 - RNA, 19 nt, Homo sapiens
aauccaagcugcaggagau

SEQ ID NO: 938405 - RNA, 19 nt, Homo sapiens
gaggaagacugcgcggaau

SEQ ID NO: 938406 - RNA, 19 nt, Homo sapiens
ucuauuggauuucucaaca

SEQ ID NO: 938407 - RNA, 19 nt, Homo sapiens
ucacgaguagcuggaauua

SEQ ID NO: 938408 - RNA, 19 nt, Homo sapiens
ccuaccaucuguucaacuu

SEQ ID NO: 938409 - RNA, 19 nt, Homo sapiens
gucagauucuuccuccuuu

SEQ ID NO: 938410 - RNA, 19 nt, Homo sapiens
acuguuacuucaugucuaa

SEQ ID NO: 938411 - RNA, 19 nt, Homo sapiens
ccauuguuccuuuaacuuu

SEQ ID NO: 938412 - RNA, 19 nt, Homo sapiens
gcacauccucacagaaauc

SEQ ID NO: 938413 - RNA, 19 nt, Homo sapiens
gcgcccagcuaauucuugu

SEQ ID NO: 938414 - RNA, 19 nt, Homo sapiens
guggacggcucaccucugu

SEQ ID NO: 938415 - RNA, 19 nt, Homo sapiens
cuaagcagcaggagaucua

SEQ ID NO: 938416 - RNA, 19 nt, Homo sapiens
cuaagcagcaggagaucua

SEQ ID NO: 938417 - RNA, 19 nt, Homo sapiens
cuaagcagcaggagaucua

SEQ ID NO: 938418 - RNA, 19 nt, Homo sapiens
ucugcaagcuccuguuuua

SEQ ID NO: 938419 - RNA, 19 nt, Homo sapiens
guaggaauggucuggacua

SEQ ID NO: 938420 - RNA, 19 nt, Homo sapiens
aggaaacuguuacuucaug

SEQ ID NO: 938421 - RNA, 19 nt, Homo sapiens
ccagguugcaaguuacaua

SEQ ID NO: 938422 - RNA, 19 nt, Homo sapiens
caaucugguucaacuuugu

SEQ ID NO: 938423 - RNA, 19 nt, Homo sapiens
caaccacuccucauguaau

SEQ ID NO: 938424 - RNA, 19 nt, Homo sapiens
ggcagcacauccucacaga

SEQ ID NO: 938425 - RNA, 19 nt, Homo sapiens
cuuggacauuguuguauuu

SEQ ID NO: 938426 - RNA, 19 nt, Homo sapiens
agaaaucuaggaacuguug

SEQ ID NO: 938427 - RNA, 19 nt, Homo sapiens
ccacugggcagaauucaca

SEQ ID NO: 938428 - RNA, 19 nt, Homo sapiens
uggaagcaccagggaauua

SEQ ID NO: 938429 - RNA, 19 nt, Homo sapiens
cacaucuuccuuugucuua

SEQ ID NO: 938430 - RNA, 19 nt, Homo sapiens
ccaagaauccacucucucu

SEQ ID NO: 938431 - RNA, 19 nt, Homo sapiens
caagcaguauuggaacaga

SEQ ID NO: 938432 - RNA, 19 nt, Homo sapiens
ggaacagggacugaguuaa

SEQ ID NO: 938433 - RNA, 19 nt, Homo sapiens
cucaacaccugaagaaagu

SEQ ID NO: 938434 - RNA, 19 nt, Homo sapiens
gaagaagaguccacaguua

SEQ ID NO: 938435 - RNA, 19 nt, Homo sapiens
gaaaguaacuccaacaaag

SEQ ID NO: 938436 - RNA, 19 nt, Homo sapiens
caagcaaacugcaacauuu

SEQ ID NO: 938437 - RNA, 19 nt, Homo sapiens
cagacaaacuucccauuua

SEQ ID NO: 938438 - RNA, 19 nt, Homo sapiens
gaagaugaguuuagugaug

SEQ ID NO: 938439 - RNA, 19 nt, Homo sapiens
ccaagaaucucauacagaa

SEQ ID NO: 938440 - RNA, 19 nt, Homo sapiens
gaaguaggcagauggaaua

SEQ ID NO: 938441 - RNA, 19 nt, Homo sapiens
caagugagguugccauuga

SEQ ID NO: 938442 - RNA, 19 nt, Homo sapiens
uaugaaagcuccagaaaug

SEQ ID NO: 938443 - RNA, 19 nt, Homo sapiens
uaacacagaucaaggagaa

SEQ ID NO: 938444 - RNA, 19 nt, Homo sapiens
cagauaaacuacagucuaa

SEQ ID NO: 938445 - RNA, 19 nt, Homo sapiens
gaagcagaaucucauguuu

SEQ ID NO: 938446 - RNA, 19 nt, Homo sapiens
gaaugaagaggauacuuua

SEQ ID NO: 938447 - RNA, 19 nt, Homo sapiens
gaaaagaacuauuguggaa

SEQ ID NO: 938448 - RNA, 19 nt, Homo sapiens
gcaguugggugguuuguau

SEQ ID NO: 938449 - RNA, 19 nt, Homo sapiens
gaagacugcuggcugauuc

SEQ ID NO: 938450 - RNA, 19 nt, Homo sapiens
gcagaaagccgucauuaca

SEQ ID NO: 938451 - RNA, 19 nt, Homo sapiens
gaauugugcuuccuacaga

SEQ ID NO: 938452 - RNA, 19 nt, Homo sapiens
caacacaucucaggguaaa

SEQ ID NO: 938453 - RNA, 19 nt, Homo sapiens
gugaagacaugaacaguga

SEQ ID NO: 938454 - RNA, 19 nt, Homo sapiens
ugacacaacuccuggaaug

SEQ ID NO: 938455 - RNA, 19 nt, Homo sapiens
guaaggauuuggaugaaga

SEQ ID NO: 938456 - RNA, 19 nt, Homo sapiens
caaagggagucauuaagug

SEQ ID NO: 938457 - RNA, 19 nt, Homo sapiens
ggaugaagaugccaaugga

SEQ ID NO: 938458 - RNA, 19 nt, Homo sapiens
caaaggagucuuacacuga

SEQ ID NO: 938459 - RNA, 19 nt, Homo sapiens
gaaggcagaucuuaauugc

SEQ ID NO: 938460 - RNA, 19 nt, Homo sapiens
gcagauaaacuacagucua

SEQ ID NO: 938461 - RNA, 19 nt, Homo sapiens
caggaagucugucauguga

SEQ ID NO: 938462 - RNA, 19 nt, Homo sapiens
gaaguaaggcuaaaucucu

SEQ ID NO: 938463 - RNA, 19 nt, Homo sapiens
gaagaugccaauggaauaa

SEQ ID NO: 938464 - RNA, 19 nt, Homo sapiens
ucagguauuucuagaauug

SEQ ID NO: 938465 - RNA, 19 nt, Homo sapiens
gcacaaaggcuaaacuucu

SEQ ID NO: 938466 - RNA, 19 nt, Homo sapiens
caaauuauucugugucuga

SEQ ID NO: 938467 - RNA, 19 nt, Homo sapiens
gaagaguccacaguuauaa

SEQ ID NO: 938468 - RNA, 19 nt, Homo sapiens
guaggcagauggaauaaca

SEQ ID NO: 938469 - RNA, 19 nt, Homo sapiens
guacaccugugaauucaga

SEQ ID NO: 938470 - RNA, 19 nt, Homo sapiens
aaagaacuauuguggaaga

SEQ ID NO: 938471 - RNA, 19 nt, Homo sapiens
aaacuacagucuaacaaga

SEQ ID NO: 938472 - RNA, 19 nt, Homo sapiens
ggagaaggcagaucuuaau

SEQ ID NO: 938473 - RNA, 19 nt, Homo sapiens
ugaagaggauacuuuaugu

SEQ ID NO: 938474 - RNA, 19 nt, Homo sapiens
acucuaaucugaacucuga

SEQ ID NO: 938475 - RNA, 19 nt, Homo sapiens
ccaauggaauaacagauga

SEQ ID NO: 938476 - RNA, 19 nt, Homo sapiens
gcagauggaauaacaacaa

SEQ ID NO: 938477 - RNA, 19 nt, Homo sapiens
gaaauuaaaggcacaaacu

SEQ ID NO: 938478 - RNA, 19 nt, Homo sapiens
gaagaaauagugucugaag

SEQ ID NO: 938479 - RNA, 19 nt, Homo sapiens
cgaaggaaguacucagaga

SEQ ID NO: 938480 - RNA, 19 nt, Homo sapiens
acacuagccuucaacaguu

SEQ ID NO: 938481 - RNA, 19 nt, Homo sapiens
ggaauugcaacuagaagaa

SEQ ID NO: 938482 - RNA, 19 nt, Homo sapiens
gaagaaguaaggcuaaauc

SEQ ID NO: 938483 - RNA, 19 nt, Homo sapiens
cuccagaaaugacaaauga

SEQ ID NO: 938484 - RNA, 19 nt, Homo sapiens
ugaaugugauaccaaacua

SEQ ID NO: 938485 - RNA, 19 nt, Homo sapiens
gaacagugaagggaaugua

SEQ ID NO: 938486 - RNA, 19 nt, Homo sapiens
ucaaagcacugaagaugag

SEQ ID NO: 938487 - RNA, 19 nt, Homo sapiens
gaaaugacaaaugaacuga

SEQ ID NO: 938488 - RNA, 19 nt, Homo sapiens
ugacuuugaugaugauuuc

SEQ ID NO: 938489 - RNA, 19 nt, Homo sapiens
aaaggagucuuacacugaa

SEQ ID NO: 938490 - RNA, 19 nt, Homo sapiens
gaggcagagucaaauuauu

SEQ ID NO: 938491 - RNA, 19 nt, Homo sapiens
ccagacaaacuucccauuu

SEQ ID NO: 938492 - RNA, 19 nt, Homo sapiens
gcucagacauuucauucuc

SEQ ID NO: 938493 - RNA, 19 nt, Homo sapiens
cagauggaauaacaacaaa

SEQ ID NO: 938494 - RNA, 19 nt, Homo sapiens
ccacagaaguucagaaaau

SEQ ID NO: 938495 - RNA, 19 nt, Homo sapiens
uugggugguuuguauauua

SEQ ID NO: 938496 - RNA, 19 nt, Homo sapiens
uggaaugagugcugauaaa

SEQ ID NO: 938497 - RNA, 19 nt, Homo sapiens
ggaaguaggcagauggaau

SEQ ID NO: 938498 - RNA, 19 nt, Homo sapiens
ugaagaugccaauggaaua

SEQ ID NO: 938499 - RNA, 19 nt, Homo sapiens
cgagggagccggaaagaug

SEQ ID NO: 938500 - RNA, 19 nt, Homo sapiens
gaagaagaaauuucgcaau

SEQ ID NO: 938501 - RNA, 19 nt, Homo sapiens
cagcugauuucuaccauuc

SEQ ID NO: 938502 - RNA, 19 nt, Homo sapiens
gaagaggauacuuuauguu

SEQ ID NO: 938503 - RNA, 19 nt, Homo sapiens
gaaagccaacagucugaaa

SEQ ID NO: 938504 - RNA, 19 nt, Homo sapiens
gugaagggaauguagauuu

SEQ ID NO: 938505 - RNA, 19 nt, Homo sapiens
ccacugggaagcaaaguuu

SEQ ID NO: 938506 - RNA, 19 nt, Homo sapiens
acaucaagcucagacauuu

SEQ ID NO: 938507 - RNA, 19 nt, Homo sapiens
gagaaggcagaucuuaauu

SEQ ID NO: 938508 - RNA, 19 nt, Homo sapiens
ggauucagauaccagacaa

SEQ ID NO: 938509 - RNA, 19 nt, Homo sapiens
cugaagaaauagugucuga

SEQ ID NO: 938510 - RNA, 19 nt, Homo sapiens
ggggauggcugguuuggua

SEQ ID NO: 938511 - RNA, 19 nt, Homo sapiens
gcugaaaguuccgggcaaa

SEQ ID NO: 938512 - RNA, 19 nt, Homo sapiens
ccacuguguuccaccauau

SEQ ID NO: 938513 - RNA, 19 nt, Homo sapiens
gauaaacuacagucuaaca

SEQ ID NO: 938514 - RNA, 19 nt, Homo sapiens
gaggauacuuuauguuuug

SEQ ID NO: 938515 - RNA, 19 nt, Homo sapiens
agaaugaagaggauacuuu

SEQ ID NO: 938516 - RNA, 19 nt, Homo sapiens
agaagaguccacaguuaua

SEQ ID NO: 938517 - RNA, 19 nt, Homo sapiens
agacaaacuucccauuuac

SEQ ID NO: 938518 - RNA, 19 nt, Homo sapiens
ucagauaccagacaaacuu

SEQ ID NO: 938519 - RNA, 19 nt, Homo sapiens
gcaccaugauaccauuuua

SEQ ID NO: 938520 - RNA, 19 nt, Homo sapiens
ccaagcaaacugcaacauu

SEQ ID NO: 938521 - RNA, 19 nt, Homo sapiens
gaaggaaguacucagagau

SEQ ID NO: 938522 - RNA, 19 nt, Homo sapiens
gguaugaaagcuccagaaa

SEQ ID NO: 938523 - RNA, 19 nt, Homo sapiens
aagaugaguuuagugauga

SEQ ID NO: 938524 - RNA, 19 nt, Homo sapiens
ggccaaagggagucauuaa

SEQ ID NO: 938525 - RNA, 19 nt, Homo sapiens
ccaggaguaugcagaggaa

SEQ ID NO: 938526 - RNA, 19 nt, Homo sapiens
gacauuucauucucuggaa

SEQ ID NO: 938527 - RNA, 19 nt, Homo sapiens
cagaagaaguaaggcuaaa

SEQ ID NO: 938528 - RNA, 19 nt, Homo sapiens
cgaaaguaacuccaacaaa

SEQ ID NO: 938529 - RNA, 19 nt, Homo sapiens
ugaguuuagugaugaagaa

SEQ ID NO: 938530 - RNA, 19 nt, Homo sapiens
ccaaagggagucauuaagu

SEQ ID NO: 938531 - RNA, 19 nt, Homo sapiens
gaacucugaggcuguaaug

SEQ ID NO: 938532 - RNA, 19 nt, Homo sapiens
guaagauuguaccaggaaa

SEQ ID NO: 938533 - RNA, 19 nt, Homo sapiens
gaacuccuaaagcuagaaa

SEQ ID NO: 938534 - RNA, 19 nt, Homo sapiens
gaaacuagaugacuucuuu

SEQ ID NO: 938535 - RNA, 19 nt, Homo sapiens
gaaccugccuggagaaaug

SEQ ID NO: 938536 - RNA, 19 nt, Homo sapiens
gcaaagcccacuuaucaua

SEQ ID NO: 938537 - RNA, 19 nt, Homo sapiens
cauugaagccugaagauua

SEQ ID NO: 938538 - RNA, 19 nt, Homo sapiens
gaauaaggccgaccaagug

SEQ ID NO: 938539 - RNA, 19 nt, Homo sapiens
uagcaaagcccacuuauca

SEQ ID NO: 938540 - RNA, 19 nt, Homo sapiens
aggaacagcuugagaacua

SEQ ID NO: 938541 - RNA, 19 nt, Homo sapiens
ggagaugccaaguguauuu

SEQ ID NO: 938542 - RNA, 19 nt, Homo sapiens
gaaacaaaauggaaccuuu

SEQ ID NO: 938543 - RNA, 19 nt, Homo sapiens
gaacuaugacuucaccaaa

SEQ ID NO: 938544 - RNA, 19 nt, Homo sapiens
ccaagcaccucaucaagau

SEQ ID NO: 938545 - RNA, 19 nt, Homo sapiens
aaagagaaauuguccaaag

SEQ ID NO: 938546 - RNA, 19 nt, Homo sapiens
ggaaaucuacauucagcua

SEQ ID NO: 938547 - RNA, 19 nt, Homo sapiens
ucaaucaaauccuguccua

SEQ ID NO: 938548 - RNA, 19 nt, Homo sapiens
guguggcccucaaacauua

SEQ ID NO: 938549 - RNA, 19 nt, Homo sapiens
agaaggagaugccaagugu

SEQ ID NO: 938550 - RNA, 19 nt, Homo sapiens
ggaauucacaaccuuuauu

SEQ ID NO: 938551 - RNA, 19 nt, Homo sapiens
acagaugccuccuggguuu

SEQ ID NO: 938552 - RNA, 19 nt, Homo sapiens
guacugcgcgucuacauug

SEQ ID NO: 938553 - RNA, 19 nt, Homo sapiens
ggucaaggcuaugcaggaa

SEQ ID NO: 938554 - RNA, 19 nt, Homo sapiens
ccaaagagaaggcgacaga

SEQ ID NO: 938555 - RNA, 19 nt, Homo sapiens
gagaaauuguccaaagagu

SEQ ID NO: 938556 - RNA, 19 nt, Homo sapiens
ggacuucccugaggucaag

SEQ ID NO: 938557 - RNA, 19 nt, Homo sapiens
cagcgagaauaccagauuu

SEQ ID NO: 938558 - RNA, 19 nt, Homo sapiens
ucucugcagugaucguuua

SEQ ID NO: 938559 - RNA, 19 nt, Homo sapiens
aagagaaauuguccaaaga

SEQ ID NO: 938560 - RNA, 19 nt, Homo sapiens
gguggacacuggaaacuag

SEQ ID NO: 938561 - RNA, 19 nt, Homo sapiens
gugcaugccuacaucauca

SEQ ID NO: 938562 - RNA, 19 nt, Homo sapiens
gcucacagcuccccaauca

SEQ ID NO: 938563 - RNA, 19 nt, Homo sapiens
caaaauggaaccuuucaua

SEQ ID NO: 938564 - RNA, 19 nt, Homo sapiens
uaauagcaaagcccacuua

SEQ ID NO: 938565 - RNA, 19 nt, Homo sapiens
ccacuuaucauacuuaaac

SEQ ID NO: 938566 - RNA, 19 nt, Homo sapiens
gaaagagaaauuguccaaa

SEQ ID NO: 938567 - RNA, 19 nt, Homo sapiens
gagaagaaagagaaauugu

SEQ ID NO: 938568 - RNA, 19 nt, Homo sapiens
acuaugacuucaccaaauu

SEQ ID NO: 938569 - RNA, 19 nt, Homo sapiens
caagaccaccuucaucaga

SEQ ID NO: 938570 - RNA, 19 nt, Homo sapiens
ccucaaacauuaaauaucc

SEQ ID NO: 938571 - RNA, 19 nt, Homo sapiens
ggcaagauaucagguguca

SEQ ID NO: 938572 - RNA, 19 nt, Homo sapiens
caaggugcaugccuacauc

SEQ ID NO: 938573 - RNA, 19 nt, Homo sapiens
gcgacggcaugcuugauga

SEQ ID NO: 938574 - RNA, 19 nt, Homo sapiens
agaccaccuucaucagaua

SEQ ID NO: 938575 - RNA, 19 nt, Homo sapiens
ggaacagcuugagaacuau

SEQ ID NO: 938576 - RNA, 19 nt, Homo sapiens
caagauaucaggugucaac

SEQ ID NO: 938577 - RNA, 19 nt, Homo sapiens
uaccggaaaucuacauuca

SEQ ID NO: 938578 - RNA, 19 nt, Homo sapiens
caucaacacgcccgaggua

SEQ ID NO: 938579 - RNA, 19 nt, Homo sapiens
gcccacuuaucauacuuaa

SEQ ID NO: 938580 - RNA, 19 nt, Homo sapiens
gaaggguugagaagaaaga

SEQ ID NO: 938581 - RNA, 19 nt, Homo sapiens
gccaagcaccucaucaaga

SEQ ID NO: 938582 - RNA, 19 nt, Homo sapiens
ucaaggcuaugcaggaaca

SEQ ID NO: 938583 - RNA, 19 nt, Homo sapiens
ggcaagaccaccuucauca

SEQ ID NO: 938584 - RNA, 19 nt, Homo sapiens
ggcaggauuuaaauucaau

SEQ ID NO: 938585 - RNA, 19 nt, Homo sapiens
ccacugacucaccgaauga

SEQ ID NO: 938586 - RNA, 19 nt, Homo sapiens
gaaggagaugccaagugua

SEQ ID NO: 938587 - RNA, 19 nt, Homo sapiens
ugaauaaggccgaccaagu

SEQ ID NO: 938588 - RNA, 19 nt, Homo sapiens
gagauugaaggguugagaa

SEQ ID NO: 938589 - RNA, 19 nt, Homo sapiens
gcucaacgaccucaucaag

SEQ ID NO: 938590 - RNA, 19 nt, Homo sapiens
gaucaguccacccagaguu

SEQ ID NO: 938591 - RNA, 19 nt, Homo sapiens
guggcaggauuuaaauuca

SEQ ID NO: 938592 - RNA, 19 nt, Homo sapiens
ugacuucuuucaccuccaa

SEQ ID NO: 938593 - RNA, 19 nt, Homo sapiens
gagcucuucuacacucugu

SEQ ID NO: 938594 - RNA, 19 nt, Homo sapiens
gaacagcuugagaacuaug

SEQ ID NO: 938595 - RNA, 19 nt, Homo sapiens
auugaaggguugagaagaa

SEQ ID NO: 938596 - RNA, 19 nt, Homo sapiens
gguggcaggauuuaaauuc

SEQ ID NO: 938597 - RNA, 19 nt, Homo sapiens
gugguucucugcagugauc

SEQ ID NO: 938598 - RNA, 19 nt, Homo sapiens
agaaagagaaauuguccaa

SEQ ID NO: 938599 - RNA, 19 nt, Homo sapiens
guagaaaacaggcauuuau

SEQ ID NO: 938600 - RNA, 19 nt, Homo sapiens
ccacccagaguuagacauu

SEQ ID NO: 938601 - RNA, 19 nt, Homo sapiens
ggcccucaaacauuaaaua

SEQ ID NO: 938602 - RNA, 19 nt, Homo sapiens
aaagagaaggcgacagaug

SEQ ID NO: 938603 - RNA, 19 nt, Homo sapiens
ucccugaggucaaggcuau

SEQ ID NO: 938604 - RNA, 19 nt, Homo sapiens
ucagcaggcuaccggaaau

SEQ ID NO: 938605 - RNA, 19 nt, Homo sapiens
aagaagagagagcuuauca

SEQ ID NO: 938606 - RNA, 19 nt, Homo sapiens
guccaaagaguccucagaa

SEQ ID NO: 938607 - RNA, 19 nt, Homo sapiens
gcaggcuaccggaaaucua

SEQ ID NO: 938608 - RNA, 19 nt, Homo sapiens
aaucaaauccuguccuagu

SEQ ID NO: 938609 - RNA, 19 nt, Homo sapiens
uggcaggauuuaaauucaa

SEQ ID NO: 938610 - RNA, 19 nt, Homo sapiens
guggguggcaggauuuaaa

SEQ ID NO: 938611 - RNA, 19 nt, Homo sapiens
gcccucaaacauuaaauau

SEQ ID NO: 938612 - RNA, 19 nt, Homo sapiens
cugcagugaucguuuagug

SEQ ID NO: 938613 - RNA, 19 nt, Homo sapiens
ccuccaagcugcccaacag

SEQ ID NO: 938614 - RNA, 19 nt, Homo sapiens
gaagagcaucagcgucauc

SEQ ID NO: 938615 - RNA, 19 nt, Homo sapiens
ucacauugaagccugaaga

SEQ ID NO: 938616 - RNA, 19 nt, Homo sapiens
gggaugcacuguggaucug

SEQ ID NO: 938617 - RNA, 19 nt, Homo sapiens
caaagaguccucagaaccu

SEQ ID NO: 938618 - RNA, 19 nt, Homo sapiens
ggguugagaagaaagagaa

SEQ ID NO: 938619 - RNA, 19 nt, Homo sapiens
cgacugcgacggcaugcuu

SEQ ID NO: 938620 - RNA, 19 nt, Homo sapiens
aaggagaugccaaguguau

SEQ ID NO: 938621 - RNA, 19 nt, Homo sapiens
ugucuaggguuuuguguuu

SEQ ID NO: 938622 - RNA, 19 nt, Homo sapiens
ugagaagaaagagaaauug

SEQ ID NO: 938623 - RNA, 19 nt, Homo sapiens
ccaaauuccacucgcugaa

SEQ ID NO: 938624 - RNA, 19 nt, Homo sapiens
aacuaugacuucaccaaau

SEQ ID NO: 938625 - RNA, 19 nt, Homo sapiens
caaagcccacuuaucauac

SEQ ID NO: 938626 - RNA, 19 nt, Homo sapiens
ccgagaggguggacaggau

SEQ ID NO: 938627 - RNA, 19 nt, Homo sapiens
ggacacuggaaacuagaug

SEQ ID NO: 938628 - RNA, 19 nt, Homo sapiens
ggucguggccaaagacaag

SEQ ID NO: 938629 - RNA, 19 nt, Homo sapiens
caaguguauuuggaaagga

SEQ ID NO: 938630 - RNA, 19 nt, Homo sapiens
gagaugccaaguguauuug

SEQ ID NO: 938631 - RNA, 19 nt, Homo sapiens
aagaccaccuucaucagau

SEQ ID NO: 938632 - RNA, 19 nt, Homo sapiens
aggcauuuauuaugucuag

SEQ ID NO: 938633 - RNA, 19 nt, Homo sapiens
ccaauaaguaauagcaaag

SEQ ID NO: 938634 - RNA, 19 nt, Homo sapiens
gaacaaagcugaccagauc

SEQ ID NO: 938635 - RNA, 19 nt, Homo sapiens
gaggaaaguugccgaguga

SEQ ID NO: 938636 - RNA, 19 nt, Homo sapiens
gaaauuguccuguagucua

SEQ ID NO: 938637 - RNA, 19 nt, Homo sapiens
guagacaauucacuucuuu

SEQ ID NO: 938638 - RNA, 19 nt, Homo sapiens
agaaggagcuggucaacaa

SEQ ID NO: 938639 - RNA, 19 nt, Homo sapiens
gaaauccauucaagagcua

SEQ ID NO: 938640 - RNA, 19 nt, Homo sapiens
caagaaacccuucaggaaa

SEQ ID NO: 938641 - RNA, 19 nt, Homo sapiens
gcucuucgaugcccacaaa

SEQ ID NO: 938642 - RNA, 19 nt, Homo sapiens
gacaaacuauggagaacaa

SEQ ID NO: 938643 - RNA, 19 nt, Homo sapiens
ccacugaaccaaucacuuu

SEQ ID NO: 938644 - RNA, 19 nt, Homo sapiens
gaggagaggugagaaagga

SEQ ID NO: 938645 - RNA, 19 nt, Homo sapiens
gcacacacacauaugcaua

SEQ ID NO: 938646 - RNA, 19 nt, Homo sapiens
ucagaaggcuaacuugaga

SEQ ID NO: 938647 - RNA, 19 nt, Homo sapiens
ggaaggacaacaagaagaa

SEQ ID NO: 938648 - RNA, 19 nt, Homo sapiens
gaaccaaucacuuuguaug

SEQ ID NO: 938649 - RNA, 19 nt, Homo sapiens
ccaagaaacccuucaggaa

SEQ ID NO: 938650 - RNA, 19 nt, Homo sapiens
guuuagauguucauacuug

SEQ ID NO: 938651 - RNA, 19 nt, Homo sapiens
gcucaacgaccucaucaaa

SEQ ID NO: 938652 - RNA, 19 nt, Homo sapiens
ggugguggaucccaagaaa

SEQ ID NO: 938653 - RNA, 19 nt, Homo sapiens
ccaaucacuuuguaugcua

SEQ ID NO: 938654 - RNA, 19 nt, Homo sapiens
gauacccaaugacaaacua

SEQ ID NO: 938655 - RNA, 19 nt, Homo sapiens
acacuugucugugcuauga

SEQ ID NO: 938656 - RNA, 19 nt, Homo sapiens
ggagcucuguucuuuccua

SEQ ID NO: 938657 - RNA, 19 nt, Homo sapiens
gucauuagucuucauguua

SEQ ID NO: 938658 - RNA, 19 nt, Homo sapiens
caagugggaccucauacua

SEQ ID NO: 938659 - RNA, 19 nt, Homo sapiens
ccuaugauguuuagauguu

SEQ ID NO: 938660 - RNA, 19 nt, Homo sapiens
gcucuguucuuuccuaauc

SEQ ID NO: 938661 - RNA, 19 nt, Homo sapiens
cccaggagcucuguucuuu

SEQ ID NO: 938662 - RNA, 19 nt, Homo sapiens
gcagugcauuugucauuag

SEQ ID NO: 938663 - RNA, 19 nt, Homo sapiens
guuaggcacuuuauauaca

SEQ ID NO: 938664 - RNA, 19 nt, Homo sapiens
gcuuugaacucugccagua

SEQ ID NO: 938665 - RNA, 19 nt, Homo sapiens
ccaaccaccucaucaaagu

SEQ ID NO: 938666 - RNA, 19 nt, Homo sapiens
ucaaagcccucaagaacca

SEQ ID NO: 938667 - RNA, 19 nt, Homo sapiens
ccucaagcccagauuauuu

SEQ ID NO: 938668 - RNA, 19 nt, Homo sapiens
gagcucuguucuuuccuaa

SEQ ID NO: 938669 - RNA, 19 nt, Homo sapiens
uaccagaccugaggcaauu

SEQ ID NO: 938670 - RNA, 19 nt, Homo sapiens
gcauuagccuucccauuuu

SEQ ID NO: 938671 - RNA, 19 nt, Homo sapiens
gaacucugccaguauuuca

SEQ ID NO: 938672 - RNA, 19 nt, Homo sapiens
ugcuuuggcuuccuaauaa

SEQ ID NO: 938673 - RNA, 19 nt, Homo sapiens
ugcauuagccuucccauuu

SEQ ID NO: 938674 - RNA, 19 nt, Homo sapiens
uaagaaauccauucaagag

SEQ ID NO: 938675 - RNA, 19 nt, Homo sapiens
gaaccacgaggacaagaug

SEQ ID NO: 938676 - RNA, 19 nt, Homo sapiens
caucaaagcccucaagaac

SEQ ID NO: 938677 - RNA, 19 nt, Homo sapiens
gauaagagugaggaaauug

SEQ ID NO: 938678 - RNA, 19 nt, Homo sapiens
aaucuaagccucugucuuc

SEQ ID NO: 938679 - RNA, 19 nt, Homo sapiens
gggcacaccuccaaguucu

SEQ ID NO: 938680 - RNA, 19 nt, Homo sapiens
gcuccaagcugcccaacag

SEQ ID NO: 938681 - RNA, 19 nt, Homo sapiens
ucaacaaccuggccgagau

SEQ ID NO: 938682 - RNA, 19 nt, Homo sapiens
caggaucccagcauugaua

SEQ ID NO: 938683 - RNA, 19 nt, Homo sapiens
cauacuugacucacauuua

SEQ ID NO: 938684 - RNA, 19 nt, Homo sapiens
ugauaagagugaggaaauu

SEQ ID NO: 938685 - RNA, 19 nt, Homo sapiens
cuaagccucugucuucuuc

SEQ ID NO: 938686 - RNA, 19 nt, Homo sapiens
gcaagcugcuggagguagu

SEQ ID NO: 938687 - RNA, 19 nt, Homo sapiens
ggaaaguugccgagugaug

SEQ ID NO: 938688 - RNA, 19 nt, Homo sapiens
gcaguguccuuggcaaauc

SEQ ID NO: 938689 - RNA, 19 nt, Homo sapiens
aaauuguccuguagucuau

SEQ ID NO: 938690 - RNA, 19 nt, Homo sapiens
ggaaggaccccgagguuuu

SEQ ID NO: 938691 - RNA, 19 nt, Homo sapiens
ggccuaugauguuuagaug

SEQ ID NO: 938692 - RNA, 19 nt, Homo sapiens
ccaccuggccuaugauguu

SEQ ID NO: 938693 - RNA, 19 nt, Homo sapiens
gcauuugucauuagucuuc

SEQ ID NO: 938694 - RNA, 19 nt, Homo sapiens
gcuggacgacgacgaguuu

SEQ ID NO: 938695 - RNA, 19 nt, Homo sapiens
gcgcuaaugccaagaagga

SEQ ID NO: 938696 - RNA, 19 nt, Homo sapiens
gggacaagcccauguacga

SEQ ID NO: 938697 - RNA, 19 nt, Homo sapiens
cagcuguccuugagugguu

SEQ ID NO: 938698 - RNA, 19 nt, Homo sapiens
cugaaccaaucacuuugua

SEQ ID NO: 938699 - RNA, 19 nt, Homo sapiens
guguuaggcacuuuauaua

SEQ ID NO: 938700 - RNA, 19 nt, Homo sapiens
auacuugacucacauuuac

SEQ ID NO: 938701 - RNA, 19 nt, Homo sapiens
caaccuggccgagaucuau

SEQ ID NO: 938702 - RNA, 19 nt, Homo sapiens
ggcaacgccuucuugaaca

SEQ ID NO: 938703 - RNA, 19 nt, Homo sapiens
agugggaccucauacuauu

SEQ ID NO: 938704 - RNA, 19 nt, Homo sapiens
ggagaacaagcaaaguaug

SEQ ID NO: 938705 - RNA, 19 nt, Homo sapiens
guucauacuugacucacau

SEQ ID NO: 938706 - RNA, 19 nt, Homo sapiens
ggaagcuggccgacauuga

SEQ ID NO: 938707 - RNA, 19 nt, Homo sapiens
ggagguaguggacgacaug

SEQ ID NO: 938708 - RNA, 19 nt, Homo sapiens
ggagaugcccucgguguuc

SEQ ID NO: 938709 - RNA, 19 nt, Homo sapiens
guucgugugugcccagcua

SEQ ID NO: 938710 - RNA, 19 nt, Homo sapiens
caccacagacuccuucauu

SEQ ID NO: 938711 - RNA, 19 nt, Homo sapiens
aaggcuaacuugagagguu

SEQ ID NO: 938712 - RNA, 19 nt, Homo sapiens
gagcuguguuaggcacuuu

SEQ ID NO: 938713 - RNA, 19 nt, Homo sapiens
aagaaacccuucaggaaac

SEQ ID NO: 938714 - RNA, 19 nt, Homo sapiens
ggccaucugucacgucaca

SEQ ID NO: 938715 - RNA, 19 nt, Homo sapiens
cucaagcccagauuauuua

SEQ ID NO: 938716 - RNA, 19 nt, Homo sapiens
uaucugcuuuggcuuccua

SEQ ID NO: 938717 - RNA, 19 nt, Homo sapiens
guuugcagcugauacuugu

SEQ ID NO: 938718 - RNA, 19 nt, Homo sapiens
ccauauucccagcaucaua

SEQ ID NO: 938719 - RNA, 19 nt, Homo sapiens
caccuggccuaugauguuu

SEQ ID NO: 938720 - RNA, 19 nt, Homo sapiens
uuugaacucugccaguauu

SEQ ID NO: 938721 - RNA, 19 nt, Homo sapiens
ggccaaccaccucaucaaa

SEQ ID NO: 938722 - RNA, 19 nt, Homo sapiens
caagaucacaggcgcuaau

SEQ ID NO: 938723 - RNA, 19 nt, Homo sapiens
ucagggacauccagagucu

SEQ ID NO: 938724 - RNA, 19 nt, Homo sapiens
ucaagaaccacgaggacaa

SEQ ID NO: 938725 - RNA, 19 nt, Homo sapiens
ugucauuagucuucauguu

SEQ ID NO: 938726 - RNA, 19 nt, Homo sapiens
gauggagagaggauucaaa

SEQ ID NO: 938727 - RNA, 19 nt, Homo sapiens
cuaagucucuaucgcucuu

SEQ ID NO: 938728 - RNA, 19 nt, Homo sapiens
ccuccaaguucucgggauu

SEQ ID NO: 938729 - RNA, 19 nt, Homo sapiens
gggaaggacaacaagaaga

SEQ ID NO: 938730 - RNA, 19 nt, Homo sapiens
ucucagaagucaucaaagc

SEQ ID NO: 938731 - RNA, 19 nt, Homo sapiens
gaccugaggcaauucacuu

SEQ ID NO: 938732 - RNA, 19 nt, Homo sapiens
gggauuagaaggacaagag

SEQ ID NO: 938733 - RNA, 19 nt, Homo sapiens
cgacaacaagcccaugguu

SEQ ID NO: 938734 - RNA, 19 nt, Homo sapiens
ugaaaugacuagcagauaa

SEQ ID NO: 938735 - RNA, 19 nt, Homo sapiens
ggagaugcccucuguguuu

SEQ ID NO: 938736 - RNA, 19 nt, Homo sapiens
ggaaggagaacaagaagaa

SEQ ID NO: 938737 - RNA, 19 nt, Homo sapiens
gaaaugacuagcagauaaa

SEQ ID NO: 938738 - RNA, 19 nt, Homo sapiens
ggacaagcccuuccgcaaa

SEQ ID NO: 938739 - RNA, 19 nt, Homo sapiens
ucacacccauuucuuuaaa

SEQ ID NO: 938740 - RNA, 19 nt, Homo sapiens
cuaccaccauuccauauuu

SEQ ID NO: 938741 - RNA, 19 nt, Homo sapiens
caaacugcccgucaucuuu

SEQ ID NO: 938742 - RNA, 19 nt, Homo sapiens
gcacugggcauuaccauag

SEQ ID NO: 938743 - RNA, 19 nt, Homo sapiens
agaaggagaugcccucugu

SEQ ID NO: 938744 - RNA, 19 nt, Homo sapiens
gaggagcacuaccgcuuug

SEQ ID NO: 938745 - RNA, 19 nt, Homo sapiens
aaauacaucugcccucaug

SEQ ID NO: 938746 - RNA, 19 nt, Homo sapiens
gagaugcccucuguguuug

SEQ ID NO: 938747 - RNA, 19 nt, Homo sapiens
gugcccagcucccuaauca

SEQ ID NO: 938748 - RNA, 19 nt, Homo sapiens
uaccaccauuccauauuua

SEQ ID NO: 938749 - RNA, 19 nt, Homo sapiens
ggagugcaguggugagauc

SEQ ID NO: 938750 - RNA, 19 nt, Homo sapiens
agaagcagcugauccucaa

SEQ ID NO: 938751 - RNA, 19 nt, Homo sapiens
gcauuaccauagagaacaa

SEQ ID NO: 938752 - RNA, 19 nt, Homo sapiens
gagggcaccuacacaguca

SEQ ID NO: 938753 - RNA, 19 nt, Homo sapiens
agauucagcuggaacauca

SEQ ID NO: 938754 - RNA, 19 nt, Homo sapiens
ucaacgaccuggugaagag

SEQ ID NO: 938755 - RNA, 19 nt, Homo sapiens
gacaagcccuuccgcaaac

SEQ ID NO: 938756 - RNA, 19 nt, Homo sapiens
ggaggagcacuaccgcuuu

SEQ ID NO: 938757 - RNA, 19 nt, Homo sapiens
caaauacgacgagaucuuc

SEQ ID NO: 938758 - RNA, 19 nt, Homo sapiens
gaaacaccuuccucaacag

SEQ ID NO: 938759 - RNA, 19 nt, Homo sapiens
ggagacacaccuacugcuu

SEQ ID NO: 938760 - RNA, 19 nt, Homo sapiens
gcuggaugaugaagaguuc

SEQ ID NO: 938761 - RNA, 19 nt, Homo sapiens
gcgacggcaugcuggauga

SEQ ID NO: 938762 - RNA, 19 nt, Homo sapiens
acgcuuacaucaucagcua

SEQ ID NO: 938763 - RNA, 19 nt, Homo sapiens
ccaaagugaugggauuaca

SEQ ID NO: 938764 - RNA, 19 nt, Homo sapiens
ccaaauacgacgagaucuu

SEQ ID NO: 938765 - RNA, 19 nt, Homo sapiens
gccaaggcuucuucccaaa

SEQ ID NO: 938766 - RNA, 19 nt, Homo sapiens
ccauccugcuccucugaua

SEQ ID NO: 938767 - RNA, 19 nt, Homo sapiens
cuucacacccauuucuuua

SEQ ID NO: 938768 - RNA, 19 nt, Homo sapiens
gcugauggcgcaugacuuc

SEQ ID NO: 938769 - RNA, 19 nt, Homo sapiens
ccaccacgcccagcuaauu

SEQ ID NO: 938770 - RNA, 19 nt, Homo sapiens
cauacccauuucuuucuuu

SEQ ID NO: 938771 - RNA, 19 nt, Homo sapiens
ggaccaagcuccccaacuc

SEQ ID NO: 938772 - RNA, 19 nt, Homo sapiens
ucacgcaaacacacacuaa

SEQ ID NO: 938773 - RNA, 19 nt, Homo sapiens
cauccgucauucauucaaa

SEQ ID NO: 938774 - RNA, 19 nt, Homo sapiens
acgacgagaucuucuacaa

SEQ ID NO: 938775 - RNA, 19 nt, Homo sapiens
gcccauacccauuucuuuc

SEQ ID NO: 938776 - RNA, 19 nt, Homo sapiens
agaccagcuucauccagua

SEQ ID NO: 938777 - RNA, 19 nt, Homo sapiens
cgacaucgccaagcucaug

SEQ ID NO: 938778 - RNA, 19 nt, Homo sapiens
aaacugcccgucaucuuug

SEQ ID NO: 938779 - RNA, 19 nt, Homo sapiens
ccauacccauuucuuucuu

SEQ ID NO: 938780 - RNA, 19 nt, Homo sapiens
gcuucacacccauuucuuu

SEQ ID NO: 938781 - RNA, 19 nt, Homo sapiens
guccuuucuuucuuucuuu

SEQ ID NO: 938782 - RNA, 19 nt, Homo sapiens
ccuguccuguccuuucuuu

SEQ ID NO: 938783 - RNA, 19 nt, Homo sapiens
ucuggaagcucagcgaugu

SEQ ID NO: 938784 - RNA, 19 nt, Homo sapiens
cugguaaucuggacuuaag

SEQ ID NO: 938785 - RNA, 19 nt, Homo sapiens
caccacgcccagcuaauuu

SEQ ID NO: 938786 - RNA, 19 nt, Homo sapiens
cuuccuuccuuccuucuuu

SEQ ID NO: 938787 - RNA, 19 nt, Homo sapiens
gcccacacccauuuauuuc

SEQ ID NO: 938788 - RNA, 19 nt, Homo sapiens
acgcaaacacacacuaauu

SEQ ID NO: 938789 - RNA, 19 nt, Homo sapiens
uccgcaaacucaacccuuu

SEQ ID NO: 938790 - RNA, 19 nt, Homo sapiens
gcccaccaccgacugcuuu

SEQ ID NO: 938791 - RNA, 19 nt, Homo sapiens
cgaguucacgcuuacauca

SEQ ID NO: 938792 - RNA, 19 nt, Homo sapiens
gggcaagaccagcuucauc

SEQ ID NO: 938793 - RNA, 19 nt, Homo sapiens
ucaucauccugcucuuuga

SEQ ID NO: 938794 - RNA, 19 nt, Homo sapiens
ucaaccggcuccaucacau

SEQ ID NO: 938795 - RNA, 19 nt, Homo sapiens
uugcugccuucaccacaua

SEQ ID NO: 938796 - RNA, 19 nt, Homo sapiens
gguaaucuggacuuaagga

SEQ ID NO: 938797 - RNA, 19 nt, Homo sapiens
uuuccuuccuuccuucuuu

SEQ ID NO: 938798 - RNA, 19 nt, Homo sapiens
uuuccuuccuuccuucuuu

SEQ ID NO: 938799 - RNA, 19 nt, Homo sapiens
gcugaaaugacuagcagau

SEQ ID NO: 938800 - RNA, 19 nt, Homo sapiens
cgcaaacacacacuaauuc

SEQ ID NO: 938801 - RNA, 19 nt, Homo sapiens
ucaaacugcccgucaucuu

SEQ ID NO: 938802 - RNA, 19 nt, Homo sapiens
gcucaacaaggccgacaug

SEQ ID NO: 938803 - RNA, 19 nt, Homo sapiens
gcacgggcaagaccagcuu

SEQ ID NO: 938804 - RNA, 19 nt, Homo sapiens
gcaaacacacacuaauucc

SEQ ID NO: 938805 - RNA, 19 nt, Homo sapiens
ggagggacaaggcuucucu

SEQ ID NO: 938806 - RNA, 19 nt, Homo sapiens
caugcuggaugaugaagag

SEQ ID NO: 938807 - RNA, 19 nt, Homo sapiens
gcgcguggaccucaucauc

SEQ ID NO: 938808 - RNA, 19 nt, Homo sapiens
ggaacaguguccccacaga

SEQ ID NO: 938809 - RNA, 19 nt, Homo sapiens
ccucugaacggaacagugu

SEQ ID NO: 938810 - RNA, 19 nt, Homo sapiens
gggaagagcaaaauacaug

SEQ ID NO: 938811 - RNA, 19 nt, Homo sapiens
guccuguccuuucuuucuu

SEQ ID NO: 938812 - RNA, 19 nt, Homo sapiens
gagagggcaccuacacagu

SEQ ID NO: 938813 - RNA, 19 nt, Homo sapiens
uggaggcacuggacgagau

SEQ ID NO: 938814 - RNA, 19 nt, Homo sapiens
cuggagagcaucagcauca

SEQ ID NO: 938815 - RNA, 19 nt, Homo sapiens
ugcccacacccauuuauuu

SEQ ID NO: 938816 - RNA, 19 nt, Homo sapiens
ccacacccauuuauuuccu

SEQ ID NO: 938817 - RNA, 19 nt, Homo sapiens
ccucauggaaggugacguu

SEQ ID NO: 938818 - RNA, 19 nt, Homo sapiens
guccaaauacgacgagauc

SEQ ID NO: 938819 - RNA, 19 nt, Homo sapiens
gggaaggagaacaagaaga

SEQ ID NO: 938820 - RNA, 19 nt, Homo sapiens
gcugguaaucuggacuuaa

SEQ ID NO: 938821 - RNA, 19 nt, Homo sapiens
cuccuggguugaagugauu

SEQ ID NO: 938822 - RNA, 19 nt, Homo sapiens
gcucuuugaugcgcacaag

SEQ ID NO: 938823 - RNA, 19 nt, Homo sapiens
ggagagcaucagcaucauc

SEQ ID NO: 938824 - RNA, 19 nt, Homo sapiens
guucacgcuuacaucauca

SEQ ID NO: 938825 - RNA, 19 nt, Homo sapiens
cugaaaugacuagcagaua

SEQ ID NO: 938826 - RNA, 19 nt, Homo sapiens
gaagcagcugauccucaaa

SEQ ID NO: 938827 - RNA, 19 nt, Homo sapiens
ggugcgaguucacgcuuac

SEQ ID NO: 938828 - RNA, 19 nt, Homo sapiens
ugaccucggcccucaagga

SEQ ID NO: 938829 - RNA, 19 nt, Homo sapiens
uguccuuucuuucuuucuu

SEQ ID NO: 938830 - RNA, 19 nt, Homo sapiens
uuuauuuccuuccuuccuu

SEQ ID NO: 938831 - RNA, 19 nt, Homo sapiens
ggcacugggcauuaccaua

SEQ ID NO: 938832 - RNA, 19 nt, Homo sapiens
uuauugagcaccuacuaug

SEQ ID NO: 938833 - RNA, 19 nt, Homo sapiens
gaaggagaacaagaagaag

SEQ ID NO: 938834 - RNA, 19 nt, Homo sapiens
gaggacggcuuacauguuu

SEQ ID NO: 938835 - RNA, 19 nt, Homo sapiens
gcagaggugucgccuuuaa

SEQ ID NO: 938836 - RNA, 19 nt, Homo sapiens
gugcagaggugucgccuuu

SEQ ID NO: 938837 - RNA, 19 nt, Homo sapiens
gcagaaagcuagagaucuc

SEQ ID NO: 938838 - RNA, 19 nt, Homo sapiens
gcccugaccuucucucuga

SEQ ID NO: 938839 - RNA, 19 nt, Homo sapiens
ggugucgccuuuaauguga

SEQ ID NO: 938840 - RNA, 19 nt, Homo sapiens
ggaggacggcuuacauguu

SEQ ID NO: 938841 - RNA, 19 nt, Homo sapiens
gaacagagaccugguacac

SEQ ID NO: 938842 - RNA, 19 nt, Homo sapiens
cggcuuacauguuuguuuc

SEQ ID NO: 938843 - RNA, 19 nt, Homo sapiens
cagcagcuuucccuguuga

SEQ ID NO: 938844 - RNA, 19 nt, Homo sapiens
cacaaggucucagaacaga

SEQ ID NO: 938845 - RNA, 19 nt, Homo sapiens
caacugcagcucuccauca

SEQ ID NO: 938846 - RNA, 19 nt, Homo sapiens
gaggaggacggcuuacaug

SEQ ID NO: 938847 - RNA, 19 nt, Homo sapiens
gcaaccuacuguuuauguc

SEQ ID NO: 938848 - RNA, 19 nt, Homo sapiens
gggcgguucugaaggacuu

SEQ ID NO: 938849 - RNA, 19 nt, Homo sapiens
ucagaacacccaaacacaa

SEQ ID NO: 938850 - RNA, 19 nt, Homo sapiens
ccaaacacaaggucucaga

SEQ ID NO: 938851 - RNA, 19 nt, Homo sapiens
ggaggaggacggcuuacau

SEQ ID NO: 938852 - RNA, 19 nt, Homo sapiens
gcuggaggaggacggcuua

SEQ ID NO: 938853 - RNA, 19 nt, Homo sapiens
cagcacgaguggccaguuc

SEQ ID NO: 938854 - RNA, 19 nt, Homo sapiens
gggcagaaagcuagagauc

SEQ ID NO: 938855 - RNA, 19 nt, Homo sapiens
gaaagcuagagaucucaga

SEQ ID NO: 938856 - RNA, 19 nt, Homo sapiens
caaccuacuguuuauguca

SEQ ID NO: 938857 - RNA, 19 nt, Homo sapiens
ccggcaaccuacuguuuau

SEQ ID NO: 938858 - RNA, 19 nt, Homo sapiens
ucagaacagagaccuggua

SEQ ID NO: 938859 - RNA, 19 nt, Homo sapiens
uccagcagcuuucccuguu

SEQ ID NO: 938860 - RNA, 19 nt, Homo sapiens
caaacacaaggucucagaa

SEQ ID NO: 938861 - RNA, 19 nt, Homo sapiens
ggacggcuuacauguuugu

SEQ ID NO: 938862 - RNA, 19 nt, Homo sapiens
ccagcagcuuucccuguug

SEQ ID NO: 938863 - RNA, 19 nt, Homo sapiens
gaacacccaaacacaaggu

SEQ ID NO: 938864 - RNA, 19 nt, Homo sapiens
ggcaaccuacuguuuaugu

SEQ ID NO: 938865 - RNA, 19 nt, Homo sapiens
aacacaaggucucagaaca

SEQ ID NO: 938866 - RNA, 19 nt, Homo sapiens
cugcuucaguugcacauca

SEQ ID NO: 938867 - RNA, 19 nt, Homo sapiens
cagaacacccaaacacaag

SEQ ID NO: 938868 - RNA, 19 nt, Homo sapiens
gaggugucgccuuuaaugu

SEQ ID NO: 938869 - RNA, 19 nt, Homo sapiens
agaggugucgccuuuaaug

SEQ ID NO: 938870 - RNA, 19 nt, Homo sapiens
gaucucagaacacccaaac

SEQ ID NO: 938871 - RNA, 19 nt, Homo sapiens
cgaguggccaguucauugu

SEQ ID NO: 938872 - RNA, 19 nt, Homo sapiens
gacagccgccugcuucagu

SEQ ID NO: 938873 - RNA, 19 nt, Homo sapiens
cagcuuucccuguugaugu

SEQ ID NO: 938874 - RNA, 19 nt, Homo sapiens
guccggcaaccuacuguuu

SEQ ID NO: 938875 - RNA, 19 nt, Homo sapiens
caccguguccggcaaccua

SEQ ID NO: 938876 - RNA, 19 nt, Homo sapiens
uccggcaaccuacuguuua

SEQ ID NO: 938877 - RNA, 19 nt, Homo sapiens
aaagcuagagaucucagaa

SEQ ID NO: 938878 - RNA, 19 nt, Homo sapiens
gcuuacauguuuguuucug

SEQ ID NO: 938879 - RNA, 19 nt, Homo sapiens
acgaguggccaguucauug

SEQ ID NO: 938880 - RNA, 19 nt, Homo sapiens
gcacgaguggccaguucau

SEQ ID NO: 938881 - RNA, 19 nt, Homo sapiens
acagccgccugcuucaguu

SEQ ID NO: 938882 - RNA, 19 nt, Homo sapiens
gaggagaacuugcuauauu

SEQ ID NO: 938883 - RNA, 19 nt, Homo sapiens
aaacaaaccuugauggaaa

SEQ ID NO: 938884 - RNA, 19 nt, Homo sapiens
ggacuuggcuuacccagaa

SEQ ID NO: 938885 - RNA, 19 nt, Homo sapiens
gaacagauucauuugcuua

SEQ ID NO: 938886 - RNA, 19 nt, Homo sapiens
gaaagacccuucguagaaa

SEQ ID NO: 938887 - RNA, 19 nt, Homo sapiens
gcauaaaucugcugugaau

SEQ ID NO: 938888 - RNA, 19 nt, Homo sapiens
ccagaaagguccuauguug

SEQ ID NO: 938889 - RNA, 19 nt, Homo sapiens
ccagaucuauucuuacaua

SEQ ID NO: 938890 - RNA, 19 nt, Homo sapiens
acacagggcuucaucguaa

SEQ ID NO: 938891 - RNA, 19 nt, Homo sapiens
gagaauagcuaagcagaug

SEQ ID NO: 938892 - RNA, 19 nt, Homo sapiens
gcacagaauugucuaccuu

SEQ ID NO: 938893 - RNA, 19 nt, Homo sapiens
guaagucguucuauauuug

SEQ ID NO: 938894 - RNA, 19 nt, Homo sapiens
uggcaaagcuccucaauuc

SEQ ID NO: 938895 - RNA, 19 nt, Homo sapiens
cggcagauuucaauuauuu

SEQ ID NO: 938896 - RNA, 19 nt, Homo sapiens
ccacugaguuagaauauau

SEQ ID NO: 938897 - RNA, 19 nt, Homo sapiens
cagcugaugucuacuguaa

SEQ ID NO: 938898 - RNA, 19 nt, Homo sapiens
agugguagcucgucaaaua

SEQ ID NO: 938899 - RNA, 19 nt, Homo sapiens
cagcugaaguguaguguuu

SEQ ID NO: 938900 - RNA, 19 nt, Homo sapiens
gcuccaagauuaaguguug

SEQ ID NO: 938901 - RNA, 19 nt, Homo sapiens
ccaaggcucccacuauuua

SEQ ID NO: 938902 - RNA, 19 nt, Homo sapiens
gaaacgaaaugguucucuu

SEQ ID NO: 938903 - RNA, 19 nt, Homo sapiens
guacuugacuaguuuacuu

SEQ ID NO: 938904 - RNA, 19 nt, Homo sapiens
caacuccgcuuguagacuu

SEQ ID NO: 938905 - RNA, 19 nt, Homo sapiens
gaucccacauugccuuuaa

SEQ ID NO: 938906 - RNA, 19 nt, Homo sapiens
gcaacaaggucuuagugau

SEQ ID NO: 938907 - RNA, 19 nt, Homo sapiens
gcaucuacguggagcauuu

SEQ ID NO: 938908 - RNA, 19 nt, Homo sapiens
gaagaaauagaugagguua

SEQ ID NO: 938909 - RNA, 19 nt, Homo sapiens
gcacacaaaucuggaguuc

SEQ ID NO: 938910 - RNA, 19 nt, Homo sapiens
gguauuauauccuaaccuu

SEQ ID NO: 938911 - RNA, 19 nt, Homo sapiens
caucguaacugcuucuaga

SEQ ID NO: 938912 - RNA, 19 nt, Homo sapiens
gaaagguccuauguuguug

SEQ ID NO: 938913 - RNA, 19 nt, Homo sapiens
gacagaagauuuacucucu

SEQ ID NO: 938914 - RNA, 19 nt, Homo sapiens
gugcaaugcugagagaaua

SEQ ID NO: 938915 - RNA, 19 nt, Homo sapiens
ggaacugauucuucauuug

SEQ ID NO: 938916 - RNA, 19 nt, Homo sapiens
cugaacaagugcuaaauaa

SEQ ID NO: 938917 - RNA, 19 nt, Homo sapiens
gaagguguaccauuauuug

SEQ ID NO: 938918 - RNA, 19 nt, Homo sapiens
gagaaggccuggucguugu

SEQ ID NO: 938919 - RNA, 19 nt, Homo sapiens
guuaagauguacuugacua

SEQ ID NO: 938920 - RNA, 19 nt, Homo sapiens
guucagacaucuucacaug

SEQ ID NO: 938921 - RNA, 19 nt, Homo sapiens
agaaagacccuucguagaa

SEQ ID NO: 938922 - RNA, 19 nt, Homo sapiens
ccauauuacuguuucauga

SEQ ID NO: 938923 - RNA, 19 nt, Homo sapiens
gugaagguguggaaauaaa

SEQ ID NO: 938924 - RNA, 19 nt, Homo sapiens
ggaaauccuauccuacuaa

SEQ ID NO: 938925 - RNA, 19 nt, Homo sapiens
acuguaaacugaugccuua

SEQ ID NO: 938926 - RNA, 19 nt, Homo sapiens
gcagugcaaugcugagaga

SEQ ID NO: 938927 - RNA, 19 nt, Homo sapiens
gaaaaugaccccaauaaug

SEQ ID NO: 938928 - RNA, 19 nt, Homo sapiens
cuagagaacagauucauuu

SEQ ID NO: 938929 - RNA, 19 nt, Homo sapiens
gagaugggauugugaaggu

SEQ ID NO: 938930 - RNA, 19 nt, Homo sapiens
agaaacagcucugagauuc

SEQ ID NO: 938931 - RNA, 19 nt, Homo sapiens
gaagacaacccggcagauu

SEQ ID NO: 938932 - RNA, 19 nt, Homo sapiens
ggaggacgguuguguugug

SEQ ID NO: 938933 - RNA, 19 nt, Homo sapiens
gauguuugccacugaguua

SEQ ID NO: 938934 - RNA, 19 nt, Homo sapiens
ggaauuggguucuucuaac

SEQ ID NO: 938935 - RNA, 19 nt, Homo sapiens
ccaacaaugucugggauuu

SEQ ID NO: 938936 - RNA, 19 nt, Homo sapiens
gagaacagauucauuugcu

SEQ ID NO: 938937 - RNA, 19 nt, Homo sapiens
cuacaaagcagaauucuag

SEQ ID NO: 938938 - RNA, 19 nt, Homo sapiens
aaagaugguuguaagcuau

SEQ ID NO: 938939 - RNA, 19 nt, Homo sapiens
ccucauagcguccauggua

SEQ ID NO: 938940 - RNA, 19 nt, Homo sapiens
uuacagccuucuccucaua

SEQ ID NO: 938941 - RNA, 19 nt, Homo sapiens
acuaccagaucuauucuua

SEQ ID NO: 938942 - RNA, 19 nt, Homo sapiens
gaccagagccaucuucaug

SEQ ID NO: 938943 - RNA, 19 nt, Homo sapiens
gccagaggauccugccaua

SEQ ID NO: 938944 - RNA, 19 nt, Homo sapiens
gaacugauucuucauuugg

SEQ ID NO: 938945 - RNA, 19 nt, Homo sapiens
ggaccaagcacacaaaucu

SEQ ID NO: 938946 - RNA, 19 nt, Homo sapiens
gaaaguaggaccaagugau

SEQ ID NO: 938947 - RNA, 19 nt, Homo sapiens
ggagacuggugacagaaga

SEQ ID NO: 938948 - RNA, 19 nt, Homo sapiens
ucaagucacugucauccuu

SEQ ID NO: 938949 - RNA, 19 nt, Homo sapiens
ggacaugagguuccaguug

SEQ ID NO: 938950 - RNA, 19 nt, Homo sapiens
ugccuuaucuugacccaua

SEQ ID NO: 938951 - RNA, 19 nt, Homo sapiens
gaugucuacuguaaacuga

SEQ ID NO: 938952 - RNA, 19 nt, Homo sapiens
caacaaggucuuagugaug

SEQ ID NO: 938953 - RNA, 19 nt, Homo sapiens
agaaauagaugagguuaca

SEQ ID NO: 938954 - RNA, 19 nt, Homo sapiens
ccacuuagcccaagaugau

SEQ ID NO: 938955 - RNA, 19 nt, Homo sapiens
gauccgcgcuagaggaaga

SEQ ID NO: 938956 - RNA, 19 nt, Homo sapiens
cagaggugcuugccauuau

SEQ ID NO: 938957 - RNA, 19 nt, Homo sapiens
gugagccucugaacgauuu

SEQ ID NO: 938958 - RNA, 19 nt, Homo sapiens
ucaagacgcucacauucug

SEQ ID NO: 938959 - RNA, 19 nt, Homo sapiens
gcaacauguucaaaugaug

SEQ ID NO: 938960 - RNA, 19 nt, Homo sapiens
uaaagcaaaggccaauaua

SEQ ID NO: 938961 - RNA, 19 nt, Homo sapiens
aaacugaugccuuaucuug

SEQ ID NO: 938962 - RNA, 19 nt, Homo sapiens
guaaacugaugccuuaucu

SEQ ID NO: 938963 - RNA, 19 nt, Homo sapiens
caaagcuccucaauucuca

SEQ ID NO: 938964 - RNA, 19 nt, Homo sapiens
ccacaugauuacuuuccua

SEQ ID NO: 938965 - RNA, 19 nt, Homo sapiens
ucagagaauugguaacuca

SEQ ID NO: 938966 - RNA, 19 nt, Homo sapiens
cagaagguguaccauuauu

SEQ ID NO: 938967 - RNA, 19 nt, Homo sapiens
caccaccacuuucugaauu

SEQ ID NO: 938968 - RNA, 19 nt, Homo sapiens
ggaagaggaagacaaacuu

SEQ ID NO: 938969 - RNA, 19 nt, Homo sapiens
ugaagaaguugcucucaca

SEQ ID NO: 938970 - RNA, 19 nt, Homo sapiens
ccaguaagucguucuauau

SEQ ID NO: 938971 - RNA, 19 nt, Homo sapiens
gcuccaagccuuacaugaa

SEQ ID NO: 938972 - RNA, 19 nt, Homo sapiens
gaugagcguauucugguua

SEQ ID NO: 938973 - RNA, 19 nt, Homo sapiens
ggcagaagauuacuuaaaa

SEQ ID NO: 938974 - RNA, 19 nt, Homo sapiens
gaauuggguucuucuaacu

SEQ ID NO: 938975 - RNA, 19 nt, Homo sapiens
gcccaucuccugucuauga

SEQ ID NO: 938976 - RNA, 19 nt, Homo sapiens
ggacuuuaaagcaugauuu

SEQ ID NO: 938977 - RNA, 19 nt, Homo sapiens
gcaaugcguggacuuuaaa

SEQ ID NO: 938978 - RNA, 19 nt, Homo sapiens
uaauugacuuggcagcuuu

SEQ ID NO: 938979 - RNA, 19 nt, Homo sapiens
guaauugacuuggcagcuu

SEQ ID NO: 938980 - RNA, 19 nt, Homo sapiens
ucacaugcgucagaagaaa

SEQ ID NO: 938981 - RNA, 19 nt, Homo sapiens
gaaggagagccuaaggaaa

SEQ ID NO: 938982 - RNA, 19 nt, Homo sapiens
guucgaggcucaccuauca

SEQ ID NO: 938983 - RNA, 19 nt, Homo sapiens
ggagguuuguuaacuauuc

SEQ ID NO: 938984 - RNA, 19 nt, Homo sapiens
gaaggaggcccugcugaaa

SEQ ID NO: 938985 - RNA, 19 nt, Homo sapiens
gugauuggcuggagguuug

SEQ ID NO: 938986 - RNA, 19 nt, Homo sapiens
gcuggagguuuguuaacua

SEQ ID NO: 938987 - RNA, 19 nt, Homo sapiens
caccgaggauuggaaauaa

SEQ ID NO: 938988 - RNA, 19 nt, Homo sapiens
gcgucaaggugagaacuua

SEQ ID NO: 938989 - RNA, 19 nt, Homo sapiens
cagggcagcucucaggauu

SEQ ID NO: 938990 - RNA, 19 nt, Homo sapiens
ccgccucucuguacaguaa

SEQ ID NO: 938991 - RNA, 19 nt, Homo sapiens
ggacaccgaggauuggaaa

SEQ ID NO: 938992 - RNA, 19 nt, Homo sapiens
gggcagcucucaggauugu

SEQ ID NO: 938993 - RNA, 19 nt, Homo sapiens
gugaacggcugggacauga

SEQ ID NO: 938994 - RNA, 19 nt, Homo sapiens
gaacuuaauccuggguuuc

SEQ ID NO: 938995 - RNA, 19 nt, Homo sapiens
cccaggguuugccuucuua

SEQ ID NO: 938996 - RNA, 19 nt, Homo sapiens
gugcaaagaguugaaauuc

SEQ ID NO: 938997 - RNA, 19 nt, Homo sapiens
gagguuuguuaacuauuca

SEQ ID NO: 938998 - RNA, 19 nt, Homo sapiens
ugaaggaggcccugcugaa

SEQ ID NO: 938999 - RNA, 19 nt, Homo sapiens
agacggacaaggguauuua

SEQ ID NO: 939000 - RNA, 19 nt, Homo sapiens
gcucucaggauugucauuu

SEQ ID NO: 939001 - RNA, 19 nt, Homo sapiens
acaccgaggauuggaaaua

SEQ ID NO: 939002 - RNA, 19 nt, Homo sapiens
ggccuggagcugaguagua

SEQ ID NO: 939003 - RNA, 19 nt, Homo sapiens
aauccuggguuucagcauu

SEQ ID NO: 939004 - RNA, 19 nt, Homo sapiens
ggugcaaagaguugaaauu

SEQ ID NO: 939005 - RNA, 19 nt, Homo sapiens
agaacuuaauccuggguuu

SEQ ID NO: 939006 - RNA, 19 nt, Homo sapiens
gcagauuggagacaagauc

SEQ ID NO: 939007 - RNA, 19 nt, Homo sapiens
caaggguauuuaugucaca

SEQ ID NO: 939008 - RNA, 19 nt, Homo sapiens
gcagcucucaggauuguca

SEQ ID NO: 939009 - RNA, 19 nt, Homo sapiens
gccuggagcugaguaguag

SEQ ID NO: 939010 - RNA, 19 nt, Homo sapiens
ucgcugggcugcagauugg

SEQ ID NO: 939011 - RNA, 19 nt, Homo sapiens
ccucuuugccuguggguuu

SEQ ID NO: 939012 - RNA, 19 nt, Homo sapiens
gaagcuuugcccagaugaa

SEQ ID NO: 939013 - RNA, 19 nt, Homo sapiens
cagaggcgcuacgaagcuu

SEQ ID NO: 939014 - RNA, 19 nt, Homo sapiens
aggaggcccugcugaaauc

SEQ ID NO: 939015 - RNA, 19 nt, Homo sapiens
acaagaucaugcaggugaa

SEQ ID NO: 939016 - RNA, 19 nt, Homo sapiens
cuggagguuuguuaacuau

SEQ ID NO: 939017 - RNA, 19 nt, Homo sapiens
gauugucauuuuccucuuu

SEQ ID NO: 939018 - RNA, 19 nt, Homo sapiens
ggauuuagacgagguucga

SEQ ID NO: 939019 - RNA, 19 nt, Homo sapiens
cggacaaggguauuuaugu

SEQ ID NO: 939020 - RNA, 19 nt, Homo sapiens
gcucagaagggcuauagcu

SEQ ID NO: 939021 - RNA, 19 nt, Homo sapiens
gauuggagacaagaucaug

SEQ ID NO: 939022 - RNA, 19 nt, Homo sapiens
acgaagcuuugcccagaug

SEQ ID NO: 939023 - RNA, 19 nt, Homo sapiens
gacggacaaggguauuuau

SEQ ID NO: 939024 - RNA, 19 nt, Homo sapiens
acaagacggacaaggguau

SEQ ID NO: 939025 - RNA, 19 nt, Homo sapiens
gcagggucgagauguccua

SEQ ID NO: 939026 - RNA, 19 nt, Homo sapiens
ccagagcagggucgagaug

SEQ ID NO: 939027 - RNA, 19 nt, Homo sapiens
ggugaacggcugggacaug

SEQ ID NO: 939028 - RNA, 19 nt, Homo sapiens
cagauuggagacaagauca

SEQ ID NO: 939029 - RNA, 19 nt, Homo sapiens
gaacuuuagucguguaaua

SEQ ID NO: 939030 - RNA, 19 nt, Homo sapiens
gcaaaucgauggaguccuu

SEQ ID NO: 939031 - RNA, 19 nt, Homo sapiens
guuaugagaucaaggauau

SEQ ID NO: 939032 - RNA, 19 nt, Homo sapiens
gaaagagucuaugcagaug

SEQ ID NO: 939033 - RNA, 19 nt, Homo sapiens
gaucagagcucggcaaacu

SEQ ID NO: 939034 - RNA, 19 nt, Homo sapiens
agaaaaggcugaacagaua

SEQ ID NO: 939035 - RNA, 19 nt, Homo sapiens
gaucaaggauauccaugug

SEQ ID NO: 939036 - RNA, 19 nt, Homo sapiens
gccaaggacuccaacacua

SEQ ID NO: 939037 - RNA, 19 nt, Homo sapiens
ccacaguucuagagucuga

SEQ ID NO: 939038 - RNA, 19 nt, Homo sapiens
caaacucucucuggacaaa

SEQ ID NO: 939039 - RNA, 19 nt, Homo sapiens
ucaaggaaauugucaucaa

SEQ ID NO: 939040 - RNA, 19 nt, Homo sapiens
gaaacgggccacaguucua

SEQ ID NO: 939041 - RNA, 19 nt, Homo sapiens
caauguaacucugcaaauc

SEQ ID NO: 939042 - RNA, 19 nt, Homo sapiens
uagcuucccugccaagauu

SEQ ID NO: 939043 - RNA, 19 nt, Homo sapiens
ggccaaggcuaaagcugaa

SEQ ID NO: 939044 - RNA, 19 nt, Homo sapiens
gaagaaacaggcccagauc

SEQ ID NO: 939045 - RNA, 19 nt, Homo sapiens
aaacaaccaugagaucaga

SEQ ID NO: 939046 - RNA, 19 nt, Homo sapiens
ggaagaaacaggcccagau

SEQ ID NO: 939047 - RNA, 19 nt, Homo sapiens
gagagucggccaucaaugu

SEQ ID NO: 939048 - RNA, 19 nt, Homo sapiens
caaggaaauugucaucaac

SEQ ID NO: 939049 - RNA, 19 nt, Homo sapiens
ggacaaggaagcagauuuu

SEQ ID NO: 939050 - RNA, 19 nt, Homo sapiens
gccagggacuccagacuca

SEQ ID NO: 939051 - RNA, 19 nt, Homo sapiens
ugaaagagucuaugcagau

SEQ ID NO: 939052 - RNA, 19 nt, Homo sapiens
gcucugacacaacauaaug

SEQ ID NO: 939053 - RNA, 19 nt, Homo sapiens
gcagcucugacacaacaua

SEQ ID NO: 939054 - RNA, 19 nt, Homo sapiens
gugcagagucucaaggaaa

SEQ ID NO: 939055 - RNA, 19 nt, Homo sapiens
gagucaagaugaguuagug

SEQ ID NO: 939056 - RNA, 19 nt, Homo sapiens
ccaaggacuccaacacuau

SEQ ID NO: 939057 - RNA, 19 nt, Homo sapiens
gagaucagagcucggcaaa

SEQ ID NO: 939058 - RNA, 19 nt, Homo sapiens
ucuccaaacuggccaagga

SEQ ID NO: 939059 - RNA, 19 nt, Homo sapiens
ggguacagaugcaagucuu

SEQ ID NO: 939060 - RNA, 19 nt, Homo sapiens
gacaauguaacucugcaaa

SEQ ID NO: 939061 - RNA, 19 nt, Homo sapiens
gggacaaggaagcagauuu

SEQ ID NO: 939062 - RNA, 19 nt, Homo sapiens
gaucgagucaagaugaguu

SEQ ID NO: 939063 - RNA, 19 nt, Homo sapiens
gacacaacauaauggagau

SEQ ID NO: 939064 - RNA, 19 nt, Homo sapiens
gauccgauaugugcagagu

SEQ ID NO: 939065 - RNA, 19 nt, Homo sapiens
ggacuccaacacuauccua

SEQ ID NO: 939066 - RNA, 19 nt, Homo sapiens
ggccacaguucuagagucu

SEQ ID NO: 939067 - RNA, 19 nt, Homo sapiens
cugcagcucugacacaaca

SEQ ID NO: 939068 - RNA, 19 nt, Homo sapiens
gauccuggccuccgaagca

SEQ ID NO: 939069 - RNA, 19 nt, Homo sapiens
gaagcagauuuuccugauu

SEQ ID NO: 939070 - RNA, 19 nt, Homo sapiens
ggaaacgggccacaguucu

SEQ ID NO: 939071 - RNA, 19 nt, Homo sapiens
caucauggacccuuacaag

SEQ ID NO: 939072 - RNA, 19 nt, Homo sapiens
uaaacucaccaguggcaaa

SEQ ID NO: 939073 - RNA, 19 nt, Homo sapiens
cauccucaucccuguguua

SEQ ID NO: 939074 - RNA, 19 nt, Homo sapiens
ggagaggccagugcaguuc

SEQ ID NO: 939075 - RNA, 19 nt, Homo sapiens
gaaaaggcugaacagauaa

SEQ ID NO: 939076 - RNA, 19 nt, Homo sapiens
ugcagagucucaaggaaau

SEQ ID NO: 939077 - RNA, 19 nt, Homo sapiens
ugucagcgcguucuccaaa

SEQ ID NO: 939078 - RNA, 19 nt, Homo sapiens
ucaaacaaccaugagauca

SEQ ID NO: 939079 - RNA, 19 nt, Homo sapiens
aggcugaacagauaaauca

SEQ ID NO: 939080 - RNA, 19 nt, Homo sapiens
ucacccagcuagcucaaac

SEQ ID NO: 939081 - RNA, 19 nt, Homo sapiens
ggcugugacucucgacaau

SEQ ID NO: 939082 - RNA, 19 nt, Homo sapiens
cgaaacaccgugguacugu

SEQ ID NO: 939083 - RNA, 19 nt, Homo sapiens
gcucaggccauggguguau

SEQ ID NO: 939084 - RNA, 19 nt, Homo sapiens
gcggaaacgggccacaguu

SEQ ID NO: 939085 - RNA, 19 nt, Homo sapiens
gauccuggagccugguuug

SEQ ID NO: 939086 - RNA, 19 nt, Homo sapiens
auauggagcccucaccaaa

SEQ ID NO: 939087 - RNA, 19 nt, Homo sapiens
uguuagaccggauccgaua

SEQ ID NO: 939088 - RNA, 19 nt, Homo sapiens
caaacaaccaugagaucag

SEQ ID NO: 939089 - RNA, 19 nt, Homo sapiens
caaggacuccaacacuauc

SEQ ID NO: 939090 - RNA, 19 nt, Homo sapiens
ccucaucccuguguuagac

SEQ ID NO: 939091 - RNA, 19 nt, Homo sapiens
gcaaacucucucuggacaa

SEQ ID NO: 939092 - RNA, 19 nt, Homo sapiens
gugacucucgacaauguaa

SEQ ID NO: 939093 - RNA, 19 nt, Homo sapiens
cugugacucucgacaaugu

SEQ ID NO: 939094 - RNA, 19 nt, Homo sapiens
ccugagcagucggcuguga

SEQ ID NO: 939095 - RNA, 19 nt, Homo sapiens
gcagagucucaaggaaauu

SEQ ID NO: 939096 - RNA, 19 nt, Homo sapiens
gaugcagcagcuucacuga

SEQ ID NO: 939097 - RNA, 19 nt, Homo sapiens
cagcucugacacaacauaa

SEQ ID NO: 939098 - RNA, 19 nt, Homo sapiens
cagagucucaaggaaauug

SEQ ID NO: 939099 - RNA, 19 nt, Homo sapiens
uggcagaagggaagaaaca

SEQ ID NO: 939100 - RNA, 19 nt, Homo sapiens
guguggaggacccugagua

SEQ ID NO: 939101 - RNA, 19 nt, Homo sapiens
ggaaucauccuaaauugua

SEQ ID NO: 939102 - RNA, 19 nt, Homo sapiens
gaugagaacaagauaauug

SEQ ID NO: 939103 - RNA, 19 nt, Homo sapiens
cagaaggccuauccuagaa

SEQ ID NO: 939104 - RNA, 19 nt, Homo sapiens
acaccaaccugugcaagua

SEQ ID NO: 939105 - RNA, 19 nt, Homo sapiens
gaaagcaagacaucaagga

SEQ ID NO: 939106 - RNA, 19 nt, Homo sapiens
gaagcuggauugaggaaac

SEQ ID NO: 939107 - RNA, 19 nt, Homo sapiens
ccagaaggccuauccuaga

SEQ ID NO: 939108 - RNA, 19 nt, Homo sapiens
ucucaggagucgaaaguga

SEQ ID NO: 939109 - RNA, 19 nt, Homo sapiens
gcucugaucucuccuuucc

SEQ ID NO: 939110 - RNA, 19 nt, Homo sapiens
gcaguugcuucaggcguuu

SEQ ID NO: 939111 - RNA, 19 nt, Homo sapiens
gaggaugagaacaagauaa

SEQ ID NO: 939112 - RNA, 19 nt, Homo sapiens
ggacaaaugauggucuuca

SEQ ID NO: 939113 - RNA, 19 nt, Homo sapiens
gaaacgaugcgggacaaau

SEQ ID NO: 939114 - RNA, 19 nt, Homo sapiens
gccaagaggaugagaacaa

SEQ ID NO: 939115 - RNA, 19 nt, Homo sapiens
ccaagaggaugagaacaag

SEQ ID NO: 939116 - RNA, 19 nt, Homo sapiens
gauaauugguggccauacg

SEQ ID NO: 939117 - RNA, 19 nt, Homo sapiens
ugagaaagcaagacaucaa

SEQ ID NO: 939118 - RNA, 19 nt, Homo sapiens
aaacgaugcgggacaaaug

SEQ ID NO: 939119 - RNA, 19 nt, Homo sapiens
cggaugaggugugccagaa

SEQ ID NO: 939120 - RNA, 19 nt, Homo sapiens
cccagcauccugaucuuua

SEQ ID NO: 939121 - RNA, 19 nt, Homo sapiens
gcccuccucucucuacuca

SEQ ID NO: 939122 - RNA, 19 nt, Homo sapiens
gcuauagccaugacacaga

SEQ ID NO: 939123 - RNA, 19 nt, Homo sapiens
cauggucugugcaggaguu

SEQ ID NO: 939124 - RNA, 19 nt, Homo sapiens
gagaaagcaagacaucaag

SEQ ID NO: 939125 - RNA, 19 nt, Homo sapiens
ccacgacaacgaccucaug

SEQ ID NO: 939126 - RNA, 19 nt, Homo sapiens
ggaugagaacaagauaauu

SEQ ID NO: 939127 - RNA, 19 nt, Homo sapiens
ucucugcugugucuucaug

SEQ ID NO: 939128 - RNA, 19 nt, Homo sapiens
cuaccucucugcugugucu

SEQ ID NO: 939129 - RNA, 19 nt, Homo sapiens
uccagggccucgugucuug

SEQ ID NO: 939130 - RNA, 19 nt, Homo sapiens
ggcauuguauuccaaagac

SEQ ID NO: 939131 - RNA, 19 nt, Homo sapiens
cggcucugaucucuccuuu

SEQ ID NO: 939132 - RNA, 19 nt, Homo sapiens
gcgggaaggacucuuguca

SEQ ID NO: 939133 - RNA, 19 nt, Homo sapiens
uuaaaccggcauuguauuc

SEQ ID NO: 939134 - RNA, 19 nt, Homo sapiens
ccuuaaaccggcauuguau

SEQ ID NO: 939135 - RNA, 19 nt, Homo sapiens
caccaucacuacucaagac

SEQ ID NO: 939136 - RNA, 19 nt, Homo sapiens
gacaaaugauggucuucac

SEQ ID NO: 939137 - RNA, 19 nt, Homo sapiens
guacagaagcuggauugag

SEQ ID NO: 939138 - RNA, 19 nt, Homo sapiens
cgaaagugagaaagcaaga

SEQ ID NO: 939139 - RNA, 19 nt, Homo sapiens
ccagcauccugaucuuuac

SEQ ID NO: 939140 - RNA, 19 nt, Homo sapiens
ugcaaugcgugaacaucaa

SEQ ID NO: 939141 - RNA, 19 nt, Homo sapiens
auggaaucauccuaaauug

SEQ ID NO: 939142 - RNA, 19 nt, Homo sapiens
cgggacaaaugauggucuu

SEQ ID NO: 939143 - RNA, 19 nt, Homo sapiens
gcgugaacaucaacaucuc

SEQ ID NO: 939144 - RNA, 19 nt, Homo sapiens
ggaaacgaugcgggacaaa

SEQ ID NO: 939145 - RNA, 19 nt, Homo sapiens
gagccaagaggaugagaac

SEQ ID NO: 939146 - RNA, 19 nt, Homo sapiens
aaaccggcauuguauucca

SEQ ID NO: 939147 - RNA, 19 nt, Homo sapiens
cccuuaaaccggcauugua

SEQ ID NO: 939148 - RNA, 19 nt, Homo sapiens
aaagugagaaagcaagaca

SEQ ID NO: 939149 - RNA, 19 nt, Homo sapiens
caagaggaugagaacaaga

SEQ ID NO: 939150 - RNA, 19 nt, Homo sapiens
caaguacagaagcuggauu

SEQ ID NO: 939151 - RNA, 19 nt, Homo sapiens
gcaaguacagaagcuggau

SEQ ID NO: 939152 - RNA, 19 nt, Homo sapiens
aggaugagaacaagauaau

SEQ ID NO: 939153 - RNA, 19 nt, Homo sapiens
gcaauagucuggaauaaau

SEQ ID NO: 939154 - RNA, 19 nt, Homo sapiens
gaacuucuuggaacuuuaa

SEQ ID NO: 939155 - RNA, 19 nt, Homo sapiens
ggaacuucuuggaacuuua

SEQ ID NO: 939156 - RNA, 19 nt, Homo sapiens
guagguggacggagagaua

SEQ ID NO: 939157 - RNA, 19 nt, Homo sapiens
gggaacuucuuggaacuuu

SEQ ID NO: 939158 - RNA, 19 nt, Homo sapiens
ugagagaagugugcaauag

SEQ ID NO: 939159 - RNA, 19 nt, Homo sapiens
gugcaauagucuggaauaa

SEQ ID NO: 939160 - RNA, 19 nt, Homo sapiens
ggagucuacaccuauauuu

SEQ ID NO: 939161 - RNA, 19 nt, Homo sapiens
gcagccacaccgaagauuu

SEQ ID NO: 939162 - RNA, 19 nt, Homo sapiens
gagaaucacgagcaacaug

SEQ ID NO: 939163 - RNA, 19 nt, Homo sapiens
ccuggagucuacaccuaua

SEQ ID NO: 939164 - RNA, 19 nt, Homo sapiens
agagaagugugcaauaguc

SEQ ID NO: 939165 - RNA, 19 nt, Homo sapiens
aaacagugacagccacgua

SEQ ID NO: 939166 - RNA, 19 nt, Homo sapiens
gagagaagugugcaauagu

SEQ ID NO: 939167 - RNA, 19 nt, Homo sapiens
gagucuacaccuauauuug

SEQ ID NO: 939168 - RNA, 19 nt, Homo sapiens
gugagagaagugugcaaua

SEQ ID NO: 939169 - RNA, 19 nt, Homo sapiens
gggagaaucacgagcaaca

SEQ ID NO: 939170 - RNA, 19 nt, Homo sapiens
uggcaucccuggagucuac

SEQ ID NO: 939171 - RNA, 19 nt, Homo sapiens
aaggugagaaggagacuuu

SEQ ID NO: 939172 - RNA, 19 nt, Homo sapiens
acaaagagacaaggugaga

SEQ ID NO: 939173 - RNA, 19 nt, Homo sapiens
gugagaaggagacuuugga

SEQ ID NO: 939174 - RNA, 19 nt, Homo sapiens
caaagagacaaggugagaa

SEQ ID NO: 939175 - RNA, 19 nt, Homo sapiens
gacgaggacaggccaaaca

SEQ ID NO: 939176 - RNA, 19 nt, Homo sapiens
aaagagacaaggugagaag

SEQ ID NO: 939177 - RNA, 19 nt, Homo sapiens
ugacagccacguagaggau

SEQ ID NO: 939178 - RNA, 19 nt, Homo sapiens
caccgaagauuuucaaugg

SEQ ID NO: 939179 - RNA, 19 nt, Homo sapiens
ugagaaggagacuuuggaa

SEQ ID NO: 939180 - RNA, 19 nt, Homo sapiens
gcagacaaagagacaaggu

SEQ ID NO: 939181 - RNA, 19 nt, Homo sapiens
ccugccagcccuucuaaga

SEQ ID NO: 939182 - RNA, 19 nt, Homo sapiens
ucccuggagucuacaccua

SEQ ID NO: 939183 - RNA, 19 nt, Homo sapiens
ugcaauagucuggaauaaa

SEQ ID NO: 939184 - RNA, 19 nt, Homo sapiens
gagaagugugcaauagucu

SEQ ID NO: 939185 - RNA, 19 nt, Homo sapiens
acaccuauauuugcaacuc

SEQ ID NO: 939186 - RNA, 19 nt, Homo sapiens
ggugagagaagugugcaau

SEQ ID NO: 939187 - RNA, 19 nt, Homo sapiens
gcaauagucuggaauaaau

SEQ ID NO: 939188 - RNA, 19 nt, Homo sapiens
gcaaguauguggacuggau

SEQ ID NO: 939189 - RNA, 19 nt, Homo sapiens
gaacuucuuggaacuuuaa

SEQ ID NO: 939190 - RNA, 19 nt, Homo sapiens
ggaacuucuuggaacuuua

SEQ ID NO: 939191 - RNA, 19 nt, Homo sapiens
guagguggacggagagaua

SEQ ID NO: 939192 - RNA, 19 nt, Homo sapiens
acaccuauauuugcaagua

SEQ ID NO: 939193 - RNA, 19 nt, Homo sapiens
gcaccaauaucuccuccau

SEQ ID NO: 939194 - RNA, 19 nt, Homo sapiens
gggaacuucuuggaacuuu

SEQ ID NO: 939195 - RNA, 19 nt, Homo sapiens
ugagagaagugugcaauag

SEQ ID NO: 939196 - RNA, 19 nt, Homo sapiens
gugcaauagucuggaauaa

SEQ ID NO: 939197 - RNA, 19 nt, Homo sapiens
ggagucuacaccuauauuu

SEQ ID NO: 939198 - RNA, 19 nt, Homo sapiens
accaauaucuccuccauca

SEQ ID NO: 939199 - RNA, 19 nt, Homo sapiens
gcagccacaccgaagauuu

SEQ ID NO: 939200 - RNA, 19 nt, Homo sapiens
gaucaugaggaacaacuga

SEQ ID NO: 939201 - RNA, 19 nt, Homo sapiens
gagaaucacgagcaacaug

SEQ ID NO: 939202 - RNA, 19 nt, Homo sapiens
ccucagagcaccaauaucu

SEQ ID NO: 939203 - RNA, 19 nt, Homo sapiens
ccuggagucuacaccuaua

SEQ ID NO: 939204 - RNA, 19 nt, Homo sapiens
agagaagugugcaauaguc

SEQ ID NO: 939205 - RNA, 19 nt, Homo sapiens
aaacagugacagccacgua

SEQ ID NO: 939206 - RNA, 19 nt, Homo sapiens
gagagaagugugcaauagu

SEQ ID NO: 939207 - RNA, 19 nt, Homo sapiens
gagucuacaccuauauuug

SEQ ID NO: 939208 - RNA, 19 nt, Homo sapiens
gugagagaagugugcaaua

SEQ ID NO: 939209 - RNA, 19 nt, Homo sapiens
gggagaaucacgagcaaca

SEQ ID NO: 939210 - RNA, 19 nt, Homo sapiens
uggcaucccuggagucuac

SEQ ID NO: 939211 - RNA, 19 nt, Homo sapiens
aaggugagaaggagacuuu

SEQ ID NO: 939212 - RNA, 19 nt, Homo sapiens
gcccucagagcaccaauau

SEQ ID NO: 939213 - RNA, 19 nt, Homo sapiens
acaaagagacaaggugaga

SEQ ID NO: 939214 - RNA, 19 nt, Homo sapiens
caauaucuccuccaucacu

SEQ ID NO: 939215 - RNA, 19 nt, Homo sapiens
ggaugaucaugaggaacaa

SEQ ID NO: 939216 - RNA, 19 nt, Homo sapiens
caccuauauuugcaaguau

SEQ ID NO: 939217 - RNA, 19 nt, Homo sapiens
caaagagacaaggugagaa

SEQ ID NO: 939218 - RNA, 19 nt, Homo sapiens
gugagaaggagacuuugga

SEQ ID NO: 939219 - RNA, 19 nt, Homo sapiens
gacgaggacaggccaaaca

SEQ ID NO: 939220 - RNA, 19 nt, Homo sapiens
aaagagacaaggugagaag

SEQ ID NO: 939221 - RNA, 19 nt, Homo sapiens
ugagaaggagacuuuggaa

SEQ ID NO: 939222 - RNA, 19 nt, Homo sapiens
ugacagccacguagaggau

SEQ ID NO: 939223 - RNA, 19 nt, Homo sapiens
caccgaagauuuucaaugg

SEQ ID NO: 939224 - RNA, 19 nt, Homo sapiens
gcagacaaagagacaaggu

SEQ ID NO: 939225 - RNA, 19 nt, Homo sapiens
cggaugaucaugaggaaca

SEQ ID NO: 939226 - RNA, 19 nt, Homo sapiens
ccugccagcccuucuaaga

SEQ ID NO: 939227 - RNA, 19 nt, Homo sapiens
ucccuggagucuacaccua

SEQ ID NO: 939228 - RNA, 19 nt, Homo sapiens
ugcaauagucuggaauaaa

SEQ ID NO: 939229 - RNA, 19 nt, Homo sapiens
gagaagugugcaauagucu

SEQ ID NO: 939230 - RNA, 19 nt, Homo sapiens
aauaucuccuccaucacuu

SEQ ID NO: 939231 - RNA, 19 nt, Homo sapiens
ggugagagaagugugcaau

SEQ ID NO: 939232 - RNA, 19 nt, Homo sapiens
gcaauagucuggaauaaau

SEQ ID NO: 939233 - RNA, 19 nt, Homo sapiens
gcaaguauguggacuggau

SEQ ID NO: 939234 - RNA, 19 nt, Homo sapiens
gaacuucuuggaacuuuaa

SEQ ID NO: 939235 - RNA, 19 nt, Homo sapiens
ggaacuucuuggaacuuua

SEQ ID NO: 939236 - RNA, 19 nt, Homo sapiens
guagguggacggagagaua

SEQ ID NO: 939237 - RNA, 19 nt, Homo sapiens
acaccuauauuugcaagua

SEQ ID NO: 939238 - RNA, 19 nt, Homo sapiens
gcaccaauaucuccuccau

SEQ ID NO: 939239 - RNA, 19 nt, Homo sapiens
gggaacuucuuggaacuuu

SEQ ID NO: 939240 - RNA, 19 nt, Homo sapiens
ugagagaagugugcaauag

SEQ ID NO: 939241 - RNA, 19 nt, Homo sapiens
gugcaauagucuggaauaa

SEQ ID NO: 939242 - RNA, 19 nt, Homo sapiens
ggagucuacaccuauauuu

SEQ ID NO: 939243 - RNA, 19 nt, Homo sapiens
accaauaucuccuccauca

SEQ ID NO: 939244 - RNA, 19 nt, Homo sapiens
gcagccacaccgaagauuu

SEQ ID NO: 939245 - RNA, 19 nt, Homo sapiens
gaucaugaggaacaacuga

SEQ ID NO: 939246 - RNA, 19 nt, Homo sapiens
gagaaucacgagcaacaug

SEQ ID NO: 939247 - RNA, 19 nt, Homo sapiens
ccucagagcaccaauaucu

SEQ ID NO: 939248 - RNA, 19 nt, Homo sapiens
ccuggagucuacaccuaua

SEQ ID NO: 939249 - RNA, 19 nt, Homo sapiens
agagaagugugcaauaguc

SEQ ID NO: 939250 - RNA, 19 nt, Homo sapiens
aaacagugacagccacgua

SEQ ID NO: 939251 - RNA, 19 nt, Homo sapiens
gagagaagugugcaauagu

SEQ ID NO: 939252 - RNA, 19 nt, Homo sapiens
gagucuacaccuauauuug

SEQ ID NO: 939253 - RNA, 19 nt, Homo sapiens
gugagagaagugugcaaua

SEQ ID NO: 939254 - RNA, 19 nt, Homo sapiens
gggagaaucacgagcaaca

SEQ ID NO: 939255 - RNA, 19 nt, Homo sapiens
uggcaucccuggagucuac

SEQ ID NO: 939256 - RNA, 19 nt, Homo sapiens
aaggugagaaggagacuuu

SEQ ID NO: 939257 - RNA, 19 nt, Homo sapiens
gcccucagagcaccaauau

SEQ ID NO: 939258 - RNA, 19 nt, Homo sapiens
acaaagagacaaggugaga

SEQ ID NO: 939259 - RNA, 19 nt, Homo sapiens
caauaucuccuccaucacu

SEQ ID NO: 939260 - RNA, 19 nt, Homo sapiens
ggaugaucaugaggaacaa

SEQ ID NO: 939261 - RNA, 19 nt, Homo sapiens
caccuauauuugcaaguau

SEQ ID NO: 939262 - RNA, 19 nt, Homo sapiens
caaagagacaaggugagaa

SEQ ID NO: 939263 - RNA, 19 nt, Homo sapiens
gugagaaggagacuuugga

SEQ ID NO: 939264 - RNA, 19 nt, Homo sapiens
gacgaggacaggccaaaca

SEQ ID NO: 939265 - RNA, 19 nt, Homo sapiens
aaagagacaaggugagaag

SEQ ID NO: 939266 - RNA, 19 nt, Homo sapiens
ugagaaggagacuuuggaa

SEQ ID NO: 939267 - RNA, 19 nt, Homo sapiens
ugacagccacguagaggau

SEQ ID NO: 939268 - RNA, 19 nt, Homo sapiens
caccgaagauuuucaaugg

SEQ ID NO: 939269 - RNA, 19 nt, Homo sapiens
gcagacaaagagacaaggu

SEQ ID NO: 939270 - RNA, 19 nt, Homo sapiens
cggaugaucaugaggaaca

SEQ ID NO: 939271 - RNA, 19 nt, Homo sapiens
ccugccagcccuucuaaga

SEQ ID NO: 939272 - RNA, 19 nt, Homo sapiens
ucccuggagucuacaccua

SEQ ID NO: 939273 - RNA, 19 nt, Homo sapiens
ugcaauagucuggaauaaa

SEQ ID NO: 939274 - RNA, 19 nt, Homo sapiens
gagaagugugcaauagucu

SEQ ID NO: 939275 - RNA, 19 nt, Homo sapiens
aauaucuccuccaucacuu

SEQ ID NO: 939276 - RNA, 19 nt, Homo sapiens
ggugagagaagugugcaau

SEQ ID NO: 939277 - RNA, 19 nt, Homo sapiens
gaacuuggcuauagucuug

SEQ ID NO: 939278 - RNA, 19 nt, Homo sapiens
gagaagcuauggaugauaa

SEQ ID NO: 939279 - RNA, 19 nt, Homo sapiens
gaccgaagauugccguuua

SEQ ID NO: 939280 - RNA, 19 nt, Homo sapiens
gaaagauaguucuguggua

SEQ ID NO: 939281 - RNA, 19 nt, Homo sapiens
ugacuaacaucguuucuaa

SEQ ID NO: 939282 - RNA, 19 nt, Homo sapiens
gaagauugccguuuaagaa

SEQ ID NO: 939283 - RNA, 19 nt, Homo sapiens
gcgaauacuuucagaguuu

SEQ ID NO: 939284 - RNA, 19 nt, Homo sapiens
gaaaagaaaugcaguguug

SEQ ID NO: 939285 - RNA, 19 nt, Homo sapiens
caaagucucuugagcauuc

SEQ ID NO: 939286 - RNA, 19 nt, Homo sapiens
aaagaaagcugauugacau

SEQ ID NO: 939287 - RNA, 19 nt, Homo sapiens
gaaaacaguucucaaaaga

SEQ ID NO: 939288 - RNA, 19 nt, Homo sapiens
gcacgggucuccuguguca

SEQ ID NO: 939289 - RNA, 19 nt, Homo sapiens
gaaacuuguuguacuauuc

SEQ ID NO: 939290 - RNA, 19 nt, Homo sapiens
ucucagaagucaucuuuaa

SEQ ID NO: 939291 - RNA, 19 nt, Homo sapiens
gagacucccuaucuauuaa

SEQ ID NO: 939292 - RNA, 19 nt, Homo sapiens
agaaggcccugaucauuaa

SEQ ID NO: 939293 - RNA, 19 nt, Homo sapiens
ggucuucaccgucauguua

SEQ ID NO: 939294 - RNA, 19 nt, Homo sapiens
ugacaggccucaagugcua

SEQ ID NO: 939295 - RNA, 19 nt, Homo sapiens
caauagaaccacuucauaa

SEQ ID NO: 939296 - RNA, 19 nt, Homo sapiens
aaagagaagugucauuguu

SEQ ID NO: 939297 - RNA, 19 nt, Homo sapiens
caacguguccuaauagaaa

SEQ ID NO: 939298 - RNA, 19 nt, Homo sapiens
ggaggaggcugaagaagag

SEQ ID NO: 939299 - RNA, 19 nt, Homo sapiens
caaaggaaauggucaaggu

SEQ ID NO: 939300 - RNA, 19 nt, Homo sapiens
gcacaugucucaggcuuca

SEQ ID NO: 939301 - RNA, 19 nt, Homo sapiens
gauagaaacuuguuguacu

SEQ ID NO: 939302 - RNA, 19 nt, Homo sapiens
gaagugucauuguuuguca

SEQ ID NO: 939303 - RNA, 19 nt, Homo sapiens
ggauuuccuuucugacuaa

SEQ ID NO: 939304 - RNA, 19 nt, Homo sapiens
gaaagcugauugacauagu

SEQ ID NO: 939305 - RNA, 19 nt, Homo sapiens
gaauaaagacgaauuuggu

SEQ ID NO: 939306 - RNA, 19 nt, Homo sapiens
gaaacgaagcgcaaggaaa

SEQ ID NO: 939307 - RNA, 19 nt, Homo sapiens
gagagcaagugugaguaua

SEQ ID NO: 939308 - RNA, 19 nt, Homo sapiens
aagaaggcccugaucauua

SEQ ID NO: 939309 - RNA, 19 nt, Homo sapiens
ugacugaggugcgcauaaa

SEQ ID NO: 939310 - RNA, 19 nt, Homo sapiens
caucuucgguguccaguga

SEQ ID NO: 939311 - RNA, 19 nt, Homo sapiens
ccaauagaaccacuucaua

SEQ ID NO: 939312 - RNA, 19 nt, Homo sapiens
gaagauagaaacuuguugu

SEQ ID NO: 939313 - RNA, 19 nt, Homo sapiens
gggauuuccuuucugacua

SEQ ID NO: 939314 - RNA, 19 nt, Homo sapiens
cgaauacuuucagaguuua

SEQ ID NO: 939315 - RNA, 19 nt, Homo sapiens
gacaacguguucagugauu

SEQ ID NO: 939316 - RNA, 19 nt, Homo sapiens
guuuguagcucaucagaga

SEQ ID NO: 939317 - RNA, 19 nt, Homo sapiens
uaagcucucuucucuccua

SEQ ID NO: 939318 - RNA, 19 nt, Homo sapiens
gaaaagaguuggccgaaag

SEQ ID NO: 939319 - RNA, 19 nt, Homo sapiens
gcaagugugaguauaagaa

SEQ ID NO: 939320 - RNA, 19 nt, Homo sapiens
gagcacgggucuccugugu

SEQ ID NO: 939321 - RNA, 19 nt, Homo sapiens
gaaaaugagucacaaacug

SEQ ID NO: 939322 - RNA, 19 nt, Homo sapiens
ggaauguguugugugcuuu

SEQ ID NO: 939323 - RNA, 19 nt, Homo sapiens
ggaaucggcacauaaggaa

SEQ ID NO: 939324 - RNA, 19 nt, Homo sapiens
agacgaauuuggugaguug

SEQ ID NO: 939325 - RNA, 19 nt, Homo sapiens
gggaauguguugugugcuu

SEQ ID NO: 939326 - RNA, 19 nt, Homo sapiens
gcacagcaagucaucaaga

SEQ ID NO: 939327 - RNA, 19 nt, Homo sapiens
uaagaaggcccugaucauu

SEQ ID NO: 939328 - RNA, 19 nt, Homo sapiens
ugagagagagagaaauuaa

SEQ ID NO: 939329 - RNA, 19 nt, Homo sapiens
caaagaaagcugauugaca

SEQ ID NO: 939330 - RNA, 19 nt, Homo sapiens
gaaacuaacaaaggaaaug

SEQ ID NO: 939331 - RNA, 19 nt, Homo sapiens
aaagauaguucugugguau

SEQ ID NO: 939332 - RNA, 19 nt, Homo sapiens
cgaacaaacacacaauuga

SEQ ID NO: 939333 - RNA, 19 nt, Homo sapiens
ucagaggaaucggcacaua

SEQ ID NO: 939334 - RNA, 19 nt, Homo sapiens
gcuauagucuugggauuuc

SEQ ID NO: 939335 - RNA, 19 nt, Homo sapiens
cgcuuucucucucaauuua

SEQ ID NO: 939336 - RNA, 19 nt, Homo sapiens
gcccuacgcuugugacauc

SEQ ID NO: 939337 - RNA, 19 nt, Homo sapiens
gccaaaggagcuuacauuu

SEQ ID NO: 939338 - RNA, 19 nt, Homo sapiens
cuugagaucucgagccaaa

SEQ ID NO: 939339 - RNA, 19 nt, Homo sapiens
agagacucccuaucuauua

SEQ ID NO: 939340 - RNA, 19 nt, Homo sapiens
gaugauaaaccagguguga

SEQ ID NO: 939341 - RNA, 19 nt, Homo sapiens
uagaaucaguuuggugaaa

SEQ ID NO: 939342 - RNA, 19 nt, Homo sapiens
agagaagugucauuguuug

SEQ ID NO: 939343 - RNA, 19 nt, Homo sapiens
uuuccaacguguccuaaua

SEQ ID NO: 939344 - RNA, 19 nt, Homo sapiens
gaauguguugugugcuuua

SEQ ID NO: 939345 - RNA, 19 nt, Homo sapiens
ucaaaggacagcuguguga

SEQ ID NO: 939346 - RNA, 19 nt, Homo sapiens
caucagagacucccuaucu

SEQ ID NO: 939347 - RNA, 19 nt, Homo sapiens
gagcaagugugaguauaag

SEQ ID NO: 939348 - RNA, 19 nt, Homo sapiens
cuucaaagccucugcaaga

SEQ ID NO: 939349 - RNA, 19 nt, Homo sapiens
ucaaggccaauaccaauaa

SEQ ID NO: 939350 - RNA, 19 nt, Homo sapiens
gugaugugcugcugauugu

SEQ ID NO: 939351 - RNA, 19 nt, Homo sapiens
gugaaaccauuuauuuguc

SEQ ID NO: 939352 - RNA, 19 nt, Homo sapiens
aaacauugccuuaagaucu

SEQ ID NO: 939353 - RNA, 19 nt, Homo sapiens
gauugccguuuaagaaguu

SEQ ID NO: 939354 - RNA, 19 nt, Homo sapiens
acagagaagcuauggauga

SEQ ID NO: 939355 - RNA, 19 nt, Homo sapiens
cagagaagcuauggaugau

SEQ ID NO: 939356 - RNA, 19 nt, Homo sapiens
caacaaaguaaaccacauc

SEQ ID NO: 939357 - RNA, 19 nt, Homo sapiens
ggacauucaagacugcauu

SEQ ID NO: 939358 - RNA, 19 nt, Homo sapiens
cagaggaaucggcacauaa

SEQ ID NO: 939359 - RNA, 19 nt, Homo sapiens
uaucucagaagucaucuuu

SEQ ID NO: 939360 - RNA, 19 nt, Homo sapiens
aaaguuaggcuuagugauc

SEQ ID NO: 939361 - RNA, 19 nt, Homo sapiens
gaaauggucaaggugaaga

SEQ ID NO: 939362 - RNA, 19 nt, Homo sapiens
uaacaaaggaaauggucaa

SEQ ID NO: 939363 - RNA, 19 nt, Homo sapiens
gcaccagguugaaguccau

SEQ ID NO: 939364 - RNA, 19 nt, Homo sapiens
agagagagagaaauuaaga

SEQ ID NO: 939365 - RNA, 19 nt, Homo sapiens
caacacggcauagugaaga

SEQ ID NO: 939366 - RNA, 19 nt, Homo sapiens
ggucuccugugucagaaga

SEQ ID NO: 939367 - RNA, 19 nt, Homo sapiens
gaugugcugcugauuguug

SEQ ID NO: 939368 - RNA, 19 nt, Homo sapiens
agaagcggguccuagcaaa

SEQ ID NO: 939369 - RNA, 19 nt, Homo sapiens
cgcccgagcugaagcaaga

SEQ ID NO: 939370 - RNA, 19 nt, Homo sapiens
acaagagguuucacaccaa

SEQ ID NO: 939371 - RNA, 19 nt, Homo sapiens
ugagcagacucccagcaaa

SEQ ID NO: 939372 - RNA, 19 nt, Homo sapiens
aaacuguauuucagcuuga

SEQ ID NO: 939373 - RNA, 19 nt, Homo sapiens
cagagacucccuaucuauu

SEQ ID NO: 939374 - RNA, 19 nt, Homo sapiens
gaugaaaacaguucucaaa

SEQ ID NO: 939375 - RNA, 19 nt, Homo sapiens
cgagaagugugggaagaug

SEQ ID NO: 939376 - RNA, 19 nt, Homo sapiens
gagagagagaaauuaagaa

SEQ ID NO: 939377 - RNA, 19 nt, Homo sapiens
ggaagaagcucgacaguuu

SEQ ID NO: 939378 - RNA, 19 nt, Homo sapiens
gcaaugcaaucaauguuua

SEQ ID NO: 939379 - RNA, 19 nt, Homo sapiens
gaaauggacccuucagaua

SEQ ID NO: 939380 - RNA, 19 nt, Homo sapiens
gaauaaacgucaugauguu

SEQ ID NO: 939381 - RNA, 19 nt, Homo sapiens
gaagaauucuggcaguauu

SEQ ID NO: 939382 - RNA, 19 nt, Homo sapiens
ggagauggaacuucuaaua

SEQ ID NO: 939383 - RNA, 19 nt, Homo sapiens
ggagauaaacacuuugaua

SEQ ID NO: 939384 - RNA, 19 nt, Homo sapiens
gaaauacgaaucugaaaga

SEQ ID NO: 939385 - RNA, 19 nt, Homo sapiens
ccaaguccaucaacagaua

SEQ ID NO: 939386 - RNA, 19 nt, Homo sapiens
gaagaacaguuaacuagag

SEQ ID NO: 939387 - RNA, 19 nt, Homo sapiens
gguaaaggcucaucauaca

SEQ ID NO: 939388 - RNA, 19 nt, Homo sapiens
gaacaagaagcccgaauug

SEQ ID NO: 939389 - RNA, 19 nt, Homo sapiens
gauggaacuucuaauacua

SEQ ID NO: 939390 - RNA, 19 nt, Homo sapiens
caacagcagugaugccaaa

SEQ ID NO: 939391 - RNA, 19 nt, Homo sapiens
gcagugauguucuguuuag

SEQ ID NO: 939392 - RNA, 19 nt, Homo sapiens
gcaagaaaccuaauagcuu

SEQ ID NO: 939393 - RNA, 19 nt, Homo sapiens
ucaagcugcugguggauua

SEQ ID NO: 939394 - RNA, 19 nt, Homo sapiens
gaucaaaggaugacaguga

SEQ ID NO: 939395 - RNA, 19 nt, Homo sapiens
gaagacagaugcucaaagc

SEQ ID NO: 939396 - RNA, 19 nt, Homo sapiens
guaaggaggugcuaaugau

SEQ ID NO: 939397 - RNA, 19 nt, Homo sapiens
ugaguacccuuguuaauau

SEQ ID NO: 939398 - RNA, 19 nt, Homo sapiens
gcaauguccugaucucuuc

SEQ ID NO: 939399 - RNA, 19 nt, Homo sapiens
uauagaaucucaucccaaa

SEQ ID NO: 939400 - RNA, 19 nt, Homo sapiens
acagaaaggucaauuuguu

SEQ ID NO: 939401 - RNA, 19 nt, Homo sapiens
gaacaacagaggcaagaaa

SEQ ID NO: 939402 - RNA, 19 nt, Homo sapiens
gaacaauugcagaaucuaa

SEQ ID NO: 939403 - RNA, 19 nt, Homo sapiens
gaagaagaacaguuaacua

SEQ ID NO: 939404 - RNA, 19 nt, Homo sapiens
gcaggacucuuacaugcaa

SEQ ID NO: 939405 - RNA, 19 nt, Homo sapiens
gaagugcaguuacaagcaa

SEQ ID NO: 939406 - RNA, 19 nt, Homo sapiens
cgacgaagcuuaaauuuug

SEQ ID NO: 939407 - RNA, 19 nt, Homo sapiens
caauagucaugacaaagua

SEQ ID NO: 939408 - RNA, 19 nt, Homo sapiens
gcaaagaugaugauggaaa

SEQ ID NO: 939409 - RNA, 19 nt, Homo sapiens
guacuguucccuucacuua

SEQ ID NO: 939410 - RNA, 19 nt, Homo sapiens
gaacagauugaacaaagaa

SEQ ID NO: 939411 - RNA, 19 nt, Homo sapiens
aaauucagcucaagcauga

SEQ ID NO: 939412 - RNA, 19 nt, Homo sapiens
gcagaaggccucacgcaaa

SEQ ID NO: 939413 - RNA, 19 nt, Homo sapiens
ugcaauaacuguucagaaa

SEQ ID NO: 939414 - RNA, 19 nt, Homo sapiens
gaagaagaagcuaagguaa

SEQ ID NO: 939415 - RNA, 19 nt, Homo sapiens
ggaugacagugauaaagaa

SEQ ID NO: 939416 - RNA, 19 nt, Homo sapiens
uaaugaugcuggauaacua

SEQ ID NO: 939417 - RNA, 19 nt, Homo sapiens
ggaacagauugaacaaaga

SEQ ID NO: 939418 - RNA, 19 nt, Homo sapiens
uuaaugagcuacaggaaga

SEQ ID NO: 939419 - RNA, 19 nt, Homo sapiens
caaagucagugcugugguu

SEQ ID NO: 939420 - RNA, 19 nt, Homo sapiens
gugauguucuguuuaguaa

SEQ ID NO: 939421 - RNA, 19 nt, Homo sapiens
gcucaugggcaaacaauaa

SEQ ID NO: 939422 - RNA, 19 nt, Homo sapiens
gaagaggaaagaacaagaa

SEQ ID NO: 939423 - RNA, 19 nt, Homo sapiens
gaauaugaacagaggcuua

SEQ ID NO: 939424 - RNA, 19 nt, Homo sapiens
gaucaacgacgcaggauga

SEQ ID NO: 939425 - RNA, 19 nt, Homo sapiens
ccacuuucauucaggauuu

SEQ ID NO: 939426 - RNA, 19 nt, Homo sapiens
ggagagaucacuagaauac

SEQ ID NO: 939427 - RNA, 19 nt, Homo sapiens
gaacaguuaacuagagaaa

SEQ ID NO: 939428 - RNA, 19 nt, Homo sapiens
caagagaugagcuguguuu

SEQ ID NO: 939429 - RNA, 19 nt, Homo sapiens
uaacagcccuugaacacau

SEQ ID NO: 939430 - RNA, 19 nt, Homo sapiens
gaauguggcagaucagauu

SEQ ID NO: 939431 - RNA, 19 nt, Homo sapiens
ccaaagaucuucuaaaaca

SEQ ID NO: 939432 - RNA, 19 nt, Homo sapiens
ggcgugaacugucagauga

SEQ ID NO: 939433 - RNA, 19 nt, Homo sapiens
gaaggcacauggaacagau

SEQ ID NO: 939434 - RNA, 19 nt, Homo sapiens
ggaaguggaaggaagaauu

SEQ ID NO: 939435 - RNA, 19 nt, Homo sapiens
gcaguauucgagacaauua

SEQ ID NO: 939436 - RNA, 19 nt, Homo sapiens
gacuggagauaaacacuuu

SEQ ID NO: 939437 - RNA, 19 nt, Homo sapiens
uaggagagaucacuagaau

SEQ ID NO: 939438 - RNA, 19 nt, Homo sapiens
gcucaagcaugaugaaagu

SEQ ID NO: 939439 - RNA, 19 nt, Homo sapiens
gaagcuaagguaaaugaaa

SEQ ID NO: 939440 - RNA, 19 nt, Homo sapiens
agaagaagcuaagguaaau

SEQ ID NO: 939441 - RNA, 19 nt, Homo sapiens
gaaguggaaggaagaauug

SEQ ID NO: 939442 - RNA, 19 nt, Homo sapiens
aaagagugauggcuucauu

SEQ ID NO: 939443 - RNA, 19 nt, Homo sapiens
ggauaacuauguaagagau

SEQ ID NO: 939444 - RNA, 19 nt, Homo sapiens
aagcaaagaugaugaugga

SEQ ID NO: 939445 - RNA, 19 nt, Homo sapiens
cagaucagauugcauuuca

SEQ ID NO: 939446 - RNA, 19 nt, Homo sapiens
gaugaaagcauacagaaag

SEQ ID NO: 939447 - RNA, 19 nt, Homo sapiens
uguaagagauuucaaagca

SEQ ID NO: 939448 - RNA, 19 nt, Homo sapiens
cuauguaacuugcgaauca

SEQ ID NO: 939449 - RNA, 19 nt, Homo sapiens
gaacaugggucugauugac

SEQ ID NO: 939450 - RNA, 19 nt, Homo sapiens
ccuaauagcuuggaguguu

SEQ ID NO: 939451 - RNA, 19 nt, Homo sapiens
gcacagcagcuaagggaaa

SEQ ID NO: 939452 - RNA, 19 nt, Homo sapiens
gcagugggaguguuucuuu

SEQ ID NO: 939453 - RNA, 19 nt, Homo sapiens
gaugcuggauaacuaugua

SEQ ID NO: 939454 - RNA, 19 nt, Homo sapiens
ugagcuggcuaacagauuu

SEQ ID NO: 939455 - RNA, 19 nt, Homo sapiens
ggucauacagcauauuuga

SEQ ID NO: 939456 - RNA, 19 nt, Homo sapiens
acaagaagcccgaauugaa

SEQ ID NO: 939457 - RNA, 19 nt, Homo sapiens
uggcagaaguccuugcuaa

SEQ ID NO: 939458 - RNA, 19 nt, Homo sapiens
caaauuccauggcagaagu

SEQ ID NO: 939459 - RNA, 19 nt, Homo sapiens
cagaguaucuuggaguuug

SEQ ID NO: 939460 - RNA, 19 nt, Homo sapiens
gauauggcauguacuuuac

SEQ ID NO: 939461 - RNA, 19 nt, Homo sapiens
acacauccuucaagcagua

SEQ ID NO: 939462 - RNA, 19 nt, Homo sapiens
gacaugcaaauacugauua

SEQ ID NO: 939463 - RNA, 19 nt, Homo sapiens
uguucgaacuucugaaaua

SEQ ID NO: 939464 - RNA, 19 nt, Homo sapiens
caacagaagccacaagauc

SEQ ID NO: 939465 - RNA, 19 nt, Homo sapiens
caguugggcugacaaggua

SEQ ID NO: 939466 - RNA, 19 nt, Homo sapiens
ugaauguucuacuugcuaa

SEQ ID NO: 939467 - RNA, 19 nt, Homo sapiens
gcagccaagucuccuguga

SEQ ID NO: 939468 - RNA, 19 nt, Homo sapiens
ggaaggucauacagcauau

SEQ ID NO: 939469 - RNA, 19 nt, Homo sapiens
ggaagagcgucagagaaga

SEQ ID NO: 939470 - RNA, 19 nt, Homo sapiens
gguaauuuccaucuuauga

SEQ ID NO: 939471 - RNA, 19 nt, Homo sapiens
aaacaaacccucacaaggu

SEQ ID NO: 939472 - RNA, 19 nt, Homo sapiens
uaauggaccuccugauaca

SEQ ID NO: 939473 - RNA, 19 nt, Homo sapiens
gcaggcccguguagaagaa

SEQ ID NO: 939474 - RNA, 19 nt, Homo sapiens
gaaauugaagcugaagaaa

SEQ ID NO: 939475 - RNA, 19 nt, Homo sapiens
gagaaagcaaggauagaaa

SEQ ID NO: 939476 - RNA, 19 nt, Homo sapiens
aaaccuaaaugucaaacug

SEQ ID NO: 939477 - RNA, 19 nt, Homo sapiens
gcucagagaguaaauauga

SEQ ID NO: 939478 - RNA, 19 nt, Homo sapiens
ccaagauagugguguauaa

SEQ ID NO: 939479 - RNA, 19 nt, Homo sapiens
ggaauuccaucugcggaua

SEQ ID NO: 939480 - RNA, 19 nt, Homo sapiens
gaacuucuccgagguauuc

SEQ ID NO: 939481 - RNA, 19 nt, Homo sapiens
cauuaaugaucccaagaua

SEQ ID NO: 939482 - RNA, 19 nt, Homo sapiens
gcacaaaauccgugucuua

SEQ ID NO: 939483 - RNA, 19 nt, Homo sapiens
ucucugugcuggcauuuaa

SEQ ID NO: 939484 - RNA, 19 nt, Homo sapiens
cgacagagcaaacccgaaa

SEQ ID NO: 939485 - RNA, 19 nt, Homo sapiens
gugcaggucuggucuuuag

SEQ ID NO: 939486 - RNA, 19 nt, Homo sapiens
aauaugagaucgccucugu

SEQ ID NO: 939487 - RNA, 19 nt, Homo sapiens
gacaaggaacgacaacauu

SEQ ID NO: 939488 - RNA, 19 nt, Homo sapiens
ggaaaaugaucacggaguu

SEQ ID NO: 939489 - RNA, 19 nt, Homo sapiens
gagcucagagaguaaauau

SEQ ID NO: 939490 - RNA, 19 nt, Homo sapiens
gaauggcacugcaaaauag

SEQ ID NO: 939491 - RNA, 19 nt, Homo sapiens
gaacacccuucagauccuu

SEQ ID NO: 939492 - RNA, 19 nt, Homo sapiens
uuaaucacgugacuuggaa

SEQ ID NO: 939493 - RNA, 19 nt, Homo sapiens
gaacgacaacauucccaau

SEQ ID NO: 939494 - RNA, 19 nt, Homo sapiens
guugggagcuaugauggaa

SEQ ID NO: 939495 - RNA, 19 nt, Homo sapiens
gcaguugggagcuaugaug

SEQ ID NO: 939496 - RNA, 19 nt, Homo sapiens
gaaaaugggcauaggaaug

SEQ ID NO: 939497 - RNA, 19 nt, Homo sapiens
gaauuccaucugcggauaa

SEQ ID NO: 939498 - RNA, 19 nt, Homo sapiens
gcagaaacagggcuacucu

SEQ ID NO: 939499 - RNA, 19 nt, Homo sapiens
uuaaugaucccaagauagu

SEQ ID NO: 939500 - RNA, 19 nt, Homo sapiens
gcaaagauuacgugagcau

SEQ ID NO: 939501 - RNA, 19 nt, Homo sapiens
uggauucagugauugauuc

SEQ ID NO: 939502 - RNA, 19 nt, Homo sapiens
ggucuggauucagugauug

SEQ ID NO: 939503 - RNA, 19 nt, Homo sapiens
agauagugguguauaagga

SEQ ID NO: 939504 - RNA, 19 nt, Homo sapiens
caaaauccgugucuuacau

SEQ ID NO: 939505 - RNA, 19 nt, Homo sapiens
ggauaaccgucugguccuu

SEQ ID NO: 939506 - RNA, 19 nt, Homo sapiens
agauucugcuguacucauu

SEQ ID NO: 939507 - RNA, 19 nt, Homo sapiens
cgauggcccuccucagcaa

SEQ ID NO: 939508 - RNA, 19 nt, Homo sapiens
cgacaaggaacgacaacau

SEQ ID NO: 939509 - RNA, 19 nt, Homo sapiens
aagcuugucugcagggaau

SEQ ID NO: 939510 - RNA, 19 nt, Homo sapiens
cgaauggcacugcaaaaua

SEQ ID NO: 939511 - RNA, 19 nt, Homo sapiens
gugguggucuggauucagu

SEQ ID NO: 939512 - RNA, 19 nt, Homo sapiens
uagcagcggugcacuaacg

SEQ ID NO: 939513 - RNA, 19 nt, Homo sapiens
gucccagucuccuuacaga

SEQ ID NO: 939514 - RNA, 19 nt, Homo sapiens
ucagagaguaaauaugaga

SEQ ID NO: 939515 - RNA, 19 nt, Homo sapiens
acaagauucugcuguacuc

SEQ ID NO: 939516 - RNA, 19 nt, Homo sapiens
caaauacccgaaagcuugu

SEQ ID NO: 939517 - RNA, 19 nt, Homo sapiens
acacgugccuagaccagau

SEQ ID NO: 939518 - RNA, 19 nt, Homo sapiens
acaaggaacgacaacauuc

SEQ ID NO: 939519 - RNA, 19 nt, Homo sapiens
ccagcuuacucugcaaguu

SEQ ID NO: 939520 - RNA, 19 nt, Homo sapiens
caugaacuucuccgaggua

SEQ ID NO: 939521 - RNA, 19 nt, Homo sapiens
gggcauccugcagccauua

SEQ ID NO: 939522 - RNA, 19 nt, Homo sapiens
caacaccacggaauuccau

SEQ ID NO: 939523 - RNA, 19 nt, Homo sapiens
cucccgagcucagagagua

SEQ ID NO: 939524 - RNA, 19 nt, Homo sapiens
caagauagugguguauaag

SEQ ID NO: 939525 - RNA, 19 nt, Homo sapiens
cagcuuacucugcaaguuc

SEQ ID NO: 939526 - RNA, 19 nt, Homo sapiens
gccgguuguuguccacgua

SEQ ID NO: 939527 - RNA, 19 nt, Homo sapiens
ggacacccaggaucucaca

SEQ ID NO: 939528 - RNA, 19 nt, Homo sapiens
uuacaucaaauacccgaaa

SEQ ID NO: 939529 - RNA, 19 nt, Homo sapiens
auccgugucuuacaucaaa

SEQ ID NO: 939530 - RNA, 19 nt, Homo sapiens
cauuuaguccugacagcua

SEQ ID NO: 939531 - RNA, 19 nt, Homo sapiens
cuacauggcgcuggcagaa

SEQ ID NO: 939532 - RNA, 19 nt, Homo sapiens
gcuacuuccuggcgacaag

SEQ ID NO: 939533 - RNA, 19 nt, Homo sapiens
gggcuacucuguguuucca

SEQ ID NO: 939534 - RNA, 19 nt, Homo sapiens
cguagcagcggugcacuaa

SEQ ID NO: 939535 - RNA, 19 nt, Homo sapiens
cagacacugaaaccuguua

SEQ ID NO: 939536 - RNA, 19 nt, Homo sapiens
ucacgugacuuggaaaaug

SEQ ID NO: 939537 - RNA, 19 nt, Homo sapiens
acuaacgugugcagaaaca

SEQ ID NO: 939538 - RNA, 19 nt, Homo sapiens
gaaaaugaucacggaguuu

SEQ ID NO: 939539 - RNA, 19 nt, Homo sapiens
acaccugcuuggaguacaa

SEQ ID NO: 939540 - RNA, 19 nt, Homo sapiens
uguauaaggaggccgagaa

SEQ ID NO: 939541 - RNA, 19 nt, Homo sapiens
gcaggucuggucuuuagag

SEQ ID NO: 939542 - RNA, 19 nt, Homo sapiens
cgagcucagagaguaaaua

SEQ ID NO: 939543 - RNA, 19 nt, Homo sapiens
ccauuaaugaucccaagau

SEQ ID NO: 939544 - RNA, 19 nt, Homo sapiens
gcaucuucgucugcaguga

SEQ ID NO: 939545 - RNA, 19 nt, Homo sapiens
uggucuggauucagugauu

SEQ ID NO: 939546 - RNA, 19 nt, Homo sapiens
uagaccagauccagcacau

SEQ ID NO: 939547 - RNA, 19 nt, Homo sapiens
gcccgaauggcacugcaaa

SEQ ID NO: 939548 - RNA, 19 nt, Homo sapiens
ugggagcuaugauggaaag

SEQ ID NO: 939549 - RNA, 19 nt, Homo sapiens
ggacaccugcuuggaguac

SEQ ID NO: 939550 - RNA, 19 nt, Homo sapiens
ggcgcgacugcaaagauua

SEQ ID NO: 939551 - RNA, 19 nt, Homo sapiens
cagacucgcucuucauccu

SEQ ID NO: 939552 - RNA, 19 nt, Homo sapiens
ggacaucagcucuucauua

SEQ ID NO: 939553 - RNA, 19 nt, Homo sapiens
gaagacagcuggagagagu

SEQ ID NO: 939554 - RNA, 19 nt, Homo sapiens
ggaaagggcagcauuauga

SEQ ID NO: 939555 - RNA, 19 nt, Homo sapiens
cuagagagcuguauuccua

SEQ ID NO: 939556 - RNA, 19 nt, Homo sapiens
ccugaacucuucuuucuua

SEQ ID NO: 939557 - RNA, 19 nt, Homo sapiens
gacaucagcucuucauuau

SEQ ID NO: 939558 - RNA, 19 nt, Homo sapiens
ggacagagcccaccagaca

SEQ ID NO: 939559 - RNA, 19 nt, Homo sapiens
gaacagagggacugagauc

SEQ ID NO: 939560 - RNA, 19 nt, Homo sapiens
caucagcucuucauuaugc

SEQ ID NO: 939561 - RNA, 19 nt, Homo sapiens
guacugaauuguccucauc

SEQ ID NO: 939562 - RNA, 19 nt, Homo sapiens
cuucaaagaugccucaguu

SEQ ID NO: 939563 - RNA, 19 nt, Homo sapiens
gcccaggccuguuucaaga

SEQ ID NO: 939564 - RNA, 19 nt, Homo sapiens
gaauuguccucaucuugug

SEQ ID NO: 939565 - RNA, 19 nt, Homo sapiens
gagauaauuucugcaagga

SEQ ID NO: 939566 - RNA, 19 nt, Homo sapiens
gcaggaagacucagagcaa

SEQ ID NO: 939567 - RNA, 19 nt, Homo sapiens
gaagagaagcgaggcauca

SEQ ID NO: 939568 - RNA, 19 nt, Homo sapiens
aggaggacaugcucagaua

SEQ ID NO: 939569 - RNA, 19 nt, Homo sapiens
gaauaagcccgcagauaca

SEQ ID NO: 939570 - RNA, 19 nt, Homo sapiens
agacagagcagacccagaa

SEQ ID NO: 939571 - RNA, 19 nt, Homo sapiens
ggucuuaguguuuaaaguu

SEQ ID NO: 939572 - RNA, 19 nt, Homo sapiens
ggagagaguuuggcuuguc

SEQ ID NO: 939573 - RNA, 19 nt, Homo sapiens
caacuugcauaccaguguu

SEQ ID NO: 939574 - RNA, 19 nt, Homo sapiens
gagcaggacagaagccaaa

SEQ ID NO: 939575 - RNA, 19 nt, Homo sapiens
caucuacccuaaugcauca

SEQ ID NO: 939576 - RNA, 19 nt, Homo sapiens
gaacucuucuuucuuaccu

SEQ ID NO: 939577 - RNA, 19 nt, Homo sapiens
acacaggaguccaccaaug

SEQ ID NO: 939578 - RNA, 19 nt, Homo sapiens
ucucugacaucucucuauu

SEQ ID NO: 939579 - RNA, 19 nt, Homo sapiens
ccagagccaggaaagaaua

SEQ ID NO: 939580 - RNA, 19 nt, Homo sapiens
caagaggaaucagacaaca

SEQ ID NO: 939581 - RNA, 19 nt, Homo sapiens
gagcuguauuccuacuuga

SEQ ID NO: 939582 - RNA, 19 nt, Homo sapiens
caaagauggaugcaaguga

SEQ ID NO: 939583 - RNA, 19 nt, Homo sapiens
gccaggcaguggucaaaga

SEQ ID NO: 939584 - RNA, 19 nt, Homo sapiens
cacaggaggccaccaauga

SEQ ID NO: 939585 - RNA, 19 nt, Homo sapiens
ggaaucagacaacagagau

SEQ ID NO: 939586 - RNA, 19 nt, Homo sapiens
gaaggcaagaggaaucaga

SEQ ID NO: 939587 - RNA, 19 nt, Homo sapiens
agaauaagcccgcagauac

SEQ ID NO: 939588 - RNA, 19 nt, Homo sapiens
ggacagcagccaccagaca

SEQ ID NO: 939589 - RNA, 19 nt, Homo sapiens
ggacagcagccaccagaca

SEQ ID NO: 939590 - RNA, 19 nt, Homo sapiens
ggagaaggcaagaggaauc

SEQ ID NO: 939591 - RNA, 19 nt, Homo sapiens
gagaagcaccaagccauga

SEQ ID NO: 939592 - RNA, 19 nt, Homo sapiens
ccagagagacagccacaga

SEQ ID NO: 939593 - RNA, 19 nt, Homo sapiens
uuaugcagcuucccuuuua

SEQ ID NO: 939594 - RNA, 19 nt, Homo sapiens
aagaauaagcccgcagaua

SEQ ID NO: 939595 - RNA, 19 nt, Homo sapiens
ugaauuguccucaucuugu

SEQ ID NO: 939596 - RNA, 19 nt, Homo sapiens
gggaaagggcagcauuaug

SEQ ID NO: 939597 - RNA, 19 nt, Homo sapiens
cuacccuaaugcaucaaua

SEQ ID NO: 939598 - RNA, 19 nt, Homo sapiens
caaagaugccucaguuacu

SEQ ID NO: 939599 - RNA, 19 nt, Homo sapiens
ggugaggaauggguugaug

SEQ ID NO: 939600 - RNA, 19 nt, Homo sapiens
gggagcagccacagacaga

SEQ ID NO: 939601 - RNA, 19 nt, Homo sapiens
agagcuguauuccuacuug

SEQ ID NO: 939602 - RNA, 19 nt, Homo sapiens
ggaugcagcccagucagaa

SEQ ID NO: 939603 - RNA, 19 nt, Homo sapiens
gcaagaggaaucagacaac

SEQ ID NO: 939604 - RNA, 19 nt, Homo sapiens
gaaagggcagcauuaugag

SEQ ID NO: 939605 - RNA, 19 nt, Homo sapiens
aaacauuaaugggaucauc

SEQ ID NO: 939606 - RNA, 19 nt, Homo sapiens
ggaauuccuggucuuagug

SEQ ID NO: 939607 - RNA, 19 nt, Homo sapiens
cacagugguuggugaggaa

SEQ ID NO: 939608 - RNA, 19 nt, Homo sapiens
ucaaagaugccucaguuac

SEQ ID NO: 939609 - RNA, 19 nt, Homo sapiens
cagaacagagggacugaga

SEQ ID NO: 939610 - RNA, 19 nt, Homo sapiens
cagaacagagggacugaga

SEQ ID NO: 939611 - RNA, 19 nt, Homo sapiens
cgacuccaauguccaguac

SEQ ID NO: 939612 - RNA, 19 nt, Homo sapiens
ggucacacaccgagacugu

SEQ ID NO: 939613 - RNA, 19 nt, Homo sapiens
gaggacacacucagauaca

SEQ ID NO: 939614 - RNA, 19 nt, Homo sapiens
ggaggacacacucagauac

SEQ ID NO: 939615 - RNA, 19 nt, Homo sapiens
gaggacaugcucagauaca

SEQ ID NO: 939616 - RNA, 19 nt, Homo sapiens
agaguuugccgaugugauu

SEQ ID NO: 939617 - RNA, 19 nt, Homo sapiens
agaggaaucagacaacaga

SEQ ID NO: 939618 - RNA, 19 nt, Homo sapiens
gagaaggcaagaggaauca

SEQ ID NO: 939619 - RNA, 19 nt, Homo sapiens
gaggggagcugaaaagacu

SEQ ID NO: 939620 - RNA, 19 nt, Homo sapiens
gugcaucccuggacaucag

SEQ ID NO: 939621 - RNA, 19 nt, Homo sapiens
cagggacuguggaauucaa

SEQ ID NO: 939622 - RNA, 19 nt, Homo sapiens
ggacuguggaauucaagga

SEQ ID NO: 939623 - RNA, 19 nt, Homo sapiens
uuccuggucuuaguguuua

SEQ ID NO: 939624 - RNA, 19 nt, Homo sapiens
gucuuaguguuuaaaguug

SEQ ID NO: 939625 - RNA, 19 nt, Homo sapiens
gaaccagcaagcagacaca

SEQ ID NO: 939626 - RNA, 19 nt, Homo sapiens
gcuguauuccuacuugaga

SEQ ID NO: 939627 - RNA, 19 nt, Homo sapiens
ucugacaucucucuauugc

SEQ ID NO: 939628 - RNA, 19 nt, Homo sapiens
agacagcuggagagaguuu

SEQ ID NO: 939629 - RNA, 19 nt, Homo sapiens
ccaggccuguuucaagaca

SEQ ID NO: 939630 - RNA, 19 nt, Homo sapiens
gaaucagacaacagagaug

SEQ ID NO: 939631 - RNA, 19 nt, Homo sapiens
aagcgaggcaucacagcua

SEQ ID NO: 939632 - RNA, 19 nt, Homo sapiens
ggcaagaggaaucagacaa

SEQ ID NO: 939633 - RNA, 19 nt, Homo sapiens
uuucuauccugaacucuuc

SEQ ID NO: 939634 - RNA, 19 nt, Homo sapiens
ggagcuuucuauccugaac

SEQ ID NO: 939635 - RNA, 19 nt, Homo sapiens
cacccaaggcgcuguguga

SEQ ID NO: 939636 - RNA, 19 nt, Homo sapiens
gcaccagcacccagacaca

SEQ ID NO: 939637 - RNA, 19 nt, Homo sapiens
gcagcccagucagaagaga

SEQ ID NO: 939638 - RNA, 19 nt, Homo sapiens
gugaggaauggguugauga

SEQ ID NO: 939639 - RNA, 19 nt, Homo sapiens
gaauuccuggucuuagugu

SEQ ID NO: 939640 - RNA, 19 nt, Homo sapiens
aggaggacacacucagaua

SEQ ID NO: 939641 - RNA, 19 nt, Homo sapiens
agacacaggaguccaccaa

SEQ ID NO: 939642 - RNA, 19 nt, Homo sapiens
acagagaugaggccagaga

SEQ ID NO: 939643 - RNA, 19 nt, Homo sapiens
aaucagacaacagagauga

SEQ ID NO: 939644 - RNA, 19 nt, Homo sapiens
uacccuaaugcaucaauaa

SEQ ID NO: 939645 - RNA, 19 nt, Homo sapiens
uuuaggucuuucucaauga

SEQ ID NO: 939646 - RNA, 19 nt, Homo sapiens
gagcugggcgaaggacaga

SEQ ID NO: 939647 - RNA, 19 nt, Homo sapiens
cagagccaggaaagaauaa

SEQ ID NO: 939648 - RNA, 19 nt, Homo sapiens
gaccagggaacaggacaga

SEQ ID NO: 939649 - RNA, 19 nt, Homo sapiens
gcaagucaccccuuuguac

SEQ ID NO: 939650 - RNA, 19 nt, Homo sapiens
cagagcaagucaccccuuu

SEQ ID NO: 939651 - RNA, 19 nt, Homo sapiens
agacacaggaggccaccaa

SEQ ID NO: 939652 - RNA, 19 nt, Homo sapiens
gcagaaagaugcccucauu

SEQ ID NO: 939653 - RNA, 19 nt, Homo sapiens
caacagcucuugaguuaug

SEQ ID NO: 939654 - RNA, 19 nt, Homo sapiens
gcucuugaguuaugaguua

SEQ ID NO: 939655 - RNA, 19 nt, Homo sapiens
ccgcagagcugagaaguua

SEQ ID NO: 939656 - RNA, 19 nt, Homo sapiens
gaagagcacaguaaacuaa

SEQ ID NO: 939657 - RNA, 19 nt, Homo sapiens
aacaacagcucuugaguua

SEQ ID NO: 939658 - RNA, 19 nt, Homo sapiens
ggacuucgcuacugugaug

SEQ ID NO: 939659 - RNA, 19 nt, Homo sapiens
gaacauuucuuacauccau

SEQ ID NO: 939660 - RNA, 19 nt, Homo sapiens
ucagagagcuggagucaau

SEQ ID NO: 939661 - RNA, 19 nt, Homo sapiens
ccaaagaguucccaagaga

SEQ ID NO: 939662 - RNA, 19 nt, Homo sapiens
gaucaacauugucagcuuu

SEQ ID NO: 939663 - RNA, 19 nt, Homo sapiens
gaagaucuacgaccuauuc

SEQ ID NO: 939664 - RNA, 19 nt, Homo sapiens
ggaacucauugcaguguuu

SEQ ID NO: 939665 - RNA, 19 nt, Homo sapiens
gaccaaagaccucaugauu

SEQ ID NO: 939666 - RNA, 19 nt, Homo sapiens
gaaagaaggaagugauaug

SEQ ID NO: 939667 - RNA, 19 nt, Homo sapiens
gagaaagaaggaagugaua

SEQ ID NO: 939668 - RNA, 19 nt, Homo sapiens
gggcacagcugaugacuac

SEQ ID NO: 939669 - RNA, 19 nt, Homo sapiens
caaagcagcagaagaucua

SEQ ID NO: 939670 - RNA, 19 nt, Homo sapiens
caucaccgcugccaauaug

SEQ ID NO: 939671 - RNA, 19 nt, Homo sapiens
ccaaggaaaugaccaccaa

SEQ ID NO: 939672 - RNA, 19 nt, Homo sapiens
cagaagauaugaugucaag

SEQ ID NO: 939673 - RNA, 19 nt, Homo sapiens
gaaguggagcuuucucuug

SEQ ID NO: 939674 - RNA, 19 nt, Homo sapiens
ccaaagaccucaugauucc

SEQ ID NO: 939675 - RNA, 19 nt, Homo sapiens
cauaagcauuucucuguga

SEQ ID NO: 939676 - RNA, 19 nt, Homo sapiens
ccagaaguccuuugagaaa

SEQ ID NO: 939677 - RNA, 19 nt, Homo sapiens
ucaggaacaucuggaagua

SEQ ID NO: 939678 - RNA, 19 nt, Homo sapiens
cucaguagcucaucuaaug

SEQ ID NO: 939679 - RNA, 19 nt, Homo sapiens
caagagaagauuaaaguuc

SEQ ID NO: 939680 - RNA, 19 nt, Homo sapiens
cuaaacagcagcagaaaga

SEQ ID NO: 939681 - RNA, 19 nt, Homo sapiens
ccaagagggugauccuguu

SEQ ID NO: 939682 - RNA, 19 nt, Homo sapiens
ggaagagcacaguaaacua

SEQ ID NO: 939683 - RNA, 19 nt, Homo sapiens
ccaauuaaagguugacauu

SEQ ID NO: 939684 - RNA, 19 nt, Homo sapiens
gcucgugucuaaucugaug

SEQ ID NO: 939685 - RNA, 19 nt, Homo sapiens
ggagacacccuggaugaaa

SEQ ID NO: 939686 - RNA, 19 nt, Homo sapiens
ggaagcagcagaguccuuu

SEQ ID NO: 939687 - RNA, 19 nt, Homo sapiens
gcuuugaccuucuuagcaa

SEQ ID NO: 939688 - RNA, 19 nt, Homo sapiens
gaacagcaucagaggacua

SEQ ID NO: 939689 - RNA, 19 nt, Homo sapiens
cugauuaccucuacaagga

SEQ ID NO: 939690 - RNA, 19 nt, Homo sapiens
gguguuugcugagcuguuu

SEQ ID NO: 939691 - RNA, 19 nt, Homo sapiens
ucccaucugucauugaaua

SEQ ID NO: 939692 - RNA, 19 nt, Homo sapiens
uuugccaacuuuccaauua

SEQ ID NO: 939693 - RNA, 19 nt, Homo sapiens
gaacucauugcaguguuua

SEQ ID NO: 939694 - RNA, 19 nt, Homo sapiens
ugacauuccugcauaagca

SEQ ID NO: 939695 - RNA, 19 nt, Homo sapiens
cagaagaucuacgaccuau

SEQ ID NO: 939696 - RNA, 19 nt, Homo sapiens
gcaaagggcacagcugaug

SEQ ID NO: 939697 - RNA, 19 nt, Homo sapiens
aaacuaaacagcagcagaa

SEQ ID NO: 939698 - RNA, 19 nt, Homo sapiens
gcagagcugagaaguuauu

SEQ ID NO: 939699 - RNA, 19 nt, Homo sapiens
gagcacaguaaacuaauug

SEQ ID NO: 939700 - RNA, 19 nt, Homo sapiens
aaaauguccuugccucuua

SEQ ID NO: 939701 - RNA, 19 nt, Homo sapiens
gaagauaugaugucaagac

SEQ ID NO: 939702 - RNA, 19 nt, Homo sapiens
gagacacccuggaugaaag

SEQ ID NO: 939703 - RNA, 19 nt, Homo sapiens
cagcaugaaugacuauagu

SEQ ID NO: 939704 - RNA, 19 nt, Homo sapiens
gcagaagaucuacgaccua

SEQ ID NO: 939705 - RNA, 19 nt, Homo sapiens
gaaagaugcccucauucuc

SEQ ID NO: 939706 - RNA, 19 nt, Homo sapiens
caagagacaccagcucauu

SEQ ID NO: 939707 - RNA, 19 nt, Homo sapiens
gcugcucgcugacgacaug

SEQ ID NO: 939708 - RNA, 19 nt, Homo sapiens
aaacaacagcucuugaguu

SEQ ID NO: 939709 - RNA, 19 nt, Homo sapiens
gaaucucacuuccucaaaa

SEQ ID NO: 939710 - RNA, 19 nt, Homo sapiens
guaaacuaauugcaaaggu

SEQ ID NO: 939711 - RNA, 19 nt, Homo sapiens
aaggaagacuccagcagaa

SEQ ID NO: 939712 - RNA, 19 nt, Homo sapiens
gguugacauuccugcauaa

SEQ ID NO: 939713 - RNA, 19 nt, Homo sapiens
cggcugaccuggugguguu

SEQ ID NO: 939714 - RNA, 19 nt, Homo sapiens
cagcuggccugaucaacau

SEQ ID NO: 939715 - RNA, 19 nt, Homo sapiens
gcaaagggaauauggaaaa

SEQ ID NO: 939716 - RNA, 19 nt, Homo sapiens
ccugacagcuggccugauc

SEQ ID NO: 939717 - RNA, 19 nt, Homo sapiens
gaagggaaagugcguaagg

SEQ ID NO: 939718 - RNA, 19 nt, Homo sapiens
caaagggcacagcugauga

SEQ ID NO: 939719 - RNA, 19 nt, Homo sapiens
aaucccaucugucauugaa

SEQ ID NO: 939720 - RNA, 19 nt, Homo sapiens
gagcccagauugcaucaac

SEQ ID NO: 939721 - RNA, 19 nt, Homo sapiens
caagaagacaucucucagu

SEQ ID NO: 939722 - RNA, 19 nt, Homo sapiens
uuaagacccugcccagcaa

SEQ ID NO: 939723 - RNA, 19 nt, Homo sapiens
ggaagacuccagcagaagu

SEQ ID NO: 939724 - RNA, 19 nt, Homo sapiens
aagcaaggcccaucccaaa

SEQ ID NO: 939725 - RNA, 19 nt, Homo sapiens
gauaacugggacagcuuua

SEQ ID NO: 939726 - RNA, 19 nt, Homo sapiens
gaaaguggaagagagaagu

SEQ ID NO: 939727 - RNA, 19 nt, Homo sapiens
ggaaguggagcuuucucuu

SEQ ID NO: 939728 - RNA, 19 nt, Homo sapiens
ugaguuaggucaaggucau

SEQ ID NO: 939729 - RNA, 19 nt, Homo sapiens
cuccagaggucccuaaaca

SEQ ID NO: 939730 - RNA, 19 nt, Homo sapiens
uuacagaggagcagaggaa

SEQ ID NO: 939731 - RNA, 19 nt, Homo sapiens
aggcagacaucaguuauuc

SEQ ID NO: 939732 - RNA, 19 nt, Homo sapiens
gaucagguucacacccuuu

SEQ ID NO: 939733 - RNA, 19 nt, Homo sapiens
caacagaaucucaguagcu

SEQ ID NO: 939734 - RNA, 19 nt, Homo sapiens
ugacuauagugcccugaug

SEQ ID NO: 939735 - RNA, 19 nt, Homo sapiens
ucauaagccucuggccaaa

SEQ ID NO: 939736 - RNA, 19 nt, Homo sapiens
aaauggcucucacuggaau

SEQ ID NO: 939737 - RNA, 19 nt, Homo sapiens
caaauggcucucacuggaa

SEQ ID NO: 939738 - RNA, 19 nt, Homo sapiens
ccucaugauucccacaguu

SEQ ID NO: 939739 - RNA, 19 nt, Homo sapiens
ucuacgaccuauuccagaa

SEQ ID NO: 939740 - RNA, 19 nt, Homo sapiens
agagcacaguaaacuaauu

SEQ ID NO: 939741 - RNA, 19 nt, Homo sapiens
acguggaacuucagcauga

SEQ ID NO: 939742 - RNA, 19 nt, Homo sapiens
uuucuuacauccauucuag

SEQ ID NO: 939743 - RNA, 19 nt, Homo sapiens
uaaguuagaggccaagaca

SEQ ID NO: 939744 - RNA, 19 nt, Homo sapiens
gcuaaaaucccaucuguca

SEQ ID NO: 939745 - RNA, 19 nt, Homo sapiens
ccaagcagcgcaagauagu

SEQ ID NO: 939746 - RNA, 19 nt, Homo sapiens
ugccaacuuuccaauuaaa

SEQ ID NO: 939747 - RNA, 19 nt, Homo sapiens
cuccaucccuuucauuugu

SEQ ID NO: 939748 - RNA, 19 nt, Homo sapiens
aaagaugcccucauucucu

SEQ ID NO: 939749 - RNA, 19 nt, Homo sapiens
aagcucgugucuaaucuga

SEQ ID NO: 939750 - RNA, 19 nt, Homo sapiens
guggagcuuucucuuggaa

SEQ ID NO: 939751 - RNA, 19 nt, Homo sapiens
gaggcagacaucaguuauu

SEQ ID NO: 939752 - RNA, 19 nt, Homo sapiens
ggacuuaacuucagagaaa

SEQ ID NO: 939753 - RNA, 19 nt, Homo sapiens
gaggaaggauaaaugcuuu

SEQ ID NO: 939754 - RNA, 19 nt, Homo sapiens
ggaagauggugaagcugua

SEQ ID NO: 939755 - RNA, 19 nt, Homo sapiens
gcacuagggaggaaggaua

SEQ ID NO: 939756 - RNA, 19 nt, Homo sapiens
agaaaccgcugacaucuag

SEQ ID NO: 939757 - RNA, 19 nt, Homo sapiens
gagaaaccgcugacaucua

SEQ ID NO: 939758 - RNA, 19 nt, Homo sapiens
ccacaagcauccaccaaag

SEQ ID NO: 939759 - RNA, 19 nt, Homo sapiens
gaaggaagggagagacaga

SEQ ID NO: 939760 - RNA, 19 nt, Homo sapiens
ggaggaaggauaaaugcuu

SEQ ID NO: 939761 - RNA, 19 nt, Homo sapiens
gacaggcucuccagaagca

SEQ ID NO: 939762 - RNA, 19 nt, Homo sapiens
gcagcacgccuccuaggaa

SEQ ID NO: 939763 - RNA, 19 nt, Homo sapiens
gcgacaggcucuccagaag

SEQ ID NO: 939764 - RNA, 19 nt, Homo sapiens
gcccagagccgagauggaa

SEQ ID NO: 939765 - RNA, 19 nt, Homo sapiens
gggagacgcaguagacaga

SEQ ID NO: 939766 - RNA, 19 nt, Homo sapiens
ggaguuugggauugaguuu

SEQ ID NO: 939767 - RNA, 19 nt, Homo sapiens
gagacgcaguagacagaga

SEQ ID NO: 939768 - RNA, 19 nt, Homo sapiens
ccgcugacaucuagaacug

SEQ ID NO: 939769 - RNA, 19 nt, Homo sapiens
cagagaaaccgcugacauc

SEQ ID NO: 939770 - RNA, 19 nt, Homo sapiens
ggagggagacgcaguagac

SEQ ID NO: 939771 - RNA, 19 nt, Homo sapiens
gacagagacagaccgagaa

SEQ ID NO: 939772 - RNA, 19 nt, Homo sapiens
gagaaggaagggagagaca

SEQ ID NO: 939773 - RNA, 19 nt, Homo sapiens
agagacagaccgagaagga

SEQ ID NO: 939774 - RNA, 19 nt, Homo sapiens
agcaagcccugcaggagaa

SEQ ID NO: 939775 - RNA, 19 nt, Homo sapiens
ugaccaccauuuugcauuu

SEQ ID NO: 939776 - RNA, 19 nt, Homo sapiens
gagacagaccgagaaggaa

SEQ ID NO: 939777 - RNA, 19 nt, Homo sapiens
acaagcauccaccaaagga

SEQ ID NO: 939778 - RNA, 19 nt, Homo sapiens
aaaccgcugacaucuagaa

SEQ ID NO: 939779 - RNA, 19 nt, Homo sapiens
gcacgccuccuaggaacug

SEQ ID NO: 939780 - RNA, 19 nt, Homo sapiens
cacuagggaggaaggauaa

SEQ ID NO: 939781 - RNA, 19 nt, Homo sapiens
uagggaggaaggauaaaug

SEQ ID NO: 939782 - RNA, 19 nt, Homo sapiens
gucaugacauuuccaacac

SEQ ID NO: 939783 - RNA, 19 nt, Homo sapiens
aggagaugauggcccagaa

SEQ ID NO: 939784 - RNA, 19 nt, Homo sapiens
ugaaaugggucuaagaaua

SEQ ID NO: 939785 - RNA, 19 nt, Homo sapiens
uaaaggagauggcaugugu

SEQ ID NO: 939786 - RNA, 19 nt, Homo sapiens
gggaaaggguaacuuauug

SEQ ID NO: 939787 - RNA, 19 nt, Homo sapiens
gaacuucacauacagauga

SEQ ID NO: 939788 - RNA, 19 nt, Homo sapiens
gaauagcacugaucucaca

SEQ ID NO: 939789 - RNA, 19 nt, Homo sapiens
gcaaaggaccucccucuug

SEQ ID NO: 939790 - RNA, 19 nt, Homo sapiens
gacaccagcuccaggauaa

SEQ ID NO: 939791 - RNA, 19 nt, Homo sapiens
ggagauggcauguguaaug

SEQ ID NO: 939792 - RNA, 19 nt, Homo sapiens
gaaaugggucuaagaauag

SEQ ID NO: 939793 - RNA, 19 nt, Homo sapiens
gguagcaggugggaaguua

SEQ ID NO: 939794 - RNA, 19 nt, Homo sapiens
gauggcauguguaaugaaa

SEQ ID NO: 939795 - RNA, 19 nt, Homo sapiens
gagauggcauguguaauga

SEQ ID NO: 939796 - RNA, 19 nt, Homo sapiens
aggauuaagugaaccaaua

SEQ ID NO: 939797 - RNA, 19 nt, Homo sapiens
ugacacaacucuucuaugc

SEQ ID NO: 939798 - RNA, 19 nt, Homo sapiens
acaccuagcugaacuaugg

SEQ ID NO: 939799 - RNA, 19 nt, Homo sapiens
aaacaggagcuaccucaua

SEQ ID NO: 939800 - RNA, 19 nt, Homo sapiens
ccagggaacuucacauaca

SEQ ID NO: 939801 - RNA, 19 nt, Homo sapiens
gaccacaucuccugcuguu

SEQ ID NO: 939802 - RNA, 19 nt, Homo sapiens
ugucugaucuugagagguu

SEQ ID NO: 939803 - RNA, 19 nt, Homo sapiens
gaacuaugguuuggugucu

SEQ ID NO: 939804 - RNA, 19 nt, Homo sapiens
gauaaaggcacagaugaga

SEQ ID NO: 939805 - RNA, 19 nt, Homo sapiens
gaaccaauacauauacagu

SEQ ID NO: 939806 - RNA, 19 nt, Homo sapiens
gcccagcccuaaaccuaaa

SEQ ID NO: 939807 - RNA, 19 nt, Homo sapiens
ugaccucaguuucagcuuu

SEQ ID NO: 939808 - RNA, 19 nt, Homo sapiens
gcacuggccacucuucaga

SEQ ID NO: 939809 - RNA, 19 nt, Homo sapiens
ggguugugaugcagauuaa

SEQ ID NO: 939810 - RNA, 19 nt, Homo sapiens
agaaaugucugugucugaa

SEQ ID NO: 939811 - RNA, 19 nt, Homo sapiens
caugaccgcugcccacaga

SEQ ID NO: 939812 - RNA, 19 nt, Homo sapiens
caauacauauacagugcuu

SEQ ID NO: 939813 - RNA, 19 nt, Homo sapiens
gagguuaccaacaugcuuu

SEQ ID NO: 939814 - RNA, 19 nt, Homo sapiens
cccaggaccuucuacaaug

SEQ ID NO: 939815 - RNA, 19 nt, Homo sapiens
cccuaaaccuaaauucaaa

SEQ ID NO: 939816 - RNA, 19 nt, Homo sapiens
ucccgcagcuccauucauu

SEQ ID NO: 939817 - RNA, 19 nt, Homo sapiens
gcccuaaaccuaaauucaa

SEQ ID NO: 939818 - RNA, 19 nt, Homo sapiens
gaccucaguuucagcuuuc

SEQ ID NO: 939819 - RNA, 19 nt, Homo sapiens
auaggguuguugaggauua

SEQ ID NO: 939820 - RNA, 19 nt, Homo sapiens
uuagggaugucacagaaau

SEQ ID NO: 939821 - RNA, 19 nt, Homo sapiens
gaaaggguaacuuauugca

SEQ ID NO: 939822 - RNA, 19 nt, Homo sapiens
ggucuaagaauagcacuga

SEQ ID NO: 939823 - RNA, 19 nt, Homo sapiens
ggaccuugcccauggcuau

SEQ ID NO: 939824 - RNA, 19 nt, Homo sapiens
aacaggagcuaccucauag

SEQ ID NO: 939825 - RNA, 19 nt, Homo sapiens
cgacaccagcuccaggaua

SEQ ID NO: 939826 - RNA, 19 nt, Homo sapiens
gacaccagguuucagcaau

SEQ ID NO: 939827 - RNA, 19 nt, Homo sapiens
ccaggaggagguacaugua

SEQ ID NO: 939828 - RNA, 19 nt, Homo sapiens
uggguaaccuugagcuaug

SEQ ID NO: 939829 - RNA, 19 nt, Homo sapiens
gggcacaaccugcuucaag

SEQ ID NO: 939830 - RNA, 19 nt, Homo sapiens
gcccaggaccuucuacaau

SEQ ID NO: 939831 - RNA, 19 nt, Homo sapiens
cagcaaugccuacagaauc

SEQ ID NO: 939832 - RNA, 19 nt, Homo sapiens
ggugggaaguuagggaugu

SEQ ID NO: 939833 - RNA, 19 nt, Homo sapiens
aagaauagcacugaucuca

SEQ ID NO: 939834 - RNA, 19 nt, Homo sapiens
ccacaucuccugcuguucu

SEQ ID NO: 939835 - RNA, 19 nt, Homo sapiens
ggauaaaggcacagaugag

SEQ ID NO: 939836 - RNA, 19 nt, Homo sapiens
aaggagauggcauguguaa

SEQ ID NO: 939837 - RNA, 19 nt, Homo sapiens
gaucuugagagguugaugu

SEQ ID NO: 939838 - RNA, 19 nt, Homo sapiens
gaaaugucugugucugaau

SEQ ID NO: 939839 - RNA, 19 nt, Homo sapiens
gagccagugaccucaguuu

SEQ ID NO: 939840 - RNA, 19 nt, Homo sapiens
acaccagguuucagcaaug

SEQ ID NO: 939841 - RNA, 19 nt, Homo sapiens
ucauaggguuguugaggau

SEQ ID NO: 939842 - RNA, 19 nt, Homo sapiens
aaaugucugugucugaauc

SEQ ID NO: 939843 - RNA, 19 nt, Homo sapiens
agcaaugccuacagaauca

SEQ ID NO: 939844 - RNA, 19 nt, Homo sapiens
uuucagcaaugccuacaga

SEQ ID NO: 939845 - RNA, 19 nt, Homo sapiens
cacccgagguuaccaacau

SEQ ID NO: 939846 - RNA, 19 nt, Homo sapiens
gugaaccaauacauauaca

SEQ ID NO: 939847 - RNA, 19 nt, Homo sapiens
gccagugaccucaguuuca

SEQ ID NO: 939848 - RNA, 19 nt, Homo sapiens
ggacuguguggaaggcaaa

SEQ ID NO: 939849 - RNA, 19 nt, Homo sapiens
uagcugaacuaugguuugg

SEQ ID NO: 939850 - RNA, 19 nt, Homo sapiens
uggaugugguguucaggaa

SEQ ID NO: 939851 - RNA, 19 nt, Homo sapiens
caggauaaaggcacagaug

SEQ ID NO: 939852 - RNA, 19 nt, Homo sapiens
gguuuggugucugaucuug

SEQ ID NO: 939853 - RNA, 19 nt, Homo sapiens
ggauuaagugaaccaauac

SEQ ID NO: 939854 - RNA, 19 nt, Homo sapiens
aguuagggaugucacagaa

SEQ ID NO: 939855 - RNA, 19 nt, Homo sapiens
caaucaagaggaugaaugg

SEQ ID NO: 939856 - RNA, 19 nt, Homo sapiens
ggacaaucaagaggaugaa

SEQ ID NO: 939857 - RNA, 19 nt, Homo sapiens
gguguggaguuggagauuc

SEQ ID NO: 939858 - RNA, 19 nt, Homo sapiens
ccagugaccucaguuucag

SEQ ID NO: 939859 - RNA, 19 nt, Homo sapiens
gggcguggccuucuucaac

SEQ ID NO: 939860 - RNA, 19 nt, Homo sapiens
ugugaaaugggucuaagaa

SEQ ID NO: 939861 - RNA, 19 nt, Homo sapiens
acuaugguuuggugucuga

SEQ ID NO: 939862 - RNA, 19 nt, Homo sapiens
ggcccagcccuaaaccuaa

SEQ ID NO: 939863 - RNA, 19 nt, Homo sapiens
ggaugucacagaaaugucu

SEQ ID NO: 939864 - RNA, 19 nt, Homo sapiens
aggaggagguacauguaug

SEQ ID NO: 939865 - RNA, 19 nt, Homo sapiens
ggaaaggguaacuuauugc

SEQ ID NO: 939866 - RNA, 19 nt, Homo sapiens
ugccagggaacuucacaua

SEQ ID NO: 939867 - RNA, 19 nt, Homo sapiens
aggcguguguggcguggua

SEQ ID NO: 939868 - RNA, 19 nt, Homo sapiens
cauccgaaacuaccgauuc

SEQ ID NO: 939869 - RNA, 19 nt, Homo sapiens
ccaggaccuucuacaaugc

SEQ ID NO: 939870 - RNA, 19 nt, Homo sapiens
ggugcucucugugcucaug

SEQ ID NO: 939871 - RNA, 19 nt, Homo sapiens
cuugagagguugauguaac

SEQ ID NO: 939872 - RNA, 19 nt, Homo sapiens
aaauucaaaucuccuccau

SEQ ID NO: 939873 - RNA, 19 nt, Homo sapiens
gcuguggccugagguagca

SEQ ID NO: 939874 - RNA, 19 nt, Homo sapiens
aaccagugccugcagcuaa

SEQ ID NO: 939875 - RNA, 19 nt, Homo sapiens
uaggguuguugaggauuaa

SEQ ID NO: 939876 - RNA, 19 nt, Homo sapiens
ggaaguuagggaugucaca

SEQ ID NO: 939877 - RNA, 19 nt, Homo sapiens
guaugacacaacucuucua

SEQ ID NO: 939878 - RNA, 19 nt, Homo sapiens
aaccuugagcuauguauga

SEQ ID NO: 939879 - RNA, 19 nt, Homo sapiens
cccaaaugcuggaccacau

SEQ ID NO: 939880 - RNA, 19 nt, Homo sapiens
ucccaagccucgacagaag

SEQ ID NO: 939881 - RNA, 19 nt, Homo sapiens
ugacugugacaccagguuu

SEQ ID NO: 939882 - RNA, 19 nt, Homo sapiens
acuauggcauccgaaacua

SEQ ID NO: 939883 - RNA, 19 nt, Homo sapiens
gguuacaagcccaagauca

SEQ ID NO: 939884 - RNA, 19 nt, Homo sapiens
gaacaaggaugaacaagca

SEQ ID NO: 939885 - RNA, 19 nt, Homo sapiens
gaagagagaacaaggauga

SEQ ID NO: 939886 - RNA, 19 nt, Homo sapiens
gaacagcuaugacaucuac

SEQ ID NO: 939887 - RNA, 19 nt, Homo sapiens
ugacugaccugguaaagaa

SEQ ID NO: 939888 - RNA, 19 nt, Homo sapiens
gcacuaccguguugugaaa

SEQ ID NO: 939889 - RNA, 19 nt, Homo sapiens
ggaacaagauucugcacaa

SEQ ID NO: 939890 - RNA, 19 nt, Homo sapiens
ggaacaaacugcgggugua

SEQ ID NO: 939891 - RNA, 19 nt, Homo sapiens
gaacaagauucugcacaau

SEQ ID NO: 939892 - RNA, 19 nt, Homo sapiens
gaaagaggagacagaauau

SEQ ID NO: 939893 - RNA, 19 nt, Homo sapiens
caagguguauggacucauu

SEQ ID NO: 939894 - RNA, 19 nt, Homo sapiens
agaaagaggagacagaaua

SEQ ID NO: 939895 - RNA, 19 nt, Homo sapiens
gauauuuggucucuaggaa

SEQ ID NO: 939896 - RNA, 19 nt, Homo sapiens
ggaagccccuguaccauua

SEQ ID NO: 939897 - RNA, 19 nt, Homo sapiens
acaagauucugcacaauga

SEQ ID NO: 939898 - RNA, 19 nt, Homo sapiens
gaaguggucuaagaaguuc

SEQ ID NO: 939899 - RNA, 19 nt, Homo sapiens
ggagauagcgccugucagu

SEQ ID NO: 939900 - RNA, 19 nt, Homo sapiens
ucaaccagcucccaccaaa

SEQ ID NO: 939901 - RNA, 19 nt, Homo sapiens
ccaagaaggccauggacua

SEQ ID NO: 939902 - RNA, 19 nt, Homo sapiens
gagcaugccuaccucaagu

SEQ ID NO: 939903 - RNA, 19 nt, Homo sapiens
ggucuaagaaguucauuga

SEQ ID NO: 939904 - RNA, 19 nt, Homo sapiens
ggaaguacaagaagcgauu

SEQ ID NO: 939905 - RNA, 19 nt, Homo sapiens
uuggauauccuguuuguua

SEQ ID NO: 939906 - RNA, 19 nt, Homo sapiens
ggccuuggauauccuguuu

SEQ ID NO: 939907 - RNA, 19 nt, Homo sapiens
aaccguaacugcaucauga

SEQ ID NO: 939908 - RNA, 19 nt, Homo sapiens
acaaacugcggguguauua

SEQ ID NO: 939909 - RNA, 19 nt, Homo sapiens
gagcaacucagaggcuuua

SEQ ID NO: 939910 - RNA, 19 nt, Homo sapiens
ugacagccauggagaggaa

SEQ ID NO: 939911 - RNA, 19 nt, Homo sapiens
gcacaaugacccagaagug

SEQ ID NO: 939912 - RNA, 19 nt, Homo sapiens
ucaugacucugaaccguaa

SEQ ID NO: 939913 - RNA, 19 nt, Homo sapiens
ggacccugcugggaucuuu

SEQ ID NO: 939914 - RNA, 19 nt, Homo sapiens
cggagcagcuacugaaguu

SEQ ID NO: 939915 - RNA, 19 nt, Homo sapiens
gaacaaacugcggguguau

SEQ ID NO: 939916 - RNA, 19 nt, Homo sapiens
gcauagaggagcagaagga

SEQ ID NO: 939917 - RNA, 19 nt, Homo sapiens
ggagugauauuuggucucu

SEQ ID NO: 939918 - RNA, 19 nt, Homo sapiens
gaacccugaugccaccuau

SEQ ID NO: 939919 - RNA, 19 nt, Homo sapiens
caacaucgccaccuacuac

SEQ ID NO: 939920 - RNA, 19 nt, Homo sapiens
ccaagaaguggucuaagaa

SEQ ID NO: 939921 - RNA, 19 nt, Homo sapiens
uccaagaaguggucuaaga

SEQ ID NO: 939922 - RNA, 19 nt, Homo sapiens
gcaucuguauauaguguga

SEQ ID NO: 939923 - RNA, 19 nt, Homo sapiens
cagggaccauuucuucauu

SEQ ID NO: 939924 - RNA, 19 nt, Homo sapiens
ggaggacuguaucgccuau

SEQ ID NO: 939925 - RNA, 19 nt, Homo sapiens
uggauauccuguuuguuaa

SEQ ID NO: 939926 - RNA, 19 nt, Homo sapiens
guaacugcaucaugaacug

SEQ ID NO: 939927 - RNA, 19 nt, Homo sapiens
ugagaaagccauugagauc

SEQ ID NO: 939928 - RNA, 19 nt, Homo sapiens
gcaugaaucccgcugacaa

SEQ ID NO: 939929 - RNA, 19 nt, Homo sapiens
gcagcgaggaggaagauga

SEQ ID NO: 939930 - RNA, 19 nt, Homo sapiens
ccacggagcagcuacugaa

SEQ ID NO: 939931 - RNA, 19 nt, Homo sapiens
gauuacaggagugauauuu

SEQ ID NO: 939932 - RNA, 19 nt, Homo sapiens
agacggaacacuuucauug

SEQ ID NO: 939933 - RNA, 19 nt, Homo sapiens
gggcagggaccauuucuuc

SEQ ID NO: 939934 - RNA, 19 nt, Homo sapiens
gggaacagcuaugacaucu

SEQ ID NO: 939935 - RNA, 19 nt, Homo sapiens
ggagacagaauaugaguac

SEQ ID NO: 939936 - RNA, 19 nt, Homo sapiens
ugaaauacgagcggauuaa

SEQ ID NO: 939937 - RNA, 19 nt, Homo sapiens
guacaagggucggcauguc

SEQ ID NO: 939938 - RNA, 19 nt, Homo sapiens
gaaucccgcugacaaacca

SEQ ID NO: 939939 - RNA, 19 nt, Homo sapiens
aagaggagacagaauauga

SEQ ID NO: 939940 - RNA, 19 nt, Homo sapiens
gagcagcuacugaaguuuc

SEQ ID NO: 939941 - RNA, 19 nt, Homo sapiens
ugacuucauugacacaugu

SEQ ID NO: 939942 - RNA, 19 nt, Homo sapiens
ggugauccaucgagacauc

SEQ ID NO: 939943 - RNA, 19 nt, Homo sapiens
cuacggagccuucaucaag

SEQ ID NO: 939944 - RNA, 19 nt, Homo sapiens
ggauuaaguuccuggucau

SEQ ID NO: 939945 - RNA, 19 nt, Homo sapiens
gcaacucagaggcuuuaaa

SEQ ID NO: 939946 - RNA, 19 nt, Homo sapiens
uuacaggagugauauuugg

SEQ ID NO: 939947 - RNA, 19 nt, Homo sapiens
gcuugcaucuguauauagu

SEQ ID NO: 939948 - RNA, 19 nt, Homo sapiens
uggagaugcugcugugcua

SEQ ID NO: 939949 - RNA, 19 nt, Homo sapiens
cuacaucccugugcacauc

SEQ ID NO: 939950 - RNA, 19 nt, Homo sapiens
acccagaaguggagaagaa

SEQ ID NO: 939951 - RNA, 19 nt, Homo sapiens
ggagaacgggcugauguug

SEQ ID NO: 939952 - RNA, 19 nt, Homo sapiens
gcugucauccgccagaauu

SEQ ID NO: 939953 - RNA, 19 nt, Homo sapiens
ggacgaggaggaagagauc

SEQ ID NO: 939954 - RNA, 19 nt, Homo sapiens
gaaauacgagcggauuaag

SEQ ID NO: 939955 - RNA, 19 nt, Homo sapiens
gugaaauacgagcggauua

SEQ ID NO: 939956 - RNA, 19 nt, Homo sapiens
gaacagcaaaggccaaagc

SEQ ID NO: 939957 - RNA, 19 nt, Homo sapiens
ucuaagaaguucauugacu

SEQ ID NO: 939958 - RNA, 19 nt, Homo sapiens
gcagggaccauuucuucau

SEQ ID NO: 939959 - RNA, 19 nt, Homo sapiens
gaaccguaacugcaucaug

SEQ ID NO: 939960 - RNA, 19 nt, Homo sapiens
acaaauucauggccuucaa

SEQ ID NO: 939961 - RNA, 19 nt, Homo sapiens
aauacgagcggauuaaguu

SEQ ID NO: 939962 - RNA, 19 nt, Homo sapiens
gggcucaaccugcucauca

SEQ ID NO: 939963 - RNA, 19 nt, Homo sapiens
gagaacagcaaaggccaaa

SEQ ID NO: 939964 - RNA, 19 nt, Homo sapiens
gagagaacaaggaugaaca

SEQ ID NO: 939965 - RNA, 19 nt, Homo sapiens
ggagaucaacaugcugaaa

SEQ ID NO: 939966 - RNA, 19 nt, Homo sapiens
ccauugagauccgcucugu

SEQ ID NO: 939967 - RNA, 19 nt, Homo sapiens
ggugagaaagccauugaga

SEQ ID NO: 939968 - RNA, 19 nt, Homo sapiens
ggaugggaguggugacuac

SEQ ID NO: 939969 - RNA, 19 nt, Homo sapiens
gcaacaucgccaccuacua

SEQ ID NO: 939970 - RNA, 19 nt, Homo sapiens
gggagaugccuacuucugu

SEQ ID NO: 939971 - RNA, 19 nt, Homo sapiens
gaaggguucuguggucaac

SEQ ID NO: 939972 - RNA, 19 nt, Homo sapiens
ggaugaacaagcagcagaa

SEQ ID NO: 939973 - RNA, 19 nt, Homo sapiens
guagaagagagaacaagga

SEQ ID NO: 939974 - RNA, 19 nt, Homo sapiens
ggaagcugcaggagaagga

SEQ ID NO: 939975 - RNA, 19 nt, Homo sapiens
agaaguggucuaagaaguu

SEQ ID NO: 939976 - RNA, 19 nt, Homo sapiens
uaugauuacaggagugaua

SEQ ID NO: 939977 - RNA, 19 nt, Homo sapiens
cagaggucaucgccuguga

SEQ ID NO: 939978 - RNA, 19 nt, Homo sapiens
ugacagcaauggguacaca

SEQ ID NO: 939979 - RNA, 19 nt, Homo sapiens
caacucagaggcuuuaaaa

SEQ ID NO: 939980 - RNA, 19 nt, Homo sapiens
cugaugccaccuaugauua

SEQ ID NO: 939981 - RNA, 19 nt, Homo sapiens
cuacuucuguggccuacau

SEQ ID NO: 939982 - RNA, 19 nt, Homo sapiens
caaacccuaccacaaauuc

SEQ ID NO: 939983 - RNA, 19 nt, Homo sapiens
acuaccguguugugaaaua

SEQ ID NO: 939984 - RNA, 19 nt, Homo sapiens
gaacaaggaugaacaagca

SEQ ID NO: 939985 - RNA, 19 nt, Homo sapiens
gaagagagaacaaggauga

SEQ ID NO: 939986 - RNA, 19 nt, Homo sapiens
gaacagcuaugacaucuac

SEQ ID NO: 939987 - RNA, 19 nt, Homo sapiens
ugacugaccugguaaagaa

SEQ ID NO: 939988 - RNA, 19 nt, Homo sapiens
gcacuaccguguugugaaa

SEQ ID NO: 939989 - RNA, 19 nt, Homo sapiens
ggaacaagauucugcacaa

SEQ ID NO: 939990 - RNA, 19 nt, Homo sapiens
ggaacaaacugcgggugua

SEQ ID NO: 939991 - RNA, 19 nt, Homo sapiens
gaacaagauucugcacaau

SEQ ID NO: 939992 - RNA, 19 nt, Homo sapiens
gaaagaggagacagaauau

SEQ ID NO: 939993 - RNA, 19 nt, Homo sapiens
caagguguauggacucauu

SEQ ID NO: 939994 - RNA, 19 nt, Homo sapiens
agaaagaggagacagaaua

SEQ ID NO: 939995 - RNA, 19 nt, Homo sapiens
gauauuuggucucuaggaa

SEQ ID NO: 939996 - RNA, 19 nt, Homo sapiens
ggaagccccuguaccauua

SEQ ID NO: 939997 - RNA, 19 nt, Homo sapiens
acaagauucugcacaauga

SEQ ID NO: 939998 - RNA, 19 nt, Homo sapiens
gaaguggucuaagaaguuc

SEQ ID NO: 939999 - RNA, 19 nt, Homo sapiens
gcaaaucuaucugcaaagg

SEQ ID NO: 940000 - RNA, 19 nt, Homo sapiens
ggagauagcgccugucagu

SEQ ID NO: 940001 - RNA, 19 nt, Homo sapiens
ucaaccagcucccaccaaa

SEQ ID NO: 940002 - RNA, 19 nt, Homo sapiens
ccaagaaggccauggacua

SEQ ID NO: 940003 - RNA, 19 nt, Homo sapiens
uggcaaaucuaucugcaaa

SEQ ID NO: 940004 - RNA, 19 nt, Homo sapiens
gagcaugccuaccucaagu

SEQ ID NO: 940005 - RNA, 19 nt, Homo sapiens
ggucuaagaaguucauuga

SEQ ID NO: 940006 - RNA, 19 nt, Homo sapiens
ggaaguacaagaagcgauu

SEQ ID NO: 940007 - RNA, 19 nt, Homo sapiens
uuggauauccuguuuguua

SEQ ID NO: 940008 - RNA, 19 nt, Homo sapiens
ggccuuggauauccuguuu

SEQ ID NO: 940009 - RNA, 19 nt, Homo sapiens
aaccguaacugcaucauga

SEQ ID NO: 940010 - RNA, 19 nt, Homo sapiens
acaaacugcggguguauua

SEQ ID NO: 940011 - RNA, 19 nt, Homo sapiens
gagcaacucagaggcuuua

SEQ ID NO: 940012 - RNA, 19 nt, Homo sapiens
ugacagccauggagaggaa

SEQ ID NO: 940013 - RNA, 19 nt, Homo sapiens
gcacaaugacccagaagug

SEQ ID NO: 940014 - RNA, 19 nt, Homo sapiens
ucaugacucugaaccguaa

SEQ ID NO: 940015 - RNA, 19 nt, Homo sapiens
ggacccugcugggaucuuu

SEQ ID NO: 940016 - RNA, 19 nt, Homo sapiens
cggagcagcuacugaaguu

SEQ ID NO: 940017 - RNA, 19 nt, Homo sapiens
gaacaaacugcggguguau

SEQ ID NO: 940018 - RNA, 19 nt, Homo sapiens
gcauagaggagcagaagga

SEQ ID NO: 940019 - RNA, 19 nt, Homo sapiens
ggagugauauuuggucucu

SEQ ID NO: 940020 - RNA, 19 nt, Homo sapiens
gaacccugaugccaccuau

SEQ ID NO: 940021 - RNA, 19 nt, Homo sapiens
caacaucgccaccuacuac

SEQ ID NO: 940022 - RNA, 19 nt, Homo sapiens
ccaagaaguggucuaagaa

SEQ ID NO: 940023 - RNA, 19 nt, Homo sapiens
uccaagaaguggucuaaga

SEQ ID NO: 940024 - RNA, 19 nt, Homo sapiens
gcaucuguauauaguguga

SEQ ID NO: 940025 - RNA, 19 nt, Homo sapiens
cagggaccauuucuucauu

SEQ ID NO: 940026 - RNA, 19 nt, Homo sapiens
ggaggacuguaucgccuau

SEQ ID NO: 940027 - RNA, 19 nt, Homo sapiens
uggauauccuguuuguuaa

SEQ ID NO: 940028 - RNA, 19 nt, Homo sapiens
guaacugcaucaugaacug

SEQ ID NO: 940029 - RNA, 19 nt, Homo sapiens
ugagaaagccauugagauc

SEQ ID NO: 940030 - RNA, 19 nt, Homo sapiens
gcaugaaucccgcugacaa

SEQ ID NO: 940031 - RNA, 19 nt, Homo sapiens
gcagcgaggaggaagauga

SEQ ID NO: 940032 - RNA, 19 nt, Homo sapiens
ccacggagcagcuacugaa

SEQ ID NO: 940033 - RNA, 19 nt, Homo sapiens
gauuacaggagugauauuu

SEQ ID NO: 940034 - RNA, 19 nt, Homo sapiens
agacggaacacuuucauug

SEQ ID NO: 940035 - RNA, 19 nt, Homo sapiens
gggcagggaccauuucuuc

SEQ ID NO: 940036 - RNA, 19 nt, Homo sapiens
gggaacagcuaugacaucu

SEQ ID NO: 940037 - RNA, 19 nt, Homo sapiens
ggagacagaauaugaguac

SEQ ID NO: 940038 - RNA, 19 nt, Homo sapiens
ugaaauacgagcggauuaa

SEQ ID NO: 940039 - RNA, 19 nt, Homo sapiens
gaaucccgcugacaaacca

SEQ ID NO: 940040 - RNA, 19 nt, Homo sapiens
aagaggagacagaauauga

SEQ ID NO: 940041 - RNA, 19 nt, Homo sapiens
gagcagcuacugaaguuuc

SEQ ID NO: 940042 - RNA, 19 nt, Homo sapiens
ugacuucauugacacaugu

SEQ ID NO: 940043 - RNA, 19 nt, Homo sapiens
guacaagggucggcauguc

SEQ ID NO: 940044 - RNA, 19 nt, Homo sapiens
ggugauccaucgagacauc

SEQ ID NO: 940045 - RNA, 19 nt, Homo sapiens
cuacggagccuucaucaag

SEQ ID NO: 940046 - RNA, 19 nt, Homo sapiens
ggauuaaguuccuggucau

SEQ ID NO: 940047 - RNA, 19 nt, Homo sapiens
gcaacucagaggcuuuaaa

SEQ ID NO: 940048 - RNA, 19 nt, Homo sapiens
uuacaggagugauauuugg

SEQ ID NO: 940049 - RNA, 19 nt, Homo sapiens
gcuugcaucuguauauagu

SEQ ID NO: 940050 - RNA, 19 nt, Homo sapiens
uggagaugcugcugugcua

SEQ ID NO: 940051 - RNA, 19 nt, Homo sapiens
cuacaucccugugcacauc

SEQ ID NO: 940052 - RNA, 19 nt, Homo sapiens
acccagaaguggagaagaa

SEQ ID NO: 940053 - RNA, 19 nt, Homo sapiens
ggagaacgggcugauguug

SEQ ID NO: 940054 - RNA, 19 nt, Homo sapiens
gcugucauccgccagaauu

SEQ ID NO: 940055 - RNA, 19 nt, Homo sapiens
ggacgaggaggaagagauc

SEQ ID NO: 940056 - RNA, 19 nt, Homo sapiens
gaaauacgagcggauuaag

SEQ ID NO: 940057 - RNA, 19 nt, Homo sapiens
gugaaauacgagcggauua

SEQ ID NO: 940058 - RNA, 19 nt, Homo sapiens
gaacagcaaaggccaaagc

SEQ ID NO: 940059 - RNA, 19 nt, Homo sapiens
ucuaagaaguucauugacu

SEQ ID NO: 940060 - RNA, 19 nt, Homo sapiens
gcagggaccauuucuucau

SEQ ID NO: 940061 - RNA, 19 nt, Homo sapiens
gaaccguaacugcaucaug

SEQ ID NO: 940062 - RNA, 19 nt, Homo sapiens
acaaauucauggccuucaa

SEQ ID NO: 940063 - RNA, 19 nt, Homo sapiens
aauacgagcggauuaaguu

SEQ ID NO: 940064 - RNA, 19 nt, Homo sapiens
gggcucaaccugcucauca

SEQ ID NO: 940065 - RNA, 19 nt, Homo sapiens
gagaacagcaaaggccaaa

SEQ ID NO: 940066 - RNA, 19 nt, Homo sapiens
gagagaacaaggaugaaca

SEQ ID NO: 940067 - RNA, 19 nt, Homo sapiens
ggagaucaacaugcugaaa

SEQ ID NO: 940068 - RNA, 19 nt, Homo sapiens
ccauugagauccgcucugu

SEQ ID NO: 940069 - RNA, 19 nt, Homo sapiens
ggugagaaagccauugaga

SEQ ID NO: 940070 - RNA, 19 nt, Homo sapiens
gcaacaucgccaccuacua

SEQ ID NO: 940071 - RNA, 19 nt, Homo sapiens
ggaugggaguggugacuac

SEQ ID NO: 940072 - RNA, 19 nt, Homo sapiens
gggagaugccuacuucugu

SEQ ID NO: 940073 - RNA, 19 nt, Homo sapiens
gaaggguucuguggucaac

SEQ ID NO: 940074 - RNA, 19 nt, Homo sapiens
ggaugaacaagcagcagaa

SEQ ID NO: 940075 - RNA, 19 nt, Homo sapiens
guagaagagagaacaagga

SEQ ID NO: 940076 - RNA, 19 nt, Homo sapiens
ggaagcugcaggagaagga

SEQ ID NO: 940077 - RNA, 19 nt, Homo sapiens
agaaguggucuaagaaguu

SEQ ID NO: 940078 - RNA, 19 nt, Homo sapiens
uaugauuacaggagugaua

SEQ ID NO: 940079 - RNA, 19 nt, Homo sapiens
cagaggucaucgccuguga

SEQ ID NO: 940080 - RNA, 19 nt, Homo sapiens
ugacagcaauggguacaca

SEQ ID NO: 940081 - RNA, 19 nt, Homo sapiens
caacucagaggcuuuaaaa

SEQ ID NO: 940082 - RNA, 19 nt, Homo sapiens
cugaugccaccuaugauua

SEQ ID NO: 940083 - RNA, 19 nt, Homo sapiens
cuacuucuguggccuacau

SEQ ID NO: 940084 - RNA, 19 nt, Homo sapiens
gaacaaggaugaacaagca

SEQ ID NO: 940085 - RNA, 19 nt, Homo sapiens
gaagagagaacaaggauga

SEQ ID NO: 940086 - RNA, 19 nt, Homo sapiens
gaacagcuaugacaucuac

SEQ ID NO: 940087 - RNA, 19 nt, Homo sapiens
ugacugaccugguaaagaa

SEQ ID NO: 940088 - RNA, 19 nt, Homo sapiens
gcacuaccguguugugaaa

SEQ ID NO: 940089 - RNA, 19 nt, Homo sapiens
ggaacaagauucugcacaa

SEQ ID NO: 940090 - RNA, 19 nt, Homo sapiens
ggaacaaacugcgggugua

SEQ ID NO: 940091 - RNA, 19 nt, Homo sapiens
gaacaagauucugcacaau

SEQ ID NO: 940092 - RNA, 19 nt, Homo sapiens
gaaagaggagacagaauau

SEQ ID NO: 940093 - RNA, 19 nt, Homo sapiens
caagguguauggacucauu

SEQ ID NO: 940094 - RNA, 19 nt, Homo sapiens
agaaagaggagacagaaua

SEQ ID NO: 940095 - RNA, 19 nt, Homo sapiens
gauauuuggucucuaggaa

SEQ ID NO: 940096 - RNA, 19 nt, Homo sapiens
ggaagccccuguaccauua

SEQ ID NO: 940097 - RNA, 19 nt, Homo sapiens
acaagauucugcacaauga

SEQ ID NO: 940098 - RNA, 19 nt, Homo sapiens
gaaguggucuaagaaguuc

SEQ ID NO: 940099 - RNA, 19 nt, Homo sapiens
ggagauagcgccugucagu

SEQ ID NO: 940100 - RNA, 19 nt, Homo sapiens
ucaaccagcucccaccaaa

SEQ ID NO: 940101 - RNA, 19 nt, Homo sapiens
ccaagaaggccauggacua

SEQ ID NO: 940102 - RNA, 19 nt, Homo sapiens
gagcaugccuaccucaagu

SEQ ID NO: 940103 - RNA, 19 nt, Homo sapiens
ggucuaagaaguucauuga

SEQ ID NO: 940104 - RNA, 19 nt, Homo sapiens
ggaaguacaagaagcgauu

SEQ ID NO: 940105 - RNA, 19 nt, Homo sapiens
uuggauauccuguuuguua

SEQ ID NO: 940106 - RNA, 19 nt, Homo sapiens
ggccuuggauauccuguuu

SEQ ID NO: 940107 - RNA, 19 nt, Homo sapiens
aaccguaacugcaucauga

SEQ ID NO: 940108 - RNA, 19 nt, Homo sapiens
acaaacugcggguguauua

SEQ ID NO: 940109 - RNA, 19 nt, Homo sapiens
gagcaacucagaggcuuua

SEQ ID NO: 940110 - RNA, 19 nt, Homo sapiens
ugacagccauggagaggaa

SEQ ID NO: 940111 - RNA, 19 nt, Homo sapiens
gcacaaugacccagaagug

SEQ ID NO: 940112 - RNA, 19 nt, Homo sapiens
ucaugacucugaaccguaa

SEQ ID NO: 940113 - RNA, 19 nt, Homo sapiens
ggacccugcugggaucuuu

SEQ ID NO: 940114 - RNA, 19 nt, Homo sapiens
cggagcagcuacugaaguu

SEQ ID NO: 940115 - RNA, 19 nt, Homo sapiens
gaacaaacugcggguguau

SEQ ID NO: 940116 - RNA, 19 nt, Homo sapiens
gcauagaggagcagaagga

SEQ ID NO: 940117 - RNA, 19 nt, Homo sapiens
ggagugauauuuggucucu

SEQ ID NO: 940118 - RNA, 19 nt, Homo sapiens
gaacccugaugccaccuau

SEQ ID NO: 940119 - RNA, 19 nt, Homo sapiens
caacaucgccaccuacuac

SEQ ID NO: 940120 - RNA, 19 nt, Homo sapiens
ccaagaaguggucuaagaa

SEQ ID NO: 940121 - RNA, 19 nt, Homo sapiens
uccaagaaguggucuaaga

SEQ ID NO: 940122 - RNA, 19 nt, Homo sapiens
gcaucuguauauaguguga

SEQ ID NO: 940123 - RNA, 19 nt, Homo sapiens
cagggaccauuucuucauu

SEQ ID NO: 940124 - RNA, 19 nt, Homo sapiens
ggaggacuguaucgccuau

SEQ ID NO: 940125 - RNA, 19 nt, Homo sapiens
uggauauccuguuuguuaa

SEQ ID NO: 940126 - RNA, 19 nt, Homo sapiens
guaacugcaucaugaacug

SEQ ID NO: 940127 - RNA, 19 nt, Homo sapiens
ugagaaagccauugagauc

SEQ ID NO: 940128 - RNA, 19 nt, Homo sapiens
gcaugaaucccgcugacaa

SEQ ID NO: 940129 - RNA, 19 nt, Homo sapiens
gcagcgaggaggaagauga

SEQ ID NO: 940130 - RNA, 19 nt, Homo sapiens
ccacggagcagcuacugaa

SEQ ID NO: 940131 - RNA, 19 nt, Homo sapiens
gauuacaggagugauauuu

SEQ ID NO: 940132 - RNA, 19 nt, Homo sapiens
agacggaacacuuucauug

SEQ ID NO: 940133 - RNA, 19 nt, Homo sapiens
gggcagggaccauuucuuc

SEQ ID NO: 940134 - RNA, 19 nt, Homo sapiens
gggaacagcuaugacaucu

SEQ ID NO: 940135 - RNA, 19 nt, Homo sapiens
ggagacagaauaugaguac

SEQ ID NO: 940136 - RNA, 19 nt, Homo sapiens
ugaaauacgagcggauuaa

SEQ ID NO: 940137 - RNA, 19 nt, Homo sapiens
guacaagggucggcauguc

SEQ ID NO: 940138 - RNA, 19 nt, Homo sapiens
gaaucccgcugacaaacca

SEQ ID NO: 940139 - RNA, 19 nt, Homo sapiens
aagaggagacagaauauga

SEQ ID NO: 940140 - RNA, 19 nt, Homo sapiens
gagcagcuacugaaguuuc

SEQ ID NO: 940141 - RNA, 19 nt, Homo sapiens
ugacuucauugacacaugu

SEQ ID NO: 940142 - RNA, 19 nt, Homo sapiens
ggugauccaucgagacauc

SEQ ID NO: 940143 - RNA, 19 nt, Homo sapiens
cuacggagccuucaucaag

SEQ ID NO: 940144 - RNA, 19 nt, Homo sapiens
ggauuaaguuccuggucau

SEQ ID NO: 940145 - RNA, 19 nt, Homo sapiens
gcaacucagaggcuuuaaa

SEQ ID NO: 940146 - RNA, 19 nt, Homo sapiens
uuacaggagugauauuugg

SEQ ID NO: 940147 - RNA, 19 nt, Homo sapiens
gcuugcaucuguauauagu

SEQ ID NO: 940148 - RNA, 19 nt, Homo sapiens
uggagaugcugcugugcua

SEQ ID NO: 940149 - RNA, 19 nt, Homo sapiens
cuacaucccugugcacauc

SEQ ID NO: 940150 - RNA, 19 nt, Homo sapiens
acccagaaguggagaagaa

SEQ ID NO: 940151 - RNA, 19 nt, Homo sapiens
ggagaacgggcugauguug

SEQ ID NO: 940152 - RNA, 19 nt, Homo sapiens
gcugucauccgccagaauu

SEQ ID NO: 940153 - RNA, 19 nt, Homo sapiens
ggacgaggaggaagagauc

SEQ ID NO: 940154 - RNA, 19 nt, Homo sapiens
gaaauacgagcggauuaag

SEQ ID NO: 940155 - RNA, 19 nt, Homo sapiens
gugaaauacgagcggauua

SEQ ID NO: 940156 - RNA, 19 nt, Homo sapiens
gaacagcaaaggccaaagc

SEQ ID NO: 940157 - RNA, 19 nt, Homo sapiens
ucuaagaaguucauugacu

SEQ ID NO: 940158 - RNA, 19 nt, Homo sapiens
gcagggaccauuucuucau

SEQ ID NO: 940159 - RNA, 19 nt, Homo sapiens
gaaccguaacugcaucaug

SEQ ID NO: 940160 - RNA, 19 nt, Homo sapiens
acaaauucauggccuucaa

SEQ ID NO: 940161 - RNA, 19 nt, Homo sapiens
aauacgagcggauuaaguu

SEQ ID NO: 940162 - RNA, 19 nt, Homo sapiens
gggcucaaccugcucauca

SEQ ID NO: 940163 - RNA, 19 nt, Homo sapiens
gagaacagcaaaggccaaa

SEQ ID NO: 940164 - RNA, 19 nt, Homo sapiens
gagagaacaaggaugaaca

SEQ ID NO: 940165 - RNA, 19 nt, Homo sapiens
ggagaucaacaugcugaaa

SEQ ID NO: 940166 - RNA, 19 nt, Homo sapiens
ccauugagauccgcucugu

SEQ ID NO: 940167 - RNA, 19 nt, Homo sapiens
ggugagaaagccauugaga

SEQ ID NO: 940168 - RNA, 19 nt, Homo sapiens
ggaugggaguggugacuac

SEQ ID NO: 940169 - RNA, 19 nt, Homo sapiens
gcaacaucgccaccuacua

SEQ ID NO: 940170 - RNA, 19 nt, Homo sapiens
gggagaugccuacuucugu

SEQ ID NO: 940171 - RNA, 19 nt, Homo sapiens
gaaggguucuguggucaac

SEQ ID NO: 940172 - RNA, 19 nt, Homo sapiens
gcuauaagcgagcaauugg

SEQ ID NO: 940173 - RNA, 19 nt, Homo sapiens
ggaugaacaagcagcagaa

SEQ ID NO: 940174 - RNA, 19 nt, Homo sapiens
guagaagagagaacaagga

SEQ ID NO: 940175 - RNA, 19 nt, Homo sapiens
ggaagcugcaggagaagga

SEQ ID NO: 940176 - RNA, 19 nt, Homo sapiens
agaaguggucuaagaaguu

SEQ ID NO: 940177 - RNA, 19 nt, Homo sapiens
uaugauuacaggagugaua

SEQ ID NO: 940178 - RNA, 19 nt, Homo sapiens
cagaggucaucgccuguga

SEQ ID NO: 940179 - RNA, 19 nt, Homo sapiens
ugacagcaauggguacaca

SEQ ID NO: 940180 - RNA, 19 nt, Homo sapiens
caacucagaggcuuuaaaa

SEQ ID NO: 940181 - RNA, 19 nt, Homo sapiens
cugaugccaccuaugauua

SEQ ID NO: 940182 - RNA, 19 nt, Homo sapiens
cuacuucuguggccuacau

SEQ ID NO: 940183 - RNA, 19 nt, Homo sapiens
caaacccuaccacaaauuc

SEQ ID NO: 940184 - RNA, 19 nt, Homo sapiens
gcaaauagcucuguucuug

SEQ ID NO: 940185 - RNA, 19 nt, Homo sapiens
gaaauucucugacgucuug

SEQ ID NO: 940186 - RNA, 19 nt, Homo sapiens
gaaaggagaauucagguua

SEQ ID NO: 940187 - RNA, 19 nt, Homo sapiens
ccaaagaccugguauagug

SEQ ID NO: 940188 - RNA, 19 nt, Homo sapiens
gagcaggaguuucuguaua

SEQ ID NO: 940189 - RNA, 19 nt, Homo sapiens
ggacucaucuacuggauug

SEQ ID NO: 940190 - RNA, 19 nt, Homo sapiens
ggaggcagcuggaauggaa

SEQ ID NO: 940191 - RNA, 19 nt, Homo sapiens
gaagaagucaguaccuuaa

SEQ ID NO: 940192 - RNA, 19 nt, Homo sapiens
gcacuucacuguggacaaa

SEQ ID NO: 940193 - RNA, 19 nt, Homo sapiens
ggaagaagucaguaccuua

SEQ ID NO: 940194 - RNA, 19 nt, Homo sapiens
ccaagcaauucuccugaua

SEQ ID NO: 940195 - RNA, 19 nt, Homo sapiens
caacaaugcugggaacaau

SEQ ID NO: 940196 - RNA, 19 nt, Homo sapiens
gaacacuguggcaauauaa

SEQ ID NO: 940197 - RNA, 19 nt, Homo sapiens
uagagaggauuuagaaguu

SEQ ID NO: 940198 - RNA, 19 nt, Homo sapiens
uauaaaggcucccucacuu

SEQ ID NO: 940199 - RNA, 19 nt, Homo sapiens
ugaacacuguggcaauaua

SEQ ID NO: 940200 - RNA, 19 nt, Homo sapiens
caaaguuacuccagagcaa

SEQ ID NO: 940201 - RNA, 19 nt, Homo sapiens
ggauuuagaaguuccaauu

SEQ ID NO: 940202 - RNA, 19 nt, Homo sapiens
aaaggagaauucagguuaa

SEQ ID NO: 940203 - RNA, 19 nt, Homo sapiens
ugaaugagagccuggguua

SEQ ID NO: 940204 - RNA, 19 nt, Homo sapiens
cagggcagcuuggagaaua

SEQ ID NO: 940205 - RNA, 19 nt, Homo sapiens
ugacuuugcacguuaauuu

SEQ ID NO: 940206 - RNA, 19 nt, Homo sapiens
cacaguccgugcugcauua

SEQ ID NO: 940207 - RNA, 19 nt, Homo sapiens
gaagucaguaccuuaaaug

SEQ ID NO: 940208 - RNA, 19 nt, Homo sapiens
ggaaauccugcucauggua

SEQ ID NO: 940209 - RNA, 19 nt, Homo sapiens
aagcaauucuccugauauu

SEQ ID NO: 940210 - RNA, 19 nt, Homo sapiens
ggaugacuuugcacguuaa

SEQ ID NO: 940211 - RNA, 19 nt, Homo sapiens
aaugaacacuguggcaaua

SEQ ID NO: 940212 - RNA, 19 nt, Homo sapiens
aaauagcucuguucuugga

SEQ ID NO: 940213 - RNA, 19 nt, Homo sapiens
gcaggaguuucuguauaaa

SEQ ID NO: 940214 - RNA, 19 nt, Homo sapiens
cuucaucacaucaaaguua

SEQ ID NO: 940215 - RNA, 19 nt, Homo sapiens
agcaggaguuucuguauaa

SEQ ID NO: 940216 - RNA, 19 nt, Homo sapiens
ggaugacuguggagaagga

SEQ ID NO: 940217 - RNA, 19 nt, Homo sapiens
aaagaccaauguccaguug

SEQ ID NO: 940218 - RNA, 19 nt, Homo sapiens
gaaauccugcucaugguau

SEQ ID NO: 940219 - RNA, 19 nt, Homo sapiens
gggaagaagucaguaccuu

SEQ ID NO: 940220 - RNA, 19 nt, Homo sapiens
cacccuggauucugaaauu

SEQ ID NO: 940221 - RNA, 19 nt, Homo sapiens
uaucagauguaaagaccaa

SEQ ID NO: 940222 - RNA, 19 nt, Homo sapiens
gacccuaugucccaucaga

SEQ ID NO: 940223 - RNA, 19 nt, Homo sapiens
ggacuuguaucuccuucag

SEQ ID NO: 940224 - RNA, 19 nt, Homo sapiens
guagagaggauuuagaagu

SEQ ID NO: 940225 - RNA, 19 nt, Homo sapiens
aggaugacuuugcacguua

SEQ ID NO: 940226 - RNA, 19 nt, Homo sapiens
guucuucucugguucaagu

SEQ ID NO: 940227 - RNA, 19 nt, Homo sapiens
ccaauugcccugcuaagga

SEQ ID NO: 940228 - RNA, 19 nt, Homo sapiens
gcccaaaucccagaguuaa

SEQ ID NO: 940229 - RNA, 19 nt, Homo sapiens
ggguagagaggauuuagaa

SEQ ID NO: 940230 - RNA, 19 nt, Homo sapiens
ccagugcuuuaaauacaaa

SEQ ID NO: 940231 - RNA, 19 nt, Homo sapiens
ggagaauucagguuaaagu

SEQ ID NO: 940232 - RNA, 19 nt, Homo sapiens
ggaaaggagaauucagguu

SEQ ID NO: 940233 - RNA, 19 nt, Homo sapiens
ggauuggccugacuaaagc

SEQ ID NO: 940234 - RNA, 19 nt, Homo sapiens
uaccuuaaaugcccaaauc

SEQ ID NO: 940235 - RNA, 19 nt, Homo sapiens
agaagucaguaccuuaaau

SEQ ID NO: 940236 - RNA, 19 nt, Homo sapiens
ccuggauucugaaauuaaa

SEQ ID NO: 940237 - RNA, 19 nt, Homo sapiens
ccagagcaaccaagcaauu

SEQ ID NO: 940238 - RNA, 19 nt, Homo sapiens
caggaugacuuugcacguu

SEQ ID NO: 940239 - RNA, 19 nt, Homo sapiens
cuucaggccuggaaugaug

SEQ ID NO: 940240 - RNA, 19 nt, Homo sapiens
ugaccucggugaccucaga

SEQ ID NO: 940241 - RNA, 19 nt, Homo sapiens
ucagugccuucaugaauuc

SEQ ID NO: 940242 - RNA, 19 nt, Homo sapiens
ugucuuggcuggaaauucu

SEQ ID NO: 940243 - RNA, 19 nt, Homo sapiens
uaaaggcucccucacuuca

SEQ ID NO: 940244 - RNA, 19 nt, Homo sapiens
agauccagauggugaauga

SEQ ID NO: 940245 - RNA, 19 nt, Homo sapiens
cagagaaaccucagcuuca

SEQ ID NO: 940246 - RNA, 19 nt, Homo sapiens
gccagugcuuuaaauacaa

SEQ ID NO: 940247 - RNA, 19 nt, Homo sapiens
aacaagaaguugggaagaa

SEQ ID NO: 940248 - RNA, 19 nt, Homo sapiens
caccauaucagauguaaag

SEQ ID NO: 940249 - RNA, 19 nt, Homo sapiens
gagcuccaacgcuuguuaa

SEQ ID NO: 940250 - RNA, 19 nt, Homo sapiens
uggagaauaugagcaaguu

SEQ ID NO: 940251 - RNA, 19 nt, Homo sapiens
gauuuagaaguuccaauug

SEQ ID NO: 940252 - RNA, 19 nt, Homo sapiens
ugaauucaccuuccagcuu

SEQ ID NO: 940253 - RNA, 19 nt, Homo sapiens
caagcaauucuccugauau

SEQ ID NO: 940254 - RNA, 19 nt, Homo sapiens
ggaaugaugccccauguga

SEQ ID NO: 940255 - RNA, 19 nt, Homo sapiens
ggcaccauaucagauguaa

SEQ ID NO: 940256 - RNA, 19 nt, Homo sapiens
gagaauucagguuaaagug

SEQ ID NO: 940257 - RNA, 19 nt, Homo sapiens
ucaaggggaacuucuauua

SEQ ID NO: 940258 - RNA, 19 nt, Homo sapiens
agagaaaccucagcuucau

SEQ ID NO: 940259 - RNA, 19 nt, Homo sapiens
aaggagaauucagguuaaa

SEQ ID NO: 940260 - RNA, 19 nt, Homo sapiens
uaaagaccaauguccaguu

SEQ ID NO: 940261 - RNA, 19 nt, Homo sapiens
ugaaaggucguguggacaa

SEQ ID NO: 940262 - RNA, 19 nt, Homo sapiens
cucccaagcucacucuuug

SEQ ID NO: 940263 - RNA, 19 nt, Homo sapiens
gcucccaagcucacucuuu

SEQ ID NO: 940264 - RNA, 19 nt, Homo sapiens
gaugacacgccauucaaca

SEQ ID NO: 940265 - RNA, 19 nt, Homo sapiens
gccgagcaguucugugugu

SEQ ID NO: 940266 - RNA, 19 nt, Homo sapiens
gaaaggucguguggacaac

SEQ ID NO: 940267 - RNA, 19 nt, Homo sapiens
acaaugcugggaacaauga

SEQ ID NO: 940268 - RNA, 19 nt, Homo sapiens
caggugagcccaacaaugc

SEQ ID NO: 940269 - RNA, 19 nt, Homo sapiens
ucucaaggcuggaaguacu

SEQ ID NO: 940270 - RNA, 19 nt, Homo sapiens
aaagugauuuggagaaagc

SEQ ID NO: 940271 - RNA, 19 nt, Homo sapiens
ccagcuuccucagaauaaa

SEQ ID NO: 940272 - RNA, 19 nt, Homo sapiens
ucagcuucaucacaucaaa

SEQ ID NO: 940273 - RNA, 19 nt, Homo sapiens
gcugcaggccguccuuuau

SEQ ID NO: 940274 - RNA, 19 nt, Homo sapiens
acaagaaguugggaagaag

SEQ ID NO: 940275 - RNA, 19 nt, Homo sapiens
ugggaacaaugaacacugu

SEQ ID NO: 940276 - RNA, 19 nt, Homo sapiens
gguauagugccgagcaguu

SEQ ID NO: 940277 - RNA, 19 nt, Homo sapiens
gauauucuacaggugguuu

SEQ ID NO: 940278 - RNA, 19 nt, Homo sapiens
uaacaagaaguugggaaga

SEQ ID NO: 940279 - RNA, 19 nt, Homo sapiens
caacaucagcacccuggau

SEQ ID NO: 940280 - RNA, 19 nt, Homo sapiens
ccacaguccgugcugcauu

SEQ ID NO: 940281 - RNA, 19 nt, Homo sapiens
caaugaacacuguggcaau

SEQ ID NO: 940282 - RNA, 19 nt, Homo sapiens
gacuaaagcagggauggaa

SEQ ID NO: 940283 - RNA, 19 nt, Homo sapiens
caggaugacuguggagaag

SEQ ID NO: 940284 - RNA, 19 nt, Homo sapiens
ggagugaucucaacccuaa

SEQ ID NO: 940285 - RNA, 19 nt, Homo sapiens
ggaauggccucccagauuu

SEQ ID NO: 940286 - RNA, 19 nt, Homo sapiens
gaggauaagucccgucuaa

SEQ ID NO: 940287 - RNA, 19 nt, Homo sapiens
ggaaugggcuguucuccaa

SEQ ID NO: 940288 - RNA, 19 nt, Homo sapiens
ggaaaugguauuagagaua

SEQ ID NO: 940289 - RNA, 19 nt, Homo sapiens
gagacuauguucuacaauu

SEQ ID NO: 940290 - RNA, 19 nt, Homo sapiens
gaacaucgcuguguaugag

SEQ ID NO: 940291 - RNA, 19 nt, Homo sapiens
cuaagcagcucacaacuga

SEQ ID NO: 940292 - RNA, 19 nt, Homo sapiens
caaaugcuguguaagaaga

SEQ ID NO: 940293 - RNA, 19 nt, Homo sapiens
agaaggagcuauuuaggaa

SEQ ID NO: 940294 - RNA, 19 nt, Homo sapiens
ccacccaggucaagacaua

SEQ ID NO: 940295 - RNA, 19 nt, Homo sapiens
gaaggaagcagccaaagau

SEQ ID NO: 940296 - RNA, 19 nt, Homo sapiens
ccaaggaacuggagugauc

SEQ ID NO: 940297 - RNA, 19 nt, Homo sapiens
cauaaugccuuuguaauuc

SEQ ID NO: 940298 - RNA, 19 nt, Homo sapiens
cauguucucuuauaucuug

SEQ ID NO: 940299 - RNA, 19 nt, Homo sapiens
uugaagaucugagggauua

SEQ ID NO: 940300 - RNA, 19 nt, Homo sapiens
ccacaucucuaauugacuu

SEQ ID NO: 940301 - RNA, 19 nt, Homo sapiens
guagagauguaccacaguu

SEQ ID NO: 940302 - RNA, 19 nt, Homo sapiens
ggcaaucucuccaucagaa

SEQ ID NO: 940303 - RNA, 19 nt, Homo sapiens
ggaccgagcccacuucaug

SEQ ID NO: 940304 - RNA, 19 nt, Homo sapiens
ggaagaagguggagaucag

SEQ ID NO: 940305 - RNA, 19 nt, Homo sapiens
gaggaaagaagacaucuga

SEQ ID NO: 940306 - RNA, 19 nt, Homo sapiens
gaacacaagaagcuacaaa

SEQ ID NO: 940307 - RNA, 19 nt, Homo sapiens
gaacuggagugaucucaac

SEQ ID NO: 940308 - RNA, 19 nt, Homo sapiens
ggagugaccuaccugcaau

SEQ ID NO: 940309 - RNA, 19 nt, Homo sapiens
cagaggcgcugcaagagaa

SEQ ID NO: 940310 - RNA, 19 nt, Homo sapiens
gacgaauucuucaccauga

SEQ ID NO: 940311 - RNA, 19 nt, Homo sapiens
gaagaaggaagcagccaaa

SEQ ID NO: 940312 - RNA, 19 nt, Homo sapiens
auacucagcucuuuaacuu

SEQ ID NO: 940313 - RNA, 19 nt, Homo sapiens
gucaggaucucccaaagaa

SEQ ID NO: 940314 - RNA, 19 nt, Homo sapiens
gauuauaaguccaccuguu

SEQ ID NO: 940315 - RNA, 19 nt, Homo sapiens
ggaaggcugugacaaagca

SEQ ID NO: 940316 - RNA, 19 nt, Homo sapiens
gcaaagauuuuaagaggaa

SEQ ID NO: 940317 - RNA, 19 nt, Homo sapiens
ccacugaugugauuucuac

SEQ ID NO: 940318 - RNA, 19 nt, Homo sapiens
caucaggaguggcauaaau

SEQ ID NO: 940319 - RNA, 19 nt, Homo sapiens
ggauaagucccgucuaaug

SEQ ID NO: 940320 - RNA, 19 nt, Homo sapiens
ucaaagagagcgugaagaa

SEQ ID NO: 940321 - RNA, 19 nt, Homo sapiens
gagcacagaagcaaagauu

SEQ ID NO: 940322 - RNA, 19 nt, Homo sapiens
gaagacauccgaaauacca

SEQ ID NO: 940323 - RNA, 19 nt, Homo sapiens
uaagucccgucuaauguuu

SEQ ID NO: 940324 - RNA, 19 nt, Homo sapiens
gaaggagauugaagacauc

SEQ ID NO: 940325 - RNA, 19 nt, Homo sapiens
caagaucccuaaggaguau

SEQ ID NO: 940326 - RNA, 19 nt, Homo sapiens
gaacccaacaccacccuaa

SEQ ID NO: 940327 - RNA, 19 nt, Homo sapiens
ccauaaugccuuuguaauu

SEQ ID NO: 940328 - RNA, 19 nt, Homo sapiens
gaccagcuguccuaguuug

SEQ ID NO: 940329 - RNA, 19 nt, Homo sapiens
gagcggcacuuccagaaag

SEQ ID NO: 940330 - RNA, 19 nt, Homo sapiens
uguaugaccuggaugagaa

SEQ ID NO: 940331 - RNA, 19 nt, Homo sapiens
gagaggagcagucccauca

SEQ ID NO: 940332 - RNA, 19 nt, Homo sapiens
gugaccagcuguccuaguu

SEQ ID NO: 940333 - RNA, 19 nt, Homo sapiens
ggacccagcgucaguuuga

SEQ ID NO: 940334 - RNA, 19 nt, Homo sapiens
gccaaaugcuguguaagaa

SEQ ID NO: 940335 - RNA, 19 nt, Homo sapiens
gauaagucccgucuaaugu

SEQ ID NO: 940336 - RNA, 19 nt, Homo sapiens
ggaaugaccaagaauguag

SEQ ID NO: 940337 - RNA, 19 nt, Homo sapiens
guaccuugauggaccguuu

SEQ ID NO: 940338 - RNA, 19 nt, Homo sapiens
ccaaagcuguaccuugaug

SEQ ID NO: 940339 - RNA, 19 nt, Homo sapiens
acccaaagcuguaccuuga

SEQ ID NO: 940340 - RNA, 19 nt, Homo sapiens
gagcugacaugggaggauu

SEQ ID NO: 940341 - RNA, 19 nt, Homo sapiens
gagaaggagcuauuuagga

SEQ ID NO: 940342 - RNA, 19 nt, Homo sapiens
gaaggcagcagcccugguu

SEQ ID NO: 940343 - RNA, 19 nt, Homo sapiens
gcccugauauucuugaugu

SEQ ID NO: 940344 - RNA, 19 nt, Homo sapiens
agacuauguucuacaauug

SEQ ID NO: 940345 - RNA, 19 nt, Homo sapiens
gcauaaauuugagguguca

SEQ ID NO: 940346 - RNA, 19 nt, Homo sapiens
ucagggagaucuacucauc

SEQ ID NO: 940347 - RNA, 19 nt, Homo sapiens
ggagguggaaaugguauua

SEQ ID NO: 940348 - RNA, 19 nt, Homo sapiens
ggaagcagccaaagaugga

SEQ ID NO: 940349 - RNA, 19 nt, Homo sapiens
gagcaguucuucucuacca

SEQ ID NO: 940350 - RNA, 19 nt, Homo sapiens
uaccacaguuuguuuauuc

SEQ ID NO: 940351 - RNA, 19 nt, Homo sapiens
ccagacaauuauacaaaug

SEQ ID NO: 940352 - RNA, 19 nt, Homo sapiens
gaccaagaauguagagaag

SEQ ID NO: 940353 - RNA, 19 nt, Homo sapiens
ugacugugcuugacuucuu

SEQ ID NO: 940354 - RNA, 19 nt, Homo sapiens
gaacaaggguuuucaaagc

SEQ ID NO: 940355 - RNA, 19 nt, Homo sapiens
ccaaggacccagagagaaa

SEQ ID NO: 940356 - RNA, 19 nt, Homo sapiens
ugacaaguguggaggugaa

SEQ ID NO: 940357 - RNA, 19 nt, Homo sapiens
ugauccagcugcccacuuu

SEQ ID NO: 940358 - RNA, 19 nt, Homo sapiens
caucauccauggcagcuau

SEQ ID NO: 940359 - RNA, 19 nt, Homo sapiens
cgucuaauguuuaccaugu

SEQ ID NO: 940360 - RNA, 19 nt, Homo sapiens
agaaggagauugaagacau

SEQ ID NO: 940361 - RNA, 19 nt, Homo sapiens
ccaagaaggagauugaaga

SEQ ID NO: 940362 - RNA, 19 nt, Homo sapiens
guaccacaguuuguuuauu

SEQ ID NO: 940363 - RNA, 19 nt, Homo sapiens
gcugaguaguauucuauug

SEQ ID NO: 940364 - RNA, 19 nt, Homo sapiens
ggaccaccaugcuauacau

SEQ ID NO: 940365 - RNA, 19 nt, Homo sapiens
uaugacggcugguuuaaca

SEQ ID NO: 940366 - RNA, 19 nt, Homo sapiens
ucaucgggcucuuuccuaa

SEQ ID NO: 940367 - RNA, 19 nt, Homo sapiens
gggauccucuggcugagaa

SEQ ID NO: 940368 - RNA, 19 nt, Homo sapiens
gcacccugcugcucaagau

SEQ ID NO: 940369 - RNA, 19 nt, Homo sapiens
acaagaagcuacaaaagaa

SEQ ID NO: 940370 - RNA, 19 nt, Homo sapiens
gaagcaaccacugauguga

SEQ ID NO: 940371 - RNA, 19 nt, Homo sapiens
gaggagcagucccaucauc

SEQ ID NO: 940372 - RNA, 19 nt, Homo sapiens
gcacagaagcaaagauuuu

SEQ ID NO: 940373 - RNA, 19 nt, Homo sapiens
gcaccacuaugagaacuuc

SEQ ID NO: 940374 - RNA, 19 nt, Homo sapiens
ggaaagaagacaucugaac

SEQ ID NO: 940375 - RNA, 19 nt, Homo sapiens
caucuguguuggcguguuu

SEQ ID NO: 940376 - RNA, 19 nt, Homo sapiens
ggugaccgcuacugguuug

SEQ ID NO: 940377 - RNA, 19 nt, Homo sapiens
ggcaggagacuauguucua

SEQ ID NO: 940378 - RNA, 19 nt, Homo sapiens
acacagaggcgcugcaaga

SEQ ID NO: 940379 - RNA, 19 nt, Homo sapiens
gaccuggugcugcuguuua

SEQ ID NO: 940380 - RNA, 19 nt, Homo sapiens
ggacggcagcgccaucuau

SEQ ID NO: 940381 - RNA, 19 nt, Homo sapiens
gauauucaguacucgaucu

SEQ ID NO: 940382 - RNA, 19 nt, Homo sapiens
gcuggucgcuguuaucaac

SEQ ID NO: 940383 - RNA, 19 nt, Homo sapiens
gcgagagacuuuccucaac

SEQ ID NO: 940384 - RNA, 19 nt, Homo sapiens
gaacagaccugacuauguc

SEQ ID NO: 940385 - RNA, 19 nt, Homo sapiens
gaaauuaucccaagcugua

SEQ ID NO: 940386 - RNA, 19 nt, Homo sapiens
cgaaccagcucucagaaua

SEQ ID NO: 940387 - RNA, 19 nt, Homo sapiens
gaauuacagugaagacuuu

SEQ ID NO: 940388 - RNA, 19 nt, Homo sapiens
cauauuaccugugguguua

SEQ ID NO: 940389 - RNA, 19 nt, Homo sapiens
ggacaagauuugaauacaa

SEQ ID NO: 940390 - RNA, 19 nt, Homo sapiens
caggagggcugcugaagua

SEQ ID NO: 940391 - RNA, 19 nt, Homo sapiens
aaagagacccugaagaaua

SEQ ID NO: 940392 - RNA, 19 nt, Homo sapiens
gaucacagccucuacauau

SEQ ID NO: 940393 - RNA, 19 nt, Homo sapiens
gggcuaggauugugucuaa

SEQ ID NO: 940394 - RNA, 19 nt, Homo sapiens
gaaucaaucagcuguguua

SEQ ID NO: 940395 - RNA, 19 nt, Homo sapiens
gcagagauauccaguccuu

SEQ ID NO: 940396 - RNA, 19 nt, Homo sapiens
gcacugaauucaagacugu

SEQ ID NO: 940397 - RNA, 19 nt, Homo sapiens
ccaaagagacccugaagaa

SEQ ID NO: 940398 - RNA, 19 nt, Homo sapiens
gccgaacacucuuggcuua

SEQ ID NO: 940399 - RNA, 19 nt, Homo sapiens
agaacgauuucgagauuua

SEQ ID NO: 940400 - RNA, 19 nt, Homo sapiens
gcaggacucuaaagaagga

SEQ ID NO: 940401 - RNA, 19 nt, Homo sapiens
gaaggaaugagugcaauuu

SEQ ID NO: 940402 - RNA, 19 nt, Homo sapiens
aggaaucacugaacuauga

SEQ ID NO: 940403 - RNA, 19 nt, Homo sapiens
acagaacgauuucgagauu

SEQ ID NO: 940404 - RNA, 19 nt, Homo sapiens
agcagaacauuccauauua

SEQ ID NO: 940405 - RNA, 19 nt, Homo sapiens
gaacaaaugcaagauugaa

SEQ ID NO: 940406 - RNA, 19 nt, Homo sapiens
ggaaugagugcaauuucua

SEQ ID NO: 940407 - RNA, 19 nt, Homo sapiens
gaaauucugcccuucauuc

SEQ ID NO: 940408 - RNA, 19 nt, Homo sapiens
caguguaucugcauuagaa

SEQ ID NO: 940409 - RNA, 19 nt, Homo sapiens
gagaugaggauccuagaaa

SEQ ID NO: 940410 - RNA, 19 nt, Homo sapiens
gaagcaggacucuaaagaa

SEQ ID NO: 940411 - RNA, 19 nt, Homo sapiens
gagcccagauuccaagcua

SEQ ID NO: 940412 - RNA, 19 nt, Homo sapiens
aaacuucucuucacaacug

SEQ ID NO: 940413 - RNA, 19 nt, Homo sapiens
aagagacccugaagaauau

SEQ ID NO: 940414 - RNA, 19 nt, Homo sapiens
gcagcaagauaccgagaug

SEQ ID NO: 940415 - RNA, 19 nt, Homo sapiens
gcccucaacuucucaguga

SEQ ID NO: 940416 - RNA, 19 nt, Homo sapiens
gcagaacauuccauauuac

SEQ ID NO: 940417 - RNA, 19 nt, Homo sapiens
ccacagacuuggcuuugga

SEQ ID NO: 940418 - RNA, 19 nt, Homo sapiens
ccaggagauuguuggauaa

SEQ ID NO: 940419 - RNA, 19 nt, Homo sapiens
gaaugagugcaauuucuaa

SEQ ID NO: 940420 - RNA, 19 nt, Homo sapiens
ccucagaugucauggaaau

SEQ ID NO: 940421 - RNA, 19 nt, Homo sapiens
gcaauaagccagucaccau

SEQ ID NO: 940422 - RNA, 19 nt, Homo sapiens
acuaugauaucuucuggua

SEQ ID NO: 940423 - RNA, 19 nt, Homo sapiens
ccaugaagcaggacucuaa

SEQ ID NO: 940424 - RNA, 19 nt, Homo sapiens
caacucauaugggacaaga

SEQ ID NO: 940425 - RNA, 19 nt, Homo sapiens
guaaccagaacaacucaua

SEQ ID NO: 940426 - RNA, 19 nt, Homo sapiens
gaugggauacagaagauaa

SEQ ID NO: 940427 - RNA, 19 nt, Homo sapiens
ccaaagaauaguaagguuu

SEQ ID NO: 940428 - RNA, 19 nt, Homo sapiens
uggaaaccauacaagcuua

SEQ ID NO: 940429 - RNA, 19 nt, Homo sapiens
gaaccagcucucagaauau

SEQ ID NO: 940430 - RNA, 19 nt, Homo sapiens
gagggcugcugaaguauca

SEQ ID NO: 940431 - RNA, 19 nt, Homo sapiens
gcaggccgcacaacuguaa

SEQ ID NO: 940432 - RNA, 19 nt, Homo sapiens
gugagaauguggcaagaug

SEQ ID NO: 940433 - RNA, 19 nt, Homo sapiens
aaccucaacugcagccuua

SEQ ID NO: 940434 - RNA, 19 nt, Homo sapiens
agacuuggcuuuggauuuc

SEQ ID NO: 940435 - RNA, 19 nt, Homo sapiens
gcugaaguaucaaacuaau

SEQ ID NO: 940436 - RNA, 19 nt, Homo sapiens
uucaagaacucccuaguga

SEQ ID NO: 940437 - RNA, 19 nt, Homo sapiens
ggaaguccauuugaggaau

SEQ ID NO: 940438 - RNA, 19 nt, Homo sapiens
cugcugacguugcauguuu

SEQ ID NO: 940439 - RNA, 19 nt, Homo sapiens
gcauguggcugcccaucug

SEQ ID NO: 940440 - RNA, 19 nt, Homo sapiens
gaaacucagcggaaucaau

SEQ ID NO: 940441 - RNA, 19 nt, Homo sapiens
aaacagaugggauacagaa

SEQ ID NO: 940442 - RNA, 19 nt, Homo sapiens
aaaccuucuugcuguauaa

SEQ ID NO: 940443 - RNA, 19 nt, Homo sapiens
ucaugaaccuuucccugaa

SEQ ID NO: 940444 - RNA, 19 nt, Homo sapiens
cauaaccucuucuuugucu

SEQ ID NO: 940445 - RNA, 19 nt, Homo sapiens
ucaaucagcuguguuaugc

SEQ ID NO: 940446 - RNA, 19 nt, Homo sapiens
ucuaagacuuugaaacuca

SEQ ID NO: 940447 - RNA, 19 nt, Homo sapiens
gaaguccauuugaggaauc

SEQ ID NO: 940448 - RNA, 19 nt, Homo sapiens
aagcagaacauuccauauu

SEQ ID NO: 940449 - RNA, 19 nt, Homo sapiens
accaggagauuguuggaua

SEQ ID NO: 940450 - RNA, 19 nt, Homo sapiens
gccaaagaauaguaagguu

SEQ ID NO: 940451 - RNA, 19 nt, Homo sapiens
cguccucgguggaaacuuu

SEQ ID NO: 940452 - RNA, 19 nt, Homo sapiens
gcuuagaagacuauacuuu

SEQ ID NO: 940453 - RNA, 19 nt, Homo sapiens
ggaaaaccuucuugcugua

SEQ ID NO: 940454 - RNA, 19 nt, Homo sapiens
gcauggugguggugcuauu

SEQ ID NO: 940455 - RNA, 19 nt, Homo sapiens
gguguuacuaucuguauuu

SEQ ID NO: 940456 - RNA, 19 nt, Homo sapiens
aagcaggacucuaaagaag

SEQ ID NO: 940457 - RNA, 19 nt, Homo sapiens
gggacaagauuugaauaca

SEQ ID NO: 940458 - RNA, 19 nt, Homo sapiens
ucauuucggucauaaguca

SEQ ID NO: 940459 - RNA, 19 nt, Homo sapiens
uugaacaaaugcaagauug

SEQ ID NO: 940460 - RNA, 19 nt, Homo sapiens
cagaugggauacagaagau

SEQ ID NO: 940461 - RNA, 19 nt, Homo sapiens
gggcuuccacucagucuuu

SEQ ID NO: 940462 - RNA, 19 nt, Homo sapiens
gugaggagcugaacuugcu

SEQ ID NO: 940463 - RNA, 19 nt, Homo sapiens
gcuguguuaugccaaagaa

SEQ ID NO: 940464 - RNA, 19 nt, Homo sapiens
ccaauucacuauccaagac

SEQ ID NO: 940465 - RNA, 19 nt, Homo sapiens
guaccucagucaaacagau

SEQ ID NO: 940466 - RNA, 19 nt, Homo sapiens
ccauuugcaucaauacuca

SEQ ID NO: 940467 - RNA, 19 nt, Homo sapiens
uaacuccauuugcaucaau

SEQ ID NO: 940468 - RNA, 19 nt, Homo sapiens
guaggagacuggacagaac

SEQ ID NO: 940469 - RNA, 19 nt, Homo sapiens
cugcugaaguaucaaacua

SEQ ID NO: 940470 - RNA, 19 nt, Homo sapiens
ugaacugaaugcagcaaga

SEQ ID NO: 940471 - RNA, 19 nt, Homo sapiens
gaugcacacuguugauuuu

SEQ ID NO: 940472 - RNA, 19 nt, Homo sapiens
uaaccaagggccagaguau

SEQ ID NO: 940473 - RNA, 19 nt, Homo sapiens
agacuggacagaacgauuu

SEQ ID NO: 940474 - RNA, 19 nt, Homo sapiens
guacugugccgaaagacuu

SEQ ID NO: 940475 - RNA, 19 nt, Homo sapiens
ccagauuccaagcuaauuu

SEQ ID NO: 940476 - RNA, 19 nt, Homo sapiens
gauaucuucugguauacuc

SEQ ID NO: 940477 - RNA, 19 nt, Homo sapiens
guggugcuauuccucauga

SEQ ID NO: 940478 - RNA, 19 nt, Homo sapiens
caaagagacccugaagaau

SEQ ID NO: 940479 - RNA, 19 nt, Homo sapiens
ugaaaccaaagcaacauuu

SEQ ID NO: 940480 - RNA, 19 nt, Homo sapiens
caccaucauuucggucaua

SEQ ID NO: 940481 - RNA, 19 nt, Homo sapiens
acucauaaccucuucuuug

SEQ ID NO: 940482 - RNA, 19 nt, Homo sapiens
uguguuaugccaaagaaua

SEQ ID NO: 940483 - RNA, 19 nt, Homo sapiens
aaacucagcggaaucaauc

SEQ ID NO: 940484 - RNA, 19 nt, Homo sapiens
gaacugcccugacagaugu

SEQ ID NO: 940485 - RNA, 19 nt, Homo sapiens
guugggaacuggugaauaa

SEQ ID NO: 940486 - RNA, 19 nt, Homo sapiens
gagaagaaauuuccugaca

SEQ ID NO: 940487 - RNA, 19 nt, Homo sapiens
gggaacuggugaauaauaa

SEQ ID NO: 940488 - RNA, 19 nt, Homo sapiens
ugacagauguauuucacua

SEQ ID NO: 940489 - RNA, 19 nt, Homo sapiens
gugguuugcugaucucuua

SEQ ID NO: 940490 - RNA, 19 nt, Homo sapiens
guaugcaugugaaagaaua

SEQ ID NO: 940491 - RNA, 19 nt, Homo sapiens
ggugaucucucuggcuuua

SEQ ID NO: 940492 - RNA, 19 nt, Homo sapiens
aaaucaggcucuucacaua

SEQ ID NO: 940493 - RNA, 19 nt, Homo sapiens
gagggucucuccaccauau

SEQ ID NO: 940494 - RNA, 19 nt, Homo sapiens
gagguguucauuucuauua

SEQ ID NO: 940495 - RNA, 19 nt, Homo sapiens
gggaagcccuuacuaacga

SEQ ID NO: 940496 - RNA, 19 nt, Homo sapiens
ggaggagucuuuccauuac

SEQ ID NO: 940497 - RNA, 19 nt, Homo sapiens
ccagagguguucauuucua

SEQ ID NO: 940498 - RNA, 19 nt, Homo sapiens
ccuaugaguuguucuggua

SEQ ID NO: 940499 - RNA, 19 nt, Homo sapiens
ucaagcagauugccuacaa

SEQ ID NO: 940500 - RNA, 19 nt, Homo sapiens
caacaucaccuucuguaga

SEQ ID NO: 940501 - RNA, 19 nt, Homo sapiens
gaggaggagucuuuccauu

SEQ ID NO: 940502 - RNA, 19 nt, Homo sapiens
gcuuuagucuugaucauga

SEQ ID NO: 940503 - RNA, 19 nt, Homo sapiens
aaacacaaccacugaauug

SEQ ID NO: 940504 - RNA, 19 nt, Homo sapiens
aaggagagcuucuagacuu

SEQ ID NO: 940505 - RNA, 19 nt, Homo sapiens
ugagcaagguguauuucua

SEQ ID NO: 940506 - RNA, 19 nt, Homo sapiens
ucucauggcugggaauaaa

SEQ ID NO: 940507 - RNA, 19 nt, Homo sapiens
ccacaaacacaaccacuga

SEQ ID NO: 940508 - RNA, 19 nt, Homo sapiens
cacaaccacugaauugcua

SEQ ID NO: 940509 - RNA, 19 nt, Homo sapiens
ugacgugauuacaggcuua

SEQ ID NO: 940510 - RNA, 19 nt, Homo sapiens
gaggucaaguccaggcauu

SEQ ID NO: 940511 - RNA, 19 nt, Homo sapiens
ggucuuguaugcaugugaa

SEQ ID NO: 940512 - RNA, 19 nt, Homo sapiens
ucagacaggccuccuauga

SEQ ID NO: 940513 - RNA, 19 nt, Homo sapiens
acaaugaguucaagcagau

SEQ ID NO: 940514 - RNA, 19 nt, Homo sapiens
agacaggccuccuaugagu

SEQ ID NO: 940515 - RNA, 19 nt, Homo sapiens
ugggauagcuguuaaugca

SEQ ID NO: 940516 - RNA, 19 nt, Homo sapiens
gaacaguacacuauaccau

SEQ ID NO: 940517 - RNA, 19 nt, Homo sapiens
caaagaacuccaccaggaa

SEQ ID NO: 940518 - RNA, 19 nt, Homo sapiens
ggaacugcccugacagaug

SEQ ID NO: 940519 - RNA, 19 nt, Homo sapiens
caaacacaaccacugaauu

SEQ ID NO: 940520 - RNA, 19 nt, Homo sapiens
cauacuuccuuagcuuaua

SEQ ID NO: 940521 - RNA, 19 nt, Homo sapiens
caaaagaugugccacuugu

SEQ ID NO: 940522 - RNA, 19 nt, Homo sapiens
guucuucuguggaccuaaa

SEQ ID NO: 940523 - RNA, 19 nt, Homo sapiens
cgaaaauacugacgugauu

SEQ ID NO: 940524 - RNA, 19 nt, Homo sapiens
gcacgagcauccgcacugu

SEQ ID NO: 940525 - RNA, 19 nt, Homo sapiens
uaacuauugugaacaguac

SEQ ID NO: 940526 - RNA, 19 nt, Homo sapiens
agacacaggugagggagaa

SEQ ID NO: 940527 - RNA, 19 nt, Homo sapiens
cagagguguucauuucuau

SEQ ID NO: 940528 - RNA, 19 nt, Homo sapiens
guguauuucuacuggauuu

SEQ ID NO: 940529 - RNA, 19 nt, Homo sapiens
ccucagauuucacaaacug

SEQ ID NO: 940530 - RNA, 19 nt, Homo sapiens
gaggaggcaauuagacaaa

SEQ ID NO: 940531 - RNA, 19 nt, Homo sapiens
cauaagaggaacaaguauu

SEQ ID NO: 940532 - RNA, 19 nt, Homo sapiens
aggaggagucuuuccauua

SEQ ID NO: 940533 - RNA, 19 nt, Homo sapiens
acuauaccauacuuccuua

SEQ ID NO: 940534 - RNA, 19 nt, Homo sapiens
caacaaggagagcuucuag

SEQ ID NO: 940535 - RNA, 19 nt, Homo sapiens
aaagaugugccacuuguau

SEQ ID NO: 940536 - RNA, 19 nt, Homo sapiens
ucgcugcucuucugaaauc

SEQ ID NO: 940537 - RNA, 19 nt, Homo sapiens
gaaaauacugacgugauua

SEQ ID NO: 940538 - RNA, 19 nt, Homo sapiens
gacccaacauccagacaca

SEQ ID NO: 940539 - RNA, 19 nt, Homo sapiens
gugacggccuguugauaug

SEQ ID NO: 940540 - RNA, 19 nt, Homo sapiens
ggaggaggcaauuagacaa

SEQ ID NO: 940541 - RNA, 19 nt, Homo sapiens
caugucauauacaacagaa

SEQ ID NO: 940542 - RNA, 19 nt, Homo sapiens
gcacaacaucaccuucugu

SEQ ID NO: 940543 - RNA, 19 nt, Homo sapiens
uaccauacuuccuuagcuu

SEQ ID NO: 940544 - RNA, 19 nt, Homo sapiens
gagcaacaaguaucaugau

SEQ ID NO: 940545 - RNA, 19 nt, Homo sapiens
gggucucuccaccauauua

SEQ ID NO: 940546 - RNA, 19 nt, Homo sapiens
ggacuucuggccgcacuuu

SEQ ID NO: 940547 - RNA, 19 nt, Homo sapiens
gguguucauuucuauuaca

SEQ ID NO: 940548 - RNA, 19 nt, Homo sapiens
cgaagagcaacaaguauca

SEQ ID NO: 940549 - RNA, 19 nt, Homo sapiens
caucguggcgcauuucuuc

SEQ ID NO: 940550 - RNA, 19 nt, Homo sapiens
gagcaagguguauuucuac

SEQ ID NO: 940551 - RNA, 19 nt, Homo sapiens
aacaguacacuauaccaua

SEQ ID NO: 940552 - RNA, 19 nt, Homo sapiens
gcagugcccagccauaucu

SEQ ID NO: 940553 - RNA, 19 nt, Homo sapiens
ggcagacaguggcccaaug

SEQ ID NO: 940554 - RNA, 19 nt, Homo sapiens
cacaacaucaccuucugua

SEQ ID NO: 940555 - RNA, 19 nt, Homo sapiens
gaggagucuuuccauuaca

SEQ ID NO: 940556 - RNA, 19 nt, Homo sapiens
ugggaacuggugaauaaua

SEQ ID NO: 940557 - RNA, 19 nt, Homo sapiens
gcuuuacacugggacgaaa

SEQ ID NO: 940558 - RNA, 19 nt, Homo sapiens
gcucuucugaaaucuauau

SEQ ID NO: 940559 - RNA, 19 nt, Homo sapiens
ggugagggagaagaaauuu

SEQ ID NO: 940560 - RNA, 19 nt, Homo sapiens
uaacugcaugcuaauucua

SEQ ID NO: 940561 - RNA, 19 nt, Homo sapiens
acaguacacuauaccauac

SEQ ID NO: 940562 - RNA, 19 nt, Homo sapiens
aggagagcuucuagacuuu

SEQ ID NO: 940563 - RNA, 19 nt, Homo sapiens
cuucgcugcucuucugaaa

SEQ ID NO: 940564 - RNA, 19 nt, Homo sapiens
aagaaguugucauuaccaa

SEQ ID NO: 940565 - RNA, 19 nt, Homo sapiens
acaaacuggucgccuaugg

SEQ ID NO: 940566 - RNA, 19 nt, Homo sapiens
ccauuacacacgaguuauu

SEQ ID NO: 940567 - RNA, 19 nt, Homo sapiens
uggaaacacggaugaguga

SEQ ID NO: 940568 - RNA, 19 nt, Homo sapiens
ggugcuggauuuugaauga

SEQ ID NO: 940569 - RNA, 19 nt, Homo sapiens
uaauuagguucuggcgauu

SEQ ID NO: 940570 - RNA, 19 nt, Homo sapiens
caucagacaggccuccuau

SEQ ID NO: 940571 - RNA, 19 nt, Homo sapiens
cauuacacacgaguuauuu

SEQ ID NO: 940572 - RNA, 19 nt, Homo sapiens
gagagcuucuagacuuugg

SEQ ID NO: 940573 - RNA, 19 nt, Homo sapiens
ccauauuaguacucucaug

SEQ ID NO: 940574 - RNA, 19 nt, Homo sapiens
cagcaguauuggcguguuc

SEQ ID NO: 940575 - RNA, 19 nt, Homo sapiens
ggaacccucggcuuggaaa

SEQ ID NO: 940576 - RNA, 19 nt, Homo sapiens
uaauaccugucagucgaaa

SEQ ID NO: 940577 - RNA, 19 nt, Homo sapiens
ggagagcuucuagacuuug

SEQ ID NO: 940578 - RNA, 19 nt, Homo sapiens
gcagcaguauuggcguguu

SEQ ID NO: 940579 - RNA, 19 nt, Homo sapiens
cuucugaaaucuauauggu

SEQ ID NO: 940580 - RNA, 19 nt, Homo sapiens
aaaccucagauuucacaaa

SEQ ID NO: 940581 - RNA, 19 nt, Homo sapiens
uaagaggaacaaguauuug

SEQ ID NO: 940582 - RNA, 19 nt, Homo sapiens
ccugucagucgaaaccuua

SEQ ID NO: 940583 - RNA, 19 nt, Homo sapiens
ggaacuggugaauaauaau

SEQ ID NO: 940584 - RNA, 19 nt, Homo sapiens
gggagaagcuggugagaaa

SEQ ID NO: 940585 - RNA, 19 nt, Homo sapiens
gagaggagcugucuuucaa

SEQ ID NO: 940586 - RNA, 19 nt, Homo sapiens
uaagggaucuauuggauuu

SEQ ID NO: 940587 - RNA, 19 nt, Homo sapiens
gcaaggcccuccaggauuc

SEQ ID NO: 940588 - RNA, 19 nt, Homo sapiens
cagcauagauggugagaug

SEQ ID NO: 940589 - RNA, 19 nt, Homo sapiens
gaaggccacuuuccugaga

SEQ ID NO: 940590 - RNA, 19 nt, Homo sapiens
uaauggugcugcccuauuu

SEQ ID NO: 940591 - RNA, 19 nt, Homo sapiens
agaauaaacugaugaacug

SEQ ID NO: 940592 - RNA, 19 nt, Homo sapiens
agacucagcucucuaugaa

SEQ ID NO: 940593 - RNA, 19 nt, Homo sapiens
gggcauaauuugcaucuca

SEQ ID NO: 940594 - RNA, 19 nt, Homo sapiens
gcaggcggcuccuuuaaag

SEQ ID NO: 940595 - RNA, 19 nt, Homo sapiens
ggacucaguuccagaucuu

SEQ ID NO: 940596 - RNA, 19 nt, Homo sapiens
gggagacccuggugauguu

SEQ ID NO: 940597 - RNA, 19 nt, Homo sapiens
ggaccuaagggaucuauug

SEQ ID NO: 940598 - RNA, 19 nt, Homo sapiens
gcugggauaugaugagaga

SEQ ID NO: 940599 - RNA, 19 nt, Homo sapiens
ggacugaggucggacuaca

SEQ ID NO: 940600 - RNA, 19 nt, Homo sapiens
ggacagacgaagacccuuu

SEQ ID NO: 940601 - RNA, 19 nt, Homo sapiens
gaguaaaggcgauaaagga

SEQ ID NO: 940602 - RNA, 19 nt, Homo sapiens
ucacaucgcugagcuugga

SEQ ID NO: 940603 - RNA, 19 nt, Homo sapiens
ggauugaucggucucauug

SEQ ID NO: 940604 - RNA, 19 nt, Homo sapiens
ccugguagcugacugugaa

SEQ ID NO: 940605 - RNA, 19 nt, Homo sapiens
gagaauaaacugaugaacu

SEQ ID NO: 940606 - RNA, 19 nt, Homo sapiens
cagcugaacuuccugaaac

SEQ ID NO: 940607 - RNA, 19 nt, Homo sapiens
gaacuucuccuugcugauc

SEQ ID NO: 940608 - RNA, 19 nt, Homo sapiens
ggccauagggcauaauuug

SEQ ID NO: 940609 - RNA, 19 nt, Homo sapiens
ugccaggccucccagguua

SEQ ID NO: 940610 - RNA, 19 nt, Homo sapiens
ccuaagggaucuauuggau

SEQ ID NO: 940611 - RNA, 19 nt, Homo sapiens
ggagaggagcugucuuuca

SEQ ID NO: 940612 - RNA, 19 nt, Homo sapiens
aguuugagaucgugaaauu

SEQ ID NO: 940613 - RNA, 19 nt, Homo sapiens
gaaucaggauccuaauggu

SEQ ID NO: 940614 - RNA, 19 nt, Homo sapiens
aaagggaagucgggaaaga

SEQ ID NO: 940615 - RNA, 19 nt, Homo sapiens
cagggaggaugaagaagga

SEQ ID NO: 940616 - RNA, 19 nt, Homo sapiens
auaaacugaugaacuguga

SEQ ID NO: 940617 - RNA, 19 nt, Homo sapiens
gaaguuugagaucgugaaa

SEQ ID NO: 940618 - RNA, 19 nt, Homo sapiens
gaaauuuggaccucaaguc

SEQ ID NO: 940619 - RNA, 19 nt, Homo sapiens
caugaugccguuccaguuu

SEQ ID NO: 940620 - RNA, 19 nt, Homo sapiens
agggaaggcugggauauga

SEQ ID NO: 940621 - RNA, 19 nt, Homo sapiens
ggaaaggacagacgaagac

SEQ ID NO: 940622 - RNA, 19 nt, Homo sapiens
ggaaggcugggauaugaug

SEQ ID NO: 940623 - RNA, 19 nt, Homo sapiens
ccacagcucgccagaacuu

SEQ ID NO: 940624 - RNA, 19 nt, Homo sapiens
gcagcugaacuuccugaaa

SEQ ID NO: 940625 - RNA, 19 nt, Homo sapiens
ccacuuuccugagaacuuc

SEQ ID NO: 940626 - RNA, 19 nt, Homo sapiens
gggaaagacaggagaagug

SEQ ID NO: 940627 - RNA, 19 nt, Homo sapiens
aaccagaccuccacugaca

SEQ ID NO: 940628 - RNA, 19 nt, Homo sapiens
caagggagacauuggugaa

SEQ ID NO: 940629 - RNA, 19 nt, Homo sapiens
cccgggaccuacuggcuua

SEQ ID NO: 940630 - RNA, 19 nt, Homo sapiens
gaggagaacugggcuucca

SEQ ID NO: 940631 - RNA, 19 nt, Homo sapiens
aaacugaugaacugugaaa

SEQ ID NO: 940632 - RNA, 19 nt, Homo sapiens
gggauaugaugagagauuc

SEQ ID NO: 940633 - RNA, 19 nt, Homo sapiens
gaagacccuuuucgaauuc

SEQ ID NO: 940634 - RNA, 19 nt, Homo sapiens
ggagagcccgcagugauug

SEQ ID NO: 940635 - RNA, 19 nt, Homo sapiens
gaaaagggccacauuggau

SEQ ID NO: 940636 - RNA, 19 nt, Homo sapiens
uggagaggauggagccaaa

SEQ ID NO: 940637 - RNA, 19 nt, Homo sapiens
ggcauaauuugcaucucaa

SEQ ID NO: 940638 - RNA, 19 nt, Homo sapiens
acucagcucucuaugaaag

SEQ ID NO: 940639 - RNA, 19 nt, Homo sapiens
gggugaaucaggauccuaa

SEQ ID NO: 940640 - RNA, 19 nt, Homo sapiens
ccuggaggcugguauagca

SEQ ID NO: 940641 - RNA, 19 nt, Homo sapiens
ggaguaaaggcgauaaagg

SEQ ID NO: 940642 - RNA, 19 nt, Homo sapiens
ggacagccagccaaucagu

SEQ ID NO: 940643 - RNA, 19 nt, Homo sapiens
gcauccaggucugaaagga

SEQ ID NO: 940644 - RNA, 19 nt, Homo sapiens
ggaugaagaaggagaugau

SEQ ID NO: 940645 - RNA, 19 nt, Homo sapiens
cagcccagcucugcaaauc

SEQ ID NO: 940646 - RNA, 19 nt, Homo sapiens
acaagaaguuugagaucgu

SEQ ID NO: 940647 - RNA, 19 nt, Homo sapiens
gcaggaggcauuggacuuc

SEQ ID NO: 940648 - RNA, 19 nt, Homo sapiens
ggagaagugggaccucuag

SEQ ID NO: 940649 - RNA, 19 nt, Homo sapiens
gggugugacuggaauugau

SEQ ID NO: 940650 - RNA, 19 nt, Homo sapiens
gagcuuggacccugacagu

SEQ ID NO: 940651 - RNA, 19 nt, Homo sapiens
gaaaaggggcagcaguuug

SEQ ID NO: 940652 - RNA, 19 nt, Homo sapiens
cgacaagaaguuugagauc

SEQ ID NO: 940653 - RNA, 19 nt, Homo sapiens
agaaagggaagucgggaaa

SEQ ID NO: 940654 - RNA, 19 nt, Homo sapiens
cuuugaagccaccguauuu

SEQ ID NO: 940655 - RNA, 19 nt, Homo sapiens
gcuguccauuuaugaugaa

SEQ ID NO: 940656 - RNA, 19 nt, Homo sapiens
gcagcagacucagcucucu

SEQ ID NO: 940657 - RNA, 19 nt, Homo sapiens
gaugaagaaggagaugauu

SEQ ID NO: 940658 - RNA, 19 nt, Homo sapiens
ugaaugucgugcagcugaa

SEQ ID NO: 940659 - RNA, 19 nt, Homo sapiens
aggagacccuggaguuuca

SEQ ID NO: 940660 - RNA, 19 nt, Homo sapiens
cagacucagcucucuauga

SEQ ID NO: 940661 - RNA, 19 nt, Homo sapiens
guccugcuguccauuuaug

SEQ ID NO: 940662 - RNA, 19 nt, Homo sapiens
ugaaucaggauccuaaugg

SEQ ID NO: 940663 - RNA, 19 nt, Homo sapiens
ugacuggguuguguuucuu

SEQ ID NO: 940664 - RNA, 19 nt, Homo sapiens
ggaaaagggccacauugga

SEQ ID NO: 940665 - RNA, 19 nt, Homo sapiens
gaaggcugggauaugauga

SEQ ID NO: 940666 - RNA, 19 nt, Homo sapiens
uucaucugcuuccuccuua

SEQ ID NO: 940667 - RNA, 19 nt, Homo sapiens
ucgcugcccuucacaccuu

SEQ ID NO: 940668 - RNA, 19 nt, Homo sapiens
gccaaugggaugugacuuc

SEQ ID NO: 940669 - RNA, 19 nt, Homo sapiens
gagaagcuggugagaaagg

SEQ ID NO: 940670 - RNA, 19 nt, Homo sapiens
gaaaagggaggaagaaagg

SEQ ID NO: 940671 - RNA, 19 nt, Homo sapiens
agucauuccuucuccuuuc

SEQ ID NO: 940672 - RNA, 19 nt, Homo sapiens
cgccagaacuucaccuacu

SEQ ID NO: 940673 - RNA, 19 nt, Homo sapiens
ggacagaaaggcucaaaag

SEQ ID NO: 940674 - RNA, 19 nt, Homo sapiens
agaaccagaccuccacuga

SEQ ID NO: 940675 - RNA, 19 nt, Homo sapiens
gccaggccauagggcauaa

SEQ ID NO: 940676 - RNA, 19 nt, Homo sapiens
ccuuugauccuuucuacuu

SEQ ID NO: 940677 - RNA, 19 nt, Homo sapiens
gccagaacuucaccuacuc

SEQ ID NO: 940678 - RNA, 19 nt, Homo sapiens
gugcuggccucgcucacau

SEQ ID NO: 940679 - RNA, 19 nt, Homo sapiens
gcauagauggugagauggu

SEQ ID NO: 940680 - RNA, 19 nt, Homo sapiens
aaggaaauuuggaccucaa

SEQ ID NO: 940681 - RNA, 19 nt, Homo sapiens
ccauagggcauaauuugca

SEQ ID NO: 940682 - RNA, 19 nt, Homo sapiens
gacuccagcuccaaaucug

SEQ ID NO: 940683 - RNA, 19 nt, Homo sapiens
cagagacuccagcuccaaa

SEQ ID NO: 940684 - RNA, 19 nt, Homo sapiens
gaaagagacuagaaaugua

SEQ ID NO: 940685 - RNA, 19 nt, Homo sapiens
agaaagaacuugaaccuaa

SEQ ID NO: 940686 - RNA, 19 nt, Homo sapiens
gcagaaagcugaggaacaa

SEQ ID NO: 940687 - RNA, 19 nt, Homo sapiens
gaucaaaggcagaagcuua

SEQ ID NO: 940688 - RNA, 19 nt, Homo sapiens
ggagaagaaucaugauaau

SEQ ID NO: 940689 - RNA, 19 nt, Homo sapiens
gcagugggauuuagauaug

SEQ ID NO: 940690 - RNA, 19 nt, Homo sapiens
ggcagaagcuuaaccaaga

SEQ ID NO: 940691 - RNA, 19 nt, Homo sapiens
gaaagaacuugaaccuaag

SEQ ID NO: 940692 - RNA, 19 nt, Homo sapiens
uaccaaggcuucucucaaa

SEQ ID NO: 940693 - RNA, 19 nt, Homo sapiens
uaaagaguauggaagaguu

SEQ ID NO: 940694 - RNA, 19 nt, Homo sapiens
ggauuuagauaugcagaaa

SEQ ID NO: 940695 - RNA, 19 nt, Homo sapiens
agaggaagauguuauugaa

SEQ ID NO: 940696 - RNA, 19 nt, Homo sapiens
gcagaagcuuaaccaagaa

SEQ ID NO: 940697 - RNA, 19 nt, Homo sapiens
gaguuggaguugacauuaa

SEQ ID NO: 940698 - RNA, 19 nt, Homo sapiens
ggaagcaucuaaauauggu

SEQ ID NO: 940699 - RNA, 19 nt, Homo sapiens
ucaggaagcaucuaaauau

SEQ ID NO: 940700 - RNA, 19 nt, Homo sapiens
uggaagaguuggagaagaa

SEQ ID NO: 940701 - RNA, 19 nt, Homo sapiens
guucagagccagagauuga

SEQ ID NO: 940702 - RNA, 19 nt, Homo sapiens
ggaguuggaguugacauua

SEQ ID NO: 940703 - RNA, 19 nt, Homo sapiens
gagcaguucauaaagagua

SEQ ID NO: 940704 - RNA, 19 nt, Homo sapiens
uacgagagccuaugacuuu

SEQ ID NO: 940705 - RNA, 19 nt, Homo sapiens
gauggaaacucagcagcaa

SEQ ID NO: 940706 - RNA, 19 nt, Homo sapiens
gacuagaaauguauaccaa

SEQ ID NO: 940707 - RNA, 19 nt, Homo sapiens
ggaaggaguuggaguugac

SEQ ID NO: 940708 - RNA, 19 nt, Homo sapiens
gagaaagagacuagaaaug

SEQ ID NO: 940709 - RNA, 19 nt, Homo sapiens
gaucagaggaagauguuau

SEQ ID NO: 940710 - RNA, 19 nt, Homo sapiens
caggaagcaucuaaauaug

SEQ ID NO: 940711 - RNA, 19 nt, Homo sapiens
gaagaaagaacuugaaccu

SEQ ID NO: 940712 - RNA, 19 nt, Homo sapiens
caagagauagcaaguguuc

SEQ ID NO: 940713 - RNA, 19 nt, Homo sapiens
caagagaaagagacuagaa

SEQ ID NO: 940714 - RNA, 19 nt, Homo sapiens
ccuaugacuuugagacuga

SEQ ID NO: 940715 - RNA, 19 nt, Homo sapiens
gaaauggcuauguugcaaa

SEQ ID NO: 940716 - RNA, 19 nt, Homo sapiens
gaaagcugaggaacaagaa

SEQ ID NO: 940717 - RNA, 19 nt, Homo sapiens
agaaagagacuagaaaugu

SEQ ID NO: 940718 - RNA, 19 nt, Homo sapiens
gaagcuuaaccaagaauau

SEQ ID NO: 940719 - RNA, 19 nt, Homo sapiens
ugagaaacguaggaagaaa

SEQ ID NO: 940720 - RNA, 19 nt, Homo sapiens
agaaauggcuauguugcaa

SEQ ID NO: 940721 - RNA, 19 nt, Homo sapiens
uggagaagaaucaugauaa

SEQ ID NO: 940722 - RNA, 19 nt, Homo sapiens
caggaguaguugaagauau

SEQ ID NO: 940723 - RNA, 19 nt, Homo sapiens
gucaggaagcaucuaaaua

SEQ ID NO: 940724 - RNA, 19 nt, Homo sapiens
gcaggaguaguugaagaua

SEQ ID NO: 940725 - RNA, 19 nt, Homo sapiens
gaaacucagcagcaagaga

SEQ ID NO: 940726 - RNA, 19 nt, Homo sapiens
uaauauguuucgacagcaa

SEQ ID NO: 940727 - RNA, 19 nt, Homo sapiens
gaagccgucuguggaagau

SEQ ID NO: 940728 - RNA, 19 nt, Homo sapiens
cagaggaagauguuauuga

SEQ ID NO: 940729 - RNA, 19 nt, Homo sapiens
agacugaagauaagaaaga

SEQ ID NO: 940730 - RNA, 19 nt, Homo sapiens
aggaguaguugaagauaug

SEQ ID NO: 940731 - RNA, 19 nt, Homo sapiens
ggaagccgucuguggaaga

SEQ ID NO: 940732 - RNA, 19 nt, Homo sapiens
acaguuauaugagcaguuc

SEQ ID NO: 940733 - RNA, 19 nt, Homo sapiens
guuauucugaugacucuuu

SEQ ID NO: 940734 - RNA, 19 nt, Homo sapiens
ucucuucaauccauguuau

SEQ ID NO: 940735 - RNA, 19 nt, Homo sapiens
aaacucagcagcaagagau

SEQ ID NO: 940736 - RNA, 19 nt, Homo sapiens
gaauaugcuggaaggaguu

SEQ ID NO: 940737 - RNA, 19 nt, Homo sapiens
gagaagaaucaugauaauc

SEQ ID NO: 940738 - RNA, 19 nt, Homo sapiens
ccagaaaauugaacauguu

SEQ ID NO: 940739 - RNA, 19 nt, Homo sapiens
gagagccuaugacuuugag

SEQ ID NO: 940740 - RNA, 19 nt, Homo sapiens
cagcagugggauuuagaua

SEQ ID NO: 940741 - RNA, 19 nt, Homo sapiens
ggggugaagugcagaauau

SEQ ID NO: 940742 - RNA, 19 nt, Homo sapiens
gcuggaaggaguuggaguu

SEQ ID NO: 940743 - RNA, 19 nt, Homo sapiens
gacugaagauaagaaagau

SEQ ID NO: 940744 - RNA, 19 nt, Homo sapiens
agcaagagauagcaagugu

SEQ ID NO: 940745 - RNA, 19 nt, Homo sapiens
uaacugguccucggccauu

SEQ ID NO: 940746 - RNA, 19 nt, Homo sapiens
aaacacaacaagaucaaag

SEQ ID NO: 940747 - RNA, 19 nt, Homo sapiens
gaaaacacaacaagaucaa

SEQ ID NO: 940748 - RNA, 19 nt, Homo sapiens
aagagaaagagacuagaaa

SEQ ID NO: 940749 - RNA, 19 nt, Homo sapiens
gcagucauugagaaacgua

SEQ ID NO: 940750 - RNA, 19 nt, Homo sapiens
gcaagagauagcaaguguu

SEQ ID NO: 940751 - RNA, 19 nt, Homo sapiens
caugauaaucuacuuacug

SEQ ID NO: 940752 - RNA, 19 nt, Homo sapiens
agagaaagagacuagaaau

SEQ ID NO: 940753 - RNA, 19 nt, Homo sapiens
acuuugagacugaagauaa

SEQ ID NO: 940754 - RNA, 19 nt, Homo sapiens
ucagucaggaagcaucuaa

SEQ ID NO: 940755 - RNA, 19 nt, Homo sapiens
gccaagagaaagagacuag

SEQ ID NO: 940756 - RNA, 19 nt, Homo sapiens
caauccauguuauucugau

SEQ ID NO: 940757 - RNA, 19 nt, Homo sapiens
guauggaagaguuggagaa

SEQ ID NO: 940758 - RNA, 19 nt, Homo sapiens
agaaagcugaggaacaaga

SEQ ID NO: 940759 - RNA, 19 nt, Homo sapiens
ggaaaacacaacaagauca

SEQ ID NO: 940760 - RNA, 19 nt, Homo sapiens
uagcaaguguucggaaguc

SEQ ID NO: 940761 - RNA, 19 nt, Homo sapiens
gaagaguuggagaagaauc

SEQ ID NO: 940762 - RNA, 19 nt, Homo sapiens
cgagagccuaugacuuuga

SEQ ID NO: 940763 - RNA, 19 nt, Homo sapiens
caaaacuaguaaccagaaa

SEQ ID NO: 940764 - RNA, 19 nt, Homo sapiens
uggaaggaguuggaguuga

SEQ ID NO: 940765 - RNA, 19 nt, Homo sapiens
cugcaggaguaguugaaga

SEQ ID NO: 940766 - RNA, 19 nt, Homo sapiens
gcagcaagagauagcaagu

SEQ ID NO: 940767 - RNA, 19 nt, Homo sapiens
gaaaauugaacauguuugg

SEQ ID NO: 940768 - RNA, 19 nt, Homo sapiens
aaggucuucugcaggagua

SEQ ID NO: 940769 - RNA, 19 nt, Homo sapiens
gcaguuucugacuuuguuu

SEQ ID NO: 940770 - RNA, 19 nt, Homo sapiens
ugagacugaagauaagaaa

SEQ ID NO: 940771 - RNA, 19 nt, Homo sapiens
gagaaacguaggaagaaaa

SEQ ID NO: 940772 - RNA, 19 nt, Homo sapiens
uggaaacucagcagcaaga

SEQ ID NO: 940773 - RNA, 19 nt, Homo sapiens
gacauuaacaaggcucuuc

SEQ ID NO: 940774 - RNA, 19 nt, Homo sapiens
ucagagccagagauugaaa

SEQ ID NO: 940775 - RNA, 19 nt, Homo sapiens
aagaaagaacuugaaccua

SEQ ID NO: 940776 - RNA, 19 nt, Homo sapiens
gaggaagauguuauugaag

SEQ ID NO: 940777 - RNA, 19 nt, Homo sapiens
ucaauccauguuauucuga

SEQ ID NO: 940778 - RNA, 19 nt, Homo sapiens
ggaagaguuggagaagaau

SEQ ID NO: 940779 - RNA, 19 nt, Homo sapiens
gcugaggaacaagaagaaa

SEQ ID NO: 940780 - RNA, 19 nt, Homo sapiens
gggauuuagauaugcagaa

SEQ ID NO: 940781 - RNA, 19 nt, Homo sapiens
gaaggcagguuccauugaa

SEQ ID NO: 940782 - RNA, 19 nt, Homo sapiens
gaacaugacagagaacaua

SEQ ID NO: 940783 - RNA, 19 nt, Homo sapiens
gaauggaucccaagaagaa

SEQ ID NO: 940784 - RNA, 19 nt, Homo sapiens
gaaggaagagguagagaaa

SEQ ID NO: 940785 - RNA, 19 nt, Homo sapiens
gagcagcaccuucucauga

SEQ ID NO: 940786 - RNA, 19 nt, Homo sapiens
ggaagaagaggaagaggaa

SEQ ID NO: 940787 - RNA, 19 nt, Homo sapiens
cagagaacauagacuguga

SEQ ID NO: 940788 - RNA, 19 nt, Homo sapiens
gaaugaagagucucggauu

SEQ ID NO: 940789 - RNA, 19 nt, Homo sapiens
gugaauggaucccaagaag

SEQ ID NO: 940790 - RNA, 19 nt, Homo sapiens
gaaacaagaggaggaggaa

SEQ ID NO: 940791 - RNA, 19 nt, Homo sapiens
cgaagagaaugaagagucu

SEQ ID NO: 940792 - RNA, 19 nt, Homo sapiens
ggaggacacgcaccuguga

SEQ ID NO: 940793 - RNA, 19 nt, Homo sapiens
gagaaggcagguuccauug

SEQ ID NO: 940794 - RNA, 19 nt, Homo sapiens
ccagagaggaggaagaaga

SEQ ID NO: 940795 - RNA, 19 nt, Homo sapiens
aggaagagguagagaaaca

SEQ ID NO: 940796 - RNA, 19 nt, Homo sapiens
gagccucccuggcauaugc

SEQ ID NO: 940797 - RNA, 19 nt, Homo sapiens
gggacccacugcagauuau

SEQ ID NO: 940798 - RNA, 19 nt, Homo sapiens
agucggagaugcaggagaa

SEQ ID NO: 940799 - RNA, 19 nt, Homo sapiens
ugagaaggcagguuccauu

SEQ ID NO: 940800 - RNA, 19 nt, Homo sapiens
agauuggcauccagaacua

SEQ ID NO: 940801 - RNA, 19 nt, Homo sapiens
cuacaucauucugaacaug

SEQ ID NO: 940802 - RNA, 19 nt, Homo sapiens
aaugaagagucucggauuc

SEQ ID NO: 940803 - RNA, 19 nt, Homo sapiens
gaagagguagagaaacaag

SEQ ID NO: 940804 - RNA, 19 nt, Homo sapiens
gaacggcugccacgacaac

SEQ ID NO: 940805 - RNA, 19 nt, Homo sapiens
gagauuggcauccagaacu

SEQ ID NO: 940806 - RNA, 19 nt, Homo sapiens
gagggagaaggaagaggua

SEQ ID NO: 940807 - RNA, 19 nt, Homo sapiens
gcagcaccuucucaugaca

SEQ ID NO: 940808 - RNA, 19 nt, Homo sapiens
gagcaagcccagcgagaag

SEQ ID NO: 940809 - RNA, 19 nt, Homo sapiens
cauagacugugagguguuc

SEQ ID NO: 940810 - RNA, 19 nt, Homo sapiens
ggaagagguagagaaacaa

SEQ ID NO: 940811 - RNA, 19 nt, Homo sapiens
ugaagagucucggauucug

SEQ ID NO: 940812 - RNA, 19 nt, Homo sapiens
caaccagcagcuccuagaa

SEQ ID NO: 940813 - RNA, 19 nt, Homo sapiens
ucaggaagcaagcgaggaa

SEQ ID NO: 940814 - RNA, 19 nt, Homo sapiens
gcgcuuggccugcucuaca

SEQ ID NO: 940815 - RNA, 19 nt, Homo sapiens
ugcaaggacuggagcaauc

SEQ ID NO: 940816 - RNA, 19 nt, Homo sapiens
aggagcagcugguuugucu

SEQ ID NO: 940817 - RNA, 19 nt, Homo sapiens
acucagaggagccuaguga

SEQ ID NO: 940818 - RNA, 19 nt, Homo sapiens
gacaagaagaucucaacca

SEQ ID NO: 940819 - RNA, 19 nt, Homo sapiens
agaaggaagagguagagaa

SEQ ID NO: 940820 - RNA, 19 nt, Homo sapiens
ggagcagcaccuucucaug

SEQ ID NO: 940821 - RNA, 19 nt, Homo sapiens
ucagaggagccuagugaga

SEQ ID NO: 940822 - RNA, 19 nt, Homo sapiens
uuuccugacuuaacugaga

SEQ ID NO: 940823 - RNA, 19 nt, Homo sapiens
ggaggaagaagaggaagag

SEQ ID NO: 940824 - RNA, 19 nt, Homo sapiens
uggagccacuggacucaga

SEQ ID NO: 940825 - RNA, 19 nt, Homo sapiens
gcaagcccagcgagaagga

SEQ ID NO: 940826 - RNA, 19 nt, Homo sapiens
aagaagaggaagaggaaga

SEQ ID NO: 940827 - RNA, 19 nt, Homo sapiens
cucaagagcugccaaaccu

SEQ ID NO: 940828 - RNA, 19 nt, Homo sapiens
aggauacccugggauucua

SEQ ID NO: 940829 - RNA, 19 nt, Homo sapiens
gacauggaacugacaccuu

SEQ ID NO: 940830 - RNA, 19 nt, Homo sapiens
ugaauggaucccaagaaga

SEQ ID NO: 940831 - RNA, 19 nt, Homo sapiens
ggagaaggaagagguagag

SEQ ID NO: 940832 - RNA, 19 nt, Homo sapiens
gggagaaggaagagguaga

SEQ ID NO: 940833 - RNA, 19 nt, Homo sapiens
ucuagaaccucagccucuu

SEQ ID NO: 940834 - RNA, 19 nt, Homo sapiens
ggacuccaccagccaagag

SEQ ID NO: 940835 - RNA, 19 nt, Homo sapiens
ggaagagcugaaugacuca

SEQ ID NO: 940836 - RNA, 19 nt, Homo sapiens
auccagaacuauuccacaa

SEQ ID NO: 940837 - RNA, 19 nt, Homo sapiens
ugagcaagcccagcgagaa

SEQ ID NO: 940838 - RNA, 19 nt, Homo sapiens
gaggaagagcugaaugacu

SEQ ID NO: 940839 - RNA, 19 nt, Homo sapiens
aacaagaggaggaggaaga

SEQ ID NO: 940840 - RNA, 19 nt, Homo sapiens
agaaggcagguuccauuga

SEQ ID NO: 940841 - RNA, 19 nt, Homo sapiens
gcaaggacuggagcaaucu

SEQ ID NO: 940842 - RNA, 19 nt, Homo sapiens
ucaaccagcagcuccuaga

SEQ ID NO: 940843 - RNA, 19 nt, Homo sapiens
cucaagauguccuuuccau

SEQ ID NO: 940844 - RNA, 19 nt, Homo sapiens
ccacucaagauguccuuuc

SEQ ID NO: 940845 - RNA, 19 nt, Homo sapiens
ccagcgaagagaaugaaga

SEQ ID NO: 940846 - RNA, 19 nt, Homo sapiens
aggaggaagagcugaauga

SEQ ID NO: 940847 - RNA, 19 nt, Homo sapiens
gaagauccccuuggcucua

SEQ ID NO: 940848 - RNA, 19 nt, Homo sapiens
gaggaggaagagcugaaug

SEQ ID NO: 940849 - RNA, 19 nt, Homo sapiens
caucugcaucaucaucauu

SEQ ID NO: 940850 - RNA, 19 nt, Homo sapiens
gcugcucccugugaaugga

SEQ ID NO: 940851 - RNA, 19 nt, Homo sapiens
gaacaggaaugaagaggaa

SEQ ID NO: 940852 - RNA, 19 nt, Homo sapiens
gaagaggaguugccagaaa

SEQ ID NO: 940853 - RNA, 19 nt, Homo sapiens
cuacgaagauuacuuaaga

SEQ ID NO: 940854 - RNA, 19 nt, Homo sapiens
gaaagcagcccaguuauga

SEQ ID NO: 940855 - RNA, 19 nt, Homo sapiens
aggaagagcugauaagaaa

SEQ ID NO: 940856 - RNA, 19 nt, Homo sapiens
ggaaagcccugaacacucu

SEQ ID NO: 940857 - RNA, 19 nt, Homo sapiens
gcaaugauuuacugagcua

SEQ ID NO: 940858 - RNA, 19 nt, Homo sapiens
caaccgggcuucuuuguag

SEQ ID NO: 940859 - RNA, 19 nt, Homo sapiens
gagcuacucuugcuaucaa

SEQ ID NO: 940860 - RNA, 19 nt, Homo sapiens
guagaagacuugacagcuu

SEQ ID NO: 940861 - RNA, 19 nt, Homo sapiens
agacagaucuacugaggaa

SEQ ID NO: 940862 - RNA, 19 nt, Homo sapiens
caacaaggauucuuuucua

SEQ ID NO: 940863 - RNA, 19 nt, Homo sapiens
aauguuaccuggaauaaga

SEQ ID NO: 940864 - RNA, 19 nt, Homo sapiens
ccugaaagcagcccaguua

SEQ ID NO: 940865 - RNA, 19 nt, Homo sapiens
gcacaaacuauucuagaga

SEQ ID NO: 940866 - RNA, 19 nt, Homo sapiens
gaagaggaagagcugauaa

SEQ ID NO: 940867 - RNA, 19 nt, Homo sapiens
gaaggccgcuagaaaguac

SEQ ID NO: 940868 - RNA, 19 nt, Homo sapiens
gcuagaaaguacagaagga

SEQ ID NO: 940869 - RNA, 19 nt, Homo sapiens
ggaagaccacguccuagaa

SEQ ID NO: 940870 - RNA, 19 nt, Homo sapiens
ggaauaagaagacaacucu

SEQ ID NO: 940871 - RNA, 19 nt, Homo sapiens
cuauuuaacuccucagaga

SEQ ID NO: 940872 - RNA, 19 nt, Homo sapiens
gaagagcugauaagaaaca

SEQ ID NO: 940873 - RNA, 19 nt, Homo sapiens
gcagauugaauguaaguga

SEQ ID NO: 940874 - RNA, 19 nt, Homo sapiens
cuugacagcuugagaauag

SEQ ID NO: 940875 - RNA, 19 nt, Homo sapiens
cagagggaauugcagauug

SEQ ID NO: 940876 - RNA, 19 nt, Homo sapiens
gaggaagagcugauaagaa

SEQ ID NO: 940877 - RNA, 19 nt, Homo sapiens
caagguggccagagcaauu

SEQ ID NO: 940878 - RNA, 19 nt, Homo sapiens
ucagagacaugcacaaacu

SEQ ID NO: 940879 - RNA, 19 nt, Homo sapiens
guucagcaaugauuuacug

SEQ ID NO: 940880 - RNA, 19 nt, Homo sapiens
agagagaggucuguaaagu

SEQ ID NO: 940881 - RNA, 19 nt, Homo sapiens
gagagaaagacaaggagaa

SEQ ID NO: 940882 - RNA, 19 nt, Homo sapiens
gggguuaauuuaccaguua

SEQ ID NO: 940883 - RNA, 19 nt, Homo sapiens
agagggaauugcagauuga

SEQ ID NO: 940884 - RNA, 19 nt, Homo sapiens
agaaggaacuuuggaugug

SEQ ID NO: 940885 - RNA, 19 nt, Homo sapiens
ccaguuaucauuuacuaga

SEQ ID NO: 940886 - RNA, 19 nt, Homo sapiens
gggaauugcagauugaaug

SEQ ID NO: 940887 - RNA, 19 nt, Homo sapiens
gcagagggaauugcagauu

SEQ ID NO: 940888 - RNA, 19 nt, Homo sapiens
ggaauugcagauugaaugu

SEQ ID NO: 940889 - RNA, 19 nt, Homo sapiens
ugauuaauuugcagucaga

SEQ ID NO: 940890 - RNA, 19 nt, Homo sapiens
gaaaggauuuugcuguauc

SEQ ID NO: 940891 - RNA, 19 nt, Homo sapiens
gagagaggucuguaaagug

SEQ ID NO: 940892 - RNA, 19 nt, Homo sapiens
gcccaguuaugacaaugaa

SEQ ID NO: 940893 - RNA, 19 nt, Homo sapiens
gggcuucuuuguaggguau

SEQ ID NO: 940894 - RNA, 19 nt, Homo sapiens
gaagaccacguccuagaag

SEQ ID NO: 940895 - RNA, 19 nt, Homo sapiens
gggccuucuugccguguua

SEQ ID NO: 940896 - RNA, 19 nt, Homo sapiens
agaaacagcuaaaauguca

SEQ ID NO: 940897 - RNA, 19 nt, Homo sapiens
gcagcccaguuaugacaau

SEQ ID NO: 940898 - RNA, 19 nt, Homo sapiens
gagcugggaacaggaauga

SEQ ID NO: 940899 - RNA, 19 nt, Homo sapiens
ucaccugguucagcaauga

SEQ ID NO: 940900 - RNA, 19 nt, Homo sapiens
ucuagucuauacauucuga

SEQ ID NO: 940901 - RNA, 19 nt, Homo sapiens
gaauugcagauugaaugua

SEQ ID NO: 940902 - RNA, 19 nt, Homo sapiens
guacagaaggaacuuugga

SEQ ID NO: 940903 - RNA, 19 nt, Homo sapiens
uaggguauguguacugcuu

SEQ ID NO: 940904 - RNA, 19 nt, Homo sapiens
ggaagaggaguugccagaa

SEQ ID NO: 940905 - RNA, 19 nt, Homo sapiens
ugaaagcagcccaguuaug

SEQ ID NO: 940906 - RNA, 19 nt, Homo sapiens
aaacuugaagggcuauuga

SEQ ID NO: 940907 - RNA, 19 nt, Homo sapiens
ccaauguuaccuggaauaa

SEQ ID NO: 940908 - RNA, 19 nt, Homo sapiens
gagacaugcacaaacuauu

SEQ ID NO: 940909 - RNA, 19 nt, Homo sapiens
ccaguuaugacaaugaaug

SEQ ID NO: 940910 - RNA, 19 nt, Homo sapiens
gaggaaagcccugaacacu

SEQ ID NO: 940911 - RNA, 19 nt, Homo sapiens
ugaagaggaagagcugaua

SEQ ID NO: 940912 - RNA, 19 nt, Homo sapiens
ggaaaggauuuugcuguau

SEQ ID NO: 940913 - RNA, 19 nt, Homo sapiens
cagaaggaacuuuggaugu

SEQ ID NO: 940914 - RNA, 19 nt, Homo sapiens
cgaagauuacuuaagaaug

SEQ ID NO: 940915 - RNA, 19 nt, Homo sapiens
agacaugcacaaacuauuc

SEQ ID NO: 940916 - RNA, 19 nt, Homo sapiens
ggaaguggaagagcauugu

SEQ ID NO: 940917 - RNA, 19 nt, Homo sapiens
gccaauguuaccuggaaua

SEQ ID NO: 940918 - RNA, 19 nt, Homo sapiens
uggcauacuuuccaacaag

SEQ ID NO: 940919 - RNA, 19 nt, Homo sapiens
cugaugcccugcacagaga

SEQ ID NO: 940920 - RNA, 19 nt, Homo sapiens
guuaugacaaugaauguuc

SEQ ID NO: 940921 - RNA, 19 nt, Homo sapiens
ugaaggccgcuagaaagua

SEQ ID NO: 940922 - RNA, 19 nt, Homo sapiens
ugccuacgaagauuacuua

SEQ ID NO: 940923 - RNA, 19 nt, Homo sapiens
agagaaagacaaggagaaa

SEQ ID NO: 940924 - RNA, 19 nt, Homo sapiens
ggguuaauuuaccaguuau

SEQ ID NO: 940925 - RNA, 19 nt, Homo sapiens
gacaaggagaaaccugaaa

SEQ ID NO: 940926 - RNA, 19 nt, Homo sapiens
uauugaaggccgcuagaaa

SEQ ID NO: 940927 - RNA, 19 nt, Homo sapiens
aaacaugcccagagcagau

SEQ ID NO: 940928 - RNA, 19 nt, Homo sapiens
agacuugacagcuugagaa

SEQ ID NO: 940929 - RNA, 19 nt, Homo sapiens
ucaaccgggcuucuuugua

SEQ ID NO: 940930 - RNA, 19 nt, Homo sapiens
ccucagagacaugcacaaa

SEQ ID NO: 940931 - RNA, 19 nt, Homo sapiens
uaaaagcgaagcagacaaa

SEQ ID NO: 940932 - RNA, 19 nt, Homo sapiens
gggugaggcuugcagaaaa

SEQ ID NO: 940933 - RNA, 19 nt, Homo sapiens
cuauugaaggccuuacuuu

SEQ ID NO: 940934 - RNA, 19 nt, Homo sapiens
gcuugugccuacgaagauu

SEQ ID NO: 940935 - RNA, 19 nt, Homo sapiens
gcuauugaaggccuuacuu

SEQ ID NO: 940936 - RNA, 19 nt, Homo sapiens
gaacagccuugggguagug

SEQ ID NO: 940937 - RNA, 19 nt, Homo sapiens
cugccaauguuaccuggaa

SEQ ID NO: 940938 - RNA, 19 nt, Homo sapiens
cggaagaccacguccuaga

SEQ ID NO: 940939 - RNA, 19 nt, Homo sapiens
gaaguggaagagcauugug

SEQ ID NO: 940940 - RNA, 19 nt, Homo sapiens
uuaucucucuggcauacuu

SEQ ID NO: 940941 - RNA, 19 nt, Homo sapiens
cagcuaaaaugucaguaga

SEQ ID NO: 940942 - RNA, 19 nt, Homo sapiens
aagaggaguugccagaaac

SEQ ID NO: 940943 - RNA, 19 nt, Homo sapiens
ucugagaaacccuaucgaa

SEQ ID NO: 940944 - RNA, 19 nt, Homo sapiens
cauucaaccgggcuucuuu

SEQ ID NO: 940945 - RNA, 19 nt, Homo sapiens
aaaugucaguagaagacuu

SEQ ID NO: 940946 - RNA, 19 nt, Homo sapiens
caacucgccgcaugaccuu

SEQ ID NO: 940947 - RNA, 19 nt, Homo sapiens
acaauggaggaaaggauuu

SEQ ID NO: 940948 - RNA, 19 nt, Homo sapiens
uacaauggaggaaaggauu

SEQ ID NO: 940949 - RNA, 19 nt, Homo sapiens
gcugggaacaggaaugaag

SEQ ID NO: 940950 - RNA, 19 nt, Homo sapiens
caaggauucuuuucuaguc

SEQ ID NO: 940951 - RNA, 19 nt, Homo sapiens
ggaagaggauucuaauuac

SEQ ID NO: 940952 - RNA, 19 nt, Homo sapiens
ggaggagccuuucaacgaa

SEQ ID NO: 940953 - RNA, 19 nt, Homo sapiens
gcaacaaguucacccagaa

SEQ ID NO: 940954 - RNA, 19 nt, Homo sapiens
ugaagacccugaaccagua

SEQ ID NO: 940955 - RNA, 19 nt, Homo sapiens
gagaacuacugaugaaaug

SEQ ID NO: 940956 - RNA, 19 nt, Homo sapiens
uggaagaggauucuaauua

SEQ ID NO: 940957 - RNA, 19 nt, Homo sapiens
caagcuaccugaaauugga

SEQ ID NO: 940958 - RNA, 19 nt, Homo sapiens
ucucaaagguuucuugugu

SEQ ID NO: 940959 - RNA, 19 nt, Homo sapiens
aaacgcagcuguacgaagu

SEQ ID NO: 940960 - RNA, 19 nt, Homo sapiens
gcaccaagaucaucaaacg

SEQ ID NO: 940961 - RNA, 19 nt, Homo sapiens
ggauggugcuggccacuug

SEQ ID NO: 940962 - RNA, 19 nt, Homo sapiens
ggaagcggcucaugauggu

SEQ ID NO: 940963 - RNA, 19 nt, Homo sapiens
ccaacgaccugaagcacuu

SEQ ID NO: 940964 - RNA, 19 nt, Homo sapiens
ggaaauaggaugggucguu

SEQ ID NO: 940965 - RNA, 19 nt, Homo sapiens
ucaaagguuucuuguguuc

SEQ ID NO: 940966 - RNA, 19 nt, Homo sapiens
caacaucuccuuccacaag

SEQ ID NO: 940967 - RNA, 19 nt, Homo sapiens
gggaggagccuuucaacga

SEQ ID NO: 940968 - RNA, 19 nt, Homo sapiens
gcaacacugucucaaaggu

SEQ ID NO: 940969 - RNA, 19 nt, Homo sapiens
gaaaugaccacagaauucu

SEQ ID NO: 940970 - RNA, 19 nt, Homo sapiens
ugaaaugaccacagaauuc

SEQ ID NO: 940971 - RNA, 19 nt, Homo sapiens
caucuucuauuuccaaagu

SEQ ID NO: 940972 - RNA, 19 nt, Homo sapiens
gaagaggauucuaauuacg

SEQ ID NO: 940973 - RNA, 19 nt, Homo sapiens
gaagugaugaggaugaaca

SEQ ID NO: 940974 - RNA, 19 nt, Homo sapiens
gugccaagcuaccugaaau

SEQ ID NO: 940975 - RNA, 19 nt, Homo sapiens
uacgagaacuacugaugaa

SEQ ID NO: 940976 - RNA, 19 nt, Homo sapiens
gaugaaaugaccacagaau

SEQ ID NO: 940977 - RNA, 19 nt, Homo sapiens
uacaugaaguuccuguuug

SEQ ID NO: 940978 - RNA, 19 nt, Homo sapiens
cuacaugaaguuccuguuu

SEQ ID NO: 940979 - RNA, 19 nt, Homo sapiens
gcaaagucuacgagaacua

SEQ ID NO: 940980 - RNA, 19 nt, Homo sapiens
ugaugaggaugaacagaau

SEQ ID NO: 940981 - RNA, 19 nt, Homo sapiens
cagcauagugagaauuauu

SEQ ID NO: 940982 - RNA, 19 nt, Homo sapiens
cugaugaaaugaccacaga

SEQ ID NO: 940983 - RNA, 19 nt, Homo sapiens
ggagagggagagaaucaug

SEQ ID NO: 940984 - RNA, 19 nt, Homo sapiens
guacgaagucuacaaacuc

SEQ ID NO: 940985 - RNA, 19 nt, Homo sapiens
gggacgaugucaaauucga

SEQ ID NO: 940986 - RNA, 19 nt, Homo sapiens
cgagaacuacugaugaaau

SEQ ID NO: 940987 - RNA, 19 nt, Homo sapiens
guacagcaucccagaaauc

SEQ ID NO: 940988 - RNA, 19 nt, Homo sapiens
uaggaugggucguucuugu

SEQ ID NO: 940989 - RNA, 19 nt, Homo sapiens
uaugcaaagucuacgagaa

SEQ ID NO: 940990 - RNA, 19 nt, Homo sapiens
aacacugucucaaagguuu

SEQ ID NO: 940991 - RNA, 19 nt, Homo sapiens
gugaugaggaugaacagaa

SEQ ID NO: 940992 - RNA, 19 nt, Homo sapiens
cuacgagaacuacugauga

SEQ ID NO: 940993 - RNA, 19 nt, Homo sapiens
acaugaaguuccuguuugu

SEQ ID NO: 940994 - RNA, 19 nt, Homo sapiens
cugcaacacugucucaaag

SEQ ID NO: 940995 - RNA, 19 nt, Homo sapiens
gcagcauagugagaauuau

SEQ ID NO: 940996 - RNA, 19 nt, Homo sapiens
caguacagcaucccagaaa

SEQ ID NO: 940997 - RNA, 19 nt, Homo sapiens
aaagguuucuuguguucug

SEQ ID NO: 940998 - RNA, 19 nt, Homo sapiens
caacacugucucaaagguu

SEQ ID NO: 940999 - RNA, 19 nt, Homo sapiens
gugcauuccauaaauucua

SEQ ID NO: 941000 - RNA, 19 nt, Homo sapiens
ggucaucuucuauuuccaa

SEQ ID NO: 941001 - RNA, 19 nt, Homo sapiens
gaacuacugaugaaaugac

SEQ ID NO: 941002 - RNA, 19 nt, Homo sapiens
caaaccgucuacucacucu

SEQ ID NO: 941003 - RNA, 19 nt, Homo sapiens
gggagagaaucaugcuuuu

SEQ ID NO: 941004 - RNA, 19 nt, Homo sapiens
acaaguucacccagaagua

SEQ ID NO: 941005 - RNA, 19 nt, Homo sapiens
agaagugaauacugcaaca

SEQ ID NO: 941006 - RNA, 19 nt, Homo sapiens
gccaagcuaccugaaauug

SEQ ID NO: 941007 - RNA, 19 nt, Homo sapiens
ccugccacauccacuauga

SEQ ID NO: 941008 - RNA, 19 nt, Homo sapiens
caaaggggacgaugucaaa

SEQ ID NO: 941009 - RNA, 19 nt, Homo sapiens
gcggaggaaucccuuuggu

SEQ ID NO: 941010 - RNA, 19 nt, Homo sapiens
gcgagcagcauagugagaa

SEQ ID NO: 941011 - RNA, 19 nt, Homo sapiens
caaguacgagacacuggaa

SEQ ID NO: 941012 - RNA, 19 nt, Homo sapiens
ggcaaaccgucuacucacu

SEQ ID NO: 941013 - RNA, 19 nt, Homo sapiens
gaagucuacaaacucgauu

SEQ ID NO: 941014 - RNA, 19 nt, Homo sapiens
gugggcagcuaccugaagu

SEQ ID NO: 941015 - RNA, 19 nt, Homo sapiens
cuuguguucuggugaauuc

SEQ ID NO: 941016 - RNA, 19 nt, Homo sapiens
gagcagcauagugagaauu

SEQ ID NO: 941017 - RNA, 19 nt, Homo sapiens
ggaccacgagcucaucuac

SEQ ID NO: 941018 - RNA, 19 nt, Homo sapiens
ggucguucuugucuguaga

SEQ ID NO: 941019 - RNA, 19 nt, Homo sapiens
agggagagaaucaugcuuu

SEQ ID NO: 941020 - RNA, 19 nt, Homo sapiens
ugucaaauucgaggaguuu

SEQ ID NO: 941021 - RNA, 19 nt, Homo sapiens
gcaccaaacgcagcuguac

SEQ ID NO: 941022 - RNA, 19 nt, Homo sapiens
ggaacucuacaacccaauc

SEQ ID NO: 941023 - RNA, 19 nt, Homo sapiens
accacgagcucaucuacug

SEQ ID NO: 941024 - RNA, 19 nt, Homo sapiens
uggaagugaugaggaugaa

SEQ ID NO: 941025 - RNA, 19 nt, Homo sapiens
cucaaagguuucuuguguu

SEQ ID NO: 941026 - RNA, 19 nt, Homo sapiens
gugaauacugcaacacugu

SEQ ID NO: 941027 - RNA, 19 nt, Homo sapiens
agcagcauagugagaauua

SEQ ID NO: 941028 - RNA, 19 nt, Homo sapiens
cgagcagcauagugagaau

SEQ ID NO: 941029 - RNA, 19 nt, Homo sapiens
caaagucuacgagaacuac

SEQ ID NO: 941030 - RNA, 19 nt, Homo sapiens
agaaguacaacaucuccuu

SEQ ID NO: 941031 - RNA, 19 nt, Homo sapiens
caaguucacccagaaguac

SEQ ID NO: 941032 - RNA, 19 nt, Homo sapiens
caacaaguucacccagaag

SEQ ID NO: 941033 - RNA, 19 nt, Homo sapiens
ccacuugcuugggauccuu

SEQ ID NO: 941034 - RNA, 19 nt, Homo sapiens
guagaagugaauacugcaa

SEQ ID NO: 941035 - RNA, 19 nt, Homo sapiens
ggaugggucguucuugucu

SEQ ID NO: 941036 - RNA, 19 nt, Homo sapiens
cuaccugaaauuggaauaa

SEQ ID NO: 941037 - RNA, 19 nt, Homo sapiens
gggcagcuaccugaaguuc

SEQ ID NO: 941038 - RNA, 19 nt, Homo sapiens
ccgccuaccgcaacaaguu

SEQ ID NO: 941039 - RNA, 19 nt, Homo sapiens
gcagcuguacgaagucuac

SEQ ID NO: 941040 - RNA, 19 nt, Homo sapiens
gucaucuucuauuuccaaa

SEQ ID NO: 941041 - RNA, 19 nt, Homo sapiens
uuucuuguguucuggugaa

SEQ ID NO: 941042 - RNA, 19 nt, Homo sapiens
gaauacugcaacacugucu

SEQ ID NO: 941043 - RNA, 19 nt, Homo sapiens
cgaagucuacaaacucgau

SEQ ID NO: 941044 - RNA, 19 nt, Homo sapiens
uggcaggagugggcagcua

SEQ ID NO: 941045 - RNA, 19 nt, Homo sapiens
ucaaacgccagcggaagaa

SEQ ID NO: 941046 - RNA, 19 nt, Homo sapiens
gaaaagcuacaugaaguuc

SEQ ID NO: 941047 - RNA, 19 nt, Homo sapiens
cagcaucccagaaaucaac

SEQ ID NO: 941048 - RNA, 19 nt, Homo sapiens
ccacaaaccuucaggaaau

SEQ ID NO: 941049 - RNA, 19 nt, Homo sapiens
gaagaaauacagccagauu

SEQ ID NO: 941050 - RNA, 19 nt, Homo sapiens
aggaagcaaugaagaaaua

SEQ ID NO: 941051 - RNA, 19 nt, Homo sapiens
ggacugaagacacucaauu

SEQ ID NO: 941052 - RNA, 19 nt, Homo sapiens
ggauggaggagacagaaua

SEQ ID NO: 941053 - RNA, 19 nt, Homo sapiens
gaugaaagccucuagucuu

SEQ ID NO: 941054 - RNA, 19 nt, Homo sapiens
ccaaaccaccaucucuuua

SEQ ID NO: 941055 - RNA, 19 nt, Homo sapiens
cagaauaggaggaaaguga

SEQ ID NO: 941056 - RNA, 19 nt, Homo sapiens
agccaaagauggaaacauu

SEQ ID NO: 941057 - RNA, 19 nt, Homo sapiens
ggaggaagcaaugaagaaa

SEQ ID NO: 941058 - RNA, 19 nt, Homo sapiens
ccaaagauggaaacauuga

SEQ ID NO: 941059 - RNA, 19 nt, Homo sapiens
cacaaaccuucaggaaaua

SEQ ID NO: 941060 - RNA, 19 nt, Homo sapiens
cagcaguugugaaggcuuu

SEQ ID NO: 941061 - RNA, 19 nt, Homo sapiens
caguguaucuuauuuaugc

SEQ ID NO: 941062 - RNA, 19 nt, Homo sapiens
caccaucucuuuacuguac

SEQ ID NO: 941063 - RNA, 19 nt, Homo sapiens
gacugaagacacucaauuu

SEQ ID NO: 941064 - RNA, 19 nt, Homo sapiens
gagcuccagucuucaauac

SEQ ID NO: 941065 - RNA, 19 nt, Homo sapiens
acacaaagccugcgaaucg

SEQ ID NO: 941066 - RNA, 19 nt, Homo sapiens
ggucacaguguaucuuauu

SEQ ID NO: 941067 - RNA, 19 nt, Homo sapiens
aaagugaugcugcugcuaa

SEQ ID NO: 941068 - RNA, 19 nt, Homo sapiens
ccacuggacugaagacacu

SEQ ID NO: 941069 - RNA, 19 nt, Homo sapiens
gauuucaggccuaagauga

SEQ ID NO: 941070 - RNA, 19 nt, Homo sapiens
acuuggacaugaaacuuua

SEQ ID NO: 941071 - RNA, 19 nt, Homo sapiens
augaaagccucuagucuug

SEQ ID NO: 941072 - RNA, 19 nt, Homo sapiens
ucagcagccucgccaauuc

SEQ ID NO: 941073 - RNA, 19 nt, Homo sapiens
gggaggaagcaaugaagaa

SEQ ID NO: 941074 - RNA, 19 nt, Homo sapiens
gucacaguguaucuuauuu

SEQ ID NO: 941075 - RNA, 19 nt, Homo sapiens
ggaacuagacauucuucug

SEQ ID NO: 941076 - RNA, 19 nt, Homo sapiens
ggaaacauugacaucagaa

SEQ ID NO: 941077 - RNA, 19 nt, Homo sapiens
ggagacagaauaggaggaa

SEQ ID NO: 941078 - RNA, 19 nt, Homo sapiens
gauucugagucacuuugaa

SEQ ID NO: 941079 - RNA, 19 nt, Homo sapiens
gacaucagaaucuuaagga

SEQ ID NO: 941080 - RNA, 19 nt, Homo sapiens
uaauugagaccauacuugu

SEQ ID NO: 941081 - RNA, 19 nt, Homo sapiens
gccaauuccuuucuuacca

SEQ ID NO: 941082 - RNA, 19 nt, Homo sapiens
uaucuggacaggguauuua

SEQ ID NO: 941083 - RNA, 19 nt, Homo sapiens
uggaaacauugacaucaga

SEQ ID NO: 941084 - RNA, 19 nt, Homo sapiens
gcagugugcaagccaaaga

SEQ ID NO: 941085 - RNA, 19 nt, Homo sapiens
ccuguggucuccagauuuc

SEQ ID NO: 941086 - RNA, 19 nt, Homo sapiens
ccaauuccuuucuuaccau

SEQ ID NO: 941087 - RNA, 19 nt, Homo sapiens
gccacaaaccuucaggaaa

SEQ ID NO: 941088 - RNA, 19 nt, Homo sapiens
gaauaggaggaaagugaug

SEQ ID NO: 941089 - RNA, 19 nt, Homo sapiens
gaggaagcaaugaagaaau

SEQ ID NO: 941090 - RNA, 19 nt, Homo sapiens
gaucagcagccucgccaau

SEQ ID NO: 941091 - RNA, 19 nt, Homo sapiens
gaaacauugacaucagaau

SEQ ID NO: 941092 - RNA, 19 nt, Homo sapiens
ccagauuucaggccuaaga

SEQ ID NO: 941093 - RNA, 19 nt, Homo sapiens
gaaagugaugcugcugcua

SEQ ID NO: 941094 - RNA, 19 nt, Homo sapiens
gaagcaaugaagaaauaca

SEQ ID NO: 941095 - RNA, 19 nt, Homo sapiens
caggaaauacgaaauggau

SEQ ID NO: 941096 - RNA, 19 nt, Homo sapiens
uaagaauauucgaggucaa

SEQ ID NO: 941097 - RNA, 19 nt, Homo sapiens
gagacagaauaggaggaaa

SEQ ID NO: 941098 - RNA, 19 nt, Homo sapiens
cagccucgccaauuccuuu

SEQ ID NO: 941099 - RNA, 19 nt, Homo sapiens
cccaaaccaccaucucuuu

SEQ ID NO: 941100 - RNA, 19 nt, Homo sapiens
gugaugcugcugcuaagaa

SEQ ID NO: 941101 - RNA, 19 nt, Homo sapiens
ucucuuuacuguacuaguc

SEQ ID NO: 941102 - RNA, 19 nt, Homo sapiens
caaaccaccaucucuuuac

SEQ ID NO: 941103 - RNA, 19 nt, Homo sapiens
gaaccucaggcagcaguug

SEQ ID NO: 941104 - RNA, 19 nt, Homo sapiens
aaacauugacaucagaauc

SEQ ID NO: 941105 - RNA, 19 nt, Homo sapiens
gcuccagucuucaauaccu

SEQ ID NO: 941106 - RNA, 19 nt, Homo sapiens
ugaugcugcugcuaagaau

SEQ ID NO: 941107 - RNA, 19 nt, Homo sapiens
gauggaggagacagaauag

SEQ ID NO: 941108 - RNA, 19 nt, Homo sapiens
uugcaugauugucuuuaug

SEQ ID NO: 941109 - RNA, 19 nt, Homo sapiens
aaaccaccaucucuuuacu

SEQ ID NO: 941110 - RNA, 19 nt, Homo sapiens
gaugcugcugcuaagaaua

SEQ ID NO: 941111 - RNA, 19 nt, Homo sapiens
gccauuugcuaagacucua

SEQ ID NO: 941112 - RNA, 19 nt, Homo sapiens
uuaauugagaccauacuug

SEQ ID NO: 941113 - RNA, 19 nt, Homo sapiens
uuacuguacuagucuugug

SEQ ID NO: 941114 - RNA, 19 nt, Homo sapiens
gaggaggcaugaccccaaa

SEQ ID NO: 941115 - RNA, 19 nt, Homo sapiens
ccagaccccugaccauuau

SEQ ID NO: 941116 - RNA, 19 nt, Homo sapiens
ccuucucucugcugcguuu

SEQ ID NO: 941117 - RNA, 19 nt, Homo sapiens
ccaucucuuuacuguacua

SEQ ID NO: 941118 - RNA, 19 nt, Homo sapiens
uaucuccuauggacuccuu

SEQ ID NO: 941119 - RNA, 19 nt, Homo sapiens
cacaaagccugcgaaucga

SEQ ID NO: 941120 - RNA, 19 nt, Homo sapiens
gccaaagauggaaacauug

SEQ ID NO: 941121 - RNA, 19 nt, Homo sapiens
uauacucuccggaagauca

SEQ ID NO: 941122 - RNA, 19 nt, Homo sapiens
cauugacaucagaaucuua

SEQ ID NO: 941123 - RNA, 19 nt, Homo sapiens
aaagauggaaacauugaca

SEQ ID NO: 941124 - RNA, 19 nt, Homo sapiens
ccucuagucuugccuucag

SEQ ID NO: 941125 - RNA, 19 nt, Homo sapiens
gaauauucgaggucaagag

SEQ ID NO: 941126 - RNA, 19 nt, Homo sapiens
uggaggagacagaauagga

SEQ ID NO: 941127 - RNA, 19 nt, Homo sapiens
gaccuccggcucugucaug

SEQ ID NO: 941128 - RNA, 19 nt, Homo sapiens
cauuauacucuccggaaga

SEQ ID NO: 941129 - RNA, 19 nt, Homo sapiens
acauugacaucagaaucuu

SEQ ID NO: 941130 - RNA, 19 nt, Homo sapiens
uugcuuccuugcaugauug

SEQ ID NO: 941131 - RNA, 19 nt, Homo sapiens
augcauuacuugcuuccuu

SEQ ID NO: 941132 - RNA, 19 nt, Homo sapiens
cuccagauuucaggccuaa

SEQ ID NO: 941133 - RNA, 19 nt, Homo sapiens
acugaagacacucaauuug

SEQ ID NO: 941134 - RNA, 19 nt, Homo sapiens
ucaggcagcaguugugaag

SEQ ID NO: 941135 - RNA, 19 nt, Homo sapiens
ccucgccaauuccuuucuu

SEQ ID NO: 941136 - RNA, 19 nt, Homo sapiens
gaauacagcugcauuauaa

SEQ ID NO: 941137 - RNA, 19 nt, Homo sapiens
gaauccagcuccacaguua

SEQ ID NO: 941138 - RNA, 19 nt, Homo sapiens
gaacaguacuggacaaggu

SEQ ID NO: 941139 - RNA, 19 nt, Homo sapiens
gcaccugacauuagaaaua

SEQ ID NO: 941140 - RNA, 19 nt, Homo sapiens
gagauugggcauauucuua

SEQ ID NO: 941141 - RNA, 19 nt, Homo sapiens
gcacaaacuugccugaucu

SEQ ID NO: 941142 - RNA, 19 nt, Homo sapiens
caaggaggauuucucaguu

SEQ ID NO: 941143 - RNA, 19 nt, Homo sapiens
guaggagccuuauucauuc

SEQ ID NO: 941144 - RNA, 19 nt, Homo sapiens
gaaccaccaccaucaguaa

SEQ ID NO: 941145 - RNA, 19 nt, Homo sapiens
ggaugcaccugacauuaga

SEQ ID NO: 941146 - RNA, 19 nt, Homo sapiens
ccaaagacaaggaggauuu

SEQ ID NO: 941147 - RNA, 19 nt, Homo sapiens
uuauaaggcucuaugacua

SEQ ID NO: 941148 - RNA, 19 nt, Homo sapiens
cuucaaggauggagaauug

SEQ ID NO: 941149 - RNA, 19 nt, Homo sapiens
cguaggagccuuauucauu

SEQ ID NO: 941150 - RNA, 19 nt, Homo sapiens
ugaagcaccucgccuccua

SEQ ID NO: 941151 - RNA, 19 nt, Homo sapiens
gcccagcuuuccugagaua

SEQ ID NO: 941152 - RNA, 19 nt, Homo sapiens
ugaauacagcugcauuaua

SEQ ID NO: 941153 - RNA, 19 nt, Homo sapiens
uaacaacccggaaauuaug

SEQ ID NO: 941154 - RNA, 19 nt, Homo sapiens
aaggaggauuucucaguua

SEQ ID NO: 941155 - RNA, 19 nt, Homo sapiens
gguccuagcuacugaagca

SEQ ID NO: 941156 - RNA, 19 nt, Homo sapiens
ggaaccaccaccaucagua

SEQ ID NO: 941157 - RNA, 19 nt, Homo sapiens
aaacuugccugaucuuguc

SEQ ID NO: 941158 - RNA, 19 nt, Homo sapiens
ccaagauggugcagggaaa

SEQ ID NO: 941159 - RNA, 19 nt, Homo sapiens
ccacugccacuacugauaa

SEQ ID NO: 941160 - RNA, 19 nt, Homo sapiens
ccucaaggauccugacuca

SEQ ID NO: 941161 - RNA, 19 nt, Homo sapiens
guucaugccuugccuagca

SEQ ID NO: 941162 - RNA, 19 nt, Homo sapiens
caaacuuucuggguauuau

SEQ ID NO: 941163 - RNA, 19 nt, Homo sapiens
uagcuuaggucuccucaca

SEQ ID NO: 941164 - RNA, 19 nt, Homo sapiens
ccgaucagcuuguucuaau

SEQ ID NO: 941165 - RNA, 19 nt, Homo sapiens
gcugcaagauuuaguuagu

SEQ ID NO: 941166 - RNA, 19 nt, Homo sapiens
cuuaacaacccggaaauua

SEQ ID NO: 941167 - RNA, 19 nt, Homo sapiens
gcuuaugccuaucuugaga

SEQ ID NO: 941168 - RNA, 19 nt, Homo sapiens
uccauaugcugcaagauuu

SEQ ID NO: 941169 - RNA, 19 nt, Homo sapiens
caacaggguuccauuugcu

SEQ ID NO: 941170 - RNA, 19 nt, Homo sapiens
gcagagcugggcuuccuuu

SEQ ID NO: 941171 - RNA, 19 nt, Homo sapiens
ccuaggaacuuaucuacag

SEQ ID NO: 941172 - RNA, 19 nt, Homo sapiens
ggagccuuauucauucaaa

SEQ ID NO: 941173 - RNA, 19 nt, Homo sapiens
gaaaagcucuacuggacau

SEQ ID NO: 941174 - RNA, 19 nt, Homo sapiens
ugaagacgcccaaagacaa

SEQ ID NO: 941175 - RNA, 19 nt, Homo sapiens
uucccuagcucucccauuu

SEQ ID NO: 941176 - RNA, 19 nt, Homo sapiens
gcagcugaaggaagagaua

SEQ ID NO: 941177 - RNA, 19 nt, Homo sapiens
caacgaggaagacuaaugg

SEQ ID NO: 941178 - RNA, 19 nt, Homo sapiens
gcaccucgccuccuacucu

SEQ ID NO: 941179 - RNA, 19 nt, Homo sapiens
acaguuacaggaugagaua

SEQ ID NO: 941180 - RNA, 19 nt, Homo sapiens
caccugacauuagaaauag

SEQ ID NO: 941181 - RNA, 19 nt, Homo sapiens
ucagguagcaggcaaggaa

SEQ ID NO: 941182 - RNA, 19 nt, Homo sapiens
acacauggaggcucaggua

SEQ ID NO: 941183 - RNA, 19 nt, Homo sapiens
uuaacaacccggaaauuau

SEQ ID NO: 941184 - RNA, 19 nt, Homo sapiens
ucagcuuguucuaaucuuu

SEQ ID NO: 941185 - RNA, 19 nt, Homo sapiens
gcacuauguacacagauau

SEQ ID NO: 941186 - RNA, 19 nt, Homo sapiens
ccauaugcugcaagauuua

SEQ ID NO: 941187 - RNA, 19 nt, Homo sapiens
cauuugcucccuuaucuuu

SEQ ID NO: 941188 - RNA, 19 nt, Homo sapiens
cacccaauuuccaauguga

SEQ ID NO: 941189 - RNA, 19 nt, Homo sapiens
gaagacgcccaaagacaag

SEQ ID NO: 941190 - RNA, 19 nt, Homo sapiens
gacagucguaggagccuua

SEQ ID NO: 941191 - RNA, 19 nt, Homo sapiens
cugcaagauuuaguuagua

SEQ ID NO: 941192 - RNA, 19 nt, Homo sapiens
uuggagcccugcauaaaga

SEQ ID NO: 941193 - RNA, 19 nt, Homo sapiens
ucaaccacuuguaccacua

SEQ ID NO: 941194 - RNA, 19 nt, Homo sapiens
ggcaggagguauagagucu

SEQ ID NO: 941195 - RNA, 19 nt, Homo sapiens
ucaucaaggugacagugaa

SEQ ID NO: 941196 - RNA, 19 nt, Homo sapiens
augacuaucuccagcaauu

SEQ ID NO: 941197 - RNA, 19 nt, Homo sapiens
guccaacacaggccuagua

SEQ ID NO: 941198 - RNA, 19 nt, Homo sapiens
caauguuguuccagaguca

SEQ ID NO: 941199 - RNA, 19 nt, Homo sapiens
gccaacaggguuccauuug

SEQ ID NO: 941200 - RNA, 19 nt, Homo sapiens
caaacuugccugaucuugu

SEQ ID NO: 941201 - RNA, 19 nt, Homo sapiens
cccagucccuaggaacuua

SEQ ID NO: 941202 - RNA, 19 nt, Homo sapiens
ccaaacuuucuggguauua

SEQ ID NO: 941203 - RNA, 19 nt, Homo sapiens
caaggauggagaauuguga

SEQ ID NO: 941204 - RNA, 19 nt, Homo sapiens
cagcacaacccugagauug

SEQ ID NO: 941205 - RNA, 19 nt, Homo sapiens
ccaaauuuacuaugaaguc

SEQ ID NO: 941206 - RNA, 19 nt, Homo sapiens
agacaaggaggauuucuca

SEQ ID NO: 941207 - RNA, 19 nt, Homo sapiens
ccaacaggguuccauuugc

SEQ ID NO: 941208 - RNA, 19 nt, Homo sapiens
uaguggaggugcugugugu

SEQ ID NO: 941209 - RNA, 19 nt, Homo sapiens
uccaugggcuuucugaauc

SEQ ID NO: 941210 - RNA, 19 nt, Homo sapiens
gguuccauuugcucccuua

SEQ ID NO: 941211 - RNA, 19 nt, Homo sapiens
caucgucacccucaucuca

SEQ ID NO: 941212 - RNA, 19 nt, Homo sapiens
ccaggaaccaccaccauca

SEQ ID NO: 941213 - RNA, 19 nt, Homo sapiens
gguauuauaaggcucuaug

SEQ ID NO: 941214 - RNA, 19 nt, Homo sapiens
ugcacuauguacacagaua

SEQ ID NO: 941215 - RNA, 19 nt, Homo sapiens
uuacguaacccugccauga

SEQ ID NO: 941216 - RNA, 19 nt, Homo sapiens
guuacaggaugagauacaa

SEQ ID NO: 941217 - RNA, 19 nt, Homo sapiens
gaucagcuuguucuaaucu

SEQ ID NO: 941218 - RNA, 19 nt, Homo sapiens
agauugggcauauucuuaa

SEQ ID NO: 941219 - RNA, 19 nt, Homo sapiens
gggcccaaguccuggauca

SEQ ID NO: 941220 - RNA, 19 nt, Homo sapiens
cugcccagcuuuccugaga

SEQ ID NO: 941221 - RNA, 19 nt, Homo sapiens
gaggauuucucaguuacag

SEQ ID NO: 941222 - RNA, 19 nt, Homo sapiens
cagugaagacgcccaaaga

SEQ ID NO: 941223 - RNA, 19 nt, Homo sapiens
ucaaggauccugacucacu

SEQ ID NO: 941224 - RNA, 19 nt, Homo sapiens
uggacaagguggagaccaa

SEQ ID NO: 941225 - RNA, 19 nt, Homo sapiens
ugacuaucuccagcaauua

SEQ ID NO: 941226 - RNA, 19 nt, Homo sapiens
uauaaggcucuaugacuau

SEQ ID NO: 941227 - RNA, 19 nt, Homo sapiens
gugaagacgcccaaagaca

SEQ ID NO: 941228 - RNA, 19 nt, Homo sapiens
uagagaagauccccuuaug

SEQ ID NO: 941229 - RNA, 19 nt, Homo sapiens
agagaacaguacuggacaa

SEQ ID NO: 941230 - RNA, 19 nt, Homo sapiens
ccaccaccaucaguaaaca

SEQ ID NO: 941231 - RNA, 19 nt, Homo sapiens
gcaucugcccucagccaaa

SEQ ID NO: 941232 - RNA, 19 nt, Homo sapiens
cauggaggcucagguagca

SEQ ID NO: 941233 - RNA, 19 nt, Homo sapiens
gccacugccacuacugaua

SEQ ID NO: 941234 - RNA, 19 nt, Homo sapiens
auuauggacccaaugcuua

SEQ ID NO: 941235 - RNA, 19 nt, Homo sapiens
cagauauuauggacccaau

SEQ ID NO: 941236 - RNA, 19 nt, Homo sapiens
gaacuuugcugacggugaa

SEQ ID NO: 941237 - RNA, 19 nt, Homo sapiens
ccaagugucugguggauga

SEQ ID NO: 941238 - RNA, 19 nt, Homo sapiens
gggcagaaguggaugauca

SEQ ID NO: 941239 - RNA, 19 nt, Homo sapiens
ccaggaagauccgaacuuu

SEQ ID NO: 941240 - RNA, 19 nt, Homo sapiens
agaaguggaugaucagaaa

SEQ ID NO: 941241 - RNA, 19 nt, Homo sapiens
acaacgacauugacuacua

SEQ ID NO: 941242 - RNA, 19 nt, Homo sapiens
ccaggaagcccuacaacaa

SEQ ID NO: 941243 - RNA, 19 nt, Homo sapiens
gaagaggugugaggaugug

SEQ ID NO: 941244 - RNA, 19 nt, Homo sapiens
caacgacauugacuacuac

SEQ ID NO: 941245 - RNA, 19 nt, Homo sapiens
gaucggcugcuccuucgua

SEQ ID NO: 941246 - RNA, 19 nt, Homo sapiens
cguuugaggugcagcagua

SEQ ID NO: 941247 - RNA, 19 nt, Homo sapiens
uggaggagguggucuacaa

SEQ ID NO: 941248 - RNA, 19 nt, Homo sapiens
gagaugagggucuacaaca

SEQ ID NO: 941249 - RNA, 19 nt, Homo sapiens
guacauggccuggaacauc

SEQ ID NO: 941250 - RNA, 19 nt, Homo sapiens
caacaacgacauugacuac

SEQ ID NO: 941251 - RNA, 19 nt, Homo sapiens
agaaagugcagacagauga

SEQ ID NO: 941252 - RNA, 19 nt, Homo sapiens
guggauggaugacuucaag

SEQ ID NO: 941253 - RNA, 19 nt, Homo sapiens
caacagugacaacguggaa

SEQ ID NO: 941254 - RNA, 19 nt, Homo sapiens
gaacguguacccggagaug

SEQ ID NO: 941255 - RNA, 19 nt, Homo sapiens
agaugagggucuacaacaa

SEQ ID NO: 941256 - RNA, 19 nt, Homo sapiens
gcaccaggaagcccuacaa

SEQ ID NO: 941257 - RNA, 19 nt, Homo sapiens
cccagaaagugcagacaga

SEQ ID NO: 941258 - RNA, 19 nt, Homo sapiens
acaacaacacccucacgua

SEQ ID NO: 941259 - RNA, 19 nt, Homo sapiens
caucaaguacagcacguuu

SEQ ID NO: 941260 - RNA, 19 nt, Homo sapiens
caaacacgcacggcacuga

SEQ ID NO: 941261 - RNA, 19 nt, Homo sapiens
gucgucggcuucuuugaug

SEQ ID NO: 941262 - RNA, 19 nt, Homo sapiens
ggaggcggaaggcaaguau

SEQ ID NO: 941263 - RNA, 19 nt, Homo sapiens
ccaucgacaacaucaagua

SEQ ID NO: 941264 - RNA, 19 nt, Homo sapiens
ggaccaguacgucaacaag

SEQ ID NO: 941265 - RNA, 19 nt, Homo sapiens
gugacaacguggaacucaa

SEQ ID NO: 941266 - RNA, 19 nt, Homo sapiens
ucagaaacuggaucaaaca

SEQ ID NO: 941267 - RNA, 19 nt, Homo sapiens
cagaaguggaugaucagaa

SEQ ID NO: 941268 - RNA, 19 nt, Homo sapiens
cgaguacuucggagacauu

SEQ ID NO: 941269 - RNA, 19 nt, Homo sapiens
gaugagggucuacaacaac

SEQ ID NO: 941270 - RNA, 19 nt, Homo sapiens
acaacaacgacauugacua

SEQ ID NO: 941271 - RNA, 19 nt, Homo sapiens
gaaagugcagacagaugag

SEQ ID NO: 941272 - RNA, 19 nt, Homo sapiens
cagaaagugcagacagaug

SEQ ID NO: 941273 - RNA, 19 nt, Homo sapiens
gaggugagaaacagcaaag

SEQ ID NO: 941274 - RNA, 19 nt, Homo sapiens
ggagaugagggucuacaac

SEQ ID NO: 941275 - RNA, 19 nt, Homo sapiens
acccaggccucgugaagau

SEQ ID NO: 941276 - RNA, 19 nt, Homo sapiens
ggucuucaucuucgucaau

SEQ ID NO: 941277 - RNA, 19 nt, Homo sapiens
ccaggccucgugaagauug

SEQ ID NO: 941278 - RNA, 19 nt, Homo sapiens
ucaagugguaccuggagaa

SEQ ID NO: 941279 - RNA, 19 nt, Homo sapiens
ggacgacaacagugacaac

SEQ ID NO: 941280 - RNA, 19 nt, Homo sapiens
gcagaaguggaugaucaga

SEQ ID NO: 941281 - RNA, 19 nt, Homo sapiens
gccuggagguggagauguc

SEQ ID NO: 941282 - RNA, 19 nt, Homo sapiens
gccaggaagauccgaacuu

SEQ ID NO: 941283 - RNA, 19 nt, Homo sapiens
ucaagucccacguguacau

SEQ ID NO: 941284 - RNA, 19 nt, Homo sapiens
cggcugcuccuucguagug

SEQ ID NO: 941285 - RNA, 19 nt, Homo sapiens
guacccaggccucgugaag

SEQ ID NO: 941286 - RNA, 19 nt, Homo sapiens
ccuacaacaacgacauuga

SEQ ID NO: 941287 - RNA, 19 nt, Homo sapiens
gcccuacaacaacgacauu

SEQ ID NO: 941288 - RNA, 19 nt, Homo sapiens
gcgaguacuucggagacau

SEQ ID NO: 941289 - RNA, 19 nt, Homo sapiens
ugacaacguggaacucaag

SEQ ID NO: 941290 - RNA, 19 nt, Homo sapiens
gaagacaccugcagccuuu

SEQ ID NO: 941291 - RNA, 19 nt, Homo sapiens
gccaauaaauccugucuua

SEQ ID NO: 941292 - RNA, 19 nt, Homo sapiens
gaagggaggucaaguuguu

SEQ ID NO: 941293 - RNA, 19 nt, Homo sapiens
cagagaaccuguugaaaug

SEQ ID NO: 941294 - RNA, 19 nt, Homo sapiens
cagaguagcuggaauuaca

SEQ ID NO: 941295 - RNA, 19 nt, Homo sapiens
ucacggagcucacccaugu

SEQ ID NO: 941296 - RNA, 19 nt, Homo sapiens
gcaagaaguccauauuguu

SEQ ID NO: 941297 - RNA, 19 nt, Homo sapiens
caccacgccuggcuaauuu

SEQ ID NO: 941298 - RNA, 19 nt, Homo sapiens
gcaaagacucgagcuauga

SEQ ID NO: 941299 - RNA, 19 nt, Homo sapiens
ucaaugauuugucagagaa

SEQ ID NO: 941300 - RNA, 19 nt, Homo sapiens
ucaaguuguuugucaauga

SEQ ID NO: 941301 - RNA, 19 nt, Homo sapiens
gagcagacccucaauaaac

SEQ ID NO: 941302 - RNA, 19 nt, Homo sapiens
gcggagacuucaagaaaug

SEQ ID NO: 941303 - RNA, 19 nt, Homo sapiens
ggaaacagcuccccaccaa

SEQ ID NO: 941304 - RNA, 19 nt, Homo sapiens
cagagcagacccucaauaa

SEQ ID NO: 941305 - RNA, 19 nt, Homo sapiens
gagaaccuguugaaaugug

SEQ ID NO: 941306 - RNA, 19 nt, Homo sapiens
gaggucaaguuguuuguca

SEQ ID NO: 941307 - RNA, 19 nt, Homo sapiens
ucagagaaccuguugaaau

SEQ ID NO: 941308 - RNA, 19 nt, Homo sapiens
cagcggagacuucaagaaa

SEQ ID NO: 941309 - RNA, 19 nt, Homo sapiens
caagaaguccauauuguuc

SEQ ID NO: 941310 - RNA, 19 nt, Homo sapiens
ucaguggacucaagaagug

SEQ ID NO: 941311 - RNA, 19 nt, Homo sapiens
ccuuugagccugauguuua

SEQ ID NO: 941312 - RNA, 19 nt, Homo sapiens
agggcaagcuucaguauga

SEQ ID NO: 941313 - RNA, 19 nt, Homo sapiens
ccaauucaauccugccaau

SEQ ID NO: 941314 - RNA, 19 nt, Homo sapiens
ccaggaguguggcagcuuu

SEQ ID NO: 941315 - RNA, 19 nt, Homo sapiens
gcaaguugguccacagcau

SEQ ID NO: 941316 - RNA, 19 nt, Homo sapiens
aaacaccaauuacguagca

SEQ ID NO: 941317 - RNA, 19 nt, Homo sapiens
ggagagggaucggccauac

SEQ ID NO: 941318 - RNA, 19 nt, Homo sapiens
ccacgugugugugugauug

SEQ ID NO: 941319 - RNA, 19 nt, Homo sapiens
caaguuguuugucaaugau

SEQ ID NO: 941320 - RNA, 19 nt, Homo sapiens
gggcuagaguuuccuuauc

SEQ ID NO: 941321 - RNA, 19 nt, Homo sapiens
ggcaagaccaguaugaaga

SEQ ID NO: 941322 - RNA, 19 nt, Homo sapiens
caccugggcugugauguga

SEQ ID NO: 941323 - RNA, 19 nt, Homo sapiens
aauccugucuuauuuguuc

SEQ ID NO: 941324 - RNA, 19 nt, Homo sapiens
ccagagcagacccucaaua

SEQ ID NO: 941325 - RNA, 19 nt, Homo sapiens
gcagcccuguggaguguga

SEQ ID NO: 941326 - RNA, 19 nt, Homo sapiens
gcgcucagauuacgaagac

SEQ ID NO: 941327 - RNA, 19 nt, Homo sapiens
ccuguugaaaugugaauua

SEQ ID NO: 941328 - RNA, 19 nt, Homo sapiens
gcacccaagagauauuuau

SEQ ID NO: 941329 - RNA, 19 nt, Homo sapiens
ugcaagaaguccauauugu

SEQ ID NO: 941330 - RNA, 19 nt, Homo sapiens
ucucaggacaguauaauau

SEQ ID NO: 941331 - RNA, 19 nt, Homo sapiens
ccaccacgccuggcuaauu

SEQ ID NO: 941332 - RNA, 19 nt, Homo sapiens
cagcagcccuguggagugu

SEQ ID NO: 941333 - RNA, 19 nt, Homo sapiens
gauauggacacguuugaca

SEQ ID NO: 941334 - RNA, 19 nt, Homo sapiens
cuucauggccgacgacauu

SEQ ID NO: 941335 - RNA, 19 nt, Homo sapiens
gucaaugauuugucagaga

SEQ ID NO: 941336 - RNA, 19 nt, Homo sapiens
uccaggagcugcaagaagu

SEQ ID NO: 941337 - RNA, 19 nt, Homo sapiens
aguaugagcugcaguacag

SEQ ID NO: 941338 - RNA, 19 nt, Homo sapiens
ggauguauuccacuucaug

SEQ ID NO: 941339 - RNA, 19 nt, Homo sapiens
cgcaaagacucgagcuaug

SEQ ID NO: 941340 - RNA, 19 nt, Homo sapiens
gaccuucucaggacaguau

SEQ ID NO: 941341 - RNA, 19 nt, Homo sapiens
auucaauccugccaauaaa

SEQ ID NO: 941342 - RNA, 19 nt, Homo sapiens
aauucaauccugccaauaa

SEQ ID NO: 941343 - RNA, 19 nt, Homo sapiens
ucacccaugugcacaagug

SEQ ID NO: 941344 - RNA, 19 nt, Homo sapiens
ccacaggucggcccacaau

SEQ ID NO: 941345 - RNA, 19 nt, Homo sapiens
uuuaugcacccaagagaua

SEQ ID NO: 941346 - RNA, 19 nt, Homo sapiens
cuaaugaggcugacuggau

SEQ ID NO: 941347 - RNA, 19 nt, Homo sapiens
gaucucaguggacucaaga

SEQ ID NO: 941348 - RNA, 19 nt, Homo sapiens
ucuccuggcgcucagauua

SEQ ID NO: 941349 - RNA, 19 nt, Homo sapiens
gcugcaagaaguccauauu

SEQ ID NO: 941350 - RNA, 19 nt, Homo sapiens
ccugaagacccauccauug

SEQ ID NO: 941351 - RNA, 19 nt, Homo sapiens
gcaagaccaguaugaagag

SEQ ID NO: 941352 - RNA, 19 nt, Homo sapiens
ucaggacaguauaauaucu

SEQ ID NO: 941353 - RNA, 19 nt, Homo sapiens
ugucagagaaccuguugaa

SEQ ID NO: 941354 - RNA, 19 nt, Homo sapiens
ggucauuccuccgccacuu

SEQ ID NO: 941355 - RNA, 19 nt, Homo sapiens
guuugucaaugauuuguca

SEQ ID NO: 941356 - RNA, 19 nt, Homo sapiens
ccagcacgcucacccuuac

SEQ ID NO: 941357 - RNA, 19 nt, Homo sapiens
aaguccauauuguuccuua

SEQ ID NO: 941358 - RNA, 19 nt, Homo sapiens
gccuggauauggacacguu

SEQ ID NO: 941359 - RNA, 19 nt, Homo sapiens
uggaggcuauggaagaaga

SEQ ID NO: 941360 - RNA, 19 nt, Homo sapiens
gcccagagcagacccucaa

SEQ ID NO: 941361 - RNA, 19 nt, Homo sapiens
ccuagggucuuguguugca

SEQ ID NO: 941362 - RNA, 19 nt, Homo sapiens
gacccagucagaggaguua

SEQ ID NO: 941363 - RNA, 19 nt, Homo sapiens
gcugugaguccgaggagaa

SEQ ID NO: 941364 - RNA, 19 nt, Homo sapiens
cuccuagggucuuguguug

SEQ ID NO: 941365 - RNA, 19 nt, Homo sapiens
ggucaucugcauccuggaa

SEQ ID NO: 941366 - RNA, 19 nt, Homo sapiens
gguuggaacuaugcagugu

SEQ ID NO: 941367 - RNA, 19 nt, Homo sapiens
gcagcggagacuucaagaa

SEQ ID NO: 941368 - RNA, 19 nt, Homo sapiens
aacgucagcuuccuuccuu

SEQ ID NO: 941369 - RNA, 19 nt, Homo sapiens
agaggcagcucagauagag

SEQ ID NO: 941370 - RNA, 19 nt, Homo sapiens
agucagaggaguuaaagga

SEQ ID NO: 941371 - RNA, 19 nt, Homo sapiens
cuagggcucugugauguag

SEQ ID NO: 941372 - RNA, 19 nt, Homo sapiens
ggucaaguuguuugucaau

SEQ ID NO: 941373 - RNA, 19 nt, Homo sapiens
caauucaauccugccaaua

SEQ ID NO: 941374 - RNA, 19 nt, Homo sapiens
uuucuaacuucugcuacua

SEQ ID NO: 941375 - RNA, 19 nt, Homo sapiens
agagcagacccucaauaaa

SEQ ID NO: 941376 - RNA, 19 nt, Homo sapiens
cugaaucccgacucugaua

SEQ ID NO: 941377 - RNA, 19 nt, Homo sapiens
uguggaggcuauggaagaa

SEQ ID NO: 941378 - RNA, 19 nt, Homo sapiens
ccgcaaagacucgagcuau

SEQ ID NO: 941379 - RNA, 19 nt, Homo sapiens
agaaccuguugaaauguga

SEQ ID NO: 941380 - RNA, 19 nt, Homo sapiens
ucaauccugccaauaaauc

SEQ ID NO: 941381 - RNA, 19 nt, Homo sapiens
gcugcagguuggaacuaug

SEQ ID NO: 941382 - RNA, 19 nt, Homo sapiens
gcuagaguuuccuuaucca

SEQ ID NO: 941383 - RNA, 19 nt, Homo sapiens
agccugauguuuacagugu

SEQ ID NO: 941384 - RNA, 19 nt, Homo sapiens
gggcugugaugugaagaca

SEQ ID NO: 941385 - RNA, 19 nt, Homo sapiens
gcccugagccagagacaag

SEQ ID NO: 941386 - RNA, 19 nt, Homo sapiens
gaagccuccuggacagacu

SEQ ID NO: 941387 - RNA, 19 nt, Homo sapiens
ugaagacccauccauugug

SEQ ID NO: 941388 - RNA, 19 nt, Homo sapiens
ggcuagaguuuccuuaucc

SEQ ID NO: 941389 - RNA, 19 nt, Homo sapiens
cugcaagaaguccauauug

SEQ ID NO: 941390 - RNA, 19 nt, Homo sapiens
gaacuggauuugcuguuua

SEQ ID NO: 941391 - RNA, 19 nt, Homo sapiens
ucugugagcucuuuccuua

SEQ ID NO: 941392 - RNA, 19 nt, Homo sapiens
gaggcuagcuuggcugaua

SEQ ID NO: 941393 - RNA, 19 nt, Homo sapiens
gaucaaagcaauuggagaa

SEQ ID NO: 941394 - RNA, 19 nt, Homo sapiens
gaagugcuguucccucaau

SEQ ID NO: 941395 - RNA, 19 nt, Homo sapiens
cuaagcacaugucauauug

SEQ ID NO: 941396 - RNA, 19 nt, Homo sapiens
ggagagaucaaagcaauug

SEQ ID NO: 941397 - RNA, 19 nt, Homo sapiens
agaaaucugugagcucuuu

SEQ ID NO: 941398 - RNA, 19 nt, Homo sapiens
gcuaagcacaugucauauu

SEQ ID NO: 941399 - RNA, 19 nt, Homo sapiens
guggagagaucaaagcaau

SEQ ID NO: 941400 - RNA, 19 nt, Homo sapiens
gcaacaggcuaagcacaug

SEQ ID NO: 941401 - RNA, 19 nt, Homo sapiens
gagcgcugcuaucugauga

SEQ ID NO: 941402 - RNA, 19 nt, Homo sapiens
gcaccuucaugcuggcuaa

SEQ ID NO: 941403 - RNA, 19 nt, Homo sapiens
caaagcaauuggagaacug

SEQ ID NO: 941404 - RNA, 19 nt, Homo sapiens
aagcacaugucauauugaa

SEQ ID NO: 941405 - RNA, 19 nt, Homo sapiens
gauagguuccagccuuaua

SEQ ID NO: 941406 - RNA, 19 nt, Homo sapiens
agugagcgcugcuaucuga

SEQ ID NO: 941407 - RNA, 19 nt, Homo sapiens
agaacuggauuugcuguuu

SEQ ID NO: 941408 - RNA, 19 nt, Homo sapiens
aggcuaagcacaugucaua

SEQ ID NO: 941409 - RNA, 19 nt, Homo sapiens
gcaauuggagaacuggauu

SEQ ID NO: 941410 - RNA, 19 nt, Homo sapiens
cugauagguuccagccuua

SEQ ID NO: 941411 - RNA, 19 nt, Homo sapiens
uagcuuggcugauaacaac

SEQ ID NO: 941412 - RNA, 19 nt, Homo sapiens
gaccagagcaaagcugaaa

SEQ ID NO: 941413 - RNA, 19 nt, Homo sapiens
ugugagcucuuuccuuaug

SEQ ID NO: 941414 - RNA, 19 nt, Homo sapiens
gaguuagaauugucugcaa

SEQ ID NO: 941415 - RNA, 19 nt, Homo sapiens
gugaugaccugcauaucca

SEQ ID NO: 941416 - RNA, 19 nt, Homo sapiens
gcugaaggacacagugaaa

SEQ ID NO: 941417 - RNA, 19 nt, Homo sapiens
ucucuuggcccucuuggua

SEQ ID NO: 941418 - RNA, 19 nt, Homo sapiens
gcuguucccucaaucugau

SEQ ID NO: 941419 - RNA, 19 nt, Homo sapiens
ggagagaguggagagauca

SEQ ID NO: 941420 - RNA, 19 nt, Homo sapiens
caagcagaaucuucagaac

SEQ ID NO: 941421 - RNA, 19 nt, Homo sapiens
uggauuugcuguuuauguc

SEQ ID NO: 941422 - RNA, 19 nt, Homo sapiens
acaagcagaaucuucagaa

SEQ ID NO: 941423 - RNA, 19 nt, Homo sapiens
ucaaagcaauuggagaacu

SEQ ID NO: 941424 - RNA, 19 nt, Homo sapiens
aggcuagcuuggcugauaa

SEQ ID NO: 941425 - RNA, 19 nt, Homo sapiens
ccagcugccuccuucucuu

SEQ ID NO: 941426 - RNA, 19 nt, Homo sapiens
caauuggagaacuggauuu

SEQ ID NO: 941427 - RNA, 19 nt, Homo sapiens
cugcauauccagaggaaug

SEQ ID NO: 941428 - RNA, 19 nt, Homo sapiens
ucaccaguugcucgaguua

SEQ ID NO: 941429 - RNA, 19 nt, Homo sapiens
uaacaacacagacguucgu

SEQ ID NO: 941430 - RNA, 19 nt, Homo sapiens
gcgcugcuaucugaugaag

SEQ ID NO: 941431 - RNA, 19 nt, Homo sapiens
acaauuagaugccccaaag

SEQ ID NO: 941432 - RNA, 19 nt, Homo sapiens
gagaacuggauuugcuguu

SEQ ID NO: 941433 - RNA, 19 nt, Homo sapiens
ccacggagucaguaugagu

SEQ ID NO: 941434 - RNA, 19 nt, Homo sapiens
accaguugcucgaguuaga

SEQ ID NO: 941435 - RNA, 19 nt, Homo sapiens
gagaguggagagaucaaag

SEQ ID NO: 941436 - RNA, 19 nt, Homo sapiens
ggugaugaccugcauaucc

SEQ ID NO: 941437 - RNA, 19 nt, Homo sapiens
guugcucgaguuagaauug

SEQ ID NO: 941438 - RNA, 19 nt, Homo sapiens
caacaggcuaagcacaugu

SEQ ID NO: 941439 - RNA, 19 nt, Homo sapiens
agcagaaucuucagaacag

SEQ ID NO: 941440 - RNA, 19 nt, Homo sapiens
aagcagaaucuucagaaca

SEQ ID NO: 941441 - RNA, 19 nt, Homo sapiens
uggagagaguggagagauc

SEQ ID NO: 941442 - RNA, 19 nt, Homo sapiens
ugagugagcgcugcuaucu

SEQ ID NO: 941443 - RNA, 19 nt, Homo sapiens
gaacuuggcuucaaacaaa

SEQ ID NO: 941444 - RNA, 19 nt, Homo sapiens
ugaaauaccuccugaagaa

SEQ ID NO: 941445 - RNA, 19 nt, Homo sapiens
gaaguucagucuugucuuu

SEQ ID NO: 941446 - RNA, 19 nt, Homo sapiens
gaagaucugugauggguuu

SEQ ID NO: 941447 - RNA, 19 nt, Homo sapiens
caauuuagcugaugauuuc

SEQ ID NO: 941448 - RNA, 19 nt, Homo sapiens
gaagaacucucaacaucau

SEQ ID NO: 941449 - RNA, 19 nt, Homo sapiens
aaacaaagcuuccuagaac

SEQ ID NO: 941450 - RNA, 19 nt, Homo sapiens
caacaucauucugcaauuu

SEQ ID NO: 941451 - RNA, 19 nt, Homo sapiens
gaagugcucuggacuaugg

SEQ ID NO: 941452 - RNA, 19 nt, Homo sapiens
cuaaacagaugucuucuug

SEQ ID NO: 941453 - RNA, 19 nt, Homo sapiens
gaggaaacguguacuugaa

SEQ ID NO: 941454 - RNA, 19 nt, Homo sapiens
ucacauuucugaacucgua

SEQ ID NO: 941455 - RNA, 19 nt, Homo sapiens
gaaacaaagcuuccuagaa

SEQ ID NO: 941456 - RNA, 19 nt, Homo sapiens
ggagaaugcuaaacagaug

SEQ ID NO: 941457 - RNA, 19 nt, Homo sapiens
cagcaggccuugaaacaaa

SEQ ID NO: 941458 - RNA, 19 nt, Homo sapiens
gcaugaaacuguguauuau

SEQ ID NO: 941459 - RNA, 19 nt, Homo sapiens
cagaagaacucucaacauc

SEQ ID NO: 941460 - RNA, 19 nt, Homo sapiens
caaacaaacucacauuucu

SEQ ID NO: 941461 - RNA, 19 nt, Homo sapiens
gaagacagacaaugagauu

SEQ ID NO: 941462 - RNA, 19 nt, Homo sapiens
caagauggcgucuguguuu

SEQ ID NO: 941463 - RNA, 19 nt, Homo sapiens
ggaaauccauacccguuug

SEQ ID NO: 941464 - RNA, 19 nt, Homo sapiens
ggaaauuugugaaugaagu

SEQ ID NO: 941465 - RNA, 19 nt, Homo sapiens
gaagcgaggagauguguuu

SEQ ID NO: 941466 - RNA, 19 nt, Homo sapiens
ggaaggagaguuacaggaa

SEQ ID NO: 941467 - RNA, 19 nt, Homo sapiens
ggaauuguccagaugguuu

SEQ ID NO: 941468 - RNA, 19 nt, Homo sapiens
gaauauuguugaugccuau

SEQ ID NO: 941469 - RNA, 19 nt, Homo sapiens
ggaaugaaaggaauguaaa

SEQ ID NO: 941470 - RNA, 19 nt, Homo sapiens
cuacaaacaucagcaagaa

SEQ ID NO: 941471 - RNA, 19 nt, Homo sapiens
ggaggaaagucuauaucug

SEQ ID NO: 941472 - RNA, 19 nt, Homo sapiens
gaacaucuuuggcucuucu

SEQ ID NO: 941473 - RNA, 19 nt, Homo sapiens
uaacaggaccaauaaauuc

SEQ ID NO: 941474 - RNA, 19 nt, Homo sapiens
gagcaaggcauggaacuaa

SEQ ID NO: 941475 - RNA, 19 nt, Homo sapiens
aaacagaugucuucuugca

SEQ ID NO: 941476 - RNA, 19 nt, Homo sapiens
gaaggaaguucagucuugu

SEQ ID NO: 941477 - RNA, 19 nt, Homo sapiens
gaaagaagaaauucagaag

SEQ ID NO: 941478 - RNA, 19 nt, Homo sapiens
gaaacuguguauuauuugg

SEQ ID NO: 941479 - RNA, 19 nt, Homo sapiens
gcaagaaguccaaaguuuc

SEQ ID NO: 941480 - RNA, 19 nt, Homo sapiens
ggaaaccaauuuagcugau

SEQ ID NO: 941481 - RNA, 19 nt, Homo sapiens
ugacagaacugaaauaccu

SEQ ID NO: 941482 - RNA, 19 nt, Homo sapiens
caagugauauugucuucau

SEQ ID NO: 941483 - RNA, 19 nt, Homo sapiens
gaugucuucuugcaauauu

SEQ ID NO: 941484 - RNA, 19 nt, Homo sapiens
ugaccacagugcaaucuaa

SEQ ID NO: 941485 - RNA, 19 nt, Homo sapiens
gcagaugccacacguauca

SEQ ID NO: 941486 - RNA, 19 nt, Homo sapiens
ggacgaccauggagaagag

SEQ ID NO: 941487 - RNA, 19 nt, Homo sapiens
gaagagaagaagagagaga

SEQ ID NO: 941488 - RNA, 19 nt, Homo sapiens
cagaagaacauauucauca

SEQ ID NO: 941489 - RNA, 19 nt, Homo sapiens
gguggaagcugcauauugc

SEQ ID NO: 941490 - RNA, 19 nt, Homo sapiens
gacgucagccuguggauuu

SEQ ID NO: 941491 - RNA, 19 nt, Homo sapiens
cguggaugcuucugauuaa

SEQ ID NO: 941492 - RNA, 19 nt, Homo sapiens
ggaauacucauguaaugga

SEQ ID NO: 941493 - RNA, 19 nt, Homo sapiens
gaacugacagaacugaaau

SEQ ID NO: 941494 - RNA, 19 nt, Homo sapiens
agaaacggcacauggaaua

SEQ ID NO: 941495 - RNA, 19 nt, Homo sapiens
agcaagaaguccaaaguuu

SEQ ID NO: 941496 - RNA, 19 nt, Homo sapiens
gaagaaauucagaagaaca

SEQ ID NO: 941497 - RNA, 19 nt, Homo sapiens
gaaaccaauuuagcugaug

SEQ ID NO: 941498 - RNA, 19 nt, Homo sapiens
ggacuauggugaugaacag

SEQ ID NO: 941499 - RNA, 19 nt, Homo sapiens
gcacuuuggaugauucuga

SEQ ID NO: 941500 - RNA, 19 nt, Homo sapiens
guucauagccggugugauc

SEQ ID NO: 941501 - RNA, 19 nt, Homo sapiens
gaagucagaaggugugaau

SEQ ID NO: 941502 - RNA, 19 nt, Homo sapiens
acagaugucuucuugcaau

SEQ ID NO: 941503 - RNA, 19 nt, Homo sapiens
gcagcuaccgggagauaaa

SEQ ID NO: 941504 - RNA, 19 nt, Homo sapiens
gaaauaccuccugaagaaa

SEQ ID NO: 941505 - RNA, 19 nt, Homo sapiens
guucuuggcucaccugaag

SEQ ID NO: 941506 - RNA, 19 nt, Homo sapiens
caacuuuggagacgucuuu

SEQ ID NO: 941507 - RNA, 19 nt, Homo sapiens
ccuguucgcugugauguuu

SEQ ID NO: 941508 - RNA, 19 nt, Homo sapiens
cugcauauaugaccggaaa

SEQ ID NO: 941509 - RNA, 19 nt, Homo sapiens
aaaccaauuuagcugauga

SEQ ID NO: 941510 - RNA, 19 nt, Homo sapiens
cagaugucuucuugcaaua

SEQ ID NO: 941511 - RNA, 19 nt, Homo sapiens
caauuuaucccugagauga

SEQ ID NO: 941512 - RNA, 19 nt, Homo sapiens
ccuggagacuguucuagaa

SEQ ID NO: 941513 - RNA, 19 nt, Homo sapiens
uggcucaccugaagcauga

SEQ ID NO: 941514 - RNA, 19 nt, Homo sapiens
agacaggaaugaaaggaau

SEQ ID NO: 941515 - RNA, 19 nt, Homo sapiens
uggcgaaucugccgaggaa

SEQ ID NO: 941516 - RNA, 19 nt, Homo sapiens
ccaauuuagcugaugauuu

SEQ ID NO: 941517 - RNA, 19 nt, Homo sapiens
auaaacaucugagucauuc

SEQ ID NO: 941518 - RNA, 19 nt, Homo sapiens
ucaaacaaacucacauuuc

SEQ ID NO: 941519 - RNA, 19 nt, Homo sapiens
cgaaagaagaaauucagaa

SEQ ID NO: 941520 - RNA, 19 nt, Homo sapiens
ggaggauccugugacgaaa

SEQ ID NO: 941521 - RNA, 19 nt, Homo sapiens
gaaccagcaggccuugaaa

SEQ ID NO: 941522 - RNA, 19 nt, Homo sapiens
agcaugaaacuguguauua

SEQ ID NO: 941523 - RNA, 19 nt, Homo sapiens
agacagacaaugagauuug

SEQ ID NO: 941524 - RNA, 19 nt, Homo sapiens
cugaugauuucuuuacuga

SEQ ID NO: 941525 - RNA, 19 nt, Homo sapiens
cggguuugaucuacaauga

SEQ ID NO: 941526 - RNA, 19 nt, Homo sapiens
uaucugauccuacuuaugg

SEQ ID NO: 941527 - RNA, 19 nt, Homo sapiens
gcuccuggcugcacuuugg

SEQ ID NO: 941528 - RNA, 19 nt, Homo sapiens
ccuacaccaucaucacuuu

SEQ ID NO: 941529 - RNA, 19 nt, Homo sapiens
acauuuaacaggaccaaua

SEQ ID NO: 941530 - RNA, 19 nt, Homo sapiens
gaagaugaaagcugucuac

SEQ ID NO: 941531 - RNA, 19 nt, Homo sapiens
ugaaagcugucuaccacau

SEQ ID NO: 941532 - RNA, 19 nt, Homo sapiens
cgaggaaacguguacuuga

SEQ ID NO: 941533 - RNA, 19 nt, Homo sapiens
gcugaugauuucuuuacug

SEQ ID NO: 941534 - RNA, 19 nt, Homo sapiens
gguuauggcuuugauuucu

SEQ ID NO: 941535 - RNA, 19 nt, Homo sapiens
ucaacaucauucugcaauu

SEQ ID NO: 941536 - RNA, 19 nt, Homo sapiens
ggaacuuggcuucaaacaa

SEQ ID NO: 941537 - RNA, 19 nt, Homo sapiens
gcuaucugauccuacuuau

SEQ ID NO: 941538 - RNA, 19 nt, Homo sapiens
ggcaagugauauugucuuc

SEQ ID NO: 941539 - RNA, 19 nt, Homo sapiens
gcagucucauuuccaguuc

SEQ ID NO: 941540 - RNA, 19 nt, Homo sapiens
ggugucauccucagccuuu

SEQ ID NO: 941541 - RNA, 19 nt, Homo sapiens
caagugaagacaggaauga

SEQ ID NO: 941542 - RNA, 19 nt, Homo sapiens
aaaugaagaugucggugau

SEQ ID NO: 941543 - RNA, 19 nt, Homo sapiens
gaacuuggcuucaaacaaa

SEQ ID NO: 941544 - RNA, 19 nt, Homo sapiens
ugaaauaccuccugaagaa

SEQ ID NO: 941545 - RNA, 19 nt, Homo sapiens
gaaguucagucuugucuuu

SEQ ID NO: 941546 - RNA, 19 nt, Homo sapiens
gaagaucugugauggguuu

SEQ ID NO: 941547 - RNA, 19 nt, Homo sapiens
caauuuagcugaugauuuc

SEQ ID NO: 941548 - RNA, 19 nt, Homo sapiens
gaagaacucucaacaucau

SEQ ID NO: 941549 - RNA, 19 nt, Homo sapiens
aaacaaagcuuccuagaac

SEQ ID NO: 941550 - RNA, 19 nt, Homo sapiens
caacaucauucugcaauuu

SEQ ID NO: 941551 - RNA, 19 nt, Homo sapiens
gaagugcucuggacuaugg

SEQ ID NO: 941552 - RNA, 19 nt, Homo sapiens
cuaaacagaugucuucuug

SEQ ID NO: 941553 - RNA, 19 nt, Homo sapiens
gaggaaacguguacuugaa

SEQ ID NO: 941554 - RNA, 19 nt, Homo sapiens
ucacauuucugaacucgua

SEQ ID NO: 941555 - RNA, 19 nt, Homo sapiens
gaaacaaagcuuccuagaa

SEQ ID NO: 941556 - RNA, 19 nt, Homo sapiens
ggagaaugcuaaacagaug

SEQ ID NO: 941557 - RNA, 19 nt, Homo sapiens
cagcaggccuugaaacaaa

SEQ ID NO: 941558 - RNA, 19 nt, Homo sapiens
gcaugaaacuguguauuau

SEQ ID NO: 941559 - RNA, 19 nt, Homo sapiens
cagaagaacucucaacauc

SEQ ID NO: 941560 - RNA, 19 nt, Homo sapiens
caaacaaacucacauuucu

SEQ ID NO: 941561 - RNA, 19 nt, Homo sapiens
gaagacagacaaugagauu

SEQ ID NO: 941562 - RNA, 19 nt, Homo sapiens
caagauggcgucuguguuu

SEQ ID NO: 941563 - RNA, 19 nt, Homo sapiens
ggaaauccauacccguuug

SEQ ID NO: 941564 - RNA, 19 nt, Homo sapiens
ggaaauuugugaaugaagu

SEQ ID NO: 941565 - RNA, 19 nt, Homo sapiens
gaagcgaggagauguguuu

SEQ ID NO: 941566 - RNA, 19 nt, Homo sapiens
ggaaggagaguuacaggaa

SEQ ID NO: 941567 - RNA, 19 nt, Homo sapiens
ggaauuguccagaugguuu

SEQ ID NO: 941568 - RNA, 19 nt, Homo sapiens
gaauauuguugaugccuau

SEQ ID NO: 941569 - RNA, 19 nt, Homo sapiens
cuacaaacaucagcaagaa

SEQ ID NO: 941570 - RNA, 19 nt, Homo sapiens
ggaggaaagucuauaucug

SEQ ID NO: 941571 - RNA, 19 nt, Homo sapiens
gaacaucuuuggcucuucu

SEQ ID NO: 941572 - RNA, 19 nt, Homo sapiens
uaacaggaccaauaaauuc

SEQ ID NO: 941573 - RNA, 19 nt, Homo sapiens
gagcaaggcauggaacuaa

SEQ ID NO: 941574 - RNA, 19 nt, Homo sapiens
aaacagaugucuucuugca

SEQ ID NO: 941575 - RNA, 19 nt, Homo sapiens
gaaggaaguucagucuugu

SEQ ID NO: 941576 - RNA, 19 nt, Homo sapiens
gaaagaagaaauucagaag

SEQ ID NO: 941577 - RNA, 19 nt, Homo sapiens
gaaacuguguauuauuugg

SEQ ID NO: 941578 - RNA, 19 nt, Homo sapiens
gcaagaaguccaaaguuuc

SEQ ID NO: 941579 - RNA, 19 nt, Homo sapiens
ggaaaccaauuuagcugau

SEQ ID NO: 941580 - RNA, 19 nt, Homo sapiens
ugacagaacugaaauaccu

SEQ ID NO: 941581 - RNA, 19 nt, Homo sapiens
caagugauauugucuucau

SEQ ID NO: 941582 - RNA, 19 nt, Homo sapiens
gaugucuucuugcaauauu

SEQ ID NO: 941583 - RNA, 19 nt, Homo sapiens
ugaccacagugcaaucuaa

SEQ ID NO: 941584 - RNA, 19 nt, Homo sapiens
gcagaugccacacguauca

SEQ ID NO: 941585 - RNA, 19 nt, Homo sapiens
ggacgaccauggagaagag

SEQ ID NO: 941586 - RNA, 19 nt, Homo sapiens
gguggaagcugcauauugc

SEQ ID NO: 941587 - RNA, 19 nt, Homo sapiens
cagaagaacauauucauca

SEQ ID NO: 941588 - RNA, 19 nt, Homo sapiens
gacgucagccuguggauuu

SEQ ID NO: 941589 - RNA, 19 nt, Homo sapiens
cguggaugcuucugauuaa

SEQ ID NO: 941590 - RNA, 19 nt, Homo sapiens
ggaauacucauguaaugga

SEQ ID NO: 941591 - RNA, 19 nt, Homo sapiens
gaacugacagaacugaaau

SEQ ID NO: 941592 - RNA, 19 nt, Homo sapiens
agaaacggcacauggaaua

SEQ ID NO: 941593 - RNA, 19 nt, Homo sapiens
agcaagaaguccaaaguuu

SEQ ID NO: 941594 - RNA, 19 nt, Homo sapiens
gaagaaauucagaagaaca

SEQ ID NO: 941595 - RNA, 19 nt, Homo sapiens
gaaaccaauuuagcugaug

SEQ ID NO: 941596 - RNA, 19 nt, Homo sapiens
ggacuauggugaugaacag

SEQ ID NO: 941597 - RNA, 19 nt, Homo sapiens
gcacuuuggaugauucuga

SEQ ID NO: 941598 - RNA, 19 nt, Homo sapiens
guucauagccggugugauc

SEQ ID NO: 941599 - RNA, 19 nt, Homo sapiens
gaagucagaaggugugaau

SEQ ID NO: 941600 - RNA, 19 nt, Homo sapiens
acagaugucuucuugcaau

SEQ ID NO: 941601 - RNA, 19 nt, Homo sapiens
gcagcuaccgggagauaaa

SEQ ID NO: 941602 - RNA, 19 nt, Homo sapiens
gaaauaccuccugaagaaa

SEQ ID NO: 941603 - RNA, 19 nt, Homo sapiens
guucuuggcucaccugaag

SEQ ID NO: 941604 - RNA, 19 nt, Homo sapiens
caacuuuggagacgucuuu

SEQ ID NO: 941605 - RNA, 19 nt, Homo sapiens
ccuguucgcugugauguuu

SEQ ID NO: 941606 - RNA, 19 nt, Homo sapiens
cugcauauaugaccggaaa

SEQ ID NO: 941607 - RNA, 19 nt, Homo sapiens
aaaccaauuuagcugauga

SEQ ID NO: 941608 - RNA, 19 nt, Homo sapiens
cagaugucuucuugcaaua

SEQ ID NO: 941609 - RNA, 19 nt, Homo sapiens
caauuuaucccugagauga

SEQ ID NO: 941610 - RNA, 19 nt, Homo sapiens
ccuggagacuguucuagaa

SEQ ID NO: 941611 - RNA, 19 nt, Homo sapiens
uggcucaccugaagcauga

SEQ ID NO: 941612 - RNA, 19 nt, Homo sapiens
uggcgaaucugccgaggaa

SEQ ID NO: 941613 - RNA, 19 nt, Homo sapiens
ccaauuuagcugaugauuu

SEQ ID NO: 941614 - RNA, 19 nt, Homo sapiens
auaaacaucugagucauuc

SEQ ID NO: 941615 - RNA, 19 nt, Homo sapiens
ucaaacaaacucacauuuc

SEQ ID NO: 941616 - RNA, 19 nt, Homo sapiens
cgaaagaagaaauucagaa

SEQ ID NO: 941617 - RNA, 19 nt, Homo sapiens
ggaggauccugugacgaaa

SEQ ID NO: 941618 - RNA, 19 nt, Homo sapiens
gaaccagcaggccuugaaa

SEQ ID NO: 941619 - RNA, 19 nt, Homo sapiens
agcaugaaacuguguauua

SEQ ID NO: 941620 - RNA, 19 nt, Homo sapiens
agacagacaaugagauuug

SEQ ID NO: 941621 - RNA, 19 nt, Homo sapiens
cugaugauuucuuuacuga

SEQ ID NO: 941622 - RNA, 19 nt, Homo sapiens
cggguuugaucuacaauga

SEQ ID NO: 941623 - RNA, 19 nt, Homo sapiens
uaucugauccuacuuaugg

SEQ ID NO: 941624 - RNA, 19 nt, Homo sapiens
gcuccuggcugcacuuugg

SEQ ID NO: 941625 - RNA, 19 nt, Homo sapiens
ccuacaccaucaucacuuu

SEQ ID NO: 941626 - RNA, 19 nt, Homo sapiens
acauuuaacaggaccaaua

SEQ ID NO: 941627 - RNA, 19 nt, Homo sapiens
gaagaugaaagcugucuac

SEQ ID NO: 941628 - RNA, 19 nt, Homo sapiens
ugaaagcugucuaccacau

SEQ ID NO: 941629 - RNA, 19 nt, Homo sapiens
cgaggaaacguguacuuga

SEQ ID NO: 941630 - RNA, 19 nt, Homo sapiens
gcugaugauuucuuuacug

SEQ ID NO: 941631 - RNA, 19 nt, Homo sapiens
gguuauggcuuugauuucu

SEQ ID NO: 941632 - RNA, 19 nt, Homo sapiens
ucaacaucauucugcaauu

SEQ ID NO: 941633 - RNA, 19 nt, Homo sapiens
ggaacuuggcuucaaacaa

SEQ ID NO: 941634 - RNA, 19 nt, Homo sapiens
gcuaucugauccuacuuau

SEQ ID NO: 941635 - RNA, 19 nt, Homo sapiens
ggcaagugauauugucuuc

SEQ ID NO: 941636 - RNA, 19 nt, Homo sapiens
gcgaggagauguguuuguc

SEQ ID NO: 941637 - RNA, 19 nt, Homo sapiens
ggugucauccucagccuuu

SEQ ID NO: 941638 - RNA, 19 nt, Homo sapiens
aaaugaagaugucggugau

SEQ ID NO: 941639 - RNA, 19 nt, Homo sapiens
aaacucacauuucugaacu

SEQ ID NO: 941640 - RNA, 19 nt, Homo sapiens
uaacacaaacagagucuca

SEQ ID NO: 941641 - RNA, 19 nt, Homo sapiens
gaagaugccacugagaaca

SEQ ID NO: 941642 - RNA, 19 nt, Homo sapiens
cauuuaacaggaccaauaa

SEQ ID NO: 941643 - RNA, 19 nt, Homo sapiens
gaacuuggcuucaaacaaa

SEQ ID NO: 941644 - RNA, 19 nt, Homo sapiens
ugaaauaccuccugaagaa

SEQ ID NO: 941645 - RNA, 19 nt, Homo sapiens
gaaguucagucuugucuuu

SEQ ID NO: 941646 - RNA, 19 nt, Homo sapiens
gaagaucugugauggguuu

SEQ ID NO: 941647 - RNA, 19 nt, Homo sapiens
caauuuagcugaugauuuc

SEQ ID NO: 941648 - RNA, 19 nt, Homo sapiens
gaagaacucucaacaucau

SEQ ID NO: 941649 - RNA, 19 nt, Homo sapiens
aaacaaagcuuccuagaac

SEQ ID NO: 941650 - RNA, 19 nt, Homo sapiens
caacaucauucugcaauuu

SEQ ID NO: 941651 - RNA, 19 nt, Homo sapiens
gaagugcucuggacuaugg

SEQ ID NO: 941652 - RNA, 19 nt, Homo sapiens
cuaaacagaugucuucuug

SEQ ID NO: 941653 - RNA, 19 nt, Homo sapiens
gaggaaacguguacuugaa

SEQ ID NO: 941654 - RNA, 19 nt, Homo sapiens
ucacauuucugaacucgua

SEQ ID NO: 941655 - RNA, 19 nt, Homo sapiens
gaaacaaagcuuccuagaa

SEQ ID NO: 941656 - RNA, 19 nt, Homo sapiens
ggagaaugcuaaacagaug

SEQ ID NO: 941657 - RNA, 19 nt, Homo sapiens
cagcaggccuugaaacaaa

SEQ ID NO: 941658 - RNA, 19 nt, Homo sapiens
gcaugaaacuguguauuau

SEQ ID NO: 941659 - RNA, 19 nt, Homo sapiens
cagaagaacucucaacauc

SEQ ID NO: 941660 - RNA, 19 nt, Homo sapiens
caaacaaacucacauuucu

SEQ ID NO: 941661 - RNA, 19 nt, Homo sapiens
gaagacagacaaugagauu

SEQ ID NO: 941662 - RNA, 19 nt, Homo sapiens
caagauggcgucuguguuu

SEQ ID NO: 941663 - RNA, 19 nt, Homo sapiens
ggaaauccauacccguuug

SEQ ID NO: 941664 - RNA, 19 nt, Homo sapiens
ggaaauuugugaaugaagu

SEQ ID NO: 941665 - RNA, 19 nt, Homo sapiens
gaagcgaggagauguguuu

SEQ ID NO: 941666 - RNA, 19 nt, Homo sapiens
ggaaggagaguuacaggaa

SEQ ID NO: 941667 - RNA, 19 nt, Homo sapiens
ggaauuguccagaugguuu

SEQ ID NO: 941668 - RNA, 19 nt, Homo sapiens
gaauauuguugaugccuau

SEQ ID NO: 941669 - RNA, 19 nt, Homo sapiens
cuacaaacaucagcaagaa

SEQ ID NO: 941670 - RNA, 19 nt, Homo sapiens
ggaggaaagucuauaucug

SEQ ID NO: 941671 - RNA, 19 nt, Homo sapiens
gaacaucuuuggcucuucu

SEQ ID NO: 941672 - RNA, 19 nt, Homo sapiens
uaacaggaccaauaaauuc

SEQ ID NO: 941673 - RNA, 19 nt, Homo sapiens
gagcaaggcauggaacuaa

SEQ ID NO: 941674 - RNA, 19 nt, Homo sapiens
aaacagaugucuucuugca

SEQ ID NO: 941675 - RNA, 19 nt, Homo sapiens
gaaggaaguucagucuugu

SEQ ID NO: 941676 - RNA, 19 nt, Homo sapiens
gaaagaagaaauucagaag

SEQ ID NO: 941677 - RNA, 19 nt, Homo sapiens
gaaacuguguauuauuugg

SEQ ID NO: 941678 - RNA, 19 nt, Homo sapiens
gcaagaaguccaaaguuuc

SEQ ID NO: 941679 - RNA, 19 nt, Homo sapiens
ggaaaccaauuuagcugau

SEQ ID NO: 941680 - RNA, 19 nt, Homo sapiens
ugacagaacugaaauaccu

SEQ ID NO: 941681 - RNA, 19 nt, Homo sapiens
caagugauauugucuucau

SEQ ID NO: 941682 - RNA, 19 nt, Homo sapiens
gaugucuucuugcaauauu

SEQ ID NO: 941683 - RNA, 19 nt, Homo sapiens
ugaccacagugcaaucuaa

SEQ ID NO: 941684 - RNA, 19 nt, Homo sapiens
gcagaugccacacguauca

SEQ ID NO: 941685 - RNA, 19 nt, Homo sapiens
ggacgaccauggagaagag

SEQ ID NO: 941686 - RNA, 19 nt, Homo sapiens
gguggaagcugcauauugc

SEQ ID NO: 941687 - RNA, 19 nt, Homo sapiens
cagaagaacauauucauca

SEQ ID NO: 941688 - RNA, 19 nt, Homo sapiens
gacgucagccuguggauuu

SEQ ID NO: 941689 - RNA, 19 nt, Homo sapiens
cguggaugcuucugauuaa

SEQ ID NO: 941690 - RNA, 19 nt, Homo sapiens
ggaauacucauguaaugga

SEQ ID NO: 941691 - RNA, 19 nt, Homo sapiens
gaacugacagaacugaaau

SEQ ID NO: 941692 - RNA, 19 nt, Homo sapiens
agaaacggcacauggaaua

SEQ ID NO: 941693 - RNA, 19 nt, Homo sapiens
agcaagaaguccaaaguuu

SEQ ID NO: 941694 - RNA, 19 nt, Homo sapiens
gaagaaauucagaagaaca

SEQ ID NO: 941695 - RNA, 19 nt, Homo sapiens
gaaaccaauuuagcugaug

SEQ ID NO: 941696 - RNA, 19 nt, Homo sapiens
ggacuauggugaugaacag

SEQ ID NO: 941697 - RNA, 19 nt, Homo sapiens
gcacuuuggaugauucuga

SEQ ID NO: 941698 - RNA, 19 nt, Homo sapiens
guucauagccggugugauc

SEQ ID NO: 941699 - RNA, 19 nt, Homo sapiens
gaagucagaaggugugaau

SEQ ID NO: 941700 - RNA, 19 nt, Homo sapiens
acagaugucuucuugcaau

SEQ ID NO: 941701 - RNA, 19 nt, Homo sapiens
gaagccaccugcggauuca

SEQ ID NO: 941702 - RNA, 19 nt, Homo sapiens
gcagcuaccgggagauaaa

SEQ ID NO: 941703 - RNA, 19 nt, Homo sapiens
gaaauaccuccugaagaaa

SEQ ID NO: 941704 - RNA, 19 nt, Homo sapiens
guucuuggcucaccugaag

SEQ ID NO: 941705 - RNA, 19 nt, Homo sapiens
caacuuuggagacgucuuu

SEQ ID NO: 941706 - RNA, 19 nt, Homo sapiens
ccuguucgcugugauguuu

SEQ ID NO: 941707 - RNA, 19 nt, Homo sapiens
cugcauauaugaccggaaa

SEQ ID NO: 941708 - RNA, 19 nt, Homo sapiens
aaaccaauuuagcugauga

SEQ ID NO: 941709 - RNA, 19 nt, Homo sapiens
cagaugucuucuugcaaua

SEQ ID NO: 941710 - RNA, 19 nt, Homo sapiens
caauuuaucccugagauga

SEQ ID NO: 941711 - RNA, 19 nt, Homo sapiens
ccuggagacuguucuagaa

SEQ ID NO: 941712 - RNA, 19 nt, Homo sapiens
uggcucaccugaagcauga

SEQ ID NO: 941713 - RNA, 19 nt, Homo sapiens
uggcgaaucugccgaggaa

SEQ ID NO: 941714 - RNA, 19 nt, Homo sapiens
ccaauuuagcugaugauuu

SEQ ID NO: 941715 - RNA, 19 nt, Homo sapiens
auaaacaucugagucauuc

SEQ ID NO: 941716 - RNA, 19 nt, Homo sapiens
ucaaacaaacucacauuuc

SEQ ID NO: 941717 - RNA, 19 nt, Homo sapiens
cgaaagaagaaauucagaa

SEQ ID NO: 941718 - RNA, 19 nt, Homo sapiens
ggaggauccugugacgaaa

SEQ ID NO: 941719 - RNA, 19 nt, Homo sapiens
gaaccagcaggccuugaaa

SEQ ID NO: 941720 - RNA, 19 nt, Homo sapiens
agcaugaaacuguguauua

SEQ ID NO: 941721 - RNA, 19 nt, Homo sapiens
agacagacaaugagauuug

SEQ ID NO: 941722 - RNA, 19 nt, Homo sapiens
cugaugauuucuuuacuga

SEQ ID NO: 941723 - RNA, 19 nt, Homo sapiens
cggguuugaucuacaauga

SEQ ID NO: 941724 - RNA, 19 nt, Homo sapiens
uaucugauccuacuuaugg

SEQ ID NO: 941725 - RNA, 19 nt, Homo sapiens
gcuccuggcugcacuuugg

SEQ ID NO: 941726 - RNA, 19 nt, Homo sapiens
ccuacaccaucaucacuuu

SEQ ID NO: 941727 - RNA, 19 nt, Homo sapiens
acauuuaacaggaccaaua

SEQ ID NO: 941728 - RNA, 19 nt, Homo sapiens
gaagaugaaagcugucuac

SEQ ID NO: 941729 - RNA, 19 nt, Homo sapiens
ggaagccaccugcggauuc

SEQ ID NO: 941730 - RNA, 19 nt, Homo sapiens
ugaaagcugucuaccacau

SEQ ID NO: 941731 - RNA, 19 nt, Homo sapiens
cgaggaaacguguacuuga

SEQ ID NO: 941732 - RNA, 19 nt, Homo sapiens
gcugaugauuucuuuacug

SEQ ID NO: 941733 - RNA, 19 nt, Homo sapiens
gguuauggcuuugauuucu

SEQ ID NO: 941734 - RNA, 19 nt, Homo sapiens
ucaacaucauucugcaauu

SEQ ID NO: 941735 - RNA, 19 nt, Homo sapiens
ggaacuuggcuucaaacaa

SEQ ID NO: 941736 - RNA, 19 nt, Homo sapiens
gcuaucugauccuacuuau

SEQ ID NO: 941737 - RNA, 19 nt, Homo sapiens
ggcaagugauauugucuuc

SEQ ID NO: 941738 - RNA, 19 nt, Homo sapiens
ggugucauccucagccuuu

SEQ ID NO: 941739 - RNA, 19 nt, Homo sapiens
aaaugaagaugucggugau

SEQ ID NO: 941740 - RNA, 19 nt, Homo sapiens
aaacucacauuucugaacu

SEQ ID NO: 941741 - RNA, 19 nt, Homo sapiens
gcgaggagauguguuuguc

SEQ ID NO: 941742 - RNA, 19 nt, Homo sapiens
uaacacaaacagagucuca

SEQ ID NO: 941743 - RNA, 19 nt, Homo sapiens
gcaaacaccuuucccauaa

SEQ ID NO: 941744 - RNA, 19 nt, Homo sapiens
uaaagaagcuggcaucuga

SEQ ID NO: 941745 - RNA, 19 nt, Homo sapiens
cagaagaaauuaccaguua

SEQ ID NO: 941746 - RNA, 19 nt, Homo sapiens
gaacaaagaugauccugau

SEQ ID NO: 941747 - RNA, 19 nt, Homo sapiens
ggacaacucauuaauguua

SEQ ID NO: 941748 - RNA, 19 nt, Homo sapiens
gaacagacaacauuaauga

SEQ ID NO: 941749 - RNA, 19 nt, Homo sapiens
gaucaaacgugacaaguug

SEQ ID NO: 941750 - RNA, 19 nt, Homo sapiens
cauugaagcuacagaauua

SEQ ID NO: 941751 - RNA, 19 nt, Homo sapiens
gacaggagcuucucaauca

SEQ ID NO: 941752 - RNA, 19 nt, Homo sapiens
cuaaauagcuagcaaucua

SEQ ID NO: 941753 - RNA, 19 nt, Homo sapiens
guucagcucuguuuguuua

SEQ ID NO: 941754 - RNA, 19 nt, Homo sapiens
ggaaggagcucaucauguc

SEQ ID NO: 941755 - RNA, 19 nt, Homo sapiens
cacagaaggugaagaaaua

SEQ ID NO: 941756 - RNA, 19 nt, Homo sapiens
ggacagccauuaccacuga

SEQ ID NO: 941757 - RNA, 19 nt, Homo sapiens
gaagacagaugaagacaca

SEQ ID NO: 941758 - RNA, 19 nt, Homo sapiens
caacuaaagugugggaaua

SEQ ID NO: 941759 - RNA, 19 nt, Homo sapiens
ccaaacaugugggcuauua

SEQ ID NO: 941760 - RNA, 19 nt, Homo sapiens
gaaggaaauugaaaggaaa

SEQ ID NO: 941761 - RNA, 19 nt, Homo sapiens
caucuaagcugucagaaau

SEQ ID NO: 941762 - RNA, 19 nt, Homo sapiens
gaacagaacaggaaagcaa

SEQ ID NO: 941763 - RNA, 19 nt, Homo sapiens
gaauauggaugacucuguu

SEQ ID NO: 941764 - RNA, 19 nt, Homo sapiens
aaacucagcuggcuacuau

SEQ ID NO: 941765 - RNA, 19 nt, Homo sapiens
ugggaaagcuugauuuaaa

SEQ ID NO: 941766 - RNA, 19 nt, Homo sapiens
agacacagauuucaaagaa

SEQ ID NO: 941767 - RNA, 19 nt, Homo sapiens
aaagaaagauaaccacuug

SEQ ID NO: 941768 - RNA, 19 nt, Homo sapiens
ggauaaggauacuuugaaa

SEQ ID NO: 941769 - RNA, 19 nt, Homo sapiens
gaacagcuuuauaagauca

SEQ ID NO: 941770 - RNA, 19 nt, Homo sapiens
gaauagagaacaagaagaa

SEQ ID NO: 941771 - RNA, 19 nt, Homo sapiens
gaacaagaauggaagaaac

SEQ ID NO: 941772 - RNA, 19 nt, Homo sapiens
gagccugucuuccacauuu

SEQ ID NO: 941773 - RNA, 19 nt, Homo sapiens
caaacuaugucaaaccaaa

SEQ ID NO: 941774 - RNA, 19 nt, Homo sapiens
ccucaugggucaucuuaua

SEQ ID NO: 941775 - RNA, 19 nt, Homo sapiens
ggagauagaaguggaauuu

SEQ ID NO: 941776 - RNA, 19 nt, Homo sapiens
gaauuaugccaaagacuua

SEQ ID NO: 941777 - RNA, 19 nt, Homo sapiens
guggauaucucucagguuu

SEQ ID NO: 941778 - RNA, 19 nt, Homo sapiens
ucagguaacuucagcauau

SEQ ID NO: 941779 - RNA, 19 nt, Homo sapiens
gcugagagcuagcaaggaa

SEQ ID NO: 941780 - RNA, 19 nt, Homo sapiens
caacaaccucuuccucuua

SEQ ID NO: 941781 - RNA, 19 nt, Homo sapiens
agaagaaauugucagguua

SEQ ID NO: 941782 - RNA, 19 nt, Homo sapiens
gaaagcaaauugauuccau

SEQ ID NO: 941783 - RNA, 19 nt, Homo sapiens
gaaguccaaugcucaauuc

SEQ ID NO: 941784 - RNA, 19 nt, Homo sapiens
caagaguucuccauagcua

SEQ ID NO: 941785 - RNA, 19 nt, Homo sapiens
ugaaggaaauugaaaggaa

SEQ ID NO: 941786 - RNA, 19 nt, Homo sapiens
gaagaaauugucagguuaa

SEQ ID NO: 941787 - RNA, 19 nt, Homo sapiens
ggaagaaacaacuugaauu

SEQ ID NO: 941788 - RNA, 19 nt, Homo sapiens
gagaaacaacguaaggaua

SEQ ID NO: 941789 - RNA, 19 nt, Homo sapiens
aacaggaacuucaggaaua

SEQ ID NO: 941790 - RNA, 19 nt, Homo sapiens
gaaagcaaaggcccuauga

SEQ ID NO: 941791 - RNA, 19 nt, Homo sapiens
uuaaggaucucuaccaaga

SEQ ID NO: 941792 - RNA, 19 nt, Homo sapiens
caaaggaucaagagaguuu

SEQ ID NO: 941793 - RNA, 19 nt, Homo sapiens
gaacucugccuucauauca

SEQ ID NO: 941794 - RNA, 19 nt, Homo sapiens
gaaccacuuucuucaaauc

SEQ ID NO: 941795 - RNA, 19 nt, Homo sapiens
gaccaaccuuccucccuua

SEQ ID NO: 941796 - RNA, 19 nt, Homo sapiens
uaucagaccuaaacaagga

SEQ ID NO: 941797 - RNA, 19 nt, Homo sapiens
acaaggaacugcacggauu

SEQ ID NO: 941798 - RNA, 19 nt, Homo sapiens
agacagggcuauauucaug

SEQ ID NO: 941799 - RNA, 19 nt, Homo sapiens
ggaagaaccagaagcuuug

SEQ ID NO: 941800 - RNA, 19 nt, Homo sapiens
ggugaauuauagagcauua

SEQ ID NO: 941801 - RNA, 19 nt, Homo sapiens
guaaggauaaggauacuuu

SEQ ID NO: 941802 - RNA, 19 nt, Homo sapiens
gaagauggaucagcaagag

SEQ ID NO: 941803 - RNA, 19 nt, Homo sapiens
ggacaugcaucuuuaagcu

SEQ ID NO: 941804 - RNA, 19 nt, Homo sapiens
gggaaagcuugauuuaaau

SEQ ID NO: 941805 - RNA, 19 nt, Homo sapiens
ggagagugguggacaggaa

SEQ ID NO: 941806 - RNA, 19 nt, Homo sapiens
gaugguuucccaaaucuua

SEQ ID NO: 941807 - RNA, 19 nt, Homo sapiens
ggacugcaaagaaagauaa

SEQ ID NO: 941808 - RNA, 19 nt, Homo sapiens
gcccauauguacagaaaga

SEQ ID NO: 941809 - RNA, 19 nt, Homo sapiens
guccaaugcucaauucaaa

SEQ ID NO: 941810 - RNA, 19 nt, Homo sapiens
cagugugacuuggaaauua

SEQ ID NO: 941811 - RNA, 19 nt, Homo sapiens
cuuaggacaugcaucuuua

SEQ ID NO: 941812 - RNA, 19 nt, Homo sapiens
gggaagaaccagaagcuuu

SEQ ID NO: 941813 - RNA, 19 nt, Homo sapiens
gaggaugguuucccaaauc

SEQ ID NO: 941814 - RNA, 19 nt, Homo sapiens
acaguuagaugcucuugaa

SEQ ID NO: 941815 - RNA, 19 nt, Homo sapiens
gccaaagacuuaaagaaca

SEQ ID NO: 941816 - RNA, 19 nt, Homo sapiens
aagaagaaauugucagguu

SEQ ID NO: 941817 - RNA, 19 nt, Homo sapiens
ucagggaacucacccaaga

SEQ ID NO: 941818 - RNA, 19 nt, Homo sapiens
gacaauauagucuggagua

SEQ ID NO: 941819 - RNA, 19 nt, Homo sapiens
ugaaugaagucuuggugaa

SEQ ID NO: 941820 - RNA, 19 nt, Homo sapiens
gagauauaauucagguuga

SEQ ID NO: 941821 - RNA, 19 nt, Homo sapiens
gaggaaagcaaauugauuc

SEQ ID NO: 941822 - RNA, 19 nt, Homo sapiens
caaccuuccucccuuaaug

SEQ ID NO: 941823 - RNA, 19 nt, Homo sapiens
ggaggugcauggaggaaga

SEQ ID NO: 941824 - RNA, 19 nt, Homo sapiens
agaaacaacguaaggauaa

SEQ ID NO: 941825 - RNA, 19 nt, Homo sapiens
gagagaaaccuacaacaca

SEQ ID NO: 941826 - RNA, 19 nt, Homo sapiens
cauaacaggugaucaagca

SEQ ID NO: 941827 - RNA, 19 nt, Homo sapiens
gaaauugucagguuaaacu

SEQ ID NO: 941828 - RNA, 19 nt, Homo sapiens
gaacucuaauaauguggaa

SEQ ID NO: 941829 - RNA, 19 nt, Homo sapiens
caaacaccuuucccauaaa

SEQ ID NO: 941830 - RNA, 19 nt, Homo sapiens
gcagaccauuccucccuaa

SEQ ID NO: 941831 - RNA, 19 nt, Homo sapiens
uagcaagucuggagcauca

SEQ ID NO: 941832 - RNA, 19 nt, Homo sapiens
gcugaaauaugggcuuuau

SEQ ID NO: 941833 - RNA, 19 nt, Homo sapiens
guaugcagcuguaaauaag

SEQ ID NO: 941834 - RNA, 19 nt, Homo sapiens
gauaaccacuugaacuucu

SEQ ID NO: 941835 - RNA, 19 nt, Homo sapiens
ggaagaauuaugccaaaga

SEQ ID NO: 941836 - RNA, 19 nt, Homo sapiens
aaacaaggaugggaagaug

SEQ ID NO: 941837 - RNA, 19 nt, Homo sapiens
gauggugcaugucauugaa

SEQ ID NO: 941838 - RNA, 19 nt, Homo sapiens
ccacugcucaucagaagua

SEQ ID NO: 941839 - RNA, 19 nt, Homo sapiens
gcaaggaaaagaaaacuua

SEQ ID NO: 941840 - RNA, 19 nt, Homo sapiens
gaagaauuaugccaaagac

SEQ ID NO: 941841 - RNA, 19 nt, Homo sapiens
ggaggaaagcaaauugauu

SEQ ID NO: 941842 - RNA, 19 nt, Homo sapiens
gugguucucccuccuauua

SEQ ID NO: 941843 - RNA, 19 nt, Homo sapiens
gcaaacaccuuucccauaa

SEQ ID NO: 941844 - RNA, 19 nt, Homo sapiens
uaaagaagcuggcaucuga

SEQ ID NO: 941845 - RNA, 19 nt, Homo sapiens
cagaagaaauuaccaguua

SEQ ID NO: 941846 - RNA, 19 nt, Homo sapiens
gaacaaagaugauccugau

SEQ ID NO: 941847 - RNA, 19 nt, Homo sapiens
ggacaacucauuaauguua

SEQ ID NO: 941848 - RNA, 19 nt, Homo sapiens
gaacagacaacauuaauga

SEQ ID NO: 941849 - RNA, 19 nt, Homo sapiens
gaucaaacgugacaaguug

SEQ ID NO: 941850 - RNA, 19 nt, Homo sapiens
cauugaagcuacagaauua

SEQ ID NO: 941851 - RNA, 19 nt, Homo sapiens
gacaggagcuucucaauca

SEQ ID NO: 941852 - RNA, 19 nt, Homo sapiens
cuaaauagcuagcaaucua

SEQ ID NO: 941853 - RNA, 19 nt, Homo sapiens
guucagcucuguuuguuua

SEQ ID NO: 941854 - RNA, 19 nt, Homo sapiens
ggaaggagcucaucauguc

SEQ ID NO: 941855 - RNA, 19 nt, Homo sapiens
cacagaaggugaagaaaua

SEQ ID NO: 941856 - RNA, 19 nt, Homo sapiens
ggacagccauuaccacuga

SEQ ID NO: 941857 - RNA, 19 nt, Homo sapiens
gaagacagaugaagacaca

SEQ ID NO: 941858 - RNA, 19 nt, Homo sapiens
ccaaacaugugggcuauua

SEQ ID NO: 941859 - RNA, 19 nt, Homo sapiens
gaaggaaauugaaaggaaa

SEQ ID NO: 941860 - RNA, 19 nt, Homo sapiens
caucuaagcugucagaaau

SEQ ID NO: 941861 - RNA, 19 nt, Homo sapiens
gaacagaacaggaaagcaa

SEQ ID NO: 941862 - RNA, 19 nt, Homo sapiens
aaacucagcuggcuacuau

SEQ ID NO: 941863 - RNA, 19 nt, Homo sapiens
ugggaaagcuugauuuaaa

SEQ ID NO: 941864 - RNA, 19 nt, Homo sapiens
agacacagauuucaaagaa

SEQ ID NO: 941865 - RNA, 19 nt, Homo sapiens
aaagaaagauaaccacuug

SEQ ID NO: 941866 - RNA, 19 nt, Homo sapiens
ggauaaggauacuuugaaa

SEQ ID NO: 941867 - RNA, 19 nt, Homo sapiens
gaacagcuuuauaagauca

SEQ ID NO: 941868 - RNA, 19 nt, Homo sapiens
gaauagagaacaagaagaa

SEQ ID NO: 941869 - RNA, 19 nt, Homo sapiens
gaacaagaauggaagaaac

SEQ ID NO: 941870 - RNA, 19 nt, Homo sapiens
gagccugucuuccacauuu

SEQ ID NO: 941871 - RNA, 19 nt, Homo sapiens
caaacuaugucaaaccaaa

SEQ ID NO: 941872 - RNA, 19 nt, Homo sapiens
ccucaugggucaucuuaua

SEQ ID NO: 941873 - RNA, 19 nt, Homo sapiens
ggagauagaaguggaauuu

SEQ ID NO: 941874 - RNA, 19 nt, Homo sapiens
gaauuaugccaaagacuua

SEQ ID NO: 941875 - RNA, 19 nt, Homo sapiens
guggauaucucucagguuu

SEQ ID NO: 941876 - RNA, 19 nt, Homo sapiens
ucagguaacuucagcauau

SEQ ID NO: 941877 - RNA, 19 nt, Homo sapiens
gcugagagcuagcaaggaa

SEQ ID NO: 941878 - RNA, 19 nt, Homo sapiens
agaagaaauugucagguua

SEQ ID NO: 941879 - RNA, 19 nt, Homo sapiens
gaaagcaaauugauuccau

SEQ ID NO: 941880 - RNA, 19 nt, Homo sapiens
gaaguccaaugcucaauuc

SEQ ID NO: 941881 - RNA, 19 nt, Homo sapiens
caagaguucuccauagcua

SEQ ID NO: 941882 - RNA, 19 nt, Homo sapiens
ugaaggaaauugaaaggaa

SEQ ID NO: 941883 - RNA, 19 nt, Homo sapiens
gaagaaauugucagguuaa

SEQ ID NO: 941884 - RNA, 19 nt, Homo sapiens
ggaagaaacaacuugaauu

SEQ ID NO: 941885 - RNA, 19 nt, Homo sapiens
gagaaacaacguaaggaua

SEQ ID NO: 941886 - RNA, 19 nt, Homo sapiens
aacaggaacuucaggaaua

SEQ ID NO: 941887 - RNA, 19 nt, Homo sapiens
gaaagcaaaggcccuauga

SEQ ID NO: 941888 - RNA, 19 nt, Homo sapiens
uuaaggaucucuaccaaga

SEQ ID NO: 941889 - RNA, 19 nt, Homo sapiens
caaaggaucaagagaguuu

SEQ ID NO: 941890 - RNA, 19 nt, Homo sapiens
gaacucugccuucauauca

SEQ ID NO: 941891 - RNA, 19 nt, Homo sapiens
gaaccacuuucuucaaauc

SEQ ID NO: 941892 - RNA, 19 nt, Homo sapiens
gaccaaccuuccucccuua

SEQ ID NO: 941893 - RNA, 19 nt, Homo sapiens
uaucagaccuaaacaagga

SEQ ID NO: 941894 - RNA, 19 nt, Homo sapiens
acaaggaacugcacggauu

SEQ ID NO: 941895 - RNA, 19 nt, Homo sapiens
agacagggcuauauucaug

SEQ ID NO: 941896 - RNA, 19 nt, Homo sapiens
ggaagaaccagaagcuuug

SEQ ID NO: 941897 - RNA, 19 nt, Homo sapiens
ggugaauuauagagcauua

SEQ ID NO: 941898 - RNA, 19 nt, Homo sapiens
guaaggauaaggauacuuu

SEQ ID NO: 941899 - RNA, 19 nt, Homo sapiens
gaagauggaucagcaagag

SEQ ID NO: 941900 - RNA, 19 nt, Homo sapiens
ggacaugcaucuuuaagcu

SEQ ID NO: 941901 - RNA, 19 nt, Homo sapiens
gggaaagcuugauuuaaau

SEQ ID NO: 941902 - RNA, 19 nt, Homo sapiens
ggagagugguggacaggaa

SEQ ID NO: 941903 - RNA, 19 nt, Homo sapiens
gaugguuucccaaaucuua

SEQ ID NO: 941904 - RNA, 19 nt, Homo sapiens
ggacugcaaagaaagauaa

SEQ ID NO: 941905 - RNA, 19 nt, Homo sapiens
gcccauauguacagaaaga

SEQ ID NO: 941906 - RNA, 19 nt, Homo sapiens
guccaaugcucaauucaaa

SEQ ID NO: 941907 - RNA, 19 nt, Homo sapiens
cagugugacuuggaaauua

SEQ ID NO: 941908 - RNA, 19 nt, Homo sapiens
cuuaggacaugcaucuuua

SEQ ID NO: 941909 - RNA, 19 nt, Homo sapiens
gggaagaaccagaagcuuu

SEQ ID NO: 941910 - RNA, 19 nt, Homo sapiens
gaggaugguuucccaaauc

SEQ ID NO: 941911 - RNA, 19 nt, Homo sapiens
acaguuagaugcucuugaa

SEQ ID NO: 941912 - RNA, 19 nt, Homo sapiens
gccaaagacuuaaagaaca

SEQ ID NO: 941913 - RNA, 19 nt, Homo sapiens
aagaagaaauugucagguu

SEQ ID NO: 941914 - RNA, 19 nt, Homo sapiens
ucagggaacucacccaaga

SEQ ID NO: 941915 - RNA, 19 nt, Homo sapiens
gacaauauagucuggagua

SEQ ID NO: 941916 - RNA, 19 nt, Homo sapiens
ugaaugaagucuuggugaa

SEQ ID NO: 941917 - RNA, 19 nt, Homo sapiens
gagauauaauucagguuga

SEQ ID NO: 941918 - RNA, 19 nt, Homo sapiens
gaggaaagcaaauugauuc

SEQ ID NO: 941919 - RNA, 19 nt, Homo sapiens
caaccuuccucccuuaaug

SEQ ID NO: 941920 - RNA, 19 nt, Homo sapiens
cauaacaggugaucaagca

SEQ ID NO: 941921 - RNA, 19 nt, Homo sapiens
ggaggugcauggaggaaga

SEQ ID NO: 941922 - RNA, 19 nt, Homo sapiens
agaaacaacguaaggauaa

SEQ ID NO: 941923 - RNA, 19 nt, Homo sapiens
gagagaaaccuacaacaca

SEQ ID NO: 941924 - RNA, 19 nt, Homo sapiens
gaaauugucagguuaaacu

SEQ ID NO: 941925 - RNA, 19 nt, Homo sapiens
gaacucuaauaauguggaa

SEQ ID NO: 941926 - RNA, 19 nt, Homo sapiens
caaacaccuuucccauaaa

SEQ ID NO: 941927 - RNA, 19 nt, Homo sapiens
gcagaccauuccucccuaa

SEQ ID NO: 941928 - RNA, 19 nt, Homo sapiens
uagcaagucuggagcauca

SEQ ID NO: 941929 - RNA, 19 nt, Homo sapiens
guaugcagcuguaaauaag

SEQ ID NO: 941930 - RNA, 19 nt, Homo sapiens
gauaaccacuugaacuucu

SEQ ID NO: 941931 - RNA, 19 nt, Homo sapiens
ggaagaauuaugccaaaga

SEQ ID NO: 941932 - RNA, 19 nt, Homo sapiens
gcugaaauaugggcuuuau

SEQ ID NO: 941933 - RNA, 19 nt, Homo sapiens
aaacaaggaugggaagaug

SEQ ID NO: 941934 - RNA, 19 nt, Homo sapiens
gauggugcaugucauugaa

SEQ ID NO: 941935 - RNA, 19 nt, Homo sapiens
ccacugcucaucagaagua

SEQ ID NO: 941936 - RNA, 19 nt, Homo sapiens
gcaaggaaaagaaaacuua

SEQ ID NO: 941937 - RNA, 19 nt, Homo sapiens
gaagaauuaugccaaagac

SEQ ID NO: 941938 - RNA, 19 nt, Homo sapiens
ggaggaaagcaaauugauu

SEQ ID NO: 941939 - RNA, 19 nt, Homo sapiens
gugguucucccuccuauua

SEQ ID NO: 941940 - RNA, 19 nt, Homo sapiens
ggaaagcaaagcaaggaaa

SEQ ID NO: 941941 - RNA, 19 nt, Homo sapiens
gcaaugcaccuuacugaca

SEQ ID NO: 941942 - RNA, 19 nt, Homo sapiens
cgcagucucugauugauuu

SEQ ID NO: 941943 - RNA, 19 nt, Homo sapiens
cagaagaaauuaccaguua

SEQ ID NO: 941944 - RNA, 19 nt, Homo sapiens
gaacaaagaugauccugau

SEQ ID NO: 941945 - RNA, 19 nt, Homo sapiens
ggacaacucauuaauguua

SEQ ID NO: 941946 - RNA, 19 nt, Homo sapiens
gaucaaacgugacaaguug

SEQ ID NO: 941947 - RNA, 19 nt, Homo sapiens
gacaggagcuucucaauca

SEQ ID NO: 941948 - RNA, 19 nt, Homo sapiens
cacagaaggugaagaaaua

SEQ ID NO: 941949 - RNA, 19 nt, Homo sapiens
ggacagccauuaccacuga

SEQ ID NO: 941950 - RNA, 19 nt, Homo sapiens
caacuaaagugugggaaua

SEQ ID NO: 941951 - RNA, 19 nt, Homo sapiens
ccaaacaugugggcuauua

SEQ ID NO: 941952 - RNA, 19 nt, Homo sapiens
gaugacagcuauccuuauu

SEQ ID NO: 941953 - RNA, 19 nt, Homo sapiens
ggauaaugcuugagauuga

SEQ ID NO: 941954 - RNA, 19 nt, Homo sapiens
gaaggaaauugaaaggaaa

SEQ ID NO: 941955 - RNA, 19 nt, Homo sapiens
caucuaagcugucagaaau

SEQ ID NO: 941956 - RNA, 19 nt, Homo sapiens
gaauauggaugacucuguu

SEQ ID NO: 941957 - RNA, 19 nt, Homo sapiens
aaacucagcuggcuacuau

SEQ ID NO: 941958 - RNA, 19 nt, Homo sapiens
gauugaaagucucuaauga

SEQ ID NO: 941959 - RNA, 19 nt, Homo sapiens
aaagaaagauaaccacuug

SEQ ID NO: 941960 - RNA, 19 nt, Homo sapiens
ggauaaggauacuuugaaa

SEQ ID NO: 941961 - RNA, 19 nt, Homo sapiens
gaacagcuuuauaagauca

SEQ ID NO: 941962 - RNA, 19 nt, Homo sapiens
gaauagagaacaagaagaa

SEQ ID NO: 941963 - RNA, 19 nt, Homo sapiens
gaacaagaauggaagaaac

SEQ ID NO: 941964 - RNA, 19 nt, Homo sapiens
caaacuaugucaaaccaaa

SEQ ID NO: 941965 - RNA, 19 nt, Homo sapiens
ccucaugggucaucuuaua

SEQ ID NO: 941966 - RNA, 19 nt, Homo sapiens
ggagauagaaguggaauuu

SEQ ID NO: 941967 - RNA, 19 nt, Homo sapiens
gaauuaugccaaagacuua

SEQ ID NO: 941968 - RNA, 19 nt, Homo sapiens
guggauaucucucagguuu

SEQ ID NO: 941969 - RNA, 19 nt, Homo sapiens
ucagguaacuucagcauau

SEQ ID NO: 941970 - RNA, 19 nt, Homo sapiens
caacaaccucuuccucuua

SEQ ID NO: 941971 - RNA, 19 nt, Homo sapiens
agaagaaauugucagguua

SEQ ID NO: 941972 - RNA, 19 nt, Homo sapiens
gaaagcaaauugauuccau

SEQ ID NO: 941973 - RNA, 19 nt, Homo sapiens
gcugagagcuagcaaggaa

SEQ ID NO: 941974 - RNA, 19 nt, Homo sapiens
caagaguucuccauagcua

SEQ ID NO: 941975 - RNA, 19 nt, Homo sapiens
ugaaggaaauugaaaggaa

SEQ ID NO: 941976 - RNA, 19 nt, Homo sapiens
gaagaaauugucagguuaa

SEQ ID NO: 941977 - RNA, 19 nt, Homo sapiens
ggaagaaacaacuugaauu

SEQ ID NO: 941978 - RNA, 19 nt, Homo sapiens
gaccguagcuuccuuggau

SEQ ID NO: 941979 - RNA, 19 nt, Homo sapiens
gagaaacaacguaaggaua

SEQ ID NO: 941980 - RNA, 19 nt, Homo sapiens
aacaggaacuucaggaaua

SEQ ID NO: 941981 - RNA, 19 nt, Homo sapiens
caaaggaucaagagaguuu

SEQ ID NO: 941982 - RNA, 19 nt, Homo sapiens
gaacucugccuucauauca

SEQ ID NO: 941983 - RNA, 19 nt, Homo sapiens
gaaccacuuucuucaaauc

SEQ ID NO: 941984 - RNA, 19 nt, Homo sapiens
gaccaaccuuccucccuua

SEQ ID NO: 941985 - RNA, 19 nt, Homo sapiens
uaucagaccuaaacaagga

SEQ ID NO: 941986 - RNA, 19 nt, Homo sapiens
ucauauagcuacuguuugu

SEQ ID NO: 941987 - RNA, 19 nt, Homo sapiens
agacagggcuauauucaug

SEQ ID NO: 941988 - RNA, 19 nt, Homo sapiens
ggaagaaccagaagcuuug

SEQ ID NO: 941989 - RNA, 19 nt, Homo sapiens
ggugaauuauagagcauua

SEQ ID NO: 941990 - RNA, 19 nt, Homo sapiens
guaaggauaaggauacuuu

SEQ ID NO: 941991 - RNA, 19 nt, Homo sapiens
gaagauggaucagcaagag

SEQ ID NO: 941992 - RNA, 19 nt, Homo sapiens
ggagagugguggacaggaa

SEQ ID NO: 941993 - RNA, 19 nt, Homo sapiens
gaugguuucccaaaucuua

SEQ ID NO: 941994 - RNA, 19 nt, Homo sapiens
ggacugcaaagaaagauaa

SEQ ID NO: 941995 - RNA, 19 nt, Homo sapiens
cagugugacuuggaaauua

SEQ ID NO: 941996 - RNA, 19 nt, Homo sapiens
gggaagaaccagaagcuuu

SEQ ID NO: 941997 - RNA, 19 nt, Homo sapiens
gaggaugguuucccaaauc

SEQ ID NO: 941998 - RNA, 19 nt, Homo sapiens
acaguuagaugcucuugaa

SEQ ID NO: 941999 - RNA, 19 nt, Homo sapiens
gccaaagacuuaaagaaca

SEQ ID NO: 942000 - RNA, 19 nt, Homo sapiens
aagaagaaauugucagguu

SEQ ID NO: 942001 - RNA, 19 nt, Homo sapiens
ucagggaacucacccaaga

SEQ ID NO: 942002 - RNA, 19 nt, Homo sapiens
gagauauaauucagguuga

SEQ ID NO: 942003 - RNA, 19 nt, Homo sapiens
gaggaaagcaaauugauuc

SEQ ID NO: 942004 - RNA, 19 nt, Homo sapiens
caaccuuccucccuuaaug

SEQ ID NO: 942005 - RNA, 19 nt, Homo sapiens
ggaggugcauggaggaaga

SEQ ID NO: 942006 - RNA, 19 nt, Homo sapiens
agaaacaacguaaggauaa

SEQ ID NO: 942007 - RNA, 19 nt, Homo sapiens
gagagaaaccuacaacaca

SEQ ID NO: 942008 - RNA, 19 nt, Homo sapiens
gaaauugucagguuaaacu

SEQ ID NO: 942009 - RNA, 19 nt, Homo sapiens
cauaacaggugaucaagca

SEQ ID NO: 942010 - RNA, 19 nt, Homo sapiens
uagcaagucuggagcauca

SEQ ID NO: 942011 - RNA, 19 nt, Homo sapiens
guaugcagcuguaaauaag

SEQ ID NO: 942012 - RNA, 19 nt, Homo sapiens
gauaaccacuugaacuucu

SEQ ID NO: 942013 - RNA, 19 nt, Homo sapiens
ggaagaauuaugccaaaga

SEQ ID NO: 942014 - RNA, 19 nt, Homo sapiens
aaacaaggaugggaagaug

SEQ ID NO: 942015 - RNA, 19 nt, Homo sapiens
gcugaaauaugggcuuuau

SEQ ID NO: 942016 - RNA, 19 nt, Homo sapiens
gcaaggaaaagaaaacuua

SEQ ID NO: 942017 - RNA, 19 nt, Homo sapiens
gaagaauuaugccaaagac

SEQ ID NO: 942018 - RNA, 19 nt, Homo sapiens
ggaggaaagcaaauugauu

SEQ ID NO: 942019 - RNA, 19 nt, Homo sapiens
gugguucucccuccuauua

SEQ ID NO: 942020 - RNA, 19 nt, Homo sapiens
gaguagcacuuuaaaauga

SEQ ID NO: 942021 - RNA, 19 nt, Homo sapiens
gauaaugcuugagauugaa

SEQ ID NO: 942022 - RNA, 19 nt, Homo sapiens
ggaaagcaaagcaaggaaa

SEQ ID NO: 942023 - RNA, 19 nt, Homo sapiens
gcaaugcaccuuacugaca

SEQ ID NO: 942024 - RNA, 19 nt, Homo sapiens
cgcagucucugauugauuu

SEQ ID NO: 942025 - RNA, 19 nt, Homo sapiens
caaagaugauccugauugg

SEQ ID NO: 942026 - RNA, 19 nt, Homo sapiens
caacguaaggauaaggaua

SEQ ID NO: 942027 - RNA, 19 nt, Homo sapiens
gcaguuagcccuugaacag

SEQ ID NO: 942028 - RNA, 19 nt, Homo sapiens
agacugagcuggaaguucu

SEQ ID NO: 942029 - RNA, 19 nt, Homo sapiens
ugaaauaugggcuuuauca

SEQ ID NO: 942030 - RNA, 19 nt, Homo sapiens
cagcaaauaaugaagauga

SEQ ID NO: 942031 - RNA, 19 nt, Homo sapiens
gcaccaggacaguuaauau

SEQ ID NO: 942032 - RNA, 19 nt, Homo sapiens
guagcuuccuuggauauuu

SEQ ID NO: 942033 - RNA, 19 nt, Homo sapiens
ggaucuguaucaccuauuc

SEQ ID NO: 942034 - RNA, 19 nt, Homo sapiens
gaaucuucaucuugaguug

SEQ ID NO: 942035 - RNA, 19 nt, Homo sapiens
gaacguaaagcccagaaag

SEQ ID NO: 942036 - RNA, 19 nt, Homo sapiens
gcuaaaagcagaagaguuu

SEQ ID NO: 942037 - RNA, 19 nt, Homo sapiens
gaaaagacagggcuauauu

SEQ ID NO: 942038 - RNA, 19 nt, Homo sapiens
cuucaggaauaucagaaua

SEQ ID NO: 942039 - RNA, 19 nt, Homo sapiens
caagcaacuucaacaggaa

SEQ ID NO: 942040 - RNA, 19 nt, Homo sapiens
ggaaaucaagcaacuucaa

SEQ ID NO: 942041 - RNA, 19 nt, Homo sapiens
ggagagacaacgagaggaa

SEQ ID NO: 942042 - RNA, 19 nt, Homo sapiens
cagcaagaguucuccauag

SEQ ID NO: 942043 - RNA, 19 nt, Homo sapiens
gcaaggaacugcucaaguc

SEQ ID NO: 942044 - RNA, 19 nt, Homo sapiens
ggaaagcgcugcauguucu

SEQ ID NO: 942045 - RNA, 19 nt, Homo sapiens
gcagagggcugacgaggau

SEQ ID NO: 942046 - RNA, 19 nt, Homo sapiens
gaacuuggcccugugcuuu

SEQ ID NO: 942047 - RNA, 19 nt, Homo sapiens
aagagaagcugaagcaguu

SEQ ID NO: 942048 - RNA, 19 nt, Homo sapiens
ucaaggagcuggaggagau

SEQ ID NO: 942049 - RNA, 19 nt, Homo sapiens
acaaggaccugaagcagaa

SEQ ID NO: 942050 - RNA, 19 nt, Homo sapiens
gcaaugagcagcagaaguc

SEQ ID NO: 942051 - RNA, 19 nt, Homo sapiens
cagcagaagucccucaaug

SEQ ID NO: 942052 - RNA, 19 nt, Homo sapiens
ggagaagaguggcaaaguc

SEQ ID NO: 942053 - RNA, 19 nt, Homo sapiens
caauugagccuggagauaa

SEQ ID NO: 942054 - RNA, 19 nt, Homo sapiens
ggaaagagagaacaagcaa

SEQ ID NO: 942055 - RNA, 19 nt, Homo sapiens
aaacugcucuuagaaugaa

SEQ ID NO: 942056 - RNA, 19 nt, Homo sapiens
gauagcaacgggaacagua

SEQ ID NO: 942057 - RNA, 19 nt, Homo sapiens
ggaacaguaugcucuccaa

SEQ ID NO: 942058 - RNA, 19 nt, Homo sapiens
gaagaacuaucgggcagau

SEQ ID NO: 942059 - RNA, 19 nt, Homo sapiens
caaguacccucugaucaug

SEQ ID NO: 942060 - RNA, 19 nt, Homo sapiens
ugaagaaucugugcgaauc

SEQ ID NO: 942061 - RNA, 19 nt, Homo sapiens
ggagcugucugggauguug

SEQ ID NO: 942062 - RNA, 19 nt, Homo sapiens
acaguaugcucuccaauca

SEQ ID NO: 942063 - RNA, 19 nt, Homo sapiens
ggacaaguacccucugauc

SEQ ID NO: 942064 - RNA, 19 nt, Homo sapiens
acaaguacauccuggacaa

SEQ ID NO: 942065 - RNA, 19 nt, Homo sapiens
caccgugacuccucccuaa

SEQ ID NO: 942066 - RNA, 19 nt, Homo sapiens
ugcccuaccucaacaagua

SEQ ID NO: 942067 - RNA, 19 nt, Homo sapiens
gaagacgucccuacacaag

SEQ ID NO: 942068 - RNA, 19 nt, Homo sapiens
ucaaggugcugucccacaa

SEQ ID NO: 942069 - RNA, 19 nt, Homo sapiens
ucaggaagauaaacuggau

SEQ ID NO: 942070 - RNA, 19 nt, Homo sapiens
gagggcaccugagaaggaa

SEQ ID NO: 942071 - RNA, 19 nt, Homo sapiens
gaagcgagggcaccugaga

SEQ ID NO: 942072 - RNA, 19 nt, Homo sapiens
ggacagcugccauccagau

SEQ ID NO: 942073 - RNA, 19 nt, Homo sapiens
gcagaagucccucaauggu

SEQ ID NO: 942074 - RNA, 19 nt, Homo sapiens
ggaagacgucccuacacaa

SEQ ID NO: 942075 - RNA, 19 nt, Homo sapiens
accaggagcucauccaaga

SEQ ID NO: 942076 - RNA, 19 nt, Homo sapiens
gaacacuuccgagaugaug

SEQ ID NO: 942077 - RNA, 19 nt, Homo sapiens
agacgucccuacacaagga

SEQ ID NO: 942078 - RNA, 19 nt, Homo sapiens
cccaggcccuccaaccaua

SEQ ID NO: 942079 - RNA, 19 nt, Homo sapiens
gaacugcucaaguccaucu

SEQ ID NO: 942080 - RNA, 19 nt, Homo sapiens
ccaauugagccuggagaua

SEQ ID NO: 942081 - RNA, 19 nt, Homo sapiens
ggaagaggaggaagagaag

SEQ ID NO: 942082 - RNA, 19 nt, Homo sapiens
gagaagaguggcaaagucu

SEQ ID NO: 942083 - RNA, 19 nt, Homo sapiens
gcaggagcgcuacaucgaa

SEQ ID NO: 942084 - RNA, 19 nt, Homo sapiens
uccuggagcucuucaauuc

SEQ ID NO: 942085 - RNA, 19 nt, Homo sapiens
ggagugaagagugcaaaga

SEQ ID NO: 942086 - RNA, 19 nt, Homo sapiens
gacaaguacccucugauca

SEQ ID NO: 942087 - RNA, 19 nt, Homo sapiens
gcagauagcaacgggaaca

SEQ ID NO: 942088 - RNA, 19 nt, Homo sapiens
gugaagagugcaaagagaa

SEQ ID NO: 942089 - RNA, 19 nt, Homo sapiens
ggacgcugacggccaagaa

SEQ ID NO: 942090 - RNA, 19 nt, Homo sapiens
gcugaugcauccaauugag

SEQ ID NO: 942091 - RNA, 19 nt, Homo sapiens
gaugaugacggcccugugu

SEQ ID NO: 942092 - RNA, 19 nt, Homo sapiens
uguggaggcugcccagaga

SEQ ID NO: 942093 - RNA, 19 nt, Homo sapiens
aggcugagauggagcugaa

SEQ ID NO: 942094 - RNA, 19 nt, Homo sapiens
ggccagcaccaacgugaaa

SEQ ID NO: 942095 - RNA, 19 nt, Homo sapiens
ugaagagugcaaagagaaa

SEQ ID NO: 942096 - RNA, 19 nt, Homo sapiens
ucuggugccucuucaacuu

SEQ ID NO: 942097 - RNA, 19 nt, Homo sapiens
gagaagcugaagcaguuga

SEQ ID NO: 942098 - RNA, 19 nt, Homo sapiens
cgagggcaccugagaagga

SEQ ID NO: 942099 - RNA, 19 nt, Homo sapiens
gaacaguaugcucuccaau

SEQ ID NO: 942100 - RNA, 19 nt, Homo sapiens
uggaagaggaggaagagaa

SEQ ID NO: 942101 - RNA, 19 nt, Homo sapiens
uccaagauguccugaagca

SEQ ID NO: 942102 - RNA, 19 nt, Homo sapiens
ugacggccaagaagaacua

SEQ ID NO: 942103 - RNA, 19 nt, Homo sapiens
acaaguacccucugaucau

SEQ ID NO: 942104 - RNA, 19 nt, Homo sapiens
gcuaggaaagagagaacaa

SEQ ID NO: 942105 - RNA, 19 nt, Homo sapiens
guugauccuugagaacuug

SEQ ID NO: 942106 - RNA, 19 nt, Homo sapiens
cggcugaugcauccaauug

SEQ ID NO: 942107 - RNA, 19 nt, Homo sapiens
caacgugaaacacuggaau

SEQ ID NO: 942108 - RNA, 19 nt, Homo sapiens
agugaagagugcaaagaga

SEQ ID NO: 942109 - RNA, 19 nt, Homo sapiens
gguggaauaccugcugaaa

SEQ ID NO: 942110 - RNA, 19 nt, Homo sapiens
uggaggaggugcggcagaa

SEQ ID NO: 942111 - RNA, 19 nt, Homo sapiens
cagcugccucugcuacuuu

SEQ ID NO: 942112 - RNA, 19 nt, Homo sapiens
ccagcugccucugcuacuu

SEQ ID NO: 942113 - RNA, 19 nt, Homo sapiens
gauacaugcccuaccucaa

SEQ ID NO: 942114 - RNA, 19 nt, Homo sapiens
cagccacccgcacguauga

SEQ ID NO: 942115 - RNA, 19 nt, Homo sapiens
gacggaaagcgcugcaugu

SEQ ID NO: 942116 - RNA, 19 nt, Homo sapiens
gagugaagagugcaaagag

SEQ ID NO: 942117 - RNA, 19 nt, Homo sapiens
aggaggcccugcaacuaga

SEQ ID NO: 942118 - RNA, 19 nt, Homo sapiens
guggcaaagucuccaaguc

SEQ ID NO: 942119 - RNA, 19 nt, Homo sapiens
ccaagucccagcucaaggu

SEQ ID NO: 942120 - RNA, 19 nt, Homo sapiens
gaaaauuagccucucuuag

SEQ ID NO: 942121 - RNA, 19 nt, Homo sapiens
uacaugcccuaccucaaca

SEQ ID NO: 942122 - RNA, 19 nt, Homo sapiens
ggcaguuccuggagcucuu

SEQ ID NO: 942123 - RNA, 19 nt, Homo sapiens
gacagccacccgcacguau

SEQ ID NO: 942124 - RNA, 19 nt, Homo sapiens
cggaaagcgcugcauguuc

SEQ ID NO: 942125 - RNA, 19 nt, Homo sapiens
gaagcugaagcaguugaug

SEQ ID NO: 942126 - RNA, 19 nt, Homo sapiens
gcaacuagaggugaaagcu

SEQ ID NO: 942127 - RNA, 19 nt, Homo sapiens
agacagccacccgcacgua

SEQ ID NO: 942128 - RNA, 19 nt, Homo sapiens
ggagaaagauuacaagaua

SEQ ID NO: 942129 - RNA, 19 nt, Homo sapiens
gggaauaacuugcaacuaa

SEQ ID NO: 942130 - RNA, 19 nt, Homo sapiens
gaaaacagauuccaucaua

SEQ ID NO: 942131 - RNA, 19 nt, Homo sapiens
gaagaucagucaauuacuu

SEQ ID NO: 942132 - RNA, 19 nt, Homo sapiens
ccagaaagcugauguaaca

SEQ ID NO: 942133 - RNA, 19 nt, Homo sapiens
ucacacagcugcucuauuc

SEQ ID NO: 942134 - RNA, 19 nt, Homo sapiens
ggaauaacuugcaacuaaa

SEQ ID NO: 942135 - RNA, 19 nt, Homo sapiens
caucaacacuacaucuuua

SEQ ID NO: 942136 - RNA, 19 nt, Homo sapiens
uaagaaggcucaugccauu

SEQ ID NO: 942137 - RNA, 19 nt, Homo sapiens
gcagaacuauuaacuaaca

SEQ ID NO: 942138 - RNA, 19 nt, Homo sapiens
gaacugcaccuggacaaua

SEQ ID NO: 942139 - RNA, 19 nt, Homo sapiens
uaugggagauuccaguuua

SEQ ID NO: 942140 - RNA, 19 nt, Homo sapiens
agaaacaacuccagauuau

SEQ ID NO: 942141 - RNA, 19 nt, Homo sapiens
cgagacauuucuucauaua

SEQ ID NO: 942142 - RNA, 19 nt, Homo sapiens
gaaaugggacauaauucua

SEQ ID NO: 942143 - RNA, 19 nt, Homo sapiens
gguagaagaucagucaauu

SEQ ID NO: 942144 - RNA, 19 nt, Homo sapiens
cagauuaugccaauucuua

SEQ ID NO: 942145 - RNA, 19 nt, Homo sapiens
cugcagaacuauuaacuaa

SEQ ID NO: 942146 - RNA, 19 nt, Homo sapiens
cgacuauguuccuguauuu

SEQ ID NO: 942147 - RNA, 19 nt, Homo sapiens
gauggaagcugugaaagug

SEQ ID NO: 942148 - RNA, 19 nt, Homo sapiens
gaacugucuuugucuucua

SEQ ID NO: 942149 - RNA, 19 nt, Homo sapiens
cagaaacaacuccagauua

SEQ ID NO: 942150 - RNA, 19 nt, Homo sapiens
ucaaauaguuacugacuca

SEQ ID NO: 942151 - RNA, 19 nt, Homo sapiens
aaacaacuccagauuauug

SEQ ID NO: 942152 - RNA, 19 nt, Homo sapiens
ucagaaagguagaagauca

SEQ ID NO: 942153 - RNA, 19 nt, Homo sapiens
gaagugaucacccgucaga

SEQ ID NO: 942154 - RNA, 19 nt, Homo sapiens
agacaaacagugcaaauuu

SEQ ID NO: 942155 - RNA, 19 nt, Homo sapiens
uaucugcaguguaaaguuu

SEQ ID NO: 942156 - RNA, 19 nt, Homo sapiens
guagaagaucagucaauua

SEQ ID NO: 942157 - RNA, 19 nt, Homo sapiens
aaacgacuauguuccugua

SEQ ID NO: 942158 - RNA, 19 nt, Homo sapiens
aacgagacauuucuucaua

SEQ ID NO: 942159 - RNA, 19 nt, Homo sapiens
aaauggagcuuguaagaag

SEQ ID NO: 942160 - RNA, 19 nt, Homo sapiens
caccaacucuggccugauu

SEQ ID NO: 942161 - RNA, 19 nt, Homo sapiens
uaacaucucuauuccaaac

SEQ ID NO: 942162 - RNA, 19 nt, Homo sapiens
gacggaaccuccagcaaug

SEQ ID NO: 942163 - RNA, 19 nt, Homo sapiens
gcacauacaaguggagaaa

SEQ ID NO: 942164 - RNA, 19 nt, Homo sapiens
ccuaacaucucuauuccaa

SEQ ID NO: 942165 - RNA, 19 nt, Homo sapiens
gcgguuaccuggauaccuu

SEQ ID NO: 942166 - RNA, 19 nt, Homo sapiens
accagaagcugcagaacua

SEQ ID NO: 942167 - RNA, 19 nt, Homo sapiens
gacaggaugagaguuauua

SEQ ID NO: 942168 - RNA, 19 nt, Homo sapiens
gggcaagucugcaguaaaa

SEQ ID NO: 942169 - RNA, 19 nt, Homo sapiens
caaauuuggugguguuucu

SEQ ID NO: 942170 - RNA, 19 nt, Homo sapiens
caccucagauccaaauuug

SEQ ID NO: 942171 - RNA, 19 nt, Homo sapiens
gcacugggcaaauauaaca

SEQ ID NO: 942172 - RNA, 19 nt, Homo sapiens
cauaacagaagaugaugua

SEQ ID NO: 942173 - RNA, 19 nt, Homo sapiens
gcucuauucucacacaaau

SEQ ID NO: 942174 - RNA, 19 nt, Homo sapiens
ccucguggcuacacauauu

SEQ ID NO: 942175 - RNA, 19 nt, Homo sapiens
ugaaacacaugcggaagaa

SEQ ID NO: 942176 - RNA, 19 nt, Homo sapiens
gaaacaacuccagauuauu

SEQ ID NO: 942177 - RNA, 19 nt, Homo sapiens
gcaaauauaacaccagcau

SEQ ID NO: 942178 - RNA, 19 nt, Homo sapiens
gccauugacccucuuaauu

SEQ ID NO: 942179 - RNA, 19 nt, Homo sapiens
agaagcugcagaacuauua

SEQ ID NO: 942180 - RNA, 19 nt, Homo sapiens
ucaaagagauuuuccuaga

SEQ ID NO: 942181 - RNA, 19 nt, Homo sapiens
ccauugacccucuuaauuc

SEQ ID NO: 942182 - RNA, 19 nt, Homo sapiens
uaaaucaacgggcagacua

SEQ ID NO: 942183 - RNA, 19 nt, Homo sapiens
gaaguaugagcucugugua

SEQ ID NO: 942184 - RNA, 19 nt, Homo sapiens
gcacaccucagauccaaau

SEQ ID NO: 942185 - RNA, 19 nt, Homo sapiens
uaauggaugugguacaauc

SEQ ID NO: 942186 - RNA, 19 nt, Homo sapiens
gaagcaaacgagacauuuc

SEQ ID NO: 942187 - RNA, 19 nt, Homo sapiens
cuguguaucugcaguguaa

SEQ ID NO: 942188 - RNA, 19 nt, Homo sapiens
aaaaugcacugggcaaaua

SEQ ID NO: 942189 - RNA, 19 nt, Homo sapiens
cuacaguggagauaauaua

SEQ ID NO: 942190 - RNA, 19 nt, Homo sapiens
auccugagcuggcuuauug

SEQ ID NO: 942191 - RNA, 19 nt, Homo sapiens
gacaauagaaagaccagaa

SEQ ID NO: 942192 - RNA, 19 nt, Homo sapiens
acauacaaguggagaaaga

SEQ ID NO: 942193 - RNA, 19 nt, Homo sapiens
aaaccagccuuucaacagu

SEQ ID NO: 942194 - RNA, 19 nt, Homo sapiens
gaucacccgucagaaacaa

SEQ ID NO: 942195 - RNA, 19 nt, Homo sapiens
uuaauucucuccuguuugg

SEQ ID NO: 942196 - RNA, 19 nt, Homo sapiens
gcaaacgagacauuucuuc

SEQ ID NO: 942197 - RNA, 19 nt, Homo sapiens
aauccuaccuagaggcuuu

SEQ ID NO: 942198 - RNA, 19 nt, Homo sapiens
gcagaaaacaucaacacua

SEQ ID NO: 942199 - RNA, 19 nt, Homo sapiens
ccagauggaagcugugaaa

SEQ ID NO: 942200 - RNA, 19 nt, Homo sapiens
gguccaacccuaagugaga

SEQ ID NO: 942201 - RNA, 19 nt, Homo sapiens
gaagcugcagaacuauuaa

SEQ ID NO: 942202 - RNA, 19 nt, Homo sapiens
gcaaguggcaauucaggau

SEQ ID NO: 942203 - RNA, 19 nt, Homo sapiens
ucagaaacaacuccagauu

SEQ ID NO: 942204 - RNA, 19 nt, Homo sapiens
caggaugagaguuauuaua

SEQ ID NO: 942205 - RNA, 19 nt, Homo sapiens
cagcaagaauucaaagaac

SEQ ID NO: 942206 - RNA, 19 nt, Homo sapiens
caaacgagacauuucuuca

SEQ ID NO: 942207 - RNA, 19 nt, Homo sapiens
gagccucucccaccucuga

SEQ ID NO: 942208 - RNA, 19 nt, Homo sapiens
gcaagaauucaaagaacug

SEQ ID NO: 942209 - RNA, 19 nt, Homo sapiens
ucuuaauucucuccuguuu

SEQ ID NO: 942210 - RNA, 19 nt, Homo sapiens
uaaaagcugucgguccuua

SEQ ID NO: 942211 - RNA, 19 nt, Homo sapiens
ccaccagucucgcugcaau

SEQ ID NO: 942212 - RNA, 19 nt, Homo sapiens
caaagagauuuuccuagaa

SEQ ID NO: 942213 - RNA, 19 nt, Homo sapiens
gccaugauccugcaacuca

SEQ ID NO: 942214 - RNA, 19 nt, Homo sapiens
ggauguagucgagaugaaa

SEQ ID NO: 942215 - RNA, 19 nt, Homo sapiens
caacuccagauuauuguga

SEQ ID NO: 942216 - RNA, 19 nt, Homo sapiens
ccaguacauugacguuuca

SEQ ID NO: 942217 - RNA, 19 nt, Homo sapiens
aggaagggccugaaaguga

SEQ ID NO: 942218 - RNA, 19 nt, Homo sapiens
cagcugcucuauucucaca

SEQ ID NO: 942219 - RNA, 19 nt, Homo sapiens
aaagguagaagaucaguca

SEQ ID NO: 942220 - RNA, 19 nt, Homo sapiens
ucugacaggaugagaguua

SEQ ID NO: 942221 - RNA, 19 nt, Homo sapiens
cguguugucuacagauuau

SEQ ID NO: 942222 - RNA, 19 nt, Homo sapiens
uacaaguggagaaagauua

SEQ ID NO: 942223 - RNA, 19 nt, Homo sapiens
gagcuggcuuauugugugu

SEQ ID NO: 942224 - RNA, 19 nt, Homo sapiens
uaacacagagccuauaaaa

SEQ ID NO: 942225 - RNA, 19 nt, Homo sapiens
gaaaacaaaagcaucagaa

SEQ ID NO: 942226 - RNA, 19 nt, Homo sapiens
ucaacgggcagacuacaaa

SEQ ID NO: 942227 - RNA, 19 nt, Homo sapiens
caaaccagccuuucaacag

SEQ ID NO: 942228 - RNA, 19 nt, Homo sapiens
gaacaucugugaagaaaug

SEQ ID NO: 942229 - RNA, 19 nt, Homo sapiens
ggaagcuucuggacucuuu

SEQ ID NO: 942230 - RNA, 19 nt, Homo sapiens
caaagaggcuuaggucaga

SEQ ID NO: 942231 - RNA, 19 nt, Homo sapiens
gcaauaaugguguaaagaa

SEQ ID NO: 942232 - RNA, 19 nt, Homo sapiens
cgaaagggccucucugaaa

SEQ ID NO: 942233 - RNA, 19 nt, Homo sapiens
gaagaaagcccugaucauc

SEQ ID NO: 942234 - RNA, 19 nt, Homo sapiens
gaaagggccucucugaaaa

SEQ ID NO: 942235 - RNA, 19 nt, Homo sapiens
gagguuagauguugaagag

SEQ ID NO: 942236 - RNA, 19 nt, Homo sapiens
aggaagcccuguuuguuua

SEQ ID NO: 942237 - RNA, 19 nt, Homo sapiens
gcaccagccuguccaagga

SEQ ID NO: 942238 - RNA, 19 nt, Homo sapiens
ccugaggacuuuccaguuu

SEQ ID NO: 942239 - RNA, 19 nt, Homo sapiens
cuaaggcacuggcagaauu

SEQ ID NO: 942240 - RNA, 19 nt, Homo sapiens
gccaaacccuguugcagaa

SEQ ID NO: 942241 - RNA, 19 nt, Homo sapiens
gaaaccgucuggaugaagu

SEQ ID NO: 942242 - RNA, 19 nt, Homo sapiens
caacauggcaggucuguag

SEQ ID NO: 942243 - RNA, 19 nt, Homo sapiens
gaacagggccuuggaggau

SEQ ID NO: 942244 - RNA, 19 nt, Homo sapiens
agaagcagcuccuccaugu

SEQ ID NO: 942245 - RNA, 19 nt, Homo sapiens
uuugagaucuguaagcuuu

SEQ ID NO: 942246 - RNA, 19 nt, Homo sapiens
ggacuuuacaguuauguga

SEQ ID NO: 942247 - RNA, 19 nt, Homo sapiens
aaagaaaccgucuggauga

SEQ ID NO: 942248 - RNA, 19 nt, Homo sapiens
gaacagggcuuggcaaaag

SEQ ID NO: 942249 - RNA, 19 nt, Homo sapiens
guaccugccugccuuagau

SEQ ID NO: 942250 - RNA, 19 nt, Homo sapiens
agccuggacuuuacaguua

SEQ ID NO: 942251 - RNA, 19 nt, Homo sapiens
caauucaucugccacuuuc

SEQ ID NO: 942252 - RNA, 19 nt, Homo sapiens
uggaaacccucaccugcua

SEQ ID NO: 942253 - RNA, 19 nt, Homo sapiens
gcuaugagacuuugagcaa

SEQ ID NO: 942254 - RNA, 19 nt, Homo sapiens
caguuucucugcagccaua

SEQ ID NO: 942255 - RNA, 19 nt, Homo sapiens
cagacgaggugcugaagga

SEQ ID NO: 942256 - RNA, 19 nt, Homo sapiens
ggugggaggugaugaagca

SEQ ID NO: 942257 - RNA, 19 nt, Homo sapiens
uggcuuauguggaggguuu

SEQ ID NO: 942258 - RNA, 19 nt, Homo sapiens
uaugagacuuugagcaaga

SEQ ID NO: 942259 - RNA, 19 nt, Homo sapiens
gcaacucuccguccucuuc

SEQ ID NO: 942260 - RNA, 19 nt, Homo sapiens
guuagauguugaagaggua

SEQ ID NO: 942261 - RNA, 19 nt, Homo sapiens
gaagugcagggucccaauu

SEQ ID NO: 942262 - RNA, 19 nt, Homo sapiens
gaagaccucaauacaacuu

SEQ ID NO: 942263 - RNA, 19 nt, Homo sapiens
ggauaucacagcuuccauu

SEQ ID NO: 942264 - RNA, 19 nt, Homo sapiens
acaggcagguggucucuga

SEQ ID NO: 942265 - RNA, 19 nt, Homo sapiens
uaaggcacuggcagaauua

SEQ ID NO: 942266 - RNA, 19 nt, Homo sapiens
ggacaaguuacgacagcua

SEQ ID NO: 942267 - RNA, 19 nt, Homo sapiens
caaacccuguugcagaaga

SEQ ID NO: 942268 - RNA, 19 nt, Homo sapiens
ccacuccucuucagcuugu

SEQ ID NO: 942269 - RNA, 19 nt, Homo sapiens
ccaauucaucugccacuuu

SEQ ID NO: 942270 - RNA, 19 nt, Homo sapiens
gauaucacagcuuccauug

SEQ ID NO: 942271 - RNA, 19 nt, Homo sapiens
gaagaagaaagcccugauc

SEQ ID NO: 942272 - RNA, 19 nt, Homo sapiens
gaauuuguccugccuuucu

SEQ ID NO: 942273 - RNA, 19 nt, Homo sapiens
cuccugaacugccugauga

SEQ ID NO: 942274 - RNA, 19 nt, Homo sapiens
ccugaugagucccgugaaa

SEQ ID NO: 942275 - RNA, 19 nt, Homo sapiens
auaaaguccuugcagguau

SEQ ID NO: 942276 - RNA, 19 nt, Homo sapiens
gaacucggacacccagaau

SEQ ID NO: 942277 - RNA, 19 nt, Homo sapiens
uugaacaucugugaagaaa

SEQ ID NO: 942278 - RNA, 19 nt, Homo sapiens
augagcagcuucugacuug

SEQ ID NO: 942279 - RNA, 19 nt, Homo sapiens
ucaaagaaaccgucuggau

SEQ ID NO: 942280 - RNA, 19 nt, Homo sapiens
caggaagaccucaauacaa

SEQ ID NO: 942281 - RNA, 19 nt, Homo sapiens
gggaggugaugaagcacaa

SEQ ID NO: 942282 - RNA, 19 nt, Homo sapiens
aggaagaccucaauacaac

SEQ ID NO: 942283 - RNA, 19 nt, Homo sapiens
ugaccucgcuggccaaacu

SEQ ID NO: 942284 - RNA, 19 nt, Homo sapiens
uggaacaugugaccguuga

SEQ ID NO: 942285 - RNA, 19 nt, Homo sapiens
acgaggugcugaaggaauu

SEQ ID NO: 942286 - RNA, 19 nt, Homo sapiens
gcgaaagggccucucugaa

SEQ ID NO: 942287 - RNA, 19 nt, Homo sapiens
ggaccgcuuuagcaaauac

SEQ ID NO: 942288 - RNA, 19 nt, Homo sapiens
aaaaguugcuggcuuaugu

SEQ ID NO: 942289 - RNA, 19 nt, Homo sapiens
gcaagaccaacccuucugu

SEQ ID NO: 942290 - RNA, 19 nt, Homo sapiens
gcacuggcagaauuaacaa

SEQ ID NO: 942291 - RNA, 19 nt, Homo sapiens
uaaaguccuugcagguauc

SEQ ID NO: 942292 - RNA, 19 nt, Homo sapiens
ggaacucggacacccagaa

SEQ ID NO: 942293 - RNA, 19 nt, Homo sapiens
gaacaugugaccguugaca

SEQ ID NO: 942294 - RNA, 19 nt, Homo sapiens
ccgagcagccuggacuuua

SEQ ID NO: 942295 - RNA, 19 nt, Homo sapiens
gcuccuccaugucccuuau

SEQ ID NO: 942296 - RNA, 19 nt, Homo sapiens
ggucagacuguucagcaaa

SEQ ID NO: 942297 - RNA, 19 nt, Homo sapiens
ccggaugucuggaucaagu

SEQ ID NO: 942298 - RNA, 19 nt, Homo sapiens
gaagcggugccucucuuug

SEQ ID NO: 942299 - RNA, 19 nt, Homo sapiens
ugucaugccucaaagaaac

SEQ ID NO: 942300 - RNA, 19 nt, Homo sapiens
cugaaaaguugcuggcuua

SEQ ID NO: 942301 - RNA, 19 nt, Homo sapiens
cuaggacccuugaacaucu

SEQ ID NO: 942302 - RNA, 19 nt, Homo sapiens
aauaaaguccuugcaggua

SEQ ID NO: 942303 - RNA, 19 nt, Homo sapiens
gaugagcagcuucugacuu

SEQ ID NO: 942304 - RNA, 19 nt, Homo sapiens
uccuggagcuccuguguga

SEQ ID NO: 942305 - RNA, 19 nt, Homo sapiens
ggaagaagaaagcccugau

SEQ ID NO: 942306 - RNA, 19 nt, Homo sapiens
ucaggaagaccucaauaca

SEQ ID NO: 942307 - RNA, 19 nt, Homo sapiens
uggcugacaugcugacugu

SEQ ID NO: 942308 - RNA, 19 nt, Homo sapiens
ggcgaaagggccucucuga

SEQ ID NO: 942309 - RNA, 19 nt, Homo sapiens
gccaugcucugcacaucau

SEQ ID NO: 942310 - RNA, 19 nt, Homo sapiens
gaggaggucagacuguuca

SEQ ID NO: 942311 - RNA, 19 nt, Homo sapiens
ggugucaugccucaaagaa

SEQ ID NO: 942312 - RNA, 19 nt, Homo sapiens
auggaagugugcuacauuu

SEQ ID NO: 942313 - RNA, 19 nt, Homo sapiens
acgcgacgcucuaccugaa

SEQ ID NO: 942314 - RNA, 19 nt, Homo sapiens
gaagcuucuggacucuuua

SEQ ID NO: 942315 - RNA, 19 nt, Homo sapiens
caaccacaccauccucuuc

SEQ ID NO: 942316 - RNA, 19 nt, Homo sapiens
cgagcagccuggacuuuac

SEQ ID NO: 942317 - RNA, 19 nt, Homo sapiens
uggcgggucugcagaagau

SEQ ID NO: 942318 - RNA, 19 nt, Homo sapiens
gaaacccucaccugcuaug

SEQ ID NO: 942319 - RNA, 19 nt, Homo sapiens
ucauggcaauaauggugua

SEQ ID NO: 942320 - RNA, 19 nt, Homo sapiens
guccauugcugagggcauu

SEQ ID NO: 942321 - RNA, 19 nt, Homo sapiens
gaagcccuguuuguuuaca

SEQ ID NO: 942322 - RNA, 19 nt, Homo sapiens
ggaccgccauauggaagug

SEQ ID NO: 942323 - RNA, 19 nt, Homo sapiens
gaccuaggacccuugaaca

SEQ ID NO: 942324 - RNA, 19 nt, Homo sapiens
uccaguggcugcucuucuu

SEQ ID NO: 942325 - RNA, 19 nt, Homo sapiens
aagaaaccgucuggaugaa

SEQ ID NO: 942326 - RNA, 19 nt, Homo sapiens
gcacacucccagcccuuug

SEQ ID NO: 942327 - RNA, 19 nt, Homo sapiens
uggcaauaaugguguaaag

SEQ ID NO: 942328 - RNA, 19 nt, Homo sapiens
ucaagacacagacagaaua

SEQ ID NO: 942329 - RNA, 19 nt, Homo sapiens
gcugcgugcugaucaugua

SEQ ID NO: 942330 - RNA, 19 nt, Homo sapiens
gggcugccauggacagugu

SEQ ID NO: 942331 - RNA, 19 nt, Homo sapiens
uguacaaggccaucuggua

SEQ ID NO: 942332 - RNA, 19 nt, Homo sapiens
gacagugugccucugauca

SEQ ID NO: 942333 - RNA, 19 nt, Homo sapiens
caucaagacacagacagaa

SEQ ID NO: 942334 - RNA, 19 nt, Homo sapiens
ggacagugugccucugauc

SEQ ID NO: 942335 - RNA, 19 nt, Homo sapiens
gaugcucuccgccguguuc

SEQ ID NO: 942336 - RNA, 19 nt, Homo sapiens
caagacacagacagaauac

SEQ ID NO: 942337 - RNA, 19 nt, Homo sapiens
cgcugacccuggagaugua

SEQ ID NO: 942338 - RNA, 19 nt, Homo sapiens
caguggagccgccugacaa

SEQ ID NO: 942339 - RNA, 19 nt, Homo sapiens
gcgugcugaucauguacaa

SEQ ID NO: 942340 - RNA, 19 nt, Homo sapiens
gacaagggacugccaucca

SEQ ID NO: 942341 - RNA, 19 nt, Homo sapiens
ucucugacucugucgcuuu

SEQ ID NO: 942342 - RNA, 19 nt, Homo sapiens
acaaggccaucugguacga

SEQ ID NO: 942343 - RNA, 19 nt, Homo sapiens
gcacaaagauggagucaag

SEQ ID NO: 942344 - RNA, 19 nt, Homo sapiens
gaaagaaguugcagaagca

SEQ ID NO: 942345 - RNA, 19 nt, Homo sapiens
gaaaggaggcugcacauag

SEQ ID NO: 942346 - RNA, 19 nt, Homo sapiens
ucaccaagcucagcaagua

SEQ ID NO: 942347 - RNA, 19 nt, Homo sapiens
ucacugaacugcagaggaa

SEQ ID NO: 942348 - RNA, 19 nt, Homo sapiens
ccagaaaccacauuuaauu

SEQ ID NO: 942349 - RNA, 19 nt, Homo sapiens
ggacaaagagggcuauguu

SEQ ID NO: 942350 - RNA, 19 nt, Homo sapiens
gcucagaacucaucuacuc

SEQ ID NO: 942351 - RNA, 19 nt, Homo sapiens
gacagucacucuugcacua

SEQ ID NO: 942352 - RNA, 19 nt, Homo sapiens
ggacagagaccuccaugug

SEQ ID NO: 942353 - RNA, 19 nt, Homo sapiens
ggagaaagacgaucauuac

SEQ ID NO: 942354 - RNA, 19 nt, Homo sapiens
ggaccaacgucaucaacga

SEQ ID NO: 942355 - RNA, 19 nt, Homo sapiens
cgaauguucuuucucuuug

SEQ ID NO: 942356 - RNA, 19 nt, Homo sapiens
ggagucaagugcuggagaa

SEQ ID NO: 942357 - RNA, 19 nt, Homo sapiens
gggagcagcuggcuaucaa

SEQ ID NO: 942358 - RNA, 19 nt, Homo sapiens
gagaagacacagagaaaga

SEQ ID NO: 942359 - RNA, 19 nt, Homo sapiens
gaacaucgaggacaucuac

SEQ ID NO: 942360 - RNA, 19 nt, Homo sapiens
cagcucaucuacuguaaga

SEQ ID NO: 942361 - RNA, 19 nt, Homo sapiens
gcacugagcgggacuacau

SEQ ID NO: 942362 - RNA, 19 nt, Homo sapiens
gaauguucuuucucuuuga

SEQ ID NO: 942363 - RNA, 19 nt, Homo sapiens
gcacagggacuucaaggau

SEQ ID NO: 942364 - RNA, 19 nt, Homo sapiens
caacgggacugaaccacau

SEQ ID NO: 942365 - RNA, 19 nt, Homo sapiens
gucaagugcuggagaaaga

SEQ ID NO: 942366 - RNA, 19 nt, Homo sapiens
aggaggaccuguaugauga

SEQ ID NO: 942367 - RNA, 19 nt, Homo sapiens
gaagcaggcccacgucgaa

SEQ ID NO: 942368 - RNA, 19 nt, Homo sapiens
ccacuugccuccacaccuu

SEQ ID NO: 942369 - RNA, 19 nt, Homo sapiens
ccucuucucuggaaaccua

SEQ ID NO: 942370 - RNA, 19 nt, Homo sapiens
gaaagagaacacccaugaa

SEQ ID NO: 942371 - RNA, 19 nt, Homo sapiens
gagaacaucgacaagauug

SEQ ID NO: 942372 - RNA, 19 nt, Homo sapiens
agaaagagaacacccauga

SEQ ID NO: 942373 - RNA, 19 nt, Homo sapiens
gcgaauguucuuucucuuu

SEQ ID NO: 942374 - RNA, 19 nt, Homo sapiens
ggagcugacucgaguuaca

SEQ ID NO: 942375 - RNA, 19 nt, Homo sapiens
gcgaggaggaccuguauga

SEQ ID NO: 942376 - RNA, 19 nt, Homo sapiens
ggaaaccuaauccuccuuu

SEQ ID NO: 942377 - RNA, 19 nt, Homo sapiens
ccaggaagcccgagcagaa

SEQ ID NO: 942378 - RNA, 19 nt, Homo sapiens
gagagagaccgaauucugu

SEQ ID NO: 942379 - RNA, 19 nt, Homo sapiens
gagcggaagcggagacuug

SEQ ID NO: 942380 - RNA, 19 nt, Homo sapiens
gaacguggcccagcucauc

SEQ ID NO: 942381 - RNA, 19 nt, Homo sapiens
gaggaggaccuguaugaug

SEQ ID NO: 942382 - RNA, 19 nt, Homo sapiens
uaagagagagaccgaauuc

SEQ ID NO: 942383 - RNA, 19 nt, Homo sapiens
gacagagaccuccauguga

SEQ ID NO: 942384 - RNA, 19 nt, Homo sapiens
gacaaagagggcuauguuu

SEQ ID NO: 942385 - RNA, 19 nt, Homo sapiens
cagcgaauguucuuucucu

SEQ ID NO: 942386 - RNA, 19 nt, Homo sapiens
ccucuucacuugugugugu

SEQ ID NO: 942387 - RNA, 19 nt, Homo sapiens
ugucugcgcugacgaagug

SEQ ID NO: 942388 - RNA, 19 nt, Homo sapiens
gucaggagcucagaacuca

SEQ ID NO: 942389 - RNA, 19 nt, Homo sapiens
ggacugggagggagaagau

SEQ ID NO: 942390 - RNA, 19 nt, Homo sapiens
gcagcuggcuaucaaugag

SEQ ID NO: 942391 - RNA, 19 nt, Homo sapiens
uggagaaagacgaucauua

SEQ ID NO: 942392 - RNA, 19 nt, Homo sapiens
aaaggaggcugcacauagg

SEQ ID NO: 942393 - RNA, 19 nt, Homo sapiens
ccacaugcccugggaagaa

SEQ ID NO: 942394 - RNA, 19 nt, Homo sapiens
ccaggaaggcgacgcuaaa

SEQ ID NO: 942395 - RNA, 19 nt, Homo sapiens
ugacuccggugcagaagau

SEQ ID NO: 942396 - RNA, 19 nt, Homo sapiens
cauaagaccuuuucaaacu

SEQ ID NO: 942397 - RNA, 19 nt, Homo sapiens
agagaaagaaguugcagaa

SEQ ID NO: 942398 - RNA, 19 nt, Homo sapiens
aaagugaaccgaccaucaa

SEQ ID NO: 942399 - RNA, 19 nt, Homo sapiens
gcauggacagucacucuug

SEQ ID NO: 942400 - RNA, 19 nt, Homo sapiens
gagcgaggaggaccuguau

SEQ ID NO: 942401 - RNA, 19 nt, Homo sapiens
ggaaggcgacgcuaaacca

SEQ ID NO: 942402 - RNA, 19 nt, Homo sapiens
gggacccucuucucuggaa

SEQ ID NO: 942403 - RNA, 19 nt, Homo sapiens
gccgcgacguguuguacua

SEQ ID NO: 942404 - RNA, 19 nt, Homo sapiens
gagcagcuggcuaucaaug

SEQ ID NO: 942405 - RNA, 19 nt, Homo sapiens
ggagcgaggaggaccugua

SEQ ID NO: 942406 - RNA, 19 nt, Homo sapiens
ucagaaggcguuccacaug

SEQ ID NO: 942407 - RNA, 19 nt, Homo sapiens
aagaugagcagaaggaaga

SEQ ID NO: 942408 - RNA, 19 nt, Homo sapiens
aaaccaagaugagcagaag

SEQ ID NO: 942409 - RNA, 19 nt, Homo sapiens
gggcagaagccaggaauuc

SEQ ID NO: 942410 - RNA, 19 nt, Homo sapiens
gaacacaggaggaaaagug

SEQ ID NO: 942411 - RNA, 19 nt, Homo sapiens
ccuaauccuccuuucauuu

SEQ ID NO: 942412 - RNA, 19 nt, Homo sapiens
gagaacacccaugaacguu

SEQ ID NO: 942413 - RNA, 19 nt, Homo sapiens
gcagcugcguaccaucuuc

SEQ ID NO: 942414 - RNA, 19 nt, Homo sapiens
cgaaaggaggcugcacaua

SEQ ID NO: 942415 - RNA, 19 nt, Homo sapiens
gguuggccuuggcucauaa

SEQ ID NO: 942416 - RNA, 19 nt, Homo sapiens
gccagaaaccacauuuaau

SEQ ID NO: 942417 - RNA, 19 nt, Homo sapiens
ugagaagccauaagagaga

SEQ ID NO: 942418 - RNA, 19 nt, Homo sapiens
uggacacccucuucacuug

SEQ ID NO: 942419 - RNA, 19 nt, Homo sapiens
gagcagcaaggaccagaug

SEQ ID NO: 942420 - RNA, 19 nt, Homo sapiens
ugauggagcucuggacaca

SEQ ID NO: 942421 - RNA, 19 nt, Homo sapiens
gaagaaccagcaggugaga

SEQ ID NO: 942422 - RNA, 19 nt, Homo sapiens
gaaggcgacgcuaaaccaa

SEQ ID NO: 942423 - RNA, 19 nt, Homo sapiens
ggucuguacuccuguuguc

SEQ ID NO: 942424 - RNA, 19 nt, Homo sapiens
gcucaucuacuguaagaag

SEQ ID NO: 942425 - RNA, 19 nt, Homo sapiens
agacacagagaaagaaguu

SEQ ID NO: 942426 - RNA, 19 nt, Homo sapiens
gaagacacagagaaagaag

SEQ ID NO: 942427 - RNA, 19 nt, Homo sapiens
agccagaaaccacauuuaa

SEQ ID NO: 942428 - RNA, 19 nt, Homo sapiens
caagccagaaaccacauuu

SEQ ID NO: 942429 - RNA, 19 nt, Homo sapiens
gugcacagccacccaggaa

SEQ ID NO: 942430 - RNA, 19 nt, Homo sapiens
aggcgacgcuaaaccaaga

SEQ ID NO: 942431 - RNA, 19 nt, Homo sapiens
ugagaacaucgacaagauu

SEQ ID NO: 942432 - RNA, 19 nt, Homo sapiens
acagggacuucaaggaugu

SEQ ID NO: 942433 - RNA, 19 nt, Homo sapiens
uugaaucucccuagaagaa

SEQ ID NO: 942434 - RNA, 19 nt, Homo sapiens
gacacccucuucacuugug

SEQ ID NO: 942435 - RNA, 19 nt, Homo sapiens
cuaauccuccuuucauuuc

SEQ ID NO: 942436 - RNA, 19 nt, Homo sapiens
gagcucagaacucaucuac

SEQ ID NO: 942437 - RNA, 19 nt, Homo sapiens
uugagaacaucgacaagau

SEQ ID NO: 942438 - RNA, 19 nt, Homo sapiens
caagccgacuuccagaucu

SEQ ID NO: 942439 - RNA, 19 nt, Homo sapiens
gagcagcugcguaccaucu

SEQ ID NO: 942440 - RNA, 19 nt, Homo sapiens
caagcgcgcagacauguuc

SEQ ID NO: 942441 - RNA, 19 nt, Homo sapiens
agaagaagccauccacucu

SEQ ID NO: 942442 - RNA, 19 nt, Homo sapiens
cagucacucuugcacuauu

SEQ ID NO: 942443 - RNA, 19 nt, Homo sapiens
gcacaaagauggagucaag

SEQ ID NO: 942444 - RNA, 19 nt, Homo sapiens
gaaagaaguugcagaagca

SEQ ID NO: 942445 - RNA, 19 nt, Homo sapiens
gaaaggaggcugcacauag

SEQ ID NO: 942446 - RNA, 19 nt, Homo sapiens
ucaccaagcucagcaagua

SEQ ID NO: 942447 - RNA, 19 nt, Homo sapiens
ucacugaacugcagaggaa

SEQ ID NO: 942448 - RNA, 19 nt, Homo sapiens
ccagaaaccacauuuaauu

SEQ ID NO: 942449 - RNA, 19 nt, Homo sapiens
ggacaaagagggcuauguu

SEQ ID NO: 942450 - RNA, 19 nt, Homo sapiens
gcucagaacucaucuacuc

SEQ ID NO: 942451 - RNA, 19 nt, Homo sapiens
gacagucacucuugcacua

SEQ ID NO: 942452 - RNA, 19 nt, Homo sapiens
ggacagagaccuccaugug

SEQ ID NO: 942453 - RNA, 19 nt, Homo sapiens
ggagaaagacgaucauuac

SEQ ID NO: 942454 - RNA, 19 nt, Homo sapiens
ggaccaacgucaucaacga

SEQ ID NO: 942455 - RNA, 19 nt, Homo sapiens
cgaauguucuuucucuuug

SEQ ID NO: 942456 - RNA, 19 nt, Homo sapiens
ggagucaagugcuggagaa

SEQ ID NO: 942457 - RNA, 19 nt, Homo sapiens
gggagcagcuggcuaucaa

SEQ ID NO: 942458 - RNA, 19 nt, Homo sapiens
gagaagacacagagaaaga

SEQ ID NO: 942459 - RNA, 19 nt, Homo sapiens
gaacaucgaggacaucuac

SEQ ID NO: 942460 - RNA, 19 nt, Homo sapiens
cagcucaucuacuguaaga

SEQ ID NO: 942461 - RNA, 19 nt, Homo sapiens
gcacugagcgggacuacau

SEQ ID NO: 942462 - RNA, 19 nt, Homo sapiens
gaauguucuuucucuuuga

SEQ ID NO: 942463 - RNA, 19 nt, Homo sapiens
gcacagggacuucaaggau

SEQ ID NO: 942464 - RNA, 19 nt, Homo sapiens
caacgggacugaaccacau

SEQ ID NO: 942465 - RNA, 19 nt, Homo sapiens
gucaagugcuggagaaaga

SEQ ID NO: 942466 - RNA, 19 nt, Homo sapiens
aggaggaccuguaugauga

SEQ ID NO: 942467 - RNA, 19 nt, Homo sapiens
gaagcaggcccacgucgaa

SEQ ID NO: 942468 - RNA, 19 nt, Homo sapiens
ccacuugccuccacaccuu

SEQ ID NO: 942469 - RNA, 19 nt, Homo sapiens
ccucuucucuggaaaccua

SEQ ID NO: 942470 - RNA, 19 nt, Homo sapiens
ugaaacaucacaugccuuu

SEQ ID NO: 942471 - RNA, 19 nt, Homo sapiens
gaaagagaacacccaugaa

SEQ ID NO: 942472 - RNA, 19 nt, Homo sapiens
gagaacaucgacaagauug

SEQ ID NO: 942473 - RNA, 19 nt, Homo sapiens
agaaagagaacacccauga

SEQ ID NO: 942474 - RNA, 19 nt, Homo sapiens
gcgaauguucuuucucuuu

SEQ ID NO: 942475 - RNA, 19 nt, Homo sapiens
ggagcugacucgaguuaca

SEQ ID NO: 942476 - RNA, 19 nt, Homo sapiens
gcgaggaggaccuguauga

SEQ ID NO: 942477 - RNA, 19 nt, Homo sapiens
ggaaaccuaauccuccuuu

SEQ ID NO: 942478 - RNA, 19 nt, Homo sapiens
guauaugguugacauucuu

SEQ ID NO: 942479 - RNA, 19 nt, Homo sapiens
ccaggaagcccgagcagaa

SEQ ID NO: 942480 - RNA, 19 nt, Homo sapiens
gagagagaccgaauucugu

SEQ ID NO: 942481 - RNA, 19 nt, Homo sapiens
gagcggaagcggagacuug

SEQ ID NO: 942482 - RNA, 19 nt, Homo sapiens
gaacguggcccagcucauc

SEQ ID NO: 942483 - RNA, 19 nt, Homo sapiens
gaggaggaccuguaugaug

SEQ ID NO: 942484 - RNA, 19 nt, Homo sapiens
uaagagagagaccgaauuc

SEQ ID NO: 942485 - RNA, 19 nt, Homo sapiens
gacagagaccuccauguga

SEQ ID NO: 942486 - RNA, 19 nt, Homo sapiens
gacaaagagggcuauguuu

SEQ ID NO: 942487 - RNA, 19 nt, Homo sapiens
cagcgaauguucuuucucu

SEQ ID NO: 942488 - RNA, 19 nt, Homo sapiens
ccucuucacuugugugugu

SEQ ID NO: 942489 - RNA, 19 nt, Homo sapiens
ugucugcgcugacgaagug

SEQ ID NO: 942490 - RNA, 19 nt, Homo sapiens
gucaggagcucagaacuca

SEQ ID NO: 942491 - RNA, 19 nt, Homo sapiens
ggacugggagggagaagau

SEQ ID NO: 942492 - RNA, 19 nt, Homo sapiens
gcagcuggcuaucaaugag

SEQ ID NO: 942493 - RNA, 19 nt, Homo sapiens
uggagaaagacgaucauua

SEQ ID NO: 942494 - RNA, 19 nt, Homo sapiens
aaaggaggcugcacauagg

SEQ ID NO: 942495 - RNA, 19 nt, Homo sapiens
ccacaugcccugggaagaa

SEQ ID NO: 942496 - RNA, 19 nt, Homo sapiens
ccaggaaggcgacgcuaaa

SEQ ID NO: 942497 - RNA, 19 nt, Homo sapiens
ggaagccugggucaguaua

SEQ ID NO: 942498 - RNA, 19 nt, Homo sapiens
ugacuccggugcagaagau

SEQ ID NO: 942499 - RNA, 19 nt, Homo sapiens
cauaagaccuuuucaaacu

SEQ ID NO: 942500 - RNA, 19 nt, Homo sapiens
agagaaagaaguugcagaa

SEQ ID NO: 942501 - RNA, 19 nt, Homo sapiens
aaagugaaccgaccaucaa

SEQ ID NO: 942502 - RNA, 19 nt, Homo sapiens
gcauggacagucacucuug

SEQ ID NO: 942503 - RNA, 19 nt, Homo sapiens
gagcgaggaggaccuguau

SEQ ID NO: 942504 - RNA, 19 nt, Homo sapiens
ggaaggcgacgcuaaacca

SEQ ID NO: 942505 - RNA, 19 nt, Homo sapiens
gggacccucuucucuggaa

SEQ ID NO: 942506 - RNA, 19 nt, Homo sapiens
agccugagcucuuggaugu

SEQ ID NO: 942507 - RNA, 19 nt, Homo sapiens
ugacaucauucccuucucu

SEQ ID NO: 942508 - RNA, 19 nt, Homo sapiens
gccgcgacguguuguacua

SEQ ID NO: 942509 - RNA, 19 nt, Homo sapiens
gagcagcuggcuaucaaug

SEQ ID NO: 942510 - RNA, 19 nt, Homo sapiens
ggagcgaggaggaccugua

SEQ ID NO: 942511 - RNA, 19 nt, Homo sapiens
ucagaaggcguuccacaug

SEQ ID NO: 942512 - RNA, 19 nt, Homo sapiens
aagaugagcagaaggaaga

SEQ ID NO: 942513 - RNA, 19 nt, Homo sapiens
aaaccaagaugagcagaag

SEQ ID NO: 942514 - RNA, 19 nt, Homo sapiens
gggcagaagccaggaauuc

SEQ ID NO: 942515 - RNA, 19 nt, Homo sapiens
gaacacaggaggaaaagug

SEQ ID NO: 942516 - RNA, 19 nt, Homo sapiens
ccuaauccuccuuucauuu

SEQ ID NO: 942517 - RNA, 19 nt, Homo sapiens
gagaacacccaugaacguu

SEQ ID NO: 942518 - RNA, 19 nt, Homo sapiens
gcagcugcguaccaucuuc

SEQ ID NO: 942519 - RNA, 19 nt, Homo sapiens
cgaaaggaggcugcacaua

SEQ ID NO: 942520 - RNA, 19 nt, Homo sapiens
gguuggccuuggcucauaa

SEQ ID NO: 942521 - RNA, 19 nt, Homo sapiens
gccagaaaccacauuuaau

SEQ ID NO: 942522 - RNA, 19 nt, Homo sapiens
ugagaagccauaagagaga

SEQ ID NO: 942523 - RNA, 19 nt, Homo sapiens
uggacacccucuucacuug

SEQ ID NO: 942524 - RNA, 19 nt, Homo sapiens
gaaggcgacgcuaaaccaa

SEQ ID NO: 942525 - RNA, 19 nt, Homo sapiens
gagcagcaaggaccagaug

SEQ ID NO: 942526 - RNA, 19 nt, Homo sapiens
ugauggagcucuggacaca

SEQ ID NO: 942527 - RNA, 19 nt, Homo sapiens
gaagaaccagcaggugaga

SEQ ID NO: 942528 - RNA, 19 nt, Homo sapiens
ggucuguacuccuguuguc

SEQ ID NO: 942529 - RNA, 19 nt, Homo sapiens
uuacccugcugacaucauu

SEQ ID NO: 942530 - RNA, 19 nt, Homo sapiens
gcucaucuacuguaagaag

SEQ ID NO: 942531 - RNA, 19 nt, Homo sapiens
agacacagagaaagaaguu

SEQ ID NO: 942532 - RNA, 19 nt, Homo sapiens
gaagacacagagaaagaag

SEQ ID NO: 942533 - RNA, 19 nt, Homo sapiens
acagggaagcccaaaggua

SEQ ID NO: 942534 - RNA, 19 nt, Homo sapiens
agccagaaaccacauuuaa

SEQ ID NO: 942535 - RNA, 19 nt, Homo sapiens
caagccagaaaccacauuu

SEQ ID NO: 942536 - RNA, 19 nt, Homo sapiens
aggcgacgcuaaaccaaga

SEQ ID NO: 942537 - RNA, 19 nt, Homo sapiens
gcaaguccuguguggcaaa

SEQ ID NO: 942538 - RNA, 19 nt, Homo sapiens
ugagaacaucgacaagauu

SEQ ID NO: 942539 - RNA, 19 nt, Homo sapiens
acagggacuucaaggaugu

SEQ ID NO: 942540 - RNA, 19 nt, Homo sapiens
gugcacagccacccaggaa

SEQ ID NO: 942541 - RNA, 19 nt, Homo sapiens
uugaaucucccuagaagaa

SEQ ID NO: 942542 - RNA, 19 nt, Homo sapiens
gacacccucuucacuugug

SEQ ID NO: 942543 - RNA, 19 nt, Homo sapiens
ggaagaagcuauaaauauc

SEQ ID NO: 942544 - RNA, 19 nt, Homo sapiens
ggaagaauuuggaaugaaa

SEQ ID NO: 942545 - RNA, 19 nt, Homo sapiens
gaagaagacuugauagaag

SEQ ID NO: 942546 - RNA, 19 nt, Homo sapiens
ggaggugucucucauaguu

SEQ ID NO: 942547 - RNA, 19 nt, Homo sapiens
uuaaagcgcuucagucaaa

SEQ ID NO: 942548 - RNA, 19 nt, Homo sapiens
caucuuaccuguacaguau

SEQ ID NO: 942549 - RNA, 19 nt, Homo sapiens
gaauuuagacggccuugua

SEQ ID NO: 942550 - RNA, 19 nt, Homo sapiens
caaugacacuuucaacaaa

SEQ ID NO: 942551 - RNA, 19 nt, Homo sapiens
gaacucaucuguguauugg

SEQ ID NO: 942552 - RNA, 19 nt, Homo sapiens
ccaagaagccgccugguaa

SEQ ID NO: 942553 - RNA, 19 nt, Homo sapiens
caaacuagaucucuggaau

SEQ ID NO: 942554 - RNA, 19 nt, Homo sapiens
ggaagguggucaaugaaug

SEQ ID NO: 942555 - RNA, 19 nt, Homo sapiens
ggccagagcuuugggcuuu

SEQ ID NO: 942556 - RNA, 19 nt, Homo sapiens
gaacuugguuugaucuuac

SEQ ID NO: 942557 - RNA, 19 nt, Homo sapiens
gaggaagaauuuggaauga

SEQ ID NO: 942558 - RNA, 19 nt, Homo sapiens
gagaaugaaugaagcaaca

SEQ ID NO: 942559 - RNA, 19 nt, Homo sapiens
caagcugugugacaagaua

SEQ ID NO: 942560 - RNA, 19 nt, Homo sapiens
cugaaacucuccauaauga

SEQ ID NO: 942561 - RNA, 19 nt, Homo sapiens
aauagaggcugaccuuaaa

SEQ ID NO: 942562 - RNA, 19 nt, Homo sapiens
ggaaagaccaacucaugaa

SEQ ID NO: 942563 - RNA, 19 nt, Homo sapiens
gcacuuggaagaagcuaua

SEQ ID NO: 942564 - RNA, 19 nt, Homo sapiens
guaaauagggcaugaggaa

SEQ ID NO: 942565 - RNA, 19 nt, Homo sapiens
cuacagcgauguuuagaau

SEQ ID NO: 942566 - RNA, 19 nt, Homo sapiens
agaaggcccuguauucauu

SEQ ID NO: 942567 - RNA, 19 nt, Homo sapiens
gaaugccgcuauuauaaag

SEQ ID NO: 942568 - RNA, 19 nt, Homo sapiens
acacuggacucucuaauuc

SEQ ID NO: 942569 - RNA, 19 nt, Homo sapiens
ccaauuucauuaacucuga

SEQ ID NO: 942570 - RNA, 19 nt, Homo sapiens
guaaagugcagaccuuaaa

SEQ ID NO: 942571 - RNA, 19 nt, Homo sapiens
ugccagcucugaaucuuua

SEQ ID NO: 942572 - RNA, 19 nt, Homo sapiens
gaaucuguggcaacuauua

SEQ ID NO: 942573 - RNA, 19 nt, Homo sapiens
caaguuugaugcaagaaug

SEQ ID NO: 942574 - RNA, 19 nt, Homo sapiens
gaaaagagguuugucaagu

SEQ ID NO: 942575 - RNA, 19 nt, Homo sapiens
gaaaagcacuucgucagaa

SEQ ID NO: 942576 - RNA, 19 nt, Homo sapiens
gcagaaaucaacaccaaga

SEQ ID NO: 942577 - RNA, 19 nt, Homo sapiens
ugccucagcuccuaugaua

SEQ ID NO: 942578 - RNA, 19 nt, Homo sapiens
gaugaccugugcaaaauua

SEQ ID NO: 942579 - RNA, 19 nt, Homo sapiens
gagagagaaucaggaaaga

SEQ ID NO: 942580 - RNA, 19 nt, Homo sapiens
guauugggaugguauuaga

SEQ ID NO: 942581 - RNA, 19 nt, Homo sapiens
gcugaggagccuaguaaua

SEQ ID NO: 942582 - RNA, 19 nt, Homo sapiens
gagaagaagacuugauaga

SEQ ID NO: 942583 - RNA, 19 nt, Homo sapiens
gaggcgaucuuugagcuuu

SEQ ID NO: 942584 - RNA, 19 nt, Homo sapiens
ggagugagaccuucgaugu

SEQ ID NO: 942585 - RNA, 19 nt, Homo sapiens
gcacuagugguaauuauuc

SEQ ID NO: 942586 - RNA, 19 nt, Homo sapiens
ccagaggccaauuucauua

SEQ ID NO: 942587 - RNA, 19 nt, Homo sapiens
gagguacucaaacaaguua

SEQ ID NO: 942588 - RNA, 19 nt, Homo sapiens
ccaagaacagccuuuauug

SEQ ID NO: 942589 - RNA, 19 nt, Homo sapiens
cgaugacacuguuuauaga

SEQ ID NO: 942590 - RNA, 19 nt, Homo sapiens
ugaacuugguuugaucuua

SEQ ID NO: 942591 - RNA, 19 nt, Homo sapiens
ucucguaucuguaccuuug

SEQ ID NO: 942592 - RNA, 19 nt, Homo sapiens
gaagccgccugguaaaaua

SEQ ID NO: 942593 - RNA, 19 nt, Homo sapiens
gaaagcaguaaaugcauug

SEQ ID NO: 942594 - RNA, 19 nt, Homo sapiens
ugaggagccuaguaauaaa

SEQ ID NO: 942595 - RNA, 19 nt, Homo sapiens
aaauagaggcugaccuuaa

SEQ ID NO: 942596 - RNA, 19 nt, Homo sapiens
augaagagcuccuuaguca

SEQ ID NO: 942597 - RNA, 19 nt, Homo sapiens
guaaaugcauugaugucau

SEQ ID NO: 942598 - RNA, 19 nt, Homo sapiens
ccagauuaguaaccucuuu

SEQ ID NO: 942599 - RNA, 19 nt, Homo sapiens
gagagguacucaaacaagu

SEQ ID NO: 942600 - RNA, 19 nt, Homo sapiens
uguguaagcuggaaucugu

SEQ ID NO: 942601 - RNA, 19 nt, Homo sapiens
ccaaugacacuuucaacaa

SEQ ID NO: 942602 - RNA, 19 nt, Homo sapiens
gaaucugaaugccgcuauu

SEQ ID NO: 942603 - RNA, 19 nt, Homo sapiens
gcacacaccaaaugauaau

SEQ ID NO: 942604 - RNA, 19 nt, Homo sapiens
gccaagaacagccuuuauu

SEQ ID NO: 942605 - RNA, 19 nt, Homo sapiens
ucagcuagccagauuagua

SEQ ID NO: 942606 - RNA, 19 nt, Homo sapiens
ggauggagagguacucaaa

SEQ ID NO: 942607 - RNA, 19 nt, Homo sapiens
cagcaacaaugagagaauu

SEQ ID NO: 942608 - RNA, 19 nt, Homo sapiens
aagaagacuugauagaaga

SEQ ID NO: 942609 - RNA, 19 nt, Homo sapiens
gaagagcucccugcaagug

SEQ ID NO: 942610 - RNA, 19 nt, Homo sapiens
gcaacaaugagagaauuaa

SEQ ID NO: 942611 - RNA, 19 nt, Homo sapiens
gaagaaggccagaaagacu

SEQ ID NO: 942612 - RNA, 19 nt, Homo sapiens
gcagacagaagcagaggaa

SEQ ID NO: 942613 - RNA, 19 nt, Homo sapiens
agaaagcaguaaaugcauu

SEQ ID NO: 942614 - RNA, 19 nt, Homo sapiens
cacaggagaggaagaauuu

SEQ ID NO: 942615 - RNA, 19 nt, Homo sapiens
gaggaacucaucuguguau

SEQ ID NO: 942616 - RNA, 19 nt, Homo sapiens
caaggaagagagaacauga

SEQ ID NO: 942617 - RNA, 19 nt, Homo sapiens
caagaaggcccuguauuca

SEQ ID NO: 942618 - RNA, 19 nt, Homo sapiens
acaagaaggcccuguauuc

SEQ ID NO: 942619 - RNA, 19 nt, Homo sapiens
gcucugaaucuuuaacuga

SEQ ID NO: 942620 - RNA, 19 nt, Homo sapiens
gaucuuacucaacuagaaa

SEQ ID NO: 942621 - RNA, 19 nt, Homo sapiens
ggaacucaucuguguauug

SEQ ID NO: 942622 - RNA, 19 nt, Homo sapiens
aaacaaaacuugagcagau

SEQ ID NO: 942623 - RNA, 19 nt, Homo sapiens
aaacagcaguggcuuaacu

SEQ ID NO: 942624 - RNA, 19 nt, Homo sapiens
gaaacucuccauaaugaca

SEQ ID NO: 942625 - RNA, 19 nt, Homo sapiens
gaagguggucaaugaaugu

SEQ ID NO: 942626 - RNA, 19 nt, Homo sapiens
caagacuggugaaucugaa

SEQ ID NO: 942627 - RNA, 19 nt, Homo sapiens
aacuagaucucuggaauuu

SEQ ID NO: 942628 - RNA, 19 nt, Homo sapiens
aaagaaagcaguaaaugca

SEQ ID NO: 942629 - RNA, 19 nt, Homo sapiens
gcaggcacggugaaaguaa

SEQ ID NO: 942630 - RNA, 19 nt, Homo sapiens
cugaggagccuaguaauaa

SEQ ID NO: 942631 - RNA, 19 nt, Homo sapiens
ucuaauuccucuacaugaa

SEQ ID NO: 942632 - RNA, 19 nt, Homo sapiens
cagcuagccagauuaguaa

SEQ ID NO: 942633 - RNA, 19 nt, Homo sapiens
ugccuaggccuacucauua

SEQ ID NO: 942634 - RNA, 19 nt, Homo sapiens
caggaaagaccaacucaug

SEQ ID NO: 942635 - RNA, 19 nt, Homo sapiens
gguauuagagagagaauca

SEQ ID NO: 942636 - RNA, 19 nt, Homo sapiens
uagacggccuuguaaauag

SEQ ID NO: 942637 - RNA, 19 nt, Homo sapiens
gacagaagcaugugcacuu

SEQ ID NO: 942638 - RNA, 19 nt, Homo sapiens
ccagaaagacucccugauc

SEQ ID NO: 942639 - RNA, 19 nt, Homo sapiens
uggcagaaaucaacaccaa

SEQ ID NO: 942640 - RNA, 19 nt, Homo sapiens
ugacagaacaagaguugaa

SEQ ID NO: 942641 - RNA, 19 nt, Homo sapiens
aaagagguuugucaagugu

SEQ ID NO: 942642 - RNA, 19 nt, Homo sapiens
gcacgaaacggagagauag

SEQ ID NO: 942643 - RNA, 19 nt, Homo sapiens
gcucaucgcucucuauucu

SEQ ID NO: 942644 - RNA, 19 nt, Homo sapiens
gcaaagugcgcucauuuua

SEQ ID NO: 942645 - RNA, 19 nt, Homo sapiens
cauaaucccauucaaagaa

SEQ ID NO: 942646 - RNA, 19 nt, Homo sapiens
gcgguaggcuggguucauu

SEQ ID NO: 942647 - RNA, 19 nt, Homo sapiens
ucaucgcucucuauucuuu

SEQ ID NO: 942648 - RNA, 19 nt, Homo sapiens
acgcgaagcucaccaagau

SEQ ID NO: 942649 - RNA, 19 nt, Homo sapiens
gaagugggcauugcaaagu

SEQ ID NO: 942650 - RNA, 19 nt, Homo sapiens
gaaaggaugacgccucaac

SEQ ID NO: 942651 - RNA, 19 nt, Homo sapiens
ucaaagaauacuagaaugg

SEQ ID NO: 942652 - RNA, 19 nt, Homo sapiens
gcacuuguuccuucugcuu

SEQ ID NO: 942653 - RNA, 19 nt, Homo sapiens
gcgcuucgcccacaacuac

SEQ ID NO: 942654 - RNA, 19 nt, Homo sapiens
caaagaauacuagaauggu

SEQ ID NO: 942655 - RNA, 19 nt, Homo sapiens
gcugggcugugggugcuaa

SEQ ID NO: 942656 - RNA, 19 nt, Homo sapiens
ccauaaucccauucaaaga

SEQ ID NO: 942657 - RNA, 19 nt, Homo sapiens
gcgaagugggcauugcaaa

SEQ ID NO: 942658 - RNA, 19 nt, Homo sapiens
gcauagcggaccacagcuu

SEQ ID NO: 942659 - RNA, 19 nt, Homo sapiens
uugcaaagugcgcucauuu

SEQ ID NO: 942660 - RNA, 19 nt, Homo sapiens
uagcggaccacagcuugua

SEQ ID NO: 942661 - RNA, 19 nt, Homo sapiens
cccauaaucccauucaaag

SEQ ID NO: 942662 - RNA, 19 nt, Homo sapiens
cgaagugggcauugcaaag

SEQ ID NO: 942663 - RNA, 19 nt, Homo sapiens
ggcgaaagaaggccaacga

SEQ ID NO: 942664 - RNA, 19 nt, Homo sapiens
ucugggcgcugacucaaac

SEQ ID NO: 942665 - RNA, 19 nt, Homo sapiens
ggaggaagcggcauuguua

SEQ ID NO: 942666 - RNA, 19 nt, Homo sapiens
gaacagacucuucauuuau

SEQ ID NO: 942667 - RNA, 19 nt, Homo sapiens
gaagaaauguuuggcagau

SEQ ID NO: 942668 - RNA, 19 nt, Homo sapiens
gcagagaggauuuaagaga

SEQ ID NO: 942669 - RNA, 19 nt, Homo sapiens
gcacacaccagcaauguau

SEQ ID NO: 942670 - RNA, 19 nt, Homo sapiens
caccagcaauguauguaua

SEQ ID NO: 942671 - RNA, 19 nt, Homo sapiens
agaaauguuuggcagauga

SEQ ID NO: 942672 - RNA, 19 nt, Homo sapiens
gcagaugagcccaggauga

SEQ ID NO: 942673 - RNA, 19 nt, Homo sapiens
ggaagcggcauuguuauga

SEQ ID NO: 942674 - RNA, 19 nt, Homo sapiens
gugcagagaggauuuaaga

SEQ ID NO: 942675 - RNA, 19 nt, Homo sapiens
ggacgugguucaggccauu

SEQ ID NO: 942676 - RNA, 19 nt, Homo sapiens
cagagaggauuuaagagau

SEQ ID NO: 942677 - RNA, 19 nt, Homo sapiens
ggucauuccuggucacaca

SEQ ID NO: 942678 - RNA, 19 nt, Homo sapiens
uggacgugcuggugaauaa

SEQ ID NO: 942679 - RNA, 19 nt, Homo sapiens
agagaggauuuaagagauu

SEQ ID NO: 942680 - RNA, 19 nt, Homo sapiens
gugcggagaagaaauguuu

SEQ ID NO: 942681 - RNA, 19 nt, Homo sapiens
cagggucaguccagaauug

SEQ ID NO: 942682 - RNA, 19 nt, Homo sapiens
cuaugcagcuuccaaguuc

SEQ ID NO: 942683 - RNA, 19 nt, Homo sapiens
caaccagaccucuucauuc

SEQ ID NO: 942684 - RNA, 19 nt, Homo sapiens
ggaauuggucuggaacuug

SEQ ID NO: 942685 - RNA, 19 nt, Homo sapiens
gaagcggcauuguuaugag

SEQ ID NO: 942686 - RNA, 19 nt, Homo sapiens
ggugaauaaugcuggaaug

SEQ ID NO: 942687 - RNA, 19 nt, Homo sapiens
gagaggauuuaagagauuc

SEQ ID NO: 942688 - RNA, 19 nt, Homo sapiens
ccacaucuaauucaaagga

SEQ ID NO: 942689 - RNA, 19 nt, Homo sapiens
gaacaaccagaccucuuca

SEQ ID NO: 942690 - RNA, 19 nt, Homo sapiens
gaugagcccaggaugaaug

SEQ ID NO: 942691 - RNA, 19 nt, Homo sapiens
cagaugagcccaggaugaa

SEQ ID NO: 942692 - RNA, 19 nt, Homo sapiens
cauucaaccucgugacuuc

SEQ ID NO: 942693 - RNA, 19 nt, Homo sapiens
cagaaggccuuuauuuuca

SEQ ID NO: 942694 - RNA, 19 nt, Homo sapiens
ccagcaauguauguauauu

SEQ ID NO: 942695 - RNA, 19 nt, Homo sapiens
cuggagggauucuucgaaa

SEQ ID NO: 942696 - RNA, 19 nt, Homo sapiens
gaaauguuuggcagaugaa

SEQ ID NO: 942697 - RNA, 19 nt, Homo sapiens
gagcacacaccagcaaugu

SEQ ID NO: 942698 - RNA, 19 nt, Homo sapiens
caggaugaauggucagagu

SEQ ID NO: 942699 - RNA, 19 nt, Homo sapiens
ccucuucauuccacaucua

SEQ ID NO: 942700 - RNA, 19 nt, Homo sapiens
caaccuuggccuucaaugu

SEQ ID NO: 942701 - RNA, 19 nt, Homo sapiens
ggaugaauggucagaguca

SEQ ID NO: 942702 - RNA, 19 nt, Homo sapiens
gagcagaugagcccaggau

SEQ ID NO: 942703 - RNA, 19 nt, Homo sapiens
gaggugcagagaggauuua

SEQ ID NO: 942704 - RNA, 19 nt, Homo sapiens
ucccagaaggccuuuauuu

SEQ ID NO: 942705 - RNA, 19 nt, Homo sapiens
uauaguaggugcggagaag

SEQ ID NO: 942706 - RNA, 19 nt, Homo sapiens
cugagacccugcacuacuu

SEQ ID NO: 942707 - RNA, 19 nt, Homo sapiens
gaucuccggcugcucauca

SEQ ID NO: 942708 - RNA, 19 nt, Homo sapiens
acaaccagaccucuucauu

SEQ ID NO: 942709 - RNA, 19 nt, Homo sapiens
ugaacaaccagaccucuuc

SEQ ID NO: 942710 - RNA, 19 nt, Homo sapiens
cuucaacgaugucuaugca

SEQ ID NO: 942711 - RNA, 19 nt, Homo sapiens
gcauuguuaugagccuuga

SEQ ID NO: 942712 - RNA, 19 nt, Homo sapiens
gaggaagcggcauuguuau

SEQ ID NO: 942713 - RNA, 19 nt, Homo sapiens
gcaguucaacaucuucauc

SEQ ID NO: 942714 - RNA, 19 nt, Homo sapiens
ccagaaggccuuuauuuuc

SEQ ID NO: 942715 - RNA, 19 nt, Homo sapiens
ccaugcagaaugucuuuga

SEQ ID NO: 942716 - RNA, 19 nt, Homo sapiens
guuaggagggagcagauga

SEQ ID NO: 942717 - RNA, 19 nt, Homo sapiens
acagacucuucauuuauuc

SEQ ID NO: 942718 - RNA, 19 nt, Homo sapiens
caaaggaugaacagacucu

SEQ ID NO: 942719 - RNA, 19 nt, Homo sapiens
cuucauuccacaucuaauu

SEQ ID NO: 942720 - RNA, 19 nt, Homo sapiens
ccucaaccuuggccuucaa

SEQ ID NO: 942721 - RNA, 19 nt, Homo sapiens
ggaagccacagcugucucu

SEQ ID NO: 942722 - RNA, 19 nt, Homo sapiens
aaccagaccucuucauucc

SEQ ID NO: 942723 - RNA, 19 nt, Homo sapiens
cagaacagagcuucacgau

SEQ ID NO: 942724 - RNA, 19 nt, Homo sapiens
caaccucgugacuucauga

SEQ ID NO: 942725 - RNA, 19 nt, Homo sapiens
ucgaaagccucgcuaucca

SEQ ID NO: 942726 - RNA, 19 nt, Homo sapiens
ggagggauucuucgaaagc

SEQ ID NO: 942727 - RNA, 19 nt, Homo sapiens
cccagugucucagcuguau

SEQ ID NO: 942728 - RNA, 19 nt, Homo sapiens
cggcugcucaucaggaauu

SEQ ID NO: 942729 - RNA, 19 nt, Homo sapiens
ucacacacuccaucagcaa

SEQ ID NO: 942730 - RNA, 19 nt, Homo sapiens
ccugcagggugucaucuuc

SEQ ID NO: 942731 - RNA, 19 nt, Homo sapiens
guggugaucagcaguguca

SEQ ID NO: 942732 - RNA, 19 nt, Homo sapiens
gggaagcccagagcaggaa

SEQ ID NO: 942733 - RNA, 19 nt, Homo sapiens
gacgugcuggugaauaaug

SEQ ID NO: 942734 - RNA, 19 nt, Homo sapiens
ucuaugcagcuuccaaguu

SEQ ID NO: 942735 - RNA, 19 nt, Homo sapiens
ggugaucagcagugucaug

SEQ ID NO: 942736 - RNA, 19 nt, Homo sapiens
aagaaauguuuggcagaug

SEQ ID NO: 942737 - RNA, 19 nt, Homo sapiens
cauuccacaucuaauucaa

SEQ ID NO: 942738 - RNA, 19 nt, Homo sapiens
gauauuaccucuucuguua

SEQ ID NO: 942739 - RNA, 19 nt, Homo sapiens
gaagauagcuugcaccaaa

SEQ ID NO: 942740 - RNA, 19 nt, Homo sapiens
ggacuuacccuuuagguuu

SEQ ID NO: 942741 - RNA, 19 nt, Homo sapiens
uaaagggacuuaagaguga

SEQ ID NO: 942742 - RNA, 19 nt, Homo sapiens
gaaacgcacuuuggacuuu

SEQ ID NO: 942743 - RNA, 19 nt, Homo sapiens
gaaccagacucucccugua

SEQ ID NO: 942744 - RNA, 19 nt, Homo sapiens
gaaauaaugccacaguaaa

SEQ ID NO: 942745 - RNA, 19 nt, Homo sapiens
ucaauacccugcacuuuaa

SEQ ID NO: 942746 - RNA, 19 nt, Homo sapiens
gaacagacuuagcuaaugg

SEQ ID NO: 942747 - RNA, 19 nt, Homo sapiens
gauugggacuuacccuuua

SEQ ID NO: 942748 - RNA, 19 nt, Homo sapiens
ggagaugucuggagcugaa

SEQ ID NO: 942749 - RNA, 19 nt, Homo sapiens
gauguuggcugcuguacuu

SEQ ID NO: 942750 - RNA, 19 nt, Homo sapiens
cagcaaacaucauucaaga

SEQ ID NO: 942751 - RNA, 19 nt, Homo sapiens
gggaacaacuggcuauuca

SEQ ID NO: 942752 - RNA, 19 nt, Homo sapiens
gggcagaagugaaggaaga

SEQ ID NO: 942753 - RNA, 19 nt, Homo sapiens
gcaaacaucaccugucuug

SEQ ID NO: 942754 - RNA, 19 nt, Homo sapiens
gaaagucccagcugaauuc

SEQ ID NO: 942755 - RNA, 19 nt, Homo sapiens
caacaaagaguaccuagga

SEQ ID NO: 942756 - RNA, 19 nt, Homo sapiens
gcaauaaagggacuuaaga

SEQ ID NO: 942757 - RNA, 19 nt, Homo sapiens
ccaguucccuucuuuauag

SEQ ID NO: 942758 - RNA, 19 nt, Homo sapiens
gaagacauguacacacaca

SEQ ID NO: 942759 - RNA, 19 nt, Homo sapiens
ggaagaauaggaaggauau

SEQ ID NO: 942760 - RNA, 19 nt, Homo sapiens
ggacaaaccagaggaguga

SEQ ID NO: 942761 - RNA, 19 nt, Homo sapiens
gcugaauucuugcccuuaa

SEQ ID NO: 942762 - RNA, 19 nt, Homo sapiens
gcauaggacucggcagaaa

SEQ ID NO: 942763 - RNA, 19 nt, Homo sapiens
ggacaagggaggcguggua

SEQ ID NO: 942764 - RNA, 19 nt, Homo sapiens
gucaauacccugcacuuua

SEQ ID NO: 942765 - RNA, 19 nt, Homo sapiens
gaccugaguuugagcuuga

SEQ ID NO: 942766 - RNA, 19 nt, Homo sapiens
cccaguauguuaagagaua

SEQ ID NO: 942767 - RNA, 19 nt, Homo sapiens
guucuuaucugcaggugaa

SEQ ID NO: 942768 - RNA, 19 nt, Homo sapiens
ggaggacacuggucauuac

SEQ ID NO: 942769 - RNA, 19 nt, Homo sapiens
ggagacauccucaggcauu

SEQ ID NO: 942770 - RNA, 19 nt, Homo sapiens
cagaagacauguacacaca

SEQ ID NO: 942771 - RNA, 19 nt, Homo sapiens
ggaaggauccucauuucug

SEQ ID NO: 942772 - RNA, 19 nt, Homo sapiens
cagaaauaaugccacagua

SEQ ID NO: 942773 - RNA, 19 nt, Homo sapiens
gagcucaggugaagauaag

SEQ ID NO: 942774 - RNA, 19 nt, Homo sapiens
cacuagagauugggacuua

SEQ ID NO: 942775 - RNA, 19 nt, Homo sapiens
gaaauggccucuccccaaa

SEQ ID NO: 942776 - RNA, 19 nt, Homo sapiens
cgaaacugguggugacaaa

SEQ ID NO: 942777 - RNA, 19 nt, Homo sapiens
gagaucaguuuguaaggau

SEQ ID NO: 942778 - RNA, 19 nt, Homo sapiens
caagaguaaugguguggaa

SEQ ID NO: 942779 - RNA, 19 nt, Homo sapiens
ucuuuaaucucccuuguuu

SEQ ID NO: 942780 - RNA, 19 nt, Homo sapiens
ggaagaagaggaggaagaa

SEQ ID NO: 942781 - RNA, 19 nt, Homo sapiens
uacaagggccacagaaaua

SEQ ID NO: 942782 - RNA, 19 nt, Homo sapiens
gcagaacagacuuagcuaa

SEQ ID NO: 942783 - RNA, 19 nt, Homo sapiens
guacuuacucccugaggua

SEQ ID NO: 942784 - RNA, 19 nt, Homo sapiens
acagucagauucuucuaaa

SEQ ID NO: 942785 - RNA, 19 nt, Homo sapiens
ccaaggauggcucuucuaa

SEQ ID NO: 942786 - RNA, 19 nt, Homo sapiens
uaaucucccuuguuucuug

SEQ ID NO: 942787 - RNA, 19 nt, Homo sapiens
cagagcuccuggccaguua

SEQ ID NO: 942788 - RNA, 19 nt, Homo sapiens
gaaggaagaauaggaagga

SEQ ID NO: 942789 - RNA, 19 nt, Homo sapiens
gaaagacaucccaggagaa

SEQ ID NO: 942790 - RNA, 19 nt, Homo sapiens
cagcacagauggcagaaca

SEQ ID NO: 942791 - RNA, 19 nt, Homo sapiens
uuuagcugcuugaucauua

SEQ ID NO: 942792 - RNA, 19 nt, Homo sapiens
gccacucucucuuugguuu

SEQ ID NO: 942793 - RNA, 19 nt, Homo sapiens
ccaguggccuagaccauga

SEQ ID NO: 942794 - RNA, 19 nt, Homo sapiens
gaucuccuaccucuccuua

SEQ ID NO: 942795 - RNA, 19 nt, Homo sapiens
gauacaagggccacagaaa

SEQ ID NO: 942796 - RNA, 19 nt, Homo sapiens
ggacgagaucaguuuguaa

SEQ ID NO: 942797 - RNA, 19 nt, Homo sapiens
gaaagucgaggcacagaca

SEQ ID NO: 942798 - RNA, 19 nt, Homo sapiens
ccacacacauacauacaca

SEQ ID NO: 942799 - RNA, 19 nt, Homo sapiens
uaagagugaacaagaguaa

SEQ ID NO: 942800 - RNA, 19 nt, Homo sapiens
gaacagugaguccaaagca

SEQ ID NO: 942801 - RNA, 19 nt, Homo sapiens
gaacaauggaguacucaag

SEQ ID NO: 942802 - RNA, 19 nt, Homo sapiens
gaaugagaacaauggagua

SEQ ID NO: 942803 - RNA, 19 nt, Homo sapiens
gaagucaucgcugggagua

SEQ ID NO: 942804 - RNA, 19 nt, Homo sapiens
caagauccaaccaagaauu

SEQ ID NO: 942805 - RNA, 19 nt, Homo sapiens
caaagaguaccuaggaaug

SEQ ID NO: 942806 - RNA, 19 nt, Homo sapiens
agaaauaaugccacaguaa

SEQ ID NO: 942807 - RNA, 19 nt, Homo sapiens
uuaggaggcuugagaaugg

SEQ ID NO: 942808 - RNA, 19 nt, Homo sapiens
uaaaaggcgucaauuucua

SEQ ID NO: 942809 - RNA, 19 nt, Homo sapiens
aaacaucaccugucuugug

SEQ ID NO: 942810 - RNA, 19 nt, Homo sapiens
ggccuuacuucagugauaa

SEQ ID NO: 942811 - RNA, 19 nt, Homo sapiens
gaagauaaggacucugaca

SEQ ID NO: 942812 - RNA, 19 nt, Homo sapiens
cgaguggucuguguuccua

SEQ ID NO: 942813 - RNA, 19 nt, Homo sapiens
gcacagauggcagaacaga

SEQ ID NO: 942814 - RNA, 19 nt, Homo sapiens
cacaagauccaaccaagaa

SEQ ID NO: 942815 - RNA, 19 nt, Homo sapiens
cagaagugaaggaagaaua

SEQ ID NO: 942816 - RNA, 19 nt, Homo sapiens
cagugaaucuacagaccua

SEQ ID NO: 942817 - RNA, 19 nt, Homo sapiens
acaauggaguacucaagaa

SEQ ID NO: 942818 - RNA, 19 nt, Homo sapiens
cgagaucaguuuguaagga

SEQ ID NO: 942819 - RNA, 19 nt, Homo sapiens
ccauugaccugagacaaga

SEQ ID NO: 942820 - RNA, 19 nt, Homo sapiens
acagagagcucaggugaag

SEQ ID NO: 942821 - RNA, 19 nt, Homo sapiens
gggaauguguggugaucga

SEQ ID NO: 942822 - RNA, 19 nt, Homo sapiens
ucauuaaucuaaggacuga

SEQ ID NO: 942823 - RNA, 19 nt, Homo sapiens
acacauacauacacacucu

SEQ ID NO: 942824 - RNA, 19 nt, Homo sapiens
ggagugaaccaacaaagag

SEQ ID NO: 942825 - RNA, 19 nt, Homo sapiens
ccagaggagugaaccaaca

SEQ ID NO: 942826 - RNA, 19 nt, Homo sapiens
cauacugguugugucaaua

SEQ ID NO: 942827 - RNA, 19 nt, Homo sapiens
ucacuuuccuuuccaccuu

SEQ ID NO: 942828 - RNA, 19 nt, Homo sapiens
gacagucagauucuucuaa

SEQ ID NO: 942829 - RNA, 19 nt, Homo sapiens
ucuuaucacuggucacuga

SEQ ID NO: 942830 - RNA, 19 nt, Homo sapiens
ggugagcgguagugacugu

SEQ ID NO: 942831 - RNA, 19 nt, Homo sapiens
gaucaguuuguaaggauuu

SEQ ID NO: 942832 - RNA, 19 nt, Homo sapiens
uguauacgaucuaugugaa

SEQ ID NO: 942833 - RNA, 19 nt, Homo sapiens
gugaagauaaggacucuga

SEQ ID NO: 942834 - RNA, 19 nt, Homo sapiens
agucccagcugaauucuug

SEQ ID NO: 942835 - RNA, 19 nt, Homo sapiens
agaacagacuuagcuaaug

SEQ ID NO: 942836 - RNA, 19 nt, Homo sapiens
gccaguucccuucuuuaua

SEQ ID NO: 942837 - RNA, 19 nt, Homo sapiens
aaagggagcagcacagaug

SEQ ID NO: 942838 - RNA, 19 nt, Homo sapiens
cuaaggagcugcagcgaua

SEQ ID NO: 942839 - RNA, 19 nt, Homo sapiens
gcaagaggcuguacgugaa

SEQ ID NO: 942840 - RNA, 19 nt, Homo sapiens
gaaugaagcucuggaaauc

SEQ ID NO: 942841 - RNA, 19 nt, Homo sapiens
gaauuugaguccuaaagaa

SEQ ID NO: 942842 - RNA, 19 nt, Homo sapiens
cggcaugccuggcuuguuu

SEQ ID NO: 942843 - RNA, 19 nt, Homo sapiens
ucaaugucaucacucaaua

SEQ ID NO: 942844 - RNA, 19 nt, Homo sapiens
guggagggcugucguuuga

SEQ ID NO: 942845 - RNA, 19 nt, Homo sapiens
ccaaagcccuccggagcua

SEQ ID NO: 942846 - RNA, 19 nt, Homo sapiens
ugauggaacucauggagaa

SEQ ID NO: 942847 - RNA, 19 nt, Homo sapiens
cucaaagccugcaucaaua

SEQ ID NO: 942848 - RNA, 19 nt, Homo sapiens
gcgaguggguguggaauug

SEQ ID NO: 942849 - RNA, 19 nt, Homo sapiens
ggaauuugaguccuaaaga

SEQ ID NO: 942850 - RNA, 19 nt, Homo sapiens
ccucaaagccugcaucaau

SEQ ID NO: 942851 - RNA, 19 nt, Homo sapiens
ggccaucuacuuugucaua

SEQ ID NO: 942852 - RNA, 19 nt, Homo sapiens
gagcugggccuccucauca

SEQ ID NO: 942853 - RNA, 19 nt, Homo sapiens
gaguggaauuugaguccua

SEQ ID NO: 942854 - RNA, 19 nt, Homo sapiens
gaaagugucgcucaagucu

SEQ ID NO: 942855 - RNA, 19 nt, Homo sapiens
gcgagaaccuggccuucau

SEQ ID NO: 942856 - RNA, 19 nt, Homo sapiens
ucacuuccauccaucucua

SEQ ID NO: 942857 - RNA, 19 nt, Homo sapiens
acaaaggcgugccggugua

SEQ ID NO: 942858 - RNA, 19 nt, Homo sapiens
cgaaaagucuuccucaaug

SEQ ID NO: 942859 - RNA, 19 nt, Homo sapiens
gaaaagccuucgaaagugu

SEQ ID NO: 942860 - RNA, 19 nt, Homo sapiens
gcagaaccauggaggaaaa

SEQ ID NO: 942861 - RNA, 19 nt, Homo sapiens
uggcaucggucacauugaa

SEQ ID NO: 942862 - RNA, 19 nt, Homo sapiens
ucaaagccugcaucaauaa

SEQ ID NO: 942863 - RNA, 19 nt, Homo sapiens
gagaaugaagcucuggaaa

SEQ ID NO: 942864 - RNA, 19 nt, Homo sapiens
gcagcuccauggaaaucaa

SEQ ID NO: 942865 - RNA, 19 nt, Homo sapiens
ggaaaagccuucgaaagug

SEQ ID NO: 942866 - RNA, 19 nt, Homo sapiens
gcuggaggccaucuacuuu

SEQ ID NO: 942867 - RNA, 19 nt, Homo sapiens
gggaccacuuccugacuaa

SEQ ID NO: 942868 - RNA, 19 nt, Homo sapiens
gaaaagucuuccucaaugu

SEQ ID NO: 942869 - RNA, 19 nt, Homo sapiens
ggaacuggcugcgaguagu

SEQ ID NO: 942870 - RNA, 19 nt, Homo sapiens
guacaaggccagccacaag

SEQ ID NO: 942871 - RNA, 19 nt, Homo sapiens
caucuacuuugucauagug

SEQ ID NO: 942872 - RNA, 19 nt, Homo sapiens
gaggccaucuacuuuguca

SEQ ID NO: 942873 - RNA, 19 nt, Homo sapiens
caccggagcuaguaagagu

SEQ ID NO: 942874 - RNA, 19 nt, Homo sapiens
ggagaaugaagcucuggaa

SEQ ID NO: 942875 - RNA, 19 nt, Homo sapiens
gcgcuggucuugcuuuacu

SEQ ID NO: 942876 - RNA, 19 nt, Homo sapiens
uaaaagagucgaugcauga

SEQ ID NO: 942877 - RNA, 19 nt, Homo sapiens
ggagggcugucguuugaac

SEQ ID NO: 942878 - RNA, 19 nt, Homo sapiens
ugucaucacucaauauugc

SEQ ID NO: 942879 - RNA, 19 nt, Homo sapiens
gcacccaggucggucaagu

SEQ ID NO: 942880 - RNA, 19 nt, Homo sapiens
caaagccugcaucaauaaa

SEQ ID NO: 942881 - RNA, 19 nt, Homo sapiens
gaacuggcugcgaguagug

SEQ ID NO: 942882 - RNA, 19 nt, Homo sapiens
agaaugaagcucuggaaau

SEQ ID NO: 942883 - RNA, 19 nt, Homo sapiens
ggacacugcaucccagauc

SEQ ID NO: 942884 - RNA, 19 nt, Homo sapiens
caucggcuauggcaaugug

SEQ ID NO: 942885 - RNA, 19 nt, Homo sapiens
ucacgacugugccucaaag

SEQ ID NO: 942886 - RNA, 19 nt, Homo sapiens
aagugucgcucaagucuuc

SEQ ID NO: 942887 - RNA, 19 nt, Homo sapiens
aagccugcaucaauaaaug

SEQ ID NO: 942888 - RNA, 19 nt, Homo sapiens
gaucggcugccugcucuuu

SEQ ID NO: 942889 - RNA, 19 nt, Homo sapiens
gggcagaaccauggaggaa

SEQ ID NO: 942890 - RNA, 19 nt, Homo sapiens
uggcgcuggucuugcuuua

SEQ ID NO: 942891 - RNA, 19 nt, Homo sapiens
cgcggcagcuccauggaaa

SEQ ID NO: 942892 - RNA, 19 nt, Homo sapiens
gcccuucccucacuuccau

SEQ ID NO: 942893 - RNA, 19 nt, Homo sapiens
ccucagugcucaccaccau

SEQ ID NO: 942894 - RNA, 19 nt, Homo sapiens
ggaccaucaucaccaccau

SEQ ID NO: 942895 - RNA, 19 nt, Homo sapiens
ucgaaagugucgcucaagu

SEQ ID NO: 942896 - RNA, 19 nt, Homo sapiens
agggaccacuuccugacua

SEQ ID NO: 942897 - RNA, 19 nt, Homo sapiens
ccuccggagcuaccaguua

SEQ ID NO: 942898 - RNA, 19 nt, Homo sapiens
uggaggccaucuacuuugu

SEQ ID NO: 942899 - RNA, 19 nt, Homo sapiens
gcaagcuggaggccaucua

SEQ ID NO: 942900 - RNA, 19 nt, Homo sapiens
gaggcuguacgugaauuaa

SEQ ID NO: 942901 - RNA, 19 nt, Homo sapiens
caaugucaucacucaauau

SEQ ID NO: 942902 - RNA, 19 nt, Homo sapiens
gagcgugcauagcgacacu

SEQ ID NO: 942903 - RNA, 19 nt, Homo sapiens
ucaagucucggcccucuca

SEQ ID NO: 942904 - RNA, 19 nt, Homo sapiens
cauggcaucggucacauug

SEQ ID NO: 942905 - RNA, 19 nt, Homo sapiens
aagagucgaugcaugaaaa

SEQ ID NO: 942906 - RNA, 19 nt, Homo sapiens
ccauccgaguggaauuuga

SEQ ID NO: 942907 - RNA, 19 nt, Homo sapiens
caucgaagggcucaagaag

SEQ ID NO: 942908 - RNA, 19 nt, Homo sapiens
gaucggcagggaccacuuc

SEQ ID NO: 942909 - RNA, 19 nt, Homo sapiens
gcgccucuucugcaucuuu

SEQ ID NO: 942910 - RNA, 19 nt, Homo sapiens
aaagagucgaugcaugaaa

SEQ ID NO: 942911 - RNA, 19 nt, Homo sapiens
ggcuguacgugaauuaaaa

SEQ ID NO: 942912 - RNA, 19 nt, Homo sapiens
caagaggcuguacgugaau

SEQ ID NO: 942913 - RNA, 19 nt, Homo sapiens
ggccgcaacauuagcaaga

SEQ ID NO: 942914 - RNA, 19 nt, Homo sapiens
cuucgaaagugucgcucaa

SEQ ID NO: 942915 - RNA, 19 nt, Homo sapiens
ccaucuacuuugucauagu

SEQ ID NO: 942916 - RNA, 19 nt, Homo sapiens
cgaaagugucgcucaaguc

SEQ ID NO: 942917 - RNA, 19 nt, Homo sapiens
ggagcaagaggcuguacgu

SEQ ID NO: 942918 - RNA, 19 nt, Homo sapiens
ugguggagcuggaguugca

SEQ ID NO: 942919 - RNA, 19 nt, Homo sapiens
gugcggacccagaaaccaa

SEQ ID NO: 942920 - RNA, 19 nt, Homo sapiens
cuccggagcuaccaguuag

SEQ ID NO: 942921 - RNA, 19 nt, Homo sapiens
uggaaauccucaccaaagc

SEQ ID NO: 942922 - RNA, 19 nt, Homo sapiens
caucaccaccaucggcuau

SEQ ID NO: 942923 - RNA, 19 nt, Homo sapiens
ggcagaaccauggaggaaa

SEQ ID NO: 942924 - RNA, 19 nt, Homo sapiens
gcaugccuggcuuguuuga

SEQ ID NO: 942925 - RNA, 19 nt, Homo sapiens
cggcaugccuggcuuguuu

SEQ ID NO: 942926 - RNA, 19 nt, Homo sapiens
cucaaagccugcaucaaua

SEQ ID NO: 942927 - RNA, 19 nt, Homo sapiens
ccucaaagccugcaucaau

SEQ ID NO: 942928 - RNA, 19 nt, Homo sapiens
ggccaucuacuuugucaua

SEQ ID NO: 942929 - RNA, 19 nt, Homo sapiens
gagcugggccuccucauca

SEQ ID NO: 942930 - RNA, 19 nt, Homo sapiens
gcgagaaccuggccuucau

SEQ ID NO: 942931 - RNA, 19 nt, Homo sapiens
ucacuuccauccaucucua

SEQ ID NO: 942932 - RNA, 19 nt, Homo sapiens
acaaaggcgugccggugua

SEQ ID NO: 942933 - RNA, 19 nt, Homo sapiens
uggcaucggucacauugaa

SEQ ID NO: 942934 - RNA, 19 nt, Homo sapiens
ucaaagccugcaucaauaa

SEQ ID NO: 942935 - RNA, 19 nt, Homo sapiens
gcuggaggccaucuacuuu

SEQ ID NO: 942936 - RNA, 19 nt, Homo sapiens
ggaacuggcugcgaguagu

SEQ ID NO: 942937 - RNA, 19 nt, Homo sapiens
caucuacuuugucauagug

SEQ ID NO: 942938 - RNA, 19 nt, Homo sapiens
gaggccaucuacuuuguca

SEQ ID NO: 942939 - RNA, 19 nt, Homo sapiens
caccggagcuaguaagagu

SEQ ID NO: 942940 - RNA, 19 nt, Homo sapiens
gcgcuggucuugcuuuacu

SEQ ID NO: 942941 - RNA, 19 nt, Homo sapiens
caaagccugcaucaauaaa

SEQ ID NO: 942942 - RNA, 19 nt, Homo sapiens
gaacuggcugcgaguagug

SEQ ID NO: 942943 - RNA, 19 nt, Homo sapiens
ucacgacugugccucaaag

SEQ ID NO: 942944 - RNA, 19 nt, Homo sapiens
caucggcuauggcaaugug

SEQ ID NO: 942945 - RNA, 19 nt, Homo sapiens
aagccugcaucaauaaaug

SEQ ID NO: 942946 - RNA, 19 nt, Homo sapiens
gaucggcugccugcucuuu

SEQ ID NO: 942947 - RNA, 19 nt, Homo sapiens
acacugggcuccgguccaa

SEQ ID NO: 942948 - RNA, 19 nt, Homo sapiens
uggcgcuggucuugcuuua

SEQ ID NO: 942949 - RNA, 19 nt, Homo sapiens
gcccuucccucacuuccau

SEQ ID NO: 942950 - RNA, 19 nt, Homo sapiens
ccucagugcucaccaccau

SEQ ID NO: 942951 - RNA, 19 nt, Homo sapiens
ggaccaucaucaccaccau

SEQ ID NO: 942952 - RNA, 19 nt, Homo sapiens
uggaggccaucuacuuugu

SEQ ID NO: 942953 - RNA, 19 nt, Homo sapiens
gcaagcuggaggccaucua

SEQ ID NO: 942954 - RNA, 19 nt, Homo sapiens
cauggcaucggucacauug

SEQ ID NO: 942955 - RNA, 19 nt, Homo sapiens
gcgccucuucugcaucuuu

SEQ ID NO: 942956 - RNA, 19 nt, Homo sapiens
ccaucuacuuugucauagu

SEQ ID NO: 942957 - RNA, 19 nt, Homo sapiens
gugcggacccagaaaccaa

SEQ ID NO: 942958 - RNA, 19 nt, Homo sapiens
gcaugccuggcuuguuuga

SEQ ID NO: 942959 - RNA, 19 nt, Homo sapiens
caucaccaccaucggcuau

SEQ ID NO: 942960 - RNA, 19 nt, Homo sapiens
cggcaugccuggcuuguuu

SEQ ID NO: 942961 - RNA, 19 nt, Homo sapiens
cucaaagccugcaucaaua

SEQ ID NO: 942962 - RNA, 19 nt, Homo sapiens
ccucaaagccugcaucaau

SEQ ID NO: 942963 - RNA, 19 nt, Homo sapiens
ggccaucuacuuugucaua

SEQ ID NO: 942964 - RNA, 19 nt, Homo sapiens
gagcugggccuccucauca

SEQ ID NO: 942965 - RNA, 19 nt, Homo sapiens
gcgagaaccuggccuucau

SEQ ID NO: 942966 - RNA, 19 nt, Homo sapiens
ucacuuccauccaucucua

SEQ ID NO: 942967 - RNA, 19 nt, Homo sapiens
acaaaggcgugccggugua

SEQ ID NO: 942968 - RNA, 19 nt, Homo sapiens
uggcaucggucacauugaa

SEQ ID NO: 942969 - RNA, 19 nt, Homo sapiens
ucaaagccugcaucaauaa

SEQ ID NO: 942970 - RNA, 19 nt, Homo sapiens
gcuggaggccaucuacuuu

SEQ ID NO: 942971 - RNA, 19 nt, Homo sapiens
ggaacuggcugcgaguagu

SEQ ID NO: 942972 - RNA, 19 nt, Homo sapiens
caucuacuuugucauagug

SEQ ID NO: 942973 - RNA, 19 nt, Homo sapiens
gaggccaucuacuuuguca

SEQ ID NO: 942974 - RNA, 19 nt, Homo sapiens
caccggagcuaguaagagu

SEQ ID NO: 942975 - RNA, 19 nt, Homo sapiens
ucggugcccuccucucuuu

SEQ ID NO: 942976 - RNA, 19 nt, Homo sapiens
gcgcuggucuugcuuuacu

SEQ ID NO: 942977 - RNA, 19 nt, Homo sapiens
caaagccugcaucaauaaa

SEQ ID NO: 942978 - RNA, 19 nt, Homo sapiens
gaacuggcugcgaguagug

SEQ ID NO: 942979 - RNA, 19 nt, Homo sapiens
ucacgacugugccucaaag

SEQ ID NO: 942980 - RNA, 19 nt, Homo sapiens
caucggcuauggcaaugug

SEQ ID NO: 942981 - RNA, 19 nt, Homo sapiens
aagccugcaucaauaaaug

SEQ ID NO: 942982 - RNA, 19 nt, Homo sapiens
gaucggcugccugcucuuu

SEQ ID NO: 942983 - RNA, 19 nt, Homo sapiens
uggcgcuggucuugcuuua

SEQ ID NO: 942984 - RNA, 19 nt, Homo sapiens
gcccuucccucacuuccau

SEQ ID NO: 942985 - RNA, 19 nt, Homo sapiens
ccucagugcucaccaccau

SEQ ID NO: 942986 - RNA, 19 nt, Homo sapiens
ggaccaucaucaccaccau

SEQ ID NO: 942987 - RNA, 19 nt, Homo sapiens
uggaggccaucuacuuugu

SEQ ID NO: 942988 - RNA, 19 nt, Homo sapiens
gcaagcuggaggccaucua

SEQ ID NO: 942989 - RNA, 19 nt, Homo sapiens
cauggcaucggucacauug

SEQ ID NO: 942990 - RNA, 19 nt, Homo sapiens
gcgccucuucugcaucuuu

SEQ ID NO: 942991 - RNA, 19 nt, Homo sapiens
ccaucuacuuugucauagu

SEQ ID NO: 942992 - RNA, 19 nt, Homo sapiens
ugucaggccagcucaguga

SEQ ID NO: 942993 - RNA, 19 nt, Homo sapiens
gugcggacccagaaaccaa

SEQ ID NO: 942994 - RNA, 19 nt, Homo sapiens
gcaugccuggcuuguuuga

SEQ ID NO: 942995 - RNA, 19 nt, Homo sapiens
caucaccaccaucggcuau

SEQ ID NO: 942996 - RNA, 19 nt, Homo sapiens
gaacauagguggaguaaug

SEQ ID NO: 942997 - RNA, 19 nt, Homo sapiens
ggaagacgcguuaauauua

SEQ ID NO: 942998 - RNA, 19 nt, Homo sapiens
gaagagaaaucugacuuaa

SEQ ID NO: 942999 - RNA, 19 nt, Homo sapiens
gaucuggguuggugaauuu

SEQ ID NO: 943000 - RNA, 19 nt, Homo sapiens
uaacauggguccaguagga

SEQ ID NO: 943001 - RNA, 19 nt, Homo sapiens
ccaauagauuucauccuua

SEQ ID NO: 943002 - RNA, 19 nt, Homo sapiens
guaagaaggccaauagauu

SEQ ID NO: 943003 - RNA, 19 nt, Homo sapiens
gaaauuaaaggaaguguuc

SEQ ID NO: 943004 - RNA, 19 nt, Homo sapiens
gauguucgcuuggaucgua

SEQ ID NO: 943005 - RNA, 19 nt, Homo sapiens
uaagaaggccaauagauuu

SEQ ID NO: 943006 - RNA, 19 nt, Homo sapiens
gccaauagauuucauccuu

SEQ ID NO: 943007 - RNA, 19 nt, Homo sapiens
agagaaaucugacuuaaag

SEQ ID NO: 943008 - RNA, 19 nt, Homo sapiens
agacuugguuccacaauuu

SEQ ID NO: 943009 - RNA, 19 nt, Homo sapiens
gacaugaaauggcaagcua

SEQ ID NO: 943010 - RNA, 19 nt, Homo sapiens
gaaguaagaaggccaauag

SEQ ID NO: 943011 - RNA, 19 nt, Homo sapiens
gaaauggcaagcuauuaaa

SEQ ID NO: 943012 - RNA, 19 nt, Homo sapiens
gcaagcaauugaagcaguu

SEQ ID NO: 943013 - RNA, 19 nt, Homo sapiens
gaaaggagcaucgauaugg

SEQ ID NO: 943014 - RNA, 19 nt, Homo sapiens
guaaagaaagcccuagaaa

SEQ ID NO: 943015 - RNA, 19 nt, Homo sapiens
cagcaagucuggucauuca

SEQ ID NO: 943016 - RNA, 19 nt, Homo sapiens
aauaggaucuucuaacaug

SEQ ID NO: 943017 - RNA, 19 nt, Homo sapiens
uaaagaggauccugaugga

SEQ ID NO: 943018 - RNA, 19 nt, Homo sapiens
caccuuccauucucaauaa

SEQ ID NO: 943019 - RNA, 19 nt, Homo sapiens
gaacaggaacaucauuuca

SEQ ID NO: 943020 - RNA, 19 nt, Homo sapiens
ggaagaaauuaaaggaagu

SEQ ID NO: 943021 - RNA, 19 nt, Homo sapiens
agaaagcccuagaaacuau

SEQ ID NO: 943022 - RNA, 19 nt, Homo sapiens
ugaaauggcaagcuauuaa

SEQ ID NO: 943023 - RNA, 19 nt, Homo sapiens
aaagagaaauucagucagu

SEQ ID NO: 943024 - RNA, 19 nt, Homo sapiens
gaaaauggaugacaagucu

SEQ ID NO: 943025 - RNA, 19 nt, Homo sapiens
caaaguugguuggaagaaa

SEQ ID NO: 943026 - RNA, 19 nt, Homo sapiens
gaauuuaccaccuuccauu

SEQ ID NO: 943027 - RNA, 19 nt, Homo sapiens
ggaucguaaugcauaauuu

SEQ ID NO: 943028 - RNA, 19 nt, Homo sapiens
ggaaugagagagagaauag

SEQ ID NO: 943029 - RNA, 19 nt, Homo sapiens
gaaagcgggcaguuauaaa

SEQ ID NO: 943030 - RNA, 19 nt, Homo sapiens
caacaucccauaugacaug

SEQ ID NO: 943031 - RNA, 19 nt, Homo sapiens
ggacuggaccggaugaguu

SEQ ID NO: 943032 - RNA, 19 nt, Homo sapiens
gaaaucugacuuaaaggaa

SEQ ID NO: 943033 - RNA, 19 nt, Homo sapiens
ugacuugacuuggcagaaa

SEQ ID NO: 943034 - RNA, 19 nt, Homo sapiens
caaaggcaaccagauauuu

SEQ ID NO: 943035 - RNA, 19 nt, Homo sapiens
uaaaggaaguguucagcau

SEQ ID NO: 943036 - RNA, 19 nt, Homo sapiens
gaaaguuggugagguuaca

SEQ ID NO: 943037 - RNA, 19 nt, Homo sapiens
agagaaaguuggugagguu

SEQ ID NO: 943038 - RNA, 19 nt, Homo sapiens
gauagaaugggaccaggua

SEQ ID NO: 943039 - RNA, 19 nt, Homo sapiens
gaaugggcacugucacuuu

SEQ ID NO: 943040 - RNA, 19 nt, Homo sapiens
aaagaaagcccuagaaacu

SEQ ID NO: 943041 - RNA, 19 nt, Homo sapiens
ggaggaaugaauagaauug

SEQ ID NO: 943042 - RNA, 19 nt, Homo sapiens
acaagucuguuccucauga

SEQ ID NO: 943043 - RNA, 19 nt, Homo sapiens
uggaauaagugguggaaug

SEQ ID NO: 943044 - RNA, 19 nt, Homo sapiens
ggagcgagauuucggacau

SEQ ID NO: 943045 - RNA, 19 nt, Homo sapiens
caauuucuauguucaaugg

SEQ ID NO: 943046 - RNA, 19 nt, Homo sapiens
uggauuaagucgaggcuuu

SEQ ID NO: 943047 - RNA, 19 nt, Homo sapiens
gggaggauuuggaggaguu

SEQ ID NO: 943048 - RNA, 19 nt, Homo sapiens
ccuagaaacuaugaacaaa

SEQ ID NO: 943049 - RNA, 19 nt, Homo sapiens
cauguaauguuugcagaaa

SEQ ID NO: 943050 - RNA, 19 nt, Homo sapiens
uuagcaacaucccauauga

SEQ ID NO: 943051 - RNA, 19 nt, Homo sapiens
ggaaaggagcaucgauaug

SEQ ID NO: 943052 - RNA, 19 nt, Homo sapiens
gaauagcaugggaggauuu

SEQ ID NO: 943053 - RNA, 19 nt, Homo sapiens
ucaagcaauuucuauguuc

SEQ ID NO: 943054 - RNA, 19 nt, Homo sapiens
ggaaguaagaaggccaaua

SEQ ID NO: 943055 - RNA, 19 nt, Homo sapiens
caucccauaugacaugaaa

SEQ ID NO: 943056 - RNA, 19 nt, Homo sapiens
agaagagaaaucugacuua

SEQ ID NO: 943057 - RNA, 19 nt, Homo sapiens
aguaggaucuggaauaagu

SEQ ID NO: 943058 - RNA, 19 nt, Homo sapiens
ggaguaaugggaaauuuag

SEQ ID NO: 943059 - RNA, 19 nt, Homo sapiens
caagcaauuucuauguuca

SEQ ID NO: 943060 - RNA, 19 nt, Homo sapiens
gcagaggaaugggcacugu

SEQ ID NO: 943061 - RNA, 19 nt, Homo sapiens
ugaaagcgggcaguuauaa

SEQ ID NO: 943062 - RNA, 19 nt, Homo sapiens
aaaguugguuggaagaaau

SEQ ID NO: 943063 - RNA, 19 nt, Homo sapiens
gcgaacaggaacaucauuu

SEQ ID NO: 943064 - RNA, 19 nt, Homo sapiens
ucaguguggucauguaaug

SEQ ID NO: 943065 - RNA, 19 nt, Homo sapiens
ugacuuggcagaaacuaaa

SEQ ID NO: 943066 - RNA, 19 nt, Homo sapiens
ugacaagucuguuccucau

SEQ ID NO: 943067 - RNA, 19 nt, Homo sapiens
caagucuggucauucaguu

SEQ ID NO: 943068 - RNA, 19 nt, Homo sapiens
ucagaaaucuaccuuuuga

SEQ ID NO: 943069 - RNA, 19 nt, Homo sapiens
ggucuggaagcaaugaaua

SEQ ID NO: 943070 - RNA, 19 nt, Homo sapiens
cggaugaguuccagcuuug

SEQ ID NO: 943071 - RNA, 19 nt, Homo sapiens
gcaguucaagcaauuucua

SEQ ID NO: 943072 - RNA, 19 nt, Homo sapiens
ggaacaucauuucaaggau

SEQ ID NO: 943073 - RNA, 19 nt, Homo sapiens
uuacauacguggagcucuu

SEQ ID NO: 943074 - RNA, 19 nt, Homo sapiens
ggcaagcuauuaaagaucu

SEQ ID NO: 943075 - RNA, 19 nt, Homo sapiens
ccaaaucguaacagaguuu

SEQ ID NO: 943076 - RNA, 19 nt, Homo sapiens
ccaaaggcaaccagauauu

SEQ ID NO: 943077 - RNA, 19 nt, Homo sapiens
ggaucuggguuggugaauu

SEQ ID NO: 943078 - RNA, 19 nt, Homo sapiens
gacagcaagucuggucauu

SEQ ID NO: 943079 - RNA, 19 nt, Homo sapiens
gaucguaaugcauaauuuc

SEQ ID NO: 943080 - RNA, 19 nt, Homo sapiens
gcuuggaucguaaugcaua

SEQ ID NO: 943081 - RNA, 19 nt, Homo sapiens
aaaggaaguguucagcaua

SEQ ID NO: 943082 - RNA, 19 nt, Homo sapiens
guuguggugugguugaauu

SEQ ID NO: 943083 - RNA, 19 nt, Homo sapiens
gaaaagaaggguccaaauc

SEQ ID NO: 943084 - RNA, 19 nt, Homo sapiens
ccggaugaguuccagcuuu

SEQ ID NO: 943085 - RNA, 19 nt, Homo sapiens
cagcuccaauggcguuaaa

SEQ ID NO: 943086 - RNA, 19 nt, Homo sapiens
gggauuacaggaagaauag

SEQ ID NO: 943087 - RNA, 19 nt, Homo sapiens
gcagcgaacaggaacauca

SEQ ID NO: 943088 - RNA, 19 nt, Homo sapiens
gcaagcuauuaaagaucua

SEQ ID NO: 943089 - RNA, 19 nt, Homo sapiens
uagaaugggaccagguaua

SEQ ID NO: 943090 - RNA, 19 nt, Homo sapiens
uuucggacaucgugauauu

SEQ ID NO: 943091 - RNA, 19 nt, Homo sapiens
guggaguaaugggaaauuu

SEQ ID NO: 943092 - RNA, 19 nt, Homo sapiens
caaaagaagagaaaucuga

SEQ ID NO: 943093 - RNA, 19 nt, Homo sapiens
acaggaacaucauuucaag

SEQ ID NO: 943094 - RNA, 19 nt, Homo sapiens
uggaagacgcguuaauauu

SEQ ID NO: 943095 - RNA, 19 nt, Homo sapiens
ggaagcggaaugagagaga

SEQ ID NO: 943096 - RNA, 19 nt, Homo sapiens
cagauacccugaagcauaa

SEQ ID NO: 943097 - RNA, 19 nt, Homo sapiens
ccagauacccugaagcaua

SEQ ID NO: 943098 - RNA, 19 nt, Homo sapiens
gagcagaagaggccagaua

SEQ ID NO: 943099 - RNA, 19 nt, Homo sapiens
acacucgacuccauaauau

SEQ ID NO: 943100 - RNA, 19 nt, Homo sapiens
gauuucauccucagacgua

SEQ ID NO: 943101 - RNA, 19 nt, Homo sapiens
gaaggcgguuccguucuga

SEQ ID NO: 943102 - RNA, 19 nt, Homo sapiens
gcagggcuauggcaacuac

SEQ ID NO: 943103 - RNA, 19 nt, Homo sapiens
cacacucgacuccauaaua

SEQ ID NO: 943104 - RNA, 19 nt, Homo sapiens
ucaagaaggagaacaagau

SEQ ID NO: 943105 - RNA, 19 nt, Homo sapiens
caagaaggagaacaagaug

SEQ ID NO: 943106 - RNA, 19 nt, Homo sapiens
aauaauugccugcuucaga

SEQ ID NO: 943107 - RNA, 19 nt, Homo sapiens
gauguauguucacaccaau

SEQ ID NO: 943108 - RNA, 19 nt, Homo sapiens
cggcaggcuuggaggcuaa

SEQ ID NO: 943109 - RNA, 19 nt, Homo sapiens
cagcuuugauuccaaggau

SEQ ID NO: 943110 - RNA, 19 nt, Homo sapiens
agauguauguucacaccaa

SEQ ID NO: 943111 - RNA, 19 nt, Homo sapiens
cagaggcuaauauaacaaa

SEQ ID NO: 943112 - RNA, 19 nt, Homo sapiens
gguaaccagucucagaaac

SEQ ID NO: 943113 - RNA, 19 nt, Homo sapiens
caagugcgcagacgagaag

SEQ ID NO: 943114 - RNA, 19 nt, Homo sapiens
uguauguucacaccaauaa

SEQ ID NO: 943115 - RNA, 19 nt, Homo sapiens
gcuggagcuuagugacuug

SEQ ID NO: 943116 - RNA, 19 nt, Homo sapiens
ugaacagcuuugauuccaa

SEQ ID NO: 943117 - RNA, 19 nt, Homo sapiens
ggccagauacccugaagca

SEQ ID NO: 943118 - RNA, 19 nt, Homo sapiens
ccaccaagggcgagaagau

SEQ ID NO: 943119 - RNA, 19 nt, Homo sapiens
uucagaggcuaauauaaca

SEQ ID NO: 943120 - RNA, 19 nt, Homo sapiens
uuagugacuuggacgacuu

SEQ ID NO: 943121 - RNA, 19 nt, Homo sapiens
gacguaaugcucaccaaca

SEQ ID NO: 943122 - RNA, 19 nt, Homo sapiens
gaggccagauacccugaag

SEQ ID NO: 943123 - RNA, 19 nt, Homo sapiens
gcacuugcacugaguugac

SEQ ID NO: 943124 - RNA, 19 nt, Homo sapiens
gcuucagaggcuaauauaa

SEQ ID NO: 943125 - RNA, 19 nt, Homo sapiens
gcacacucgacuccauaau

SEQ ID NO: 943126 - RNA, 19 nt, Homo sapiens
caccaggacuccccgguaa

SEQ ID NO: 943127 - RNA, 19 nt, Homo sapiens
caaggaugguucgggaucu

SEQ ID NO: 943128 - RNA, 19 nt, Homo sapiens
cuucagaggcuaauauaac

SEQ ID NO: 943129 - RNA, 19 nt, Homo sapiens
gucaaaaguuuaacaugga

SEQ ID NO: 943130 - RNA, 19 nt, Homo sapiens
ccaagaugacccucacaca

SEQ ID NO: 943131 - RNA, 19 nt, Homo sapiens
gaucaugcuggccaucauc

SEQ ID NO: 943132 - RNA, 19 nt, Homo sapiens
ggacuccugggaacaugga

SEQ ID NO: 943133 - RNA, 19 nt, Homo sapiens
cugaacagcuuugauucca

SEQ ID NO: 943134 - RNA, 19 nt, Homo sapiens
guaaccagucucagaaacu

SEQ ID NO: 943135 - RNA, 19 nt, Homo sapiens
ccgguaaccagucucagaa

SEQ ID NO: 943136 - RNA, 19 nt, Homo sapiens
ggauugacauauuguguua

SEQ ID NO: 943137 - RNA, 19 nt, Homo sapiens
gcuaugaauugcacuguga

SEQ ID NO: 943138 - RNA, 19 nt, Homo sapiens
gccauuaaagcagaaauua

SEQ ID NO: 943139 - RNA, 19 nt, Homo sapiens
caagucaauucauaaccaa

SEQ ID NO: 943140 - RNA, 19 nt, Homo sapiens
ucucagauguguugaagca

SEQ ID NO: 943141 - RNA, 19 nt, Homo sapiens
aaagcacucuucccucuca

SEQ ID NO: 943142 - RNA, 19 nt, Homo sapiens
ucaagucaauucauaacca

SEQ ID NO: 943143 - RNA, 19 nt, Homo sapiens
uuugaacgcugcuaugaau

SEQ ID NO: 943144 - RNA, 19 nt, Homo sapiens
cuuaagcucuguccaccuu

SEQ ID NO: 943145 - RNA, 19 nt, Homo sapiens
gcacucuucccucucaguu

SEQ ID NO: 943146 - RNA, 19 nt, Homo sapiens
gaacgcugcuaugaauugc

SEQ ID NO: 943147 - RNA, 19 nt, Homo sapiens
ugaacgcugcuaugaauug

SEQ ID NO: 943148 - RNA, 19 nt, Homo sapiens
ugaaugcacaucucucaga

SEQ ID NO: 943149 - RNA, 19 nt, Homo sapiens
agucaacccuucacacagu

SEQ ID NO: 943150 - RNA, 19 nt, Homo sapiens
gucaauucauaaccaaguu

SEQ ID NO: 943151 - RNA, 19 nt, Homo sapiens
ucuaaucacuggcuuucuc

SEQ ID NO: 943152 - RNA, 19 nt, Homo sapiens
uaagcucuguccaccuuca

SEQ ID NO: 943153 - RNA, 19 nt, Homo sapiens
gcucuuuguuaaacuccaa

SEQ ID NO: 943154 - RNA, 19 nt, Homo sapiens
gaauccaggugcugaaacc

SEQ ID NO: 943155 - RNA, 19 nt, Homo sapiens
ucacuggcuuucucaagag

SEQ ID NO: 943156 - RNA, 19 nt, Homo sapiens
aaagucaacccuucacaca

SEQ ID NO: 943157 - RNA, 19 nt, Homo sapiens
guugaagcauccauugcau

SEQ ID NO: 943158 - RNA, 19 nt, Homo sapiens
aagcauccauugcauccau

SEQ ID NO: 943159 - RNA, 19 nt, Homo sapiens
guagaauccaggugcugaa

SEQ ID NO: 943160 - RNA, 19 nt, Homo sapiens
uaugaaugcacaucucuca

SEQ ID NO: 943161 - RNA, 19 nt, Homo sapiens
accuucaagucaauucaua

SEQ ID NO: 943162 - RNA, 19 nt, Homo sapiens
gcauccauugcauccauuu

SEQ ID NO: 943163 - RNA, 19 nt, Homo sapiens
uucccaugcucuuuguuaa

SEQ ID NO: 943164 - RNA, 19 nt, Homo sapiens
uuucccaugcucuuuguua

SEQ ID NO: 943165 - RNA, 19 nt, Homo sapiens
gucaacccuucacacaguu

SEQ ID NO: 943166 - RNA, 19 nt, Homo sapiens
guaaacagguguaccaaua

SEQ ID NO: 943167 - RNA, 19 nt, Homo sapiens
gaucugcccugauaaauaa

SEQ ID NO: 943168 - RNA, 19 nt, Homo sapiens
ggaaacacuucauucuuua

SEQ ID NO: 943169 - RNA, 19 nt, Homo sapiens
gaaaucaucuaguguguug

SEQ ID NO: 943170 - RNA, 19 nt, Homo sapiens
gaaagcaacuggauuuaca

SEQ ID NO: 943171 - RNA, 19 nt, Homo sapiens
caaauucacugcugccuuu

SEQ ID NO: 943172 - RNA, 19 nt, Homo sapiens
gaaacaagccgucuuacaa

SEQ ID NO: 943173 - RNA, 19 nt, Homo sapiens
ggagaaauguguguaacua

SEQ ID NO: 943174 - RNA, 19 nt, Homo sapiens
gcaacuggauuuacagauu

SEQ ID NO: 943175 - RNA, 19 nt, Homo sapiens
gaacagaaaccaacaagau

SEQ ID NO: 943176 - RNA, 19 nt, Homo sapiens
cugaaugacuguucuaaua

SEQ ID NO: 943177 - RNA, 19 nt, Homo sapiens
gaaaauaccuguguacuga

SEQ ID NO: 943178 - RNA, 19 nt, Homo sapiens
caacuggauuuacagauuu

SEQ ID NO: 943179 - RNA, 19 nt, Homo sapiens
ucaagagacuaaaggcuua

SEQ ID NO: 943180 - RNA, 19 nt, Homo sapiens
gcaccaaaguugaaugaau

SEQ ID NO: 943181 - RNA, 19 nt, Homo sapiens
uaagaugcaucguuugaaa

SEQ ID NO: 943182 - RNA, 19 nt, Homo sapiens
caugauagguuaacaagga

SEQ ID NO: 943183 - RNA, 19 nt, Homo sapiens
cuaaggaugugccaaauga

SEQ ID NO: 943184 - RNA, 19 nt, Homo sapiens
cauggcauauuuacucuua

SEQ ID NO: 943185 - RNA, 19 nt, Homo sapiens
guacugaggguuaugauuu

SEQ ID NO: 943186 - RNA, 19 nt, Homo sapiens
ugacucagguuaagaaaug

SEQ ID NO: 943187 - RNA, 19 nt, Homo sapiens
uaagaugacuuguuuccuu

SEQ ID NO: 943188 - RNA, 19 nt, Homo sapiens
caccaaaguugaaugaauu

SEQ ID NO: 943189 - RNA, 19 nt, Homo sapiens
caaaugauucggauacuaa

SEQ ID NO: 943190 - RNA, 19 nt, Homo sapiens
ccagaaagcuucaguuacu

SEQ ID NO: 943191 - RNA, 19 nt, Homo sapiens
gcacagaaauuggcguguu

SEQ ID NO: 943192 - RNA, 19 nt, Homo sapiens
auacuaagaugcaucguuu

SEQ ID NO: 943193 - RNA, 19 nt, Homo sapiens
aggaaacacuucauucuuu

SEQ ID NO: 943194 - RNA, 19 nt, Homo sapiens
gaaagaaagcaacuggauu

SEQ ID NO: 943195 - RNA, 19 nt, Homo sapiens
aaagaaagcaacuggauuu

SEQ ID NO: 943196 - RNA, 19 nt, Homo sapiens
aaacagguguaccaauaaa

SEQ ID NO: 943197 - RNA, 19 nt, Homo sapiens
cacagaaauuggcguguua

SEQ ID NO: 943198 - RNA, 19 nt, Homo sapiens
cucaauggcuucugaauga

SEQ ID NO: 943199 - RNA, 19 nt, Homo sapiens
ugugugaucugcccugaua

SEQ ID NO: 943200 - RNA, 19 nt, Homo sapiens
gcgcaucacuacacacuuc

SEQ ID NO: 943201 - RNA, 19 nt, Homo sapiens
uaacuguggcuauuacuuu

SEQ ID NO: 943202 - RNA, 19 nt, Homo sapiens
ccaaaugauucggauacua

SEQ ID NO: 943203 - RNA, 19 nt, Homo sapiens
guauaugcuuuccuacaaa

SEQ ID NO: 943204 - RNA, 19 nt, Homo sapiens
ccaaacuuauggauuauca

SEQ ID NO: 943205 - RNA, 19 nt, Homo sapiens
ugucuuccauggcauauuu

SEQ ID NO: 943206 - RNA, 19 nt, Homo sapiens
gaacauggugagacacuau

SEQ ID NO: 943207 - RNA, 19 nt, Homo sapiens
gaaauuugugcauagauug

SEQ ID NO: 943208 - RNA, 19 nt, Homo sapiens
ccuaagacuucuaguaugu

SEQ ID NO: 943209 - RNA, 19 nt, Homo sapiens
ggagaaagaacucuauugg

SEQ ID NO: 943210 - RNA, 19 nt, Homo sapiens
aaagacauuuccagcauug

SEQ ID NO: 943211 - RNA, 19 nt, Homo sapiens
gaugguugcugauguacug

SEQ ID NO: 943212 - RNA, 19 nt, Homo sapiens
cgucugagcagccauuuaa

SEQ ID NO: 943213 - RNA, 19 nt, Homo sapiens
gauuaucacuagguuauca

SEQ ID NO: 943214 - RNA, 19 nt, Homo sapiens
gaugacuuguuuccuuuga

SEQ ID NO: 943215 - RNA, 19 nt, Homo sapiens
aaaguuacaugucauuugg

SEQ ID NO: 943216 - RNA, 19 nt, Homo sapiens
aaagagcauuugguaguaa

SEQ ID NO: 943217 - RNA, 19 nt, Homo sapiens
ggccgagucuauaacauug

SEQ ID NO: 943218 - RNA, 19 nt, Homo sapiens
ggcagaagcccuagauaga

SEQ ID NO: 943219 - RNA, 19 nt, Homo sapiens
aagaugacuuguuuccuuu

SEQ ID NO: 943220 - RNA, 19 nt, Homo sapiens
cuauguauaugcuuuccua

SEQ ID NO: 943221 - RNA, 19 nt, Homo sapiens
gauuuggcccuauguauau

SEQ ID NO: 943222 - RNA, 19 nt, Homo sapiens
uaaacagguguaccaauaa

SEQ ID NO: 943223 - RNA, 19 nt, Homo sapiens
guaagcauacuuuguuguu

SEQ ID NO: 943224 - RNA, 19 nt, Homo sapiens
caacaagauuuggcccuau

SEQ ID NO: 943225 - RNA, 19 nt, Homo sapiens
ggaacauggugagacacua

SEQ ID NO: 943226 - RNA, 19 nt, Homo sapiens
gcauuugguaguaaucuaa

SEQ ID NO: 943227 - RNA, 19 nt, Homo sapiens
acagaaaccaacaagauuu

SEQ ID NO: 943228 - RNA, 19 nt, Homo sapiens
gacuaaaggcuuaugaaga

SEQ ID NO: 943229 - RNA, 19 nt, Homo sapiens
acacagugauuaaccugaa

SEQ ID NO: 943230 - RNA, 19 nt, Homo sapiens
ucaguuaugacucagguua

SEQ ID NO: 943231 - RNA, 19 nt, Homo sapiens
ugaaauaccaaacuuaugg

SEQ ID NO: 943232 - RNA, 19 nt, Homo sapiens
acaagucguuauugccuuu

SEQ ID NO: 943233 - RNA, 19 nt, Homo sapiens
aaggaugguugcugaugua

SEQ ID NO: 943234 - RNA, 19 nt, Homo sapiens
agcgaugucugaaccuuua

SEQ ID NO: 943235 - RNA, 19 nt, Homo sapiens
aaugaaacaagccgucuua

SEQ ID NO: 943236 - RNA, 19 nt, Homo sapiens
ggaccaggaaagugaguuu

SEQ ID NO: 943237 - RNA, 19 nt, Homo sapiens
ucagaaauuugugcauaga

SEQ ID NO: 943238 - RNA, 19 nt, Homo sapiens
guaugcaguuauccucaaa

SEQ ID NO: 943239 - RNA, 19 nt, Homo sapiens
ccacaaagaagccagaaag

SEQ ID NO: 943240 - RNA, 19 nt, Homo sapiens
cagagacgguuaucaagag

SEQ ID NO: 943241 - RNA, 19 nt, Homo sapiens
gaaauaccaaacuuaugga

SEQ ID NO: 943242 - RNA, 19 nt, Homo sapiens
auugauaccuguuagcauu

SEQ ID NO: 943243 - RNA, 19 nt, Homo sapiens
acaaggaccaggaaaguga

SEQ ID NO: 943244 - RNA, 19 nt, Homo sapiens
uuucauaacuguggcuauu

SEQ ID NO: 943245 - RNA, 19 nt, Homo sapiens
ggcccuauguauaugcuuu

SEQ ID NO: 943246 - RNA, 19 nt, Homo sapiens
ggaaacauucuccggaaca

SEQ ID NO: 943247 - RNA, 19 nt, Homo sapiens
uaaccugaaugugcccuuu

SEQ ID NO: 943248 - RNA, 19 nt, Homo sapiens
ccuuugaggucauuaaaca

SEQ ID NO: 943249 - RNA, 19 nt, Homo sapiens
guugugaaauaccaaacuu

SEQ ID NO: 943250 - RNA, 19 nt, Homo sapiens
ugaucugcccugauaaaua

SEQ ID NO: 943251 - RNA, 19 nt, Homo sapiens
ugacucggcuggcccuuca

SEQ ID NO: 943252 - RNA, 19 nt, Homo sapiens
gagaaauguguguaacuau

SEQ ID NO: 943253 - RNA, 19 nt, Homo sapiens
agauuuggcccuauguaua

SEQ ID NO: 943254 - RNA, 19 nt, Homo sapiens
acuaaaggcuuaugaagac

SEQ ID NO: 943255 - RNA, 19 nt, Homo sapiens
uaucagaucgacacaguga

SEQ ID NO: 943256 - RNA, 19 nt, Homo sapiens
uaugagagauggaggaaaa

SEQ ID NO: 943257 - RNA, 19 nt, Homo sapiens
uggcauaaauagcaaucaa

SEQ ID NO: 943258 - RNA, 19 nt, Homo sapiens
aagcauacuuuguuguuag

SEQ ID NO: 943259 - RNA, 19 nt, Homo sapiens
aaaggaugguugcugaugu

SEQ ID NO: 943260 - RNA, 19 nt, Homo sapiens
ggaguucuuuguuccugau

SEQ ID NO: 943261 - RNA, 19 nt, Homo sapiens
uaacaaggaccaggaaagu

SEQ ID NO: 943262 - RNA, 19 nt, Homo sapiens
aagcauacuuucaguuuac

SEQ ID NO: 943263 - RNA, 19 nt, Homo sapiens
gagaaaauacguaaucaga

SEQ ID NO: 943264 - RNA, 19 nt, Homo sapiens
gagacuaaaggcuuaugaa

SEQ ID NO: 943265 - RNA, 19 nt, Homo sapiens
ccagagacgguuaucaaga

SEQ ID NO: 943266 - RNA, 19 nt, Homo sapiens
ggaaauaugugucucagua

SEQ ID NO: 943267 - RNA, 19 nt, Homo sapiens
ccacugcucugaagaagua

SEQ ID NO: 943268 - RNA, 19 nt, Homo sapiens
uaaagaagcuuccuacagu

SEQ ID NO: 943269 - RNA, 19 nt, Homo sapiens
gauggaauaugcaaucuug

SEQ ID NO: 943270 - RNA, 19 nt, Homo sapiens
ucaaacagguuaaaggaaa

SEQ ID NO: 943271 - RNA, 19 nt, Homo sapiens
caaguuaggugagaaggua

SEQ ID NO: 943272 - RNA, 19 nt, Homo sapiens
gaagaaguauguccuagag

SEQ ID NO: 943273 - RNA, 19 nt, Homo sapiens
gcaaauccaccaugaagaa

SEQ ID NO: 943274 - RNA, 19 nt, Homo sapiens
guggaagccugauggaaua

SEQ ID NO: 943275 - RNA, 19 nt, Homo sapiens
agacauaaguucagaggaa

SEQ ID NO: 943276 - RNA, 19 nt, Homo sapiens
ggccucagcuguugaagaa

SEQ ID NO: 943277 - RNA, 19 nt, Homo sapiens
gaaccaauucuaacuauca

SEQ ID NO: 943278 - RNA, 19 nt, Homo sapiens
gauccacgcggacaaguua

SEQ ID NO: 943279 - RNA, 19 nt, Homo sapiens
ggaguucuguuuccgaaga

SEQ ID NO: 943280 - RNA, 19 nt, Homo sapiens
gagaugaggaugaagauga

SEQ ID NO: 943281 - RNA, 19 nt, Homo sapiens
gaagaaagagccagaugau

SEQ ID NO: 943282 - RNA, 19 nt, Homo sapiens
ugagaaagaucagucuaaa

SEQ ID NO: 943283 - RNA, 19 nt, Homo sapiens
aaauaagucuucugaggaa

SEQ ID NO: 943284 - RNA, 19 nt, Homo sapiens
guccaaaccugcaccuaaa

SEQ ID NO: 943285 - RNA, 19 nt, Homo sapiens
gaagagccgccaccuaaga

SEQ ID NO: 943286 - RNA, 19 nt, Homo sapiens
agaaguauguccuagagaa

SEQ ID NO: 943287 - RNA, 19 nt, Homo sapiens
agaaagaucagucuaaaga

SEQ ID NO: 943288 - RNA, 19 nt, Homo sapiens
gaaucugucuccacuguag

SEQ ID NO: 943289 - RNA, 19 nt, Homo sapiens
ggaugaagaugaagaugag

SEQ ID NO: 943290 - RNA, 19 nt, Homo sapiens
aaacaccgauggcuucuuc

SEQ ID NO: 943291 - RNA, 19 nt, Homo sapiens
gaagaacaagagaaugaaa

SEQ ID NO: 943292 - RNA, 19 nt, Homo sapiens
ggacauuccagcugaagaa

SEQ ID NO: 943293 - RNA, 19 nt, Homo sapiens
acagauaacuggcaaaggu

SEQ ID NO: 943294 - RNA, 19 nt, Homo sapiens
ggagucaucaaacagguua

SEQ ID NO: 943295 - RNA, 19 nt, Homo sapiens
aagagaagguugcagaaga

SEQ ID NO: 943296 - RNA, 19 nt, Homo sapiens
gaaagaucagucuaaagaa

SEQ ID NO: 943297 - RNA, 19 nt, Homo sapiens
agaaagagccagaugauuc

SEQ ID NO: 943298 - RNA, 19 nt, Homo sapiens
agagaagguugcagaagaa

SEQ ID NO: 943299 - RNA, 19 nt, Homo sapiens
uagaagaacaagagaauga

SEQ ID NO: 943300 - RNA, 19 nt, Homo sapiens
guacucgggccuagaaauu

SEQ ID NO: 943301 - RNA, 19 nt, Homo sapiens
gaaagagccagaugauucu

SEQ ID NO: 943302 - RNA, 19 nt, Homo sapiens
caucaggccucagcuguug

SEQ ID NO: 943303 - RNA, 19 nt, Homo sapiens
gaaauaugugucucaguau

SEQ ID NO: 943304 - RNA, 19 nt, Homo sapiens
ccagaagaguggugcauca

SEQ ID NO: 943305 - RNA, 19 nt, Homo sapiens
gugagaagguagaagauag

SEQ ID NO: 943306 - RNA, 19 nt, Homo sapiens
gguccaaaccugcaccuaa

SEQ ID NO: 943307 - RNA, 19 nt, Homo sapiens
ccagaugauucuagagaug

SEQ ID NO: 943308 - RNA, 19 nt, Homo sapiens
gcagaggcuucagagugua

SEQ ID NO: 943309 - RNA, 19 nt, Homo sapiens
gaagcuuccuacagucuca

SEQ ID NO: 943310 - RNA, 19 nt, Homo sapiens
gauccagaaccacaaguaa

SEQ ID NO: 943311 - RNA, 19 nt, Homo sapiens
gaacagauaacuggcaaag

SEQ ID NO: 943312 - RNA, 19 nt, Homo sapiens
aaauagaggagucaucaaa

SEQ ID NO: 943313 - RNA, 19 nt, Homo sapiens
gugcaucagugguugcuau

SEQ ID NO: 943314 - RNA, 19 nt, Homo sapiens
cauccacagucaucaagaa

SEQ ID NO: 943315 - RNA, 19 nt, Homo sapiens
cgaagaaagagccagauga

SEQ ID NO: 943316 - RNA, 19 nt, Homo sapiens
ccgaagaccugcucuacca

SEQ ID NO: 943317 - RNA, 19 nt, Homo sapiens
aaucuuaacugaggccauu

SEQ ID NO: 943318 - RNA, 19 nt, Homo sapiens
uaagaaagcaccuccuaag

SEQ ID NO: 943319 - RNA, 19 nt, Homo sapiens
ccagaaaacagaaagaaua

SEQ ID NO: 943320 - RNA, 19 nt, Homo sapiens
uggaugcaaucuuaacuga

SEQ ID NO: 943321 - RNA, 19 nt, Homo sapiens
gggaaggccgcaucuguga

SEQ ID NO: 943322 - RNA, 19 nt, Homo sapiens
ggaaccaauucuaacuauc

SEQ ID NO: 943323 - RNA, 19 nt, Homo sapiens
caucaaacagguuaaagga

SEQ ID NO: 943324 - RNA, 19 nt, Homo sapiens
agaagacucugaggaugaa

SEQ ID NO: 943325 - RNA, 19 nt, Homo sapiens
gguggaagccugauggaau

SEQ ID NO: 943326 - RNA, 19 nt, Homo sapiens
gacauaaguucagaggaau

SEQ ID NO: 943327 - RNA, 19 nt, Homo sapiens
gcaccuuccagcucuguuu

SEQ ID NO: 943328 - RNA, 19 nt, Homo sapiens
gaaguauguccuagagaau

SEQ ID NO: 943329 - RNA, 19 nt, Homo sapiens
gaaaaggugcuucuuggaa

SEQ ID NO: 943330 - RNA, 19 nt, Homo sapiens
gaaugaagagaaggaagaa

SEQ ID NO: 943331 - RNA, 19 nt, Homo sapiens
ugucuccacuguagaagaa

SEQ ID NO: 943332 - RNA, 19 nt, Homo sapiens
ggugagaagguagaagaua

SEQ ID NO: 943333 - RNA, 19 nt, Homo sapiens
agugguggcuccucaaaga

SEQ ID NO: 943334 - RNA, 19 nt, Homo sapiens
ggauccagaaccacaagua

SEQ ID NO: 943335 - RNA, 19 nt, Homo sapiens
gauagcaccaugccgauuc

SEQ ID NO: 943336 - RNA, 19 nt, Homo sapiens
gggcaaauccaccaugaag

SEQ ID NO: 943337 - RNA, 19 nt, Homo sapiens
gaugaagagccgccaccua

SEQ ID NO: 943338 - RNA, 19 nt, Homo sapiens
agaugaggaugaagaugaa

SEQ ID NO: 943339 - RNA, 19 nt, Homo sapiens
cauuccagcugaagaaauc

SEQ ID NO: 943340 - RNA, 19 nt, Homo sapiens
ccuacagucucaucaggaa

SEQ ID NO: 943341 - RNA, 19 nt, Homo sapiens
gaagagaaggaagaaaaua

SEQ ID NO: 943342 - RNA, 19 nt, Homo sapiens
ccaaaacgccugccaagaa

SEQ ID NO: 943343 - RNA, 19 nt, Homo sapiens
gcacucccacuuauaguag

SEQ ID NO: 943344 - RNA, 19 nt, Homo sapiens
gaacucguccauccuaagg

SEQ ID NO: 943345 - RNA, 19 nt, Homo sapiens
augaagagccgccaccuaa

SEQ ID NO: 943346 - RNA, 19 nt, Homo sapiens
gaagccugauggaauaugc

SEQ ID NO: 943347 - RNA, 19 nt, Homo sapiens
gaagaaaucaggggagaaa

SEQ ID NO: 943348 - RNA, 19 nt, Homo sapiens
ggugaacucguccauccua

SEQ ID NO: 943349 - RNA, 19 nt, Homo sapiens
gaaaacagaaagaauagga

SEQ ID NO: 943350 - RNA, 19 nt, Homo sapiens
uaacagcagaggcuucaga

SEQ ID NO: 943351 - RNA, 19 nt, Homo sapiens
cuaagaaagcaccuccuaa

SEQ ID NO: 943352 - RNA, 19 nt, Homo sapiens
gaaggccgcaucugugaag

SEQ ID NO: 943353 - RNA, 19 nt, Homo sapiens
gcggacaaguuaggugaga

SEQ ID NO: 943354 - RNA, 19 nt, Homo sapiens
ugauacgucucaaggugaa

SEQ ID NO: 943355 - RNA, 19 nt, Homo sapiens
uaggagcucugcaguggau

SEQ ID NO: 943356 - RNA, 19 nt, Homo sapiens
gggguuaucuccuuaaaca

SEQ ID NO: 943357 - RNA, 19 nt, Homo sapiens
gaugagaaagaucagucua

SEQ ID NO: 943358 - RNA, 19 nt, Homo sapiens
agaagaagacucugaggau

SEQ ID NO: 943359 - RNA, 19 nt, Homo sapiens
auagaggagucaucaaaca

SEQ ID NO: 943360 - RNA, 19 nt, Homo sapiens
gugaacucguccauccuaa

SEQ ID NO: 943361 - RNA, 19 nt, Homo sapiens
aggguaugaugaugaaauu

SEQ ID NO: 943362 - RNA, 19 nt, Homo sapiens
aggaaccaauucuaacuau

SEQ ID NO: 943363 - RNA, 19 nt, Homo sapiens
ggaauaugcaaucuugucu

SEQ ID NO: 943364 - RNA, 19 nt, Homo sapiens
ggccuuuacucgccuuugu

SEQ ID NO: 943365 - RNA, 19 nt, Homo sapiens
gaaacuccaccugcuacuu

SEQ ID NO: 943366 - RNA, 19 nt, Homo sapiens
caacagagcucuucagaaa

SEQ ID NO: 943367 - RNA, 19 nt, Homo sapiens
ggaagaaggugauagagua

SEQ ID NO: 943368 - RNA, 19 nt, Homo sapiens
gaacacauuuagucaguuu

SEQ ID NO: 943369 - RNA, 19 nt, Homo sapiens
gaacaucuuucgcguauuc

SEQ ID NO: 943370 - RNA, 19 nt, Homo sapiens
aaacacaacuucagacuug

SEQ ID NO: 943371 - RNA, 19 nt, Homo sapiens
ggaccuaacuaccauaaug

SEQ ID NO: 943372 - RNA, 19 nt, Homo sapiens
ugacagaacccaggaauua

SEQ ID NO: 943373 - RNA, 19 nt, Homo sapiens
gaaaggauuuaacgaagga

SEQ ID NO: 943374 - RNA, 19 nt, Homo sapiens
ugacaaagacugcaaagaa

SEQ ID NO: 943375 - RNA, 19 nt, Homo sapiens
gcaaacaaguauccuaucu

SEQ ID NO: 943376 - RNA, 19 nt, Homo sapiens
aaacaaguauccuaucuuc

SEQ ID NO: 943377 - RNA, 19 nt, Homo sapiens
caaguauccuaucuucuuu

SEQ ID NO: 943378 - RNA, 19 nt, Homo sapiens
uauguaacgugagguauua

SEQ ID NO: 943379 - RNA, 19 nt, Homo sapiens
gagaacacauuuagucagu

SEQ ID NO: 943380 - RNA, 19 nt, Homo sapiens
gaagggaccuaacuaccau

SEQ ID NO: 943381 - RNA, 19 nt, Homo sapiens
ucaaagaaauccucuaaac

SEQ ID NO: 943382 - RNA, 19 nt, Homo sapiens
gaaaauaacccaggaguaa

SEQ ID NO: 943383 - RNA, 19 nt, Homo sapiens
ccacucaacauaaugcuua

SEQ ID NO: 943384 - RNA, 19 nt, Homo sapiens
gaugaccacucaacauaau

SEQ ID NO: 943385 - RNA, 19 nt, Homo sapiens
caagaagguuauauguuug

SEQ ID NO: 943386 - RNA, 19 nt, Homo sapiens
gacaaagacugcaaagaag

SEQ ID NO: 943387 - RNA, 19 nt, Homo sapiens
gauuugagguuguaagcaa

SEQ ID NO: 943388 - RNA, 19 nt, Homo sapiens
caucaaacacucaguuaaa

SEQ ID NO: 943389 - RNA, 19 nt, Homo sapiens
gaaaccagacaaagcauug

SEQ ID NO: 943390 - RNA, 19 nt, Homo sapiens
gaggccauguguaaaguuu

SEQ ID NO: 943391 - RNA, 19 nt, Homo sapiens
gcaguuaugaucaucguuu

SEQ ID NO: 943392 - RNA, 19 nt, Homo sapiens
gagaugaagaugacaaaga

SEQ ID NO: 943393 - RNA, 19 nt, Homo sapiens
ggaacuacaauuagaauag

SEQ ID NO: 943394 - RNA, 19 nt, Homo sapiens
acauaacguugguauauug

SEQ ID NO: 943395 - RNA, 19 nt, Homo sapiens
uagaugaccacucaacaua

SEQ ID NO: 943396 - RNA, 19 nt, Homo sapiens
ccacuaaggauuaucaaga

SEQ ID NO: 943397 - RNA, 19 nt, Homo sapiens
gauuugauaugaaccaaca

SEQ ID NO: 943398 - RNA, 19 nt, Homo sapiens
aaacaaacggaaaggauuu

SEQ ID NO: 943399 - RNA, 19 nt, Homo sapiens
caaacaaacggaaaggauu

SEQ ID NO: 943400 - RNA, 19 nt, Homo sapiens
ggaguacaaagacaaguuu

SEQ ID NO: 943401 - RNA, 19 nt, Homo sapiens
caaagaaauccucuaaaca

SEQ ID NO: 943402 - RNA, 19 nt, Homo sapiens
cauauaaggaguacaaaga

SEQ ID NO: 943403 - RNA, 19 nt, Homo sapiens
caagaaacacaacuucaga

SEQ ID NO: 943404 - RNA, 19 nt, Homo sapiens
gggagaagguggaaauacu

SEQ ID NO: 943405 - RNA, 19 nt, Homo sapiens
gcaacagcccuaugggaaa

SEQ ID NO: 943406 - RNA, 19 nt, Homo sapiens
gaaggauugugggaaauag

SEQ ID NO: 943407 - RNA, 19 nt, Homo sapiens
uggaacaucuuucgcguau

SEQ ID NO: 943408 - RNA, 19 nt, Homo sapiens
caagguggauacuuuacau

SEQ ID NO: 943409 - RNA, 19 nt, Homo sapiens
guugacagcuuauacuucu

SEQ ID NO: 943410 - RNA, 19 nt, Homo sapiens
cauaguccuuguugucauu

SEQ ID NO: 943411 - RNA, 19 nt, Homo sapiens
gaaacacaacuucagacuu

SEQ ID NO: 943412 - RNA, 19 nt, Homo sapiens
acauaaugcuuaagaaugg

SEQ ID NO: 943413 - RNA, 19 nt, Homo sapiens
gaccaaggacuaccaggaa

SEQ ID NO: 943414 - RNA, 19 nt, Homo sapiens
agacaaguuuggaaaguca

SEQ ID NO: 943415 - RNA, 19 nt, Homo sapiens
uaacccaggaguaaaguuu

SEQ ID NO: 943416 - RNA, 19 nt, Homo sapiens
acaaguauccuaucuucuu

SEQ ID NO: 943417 - RNA, 19 nt, Homo sapiens
gaaccaacacauaguccuu

SEQ ID NO: 943418 - RNA, 19 nt, Homo sapiens
ccacaagaagguuauaugu

SEQ ID NO: 943419 - RNA, 19 nt, Homo sapiens
uaacuaccauaaugaaugc

SEQ ID NO: 943420 - RNA, 19 nt, Homo sapiens
gagguuguaagcaaacuaa

SEQ ID NO: 943421 - RNA, 19 nt, Homo sapiens
cagcuuauauugugagaac

SEQ ID NO: 943422 - RNA, 19 nt, Homo sapiens
cuaaauacauaacguuggu

SEQ ID NO: 943423 - RNA, 19 nt, Homo sapiens
gacagaacccaggaauuaa

SEQ ID NO: 943424 - RNA, 19 nt, Homo sapiens
gcaugaaguugcccuuaac

SEQ ID NO: 943425 - RNA, 19 nt, Homo sapiens
aaagaaauccucuaaacag

SEQ ID NO: 943426 - RNA, 19 nt, Homo sapiens
aguguaauuuggcuucaua

SEQ ID NO: 943427 - RNA, 19 nt, Homo sapiens
ggaaaccagacaaagcauu

SEQ ID NO: 943428 - RNA, 19 nt, Homo sapiens
uaagagaaaccacaagaag

SEQ ID NO: 943429 - RNA, 19 nt, Homo sapiens
gaccuaacuaccauaauga

SEQ ID NO: 943430 - RNA, 19 nt, Homo sapiens
ggaaaaggcaaaagaaaga

SEQ ID NO: 943431 - RNA, 19 nt, Homo sapiens
acagagcucuucagaaacu

SEQ ID NO: 943432 - RNA, 19 nt, Homo sapiens
aacgugagguauuaaugua

SEQ ID NO: 943433 - RNA, 19 nt, Homo sapiens
cacucaagguggauacuuu

SEQ ID NO: 943434 - RNA, 19 nt, Homo sapiens
uaacguugguauauugaag

SEQ ID NO: 943435 - RNA, 19 nt, Homo sapiens
agaaggugauagaguagaa

SEQ ID NO: 943436 - RNA, 19 nt, Homo sapiens
gcaacagagcucuucagaa

SEQ ID NO: 943437 - RNA, 19 nt, Homo sapiens
uaacgugagguauuaaugu

SEQ ID NO: 943438 - RNA, 19 nt, Homo sapiens
cgaaggauugugggaaaua

SEQ ID NO: 943439 - RNA, 19 nt, Homo sapiens
aaagacaaguuuggaaagu

SEQ ID NO: 943440 - RNA, 19 nt, Homo sapiens
caaagaagaggaaaacaaa

SEQ ID NO: 943441 - RNA, 19 nt, Homo sapiens
gaagaaggugauagaguag

SEQ ID NO: 943442 - RNA, 19 nt, Homo sapiens
ugcaugaaguugcccuuaa

SEQ ID NO: 943443 - RNA, 19 nt, Homo sapiens
uaugccagcuuauauugug

SEQ ID NO: 943444 - RNA, 19 nt, Homo sapiens
cacuaaggauuaucaagau

SEQ ID NO: 943445 - RNA, 19 nt, Homo sapiens
caacuucagacuugcagaa

SEQ ID NO: 943446 - RNA, 19 nt, Homo sapiens
aguaagauuugagguugua

SEQ ID NO: 943447 - RNA, 19 nt, Homo sapiens
caacagcccuaugggaaac

SEQ ID NO: 943448 - RNA, 19 nt, Homo sapiens
ccaauacaauuuugagcua

SEQ ID NO: 943449 - RNA, 19 nt, Homo sapiens
aagaaauccucuaaacagu

SEQ ID NO: 943450 - RNA, 19 nt, Homo sapiens
cagcaaacaaguauccuau

SEQ ID NO: 943451 - RNA, 19 nt, Homo sapiens
cuucaaagaaauccucuaa

SEQ ID NO: 943452 - RNA, 19 nt, Homo sapiens
gugauagaguagaagaaga

SEQ ID NO: 943453 - RNA, 19 nt, Homo sapiens
gaguaagauuugagguugu

SEQ ID NO: 943454 - RNA, 19 nt, Homo sapiens
gggaguaagauuugagguu

SEQ ID NO: 943455 - RNA, 19 nt, Homo sapiens
guuaaugcuuguccuugga

SEQ ID NO: 943456 - RNA, 19 nt, Homo sapiens
uauaaggaguacaaagaca

SEQ ID NO: 943457 - RNA, 19 nt, Homo sapiens
gcgcagacuuauacauguc

SEQ ID NO: 943458 - RNA, 19 nt, Homo sapiens
ucuaaacagucccggaaau

SEQ ID NO: 943459 - RNA, 19 nt, Homo sapiens
caaacaaguauccuaucuu

SEQ ID NO: 943460 - RNA, 19 nt, Homo sapiens
ucaaggcaguuaugaucau

SEQ ID NO: 943461 - RNA, 19 nt, Homo sapiens
cuaacuaccauaaugaaug

SEQ ID NO: 943462 - RNA, 19 nt, Homo sapiens
gcaaagaagaggaaaacaa

SEQ ID NO: 943463 - RNA, 19 nt, Homo sapiens
ggagaagguggaaauacug

SEQ ID NO: 943464 - RNA, 19 nt, Homo sapiens
aacgaaggauugugggaaa

SEQ ID NO: 943465 - RNA, 19 nt, Homo sapiens
gguggauacuuuacauuuu

SEQ ID NO: 943466 - RNA, 19 nt, Homo sapiens
gacauacgcugacuacuua

SEQ ID NO: 943467 - RNA, 19 nt, Homo sapiens
uaacagaggcucagaagaa

SEQ ID NO: 943468 - RNA, 19 nt, Homo sapiens
gagagaugauucuuucuug

SEQ ID NO: 943469 - RNA, 19 nt, Homo sapiens
uggaagaccuugugauuga

SEQ ID NO: 943470 - RNA, 19 nt, Homo sapiens
ggacauacgcugacuacuu

SEQ ID NO: 943471 - RNA, 19 nt, Homo sapiens
gaauggcagccguuucuua

SEQ ID NO: 943472 - RNA, 19 nt, Homo sapiens
acacuacagucauuucuuu

SEQ ID NO: 943473 - RNA, 19 nt, Homo sapiens
ggaaggguauauagauugu

SEQ ID NO: 943474 - RNA, 19 nt, Homo sapiens
guugagagaugauucuuuc

SEQ ID NO: 943475 - RNA, 19 nt, Homo sapiens
cacccuggcugcuaaagua

SEQ ID NO: 943476 - RNA, 19 nt, Homo sapiens
cgagggagcgccaagauuu

SEQ ID NO: 943477 - RNA, 19 nt, Homo sapiens
gaagggaaggguauauaga

SEQ ID NO: 943478 - RNA, 19 nt, Homo sapiens
cauuacaugucauugagua

SEQ ID NO: 943479 - RNA, 19 nt, Homo sapiens
ucagggagguggcaggaaa

SEQ ID NO: 943480 - RNA, 19 nt, Homo sapiens
caucugucccuguucauua

SEQ ID NO: 943481 - RNA, 19 nt, Homo sapiens
uaaaguguaucccauaugc

SEQ ID NO: 943482 - RNA, 19 nt, Homo sapiens
caugcucucucccuuguuu

SEQ ID NO: 943483 - RNA, 19 nt, Homo sapiens
ucaaauguaggucauguuu

SEQ ID NO: 943484 - RNA, 19 nt, Homo sapiens
cagaggcucagaagaauaa

SEQ ID NO: 943485 - RNA, 19 nt, Homo sapiens
cuagaauccugucacacua

SEQ ID NO: 943486 - RNA, 19 nt, Homo sapiens
ggacauguucauccuagaa

SEQ ID NO: 943487 - RNA, 19 nt, Homo sapiens
gcuggaagaccuugugauu

SEQ ID NO: 943488 - RNA, 19 nt, Homo sapiens
gaaucuuccuccacuaaca

SEQ ID NO: 943489 - RNA, 19 nt, Homo sapiens
gcagaaccaggagcaauuu

SEQ ID NO: 943490 - RNA, 19 nt, Homo sapiens
ggaagggaaggguauauag

SEQ ID NO: 943491 - RNA, 19 nt, Homo sapiens
gauaauccuagguucauga

SEQ ID NO: 943492 - RNA, 19 nt, Homo sapiens
gcucuugcccugcguaaug

SEQ ID NO: 943493 - RNA, 19 nt, Homo sapiens
ucacaguguuugcuuaugg

SEQ ID NO: 943494 - RNA, 19 nt, Homo sapiens
gggaagggaaggguauaua

SEQ ID NO: 943495 - RNA, 19 nt, Homo sapiens
gguccaagucgaauugaaa

SEQ ID NO: 943496 - RNA, 19 nt, Homo sapiens
gggaaggguauauagauug

SEQ ID NO: 943497 - RNA, 19 nt, Homo sapiens
cagcaucugucccuguuca

SEQ ID NO: 943498 - RNA, 19 nt, Homo sapiens
gacuucauguguuccauug

SEQ ID NO: 943499 - RNA, 19 nt, Homo sapiens
ggagucaaauguaggucau

SEQ ID NO: 943500 - RNA, 19 nt, Homo sapiens
cuuaacauguugagagaug

SEQ ID NO: 943501 - RNA, 19 nt, Homo sapiens
ggcagaaccaggagcaauu

SEQ ID NO: 943502 - RNA, 19 nt, Homo sapiens
uaucccauaugcaguguug

SEQ ID NO: 943503 - RNA, 19 nt, Homo sapiens
cugcuaaaguaaaguguau

SEQ ID NO: 943504 - RNA, 19 nt, Homo sapiens
gccaugcucucucccuugu

SEQ ID NO: 943505 - RNA, 19 nt, Homo sapiens
ggugagccgugccaaccaa

SEQ ID NO: 943506 - RNA, 19 nt, Homo sapiens
uggcagccguuucuuaaca

SEQ ID NO: 943507 - RNA, 19 nt, Homo sapiens
guucauuacaugucauuga

SEQ ID NO: 943508 - RNA, 19 nt, Homo sapiens
cuuaagagcucagcaucug

SEQ ID NO: 943509 - RNA, 19 nt, Homo sapiens
gaaccaggagcaauuucug

SEQ ID NO: 943510 - RNA, 19 nt, Homo sapiens
agggaaggguauauagauu

SEQ ID NO: 943511 - RNA, 19 nt, Homo sapiens
aauggcagccguuucuuaa

SEQ ID NO: 943512 - RNA, 19 nt, Homo sapiens
ccaagucgaauugaaagaa

SEQ ID NO: 943513 - RNA, 19 nt, Homo sapiens
gcagaaauaaaucuaugag

SEQ ID NO: 943514 - RNA, 19 nt, Homo sapiens
acgcagaaauaaaucuaug

SEQ ID NO: 943515 - RNA, 19 nt, Homo sapiens
gcaggaaaggcuuggaaca

SEQ ID NO: 943516 - RNA, 19 nt, Homo sapiens
aggagucacuggacauguu

SEQ ID NO: 943517 - RNA, 19 nt, Homo sapiens
caagucgaauugaaagaac

SEQ ID NO: 943518 - RNA, 19 nt, Homo sapiens
aguaaaguguaucccauau

SEQ ID NO: 943519 - RNA, 19 nt, Homo sapiens
gcagccguuucuuaacaug

SEQ ID NO: 943520 - RNA, 19 nt, Homo sapiens
gcauaacccacaggcguuu

SEQ ID NO: 943521 - RNA, 19 nt, Homo sapiens
gagggagcgccaagauuug

SEQ ID NO: 943522 - RNA, 19 nt, Homo sapiens
gcccuuggguccugggaau

SEQ ID NO: 943523 - RNA, 19 nt, Homo sapiens
ucucucccuuguuuccuua

SEQ ID NO: 943524 - RNA, 19 nt, Homo sapiens
guaaaguguaucccauaug

SEQ ID NO: 943525 - RNA, 19 nt, Homo sapiens
gcucacaguguuugcuuau

SEQ ID NO: 943526 - RNA, 19 nt, Homo sapiens
ugacgcagaaauaaaucua

SEQ ID NO: 943527 - RNA, 19 nt, Homo sapiens
ugagagaugauucuuucuu

SEQ ID NO: 943528 - RNA, 19 nt, Homo sapiens
ggaaugcugcugcuucaac

SEQ ID NO: 943529 - RNA, 19 nt, Homo sapiens
agcagcagauugagaguga

SEQ ID NO: 943530 - RNA, 19 nt, Homo sapiens
gagagcuggcugagaguga

SEQ ID NO: 943531 - RNA, 19 nt, Homo sapiens
cuagggaggagucaaaugu

SEQ ID NO: 943532 - RNA, 19 nt, Homo sapiens
cagcugauaauccuagguu

SEQ ID NO: 943533 - RNA, 19 nt, Homo sapiens
gcagauugagagugagguu

SEQ ID NO: 943534 - RNA, 19 nt, Homo sapiens
gccugaagcagcagauuga

SEQ ID NO: 943535 - RNA, 19 nt, Homo sapiens
ggaagaccuugugauugag

SEQ ID NO: 943536 - RNA, 19 nt, Homo sapiens
gcugauaauccuagguuca

SEQ ID NO: 943537 - RNA, 19 nt, Homo sapiens
cccgaacccugcaggaaug

SEQ ID NO: 943538 - RNA, 19 nt, Homo sapiens
gaugagugcggaagugaag

SEQ ID NO: 943539 - RNA, 19 nt, Homo sapiens
gcugccugccugccucuua

SEQ ID NO: 943540 - RNA, 19 nt, Homo sapiens
cuacguguuuggagaacug

SEQ ID NO: 943541 - RNA, 19 nt, Homo sapiens
uggccacacucauccauca

SEQ ID NO: 943542 - RNA, 19 nt, Homo sapiens
ugggaaugcugcugcuuca

SEQ ID NO: 943543 - RNA, 19 nt, Homo sapiens
guagguggguagcccugau

SEQ ID NO: 943544 - RNA, 19 nt, Homo sapiens
gcugcuaaaguaaagugua

SEQ ID NO: 943545 - RNA, 19 nt, Homo sapiens
aacagaggcucagaagaau

SEQ ID NO: 943546 - RNA, 19 nt, Homo sapiens
gaaggguauauagauugua

SEQ ID NO: 943547 - RNA, 19 nt, Homo sapiens
gcaauccuggaaggguuua

SEQ ID NO: 943548 - RNA, 19 nt, Homo sapiens
gcaucugucccuguucauu

SEQ ID NO: 943549 - RNA, 19 nt, Homo sapiens
ggaggagucaaauguaggu

SEQ ID NO: 943550 - RNA, 19 nt, Homo sapiens
uagggaggagucaaaugua

SEQ ID NO: 943551 - RNA, 19 nt, Homo sapiens
ccagcaagaaagccucaaa

SEQ ID NO: 943552 - RNA, 19 nt, Homo sapiens
gcccgaacccugcaggaau

SEQ ID NO: 943553 - RNA, 19 nt, Homo sapiens
aaguaaaguguaucccaua

SEQ ID NO: 943554 - RNA, 19 nt, Homo sapiens
gguuuaaucuccuuuugug

SEQ ID NO: 943555 - RNA, 19 nt, Homo sapiens
gaagcuugauggcaauccu

SEQ ID NO: 943556 - RNA, 19 nt, Homo sapiens
ggccugaagcagcagauug

SEQ ID NO: 943557 - RNA, 19 nt, Homo sapiens
acagaggcucagaagaaua

SEQ ID NO: 943558 - RNA, 19 nt, Homo sapiens
uuggagaacugcuggacau

SEQ ID NO: 943559 - RNA, 19 nt, Homo sapiens
gacauguucauccuagaau

SEQ ID NO: 943560 - RNA, 19 nt, Homo sapiens
ggagucacuggacauguuc

SEQ ID NO: 943561 - RNA, 19 nt, Homo sapiens
uguguaugcugacgugcuu

SEQ ID NO: 943562 - RNA, 19 nt, Homo sapiens
cuauugagcagccucugaa

SEQ ID NO: 943563 - RNA, 19 nt, Homo sapiens
gggcagaaccaggagcaau

SEQ ID NO: 943564 - RNA, 19 nt, Homo sapiens
gcgccagcccagcaagaaa

SEQ ID NO: 943565 - RNA, 19 nt, Homo sapiens
gauugaggcuguguaugcu

SEQ ID NO: 943566 - RNA, 19 nt, Homo sapiens
gcaggcagcuucauauuau

SEQ ID NO: 943567 - RNA, 19 nt, Homo sapiens
caaagugaaugcugacaua

SEQ ID NO: 943568 - RNA, 19 nt, Homo sapiens
ugacaggccucaauuauga

SEQ ID NO: 943569 - RNA, 19 nt, Homo sapiens
ggaggaagcucggcugauu

SEQ ID NO: 943570 - RNA, 19 nt, Homo sapiens
gaauggaacugaagaccuu

SEQ ID NO: 943571 - RNA, 19 nt, Homo sapiens
gccaagagaugcacaguga

SEQ ID NO: 943572 - RNA, 19 nt, Homo sapiens
gaaauggaaccagcaguua

SEQ ID NO: 943573 - RNA, 19 nt, Homo sapiens
aaacagacauuucuuccuu

SEQ ID NO: 943574 - RNA, 19 nt, Homo sapiens
gauaugcugucaauguauu

SEQ ID NO: 943575 - RNA, 19 nt, Homo sapiens
gcaguuagcgagccaauga

SEQ ID NO: 943576 - RNA, 19 nt, Homo sapiens
ggaagaacuugguggacuu

SEQ ID NO: 943577 - RNA, 19 nt, Homo sapiens
ugaaacccauugacuacua

SEQ ID NO: 943578 - RNA, 19 nt, Homo sapiens
gaccauggaugaugcuaug

SEQ ID NO: 943579 - RNA, 19 nt, Homo sapiens
gggaaggcauuucacauca

SEQ ID NO: 943580 - RNA, 19 nt, Homo sapiens
ggauuuggauuucuugaag

SEQ ID NO: 943581 - RNA, 19 nt, Homo sapiens
ggaacuggauuuggauuuc

SEQ ID NO: 943582 - RNA, 19 nt, Homo sapiens
gaggauaugcugucaaugu

SEQ ID NO: 943583 - RNA, 19 nt, Homo sapiens
agacauuucuuccuucaug

SEQ ID NO: 943584 - RNA, 19 nt, Homo sapiens
uaacauccuuugaaugagu

SEQ ID NO: 943585 - RNA, 19 nt, Homo sapiens
ccaacgauccugagaagaa

SEQ ID NO: 943586 - RNA, 19 nt, Homo sapiens
gcaagaggauaugcuguca

SEQ ID NO: 943587 - RNA, 19 nt, Homo sapiens
acaaggagcucuuuuauag

SEQ ID NO: 943588 - RNA, 19 nt, Homo sapiens
cagcaaggguuugauaauc

SEQ ID NO: 943589 - RNA, 19 nt, Homo sapiens
ccuguggauugaugaaaua

SEQ ID NO: 943590 - RNA, 19 nt, Homo sapiens
uaucaagaauggaacugaa

SEQ ID NO: 943591 - RNA, 19 nt, Homo sapiens
gaacuggauuuggauuucu

SEQ ID NO: 943592 - RNA, 19 nt, Homo sapiens
ucauggaacuggauuugga

SEQ ID NO: 943593 - RNA, 19 nt, Homo sapiens
caagaugaaguucgugauu

SEQ ID NO: 943594 - RNA, 19 nt, Homo sapiens
acacagagacuaagaucuu

SEQ ID NO: 943595 - RNA, 19 nt, Homo sapiens
aggauaugcugucaaugua

SEQ ID NO: 943596 - RNA, 19 nt, Homo sapiens
caacgauccugagaagaau

SEQ ID NO: 943597 - RNA, 19 nt, Homo sapiens
gggcgucgauaucaagaau

SEQ ID NO: 943598 - RNA, 19 nt, Homo sapiens
ccaugaaacccauugacua

SEQ ID NO: 943599 - RNA, 19 nt, Homo sapiens
guggauugaugaaauaaca

SEQ ID NO: 943600 - RNA, 19 nt, Homo sapiens
gaaaugggaagaacuuggu

SEQ ID NO: 943601 - RNA, 19 nt, Homo sapiens
uagaaaagguuaaccagaa

SEQ ID NO: 943602 - RNA, 19 nt, Homo sapiens
agugaaugcugacauagaa

SEQ ID NO: 943603 - RNA, 19 nt, Homo sapiens
cauugaaacuugcaaagag

SEQ ID NO: 943604 - RNA, 19 nt, Homo sapiens
aagaggauaugcugucaau

SEQ ID NO: 943605 - RNA, 19 nt, Homo sapiens
cgaaauggaaccagcaguu

SEQ ID NO: 943606 - RNA, 19 nt, Homo sapiens
ugaaguucgugauuggaaa

SEQ ID NO: 943607 - RNA, 19 nt, Homo sapiens
ggugaucaguccugucauc

SEQ ID NO: 943608 - RNA, 19 nt, Homo sapiens
gaaacccauugacuacuac

SEQ ID NO: 943609 - RNA, 19 nt, Homo sapiens
gaccuucccuaugccauga

SEQ ID NO: 943610 - RNA, 19 nt, Homo sapiens
uaacaacaaggagcucuuu

SEQ ID NO: 943611 - RNA, 19 nt, Homo sapiens
guacccagcucugaaaggu

SEQ ID NO: 943612 - RNA, 19 nt, Homo sapiens
aagaugaaguucgugauug

SEQ ID NO: 943613 - RNA, 19 nt, Homo sapiens
caggcagcuucauauuaua

SEQ ID NO: 943614 - RNA, 19 nt, Homo sapiens
ccuacuggguggccuacua

SEQ ID NO: 943615 - RNA, 19 nt, Homo sapiens
cauccgcccucauggcauu

SEQ ID NO: 943616 - RNA, 19 nt, Homo sapiens
gagcgcacccuacucuuuc

SEQ ID NO: 943617 - RNA, 19 nt, Homo sapiens
uuacaaacgggaccauauu

SEQ ID NO: 943618 - RNA, 19 nt, Homo sapiens
gcagagagcgcacccuacu

SEQ ID NO: 943619 - RNA, 19 nt, Homo sapiens
ggaacggcaagaugaaguu

SEQ ID NO: 943620 - RNA, 19 nt, Homo sapiens
gccaggaacggcaagauga

SEQ ID NO: 943621 - RNA, 19 nt, Homo sapiens
gugccagugucaucuuuga

SEQ ID NO: 943622 - RNA, 19 nt, Homo sapiens
gcacaugguggagcaguug

SEQ ID NO: 943623 - RNA, 19 nt, Homo sapiens
caagagaugcacagugauc

SEQ ID NO: 943624 - RNA, 19 nt, Homo sapiens
gaccauauuuugcuucgaa

SEQ ID NO: 943625 - RNA, 19 nt, Homo sapiens
gaaguucgugauuggaaau

SEQ ID NO: 943626 - RNA, 19 nt, Homo sapiens
ggauaugcugucaauguau

SEQ ID NO: 943627 - RNA, 19 nt, Homo sapiens
uacaaacgggaccauauuu

SEQ ID NO: 943628 - RNA, 19 nt, Homo sapiens
gcacauuccacuacuacag

SEQ ID NO: 943629 - RNA, 19 nt, Homo sapiens
ggacggaaaagaaaaguug

SEQ ID NO: 943630 - RNA, 19 nt, Homo sapiens
gaucgguggcucuggauuc

SEQ ID NO: 943631 - RNA, 19 nt, Homo sapiens
agaaucaggccaagagaug

SEQ ID NO: 943632 - RNA, 19 nt, Homo sapiens
gagcugggccaauccucuu

SEQ ID NO: 943633 - RNA, 19 nt, Homo sapiens
gauuacaaacgggaccaua

SEQ ID NO: 943634 - RNA, 19 nt, Homo sapiens
acagacauuucuuccuuca

SEQ ID NO: 943635 - RNA, 19 nt, Homo sapiens
ggagaacgugguccaugga

SEQ ID NO: 943636 - RNA, 19 nt, Homo sapiens
caagggacccgcaguuggu

SEQ ID NO: 943637 - RNA, 19 nt, Homo sapiens
gcgucgauaucaagaaugg

SEQ ID NO: 943638 - RNA, 19 nt, Homo sapiens
caacaaggagcucuuuuau

SEQ ID NO: 943639 - RNA, 19 nt, Homo sapiens
gaucuguacccagcucuga

SEQ ID NO: 943640 - RNA, 19 nt, Homo sapiens
cuaccuggcccuccugcua

SEQ ID NO: 943641 - RNA, 19 nt, Homo sapiens
ggaaggcauuucacaucac

SEQ ID NO: 943642 - RNA, 19 nt, Homo sapiens
caugaaacccauugacuac

SEQ ID NO: 943643 - RNA, 19 nt, Homo sapiens
cagugccagugucaucuuu

SEQ ID NO: 943644 - RNA, 19 nt, Homo sapiens
cagaggacacucccaaagu

SEQ ID NO: 943645 - RNA, 19 nt, Homo sapiens
agcaggcagcuucauauua

SEQ ID NO: 943646 - RNA, 19 nt, Homo sapiens
cgcacuggcuggcacauuc

SEQ ID NO: 943647 - RNA, 19 nt, Homo sapiens
cgccaacgauccugagaag

SEQ ID NO: 943648 - RNA, 19 nt, Homo sapiens
ucaagaauggaacugaaga

SEQ ID NO: 943649 - RNA, 19 nt, Homo sapiens
gacagaggacacucccaaa

SEQ ID NO: 943650 - RNA, 19 nt, Homo sapiens
uugaaugaguuugcucuga

SEQ ID NO: 943651 - RNA, 19 nt, Homo sapiens
agaugaaguucgugauugg

SEQ ID NO: 943652 - RNA, 19 nt, Homo sapiens
ccaggaacggcaagaugaa

SEQ ID NO: 943653 - RNA, 19 nt, Homo sapiens
ccagcaaggguuugauaau

SEQ ID NO: 943654 - RNA, 19 nt, Homo sapiens
gaggaagcucggcugauuc

SEQ ID NO: 943655 - RNA, 19 nt, Homo sapiens
auaccgauuuguucucugu

SEQ ID NO: 943656 - RNA, 19 nt, Homo sapiens
gcaagaugaaguucgugau

SEQ ID NO: 943657 - RNA, 19 nt, Homo sapiens
gauuggaaaugggaagaac

SEQ ID NO: 943658 - RNA, 19 nt, Homo sapiens
gcagugccagugucaucuu

SEQ ID NO: 943659 - RNA, 19 nt, Homo sapiens
cuacuacagcugcgagaga

SEQ ID NO: 943660 - RNA, 19 nt, Homo sapiens
ucauugaaacuugcaaaga

SEQ ID NO: 943661 - RNA, 19 nt, Homo sapiens
acaacaaggagcucuuuua

SEQ ID NO: 943662 - RNA, 19 nt, Homo sapiens
gcucugaaagguguaaaca

SEQ ID NO: 943663 - RNA, 19 nt, Homo sapiens
uuagcgagccaaugagaga

SEQ ID NO: 943664 - RNA, 19 nt, Homo sapiens
agaggaccgugcagagcuu

SEQ ID NO: 943665 - RNA, 19 nt, Homo sapiens
gucgauaucaagaauggaa

SEQ ID NO: 943666 - RNA, 19 nt, Homo sapiens
gaaugugacugaacacuuc

SEQ ID NO: 943667 - RNA, 19 nt, Homo sapiens
guaccugccucccuuaauu

SEQ ID NO: 943668 - RNA, 19 nt, Homo sapiens
gaagaggagugaguauuau

SEQ ID NO: 943669 - RNA, 19 nt, Homo sapiens
caagauggcuaagaugauu

SEQ ID NO: 943670 - RNA, 19 nt, Homo sapiens
uaagaugauuggcgaagua

SEQ ID NO: 943671 - RNA, 19 nt, Homo sapiens
gaaagaagaggagugagua

SEQ ID NO: 943672 - RNA, 19 nt, Homo sapiens
ccgcaucucugaucaauga

SEQ ID NO: 943673 - RNA, 19 nt, Homo sapiens
gguagcagcugguucaaga

SEQ ID NO: 943674 - RNA, 19 nt, Homo sapiens
gcagacauuuguagugaug

SEQ ID NO: 943675 - RNA, 19 nt, Homo sapiens
ucaaugaguuuaagcucua

SEQ ID NO: 943676 - RNA, 19 nt, Homo sapiens
aaaccaagauggcuaagau

SEQ ID NO: 943677 - RNA, 19 nt, Homo sapiens
agaagaggagugaguauua

SEQ ID NO: 943678 - RNA, 19 nt, Homo sapiens
uaagcucuauucugucuuu

SEQ ID NO: 943679 - RNA, 19 nt, Homo sapiens
gggacaagcuccagagauc

SEQ ID NO: 943680 - RNA, 19 nt, Homo sapiens
gaauugaggccaccaggaa

SEQ ID NO: 943681 - RNA, 19 nt, Homo sapiens
gcgaaguaaugacaauguu

SEQ ID NO: 943682 - RNA, 19 nt, Homo sapiens
ccagagauccaaccacuga

SEQ ID NO: 943683 - RNA, 19 nt, Homo sapiens
ccacucauuuauucucauu

SEQ ID NO: 943684 - RNA, 19 nt, Homo sapiens
gcuggccacucauuuauuc

SEQ ID NO: 943685 - RNA, 19 nt, Homo sapiens
aguauuaucugauccaugu

SEQ ID NO: 943686 - RNA, 19 nt, Homo sapiens
aagcagacauuuguaguga

SEQ ID NO: 943687 - RNA, 19 nt, Homo sapiens
cuucuucuuucucuucuua

SEQ ID NO: 943688 - RNA, 19 nt, Homo sapiens
gaaugucuuugucugacuu

SEQ ID NO: 943689 - RNA, 19 nt, Homo sapiens
ccaggaaugugacugaaca

SEQ ID NO: 943690 - RNA, 19 nt, Homo sapiens
agaauucucucccaacaca

SEQ ID NO: 943691 - RNA, 19 nt, Homo sapiens
gaugauuggcgaaguaaug

SEQ ID NO: 943692 - RNA, 19 nt, Homo sapiens
gaaucauccuuuccuucuu

SEQ ID NO: 943693 - RNA, 19 nt, Homo sapiens
acacaugauucagggauaa

SEQ ID NO: 943694 - RNA, 19 nt, Homo sapiens
ggaucauucugcuguguau

SEQ ID NO: 943695 - RNA, 19 nt, Homo sapiens
gaagcagacauuuguagug

SEQ ID NO: 943696 - RNA, 19 nt, Homo sapiens
caagagggccaucagaauc

SEQ ID NO: 943697 - RNA, 19 nt, Homo sapiens
ggaaugugacugaacacuu

SEQ ID NO: 943698 - RNA, 19 nt, Homo sapiens
uggcucaaguggagaguuu

SEQ ID NO: 943699 - RNA, 19 nt, Homo sapiens
aguuuaagcucuauucugu

SEQ ID NO: 943700 - RNA, 19 nt, Homo sapiens
cgaaguaaugacaauguuu

SEQ ID NO: 943701 - RNA, 19 nt, Homo sapiens
gagugaguauuaucugauc

SEQ ID NO: 943702 - RNA, 19 nt, Homo sapiens
gcaaauuauugauguuucc

SEQ ID NO: 943703 - RNA, 19 nt, Homo sapiens
caucucugaucaaugaguu

SEQ ID NO: 943704 - RNA, 19 nt, Homo sapiens
aaucauccuuuccuucuuc

SEQ ID NO: 943705 - RNA, 19 nt, Homo sapiens
ucuggucaauuguuucauu

SEQ ID NO: 943706 - RNA, 19 nt, Homo sapiens
gcucuauucugucuuuagg

SEQ ID NO: 943707 - RNA, 19 nt, Homo sapiens
gcucuuauccugugguagu

SEQ ID NO: 943708 - RNA, 19 nt, Homo sapiens
ccacugaggcccacaagag

SEQ ID NO: 943709 - RNA, 19 nt, Homo sapiens
ucagaaagaagaggaguga

SEQ ID NO: 943710 - RNA, 19 nt, Homo sapiens
cacacaugauucagggaua

SEQ ID NO: 943711 - RNA, 19 nt, Homo sapiens
ucagaaucauccuuuccuu

SEQ ID NO: 943712 - RNA, 19 nt, Homo sapiens
gagaguuucuagggugaug

SEQ ID NO: 943713 - RNA, 19 nt, Homo sapiens
caugauucagggauaauaa

SEQ ID NO: 943714 - RNA, 19 nt, Homo sapiens
cauccuuuccuucuucuuu

SEQ ID NO: 943715 - RNA, 19 nt, Homo sapiens
gaggaucauucugcugugu

SEQ ID NO: 943716 - RNA, 19 nt, Homo sapiens
gccaucagaaucauccuuu

SEQ ID NO: 943717 - RNA, 19 nt, Homo sapiens
cacaagagggccaucagaa

SEQ ID NO: 943718 - RNA, 19 nt, Homo sapiens
ggagugaguauuaucugau

SEQ ID NO: 943719 - RNA, 19 nt, Homo sapiens
ccacauuccucuggcucaa

SEQ ID NO: 943720 - RNA, 19 nt, Homo sapiens
ucagggauaauaaugcaaa

SEQ ID NO: 943721 - RNA, 19 nt, Homo sapiens
ccacaagagggccaucaga

SEQ ID NO: 943722 - RNA, 19 nt, Homo sapiens
ccaccaggaaugugacuga

SEQ ID NO: 943723 - RNA, 19 nt, Homo sapiens
acaaaccaucugagcauuu

SEQ ID NO: 943724 - RNA, 19 nt, Homo sapiens
ggacauuuacaaaccaucu

SEQ ID NO: 943725 - RNA, 19 nt, Homo sapiens
ggccacucauuuauucuca

SEQ ID NO: 943726 - RNA, 19 nt, Homo sapiens
ccugcuggccacucauuua

SEQ ID NO: 943727 - RNA, 19 nt, Homo sapiens
ucaccacccuggcacucuu

SEQ ID NO: 943728 - RNA, 19 nt, Homo sapiens
uaucugauccauguucuug

SEQ ID NO: 943729 - RNA, 19 nt, Homo sapiens
gcugaagcagacauuugua

SEQ ID NO: 943730 - RNA, 19 nt, Homo sapiens
acaagagggccaucagaau

SEQ ID NO: 943731 - RNA, 19 nt, Homo sapiens
aggagugaguauuaucuga

SEQ ID NO: 943732 - RNA, 19 nt, Homo sapiens
uacaaaccaucugagcauu

SEQ ID NO: 943733 - RNA, 19 nt, Homo sapiens
auagaauucucucccaaca

SEQ ID NO: 943734 - RNA, 19 nt, Homo sapiens
guaagcugaagcagacauu

SEQ ID NO: 943735 - RNA, 19 nt, Homo sapiens
gaggccaccaggaauguga

SEQ ID NO: 943736 - RNA, 19 nt, Homo sapiens
uguguauuaucuugacuga

SEQ ID NO: 943737 - RNA, 19 nt, Homo sapiens
uuacaaaccaucugagcau

SEQ ID NO: 943738 - RNA, 19 nt, Homo sapiens
ggauccaagggacccauuu

SEQ ID NO: 943739 - RNA, 19 nt, Homo sapiens
agagaaugucuuugucuga

SEQ ID NO: 943740 - RNA, 19 nt, Homo sapiens
ccaagauggcuaagaugau

SEQ ID NO: 943741 - RNA, 19 nt, Homo sapiens
agaaagaagaggagugagu

SEQ ID NO: 943742 - RNA, 19 nt, Homo sapiens
uuuaagcucuauucugucu

SEQ ID NO: 943743 - RNA, 19 nt, Homo sapiens
gaguuuaagcucuauucug

SEQ ID NO: 943744 - RNA, 19 nt, Homo sapiens
ucucugaucaaugaguuua

SEQ ID NO: 943745 - RNA, 19 nt, Homo sapiens
ucauucugcuguguauuau

SEQ ID NO: 943746 - RNA, 19 nt, Homo sapiens
ggaacaguaagcugaagca

SEQ ID NO: 943747 - RNA, 19 nt, Homo sapiens
cugccucccuuaauugugu

SEQ ID NO: 943748 - RNA, 19 nt, Homo sapiens
caaugaguuuaagcucuau

SEQ ID NO: 943749 - RNA, 19 nt, Homo sapiens
uaccgcaucucugaucaau

SEQ ID NO: 943750 - RNA, 19 nt, Homo sapiens
uuucuagggugaugguaug

SEQ ID NO: 943751 - RNA, 19 nt, Homo sapiens
gguucaagaccaagagaau

SEQ ID NO: 943752 - RNA, 19 nt, Homo sapiens
ccaucagaaucauccuuuc

SEQ ID NO: 943753 - RNA, 19 nt, Homo sapiens
caccaggaaugugacugaa

SEQ ID NO: 943754 - RNA, 19 nt, Homo sapiens
cuagggugaugguauggau

SEQ ID NO: 943755 - RNA, 19 nt, Homo sapiens
aucauucugcuguguauua

SEQ ID NO: 943756 - RNA, 19 nt, Homo sapiens
aagcugaagcagacauuug

SEQ ID NO: 943757 - RNA, 19 nt, Homo sapiens
aagaagaggagugaguauu

SEQ ID NO: 943758 - RNA, 19 nt, Homo sapiens
aaagaagaggagugaguau

SEQ ID NO: 943759 - RNA, 19 nt, Homo sapiens
ugggugcacugcucuuauc

SEQ ID NO: 943760 - RNA, 19 nt, Homo sapiens
cagggauaauaaugcaaau

SEQ ID NO: 943761 - RNA, 19 nt, Homo sapiens
ggcgaaguaaugacaaugu

SEQ ID NO: 943762 - RNA, 19 nt, Homo sapiens
cuaagaugauuggcgaagu

SEQ ID NO: 943763 - RNA, 19 nt, Homo sapiens
guucaagaccaagagaaug

SEQ ID NO: 943764 - RNA, 19 nt, Homo sapiens
gcacucuugaggaucauuc

SEQ ID NO: 943765 - RNA, 19 nt, Homo sapiens
aagagggccaucagaauca

SEQ ID NO: 943766 - RNA, 19 nt, Homo sapiens
gagcucaucucuccaguuc

SEQ ID NO: 943767 - RNA, 19 nt, Homo sapiens
ggagacauauacagaagau

SEQ ID NO: 943768 - RNA, 19 nt, Homo sapiens
caucuugucuuuagugguu

SEQ ID NO: 943769 - RNA, 19 nt, Homo sapiens
gacauucuguucucauuau

SEQ ID NO: 943770 - RNA, 19 nt, Homo sapiens
ggacauucuguucucauua

SEQ ID NO: 943771 - RNA, 19 nt, Homo sapiens
ugaagcugauggucuauuu

SEQ ID NO: 943772 - RNA, 19 nt, Homo sapiens
gacggaagcucauguaggu

SEQ ID NO: 943773 - RNA, 19 nt, Homo sapiens
gagggcaucuugucuuuag

SEQ ID NO: 943774 - RNA, 19 nt, Homo sapiens
cuaugaagcugauggucua

SEQ ID NO: 943775 - RNA, 19 nt, Homo sapiens
gcuauuauugccucaguua

SEQ ID NO: 943776 - RNA, 19 nt, Homo sapiens
uuugugaccuugcucaaua

SEQ ID NO: 943777 - RNA, 19 nt, Homo sapiens
gugagggcaucuugucuuu

SEQ ID NO: 943778 - RNA, 19 nt, Homo sapiens
gaacuugugacuacgagaa

SEQ ID NO: 943779 - RNA, 19 nt, Homo sapiens
gaggagacauauacagaag

SEQ ID NO: 943780 - RNA, 19 nt, Homo sapiens
gcucaucucuccaguucau

SEQ ID NO: 943781 - RNA, 19 nt, Homo sapiens
cgagaaauaacacaucauu

SEQ ID NO: 943782 - RNA, 19 nt, Homo sapiens
ucucuccaguucaucauua

SEQ ID NO: 943783 - RNA, 19 nt, Homo sapiens
gugugaagauuacuaacuu

SEQ ID NO: 943784 - RNA, 19 nt, Homo sapiens
ggcaucaccagguuucuua

SEQ ID NO: 943785 - RNA, 19 nt, Homo sapiens
ucacacauccuaaacugaa

SEQ ID NO: 943786 - RNA, 19 nt, Homo sapiens
uaucacacauccuaaacug

SEQ ID NO: 943787 - RNA, 19 nt, Homo sapiens
cagucuaccugucugcuuu

SEQ ID NO: 943788 - RNA, 19 nt, Homo sapiens
ugaccuugcucaauaucuu

SEQ ID NO: 943789 - RNA, 19 nt, Homo sapiens
uguguuguguuucauguuu

SEQ ID NO: 943790 - RNA, 19 nt, Homo sapiens
cggaauaucuccccaaaga

SEQ ID NO: 943791 - RNA, 19 nt, Homo sapiens
uacuucgucucuucaaaua

SEQ ID NO: 943792 - RNA, 19 nt, Homo sapiens
uuacaguggucaauugcaa

SEQ ID NO: 943793 - RNA, 19 nt, Homo sapiens
gccauagaaucuccucuuc

SEQ ID NO: 943794 - RNA, 19 nt, Homo sapiens
uuauuacaguggucaauug

SEQ ID NO: 943795 - RNA, 19 nt, Homo sapiens
ugucuuuagugguuucuuu

SEQ ID NO: 943796 - RNA, 19 nt, Homo sapiens
uccaguaucuccccuuuua

SEQ ID NO: 943797 - RNA, 19 nt, Homo sapiens
uacgagaaauaacacauca

SEQ ID NO: 943798 - RNA, 19 nt, Homo sapiens
gaaaacaacagcaaagaag

SEQ ID NO: 943799 - RNA, 19 nt, Homo sapiens
aaacaacagcaaagaagau

SEQ ID NO: 943800 - RNA, 19 nt, Homo sapiens
uacauuccauauucaguug

SEQ ID NO: 943801 - RNA, 19 nt, Homo sapiens
gacuucugcuuccuugcua

SEQ ID NO: 943802 - RNA, 19 nt, Homo sapiens
ccagacggaagcucaugua

SEQ ID NO: 943803 - RNA, 19 nt, Homo sapiens
ucaauaucuuguacugugu

SEQ ID NO: 943804 - RNA, 19 nt, Homo sapiens
agcagugucugguuuguga

SEQ ID NO: 943805 - RNA, 19 nt, Homo sapiens
cuacauuccauauucaguu

SEQ ID NO: 943806 - RNA, 19 nt, Homo sapiens
ccucuacauuccauauuca

SEQ ID NO: 943807 - RNA, 19 nt, Homo sapiens
ucuauuuccucauccucua

SEQ ID NO: 943808 - RNA, 19 nt, Homo sapiens
ccacuugccuguacaucac

SEQ ID NO: 943809 - RNA, 19 nt, Homo sapiens
ugaggagacauauacagaa

SEQ ID NO: 943810 - RNA, 19 nt, Homo sapiens
gugcugauuucugcuuuca

SEQ ID NO: 943811 - RNA, 19 nt, Homo sapiens
ccaucuacuucgucucuuc

SEQ ID NO: 943812 - RNA, 19 nt, Homo sapiens
cacacauccuaaacugaaa

SEQ ID NO: 943813 - RNA, 19 nt, Homo sapiens
caguucaucauuaauguga

SEQ ID NO: 943814 - RNA, 19 nt, Homo sapiens
cuacuucgucucuucaaau

SEQ ID NO: 943815 - RNA, 19 nt, Homo sapiens
gaagcugauggucuauuuc

SEQ ID NO: 943816 - RNA, 19 nt, Homo sapiens
aggacauucuguucucauu

SEQ ID NO: 943817 - RNA, 19 nt, Homo sapiens
gggcaucuugucuuuagug

SEQ ID NO: 943818 - RNA, 19 nt, Homo sapiens
ccaggacauucuguucuca

SEQ ID NO: 943819 - RNA, 19 nt, Homo sapiens
uaucagugagggcaucuug

SEQ ID NO: 943820 - RNA, 19 nt, Homo sapiens
uuccugaacuugugacuac

SEQ ID NO: 943821 - RNA, 19 nt, Homo sapiens
gaaucuccucuucugauag

SEQ ID NO: 943822 - RNA, 19 nt, Homo sapiens
gccacugguuucuggaauc

SEQ ID NO: 943823 - RNA, 19 nt, Homo sapiens
gaccuugcucaauaucuug

SEQ ID NO: 943824 - RNA, 19 nt, Homo sapiens
gccuguacaucacgcuuag

SEQ ID NO: 943825 - RNA, 19 nt, Homo sapiens
ucuacuucgucucuucaaa

SEQ ID NO: 943826 - RNA, 19 nt, Homo sapiens
guucaucauuaaugugacu

SEQ ID NO: 943827 - RNA, 19 nt, Homo sapiens
uccaguucaucauuaaugu

SEQ ID NO: 943828 - RNA, 19 nt, Homo sapiens
cuugugacuacgagaaaua

SEQ ID NO: 943829 - RNA, 19 nt, Homo sapiens
uuucugcuuucaccacuug

SEQ ID NO: 943830 - RNA, 19 nt, Homo sapiens
gugugcugauuucugcuuu

SEQ ID NO: 943831 - RNA, 19 nt, Homo sapiens
gcuggccugugugcugauu

SEQ ID NO: 943832 - RNA, 19 nt, Homo sapiens
caguguuucuccugcugaa

SEQ ID NO: 943833 - RNA, 19 nt, Homo sapiens
cucgagcagugucugguuu

SEQ ID NO: 943834 - RNA, 19 nt, Homo sapiens
ucugauaggauucuguuca

SEQ ID NO: 943835 - RNA, 19 nt, Homo sapiens
aaucuccucuucugauagg

SEQ ID NO: 943836 - RNA, 19 nt, Homo sapiens
caucaaugcugaacaauuu

SEQ ID NO: 943837 - RNA, 19 nt, Homo sapiens
gcaucaaggucucuucuuu

SEQ ID NO: 943838 - RNA, 19 nt, Homo sapiens
ugucuaugcuuucaucuua

SEQ ID NO: 943839 - RNA, 19 nt, Homo sapiens
uggcugagguggagaauuu

SEQ ID NO: 943840 - RNA, 19 nt, Homo sapiens
gggcaucucucgcuucugu

SEQ ID NO: 943841 - RNA, 19 nt, Homo sapiens
gugcagagcagccuaauug

SEQ ID NO: 943842 - RNA, 19 nt, Homo sapiens
cuugaguccuugacaauua

SEQ ID NO: 943843 - RNA, 19 nt, Homo sapiens
gagcagcccuacguugaaa

SEQ ID NO: 943844 - RNA, 19 nt, Homo sapiens
ccaacucacugucuucuuc

SEQ ID NO: 943845 - RNA, 19 nt, Homo sapiens
ccaagcagauacaacauca

SEQ ID NO: 943846 - RNA, 19 nt, Homo sapiens
cuucagcuauugggaauua

SEQ ID NO: 943847 - RNA, 19 nt, Homo sapiens
aaucaucccuucagcuauu

SEQ ID NO: 943848 - RNA, 19 nt, Homo sapiens
uaagagauguugguuaugg

SEQ ID NO: 943849 - RNA, 19 nt, Homo sapiens
gcuuucaucuuaaugcauu

SEQ ID NO: 943850 - RNA, 19 nt, Homo sapiens
gagguuguuucccuggaua

SEQ ID NO: 943851 - RNA, 19 nt, Homo sapiens
gcauuccacuucacugaug

SEQ ID NO: 943852 - RNA, 19 nt, Homo sapiens
cagagcagccuaauuguug

SEQ ID NO: 943853 - RNA, 19 nt, Homo sapiens
gaggucccuugccgucuua

SEQ ID NO: 943854 - RNA, 19 nt, Homo sapiens
guuccaggcucauacaguu

SEQ ID NO: 943855 - RNA, 19 nt, Homo sapiens
gagcaucuaccaagaaaca

SEQ ID NO: 943856 - RNA, 19 nt, Homo sapiens
gcagagcagccuaauuguu

SEQ ID NO: 943857 - RNA, 19 nt, Homo sapiens
uuacuggguucucugauga

SEQ ID NO: 943858 - RNA, 19 nt, Homo sapiens
aagcagauacaacaucaua

SEQ ID NO: 943859 - RNA, 19 nt, Homo sapiens
gguacucuauuugauaaga

SEQ ID NO: 943860 - RNA, 19 nt, Homo sapiens
guuuaccucuuacuuucua

SEQ ID NO: 943861 - RNA, 19 nt, Homo sapiens
ucauacaguugcauugguu

SEQ ID NO: 943862 - RNA, 19 nt, Homo sapiens
guguuuaccucuuacuuuc

SEQ ID NO: 943863 - RNA, 19 nt, Homo sapiens
cacuguaacugacaaacuu

SEQ ID NO: 943864 - RNA, 19 nt, Homo sapiens
gcugaugccuguggacaug

SEQ ID NO: 943865 - RNA, 19 nt, Homo sapiens
aaaggauucuaaagggaaa

SEQ ID NO: 943866 - RNA, 19 nt, Homo sapiens
uggagcaucuaccaagaaa

SEQ ID NO: 943867 - RNA, 19 nt, Homo sapiens
acaaucaucccuucagcua

SEQ ID NO: 943868 - RNA, 19 nt, Homo sapiens
guucucugaugauuacuug

SEQ ID NO: 943869 - RNA, 19 nt, Homo sapiens
uugcauugguuauuccuuu

SEQ ID NO: 943870 - RNA, 19 nt, Homo sapiens
gaucaucuaugugcuugag

SEQ ID NO: 943871 - RNA, 19 nt, Homo sapiens
uggcaucacugaccaagca

SEQ ID NO: 943872 - RNA, 19 nt, Homo sapiens
guaacugacaaacuugaaa

SEQ ID NO: 943873 - RNA, 19 nt, Homo sapiens
cauggagcaucuaccaaga

SEQ ID NO: 943874 - RNA, 19 nt, Homo sapiens
guacuuugcaacuuaacaa

SEQ ID NO: 943875 - RNA, 19 nt, Homo sapiens
ugauaagagauguugguua

SEQ ID NO: 943876 - RNA, 19 nt, Homo sapiens
ggauauuacuggguucucu

SEQ ID NO: 943877 - RNA, 19 nt, Homo sapiens
uuucacccaucacaucuuu

SEQ ID NO: 943878 - RNA, 19 nt, Homo sapiens
ugaccaagcagauacaaca

SEQ ID NO: 943879 - RNA, 19 nt, Homo sapiens
gugcuugaguccuugacaa

SEQ ID NO: 943880 - RNA, 19 nt, Homo sapiens
guuguuucccuggauauua

SEQ ID NO: 943881 - RNA, 19 nt, Homo sapiens
uaaccauacucaucaccau

SEQ ID NO: 943882 - RNA, 19 nt, Homo sapiens
ucuaugugcuugaguccuu

SEQ ID NO: 943883 - RNA, 19 nt, Homo sapiens
aacaaucaccugggaauuu

SEQ ID NO: 943884 - RNA, 19 nt, Homo sapiens
cuuugcaacuuaacaauca

SEQ ID NO: 943885 - RNA, 19 nt, Homo sapiens
cuuaaugcauuccacuuca

SEQ ID NO: 943886 - RNA, 19 nt, Homo sapiens
acaguugcauugguuauuc

SEQ ID NO: 943887 - RNA, 19 nt, Homo sapiens
ccauacucaucaccauuau

SEQ ID NO: 943888 - RNA, 19 nt, Homo sapiens
ugaggucccuugccgucuu

SEQ ID NO: 943889 - RNA, 19 nt, Homo sapiens
gcagauacaacaucauagc

SEQ ID NO: 943890 - RNA, 19 nt, Homo sapiens
uaacaaucaccugggaauu

SEQ ID NO: 943891 - RNA, 19 nt, Homo sapiens
ucccuugccgucuuauuua

SEQ ID NO: 943892 - RNA, 19 nt, Homo sapiens
caucaaggucucuucuuuc

SEQ ID NO: 943893 - RNA, 19 nt, Homo sapiens
gucccuugccgucuuauuu

SEQ ID NO: 943894 - RNA, 19 nt, Homo sapiens
gcacuguaacugacaaacu

SEQ ID NO: 943895 - RNA, 19 nt, Homo sapiens
ugguuaaacagcuugcuua

SEQ ID NO: 943896 - RNA, 19 nt, Homo sapiens
auccuuacauucugguuaa

SEQ ID NO: 943897 - RNA, 19 nt, Homo sapiens
gucuaugcuuucaucuuaa

SEQ ID NO: 943898 - RNA, 19 nt, Homo sapiens
cuugccgucuuauuuauug

SEQ ID NO: 943899 - RNA, 19 nt, Homo sapiens
cucacugucuucuucauga

SEQ ID NO: 943900 - RNA, 19 nt, Homo sapiens
accauacucaucaccauua

SEQ ID NO: 943901 - RNA, 19 nt, Homo sapiens
ccucuuacuuucuaaccau

SEQ ID NO: 943902 - RNA, 19 nt, Homo sapiens
acaaucaccugggaauuuu

SEQ ID NO: 943903 - RNA, 19 nt, Homo sapiens
auacucaucaccauuauag

SEQ ID NO: 943904 - RNA, 19 nt, Homo sapiens
aucaaggucucuucuuuca

SEQ ID NO: 943905 - RNA, 19 nt, Homo sapiens
uauccuuacauucugguua

SEQ ID NO: 943906 - RNA, 19 nt, Homo sapiens
uggguucucugaugauuac

SEQ ID NO: 943907 - RNA, 19 nt, Homo sapiens
acagcuugcuuaccguguu

SEQ ID NO: 943908 - RNA, 19 nt, Homo sapiens
gcagugcugggcagagaau

SEQ ID NO: 943909 - RNA, 19 nt, Homo sapiens
cugggaagcuuuugucuau

SEQ ID NO: 943910 - RNA, 19 nt, Homo sapiens
uguguuuaccucuuacuuu

SEQ ID NO: 943911 - RNA, 19 nt, Homo sapiens
ucugaugauuacuugugua

SEQ ID NO: 943912 - RNA, 19 nt, Homo sapiens
ccauccaacucacugucuu

SEQ ID NO: 943913 - RNA, 19 nt, Homo sapiens
uagcacuggucacugcaau

SEQ ID NO: 943914 - RNA, 19 nt, Homo sapiens
cauacaguugcauugguua

SEQ ID NO: 943915 - RNA, 19 nt, Homo sapiens
ucucuucuuucacccauca

SEQ ID NO: 943916 - RNA, 19 nt, Homo sapiens
cagcuugcuuaccguguuc

SEQ ID NO: 943917 - RNA, 19 nt, Homo sapiens
caacucacugucuucuuca

SEQ ID NO: 943918 - RNA, 19 nt, Homo sapiens
cugagcagcccuacguuga

SEQ ID NO: 943919 - RNA, 19 nt, Homo sapiens
ucacugucuucuucaugau

SEQ ID NO: 943920 - RNA, 19 nt, Homo sapiens
cauacucaucaccauuaua

SEQ ID NO: 943921 - RNA, 19 nt, Homo sapiens
caucauagcacuggucacu

SEQ ID NO: 943922 - RNA, 19 nt, Homo sapiens
uaucaguuccaggcucaua

SEQ ID NO: 943923 - RNA, 19 nt, Homo sapiens
cuuacauucugguuaaaca

SEQ ID NO: 943924 - RNA, 19 nt, Homo sapiens
acuggucacugcaauccaa

SEQ ID NO: 943925 - RNA, 19 nt, Homo sapiens
ucacugaccaagcagauac

SEQ ID NO: 943926 - RNA, 19 nt, Homo sapiens
uugaguccuugacaauuau

SEQ ID NO: 943927 - RNA, 19 nt, Homo sapiens
gcuugaguccuugacaauu

SEQ ID NO: 943928 - RNA, 19 nt, Homo sapiens
guaacaaucaucccuucag

SEQ ID NO: 943929 - RNA, 19 nt, Homo sapiens
uuucuaaccauacucauca

SEQ ID NO: 943930 - RNA, 19 nt, Homo sapiens
ugagcagcccuacguugaa

SEQ ID NO: 943931 - RNA, 19 nt, Homo sapiens
agagaauggcugcaaguca

SEQ ID NO: 943932 - RNA, 19 nt, Homo sapiens
gcauugguuauuccuuuca

SEQ ID NO: 943933 - RNA, 19 nt, Homo sapiens
gcucauacaguugcauugg

SEQ ID NO: 943934 - RNA, 19 nt, Homo sapiens
uagcaaauaugcaggguuu

SEQ ID NO: 943935 - RNA, 19 nt, Homo sapiens
gcuagagucucaccucauu

SEQ ID NO: 943936 - RNA, 19 nt, Homo sapiens
uggacacucucucaucuua

SEQ ID NO: 943937 - RNA, 19 nt, Homo sapiens
gaagguucaucuuucuguu

SEQ ID NO: 943938 - RNA, 19 nt, Homo sapiens
gugauacaauuucuucuug

SEQ ID NO: 943939 - RNA, 19 nt, Homo sapiens
caucagaagguucaucuuu

SEQ ID NO: 943940 - RNA, 19 nt, Homo sapiens
gaagauacacuggcuauac

SEQ ID NO: 943941 - RNA, 19 nt, Homo sapiens
gcaaauaugcaggguuuau

SEQ ID NO: 943942 - RNA, 19 nt, Homo sapiens
gacacucucucaucuuaau

SEQ ID NO: 943943 - RNA, 19 nt, Homo sapiens
gcagugauacaauuucuuc

SEQ ID NO: 943944 - RNA, 19 nt, Homo sapiens
ucucuaaaguuucacauca

SEQ ID NO: 943945 - RNA, 19 nt, Homo sapiens
caucauguguucugcgaau

SEQ ID NO: 943946 - RNA, 19 nt, Homo sapiens
agucucaccucauuaucua

SEQ ID NO: 943947 - RNA, 19 nt, Homo sapiens
uagaauucaucauguguuc

SEQ ID NO: 943948 - RNA, 19 nt, Homo sapiens
ucucucuucucuaaaguuu

SEQ ID NO: 943949 - RNA, 19 nt, Homo sapiens
ucauagaauucaucaugug

SEQ ID NO: 943950 - RNA, 19 nt, Homo sapiens
uacacuggcuauacagauu

SEQ ID NO: 943951 - RNA, 19 nt, Homo sapiens
aagauacacuggcuauaca

SEQ ID NO: 943952 - RNA, 19 nt, Homo sapiens
caaaaugccacaauucaaa

SEQ ID NO: 943953 - RNA, 19 nt, Homo sapiens
ucuaaaguuucacaucaga

SEQ ID NO: 943954 - RNA, 19 nt, Homo sapiens
ccacauggcucggcguuuu

SEQ ID NO: 943955 - RNA, 19 nt, Homo sapiens
uuguucaucuucuacguua

SEQ ID NO: 943956 - RNA, 19 nt, Homo sapiens
ggacacucucucaucuuaa

SEQ ID NO: 943957 - RNA, 19 nt, Homo sapiens
ucucuucucuaaaguuuca

SEQ ID NO: 943958 - RNA, 19 nt, Homo sapiens
ucagugccauugcuuaucu

SEQ ID NO: 943959 - RNA, 19 nt, Homo sapiens
gcacacccggcaaaugaga

SEQ ID NO: 943960 - RNA, 19 nt, Homo sapiens
gaauucaucauguguucug

SEQ ID NO: 943961 - RNA, 19 nt, Homo sapiens
caaauaugcaggguuuaug

SEQ ID NO: 943962 - RNA, 19 nt, Homo sapiens
gguugaagaugaggauauc

SEQ ID NO: 943963 - RNA, 19 nt, Homo sapiens
cuucauagaauucaucaug

SEQ ID NO: 943964 - RNA, 19 nt, Homo sapiens
ucuggcaguuucuagaauu

SEQ ID NO: 943965 - RNA, 19 nt, Homo sapiens
guucaucuuucuguucuuc

SEQ ID NO: 943966 - RNA, 19 nt, Homo sapiens
aggcacacccggcaaauga

SEQ ID NO: 943967 - RNA, 19 nt, Homo sapiens
cuucuacguuaaugugauu

SEQ ID NO: 943968 - RNA, 19 nt, Homo sapiens
acaauuucuucuugggauu

SEQ ID NO: 943969 - RNA, 19 nt, Homo sapiens
cagauuuucucuuuuguug

SEQ ID NO: 943970 - RNA, 19 nt, Homo sapiens
uagagucucaccucauuau

SEQ ID NO: 943971 - RNA, 19 nt, Homo sapiens
ggucucugcuauauguauc

SEQ ID NO: 943972 - RNA, 19 nt, Homo sapiens
aagcuggucccauggauga

SEQ ID NO: 943973 - RNA, 19 nt, Homo sapiens
uggaucuccuucuuucuug

SEQ ID NO: 943974 - RNA, 19 nt, Homo sapiens
gauacacuggcuauacaga

SEQ ID NO: 943975 - RNA, 19 nt, Homo sapiens
uaaaguuucacaucagaag

SEQ ID NO: 943976 - RNA, 19 nt, Homo sapiens
ccaagcuggucccauggau

SEQ ID NO: 943977 - RNA, 19 nt, Homo sapiens
cuacguuaaugugauuguu

SEQ ID NO: 943978 - RNA, 19 nt, Homo sapiens
uuucuugucuggcaguuuc

SEQ ID NO: 943979 - RNA, 19 nt, Homo sapiens
ggaucuccuucuuucuugu

SEQ ID NO: 943980 - RNA, 19 nt, Homo sapiens
guucuucauccuugugauu

SEQ ID NO: 943981 - RNA, 19 nt, Homo sapiens
caauuucuucuugggauuu

SEQ ID NO: 943982 - RNA, 19 nt, Homo sapiens
caucuucuacguuaaugug

SEQ ID NO: 943983 - RNA, 19 nt, Homo sapiens
guucaucuucuacguuaau

SEQ ID NO: 943984 - RNA, 19 nt, Homo sapiens
caguaagugcugucaguga

SEQ ID NO: 943985 - RNA, 19 nt, Homo sapiens
gcaucauugugguggugaa

SEQ ID NO: 943986 - RNA, 19 nt, Homo sapiens
acacuggcuauacagauuu

SEQ ID NO: 943987 - RNA, 19 nt, Homo sapiens
aagaagauacacuggcuau

SEQ ID NO: 943988 - RNA, 19 nt, Homo sapiens
ucugcuauauguaucuaug

SEQ ID NO: 943989 - RNA, 19 nt, Homo sapiens
cuggcaguuucuagaauuu

SEQ ID NO: 943990 - RNA, 19 nt, Homo sapiens
ggaaauccuaaauugaaac

SEQ ID NO: 943991 - RNA, 19 nt, Homo sapiens
cauagaauucaucaugugu

SEQ ID NO: 943992 - RNA, 19 nt, Homo sapiens
ucuggacacucucucaucu

SEQ ID NO: 943993 - RNA, 19 nt, Homo sapiens
aucagaagguucaucuuuc

SEQ ID NO: 943994 - RNA, 19 nt, Homo sapiens
gcgcguugcugucuauccu

SEQ ID NO: 943995 - RNA, 19 nt, Homo sapiens
gagucucaccucauuaucu

SEQ ID NO: 943996 - RNA, 19 nt, Homo sapiens
cuagagucucaccucauua

SEQ ID NO: 943997 - RNA, 19 nt, Homo sapiens
cauguguucugcgaauugu

SEQ ID NO: 943998 - RNA, 19 nt, Homo sapiens
cgcuggaucuccuucuuuc

SEQ ID NO: 943999 - RNA, 19 nt, Homo sapiens
ccgcuggaucuccuucuuu

SEQ ID NO: 944000 - RNA, 19 nt, Homo sapiens
gccauugcuuaucuuccuu

SEQ ID NO: 944001 - RNA, 19 nt, Homo sapiens
ucucaccucauuaucuauu

SEQ ID NO: 944002 - RNA, 19 nt, Homo sapiens
gaagagauauuuccuugau

SEQ ID NO: 944003 - RNA, 19 nt, Homo sapiens
gaugauuggugacauagua

SEQ ID NO: 944004 - RNA, 19 nt, Homo sapiens
caaagucagucaugaagaa

SEQ ID NO: 944005 - RNA, 19 nt, Homo sapiens
gcaauagaggcaauauaua

SEQ ID NO: 944006 - RNA, 19 nt, Homo sapiens
caauauaucgcacccauuu

SEQ ID NO: 944007 - RNA, 19 nt, Homo sapiens
gguccuuucuuaucucuuu

SEQ ID NO: 944008 - RNA, 19 nt, Homo sapiens
gauauuuccuugauugaca

SEQ ID NO: 944009 - RNA, 19 nt, Homo sapiens
cugaagauguuaagauuug

SEQ ID NO: 944010 - RNA, 19 nt, Homo sapiens
uacccagucuuucuuguua

SEQ ID NO: 944011 - RNA, 19 nt, Homo sapiens
ggacauuugccaauaauuc

SEQ ID NO: 944012 - RNA, 19 nt, Homo sapiens
agagauauuuccuugauug

SEQ ID NO: 944013 - RNA, 19 nt, Homo sapiens
gaauugaccauagggauuu

SEQ ID NO: 944014 - RNA, 19 nt, Homo sapiens
gaaucugucugcugugugu

SEQ ID NO: 944015 - RNA, 19 nt, Homo sapiens
guugaugauuggugacaua

SEQ ID NO: 944016 - RNA, 19 nt, Homo sapiens
uaaaggcagugaucaucuu

SEQ ID NO: 944017 - RNA, 19 nt, Homo sapiens
uaauucaagucucugguuu

SEQ ID NO: 944018 - RNA, 19 nt, Homo sapiens
ccagguacauauggcaaua

SEQ ID NO: 944019 - RNA, 19 nt, Homo sapiens
uuagauggcuucuuuaugc

SEQ ID NO: 944020 - RNA, 19 nt, Homo sapiens
ggaaauucaaagugaguaa

SEQ ID NO: 944021 - RNA, 19 nt, Homo sapiens
gugaaguguuuccuuagaa

SEQ ID NO: 944022 - RNA, 19 nt, Homo sapiens
ggauucauuguacuaguua

SEQ ID NO: 944023 - RNA, 19 nt, Homo sapiens
uuugugaaguguuuccuua

SEQ ID NO: 944024 - RNA, 19 nt, Homo sapiens
gcaaguugagggaagcuuu

SEQ ID NO: 944025 - RNA, 19 nt, Homo sapiens
caaagaaugaugauaugug

SEQ ID NO: 944026 - RNA, 19 nt, Homo sapiens
ucaaacaguuaacccugaa

SEQ ID NO: 944027 - RNA, 19 nt, Homo sapiens
gccaauaauucaagucucu

SEQ ID NO: 944028 - RNA, 19 nt, Homo sapiens
cuaguuaacugcauugacu

SEQ ID NO: 944029 - RNA, 19 nt, Homo sapiens
cauaguaacugucauuuuc

SEQ ID NO: 944030 - RNA, 19 nt, Homo sapiens
guacagaggcccacaugag

SEQ ID NO: 944031 - RNA, 19 nt, Homo sapiens
ggugaugguucccuuuauc

SEQ ID NO: 944032 - RNA, 19 nt, Homo sapiens
gaagaaaacauuacuugga

SEQ ID NO: 944033 - RNA, 19 nt, Homo sapiens
agaaugaugauauguggua

SEQ ID NO: 944034 - RNA, 19 nt, Homo sapiens
aucauuagauggcuucuuu

SEQ ID NO: 944035 - RNA, 19 nt, Homo sapiens
uaugggaaauagcaaguug

SEQ ID NO: 944036 - RNA, 19 nt, Homo sapiens
guuaagauuugugaagugu

SEQ ID NO: 944037 - RNA, 19 nt, Homo sapiens
gagggaagcuuuucugaag

SEQ ID NO: 944038 - RNA, 19 nt, Homo sapiens
ccagguacuuucaaacagu

SEQ ID NO: 944039 - RNA, 19 nt, Homo sapiens
ggcugaagcuaaagaucaa

SEQ ID NO: 944040 - RNA, 19 nt, Homo sapiens
cagauucgacugcaugcua

SEQ ID NO: 944041 - RNA, 19 nt, Homo sapiens
uuacuuuucucccuaguua

SEQ ID NO: 944042 - RNA, 19 nt, Homo sapiens
gaaugaugauaugugguau

SEQ ID NO: 944043 - RNA, 19 nt, Homo sapiens
gccucaguaucuucuauuu

SEQ ID NO: 944044 - RNA, 19 nt, Homo sapiens
ucuggacauuugccaauaa

SEQ ID NO: 944045 - RNA, 19 nt, Homo sapiens
caagugcaauagaggcaau

SEQ ID NO: 944046 - RNA, 19 nt, Homo sapiens
ugcaauagaggcaauauau

SEQ ID NO: 944047 - RNA, 19 nt, Homo sapiens
gaaguguuuccuuagaaga

SEQ ID NO: 944048 - RNA, 19 nt, Homo sapiens
guacuacccagucuuucuu

SEQ ID NO: 944049 - RNA, 19 nt, Homo sapiens
gaucaacaaggucaugcuu

SEQ ID NO: 944050 - RNA, 19 nt, Homo sapiens
ccucaguaucuucuauuua

SEQ ID NO: 944051 - RNA, 19 nt, Homo sapiens
ugugaaguguuuccuuaga

SEQ ID NO: 944052 - RNA, 19 nt, Homo sapiens
ugaauugaccauagggauu

SEQ ID NO: 944053 - RNA, 19 nt, Homo sapiens
gagauauuuccuugauuga

SEQ ID NO: 944054 - RNA, 19 nt, Homo sapiens
uggauucauuguacuaguu

SEQ ID NO: 944055 - RNA, 19 nt, Homo sapiens
uccaaagaaugaugauaug

SEQ ID NO: 944056 - RNA, 19 nt, Homo sapiens
gacauuugccaauaauuca

SEQ ID NO: 944057 - RNA, 19 nt, Homo sapiens
ugaaguguuuccuuagaag

SEQ ID NO: 944058 - RNA, 19 nt, Homo sapiens
ucaagccauucauucauuc

SEQ ID NO: 944059 - RNA, 19 nt, Homo sapiens
cucaguaucuucuauuuac

SEQ ID NO: 944060 - RNA, 19 nt, Homo sapiens
gcuaguaagcauugugaau

SEQ ID NO: 944061 - RNA, 19 nt, Homo sapiens
augcugcucuuuccaggua

SEQ ID NO: 944062 - RNA, 19 nt, Homo sapiens
cagguacuuucaaacaguu

SEQ ID NO: 944063 - RNA, 19 nt, Homo sapiens
gauguuaagauuugugaag

SEQ ID NO: 944064 - RNA, 19 nt, Homo sapiens
gaagauguuaagauuugug

SEQ ID NO: 944065 - RNA, 19 nt, Homo sapiens
agccauucauucauucuaa

SEQ ID NO: 944066 - RNA, 19 nt, Homo sapiens
gggugaugguucccuuuau

SEQ ID NO: 944067 - RNA, 19 nt, Homo sapiens
gccauucauucauucuaau

SEQ ID NO: 944068 - RNA, 19 nt, Homo sapiens
gugcaauagaggcaauaua

SEQ ID NO: 944069 - RNA, 19 nt, Homo sapiens
ugucugcuguguguaauau

SEQ ID NO: 944070 - RNA, 19 nt, Homo sapiens
ccaucaagccauucauuca

SEQ ID NO: 944071 - RNA, 19 nt, Homo sapiens
ccacaugagggccauaaag

SEQ ID NO: 944072 - RNA, 19 nt, Homo sapiens
augguucccuuuauccuuu

SEQ ID NO: 944073 - RNA, 19 nt, Homo sapiens
gcucuuuccagguacauau

SEQ ID NO: 944074 - RNA, 19 nt, Homo sapiens
uguacuaguuaacugcauu

SEQ ID NO: 944075 - RNA, 19 nt, Homo sapiens
cuucugggguccuuucuua

SEQ ID NO: 944076 - RNA, 19 nt, Homo sapiens
ggucaugcuugcgauucuu

SEQ ID NO: 944077 - RNA, 19 nt, Homo sapiens
gaagcuaaagaucaacaag

SEQ ID NO: 944078 - RNA, 19 nt, Homo sapiens
cauuagauggcuucuuuau

SEQ ID NO: 944079 - RNA, 19 nt, Homo sapiens
gucuggacauuugccaaua

SEQ ID NO: 944080 - RNA, 19 nt, Homo sapiens
cuaauuaugggaaauagca

SEQ ID NO: 944081 - RNA, 19 nt, Homo sapiens
gaugguucccuuuauccuu

SEQ ID NO: 944082 - RNA, 19 nt, Homo sapiens
cauaaaggcagugaucauc

SEQ ID NO: 944083 - RNA, 19 nt, Homo sapiens
gcuuggccaucuccagaau

SEQ ID NO: 944084 - RNA, 19 nt, Homo sapiens
uacucaagauagccaauau

SEQ ID NO: 944085 - RNA, 19 nt, Homo sapiens
aucaagccauucauucauu

SEQ ID NO: 944086 - RNA, 19 nt, Homo sapiens
ggaaaauuaguguugauga

SEQ ID NO: 944087 - RNA, 19 nt, Homo sapiens
guccuuucuuaucucuuua

SEQ ID NO: 944088 - RNA, 19 nt, Homo sapiens
guacuaguuaacugcauug

SEQ ID NO: 944089 - RNA, 19 nt, Homo sapiens
ccaaagaaugaugauaugu

SEQ ID NO: 944090 - RNA, 19 nt, Homo sapiens
cucaagauagccaauauau

SEQ ID NO: 944091 - RNA, 19 nt, Homo sapiens
caucaagccauucauucau

SEQ ID NO: 944092 - RNA, 19 nt, Homo sapiens
ucaaagucagucaugaaga

SEQ ID NO: 944093 - RNA, 19 nt, Homo sapiens
ucugcuguguguaauauca

SEQ ID NO: 944094 - RNA, 19 nt, Homo sapiens
cguguacuacccagucuuu

SEQ ID NO: 944095 - RNA, 19 nt, Homo sapiens
ggccauaaaggcagugauc

SEQ ID NO: 944096 - RNA, 19 nt, Homo sapiens
agacacaccaagcagauuc

SEQ ID NO: 944097 - RNA, 19 nt, Homo sapiens
uggcugaagcuaaagauca

SEQ ID NO: 944098 - RNA, 19 nt, Homo sapiens
uccuuugccugaucucauu

SEQ ID NO: 944099 - RNA, 19 nt, Homo sapiens
uuaguguuccaaagaauga

SEQ ID NO: 944100 - RNA, 19 nt, Homo sapiens
ucauuguacuaguuaacug

SEQ ID NO: 944101 - RNA, 19 nt, Homo sapiens
aauucaagucucugguuua

SEQ ID NO: 944102 - RNA, 19 nt, Homo sapiens
caaguuagcuguggaguuu

SEQ ID NO: 944103 - RNA, 19 nt, Homo sapiens
guacugaguugugauuaua

SEQ ID NO: 944104 - RNA, 19 nt, Homo sapiens
ccuaauaacuggagaauuc

SEQ ID NO: 944105 - RNA, 19 nt, Homo sapiens
gaacccagauguuuauaca

SEQ ID NO: 944106 - RNA, 19 nt, Homo sapiens
gauuauagguuucaugcaa

SEQ ID NO: 944107 - RNA, 19 nt, Homo sapiens
cuacauccuuaccaauuua

SEQ ID NO: 944108 - RNA, 19 nt, Homo sapiens
guacugaacccagauguuu

SEQ ID NO: 944109 - RNA, 19 nt, Homo sapiens
agacauaccaagcaaauaa

SEQ ID NO: 944110 - RNA, 19 nt, Homo sapiens
gccuuaaugucuucuauuu

SEQ ID NO: 944111 - RNA, 19 nt, Homo sapiens
gacauuugccaacuacuua

SEQ ID NO: 944112 - RNA, 19 nt, Homo sapiens
acaguugacuacauccuua

SEQ ID NO: 944113 - RNA, 19 nt, Homo sapiens
gaauuuguuugaucagugu

SEQ ID NO: 944114 - RNA, 19 nt, Homo sapiens
caacuggauugacuggauu

SEQ ID NO: 944115 - RNA, 19 nt, Homo sapiens
gaguugugauuauagguuu

SEQ ID NO: 944116 - RNA, 19 nt, Homo sapiens
uggauugacuggauuaaga

SEQ ID NO: 944117 - RNA, 19 nt, Homo sapiens
uuacugaaauguuccaugu

SEQ ID NO: 944118 - RNA, 19 nt, Homo sapiens
caauaguacugaguuguga

SEQ ID NO: 944119 - RNA, 19 nt, Homo sapiens
ccuuauagcagcaauagua

SEQ ID NO: 944120 - RNA, 19 nt, Homo sapiens
gaaauguuccaugugagua

SEQ ID NO: 944121 - RNA, 19 nt, Homo sapiens
gccaacuacuuaaauaugu

SEQ ID NO: 944122 - RNA, 19 nt, Homo sapiens
uuaguuaucgccagaauuu

SEQ ID NO: 944123 - RNA, 19 nt, Homo sapiens
ggagacauaccaagcaaau

SEQ ID NO: 944124 - RNA, 19 nt, Homo sapiens
gcacuagucaacuggauug

SEQ ID NO: 944125 - RNA, 19 nt, Homo sapiens
aaacugaggcagacauuug

SEQ ID NO: 944126 - RNA, 19 nt, Homo sapiens
ggacauuugccaacuacuu

SEQ ID NO: 944127 - RNA, 19 nt, Homo sapiens
acugaaauguuccauguga

SEQ ID NO: 944128 - RNA, 19 nt, Homo sapiens
acccagauguuuauacaaa

SEQ ID NO: 944129 - RNA, 19 nt, Homo sapiens
gccagaauuuguuugauca

SEQ ID NO: 944130 - RNA, 19 nt, Homo sapiens
ggagaauucauacuaggaa

SEQ ID NO: 944131 - RNA, 19 nt, Homo sapiens
uugggucacucacuuauuu

SEQ ID NO: 944132 - RNA, 19 nt, Homo sapiens
gcaauaguacugaguugug

SEQ ID NO: 944133 - RNA, 19 nt, Homo sapiens
gacuacauccuuaccaauu

SEQ ID NO: 944134 - RNA, 19 nt, Homo sapiens
aaaauugccugcaugauau

SEQ ID NO: 944135 - RNA, 19 nt, Homo sapiens
ccaccugccuuaaugucuu

SEQ ID NO: 944136 - RNA, 19 nt, Homo sapiens
cagcaauaguacugaguug

SEQ ID NO: 944137 - RNA, 19 nt, Homo sapiens
uggauuaccaccugccuua

SEQ ID NO: 944138 - RNA, 19 nt, Homo sapiens
acuacauccuuaccaauuu

SEQ ID NO: 944139 - RNA, 19 nt, Homo sapiens
accuuuagcuaucuuauga

SEQ ID NO: 944140 - RNA, 19 nt, Homo sapiens
ggauugacuggauuaagaa

SEQ ID NO: 944141 - RNA, 19 nt, Homo sapiens
gaacccuugacucucuuua

SEQ ID NO: 944142 - RNA, 19 nt, Homo sapiens
gcagcaauaguacugaguu

SEQ ID NO: 944143 - RNA, 19 nt, Homo sapiens
ccaacuacuuaaauaugug

SEQ ID NO: 944144 - RNA, 19 nt, Homo sapiens
gacauaccaagcaaauaaa

SEQ ID NO: 944145 - RNA, 19 nt, Homo sapiens
ucaguguaaugguuguaaa

SEQ ID NO: 944146 - RNA, 19 nt, Homo sapiens
gcuuugccauuuccuuguu

SEQ ID NO: 944147 - RNA, 19 nt, Homo sapiens
gagacauaccaagcaaaua

SEQ ID NO: 944148 - RNA, 19 nt, Homo sapiens
gcaauugccaaacauaaaa

SEQ ID NO: 944149 - RNA, 19 nt, Homo sapiens
guucaugugagagccauua

SEQ ID NO: 944150 - RNA, 19 nt, Homo sapiens
uugacuggauuaagaagaa

SEQ ID NO: 944151 - RNA, 19 nt, Homo sapiens
guuugcaauugucccauuu

SEQ ID NO: 944152 - RNA, 19 nt, Homo sapiens
gcauuguaauaguacugaa

SEQ ID NO: 944153 - RNA, 19 nt, Homo sapiens
uugaugaccuuuagcuauc

SEQ ID NO: 944154 - RNA, 19 nt, Homo sapiens
ucuuuaaccuguuugcaau

SEQ ID NO: 944155 - RNA, 19 nt, Homo sapiens
gcugggaugcuuugccauu

SEQ ID NO: 944156 - RNA, 19 nt, Homo sapiens
cgccagaauuuguuugauc

SEQ ID NO: 944157 - RNA, 19 nt, Homo sapiens
ugacuggauuaagaagaaa

SEQ ID NO: 944158 - RNA, 19 nt, Homo sapiens
guguaaugguuguaaaugg

SEQ ID NO: 944159 - RNA, 19 nt, Homo sapiens
guucaguccugcagauaac

SEQ ID NO: 944160 - RNA, 19 nt, Homo sapiens
ugagagccauuaaaacuau

SEQ ID NO: 944161 - RNA, 19 nt, Homo sapiens
gaugaccuuuagcuaucuu

SEQ ID NO: 944162 - RNA, 19 nt, Homo sapiens
uaaccuguuugcaauuguc

SEQ ID NO: 944163 - RNA, 19 nt, Homo sapiens
gcuguggaguuuggagaga

SEQ ID NO: 944164 - RNA, 19 nt, Homo sapiens
uuugaucaguguaaugguu

SEQ ID NO: 944165 - RNA, 19 nt, Homo sapiens
agaaugcugacauguagaa

SEQ ID NO: 944166 - RNA, 19 nt, Homo sapiens
uugugucacugauaucauu

SEQ ID NO: 944167 - RNA, 19 nt, Homo sapiens
uugcaauugucccauuuau

SEQ ID NO: 944168 - RNA, 19 nt, Homo sapiens
aaauguuccaugugaguaa

SEQ ID NO: 944169 - RNA, 19 nt, Homo sapiens
uggcugaaguggaaaauug

SEQ ID NO: 944170 - RNA, 19 nt, Homo sapiens
gauagccaguuccucucau

SEQ ID NO: 944171 - RNA, 19 nt, Homo sapiens
ggauuaccaccugccuuaa

SEQ ID NO: 944172 - RNA, 19 nt, Homo sapiens
ucuggacauuugccaacua

SEQ ID NO: 944173 - RNA, 19 nt, Homo sapiens
cagaauuuguuugaucagu

SEQ ID NO: 944174 - RNA, 19 nt, Homo sapiens
ggauacauugcacuaguca

SEQ ID NO: 944175 - RNA, 19 nt, Homo sapiens
gaauauuggggaauggaua

SEQ ID NO: 944176 - RNA, 19 nt, Homo sapiens
ccauuuauugugucacuga

SEQ ID NO: 944177 - RNA, 19 nt, Homo sapiens
uuuaaccuguuugcaauug

SEQ ID NO: 944178 - RNA, 19 nt, Homo sapiens
aguacugaguugugauuau

SEQ ID NO: 944179 - RNA, 19 nt, Homo sapiens
cugggaugcuuugccauuu

SEQ ID NO: 944180 - RNA, 19 nt, Homo sapiens
uacugaacccagauguuua

SEQ ID NO: 944181 - RNA, 19 nt, Homo sapiens
uaaacugaggcagacauuu

SEQ ID NO: 944182 - RNA, 19 nt, Homo sapiens
gaccuuuagcuaucuuaug

SEQ ID NO: 944183 - RNA, 19 nt, Homo sapiens
uaagaucuuuauggagaca

SEQ ID NO: 944184 - RNA, 19 nt, Homo sapiens
ugaaauguuccaugugagu

SEQ ID NO: 944185 - RNA, 19 nt, Homo sapiens
caugcaauugccaaacaua

SEQ ID NO: 944186 - RNA, 19 nt, Homo sapiens
uguggaguuuggagagauu

SEQ ID NO: 944187 - RNA, 19 nt, Homo sapiens
gacucucuuuaaccuguuu

SEQ ID NO: 944188 - RNA, 19 nt, Homo sapiens
ugcaauugccaaacauaaa

SEQ ID NO: 944189 - RNA, 19 nt, Homo sapiens
ccaagcaaauaaaacucua

SEQ ID NO: 944190 - RNA, 19 nt, Homo sapiens
uuugaacccuugacucucu

SEQ ID NO: 944191 - RNA, 19 nt, Homo sapiens
ugaguugugauuauagguu

SEQ ID NO: 944192 - RNA, 19 nt, Homo sapiens
acauugcacuagucaacug

SEQ ID NO: 944193 - RNA, 19 nt, Homo sapiens
caguuccucucauccacuu

SEQ ID NO: 944194 - RNA, 19 nt, Homo sapiens
ugggaugcuuugccauuuc

SEQ ID NO: 944195 - RNA, 19 nt, Homo sapiens
cauccuuaccaauuuaguu

SEQ ID NO: 944196 - RNA, 19 nt, Homo sapiens
gaucaguguaaugguugua

SEQ ID NO: 944197 - RNA, 19 nt, Homo sapiens
uugacuacauccuuaccaa

SEQ ID NO: 944198 - RNA, 19 nt, Homo sapiens
aauguuccaugugaguaaa

SEQ ID NO: 944199 - RNA, 19 nt, Homo sapiens
guuaucgccagaauuuguu

SEQ ID NO: 944200 - RNA, 19 nt, Homo sapiens
uauagcagcaauaguacug

SEQ ID NO: 944201 - RNA, 19 nt, Homo sapiens
acuggagaauucauacuag

SEQ ID NO: 944202 - RNA, 19 nt, Homo sapiens
caaccugccucagcauuua

SEQ ID NO: 944203 - RNA, 19 nt, Homo sapiens
gcagacuacuuuauuguuc

SEQ ID NO: 944204 - RNA, 19 nt, Homo sapiens
gacacuaaccaaucauuua

SEQ ID NO: 944205 - RNA, 19 nt, Homo sapiens
ggaaaguaaugucuauucu

SEQ ID NO: 944206 - RNA, 19 nt, Homo sapiens
uuaaguaucugguuugcaa

SEQ ID NO: 944207 - RNA, 19 nt, Homo sapiens
gcagauaaagugcagacua

SEQ ID NO: 944208 - RNA, 19 nt, Homo sapiens
ucacaagucuggccauauc

SEQ ID NO: 944209 - RNA, 19 nt, Homo sapiens
uggaugaaguggagaauug

SEQ ID NO: 944210 - RNA, 19 nt, Homo sapiens
ggacacuaaccaaucauuu

SEQ ID NO: 944211 - RNA, 19 nt, Homo sapiens
caacaugcuucuaccaagu

SEQ ID NO: 944212 - RNA, 19 nt, Homo sapiens
ccaacaacauaaacaaauc

SEQ ID NO: 944213 - RNA, 19 nt, Homo sapiens
ggaguugcagaguaaauaa

SEQ ID NO: 944214 - RNA, 19 nt, Homo sapiens
gaagaaaauuccaacaaca

SEQ ID NO: 944215 - RNA, 19 nt, Homo sapiens
gugguucucucuguguuua

SEQ ID NO: 944216 - RNA, 19 nt, Homo sapiens
gcaaccugccucagcauuu

SEQ ID NO: 944217 - RNA, 19 nt, Homo sapiens
aaggugauuuggaaaguaa

SEQ ID NO: 944218 - RNA, 19 nt, Homo sapiens
cagauaaagugcagacuac

SEQ ID NO: 944219 - RNA, 19 nt, Homo sapiens
ggagacauaucaggcgaau

SEQ ID NO: 944220 - RNA, 19 nt, Homo sapiens
gaauuugaacgcugauuuc

SEQ ID NO: 944221 - RNA, 19 nt, Homo sapiens
gguaaagaaaugagaauca

SEQ ID NO: 944222 - RNA, 19 nt, Homo sapiens
aaaauugccuccauugauu

SEQ ID NO: 944223 - RNA, 19 nt, Homo sapiens
aaaggugauuuggaaagua

SEQ ID NO: 944224 - RNA, 19 nt, Homo sapiens
gaauugacagggugauuuc

SEQ ID NO: 944225 - RNA, 19 nt, Homo sapiens
uaaaggugauuuggaaagu

SEQ ID NO: 944226 - RNA, 19 nt, Homo sapiens
agacaugcaucucuaaagg

SEQ ID NO: 944227 - RNA, 19 nt, Homo sapiens
cuuagcaguuggagaguuu

SEQ ID NO: 944228 - RNA, 19 nt, Homo sapiens
ccucagcauuuacuauuuc

SEQ ID NO: 944229 - RNA, 19 nt, Homo sapiens
ggccauauccagaauuugu

SEQ ID NO: 944230 - RNA, 19 nt, Homo sapiens
gaaaauugccuccauugau

SEQ ID NO: 944231 - RNA, 19 nt, Homo sapiens
ccucaagucauucauuuau

SEQ ID NO: 944232 - RNA, 19 nt, Homo sapiens
gccucagcauuuacuauuu

SEQ ID NO: 944233 - RNA, 19 nt, Homo sapiens
ccucacaagucuggccaua

SEQ ID NO: 944234 - RNA, 19 nt, Homo sapiens
gacuucuucuggacacuaa

SEQ ID NO: 944235 - RNA, 19 nt, Homo sapiens
auuaagacaugcaucucua

SEQ ID NO: 944236 - RNA, 19 nt, Homo sapiens
cuaugccacugguaaagaa

SEQ ID NO: 944237 - RNA, 19 nt, Homo sapiens
uaagacaugcaucucuaaa

SEQ ID NO: 944238 - RNA, 19 nt, Homo sapiens
ggaaaacaaacuuaacuug

SEQ ID NO: 944239 - RNA, 19 nt, Homo sapiens
uauuuguccuuucucauug

SEQ ID NO: 944240 - RNA, 19 nt, Homo sapiens
gauuucagguuuuguguga

SEQ ID NO: 944241 - RNA, 19 nt, Homo sapiens
auccagaauuugucuauug

SEQ ID NO: 944242 - RNA, 19 nt, Homo sapiens
cuauuuguccuuucucauu

SEQ ID NO: 944243 - RNA, 19 nt, Homo sapiens
agacauaucaggcgaaugc

SEQ ID NO: 944244 - RNA, 19 nt, Homo sapiens
acaugcuucuaccaaguua

SEQ ID NO: 944245 - RNA, 19 nt, Homo sapiens
acuuggaguugcagaguaa

SEQ ID NO: 944246 - RNA, 19 nt, Homo sapiens
agaauuugaacgcugauuu

SEQ ID NO: 944247 - RNA, 19 nt, Homo sapiens
gugauuuccuggauucuac

SEQ ID NO: 944248 - RNA, 19 nt, Homo sapiens
cucuaaaggugauuuggaa

SEQ ID NO: 944249 - RNA, 19 nt, Homo sapiens
gguucucucuguguuuauu

SEQ ID NO: 944250 - RNA, 19 nt, Homo sapiens
gcuauauccagaugucuau

SEQ ID NO: 944251 - RNA, 19 nt, Homo sapiens
caacgcugcuccccuuuug

SEQ ID NO: 944252 - RNA, 19 nt, Homo sapiens
gagaauugacagggugauu

SEQ ID NO: 944253 - RNA, 19 nt, Homo sapiens
ggaugaaguggagaauuga

SEQ ID NO: 944254 - RNA, 19 nt, Homo sapiens
uaauuucuuucacccacuu

SEQ ID NO: 944255 - RNA, 19 nt, Homo sapiens
cagcauuuacuauuucuuc

SEQ ID NO: 944256 - RNA, 19 nt, Homo sapiens
ucuggacacuaaccaauca

SEQ ID NO: 944257 - RNA, 19 nt, Homo sapiens
gcauucauuggauugguaa

SEQ ID NO: 944258 - RNA, 19 nt, Homo sapiens
cuaccaaguuauuucucaa

SEQ ID NO: 944259 - RNA, 19 nt, Homo sapiens
gcauggacugggucaagaa

SEQ ID NO: 944260 - RNA, 19 nt, Homo sapiens
agaauugacagggugauuu

SEQ ID NO: 944261 - RNA, 19 nt, Homo sapiens
ggugcuauauccagauguc

SEQ ID NO: 944262 - RNA, 19 nt, Homo sapiens
ucaagucauucauuuaucc

SEQ ID NO: 944263 - RNA, 19 nt, Homo sapiens
aaacucaacaugcuucuac

SEQ ID NO: 944264 - RNA, 19 nt, Homo sapiens
gaguugcagaguaaauaaa

SEQ ID NO: 944265 - RNA, 19 nt, Homo sapiens
ggggaacaauaaauuaaga

SEQ ID NO: 944266 - RNA, 19 nt, Homo sapiens
ucuaccaaguuauuucuca

SEQ ID NO: 944267 - RNA, 19 nt, Homo sapiens
ugcauucauuggauuggua

SEQ ID NO: 944268 - RNA, 19 nt, Homo sapiens
ggaaaauugccuccauuga

SEQ ID NO: 944269 - RNA, 19 nt, Homo sapiens
gauagguaauuucuuucac

SEQ ID NO: 944270 - RNA, 19 nt, Homo sapiens
agugcagacuacuuuauug

SEQ ID NO: 944271 - RNA, 19 nt, Homo sapiens
cagacuacuuuauuguucu

SEQ ID NO: 944272 - RNA, 19 nt, Homo sapiens
uccagaauuugucuauugu

SEQ ID NO: 944273 - RNA, 19 nt, Homo sapiens
uggaaaguaaugucuauuc

SEQ ID NO: 944274 - RNA, 19 nt, Homo sapiens
ccucuuuauugccuacuau

SEQ ID NO: 944275 - RNA, 19 nt, Homo sapiens
uggaguugcagaguaaaua

SEQ ID NO: 944276 - RNA, 19 nt, Homo sapiens
uuaagacaugcaucucuaa

SEQ ID NO: 944277 - RNA, 19 nt, Homo sapiens
gcccugaaagcugucauuu

SEQ ID NO: 944278 - RNA, 19 nt, Homo sapiens
ggugauuuccuggauucua

SEQ ID NO: 944279 - RNA, 19 nt, Homo sapiens
gugcagacuacuuuauugu

SEQ ID NO: 944280 - RNA, 19 nt, Homo sapiens
gugaguccauagcucuaau

SEQ ID NO: 944281 - RNA, 19 nt, Homo sapiens
ggugaguccauagcucuaa

SEQ ID NO: 944282 - RNA, 19 nt, Homo sapiens
gcgugguucucucuguguu

SEQ ID NO: 944283 - RNA, 19 nt, Homo sapiens
gcaaagaggaaaacaaacu

SEQ ID NO: 944284 - RNA, 19 nt, Homo sapiens
guucucucuguguuuauua

SEQ ID NO: 944285 - RNA, 19 nt, Homo sapiens
ggugcgugguucucucugu

SEQ ID NO: 944286 - RNA, 19 nt, Homo sapiens
ccuacuauuuguccuuucu

SEQ ID NO: 944287 - RNA, 19 nt, Homo sapiens
uuauuguucuuagcaguug

SEQ ID NO: 944288 - RNA, 19 nt, Homo sapiens
cuaaaggugauuuggaaag

SEQ ID NO: 944289 - RNA, 19 nt, Homo sapiens
ccaccuccagcuacuuuau

SEQ ID NO: 944290 - RNA, 19 nt, Homo sapiens
ucauuggauugguaaacug

SEQ ID NO: 944291 - RNA, 19 nt, Homo sapiens
cuuuauugccuacuauuug

SEQ ID NO: 944292 - RNA, 19 nt, Homo sapiens
uuccuucuccucuuuauug

SEQ ID NO: 944293 - RNA, 19 nt, Homo sapiens
gcagagaccccagcacaga

SEQ ID NO: 944294 - RNA, 19 nt, Homo sapiens
uuccagccacugagaauuu

SEQ ID NO: 944295 - RNA, 19 nt, Homo sapiens
ugccuacuauuuguccuuu

SEQ ID NO: 944296 - RNA, 19 nt, Homo sapiens
ggaacaggauuaagaauua

SEQ ID NO: 944297 - RNA, 19 nt, Homo sapiens
gcagaaacaucuccagaaa

SEQ ID NO: 944298 - RNA, 19 nt, Homo sapiens
gaaccuuggucuucuuauu

SEQ ID NO: 944299 - RNA, 19 nt, Homo sapiens
gaaagugcccugccgagua

SEQ ID NO: 944300 - RNA, 19 nt, Homo sapiens
gaaagaaacacaacuugga

SEQ ID NO: 944301 - RNA, 19 nt, Homo sapiens
gguaugggcuaaacgauga

SEQ ID NO: 944302 - RNA, 19 nt, Homo sapiens
aaagagagcuguccucagu

SEQ ID NO: 944303 - RNA, 19 nt, Homo sapiens
gggcugaucugggaaauau

SEQ ID NO: 944304 - RNA, 19 nt, Homo sapiens
gcaacucaauuacaaagga

SEQ ID NO: 944305 - RNA, 19 nt, Homo sapiens
caaagugauucugaugaua

SEQ ID NO: 944306 - RNA, 19 nt, Homo sapiens
guucucauaucauggauuu

SEQ ID NO: 944307 - RNA, 19 nt, Homo sapiens
aaacacaacuuggaauuuc

SEQ ID NO: 944308 - RNA, 19 nt, Homo sapiens
gaaacacaacuuggaauuu

SEQ ID NO: 944309 - RNA, 19 nt, Homo sapiens
gagcaauggauuuauagua

SEQ ID NO: 944310 - RNA, 19 nt, Homo sapiens
gcugaucugggaaauauua

SEQ ID NO: 944311 - RNA, 19 nt, Homo sapiens
acagugaucuacaugcuuu

SEQ ID NO: 944312 - RNA, 19 nt, Homo sapiens
ccauacaaaugccuugaaa

SEQ ID NO: 944313 - RNA, 19 nt, Homo sapiens
gauaguuucuaaucacuuc

SEQ ID NO: 944314 - RNA, 19 nt, Homo sapiens
guaaacaaagugauucuga

SEQ ID NO: 944315 - RNA, 19 nt, Homo sapiens
gaucugggaaauauuagua

SEQ ID NO: 944316 - RNA, 19 nt, Homo sapiens
ugagugacuuugaaacauu

SEQ ID NO: 944317 - RNA, 19 nt, Homo sapiens
caacuuggaauuucaguau

SEQ ID NO: 944318 - RNA, 19 nt, Homo sapiens
ggaccgauaugaaagaaac

SEQ ID NO: 944319 - RNA, 19 nt, Homo sapiens
gagaguaaacaaagugauu

SEQ ID NO: 944320 - RNA, 19 nt, Homo sapiens
gagugacuuugaaacauuu

SEQ ID NO: 944321 - RNA, 19 nt, Homo sapiens
gaaguggagaguaaacaaa

SEQ ID NO: 944322 - RNA, 19 nt, Homo sapiens
gcuacaaucuucagcaucu

SEQ ID NO: 944323 - RNA, 19 nt, Homo sapiens
acaaaugccuugaaaauug

SEQ ID NO: 944324 - RNA, 19 nt, Homo sapiens
aaagugcccugccgaguau

SEQ ID NO: 944325 - RNA, 19 nt, Homo sapiens
uauuugaaguggagaguaa

SEQ ID NO: 944326 - RNA, 19 nt, Homo sapiens
gaauuugagcaauggauuu

SEQ ID NO: 944327 - RNA, 19 nt, Homo sapiens
gagcuguccucagucgaua

SEQ ID NO: 944328 - RNA, 19 nt, Homo sapiens
gaacacagugaucuacaug

SEQ ID NO: 944329 - RNA, 19 nt, Homo sapiens
caaauucacuaugacuaug

SEQ ID NO: 944330 - RNA, 19 nt, Homo sapiens
guacugaucaacugcauug

SEQ ID NO: 944331 - RNA, 19 nt, Homo sapiens
gucgauaaacuccucauua

SEQ ID NO: 944332 - RNA, 19 nt, Homo sapiens
ucuaggaaacgcuaaguua

SEQ ID NO: 944333 - RNA, 19 nt, Homo sapiens
gcuaguuucuuucuaugug

SEQ ID NO: 944334 - RNA, 19 nt, Homo sapiens
aagacuggcuggaccgaua

SEQ ID NO: 944335 - RNA, 19 nt, Homo sapiens
ucaagccacuccuuucuuc

SEQ ID NO: 944336 - RNA, 19 nt, Homo sapiens
cagcuaagguaugggcuaa

SEQ ID NO: 944337 - RNA, 19 nt, Homo sapiens
ggaauuugagcaauggauu

SEQ ID NO: 944338 - RNA, 19 nt, Homo sapiens
ucuaaucacuucaaucucu

SEQ ID NO: 944339 - RNA, 19 nt, Homo sapiens
ccacuccuuucuucugauu

SEQ ID NO: 944340 - RNA, 19 nt, Homo sapiens
ggaauuucaguaugaguga

SEQ ID NO: 944341 - RNA, 19 nt, Homo sapiens
acaaagugauucugaugau

SEQ ID NO: 944342 - RNA, 19 nt, Homo sapiens
ugcauuaucuagccauauu

SEQ ID NO: 944343 - RNA, 19 nt, Homo sapiens
gggaaauauuaguaaguug

SEQ ID NO: 944344 - RNA, 19 nt, Homo sapiens
ugaucuacaugcuuuguga

SEQ ID NO: 944345 - RNA, 19 nt, Homo sapiens
gcaauggauuuauaguacu

SEQ ID NO: 944346 - RNA, 19 nt, Homo sapiens
cuaggaaacgcuaaguuaa

SEQ ID NO: 944347 - RNA, 19 nt, Homo sapiens
ggauuuauaguacugauca

SEQ ID NO: 944348 - RNA, 19 nt, Homo sapiens
gcuggauaguuucuaauca

SEQ ID NO: 944349 - RNA, 19 nt, Homo sapiens
auugugaucucauuccuuu

SEQ ID NO: 944350 - RNA, 19 nt, Homo sapiens
agaaacaucuccagaaaau

SEQ ID NO: 944351 - RNA, 19 nt, Homo sapiens
ucggucaaauucacuauga

SEQ ID NO: 944352 - RNA, 19 nt, Homo sapiens
aggaaacgcuaaguuaaga

SEQ ID NO: 944353 - RNA, 19 nt, Homo sapiens
caguaugagugacuuugaa

SEQ ID NO: 944354 - RNA, 19 nt, Homo sapiens
aaagaaacacaacuuggaa

SEQ ID NO: 944355 - RNA, 19 nt, Homo sapiens
aaacaaagugauucugaug

SEQ ID NO: 944356 - RNA, 19 nt, Homo sapiens
gaaacgcuaaguuaagaca

SEQ ID NO: 944357 - RNA, 19 nt, Homo sapiens
caauggauuuauaguacug

SEQ ID NO: 944358 - RNA, 19 nt, Homo sapiens
agaaacacaacuuggaauu

SEQ ID NO: 944359 - RNA, 19 nt, Homo sapiens
gcuaggaaccuuggucuuc

SEQ ID NO: 944360 - RNA, 19 nt, Homo sapiens
gcuaagguaugggcuaaac

SEQ ID NO: 944361 - RNA, 19 nt, Homo sapiens
uucaaucucuggcuugcua

SEQ ID NO: 944362 - RNA, 19 nt, Homo sapiens
uggaacaggauuaagaauu

SEQ ID NO: 944363 - RNA, 19 nt, Homo sapiens
ggauuucugagcuguauca

SEQ ID NO: 944364 - RNA, 19 nt, Homo sapiens
gguggcagcuaagguaugg

SEQ ID NO: 944365 - RNA, 19 nt, Homo sapiens
aaccuuggucuucuuauuu

SEQ ID NO: 944366 - RNA, 19 nt, Homo sapiens
gcauuaucuagccauauuu

SEQ ID NO: 944367 - RNA, 19 nt, Homo sapiens
acuuggaauuucaguauga

SEQ ID NO: 944368 - RNA, 19 nt, Homo sapiens
agcaauggauuuauaguac

SEQ ID NO: 944369 - RNA, 19 nt, Homo sapiens
uaaguuaagacaggccuuu

SEQ ID NO: 944370 - RNA, 19 nt, Homo sapiens
caaaugccuugaaaauugu

SEQ ID NO: 944371 - RNA, 19 nt, Homo sapiens
uggcuggaccgauaugaaa

SEQ ID NO: 944372 - RNA, 19 nt, Homo sapiens
uaagguaugggcuaaacga

SEQ ID NO: 944373 - RNA, 19 nt, Homo sapiens
caaaauagcgaguuucucu

SEQ ID NO: 944374 - RNA, 19 nt, Homo sapiens
uuauaguacugaucaacug

SEQ ID NO: 944375 - RNA, 19 nt, Homo sapiens
uaucuagccauauuugugu

SEQ ID NO: 944376 - RNA, 19 nt, Homo sapiens
agaacacagugaucuacau

SEQ ID NO: 944377 - RNA, 19 nt, Homo sapiens
gaaaaugcaacucaauuac

SEQ ID NO: 944378 - RNA, 19 nt, Homo sapiens
ugaaguggagaguaaacaa

SEQ ID NO: 944379 - RNA, 19 nt, Homo sapiens
gauaugaaagaaacacaac

SEQ ID NO: 944380 - RNA, 19 nt, Homo sapiens
gcccugcuuuucucuauuu

SEQ ID NO: 944381 - RNA, 19 nt, Homo sapiens
aaauagcgaguuucucuag

SEQ ID NO: 944382 - RNA, 19 nt, Homo sapiens
uaggaaacgcuaaguuaag

SEQ ID NO: 944383 - RNA, 19 nt, Homo sapiens
acacagugaucuacaugcu

SEQ ID NO: 944384 - RNA, 19 nt, Homo sapiens
uaaacuccucauuaucuug

SEQ ID NO: 944385 - RNA, 19 nt, Homo sapiens
caauuacaaaggacacaga

SEQ ID NO: 944386 - RNA, 19 nt, Homo sapiens
uaggaaccuuggucuucuu

SEQ ID NO: 944387 - RNA, 19 nt, Homo sapiens
cuaggaaccuuggucuucu

SEQ ID NO: 944388 - RNA, 19 nt, Homo sapiens
uaugagugacuuugaaaca

SEQ ID NO: 944389 - RNA, 19 nt, Homo sapiens
ucaguaugagugacuuuga

SEQ ID NO: 944390 - RNA, 19 nt, Homo sapiens
cucauuaucuuggcaaucu

SEQ ID NO: 944391 - RNA, 19 nt, Homo sapiens
cauuaucuagccauauuug

SEQ ID NO: 944392 - RNA, 19 nt, Homo sapiens
gcuggaccgauaugaaaga

SEQ ID NO: 944393 - RNA, 19 nt, Homo sapiens
aaagugauucugaugauac

SEQ ID NO: 944394 - RNA, 19 nt, Homo sapiens
gcuguccucagucgauaaa

SEQ ID NO: 944395 - RNA, 19 nt, Homo sapiens
ggauaguuucuaaucacuu

SEQ ID NO: 944396 - RNA, 19 nt, Homo sapiens
gguaaucaaucaaguaugu

SEQ ID NO: 944397 - RNA, 19 nt, Homo sapiens
ccgguaaccuaauugaaua

SEQ ID NO: 944398 - RNA, 19 nt, Homo sapiens
gaaaacaaacugcugcuua

SEQ ID NO: 944399 - RNA, 19 nt, Homo sapiens
uugaagagcagaacaaaua

SEQ ID NO: 944400 - RNA, 19 nt, Homo sapiens
acagauggauuuauacaga

SEQ ID NO: 944401 - RNA, 19 nt, Homo sapiens
cggcuuagcuauuucaaga

SEQ ID NO: 944402 - RNA, 19 nt, Homo sapiens
caauugaagugcugugaga

SEQ ID NO: 944403 - RNA, 19 nt, Homo sapiens
gagcagaacaaauaugguu

SEQ ID NO: 944404 - RNA, 19 nt, Homo sapiens
cagaugcaaucgaauguga

SEQ ID NO: 944405 - RNA, 19 nt, Homo sapiens
ucugggaucucaacaugua

SEQ ID NO: 944406 - RNA, 19 nt, Homo sapiens
ggucacucauuuaucuuaa

SEQ ID NO: 944407 - RNA, 19 nt, Homo sapiens
acaaacugcugcuuauguu

SEQ ID NO: 944408 - RNA, 19 nt, Homo sapiens
gaauggauuuauuggacuu

SEQ ID NO: 944409 - RNA, 19 nt, Homo sapiens
guucuucccuucaugauag

SEQ ID NO: 944410 - RNA, 19 nt, Homo sapiens
auacagauauucucuccaa

SEQ ID NO: 944411 - RNA, 19 nt, Homo sapiens
aggcauggccauagaaaua

SEQ ID NO: 944412 - RNA, 19 nt, Homo sapiens
ggagucauuuucuucuuua

SEQ ID NO: 944413 - RNA, 19 nt, Homo sapiens
acgauuggcuuuauucuca

SEQ ID NO: 944414 - RNA, 19 nt, Homo sapiens
ggauuuauuggacuuguaa

SEQ ID NO: 944415 - RNA, 19 nt, Homo sapiens
gaaugugacaggauugaga

SEQ ID NO: 944416 - RNA, 19 nt, Homo sapiens
gcuuagcuauuucaagaau

SEQ ID NO: 944417 - RNA, 19 nt, Homo sapiens
ugaggguacugcagcaauu

SEQ ID NO: 944418 - RNA, 19 nt, Homo sapiens
gaagagcagaacaaauaug

SEQ ID NO: 944419 - RNA, 19 nt, Homo sapiens
acaggcagaugcaaucgaa

SEQ ID NO: 944420 - RNA, 19 nt, Homo sapiens
uaucuacgauuggcuuuau

SEQ ID NO: 944421 - RNA, 19 nt, Homo sapiens
ggaaacagcaagcuaaagc

SEQ ID NO: 944422 - RNA, 19 nt, Homo sapiens
gagagacuccaacacagaa

SEQ ID NO: 944423 - RNA, 19 nt, Homo sapiens
cugcuuauguuuggaauga

SEQ ID NO: 944424 - RNA, 19 nt, Homo sapiens
ggacuuguaaacugcauug

SEQ ID NO: 944425 - RNA, 19 nt, Homo sapiens
cuaggaaacagcaagcuaa

SEQ ID NO: 944426 - RNA, 19 nt, Homo sapiens
gugaaggcaaugaaaguuu

SEQ ID NO: 944427 - RNA, 19 nt, Homo sapiens
ucaaucaaguaugugguuu

SEQ ID NO: 944428 - RNA, 19 nt, Homo sapiens
uugcauacauugcgaagau

SEQ ID NO: 944429 - RNA, 19 nt, Homo sapiens
uccugaagauagcaaauuu

SEQ ID NO: 944430 - RNA, 19 nt, Homo sapiens
caucauccucuuuaucuug

SEQ ID NO: 944431 - RNA, 19 nt, Homo sapiens
gggucacucauuuaucuua

SEQ ID NO: 944432 - RNA, 19 nt, Homo sapiens
gcauggccauagaaauauc

SEQ ID NO: 944433 - RNA, 19 nt, Homo sapiens
aaacgaagaaugacacagu

SEQ ID NO: 944434 - RNA, 19 nt, Homo sapiens
aaaacaaacugcugcuuau

SEQ ID NO: 944435 - RNA, 19 nt, Homo sapiens
gccucagcaucuucuauuu

SEQ ID NO: 944436 - RNA, 19 nt, Homo sapiens
gaaacagcaagcuaaagca

SEQ ID NO: 944437 - RNA, 19 nt, Homo sapiens
cagauggauuuauacagau

SEQ ID NO: 944438 - RNA, 19 nt, Homo sapiens
gacaaccacagccaucuau

SEQ ID NO: 944439 - RNA, 19 nt, Homo sapiens
ggccauagaaauaucaugu

SEQ ID NO: 944440 - RNA, 19 nt, Homo sapiens
auauuucucugguugaaga

SEQ ID NO: 944441 - RNA, 19 nt, Homo sapiens
ugaaggcaaugaaaguuuu

SEQ ID NO: 944442 - RNA, 19 nt, Homo sapiens
agucugggaucucaacaug

SEQ ID NO: 944443 - RNA, 19 nt, Homo sapiens
gacacagucugggaucuca

SEQ ID NO: 944444 - RNA, 19 nt, Homo sapiens
gcauugacugugccaagaa

SEQ ID NO: 944445 - RNA, 19 nt, Homo sapiens
cacuaucccuaauuacaug

SEQ ID NO: 944446 - RNA, 19 nt, Homo sapiens
gggagucauuuucuucuuu

SEQ ID NO: 944447 - RNA, 19 nt, Homo sapiens
uuauuggacuuguaaacug

SEQ ID NO: 944448 - RNA, 19 nt, Homo sapiens
aaacagcaagcuaaagcaa

SEQ ID NO: 944449 - RNA, 19 nt, Homo sapiens
gcuuauguuuggaaugaca

SEQ ID NO: 944450 - RNA, 19 nt, Homo sapiens
ugagagacuccaacacaga

SEQ ID NO: 944451 - RNA, 19 nt, Homo sapiens
uuaaucauuucccuuugga

SEQ ID NO: 944452 - RNA, 19 nt, Homo sapiens
ugacaaccacagccaucua

SEQ ID NO: 944453 - RNA, 19 nt, Homo sapiens
uuauaggcauggccauaga

SEQ ID NO: 944454 - RNA, 19 nt, Homo sapiens
guuagugagucaguguuug

SEQ ID NO: 944455 - RNA, 19 nt, Homo sapiens
ugaagagcagaacaaauau

SEQ ID NO: 944456 - RNA, 19 nt, Homo sapiens
acagauauucucuccaaau

SEQ ID NO: 944457 - RNA, 19 nt, Homo sapiens
cauccucuuuaucuuguau

SEQ ID NO: 944458 - RNA, 19 nt, Homo sapiens
uggauuuauuggacuugua

SEQ ID NO: 944459 - RNA, 19 nt, Homo sapiens
gggaucucaacauguauaa

SEQ ID NO: 944460 - RNA, 19 nt, Homo sapiens
ccaccagccucagcaucuu

SEQ ID NO: 944461 - RNA, 19 nt, Homo sapiens
uaggaaacagcaagcuaaa

SEQ ID NO: 944462 - RNA, 19 nt, Homo sapiens
gcauacauugcgaagauuc

SEQ ID NO: 944463 - RNA, 19 nt, Homo sapiens
cauugacugugccaagaau

SEQ ID NO: 944464 - RNA, 19 nt, Homo sapiens
cuuguaaacugcauugacu

SEQ ID NO: 944465 - RNA, 19 nt, Homo sapiens
ggauugagagacuccaaca

SEQ ID NO: 944466 - RNA, 19 nt, Homo sapiens
acauauuucucugguugaa

SEQ ID NO: 944467 - RNA, 19 nt, Homo sapiens
auauauaugccuccgguaa

SEQ ID NO: 944468 - RNA, 19 nt, Homo sapiens
aagcucaugugaaggcaau

SEQ ID NO: 944469 - RNA, 19 nt, Homo sapiens
guaguuagugagucagugu

SEQ ID NO: 944470 - RNA, 19 nt, Homo sapiens
gguucuucccuucaugaua

SEQ ID NO: 944471 - RNA, 19 nt, Homo sapiens
guacugcagcaauugaagu

SEQ ID NO: 944472 - RNA, 19 nt, Homo sapiens
aaacaaacugcugcuuaug

SEQ ID NO: 944473 - RNA, 19 nt, Homo sapiens
ggcauggccauagaaauau

SEQ ID NO: 944474 - RNA, 19 nt, Homo sapiens
caaucaaguaugugguuug

SEQ ID NO: 944475 - RNA, 19 nt, Homo sapiens
gaggguacugcagcaauug

SEQ ID NO: 944476 - RNA, 19 nt, Homo sapiens
gccauagaaauaucauguu

SEQ ID NO: 944477 - RNA, 19 nt, Homo sapiens
ucauuucccuuuggagaca

SEQ ID NO: 944478 - RNA, 19 nt, Homo sapiens
gguugaagagcagaacaaa

SEQ ID NO: 944479 - RNA, 19 nt, Homo sapiens
ucuuucaucauccucuuua

SEQ ID NO: 944480 - RNA, 19 nt, Homo sapiens
uaucuuucaucauccucuu

SEQ ID NO: 944481 - RNA, 19 nt, Homo sapiens
gugacaggauugagagacu

SEQ ID NO: 944482 - RNA, 19 nt, Homo sapiens
gaugcaaucgaaugugaca

SEQ ID NO: 944483 - RNA, 19 nt, Homo sapiens
ugccuccgguaaccuaauu

SEQ ID NO: 944484 - RNA, 19 nt, Homo sapiens
gcagaugcaaucgaaugug

SEQ ID NO: 944485 - RNA, 19 nt, Homo sapiens
gcuaaaucugggagucauu

SEQ ID NO: 944486 - RNA, 19 nt, Homo sapiens
cucaccggcuuagcuauuu

SEQ ID NO: 944487 - RNA, 19 nt, Homo sapiens
aacaaacugcugcuuaugu

SEQ ID NO: 944488 - RNA, 19 nt, Homo sapiens
ucaucauccucuuuaucuu

SEQ ID NO: 944489 - RNA, 19 nt, Homo sapiens
acacuaucccuaauuacau

SEQ ID NO: 944490 - RNA, 19 nt, Homo sapiens
uacacuaucccuaauuaca

SEQ ID NO: 944491 - RNA, 19 nt, Homo sapiens
ugggaucucaacauguaua

SEQ ID NO: 944492 - RNA, 19 nt, Homo sapiens
ccucagcaucuucuauuuc

SEQ ID NO: 944493 - RNA, 19 nt, Homo sapiens
gaauuagccugguuugguu

SEQ ID NO: 944494 - RNA, 19 nt, Homo sapiens
gggaauggcuuauccuuca

SEQ ID NO: 944495 - RNA, 19 nt, Homo sapiens
gagcauauuuacauucguu

SEQ ID NO: 944496 - RNA, 19 nt, Homo sapiens
acuaauaucuggacaguga

SEQ ID NO: 944497 - RNA, 19 nt, Homo sapiens
ugagguacauguucaaaga

SEQ ID NO: 944498 - RNA, 19 nt, Homo sapiens
ggaaacaucgcaagaagau

SEQ ID NO: 944499 - RNA, 19 nt, Homo sapiens
ucacucauguguucugauu

SEQ ID NO: 944500 - RNA, 19 nt, Homo sapiens
gcagcacacugucaaaaua

SEQ ID NO: 944501 - RNA, 19 nt, Homo sapiens
gcacugauaaacauccaua

SEQ ID NO: 944502 - RNA, 19 nt, Homo sapiens
ugacuucggucuucuuguu

SEQ ID NO: 944503 - RNA, 19 nt, Homo sapiens
cuacaggccucgguacuuu

SEQ ID NO: 944504 - RNA, 19 nt, Homo sapiens
uuggcaaucucucgaauua

SEQ ID NO: 944505 - RNA, 19 nt, Homo sapiens
gcccucaggucacaaagaa

SEQ ID NO: 944506 - RNA, 19 nt, Homo sapiens
gaaacaagaagcugagaca

SEQ ID NO: 944507 - RNA, 19 nt, Homo sapiens
gcaguucugauucaaguaa

SEQ ID NO: 944508 - RNA, 19 nt, Homo sapiens
ugugaucacuuucuuccua

SEQ ID NO: 944509 - RNA, 19 nt, Homo sapiens
ggauacagaagaaacaaga

SEQ ID NO: 944510 - RNA, 19 nt, Homo sapiens
ccauauaaaugccaguauc

SEQ ID NO: 944511 - RNA, 19 nt, Homo sapiens
gcacuggugaacuguauug

SEQ ID NO: 944512 - RNA, 19 nt, Homo sapiens
uagccugguuugguuaaua

SEQ ID NO: 944513 - RNA, 19 nt, Homo sapiens
ucauagcacuggugaacug

SEQ ID NO: 944514 - RNA, 19 nt, Homo sapiens
guggaaacaucgcaagaag

SEQ ID NO: 944515 - RNA, 19 nt, Homo sapiens
uuuagugucugguuagcua

SEQ ID NO: 944516 - RNA, 19 nt, Homo sapiens
ucugaaagguuggaggaaa

SEQ ID NO: 944517 - RNA, 19 nt, Homo sapiens
uagcacuggugaacuguau

SEQ ID NO: 944518 - RNA, 19 nt, Homo sapiens
uuucauacccuuuacuuug

SEQ ID NO: 944519 - RNA, 19 nt, Homo sapiens
ccucaggucacaaagaauu

SEQ ID NO: 944520 - RNA, 19 nt, Homo sapiens
ggcaaucucucgaauuagc

SEQ ID NO: 944521 - RNA, 19 nt, Homo sapiens
ggaauggcuuauccuucau

SEQ ID NO: 944522 - RNA, 19 nt, Homo sapiens
aaccagcacuguguucauu

SEQ ID NO: 944523 - RNA, 19 nt, Homo sapiens
cagaaugcuuacuaauauc

SEQ ID NO: 944524 - RNA, 19 nt, Homo sapiens
cagcuuuauuugccacuga

SEQ ID NO: 944525 - RNA, 19 nt, Homo sapiens
cgaauuagccugguuuggu

SEQ ID NO: 944526 - RNA, 19 nt, Homo sapiens
uggcuuauccuucauguca

SEQ ID NO: 944527 - RNA, 19 nt, Homo sapiens
guauuaaccagcacugugu

SEQ ID NO: 944528 - RNA, 19 nt, Homo sapiens
gcuggugugugucuguguu

SEQ ID NO: 944529 - RNA, 19 nt, Homo sapiens
gacuugcaguucugauuca

SEQ ID NO: 944530 - RNA, 19 nt, Homo sapiens
cauauaaaugccaguauca

SEQ ID NO: 944531 - RNA, 19 nt, Homo sapiens
uaaaugccaguaucaaugg

SEQ ID NO: 944532 - RNA, 19 nt, Homo sapiens
uuacuaauaucuggacagu

SEQ ID NO: 944533 - RNA, 19 nt, Homo sapiens
ucaggucacaaagaauuua

SEQ ID NO: 944534 - RNA, 19 nt, Homo sapiens
uggcugagguacauguuca

SEQ ID NO: 944535 - RNA, 19 nt, Homo sapiens
auaaaugccaguaucaaug

SEQ ID NO: 944536 - RNA, 19 nt, Homo sapiens
ucacuuucuuccuacucua

SEQ ID NO: 944537 - RNA, 19 nt, Homo sapiens
gaagcuggugugugucugu

SEQ ID NO: 944538 - RNA, 19 nt, Homo sapiens
ggagcccucaggucacaaa

SEQ ID NO: 944539 - RNA, 19 nt, Homo sapiens
gaauggcuuauccuucaug

SEQ ID NO: 944540 - RNA, 19 nt, Homo sapiens
caauguuucuucuccucau

SEQ ID NO: 944541 - RNA, 19 nt, Homo sapiens
aucaauggauacagaagaa

SEQ ID NO: 944542 - RNA, 19 nt, Homo sapiens
acucauguguucugauucu

SEQ ID NO: 944543 - RNA, 19 nt, Homo sapiens
uucauacccuuuacuuugu

SEQ ID NO: 944544 - RNA, 19 nt, Homo sapiens
uguucagaaugcuuacuaa

SEQ ID NO: 944545 - RNA, 19 nt, Homo sapiens
uucggaagcuggugugugu

SEQ ID NO: 944546 - RNA, 19 nt, Homo sapiens
ggagacgccagcaccaaag

SEQ ID NO: 944547 - RNA, 19 nt, Homo sapiens
ggucaagggaagaaagauc

SEQ ID NO: 944548 - RNA, 19 nt, Homo sapiens
cuccucaucuucuccaugu

SEQ ID NO: 944549 - RNA, 19 nt, Homo sapiens
cuggugaacuguauugacu

SEQ ID NO: 944550 - RNA, 19 nt, Homo sapiens
ccacagaggaguuaaaagu

SEQ ID NO: 944551 - RNA, 19 nt, Homo sapiens
aagagcauauuuacauucg

SEQ ID NO: 944552 - RNA, 19 nt, Homo sapiens
ccagcacuguguucauuuu

SEQ ID NO: 944553 - RNA, 19 nt, Homo sapiens
uugcaguucugauucaagu

SEQ ID NO: 944554 - RNA, 19 nt, Homo sapiens
gcuacaggccucgguacuu

SEQ ID NO: 944555 - RNA, 19 nt, Homo sapiens
caaagcccacagaggaguu

SEQ ID NO: 944556 - RNA, 19 nt, Homo sapiens
acacgauuuuccagucuua

SEQ ID NO: 944557 - RNA, 19 nt, Homo sapiens
guucagaaugcuuacuaau

SEQ ID NO: 944558 - RNA, 19 nt, Homo sapiens
agguacauguucaaagaug

SEQ ID NO: 944559 - RNA, 19 nt, Homo sapiens
agccugguuugguuaauau

SEQ ID NO: 944560 - RNA, 19 nt, Homo sapiens
cggagacgccagcaccaaa

SEQ ID NO: 944561 - RNA, 19 nt, Homo sapiens
gaugcagcacacugucaaa

SEQ ID NO: 944562 - RNA, 19 nt, Homo sapiens
ggucacaaagaauuuagag

SEQ ID NO: 944563 - RNA, 19 nt, Homo sapiens
gcugagguacauguucaaa

SEQ ID NO: 944564 - RNA, 19 nt, Homo sapiens
agaagaugcagcacacugu

SEQ ID NO: 944565 - RNA, 19 nt, Homo sapiens
ccucacugcuuuggcaauc

SEQ ID NO: 944566 - RNA, 19 nt, Homo sapiens
gacuucggucuucuuguuu

SEQ ID NO: 944567 - RNA, 19 nt, Homo sapiens
ggucaaagcugauaacuca

SEQ ID NO: 944568 - RNA, 19 nt, Homo sapiens
cgacuggcaugcauuggua

SEQ ID NO: 944569 - RNA, 19 nt, Homo sapiens
ggacaagaacgcucccuuu

SEQ ID NO: 944570 - RNA, 19 nt, Homo sapiens
ggagugcgccuacgaguga

SEQ ID NO: 944571 - RNA, 19 nt, Homo sapiens
ggaaagggcugcgggaacu

SEQ ID NO: 944572 - RNA, 19 nt, Homo sapiens
ggugaacgcuuuggccauu

SEQ ID NO: 944573 - RNA, 19 nt, Homo sapiens
guacugagaggaggugaua

SEQ ID NO: 944574 - RNA, 19 nt, Homo sapiens
ggacgcugcuggugaacga

SEQ ID NO: 944575 - RNA, 19 nt, Homo sapiens
cagccagucugacaucuga

SEQ ID NO: 944576 - RNA, 19 nt, Homo sapiens
ggugcgcacuccuuaaaga

SEQ ID NO: 944577 - RNA, 19 nt, Homo sapiens
ccugcaaggugggcuaaua

SEQ ID NO: 944578 - RNA, 19 nt, Homo sapiens
gagcgucccaggcauagaa

SEQ ID NO: 944579 - RNA, 19 nt, Homo sapiens
uucaggagcuuacuggaaa

SEQ ID NO: 944580 - RNA, 19 nt, Homo sapiens
ccaccacgcucaggauuca

SEQ ID NO: 944581 - RNA, 19 nt, Homo sapiens
uaugaugguuugucaguag

SEQ ID NO: 944582 - RNA, 19 nt, Homo sapiens
caagaacgcucccuuuugg

SEQ ID NO: 944583 - RNA, 19 nt, Homo sapiens
ggcauggcauuaacacugu

SEQ ID NO: 944584 - RNA, 19 nt, Homo sapiens
cuacgaaggccgugcuuug

SEQ ID NO: 944585 - RNA, 19 nt, Homo sapiens
ggaaggcuuucaggagcuu

SEQ ID NO: 944586 - RNA, 19 nt, Homo sapiens
gcaaggugggcuaauaaag

SEQ ID NO: 944587 - RNA, 19 nt, Homo sapiens
ccauggcucuccugaccaa

SEQ ID NO: 944588 - RNA, 19 nt, Homo sapiens
caaggugggcuaauaaagg

SEQ ID NO: 944589 - RNA, 19 nt, Homo sapiens
gcugagcgucccaggcaua

SEQ ID NO: 944590 - RNA, 19 nt, Homo sapiens
agucugacaucugacguuu

SEQ ID NO: 944591 - RNA, 19 nt, Homo sapiens
ugacacagccagccagucu

SEQ ID NO: 944592 - RNA, 19 nt, Homo sapiens
aggauucacuccacuacga

SEQ ID NO: 944593 - RNA, 19 nt, Homo sapiens
gcuaugaugguuugucagu

SEQ ID NO: 944594 - RNA, 19 nt, Homo sapiens
gaacugcaccgcggagacu

SEQ ID NO: 944595 - RNA, 19 nt, Homo sapiens
cgacaucaucuucaaggau

SEQ ID NO: 944596 - RNA, 19 nt, Homo sapiens
ccgcuacucuacaagcaau

SEQ ID NO: 944597 - RNA, 19 nt, Homo sapiens
gacaagaacgcucccuuuu

SEQ ID NO: 944598 - RNA, 19 nt, Homo sapiens
cugcaaggugggcuaauaa

SEQ ID NO: 944599 - RNA, 19 nt, Homo sapiens
gauggugcgcacuccuuaa

SEQ ID NO: 944600 - RNA, 19 nt, Homo sapiens
gaggugauaccggguccua

SEQ ID NO: 944601 - RNA, 19 nt, Homo sapiens
gggcaaccucguacugaga

SEQ ID NO: 944602 - RNA, 19 nt, Homo sapiens
cuaugaugguuugucagua

SEQ ID NO: 944603 - RNA, 19 nt, Homo sapiens
ugauggugcgcacuccuua

SEQ ID NO: 944604 - RNA, 19 nt, Homo sapiens
ccauugccgugaugaacau

SEQ ID NO: 944605 - RNA, 19 nt, Homo sapiens
acacagccagccagucuga

SEQ ID NO: 944606 - RNA, 19 nt, Homo sapiens
ggagaguuagugaggacaa

SEQ ID NO: 944607 - RNA, 19 nt, Homo sapiens
cugcuaugaugguuuguca

SEQ ID NO: 944608 - RNA, 19 nt, Homo sapiens
ggauucacuccacuacgaa

SEQ ID NO: 944609 - RNA, 19 nt, Homo sapiens
ugaccgagcguuguaagga

SEQ ID NO: 944610 - RNA, 19 nt, Homo sapiens
gaguuagugaggacaagaa

SEQ ID NO: 944611 - RNA, 19 nt, Homo sapiens
gagaguuagugaggacaag

SEQ ID NO: 944612 - RNA, 19 nt, Homo sapiens
acgauguccuggccucuug

SEQ ID NO: 944613 - RNA, 19 nt, Homo sapiens
gucaguagcagguccuaga

SEQ ID NO: 944614 - RNA, 19 nt, Homo sapiens
gcuacucuacaagcaauuu

SEQ ID NO: 944615 - RNA, 19 nt, Homo sapiens
cagacgaugccgacuggaa

SEQ ID NO: 944616 - RNA, 19 nt, Homo sapiens
acgggacgcugcuggugaa

SEQ ID NO: 944617 - RNA, 19 nt, Homo sapiens
gggaccucgugcccaacua

SEQ ID NO: 944618 - RNA, 19 nt, Homo sapiens
ucccugcuaugaugguuug

SEQ ID NO: 944619 - RNA, 19 nt, Homo sapiens
ucgacugggucuacuacga

SEQ ID NO: 944620 - RNA, 19 nt, Homo sapiens
gugaacgcuuuggccauug

SEQ ID NO: 944621 - RNA, 19 nt, Homo sapiens
uggccgagguccgcuguau

SEQ ID NO: 944622 - RNA, 19 nt, Homo sapiens
gaaaugaaauccaacuaga

SEQ ID NO: 944623 - RNA, 19 nt, Homo sapiens
ggaaaucccuaacagaauu

SEQ ID NO: 944624 - RNA, 19 nt, Homo sapiens
gagaacaagugcuuuagua

SEQ ID NO: 944625 - RNA, 19 nt, Homo sapiens
ggucuuagcucuuuguuga

SEQ ID NO: 944626 - RNA, 19 nt, Homo sapiens
gaauguugcuggaaauaaa

SEQ ID NO: 944627 - RNA, 19 nt, Homo sapiens
caggagagcuggucuuuga

SEQ ID NO: 944628 - RNA, 19 nt, Homo sapiens
gaagguacuuacucuugua

SEQ ID NO: 944629 - RNA, 19 nt, Homo sapiens
gaaggagaauucaaacaga

SEQ ID NO: 944630 - RNA, 19 nt, Homo sapiens
ggacacccaugacuucaaa

SEQ ID NO: 944631 - RNA, 19 nt, Homo sapiens
caccaugccuggcuaauuu

SEQ ID NO: 944632 - RNA, 19 nt, Homo sapiens
gaauacaccugguucaaag

SEQ ID NO: 944633 - RNA, 19 nt, Homo sapiens
gaucacagcuuccuaugag

SEQ ID NO: 944634 - RNA, 19 nt, Homo sapiens
ccaccagucuauuuauuaa

SEQ ID NO: 944635 - RNA, 19 nt, Homo sapiens
aaguagagcuuaugaaaug

SEQ ID NO: 944636 - RNA, 19 nt, Homo sapiens
gaauagguaucuugagcuu

SEQ ID NO: 944637 - RNA, 19 nt, Homo sapiens
uggcagggaucuuugaaua

SEQ ID NO: 944638 - RNA, 19 nt, Homo sapiens
cgaguaagaaggugauuua

SEQ ID NO: 944639 - RNA, 19 nt, Homo sapiens
cagaagaaaugaaauccaa

SEQ ID NO: 944640 - RNA, 19 nt, Homo sapiens
gaauaauccugugaaguug

SEQ ID NO: 944641 - RNA, 19 nt, Homo sapiens
ggugaaugguuccuuauug

SEQ ID NO: 944642 - RNA, 19 nt, Homo sapiens
gggugaagcugaugcugua

SEQ ID NO: 944643 - RNA, 19 nt, Homo sapiens
aacaagugcuuuaguagua

SEQ ID NO: 944644 - RNA, 19 nt, Homo sapiens
guaguggucuuagcucuuu

SEQ ID NO: 944645 - RNA, 19 nt, Homo sapiens
gaauuuacuucucuagcuu

SEQ ID NO: 944646 - RNA, 19 nt, Homo sapiens
gagauuguauuucuaugug

SEQ ID NO: 944647 - RNA, 19 nt, Homo sapiens
ugaggugaaugguuccuua

SEQ ID NO: 944648 - RNA, 19 nt, Homo sapiens
gagaagguacuuacucuug

SEQ ID NO: 944649 - RNA, 19 nt, Homo sapiens
ggucaggaguucaagauca

SEQ ID NO: 944650 - RNA, 19 nt, Homo sapiens
caacugguaucaccuucaa

SEQ ID NO: 944651 - RNA, 19 nt, Homo sapiens
agaauaauccugugaaguu

SEQ ID NO: 944652 - RNA, 19 nt, Homo sapiens
ugacugacauugacugugu

SEQ ID NO: 944653 - RNA, 19 nt, Homo sapiens
gaaagggacuucgaguaag

SEQ ID NO: 944654 - RNA, 19 nt, Homo sapiens
ggauagugaugccuacgaa

SEQ ID NO: 944655 - RNA, 19 nt, Homo sapiens
gaucauggguggucugcau

SEQ ID NO: 944656 - RNA, 19 nt, Homo sapiens
agaaagggacuucgaguaa

SEQ ID NO: 944657 - RNA, 19 nt, Homo sapiens
guucaaagaugggauagug

SEQ ID NO: 944658 - RNA, 19 nt, Homo sapiens
ccaccagacucguuugcua

SEQ ID NO: 944659 - RNA, 19 nt, Homo sapiens
ggaauuuacuucucuagcu

SEQ ID NO: 944660 - RNA, 19 nt, Homo sapiens
gaucuuggcucacuguaac

SEQ ID NO: 944661 - RNA, 19 nt, Homo sapiens
gcaugugaaugaacaggaa

SEQ ID NO: 944662 - RNA, 19 nt, Homo sapiens
gaacaagugcuuuaguagu

SEQ ID NO: 944663 - RNA, 19 nt, Homo sapiens
gccauugacuucccuucua

SEQ ID NO: 944664 - RNA, 19 nt, Homo sapiens
gaacaaagaaagggacuuc

SEQ ID NO: 944665 - RNA, 19 nt, Homo sapiens
cauccaagccuacaguuaa

SEQ ID NO: 944666 - RNA, 19 nt, Homo sapiens
ccauugacuucccuucuaa

SEQ ID NO: 944667 - RNA, 19 nt, Homo sapiens
ucaaacagaccucgucauu

SEQ ID NO: 944668 - RNA, 19 nt, Homo sapiens
agacucguuugcuauaaua

SEQ ID NO: 944669 - RNA, 19 nt, Homo sapiens
ggaagacacugggacauac

SEQ ID NO: 944670 - RNA, 19 nt, Homo sapiens
gaaaacaccuugucugcau

SEQ ID NO: 944671 - RNA, 19 nt, Homo sapiens
gaagaauaugagucaguua

SEQ ID NO: 944672 - RNA, 19 nt, Homo sapiens
ugaagaauaugagucaguu

SEQ ID NO: 944673 - RNA, 19 nt, Homo sapiens
aaacagaccucgucauucc

SEQ ID NO: 944674 - RNA, 19 nt, Homo sapiens
aaagggacuucgaguaaga

SEQ ID NO: 944675 - RNA, 19 nt, Homo sapiens
acacuuguauggucucuga

SEQ ID NO: 944676 - RNA, 19 nt, Homo sapiens
gcacucuucugaaccugaa

SEQ ID NO: 944677 - RNA, 19 nt, Homo sapiens
ucaaacuccugaccucuug

SEQ ID NO: 944678 - RNA, 19 nt, Homo sapiens
ggagugcagugguaugauc

SEQ ID NO: 944679 - RNA, 19 nt, Homo sapiens
gcagggaucuuugaauagg

SEQ ID NO: 944680 - RNA, 19 nt, Homo sapiens
gugaaugguuccuuauugu

SEQ ID NO: 944681 - RNA, 19 nt, Homo sapiens
gggaagacacugggacaua

SEQ ID NO: 944682 - RNA, 19 nt, Homo sapiens
gugaugggauuacagaugu

SEQ ID NO: 944683 - RNA, 19 nt, Homo sapiens
cagagaacuugaagccaaa

SEQ ID NO: 944684 - RNA, 19 nt, Homo sapiens
cagcaacucuuccuauguc

SEQ ID NO: 944685 - RNA, 19 nt, Homo sapiens
ccugaugucuguaguuuca

SEQ ID NO: 944686 - RNA, 19 nt, Homo sapiens
guaaagaugaguuuguugu

SEQ ID NO: 944687 - RNA, 19 nt, Homo sapiens
caguaaagaugaguuuguu

SEQ ID NO: 944688 - RNA, 19 nt, Homo sapiens
uaacuuagcaagaggacaa

SEQ ID NO: 944689 - RNA, 19 nt, Homo sapiens
gcucuuuggugagauugua

SEQ ID NO: 944690 - RNA, 19 nt, Homo sapiens
uggagagcauaguaaauuu

SEQ ID NO: 944691 - RNA, 19 nt, Homo sapiens
uagagcggcugaaaugguu

SEQ ID NO: 944692 - RNA, 19 nt, Homo sapiens
uuacuucucuagcuuacaa

SEQ ID NO: 944693 - RNA, 19 nt, Homo sapiens
gaagacagaguaggaagga

SEQ ID NO: 944694 - RNA, 19 nt, Homo sapiens
agacaggguuucaccaugu

SEQ ID NO: 944695 - RNA, 19 nt, Homo sapiens
ggacccuucucugcccuua

SEQ ID NO: 944696 - RNA, 19 nt, Homo sapiens
guggagagcauaguaaauu

SEQ ID NO: 944697 - RNA, 19 nt, Homo sapiens
aaugggagcucuuguugug

SEQ ID NO: 944698 - RNA, 19 nt, Homo sapiens
cggcugaaaugguuguuug

SEQ ID NO: 944699 - RNA, 19 nt, Homo sapiens
caggaugccuuauuugucu

SEQ ID NO: 944700 - RNA, 19 nt, Homo sapiens
agacagaguaggaaggaua

SEQ ID NO: 944701 - RNA, 19 nt, Homo sapiens
gaaauuugaagaccagauc

SEQ ID NO: 944702 - RNA, 19 nt, Homo sapiens
caagaucacagcuuccuau

SEQ ID NO: 944703 - RNA, 19 nt, Homo sapiens
gaaaugguucaguaaagau

SEQ ID NO: 944704 - RNA, 19 nt, Homo sapiens
gugcuuuaguaguaguuua

SEQ ID NO: 944705 - RNA, 19 nt, Homo sapiens
gcaucugguuugccuauag

SEQ ID NO: 944706 - RNA, 19 nt, Homo sapiens
cuaggccacuugugaagaa

SEQ ID NO: 944707 - RNA, 19 nt, Homo sapiens
ugaaauccaacuagacaaa

SEQ ID NO: 944708 - RNA, 19 nt, Homo sapiens
ggauuucucaggucauuug

SEQ ID NO: 944709 - RNA, 19 nt, Homo sapiens
gaauacaagcugacugaca

SEQ ID NO: 944710 - RNA, 19 nt, Homo sapiens
gcucuuuccuuguguacug

SEQ ID NO: 944711 - RNA, 19 nt, Homo sapiens
gccuggaacuuguuuaaag

SEQ ID NO: 944712 - RNA, 19 nt, Homo sapiens
ggaaggauauggaaaaggu

SEQ ID NO: 944713 - RNA, 19 nt, Homo sapiens
ucaguucugugucaugguu

SEQ ID NO: 944714 - RNA, 19 nt, Homo sapiens
uaaaaccgcugcucuaaag

SEQ ID NO: 944715 - RNA, 19 nt, Homo sapiens
ccagacucguuugcuauaa

SEQ ID NO: 944716 - RNA, 19 nt, Homo sapiens
ggucacaugccaauaaaca

SEQ ID NO: 944717 - RNA, 19 nt, Homo sapiens
uaacugcuacuguauuuag

SEQ ID NO: 944718 - RNA, 19 nt, Homo sapiens
cgacuuugcccuauccuau

SEQ ID NO: 944719 - RNA, 19 nt, Homo sapiens
guuccuaggcuccuuugua

SEQ ID NO: 944720 - RNA, 19 nt, Homo sapiens
aauacaagcugacugacau

SEQ ID NO: 944721 - RNA, 19 nt, Homo sapiens
ggaaggcggcaacagcuau

SEQ ID NO: 944722 - RNA, 19 nt, Homo sapiens
caggagagcuggucuuuga

SEQ ID NO: 944723 - RNA, 19 nt, Homo sapiens
gaaggagaauucaaacaga

SEQ ID NO: 944724 - RNA, 19 nt, Homo sapiens
ggacacccaugacuucaaa

SEQ ID NO: 944725 - RNA, 19 nt, Homo sapiens
gaauacaccugguucaaag

SEQ ID NO: 944726 - RNA, 19 nt, Homo sapiens
gaucacagcuuccuaugag

SEQ ID NO: 944727 - RNA, 19 nt, Homo sapiens
gaauagguaucuugagcuu

SEQ ID NO: 944728 - RNA, 19 nt, Homo sapiens
uggcagggaucuuugaaua

SEQ ID NO: 944729 - RNA, 19 nt, Homo sapiens
cgaguaagaaggugauuua

SEQ ID NO: 944730 - RNA, 19 nt, Homo sapiens
gaauaauccugugaaguug

SEQ ID NO: 944731 - RNA, 19 nt, Homo sapiens
ggugaaugguuccuuauug

SEQ ID NO: 944732 - RNA, 19 nt, Homo sapiens
gaauuuacuucucuagcuu

SEQ ID NO: 944733 - RNA, 19 nt, Homo sapiens
ugaggugaaugguuccuua

SEQ ID NO: 944734 - RNA, 19 nt, Homo sapiens
caacugguaucaccuucaa

SEQ ID NO: 944735 - RNA, 19 nt, Homo sapiens
agaauaauccugugaaguu

SEQ ID NO: 944736 - RNA, 19 nt, Homo sapiens
ugacugacauugacugugu

SEQ ID NO: 944737 - RNA, 19 nt, Homo sapiens
gaaagggacuucgaguaag

SEQ ID NO: 944738 - RNA, 19 nt, Homo sapiens
ggauagugaugccuacgaa

SEQ ID NO: 944739 - RNA, 19 nt, Homo sapiens
agaaagggacuucgaguaa

SEQ ID NO: 944740 - RNA, 19 nt, Homo sapiens
guucaaagaugggauagug

SEQ ID NO: 944741 - RNA, 19 nt, Homo sapiens
ccaccagacucguuugcua

SEQ ID NO: 944742 - RNA, 19 nt, Homo sapiens
ggaauuuacuucucuagcu

SEQ ID NO: 944743 - RNA, 19 nt, Homo sapiens
gccauugacuucccuucua

SEQ ID NO: 944744 - RNA, 19 nt, Homo sapiens
gaacaaagaaagggacuuc

SEQ ID NO: 944745 - RNA, 19 nt, Homo sapiens
cauccaagccuacaguuaa

SEQ ID NO: 944746 - RNA, 19 nt, Homo sapiens
ccauugacuucccuucuaa

SEQ ID NO: 944747 - RNA, 19 nt, Homo sapiens
ucaaacagaccucgucauu

SEQ ID NO: 944748 - RNA, 19 nt, Homo sapiens
agacucguuugcuauaaua

SEQ ID NO: 944749 - RNA, 19 nt, Homo sapiens
ggaagacacugggacauac

SEQ ID NO: 944750 - RNA, 19 nt, Homo sapiens
gaaaacaccuugucugcau

SEQ ID NO: 944751 - RNA, 19 nt, Homo sapiens
gaagaauaugagucaguua

SEQ ID NO: 944752 - RNA, 19 nt, Homo sapiens
ugaagaauaugagucaguu

SEQ ID NO: 944753 - RNA, 19 nt, Homo sapiens
aaacagaccucgucauucc

SEQ ID NO: 944754 - RNA, 19 nt, Homo sapiens
aaagggacuucgaguaaga

SEQ ID NO: 944755 - RNA, 19 nt, Homo sapiens
acacuuguauggucucuga

SEQ ID NO: 944756 - RNA, 19 nt, Homo sapiens
gcacucuucugaaccugaa

SEQ ID NO: 944757 - RNA, 19 nt, Homo sapiens
gcagggaucuuugaauagg

SEQ ID NO: 944758 - RNA, 19 nt, Homo sapiens
gugaaugguuccuuauugu

SEQ ID NO: 944759 - RNA, 19 nt, Homo sapiens
gggaagacacugggacaua

SEQ ID NO: 944760 - RNA, 19 nt, Homo sapiens
gugaugggauuacagaugu

SEQ ID NO: 944761 - RNA, 19 nt, Homo sapiens
cagagaacuugaagccaaa

SEQ ID NO: 944762 - RNA, 19 nt, Homo sapiens
cagcaacucuuccuauguc

SEQ ID NO: 944763 - RNA, 19 nt, Homo sapiens
ccugaugucuguaguuuca

SEQ ID NO: 944764 - RNA, 19 nt, Homo sapiens
uggagagcauaguaaauuu

SEQ ID NO: 944765 - RNA, 19 nt, Homo sapiens
uagagcggcugaaaugguu

SEQ ID NO: 944766 - RNA, 19 nt, Homo sapiens
uuacuucucuagcuuacaa

SEQ ID NO: 944767 - RNA, 19 nt, Homo sapiens
gaagacagaguaggaagga

SEQ ID NO: 944768 - RNA, 19 nt, Homo sapiens
guggagagcauaguaaauu

SEQ ID NO: 944769 - RNA, 19 nt, Homo sapiens
aaugggagcucuuguugug

SEQ ID NO: 944770 - RNA, 19 nt, Homo sapiens
cggcugaaaugguuguuug

SEQ ID NO: 944771 - RNA, 19 nt, Homo sapiens
caggaugccuuauuugucu

SEQ ID NO: 944772 - RNA, 19 nt, Homo sapiens
agacagaguaggaaggaua

SEQ ID NO: 944773 - RNA, 19 nt, Homo sapiens
caagaucacagcuuccuau

SEQ ID NO: 944774 - RNA, 19 nt, Homo sapiens
gcaucugguuugccuauag

SEQ ID NO: 944775 - RNA, 19 nt, Homo sapiens
cuaggccacuugugaagaa

SEQ ID NO: 944776 - RNA, 19 nt, Homo sapiens
gaauacaagcugacugaca

SEQ ID NO: 944777 - RNA, 19 nt, Homo sapiens
gcucuuuccuuguguacug

SEQ ID NO: 944778 - RNA, 19 nt, Homo sapiens
gccuggaacuuguuuaaag

SEQ ID NO: 944779 - RNA, 19 nt, Homo sapiens
ggaaggauauggaaaaggu

SEQ ID NO: 944780 - RNA, 19 nt, Homo sapiens
ucaguucugugucaugguu

SEQ ID NO: 944781 - RNA, 19 nt, Homo sapiens
ccagacucguuugcuauaa

SEQ ID NO: 944782 - RNA, 19 nt, Homo sapiens
aauacaagcugacugacau

SEQ ID NO: 944783 - RNA, 19 nt, Homo sapiens
ggaaggcggcaacagcuau

SEQ ID NO: 944784 - RNA, 19 nt, Homo sapiens
ggccacuugugaagaauau

SEQ ID NO: 944785 - RNA, 19 nt, Homo sapiens
ccaaagugaugggauuaca

SEQ ID NO: 944786 - RNA, 19 nt, Homo sapiens
gaauuugaggugaaugguu

SEQ ID NO: 944787 - RNA, 19 nt, Homo sapiens
gaaaaugggagcucuuguu

SEQ ID NO: 944788 - RNA, 19 nt, Homo sapiens
ugaguggccuggaacuugu

SEQ ID NO: 944789 - RNA, 19 nt, Homo sapiens
ccacuugugaagaauauga

SEQ ID NO: 944790 - RNA, 19 nt, Homo sapiens
ugucugcauucacuuuaaa

SEQ ID NO: 944791 - RNA, 19 nt, Homo sapiens
ucauggcucugugaauuug

SEQ ID NO: 944792 - RNA, 19 nt, Homo sapiens
uuacagugcacucuucuga

SEQ ID NO: 944793 - RNA, 19 nt, Homo sapiens
cagacucguuugcuauaau

SEQ ID NO: 944794 - RNA, 19 nt, Homo sapiens
cauauuggcgauccuguug

SEQ ID NO: 944795 - RNA, 19 nt, Homo sapiens
ggcuagagcggcugaaaug

SEQ ID NO: 944796 - RNA, 19 nt, Homo sapiens
aagaaagggacuucgagua

SEQ ID NO: 944797 - RNA, 19 nt, Homo sapiens
uguugugccucuucauauu

SEQ ID NO: 944798 - RNA, 19 nt, Homo sapiens
gaaugguuccuuauugucu

SEQ ID NO: 944799 - RNA, 19 nt, Homo sapiens
ccucugauacuggagaaua

SEQ ID NO: 944800 - RNA, 19 nt, Homo sapiens
gaagcagaggugauucaug

SEQ ID NO: 944801 - RNA, 19 nt, Homo sapiens
uucacaggaugccuuauuu

SEQ ID NO: 944802 - RNA, 19 nt, Homo sapiens
ccgccuaucaucugcauuu

SEQ ID NO: 944803 - RNA, 19 nt, Homo sapiens
guggaaguuugaccaagga

SEQ ID NO: 944804 - RNA, 19 nt, Homo sapiens
aaacuguugugccucuuca

SEQ ID NO: 944805 - RNA, 19 nt, Homo sapiens
ggagagcuggucuuugauc

SEQ ID NO: 944806 - RNA, 19 nt, Homo sapiens
ucgcggagcugugucuguu

SEQ ID NO: 944807 - RNA, 19 nt, Homo sapiens
gaagacacugggacauaca

SEQ ID NO: 944808 - RNA, 19 nt, Homo sapiens
caauggaccuuuugaacug

SEQ ID NO: 944809 - RNA, 19 nt, Homo sapiens
uugccagccuuggaauuua

SEQ ID NO: 944810 - RNA, 19 nt, Homo sapiens
ugagaauaauccugugaag

SEQ ID NO: 944811 - RNA, 19 nt, Homo sapiens
gagaauaauccugugaagu

SEQ ID NO: 944812 - RNA, 19 nt, Homo sapiens
aaagugaugggauuacaga

SEQ ID NO: 944813 - RNA, 19 nt, Homo sapiens
caagcugacugacauugac

SEQ ID NO: 944814 - RNA, 19 nt, Homo sapiens
agggaucuuugaauaggua

SEQ ID NO: 944815 - RNA, 19 nt, Homo sapiens
gaaacuguugugccucuuc

SEQ ID NO: 944816 - RNA, 19 nt, Homo sapiens
cgaggccacuuugacagaa

SEQ ID NO: 944817 - RNA, 19 nt, Homo sapiens
gacaugcucagaacaagau

SEQ ID NO: 944818 - RNA, 19 nt, Homo sapiens
ccauccaagccuacaguua

SEQ ID NO: 944819 - RNA, 19 nt, Homo sapiens
gcccuguccuccugaauac

SEQ ID NO: 944820 - RNA, 19 nt, Homo sapiens
gaaaugguuguuuggugau

SEQ ID NO: 944821 - RNA, 19 nt, Homo sapiens
gcucaccgccuaucaucug

SEQ ID NO: 944822 - RNA, 19 nt, Homo sapiens
gaaaugaaauccaacuaga

SEQ ID NO: 944823 - RNA, 19 nt, Homo sapiens
ggaaaucccuaacagaauu

SEQ ID NO: 944824 - RNA, 19 nt, Homo sapiens
gagaacaagugcuuuagua

SEQ ID NO: 944825 - RNA, 19 nt, Homo sapiens
ggucuuagcucuuuguuga

SEQ ID NO: 944826 - RNA, 19 nt, Homo sapiens
gaauguugcuggaaauaaa

SEQ ID NO: 944827 - RNA, 19 nt, Homo sapiens
caggagagcuggucuuuga

SEQ ID NO: 944828 - RNA, 19 nt, Homo sapiens
gaagguacuuacucuugua

SEQ ID NO: 944829 - RNA, 19 nt, Homo sapiens
gaaggagaauucaaacaga

SEQ ID NO: 944830 - RNA, 19 nt, Homo sapiens
ggacacccaugacuucaaa

SEQ ID NO: 944831 - RNA, 19 nt, Homo sapiens
caccaugccuggcuaauuu

SEQ ID NO: 944832 - RNA, 19 nt, Homo sapiens
gaauacaccugguucaaag

SEQ ID NO: 944833 - RNA, 19 nt, Homo sapiens
ccaccagucuauuuauuaa

SEQ ID NO: 944834 - RNA, 19 nt, Homo sapiens
aaguagagcuuaugaaaug

SEQ ID NO: 944835 - RNA, 19 nt, Homo sapiens
gaauagguaucuugagcuu

SEQ ID NO: 944836 - RNA, 19 nt, Homo sapiens
uggcagggaucuuugaaua

SEQ ID NO: 944837 - RNA, 19 nt, Homo sapiens
cgaguaagaaggugauuua

SEQ ID NO: 944838 - RNA, 19 nt, Homo sapiens
cagaagaaaugaaauccaa

SEQ ID NO: 944839 - RNA, 19 nt, Homo sapiens
gaauaauccugugaaguug

SEQ ID NO: 944840 - RNA, 19 nt, Homo sapiens
ggugaaugguuccuuauug

SEQ ID NO: 944841 - RNA, 19 nt, Homo sapiens
gggugaagcugaugcugua

SEQ ID NO: 944842 - RNA, 19 nt, Homo sapiens
aacaagugcuuuaguagua

SEQ ID NO: 944843 - RNA, 19 nt, Homo sapiens
guaguggucuuagcucuuu

SEQ ID NO: 944844 - RNA, 19 nt, Homo sapiens
gaauuuacuucucuagcuu

SEQ ID NO: 944845 - RNA, 19 nt, Homo sapiens
gagauuguauuucuaugug

SEQ ID NO: 944846 - RNA, 19 nt, Homo sapiens
ugaggugaaugguuccuua

SEQ ID NO: 944847 - RNA, 19 nt, Homo sapiens
gagaagguacuuacucuug

SEQ ID NO: 944848 - RNA, 19 nt, Homo sapiens
ggucaggaguucaagauca

SEQ ID NO: 944849 - RNA, 19 nt, Homo sapiens
caacugguaucaccuucaa

SEQ ID NO: 944850 - RNA, 19 nt, Homo sapiens
agaauaauccugugaaguu

SEQ ID NO: 944851 - RNA, 19 nt, Homo sapiens
ugacugacauugacugugu

SEQ ID NO: 944852 - RNA, 19 nt, Homo sapiens
gaaagggacuucgaguaag

SEQ ID NO: 944853 - RNA, 19 nt, Homo sapiens
ggauagugaugccuacgaa

SEQ ID NO: 944854 - RNA, 19 nt, Homo sapiens
gaucauggguggucugcau

SEQ ID NO: 944855 - RNA, 19 nt, Homo sapiens
agaaagggacuucgaguaa

SEQ ID NO: 944856 - RNA, 19 nt, Homo sapiens
guucaaagaugggauagug

SEQ ID NO: 944857 - RNA, 19 nt, Homo sapiens
ggaauuuacuucucuagcu

SEQ ID NO: 944858 - RNA, 19 nt, Homo sapiens
gaucuuggcucacuguaac

SEQ ID NO: 944859 - RNA, 19 nt, Homo sapiens
gcaugugaaugaacaggaa

SEQ ID NO: 944860 - RNA, 19 nt, Homo sapiens
gaacaagugcuuuaguagu

SEQ ID NO: 944861 - RNA, 19 nt, Homo sapiens
gccauugacuucccuucua

SEQ ID NO: 944862 - RNA, 19 nt, Homo sapiens
gaacaaagaaagggacuuc

SEQ ID NO: 944863 - RNA, 19 nt, Homo sapiens
cauccaagccuacaguuaa

SEQ ID NO: 944864 - RNA, 19 nt, Homo sapiens
ccauugacuucccuucuaa

SEQ ID NO: 944865 - RNA, 19 nt, Homo sapiens
ucaaacagaccucgucauu

SEQ ID NO: 944866 - RNA, 19 nt, Homo sapiens
ggaagacacugggacauac

SEQ ID NO: 944867 - RNA, 19 nt, Homo sapiens
gaaaacaccuugucugcau

SEQ ID NO: 944868 - RNA, 19 nt, Homo sapiens
gaagaauaugagucaguua

SEQ ID NO: 944869 - RNA, 19 nt, Homo sapiens
ugaagaauaugagucaguu

SEQ ID NO: 944870 - RNA, 19 nt, Homo sapiens
aaacagaccucgucauucc

SEQ ID NO: 944871 - RNA, 19 nt, Homo sapiens
aaagggacuucgaguaaga

SEQ ID NO: 944872 - RNA, 19 nt, Homo sapiens
acacuuguauggucucuga

SEQ ID NO: 944873 - RNA, 19 nt, Homo sapiens
ucaaacuccugaccucuug

SEQ ID NO: 944874 - RNA, 19 nt, Homo sapiens
ggagugcagugguaugauc

SEQ ID NO: 944875 - RNA, 19 nt, Homo sapiens
gcagggaucuuugaauagg

SEQ ID NO: 944876 - RNA, 19 nt, Homo sapiens
gugaaugguuccuuauugu

SEQ ID NO: 944877 - RNA, 19 nt, Homo sapiens
gggaagacacugggacaua

SEQ ID NO: 944878 - RNA, 19 nt, Homo sapiens
gugaugggauuacagaugu

SEQ ID NO: 944879 - RNA, 19 nt, Homo sapiens
cagagaacuugaagccaaa

SEQ ID NO: 944880 - RNA, 19 nt, Homo sapiens
cagcaacucuuccuauguc

SEQ ID NO: 944881 - RNA, 19 nt, Homo sapiens
ccugaugucuguaguuuca

SEQ ID NO: 944882 - RNA, 19 nt, Homo sapiens
guaaagaugaguuuguugu

SEQ ID NO: 944883 - RNA, 19 nt, Homo sapiens
caguaaagaugaguuuguu

SEQ ID NO: 944884 - RNA, 19 nt, Homo sapiens
uaacuuagcaagaggacaa

SEQ ID NO: 944885 - RNA, 19 nt, Homo sapiens
gcucuuuggugagauugua

SEQ ID NO: 944886 - RNA, 19 nt, Homo sapiens
uggagagcauaguaaauuu

SEQ ID NO: 944887 - RNA, 19 nt, Homo sapiens
uagagcggcugaaaugguu

SEQ ID NO: 944888 - RNA, 19 nt, Homo sapiens
uuacuucucuagcuuacaa

SEQ ID NO: 944889 - RNA, 19 nt, Homo sapiens
gaagacagaguaggaagga

SEQ ID NO: 944890 - RNA, 19 nt, Homo sapiens
agacaggguuucaccaugu

SEQ ID NO: 944891 - RNA, 19 nt, Homo sapiens
ggacccuucucugcccuua

SEQ ID NO: 944892 - RNA, 19 nt, Homo sapiens
guggagagcauaguaaauu

SEQ ID NO: 944893 - RNA, 19 nt, Homo sapiens
aaugggagcucuuguugug

SEQ ID NO: 944894 - RNA, 19 nt, Homo sapiens
cggcugaaaugguuguuug

SEQ ID NO: 944895 - RNA, 19 nt, Homo sapiens
caggaugccuuauuugucu

SEQ ID NO: 944896 - RNA, 19 nt, Homo sapiens
agacagaguaggaaggaua

SEQ ID NO: 944897 - RNA, 19 nt, Homo sapiens
gaaauuugaagaccagauc

SEQ ID NO: 944898 - RNA, 19 nt, Homo sapiens
gaaaugguucaguaaagau

SEQ ID NO: 944899 - RNA, 19 nt, Homo sapiens
gugcuuuaguaguaguuua

SEQ ID NO: 944900 - RNA, 19 nt, Homo sapiens
gcaucugguuugccuauag

SEQ ID NO: 944901 - RNA, 19 nt, Homo sapiens
cuaggccacuugugaagaa

SEQ ID NO: 944902 - RNA, 19 nt, Homo sapiens
ugaaauccaacuagacaaa

SEQ ID NO: 944903 - RNA, 19 nt, Homo sapiens
ggauuucucaggucauuug

SEQ ID NO: 944904 - RNA, 19 nt, Homo sapiens
gaauacaagcugacugaca

SEQ ID NO: 944905 - RNA, 19 nt, Homo sapiens
gcucuuuccuuguguacug

SEQ ID NO: 944906 - RNA, 19 nt, Homo sapiens
gccuggaacuuguuuaaag

SEQ ID NO: 944907 - RNA, 19 nt, Homo sapiens
ggaaggauauggaaaaggu

SEQ ID NO: 944908 - RNA, 19 nt, Homo sapiens
ucaguucugugucaugguu

SEQ ID NO: 944909 - RNA, 19 nt, Homo sapiens
uaaaaccgcugcucuaaag

SEQ ID NO: 944910 - RNA, 19 nt, Homo sapiens
ggucacaugccaauaaaca

SEQ ID NO: 944911 - RNA, 19 nt, Homo sapiens
uaacugcuacuguauuuag

SEQ ID NO: 944912 - RNA, 19 nt, Homo sapiens
cgacuuugcccuauccuau

SEQ ID NO: 944913 - RNA, 19 nt, Homo sapiens
guuccuaggcuccuuugua

SEQ ID NO: 944914 - RNA, 19 nt, Homo sapiens
aauacaagcugacugacau

SEQ ID NO: 944915 - RNA, 19 nt, Homo sapiens
ggaaggcggcaacagcuau

SEQ ID NO: 944916 - RNA, 19 nt, Homo sapiens
ggccacuugugaagaauau

SEQ ID NO: 944917 - RNA, 19 nt, Homo sapiens
ccaaagugaugggauuaca

SEQ ID NO: 944918 - RNA, 19 nt, Homo sapiens
gacaggguuucaccauguu

SEQ ID NO: 944919 - RNA, 19 nt, Homo sapiens
gguaugaucuuggcucacu

SEQ ID NO: 944920 - RNA, 19 nt, Homo sapiens
ccaacuagacaaauaaagu

SEQ ID NO: 944921 - RNA, 19 nt, Homo sapiens
gaaauccaacuagacaaau

SEQ ID NO: 944922 - RNA, 19 nt, Homo sapiens
gaaaugaaauccaacuaga

SEQ ID NO: 944923 - RNA, 19 nt, Homo sapiens
ggaaaucccuaacagaauu

SEQ ID NO: 944924 - RNA, 19 nt, Homo sapiens
gagaacaagugcuuuagua

SEQ ID NO: 944925 - RNA, 19 nt, Homo sapiens
ggucuuagcucuuuguuga

SEQ ID NO: 944926 - RNA, 19 nt, Homo sapiens
gaauguugcuggaaauaaa

SEQ ID NO: 944927 - RNA, 19 nt, Homo sapiens
caggagagcuggucuuuga

SEQ ID NO: 944928 - RNA, 19 nt, Homo sapiens
gaagguacuuacucuugua

SEQ ID NO: 944929 - RNA, 19 nt, Homo sapiens
gaaggagaauucaaacaga

SEQ ID NO: 944930 - RNA, 19 nt, Homo sapiens
ggacacccaugacuucaaa

SEQ ID NO: 944931 - RNA, 19 nt, Homo sapiens
caccaugccuggcuaauuu

SEQ ID NO: 944932 - RNA, 19 nt, Homo sapiens
gaauacaccugguucaaag

SEQ ID NO: 944933 - RNA, 19 nt, Homo sapiens
gaucacagcuuccuaugag

SEQ ID NO: 944934 - RNA, 19 nt, Homo sapiens
ccaccagucuauuuauuaa

SEQ ID NO: 944935 - RNA, 19 nt, Homo sapiens
aaguagagcuuaugaaaug

SEQ ID NO: 944936 - RNA, 19 nt, Homo sapiens
gaauagguaucuugagcuu

SEQ ID NO: 944937 - RNA, 19 nt, Homo sapiens
uggcagggaucuuugaaua

SEQ ID NO: 944938 - RNA, 19 nt, Homo sapiens
cgaguaagaaggugauuua

SEQ ID NO: 944939 - RNA, 19 nt, Homo sapiens
cagaagaaaugaaauccaa

SEQ ID NO: 944940 - RNA, 19 nt, Homo sapiens
gaauaauccugugaaguug

SEQ ID NO: 944941 - RNA, 19 nt, Homo sapiens
ggugaaugguuccuuauug

SEQ ID NO: 944942 - RNA, 19 nt, Homo sapiens
gggugaagcugaugcugua

SEQ ID NO: 944943 - RNA, 19 nt, Homo sapiens
aacaagugcuuuaguagua

SEQ ID NO: 944944 - RNA, 19 nt, Homo sapiens
guaguggucuuagcucuuu

SEQ ID NO: 944945 - RNA, 19 nt, Homo sapiens
gaauuuacuucucuagcuu

SEQ ID NO: 944946 - RNA, 19 nt, Homo sapiens
gagauuguauuucuaugug

SEQ ID NO: 944947 - RNA, 19 nt, Homo sapiens
ugaggugaaugguuccuua

SEQ ID NO: 944948 - RNA, 19 nt, Homo sapiens
gagaagguacuuacucuug

SEQ ID NO: 944949 - RNA, 19 nt, Homo sapiens
ggucaggaguucaagauca

SEQ ID NO: 944950 - RNA, 19 nt, Homo sapiens
caacugguaucaccuucaa

SEQ ID NO: 944951 - RNA, 19 nt, Homo sapiens
agaauaauccugugaaguu

SEQ ID NO: 944952 - RNA, 19 nt, Homo sapiens
ugacugacauugacugugu

SEQ ID NO: 944953 - RNA, 19 nt, Homo sapiens
gaaagggacuucgaguaag

SEQ ID NO: 944954 - RNA, 19 nt, Homo sapiens
ggauagugaugccuacgaa

SEQ ID NO: 944955 - RNA, 19 nt, Homo sapiens
gaucauggguggucugcau

SEQ ID NO: 944956 - RNA, 19 nt, Homo sapiens
agaaagggacuucgaguaa

SEQ ID NO: 944957 - RNA, 19 nt, Homo sapiens
guucaaagaugggauagug

SEQ ID NO: 944958 - RNA, 19 nt, Homo sapiens
ccaccagacucguuugcua

SEQ ID NO: 944959 - RNA, 19 nt, Homo sapiens
ggaauuuacuucucuagcu

SEQ ID NO: 944960 - RNA, 19 nt, Homo sapiens
gaucuuggcucacuguaac

SEQ ID NO: 944961 - RNA, 19 nt, Homo sapiens
gcaugugaaugaacaggaa

SEQ ID NO: 944962 - RNA, 19 nt, Homo sapiens
gaacaagugcuuuaguagu

SEQ ID NO: 944963 - RNA, 19 nt, Homo sapiens
gccauugacuucccuucua

SEQ ID NO: 944964 - RNA, 19 nt, Homo sapiens
gaacaaagaaagggacuuc

SEQ ID NO: 944965 - RNA, 19 nt, Homo sapiens
cauccaagccuacaguuaa

SEQ ID NO: 944966 - RNA, 19 nt, Homo sapiens
ccauugacuucccuucuaa

SEQ ID NO: 944967 - RNA, 19 nt, Homo sapiens
ucaaacagaccucgucauu

SEQ ID NO: 944968 - RNA, 19 nt, Homo sapiens
agacucguuugcuauaaua

SEQ ID NO: 944969 - RNA, 19 nt, Homo sapiens
gaacccagccagucaggaa

SEQ ID NO: 944970 - RNA, 19 nt, Homo sapiens
ggaagacacugggacauac

SEQ ID NO: 944971 - RNA, 19 nt, Homo sapiens
gaaaacaccuugucugcau

SEQ ID NO: 944972 - RNA, 19 nt, Homo sapiens
gaagaauaugagucaguua

SEQ ID NO: 944973 - RNA, 19 nt, Homo sapiens
ugaagaauaugagucaguu

SEQ ID NO: 944974 - RNA, 19 nt, Homo sapiens
aaacagaccucgucauucc

SEQ ID NO: 944975 - RNA, 19 nt, Homo sapiens
aaagggacuucgaguaaga

SEQ ID NO: 944976 - RNA, 19 nt, Homo sapiens
acacuuguauggucucuga

SEQ ID NO: 944977 - RNA, 19 nt, Homo sapiens
gcacucuucugaaccugaa

SEQ ID NO: 944978 - RNA, 19 nt, Homo sapiens
ucaaacuccugaccucuug

SEQ ID NO: 944979 - RNA, 19 nt, Homo sapiens
ggagugcagugguaugauc

SEQ ID NO: 944980 - RNA, 19 nt, Homo sapiens
gcagggaucuuugaauagg

SEQ ID NO: 944981 - RNA, 19 nt, Homo sapiens
gugaaugguuccuuauugu

SEQ ID NO: 944982 - RNA, 19 nt, Homo sapiens
gggaagacacugggacaua

SEQ ID NO: 944983 - RNA, 19 nt, Homo sapiens
gugaugggauuacagaugu

SEQ ID NO: 944984 - RNA, 19 nt, Homo sapiens
cagagaacuugaagccaaa

SEQ ID NO: 944985 - RNA, 19 nt, Homo sapiens
cagcaacucuuccuauguc

SEQ ID NO: 944986 - RNA, 19 nt, Homo sapiens
ccugaugucuguaguuuca

SEQ ID NO: 944987 - RNA, 19 nt, Homo sapiens
guaaagaugaguuuguugu

SEQ ID NO: 944988 - RNA, 19 nt, Homo sapiens
caguaaagaugaguuuguu

SEQ ID NO: 944989 - RNA, 19 nt, Homo sapiens
uaacuuagcaagaggacaa

SEQ ID NO: 944990 - RNA, 19 nt, Homo sapiens
gcucuuuggugagauugua

SEQ ID NO: 944991 - RNA, 19 nt, Homo sapiens
uggagagcauaguaaauuu

SEQ ID NO: 944992 - RNA, 19 nt, Homo sapiens
uagagcggcugaaaugguu

SEQ ID NO: 944993 - RNA, 19 nt, Homo sapiens
uuacuucucuagcuuacaa

SEQ ID NO: 944994 - RNA, 19 nt, Homo sapiens
gaagacagaguaggaagga

SEQ ID NO: 944995 - RNA, 19 nt, Homo sapiens
agacaggguuucaccaugu

SEQ ID NO: 944996 - RNA, 19 nt, Homo sapiens
ggacccuucucugcccuua

SEQ ID NO: 944997 - RNA, 19 nt, Homo sapiens
guggagagcauaguaaauu

SEQ ID NO: 944998 - RNA, 19 nt, Homo sapiens
aaugggagcucuuguugug

SEQ ID NO: 944999 - RNA, 19 nt, Homo sapiens
cggcugaaaugguuguuug

SEQ ID NO: 945000 - RNA, 19 nt, Homo sapiens
caggaugccuuauuugucu

SEQ ID NO: 945001 - RNA, 19 nt, Homo sapiens
agacagaguaggaaggaua

SEQ ID NO: 945002 - RNA, 19 nt, Homo sapiens
gaaauuugaagaccagauc

SEQ ID NO: 945003 - RNA, 19 nt, Homo sapiens
caagaucacagcuuccuau

SEQ ID NO: 945004 - RNA, 19 nt, Homo sapiens
gaaaugguucaguaaagau

SEQ ID NO: 945005 - RNA, 19 nt, Homo sapiens
gugcuuuaguaguaguuua

SEQ ID NO: 945006 - RNA, 19 nt, Homo sapiens
gcaucugguuugccuauag

SEQ ID NO: 945007 - RNA, 19 nt, Homo sapiens
cuaggccacuugugaagaa

SEQ ID NO: 945008 - RNA, 19 nt, Homo sapiens
ugaaauccaacuagacaaa

SEQ ID NO: 945009 - RNA, 19 nt, Homo sapiens
ggauuucucaggucauuug

SEQ ID NO: 945010 - RNA, 19 nt, Homo sapiens
gaauacaagcugacugaca

SEQ ID NO: 945011 - RNA, 19 nt, Homo sapiens
gcucuuuccuuguguacug

SEQ ID NO: 945012 - RNA, 19 nt, Homo sapiens
gccuggaacuuguuuaaag

SEQ ID NO: 945013 - RNA, 19 nt, Homo sapiens
ggaaggauauggaaaaggu

SEQ ID NO: 945014 - RNA, 19 nt, Homo sapiens
ucaguucugugucaugguu

SEQ ID NO: 945015 - RNA, 19 nt, Homo sapiens
uaaaaccgcugcucuaaag

SEQ ID NO: 945016 - RNA, 19 nt, Homo sapiens
ggucacaugccaauaaaca

SEQ ID NO: 945017 - RNA, 19 nt, Homo sapiens
uaacugcuacuguauuuag

SEQ ID NO: 945018 - RNA, 19 nt, Homo sapiens
agacggaguuucgcucuug

SEQ ID NO: 945019 - RNA, 19 nt, Homo sapiens
ccagacucguuugcuauaa

SEQ ID NO: 945020 - RNA, 19 nt, Homo sapiens
cgacuuugcccuauccuau

SEQ ID NO: 945021 - RNA, 19 nt, Homo sapiens
guuccuaggcuccuuugua

SEQ ID NO: 945022 - RNA, 19 nt, Homo sapiens
gaaaugaaauccaacuaga

SEQ ID NO: 945023 - RNA, 19 nt, Homo sapiens
ggaaaucccuaacagaauu

SEQ ID NO: 945024 - RNA, 19 nt, Homo sapiens
gagaacaagugcuuuagua

SEQ ID NO: 945025 - RNA, 19 nt, Homo sapiens
ggucuuagcucuuuguuga

SEQ ID NO: 945026 - RNA, 19 nt, Homo sapiens
gaauguugcuggaaauaaa

SEQ ID NO: 945027 - RNA, 19 nt, Homo sapiens
caggagagcuggucuuuga

SEQ ID NO: 945028 - RNA, 19 nt, Homo sapiens
gaagguacuuacucuugua

SEQ ID NO: 945029 - RNA, 19 nt, Homo sapiens
gaaggagaauucaaacaga

SEQ ID NO: 945030 - RNA, 19 nt, Homo sapiens
ggacacccaugacuucaaa

SEQ ID NO: 945031 - RNA, 19 nt, Homo sapiens
caccaugccuggcuaauuu

SEQ ID NO: 945032 - RNA, 19 nt, Homo sapiens
gaauacaccugguucaaag

SEQ ID NO: 945033 - RNA, 19 nt, Homo sapiens
gaucacagcuuccuaugag

SEQ ID NO: 945034 - RNA, 19 nt, Homo sapiens
ccaccagucuauuuauuaa

SEQ ID NO: 945035 - RNA, 19 nt, Homo sapiens
caccauggcuggagaggua

SEQ ID NO: 945036 - RNA, 19 nt, Homo sapiens
aaguagagcuuaugaaaug

SEQ ID NO: 945037 - RNA, 19 nt, Homo sapiens
gaauagguaucuugagcuu

SEQ ID NO: 945038 - RNA, 19 nt, Homo sapiens
uggcagggaucuuugaaua

SEQ ID NO: 945039 - RNA, 19 nt, Homo sapiens
cgaguaagaaggugauuua

SEQ ID NO: 945040 - RNA, 19 nt, Homo sapiens
cagaagaaaugaaauccaa

SEQ ID NO: 945041 - RNA, 19 nt, Homo sapiens
gaauaauccugugaaguug

SEQ ID NO: 945042 - RNA, 19 nt, Homo sapiens
ggugaaugguuccuuauug

SEQ ID NO: 945043 - RNA, 19 nt, Homo sapiens
gggugaagcugaugcugua

SEQ ID NO: 945044 - RNA, 19 nt, Homo sapiens
aacaagugcuuuaguagua

SEQ ID NO: 945045 - RNA, 19 nt, Homo sapiens
guaguggucuuagcucuuu

SEQ ID NO: 945046 - RNA, 19 nt, Homo sapiens
gaauuuacuucucuagcuu

SEQ ID NO: 945047 - RNA, 19 nt, Homo sapiens
gagauuguauuucuaugug

SEQ ID NO: 945048 - RNA, 19 nt, Homo sapiens
ugaggugaaugguuccuua

SEQ ID NO: 945049 - RNA, 19 nt, Homo sapiens
gagaagguacuuacucuug

SEQ ID NO: 945050 - RNA, 19 nt, Homo sapiens
ggucaggaguucaagauca

SEQ ID NO: 945051 - RNA, 19 nt, Homo sapiens
caacugguaucaccuucaa

SEQ ID NO: 945052 - RNA, 19 nt, Homo sapiens
agaauaauccugugaaguu

SEQ ID NO: 945053 - RNA, 19 nt, Homo sapiens
ugacugacauugacugugu

SEQ ID NO: 945054 - RNA, 19 nt, Homo sapiens
gaaagggacuucgaguaag

SEQ ID NO: 945055 - RNA, 19 nt, Homo sapiens
ggauagugaugccuacgaa

SEQ ID NO: 945056 - RNA, 19 nt, Homo sapiens
gaucauggguggucugcau

SEQ ID NO: 945057 - RNA, 19 nt, Homo sapiens
agaaagggacuucgaguaa

SEQ ID NO: 945058 - RNA, 19 nt, Homo sapiens
guucaaagaugggauagug

SEQ ID NO: 945059 - RNA, 19 nt, Homo sapiens
ccaccagacucguuugcua

SEQ ID NO: 945060 - RNA, 19 nt, Homo sapiens
ggaauuuacuucucuagcu

SEQ ID NO: 945061 - RNA, 19 nt, Homo sapiens
gaucuuggcucacuguaac

SEQ ID NO: 945062 - RNA, 19 nt, Homo sapiens
gcaugugaaugaacaggaa

SEQ ID NO: 945063 - RNA, 19 nt, Homo sapiens
gaacaagugcuuuaguagu

SEQ ID NO: 945064 - RNA, 19 nt, Homo sapiens
gccauugacuucccuucua

SEQ ID NO: 945065 - RNA, 19 nt, Homo sapiens
gaacaaagaaagggacuuc

SEQ ID NO: 945066 - RNA, 19 nt, Homo sapiens
cauccaagccuacaguuaa

SEQ ID NO: 945067 - RNA, 19 nt, Homo sapiens
ccauugacuucccuucuaa

SEQ ID NO: 945068 - RNA, 19 nt, Homo sapiens
ucaaacagaccucgucauu

SEQ ID NO: 945069 - RNA, 19 nt, Homo sapiens
agacucguuugcuauaaua

SEQ ID NO: 945070 - RNA, 19 nt, Homo sapiens
gaacccagccagucaggaa

SEQ ID NO: 945071 - RNA, 19 nt, Homo sapiens
ggaagacacugggacauac

SEQ ID NO: 945072 - RNA, 19 nt, Homo sapiens
gaaaacaccuugucugcau

SEQ ID NO: 945073 - RNA, 19 nt, Homo sapiens
gaagaauaugagucaguua

SEQ ID NO: 945074 - RNA, 19 nt, Homo sapiens
ugaagaauaugagucaguu

SEQ ID NO: 945075 - RNA, 19 nt, Homo sapiens
aaacagaccucgucauucc

SEQ ID NO: 945076 - RNA, 19 nt, Homo sapiens
aaagggacuucgaguaaga

SEQ ID NO: 945077 - RNA, 19 nt, Homo sapiens
acacuuguauggucucuga

SEQ ID NO: 945078 - RNA, 19 nt, Homo sapiens
gcacucuucugaaccugaa

SEQ ID NO: 945079 - RNA, 19 nt, Homo sapiens
ucaaacuccugaccucuug

SEQ ID NO: 945080 - RNA, 19 nt, Homo sapiens
ggagugcagugguaugauc

SEQ ID NO: 945081 - RNA, 19 nt, Homo sapiens
gcagggaucuuugaauagg

SEQ ID NO: 945082 - RNA, 19 nt, Homo sapiens
gugaaugguuccuuauugu

SEQ ID NO: 945083 - RNA, 19 nt, Homo sapiens
gggaagacacugggacaua

SEQ ID NO: 945084 - RNA, 19 nt, Homo sapiens
gugaugggauuacagaugu

SEQ ID NO: 945085 - RNA, 19 nt, Homo sapiens
cagagaacuugaagccaaa

SEQ ID NO: 945086 - RNA, 19 nt, Homo sapiens
cagcaacucuuccuauguc

SEQ ID NO: 945087 - RNA, 19 nt, Homo sapiens
ccugaugucuguaguuuca

SEQ ID NO: 945088 - RNA, 19 nt, Homo sapiens
guaaagaugaguuuguugu

SEQ ID NO: 945089 - RNA, 19 nt, Homo sapiens
caguaaagaugaguuuguu

SEQ ID NO: 945090 - RNA, 19 nt, Homo sapiens
uaacuuagcaagaggacaa

SEQ ID NO: 945091 - RNA, 19 nt, Homo sapiens
gcucuuuggugagauugua

SEQ ID NO: 945092 - RNA, 19 nt, Homo sapiens
uggagagcauaguaaauuu

SEQ ID NO: 945093 - RNA, 19 nt, Homo sapiens
uagagcggcugaaaugguu

SEQ ID NO: 945094 - RNA, 19 nt, Homo sapiens
uuacuucucuagcuuacaa

SEQ ID NO: 945095 - RNA, 19 nt, Homo sapiens
gaagacagaguaggaagga

SEQ ID NO: 945096 - RNA, 19 nt, Homo sapiens
agacaggguuucaccaugu

SEQ ID NO: 945097 - RNA, 19 nt, Homo sapiens
ggacccuucucugcccuua

SEQ ID NO: 945098 - RNA, 19 nt, Homo sapiens
guggagagcauaguaaauu

SEQ ID NO: 945099 - RNA, 19 nt, Homo sapiens
aaugggagcucuuguugug

SEQ ID NO: 945100 - RNA, 19 nt, Homo sapiens
cggcugaaaugguuguuug

SEQ ID NO: 945101 - RNA, 19 nt, Homo sapiens
caggaugccuuauuugucu

SEQ ID NO: 945102 - RNA, 19 nt, Homo sapiens
agacagaguaggaaggaua

SEQ ID NO: 945103 - RNA, 19 nt, Homo sapiens
gaaauuugaagaccagauc

SEQ ID NO: 945104 - RNA, 19 nt, Homo sapiens
caagaucacagcuuccuau

SEQ ID NO: 945105 - RNA, 19 nt, Homo sapiens
gaaaugguucaguaaagau

SEQ ID NO: 945106 - RNA, 19 nt, Homo sapiens
gugcuuuaguaguaguuua

SEQ ID NO: 945107 - RNA, 19 nt, Homo sapiens
gcaucugguuugccuauag

SEQ ID NO: 945108 - RNA, 19 nt, Homo sapiens
cuaggccacuugugaagaa

SEQ ID NO: 945109 - RNA, 19 nt, Homo sapiens
ugaaauccaacuagacaaa

SEQ ID NO: 945110 - RNA, 19 nt, Homo sapiens
ggauuucucaggucauuug

SEQ ID NO: 945111 - RNA, 19 nt, Homo sapiens
gaauacaagcugacugaca

SEQ ID NO: 945112 - RNA, 19 nt, Homo sapiens
gcucuuuccuuguguacug

SEQ ID NO: 945113 - RNA, 19 nt, Homo sapiens
gccuggaacuuguuuaaag

SEQ ID NO: 945114 - RNA, 19 nt, Homo sapiens
ggaaggauauggaaaaggu

SEQ ID NO: 945115 - RNA, 19 nt, Homo sapiens
ucaguucugugucaugguu

SEQ ID NO: 945116 - RNA, 19 nt, Homo sapiens
uaaaaccgcugcucuaaag

SEQ ID NO: 945117 - RNA, 19 nt, Homo sapiens
ggucacaugccaauaaaca

SEQ ID NO: 945118 - RNA, 19 nt, Homo sapiens
uaacugcuacuguauuuag

SEQ ID NO: 945119 - RNA, 19 nt, Homo sapiens
ccagacucguuugcuauaa

SEQ ID NO: 945120 - RNA, 19 nt, Homo sapiens
cgacuuugcccuauccuau

SEQ ID NO: 945121 - RNA, 19 nt, Homo sapiens
guuccuaggcuccuuugua

SEQ ID NO: 945122 - RNA, 19 nt, Homo sapiens
gaugguggcuuaccucuua

SEQ ID NO: 945123 - RNA, 19 nt, Homo sapiens
guacaucaguuguuucuuu

SEQ ID NO: 945124 - RNA, 19 nt, Homo sapiens
uaaacuagcuggaccauga

SEQ ID NO: 945125 - RNA, 19 nt, Homo sapiens
ggaaacagaauacucauuu

SEQ ID NO: 945126 - RNA, 19 nt, Homo sapiens
gagagaaccuauaaacuag

SEQ ID NO: 945127 - RNA, 19 nt, Homo sapiens
gggcuuggcuuugguuaua

SEQ ID NO: 945128 - RNA, 19 nt, Homo sapiens
gcaacuacaugcaauagau

SEQ ID NO: 945129 - RNA, 19 nt, Homo sapiens
gcuaagagagaaccuauaa

SEQ ID NO: 945130 - RNA, 19 nt, Homo sapiens
ggauggagaugagcaacua

SEQ ID NO: 945131 - RNA, 19 nt, Homo sapiens
gcacagauaaagauaaguu

SEQ ID NO: 945132 - RNA, 19 nt, Homo sapiens
gagaugacaauguuucuuu

SEQ ID NO: 945133 - RNA, 19 nt, Homo sapiens
gaagacacaccaauuuaug

SEQ ID NO: 945134 - RNA, 19 nt, Homo sapiens
agagagaaccuauaaacua

SEQ ID NO: 945135 - RNA, 19 nt, Homo sapiens
gaaaagcaacgacaagaua

SEQ ID NO: 945136 - RNA, 19 nt, Homo sapiens
guauguacaucaguuguuu

SEQ ID NO: 945137 - RNA, 19 nt, Homo sapiens
gcacaggcaaccaaugaaa

SEQ ID NO: 945138 - RNA, 19 nt, Homo sapiens
ugauuuggcuccuauugaa

SEQ ID NO: 945139 - RNA, 19 nt, Homo sapiens
guagaaagcccaggaaaca

SEQ ID NO: 945140 - RNA, 19 nt, Homo sapiens
uaaacuuucuuuccaguca

SEQ ID NO: 945141 - RNA, 19 nt, Homo sapiens
ggaccaugaucuaguucaa

SEQ ID NO: 945142 - RNA, 19 nt, Homo sapiens
auacuugucucuguccuua

SEQ ID NO: 945143 - RNA, 19 nt, Homo sapiens
gauaaccaaaucacaguuu

SEQ ID NO: 945144 - RNA, 19 nt, Homo sapiens
aaauugagccugauaacaa

SEQ ID NO: 945145 - RNA, 19 nt, Homo sapiens
ucaaugauuuggcuccuau

SEQ ID NO: 945146 - RNA, 19 nt, Homo sapiens
acaccaggguugaugagua

SEQ ID NO: 945147 - RNA, 19 nt, Homo sapiens
gcaugcuccuuacaacaaa

SEQ ID NO: 945148 - RNA, 19 nt, Homo sapiens
gcuggaccaugaucuaguu

SEQ ID NO: 945149 - RNA, 19 nt, Homo sapiens
gauaugauuucagaaccaa

SEQ ID NO: 945150 - RNA, 19 nt, Homo sapiens
gagauagucacuuggagaa

SEQ ID NO: 945151 - RNA, 19 nt, Homo sapiens
caucagaaacacauacuau

SEQ ID NO: 945152 - RNA, 19 nt, Homo sapiens
auucacagcuuacacuuau

SEQ ID NO: 945153 - RNA, 19 nt, Homo sapiens
uugaugggaugguggcuua

SEQ ID NO: 945154 - RNA, 19 nt, Homo sapiens
caccaggguugaugaguau

SEQ ID NO: 945155 - RNA, 19 nt, Homo sapiens
aaagaagcaugucaggaau

SEQ ID NO: 945156 - RNA, 19 nt, Homo sapiens
aauaagacccagcuugaaa

SEQ ID NO: 945157 - RNA, 19 nt, Homo sapiens
uaagagagaaccuauaaac

SEQ ID NO: 945158 - RNA, 19 nt, Homo sapiens
guagaggaaacauucauga

SEQ ID NO: 945159 - RNA, 19 nt, Homo sapiens
gaaagguauaggaaacauu

SEQ ID NO: 945160 - RNA, 19 nt, Homo sapiens
uuaauaagacccagcuuga

SEQ ID NO: 945161 - RNA, 19 nt, Homo sapiens
gaaagcccgaccagagaaa

SEQ ID NO: 945162 - RNA, 19 nt, Homo sapiens
gauagucacuuggagaaac

SEQ ID NO: 945163 - RNA, 19 nt, Homo sapiens
gaauucuacuagccagaga

SEQ ID NO: 945164 - RNA, 19 nt, Homo sapiens
gaguuuaggaauucuacua

SEQ ID NO: 945165 - RNA, 19 nt, Homo sapiens
gaugccagcguuucuaaga

SEQ ID NO: 945166 - RNA, 19 nt, Homo sapiens
agacaaggauggagaugag

SEQ ID NO: 945167 - RNA, 19 nt, Homo sapiens
ccaggaaacagaauacuca

SEQ ID NO: 945168 - RNA, 19 nt, Homo sapiens
gaaagcccaggaaacagaa

SEQ ID NO: 945169 - RNA, 19 nt, Homo sapiens
ugaagacacaccaauuuau

SEQ ID NO: 945170 - RNA, 19 nt, Homo sapiens
uaacauaacagagcaacau

SEQ ID NO: 945171 - RNA, 19 nt, Homo sapiens
ccaucagacuguuuggauu

SEQ ID NO: 945172 - RNA, 19 nt, Homo sapiens
gcaauagaugccagcguuu

SEQ ID NO: 945173 - RNA, 19 nt, Homo sapiens
ggagaugagcaacuacaug

SEQ ID NO: 945174 - RNA, 19 nt, Homo sapiens
ggaugaaaauugcuaugaa

SEQ ID NO: 945175 - RNA, 19 nt, Homo sapiens
ucucuguccuuaaguguga

SEQ ID NO: 945176 - RNA, 19 nt, Homo sapiens
uugaagacacaccaauuua

SEQ ID NO: 945177 - RNA, 19 nt, Homo sapiens
ccaggguugaugaguauua

SEQ ID NO: 945178 - RNA, 19 nt, Homo sapiens
uauaauaugccaagguaug

SEQ ID NO: 945179 - RNA, 19 nt, Homo sapiens
cuauaauacuugucucugu

SEQ ID NO: 945180 - RNA, 19 nt, Homo sapiens
ccaccuuaguagacaguuu

SEQ ID NO: 945181 - RNA, 19 nt, Homo sapiens
ucacgcugcuuuuaacaua

SEQ ID NO: 945182 - RNA, 19 nt, Homo sapiens
agccagagauagucacuug

SEQ ID NO: 945183 - RNA, 19 nt, Homo sapiens
agacccagcuugaaaauug

SEQ ID NO: 945184 - RNA, 19 nt, Homo sapiens
ccaaauguaaggccaugaa

SEQ ID NO: 945185 - RNA, 19 nt, Homo sapiens
gaugagcaacuacaugcaa

SEQ ID NO: 945186 - RNA, 19 nt, Homo sapiens
uggaacacguuagaagaaa

SEQ ID NO: 945187 - RNA, 19 nt, Homo sapiens
caaauguaaggccaugaaa

SEQ ID NO: 945188 - RNA, 19 nt, Homo sapiens
gaucuaguucaaugauuug

SEQ ID NO: 945189 - RNA, 19 nt, Homo sapiens
caucagacuguuuggauug

SEQ ID NO: 945190 - RNA, 19 nt, Homo sapiens
gauugaaagguauaggaaa

SEQ ID NO: 945191 - RNA, 19 nt, Homo sapiens
agagcaacaucaccuagga

SEQ ID NO: 945192 - RNA, 19 nt, Homo sapiens
gagaaccuauaaacuagcu

SEQ ID NO: 945193 - RNA, 19 nt, Homo sapiens
gauccgugcuaagagagaa

SEQ ID NO: 945194 - RNA, 19 nt, Homo sapiens
ggcaguagaggaaacauuc

SEQ ID NO: 945195 - RNA, 19 nt, Homo sapiens
agaaagcccaggaaacaga

SEQ ID NO: 945196 - RNA, 19 nt, Homo sapiens
gaugauaugauuucagaac

SEQ ID NO: 945197 - RNA, 19 nt, Homo sapiens
ggguugaugaguauuauau

SEQ ID NO: 945198 - RNA, 19 nt, Homo sapiens
ggaacacguuagaagaaaa

SEQ ID NO: 945199 - RNA, 19 nt, Homo sapiens
gagccugauaacaagauua

SEQ ID NO: 945200 - RNA, 19 nt, Homo sapiens
gaucccaucagacuguuug

SEQ ID NO: 945201 - RNA, 19 nt, Homo sapiens
agaggaaacauucaugaug

SEQ ID NO: 945202 - RNA, 19 nt, Homo sapiens
ccagaaagccaggcaguag

SEQ ID NO: 945203 - RNA, 19 nt, Homo sapiens
caacuacaugcaauagaug

SEQ ID NO: 945204 - RNA, 19 nt, Homo sapiens
uuucagaaccaauggauga

SEQ ID NO: 945205 - RNA, 19 nt, Homo sapiens
aaauacugcuucacugucu

SEQ ID NO: 945206 - RNA, 19 nt, Homo sapiens
ccagagauagucacuugga

SEQ ID NO: 945207 - RNA, 19 nt, Homo sapiens
caauauuucccacuaugug

SEQ ID NO: 945208 - RNA, 19 nt, Homo sapiens
gaugacaauguuucuuuca

SEQ ID NO: 945209 - RNA, 19 nt, Homo sapiens
ccagucaaccauauauugu

SEQ ID NO: 945210 - RNA, 19 nt, Homo sapiens
cggcagcacauauacuaaa

SEQ ID NO: 945211 - RNA, 19 nt, Homo sapiens
accaugaucuaguucaaug

SEQ ID NO: 945212 - RNA, 19 nt, Homo sapiens
gagcaacuacaugcaauag

SEQ ID NO: 945213 - RNA, 19 nt, Homo sapiens
ucacuugaucacagcguua

SEQ ID NO: 945214 - RNA, 19 nt, Homo sapiens
gagcaacaucaccuaggaa

SEQ ID NO: 945215 - RNA, 19 nt, Homo sapiens
agguugagaugacaauguu

SEQ ID NO: 945216 - RNA, 19 nt, Homo sapiens
aaagcaagguugagaugac

SEQ ID NO: 945217 - RNA, 19 nt, Homo sapiens
ugaaagguauaggaaacau

SEQ ID NO: 945218 - RNA, 19 nt, Homo sapiens
uaauaagacccagcuugaa

SEQ ID NO: 945219 - RNA, 19 nt, Homo sapiens
caccucggcagcacauaua

SEQ ID NO: 945220 - RNA, 19 nt, Homo sapiens
aaagcaacgacaagauaaa

SEQ ID NO: 945221 - RNA, 19 nt, Homo sapiens
gcaagguugagaugacaau

SEQ ID NO: 945222 - RNA, 19 nt, Homo sapiens
ggaacuagaugucauguau

SEQ ID NO: 945223 - RNA, 19 nt, Homo sapiens
ggauaaaucgauucaugua

SEQ ID NO: 945224 - RNA, 19 nt, Homo sapiens
gcacacccagccuaaguua

SEQ ID NO: 945225 - RNA, 19 nt, Homo sapiens
ggagagagcugggcaccau

SEQ ID NO: 945226 - RNA, 19 nt, Homo sapiens
ggaaauccaaggaggaauu

SEQ ID NO: 945227 - RNA, 19 nt, Homo sapiens
aggaggaccuggacaagua

SEQ ID NO: 945228 - RNA, 19 nt, Homo sapiens
cagcugggcuucuucugaa

SEQ ID NO: 945229 - RNA, 19 nt, Homo sapiens
gacucugacuuccaagaua

SEQ ID NO: 945230 - RNA, 19 nt, Homo sapiens
caacuccagugacaucuuc

SEQ ID NO: 945231 - RNA, 19 nt, Homo sapiens
ggaccaggguggcuucaag

SEQ ID NO: 945232 - RNA, 19 nt, Homo sapiens
caggacagcucagagaaug

SEQ ID NO: 945233 - RNA, 19 nt, Homo sapiens
gucaacaacuugcggcuau

SEQ ID NO: 945234 - RNA, 19 nt, Homo sapiens
gagcugggcaccauggaaa

SEQ ID NO: 945235 - RNA, 19 nt, Homo sapiens
gauaacagcagaagucaac

SEQ ID NO: 945236 - RNA, 19 nt, Homo sapiens
gcagcugggcuucuucuga

SEQ ID NO: 945237 - RNA, 19 nt, Homo sapiens
gaagggcuguaauggugau

SEQ ID NO: 945238 - RNA, 19 nt, Homo sapiens
ccacaaggcuuuuccaagu

SEQ ID NO: 945239 - RNA, 19 nt, Homo sapiens
cagcaucaaccaucucuga

SEQ ID NO: 945240 - RNA, 19 nt, Homo sapiens
caggguggcuucaagaucu

SEQ ID NO: 945241 - RNA, 19 nt, Homo sapiens
ggaggaggacuucuacauc

SEQ ID NO: 945242 - RNA, 19 nt, Homo sapiens
gaacuagaugucauguaug

SEQ ID NO: 945243 - RNA, 19 nt, Homo sapiens
aagcagcucuuccggacuu

SEQ ID NO: 945244 - RNA, 19 nt, Homo sapiens
ccacugcggaugagauuga

SEQ ID NO: 945245 - RNA, 19 nt, Homo sapiens
agggauaaaucgauucaug

SEQ ID NO: 945246 - RNA, 19 nt, Homo sapiens
ugagauaacagcagaaguc

SEQ ID NO: 945247 - RNA, 19 nt, Homo sapiens
gcagcagcaucaaccaucu

SEQ ID NO: 945248 - RNA, 19 nt, Homo sapiens
gccaugagccucccaccuu

SEQ ID NO: 945249 - RNA, 19 nt, Homo sapiens
gggauaaaucgauucaugu

SEQ ID NO: 945250 - RNA, 19 nt, Homo sapiens
gaaauccaaggaggaauuc

SEQ ID NO: 945251 - RNA, 19 nt, Homo sapiens
ggacagcucagagaaugau

SEQ ID NO: 945252 - RNA, 19 nt, Homo sapiens
ccaagaccagcauuucuga

SEQ ID NO: 945253 - RNA, 19 nt, Homo sapiens
cgggagggauaaaucgauu

SEQ ID NO: 945254 - RNA, 19 nt, Homo sapiens
cauguaugguggcguccua

SEQ ID NO: 945255 - RNA, 19 nt, Homo sapiens
ggagggauaaaucgauuca

SEQ ID NO: 945256 - RNA, 19 nt, Homo sapiens
acucugacuuccaagauau

SEQ ID NO: 945257 - RNA, 19 nt, Homo sapiens
gagccucccaccuucauug

SEQ ID NO: 945258 - RNA, 19 nt, Homo sapiens
guaugguggcguccuagua

SEQ ID NO: 945259 - RNA, 19 nt, Homo sapiens
uaacagcagaagucaacaa

SEQ ID NO: 945260 - RNA, 19 nt, Homo sapiens
agauuggugugguggauga

SEQ ID NO: 945261 - RNA, 19 nt, Homo sapiens
gagauaacagcagaaguca

SEQ ID NO: 945262 - RNA, 19 nt, Homo sapiens
ccagugacaucuucuugcu

SEQ ID NO: 945263 - RNA, 19 nt, Homo sapiens
gccuguaccaugucuauga

SEQ ID NO: 945264 - RNA, 19 nt, Homo sapiens
uuggaugguucuucacuug

SEQ ID NO: 945265 - RNA, 19 nt, Homo sapiens
gcauccaccacaaggcuuu

SEQ ID NO: 945266 - RNA, 19 nt, Homo sapiens
gcaggaggaggacuucuac

SEQ ID NO: 945267 - RNA, 19 nt, Homo sapiens
ucacagccagcgucugcua

SEQ ID NO: 945268 - RNA, 19 nt, Homo sapiens
uguaccaugucuaugagaa

SEQ ID NO: 945269 - RNA, 19 nt, Homo sapiens
ggaggaccuggacaaguau

SEQ ID NO: 945270 - RNA, 19 nt, Homo sapiens
gguggucacugucauuucc

SEQ ID NO: 945271 - RNA, 19 nt, Homo sapiens
gaccaggguggcuucaaga

SEQ ID NO: 945272 - RNA, 19 nt, Homo sapiens
ggucauccucugcguguca

SEQ ID NO: 945273 - RNA, 19 nt, Homo sapiens
gcaccagcgccacgaucaa

SEQ ID NO: 945274 - RNA, 19 nt, Homo sapiens
gguggaugaugaggccaaa

SEQ ID NO: 945275 - RNA, 19 nt, Homo sapiens
ccucccaccuucauuggau

SEQ ID NO: 945276 - RNA, 19 nt, Homo sapiens
aacuagaugucauguaugg

SEQ ID NO: 945277 - RNA, 19 nt, Homo sapiens
gcugggccguguucaguac

SEQ ID NO: 945278 - RNA, 19 nt, Homo sapiens
acugcuaccuugugcucua

SEQ ID NO: 945279 - RNA, 19 nt, Homo sapiens
gcacugacagccacaacac

SEQ ID NO: 945280 - RNA, 19 nt, Homo sapiens
gcaacgcugaggaacuaga

SEQ ID NO: 945281 - RNA, 19 nt, Homo sapiens
aauccaaggaggaauucua

SEQ ID NO: 945282 - RNA, 19 nt, Homo sapiens
gggcuggcuuugaccuaca

SEQ ID NO: 945283 - RNA, 19 nt, Homo sapiens
cgucugcuaccucugguuu

SEQ ID NO: 945284 - RNA, 19 nt, Homo sapiens
ggccaauguucgccuguac

SEQ ID NO: 945285 - RNA, 19 nt, Homo sapiens
gagauugaggcccugaaca

SEQ ID NO: 945286 - RNA, 19 nt, Homo sapiens
gggcccaagaccagcauuu

SEQ ID NO: 945287 - RNA, 19 nt, Homo sapiens
ccaggacagcucagagaau

SEQ ID NO: 945288 - RNA, 19 nt, Homo sapiens
ccaggaagaaugaggaaac

SEQ ID NO: 945289 - RNA, 19 nt, Homo sapiens
ccacuuccucgccaucuuc

SEQ ID NO: 945290 - RNA, 19 nt, Homo sapiens
uugaggcccugaacagcaa

SEQ ID NO: 945291 - RNA, 19 nt, Homo sapiens
ggccacugcggaugagauu

SEQ ID NO: 945292 - RNA, 19 nt, Homo sapiens
ucccucaacuccagugaca

SEQ ID NO: 945293 - RNA, 19 nt, Homo sapiens
ccaaggaggaauucuacag

SEQ ID NO: 945294 - RNA, 19 nt, Homo sapiens
ccacccgucccacaaggaa

SEQ ID NO: 945295 - RNA, 19 nt, Homo sapiens
ccaccuucauuggaugguu

SEQ ID NO: 945296 - RNA, 19 nt, Homo sapiens
caacgcugaggaacuagau

SEQ ID NO: 945297 - RNA, 19 nt, Homo sapiens
uggcagggacgcaugucua

SEQ ID NO: 945298 - RNA, 19 nt, Homo sapiens
ggaauuugcugacacaaua

SEQ ID NO: 945299 - RNA, 19 nt, Homo sapiens
gagcagcugucaccuuauu

SEQ ID NO: 945300 - RNA, 19 nt, Homo sapiens
gagugaaggucuaagguuu

SEQ ID NO: 945301 - RNA, 19 nt, Homo sapiens
gggcauauccuaagaacuu

SEQ ID NO: 945302 - RNA, 19 nt, Homo sapiens
ggagagaagcuuuguaugg

SEQ ID NO: 945303 - RNA, 19 nt, Homo sapiens
caaugcaccuucacagaga

SEQ ID NO: 945304 - RNA, 19 nt, Homo sapiens
ggucuaagguuuggaaucu

SEQ ID NO: 945305 - RNA, 19 nt, Homo sapiens
caacuuuccuguauuaucc

SEQ ID NO: 945306 - RNA, 19 nt, Homo sapiens
guaauggcccgacuguuga

SEQ ID NO: 945307 - RNA, 19 nt, Homo sapiens
gaaggucuaagguuuggaa

SEQ ID NO: 945308 - RNA, 19 nt, Homo sapiens
ggagagccaugccuguucu

SEQ ID NO: 945309 - RNA, 19 nt, Homo sapiens
uggaguuucuggugucuuu

SEQ ID NO: 945310 - RNA, 19 nt, Homo sapiens
gcucguggguuggcaguau

SEQ ID NO: 945311 - RNA, 19 nt, Homo sapiens
uguaauggcccgacuguug

SEQ ID NO: 945312 - RNA, 19 nt, Homo sapiens
caacuaaugaacucuggaa

SEQ ID NO: 945313 - RNA, 19 nt, Homo sapiens
gacaaugcaccuucacaga

SEQ ID NO: 945314 - RNA, 19 nt, Homo sapiens
caaaacaacuaaugaacuc

SEQ ID NO: 945315 - RNA, 19 nt, Homo sapiens
ugucuuugcuuggaacuga

SEQ ID NO: 945316 - RNA, 19 nt, Homo sapiens
gcuuggaacugaccuagcu

SEQ ID NO: 945317 - RNA, 19 nt, Homo sapiens
gaauuugcugacacaauau

SEQ ID NO: 945318 - RNA, 19 nt, Homo sapiens
guauggcugucaugcuuag

SEQ ID NO: 945319 - RNA, 19 nt, Homo sapiens
uaaucugagugaaggucua

SEQ ID NO: 945320 - RNA, 19 nt, Homo sapiens
ccuguauuauccuguguga

SEQ ID NO: 945321 - RNA, 19 nt, Homo sapiens
agugauuccugcaacuuga

SEQ ID NO: 945322 - RNA, 19 nt, Homo sapiens
ggcaguaugagaguuguaa

SEQ ID NO: 945323 - RNA, 19 nt, Homo sapiens
gugaaggucuaagguuugg

SEQ ID NO: 945324 - RNA, 19 nt, Homo sapiens
ugagugaaggucuaagguu

SEQ ID NO: 945325 - RNA, 19 nt, Homo sapiens
cagggacaaugcaccuuca

SEQ ID NO: 945326 - RNA, 19 nt, Homo sapiens
uuguauggcugucaugcuu

SEQ ID NO: 945327 - RNA, 19 nt, Homo sapiens
ccucauggagagaagcuuu

SEQ ID NO: 945328 - RNA, 19 nt, Homo sapiens
agccaugccuguucuccuu

SEQ ID NO: 945329 - RNA, 19 nt, Homo sapiens
uggcccgacuguugaguga

SEQ ID NO: 945330 - RNA, 19 nt, Homo sapiens
gcagcugucaccuuauugg

SEQ ID NO: 945331 - RNA, 19 nt, Homo sapiens
gacagugauuccugcaacu

SEQ ID NO: 945332 - RNA, 19 nt, Homo sapiens
guugcacacuggaguuucu

SEQ ID NO: 945333 - RNA, 19 nt, Homo sapiens
ggugcugggcauauccuaa

SEQ ID NO: 945334 - RNA, 19 nt, Homo sapiens
caguaugagaguuguaaug

SEQ ID NO: 945335 - RNA, 19 nt, Homo sapiens
caacagccauaaccucauu

SEQ ID NO: 945336 - RNA, 19 nt, Homo sapiens
caagauuuccgccagguuu

SEQ ID NO: 945337 - RNA, 19 nt, Homo sapiens
ccagguuuccucagucaua

SEQ ID NO: 945338 - RNA, 19 nt, Homo sapiens
gaggugaagagcaaauuug

SEQ ID NO: 945339 - RNA, 19 nt, Homo sapiens
ggacauggcagggacuuca

SEQ ID NO: 945340 - RNA, 19 nt, Homo sapiens
cugcugagccugauaguga

SEQ ID NO: 945341 - RNA, 19 nt, Homo sapiens
caaauuugacgccgaguuc

SEQ ID NO: 945342 - RNA, 19 nt, Homo sapiens
gcaaauuugacgccgaguu

SEQ ID NO: 945343 - RNA, 19 nt, Homo sapiens
cggccacccuugcuaauca

SEQ ID NO: 945344 - RNA, 19 nt, Homo sapiens
ccaagugacggacaugaug

SEQ ID NO: 945345 - RNA, 19 nt, Homo sapiens
cgaggugaagagcaaauuu

SEQ ID NO: 945346 - RNA, 19 nt, Homo sapiens
cuucaucucccgccuggua

SEQ ID NO: 945347 - RNA, 19 nt, Homo sapiens
ggacgugcuacuuggcuau

SEQ ID NO: 945348 - RNA, 19 nt, Homo sapiens
agccauaaccucauuguca

SEQ ID NO: 945349 - RNA, 19 nt, Homo sapiens
ggccuggacgugcuacuug

SEQ ID NO: 945350 - RNA, 19 nt, Homo sapiens
ucauagacguggaccuacu

SEQ ID NO: 945351 - RNA, 19 nt, Homo sapiens
agucauagacguggaccua

SEQ ID NO: 945352 - RNA, 19 nt, Homo sapiens
gaccaagugacggacauga

SEQ ID NO: 945353 - RNA, 19 nt, Homo sapiens
ggcggucagugaugagauc

SEQ ID NO: 945354 - RNA, 19 nt, Homo sapiens
ccgccaaccagcgcaauaa

SEQ ID NO: 945355 - RNA, 19 nt, Homo sapiens
cagguuuccucagucauag

SEQ ID NO: 945356 - RNA, 19 nt, Homo sapiens
cgccagguuuccucaguca

SEQ ID NO: 945357 - RNA, 19 nt, Homo sapiens
gacgugcuacuuggcuaua

SEQ ID NO: 945358 - RNA, 19 nt, Homo sapiens
gaacaugagucucucuuaa

SEQ ID NO: 945359 - RNA, 19 nt, Homo sapiens
ggaaaucacuuaugcugaa

SEQ ID NO: 945360 - RNA, 19 nt, Homo sapiens
gaauuuagguggucuguca

SEQ ID NO: 945361 - RNA, 19 nt, Homo sapiens
gagaauuggucuauacauu

SEQ ID NO: 945362 - RNA, 19 nt, Homo sapiens
gagcauuuauugagcauuu

SEQ ID NO: 945363 - RNA, 19 nt, Homo sapiens
ggaaagggcuucugugaac

SEQ ID NO: 945364 - RNA, 19 nt, Homo sapiens
gaauuggucuauacauuga

SEQ ID NO: 945365 - RNA, 19 nt, Homo sapiens
ggaaugauguuaauugucu

SEQ ID NO: 945366 - RNA, 19 nt, Homo sapiens
gauaaacacucaagaagag

SEQ ID NO: 945367 - RNA, 19 nt, Homo sapiens
gagaaggacugugcuagaa

SEQ ID NO: 945368 - RNA, 19 nt, Homo sapiens
gaaggacugugcuagaaug

SEQ ID NO: 945369 - RNA, 19 nt, Homo sapiens
uaagggagguccauagaau

SEQ ID NO: 945370 - RNA, 19 nt, Homo sapiens
aaaggaaggagguaauuua

SEQ ID NO: 945371 - RNA, 19 nt, Homo sapiens
caaaagagcugguucauac

SEQ ID NO: 945372 - RNA, 19 nt, Homo sapiens
caagaagaaucugcuuauu

SEQ ID NO: 945373 - RNA, 19 nt, Homo sapiens
gcaagaagaaucugcuuau

SEQ ID NO: 945374 - RNA, 19 nt, Homo sapiens
gaucagacaccauacaaug

SEQ ID NO: 945375 - RNA, 19 nt, Homo sapiens
gcaauggguugaucagaca

SEQ ID NO: 945376 - RNA, 19 nt, Homo sapiens
gaaaggaaggagguaauuu

SEQ ID NO: 945377 - RNA, 19 nt, Homo sapiens
ucugguugcuaaagaauua

SEQ ID NO: 945378 - RNA, 19 nt, Homo sapiens
gaggaaagggcuucuguga

SEQ ID NO: 945379 - RNA, 19 nt, Homo sapiens
cauguuugguuccuguuua

SEQ ID NO: 945380 - RNA, 19 nt, Homo sapiens
acaugagucucucuuaauu

SEQ ID NO: 945381 - RNA, 19 nt, Homo sapiens
ugaugaagauccacuuaug

SEQ ID NO: 945382 - RNA, 19 nt, Homo sapiens
gaugaugaagauccacuua

SEQ ID NO: 945383 - RNA, 19 nt, Homo sapiens
gaugaagauccacuuauga

SEQ ID NO: 945384 - RNA, 19 nt, Homo sapiens
caaagaauuggaagucauu

SEQ ID NO: 945385 - RNA, 19 nt, Homo sapiens
ugagagaauuggucuauac

SEQ ID NO: 945386 - RNA, 19 nt, Homo sapiens
ggagguccauagaauuuag

SEQ ID NO: 945387 - RNA, 19 nt, Homo sapiens
ccucugcucuccacuaguu

SEQ ID NO: 945388 - RNA, 19 nt, Homo sapiens
gguggucugucaacuauuc

SEQ ID NO: 945389 - RNA, 19 nt, Homo sapiens
gggcuggaaugauguuaau

SEQ ID NO: 945390 - RNA, 19 nt, Homo sapiens
gugccucacuguugauauu

SEQ ID NO: 945391 - RNA, 19 nt, Homo sapiens
ugacuucggaaaucacuua

SEQ ID NO: 945392 - RNA, 19 nt, Homo sapiens
ggauugguaucugucauug

SEQ ID NO: 945393 - RNA, 19 nt, Homo sapiens
gcucucagauccagaaggu

SEQ ID NO: 945394 - RNA, 19 nt, Homo sapiens
uuggcaaucucauucuuua

SEQ ID NO: 945395 - RNA, 19 nt, Homo sapiens
uagguggucugucaacuau

SEQ ID NO: 945396 - RNA, 19 nt, Homo sapiens
gcuacuuuauuucuacuga

SEQ ID NO: 945397 - RNA, 19 nt, Homo sapiens
ggcaaucucauucuuuauu

SEQ ID NO: 945398 - RNA, 19 nt, Homo sapiens
gucuauacauugacugauu

SEQ ID NO: 945399 - RNA, 19 nt, Homo sapiens
gaagauccacuuaugaacu

SEQ ID NO: 945400 - RNA, 19 nt, Homo sapiens
ggugauaaacacucaagaa

SEQ ID NO: 945401 - RNA, 19 nt, Homo sapiens
auugguaucugucauugua

SEQ ID NO: 945402 - RNA, 19 nt, Homo sapiens
acaggugguuggauuggua

SEQ ID NO: 945403 - RNA, 19 nt, Homo sapiens
gcuggaaugauguuaauug

SEQ ID NO: 945404 - RNA, 19 nt, Homo sapiens
caacuauucuacuuaugag

SEQ ID NO: 945405 - RNA, 19 nt, Homo sapiens
uccaacugcuacuuuauuu

SEQ ID NO: 945406 - RNA, 19 nt, Homo sapiens
cuuaugaacugaacauucu

SEQ ID NO: 945407 - RNA, 19 nt, Homo sapiens
uacauugacugauucacuu

SEQ ID NO: 945408 - RNA, 19 nt, Homo sapiens
gaaaucacuuaugcugaag

SEQ ID NO: 945409 - RNA, 19 nt, Homo sapiens
caacugcuacuuuauuucu

SEQ ID NO: 945410 - RNA, 19 nt, Homo sapiens
uaauuuaccaccauguuug

SEQ ID NO: 945411 - RNA, 19 nt, Homo sapiens
agaauuggucuauacauug

SEQ ID NO: 945412 - RNA, 19 nt, Homo sapiens
guaagggagguccauagaa

SEQ ID NO: 945413 - RNA, 19 nt, Homo sapiens
ugauaaacacucaagaaga

SEQ ID NO: 945414 - RNA, 19 nt, Homo sapiens
gcuguugcccaaagaauug

SEQ ID NO: 945415 - RNA, 19 nt, Homo sapiens
cagacaccauacaaugaaa

SEQ ID NO: 945416 - RNA, 19 nt, Homo sapiens
ggguugaucagacaccaua

SEQ ID NO: 945417 - RNA, 19 nt, Homo sapiens
ggauagauaauaagcucuu

SEQ ID NO: 945418 - RNA, 19 nt, Homo sapiens
ucagacaccauacaaugaa

SEQ ID NO: 945419 - RNA, 19 nt, Homo sapiens
cauuaugacuucggaaauc

SEQ ID NO: 945420 - RNA, 19 nt, Homo sapiens
gaaagggcuucugugaacu

SEQ ID NO: 945421 - RNA, 19 nt, Homo sapiens
aaagugagcauuuauugag

SEQ ID NO: 945422 - RNA, 19 nt, Homo sapiens
agagcaggauuucaucuuc

SEQ ID NO: 945423 - RNA, 19 nt, Homo sapiens
gggagguccauagaauuua

SEQ ID NO: 945424 - RNA, 19 nt, Homo sapiens
ugaacauucuccaugaaca

SEQ ID NO: 945425 - RNA, 19 nt, Homo sapiens
uuugugagaugaugaagau

SEQ ID NO: 945426 - RNA, 19 nt, Homo sapiens
guaaaucacccaaaagaug

SEQ ID NO: 945427 - RNA, 19 nt, Homo sapiens
caugagucucucuuaauuu

SEQ ID NO: 945428 - RNA, 19 nt, Homo sapiens
ugaaaggaaggagguaauu

SEQ ID NO: 945429 - RNA, 19 nt, Homo sapiens
gauagauaauaagcucuuc

SEQ ID NO: 945430 - RNA, 19 nt, Homo sapiens
augaacaggugguuggauu

SEQ ID NO: 945431 - RNA, 19 nt, Homo sapiens
auacaacauuggagugugu

SEQ ID NO: 945432 - RNA, 19 nt, Homo sapiens
agaacaugagucucucuua

SEQ ID NO: 945433 - RNA, 19 nt, Homo sapiens
gaacaggugguuggauugg

SEQ ID NO: 945434 - RNA, 19 nt, Homo sapiens
gaacauucuccaugaacag

SEQ ID NO: 945435 - RNA, 19 nt, Homo sapiens
aagauccacuuaugaacug

SEQ ID NO: 945436 - RNA, 19 nt, Homo sapiens
gaagagcaggauuucaucu

SEQ ID NO: 945437 - RNA, 19 nt, Homo sapiens
guuugguuccuguuuauaa

SEQ ID NO: 945438 - RNA, 19 nt, Homo sapiens
ugagaaggacugugcuaga

SEQ ID NO: 945439 - RNA, 19 nt, Homo sapiens
gcugguucauacaacauug

SEQ ID NO: 945440 - RNA, 19 nt, Homo sapiens
gagagaauuggucuauaca

SEQ ID NO: 945441 - RNA, 19 nt, Homo sapiens
ucugucaacuauucuacuu

SEQ ID NO: 945442 - RNA, 19 nt, Homo sapiens
caccauacaaugaaaguuc

SEQ ID NO: 945443 - RNA, 19 nt, Homo sapiens
ggcaagacagugagaagga

SEQ ID NO: 945444 - RNA, 19 nt, Homo sapiens
gaauuggaagucauuuagu

SEQ ID NO: 945445 - RNA, 19 nt, Homo sapiens
ucuauacauugacugauuc

SEQ ID NO: 945446 - RNA, 19 nt, Homo sapiens
aagaagagcaggauuucau

SEQ ID NO: 945447 - RNA, 19 nt, Homo sapiens
gugauaaacacucaagaag

SEQ ID NO: 945448 - RNA, 19 nt, Homo sapiens
cuucggaaaucacuuaugc

SEQ ID NO: 945449 - RNA, 19 nt, Homo sapiens
ccagaaggucagcgacauu

SEQ ID NO: 945450 - RNA, 19 nt, Homo sapiens
aaagagcugguucauacaa

SEQ ID NO: 945451 - RNA, 19 nt, Homo sapiens
agggagguccauagaauuu

SEQ ID NO: 945452 - RNA, 19 nt, Homo sapiens
aacugaacauucuccauga

SEQ ID NO: 945453 - RNA, 19 nt, Homo sapiens
cuggaaugauguuaauugu

SEQ ID NO: 945454 - RNA, 19 nt, Homo sapiens
ccaaugagcgcugcguugu

SEQ ID NO: 945455 - RNA, 19 nt, Homo sapiens
ucaagaagagcaggauuuc

SEQ ID NO: 945456 - RNA, 19 nt, Homo sapiens
agaauuggaagucauuuag

SEQ ID NO: 945457 - RNA, 19 nt, Homo sapiens
uaugagagaauuggucuau

SEQ ID NO: 945458 - RNA, 19 nt, Homo sapiens
gcauuuaccuugauaagaa

SEQ ID NO: 945459 - RNA, 19 nt, Homo sapiens
ucacuuggcuggauguuua

SEQ ID NO: 945460 - RNA, 19 nt, Homo sapiens
ggacagugcugguguguug

SEQ ID NO: 945461 - RNA, 19 nt, Homo sapiens
gaaauguagucgccauaaa

SEQ ID NO: 945462 - RNA, 19 nt, Homo sapiens
gagagaagcagauucgaua

SEQ ID NO: 945463 - RNA, 19 nt, Homo sapiens
ugacagauauggaaaugaa

SEQ ID NO: 945464 - RNA, 19 nt, Homo sapiens
gauccaugcuuaaagauga

SEQ ID NO: 945465 - RNA, 19 nt, Homo sapiens
gaacaaauuccgagacgaa

SEQ ID NO: 945466 - RNA, 19 nt, Homo sapiens
aaacagaucucagucaaau

SEQ ID NO: 945467 - RNA, 19 nt, Homo sapiens
uaaaugguguugcagauug

SEQ ID NO: 945468 - RNA, 19 nt, Homo sapiens
gcuuaaagaugaaauguag

SEQ ID NO: 945469 - RNA, 19 nt, Homo sapiens
gaugaaagaagcaggagua

SEQ ID NO: 945470 - RNA, 19 nt, Homo sapiens
gucaugggauccagaauaa

SEQ ID NO: 945471 - RNA, 19 nt, Homo sapiens
gaaagaagcaggaguagac

SEQ ID NO: 945472 - RNA, 19 nt, Homo sapiens
gcugguguguugacagaua

SEQ ID NO: 945473 - RNA, 19 nt, Homo sapiens
gauaccacauggcaagaaa

SEQ ID NO: 945474 - RNA, 19 nt, Homo sapiens
ggacugaugaugaggauga

SEQ ID NO: 945475 - RNA, 19 nt, Homo sapiens
aagcagaaauguuaagaga

SEQ ID NO: 945476 - RNA, 19 nt, Homo sapiens
ggaaaaccauggauucuga

SEQ ID NO: 945477 - RNA, 19 nt, Homo sapiens
ggaaguggcaaacagauug

SEQ ID NO: 945478 - RNA, 19 nt, Homo sapiens
guagaguccucaauugugu

SEQ ID NO: 945479 - RNA, 19 nt, Homo sapiens
caaggacaguuuaauaucu

SEQ ID NO: 945480 - RNA, 19 nt, Homo sapiens
gaaaacagaucucagucaa

SEQ ID NO: 945481 - RNA, 19 nt, Homo sapiens
gagacgaaguagaggauga

SEQ ID NO: 945482 - RNA, 19 nt, Homo sapiens
gaugaagacgauauuauga

SEQ ID NO: 945483 - RNA, 19 nt, Homo sapiens
uaacagacuugauacaaac

SEQ ID NO: 945484 - RNA, 19 nt, Homo sapiens
gcccauguccuucagauaa

SEQ ID NO: 945485 - RNA, 19 nt, Homo sapiens
ccaaggcauucuucaauuc

SEQ ID NO: 945486 - RNA, 19 nt, Homo sapiens
ucagaagcauuuaccuuga

SEQ ID NO: 945487 - RNA, 19 nt, Homo sapiens
cgaaguagaggaugauuau

SEQ ID NO: 945488 - RNA, 19 nt, Homo sapiens
caaauuccgagacgaagua

SEQ ID NO: 945489 - RNA, 19 nt, Homo sapiens
cagaauaaaugguguugca

SEQ ID NO: 945490 - RNA, 19 nt, Homo sapiens
gcagugaccuggaguucag

SEQ ID NO: 945491 - RNA, 19 nt, Homo sapiens
cauggauucugaaaguuaa

SEQ ID NO: 945492 - RNA, 19 nt, Homo sapiens
ucaccacaaucucucagua

SEQ ID NO: 945493 - RNA, 19 nt, Homo sapiens
ugaagaugguuacuacaug

SEQ ID NO: 945494 - RNA, 19 nt, Homo sapiens
acacauacaaggacaguuu

SEQ ID NO: 945495 - RNA, 19 nt, Homo sapiens
gauaagcccaccaguacaa

SEQ ID NO: 945496 - RNA, 19 nt, Homo sapiens
gugaugaccaugauguaua

SEQ ID NO: 945497 - RNA, 19 nt, Homo sapiens
ugaagaugaugaugaagau

SEQ ID NO: 945498 - RNA, 19 nt, Homo sapiens
ucagauaagcccaccagua

SEQ ID NO: 945499 - RNA, 19 nt, Homo sapiens
ccauggauucugaaaguua

SEQ ID NO: 945500 - RNA, 19 nt, Homo sapiens
cauaugcagucuagucaga

SEQ ID NO: 945501 - RNA, 19 nt, Homo sapiens
agaagcauuuaccuugaua

SEQ ID NO: 945502 - RNA, 19 nt, Homo sapiens
aguacaagcagaaauguua

SEQ ID NO: 945503 - RNA, 19 nt, Homo sapiens
aacaauggcucaccacaau

SEQ ID NO: 945504 - RNA, 19 nt, Homo sapiens
ccucaauuguguuuacauu

SEQ ID NO: 945505 - RNA, 19 nt, Homo sapiens
gaugaugaagacgauauua

SEQ ID NO: 945506 - RNA, 19 nt, Homo sapiens
cagauugugcuauagauuu

SEQ ID NO: 945507 - RNA, 19 nt, Homo sapiens
ucagagcucagaagcauuu

SEQ ID NO: 945508 - RNA, 19 nt, Homo sapiens
accagcaucuugccaauuu

SEQ ID NO: 945509 - RNA, 19 nt, Homo sapiens
guggaggggucccauauua

SEQ ID NO: 945510 - RNA, 19 nt, Homo sapiens
aaauacauaugcagucuag

SEQ ID NO: 945511 - RNA, 19 nt, Homo sapiens
gagcucagcaauauucaga

SEQ ID NO: 945512 - RNA, 19 nt, Homo sapiens
uacaaacuaugaccugcua

SEQ ID NO: 945513 - RNA, 19 nt, Homo sapiens
guacaagcagaaauguuaa

SEQ ID NO: 945514 - RNA, 19 nt, Homo sapiens
gaagaugaaauugaagaug

SEQ ID NO: 945515 - RNA, 19 nt, Homo sapiens
ugaauggacugaugaugag

SEQ ID NO: 945516 - RNA, 19 nt, Homo sapiens
ugaugaagaugguuacuac

SEQ ID NO: 945517 - RNA, 19 nt, Homo sapiens
gauaagaaugaacagugua

SEQ ID NO: 945518 - RNA, 19 nt, Homo sapiens
aaggauccaugcuuaaaga

SEQ ID NO: 945519 - RNA, 19 nt, Homo sapiens
acaacaagaugcucaaggu

SEQ ID NO: 945520 - RNA, 19 nt, Homo sapiens
gaagucaugggauccagaa

SEQ ID NO: 945521 - RNA, 19 nt, Homo sapiens
ugauaagaaugaacagugu

SEQ ID NO: 945522 - RNA, 19 nt, Homo sapiens
gcagauugugcuauagauu

SEQ ID NO: 945523 - RNA, 19 nt, Homo sapiens
gcucagcaauauucagaag

SEQ ID NO: 945524 - RNA, 19 nt, Homo sapiens
cagauaagcccaccaguac

SEQ ID NO: 945525 - RNA, 19 nt, Homo sapiens
ggucauaccuacucuuuuc

SEQ ID NO: 945526 - RNA, 19 nt, Homo sapiens
guaaaucuuccauaagcaa

SEQ ID NO: 945527 - RNA, 19 nt, Homo sapiens
acuaugaccugcuauugga

SEQ ID NO: 945528 - RNA, 19 nt, Homo sapiens
uagaauaucaggcaugugu

SEQ ID NO: 945529 - RNA, 19 nt, Homo sapiens
aaccauggauucugaaagu

SEQ ID NO: 945530 - RNA, 19 nt, Homo sapiens
ggaucguacauguuaauuu

SEQ ID NO: 945531 - RNA, 19 nt, Homo sapiens
caugaaaguggaagucaaa

SEQ ID NO: 945532 - RNA, 19 nt, Homo sapiens
ucaggcaugugucuuagga

SEQ ID NO: 945533 - RNA, 19 nt, Homo sapiens
aguagaggaugauuauuuc

SEQ ID NO: 945534 - RNA, 19 nt, Homo sapiens
gaagacgauauuaugaaug

SEQ ID NO: 945535 - RNA, 19 nt, Homo sapiens
caaacuaugaccugcuauu

SEQ ID NO: 945536 - RNA, 19 nt, Homo sapiens
ccacaaucucucaguauga

SEQ ID NO: 945537 - RNA, 19 nt, Homo sapiens
cuugggaucguacauguua

SEQ ID NO: 945538 - RNA, 19 nt, Homo sapiens
gaaaauacauaugcagucu

SEQ ID NO: 945539 - RNA, 19 nt, Homo sapiens
gugcugguguguugacaga

SEQ ID NO: 945540 - RNA, 19 nt, Homo sapiens
cagaagcauuuaccuugau

SEQ ID NO: 945541 - RNA, 19 nt, Homo sapiens
guucagauggucauaccua

SEQ ID NO: 945542 - RNA, 19 nt, Homo sapiens
gaagcaggaguagaccaua

SEQ ID NO: 945543 - RNA, 19 nt, Homo sapiens
ggcagucucaugcagauuu

SEQ ID NO: 945544 - RNA, 19 nt, Homo sapiens
ugaugaagacgauauuaug

SEQ ID NO: 945545 - RNA, 19 nt, Homo sapiens
guugacagauauggaaaug

SEQ ID NO: 945546 - RNA, 19 nt, Homo sapiens
gaugauuauuuccgcacuu

SEQ ID NO: 945547 - RNA, 19 nt, Homo sapiens
gcuagugcuugggaucgua

SEQ ID NO: 945548 - RNA, 19 nt, Homo sapiens
uguugcagauugugcuaua

SEQ ID NO: 945549 - RNA, 19 nt, Homo sapiens
caugggauccagaauaaau

SEQ ID NO: 945550 - RNA, 19 nt, Homo sapiens
gcucagaagcauuuaccuu

SEQ ID NO: 945551 - RNA, 19 nt, Homo sapiens
ggugucagccguacugugu

SEQ ID NO: 945552 - RNA, 19 nt, Homo sapiens
gaaauugaagaugaugaug

SEQ ID NO: 945553 - RNA, 19 nt, Homo sapiens
aauaaaugguguugcagau

SEQ ID NO: 945554 - RNA, 19 nt, Homo sapiens
guuacuacaugccaacaca

SEQ ID NO: 945555 - RNA, 19 nt, Homo sapiens
gacuugauacaaacuauga

SEQ ID NO: 945556 - RNA, 19 nt, Homo sapiens
aggcaugugucuuaggaaa

SEQ ID NO: 945557 - RNA, 19 nt, Homo sapiens
uaacagagagauaccacau

SEQ ID NO: 945558 - RNA, 19 nt, Homo sapiens
gcgaaagccuacuguaaua

SEQ ID NO: 945559 - RNA, 19 nt, Homo sapiens
ccaauaccgucuaccagua

SEQ ID NO: 945560 - RNA, 19 nt, Homo sapiens
ccaacacccuucccacuug

SEQ ID NO: 945561 - RNA, 19 nt, Homo sapiens
aggagaagcucaacuacaa

SEQ ID NO: 945562 - RNA, 19 nt, Homo sapiens
acaaggcgcuggaggagaa

SEQ ID NO: 945563 - RNA, 19 nt, Homo sapiens
gaacugagggcugggauau

SEQ ID NO: 945564 - RNA, 19 nt, Homo sapiens
ggaggagaauaacaacuuc

SEQ ID NO: 945565 - RNA, 19 nt, Homo sapiens
gaaagccuacuguaauaug

SEQ ID NO: 945566 - RNA, 19 nt, Homo sapiens
gaagagaugucgggcuaag

SEQ ID NO: 945567 - RNA, 19 nt, Homo sapiens
gggcugaguuccuucuuuc

SEQ ID NO: 945568 - RNA, 19 nt, Homo sapiens
gaacaaggagcagcgagaa

SEQ ID NO: 945569 - RNA, 19 nt, Homo sapiens
guucaccucugucuagaug

SEQ ID NO: 945570 - RNA, 19 nt, Homo sapiens
gcacagggguccucugaga

SEQ ID NO: 945571 - RNA, 19 nt, Homo sapiens
uagcgaaagccuacuguaa

SEQ ID NO: 945572 - RNA, 19 nt, Homo sapiens
gcccacagauccagguguu

SEQ ID NO: 945573 - RNA, 19 nt, Homo sapiens
gaaagggaagcagaacuga

SEQ ID NO: 945574 - RNA, 19 nt, Homo sapiens
cggcugaguucucuuagga

SEQ ID NO: 945575 - RNA, 19 nt, Homo sapiens
gagaagcucaacuacaaga

SEQ ID NO: 945576 - RNA, 19 nt, Homo sapiens
gaagcucaacuacaagaug

SEQ ID NO: 945577 - RNA, 19 nt, Homo sapiens
caccagggcuuugcagaug

SEQ ID NO: 945578 - RNA, 19 nt, Homo sapiens
guaauaugcacccaucuca

SEQ ID NO: 945579 - RNA, 19 nt, Homo sapiens
gugcaagaguuccaaagag

SEQ ID NO: 945580 - RNA, 19 nt, Homo sapiens
ggcugcagcuuuccuuaau

SEQ ID NO: 945581 - RNA, 19 nt, Homo sapiens
agauggagcucagcaagga

SEQ ID NO: 945582 - RNA, 19 nt, Homo sapiens
gaagugcaagaguuccaaa

SEQ ID NO: 945583 - RNA, 19 nt, Homo sapiens
acaaggagaagaugaagga

SEQ ID NO: 945584 - RNA, 19 nt, Homo sapiens
gggcugcagcuuuccuuaa

SEQ ID NO: 945585 - RNA, 19 nt, Homo sapiens
gaggagaagcucaacuaca

SEQ ID NO: 945586 - RNA, 19 nt, Homo sapiens
ccaaggcuguccacaucug

SEQ ID NO: 945587 - RNA, 19 nt, Homo sapiens
ugaaagacccacccuagag

SEQ ID NO: 945588 - RNA, 19 nt, Homo sapiens
cggaggagaagcucaacua

SEQ ID NO: 945589 - RNA, 19 nt, Homo sapiens
acugagggcugggauauuc

SEQ ID NO: 945590 - RNA, 19 nt, Homo sapiens
ggaagcggcagccacaagu

SEQ ID NO: 945591 - RNA, 19 nt, Homo sapiens
gcagauguccuugaaagac

SEQ ID NO: 945592 - RNA, 19 nt, Homo sapiens
cugcagcuuuccuuaaugu

SEQ ID NO: 945593 - RNA, 19 nt, Homo sapiens
gcugcagcuuuccuuaaug

SEQ ID NO: 945594 - RNA, 19 nt, Homo sapiens
caucucauccacguaguaa

SEQ ID NO: 945595 - RNA, 19 nt, Homo sapiens
gagccagggcccucaacuu

SEQ ID NO: 945596 - RNA, 19 nt, Homo sapiens
ccucugggcugaguuccuu

SEQ ID NO: 945597 - RNA, 19 nt, Homo sapiens
uugcagauguccuugaaag

SEQ ID NO: 945598 - RNA, 19 nt, Homo sapiens
acccaaggcuguccacauc

SEQ ID NO: 945599 - RNA, 19 nt, Homo sapiens
caagacagccccagaagga

SEQ ID NO: 945600 - RNA, 19 nt, Homo sapiens
gcugcauggucuagagguu

SEQ ID NO: 945601 - RNA, 19 nt, Homo sapiens
acaaggagcagcgagaaga

SEQ ID NO: 945602 - RNA, 19 nt, Homo sapiens
cgaaagccuacuguaauau

SEQ ID NO: 945603 - RNA, 19 nt, Homo sapiens
ccagggcccucaacuucca

SEQ ID NO: 945604 - RNA, 19 nt, Homo sapiens
caugguggcagcgcucaua

SEQ ID NO: 945605 - RNA, 19 nt, Homo sapiens
uggaggagaauaacaacuu

SEQ ID NO: 945606 - RNA, 19 nt, Homo sapiens
ugggcugaguuccuucuuu

SEQ ID NO: 945607 - RNA, 19 nt, Homo sapiens
caucugcuccugcuucuac

SEQ ID NO: 945608 - RNA, 19 nt, Homo sapiens
gggcugggauauuccucau

SEQ ID NO: 945609 - RNA, 19 nt, Homo sapiens
agaaagggaagcagaacug

SEQ ID NO: 945610 - RNA, 19 nt, Homo sapiens
ucaccucugucuagaugca

SEQ ID NO: 945611 - RNA, 19 nt, Homo sapiens
gggcuuugcagauguccuu

SEQ ID NO: 945612 - RNA, 19 nt, Homo sapiens
gcuccugcuucuacacaca

SEQ ID NO: 945613 - RNA, 19 nt, Homo sapiens
ggagaagcucaacuacaag

SEQ ID NO: 945614 - RNA, 19 nt, Homo sapiens
ggaggagaagcucaacuac

SEQ ID NO: 945615 - RNA, 19 nt, Homo sapiens
gcuguccacaucuggcuuu

SEQ ID NO: 945616 - RNA, 19 nt, Homo sapiens
ccuacaaggagaagaugaa

SEQ ID NO: 945617 - RNA, 19 nt, Homo sapiens
gaggagaauaacaacuuca

SEQ ID NO: 945618 - RNA, 19 nt, Homo sapiens
ccuguguguuuaagacaug

SEQ ID NO: 945619 - RNA, 19 nt, Homo sapiens
aauaugcacccaucucauc

SEQ ID NO: 945620 - RNA, 19 nt, Homo sapiens
cuuugcagauguccuugaa

SEQ ID NO: 945621 - RNA, 19 nt, Homo sapiens
gugcagccggugcuuguug

SEQ ID NO: 945622 - RNA, 19 nt, Homo sapiens
gagcagcgagaagagaugu

SEQ ID NO: 945623 - RNA, 19 nt, Homo sapiens
ccaccagggcuuugcagau

SEQ ID NO: 945624 - RNA, 19 nt, Homo sapiens
gagaguggcuccuuaacuu

SEQ ID NO: 945625 - RNA, 19 nt, Homo sapiens
caucacggaucaugaauuu

SEQ ID NO: 945626 - RNA, 19 nt, Homo sapiens
gaaacuaugugaagcaaca

SEQ ID NO: 945627 - RNA, 19 nt, Homo sapiens
ugucagaaguguauugaua

SEQ ID NO: 945628 - RNA, 19 nt, Homo sapiens
ugaagcagcugaccgauga

SEQ ID NO: 945629 - RNA, 19 nt, Homo sapiens
agacacaguugguuauuaa

SEQ ID NO: 945630 - RNA, 19 nt, Homo sapiens
gaucagacacaguugguua

SEQ ID NO: 945631 - RNA, 19 nt, Homo sapiens
gaagcaacacucuggauuu

SEQ ID NO: 945632 - RNA, 19 nt, Homo sapiens
gaugauauggcuaacuaua

SEQ ID NO: 945633 - RNA, 19 nt, Homo sapiens
aagaugauauggcuaacua

SEQ ID NO: 945634 - RNA, 19 nt, Homo sapiens
ggaggaguguuguaucugu

SEQ ID NO: 945635 - RNA, 19 nt, Homo sapiens
cacaggaauugcccuauuu

SEQ ID NO: 945636 - RNA, 19 nt, Homo sapiens
gccaugaccuugaagugaa

SEQ ID NO: 945637 - RNA, 19 nt, Homo sapiens
cagacacaguugguuauua

SEQ ID NO: 945638 - RNA, 19 nt, Homo sapiens
aaaugaaucuuggguggua

SEQ ID NO: 945639 - RNA, 19 nt, Homo sapiens
gaaguguauugauaaaugg

SEQ ID NO: 945640 - RNA, 19 nt, Homo sapiens
gaggaguguuguaucugua

SEQ ID NO: 945641 - RNA, 19 nt, Homo sapiens
gaggaggaguguuguaucu

SEQ ID NO: 945642 - RNA, 19 nt, Homo sapiens
gaaaacucauccucuguaa

SEQ ID NO: 945643 - RNA, 19 nt, Homo sapiens
uuaaugauguaacggcuaa

SEQ ID NO: 945644 - RNA, 19 nt, Homo sapiens
auugugggcucaaauauuu

SEQ ID NO: 945645 - RNA, 19 nt, Homo sapiens
gaaagucuucuguugcuau

SEQ ID NO: 945646 - RNA, 19 nt, Homo sapiens
ucaagcagcaggaguauug

SEQ ID NO: 945647 - RNA, 19 nt, Homo sapiens
cuccuuaacuuaugaagaa

SEQ ID NO: 945648 - RNA, 19 nt, Homo sapiens
acagaugacuggagcaaau

SEQ ID NO: 945649 - RNA, 19 nt, Homo sapiens
acacaggaauugcccuauu

SEQ ID NO: 945650 - RNA, 19 nt, Homo sapiens
ucacggaucaugaauuuau

SEQ ID NO: 945651 - RNA, 19 nt, Homo sapiens
gacagcaaauuucggauca

SEQ ID NO: 945652 - RNA, 19 nt, Homo sapiens
gcucacagcuuuugucaga

SEQ ID NO: 945653 - RNA, 19 nt, Homo sapiens
gcaacacucuggauuuuga

SEQ ID NO: 945654 - RNA, 19 nt, Homo sapiens
ggaagaauguaggguugug

SEQ ID NO: 945655 - RNA, 19 nt, Homo sapiens
aaacucauccucuguaaca

SEQ ID NO: 945656 - RNA, 19 nt, Homo sapiens
gagcuccaccucugaagaa

SEQ ID NO: 945657 - RNA, 19 nt, Homo sapiens
gcaggaguauuggcacaga

SEQ ID NO: 945658 - RNA, 19 nt, Homo sapiens
aaucuugggugguaucaga

SEQ ID NO: 945659 - RNA, 19 nt, Homo sapiens
ucgagagaguggcuccuua

SEQ ID NO: 945660 - RNA, 19 nt, Homo sapiens
gcaaauuucggaucagaca

SEQ ID NO: 945661 - RNA, 19 nt, Homo sapiens
ggagugaucgacacaggaa

SEQ ID NO: 945662 - RNA, 19 nt, Homo sapiens
cagcaaauuucggaucaga

SEQ ID NO: 945663 - RNA, 19 nt, Homo sapiens
gggaaacuaugugaagcaa

SEQ ID NO: 945664 - RNA, 19 nt, Homo sapiens
guaccaagauuaacaaaag

SEQ ID NO: 945665 - RNA, 19 nt, Homo sapiens
aaagauaucacaagucaag

SEQ ID NO: 945666 - RNA, 19 nt, Homo sapiens
cgagagaguggcuccuuaa

SEQ ID NO: 945667 - RNA, 19 nt, Homo sapiens
ccacaggccaugaccuuga

SEQ ID NO: 945668 - RNA, 19 nt, Homo sapiens
ggucugauuccucugcuuu

SEQ ID NO: 945669 - RNA, 19 nt, Homo sapiens
cacggaucaugaauuuaua

SEQ ID NO: 945670 - RNA, 19 nt, Homo sapiens
aaagucuucuguugcuauu

SEQ ID NO: 945671 - RNA, 19 nt, Homo sapiens
ccaugaccuugaagugaaa

SEQ ID NO: 945672 - RNA, 19 nt, Homo sapiens
gugaaagucuucuguugcu

SEQ ID NO: 945673 - RNA, 19 nt, Homo sapiens
aagugaaagucuucuguug

SEQ ID NO: 945674 - RNA, 19 nt, Homo sapiens
gucagaaguguauugauaa

SEQ ID NO: 945675 - RNA, 19 nt, Homo sapiens
guacaaccugggucugauu

SEQ ID NO: 945676 - RNA, 19 nt, Homo sapiens
ggaguguuguaucuguaug

SEQ ID NO: 945677 - RNA, 19 nt, Homo sapiens
ccuugaaccugggaaacua

SEQ ID NO: 945678 - RNA, 19 nt, Homo sapiens
cagaugcacccacugaaga

SEQ ID NO: 945679 - RNA, 19 nt, Homo sapiens
caucaugggacagcaaauu

SEQ ID NO: 945680 - RNA, 19 nt, Homo sapiens
cauccucuguaacaucuug

SEQ ID NO: 945681 - RNA, 19 nt, Homo sapiens
ugaagaaccugaugaaaac

SEQ ID NO: 945682 - RNA, 19 nt, Homo sapiens
ugaagcaacacucuggauu

SEQ ID NO: 945683 - RNA, 19 nt, Homo sapiens
guggaggcaucacggauca

SEQ ID NO: 945684 - RNA, 19 nt, Homo sapiens
caaaagcaguggcauugug

SEQ ID NO: 945685 - RNA, 19 nt, Homo sapiens
uugcuauucugaucauuug

SEQ ID NO: 945686 - RNA, 19 nt, Homo sapiens
ggccaugaccuugaaguga

SEQ ID NO: 945687 - RNA, 19 nt, Homo sapiens
gaugaggaggaguguugua

SEQ ID NO: 945688 - RNA, 19 nt, Homo sapiens
gaguggcuccuuaacuuau

SEQ ID NO: 945689 - RNA, 19 nt, Homo sapiens
agaguggcuccuuaacuua

SEQ ID NO: 945690 - RNA, 19 nt, Homo sapiens
cacaggccaugaccuugaa

SEQ ID NO: 945691 - RNA, 19 nt, Homo sapiens
gaaccugggaaacuaugug

SEQ ID NO: 945692 - RNA, 19 nt, Homo sapiens
gcaucacggaucaugaauu

SEQ ID NO: 945693 - RNA, 19 nt, Homo sapiens
ugaaagucuucuguugcua

SEQ ID NO: 945694 - RNA, 19 nt, Homo sapiens
caaaacauguuacguuggu

SEQ ID NO: 945695 - RNA, 19 nt, Homo sapiens
cugaagaugauauggcuaa

SEQ ID NO: 945696 - RNA, 19 nt, Homo sapiens
gaccucauccugccuugug

SEQ ID NO: 945697 - RNA, 19 nt, Homo sapiens
ccgaugaggaggaguguug

SEQ ID NO: 945698 - RNA, 19 nt, Homo sapiens
gguacaaccugggucugau

SEQ ID NO: 945699 - RNA, 19 nt, Homo sapiens
ugauguaacggcuaaagug

SEQ ID NO: 945700 - RNA, 19 nt, Homo sapiens
agucuucuguugcuauugu

SEQ ID NO: 945701 - RNA, 19 nt, Homo sapiens
aagcaacacucuggauuuu

SEQ ID NO: 945702 - RNA, 19 nt, Homo sapiens
auugauaaauggagugauc

SEQ ID NO: 945703 - RNA, 19 nt, Homo sapiens
ggaggcaucacggaucaug

SEQ ID NO: 945704 - RNA, 19 nt, Homo sapiens
gaugacuggagcaaaugaa

SEQ ID NO: 945705 - RNA, 19 nt, Homo sapiens
guggcuccuuaacuuauga

SEQ ID NO: 945706 - RNA, 19 nt, Homo sapiens
gacuggagcaaaugaaucu

SEQ ID NO: 945707 - RNA, 19 nt, Homo sapiens
uaacaaaagcaguggcauu

SEQ ID NO: 945708 - RNA, 19 nt, Homo sapiens
gaagaugauauggcuaacu

SEQ ID NO: 945709 - RNA, 19 nt, Homo sapiens
ugaaaacucauccucugua

SEQ ID NO: 945710 - RNA, 19 nt, Homo sapiens
cugaagaaccugaugaaaa

SEQ ID NO: 945711 - RNA, 19 nt, Homo sapiens
guagagauuucuucagaua

SEQ ID NO: 945712 - RNA, 19 nt, Homo sapiens
ucagauaucuccauuaaug

SEQ ID NO: 945713 - RNA, 19 nt, Homo sapiens
aaacagaccuuuccucuca

SEQ ID NO: 945714 - RNA, 19 nt, Homo sapiens
gcaaguaucucccaaaauu

SEQ ID NO: 945715 - RNA, 19 nt, Homo sapiens
gcaccugcuucucaaauuu

SEQ ID NO: 945716 - RNA, 19 nt, Homo sapiens
aaacucaucuucuucaaug

SEQ ID NO: 945717 - RNA, 19 nt, Homo sapiens
caaauucaaucaguccaua

SEQ ID NO: 945718 - RNA, 19 nt, Homo sapiens
cuucagauaucuccauuaa

SEQ ID NO: 945719 - RNA, 19 nt, Homo sapiens
cagcagaauuccaguggua

SEQ ID NO: 945720 - RNA, 19 nt, Homo sapiens
gaagacgaauacuuggaaa

SEQ ID NO: 945721 - RNA, 19 nt, Homo sapiens
gaacuauccaccauacauu

SEQ ID NO: 945722 - RNA, 19 nt, Homo sapiens
gaagaaacacagccucaug

SEQ ID NO: 945723 - RNA, 19 nt, Homo sapiens
guacaaggaugacaaaaga

SEQ ID NO: 945724 - RNA, 19 nt, Homo sapiens
gaacaugacuaugggaacu

SEQ ID NO: 945725 - RNA, 19 nt, Homo sapiens
ggaggagucugcgcgcuuu

SEQ ID NO: 945726 - RNA, 19 nt, Homo sapiens
gaaaauugccuugcagaua

SEQ ID NO: 945727 - RNA, 19 nt, Homo sapiens
gagcuggccaucccaaauu

SEQ ID NO: 945728 - RNA, 19 nt, Homo sapiens
gcagauauuuagguacaau

SEQ ID NO: 945729 - RNA, 19 nt, Homo sapiens
gacagcaaccaaucagaua

SEQ ID NO: 945730 - RNA, 19 nt, Homo sapiens
gagugaagacgaauacuug

SEQ ID NO: 945731 - RNA, 19 nt, Homo sapiens
caaccaaucagauauauac

SEQ ID NO: 945732 - RNA, 19 nt, Homo sapiens
agacacaucucucccaaag

SEQ ID NO: 945733 - RNA, 19 nt, Homo sapiens
gaacguggauguguaugac

SEQ ID NO: 945734 - RNA, 19 nt, Homo sapiens
gcaaccaaucagauauaua

SEQ ID NO: 945735 - RNA, 19 nt, Homo sapiens
cagcaaccaaucagauaua

SEQ ID NO: 945736 - RNA, 19 nt, Homo sapiens
aaagacugauugaaggaaa

SEQ ID NO: 945737 - RNA, 19 nt, Homo sapiens
gaccagagccuacgguuac

SEQ ID NO: 945738 - RNA, 19 nt, Homo sapiens
ccaaagcuauggacaacgu

SEQ ID NO: 945739 - RNA, 19 nt, Homo sapiens
ccauagagacgaacagaau

SEQ ID NO: 945740 - RNA, 19 nt, Homo sapiens
aaaauugccuugcagauau

SEQ ID NO: 945741 - RNA, 19 nt, Homo sapiens
agagauuucuucagauauc

SEQ ID NO: 945742 - RNA, 19 nt, Homo sapiens
gcaucgagauccagaacgu

SEQ ID NO: 945743 - RNA, 19 nt, Homo sapiens
gcaacacccaaacgcagua

SEQ ID NO: 945744 - RNA, 19 nt, Homo sapiens
agacgaauacuuggaaauu

SEQ ID NO: 945745 - RNA, 19 nt, Homo sapiens
guugugaaacgugaaauaa

SEQ ID NO: 945746 - RNA, 19 nt, Homo sapiens
ccaccucauugugcaagua

SEQ ID NO: 945747 - RNA, 19 nt, Homo sapiens
ggaguuuucuuuucccaaa

SEQ ID NO: 945748 - RNA, 19 nt, Homo sapiens
uuguagagauuucuucaga

SEQ ID NO: 945749 - RNA, 19 nt, Homo sapiens
aaauugccuugcagauauu

SEQ ID NO: 945750 - RNA, 19 nt, Homo sapiens
ugaagacgaauacuuggaa

SEQ ID NO: 945751 - RNA, 19 nt, Homo sapiens
gcagcaccauccucuaugc

SEQ ID NO: 945752 - RNA, 19 nt, Homo sapiens
ccuugcagauauuuaggua

SEQ ID NO: 945753 - RNA, 19 nt, Homo sapiens
ccucaugggacagaaauuu

SEQ ID NO: 945754 - RNA, 19 nt, Homo sapiens
cgacagcaaccaaucagau

SEQ ID NO: 945755 - RNA, 19 nt, Homo sapiens
ggagcuggccaucccaaau

SEQ ID NO: 945756 - RNA, 19 nt, Homo sapiens
acagaccuuuccucucaaa

SEQ ID NO: 945757 - RNA, 19 nt, Homo sapiens
agacagacaaccacccaaa

SEQ ID NO: 945758 - RNA, 19 nt, Homo sapiens
acccucaggugcacuauug

SEQ ID NO: 945759 - RNA, 19 nt, Homo sapiens
caacaccgacagcaaccaa

SEQ ID NO: 945760 - RNA, 19 nt, Homo sapiens
caucccaaauucaaucagu

SEQ ID NO: 945761 - RNA, 19 nt, Homo sapiens
uugcagauauuuagguaca

SEQ ID NO: 945762 - RNA, 19 nt, Homo sapiens
cgagugcagugccuccaau

SEQ ID NO: 945763 - RNA, 19 nt, Homo sapiens
acagacaaccacccaaaga

SEQ ID NO: 945764 - RNA, 19 nt, Homo sapiens
ccagaacguggauguguau

SEQ ID NO: 945765 - RNA, 19 nt, Homo sapiens
acacuugcguggccuccaa

SEQ ID NO: 945766 - RNA, 19 nt, Homo sapiens
ucucaaaacucaucuucuu

SEQ ID NO: 945767 - RNA, 19 nt, Homo sapiens
gaaagaaaggggugaaagu

SEQ ID NO: 945768 - RNA, 19 nt, Homo sapiens
gugcaaguaucucccaaaa

SEQ ID NO: 945769 - RNA, 19 nt, Homo sapiens
guacaauggaguuuucuuu

SEQ ID NO: 945770 - RNA, 19 nt, Homo sapiens
agaccagagccuacgguua

SEQ ID NO: 945771 - RNA, 19 nt, Homo sapiens
cagauaucuccauuaauga

SEQ ID NO: 945772 - RNA, 19 nt, Homo sapiens
cgugaacuauccaccauac

SEQ ID NO: 945773 - RNA, 19 nt, Homo sapiens
ugagugaagacgaauacuu

SEQ ID NO: 945774 - RNA, 19 nt, Homo sapiens
ucaugggacagaaauuuga

SEQ ID NO: 945775 - RNA, 19 nt, Homo sapiens
gcagaauuccagugguaca

SEQ ID NO: 945776 - RNA, 19 nt, Homo sapiens
ugaacuauccaccauacau

SEQ ID NO: 945777 - RNA, 19 nt, Homo sapiens
cauccucuaugcugggaau

SEQ ID NO: 945778 - RNA, 19 nt, Homo sapiens
ucaggcugcuguuccuugu

SEQ ID NO: 945779 - RNA, 19 nt, Homo sapiens
uucaaucaguccauagaga

SEQ ID NO: 945780 - RNA, 19 nt, Homo sapiens
gauauuuagguacaaugga

SEQ ID NO: 945781 - RNA, 19 nt, Homo sapiens
ccgcagcaccauccucuau

SEQ ID NO: 945782 - RNA, 19 nt, Homo sapiens
gacaaaagacugauugaag

SEQ ID NO: 945783 - RNA, 19 nt, Homo sapiens
gagccuacgguuacuugga

SEQ ID NO: 945784 - RNA, 19 nt, Homo sapiens
auagagacgaacagaauga

SEQ ID NO: 945785 - RNA, 19 nt, Homo sapiens
ugcaccugcuucucaaauu

SEQ ID NO: 945786 - RNA, 19 nt, Homo sapiens
ucucugaacaugacuaugg

SEQ ID NO: 945787 - RNA, 19 nt, Homo sapiens
gcaguacagcaucgagauc

SEQ ID NO: 945788 - RNA, 19 nt, Homo sapiens
cauagagacgaacagaaug

SEQ ID NO: 945789 - RNA, 19 nt, Homo sapiens
aguuguggcugucgagaau

SEQ ID NO: 945790 - RNA, 19 nt, Homo sapiens
gcgugguccuucugagcaa

SEQ ID NO: 945791 - RNA, 19 nt, Homo sapiens
caaaacucaucuucuucaa

SEQ ID NO: 945792 - RNA, 19 nt, Homo sapiens
caggugcacuauugacaac

SEQ ID NO: 945793 - RNA, 19 nt, Homo sapiens
acaauggaguuuucuuuuc

SEQ ID NO: 945794 - RNA, 19 nt, Homo sapiens
gggaggggaacaaagaaua

SEQ ID NO: 945795 - RNA, 19 nt, Homo sapiens
cagagccuacgguuacuug

SEQ ID NO: 945796 - RNA, 19 nt, Homo sapiens
cugcauagcaacugguaga

SEQ ID NO: 945797 - RNA, 19 nt, Homo sapiens
gauaucuccauuaaugaag

SEQ ID NO: 945798 - RNA, 19 nt, Homo sapiens
uguagagauuucuucagau

SEQ ID NO: 945799 - RNA, 19 nt, Homo sapiens
gcucggugcagacagacaa

SEQ ID NO: 945800 - RNA, 19 nt, Homo sapiens
cuucugagcaacacccaaa

SEQ ID NO: 945801 - RNA, 19 nt, Homo sapiens
caagcugggccacaccaau

SEQ ID NO: 945802 - RNA, 19 nt, Homo sapiens
ggacagugcuucccaaguu

SEQ ID NO: 945803 - RNA, 19 nt, Homo sapiens
ggaagaaguugccuaugaa

SEQ ID NO: 945804 - RNA, 19 nt, Homo sapiens
gaaguugccuaugaagaaa

SEQ ID NO: 945805 - RNA, 19 nt, Homo sapiens
caaggaagcagacuacgua

SEQ ID NO: 945806 - RNA, 19 nt, Homo sapiens
caguagaagugacagauaa

SEQ ID NO: 945807 - RNA, 19 nt, Homo sapiens
gaaauaauacagccaagau

SEQ ID NO: 945808 - RNA, 19 nt, Homo sapiens
cagauaagccuguggauga

SEQ ID NO: 945809 - RNA, 19 nt, Homo sapiens
uaaccaacuuuccuucaaa

SEQ ID NO: 945810 - RNA, 19 nt, Homo sapiens
gacagucccuauuuccuuu

SEQ ID NO: 945811 - RNA, 19 nt, Homo sapiens
ccacugaaccaagaacuua

SEQ ID NO: 945812 - RNA, 19 nt, Homo sapiens
aggaagaaguugccuauga

SEQ ID NO: 945813 - RNA, 19 nt, Homo sapiens
gcagcauccuucucauuga

SEQ ID NO: 945814 - RNA, 19 nt, Homo sapiens
gaagaaagggccugugaag

SEQ ID NO: 945815 - RNA, 19 nt, Homo sapiens
caaauuugccacaguagaa

SEQ ID NO: 945816 - RNA, 19 nt, Homo sapiens
gggaaggcaucacugucua

SEQ ID NO: 945817 - RNA, 19 nt, Homo sapiens
ggaugacagucccuauuuc

SEQ ID NO: 945818 - RNA, 19 nt, Homo sapiens
ggaagcagacuacguagca

SEQ ID NO: 945819 - RNA, 19 nt, Homo sapiens
caaggaagaaguugccuau

SEQ ID NO: 945820 - RNA, 19 nt, Homo sapiens
ggaaauaauacagccaaga

SEQ ID NO: 945821 - RNA, 19 nt, Homo sapiens
gaagugugccucugugucu

SEQ ID NO: 945822 - RNA, 19 nt, Homo sapiens
gacaaaagcguuaagauug

SEQ ID NO: 945823 - RNA, 19 nt, Homo sapiens
gggaagcaaugcccaaggu

SEQ ID NO: 945824 - RNA, 19 nt, Homo sapiens
agaaguugccuaugaagaa

SEQ ID NO: 945825 - RNA, 19 nt, Homo sapiens
guuaugacccucccaugaa

SEQ ID NO: 945826 - RNA, 19 nt, Homo sapiens
ugcccaaggucgcaaagua

SEQ ID NO: 945827 - RNA, 19 nt, Homo sapiens
ugccugaucuuucaucugu

SEQ ID NO: 945828 - RNA, 19 nt, Homo sapiens
ccaugcaguuuggugguua

SEQ ID NO: 945829 - RNA, 19 nt, Homo sapiens
gaaggcaucacugucuauu

SEQ ID NO: 945830 - RNA, 19 nt, Homo sapiens
caucugugauucuuauaag

SEQ ID NO: 945831 - RNA, 19 nt, Homo sapiens
gaucuuucaucugugauuc

SEQ ID NO: 945832 - RNA, 19 nt, Homo sapiens
uuaaccaacuuuccuucaa

SEQ ID NO: 945833 - RNA, 19 nt, Homo sapiens
ccugaucuuucaucuguga

SEQ ID NO: 945834 - RNA, 19 nt, Homo sapiens
gguuaugacccucccauga

SEQ ID NO: 945835 - RNA, 19 nt, Homo sapiens
gacagugcuucccaaguuc

SEQ ID NO: 945836 - RNA, 19 nt, Homo sapiens
gcucucugcagaagaaauu

SEQ ID NO: 945837 - RNA, 19 nt, Homo sapiens
cagcauccuucucauugau

SEQ ID NO: 945838 - RNA, 19 nt, Homo sapiens
acaaaagcguuaagauuga

SEQ ID NO: 945839 - RNA, 19 nt, Homo sapiens
ggaaggcaucacugucuau

SEQ ID NO: 945840 - RNA, 19 nt, Homo sapiens
gaagaaguugccuaugaag

SEQ ID NO: 945841 - RNA, 19 nt, Homo sapiens
cauguuccauauacuaagu

SEQ ID NO: 945842 - RNA, 19 nt, Homo sapiens
ugacaaaagcguuaagauu

SEQ ID NO: 945843 - RNA, 19 nt, Homo sapiens
ugacagucccuauuuccuu

SEQ ID NO: 945844 - RNA, 19 nt, Homo sapiens
gcaccaaugacaagggaau

SEQ ID NO: 945845 - RNA, 19 nt, Homo sapiens
cgucucggcuacaacaugu

SEQ ID NO: 945846 - RNA, 19 nt, Homo sapiens
aagcauguuccauauacua

SEQ ID NO: 945847 - RNA, 19 nt, Homo sapiens
gcccaaggucgcaaaguau

SEQ ID NO: 945848 - RNA, 19 nt, Homo sapiens
ccauauacuaagucucuuu

SEQ ID NO: 945849 - RNA, 19 nt, Homo sapiens
gggagcgucucggcuacaa

SEQ ID NO: 945850 - RNA, 19 nt, Homo sapiens
gugacccacugaaccaaga

SEQ ID NO: 945851 - RNA, 19 nt, Homo sapiens
gagcgucucggcuacaaca

SEQ ID NO: 945852 - RNA, 19 nt, Homo sapiens
acaguagaagugacagaua

SEQ ID NO: 945853 - RNA, 19 nt, Homo sapiens
aaagucugguuccggauuc

SEQ ID NO: 945854 - RNA, 19 nt, Homo sapiens
ugugaaggcggcaaauuug

SEQ ID NO: 945855 - RNA, 19 nt, Homo sapiens
caacuuaaccaacuuuccu

SEQ ID NO: 945856 - RNA, 19 nt, Homo sapiens
gcaucacugucuauuccau

SEQ ID NO: 945857 - RNA, 19 nt, Homo sapiens
gcaaaggggacaaggaaga

SEQ ID NO: 945858 - RNA, 19 nt, Homo sapiens
gauuugugccugaucuuuc

SEQ ID NO: 945859 - RNA, 19 nt, Homo sapiens
cugugaaggcggcaaauuu

SEQ ID NO: 945860 - RNA, 19 nt, Homo sapiens
agagcuuugucuucagaaa

SEQ ID NO: 945861 - RNA, 19 nt, Homo sapiens
aaaagcauguuccauauac

SEQ ID NO: 945862 - RNA, 19 nt, Homo sapiens
ugaagaaagggccugugaa

SEQ ID NO: 945863 - RNA, 19 nt, Homo sapiens
ucuauuccaugcaguuugg

SEQ ID NO: 945864 - RNA, 19 nt, Homo sapiens
ccuauuuccuuugcugugu

SEQ ID NO: 945865 - RNA, 19 nt, Homo sapiens
uguugggcaugaucaagaa

SEQ ID NO: 945866 - RNA, 19 nt, Homo sapiens
auaauacagccaagauaug

SEQ ID NO: 945867 - RNA, 19 nt, Homo sapiens
uuaugacccucccaugaag

SEQ ID NO: 945868 - RNA, 19 nt, Homo sapiens
ccggauuccaaaccaauuu

SEQ ID NO: 945869 - RNA, 19 nt, Homo sapiens
ugcagcauccuucucauug

SEQ ID NO: 945870 - RNA, 19 nt, Homo sapiens
uaauacagccaagauaugc

SEQ ID NO: 945871 - RNA, 19 nt, Homo sapiens
gaaagugaauuuagcaaug

SEQ ID NO: 945872 - RNA, 19 nt, Homo sapiens
gaacaugcuuccauuucua

SEQ ID NO: 945873 - RNA, 19 nt, Homo sapiens
aaacaagucuggagaugua

SEQ ID NO: 945874 - RNA, 19 nt, Homo sapiens
aaacagagaucaacauugu

SEQ ID NO: 945875 - RNA, 19 nt, Homo sapiens
caagagggauguuguagaa

SEQ ID NO: 945876 - RNA, 19 nt, Homo sapiens
uaagagagaugguucagaa

SEQ ID NO: 945877 - RNA, 19 nt, Homo sapiens
cagaagcagugacauguua

SEQ ID NO: 945878 - RNA, 19 nt, Homo sapiens
ugacagccauggauugaua

SEQ ID NO: 945879 - RNA, 19 nt, Homo sapiens
caacagauagugacaauga

SEQ ID NO: 945880 - RNA, 19 nt, Homo sapiens
gcagugacauguuauaucu

SEQ ID NO: 945881 - RNA, 19 nt, Homo sapiens
ggugcaagcucucuccaua

SEQ ID NO: 945882 - RNA, 19 nt, Homo sapiens
ggagacagcugugcccauu

SEQ ID NO: 945883 - RNA, 19 nt, Homo sapiens
ggacguacauuccaucaag

SEQ ID NO: 945884 - RNA, 19 nt, Homo sapiens
ggaaucagcaccagagaaa

SEQ ID NO: 945885 - RNA, 19 nt, Homo sapiens
gaaacuugguggaccugua

SEQ ID NO: 945886 - RNA, 19 nt, Homo sapiens
gacaagggaucauacaaau

SEQ ID NO: 945887 - RNA, 19 nt, Homo sapiens
ggacaagggaucauacaaa

SEQ ID NO: 945888 - RNA, 19 nt, Homo sapiens
ccagaaaccuccuaugaca

SEQ ID NO: 945889 - RNA, 19 nt, Homo sapiens
ggaagcaacuggagaaggu

SEQ ID NO: 945890 - RNA, 19 nt, Homo sapiens
gauaaugggauuggauuua

SEQ ID NO: 945891 - RNA, 19 nt, Homo sapiens
ggaaaccuggaacauauua

SEQ ID NO: 945892 - RNA, 19 nt, Homo sapiens
gcccaucaaugcuuacuuu

SEQ ID NO: 945893 - RNA, 19 nt, Homo sapiens
caagucagauaaauggaaa

SEQ ID NO: 945894 - RNA, 19 nt, Homo sapiens
ucaaagcaguggcacauga

SEQ ID NO: 945895 - RNA, 19 nt, Homo sapiens
ggaaacaagucuggagaug

SEQ ID NO: 945896 - RNA, 19 nt, Homo sapiens
gaaaccuccuaugacauua

SEQ ID NO: 945897 - RNA, 19 nt, Homo sapiens
caauaacacucccauucaa

SEQ ID NO: 945898 - RNA, 19 nt, Homo sapiens
ggaagaaucgccagcagaa

SEQ ID NO: 945899 - RNA, 19 nt, Homo sapiens
agacaucccuccuuccaaa

SEQ ID NO: 945900 - RNA, 19 nt, Homo sapiens
ggcauuagcuguucuuucu

SEQ ID NO: 945901 - RNA, 19 nt, Homo sapiens
gaccuuaauucaaaucaga

SEQ ID NO: 945902 - RNA, 19 nt, Homo sapiens
uguguuaacugccgaaauu

SEQ ID NO: 945903 - RNA, 19 nt, Homo sapiens
ggaaguucguaguuuagaa

SEQ ID NO: 945904 - RNA, 19 nt, Homo sapiens
ucauugccaucaaccauua

SEQ ID NO: 945905 - RNA, 19 nt, Homo sapiens
caucaaugcuuacuuugug

SEQ ID NO: 945906 - RNA, 19 nt, Homo sapiens
ccacaaagcauguuauuac

SEQ ID NO: 945907 - RNA, 19 nt, Homo sapiens
gauggaaaccuggaacaua

SEQ ID NO: 945908 - RNA, 19 nt, Homo sapiens
ggagccaucuagucuuuau

SEQ ID NO: 945909 - RNA, 19 nt, Homo sapiens
gcaaugugccuguggaaga

SEQ ID NO: 945910 - RNA, 19 nt, Homo sapiens
caagcucucuccauauuca

SEQ ID NO: 945911 - RNA, 19 nt, Homo sapiens
caagggaucauacaaaugu

SEQ ID NO: 945912 - RNA, 19 nt, Homo sapiens
aagcugaggugcgcuauaa

SEQ ID NO: 945913 - RNA, 19 nt, Homo sapiens
ucucucaacuccucucuuu

SEQ ID NO: 945914 - RNA, 19 nt, Homo sapiens
agaagcaucucucaugguu

SEQ ID NO: 945915 - RNA, 19 nt, Homo sapiens
cugcgaagcugcaaaugaa

SEQ ID NO: 945916 - RNA, 19 nt, Homo sapiens
gcagacggagacuuuguua

SEQ ID NO: 945917 - RNA, 19 nt, Homo sapiens
ggacacacguggauuuuga

SEQ ID NO: 945918 - RNA, 19 nt, Homo sapiens
gaauuuagcaaugugauga

SEQ ID NO: 945919 - RNA, 19 nt, Homo sapiens
caucuagucuuuaugaagu

SEQ ID NO: 945920 - RNA, 19 nt, Homo sapiens
cuaaaggacuacaggauca

SEQ ID NO: 945921 - RNA, 19 nt, Homo sapiens
ggauaucucuaccaaggau

SEQ ID NO: 945922 - RNA, 19 nt, Homo sapiens
gaagcagugacauguuaua

SEQ ID NO: 945923 - RNA, 19 nt, Homo sapiens
auacaaaugugcagcuuau

SEQ ID NO: 945924 - RNA, 19 nt, Homo sapiens
gaaacagagaucaacauug

SEQ ID NO: 945925 - RNA, 19 nt, Homo sapiens
gggcacagcaacucucuaa

SEQ ID NO: 945926 - RNA, 19 nt, Homo sapiens
gugaugaucugcgagacua

SEQ ID NO: 945927 - RNA, 19 nt, Homo sapiens
ggagugguacuuacagauu

SEQ ID NO: 945928 - RNA, 19 nt, Homo sapiens
gcacucuacuggaagacuu

SEQ ID NO: 945929 - RNA, 19 nt, Homo sapiens
gagcaagucagauaaaugg

SEQ ID NO: 945930 - RNA, 19 nt, Homo sapiens
uaccaaggaucagauauga

SEQ ID NO: 945931 - RNA, 19 nt, Homo sapiens
aagaaucgccagcagaaua

SEQ ID NO: 945932 - RNA, 19 nt, Homo sapiens
gguggcagcugaagacauc

SEQ ID NO: 945933 - RNA, 19 nt, Homo sapiens
ugacaauucuuucucucaa

SEQ ID NO: 945934 - RNA, 19 nt, Homo sapiens
gcagagacagucacacuuc

SEQ ID NO: 945935 - RNA, 19 nt, Homo sapiens
cuggaagacuugaaauuga

SEQ ID NO: 945936 - RNA, 19 nt, Homo sapiens
ggaagauguugggauguau

SEQ ID NO: 945937 - RNA, 19 nt, Homo sapiens
acaaaugugcagcuuauaa

SEQ ID NO: 945938 - RNA, 19 nt, Homo sapiens
gcaggguaccggagaguaa

SEQ ID NO: 945939 - RNA, 19 nt, Homo sapiens
gcaagucagauaaauggaa

SEQ ID NO: 945940 - RNA, 19 nt, Homo sapiens
caaugugccuguggaagaa

SEQ ID NO: 945941 - RNA, 19 nt, Homo sapiens
cugaauauccugucaaaga

SEQ ID NO: 945942 - RNA, 19 nt, Homo sapiens
ggaggagaaagugaauuua

SEQ ID NO: 945943 - RNA, 19 nt, Homo sapiens
auacucagaucaugcuaaa

SEQ ID NO: 945944 - RNA, 19 nt, Homo sapiens
aguggaaguucguaguuua

SEQ ID NO: 945945 - RNA, 19 nt, Homo sapiens
uccaaucacugccuucaaa

SEQ ID NO: 945946 - RNA, 19 nt, Homo sapiens
acagagaucaacauuguaa

SEQ ID NO: 945947 - RNA, 19 nt, Homo sapiens
caggaugguuuggaaauga

SEQ ID NO: 945948 - RNA, 19 nt, Homo sapiens
gaacauccucaucaucuag

SEQ ID NO: 945949 - RNA, 19 nt, Homo sapiens
ccaaugcagucaauggaau

SEQ ID NO: 945950 - RNA, 19 nt, Homo sapiens
ggacuacaccacucucuca

SEQ ID NO: 945951 - RNA, 19 nt, Homo sapiens
ccuucaaagucgaauauaa

SEQ ID NO: 945952 - RNA, 19 nt, Homo sapiens
uggaagacuugaaauugaa

SEQ ID NO: 945953 - RNA, 19 nt, Homo sapiens
ccagucauguuccaacuuc

SEQ ID NO: 945954 - RNA, 19 nt, Homo sapiens
gaauggugguggaauguac

SEQ ID NO: 945955 - RNA, 19 nt, Homo sapiens
ggacuuggcaccuuauuuu

SEQ ID NO: 945956 - RNA, 19 nt, Homo sapiens
gagagaugguucagaaacu

SEQ ID NO: 945957 - RNA, 19 nt, Homo sapiens
ugcaagcucucuccauauu

SEQ ID NO: 945958 - RNA, 19 nt, Homo sapiens
uggaagauguugggaugua

SEQ ID NO: 945959 - RNA, 19 nt, Homo sapiens
ggagauguagaauauguga

SEQ ID NO: 945960 - RNA, 19 nt, Homo sapiens
gucuggagauguagaauau

SEQ ID NO: 945961 - RNA, 19 nt, Homo sapiens
caaaugugcagcuuauaau

SEQ ID NO: 945962 - RNA, 19 nt, Homo sapiens
cgugugcccuuuuauauua

SEQ ID NO: 945963 - RNA, 19 nt, Homo sapiens
ugaacauccucaucaucua

SEQ ID NO: 945964 - RNA, 19 nt, Homo sapiens
ccucaaguguauuggcuaa

SEQ ID NO: 945965 - RNA, 19 nt, Homo sapiens
agacagcugugcccauuca

SEQ ID NO: 945966 - RNA, 19 nt, Homo sapiens
cagaagauccagcagaguu

SEQ ID NO: 945967 - RNA, 19 nt, Homo sapiens
gaggagaaagugaauuuag

SEQ ID NO: 945968 - RNA, 19 nt, Homo sapiens
uagcaucggugccauugug

SEQ ID NO: 945969 - RNA, 19 nt, Homo sapiens
ggauucaagccaguuauaa

SEQ ID NO: 945970 - RNA, 19 nt, Homo sapiens
gaaacaagucuggagaugu

SEQ ID NO: 945971 - RNA, 19 nt, Homo sapiens
gaacuuggcuauugauaaa

SEQ ID NO: 945972 - RNA, 19 nt, Homo sapiens
ggagaugacuugaguuaua

SEQ ID NO: 945973 - RNA, 19 nt, Homo sapiens
ggagauuacuuguuacuua

SEQ ID NO: 945974 - RNA, 19 nt, Homo sapiens
gcacaaaccuacuuaucua

SEQ ID NO: 945975 - RNA, 19 nt, Homo sapiens
cauagaagcuuaaucauga

SEQ ID NO: 945976 - RNA, 19 nt, Homo sapiens
gaacauagaagcuuaauca

SEQ ID NO: 945977 - RNA, 19 nt, Homo sapiens
gcagugagcuuuccagaga

SEQ ID NO: 945978 - RNA, 19 nt, Homo sapiens
gaaagacagugguuaauca

SEQ ID NO: 945979 - RNA, 19 nt, Homo sapiens
ccacagagaugguuagugu

SEQ ID NO: 945980 - RNA, 19 nt, Homo sapiens
gcuagaggaugaaguaauu

SEQ ID NO: 945981 - RNA, 19 nt, Homo sapiens
gcggagaucuauucuguuu

SEQ ID NO: 945982 - RNA, 19 nt, Homo sapiens
gauggaaagugugacauua

SEQ ID NO: 945983 - RNA, 19 nt, Homo sapiens
ggaaaggacuucuggaucu

SEQ ID NO: 945984 - RNA, 19 nt, Homo sapiens
agauggagauuacuuguua

SEQ ID NO: 945985 - RNA, 19 nt, Homo sapiens
gauaaauacucucuugaug

SEQ ID NO: 945986 - RNA, 19 nt, Homo sapiens
gaagauggauuagccaaug

SEQ ID NO: 945987 - RNA, 19 nt, Homo sapiens
gaucuauucuguuuccuaa

SEQ ID NO: 945988 - RNA, 19 nt, Homo sapiens
gaaacugacuuaugcaaag

SEQ ID NO: 945989 - RNA, 19 nt, Homo sapiens
gaagaaaucagacagaugu

SEQ ID NO: 945990 - RNA, 19 nt, Homo sapiens
caaagucaaagaccaauua

SEQ ID NO: 945991 - RNA, 19 nt, Homo sapiens
caagagagaaugagaguuu

SEQ ID NO: 945992 - RNA, 19 nt, Homo sapiens
gaggauauggaacaaauua

SEQ ID NO: 945993 - RNA, 19 nt, Homo sapiens
ggaaauucguguacuugaa

SEQ ID NO: 945994 - RNA, 19 nt, Homo sapiens
gggaagaacuacaggauuc

SEQ ID NO: 945995 - RNA, 19 nt, Homo sapiens
caaagcaccucuuauacug

SEQ ID NO: 945996 - RNA, 19 nt, Homo sapiens
gugaacagauugcagaauu

SEQ ID NO: 945997 - RNA, 19 nt, Homo sapiens
gcagaugcuucccuggaua

SEQ ID NO: 945998 - RNA, 19 nt, Homo sapiens
uaaauacucucuugaugug

SEQ ID NO: 945999 - RNA, 19 nt, Homo sapiens
gaggagaugacuugaguua

SEQ ID NO: 946000 - RNA, 19 nt, Homo sapiens
ucaccaaacugaagaucua

SEQ ID NO: 946001 - RNA, 19 nt, Homo sapiens
gaagauuucucuggguauu

SEQ ID NO: 946002 - RNA, 19 nt, Homo sapiens
ggauuuggacacucaauua

SEQ ID NO: 946003 - RNA, 19 nt, Homo sapiens
ccacagaccaaauuaguaa

SEQ ID NO: 946004 - RNA, 19 nt, Homo sapiens
gaaggagacuuuccaucau

SEQ ID NO: 946005 - RNA, 19 nt, Homo sapiens
cgucaucuauucuggauaa

SEQ ID NO: 946006 - RNA, 19 nt, Homo sapiens
ugaagaaacugacuuaugc

SEQ ID NO: 946007 - RNA, 19 nt, Homo sapiens
gacagccucucaucuauug

SEQ ID NO: 946008 - RNA, 19 nt, Homo sapiens
ugacagauccacacacuuu

SEQ ID NO: 946009 - RNA, 19 nt, Homo sapiens
caccauaucugaccucuuc

SEQ ID NO: 946010 - RNA, 19 nt, Homo sapiens
gaagcuuaaucaugaagaa

SEQ ID NO: 946011 - RNA, 19 nt, Homo sapiens
gagcagagaagaaaucaga

SEQ ID NO: 946012 - RNA, 19 nt, Homo sapiens
gaagaacggcccugucaga

SEQ ID NO: 946013 - RNA, 19 nt, Homo sapiens
ccaauucugucccuccuaa

SEQ ID NO: 946014 - RNA, 19 nt, Homo sapiens
cgaaugaaguuugccaauu

SEQ ID NO: 946015 - RNA, 19 nt, Homo sapiens
ggagugagacuucaucaga

SEQ ID NO: 946016 - RNA, 19 nt, Homo sapiens
gcaacgccgucaucuauuc

SEQ ID NO: 946017 - RNA, 19 nt, Homo sapiens
guugaugauugcucaguua

SEQ ID NO: 946018 - RNA, 19 nt, Homo sapiens
guaagcagcucugaacugu

SEQ ID NO: 946019 - RNA, 19 nt, Homo sapiens
gagagaguuuggacaagaa

SEQ ID NO: 946020 - RNA, 19 nt, Homo sapiens
gggaggauauggaacaaau

SEQ ID NO: 946021 - RNA, 19 nt, Homo sapiens
cagcugagauugaagacaa

SEQ ID NO: 946022 - RNA, 19 nt, Homo sapiens
uaucugaccucuucuauac

SEQ ID NO: 946023 - RNA, 19 nt, Homo sapiens
guuagcagcuugacucuuc

SEQ ID NO: 946024 - RNA, 19 nt, Homo sapiens
gaugauaaacccacuguug

SEQ ID NO: 946025 - RNA, 19 nt, Homo sapiens
caaggaaauucguguacuu

SEQ ID NO: 946026 - RNA, 19 nt, Homo sapiens
gagaagaaaucagacagau

SEQ ID NO: 946027 - RNA, 19 nt, Homo sapiens
uaccaaagcaccucuuaua

SEQ ID NO: 946028 - RNA, 19 nt, Homo sapiens
ucaguaacuucagagauua

SEQ ID NO: 946029 - RNA, 19 nt, Homo sapiens
gauguuuacuaugcaguua

SEQ ID NO: 946030 - RNA, 19 nt, Homo sapiens
gaggauggagucacaagua

SEQ ID NO: 946031 - RNA, 19 nt, Homo sapiens
uggcguagauguuuacuau

SEQ ID NO: 946032 - RNA, 19 nt, Homo sapiens
gaaaucagacagauguaug

SEQ ID NO: 946033 - RNA, 19 nt, Homo sapiens
gacacagucuaccaaauug

SEQ ID NO: 946034 - RNA, 19 nt, Homo sapiens
cuuaacaucuucaccauau

SEQ ID NO: 946035 - RNA, 19 nt, Homo sapiens
caucaggacucuucaagca

SEQ ID NO: 946036 - RNA, 19 nt, Homo sapiens
ggaacaaauuacugaguca

SEQ ID NO: 946037 - RNA, 19 nt, Homo sapiens
ccagaugcauccauggaaa

SEQ ID NO: 946038 - RNA, 19 nt, Homo sapiens
gcagagaaacugaaagaca

SEQ ID NO: 946039 - RNA, 19 nt, Homo sapiens
gcaaguuucaggccuguaa

SEQ ID NO: 946040 - RNA, 19 nt, Homo sapiens
ugacacagucuaccaaauu

SEQ ID NO: 946041 - RNA, 19 nt, Homo sapiens
agaaguaccugguguugau

SEQ ID NO: 946042 - RNA, 19 nt, Homo sapiens
gaucucacuugguagaaga

SEQ ID NO: 946043 - RNA, 19 nt, Homo sapiens
agacauugcagcagaauuu

SEQ ID NO: 946044 - RNA, 19 nt, Homo sapiens
guggaaaugucaacaagug

SEQ ID NO: 946045 - RNA, 19 nt, Homo sapiens
gaagaugaugauucacuuu

SEQ ID NO: 946046 - RNA, 19 nt, Homo sapiens
gcaccuugaagaagaauuu

SEQ ID NO: 946047 - RNA, 19 nt, Homo sapiens
uggcaaaucaugugaagua

SEQ ID NO: 946048 - RNA, 19 nt, Homo sapiens
agacagugguuaaucagaa

SEQ ID NO: 946049 - RNA, 19 nt, Homo sapiens
caaaccuacuuaucuauag

SEQ ID NO: 946050 - RNA, 19 nt, Homo sapiens
gugaggaauuugugucuga

SEQ ID NO: 946051 - RNA, 19 nt, Homo sapiens
caagcacugugaggaauuu

SEQ ID NO: 946052 - RNA, 19 nt, Homo sapiens
guaguuauguggaaauguc

SEQ ID NO: 946053 - RNA, 19 nt, Homo sapiens
ggaacuguaugccaaugau

SEQ ID NO: 946054 - RNA, 19 nt, Homo sapiens
cugaagaucuaguuuggaa

SEQ ID NO: 946055 - RNA, 19 nt, Homo sapiens
gcuaucaucuacuucuuca

SEQ ID NO: 946056 - RNA, 19 nt, Homo sapiens
agagacauauuggcaagua

SEQ ID NO: 946057 - RNA, 19 nt, Homo sapiens
agccagauaugcaaacuuu

SEQ ID NO: 946058 - RNA, 19 nt, Homo sapiens
ucaaggauuuggacacuca

SEQ ID NO: 946059 - RNA, 19 nt, Homo sapiens
ucagagagcagcuuggaaa

SEQ ID NO: 946060 - RNA, 19 nt, Homo sapiens
gaugacagauccacacacu

SEQ ID NO: 946061 - RNA, 19 nt, Homo sapiens
gaacagauugcagaauuca

SEQ ID NO: 946062 - RNA, 19 nt, Homo sapiens
gauggagucacaaguauau

SEQ ID NO: 946063 - RNA, 19 nt, Homo sapiens
gcaaaucaugugaaguauu

SEQ ID NO: 946064 - RNA, 19 nt, Homo sapiens
gagaugacuugaguuauac

SEQ ID NO: 946065 - RNA, 19 nt, Homo sapiens
gaagaucuaguuuggaaca

SEQ ID NO: 946066 - RNA, 19 nt, Homo sapiens
ggugaggccaucagcaaua

SEQ ID NO: 946067 - RNA, 19 nt, Homo sapiens
gagaguauuagcaaugaaa

SEQ ID NO: 946068 - RNA, 19 nt, Homo sapiens
gugaaucuguggaacauag

SEQ ID NO: 946069 - RNA, 19 nt, Homo sapiens
agaaugcugugaaguacaa

SEQ ID NO: 946070 - RNA, 19 nt, Homo sapiens
ccaugaacuuggcuauuga

SEQ ID NO: 946071 - RNA, 19 nt, Homo sapiens
gcagagccauggagaauaa

SEQ ID NO: 946072 - RNA, 19 nt, Homo sapiens
ucaaagauaucuccaauga

SEQ ID NO: 946073 - RNA, 19 nt, Homo sapiens
gcacagagaacucaaauga

SEQ ID NO: 946074 - RNA, 19 nt, Homo sapiens
gaacgcauauucuauagga

SEQ ID NO: 946075 - RNA, 19 nt, Homo sapiens
ggaauggauugauagauuu

SEQ ID NO: 946076 - RNA, 19 nt, Homo sapiens
caacuggaguggauugaua

SEQ ID NO: 946077 - RNA, 19 nt, Homo sapiens
gaauagcaaccaccaaaua

SEQ ID NO: 946078 - RNA, 19 nt, Homo sapiens
gaacaggaccuacgaugaa

SEQ ID NO: 946079 - RNA, 19 nt, Homo sapiens
cagaaggaauggauugaua

SEQ ID NO: 946080 - RNA, 19 nt, Homo sapiens
ccaagaauccuaauuugua

SEQ ID NO: 946081 - RNA, 19 nt, Homo sapiens
gaagccagguuuacaauag

SEQ ID NO: 946082 - RNA, 19 nt, Homo sapiens
uggaguggcucaaguguua

SEQ ID NO: 946083 - RNA, 19 nt, Homo sapiens
gagugaaucugccucagua

SEQ ID NO: 946084 - RNA, 19 nt, Homo sapiens
caacaggccuuccagugaa

SEQ ID NO: 946085 - RNA, 19 nt, Homo sapiens
gaaacaaugcuucaaaugu

SEQ ID NO: 946086 - RNA, 19 nt, Homo sapiens
cauuagcgcugcuucauuu

SEQ ID NO: 946087 - RNA, 19 nt, Homo sapiens
guaaccaacuuaaagcaaa

SEQ ID NO: 946088 - RNA, 19 nt, Homo sapiens
gauggauccuuuagaauug

SEQ ID NO: 946089 - RNA, 19 nt, Homo sapiens
gaacugaauucuuugaacu

SEQ ID NO: 946090 - RNA, 19 nt, Homo sapiens
gcugaccgcugcucucuuu

SEQ ID NO: 946091 - RNA, 19 nt, Homo sapiens
gaacacgcaugggcugaaa

SEQ ID NO: 946092 - RNA, 19 nt, Homo sapiens
agaaagaccuaacaucuca

SEQ ID NO: 946093 - RNA, 19 nt, Homo sapiens
aaacagacuugaugggaaa

SEQ ID NO: 946094 - RNA, 19 nt, Homo sapiens
cagaguuguuugaagauua

SEQ ID NO: 946095 - RNA, 19 nt, Homo sapiens
ggucaaagauaucuccaau

SEQ ID NO: 946096 - RNA, 19 nt, Homo sapiens
caacaucccucugguguca

SEQ ID NO: 946097 - RNA, 19 nt, Homo sapiens
ugagaacaguuucaaagaa

SEQ ID NO: 946098 - RNA, 19 nt, Homo sapiens
ggaauauagugaccuuaug

SEQ ID NO: 946099 - RNA, 19 nt, Homo sapiens
ccgacuggcuaauaaauaa

SEQ ID NO: 946100 - RNA, 19 nt, Homo sapiens
aaacucugcugaaauguga

SEQ ID NO: 946101 - RNA, 19 nt, Homo sapiens
caagcuuguuuccuuauuu

SEQ ID NO: 946102 - RNA, 19 nt, Homo sapiens
ugaaggagcuccauuuacu

SEQ ID NO: 946103 - RNA, 19 nt, Homo sapiens
gugaggaguucugguauaa

SEQ ID NO: 946104 - RNA, 19 nt, Homo sapiens
caagcuaacuggauacaag

SEQ ID NO: 946105 - RNA, 19 nt, Homo sapiens
caagugacaucuagaaacu

SEQ ID NO: 946106 - RNA, 19 nt, Homo sapiens
guauagggcuuuucuguuu

SEQ ID NO: 946107 - RNA, 19 nt, Homo sapiens
gaugaaaucgacaagcuaa

SEQ ID NO: 946108 - RNA, 19 nt, Homo sapiens
gggcaaagaacgcauauuc

SEQ ID NO: 946109 - RNA, 19 nt, Homo sapiens
gggaagagcuacaccaaaa

SEQ ID NO: 946110 - RNA, 19 nt, Homo sapiens
ggagaaaauugucaagaaa

SEQ ID NO: 946111 - RNA, 19 nt, Homo sapiens
ggacaggcacccagaguug

SEQ ID NO: 946112 - RNA, 19 nt, Homo sapiens
caaagaacauugggcuaga

SEQ ID NO: 946113 - RNA, 19 nt, Homo sapiens
aggaauggauugauagauu

SEQ ID NO: 946114 - RNA, 19 nt, Homo sapiens
ucuuugaacuugucaguaa

SEQ ID NO: 946115 - RNA, 19 nt, Homo sapiens
gcauggagaaaucaucaua

SEQ ID NO: 946116 - RNA, 19 nt, Homo sapiens
gaacauugggcuagaagau

SEQ ID NO: 946117 - RNA, 19 nt, Homo sapiens
gacuauagcaaauguguuu

SEQ ID NO: 946118 - RNA, 19 nt, Homo sapiens
gaauacgauuggaacauca

SEQ ID NO: 946119 - RNA, 19 nt, Homo sapiens
aagcugaaguugacaaguu

SEQ ID NO: 946120 - RNA, 19 nt, Homo sapiens
ggacuuggcaucaacaaca

SEQ ID NO: 946121 - RNA, 19 nt, Homo sapiens
ucgacaagcuaacuggaua

SEQ ID NO: 946122 - RNA, 19 nt, Homo sapiens
ggaagccagguuuacaaua

SEQ ID NO: 946123 - RNA, 19 nt, Homo sapiens
uccuagagcuucuuauuga

SEQ ID NO: 946124 - RNA, 19 nt, Homo sapiens
gaccuaacaucucaaggau

SEQ ID NO: 946125 - RNA, 19 nt, Homo sapiens
ggagaaacggucaacauuc

SEQ ID NO: 946126 - RNA, 19 nt, Homo sapiens
aaacgauucucgaacaugu

SEQ ID NO: 946127 - RNA, 19 nt, Homo sapiens
gguaaacuauacuauccuu

SEQ ID NO: 946128 - RNA, 19 nt, Homo sapiens
gggaugguacagaaauuua

SEQ ID NO: 946129 - RNA, 19 nt, Homo sapiens
cccaaacucugcugaaaug

SEQ ID NO: 946130 - RNA, 19 nt, Homo sapiens
cuacagccaucgacuacaa

SEQ ID NO: 946131 - RNA, 19 nt, Homo sapiens
ggaaacgauucucgaacau

SEQ ID NO: 946132 - RNA, 19 nt, Homo sapiens
ggcaucaacaacacaauua

SEQ ID NO: 946133 - RNA, 19 nt, Homo sapiens
gagaaacggucaacauucc

SEQ ID NO: 946134 - RNA, 19 nt, Homo sapiens
guuugaagauuacuugaug

SEQ ID NO: 946135 - RNA, 19 nt, Homo sapiens
guaggacuauagcaaaugu

SEQ ID NO: 946136 - RNA, 19 nt, Homo sapiens
ggaaagaauaugaaagaag

SEQ ID NO: 946137 - RNA, 19 nt, Homo sapiens
gcagugauggugagauuau

SEQ ID NO: 946138 - RNA, 19 nt, Homo sapiens
auccuuagcuuuggcauua

SEQ ID NO: 946139 - RNA, 19 nt, Homo sapiens
gaaggaauggauugauaga

SEQ ID NO: 946140 - RNA, 19 nt, Homo sapiens
agaaagagcuaaggaagag

SEQ ID NO: 946141 - RNA, 19 nt, Homo sapiens
ggaagcaggagaugguuga

SEQ ID NO: 946142 - RNA, 19 nt, Homo sapiens
gaggaguucugguauaaaa

SEQ ID NO: 946143 - RNA, 19 nt, Homo sapiens
gaauaagcauugacuaccu

SEQ ID NO: 946144 - RNA, 19 nt, Homo sapiens
gagcagagccauggagaau

SEQ ID NO: 946145 - RNA, 19 nt, Homo sapiens
caaggaagacaggaacuaa

SEQ ID NO: 946146 - RNA, 19 nt, Homo sapiens
gucacaauaucuuugcuaa

SEQ ID NO: 946147 - RNA, 19 nt, Homo sapiens
aacaaugccuuccaagcua

SEQ ID NO: 946148 - RNA, 19 nt, Homo sapiens
uagcaaccaccaaauaauu

SEQ ID NO: 946149 - RNA, 19 nt, Homo sapiens
ggugguuaaugaccucuuu

SEQ ID NO: 946150 - RNA, 19 nt, Homo sapiens
gacuacaagugccaucuga

SEQ ID NO: 946151 - RNA, 19 nt, Homo sapiens
caugguauguguuauccaa

SEQ ID NO: 946152 - RNA, 19 nt, Homo sapiens
guagauguaaugacuagaa

SEQ ID NO: 946153 - RNA, 19 nt, Homo sapiens
guagcuggauuuaccacaa

SEQ ID NO: 946154 - RNA, 19 nt, Homo sapiens
ugauggauccuuuagaauu

SEQ ID NO: 946155 - RNA, 19 nt, Homo sapiens
ugaagccgaugcuagauuc

SEQ ID NO: 946156 - RNA, 19 nt, Homo sapiens
uaccacaacuggagacaug

SEQ ID NO: 946157 - RNA, 19 nt, Homo sapiens
uggaauuggucaaagauau

SEQ ID NO: 946158 - RNA, 19 nt, Homo sapiens
ucagugcgcugcuggaauc

SEQ ID NO: 946159 - RNA, 19 nt, Homo sapiens
gugaugauccuucaaagug

SEQ ID NO: 946160 - RNA, 19 nt, Homo sapiens
caacgugugucagcugaug

SEQ ID NO: 946161 - RNA, 19 nt, Homo sapiens
ugucagaacuugccaucga

SEQ ID NO: 946162 - RNA, 19 nt, Homo sapiens
ucaaagaaagcauggagaa

SEQ ID NO: 946163 - RNA, 19 nt, Homo sapiens
ugcuagaggugguuaauga

SEQ ID NO: 946164 - RNA, 19 nt, Homo sapiens
aagcagugauggugagauu

SEQ ID NO: 946165 - RNA, 19 nt, Homo sapiens
gagaauaagcauugacuac

SEQ ID NO: 946166 - RNA, 19 nt, Homo sapiens
ccacaagugacaucuagaa

SEQ ID NO: 946167 - RNA, 19 nt, Homo sapiens
gcaacgggaaggacaaaga

SEQ ID NO: 946168 - RNA, 19 nt, Homo sapiens
acaaggagaucgggagaga

SEQ ID NO: 946169 - RNA, 19 nt, Homo sapiens
ggaugguacagaaauuuaa

SEQ ID NO: 946170 - RNA, 19 nt, Homo sapiens
aagaaagcauggagaaauc

SEQ ID NO: 946171 - RNA, 19 nt, Homo sapiens
gagcuggaguuccgcaaga

SEQ ID NO: 946172 - RNA, 19 nt, Homo sapiens
caacauggacuacuucaag

SEQ ID NO: 946173 - RNA, 19 nt, Homo sapiens
caaauggugucugcaagug

SEQ ID NO: 946174 - RNA, 19 nt, Homo sapiens
gcccaugccuccucuucuu

SEQ ID NO: 946175 - RNA, 19 nt, Homo sapiens
ggaaggugagcuccucuga

SEQ ID NO: 946176 - RNA, 19 nt, Homo sapiens
gagaagcagcggacacuca

SEQ ID NO: 946177 - RNA, 19 nt, Homo sapiens
ugacugggauggccucaag

SEQ ID NO: 946178 - RNA, 19 nt, Homo sapiens
gcaaauggugucugcaagu

SEQ ID NO: 946179 - RNA, 19 nt, Homo sapiens
gaagggcagggcacaaugu

SEQ ID NO: 946180 - RNA, 19 nt, Homo sapiens
ggaacgggauguggguugu

SEQ ID NO: 946181 - RNA, 19 nt, Homo sapiens
cuggagggcugcacccaaa

SEQ ID NO: 946182 - RNA, 19 nt, Homo sapiens
gcucugcaccuucccaaau

SEQ ID NO: 946183 - RNA, 19 nt, Homo sapiens
ggagagcccagccaugauc

SEQ ID NO: 946184 - RNA, 19 nt, Homo sapiens
gagaagggcagggcacaau

SEQ ID NO: 946185 - RNA, 19 nt, Homo sapiens
ugaccaaggcuucaucugu

SEQ ID NO: 946186 - RNA, 19 nt, Homo sapiens
cagaguuccuccacaacau

SEQ ID NO: 946187 - RNA, 19 nt, Homo sapiens
cauguuugccuucuucaga

SEQ ID NO: 946188 - RNA, 19 nt, Homo sapiens
gccugggucugggcucaua

SEQ ID NO: 946189 - RNA, 19 nt, Homo sapiens
ucccagaguuccuccacaa

SEQ ID NO: 946190 - RNA, 19 nt, Homo sapiens
ucgaagagccagaggacuu

SEQ ID NO: 946191 - RNA, 19 nt, Homo sapiens
ccacaacauggacuacuuc

SEQ ID NO: 946192 - RNA, 19 nt, Homo sapiens
cuucaucuguggcaucauc

SEQ ID NO: 946193 - RNA, 19 nt, Homo sapiens
caaccugagucugcacaag

SEQ ID NO: 946194 - RNA, 19 nt, Homo sapiens
gggcuccugcugcaucgua

SEQ ID NO: 946195 - RNA, 19 nt, Homo sapiens
gaacgggauguggguuguu

SEQ ID NO: 946196 - RNA, 19 nt, Homo sapiens
ccagaguuccuccacaaca

SEQ ID NO: 946197 - RNA, 19 nt, Homo sapiens
acgcauguuugccuucuuc

SEQ ID NO: 946198 - RNA, 19 nt, Homo sapiens
ccuacccacugcuggcaaa

SEQ ID NO: 946199 - RNA, 19 nt, Homo sapiens
cagcacauucccagaguuc

SEQ ID NO: 946200 - RNA, 19 nt, Homo sapiens
ccaccuggcugggaaaaug

SEQ ID NO: 946201 - RNA, 19 nt, Homo sapiens
gcuggaguuccgcaagaaa

SEQ ID NO: 946202 - RNA, 19 nt, Homo sapiens
agaagcagcggacacucaa

SEQ ID NO: 946203 - RNA, 19 nt, Homo sapiens
ucagauggcucucaacaaa

SEQ ID NO: 946204 - RNA, 19 nt, Homo sapiens
gagaacggcuggcaggaaa

SEQ ID NO: 946205 - RNA, 19 nt, Homo sapiens
ugaagaaguuccuggagua

SEQ ID NO: 946206 - RNA, 19 nt, Homo sapiens
gaagauggcgaauuccuuu

SEQ ID NO: 946207 - RNA, 19 nt, Homo sapiens
gcaacacgcugauggugaa

SEQ ID NO: 946208 - RNA, 19 nt, Homo sapiens
gagaagaucaaaguacuua

SEQ ID NO: 946209 - RNA, 19 nt, Homo sapiens
gggcauagcugaugagaac

SEQ ID NO: 946210 - RNA, 19 nt, Homo sapiens
gcuccaagcuucagcaguu

SEQ ID NO: 946211 - RNA, 19 nt, Homo sapiens
ugacagaccuuaccuagca

SEQ ID NO: 946212 - RNA, 19 nt, Homo sapiens
gcgauuacaucauuaagga

SEQ ID NO: 946213 - RNA, 19 nt, Homo sapiens
gaacacggcucugcacauc

SEQ ID NO: 946214 - RNA, 19 nt, Homo sapiens
ccaaaucuaugaccucaga

SEQ ID NO: 946215 - RNA, 19 nt, Homo sapiens
cgaccgggcucucaaauuc

SEQ ID NO: 946216 - RNA, 19 nt, Homo sapiens
agaagcagcuggccaaguu

SEQ ID NO: 946217 - RNA, 19 nt, Homo sapiens
caagaaagccgcagugaca

SEQ ID NO: 946218 - RNA, 19 nt, Homo sapiens
ucaacaaacuggacgaaau

SEQ ID NO: 946219 - RNA, 19 nt, Homo sapiens
caacagaccaucagugcaa

SEQ ID NO: 946220 - RNA, 19 nt, Homo sapiens
acaaggaugugaagaacaa

SEQ ID NO: 946221 - RNA, 19 nt, Homo sapiens
gcucaacuauggccuguuc

SEQ ID NO: 946222 - RNA, 19 nt, Homo sapiens
gauacaagacccgaguuua

SEQ ID NO: 946223 - RNA, 19 nt, Homo sapiens
agaccaaccuggaugagaa

SEQ ID NO: 946224 - RNA, 19 nt, Homo sapiens
gcucaugacucccucuaag

SEQ ID NO: 946225 - RNA, 19 nt, Homo sapiens
gcgagagccugcaggaugu

SEQ ID NO: 946226 - RNA, 19 nt, Homo sapiens
ggacuccgagacccuguua

SEQ ID NO: 946227 - RNA, 19 nt, Homo sapiens
gggagcgauuacaucauua

SEQ ID NO: 946228 - RNA, 19 nt, Homo sapiens
gcgagaagaucaaaguacu

SEQ ID NO: 946229 - RNA, 19 nt, Homo sapiens
cauccagccugacauccua

SEQ ID NO: 946230 - RNA, 19 nt, Homo sapiens
uguggaagauggcgaauuc

SEQ ID NO: 946231 - RNA, 19 nt, Homo sapiens
guuacgagcguccuucuuu

SEQ ID NO: 946232 - RNA, 19 nt, Homo sapiens
caacaaacuggacgaaauc

SEQ ID NO: 946233 - RNA, 19 nt, Homo sapiens
agaaguuccuggaguaugu

SEQ ID NO: 946234 - RNA, 19 nt, Homo sapiens
gggcaaacaccgacccaaa

SEQ ID NO: 946235 - RNA, 19 nt, Homo sapiens
ggagcgauuacaucauuaa

SEQ ID NO: 946236 - RNA, 19 nt, Homo sapiens
caggagagcaagcaagaaa

SEQ ID NO: 946237 - RNA, 19 nt, Homo sapiens
gccagggacucuguucaaa

SEQ ID NO: 946238 - RNA, 19 nt, Homo sapiens
ggaggacuacgucgaucua

SEQ ID NO: 946239 - RNA, 19 nt, Homo sapiens
ucagcagccuguuucagaa

SEQ ID NO: 946240 - RNA, 19 nt, Homo sapiens
cagaagaugacagaccuua

SEQ ID NO: 946241 - RNA, 19 nt, Homo sapiens
agggagcgauuacaucauu

SEQ ID NO: 946242 - RNA, 19 nt, Homo sapiens
gaagaaguuccuggaguau

SEQ ID NO: 946243 - RNA, 19 nt, Homo sapiens
ucagugaacucagcuccaa

SEQ ID NO: 946244 - RNA, 19 nt, Homo sapiens
cgacagguggugaacauga

SEQ ID NO: 946245 - RNA, 19 nt, Homo sapiens
cgacaaggaugugaagaac

SEQ ID NO: 946246 - RNA, 19 nt, Homo sapiens
ggcaugaccgcacugcaua

SEQ ID NO: 946247 - RNA, 19 nt, Homo sapiens
cagccuaucugccgaaggu

SEQ ID NO: 946248 - RNA, 19 nt, Homo sapiens
cacgugcgguuccuugaaa

SEQ ID NO: 946249 - RNA, 19 nt, Homo sapiens
uggaggagauggaguacga

SEQ ID NO: 946250 - RNA, 19 nt, Homo sapiens
ugcaggaugugcucaacua

SEQ ID NO: 946251 - RNA, 19 nt, Homo sapiens
gaggugaacgggcagaaug

SEQ ID NO: 946252 - RNA, 19 nt, Homo sapiens
gcacaucugcgcccucuac

SEQ ID NO: 946253 - RNA, 19 nt, Homo sapiens
ggcagaauguggugaaggu

SEQ ID NO: 946254 - RNA, 19 nt, Homo sapiens
gauccgaaaccaccgagaa

SEQ ID NO: 946255 - RNA, 19 nt, Homo sapiens
gcaugauggucuucaggau

SEQ ID NO: 946256 - RNA, 19 nt, Homo sapiens
ggacuacgucgaucuaggu

SEQ ID NO: 946257 - RNA, 19 nt, Homo sapiens
ggacuucacgagccaguuc

SEQ ID NO: 946258 - RNA, 19 nt, Homo sapiens
aaacaccgacccaaagguu

SEQ ID NO: 946259 - RNA, 19 nt, Homo sapiens
gcacgugcgguuccuugaa

SEQ ID NO: 946260 - RNA, 19 nt, Homo sapiens
gcaaacaccgacccaaagg

SEQ ID NO: 946261 - RNA, 19 nt, Homo sapiens
gacagguggugaacaugau

SEQ ID NO: 946262 - RNA, 19 nt, Homo sapiens
ccagggagcgauuacauca

SEQ ID NO: 946263 - RNA, 19 nt, Homo sapiens
cagggacucuguucaaacu

SEQ ID NO: 946264 - RNA, 19 nt, Homo sapiens
gacgcccacuucagcauga

SEQ ID NO: 946265 - RNA, 19 nt, Homo sapiens
gacaagcgaggacgaggaa

SEQ ID NO: 946266 - RNA, 19 nt, Homo sapiens
caagacccgaguuuacaaa

SEQ ID NO: 946267 - RNA, 19 nt, Homo sapiens
augauggucuucaggauug

SEQ ID NO: 946268 - RNA, 19 nt, Homo sapiens
caaaaugccuucgcuucaa

SEQ ID NO: 946269 - RNA, 19 nt, Homo sapiens
ucauggcugugaaguccua

SEQ ID NO: 946270 - RNA, 19 nt, Homo sapiens
guaucgaggugccgacaag

SEQ ID NO: 946271 - RNA, 19 nt, Homo sapiens
gcaugaccgcacugcauaa

SEQ ID NO: 946272 - RNA, 19 nt, Homo sapiens
uggaagaaguggcgaaucg

SEQ ID NO: 946273 - RNA, 19 nt, Homo sapiens
gguagccuggccucuguua

SEQ ID NO: 946274 - RNA, 19 nt, Homo sapiens
acacggcucugcacaucug

SEQ ID NO: 946275 - RNA, 19 nt, Homo sapiens
caaggaggacuacgucgau

SEQ ID NO: 946276 - RNA, 19 nt, Homo sapiens
gaagaucaaaguacuuagc

SEQ ID NO: 946277 - RNA, 19 nt, Homo sapiens
gggcgagaagaucaaagua

SEQ ID NO: 946278 - RNA, 19 nt, Homo sapiens
gcaagggcgagaagaucaa

SEQ ID NO: 946279 - RNA, 19 nt, Homo sapiens
ggacgaggaacgccacagu

SEQ ID NO: 946280 - RNA, 19 nt, Homo sapiens
uuucagaacuggcccaaac

SEQ ID NO: 946281 - RNA, 19 nt, Homo sapiens
gaugaggcagugcacaaga

SEQ ID NO: 946282 - RNA, 19 nt, Homo sapiens
agacucuuccggcauuaua

SEQ ID NO: 946283 - RNA, 19 nt, Homo sapiens
gcagugacaaggcaaagag

SEQ ID NO: 946284 - RNA, 19 nt, Homo sapiens
gagcaagggcgagaagauc

SEQ ID NO: 946285 - RNA, 19 nt, Homo sapiens
cgauacaagacccgaguuu

SEQ ID NO: 946286 - RNA, 19 nt, Homo sapiens
gucagcagccuguuucaga

SEQ ID NO: 946287 - RNA, 19 nt, Homo sapiens
aagccagcaucaucaguga

SEQ ID NO: 946288 - RNA, 19 nt, Homo sapiens
uuacgagcguccuucuuuc

SEQ ID NO: 946289 - RNA, 19 nt, Homo sapiens
gaaggacagugagggguuu

SEQ ID NO: 946290 - RNA, 19 nt, Homo sapiens
gaacggcuggcaggaaauc

SEQ ID NO: 946291 - RNA, 19 nt, Homo sapiens
ccacagugccagcgagugu

SEQ ID NO: 946292 - RNA, 19 nt, Homo sapiens
caugauggucuucaggauu

SEQ ID NO: 946293 - RNA, 19 nt, Homo sapiens
aggaugugcucaacuaugg

SEQ ID NO: 946294 - RNA, 19 nt, Homo sapiens
uguaucagauggcucucaa

SEQ ID NO: 946295 - RNA, 19 nt, Homo sapiens
gaagaugacagaccuuacc

SEQ ID NO: 946296 - RNA, 19 nt, Homo sapiens
uggccaaguugcacacgaa

SEQ ID NO: 946297 - RNA, 19 nt, Homo sapiens
gcagugauugcugggaauu

SEQ ID NO: 946298 - RNA, 19 nt, Homo sapiens
ggccagggacucuguucaa

SEQ ID NO: 946299 - RNA, 19 nt, Homo sapiens
ccucuacccaggccucuuu

SEQ ID NO: 946300 - RNA, 19 nt, Homo sapiens
gcagcgccuucaccagcuu

SEQ ID NO: 946301 - RNA, 19 nt, Homo sapiens
ggaaggccaggucaaaggu

SEQ ID NO: 946302 - RNA, 19 nt, Homo sapiens
ggaacacggcucugcacau

SEQ ID NO: 946303 - RNA, 19 nt, Homo sapiens
gaagaucggcuuucaugua

SEQ ID NO: 946304 - RNA, 19 nt, Homo sapiens
ggacugagaugaucauuac

SEQ ID NO: 946305 - RNA, 19 nt, Homo sapiens
guaaucauguucauuggua

SEQ ID NO: 946306 - RNA, 19 nt, Homo sapiens
caacaguucucagucuuua

SEQ ID NO: 946307 - RNA, 19 nt, Homo sapiens
gcaauuaaccauuaccuuu

SEQ ID NO: 946308 - RNA, 19 nt, Homo sapiens
gacaauagcauuucuagaa

SEQ ID NO: 946309 - RNA, 19 nt, Homo sapiens
gaaggcaaauguaaucaug

SEQ ID NO: 946310 - RNA, 19 nt, Homo sapiens
gcaugaaacucaccaacaa

SEQ ID NO: 946311 - RNA, 19 nt, Homo sapiens
ccucaugccuuuauacuuu

SEQ ID NO: 946312 - RNA, 19 nt, Homo sapiens
gcacuuaguugcuccuuuc

SEQ ID NO: 946313 - RNA, 19 nt, Homo sapiens
gaacacaaagaucaaauga

SEQ ID NO: 946314 - RNA, 19 nt, Homo sapiens
gaagauggauguaauucuc

SEQ ID NO: 946315 - RNA, 19 nt, Homo sapiens
ccaaagaaauuucaacagu

SEQ ID NO: 946316 - RNA, 19 nt, Homo sapiens
gaagcuaguucaccacguu

SEQ ID NO: 946317 - RNA, 19 nt, Homo sapiens
gaaaauugaugcuaaguga

SEQ ID NO: 946318 - RNA, 19 nt, Homo sapiens
gaucggcuuucauguaauu

SEQ ID NO: 946319 - RNA, 19 nt, Homo sapiens
ggauguaauucucaugaaa

SEQ ID NO: 946320 - RNA, 19 nt, Homo sapiens
ugaaagcagugaagcaauu

SEQ ID NO: 946321 - RNA, 19 nt, Homo sapiens
caacagauuacgaaacuaa

SEQ ID NO: 946322 - RNA, 19 nt, Homo sapiens
gauuuaaagugccuuauca

SEQ ID NO: 946323 - RNA, 19 nt, Homo sapiens
ugacaaaggccacaucauu

SEQ ID NO: 946324 - RNA, 19 nt, Homo sapiens
caaauaaggacacaaacuu

SEQ ID NO: 946325 - RNA, 19 nt, Homo sapiens
aagaucggcuuucauguaa

SEQ ID NO: 946326 - RNA, 19 nt, Homo sapiens
gauggaagugccuauguua

SEQ ID NO: 946327 - RNA, 19 nt, Homo sapiens
caaaugaaaccuacaggaa

SEQ ID NO: 946328 - RNA, 19 nt, Homo sapiens
ccaaucaaauguuauaugg

SEQ ID NO: 946329 - RNA, 19 nt, Homo sapiens
gagcaaggcagcaguguug

SEQ ID NO: 946330 - RNA, 19 nt, Homo sapiens
acaaugagauggaugacaa

SEQ ID NO: 946331 - RNA, 19 nt, Homo sapiens
gaagaaacuacuaaucuca

SEQ ID NO: 946332 - RNA, 19 nt, Homo sapiens
gugaugggauuuucaauua

SEQ ID NO: 946333 - RNA, 19 nt, Homo sapiens
ccuuugaacuccuuacuuu

SEQ ID NO: 946334 - RNA, 19 nt, Homo sapiens
gaugguagcugggaauaca

SEQ ID NO: 946335 - RNA, 19 nt, Homo sapiens
caacaguuauugggcuuaa

SEQ ID NO: 946336 - RNA, 19 nt, Homo sapiens
gagaugaucauuacuaaag

SEQ ID NO: 946337 - RNA, 19 nt, Homo sapiens
gcaccuaauucuaccaauc

SEQ ID NO: 946338 - RNA, 19 nt, Homo sapiens
ccaaccaucuuaaagugaa

SEQ ID NO: 946339 - RNA, 19 nt, Homo sapiens
acagucaccuggaaauauu

SEQ ID NO: 946340 - RNA, 19 nt, Homo sapiens
auacuuugcuguugaagaa

SEQ ID NO: 946341 - RNA, 19 nt, Homo sapiens
gaugcuaagugaugggauu

SEQ ID NO: 946342 - RNA, 19 nt, Homo sapiens
ggagaaggcaaauguaauc

SEQ ID NO: 946343 - RNA, 19 nt, Homo sapiens
ggaagugccuauguuaucu

SEQ ID NO: 946344 - RNA, 19 nt, Homo sapiens
ccucuaugcuacaagauuu

SEQ ID NO: 946345 - RNA, 19 nt, Homo sapiens
ggauuacagucaccuggaa

SEQ ID NO: 946346 - RNA, 19 nt, Homo sapiens
gaaagcagugaagcaauuu

SEQ ID NO: 946347 - RNA, 19 nt, Homo sapiens
uaaagugaaugacgacagu

SEQ ID NO: 946348 - RNA, 19 nt, Homo sapiens
cagcuuugaucgcaugaaa

SEQ ID NO: 946349 - RNA, 19 nt, Homo sapiens
gcaaauguaaucauguuca

SEQ ID NO: 946350 - RNA, 19 nt, Homo sapiens
agacagagcccucaacauc

SEQ ID NO: 946351 - RNA, 19 nt, Homo sapiens
gaaggaacacaaagaucaa

SEQ ID NO: 946352 - RNA, 19 nt, Homo sapiens
gaugauacuccaccaguga

SEQ ID NO: 946353 - RNA, 19 nt, Homo sapiens
caagauuuguccaacuaau

SEQ ID NO: 946354 - RNA, 19 nt, Homo sapiens
gacaaaggccacaucauuc

SEQ ID NO: 946355 - RNA, 19 nt, Homo sapiens
gaccauuugugcaucauuc

SEQ ID NO: 946356 - RNA, 19 nt, Homo sapiens
cugaaagucuggaagagaa

SEQ ID NO: 946357 - RNA, 19 nt, Homo sapiens
gcaacaguucucagucuuu

SEQ ID NO: 946358 - RNA, 19 nt, Homo sapiens
ugaagaaacuacuaaucuc

SEQ ID NO: 946359 - RNA, 19 nt, Homo sapiens
ugaaggaacacaaagauca

SEQ ID NO: 946360 - RNA, 19 nt, Homo sapiens
ggcaacagcucugaaaguc

SEQ ID NO: 946361 - RNA, 19 nt, Homo sapiens
ucaccuauguuucauuuac

SEQ ID NO: 946362 - RNA, 19 nt, Homo sapiens
ucaccacaguaacggcuua

SEQ ID NO: 946363 - RNA, 19 nt, Homo sapiens
cugagaugaucauuacuaa

SEQ ID NO: 946364 - RNA, 19 nt, Homo sapiens
caauagcauuucuagaaca

SEQ ID NO: 946365 - RNA, 19 nt, Homo sapiens
guaagacaauagcauuucu

SEQ ID NO: 946366 - RNA, 19 nt, Homo sapiens
ggaacacaaagaucaaaug

SEQ ID NO: 946367 - RNA, 19 nt, Homo sapiens
auccagcaauuaaccauua

SEQ ID NO: 946368 - RNA, 19 nt, Homo sapiens
uaugccaucuagacugaua

SEQ ID NO: 946369 - RNA, 19 nt, Homo sapiens
ggaagagaaagauauucaa

SEQ ID NO: 946370 - RNA, 19 nt, Homo sapiens
acagcaaccucuuguuuua

SEQ ID NO: 946371 - RNA, 19 nt, Homo sapiens
gugcaucauuccuagauuc

SEQ ID NO: 946372 - RNA, 19 nt, Homo sapiens
ucaaauggagcuucaagga

SEQ ID NO: 946373 - RNA, 19 nt, Homo sapiens
aaugaaaccuacaggaauc

SEQ ID NO: 946374 - RNA, 19 nt, Homo sapiens
cuacaagcaccuaauucua

SEQ ID NO: 946375 - RNA, 19 nt, Homo sapiens
ugauggaagugccuauguu

SEQ ID NO: 946376 - RNA, 19 nt, Homo sapiens
gcagacacacaaaguggaa

SEQ ID NO: 946377 - RNA, 19 nt, Homo sapiens
uuagagaccuacccaugga

SEQ ID NO: 946378 - RNA, 19 nt, Homo sapiens
cagcaacaguucucagucu

SEQ ID NO: 946379 - RNA, 19 nt, Homo sapiens
ggauuuagagauacuggaa

SEQ ID NO: 946380 - RNA, 19 nt, Homo sapiens
gggacugagaugaucauua

SEQ ID NO: 946381 - RNA, 19 nt, Homo sapiens
aggcaaauguaaucauguu

SEQ ID NO: 946382 - RNA, 19 nt, Homo sapiens
ccacuuugcuuuucaccua

SEQ ID NO: 946383 - RNA, 19 nt, Homo sapiens
gaagaggaggagagaagga

SEQ ID NO: 946384 - RNA, 19 nt, Homo sapiens
agacuccagugaucaguau

SEQ ID NO: 946385 - RNA, 19 nt, Homo sapiens
ccaacaaugagauggauga

SEQ ID NO: 946386 - RNA, 19 nt, Homo sapiens
ggaauacagaccauuugug

SEQ ID NO: 946387 - RNA, 19 nt, Homo sapiens
caaauggagcuucaaggau

SEQ ID NO: 946388 - RNA, 19 nt, Homo sapiens
gagaaagauauucaaaugg

SEQ ID NO: 946389 - RNA, 19 nt, Homo sapiens
gaaaagauuccaugacauc

SEQ ID NO: 946390 - RNA, 19 nt, Homo sapiens
caauuauacugaagcuagu

SEQ ID NO: 946391 - RNA, 19 nt, Homo sapiens
gaucugaacuguggaaaag

SEQ ID NO: 946392 - RNA, 19 nt, Homo sapiens
gcucugaaagucuggaaga

SEQ ID NO: 946393 - RNA, 19 nt, Homo sapiens
caucugaagacuccaguga

SEQ ID NO: 946394 - RNA, 19 nt, Homo sapiens
ugaaacucaccaacaauga

SEQ ID NO: 946395 - RNA, 19 nt, Homo sapiens
cggcagaucaucagcuuug

SEQ ID NO: 946396 - RNA, 19 nt, Homo sapiens
acaguggccuugagcuuca

SEQ ID NO: 946397 - RNA, 19 nt, Homo sapiens
acaauagcauuucuagaac

SEQ ID NO: 946398 - RNA, 19 nt, Homo sapiens
ucugaagacuccagugauc

SEQ ID NO: 946399 - RNA, 19 nt, Homo sapiens
gauguaauucucaugaaag

SEQ ID NO: 946400 - RNA, 19 nt, Homo sapiens
aaaugaaaccuacaggaau

SEQ ID NO: 946401 - RNA, 19 nt, Homo sapiens
guucauugguauccagcaa

SEQ ID NO: 946402 - RNA, 19 nt, Homo sapiens
cagggaagcaguaccaugu

SEQ ID NO: 946403 - RNA, 19 nt, Homo sapiens
gaaauaacaucauccauug

SEQ ID NO: 946404 - RNA, 19 nt, Homo sapiens
ccagagacauuguuaauaa

SEQ ID NO: 946405 - RNA, 19 nt, Homo sapiens
ccaaagacguguccgagua

SEQ ID NO: 946406 - RNA, 19 nt, Homo sapiens
ggaccucaauuuccacuuu

SEQ ID NO: 946407 - RNA, 19 nt, Homo sapiens
caaggucacuuccagaauu

SEQ ID NO: 946408 - RNA, 19 nt, Homo sapiens
ccacuaacuugcuguguaa

SEQ ID NO: 946409 - RNA, 19 nt, Homo sapiens
uggcauaucuuacacuaaa

SEQ ID NO: 946410 - RNA, 19 nt, Homo sapiens
gcgcgugguuugauuguuu

SEQ ID NO: 946411 - RNA, 19 nt, Homo sapiens
ccagacaaccucuuacuuu

SEQ ID NO: 946412 - RNA, 19 nt, Homo sapiens
agaagcacaugacauauga

SEQ ID NO: 946413 - RNA, 19 nt, Homo sapiens
gauggcauaucuuacacua

SEQ ID NO: 946414 - RNA, 19 nt, Homo sapiens
uuacugcucuuacauguga

SEQ ID NO: 946415 - RNA, 19 nt, Homo sapiens
gaaacugcagagcauaaua

SEQ ID NO: 946416 - RNA, 19 nt, Homo sapiens
cgaggagacuauuggcaua

SEQ ID NO: 946417 - RNA, 19 nt, Homo sapiens
caccggagcuggagaacaa

SEQ ID NO: 946418 - RNA, 19 nt, Homo sapiens
gccacuaacuugcugugua

SEQ ID NO: 946419 - RNA, 19 nt, Homo sapiens
guagagaaugacaauguua

SEQ ID NO: 946420 - RNA, 19 nt, Homo sapiens
gagaaacugcagagcauaa

SEQ ID NO: 946421 - RNA, 19 nt, Homo sapiens
gaaagagagagaaugaaug

SEQ ID NO: 946422 - RNA, 19 nt, Homo sapiens
ggagacuauuggcauauga

SEQ ID NO: 946423 - RNA, 19 nt, Homo sapiens
gcaguugcauugauucagu

SEQ ID NO: 946424 - RNA, 19 nt, Homo sapiens
ggcaggcguucaagaauga

SEQ ID NO: 946425 - RNA, 19 nt, Homo sapiens
ccacaagaaugaaaguagu

SEQ ID NO: 946426 - RNA, 19 nt, Homo sapiens
cagacaaccucuuacuuuc

SEQ ID NO: 946427 - RNA, 19 nt, Homo sapiens
gagaacaacaagaccauga

SEQ ID NO: 946428 - RNA, 19 nt, Homo sapiens
guacauaugcugagaaacu

SEQ ID NO: 946429 - RNA, 19 nt, Homo sapiens
gcacaucccuuuugagaca

SEQ ID NO: 946430 - RNA, 19 nt, Homo sapiens
gagcagccaucacaaacuc

SEQ ID NO: 946431 - RNA, 19 nt, Homo sapiens
caugugauggcauaucuua

SEQ ID NO: 946432 - RNA, 19 nt, Homo sapiens
gaacuacacaauucuccuu

SEQ ID NO: 946433 - RNA, 19 nt, Homo sapiens
ggacacauuucugccuaga

SEQ ID NO: 946434 - RNA, 19 nt, Homo sapiens
gacaaccucuuacuuucug

SEQ ID NO: 946435 - RNA, 19 nt, Homo sapiens
gggagggaauugagaguca

SEQ ID NO: 946436 - RNA, 19 nt, Homo sapiens
gcacaugacauaugaaagc

SEQ ID NO: 946437 - RNA, 19 nt, Homo sapiens
aacagaagcacaugacaua

SEQ ID NO: 946438 - RNA, 19 nt, Homo sapiens
gaauugagagucacagaca

SEQ ID NO: 946439 - RNA, 19 nt, Homo sapiens
gaaugaaaguagugguuuu

SEQ ID NO: 946440 - RNA, 19 nt, Homo sapiens
gugaugcucucuucugaca

SEQ ID NO: 946441 - RNA, 19 nt, Homo sapiens
agagaaagagagagaauga

SEQ ID NO: 946442 - RNA, 19 nt, Homo sapiens
gaccucaauuuccacuuug

SEQ ID NO: 946443 - RNA, 19 nt, Homo sapiens
ggcaagugguggcgaccua

SEQ ID NO: 946444 - RNA, 19 nt, Homo sapiens
gaaucaugaccgaaagaaa

SEQ ID NO: 946445 - RNA, 19 nt, Homo sapiens
ugagagagagagagagaaa

SEQ ID NO: 946446 - RNA, 19 nt, Homo sapiens
gaguugugaugcucucuuc

SEQ ID NO: 946447 - RNA, 19 nt, Homo sapiens
uguagagaaugacaauguu

SEQ ID NO: 946448 - RNA, 19 nt, Homo sapiens
cagaagcacaugacauaug

SEQ ID NO: 946449 - RNA, 19 nt, Homo sapiens
ccucuuacuuucuguguag

SEQ ID NO: 946450 - RNA, 19 nt, Homo sapiens
cugacaaacuccuggaaga

SEQ ID NO: 946451 - RNA, 19 nt, Homo sapiens
ucuuacaugugauggcaua

SEQ ID NO: 946452 - RNA, 19 nt, Homo sapiens
agaaagagagagaaugaau

SEQ ID NO: 946453 - RNA, 19 nt, Homo sapiens
gguuaagaaaguuggauaa

SEQ ID NO: 946454 - RNA, 19 nt, Homo sapiens
uggcaggcguucaagaaug

SEQ ID NO: 946455 - RNA, 19 nt, Homo sapiens
gaacaacaagaccaugaac

SEQ ID NO: 946456 - RNA, 19 nt, Homo sapiens
gguggcaggcguucaagaa

SEQ ID NO: 946457 - RNA, 19 nt, Homo sapiens
ugacaaacuccuggaagaa

SEQ ID NO: 946458 - RNA, 19 nt, Homo sapiens
agagagagagagagaaaga

SEQ ID NO: 946459 - RNA, 19 nt, Homo sapiens
ggacuccagugccuuuuga

SEQ ID NO: 946460 - RNA, 19 nt, Homo sapiens
ggacugguuaagaaaguug

SEQ ID NO: 946461 - RNA, 19 nt, Homo sapiens
agaaugaugccacggaaau

SEQ ID NO: 946462 - RNA, 19 nt, Homo sapiens
cgagggagcagccaucaca

SEQ ID NO: 946463 - RNA, 19 nt, Homo sapiens
gagaaagagagagaaugaa

SEQ ID NO: 946464 - RNA, 19 nt, Homo sapiens
ggugagagagagagagaga

SEQ ID NO: 946465 - RNA, 19 nt, Homo sapiens
gaggugagagagagagaga

SEQ ID NO: 946466 - RNA, 19 nt, Homo sapiens
gaguccagagacauuguua

SEQ ID NO: 946467 - RNA, 19 nt, Homo sapiens
aaacugcagagcauaauag

SEQ ID NO: 946468 - RNA, 19 nt, Homo sapiens
cagaccagcacaucccuuu

SEQ ID NO: 946469 - RNA, 19 nt, Homo sapiens
cgaagagaagugaaagguu

SEQ ID NO: 946470 - RNA, 19 nt, Homo sapiens
gccaaggucacuuccagaa

SEQ ID NO: 946471 - RNA, 19 nt, Homo sapiens
gagagaaagagagagaaug

SEQ ID NO: 946472 - RNA, 19 nt, Homo sapiens
gaggguggaggugggaaua

SEQ ID NO: 946473 - RNA, 19 nt, Homo sapiens
guccagagacauuguuaau

SEQ ID NO: 946474 - RNA, 19 nt, Homo sapiens
cugagaaacugcagagcau

SEQ ID NO: 946475 - RNA, 19 nt, Homo sapiens
cauauuuacggcugacaaa

SEQ ID NO: 946476 - RNA, 19 nt, Homo sapiens
cgcgugguuugauuguuua

SEQ ID NO: 946477 - RNA, 19 nt, Homo sapiens
cuguacauaugcugagaaa

SEQ ID NO: 946478 - RNA, 19 nt, Homo sapiens
aagcacaugacauaugaaa

SEQ ID NO: 946479 - RNA, 19 nt, Homo sapiens
aaacagaagcacaugacau

SEQ ID NO: 946480 - RNA, 19 nt, Homo sapiens
gagagaaugaaugcaguug

SEQ ID NO: 946481 - RNA, 19 nt, Homo sapiens
aaagagagagaaugaaugc

SEQ ID NO: 946482 - RNA, 19 nt, Homo sapiens
agagagagagaaagagaga

SEQ ID NO: 946483 - RNA, 19 nt, Homo sapiens
agagagagagagaaagaga

SEQ ID NO: 946484 - RNA, 19 nt, Homo sapiens
agaaugaaaguagugguuu

SEQ ID NO: 946485 - RNA, 19 nt, Homo sapiens
gaggguggugggagggaua

SEQ ID NO: 946486 - RNA, 19 nt, Homo sapiens
agagagagaaagagagaga

SEQ ID NO: 946487 - RNA, 19 nt, Homo sapiens
gaaaguuggauaagauucc

SEQ ID NO: 946488 - RNA, 19 nt, Homo sapiens
gggacugguuaagaaaguu

SEQ ID NO: 946489 - RNA, 19 nt, Homo sapiens
agaggaggcagaaauggaa

SEQ ID NO: 946490 - RNA, 19 nt, Homo sapiens
gacaaacuccuggaagaag

SEQ ID NO: 946491 - RNA, 19 nt, Homo sapiens
cuuccagaauucagaguug

SEQ ID NO: 946492 - RNA, 19 nt, Homo sapiens
gcuguguaaccuugaacua

SEQ ID NO: 946493 - RNA, 19 nt, Homo sapiens
cagaggaggcagaaaugga

SEQ ID NO: 946494 - RNA, 19 nt, Homo sapiens
uacaugugauggcauaucu

SEQ ID NO: 946495 - RNA, 19 nt, Homo sapiens
gaggagacuauuggcauau

SEQ ID NO: 946496 - RNA, 19 nt, Homo sapiens
gaaugaugccacggaaauc

SEQ ID NO: 946497 - RNA, 19 nt, Homo sapiens
ucugacagccaaagaugaa

SEQ ID NO: 946498 - RNA, 19 nt, Homo sapiens
aaggucacuuccagaauuc

SEQ ID NO: 946499 - RNA, 19 nt, Homo sapiens
ugaaugggcagaggugaga

SEQ ID NO: 946500 - RNA, 19 nt, Homo sapiens
uggcauaugauuccaagga

SEQ ID NO: 946501 - RNA, 19 nt, Homo sapiens
caaagacguguccgaguac

SEQ ID NO: 946502 - RNA, 19 nt, Homo sapiens
cuuacuuucuguguaguuu

SEQ ID NO: 946503 - RNA, 19 nt, Homo sapiens
gaacaaaggucaauaagau

SEQ ID NO: 946504 - RNA, 19 nt, Homo sapiens
gcaaugagaagcaaauuua

SEQ ID NO: 946505 - RNA, 19 nt, Homo sapiens
gcaaaugucuuaggugauu

SEQ ID NO: 946506 - RNA, 19 nt, Homo sapiens
ggaagaaacuuuggcugua

SEQ ID NO: 946507 - RNA, 19 nt, Homo sapiens
ggaauacuaaggacaauua

SEQ ID NO: 946508 - RNA, 19 nt, Homo sapiens
gagauacauuucccucuua

SEQ ID NO: 946509 - RNA, 19 nt, Homo sapiens
gauagcgacuucaccuuua

SEQ ID NO: 946510 - RNA, 19 nt, Homo sapiens
ccacugaucuuaaaccuau

SEQ ID NO: 946511 - RNA, 19 nt, Homo sapiens
gagaagagcagcuuagauu

SEQ ID NO: 946512 - RNA, 19 nt, Homo sapiens
gcauuagucuuuguacuuu

SEQ ID NO: 946513 - RNA, 19 nt, Homo sapiens
aaacauagacucccaaguu

SEQ ID NO: 946514 - RNA, 19 nt, Homo sapiens
guacaauaaugcacaauca

SEQ ID NO: 946515 - RNA, 19 nt, Homo sapiens
guacagauauaaacuacug

SEQ ID NO: 946516 - RNA, 19 nt, Homo sapiens
ugccguauaugaucaauua

SEQ ID NO: 946517 - RNA, 19 nt, Homo sapiens
gaucgaaacauacaagaaa

SEQ ID NO: 946518 - RNA, 19 nt, Homo sapiens
gauauaaacuacugcaucu

SEQ ID NO: 946519 - RNA, 19 nt, Homo sapiens
gcagaacaaaggucaauaa

SEQ ID NO: 946520 - RNA, 19 nt, Homo sapiens
gaaguaaggauuagaaaca

SEQ ID NO: 946521 - RNA, 19 nt, Homo sapiens
uaacaugauugcugacuug

SEQ ID NO: 946522 - RNA, 19 nt, Homo sapiens
agacugaaguuggugauua

SEQ ID NO: 946523 - RNA, 19 nt, Homo sapiens
gaucugggccuaccauaaa

SEQ ID NO: 946524 - RNA, 19 nt, Homo sapiens
gauauugauuuccaucuug

SEQ ID NO: 946525 - RNA, 19 nt, Homo sapiens
ugaagagucuguuugaaga

SEQ ID NO: 946526 - RNA, 19 nt, Homo sapiens
ugagguaaaugccguauau

SEQ ID NO: 946527 - RNA, 19 nt, Homo sapiens
gcacuggguguacauauuu

SEQ ID NO: 946528 - RNA, 19 nt, Homo sapiens
gaagaaacuuuggcuguag

SEQ ID NO: 946529 - RNA, 19 nt, Homo sapiens
gagaaaaccuaauccaaaa

SEQ ID NO: 946530 - RNA, 19 nt, Homo sapiens
guaggaaacagguauaauu

SEQ ID NO: 946531 - RNA, 19 nt, Homo sapiens
ggccuaccauaaauaaaua

SEQ ID NO: 946532 - RNA, 19 nt, Homo sapiens
gaaguacaauaaugcacaa

SEQ ID NO: 946533 - RNA, 19 nt, Homo sapiens
caaccgauuuccauaaugu

SEQ ID NO: 946534 - RNA, 19 nt, Homo sapiens
gcuguuaaauuugcaauga

SEQ ID NO: 946535 - RNA, 19 nt, Homo sapiens
acaagaagauuggaagaaa

SEQ ID NO: 946536 - RNA, 19 nt, Homo sapiens
ggagcaggauuagauauug

SEQ ID NO: 946537 - RNA, 19 nt, Homo sapiens
caaaguuucugccaucuag

SEQ ID NO: 946538 - RNA, 19 nt, Homo sapiens
gaagccauauuaauaacug

SEQ ID NO: 946539 - RNA, 19 nt, Homo sapiens
gagcaggauuagauauuga

SEQ ID NO: 946540 - RNA, 19 nt, Homo sapiens
gaagagcagcuuagauuuc

SEQ ID NO: 946541 - RNA, 19 nt, Homo sapiens
ugucagccauucaaguuua

SEQ ID NO: 946542 - RNA, 19 nt, Homo sapiens
caucugaaguacaauaaug

SEQ ID NO: 946543 - RNA, 19 nt, Homo sapiens
gaucuuaaaccuaugauuc

SEQ ID NO: 946544 - RNA, 19 nt, Homo sapiens
gagaagcaaauuuacagua

SEQ ID NO: 946545 - RNA, 19 nt, Homo sapiens
gaaucugacuggcucauca

SEQ ID NO: 946546 - RNA, 19 nt, Homo sapiens
gcucugauaugcauuugga

SEQ ID NO: 946547 - RNA, 19 nt, Homo sapiens
caagaagauuggaagaaau

SEQ ID NO: 946548 - RNA, 19 nt, Homo sapiens
acacuaaggccuagaguuu

SEQ ID NO: 946549 - RNA, 19 nt, Homo sapiens
gauguugaaguaaggauua

SEQ ID NO: 946550 - RNA, 19 nt, Homo sapiens
cuacaagaauucugguuug

SEQ ID NO: 946551 - RNA, 19 nt, Homo sapiens
ggagaucgaguaccaaguu

SEQ ID NO: 946552 - RNA, 19 nt, Homo sapiens
gcaaauuuacaguaccaua

SEQ ID NO: 946553 - RNA, 19 nt, Homo sapiens
gugaauaacccauauauac

SEQ ID NO: 946554 - RNA, 19 nt, Homo sapiens
cauauuagcagaaagcauu

SEQ ID NO: 946555 - RNA, 19 nt, Homo sapiens
gaagauaagaggaaaagua

SEQ ID NO: 946556 - RNA, 19 nt, Homo sapiens
gaacaagaagauuggaaga

SEQ ID NO: 946557 - RNA, 19 nt, Homo sapiens
gauuacauguucugcuuug

SEQ ID NO: 946558 - RNA, 19 nt, Homo sapiens
gagaucgaguaccaaguuu

SEQ ID NO: 946559 - RNA, 19 nt, Homo sapiens
aauguaagcccuacuguaa

SEQ ID NO: 946560 - RNA, 19 nt, Homo sapiens
uaaaugccguauaugauca

SEQ ID NO: 946561 - RNA, 19 nt, Homo sapiens
aaagcaggguacagauaua

SEQ ID NO: 946562 - RNA, 19 nt, Homo sapiens
uaagauccuugccuaugaa

SEQ ID NO: 946563 - RNA, 19 nt, Homo sapiens
gcucuaagaauuaucagaa

SEQ ID NO: 946564 - RNA, 19 nt, Homo sapiens
auaugcaucucuccuauaa

SEQ ID NO: 946565 - RNA, 19 nt, Homo sapiens
cuuauaaacagccaucuua

SEQ ID NO: 946566 - RNA, 19 nt, Homo sapiens
gauaugcauuuggaugauu

SEQ ID NO: 946567 - RNA, 19 nt, Homo sapiens
uguacucucugacuccuua

SEQ ID NO: 946568 - RNA, 19 nt, Homo sapiens
aacauagacucccaaguuu

SEQ ID NO: 946569 - RNA, 19 nt, Homo sapiens
ggacauguuuucucuuuga

SEQ ID NO: 946570 - RNA, 19 nt, Homo sapiens
gagagugauuucauuuaca

SEQ ID NO: 946571 - RNA, 19 nt, Homo sapiens
uaaaucaccugagaauuac

SEQ ID NO: 946572 - RNA, 19 nt, Homo sapiens
ugaaguuggugauuacaug

SEQ ID NO: 946573 - RNA, 19 nt, Homo sapiens
auaagauccuugccuauga

SEQ ID NO: 946574 - RNA, 19 nt, Homo sapiens
guaaaugccguauaugauc

SEQ ID NO: 946575 - RNA, 19 nt, Homo sapiens
caauaaugauaaccagaga

SEQ ID NO: 946576 - RNA, 19 nt, Homo sapiens
gcaucucuccuauaaugua

SEQ ID NO: 946577 - RNA, 19 nt, Homo sapiens
ucuggucuaugguuaauuu

SEQ ID NO: 946578 - RNA, 19 nt, Homo sapiens
gugauuacauguucugcuu

SEQ ID NO: 946579 - RNA, 19 nt, Homo sapiens
cagagagugauuucauuua

SEQ ID NO: 946580 - RNA, 19 nt, Homo sapiens
guuuaugacuacauuguga

SEQ ID NO: 946581 - RNA, 19 nt, Homo sapiens
augcggcaguuacaaauua

SEQ ID NO: 946582 - RNA, 19 nt, Homo sapiens
uaaaugcggcaguuacaaa

SEQ ID NO: 946583 - RNA, 19 nt, Homo sapiens
caaacuagaguacguaaca

SEQ ID NO: 946584 - RNA, 19 nt, Homo sapiens
gcacauacaaauucugcuu

SEQ ID NO: 946585 - RNA, 19 nt, Homo sapiens
aaugagcacuuacaauugu

SEQ ID NO: 946586 - RNA, 19 nt, Homo sapiens
guuaugcuguucuuucaug

SEQ ID NO: 946587 - RNA, 19 nt, Homo sapiens
uaaagcaggguacagauau

SEQ ID NO: 946588 - RNA, 19 nt, Homo sapiens
ccagagagugauuucauuu

SEQ ID NO: 946589 - RNA, 19 nt, Homo sapiens
caucucuccuauaauguaa

SEQ ID NO: 946590 - RNA, 19 nt, Homo sapiens
uuaacugaaugaagccaua

SEQ ID NO: 946591 - RNA, 19 nt, Homo sapiens
uagaguacguaacauugaa

SEQ ID NO: 946592 - RNA, 19 nt, Homo sapiens
ggucuaugguuaauuuagu

SEQ ID NO: 946593 - RNA, 19 nt, Homo sapiens
gcacaagaacaagaagauu

SEQ ID NO: 946594 - RNA, 19 nt, Homo sapiens
gaacaaagaaaaucagaug

SEQ ID NO: 946595 - RNA, 19 nt, Homo sapiens
gguauccucugcaacacuu

SEQ ID NO: 946596 - RNA, 19 nt, Homo sapiens
augacuacauugugaguua

SEQ ID NO: 946597 - RNA, 19 nt, Homo sapiens
ucagaaacaggaaagaauu

SEQ ID NO: 946598 - RNA, 19 nt, Homo sapiens
caugauugcugacuuggau

SEQ ID NO: 946599 - RNA, 19 nt, Homo sapiens
gaggguguuuguaauuuua

SEQ ID NO: 946600 - RNA, 19 nt, Homo sapiens
ugaguaagcuguuuaucac

SEQ ID NO: 946601 - RNA, 19 nt, Homo sapiens
gauggagcaggauuagaua

SEQ ID NO: 946602 - RNA, 19 nt, Homo sapiens
gguaaaugccguauaugau

SEQ ID NO: 946603 - RNA, 19 nt, Homo sapiens
ucaaagaaaucgauacgua

SEQ ID NO: 946604 - RNA, 19 nt, Homo sapiens
caaaggaucuggaggcauu

SEQ ID NO: 946605 - RNA, 19 nt, Homo sapiens
gaacauaacaguccaggaa

SEQ ID NO: 946606 - RNA, 19 nt, Homo sapiens
ggaaagcguuauaauguug

SEQ ID NO: 946607 - RNA, 19 nt, Homo sapiens
gcaaauugauuccuguuau

SEQ ID NO: 946608 - RNA, 19 nt, Homo sapiens
gacaugcacuaguggauua

SEQ ID NO: 946609 - RNA, 19 nt, Homo sapiens
gaucucaaguucaacaauu

SEQ ID NO: 946610 - RNA, 19 nt, Homo sapiens
uguauggucugguuuguua

SEQ ID NO: 946611 - RNA, 19 nt, Homo sapiens
gcacaacugcaccaaauuu

SEQ ID NO: 946612 - RNA, 19 nt, Homo sapiens
gcaugaaucucagcaaguu

SEQ ID NO: 946613 - RNA, 19 nt, Homo sapiens
cuagcagacuuuacaauaa

SEQ ID NO: 946614 - RNA, 19 nt, Homo sapiens
caauggaucucaaguucaa

SEQ ID NO: 946615 - RNA, 19 nt, Homo sapiens
agggaacaaucaucaauua

SEQ ID NO: 946616 - RNA, 19 nt, Homo sapiens
gaaaugguauuguauucgu

SEQ ID NO: 946617 - RNA, 19 nt, Homo sapiens
caaagaaaucgauacguaa

SEQ ID NO: 946618 - RNA, 19 nt, Homo sapiens
ggauugacaugcacuagug

SEQ ID NO: 946619 - RNA, 19 nt, Homo sapiens
caaauugauuccuguuaug

SEQ ID NO: 946620 - RNA, 19 nt, Homo sapiens
cagcacaacugcaccaaau

SEQ ID NO: 946621 - RNA, 19 nt, Homo sapiens
gugggcagauuucauauga

SEQ ID NO: 946622 - RNA, 19 nt, Homo sapiens
gaucuccucuccuccagaa

SEQ ID NO: 946623 - RNA, 19 nt, Homo sapiens
caaggaaagcguuauaaug

SEQ ID NO: 946624 - RNA, 19 nt, Homo sapiens
caaacaaugucaccacaca

SEQ ID NO: 946625 - RNA, 19 nt, Homo sapiens
guuauaauguugcagaugu

SEQ ID NO: 946626 - RNA, 19 nt, Homo sapiens
caagacuaauuggcuauaa

SEQ ID NO: 946627 - RNA, 19 nt, Homo sapiens
agagaaagcuaugaaacuu

SEQ ID NO: 946628 - RNA, 19 nt, Homo sapiens
gaauuacccuacccaaguc

SEQ ID NO: 946629 - RNA, 19 nt, Homo sapiens
uguaauuccuagcaguuua

SEQ ID NO: 946630 - RNA, 19 nt, Homo sapiens
ggaggagaauaccaggaaa

SEQ ID NO: 946631 - RNA, 19 nt, Homo sapiens
guacuuggcaugaaucuca

SEQ ID NO: 946632 - RNA, 19 nt, Homo sapiens
gcagaugccgucauuggaa

SEQ ID NO: 946633 - RNA, 19 nt, Homo sapiens
cuaauagaacuucagcuua

SEQ ID NO: 946634 - RNA, 19 nt, Homo sapiens
guugaagucuggagagaau

SEQ ID NO: 946635 - RNA, 19 nt, Homo sapiens
gcauugcuaucccauuugu

SEQ ID NO: 946636 - RNA, 19 nt, Homo sapiens
gauaaacaaaucaguggaa

SEQ ID NO: 946637 - RNA, 19 nt, Homo sapiens
ggauuaggcccugcaguaa

SEQ ID NO: 946638 - RNA, 19 nt, Homo sapiens
cuucagagcauuuguuuga

SEQ ID NO: 946639 - RNA, 19 nt, Homo sapiens
uaacaauggaucucaaguu

SEQ ID NO: 946640 - RNA, 19 nt, Homo sapiens
agaaaucgauacguaauag

SEQ ID NO: 946641 - RNA, 19 nt, Homo sapiens
ccauuguacuuucguuuau

SEQ ID NO: 946642 - RNA, 19 nt, Homo sapiens
aaggaaagcguuauaaugu

SEQ ID NO: 946643 - RNA, 19 nt, Homo sapiens
ucuagcagacuuuacaaua

SEQ ID NO: 946644 - RNA, 19 nt, Homo sapiens
ugacugacuuccaaagcaa

SEQ ID NO: 946645 - RNA, 19 nt, Homo sapiens
aggcauugcuaucccauuu

SEQ ID NO: 946646 - RNA, 19 nt, Homo sapiens
cagaugccgucauuggaaa

SEQ ID NO: 946647 - RNA, 19 nt, Homo sapiens
uaugagccuuggccugaua

SEQ ID NO: 946648 - RNA, 19 nt, Homo sapiens
agaugugucugcugccaua

SEQ ID NO: 946649 - RNA, 19 nt, Homo sapiens
gaagcaagaaagucaagga

SEQ ID NO: 946650 - RNA, 19 nt, Homo sapiens
gguauuguauucguauuca

SEQ ID NO: 946651 - RNA, 19 nt, Homo sapiens
aacaauggaucucaaguuc

SEQ ID NO: 946652 - RNA, 19 nt, Homo sapiens
gcaagacuaauuggcuaua

SEQ ID NO: 946653 - RNA, 19 nt, Homo sapiens
ccuagcaguuuauugagaa

SEQ ID NO: 946654 - RNA, 19 nt, Homo sapiens
gggaacaaucaucaauuaa

SEQ ID NO: 946655 - RNA, 19 nt, Homo sapiens
caacugcaccaaauuucaa

SEQ ID NO: 946656 - RNA, 19 nt, Homo sapiens
agaaggagcguucgaggaa

SEQ ID NO: 946657 - RNA, 19 nt, Homo sapiens
gaaggagcguucgaggaau

SEQ ID NO: 946658 - RNA, 19 nt, Homo sapiens
ugaauuacccuacccaagu

SEQ ID NO: 946659 - RNA, 19 nt, Homo sapiens
ccacacaucaagucaguug

SEQ ID NO: 946660 - RNA, 19 nt, Homo sapiens
gcauuuguuugacugacuu

SEQ ID NO: 946661 - RNA, 19 nt, Homo sapiens
gcaguaacauuuugugcaa

SEQ ID NO: 946662 - RNA, 19 nt, Homo sapiens
uggaaauguucaagagaaa

SEQ ID NO: 946663 - RNA, 19 nt, Homo sapiens
gauacguaauagcagauug

SEQ ID NO: 946664 - RNA, 19 nt, Homo sapiens
ugacggguguggugcuuau

SEQ ID NO: 946665 - RNA, 19 nt, Homo sapiens
ucaauaugaaggacuguaa

SEQ ID NO: 946666 - RNA, 19 nt, Homo sapiens
acagugauuguccuauuua

SEQ ID NO: 946667 - RNA, 19 nt, Homo sapiens
caaaucaguggaagcaaga

SEQ ID NO: 946668 - RNA, 19 nt, Homo sapiens
aggaaagcguuauaauguu

SEQ ID NO: 946669 - RNA, 19 nt, Homo sapiens
gcaguuaaucaaggcauaa

SEQ ID NO: 946670 - RNA, 19 nt, Homo sapiens
gaguugaagucuggagaga

SEQ ID NO: 946671 - RNA, 19 nt, Homo sapiens
gaccauguguugcaagacu

SEQ ID NO: 946672 - RNA, 19 nt, Homo sapiens
cauaaugcuucuaauucug

SEQ ID NO: 946673 - RNA, 19 nt, Homo sapiens
uuggaaauguucaagagaa

SEQ ID NO: 946674 - RNA, 19 nt, Homo sapiens
caaaagacauacagaacau

SEQ ID NO: 946675 - RNA, 19 nt, Homo sapiens
gaaacgggugauucccuuu

SEQ ID NO: 946676 - RNA, 19 nt, Homo sapiens
agacuaccaucacuguaug

SEQ ID NO: 946677 - RNA, 19 nt, Homo sapiens
caguauguauggucugguu

SEQ ID NO: 946678 - RNA, 19 nt, Homo sapiens
uuuggaaucuccuuuguuc

SEQ ID NO: 946679 - RNA, 19 nt, Homo sapiens
uggauuaggcccugcagua

SEQ ID NO: 946680 - RNA, 19 nt, Homo sapiens
caagugcugcaaauugauu

SEQ ID NO: 946681 - RNA, 19 nt, Homo sapiens
ugaagucuggagagaauaa

SEQ ID NO: 946682 - RNA, 19 nt, Homo sapiens
cagugauuguccuauuuaa

SEQ ID NO: 946683 - RNA, 19 nt, Homo sapiens
cuugguauauuucucaaug

SEQ ID NO: 946684 - RNA, 19 nt, Homo sapiens
guucggaccuaugguuaug

SEQ ID NO: 946685 - RNA, 19 nt, Homo sapiens
gagaaagcuaugaaacuuc

SEQ ID NO: 946686 - RNA, 19 nt, Homo sapiens
uccuguggcugguaccuua

SEQ ID NO: 946687 - RNA, 19 nt, Homo sapiens
uaagggaacaaucaucaau

SEQ ID NO: 946688 - RNA, 19 nt, Homo sapiens
ucucaauguuuacagcaaa

SEQ ID NO: 946689 - RNA, 19 nt, Homo sapiens
ggucugguuuguuaguugu

SEQ ID NO: 946690 - RNA, 19 nt, Homo sapiens
cugaaaugguauuguauuc

SEQ ID NO: 946691 - RNA, 19 nt, Homo sapiens
gaaacuucauaaugcuucu

SEQ ID NO: 946692 - RNA, 19 nt, Homo sapiens
ucaagagaaagcuaugaaa

SEQ ID NO: 946693 - RNA, 19 nt, Homo sapiens
cauauguguugcuggaguu

SEQ ID NO: 946694 - RNA, 19 nt, Homo sapiens
cauaauggcauggacuuga

SEQ ID NO: 946695 - RNA, 19 nt, Homo sapiens
gcaguuuauugagaauuuc

SEQ ID NO: 946696 - RNA, 19 nt, Homo sapiens
aaacaaaucaguggaagca

SEQ ID NO: 946697 - RNA, 19 nt, Homo sapiens
caagagaaagcuaugaaac

SEQ ID NO: 946698 - RNA, 19 nt, Homo sapiens
ucaaggaaagcguuauaau

SEQ ID NO: 946699 - RNA, 19 nt, Homo sapiens
aaaccuacaugauaauagc

SEQ ID NO: 946700 - RNA, 19 nt, Homo sapiens
ccuaauagaacuucagcuu

SEQ ID NO: 946701 - RNA, 19 nt, Homo sapiens
uuacugggauugacaugca

SEQ ID NO: 946702 - RNA, 19 nt, Homo sapiens
guaauuccuagcaguuuau

SEQ ID NO: 946703 - RNA, 19 nt, Homo sapiens
ggaagaggcuauucagauu

SEQ ID NO: 946704 - RNA, 19 nt, Homo sapiens
uagaagaacuggaugaauu

SEQ ID NO: 946705 - RNA, 19 nt, Homo sapiens
gaaagaacuugaacuuagu

SEQ ID NO: 946706 - RNA, 19 nt, Homo sapiens
ccaaagauguuaacugcaa

SEQ ID NO: 946707 - RNA, 19 nt, Homo sapiens
gaacuugaacuuaguguga

SEQ ID NO: 946708 - RNA, 19 nt, Homo sapiens
gaagaggcuauucagauua

SEQ ID NO: 946709 - RNA, 19 nt, Homo sapiens
agaaagaacuugaacuuag

SEQ ID NO: 946710 - RNA, 19 nt, Homo sapiens
gaagaagacuagagaucug

SEQ ID NO: 946711 - RNA, 19 nt, Homo sapiens
gaacuuagugugaagaaga

SEQ ID NO: 946712 - RNA, 19 nt, Homo sapiens
caaaugcuucuguuucuua

SEQ ID NO: 946713 - RNA, 19 nt, Homo sapiens
caaagaaagacacuuguuu

SEQ ID NO: 946714 - RNA, 19 nt, Homo sapiens
gaagguuuaucgucuugaa

SEQ ID NO: 946715 - RNA, 19 nt, Homo sapiens
uggcuuaucugcauucaaa

SEQ ID NO: 946716 - RNA, 19 nt, Homo sapiens
caaguagucaggagaauaa

SEQ ID NO: 946717 - RNA, 19 nt, Homo sapiens
gagacuauguggaucauuc

SEQ ID NO: 946718 - RNA, 19 nt, Homo sapiens
caacauaugaucaccagaa

SEQ ID NO: 946719 - RNA, 19 nt, Homo sapiens
ggacaaacuaguaucuauu

SEQ ID NO: 946720 - RNA, 19 nt, Homo sapiens
gcagcaaaccuccuucuga

SEQ ID NO: 946721 - RNA, 19 nt, Homo sapiens
ccacaucauugucaaguuc

SEQ ID NO: 946722 - RNA, 19 nt, Homo sapiens
ggaaagacuggauaacaga

SEQ ID NO: 946723 - RNA, 19 nt, Homo sapiens
auacaaggcuguuuaaggu

SEQ ID NO: 946724 - RNA, 19 nt, Homo sapiens
gauaacagauugggauuuu

SEQ ID NO: 946725 - RNA, 19 nt, Homo sapiens
cagaaagaacuugaacuua

SEQ ID NO: 946726 - RNA, 19 nt, Homo sapiens
gcaaaugcuucuguuucuu

SEQ ID NO: 946727 - RNA, 19 nt, Homo sapiens
gugaagagauugccaaagc

SEQ ID NO: 946728 - RNA, 19 nt, Homo sapiens
ggucaaagaaagacacuug

SEQ ID NO: 946729 - RNA, 19 nt, Homo sapiens
caaagauguuaacugcaaa

SEQ ID NO: 946730 - RNA, 19 nt, Homo sapiens
uuaaagauguggguauaga

SEQ ID NO: 946731 - RNA, 19 nt, Homo sapiens
ugaauugccuccauugucu

SEQ ID NO: 946732 - RNA, 19 nt, Homo sapiens
ccagaugguuuaacucagu

SEQ ID NO: 946733 - RNA, 19 nt, Homo sapiens
cagauacccagaugguuua

SEQ ID NO: 946734 - RNA, 19 nt, Homo sapiens
ugaaugaacagucacagaa

SEQ ID NO: 946735 - RNA, 19 nt, Homo sapiens
ucagaaagaacuugaacuu

SEQ ID NO: 946736 - RNA, 19 nt, Homo sapiens
gauauccucugacaauugc

SEQ ID NO: 946737 - RNA, 19 nt, Homo sapiens
gacaaacuaguaucuauuc

SEQ ID NO: 946738 - RNA, 19 nt, Homo sapiens
aaaccuaacuacaucucuu

SEQ ID NO: 946739 - RNA, 19 nt, Homo sapiens
caaguucccacagguauuu

SEQ ID NO: 946740 - RNA, 19 nt, Homo sapiens
uuaccgagacguuugauuu

SEQ ID NO: 946741 - RNA, 19 nt, Homo sapiens
uugcacagauggucagaaa

SEQ ID NO: 946742 - RNA, 19 nt, Homo sapiens
gcaguauuguaaagugaau

SEQ ID NO: 946743 - RNA, 19 nt, Homo sapiens
uaguaucuauuccugauga

SEQ ID NO: 946744 - RNA, 19 nt, Homo sapiens
caacagauacccagauggu

SEQ ID NO: 946745 - RNA, 19 nt, Homo sapiens
cuaacuacaucucuuugga

SEQ ID NO: 946746 - RNA, 19 nt, Homo sapiens
acagauacccagaugguuu

SEQ ID NO: 946747 - RNA, 19 nt, Homo sapiens
gcagccaauuucagaggaa

SEQ ID NO: 946748 - RNA, 19 nt, Homo sapiens
uggacaaacuaguaucuau

SEQ ID NO: 946749 - RNA, 19 nt, Homo sapiens
aagcagauguugcacagau

SEQ ID NO: 946750 - RNA, 19 nt, Homo sapiens
cugagacucugcagaaguu

SEQ ID NO: 946751 - RNA, 19 nt, Homo sapiens
aagaggcuauucagauuau

SEQ ID NO: 946752 - RNA, 19 nt, Homo sapiens
aagcaggccucgccacaga

SEQ ID NO: 946753 - RNA, 19 nt, Homo sapiens
auucugagcuguuucuaga

SEQ ID NO: 946754 - RNA, 19 nt, Homo sapiens
cagaaucccaaagauguua

SEQ ID NO: 946755 - RNA, 19 nt, Homo sapiens
gaagacuagagaucuggua

SEQ ID NO: 946756 - RNA, 19 nt, Homo sapiens
gccaccagcuucauucaca

SEQ ID NO: 946757 - RNA, 19 nt, Homo sapiens
caaugcagccaauuucaga

SEQ ID NO: 946758 - RNA, 19 nt, Homo sapiens
ucacagaagacacaaaaua

SEQ ID NO: 946759 - RNA, 19 nt, Homo sapiens
acacuuguuucuuaccuau

SEQ ID NO: 946760 - RNA, 19 nt, Homo sapiens
aaugaacagucacagaaga

SEQ ID NO: 946761 - RNA, 19 nt, Homo sapiens
gaagagauugccaaagcau

SEQ ID NO: 946762 - RNA, 19 nt, Homo sapiens
gacacuuguuucuuaccua

SEQ ID NO: 946763 - RNA, 19 nt, Homo sapiens
ucaaguagucaggagaaua

SEQ ID NO: 946764 - RNA, 19 nt, Homo sapiens
ucaaagaaagacacuuguu

SEQ ID NO: 946765 - RNA, 19 nt, Homo sapiens
ucaccagaaucccaaagau

SEQ ID NO: 946766 - RNA, 19 nt, Homo sapiens
ggauaacagauugggauuu

SEQ ID NO: 946767 - RNA, 19 nt, Homo sapiens
gaaagacuggauaacagau

SEQ ID NO: 946768 - RNA, 19 nt, Homo sapiens
caggguggcuuaucugcau

SEQ ID NO: 946769 - RNA, 19 nt, Homo sapiens
ugaagaccaggguggcuua

SEQ ID NO: 946770 - RNA, 19 nt, Homo sapiens
uauagaggauaaccaacug

SEQ ID NO: 946771 - RNA, 19 nt, Homo sapiens
gaaugaacagucacagaag

SEQ ID NO: 946772 - RNA, 19 nt, Homo sapiens
uggaaagacuggauaacag

SEQ ID NO: 946773 - RNA, 19 nt, Homo sapiens
agaagaacuggaugaauug

SEQ ID NO: 946774 - RNA, 19 nt, Homo sapiens
caucaguacaggacuuuga

SEQ ID NO: 946775 - RNA, 19 nt, Homo sapiens
ugaagagauugccaaagca

SEQ ID NO: 946776 - RNA, 19 nt, Homo sapiens
ggaagagcacaguaugauc

SEQ ID NO: 946777 - RNA, 19 nt, Homo sapiens
gcacaacucacaaaacguu

SEQ ID NO: 946778 - RNA, 19 nt, Homo sapiens
ccaaggcugcuaacuggaa

SEQ ID NO: 946779 - RNA, 19 nt, Homo sapiens
aagacuggauaacagauug

SEQ ID NO: 946780 - RNA, 19 nt, Homo sapiens
gaggaagaggcuauucaga

SEQ ID NO: 946781 - RNA, 19 nt, Homo sapiens
gcucaaguagucaggagaa

SEQ ID NO: 946782 - RNA, 19 nt, Homo sapiens
uaugaagguuuaucgucuu

SEQ ID NO: 946783 - RNA, 19 nt, Homo sapiens
ggauuuguccaagauagaa

SEQ ID NO: 946784 - RNA, 19 nt, Homo sapiens
gaggcuauucagauuauug

SEQ ID NO: 946785 - RNA, 19 nt, Homo sapiens
ggaugaauugccuccauug

SEQ ID NO: 946786 - RNA, 19 nt, Homo sapiens
uauccagcuuugauucuga

SEQ ID NO: 946787 - RNA, 19 nt, Homo sapiens
uuugucagcccaacagaua

SEQ ID NO: 946788 - RNA, 19 nt, Homo sapiens
agaccaggguggcuuaucu

SEQ ID NO: 946789 - RNA, 19 nt, Homo sapiens
cauuaaugcugcacaacuc

SEQ ID NO: 946790 - RNA, 19 nt, Homo sapiens
ggguauagaggauaaccaa

SEQ ID NO: 946791 - RNA, 19 nt, Homo sapiens
cccaacagauacccagaug

SEQ ID NO: 946792 - RNA, 19 nt, Homo sapiens
ccucauuaaugcugcacaa

SEQ ID NO: 946793 - RNA, 19 nt, Homo sapiens
uguuuaaggucaaagaaag

SEQ ID NO: 946794 - RNA, 19 nt, Homo sapiens
ugaagaagacuagagaucu

SEQ ID NO: 946795 - RNA, 19 nt, Homo sapiens
guggaaagacuggauaaca

SEQ ID NO: 946796 - RNA, 19 nt, Homo sapiens
ggucagaaaagcaccauuu

SEQ ID NO: 946797 - RNA, 19 nt, Homo sapiens
ugggagcauuccugacaaa

SEQ ID NO: 946798 - RNA, 19 nt, Homo sapiens
gaugaauugccuccauugu

SEQ ID NO: 946799 - RNA, 19 nt, Homo sapiens
acuaguaucuauuccugau

SEQ ID NO: 946800 - RNA, 19 nt, Homo sapiens
ccagaaucccaaagauguu

SEQ ID NO: 946801 - RNA, 19 nt, Homo sapiens
gguuuaucgucuugaacuu

SEQ ID NO: 946802 - RNA, 19 nt, Homo sapiens
gugaagaagacuagagauc

SEQ ID NO: 946803 - RNA, 19 nt, Homo sapiens
ccuaauaucucaaguagaa

SEQ ID NO: 946804 - RNA, 19 nt, Homo sapiens
gaaaguaucgggacauuau

SEQ ID NO: 946805 - RNA, 19 nt, Homo sapiens
caagaacucuaucuacuga

SEQ ID NO: 946806 - RNA, 19 nt, Homo sapiens
gaaaugcaguuaacacauc

SEQ ID NO: 946807 - RNA, 19 nt, Homo sapiens
gcaaaugacacuucaauuc

SEQ ID NO: 946808 - RNA, 19 nt, Homo sapiens
gaaguugugagcuuuguuu

SEQ ID NO: 946809 - RNA, 19 nt, Homo sapiens
ggacauuauuggaugcuau

SEQ ID NO: 946810 - RNA, 19 nt, Homo sapiens
gacaagaacucuaucuacu

SEQ ID NO: 946811 - RNA, 19 nt, Homo sapiens
gcgggagacuugagaagaa

SEQ ID NO: 946812 - RNA, 19 nt, Homo sapiens
gaauccugcuuaucuguga

SEQ ID NO: 946813 - RNA, 19 nt, Homo sapiens
uauaaacucucuucacaag

SEQ ID NO: 946814 - RNA, 19 nt, Homo sapiens
gauguagaauccugcuuau

SEQ ID NO: 946815 - RNA, 19 nt, Homo sapiens
cacaucagcuggaccuauu

SEQ ID NO: 946816 - RNA, 19 nt, Homo sapiens
caaagcaguucaccucuac

SEQ ID NO: 946817 - RNA, 19 nt, Homo sapiens
gagaagaaaggccauggaa

SEQ ID NO: 946818 - RNA, 19 nt, Homo sapiens
gaugcuaucauuuguagaa

SEQ ID NO: 946819 - RNA, 19 nt, Homo sapiens
caaaugacacuucaauucu

SEQ ID NO: 946820 - RNA, 19 nt, Homo sapiens
acaaagcaguucaccucua

SEQ ID NO: 946821 - RNA, 19 nt, Homo sapiens
agaacucuaucuacugaaa

SEQ ID NO: 946822 - RNA, 19 nt, Homo sapiens
ggaccuauuucccgaaugc

SEQ ID NO: 946823 - RNA, 19 nt, Homo sapiens
guagaauccugcuuaucug

SEQ ID NO: 946824 - RNA, 19 nt, Homo sapiens
aguagaaggucaucagguu

SEQ ID NO: 946825 - RNA, 19 nt, Homo sapiens
uaccuaauaucucaaguag

SEQ ID NO: 946826 - RNA, 19 nt, Homo sapiens
guagaaggucaucagguuu

SEQ ID NO: 946827 - RNA, 19 nt, Homo sapiens
gaagacaagaacucuaucu

SEQ ID NO: 946828 - RNA, 19 nt, Homo sapiens
aagaaaguaucgggacauu

SEQ ID NO: 946829 - RNA, 19 nt, Homo sapiens
cagcaaaugacacuucaau

SEQ ID NO: 946830 - RNA, 19 nt, Homo sapiens
gcaguucaccucuacaaac

SEQ ID NO: 946831 - RNA, 19 nt, Homo sapiens
guugauccauuucagauac

SEQ ID NO: 946832 - RNA, 19 nt, Homo sapiens
agugauuguugauccauuu

SEQ ID NO: 946833 - RNA, 19 nt, Homo sapiens
uggaugcuaucauuuguag

SEQ ID NO: 946834 - RNA, 19 nt, Homo sapiens
gaacucuaucuacugaaau

SEQ ID NO: 946835 - RNA, 19 nt, Homo sapiens
gaagaaaguaucgggacau

SEQ ID NO: 946836 - RNA, 19 nt, Homo sapiens
uguagaauccugcuuaucu

SEQ ID NO: 946837 - RNA, 19 nt, Homo sapiens
ugauaaauccuacagugau

SEQ ID NO: 946838 - RNA, 19 nt, Homo sapiens
caagaauaccuaauaucuc

SEQ ID NO: 946839 - RNA, 19 nt, Homo sapiens
cgggagacuugagaagaaa

SEQ ID NO: 946840 - RNA, 19 nt, Homo sapiens
aaaugcaguuaacacauca

SEQ ID NO: 946841 - RNA, 19 nt, Homo sapiens
gaauaccuaauaucucaag

SEQ ID NO: 946842 - RNA, 19 nt, Homo sapiens
gugaaaugcaguuaacaca

SEQ ID NO: 946843 - RNA, 19 nt, Homo sapiens
agacaagaacucuaucuac

SEQ ID NO: 946844 - RNA, 19 nt, Homo sapiens
uauuggaugcuaucauuug

SEQ ID NO: 946845 - RNA, 19 nt, Homo sapiens
agaaaguaucgggacauua

SEQ ID NO: 946846 - RNA, 19 nt, Homo sapiens
cugcuuaucugugaaaugc

SEQ ID NO: 946847 - RNA, 19 nt, Homo sapiens
uagaaggucaucagguuuc

SEQ ID NO: 946848 - RNA, 19 nt, Homo sapiens
aagacaagaacucuaucua

SEQ ID NO: 946849 - RNA, 19 nt, Homo sapiens
uuccuuuccugacuauaaa

SEQ ID NO: 946850 - RNA, 19 nt, Homo sapiens
gggacauuauuggaugcua

SEQ ID NO: 946851 - RNA, 19 nt, Homo sapiens
ggaaguugugagcuuuguu

SEQ ID NO: 946852 - RNA, 19 nt, Homo sapiens
acaagaacucuaucuacug

SEQ ID NO: 946853 - RNA, 19 nt, Homo sapiens
cugauaaauccuacaguga

SEQ ID NO: 946854 - RNA, 19 nt, Homo sapiens
ugaaaugcaguuaacacau

SEQ ID NO: 946855 - RNA, 19 nt, Homo sapiens
gcagcaaacaaagcaguuc

SEQ ID NO: 946856 - RNA, 19 nt, Homo sapiens
gauuguugauccauuucag

SEQ ID NO: 946857 - RNA, 19 nt, Homo sapiens
cagugauuguugauccauu

SEQ ID NO: 946858 - RNA, 19 nt, Homo sapiens
ucugugaaaugcaguuaac

SEQ ID NO: 946859 - RNA, 19 nt, Homo sapiens
cagcaaacaaagcaguuca

SEQ ID NO: 946860 - RNA, 19 nt, Homo sapiens
acccuucuguuauuuaaag

SEQ ID NO: 946861 - RNA, 19 nt, Homo sapiens
gaaaggagcuggugaaugc

SEQ ID NO: 946862 - RNA, 19 nt, Homo sapiens
ccaaagagguuacuucaaa

SEQ ID NO: 946863 - RNA, 19 nt, Homo sapiens
gcauaaagguucuugaauu

SEQ ID NO: 946864 - RNA, 19 nt, Homo sapiens
caaaccaggugcuauguua

SEQ ID NO: 946865 - RNA, 19 nt, Homo sapiens
uaacuggacucuugacuuu

SEQ ID NO: 946866 - RNA, 19 nt, Homo sapiens
ggaaagcuaccauugauuu

SEQ ID NO: 946867 - RNA, 19 nt, Homo sapiens
uaaaguacccucaguguuu

SEQ ID NO: 946868 - RNA, 19 nt, Homo sapiens
ucacugaccucuuuaaauc

SEQ ID NO: 946869 - RNA, 19 nt, Homo sapiens
caagguggcuuuaagaauc

SEQ ID NO: 946870 - RNA, 19 nt, Homo sapiens
gaacagcagauucuacauu

SEQ ID NO: 946871 - RNA, 19 nt, Homo sapiens
cauaaagguucuugaauuc

SEQ ID NO: 946872 - RNA, 19 nt, Homo sapiens
gcaagaccaucuccuggaa

SEQ ID NO: 946873 - RNA, 19 nt, Homo sapiens
caacuacucuaccacucua

SEQ ID NO: 946874 - RNA, 19 nt, Homo sapiens
gaauaugccaaguaucuaa

SEQ ID NO: 946875 - RNA, 19 nt, Homo sapiens
aaaguacccucaguguuua

SEQ ID NO: 946876 - RNA, 19 nt, Homo sapiens
gacaggaacugcauaaagg

SEQ ID NO: 946877 - RNA, 19 nt, Homo sapiens
gaaccuuacugucucagau

SEQ ID NO: 946878 - RNA, 19 nt, Homo sapiens
ggaaagacccagaauaugc

SEQ ID NO: 946879 - RNA, 19 nt, Homo sapiens
gugcgaaauuuauugauga

SEQ ID NO: 946880 - RNA, 19 nt, Homo sapiens
ccaaguauacugaauucua

SEQ ID NO: 946881 - RNA, 19 nt, Homo sapiens
ggaauuugugcaauguuua

SEQ ID NO: 946882 - RNA, 19 nt, Homo sapiens
ggacaggaacugcauaaag

SEQ ID NO: 946883 - RNA, 19 nt, Homo sapiens
gcuccaauaugaacacuuc

SEQ ID NO: 946884 - RNA, 19 nt, Homo sapiens
gagguuacuucaaagacaa

SEQ ID NO: 946885 - RNA, 19 nt, Homo sapiens
uguauuaccugcuuugcaa

SEQ ID NO: 946886 - RNA, 19 nt, Homo sapiens
gaaagcuaccauugauuug

SEQ ID NO: 946887 - RNA, 19 nt, Homo sapiens
uaaagguucuugaauucug

SEQ ID NO: 946888 - RNA, 19 nt, Homo sapiens
acucuaagauguagugaga

SEQ ID NO: 946889 - RNA, 19 nt, Homo sapiens
uguuaaaccugaauuguuc

SEQ ID NO: 946890 - RNA, 19 nt, Homo sapiens
aaaccugaauuguucuuug

SEQ ID NO: 946891 - RNA, 19 nt, Homo sapiens
ugaaaacucuuccuaucua

SEQ ID NO: 946892 - RNA, 19 nt, Homo sapiens
caaagagguuacuucaaag

SEQ ID NO: 946893 - RNA, 19 nt, Homo sapiens
uggaauuugugcaauguuu

SEQ ID NO: 946894 - RNA, 19 nt, Homo sapiens
gcaggacaacuagugguua

SEQ ID NO: 946895 - RNA, 19 nt, Homo sapiens
gcaagguggcuuuaagaau

SEQ ID NO: 946896 - RNA, 19 nt, Homo sapiens
gcuagcuguuccugacaua

SEQ ID NO: 946897 - RNA, 19 nt, Homo sapiens
gauacaaacgaggcacuua

SEQ ID NO: 946898 - RNA, 19 nt, Homo sapiens
gcucagugugcgaaauuua

SEQ ID NO: 946899 - RNA, 19 nt, Homo sapiens
ccacaaaccaggugcuaug

SEQ ID NO: 946900 - RNA, 19 nt, Homo sapiens
gacagaugaugcuggaaau

SEQ ID NO: 946901 - RNA, 19 nt, Homo sapiens
guuaggugcuuuagaccaa

SEQ ID NO: 946902 - RNA, 19 nt, Homo sapiens
cuaccacucuacucuaaga

SEQ ID NO: 946903 - RNA, 19 nt, Homo sapiens
caccaaguauacugaauuc

SEQ ID NO: 946904 - RNA, 19 nt, Homo sapiens
acucuugacuuuagaacaa

SEQ ID NO: 946905 - RNA, 19 nt, Homo sapiens
ccacucuacucuaagaugu

SEQ ID NO: 946906 - RNA, 19 nt, Homo sapiens
aacagcagauucuacauug

SEQ ID NO: 946907 - RNA, 19 nt, Homo sapiens
cagaauaugccaaguaucu

SEQ ID NO: 946908 - RNA, 19 nt, Homo sapiens
cuaucuaccuuuauuaugg

SEQ ID NO: 946909 - RNA, 19 nt, Homo sapiens
cccagaauaugccaaguau

SEQ ID NO: 946910 - RNA, 19 nt, Homo sapiens
ugggaaagcuaccauugau

SEQ ID NO: 946911 - RNA, 19 nt, Homo sapiens
caaacgaggcacuuaauac

SEQ ID NO: 946912 - RNA, 19 nt, Homo sapiens
acaaacgaggcacuuaaua

SEQ ID NO: 946913 - RNA, 19 nt, Homo sapiens
uaugaacacuuccgaaagg

SEQ ID NO: 946914 - RNA, 19 nt, Homo sapiens
uaacuguauuaccugcuuu

SEQ ID NO: 946915 - RNA, 19 nt, Homo sapiens
cuuccuaucuaccuuuauu

SEQ ID NO: 946916 - RNA, 19 nt, Homo sapiens
ggugcuauguuaagugcuu

SEQ ID NO: 946917 - RNA, 19 nt, Homo sapiens
ggaguuggaauuugugcaa

SEQ ID NO: 946918 - RNA, 19 nt, Homo sapiens
gacuuuagaacaaacauga

SEQ ID NO: 946919 - RNA, 19 nt, Homo sapiens
uagcuguuccugacauaua

SEQ ID NO: 946920 - RNA, 19 nt, Homo sapiens
ccugaauuguucuuugauu

SEQ ID NO: 946921 - RNA, 19 nt, Homo sapiens
aauacuugcuuuacuggaa

SEQ ID NO: 946922 - RNA, 19 nt, Homo sapiens
ccaccaaguauacugaauu

SEQ ID NO: 946923 - RNA, 19 nt, Homo sapiens
aaccugaauuguucuuuga

SEQ ID NO: 946924 - RNA, 19 nt, Homo sapiens
aaacgaggcacuuaauaca

SEQ ID NO: 946925 - RNA, 19 nt, Homo sapiens
gcagagcagcaacagcaaa

SEQ ID NO: 946926 - RNA, 19 nt, Homo sapiens
guuuagccaacccaaauua

SEQ ID NO: 946927 - RNA, 19 nt, Homo sapiens
acgaggcacuuaauacaug

SEQ ID NO: 946928 - RNA, 19 nt, Homo sapiens
uaacacaucgggaaaauga

SEQ ID NO: 946929 - RNA, 19 nt, Homo sapiens
gcuggugaaugcucagugu

SEQ ID NO: 946930 - RNA, 19 nt, Homo sapiens
caggacaacuagugguuag

SEQ ID NO: 946931 - RNA, 19 nt, Homo sapiens
ugauuucccuguggauuug

SEQ ID NO: 946932 - RNA, 19 nt, Homo sapiens
gaauuugugcaauguuuag

SEQ ID NO: 946933 - RNA, 19 nt, Homo sapiens
agacagaugaugcuggaaa

SEQ ID NO: 946934 - RNA, 19 nt, Homo sapiens
gagcagcaacagcaaaaua

SEQ ID NO: 946935 - RNA, 19 nt, Homo sapiens
aauaugaacacuuccgaaa

SEQ ID NO: 946936 - RNA, 19 nt, Homo sapiens
agucauggcaggacaacua

SEQ ID NO: 946937 - RNA, 19 nt, Homo sapiens
ucuaagauguagugagagu

SEQ ID NO: 946938 - RNA, 19 nt, Homo sapiens
cagaucaacuacucuacca

SEQ ID NO: 946939 - RNA, 19 nt, Homo sapiens
auacaaacgaggcacuuaa

SEQ ID NO: 946940 - RNA, 19 nt, Homo sapiens
uaucuaaaguacccucagu

SEQ ID NO: 946941 - RNA, 19 nt, Homo sapiens
gcccaaagagguuacuuca

SEQ ID NO: 946942 - RNA, 19 nt, Homo sapiens
ucaguuggaguuggaauuu

SEQ ID NO: 946943 - RNA, 19 nt, Homo sapiens
gggaaagcuaccauugauu

SEQ ID NO: 946944 - RNA, 19 nt, Homo sapiens
uaagauguagugagaguag

SEQ ID NO: 946945 - RNA, 19 nt, Homo sapiens
auacuugcuuuacuggaaa

SEQ ID NO: 946946 - RNA, 19 nt, Homo sapiens
gaauucugcaggacaggaa

SEQ ID NO: 946947 - RNA, 19 nt, Homo sapiens
agagguuacuucaaagaca

SEQ ID NO: 946948 - RNA, 19 nt, Homo sapiens
ugugcgaaauuuauugaug

SEQ ID NO: 946949 - RNA, 19 nt, Homo sapiens
gcuuuaagaaucacugaau

SEQ ID NO: 946950 - RNA, 19 nt, Homo sapiens
aaagagguuacuucaaaga

SEQ ID NO: 946951 - RNA, 19 nt, Homo sapiens
guuggaauuugugcaaugu

SEQ ID NO: 946952 - RNA, 19 nt, Homo sapiens
uacauuggcagcacuauuc

SEQ ID NO: 946953 - RNA, 19 nt, Homo sapiens
gaaucacuguggccucacu

SEQ ID NO: 946954 - RNA, 19 nt, Homo sapiens
ugucucagaucaacuacuc

SEQ ID NO: 946955 - RNA, 19 nt, Homo sapiens
gaauuguucuuugauuucc

SEQ ID NO: 946956 - RNA, 19 nt, Homo sapiens
gguuucaguuggaguugga

SEQ ID NO: 946957 - RNA, 19 nt, Homo sapiens
cgaggcacuuaauacaugu

SEQ ID NO: 946958 - RNA, 19 nt, Homo sapiens
cuaaaguacccucaguguu

SEQ ID NO: 946959 - RNA, 19 nt, Homo sapiens
cgaaaggagcuggugaaug

SEQ ID NO: 946960 - RNA, 19 nt, Homo sapiens
aaaccaggugcuauguuaa

SEQ ID NO: 946961 - RNA, 19 nt, Homo sapiens
gaccauaucugcaacauga

SEQ ID NO: 946962 - RNA, 19 nt, Homo sapiens
gauauucacuuucaugaca

SEQ ID NO: 946963 - RNA, 19 nt, Homo sapiens
cgaagcagguccaaagaaa

SEQ ID NO: 946964 - RNA, 19 nt, Homo sapiens
guacuccucuccuaaagaa

SEQ ID NO: 946965 - RNA, 19 nt, Homo sapiens
agaaaguacuggagaaauu

SEQ ID NO: 946966 - RNA, 19 nt, Homo sapiens
caaagaaaguacuggagaa

SEQ ID NO: 946967 - RNA, 19 nt, Homo sapiens
ggacccaucauacauauuu

SEQ ID NO: 946968 - RNA, 19 nt, Homo sapiens
gagcaaagccauucgcuau

SEQ ID NO: 946969 - RNA, 19 nt, Homo sapiens
gcaaagccauucgcuauac

SEQ ID NO: 946970 - RNA, 19 nt, Homo sapiens
gcuauaucguggagaauga

SEQ ID NO: 946971 - RNA, 19 nt, Homo sapiens
gaaaguacuggagaaauug

SEQ ID NO: 946972 - RNA, 19 nt, Homo sapiens
gaaagauuacguugaugaa

SEQ ID NO: 946973 - RNA, 19 nt, Homo sapiens
ccucacagguuaugaaaca

SEQ ID NO: 946974 - RNA, 19 nt, Homo sapiens
caacguagccuggcagaga

SEQ ID NO: 946975 - RNA, 19 nt, Homo sapiens
cagaggcccugauaauguu

SEQ ID NO: 946976 - RNA, 19 nt, Homo sapiens
cgaguucuguuuccucuug

SEQ ID NO: 946977 - RNA, 19 nt, Homo sapiens
caacgcuucucaguaguuu

SEQ ID NO: 946978 - RNA, 19 nt, Homo sapiens
ucacaacacugcucuucug

SEQ ID NO: 946979 - RNA, 19 nt, Homo sapiens
gaaauugucagaaacuuac

SEQ ID NO: 946980 - RNA, 19 nt, Homo sapiens
uaccuggccuuguccauuu

SEQ ID NO: 946981 - RNA, 19 nt, Homo sapiens
gaaagacagcgucacaaca

SEQ ID NO: 946982 - RNA, 19 nt, Homo sapiens
aaugugagcuggaacuaug

SEQ ID NO: 946983 - RNA, 19 nt, Homo sapiens
gagaaauugucagaaacuu

SEQ ID NO: 946984 - RNA, 19 nt, Homo sapiens
uagaugacaugggcuauau

SEQ ID NO: 946985 - RNA, 19 nt, Homo sapiens
cuggagaaauugucagaaa

SEQ ID NO: 946986 - RNA, 19 nt, Homo sapiens
gaacagauuauggccuuug

SEQ ID NO: 946987 - RNA, 19 nt, Homo sapiens
ccacucaaagaacagauua

SEQ ID NO: 946988 - RNA, 19 nt, Homo sapiens
cugcaacgcuucucaguag

SEQ ID NO: 946989 - RNA, 19 nt, Homo sapiens
ccaggacccaucauacaua

SEQ ID NO: 946990 - RNA, 19 nt, Homo sapiens
gcccugauaauguuugaua

SEQ ID NO: 946991 - RNA, 19 nt, Homo sapiens
guugauaggugcagauggu

SEQ ID NO: 946992 - RNA, 19 nt, Homo sapiens
gcaccuuccagaccaaauu

SEQ ID NO: 946993 - RNA, 19 nt, Homo sapiens
caggacccaucauacauau

SEQ ID NO: 946994 - RNA, 19 nt, Homo sapiens
agaaagauuacguugauga

SEQ ID NO: 946995 - RNA, 19 nt, Homo sapiens
gcccuuggguucauauuac

SEQ ID NO: 946996 - RNA, 19 nt, Homo sapiens
ugaccagucugcuguugug

SEQ ID NO: 946997 - RNA, 19 nt, Homo sapiens
caacagggucagcuccauu

SEQ ID NO: 946998 - RNA, 19 nt, Homo sapiens
aaugaguacuccucuccua

SEQ ID NO: 946999 - RNA, 19 nt, Homo sapiens
cagaccaaauuguugauag

SEQ ID NO: 947000 - RNA, 19 nt, Homo sapiens
gcucgaagcagguccaaag

SEQ ID NO: 947001 - RNA, 19 nt, Homo sapiens
gcaacgcuucucaguaguu

SEQ ID NO: 947002 - RNA, 19 nt, Homo sapiens
ggagaaauugucagaaacu

SEQ ID NO: 947003 - RNA, 19 nt, Homo sapiens
ucagaaacuuacagcaaca

SEQ ID NO: 947004 - RNA, 19 nt, Homo sapiens
uggcuacucugcauuuauc

SEQ ID NO: 947005 - RNA, 19 nt, Homo sapiens
cauauuacccuaggugaug

SEQ ID NO: 947006 - RNA, 19 nt, Homo sapiens
caugagauacagagccuuu

SEQ ID NO: 947007 - RNA, 19 nt, Homo sapiens
gaguacuccucuccuaaag

SEQ ID NO: 947008 - RNA, 19 nt, Homo sapiens
ugaguacuccucuccuaaa

SEQ ID NO: 947009 - RNA, 19 nt, Homo sapiens
ggccacaaaugcagugucu

SEQ ID NO: 947010 - RNA, 19 nt, Homo sapiens
caccuugaguuccuugguu

SEQ ID NO: 947011 - RNA, 19 nt, Homo sapiens
gggacaugcugcugaguac

SEQ ID NO: 947012 - RNA, 19 nt, Homo sapiens
caucaugcaugcucucacu

SEQ ID NO: 947013 - RNA, 19 nt, Homo sapiens
aaagaaaguacuggagaaa

SEQ ID NO: 947014 - RNA, 19 nt, Homo sapiens
gaaugugagcuggaacuau

SEQ ID NO: 947015 - RNA, 19 nt, Homo sapiens
gcaacagggucagcuccau

SEQ ID NO: 947016 - RNA, 19 nt, Homo sapiens
gaagcagguccaaagaaag

SEQ ID NO: 947017 - RNA, 19 nt, Homo sapiens
guacggcagccuucaaugg

SEQ ID NO: 947018 - RNA, 19 nt, Homo sapiens
gcagcaccuuccagaccaa

SEQ ID NO: 947019 - RNA, 19 nt, Homo sapiens
gagugacgguucucuacag

SEQ ID NO: 947020 - RNA, 19 nt, Homo sapiens
cacagguuaugaaacagaa

SEQ ID NO: 947021 - RNA, 19 nt, Homo sapiens
caaaagccgaguucuguuu

SEQ ID NO: 947022 - RNA, 19 nt, Homo sapiens
ugucagaaacuuacagcaa

SEQ ID NO: 947023 - RNA, 19 nt, Homo sapiens
ucaugcaugcucucacuaa

SEQ ID NO: 947024 - RNA, 19 nt, Homo sapiens
gcccaggacccaucauaca

SEQ ID NO: 947025 - RNA, 19 nt, Homo sapiens
ccuaaagaaagauuacguu

SEQ ID NO: 947026 - RNA, 19 nt, Homo sapiens
ugucuccacucaaagaaca

SEQ ID NO: 947027 - RNA, 19 nt, Homo sapiens
ucacagguuaugaaacaga

SEQ ID NO: 947028 - RNA, 19 nt, Homo sapiens
ccucuuggguugggacaug

SEQ ID NO: 947029 - RNA, 19 nt, Homo sapiens
ucagacaccuugaguuccu

SEQ ID NO: 947030 - RNA, 19 nt, Homo sapiens
uaucagaggccacagaaaa

SEQ ID NO: 947031 - RNA, 19 nt, Homo sapiens
ggaguacggcaggcuguug

SEQ ID NO: 947032 - RNA, 19 nt, Homo sapiens
ccagaccaaauuguugaua

SEQ ID NO: 947033 - RNA, 19 nt, Homo sapiens
gcaguuggaggcugugucu

SEQ ID NO: 947034 - RNA, 19 nt, Homo sapiens
cagauuauggccuuugcaa

SEQ ID NO: 947035 - RNA, 19 nt, Homo sapiens
gcugcuacagacuuacuaa

SEQ ID NO: 947036 - RNA, 19 nt, Homo sapiens
acagaaagacagcgucaca

SEQ ID NO: 947037 - RNA, 19 nt, Homo sapiens
guuaugaaacagaaagaca

SEQ ID NO: 947038 - RNA, 19 nt, Homo sapiens
cuggugccaugcugcagua

SEQ ID NO: 947039 - RNA, 19 nt, Homo sapiens
uguggcuacucugcauuua

SEQ ID NO: 947040 - RNA, 19 nt, Homo sapiens
cuacaggagcaaagccauu

SEQ ID NO: 947041 - RNA, 19 nt, Homo sapiens
ugggcuauaucguggagaa

SEQ ID NO: 947042 - RNA, 19 nt, Homo sapiens
ugaacaugcagcagagcua

SEQ ID NO: 947043 - RNA, 19 nt, Homo sapiens
agaccaaauuguugauagg

SEQ ID NO: 947044 - RNA, 19 nt, Homo sapiens
uuagaugacaugggcuaua

SEQ ID NO: 947045 - RNA, 19 nt, Homo sapiens
uaugaccagucugcuguug

SEQ ID NO: 947046 - RNA, 19 nt, Homo sapiens
aagcagguccaaagaaagu

SEQ ID NO: 947047 - RNA, 19 nt, Homo sapiens
ggccuuguccauuuccuau

SEQ ID NO: 947048 - RNA, 19 nt, Homo sapiens
gaugacaugggcuauaucg

SEQ ID NO: 947049 - RNA, 19 nt, Homo sapiens
cugauaauguuugauaagg

SEQ ID NO: 947050 - RNA, 19 nt, Homo sapiens
uggagaaauugucagaaac

SEQ ID NO: 947051 - RNA, 19 nt, Homo sapiens
ggaccauaucugcaacaug

SEQ ID NO: 947052 - RNA, 19 nt, Homo sapiens
cccugauaauguuugauaa

SEQ ID NO: 947053 - RNA, 19 nt, Homo sapiens
ccauaucugcaacaugaga

SEQ ID NO: 947054 - RNA, 19 nt, Homo sapiens
ggauaauuuagaugacaug

SEQ ID NO: 947055 - RNA, 19 nt, Homo sapiens
aaagacagcgucacaacac

SEQ ID NO: 947056 - RNA, 19 nt, Homo sapiens
ugggacaugcugcugagua

SEQ ID NO: 947057 - RNA, 19 nt, Homo sapiens
ggacgcagcuaggcaguga

SEQ ID NO: 947058 - RNA, 19 nt, Homo sapiens
gcagaucaacgguggauuu

SEQ ID NO: 947059 - RNA, 19 nt, Homo sapiens
gaucaacgguggauuuggu

SEQ ID NO: 947060 - RNA, 19 nt, Homo sapiens
caucuuggcucccggauuc

SEQ ID NO: 947061 - RNA, 19 nt, Homo sapiens
ggagguuuaucacaagguu

SEQ ID NO: 947062 - RNA, 19 nt, Homo sapiens
caccggagguuuaucacaa

SEQ ID NO: 947063 - RNA, 19 nt, Homo sapiens
gagcggagccaccuucauc

SEQ ID NO: 947064 - RNA, 19 nt, Homo sapiens
acaaggaccucggcugaga

SEQ ID NO: 947065 - RNA, 19 nt, Homo sapiens
gagcccugcuggauugaug

SEQ ID NO: 947066 - RNA, 19 nt, Homo sapiens
ucaacgccaugcugccuuu

SEQ ID NO: 947067 - RNA, 19 nt, Homo sapiens
caagguuguuccucagauc

SEQ ID NO: 947068 - RNA, 19 nt, Homo sapiens
ucagaucccugugaagagu

SEQ ID NO: 947069 - RNA, 19 nt, Homo sapiens
ccucagaucccugugaaga

SEQ ID NO: 947070 - RNA, 19 nt, Homo sapiens
uggauuugguguugacuuc

SEQ ID NO: 947071 - RNA, 19 nt, Homo sapiens
ggccguagccacgaaguga

SEQ ID NO: 947072 - RNA, 19 nt, Homo sapiens
gcagcuaggcagugacaag

SEQ ID NO: 947073 - RNA, 19 nt, Homo sapiens
caacgguggauuugguguu

SEQ ID NO: 947074 - RNA, 19 nt, Homo sapiens
gauuugguguugacuucuc

SEQ ID NO: 947075 - RNA, 19 nt, Homo sapiens
cuucaucacccaccucuuc

SEQ ID NO: 947076 - RNA, 19 nt, Homo sapiens
gauccugcgcggagggaaa

SEQ ID NO: 947077 - RNA, 19 nt, Homo sapiens
ucaucgacgugcagaucaa

SEQ ID NO: 947078 - RNA, 19 nt, Homo sapiens
caucuuggacccagagaag

SEQ ID NO: 947079 - RNA, 19 nt, Homo sapiens
cagaucaacgguggauuug

SEQ ID NO: 947080 - RNA, 19 nt, Homo sapiens
ggcgguggcugggauaaac

SEQ ID NO: 947081 - RNA, 19 nt, Homo sapiens
aggacuugcuggccaccua

SEQ ID NO: 947082 - RNA, 19 nt, Homo sapiens
gagagcagguuucuuuaua

SEQ ID NO: 947083 - RNA, 19 nt, Homo sapiens
gcagguuucuuuauaguuu

SEQ ID NO: 947084 - RNA, 19 nt, Homo sapiens
ggugaaagcuguggucuaa

SEQ ID NO: 947085 - RNA, 19 nt, Homo sapiens
ugacaaagagcuuccauuu

SEQ ID NO: 947086 - RNA, 19 nt, Homo sapiens
ucagagagcagguuucuuu

SEQ ID NO: 947087 - RNA, 19 nt, Homo sapiens
gccagggacucaugacuuu

SEQ ID NO: 947088 - RNA, 19 nt, Homo sapiens
ucaaaugucuggucuuaag

SEQ ID NO: 947089 - RNA, 19 nt, Homo sapiens
ggaggaaggugacaaugag

SEQ ID NO: 947090 - RNA, 19 nt, Homo sapiens
cuucaaaugucuggucuua

SEQ ID NO: 947091 - RNA, 19 nt, Homo sapiens
acaaagagcuuccauuucc

SEQ ID NO: 947092 - RNA, 19 nt, Homo sapiens
gaacucggccuccagaauc

SEQ ID NO: 947093 - RNA, 19 nt, Homo sapiens
gagcagguuucuuuauagu

SEQ ID NO: 947094 - RNA, 19 nt, Homo sapiens
acaaguggcugacaaagag

SEQ ID NO: 947095 - RNA, 19 nt, Homo sapiens
uaaagggacugaguuugga

SEQ ID NO: 947096 - RNA, 19 nt, Homo sapiens
ggcaggaaauaaaugaaug

SEQ ID NO: 947097 - RNA, 19 nt, Homo sapiens
ucucuuugcuguauuugaa

SEQ ID NO: 947098 - RNA, 19 nt, Homo sapiens
caacuggagcuuccuguau

SEQ ID NO: 947099 - RNA, 19 nt, Homo sapiens
gggaggaaggugacaauga

SEQ ID NO: 947100 - RNA, 19 nt, Homo sapiens
gcuguccucuucaucuuga

SEQ ID NO: 947101 - RNA, 19 nt, Homo sapiens
ugaaagcuguggucuaacu

SEQ ID NO: 947102 - RNA, 19 nt, Homo sapiens
ggcaucaccuucuacaaca

SEQ ID NO: 947103 - RNA, 19 nt, Homo sapiens
cagggcaaauggcuuagaa

SEQ ID NO: 947104 - RNA, 19 nt, Homo sapiens
acaaugaggaggaggagua

SEQ ID NO: 947105 - RNA, 19 nt, Homo sapiens
agccaggccuccuucauuu

SEQ ID NO: 947106 - RNA, 19 nt, Homo sapiens
gagcgcugcauccaauuaa

SEQ ID NO: 947107 - RNA, 19 nt, Homo sapiens
cagccucacucucuccauu

SEQ ID NO: 947108 - RNA, 19 nt, Homo sapiens
ugacagccgagacucauuu

SEQ ID NO: 947109 - RNA, 19 nt, Homo sapiens
gguuugggcuucucugagu

SEQ ID NO: 947110 - RNA, 19 nt, Homo sapiens
gacaaagagcuuccauuuc

SEQ ID NO: 947111 - RNA, 19 nt, Homo sapiens
gccuggagccuucuucaaa

SEQ ID NO: 947112 - RNA, 19 nt, Homo sapiens
ggcuggugcuucucuacua

SEQ ID NO: 947113 - RNA, 19 nt, Homo sapiens
cagagagcagguuucuuua

SEQ ID NO: 947114 - RNA, 19 nt, Homo sapiens
aggcacagcagcuuucuaa

SEQ ID NO: 947115 - RNA, 19 nt, Homo sapiens
gcaccuggccgugaucuuc

SEQ ID NO: 947116 - RNA, 19 nt, Homo sapiens
gcaggaaauaaaugaaugu

SEQ ID NO: 947117 - RNA, 19 nt, Homo sapiens
ugugagcgcugcauccaau

SEQ ID NO: 947118 - RNA, 19 nt, Homo sapiens
gacgugggcuuguccaacu

SEQ ID NO: 947119 - RNA, 19 nt, Homo sapiens
ccuggagccuucuucaaau

SEQ ID NO: 947120 - RNA, 19 nt, Homo sapiens
cagcuguccucuucaucuu

SEQ ID NO: 947121 - RNA, 19 nt, Homo sapiens
gcaucaccuucuacaacaa

SEQ ID NO: 947122 - RNA, 19 nt, Homo sapiens
ggaggaggaguacuuugug

SEQ ID NO: 947123 - RNA, 19 nt, Homo sapiens
gcucuucccucucuuugcu

SEQ ID NO: 947124 - RNA, 19 nt, Homo sapiens
cuacaaguccacacaguuc

SEQ ID NO: 947125 - RNA, 19 nt, Homo sapiens
agagcagguuucuuuauag

SEQ ID NO: 947126 - RNA, 19 nt, Homo sapiens
gauucucgccuuugguuug

SEQ ID NO: 947127 - RNA, 19 nt, Homo sapiens
gggauucucgccuuugguu

SEQ ID NO: 947128 - RNA, 19 nt, Homo sapiens
gccgugaucuuccucuucu

SEQ ID NO: 947129 - RNA, 19 nt, Homo sapiens
uacaacaaguggcugacaa

SEQ ID NO: 947130 - RNA, 19 nt, Homo sapiens
gcuggcaggaaauaaauga

SEQ ID NO: 947131 - RNA, 19 nt, Homo sapiens
cuaaagggacugaguuugg

SEQ ID NO: 947132 - RNA, 19 nt, Homo sapiens
ugagcgcugcauccaauua

SEQ ID NO: 947133 - RNA, 19 nt, Homo sapiens
cccagaugcuccugcagaa

SEQ ID NO: 947134 - RNA, 19 nt, Homo sapiens
cgccagggcucaucauggu

SEQ ID NO: 947135 - RNA, 19 nt, Homo sapiens
ucaccugggcagugucuuu

SEQ ID NO: 947136 - RNA, 19 nt, Homo sapiens
ccuccacguugcccucaaa

SEQ ID NO: 947137 - RNA, 19 nt, Homo sapiens
agucugcacuuugcuguug

SEQ ID NO: 947138 - RNA, 19 nt, Homo sapiens
ccaacuggagcuuccugua

SEQ ID NO: 947139 - RNA, 19 nt, Homo sapiens
ggagccuucuucaaauguc

SEQ ID NO: 947140 - RNA, 19 nt, Homo sapiens
uugaaggucuccauuuguc

SEQ ID NO: 947141 - RNA, 19 nt, Homo sapiens
aacuggagcuuccuguaug

SEQ ID NO: 947142 - RNA, 19 nt, Homo sapiens
ccaucggcaucaccuucua

SEQ ID NO: 947143 - RNA, 19 nt, Homo sapiens
aagccaggccuccuucauu

SEQ ID NO: 947144 - RNA, 19 nt, Homo sapiens
gcucuuccugcacauugua

SEQ ID NO: 947145 - RNA, 19 nt, Homo sapiens
auuugaaggucuccauuug

SEQ ID NO: 947146 - RNA, 19 nt, Homo sapiens
cagguuucuuuauaguuug

SEQ ID NO: 947147 - RNA, 19 nt, Homo sapiens
ccaaggcacagcagcuuuc

SEQ ID NO: 947148 - RNA, 19 nt, Homo sapiens
ggagacguucuuggugaaa

SEQ ID NO: 947149 - RNA, 19 nt, Homo sapiens
gagacguucuuggugaaag

SEQ ID NO: 947150 - RNA, 19 nt, Homo sapiens
uauuugaaggucuccauuu

SEQ ID NO: 947151 - RNA, 19 nt, Homo sapiens
uguacacaaugaccaaauc

SEQ ID NO: 947152 - RNA, 19 nt, Homo sapiens
acaacaaguggcugacaaa

SEQ ID NO: 947153 - RNA, 19 nt, Homo sapiens
uggagacguucuuggugaa

SEQ ID NO: 947154 - RNA, 19 nt, Homo sapiens
ggcagugucuuuucucaga

SEQ ID NO: 947155 - RNA, 19 nt, Homo sapiens
gcgggauucucgccuuugg

SEQ ID NO: 947156 - RNA, 19 nt, Homo sapiens
ccucagcuguccucuucau

SEQ ID NO: 947157 - RNA, 19 nt, Homo sapiens
cuggagccuucuucaaaug

SEQ ID NO: 947158 - RNA, 19 nt, Homo sapiens
agagagcagguuucuuuau

SEQ ID NO: 947159 - RNA, 19 nt, Homo sapiens
gaaccuccagccucacucu

SEQ ID NO: 947160 - RNA, 19 nt, Homo sapiens
gcuggugcuucucuacuac

SEQ ID NO: 947161 - RNA, 19 nt, Homo sapiens
ccucuuccuuggcgggauu

SEQ ID NO: 947162 - RNA, 19 nt, Homo sapiens
ccgucucgcuguacacaau

SEQ ID NO: 947163 - RNA, 19 nt, Homo sapiens
ugaggaggaggaguacuuu

SEQ ID NO: 947164 - RNA, 19 nt, Homo sapiens
ugaacucggccuccagaau

SEQ ID NO: 947165 - RNA, 19 nt, Homo sapiens
ccgacuaccucagaagagu

SEQ ID NO: 947166 - RNA, 19 nt, Homo sapiens
gagccuucuucaaaugucu

SEQ ID NO: 947167 - RNA, 19 nt, Homo sapiens
caacaaguggcugacaaag

SEQ ID NO: 947168 - RNA, 19 nt, Homo sapiens
ccaagccagggacucauga

SEQ ID NO: 947169 - RNA, 19 nt, Homo sapiens
gaggaggaggaguacuuug

SEQ ID NO: 947170 - RNA, 19 nt, Homo sapiens
guauuugaaggucuccauu

SEQ ID NO: 947171 - RNA, 19 nt, Homo sapiens
aucuugaucuucucucuga

SEQ ID NO: 947172 - RNA, 19 nt, Homo sapiens
auccucagcuguccucuuc

SEQ ID NO: 947173 - RNA, 19 nt, Homo sapiens
agccgagacucauuuccaa

SEQ ID NO: 947174 - RNA, 19 nt, Homo sapiens
gggagugggcugguucuuc

SEQ ID NO: 947175 - RNA, 19 nt, Homo sapiens
gaccagccagggcaaaugg

SEQ ID NO: 947176 - RNA, 19 nt, Homo sapiens
cugagaaaaucuuccguuu

SEQ ID NO: 947177 - RNA, 19 nt, Homo sapiens
gagagcagguuucuuuaua

SEQ ID NO: 947178 - RNA, 19 nt, Homo sapiens
gcagguuucuuuauaguuu

SEQ ID NO: 947179 - RNA, 19 nt, Homo sapiens
ggugaaagcuguggucuaa

SEQ ID NO: 947180 - RNA, 19 nt, Homo sapiens
ugacaaagagcuuccauuu

SEQ ID NO: 947181 - RNA, 19 nt, Homo sapiens
ucagagagcagguuucuuu

SEQ ID NO: 947182 - RNA, 19 nt, Homo sapiens
gccagggacucaugacuuu

SEQ ID NO: 947183 - RNA, 19 nt, Homo sapiens
ucaaaugucuggucuuaag

SEQ ID NO: 947184 - RNA, 19 nt, Homo sapiens
ggaggaaggugacaaugag

SEQ ID NO: 947185 - RNA, 19 nt, Homo sapiens
cuucaaaugucuggucuua

SEQ ID NO: 947186 - RNA, 19 nt, Homo sapiens
acaaagagcuuccauuucc

SEQ ID NO: 947187 - RNA, 19 nt, Homo sapiens
gaacucggccuccagaauc

SEQ ID NO: 947188 - RNA, 19 nt, Homo sapiens
gagcagguuucuuuauagu

SEQ ID NO: 947189 - RNA, 19 nt, Homo sapiens
acaaguggcugacaaagag

SEQ ID NO: 947190 - RNA, 19 nt, Homo sapiens
uaaagggacugaguuugga

SEQ ID NO: 947191 - RNA, 19 nt, Homo sapiens
ggcaggaaauaaaugaaug

SEQ ID NO: 947192 - RNA, 19 nt, Homo sapiens
ucucuuugcuguauuugaa

SEQ ID NO: 947193 - RNA, 19 nt, Homo sapiens
caacuggagcuuccuguau

SEQ ID NO: 947194 - RNA, 19 nt, Homo sapiens
gggaggaaggugacaauga

SEQ ID NO: 947195 - RNA, 19 nt, Homo sapiens
gcuguccucuucaucuuga

SEQ ID NO: 947196 - RNA, 19 nt, Homo sapiens
ugaaagcuguggucuaacu

SEQ ID NO: 947197 - RNA, 19 nt, Homo sapiens
ggcaucaccuucuacaaca

SEQ ID NO: 947198 - RNA, 19 nt, Homo sapiens
cagggcaaauggcuuagaa

SEQ ID NO: 947199 - RNA, 19 nt, Homo sapiens
acaaugaggaggaggagua

SEQ ID NO: 947200 - RNA, 19 nt, Homo sapiens
agccaggccuccuucauuu

SEQ ID NO: 947201 - RNA, 19 nt, Homo sapiens
gagcgcugcauccaauuaa

SEQ ID NO: 947202 - RNA, 19 nt, Homo sapiens
cagccucacucucuccauu

SEQ ID NO: 947203 - RNA, 19 nt, Homo sapiens
ugacagccgagacucauuu

SEQ ID NO: 947204 - RNA, 19 nt, Homo sapiens
gguuugggcuucucugagu

SEQ ID NO: 947205 - RNA, 19 nt, Homo sapiens
gacaaagagcuuccauuuc

SEQ ID NO: 947206 - RNA, 19 nt, Homo sapiens
gccuggagccuucuucaaa

SEQ ID NO: 947207 - RNA, 19 nt, Homo sapiens
ggcuggugcuucucuacua

SEQ ID NO: 947208 - RNA, 19 nt, Homo sapiens
cagagagcagguuucuuua

SEQ ID NO: 947209 - RNA, 19 nt, Homo sapiens
aggcacagcagcuuucuaa

SEQ ID NO: 947210 - RNA, 19 nt, Homo sapiens
gcaccuggccgugaucuuc

SEQ ID NO: 947211 - RNA, 19 nt, Homo sapiens
gcaggaaauaaaugaaugu

SEQ ID NO: 947212 - RNA, 19 nt, Homo sapiens
ugugagcgcugcauccaau

SEQ ID NO: 947213 - RNA, 19 nt, Homo sapiens
gacgugggcuuguccaacu

SEQ ID NO: 947214 - RNA, 19 nt, Homo sapiens
ccuggagccuucuucaaau

SEQ ID NO: 947215 - RNA, 19 nt, Homo sapiens
cagcuguccucuucaucuu

SEQ ID NO: 947216 - RNA, 19 nt, Homo sapiens
gcaucaccuucuacaacaa

SEQ ID NO: 947217 - RNA, 19 nt, Homo sapiens
ggaggaggaguacuuugug

SEQ ID NO: 947218 - RNA, 19 nt, Homo sapiens
gcucuucccucucuuugcu

SEQ ID NO: 947219 - RNA, 19 nt, Homo sapiens
agagcagguuucuuuauag

SEQ ID NO: 947220 - RNA, 19 nt, Homo sapiens
gauucucgccuuugguuug

SEQ ID NO: 947221 - RNA, 19 nt, Homo sapiens
gggauucucgccuuugguu

SEQ ID NO: 947222 - RNA, 19 nt, Homo sapiens
gccgugaucuuccucuucu

SEQ ID NO: 947223 - RNA, 19 nt, Homo sapiens
uacaacaaguggcugacaa

SEQ ID NO: 947224 - RNA, 19 nt, Homo sapiens
gcuggcaggaaauaaauga

SEQ ID NO: 947225 - RNA, 19 nt, Homo sapiens
cuaaagggacugaguuugg

SEQ ID NO: 947226 - RNA, 19 nt, Homo sapiens
ugagcgcugcauccaauua

SEQ ID NO: 947227 - RNA, 19 nt, Homo sapiens
cccagaugcuccugcagaa

SEQ ID NO: 947228 - RNA, 19 nt, Homo sapiens
cgccagggcucaucauggu

SEQ ID NO: 947229 - RNA, 19 nt, Homo sapiens
ucaccugggcagugucuuu

SEQ ID NO: 947230 - RNA, 19 nt, Homo sapiens
ccuccacguugcccucaaa

SEQ ID NO: 947231 - RNA, 19 nt, Homo sapiens
agucugcacuuugcuguug

SEQ ID NO: 947232 - RNA, 19 nt, Homo sapiens
ccaacuggagcuuccugua

SEQ ID NO: 947233 - RNA, 19 nt, Homo sapiens
ggagccuucuucaaauguc

SEQ ID NO: 947234 - RNA, 19 nt, Homo sapiens
uugaaggucuccauuuguc

SEQ ID NO: 947235 - RNA, 19 nt, Homo sapiens
aacuggagcuuccuguaug

SEQ ID NO: 947236 - RNA, 19 nt, Homo sapiens
ccaucggcaucaccuucua

SEQ ID NO: 947237 - RNA, 19 nt, Homo sapiens
aagccaggccuccuucauu

SEQ ID NO: 947238 - RNA, 19 nt, Homo sapiens
gcucuuccugcacauugua

SEQ ID NO: 947239 - RNA, 19 nt, Homo sapiens
auuugaaggucuccauuug

SEQ ID NO: 947240 - RNA, 19 nt, Homo sapiens
cagguuucuuuauaguuug

SEQ ID NO: 947241 - RNA, 19 nt, Homo sapiens
ccaaggcacagcagcuuuc

SEQ ID NO: 947242 - RNA, 19 nt, Homo sapiens
ggagacguucuuggugaaa

SEQ ID NO: 947243 - RNA, 19 nt, Homo sapiens
gagacguucuuggugaaag

SEQ ID NO: 947244 - RNA, 19 nt, Homo sapiens
uauuugaaggucuccauuu

SEQ ID NO: 947245 - RNA, 19 nt, Homo sapiens
uguacacaaugaccaaauc

SEQ ID NO: 947246 - RNA, 19 nt, Homo sapiens
acaacaaguggcugacaaa

SEQ ID NO: 947247 - RNA, 19 nt, Homo sapiens
uggagacguucuuggugaa

SEQ ID NO: 947248 - RNA, 19 nt, Homo sapiens
ggcagugucuuuucucaga

SEQ ID NO: 947249 - RNA, 19 nt, Homo sapiens
gcgggauucucgccuuugg

SEQ ID NO: 947250 - RNA, 19 nt, Homo sapiens
ccucagcuguccucuucau

SEQ ID NO: 947251 - RNA, 19 nt, Homo sapiens
cuggagccuucuucaaaug

SEQ ID NO: 947252 - RNA, 19 nt, Homo sapiens
agagagcagguuucuuuau

SEQ ID NO: 947253 - RNA, 19 nt, Homo sapiens
gaaccuccagccucacucu

SEQ ID NO: 947254 - RNA, 19 nt, Homo sapiens
gcuggugcuucucuacuac

SEQ ID NO: 947255 - RNA, 19 nt, Homo sapiens
ccucuuccuuggcgggauu

SEQ ID NO: 947256 - RNA, 19 nt, Homo sapiens
ccgucucgcuguacacaau

SEQ ID NO: 947257 - RNA, 19 nt, Homo sapiens
ugaggaggaggaguacuuu

SEQ ID NO: 947258 - RNA, 19 nt, Homo sapiens
ugaacucggccuccagaau

SEQ ID NO: 947259 - RNA, 19 nt, Homo sapiens
ccgacuaccucagaagagu

SEQ ID NO: 947260 - RNA, 19 nt, Homo sapiens
gagccuucuucaaaugucu

SEQ ID NO: 947261 - RNA, 19 nt, Homo sapiens
ccaagccagggacucauga

SEQ ID NO: 947262 - RNA, 19 nt, Homo sapiens
caacaaguggcugacaaag

SEQ ID NO: 947263 - RNA, 19 nt, Homo sapiens
gaggaggaggaguacuuug

SEQ ID NO: 947264 - RNA, 19 nt, Homo sapiens
guauuugaaggucuccauu

SEQ ID NO: 947265 - RNA, 19 nt, Homo sapiens
aucuugaucuucucucuga

SEQ ID NO: 947266 - RNA, 19 nt, Homo sapiens
auccucagcuguccucuuc

SEQ ID NO: 947267 - RNA, 19 nt, Homo sapiens
agccgagacucauuuccaa

SEQ ID NO: 947268 - RNA, 19 nt, Homo sapiens
gggagugggcugguucuuc

SEQ ID NO: 947269 - RNA, 19 nt, Homo sapiens
gaccagccagggcaaaugg

SEQ ID NO: 947270 - RNA, 19 nt, Homo sapiens
cugagaaaaucuuccguuu

SEQ ID NO: 947271 - RNA, 19 nt, Homo sapiens
gagagcagguuucuuuaua

SEQ ID NO: 947272 - RNA, 19 nt, Homo sapiens
gcagguuucuuuauaguuu

SEQ ID NO: 947273 - RNA, 19 nt, Homo sapiens
ggugaaagcuguggucuaa

SEQ ID NO: 947274 - RNA, 19 nt, Homo sapiens
ugacaaagagcuuccauuu

SEQ ID NO: 947275 - RNA, 19 nt, Homo sapiens
ucagagagcagguuucuuu

SEQ ID NO: 947276 - RNA, 19 nt, Homo sapiens
gccagggacucaugacuuu

SEQ ID NO: 947277 - RNA, 19 nt, Homo sapiens
ucaaaugucuggucuuaag

SEQ ID NO: 947278 - RNA, 19 nt, Homo sapiens
ggaggaaggugacaaugag

SEQ ID NO: 947279 - RNA, 19 nt, Homo sapiens
cuucaaaugucuggucuua

SEQ ID NO: 947280 - RNA, 19 nt, Homo sapiens
acaaagagcuuccauuucc

SEQ ID NO: 947281 - RNA, 19 nt, Homo sapiens
gaacucggccuccagaauc

SEQ ID NO: 947282 - RNA, 19 nt, Homo sapiens
gagcagguuucuuuauagu

SEQ ID NO: 947283 - RNA, 19 nt, Homo sapiens
acaaguggcugacaaagag

SEQ ID NO: 947284 - RNA, 19 nt, Homo sapiens
uaaagggacugaguuugga

SEQ ID NO: 947285 - RNA, 19 nt, Homo sapiens
ggcaggaaauaaaugaaug

SEQ ID NO: 947286 - RNA, 19 nt, Homo sapiens
ucucuuugcuguauuugaa

SEQ ID NO: 947287 - RNA, 19 nt, Homo sapiens
caacuggagcuuccuguau

SEQ ID NO: 947288 - RNA, 19 nt, Homo sapiens
gggaggaaggugacaauga

SEQ ID NO: 947289 - RNA, 19 nt, Homo sapiens
gcuguccucuucaucuuga

SEQ ID NO: 947290 - RNA, 19 nt, Homo sapiens
ugaaagcuguggucuaacu

SEQ ID NO: 947291 - RNA, 19 nt, Homo sapiens
ggcaucaccuucuacaaca

SEQ ID NO: 947292 - RNA, 19 nt, Homo sapiens
cagggcaaauggcuuagaa

SEQ ID NO: 947293 - RNA, 19 nt, Homo sapiens
acaaugaggaggaggagua

SEQ ID NO: 947294 - RNA, 19 nt, Homo sapiens
agccaggccuccuucauuu

SEQ ID NO: 947295 - RNA, 19 nt, Homo sapiens
cagccucacucucuccauu

SEQ ID NO: 947296 - RNA, 19 nt, Homo sapiens
gagcgcugcauccaauuaa

SEQ ID NO: 947297 - RNA, 19 nt, Homo sapiens
gguggcaguucauggagaa

SEQ ID NO: 947298 - RNA, 19 nt, Homo sapiens
ugacagccgagacucauuu

SEQ ID NO: 947299 - RNA, 19 nt, Homo sapiens
gguuugggcuucucugagu

SEQ ID NO: 947300 - RNA, 19 nt, Homo sapiens
gacaaagagcuuccauuuc

SEQ ID NO: 947301 - RNA, 19 nt, Homo sapiens
gccuggagccuucuucaaa

SEQ ID NO: 947302 - RNA, 19 nt, Homo sapiens
ggcuggugcuucucuacua

SEQ ID NO: 947303 - RNA, 19 nt, Homo sapiens
cagagagcagguuucuuua

SEQ ID NO: 947304 - RNA, 19 nt, Homo sapiens
aggcacagcagcuuucuaa

SEQ ID NO: 947305 - RNA, 19 nt, Homo sapiens
gcaccuggccgugaucuuc

SEQ ID NO: 947306 - RNA, 19 nt, Homo sapiens
gcaggaaauaaaugaaugu

SEQ ID NO: 947307 - RNA, 19 nt, Homo sapiens
ucacuuugguggcaguuca

SEQ ID NO: 947308 - RNA, 19 nt, Homo sapiens
gacgugggcuuguccaacu

SEQ ID NO: 947309 - RNA, 19 nt, Homo sapiens
ugugagcgcugcauccaau

SEQ ID NO: 947310 - RNA, 19 nt, Homo sapiens
ccuggagccuucuucaaau

SEQ ID NO: 947311 - RNA, 19 nt, Homo sapiens
cagcuguccucuucaucuu

SEQ ID NO: 947312 - RNA, 19 nt, Homo sapiens
gcaucaccuucuacaacaa

SEQ ID NO: 947313 - RNA, 19 nt, Homo sapiens
gggccgaggucacuuuggu

SEQ ID NO: 947314 - RNA, 19 nt, Homo sapiens
ggaggaggaguacuuugug

SEQ ID NO: 947315 - RNA, 19 nt, Homo sapiens
gcucuucccucucuuugcu

SEQ ID NO: 947316 - RNA, 19 nt, Homo sapiens
cuacaaguccacacaguuc

SEQ ID NO: 947317 - RNA, 19 nt, Homo sapiens
agagcagguuucuuuauag

SEQ ID NO: 947318 - RNA, 19 nt, Homo sapiens
ggcaguucauggagaauag

SEQ ID NO: 947319 - RNA, 19 nt, Homo sapiens
gauucucgccuuugguuug

SEQ ID NO: 947320 - RNA, 19 nt, Homo sapiens
gggauucucgccuuugguu

SEQ ID NO: 947321 - RNA, 19 nt, Homo sapiens
gccgugaucuuccucuucu

SEQ ID NO: 947322 - RNA, 19 nt, Homo sapiens
uacaacaaguggcugacaa

SEQ ID NO: 947323 - RNA, 19 nt, Homo sapiens
gcuggcaggaaauaaauga

SEQ ID NO: 947324 - RNA, 19 nt, Homo sapiens
cuaaagggacugaguuugg

SEQ ID NO: 947325 - RNA, 19 nt, Homo sapiens
ugagcgcugcauccaauua

SEQ ID NO: 947326 - RNA, 19 nt, Homo sapiens
cccagaugcuccugcagaa

SEQ ID NO: 947327 - RNA, 19 nt, Homo sapiens
cgccagggcucaucauggu

SEQ ID NO: 947328 - RNA, 19 nt, Homo sapiens
ucaccugggcagugucuuu

SEQ ID NO: 947329 - RNA, 19 nt, Homo sapiens
ccuccacguugcccucaaa

SEQ ID NO: 947330 - RNA, 19 nt, Homo sapiens
agucugcacuuugcuguug

SEQ ID NO: 947331 - RNA, 19 nt, Homo sapiens
ccaacuggagcuuccugua

SEQ ID NO: 947332 - RNA, 19 nt, Homo sapiens
gcacccauggcuacgagaa

SEQ ID NO: 947333 - RNA, 19 nt, Homo sapiens
ggagccuucuucaaauguc

SEQ ID NO: 947334 - RNA, 19 nt, Homo sapiens
uugaaggucuccauuuguc

SEQ ID NO: 947335 - RNA, 19 nt, Homo sapiens
aacuggagcuuccuguaug

SEQ ID NO: 947336 - RNA, 19 nt, Homo sapiens
ccaucggcaucaccuucua

SEQ ID NO: 947337 - RNA, 19 nt, Homo sapiens
aagccaggccuccuucauu

SEQ ID NO: 947338 - RNA, 19 nt, Homo sapiens
auuugaaggucuccauuug

SEQ ID NO: 947339 - RNA, 19 nt, Homo sapiens
gcucuuccugcacauugua

SEQ ID NO: 947340 - RNA, 19 nt, Homo sapiens
cagguuucuuuauaguuug

SEQ ID NO: 947341 - RNA, 19 nt, Homo sapiens
ccaaggcacagcagcuuuc

SEQ ID NO: 947342 - RNA, 19 nt, Homo sapiens
ggagacguucuuggugaaa

SEQ ID NO: 947343 - RNA, 19 nt, Homo sapiens
uauuugaaggucuccauuu

SEQ ID NO: 947344 - RNA, 19 nt, Homo sapiens
uguacacaaugaccaaauc

SEQ ID NO: 947345 - RNA, 19 nt, Homo sapiens
gagacguucuuggugaaag

SEQ ID NO: 947346 - RNA, 19 nt, Homo sapiens
acaacaaguggcugacaaa

SEQ ID NO: 947347 - RNA, 19 nt, Homo sapiens
ggcagugucuuuucucaga

SEQ ID NO: 947348 - RNA, 19 nt, Homo sapiens
uggagacguucuuggugaa

SEQ ID NO: 947349 - RNA, 19 nt, Homo sapiens
gcgggauucucgccuuugg

SEQ ID NO: 947350 - RNA, 19 nt, Homo sapiens
ccucagcuguccucuucau

SEQ ID NO: 947351 - RNA, 19 nt, Homo sapiens
cuggagccuucuucaaaug

SEQ ID NO: 947352 - RNA, 19 nt, Homo sapiens
ccagggccgaggucacuuu

SEQ ID NO: 947353 - RNA, 19 nt, Homo sapiens
agagagcagguuucuuuau

SEQ ID NO: 947354 - RNA, 19 nt, Homo sapiens
gaaccuccagccucacucu

SEQ ID NO: 947355 - RNA, 19 nt, Homo sapiens
ccucuuccuuggcgggauu

SEQ ID NO: 947356 - RNA, 19 nt, Homo sapiens
ccgucucgcuguacacaau

SEQ ID NO: 947357 - RNA, 19 nt, Homo sapiens
gcuggugcuucucuacuac

SEQ ID NO: 947358 - RNA, 19 nt, Homo sapiens
ugaggaggaggaguacuuu

SEQ ID NO: 947359 - RNA, 19 nt, Homo sapiens
ugaacucggccuccagaau

SEQ ID NO: 947360 - RNA, 19 nt, Homo sapiens
ccgacuaccucagaagagu

SEQ ID NO: 947361 - RNA, 19 nt, Homo sapiens
gagccuucuucaaaugucu

SEQ ID NO: 947362 - RNA, 19 nt, Homo sapiens
ccaagccagggacucauga

SEQ ID NO: 947363 - RNA, 19 nt, Homo sapiens
gaggaggaggaguacuuug

SEQ ID NO: 947364 - RNA, 19 nt, Homo sapiens
guauuugaaggucuccauu

SEQ ID NO: 947365 - RNA, 19 nt, Homo sapiens
aucuugaucuucucucuga

SEQ ID NO: 947366 - RNA, 19 nt, Homo sapiens
auccucagcuguccucuuc

SEQ ID NO: 947367 - RNA, 19 nt, Homo sapiens
caacaaguggcugacaaag

SEQ ID NO: 947368 - RNA, 19 nt, Homo sapiens
agccgagacucauuuccaa

SEQ ID NO: 947369 - RNA, 19 nt, Homo sapiens
gagucacgcagccuucaga

SEQ ID NO: 947370 - RNA, 19 nt, Homo sapiens
gggagugggcugguucuuc

SEQ ID NO: 947371 - RNA, 19 nt, Homo sapiens
gaacagaccuaucaacaug

SEQ ID NO: 947372 - RNA, 19 nt, Homo sapiens
ggaaagcacuagaaacuaa

SEQ ID NO: 947373 - RNA, 19 nt, Homo sapiens
gcaaauauaucuucaagga

SEQ ID NO: 947374 - RNA, 19 nt, Homo sapiens
ggauuuccuuccuguauua

SEQ ID NO: 947375 - RNA, 19 nt, Homo sapiens
ucaggcaucuggacuaaua

SEQ ID NO: 947376 - RNA, 19 nt, Homo sapiens
gcauauaguuggaaagaga

SEQ ID NO: 947377 - RNA, 19 nt, Homo sapiens
gaaagcagcccuucacuca

SEQ ID NO: 947378 - RNA, 19 nt, Homo sapiens
caccaugccuggcuaauuu

SEQ ID NO: 947379 - RNA, 19 nt, Homo sapiens
gggcauaauuggaauauca

SEQ ID NO: 947380 - RNA, 19 nt, Homo sapiens
guccacagcuuauaagauu

SEQ ID NO: 947381 - RNA, 19 nt, Homo sapiens
gcacaguucaguaacguua

SEQ ID NO: 947382 - RNA, 19 nt, Homo sapiens
caacaggcuacaagaauua

SEQ ID NO: 947383 - RNA, 19 nt, Homo sapiens
gcaucgaaaugguguaauu

SEQ ID NO: 947384 - RNA, 19 nt, Homo sapiens
agacacagcuuuccucuuc

SEQ ID NO: 947385 - RNA, 19 nt, Homo sapiens
ccacaaggauuccggucua

SEQ ID NO: 947386 - RNA, 19 nt, Homo sapiens
cauacugucuucaccauuu

SEQ ID NO: 947387 - RNA, 19 nt, Homo sapiens
ccaacaggcuacaagaauu

SEQ ID NO: 947388 - RNA, 19 nt, Homo sapiens
ggaagaauccaguccaaga

SEQ ID NO: 947389 - RNA, 19 nt, Homo sapiens
gagaaagugucauggaagu

SEQ ID NO: 947390 - RNA, 19 nt, Homo sapiens
gcagacaugugagaugcua

SEQ ID NO: 947391 - RNA, 19 nt, Homo sapiens
ggaauaucauuuggagaaa

SEQ ID NO: 947392 - RNA, 19 nt, Homo sapiens
caaggaaagagaaucauuu

SEQ ID NO: 947393 - RNA, 19 nt, Homo sapiens
gaagaauccaguccaagaa

SEQ ID NO: 947394 - RNA, 19 nt, Homo sapiens
ggauuccggucuacuuuga

SEQ ID NO: 947395 - RNA, 19 nt, Homo sapiens
gaaggcagguacaaucucu

SEQ ID NO: 947396 - RNA, 19 nt, Homo sapiens
ggauagaauacaugaauga

SEQ ID NO: 947397 - RNA, 19 nt, Homo sapiens
guagacagcuuuggaaacu

SEQ ID NO: 947398 - RNA, 19 nt, Homo sapiens
gaagagauccagcagacau

SEQ ID NO: 947399 - RNA, 19 nt, Homo sapiens
aaauagaaauggagaccaa

SEQ ID NO: 947400 - RNA, 19 nt, Homo sapiens
gugaaagaguggaauagug

SEQ ID NO: 947401 - RNA, 19 nt, Homo sapiens
guucauccauguuguguca

SEQ ID NO: 947402 - RNA, 19 nt, Homo sapiens
ggaaucauacagugacuug

SEQ ID NO: 947403 - RNA, 19 nt, Homo sapiens
uaagugcacaguucaguaa

SEQ ID NO: 947404 - RNA, 19 nt, Homo sapiens
gaaagcacuagaaacuaaa

SEQ ID NO: 947405 - RNA, 19 nt, Homo sapiens
gaaagugucauggaaguuc

SEQ ID NO: 947406 - RNA, 19 nt, Homo sapiens
cggcuucccucacgauauu

SEQ ID NO: 947407 - RNA, 19 nt, Homo sapiens
gauucaccauugccucuaa

SEQ ID NO: 947408 - RNA, 19 nt, Homo sapiens
cccuaaagcugaauucaau

SEQ ID NO: 947409 - RNA, 19 nt, Homo sapiens
ggagaauuugugccuauaa

SEQ ID NO: 947410 - RNA, 19 nt, Homo sapiens
uuugauggccgaaauauuu

SEQ ID NO: 947411 - RNA, 19 nt, Homo sapiens
gggauagaauacaugaaug

SEQ ID NO: 947412 - RNA, 19 nt, Homo sapiens
ccaaagugcugggauuaca

SEQ ID NO: 947413 - RNA, 19 nt, Homo sapiens
ggaguagugcuaauacaga

SEQ ID NO: 947414 - RNA, 19 nt, Homo sapiens
uggaaacuguacccauuaa

SEQ ID NO: 947415 - RNA, 19 nt, Homo sapiens
ccaaaguccauaugaaaga

SEQ ID NO: 947416 - RNA, 19 nt, Homo sapiens
gaaacuguacccauuaaac

SEQ ID NO: 947417 - RNA, 19 nt, Homo sapiens
gagaauuugugccuauaac

SEQ ID NO: 947418 - RNA, 19 nt, Homo sapiens
caaaguccauaugaaagau

SEQ ID NO: 947419 - RNA, 19 nt, Homo sapiens
gauuugauggccggaauua

SEQ ID NO: 947420 - RNA, 19 nt, Homo sapiens
uggagaaagugucauggaa

SEQ ID NO: 947421 - RNA, 19 nt, Homo sapiens
gaauaucauuuggagaaag

SEQ ID NO: 947422 - RNA, 19 nt, Homo sapiens
cuacacagcggaaggcaaa

SEQ ID NO: 947423 - RNA, 19 nt, Homo sapiens
ggagaugccagggauagaa

SEQ ID NO: 947424 - RNA, 19 nt, Homo sapiens
gcccuucacucacuuccuu

SEQ ID NO: 947425 - RNA, 19 nt, Homo sapiens
ggaagaaaauagaaaugga

SEQ ID NO: 947426 - RNA, 19 nt, Homo sapiens
ccucaagguucauccaugu

SEQ ID NO: 947427 - RNA, 19 nt, Homo sapiens
cucaguaucucauauaagu

SEQ ID NO: 947428 - RNA, 19 nt, Homo sapiens
ugaaagaguggaauagugu

SEQ ID NO: 947429 - RNA, 19 nt, Homo sapiens
ccaccauucugcuuucugu

SEQ ID NO: 947430 - RNA, 19 nt, Homo sapiens
gcacuagaaacuaaacauc

SEQ ID NO: 947431 - RNA, 19 nt, Homo sapiens
gcaugguggauguucuuua

SEQ ID NO: 947432 - RNA, 19 nt, Homo sapiens
ccgaguagcugggauuaca

SEQ ID NO: 947433 - RNA, 19 nt, Homo sapiens
uggaauaucauuuggagaa

SEQ ID NO: 947434 - RNA, 19 nt, Homo sapiens
gagacucugccuuuaauuc

SEQ ID NO: 947435 - RNA, 19 nt, Homo sapiens
ggaaacuguacccauuaaa

SEQ ID NO: 947436 - RNA, 19 nt, Homo sapiens
cagcggaaggcaaauauau

SEQ ID NO: 947437 - RNA, 19 nt, Homo sapiens
cuacaagaauuaguugauc

SEQ ID NO: 947438 - RNA, 19 nt, Homo sapiens
ucacgauauugcagaaaga

SEQ ID NO: 947439 - RNA, 19 nt, Homo sapiens
ccuauaacccuuagugugu

SEQ ID NO: 947440 - RNA, 19 nt, Homo sapiens
ugagguggaucuuggaaag

SEQ ID NO: 947441 - RNA, 19 nt, Homo sapiens
caggaagaauccaguccaa

SEQ ID NO: 947442 - RNA, 19 nt, Homo sapiens
ucaauucacaucucucaga

SEQ ID NO: 947443 - RNA, 19 nt, Homo sapiens
caugguggauguucuuuac

SEQ ID NO: 947444 - RNA, 19 nt, Homo sapiens
guguaaagaggaauucauu

SEQ ID NO: 947445 - RNA, 19 nt, Homo sapiens
acagaccuaucaacaugaa

SEQ ID NO: 947446 - RNA, 19 nt, Homo sapiens
ccacagcuuauaagauuug

SEQ ID NO: 947447 - RNA, 19 nt, Homo sapiens
aaacuguacccauuaaaca

SEQ ID NO: 947448 - RNA, 19 nt, Homo sapiens
agaguggaauagugugaaa

SEQ ID NO: 947449 - RNA, 19 nt, Homo sapiens
ggaauuacaggaagaaucc

SEQ ID NO: 947450 - RNA, 19 nt, Homo sapiens
guucugcguccacagcuua

SEQ ID NO: 947451 - RNA, 19 nt, Homo sapiens
caagguucauccauguugu

SEQ ID NO: 947452 - RNA, 19 nt, Homo sapiens
aaggagaauuugugccuau

SEQ ID NO: 947453 - RNA, 19 nt, Homo sapiens
ucaaggaaagagaaucauu

SEQ ID NO: 947454 - RNA, 19 nt, Homo sapiens
caugcuacaguuaugaaua

SEQ ID NO: 947455 - RNA, 19 nt, Homo sapiens
cgccaaaguccauaugaaa

SEQ ID NO: 947456 - RNA, 19 nt, Homo sapiens
cagcuuauaagauuugaug

SEQ ID NO: 947457 - RNA, 19 nt, Homo sapiens
ggauguucuuuacgccaaa

SEQ ID NO: 947458 - RNA, 19 nt, Homo sapiens
agacagcuuuggaaacuac

SEQ ID NO: 947459 - RNA, 19 nt, Homo sapiens
gcugaaggcagguacaauc

SEQ ID NO: 947460 - RNA, 19 nt, Homo sapiens
caaggauuccggucuacuu

SEQ ID NO: 947461 - RNA, 19 nt, Homo sapiens
gugaacacuuggcuugcuu

SEQ ID NO: 947462 - RNA, 19 nt, Homo sapiens
gcuuauuucacuuagcaua

SEQ ID NO: 947463 - RNA, 19 nt, Homo sapiens
uccauaggcuucucagcuu

SEQ ID NO: 947464 - RNA, 19 nt, Homo sapiens
gcauaauguccucaagguu

SEQ ID NO: 947465 - RNA, 19 nt, Homo sapiens
cauaaaacauacugucuuc

SEQ ID NO: 947466 - RNA, 19 nt, Homo sapiens
gggcauaaggagaauuugu

SEQ ID NO: 947467 - RNA, 19 nt, Homo sapiens
cagguacaaucucuacaca

SEQ ID NO: 947468 - RNA, 19 nt, Homo sapiens
ggauugauguucuuuugga

SEQ ID NO: 947469 - RNA, 19 nt, Homo sapiens
uguaaucacuggccagcau

SEQ ID NO: 947470 - RNA, 19 nt, Homo sapiens
uugagacucugccuuuaau

SEQ ID NO: 947471 - RNA, 19 nt, Homo sapiens
gaagauguauuucccaauc

SEQ ID NO: 947472 - RNA, 19 nt, Homo sapiens
caaucaaccugguggaaua

SEQ ID NO: 947473 - RNA, 19 nt, Homo sapiens
gaagacauuuccaacaguu

SEQ ID NO: 947474 - RNA, 19 nt, Homo sapiens
cagaugaggauccaaauua

SEQ ID NO: 947475 - RNA, 19 nt, Homo sapiens
caauaaugcucgucuaugu

SEQ ID NO: 947476 - RNA, 19 nt, Homo sapiens
gaaaugguacacugacuaa

SEQ ID NO: 947477 - RNA, 19 nt, Homo sapiens
cagaagcacuuuaugaaau

SEQ ID NO: 947478 - RNA, 19 nt, Homo sapiens
cagcagacuuuguauuuau

SEQ ID NO: 947479 - RNA, 19 nt, Homo sapiens
gacagcagacuuuguauuu

SEQ ID NO: 947480 - RNA, 19 nt, Homo sapiens
ggagauuaaucaccaacuu

SEQ ID NO: 947481 - RNA, 19 nt, Homo sapiens
gaucacaccuuuucaguug

SEQ ID NO: 947482 - RNA, 19 nt, Homo sapiens
ucacuacacugguacugaa

SEQ ID NO: 947483 - RNA, 19 nt, Homo sapiens
uaaagcagcagugccaaua

SEQ ID NO: 947484 - RNA, 19 nt, Homo sapiens
gcaguuggacacauauauu

SEQ ID NO: 947485 - RNA, 19 nt, Homo sapiens
acagcagacuuuguauuua

SEQ ID NO: 947486 - RNA, 19 nt, Homo sapiens
ggacagcagacuuuguauu

SEQ ID NO: 947487 - RNA, 19 nt, Homo sapiens
cagaagacauuuccaacag

SEQ ID NO: 947488 - RNA, 19 nt, Homo sapiens
ccagaagcacuuuaugaaa

SEQ ID NO: 947489 - RNA, 19 nt, Homo sapiens
ucuaacaaguacaugagua

SEQ ID NO: 947490 - RNA, 19 nt, Homo sapiens
uggaauugaucacaccuuu

SEQ ID NO: 947491 - RNA, 19 nt, Homo sapiens
agaagcacuuuaugaaaug

SEQ ID NO: 947492 - RNA, 19 nt, Homo sapiens
gcagcagugccaauaauga

SEQ ID NO: 947493 - RNA, 19 nt, Homo sapiens
gccagcggcuuggagguua

SEQ ID NO: 947494 - RNA, 19 nt, Homo sapiens
guuccucacuacacuggua

SEQ ID NO: 947495 - RNA, 19 nt, Homo sapiens
uauugcaguuggacacaua

SEQ ID NO: 947496 - RNA, 19 nt, Homo sapiens
uuugguggauucuuaauga

SEQ ID NO: 947497 - RNA, 19 nt, Homo sapiens
uagaugaggccauggugua

SEQ ID NO: 947498 - RNA, 19 nt, Homo sapiens
gggaaggacucggugauac

SEQ ID NO: 947499 - RNA, 19 nt, Homo sapiens
uaaauggaaguuucagaga

SEQ ID NO: 947500 - RNA, 19 nt, Homo sapiens
uuacaauaaugcucgucua

SEQ ID NO: 947501 - RNA, 19 nt, Homo sapiens
guaauuucuuagagccaaa

SEQ ID NO: 947502 - RNA, 19 nt, Homo sapiens
ugaaaugguacacugacua

SEQ ID NO: 947503 - RNA, 19 nt, Homo sapiens
aagcagcagugccaauaau

SEQ ID NO: 947504 - RNA, 19 nt, Homo sapiens
caguuggacacauauauuu

SEQ ID NO: 947505 - RNA, 19 nt, Homo sapiens
gagauuaaucaccaacuuc

SEQ ID NO: 947506 - RNA, 19 nt, Homo sapiens
caaccugguggaauaagaa

SEQ ID NO: 947507 - RNA, 19 nt, Homo sapiens
ucaaccugguggaauaaga

SEQ ID NO: 947508 - RNA, 19 nt, Homo sapiens
uuugacagcuuggcagauu

SEQ ID NO: 947509 - RNA, 19 nt, Homo sapiens
gaucuuuuauccuuuguug

SEQ ID NO: 947510 - RNA, 19 nt, Homo sapiens
ccagaagacauuuccaaca

SEQ ID NO: 947511 - RNA, 19 nt, Homo sapiens
ccagaugaggauccaaauu

SEQ ID NO: 947512 - RNA, 19 nt, Homo sapiens
ucggacagcagacuuugua

SEQ ID NO: 947513 - RNA, 19 nt, Homo sapiens
uaacuccagaagcacuuua

SEQ ID NO: 947514 - RNA, 19 nt, Homo sapiens
gauuuuaacuccagaagca

SEQ ID NO: 947515 - RNA, 19 nt, Homo sapiens
ccugggugcucaugggauu

SEQ ID NO: 947516 - RNA, 19 nt, Homo sapiens
gccaggccuuuacaauaau

SEQ ID NO: 947517 - RNA, 19 nt, Homo sapiens
cuauaucguuacugucgaa

SEQ ID NO: 947518 - RNA, 19 nt, Homo sapiens
gaagcacuuuaugaaaugg

SEQ ID NO: 947519 - RNA, 19 nt, Homo sapiens
uaucguuacugucgaaugc

SEQ ID NO: 947520 - RNA, 19 nt, Homo sapiens
gaugaggccaugguguaaa

SEQ ID NO: 947521 - RNA, 19 nt, Homo sapiens
agaagacauuuccaacagu

SEQ ID NO: 947522 - RNA, 19 nt, Homo sapiens
ugacuaauccagaagacau

SEQ ID NO: 947523 - RNA, 19 nt, Homo sapiens
ccagcggcuuggagguuaa

SEQ ID NO: 947524 - RNA, 19 nt, Homo sapiens
gaugaggauccaaauuaca

SEQ ID NO: 947525 - RNA, 19 nt, Homo sapiens
gaauugaucacaccuuuuc

SEQ ID NO: 947526 - RNA, 19 nt, Homo sapiens
gguacugaaaguguaauuu

SEQ ID NO: 947527 - RNA, 19 nt, Homo sapiens
cuacacugguacugaaagu

SEQ ID NO: 947528 - RNA, 19 nt, Homo sapiens
uccagaagcacuuuaugaa

SEQ ID NO: 947529 - RNA, 19 nt, Homo sapiens
aaagcagcagugccaauaa

SEQ ID NO: 947530 - RNA, 19 nt, Homo sapiens
agaugaggauccaaauuac

SEQ ID NO: 947531 - RNA, 19 nt, Homo sapiens
agauguauuucccaaucaa

SEQ ID NO: 947532 - RNA, 19 nt, Homo sapiens
ccaggccuuuacaauaaug

SEQ ID NO: 947533 - RNA, 19 nt, Homo sapiens
agacauuuccaacaguuug

SEQ ID NO: 947534 - RNA, 19 nt, Homo sapiens
uacacugacuaauccagaa

SEQ ID NO: 947535 - RNA, 19 nt, Homo sapiens
caccagaugaggauccaaa

SEQ ID NO: 947536 - RNA, 19 nt, Homo sapiens
gaacuucuucggccuucuc

SEQ ID NO: 947537 - RNA, 19 nt, Homo sapiens
aagauguauuucccaauca

SEQ ID NO: 947538 - RNA, 19 nt, Homo sapiens
ucagagaggacaaaauaaa

SEQ ID NO: 947539 - RNA, 19 nt, Homo sapiens
gccgugcaguuggaauuga

SEQ ID NO: 947540 - RNA, 19 nt, Homo sapiens
gcagacuuuguauuuaugu

SEQ ID NO: 947541 - RNA, 19 nt, Homo sapiens
gcaguuggaauugaucaca

SEQ ID NO: 947542 - RNA, 19 nt, Homo sapiens
caacaguuugccagugguu

SEQ ID NO: 947543 - RNA, 19 nt, Homo sapiens
gacuaauccagaagacauu

SEQ ID NO: 947544 - RNA, 19 nt, Homo sapiens
ggccaguuggauucaauuu

SEQ ID NO: 947545 - RNA, 19 nt, Homo sapiens
cugaaaacaccaucuauuu

SEQ ID NO: 947546 - RNA, 19 nt, Homo sapiens
ccaaucaaccugguggaau

SEQ ID NO: 947547 - RNA, 19 nt, Homo sapiens
ucacaccuuuucaguugua

SEQ ID NO: 947548 - RNA, 19 nt, Homo sapiens
gguguaaauggaaguuuca

SEQ ID NO: 947549 - RNA, 19 nt, Homo sapiens
cuccagaagcacuuuauga

SEQ ID NO: 947550 - RNA, 19 nt, Homo sapiens
uacaauaaugcucgucuau

SEQ ID NO: 947551 - RNA, 19 nt, Homo sapiens
uuucagagaggacaaaaua

SEQ ID NO: 947552 - RNA, 19 nt, Homo sapiens
ugguguaaauggaaguuuc

SEQ ID NO: 947553 - RNA, 19 nt, Homo sapiens
gaggauccaaauuacaauc

SEQ ID NO: 947554 - RNA, 19 nt, Homo sapiens
aauauccugccaccucuaa

SEQ ID NO: 947555 - RNA, 19 nt, Homo sapiens
aaugguacacugacuaauc

SEQ ID NO: 947556 - RNA, 19 nt, Homo sapiens
ugggaaggacucggugaua

SEQ ID NO: 947557 - RNA, 19 nt, Homo sapiens
ccaaauuacaauccacuac

SEQ ID NO: 947558 - RNA, 19 nt, Homo sapiens
gauuaaucaccaacuucuu

SEQ ID NO: 947559 - RNA, 19 nt, Homo sapiens
ucguuacugucgaaugcua

SEQ ID NO: 947560 - RNA, 19 nt, Homo sapiens
ggagauauauucaaaguug

SEQ ID NO: 947561 - RNA, 19 nt, Homo sapiens
gaauauggguuaaggcaaa

SEQ ID NO: 947562 - RNA, 19 nt, Homo sapiens
gcagaaaguugauauaggu

SEQ ID NO: 947563 - RNA, 19 nt, Homo sapiens
uaaagugacucugggcuua

SEQ ID NO: 947564 - RNA, 19 nt, Homo sapiens
ggagugagccagcuucuuu

SEQ ID NO: 947565 - RNA, 19 nt, Homo sapiens
gaagcgguauguuccagua

SEQ ID NO: 947566 - RNA, 19 nt, Homo sapiens
gaagauaaggugugaaugu

SEQ ID NO: 947567 - RNA, 19 nt, Homo sapiens
gagauaguauuuggaauga

SEQ ID NO: 947568 - RNA, 19 nt, Homo sapiens
gauaaggugugaauguaug

SEQ ID NO: 947569 - RNA, 19 nt, Homo sapiens
gagauggucuguauugaca

SEQ ID NO: 947570 - RNA, 19 nt, Homo sapiens
uggaaugaauggaagaaua

SEQ ID NO: 947571 - RNA, 19 nt, Homo sapiens
ggaaugaauggaagaauau

SEQ ID NO: 947572 - RNA, 19 nt, Homo sapiens
ggaagaauauggguuaagg

SEQ ID NO: 947573 - RNA, 19 nt, Homo sapiens
ggagauaguauuuggaaug

SEQ ID NO: 947574 - RNA, 19 nt, Homo sapiens
ggugugaauguauguauua

SEQ ID NO: 947575 - RNA, 19 nt, Homo sapiens
acucugggcuuaauuagaa

SEQ ID NO: 947576 - RNA, 19 nt, Homo sapiens
aagauaaggugugaaugua

SEQ ID NO: 947577 - RNA, 19 nt, Homo sapiens
ucucaucuauggccaguuu

SEQ ID NO: 947578 - RNA, 19 nt, Homo sapiens
gaacacaugacgucagauc

SEQ ID NO: 947579 - RNA, 19 nt, Homo sapiens
gagagaaaaucauugcaaa

SEQ ID NO: 947580 - RNA, 19 nt, Homo sapiens
gugaacacaugacgucaga

SEQ ID NO: 947581 - RNA, 19 nt, Homo sapiens
ugucuuacuugucauuuga

SEQ ID NO: 947582 - RNA, 19 nt, Homo sapiens
ggacaggauggucugcuuu

SEQ ID NO: 947583 - RNA, 19 nt, Homo sapiens
aauggaagaauauggguua

SEQ ID NO: 947584 - RNA, 19 nt, Homo sapiens
cagauuggcagaaaguuga

SEQ ID NO: 947585 - RNA, 19 nt, Homo sapiens
cacaugacgucagaucaaa

SEQ ID NO: 947586 - RNA, 19 nt, Homo sapiens
cagcagaagcgguauguuc

SEQ ID NO: 947587 - RNA, 19 nt, Homo sapiens
cagcuucuuugucuuacuu

SEQ ID NO: 947588 - RNA, 19 nt, Homo sapiens
ggcagaaaguugauauagg

SEQ ID NO: 947589 - RNA, 19 nt, Homo sapiens
guuugugguugcuaauaaa

SEQ ID NO: 947590 - RNA, 19 nt, Homo sapiens
gccaguuugugguugcuaa

SEQ ID NO: 947591 - RNA, 19 nt, Homo sapiens
ugagccagcuucuuugucu

SEQ ID NO: 947592 - RNA, 19 nt, Homo sapiens
cagaagauaaggugugaau

SEQ ID NO: 947593 - RNA, 19 nt, Homo sapiens
gugacucugggcuuaauua

SEQ ID NO: 947594 - RNA, 19 nt, Homo sapiens
ccauuuaaauacucagaag

SEQ ID NO: 947595 - RNA, 19 nt, Homo sapiens
acaggucaguugaggcaaa

SEQ ID NO: 947596 - RNA, 19 nt, Homo sapiens
aaagaaacagaccaaaugu

SEQ ID NO: 947597 - RNA, 19 nt, Homo sapiens
gcaguggagcgaccguuga

SEQ ID NO: 947598 - RNA, 19 nt, Homo sapiens
gacgucagaucaaagaaaa

SEQ ID NO: 947599 - RNA, 19 nt, Homo sapiens
ugacgucagaucaaagaaa

SEQ ID NO: 947600 - RNA, 19 nt, Homo sapiens
aaaaggagaccaugugauu

SEQ ID NO: 947601 - RNA, 19 nt, Homo sapiens
guauuuggaaugaauggaa

SEQ ID NO: 947602 - RNA, 19 nt, Homo sapiens
aguuugugguugcuaauaa

SEQ ID NO: 947603 - RNA, 19 nt, Homo sapiens
uauuagaguccgaaaguau

SEQ ID NO: 947604 - RNA, 19 nt, Homo sapiens
uuauuagaguccgaaagua

SEQ ID NO: 947605 - RNA, 19 nt, Homo sapiens
uuuagaagcuugugaacac

SEQ ID NO: 947606 - RNA, 19 nt, Homo sapiens
ccguugagccugaaugcua

SEQ ID NO: 947607 - RNA, 19 nt, Homo sapiens
agacauggaaccagagaug

SEQ ID NO: 947608 - RNA, 19 nt, Homo sapiens
cuggagauauauucaaagu

SEQ ID NO: 947609 - RNA, 19 nt, Homo sapiens
ccagauuggcagaaaguug

SEQ ID NO: 947610 - RNA, 19 nt, Homo sapiens
acacaugacgucagaucaa

SEQ ID NO: 947611 - RNA, 19 nt, Homo sapiens
ccagcagacuuuaauuuug

SEQ ID NO: 947612 - RNA, 19 nt, Homo sapiens
cauuugaaggugcaacuaa

SEQ ID NO: 947613 - RNA, 19 nt, Homo sapiens
gcauagugacagcuaaauc

SEQ ID NO: 947614 - RNA, 19 nt, Homo sapiens
guugauauagguggacuuu

SEQ ID NO: 947615 - RNA, 19 nt, Homo sapiens
caugacgucagaucaaaga

SEQ ID NO: 947616 - RNA, 19 nt, Homo sapiens
ccaugugauuggcauagug

SEQ ID NO: 947617 - RNA, 19 nt, Homo sapiens
aaaagaaacagaccaaaug

SEQ ID NO: 947618 - RNA, 19 nt, Homo sapiens
cauagugacagcuaaaucu

SEQ ID NO: 947619 - RNA, 19 nt, Homo sapiens
uuagaguccgaaaguauuu

SEQ ID NO: 947620 - RNA, 19 nt, Homo sapiens
gcaaacauuuuagaagcuu

SEQ ID NO: 947621 - RNA, 19 nt, Homo sapiens
aaaccauccagcagacuuu

SEQ ID NO: 947622 - RNA, 19 nt, Homo sapiens
gaaugaauggaagaauaug

SEQ ID NO: 947623 - RNA, 19 nt, Homo sapiens
gagccagcuucuuugucuu

SEQ ID NO: 947624 - RNA, 19 nt, Homo sapiens
gguggacucucagcagaag

SEQ ID NO: 947625 - RNA, 19 nt, Homo sapiens
gaaggugcaacuaaaagaa

SEQ ID NO: 947626 - RNA, 19 nt, Homo sapiens
guucgguacaauaaaguuu

SEQ ID NO: 947627 - RNA, 19 nt, Homo sapiens
uauuagcuccagauuguga

SEQ ID NO: 947628 - RNA, 19 nt, Homo sapiens
gugaaaucauacaggaagu

SEQ ID NO: 947629 - RNA, 19 nt, Homo sapiens
auuugaaggugcaacuaaa

SEQ ID NO: 947630 - RNA, 19 nt, Homo sapiens
ggagagaaaaucauugcaa

SEQ ID NO: 947631 - RNA, 19 nt, Homo sapiens
cucagaagauaagguguga

SEQ ID NO: 947632 - RNA, 19 nt, Homo sapiens
caugugauuggcauaguga

SEQ ID NO: 947633 - RNA, 19 nt, Homo sapiens
ccacuggagauaguauuug

SEQ ID NO: 947634 - RNA, 19 nt, Homo sapiens
gagugagccagcuucuuug

SEQ ID NO: 947635 - RNA, 19 nt, Homo sapiens
agccagcuucuuugucuua

SEQ ID NO: 947636 - RNA, 19 nt, Homo sapiens
gcagguuggagaucucauc

SEQ ID NO: 947637 - RNA, 19 nt, Homo sapiens
cagaccaaaugugcagguu

SEQ ID NO: 947638 - RNA, 19 nt, Homo sapiens
guaaaaggagaccauguga

SEQ ID NO: 947639 - RNA, 19 nt, Homo sapiens
aaaggagaccaugugauug

SEQ ID NO: 947640 - RNA, 19 nt, Homo sapiens
cagcagacuuuaauuuugg

SEQ ID NO: 947641 - RNA, 19 nt, Homo sapiens
aaagugacucugggcuuaa

SEQ ID NO: 947642 - RNA, 19 nt, Homo sapiens
ggacgagccaauggaaugg

SEQ ID NO: 947643 - RNA, 19 nt, Homo sapiens
ggagggagugagccagcuu

SEQ ID NO: 947644 - RNA, 19 nt, Homo sapiens
cacuggagauaguauuugg

SEQ ID NO: 947645 - RNA, 19 nt, Homo sapiens
uggacaggauggucugcuu

SEQ ID NO: 947646 - RNA, 19 nt, Homo sapiens
uuacuugucauuugaaggu

SEQ ID NO: 947647 - RNA, 19 nt, Homo sapiens
agcgguauguuccaguaaa

SEQ ID NO: 947648 - RNA, 19 nt, Homo sapiens
gcucgugacuggcaaauga

SEQ ID NO: 947649 - RNA, 19 nt, Homo sapiens
ccacacaacuuaaagaucu

SEQ ID NO: 947650 - RNA, 19 nt, Homo sapiens
gggaugaaguccaguguga

SEQ ID NO: 947651 - RNA, 19 nt, Homo sapiens
ggagguagauugggaagug

SEQ ID NO: 947652 - RNA, 19 nt, Homo sapiens
caagacagaggaccugaua

SEQ ID NO: 947653 - RNA, 19 nt, Homo sapiens
cagauaagguggugugugu

SEQ ID NO: 947654 - RNA, 19 nt, Homo sapiens
cgaagacgaugacgcaguu

SEQ ID NO: 947655 - RNA, 19 nt, Homo sapiens
gaagaagguuacucacagu

SEQ ID NO: 947656 - RNA, 19 nt, Homo sapiens
ucaacaagguggugugaug

SEQ ID NO: 947657 - RNA, 19 nt, Homo sapiens
gcucagaaguggcccuuuc

SEQ ID NO: 947658 - RNA, 19 nt, Homo sapiens
ccaaggagcccaucaucuu

SEQ ID NO: 947659 - RNA, 19 nt, Homo sapiens
gaacuaggugucaucauca

SEQ ID NO: 947660 - RNA, 19 nt, Homo sapiens
gaaguccagugugagauug

SEQ ID NO: 947661 - RNA, 19 nt, Homo sapiens
gaagguuacucacaguucu

SEQ ID NO: 947662 - RNA, 19 nt, Homo sapiens
gcuggugucugguagaaga

SEQ ID NO: 947663 - RNA, 19 nt, Homo sapiens
gcagauccacacaacuuaa

SEQ ID NO: 947664 - RNA, 19 nt, Homo sapiens
aacaauggcugcugggaaa

SEQ ID NO: 947665 - RNA, 19 nt, Homo sapiens
gagcucucuucaauaaauu

SEQ ID NO: 947666 - RNA, 19 nt, Homo sapiens
agaacuaggugucaucauc

SEQ ID NO: 947667 - RNA, 19 nt, Homo sapiens
gaaagaaaggcaagcacau

SEQ ID NO: 947668 - RNA, 19 nt, Homo sapiens
caaggacaguguagcagau

SEQ ID NO: 947669 - RNA, 19 nt, Homo sapiens
gguagaagaagguuacuca

SEQ ID NO: 947670 - RNA, 19 nt, Homo sapiens
gaugaaguccagugugaga

SEQ ID NO: 947671 - RNA, 19 nt, Homo sapiens
ccagucacacgaccagaua

SEQ ID NO: 947672 - RNA, 19 nt, Homo sapiens
gaaaggcaagcacaucaag

SEQ ID NO: 947673 - RNA, 19 nt, Homo sapiens
uagcagauccacacaacuu

SEQ ID NO: 947674 - RNA, 19 nt, Homo sapiens
gaagaacuaggugucauca

SEQ ID NO: 947675 - RNA, 19 nt, Homo sapiens
aaugagacguaaugggaaa

SEQ ID NO: 947676 - RNA, 19 nt, Homo sapiens
gcacaucaaggccacagau

SEQ ID NO: 947677 - RNA, 19 nt, Homo sapiens
gauccacacaacuuaaaga

SEQ ID NO: 947678 - RNA, 19 nt, Homo sapiens
ggagcuggccguggucauu

SEQ ID NO: 947679 - RNA, 19 nt, Homo sapiens
ccugguggguccucacuug

SEQ ID NO: 947680 - RNA, 19 nt, Homo sapiens
aagaucugcugccgaguga

SEQ ID NO: 947681 - RNA, 19 nt, Homo sapiens
gaucugcugccgagugaau

SEQ ID NO: 947682 - RNA, 19 nt, Homo sapiens
caucaucuucagcaaguuu

SEQ ID NO: 947683 - RNA, 19 nt, Homo sapiens
caaggagcccaucaucuuc

SEQ ID NO: 947684 - RNA, 19 nt, Homo sapiens
ccagagacaugagacuagu

SEQ ID NO: 947685 - RNA, 19 nt, Homo sapiens
gggcaucugcucccacuca

SEQ ID NO: 947686 - RNA, 19 nt, Homo sapiens
uuucaacccuccagagaca

SEQ ID NO: 947687 - RNA, 19 nt, Homo sapiens
gugugagauugaagaacua

SEQ ID NO: 947688 - RNA, 19 nt, Homo sapiens
ugaaguccagugugagauu

SEQ ID NO: 947689 - RNA, 19 nt, Homo sapiens
cagauccacacaacuuaaa

SEQ ID NO: 947690 - RNA, 19 nt, Homo sapiens
cguggucauuggaaagaaa

SEQ ID NO: 947691 - RNA, 19 nt, Homo sapiens
auaaauucgucaggucaaa

SEQ ID NO: 947692 - RNA, 19 nt, Homo sapiens
ccagggaaaggcccaguga

SEQ ID NO: 947693 - RNA, 19 nt, Homo sapiens
uggcaaaugagacguaaug

SEQ ID NO: 947694 - RNA, 19 nt, Homo sapiens
gcuucacuguggcucauga

SEQ ID NO: 947695 - RNA, 19 nt, Homo sapiens
gugugggcaugaauuaugu

SEQ ID NO: 947696 - RNA, 19 nt, Homo sapiens
gacguaaugggaaacaaug

SEQ ID NO: 947697 - RNA, 19 nt, Homo sapiens
acaugagacuagugcaguu

SEQ ID NO: 947698 - RNA, 19 nt, Homo sapiens
gagcuggccguggucauug

SEQ ID NO: 947699 - RNA, 19 nt, Homo sapiens
cccaucaucuucagcaagu

SEQ ID NO: 947700 - RNA, 19 nt, Homo sapiens
gaccaaggacaguguagca

SEQ ID NO: 947701 - RNA, 19 nt, Homo sapiens
gagacguaaugggaaacaa

SEQ ID NO: 947702 - RNA, 19 nt, Homo sapiens
uagaagaagguuacucaca

SEQ ID NO: 947703 - RNA, 19 nt, Homo sapiens
ugugugugggcaugaauua

SEQ ID NO: 947704 - RNA, 19 nt, Homo sapiens
uaggugucaucaucaacaa

SEQ ID NO: 947705 - RNA, 19 nt, Homo sapiens
aagaaaggcaagcacauca

SEQ ID NO: 947706 - RNA, 19 nt, Homo sapiens
agugugagauugaagaacu

SEQ ID NO: 947707 - RNA, 19 nt, Homo sapiens
gaguggcccuggguuagca

SEQ ID NO: 947708 - RNA, 19 nt, Homo sapiens
ccagaugguauucaagaca

SEQ ID NO: 947709 - RNA, 19 nt, Homo sapiens
uguagcagauccacacaac

SEQ ID NO: 947710 - RNA, 19 nt, Homo sapiens
aaagaaaggcaagcacauc

SEQ ID NO: 947711 - RNA, 19 nt, Homo sapiens
uaucaaccucaaugccuuu

SEQ ID NO: 947712 - RNA, 19 nt, Homo sapiens
cggcaacaccaaccagaug

SEQ ID NO: 947713 - RNA, 19 nt, Homo sapiens
gacgaugacgcaguuccua

SEQ ID NO: 947714 - RNA, 19 nt, Homo sapiens
caucaacaaggugguguga

SEQ ID NO: 947715 - RNA, 19 nt, Homo sapiens
cgaugacgcaguuccuaga

SEQ ID NO: 947716 - RNA, 19 nt, Homo sapiens
gaacuaaacuggaauaagu

SEQ ID NO: 947717 - RNA, 19 nt, Homo sapiens
uaacgggaauuccuuauuu

SEQ ID NO: 947718 - RNA, 19 nt, Homo sapiens
caagagaccaguuaauaua

SEQ ID NO: 947719 - RNA, 19 nt, Homo sapiens
gcacaagggagcucacuua

SEQ ID NO: 947720 - RNA, 19 nt, Homo sapiens
uaagagaacuaaacuggaa

SEQ ID NO: 947721 - RNA, 19 nt, Homo sapiens
gagggcagcugcaaacuga

SEQ ID NO: 947722 - RNA, 19 nt, Homo sapiens
ggcaugauaugucagguua

SEQ ID NO: 947723 - RNA, 19 nt, Homo sapiens
caagggagcucacuuaaaa

SEQ ID NO: 947724 - RNA, 19 nt, Homo sapiens
gaagugaucgugacaguug

SEQ ID NO: 947725 - RNA, 19 nt, Homo sapiens
ccacagaaauaguauaaca

SEQ ID NO: 947726 - RNA, 19 nt, Homo sapiens
ggaguuagccucagcaguu

SEQ ID NO: 947727 - RNA, 19 nt, Homo sapiens
gauuagcucuugccuuuau

SEQ ID NO: 947728 - RNA, 19 nt, Homo sapiens
gguauuaacuuccuuggau

SEQ ID NO: 947729 - RNA, 19 nt, Homo sapiens
ggaaacugguauugauauu

SEQ ID NO: 947730 - RNA, 19 nt, Homo sapiens
aaacauaugugcaagaaca

SEQ ID NO: 947731 - RNA, 19 nt, Homo sapiens
gggaucaucugaaauuaau

SEQ ID NO: 947732 - RNA, 19 nt, Homo sapiens
caaguacgauauccucaaa

SEQ ID NO: 947733 - RNA, 19 nt, Homo sapiens
uaacuuccuuggauuugua

SEQ ID NO: 947734 - RNA, 19 nt, Homo sapiens
ucuccaaacugacuauaua

SEQ ID NO: 947735 - RNA, 19 nt, Homo sapiens
ggacugccuuccauuguga

SEQ ID NO: 947736 - RNA, 19 nt, Homo sapiens
caauggaacuuaaaucuac

SEQ ID NO: 947737 - RNA, 19 nt, Homo sapiens
guacauaaaccacagaaau

SEQ ID NO: 947738 - RNA, 19 nt, Homo sapiens
gcaggcaauuaacuacuaa

SEQ ID NO: 947739 - RNA, 19 nt, Homo sapiens
ccaggucucuccaaacuga

SEQ ID NO: 947740 - RNA, 19 nt, Homo sapiens
gaguuagccucagcaguua

SEQ ID NO: 947741 - RNA, 19 nt, Homo sapiens
ugaaacccuuggacuauuu

SEQ ID NO: 947742 - RNA, 19 nt, Homo sapiens
gcuaaggcaugauauguca

SEQ ID NO: 947743 - RNA, 19 nt, Homo sapiens
acacaagaagccauaauua

SEQ ID NO: 947744 - RNA, 19 nt, Homo sapiens
uaacaugacuccaacaaaa

SEQ ID NO: 947745 - RNA, 19 nt, Homo sapiens
gagcagagccaccuccuau

SEQ ID NO: 947746 - RNA, 19 nt, Homo sapiens
uggaauggguaauacauaa

SEQ ID NO: 947747 - RNA, 19 nt, Homo sapiens
gaugagagacuuauauaca

SEQ ID NO: 947748 - RNA, 19 nt, Homo sapiens
gcuauaaaccaccauuaaa

SEQ ID NO: 947749 - RNA, 19 nt, Homo sapiens
uaaaagggaucaucugaaa

SEQ ID NO: 947750 - RNA, 19 nt, Homo sapiens
gaaaacauaugugcaagaa

SEQ ID NO: 947751 - RNA, 19 nt, Homo sapiens
aaggagaaauuguguaguu

SEQ ID NO: 947752 - RNA, 19 nt, Homo sapiens
augauuagcucuugccuuu

SEQ ID NO: 947753 - RNA, 19 nt, Homo sapiens
aaagggaucaucugaaauu

SEQ ID NO: 947754 - RNA, 19 nt, Homo sapiens
caugauaugucagguuauu

SEQ ID NO: 947755 - RNA, 19 nt, Homo sapiens
gcagugcucuaacuuaaac

SEQ ID NO: 947756 - RNA, 19 nt, Homo sapiens
gauauucagucuccuuaag

SEQ ID NO: 947757 - RNA, 19 nt, Homo sapiens
gaugcagggccucuaaaua

SEQ ID NO: 947758 - RNA, 19 nt, Homo sapiens
gagaagugaucgugacagu

SEQ ID NO: 947759 - RNA, 19 nt, Homo sapiens
gcaauggaauggguaauac

SEQ ID NO: 947760 - RNA, 19 nt, Homo sapiens
guauugauuugcccaaguu

SEQ ID NO: 947761 - RNA, 19 nt, Homo sapiens
gcacaacaagcaaaugaau

SEQ ID NO: 947762 - RNA, 19 nt, Homo sapiens
uuacucaaaugaugucuug

SEQ ID NO: 947763 - RNA, 19 nt, Homo sapiens
gagaccaguuaauauaugu

SEQ ID NO: 947764 - RNA, 19 nt, Homo sapiens
ccaagagaccaguuaauau

SEQ ID NO: 947765 - RNA, 19 nt, Homo sapiens
ggaagaacaagcauaaugg

SEQ ID NO: 947766 - RNA, 19 nt, Homo sapiens
gggaagaacaagcauaaug

SEQ ID NO: 947767 - RNA, 19 nt, Homo sapiens
ggagcuguguaucauuuga

SEQ ID NO: 947768 - RNA, 19 nt, Homo sapiens
uaaaguaacaugacuccaa

SEQ ID NO: 947769 - RNA, 19 nt, Homo sapiens
gcaagaggaaccauaagga

SEQ ID NO: 947770 - RNA, 19 nt, Homo sapiens
gaaacccuuggacuauuua

SEQ ID NO: 947771 - RNA, 19 nt, Homo sapiens
aaggagcuguguaucauuu

SEQ ID NO: 947772 - RNA, 19 nt, Homo sapiens
guauuaacuuccuuggauu

SEQ ID NO: 947773 - RNA, 19 nt, Homo sapiens
gguuggaguugauguguug

SEQ ID NO: 947774 - RNA, 19 nt, Homo sapiens
guugaaaugugaauuaagg

SEQ ID NO: 947775 - RNA, 19 nt, Homo sapiens
gcauaaaucccagguacuu

SEQ ID NO: 947776 - RNA, 19 nt, Homo sapiens
gcuuugacauuugcaauug

SEQ ID NO: 947777 - RNA, 19 nt, Homo sapiens
ugaaggagcuguguaucau

SEQ ID NO: 947778 - RNA, 19 nt, Homo sapiens
guaaggcuaugugacuuga

SEQ ID NO: 947779 - RNA, 19 nt, Homo sapiens
gacacaagaagccauaauu

SEQ ID NO: 947780 - RNA, 19 nt, Homo sapiens
guagaugagagacuuauau

SEQ ID NO: 947781 - RNA, 19 nt, Homo sapiens
guguaaugcccuaauauuu

SEQ ID NO: 947782 - RNA, 19 nt, Homo sapiens
ugauaaacuucuagucaug

SEQ ID NO: 947783 - RNA, 19 nt, Homo sapiens
uugcagugcucuaacuuaa

SEQ ID NO: 947784 - RNA, 19 nt, Homo sapiens
ggauuuguacuuugugauu

SEQ ID NO: 947785 - RNA, 19 nt, Homo sapiens
gcagagccaccuccuauag

SEQ ID NO: 947786 - RNA, 19 nt, Homo sapiens
gugauaaacuucuagucau

SEQ ID NO: 947787 - RNA, 19 nt, Homo sapiens
gaaauacccaaacccuaug

SEQ ID NO: 947788 - RNA, 19 nt, Homo sapiens
gaacuccaccugacuuugg

SEQ ID NO: 947789 - RNA, 19 nt, Homo sapiens
ggaauggguaauacauaaa

SEQ ID NO: 947790 - RNA, 19 nt, Homo sapiens
gguguaaugcccuaauauu

SEQ ID NO: 947791 - RNA, 19 nt, Homo sapiens
uaaagucauuaccugaguu

SEQ ID NO: 947792 - RNA, 19 nt, Homo sapiens
ccauugcccugcugcugua

SEQ ID NO: 947793 - RNA, 19 nt, Homo sapiens
agaaauacccaaacccuau

SEQ ID NO: 947794 - RNA, 19 nt, Homo sapiens
augcagggccucuaaauaa

SEQ ID NO: 947795 - RNA, 19 nt, Homo sapiens
gaaggacugauggcaagua

SEQ ID NO: 947796 - RNA, 19 nt, Homo sapiens
ccucagcaguuaccuugaa

SEQ ID NO: 947797 - RNA, 19 nt, Homo sapiens
aaaugaaacccuuggacua

SEQ ID NO: 947798 - RNA, 19 nt, Homo sapiens
uuugaggguuccaguauuu

SEQ ID NO: 947799 - RNA, 19 nt, Homo sapiens
gaagcaauggaauggguaa

SEQ ID NO: 947800 - RNA, 19 nt, Homo sapiens
ggacugauggcaaguacga

SEQ ID NO: 947801 - RNA, 19 nt, Homo sapiens
uccaagagaccaguuaaua

SEQ ID NO: 947802 - RNA, 19 nt, Homo sapiens
gccugaaacuaaccacuga

SEQ ID NO: 947803 - RNA, 19 nt, Homo sapiens
gaaggagcuguguaucauu

SEQ ID NO: 947804 - RNA, 19 nt, Homo sapiens
guaaagguauuaacuuccu

SEQ ID NO: 947805 - RNA, 19 nt, Homo sapiens
gcaaguacgauauccucaa

SEQ ID NO: 947806 - RNA, 19 nt, Homo sapiens
aagguguaaugcccuaaua

SEQ ID NO: 947807 - RNA, 19 nt, Homo sapiens
gaaacugguauugauauuc

SEQ ID NO: 947808 - RNA, 19 nt, Homo sapiens
cuucuuaggacauuuguaa

SEQ ID NO: 947809 - RNA, 19 nt, Homo sapiens
uuguuuagcuuaagacuuc

SEQ ID NO: 947810 - RNA, 19 nt, Homo sapiens
agagaccaguuaauauaug

SEQ ID NO: 947811 - RNA, 19 nt, Homo sapiens
gggacugccuuccauugug

SEQ ID NO: 947812 - RNA, 19 nt, Homo sapiens
gcacugcagguuuuacuua

SEQ ID NO: 947813 - RNA, 19 nt, Homo sapiens
gaagaacaagcauaauggu

SEQ ID NO: 947814 - RNA, 19 nt, Homo sapiens
guaacaugacuccaacaaa

SEQ ID NO: 947815 - RNA, 19 nt, Homo sapiens
ugcagggccucuaaauaaa

SEQ ID NO: 947816 - RNA, 19 nt, Homo sapiens
gaaaguagcccgaguacaa

SEQ ID NO: 947817 - RNA, 19 nt, Homo sapiens
uauagagucuguugucuua

SEQ ID NO: 947818 - RNA, 19 nt, Homo sapiens
gguaagcuguuccugagua

SEQ ID NO: 947819 - RNA, 19 nt, Homo sapiens
aaacaggucuggagugaga

SEQ ID NO: 947820 - RNA, 19 nt, Homo sapiens
gagaugcagugcccuaaga

SEQ ID NO: 947821 - RNA, 19 nt, Homo sapiens
gcaguuucauuugacaaua

SEQ ID NO: 947822 - RNA, 19 nt, Homo sapiens
ugacaguccuuauaaauac

SEQ ID NO: 947823 - RNA, 19 nt, Homo sapiens
ugaaacaggucuggaguga

SEQ ID NO: 947824 - RNA, 19 nt, Homo sapiens
caacagccacuuccagaaa

SEQ ID NO: 947825 - RNA, 19 nt, Homo sapiens
uagcaucaauucacgcuuu

SEQ ID NO: 947826 - RNA, 19 nt, Homo sapiens
agaaacagagucccaguua

SEQ ID NO: 947827 - RNA, 19 nt, Homo sapiens
gaugcagucuuacuauguu

SEQ ID NO: 947828 - RNA, 19 nt, Homo sapiens
uuguagagaugcagucuua

SEQ ID NO: 947829 - RNA, 19 nt, Homo sapiens
gcugcugucuuuauucaaa

SEQ ID NO: 947830 - RNA, 19 nt, Homo sapiens
gagcuauuguaaccuguaa

SEQ ID NO: 947831 - RNA, 19 nt, Homo sapiens
gagaugcagucuuacuaug

SEQ ID NO: 947832 - RNA, 19 nt, Homo sapiens
ucauuuagguacauuguga

SEQ ID NO: 947833 - RNA, 19 nt, Homo sapiens
gagaaagacaucuaaaugg

SEQ ID NO: 947834 - RNA, 19 nt, Homo sapiens
gcccuaagacccacacuaa

SEQ ID NO: 947835 - RNA, 19 nt, Homo sapiens
agaaagacaucuaaauggu

SEQ ID NO: 947836 - RNA, 19 nt, Homo sapiens
ugauacagauagcauguga

SEQ ID NO: 947837 - RNA, 19 nt, Homo sapiens
gaacuauccgcaaggaaga

SEQ ID NO: 947838 - RNA, 19 nt, Homo sapiens
uaaggucucuagcaucaau

SEQ ID NO: 947839 - RNA, 19 nt, Homo sapiens
uguaaggucucuagcauca

SEQ ID NO: 947840 - RNA, 19 nt, Homo sapiens
gaugugggagcuauuguaa

SEQ ID NO: 947841 - RNA, 19 nt, Homo sapiens
gaaacagagucccaguuac

SEQ ID NO: 947842 - RNA, 19 nt, Homo sapiens
uaaagaauuccggaaagua

SEQ ID NO: 947843 - RNA, 19 nt, Homo sapiens
gacccacacuaaagaauuc

SEQ ID NO: 947844 - RNA, 19 nt, Homo sapiens
gcagagaaagacaucuaaa

SEQ ID NO: 947845 - RNA, 19 nt, Homo sapiens
gaaccuaucaguggauuuc

SEQ ID NO: 947846 - RNA, 19 nt, Homo sapiens
ccaaggugcugauaguaca

SEQ ID NO: 947847 - RNA, 19 nt, Homo sapiens
gaggacacguggugauaca

SEQ ID NO: 947848 - RNA, 19 nt, Homo sapiens
agagaaagacaucuaaaug

SEQ ID NO: 947849 - RNA, 19 nt, Homo sapiens
gcgaacgucuguguaacuu

SEQ ID NO: 947850 - RNA, 19 nt, Homo sapiens
gaagauguccgagcaacug

SEQ ID NO: 947851 - RNA, 19 nt, Homo sapiens
gaggaacuauccgcaagga

SEQ ID NO: 947852 - RNA, 19 nt, Homo sapiens
guaagcuguuccugaguau

SEQ ID NO: 947853 - RNA, 19 nt, Homo sapiens
ccaaagugaucuccuuagg

SEQ ID NO: 947854 - RNA, 19 nt, Homo sapiens
cccaucagcuggugugaga

SEQ ID NO: 947855 - RNA, 19 nt, Homo sapiens
ugagucaggugcuuuacau

SEQ ID NO: 947856 - RNA, 19 nt, Homo sapiens
cuaaagaauuccggaaagu

SEQ ID NO: 947857 - RNA, 19 nt, Homo sapiens
ggccaaagugaucuccuua

SEQ ID NO: 947858 - RNA, 19 nt, Homo sapiens
guaaaucccagcacuuugg

SEQ ID NO: 947859 - RNA, 19 nt, Homo sapiens
cugacaguccuuauaaaua

SEQ ID NO: 947860 - RNA, 19 nt, Homo sapiens
gagaaacagagucccaguu

SEQ ID NO: 947861 - RNA, 19 nt, Homo sapiens
ggacacguggugauacaga

SEQ ID NO: 947862 - RNA, 19 nt, Homo sapiens
ggauuucauucucuugagu

SEQ ID NO: 947863 - RNA, 19 nt, Homo sapiens
ugagucagguauccagaug

SEQ ID NO: 947864 - RNA, 19 nt, Homo sapiens
cugagguucugcauguaua

SEQ ID NO: 947865 - RNA, 19 nt, Homo sapiens
cacuagcaguuucauuuga

SEQ ID NO: 947866 - RNA, 19 nt, Homo sapiens
ggacauuucaguacuucug

SEQ ID NO: 947867 - RNA, 19 nt, Homo sapiens
cagagaaagacaucuaaau

SEQ ID NO: 947868 - RNA, 19 nt, Homo sapiens
gauguuauagagucuguug

SEQ ID NO: 947869 - RNA, 19 nt, Homo sapiens
uggaacauguuucugugaa

SEQ ID NO: 947870 - RNA, 19 nt, Homo sapiens
aagcuguuccugaguauaa

SEQ ID NO: 947871 - RNA, 19 nt, Homo sapiens
ccaguggugucuguaguga

SEQ ID NO: 947872 - RNA, 19 nt, Homo sapiens
gguccaugccucuuaagaa

SEQ ID NO: 947873 - RNA, 19 nt, Homo sapiens
gagcuucucaaucuuuaau

SEQ ID NO: 947874 - RNA, 19 nt, Homo sapiens
caguacuucugcuuauuga

SEQ ID NO: 947875 - RNA, 19 nt, Homo sapiens
gaguacaacccgaauucuu

SEQ ID NO: 947876 - RNA, 19 nt, Homo sapiens
cuaagacccacacuaaaga

SEQ ID NO: 947877 - RNA, 19 nt, Homo sapiens
gcuucucaaucuuuaaugu

SEQ ID NO: 947878 - RNA, 19 nt, Homo sapiens
guacuucugcuuauugagu

SEQ ID NO: 947879 - RNA, 19 nt, Homo sapiens
ucaggacauuucaguacuu

SEQ ID NO: 947880 - RNA, 19 nt, Homo sapiens
ggcaagcuaaggaggauuu

SEQ ID NO: 947881 - RNA, 19 nt, Homo sapiens
gggaaggccgaguugguuu

SEQ ID NO: 947882 - RNA, 19 nt, Homo sapiens
uagagaugcagucuuacua

SEQ ID NO: 947883 - RNA, 19 nt, Homo sapiens
gauuucauucucuugagua

SEQ ID NO: 947884 - RNA, 19 nt, Homo sapiens
ggaacauguuucugugaac

SEQ ID NO: 947885 - RNA, 19 nt, Homo sapiens
gugaugcacaguccaacua

SEQ ID NO: 947886 - RNA, 19 nt, Homo sapiens
caaaucaccuggggaauag

SEQ ID NO: 947887 - RNA, 19 nt, Homo sapiens
ucacuagcaguuucauuug

SEQ ID NO: 947888 - RNA, 19 nt, Homo sapiens
ggagcuauuguaaccugua

SEQ ID NO: 947889 - RNA, 19 nt, Homo sapiens
uagagucuguugucuuaag

SEQ ID NO: 947890 - RNA, 19 nt, Homo sapiens
guagauggaacauguuucu

SEQ ID NO: 947891 - RNA, 19 nt, Homo sapiens
agaugcugcugucuuuauu

SEQ ID NO: 947892 - RNA, 19 nt, Homo sapiens
aaagaauuccggaaaguag

SEQ ID NO: 947893 - RNA, 19 nt, Homo sapiens
ccuaagacccacacuaaag

SEQ ID NO: 947894 - RNA, 19 nt, Homo sapiens
guccaugccucuuaagaac

SEQ ID NO: 947895 - RNA, 19 nt, Homo sapiens
ucaaacuccuggccucaag

SEQ ID NO: 947896 - RNA, 19 nt, Homo sapiens
aaacagagucccaguuacu

SEQ ID NO: 947897 - RNA, 19 nt, Homo sapiens
ucaguacuucugcuuauug

SEQ ID NO: 947898 - RNA, 19 nt, Homo sapiens
uuucaguacuucugcuuau

SEQ ID NO: 947899 - RNA, 19 nt, Homo sapiens
gacaguccuuauaaauaca

SEQ ID NO: 947900 - RNA, 19 nt, Homo sapiens
ccuguaaggucucuagcau

SEQ ID NO: 947901 - RNA, 19 nt, Homo sapiens
gauguccgagcaacugaaa

SEQ ID NO: 947902 - RNA, 19 nt, Homo sapiens
gguucugcauguauaacaa

SEQ ID NO: 947903 - RNA, 19 nt, Homo sapiens
uaaggaggauuuucacuag

SEQ ID NO: 947904 - RNA, 19 nt, Homo sapiens
aagcagagaaagacaucua

SEQ ID NO: 947905 - RNA, 19 nt, Homo sapiens
cuaaaaggauguuauagag

SEQ ID NO: 947906 - RNA, 19 nt, Homo sapiens
uaagacccacacuaaagaa

SEQ ID NO: 947907 - RNA, 19 nt, Homo sapiens
ccaaaucaccuggggaaua

SEQ ID NO: 947908 - RNA, 19 nt, Homo sapiens
gcugauaguacaggcauga

SEQ ID NO: 947909 - RNA, 19 nt, Homo sapiens
aguggugucuguagugaga

SEQ ID NO: 947910 - RNA, 19 nt, Homo sapiens
gugaaccuaucaguggauu

SEQ ID NO: 947911 - RNA, 19 nt, Homo sapiens
ccgaauucuugcagaccua

SEQ ID NO: 947912 - RNA, 19 nt, Homo sapiens
acuaaagaauuccggaaag

SEQ ID NO: 947913 - RNA, 19 nt, Homo sapiens
caaagugaucuccuuaggu

SEQ ID NO: 947914 - RNA, 19 nt, Homo sapiens
gacacguggugauacagau

SEQ ID NO: 947915 - RNA, 19 nt, Homo sapiens
gaugaagagcagcgagaau

SEQ ID NO: 947916 - RNA, 19 nt, Homo sapiens
caagauggcucuaugagua

SEQ ID NO: 947917 - RNA, 19 nt, Homo sapiens
gaccagccaucaaguauuu

SEQ ID NO: 947918 - RNA, 19 nt, Homo sapiens
gagcacgguucaagaaauu

SEQ ID NO: 947919 - RNA, 19 nt, Homo sapiens
gguuugcaaugccauauua

SEQ ID NO: 947920 - RNA, 19 nt, Homo sapiens
agucaggaguguuguauua

SEQ ID NO: 947921 - RNA, 19 nt, Homo sapiens
aaguauggcuugcugaaua

SEQ ID NO: 947922 - RNA, 19 nt, Homo sapiens
guacucugaucguaucuuu

SEQ ID NO: 947923 - RNA, 19 nt, Homo sapiens
uaacagaacaauacccuaa

SEQ ID NO: 947924 - RNA, 19 nt, Homo sapiens
ccagggauucuaauauuua

SEQ ID NO: 947925 - RNA, 19 nt, Homo sapiens
uaacaucuuugaaguaugg

SEQ ID NO: 947926 - RNA, 19 nt, Homo sapiens
gaaaagggaugggauagaa

SEQ ID NO: 947927 - RNA, 19 nt, Homo sapiens
caggaguguuguauuauuu

SEQ ID NO: 947928 - RNA, 19 nt, Homo sapiens
uugaagaacugguaugcua

SEQ ID NO: 947929 - RNA, 19 nt, Homo sapiens
caccuacucuccaaauauu

SEQ ID NO: 947930 - RNA, 19 nt, Homo sapiens
ggagcacgguucaagaaau

SEQ ID NO: 947931 - RNA, 19 nt, Homo sapiens
ggaauuccuguuauuguaa

SEQ ID NO: 947932 - RNA, 19 nt, Homo sapiens
cugaauaucuuuaccaaca

SEQ ID NO: 947933 - RNA, 19 nt, Homo sapiens
uuaaccagcuagaccauuu

SEQ ID NO: 947934 - RNA, 19 nt, Homo sapiens
gauagaaggguuugcaaug

SEQ ID NO: 947935 - RNA, 19 nt, Homo sapiens
ucaggaguguuguauuauu

SEQ ID NO: 947936 - RNA, 19 nt, Homo sapiens
gauaaggacgcaucgcaaa

SEQ ID NO: 947937 - RNA, 19 nt, Homo sapiens
agauaaagcuuggguggaa

SEQ ID NO: 947938 - RNA, 19 nt, Homo sapiens
cagauugauuggaauaaga

SEQ ID NO: 947939 - RNA, 19 nt, Homo sapiens
gaauaucuuuaccaacauc

SEQ ID NO: 947940 - RNA, 19 nt, Homo sapiens
gaagaugccuguuuugucu

SEQ ID NO: 947941 - RNA, 19 nt, Homo sapiens
cacacaagcucuucuuauc

SEQ ID NO: 947942 - RNA, 19 nt, Homo sapiens
cauuguuucucuucgauaa

SEQ ID NO: 947943 - RNA, 19 nt, Homo sapiens
aagcuuggguggaauauca

SEQ ID NO: 947944 - RNA, 19 nt, Homo sapiens
guauaggacauuugaagaa

SEQ ID NO: 947945 - RNA, 19 nt, Homo sapiens
gaagcaugauggacaggau

SEQ ID NO: 947946 - RNA, 19 nt, Homo sapiens
gagucgagguucacauugu

SEQ ID NO: 947947 - RNA, 19 nt, Homo sapiens
cgacaugcaccgcaaauuc

SEQ ID NO: 947948 - RNA, 19 nt, Homo sapiens
ucucaguaaugauuuggua

SEQ ID NO: 947949 - RNA, 19 nt, Homo sapiens
uaauguggauguagugcuu

SEQ ID NO: 947950 - RNA, 19 nt, Homo sapiens
gaaaaugacguaccaacaa

SEQ ID NO: 947951 - RNA, 19 nt, Homo sapiens
caaugaagaugccuguuuu

SEQ ID NO: 947952 - RNA, 19 nt, Homo sapiens
guaccagcauuuaguuaca

SEQ ID NO: 947953 - RNA, 19 nt, Homo sapiens
agaaguagaagcggcauua

SEQ ID NO: 947954 - RNA, 19 nt, Homo sapiens
acaggacucugaaucaugu

SEQ ID NO: 947955 - RNA, 19 nt, Homo sapiens
caguaaugauuugguagua

SEQ ID NO: 947956 - RNA, 19 nt, Homo sapiens
gaagcggcauuagcagaga

SEQ ID NO: 947957 - RNA, 19 nt, Homo sapiens
aaacugguacuuccaaaga

SEQ ID NO: 947958 - RNA, 19 nt, Homo sapiens
gcugugauaugcaggaaag

SEQ ID NO: 947959 - RNA, 19 nt, Homo sapiens
ugacguaccaacaaugauu

SEQ ID NO: 947960 - RNA, 19 nt, Homo sapiens
acaaugaagaugccuguuu

SEQ ID NO: 947961 - RNA, 19 nt, Homo sapiens
ccacacaagcucuucuuau

SEQ ID NO: 947962 - RNA, 19 nt, Homo sapiens
gaaggacagucaggugaag

SEQ ID NO: 947963 - RNA, 19 nt, Homo sapiens
ccacaggacucugaaucau

SEQ ID NO: 947964 - RNA, 19 nt, Homo sapiens
ccacaagauggcucuauga

SEQ ID NO: 947965 - RNA, 19 nt, Homo sapiens
gaucuauccguaccaaaug

SEQ ID NO: 947966 - RNA, 19 nt, Homo sapiens
gcagacucuugugaaguuu

SEQ ID NO: 947967 - RNA, 19 nt, Homo sapiens
ucucuacuguguacucuga

SEQ ID NO: 947968 - RNA, 19 nt, Homo sapiens
gaguaccagcauuuaguua

SEQ ID NO: 947969 - RNA, 19 nt, Homo sapiens
cagcuagaccauuugagua

SEQ ID NO: 947970 - RNA, 19 nt, Homo sapiens
aaacugcccuggagcuagu

SEQ ID NO: 947971 - RNA, 19 nt, Homo sapiens
uuccagggauucuaauauu

SEQ ID NO: 947972 - RNA, 19 nt, Homo sapiens
guucauguucuguucuaua

SEQ ID NO: 947973 - RNA, 19 nt, Homo sapiens
ggaaaucuuacaccuucaa

SEQ ID NO: 947974 - RNA, 19 nt, Homo sapiens
ugcagacucuugugaaguu

SEQ ID NO: 947975 - RNA, 19 nt, Homo sapiens
uccagggauucuaauauuu

SEQ ID NO: 947976 - RNA, 19 nt, Homo sapiens
ucacuacccugggaaaucu

SEQ ID NO: 947977 - RNA, 19 nt, Homo sapiens
caacaaugauuuggcuuuu

SEQ ID NO: 947978 - RNA, 19 nt, Homo sapiens
ggucauuguuucucuucga

SEQ ID NO: 947979 - RNA, 19 nt, Homo sapiens
gauaaagcuuggguggaau

SEQ ID NO: 947980 - RNA, 19 nt, Homo sapiens
uuagugaguugcauugauc

SEQ ID NO: 947981 - RNA, 19 nt, Homo sapiens
ucccggugcucuucuguuu

SEQ ID NO: 947982 - RNA, 19 nt, Homo sapiens
cuaguguccacaagauuua

SEQ ID NO: 947983 - RNA, 19 nt, Homo sapiens
ggauagaaggguuugcaau

SEQ ID NO: 947984 - RNA, 19 nt, Homo sapiens
cacaagcucuucuuaucuc

SEQ ID NO: 947985 - RNA, 19 nt, Homo sapiens
gacauuugaagaacuggua

SEQ ID NO: 947986 - RNA, 19 nt, Homo sapiens
ggaguguuguauuauuugg

SEQ ID NO: 947987 - RNA, 19 nt, Homo sapiens
ucagaccagccaucaagua

SEQ ID NO: 947988 - RNA, 19 nt, Homo sapiens
ugaaacugcugucuuuuau

SEQ ID NO: 947989 - RNA, 19 nt, Homo sapiens
augugaaacugcugucuuu

SEQ ID NO: 947990 - RNA, 19 nt, Homo sapiens
ucaccuacucuccaaauau

SEQ ID NO: 947991 - RNA, 19 nt, Homo sapiens
cuuuacagauugauuggaa

SEQ ID NO: 947992 - RNA, 19 nt, Homo sapiens
guucugcguucagcuggua

SEQ ID NO: 947993 - RNA, 19 nt, Homo sapiens
acaauacccuaaaggucuu

SEQ ID NO: 947994 - RNA, 19 nt, Homo sapiens
acagaacaauacccuaaag

SEQ ID NO: 947995 - RNA, 19 nt, Homo sapiens
gaaguauggcuugcugaau

SEQ ID NO: 947996 - RNA, 19 nt, Homo sapiens
cguaccaaaugauguugaa

SEQ ID NO: 947997 - RNA, 19 nt, Homo sapiens
gacguaccaacaaugauuu

SEQ ID NO: 947998 - RNA, 19 nt, Homo sapiens
ccaaagugcagacucuugu

SEQ ID NO: 947999 - RNA, 19 nt, Homo sapiens
gaguauucuuccagggauu

SEQ ID NO: 948000 - RNA, 19 nt, Homo sapiens
guuagaggguuuugaaaug

SEQ ID NO: 948001 - RNA, 19 nt, Homo sapiens
ugaguugcauugaucuauc

SEQ ID NO: 948002 - RNA, 19 nt, Homo sapiens
ggagucaggaguguuguau

SEQ ID NO: 948003 - RNA, 19 nt, Homo sapiens
ucuaguguccacaagauuu

SEQ ID NO: 948004 - RNA, 19 nt, Homo sapiens
gcucuucuuaucucuacua

SEQ ID NO: 948005 - RNA, 19 nt, Homo sapiens
agaaguuccucagccugua

SEQ ID NO: 948006 - RNA, 19 nt, Homo sapiens
gcagagauucccggaguca

SEQ ID NO: 948007 - RNA, 19 nt, Homo sapiens
gcgaccagaucgacaugca

SEQ ID NO: 948008 - RNA, 19 nt, Homo sapiens
aguauggcuugcugaauau

SEQ ID NO: 948009 - RNA, 19 nt, Homo sapiens
uaaagaaaaugacguacca

SEQ ID NO: 948010 - RNA, 19 nt, Homo sapiens
ccauuugaguaccagcauu

SEQ ID NO: 948011 - RNA, 19 nt, Homo sapiens
gugaaacugcugucuuuua

SEQ ID NO: 948012 - RNA, 19 nt, Homo sapiens
aaauguucauguucuguuc

SEQ ID NO: 948013 - RNA, 19 nt, Homo sapiens
guucagaccagccaucaag

SEQ ID NO: 948014 - RNA, 19 nt, Homo sapiens
ggagucgagguucacauug

SEQ ID NO: 948015 - RNA, 19 nt, Homo sapiens
cagaccagccaucaaguau

SEQ ID NO: 948016 - RNA, 19 nt, Homo sapiens
ggugggagcucuacuggaa

SEQ ID NO: 948017 - RNA, 19 nt, Homo sapiens
gcagaauucuucccugaug

SEQ ID NO: 948018 - RNA, 19 nt, Homo sapiens
uaaagagacuugggcugaa

SEQ ID NO: 948019 - RNA, 19 nt, Homo sapiens
ggugguggcugguuacuac

SEQ ID NO: 948020 - RNA, 19 nt, Homo sapiens
aaagagacuugggcugaaa

SEQ ID NO: 948021 - RNA, 19 nt, Homo sapiens
ccugaugcaguacuuauua

SEQ ID NO: 948022 - RNA, 19 nt, Homo sapiens
caaugcagcugugaacgau

SEQ ID NO: 948023 - RNA, 19 nt, Homo sapiens
ggacuuugacugccaccuu

SEQ ID NO: 948024 - RNA, 19 nt, Homo sapiens
auucuucccugaugcagua

SEQ ID NO: 948025 - RNA, 19 nt, Homo sapiens
ccacuaauggaaauggaaa

SEQ ID NO: 948026 - RNA, 19 nt, Homo sapiens
gcugggucccuaaggauaa

SEQ ID NO: 948027 - RNA, 19 nt, Homo sapiens
gaugcaguacuuauuaugu

SEQ ID NO: 948028 - RNA, 19 nt, Homo sapiens
gcagauggugggagcucua

SEQ ID NO: 948029 - RNA, 19 nt, Homo sapiens
ggaagagucacggcagaug

SEQ ID NO: 948030 - RNA, 19 nt, Homo sapiens
ugggagcucuacuggaaga

SEQ ID NO: 948031 - RNA, 19 nt, Homo sapiens
ugcaguacuuauuauguug

SEQ ID NO: 948032 - RNA, 19 nt, Homo sapiens
cugaugcaguacuuauuau

SEQ ID NO: 948033 - RNA, 19 nt, Homo sapiens
cuaccugcgagucgaguua

SEQ ID NO: 948034 - RNA, 19 nt, Homo sapiens
ccaaugcagcugugaacga

SEQ ID NO: 948035 - RNA, 19 nt, Homo sapiens
cggcucaacacucaaauca

SEQ ID NO: 948036 - RNA, 19 nt, Homo sapiens
uuacuaccaugccaaugca

SEQ ID NO: 948037 - RNA, 19 nt, Homo sapiens
ccagcaccuuguggacuuu

SEQ ID NO: 948038 - RNA, 19 nt, Homo sapiens
cagcggcucaacacucaaa

SEQ ID NO: 948039 - RNA, 19 nt, Homo sapiens
gucuggugguggcugguua

SEQ ID NO: 948040 - RNA, 19 nt, Homo sapiens
ggcccuguccgucauguug

SEQ ID NO: 948041 - RNA, 19 nt, Homo sapiens
gcccuggccuacgugaaga

SEQ ID NO: 948042 - RNA, 19 nt, Homo sapiens
gauggugggagcucuacug

SEQ ID NO: 948043 - RNA, 19 nt, Homo sapiens
uggccuacgugaagaugug

SEQ ID NO: 948044 - RNA, 19 nt, Homo sapiens
augcagcugugaacgauca

SEQ ID NO: 948045 - RNA, 19 nt, Homo sapiens
gcagucaacgggcuguuuu

SEQ ID NO: 948046 - RNA, 19 nt, Homo sapiens
gaaaugaugugcagaguaa

SEQ ID NO: 948047 - RNA, 19 nt, Homo sapiens
caaacagacugaagugaaa

SEQ ID NO: 948048 - RNA, 19 nt, Homo sapiens
gagaaagcgugcuaaguug

SEQ ID NO: 948049 - RNA, 19 nt, Homo sapiens
ggucaugucuauuggugua

SEQ ID NO: 948050 - RNA, 19 nt, Homo sapiens
agagaaaucuucagagaau

SEQ ID NO: 948051 - RNA, 19 nt, Homo sapiens
gcaagaaagacuagagaaa

SEQ ID NO: 948052 - RNA, 19 nt, Homo sapiens
cuaaaguccucaacaagaa

SEQ ID NO: 948053 - RNA, 19 nt, Homo sapiens
cauaaagcaucauaggaaa

SEQ ID NO: 948054 - RNA, 19 nt, Homo sapiens
gauccuacgugaugauuuc

SEQ ID NO: 948055 - RNA, 19 nt, Homo sapiens
gaagugaaaucagaagaag

SEQ ID NO: 948056 - RNA, 19 nt, Homo sapiens
uaucaacuguuuccaagaa

SEQ ID NO: 948057 - RNA, 19 nt, Homo sapiens
uaaggaagcuggaaguucu

SEQ ID NO: 948058 - RNA, 19 nt, Homo sapiens
gauggagaaucaaguguug

SEQ ID NO: 948059 - RNA, 19 nt, Homo sapiens
caagugacucugauacaua

SEQ ID NO: 948060 - RNA, 19 nt, Homo sapiens
ugagaaagcgugcuaaguu

SEQ ID NO: 948061 - RNA, 19 nt, Homo sapiens
gcaagugacucugauacau

SEQ ID NO: 948062 - RNA, 19 nt, Homo sapiens
agagagaaaucuucagaga

SEQ ID NO: 948063 - RNA, 19 nt, Homo sapiens
gaagcuggaaguucuauga

SEQ ID NO: 948064 - RNA, 19 nt, Homo sapiens
ggauaccauuuguaagaaa

SEQ ID NO: 948065 - RNA, 19 nt, Homo sapiens
caaaugagacugcuucaag

SEQ ID NO: 948066 - RNA, 19 nt, Homo sapiens
ggaaaugaugugcagagua

SEQ ID NO: 948067 - RNA, 19 nt, Homo sapiens
caagaaaacuccugaaagu

SEQ ID NO: 948068 - RNA, 19 nt, Homo sapiens
gcuaaaguccucaacaaga

SEQ ID NO: 948069 - RNA, 19 nt, Homo sapiens
gggcagaugcuauggcuaa

SEQ ID NO: 948070 - RNA, 19 nt, Homo sapiens
caauagaagcugacaguga

SEQ ID NO: 948071 - RNA, 19 nt, Homo sapiens
gaaaacuccugaaaguaaa

SEQ ID NO: 948072 - RNA, 19 nt, Homo sapiens
gaagaaggcccagguugga

SEQ ID NO: 948073 - RNA, 19 nt, Homo sapiens
acaaagagacagagagaaa

SEQ ID NO: 948074 - RNA, 19 nt, Homo sapiens
gaaagacugggacaaggaa

SEQ ID NO: 948075 - RNA, 19 nt, Homo sapiens
guugggaaguuauugagaa

SEQ ID NO: 948076 - RNA, 19 nt, Homo sapiens
ggacgauccuacgugauga

SEQ ID NO: 948077 - RNA, 19 nt, Homo sapiens
ccaaacagacugaagugaa

SEQ ID NO: 948078 - RNA, 19 nt, Homo sapiens
gagagaaaucuucagagaa

SEQ ID NO: 948079 - RNA, 19 nt, Homo sapiens
aagugacucugauacauaa

SEQ ID NO: 948080 - RNA, 19 nt, Homo sapiens
gaugacagcagaccagaau

SEQ ID NO: 948081 - RNA, 19 nt, Homo sapiens
ggaaagugaugggccagau

SEQ ID NO: 948082 - RNA, 19 nt, Homo sapiens
gagaaaucuucagagaauu

SEQ ID NO: 948083 - RNA, 19 nt, Homo sapiens
ucauauuggucaugucuau

SEQ ID NO: 948084 - RNA, 19 nt, Homo sapiens
aauaugucauccucugaua

SEQ ID NO: 948085 - RNA, 19 nt, Homo sapiens
aaucaaguguugggacuaa

SEQ ID NO: 948086 - RNA, 19 nt, Homo sapiens
acucaacuauguaucugua

SEQ ID NO: 948087 - RNA, 19 nt, Homo sapiens
caugucuauugguguauua

SEQ ID NO: 948088 - RNA, 19 nt, Homo sapiens
ggaauuauaaggauaccau

SEQ ID NO: 948089 - RNA, 19 nt, Homo sapiens
acauaaagcaucauaggaa

SEQ ID NO: 948090 - RNA, 19 nt, Homo sapiens
gguguggugcaauuauuua

SEQ ID NO: 948091 - RNA, 19 nt, Homo sapiens
gaguaaagccagauguugu

SEQ ID NO: 948092 - RNA, 19 nt, Homo sapiens
cagaugcuauggcuaaagu

SEQ ID NO: 948093 - RNA, 19 nt, Homo sapiens
uggcuaaaguccucaacaa

SEQ ID NO: 948094 - RNA, 19 nt, Homo sapiens
uagcgucggugcuggaaga

SEQ ID NO: 948095 - RNA, 19 nt, Homo sapiens
aaggauaccauuuguaaga

SEQ ID NO: 948096 - RNA, 19 nt, Homo sapiens
gauggaaguacaaaugaga

SEQ ID NO: 948097 - RNA, 19 nt, Homo sapiens
gaaagcgugcuaaguugau

SEQ ID NO: 948098 - RNA, 19 nt, Homo sapiens
ucaaguguugggacuaaua

SEQ ID NO: 948099 - RNA, 19 nt, Homo sapiens
gauaccauuuguaagaaag

SEQ ID NO: 948100 - RNA, 19 nt, Homo sapiens
aaauacaauugcagucguu

SEQ ID NO: 948101 - RNA, 19 nt, Homo sapiens
cauaggaaauacaauugca

SEQ ID NO: 948102 - RNA, 19 nt, Homo sapiens
gaaagugaugggccagaug

SEQ ID NO: 948103 - RNA, 19 nt, Homo sapiens
aaagcgugcuaaguugaua

SEQ ID NO: 948104 - RNA, 19 nt, Homo sapiens
gaagaaaccaaaagccaaa

SEQ ID NO: 948105 - RNA, 19 nt, Homo sapiens
ggauggaaguacaaaugag

SEQ ID NO: 948106 - RNA, 19 nt, Homo sapiens
aaagccagauguuguccaa

SEQ ID NO: 948107 - RNA, 19 nt, Homo sapiens
auaagaagcuggaaaagga

SEQ ID NO: 948108 - RNA, 19 nt, Homo sapiens
gaugaugacgcaauagaag

SEQ ID NO: 948109 - RNA, 19 nt, Homo sapiens
gaucauauuggucaugucu

SEQ ID NO: 948110 - RNA, 19 nt, Homo sapiens
ugaagugaaaucagaagaa

SEQ ID NO: 948111 - RNA, 19 nt, Homo sapiens
gaauguugaugaaaagguu

SEQ ID NO: 948112 - RNA, 19 nt, Homo sapiens
agacaaagagacagagaga

SEQ ID NO: 948113 - RNA, 19 nt, Homo sapiens
gcuuuguguugggaaguua

SEQ ID NO: 948114 - RNA, 19 nt, Homo sapiens
caagaaagacuagagaaaa

SEQ ID NO: 948115 - RNA, 19 nt, Homo sapiens
agaaaacuccugaaaguaa

SEQ ID NO: 948116 - RNA, 19 nt, Homo sapiens
aauaugggcugggcagaug

SEQ ID NO: 948117 - RNA, 19 nt, Homo sapiens
agaaaucuucagagaauug

SEQ ID NO: 948118 - RNA, 19 nt, Homo sapiens
caaagagacagagagaaau

SEQ ID NO: 948119 - RNA, 19 nt, Homo sapiens
guuaaagcaagaaagacua

SEQ ID NO: 948120 - RNA, 19 nt, Homo sapiens
uaaaguccucaacaagaaa

SEQ ID NO: 948121 - RNA, 19 nt, Homo sapiens
gcugagcccugugacaaag

SEQ ID NO: 948122 - RNA, 19 nt, Homo sapiens
uaagcauuguuccucagaa

SEQ ID NO: 948123 - RNA, 19 nt, Homo sapiens
aaagugaugggccagauga

SEQ ID NO: 948124 - RNA, 19 nt, Homo sapiens
agccagauguuguccaaga

SEQ ID NO: 948125 - RNA, 19 nt, Homo sapiens
gggaaaugaugugcagagu

SEQ ID NO: 948126 - RNA, 19 nt, Homo sapiens
ucugauaguuggggaauua

SEQ ID NO: 948127 - RNA, 19 nt, Homo sapiens
ugaaagacugggacaagga

SEQ ID NO: 948128 - RNA, 19 nt, Homo sapiens
caaguguugggacuaauau

SEQ ID NO: 948129 - RNA, 19 nt, Homo sapiens
ccucagaacauuuguaaaa

SEQ ID NO: 948130 - RNA, 19 nt, Homo sapiens
caagcaggaagaaaccaaa

SEQ ID NO: 948131 - RNA, 19 nt, Homo sapiens
acagagagaaaucuucaga

SEQ ID NO: 948132 - RNA, 19 nt, Homo sapiens
agacagagagaaaucuuca

SEQ ID NO: 948133 - RNA, 19 nt, Homo sapiens
caagacaaagagacagaga

SEQ ID NO: 948134 - RNA, 19 nt, Homo sapiens
cagaguaaagccagauguu

SEQ ID NO: 948135 - RNA, 19 nt, Homo sapiens
ggauauauuucugcuugac

SEQ ID NO: 948136 - RNA, 19 nt, Homo sapiens
uaagaaagccaaaagacuu

SEQ ID NO: 948137 - RNA, 19 nt, Homo sapiens
gauaguuggggaauuauaa

SEQ ID NO: 948138 - RNA, 19 nt, Homo sapiens
caauugcagucguuuuauu

SEQ ID NO: 948139 - RNA, 19 nt, Homo sapiens
ggguguggugcaauuauuu

SEQ ID NO: 948140 - RNA, 19 nt, Homo sapiens
gauuucauauuuccccuuu

SEQ ID NO: 948141 - RNA, 19 nt, Homo sapiens
gggcugggcagaugcuaug

SEQ ID NO: 948142 - RNA, 19 nt, Homo sapiens
caagggguguggugcaauu

SEQ ID NO: 948143 - RNA, 19 nt, Homo sapiens
aaagagacagagagaaauc

SEQ ID NO: 948144 - RNA, 19 nt, Homo sapiens
uugggaaguuauugagaaa

SEQ ID NO: 948145 - RNA, 19 nt, Homo sapiens
gaagacgaggccacagaca

SEQ ID NO: 948146 - RNA, 19 nt, Homo sapiens
ccaagcuucuucuauguua

SEQ ID NO: 948147 - RNA, 19 nt, Homo sapiens
guugaaguaucuccuuuaa

SEQ ID NO: 948148 - RNA, 19 nt, Homo sapiens
gcagaccuuucacuucgua

SEQ ID NO: 948149 - RNA, 19 nt, Homo sapiens
cuaccaagcuucuucuaug

SEQ ID NO: 948150 - RNA, 19 nt, Homo sapiens
ugaacucucuuagucauaa

SEQ ID NO: 948151 - RNA, 19 nt, Homo sapiens
guagaagaaaguucagaua

SEQ ID NO: 948152 - RNA, 19 nt, Homo sapiens
ugagaaaacuguagaagaa

SEQ ID NO: 948153 - RNA, 19 nt, Homo sapiens
acaggaaagugaaguauca

SEQ ID NO: 948154 - RNA, 19 nt, Homo sapiens
uagaugaugucacaguuga

SEQ ID NO: 948155 - RNA, 19 nt, Homo sapiens
gaaaguugagacgugauua

SEQ ID NO: 948156 - RNA, 19 nt, Homo sapiens
gaacucucuuagucauaaa

SEQ ID NO: 948157 - RNA, 19 nt, Homo sapiens
gauagcgaaucuucuuuua

SEQ ID NO: 948158 - RNA, 19 nt, Homo sapiens
ggacgggcuuccucucaug

SEQ ID NO: 948159 - RNA, 19 nt, Homo sapiens
ugaccaaggugccagcuau

SEQ ID NO: 948160 - RNA, 19 nt, Homo sapiens
gcaaaguugucaucuaucc

SEQ ID NO: 948161 - RNA, 19 nt, Homo sapiens
gaacaguacacaagacucu

SEQ ID NO: 948162 - RNA, 19 nt, Homo sapiens
ggaaaguugagacgugauu

SEQ ID NO: 948163 - RNA, 19 nt, Homo sapiens
ggacuagacccagaucuuc

SEQ ID NO: 948164 - RNA, 19 nt, Homo sapiens
gaaguaucuccuuuaaaug

SEQ ID NO: 948165 - RNA, 19 nt, Homo sapiens
gcagaacaguacacaagac

SEQ ID NO: 948166 - RNA, 19 nt, Homo sapiens
augcaaaguugucaucuau

SEQ ID NO: 948167 - RNA, 19 nt, Homo sapiens
caaauugaaacaacucuca

SEQ ID NO: 948168 - RNA, 19 nt, Homo sapiens
gauugagccugaacucucu

SEQ ID NO: 948169 - RNA, 19 nt, Homo sapiens
caagcuucuucuauguuaa

SEQ ID NO: 948170 - RNA, 19 nt, Homo sapiens
ccagugauggcaauaagaa

SEQ ID NO: 948171 - RNA, 19 nt, Homo sapiens
caguugaaguaucuccuuu

SEQ ID NO: 948172 - RNA, 19 nt, Homo sapiens
uagccaaggauccaagaua

SEQ ID NO: 948173 - RNA, 19 nt, Homo sapiens
aaugauaucagaaggacua

SEQ ID NO: 948174 - RNA, 19 nt, Homo sapiens
gauccaagauaugccagau

SEQ ID NO: 948175 - RNA, 19 nt, Homo sapiens
ugucacaguugaaguaucu

SEQ ID NO: 948176 - RNA, 19 nt, Homo sapiens
agccaaggauccaagauau

SEQ ID NO: 948177 - RNA, 19 nt, Homo sapiens
acacaagacucuggacuac

SEQ ID NO: 948178 - RNA, 19 nt, Homo sapiens
ccuagaugaugucacaguu

SEQ ID NO: 948179 - RNA, 19 nt, Homo sapiens
cuucguauccaacaaauug

SEQ ID NO: 948180 - RNA, 19 nt, Homo sapiens
uaccaagcuucuucuaugu

SEQ ID NO: 948181 - RNA, 19 nt, Homo sapiens
acaagacucuggacuacag

SEQ ID NO: 948182 - RNA, 19 nt, Homo sapiens
cagcagaacaguacacaag

SEQ ID NO: 948183 - RNA, 19 nt, Homo sapiens
ugaugucacaguugaagua

SEQ ID NO: 948184 - RNA, 19 nt, Homo sapiens
ccaacaaauugaaacaacu

SEQ ID NO: 948185 - RNA, 19 nt, Homo sapiens
uagaagaaaguucagauag

SEQ ID NO: 948186 - RNA, 19 nt, Homo sapiens
ccagauaucucaaaauggu

SEQ ID NO: 948187 - RNA, 19 nt, Homo sapiens
caaccacagcagaacagua

SEQ ID NO: 948188 - RNA, 19 nt, Homo sapiens
ucaccagugucacaaaugg

SEQ ID NO: 948189 - RNA, 19 nt, Homo sapiens
agaagaaaguucagauagc

SEQ ID NO: 948190 - RNA, 19 nt, Homo sapiens
gagaaacuggcagaccuuu

SEQ ID NO: 948191 - RNA, 19 nt, Homo sapiens
ggagaaacuggcagaccuu

SEQ ID NO: 948192 - RNA, 19 nt, Homo sapiens
guaagagauugagccugaa

SEQ ID NO: 948193 - RNA, 19 nt, Homo sapiens
caaguggguguaccaguga

SEQ ID NO: 948194 - RNA, 19 nt, Homo sapiens
uuaaaugucaccaguguca

SEQ ID NO: 948195 - RNA, 19 nt, Homo sapiens
ucacuucguauccaacaaa

SEQ ID NO: 948196 - RNA, 19 nt, Homo sapiens
ugccagcuauucaacagaa

SEQ ID NO: 948197 - RNA, 19 nt, Homo sapiens
caaggugccagcuauucaa

SEQ ID NO: 948198 - RNA, 19 nt, Homo sapiens
aaauggagcacauccugaa

SEQ ID NO: 948199 - RNA, 19 nt, Homo sapiens
guaccagugauggcaauaa

SEQ ID NO: 948200 - RNA, 19 nt, Homo sapiens
guaucuccuuuaaauguca

SEQ ID NO: 948201 - RNA, 19 nt, Homo sapiens
ccgcugaggagauggauga

SEQ ID NO: 948202 - RNA, 19 nt, Homo sapiens
caacaaauugaaacaacuc

SEQ ID NO: 948203 - RNA, 19 nt, Homo sapiens
ccaaggugccagcuauuca

SEQ ID NO: 948204 - RNA, 19 nt, Homo sapiens
ggccacauguccacuacca

SEQ ID NO: 948205 - RNA, 19 nt, Homo sapiens
gaacgguggcuuuucuaaa

SEQ ID NO: 948206 - RNA, 19 nt, Homo sapiens
cuuuaaaugucaccagugu

SEQ ID NO: 948207 - RNA, 19 nt, Homo sapiens
agccugaacucucuuaguc

SEQ ID NO: 948208 - RNA, 19 nt, Homo sapiens
gagcaaccacagcagaaca

SEQ ID NO: 948209 - RNA, 19 nt, Homo sapiens
ccugaacucucuuagucau

SEQ ID NO: 948210 - RNA, 19 nt, Homo sapiens
uagcgaaucuucuuuuagu

SEQ ID NO: 948211 - RNA, 19 nt, Homo sapiens
gauaucagaaggacuagac

SEQ ID NO: 948212 - RNA, 19 nt, Homo sapiens
ugucaccagugucacaaau

SEQ ID NO: 948213 - RNA, 19 nt, Homo sapiens
gaccaaggugccagcuauu

SEQ ID NO: 948214 - RNA, 19 nt, Homo sapiens
ggguacauuuacauucugu

SEQ ID NO: 948215 - RNA, 19 nt, Homo sapiens
aacaucaaauggccacaug

SEQ ID NO: 948216 - RNA, 19 nt, Homo sapiens
gaaaguucagauagcgaau

SEQ ID NO: 948217 - RNA, 19 nt, Homo sapiens
uaccagugauggcaauaag

SEQ ID NO: 948218 - RNA, 19 nt, Homo sapiens
uacacaagacucuggacua

SEQ ID NO: 948219 - RNA, 19 nt, Homo sapiens
cagagcaaccacagcagaa

SEQ ID NO: 948220 - RNA, 19 nt, Homo sapiens
aggccuagaugaugucaca

SEQ ID NO: 948221 - RNA, 19 nt, Homo sapiens
agacccagaucuucuugag

SEQ ID NO: 948222 - RNA, 19 nt, Homo sapiens
ggugccagcuauucaacag

SEQ ID NO: 948223 - RNA, 19 nt, Homo sapiens
ugucacaaauggagcacau

SEQ ID NO: 948224 - RNA, 19 nt, Homo sapiens
gcauagggguacauuuaca

SEQ ID NO: 948225 - RNA, 19 nt, Homo sapiens
gaaggacuagacccagauc

SEQ ID NO: 948226 - RNA, 19 nt, Homo sapiens
ccaaggauccaagauaugc

SEQ ID NO: 948227 - RNA, 19 nt, Homo sapiens
agugaaguaucagcagaaa

SEQ ID NO: 948228 - RNA, 19 nt, Homo sapiens
ggacuacaggaaagugaag

SEQ ID NO: 948229 - RNA, 19 nt, Homo sapiens
ucccaggccuagaugaugu

SEQ ID NO: 948230 - RNA, 19 nt, Homo sapiens
caucaaauggccacauguc

SEQ ID NO: 948231 - RNA, 19 nt, Homo sapiens
agaauuacauaugcaugca

SEQ ID NO: 948232 - RNA, 19 nt, Homo sapiens
ugaaguaucagcagaaaau

SEQ ID NO: 948233 - RNA, 19 nt, Homo sapiens
gaugaugucacaguugaag

SEQ ID NO: 948234 - RNA, 19 nt, Homo sapiens
cauguccacuaccaagcuu

SEQ ID NO: 948235 - RNA, 19 nt, Homo sapiens
gauggcaauaagaaacaaa

SEQ ID NO: 948236 - RNA, 19 nt, Homo sapiens
gccaaggauccaagauaug

SEQ ID NO: 948237 - RNA, 19 nt, Homo sapiens
gccagcuauucaacagaaa

SEQ ID NO: 948238 - RNA, 19 nt, Homo sapiens
gagccugaacucucuuagu

SEQ ID NO: 948239 - RNA, 19 nt, Homo sapiens
uccaacaaauugaaacaac

SEQ ID NO: 948240 - RNA, 19 nt, Homo sapiens
ugccagauaucucaaaaug

SEQ ID NO: 948241 - RNA, 19 nt, Homo sapiens
gaugucacaguugaaguau

SEQ ID NO: 948242 - RNA, 19 nt, Homo sapiens
gaaguaucagcagaaaaua

SEQ ID NO: 948243 - RNA, 19 nt, Homo sapiens
cuacaggaaagugaaguau

SEQ ID NO: 948244 - RNA, 19 nt, Homo sapiens
gaaaggagcucuaugaacu

SEQ ID NO: 948245 - RNA, 19 nt, Homo sapiens
gaaagaagcacuaacauag

SEQ ID NO: 948246 - RNA, 19 nt, Homo sapiens
caacuuguauuccuuugua

SEQ ID NO: 948247 - RNA, 19 nt, Homo sapiens
ugaaauugcugccuuauuc

SEQ ID NO: 948248 - RNA, 19 nt, Homo sapiens
gaauauaucaacccgauuu

SEQ ID NO: 948249 - RNA, 19 nt, Homo sapiens
cuugagaccuuuauuguaa

SEQ ID NO: 948250 - RNA, 19 nt, Homo sapiens
ucaagcaucugaauaugaa

SEQ ID NO: 948251 - RNA, 19 nt, Homo sapiens
caagaaaugugauacaacu

SEQ ID NO: 948252 - RNA, 19 nt, Homo sapiens
gaugugagucuguuuguuu

SEQ ID NO: 948253 - RNA, 19 nt, Homo sapiens
gcagaaagaagcacuaaca

SEQ ID NO: 948254 - RNA, 19 nt, Homo sapiens
cuucagacuucuaaucaua

SEQ ID NO: 948255 - RNA, 19 nt, Homo sapiens
gcagauaacccagcuccua

SEQ ID NO: 948256 - RNA, 19 nt, Homo sapiens
gagauaguccagcuuguuu

SEQ ID NO: 948257 - RNA, 19 nt, Homo sapiens
ugaagcagcuagaccaaug

SEQ ID NO: 948258 - RNA, 19 nt, Homo sapiens
gcuuguaaaccuacuaaua

SEQ ID NO: 948259 - RNA, 19 nt, Homo sapiens
agaaagaagcacuaacaua

SEQ ID NO: 948260 - RNA, 19 nt, Homo sapiens
cugcaagacuucuaugauu

SEQ ID NO: 948261 - RNA, 19 nt, Homo sapiens
agaccaaugugaaaugauu

SEQ ID NO: 948262 - RNA, 19 nt, Homo sapiens
ucagaaaggagcucuauga

SEQ ID NO: 948263 - RNA, 19 nt, Homo sapiens
caucaggugagaaauauaa

SEQ ID NO: 948264 - RNA, 19 nt, Homo sapiens
gauacaacuugggcacuaa

SEQ ID NO: 948265 - RNA, 19 nt, Homo sapiens
gcagaagccaaauuuguga

SEQ ID NO: 948266 - RNA, 19 nt, Homo sapiens
ugaagaccuugaacacaaa

SEQ ID NO: 948267 - RNA, 19 nt, Homo sapiens
gaaaugauucuucaagcau

SEQ ID NO: 948268 - RNA, 19 nt, Homo sapiens
gacccaaucuagugcagaa

SEQ ID NO: 948269 - RNA, 19 nt, Homo sapiens
gaagcuaugaagcagauaa

SEQ ID NO: 948270 - RNA, 19 nt, Homo sapiens
uaucaucaggugagaaaua

SEQ ID NO: 948271 - RNA, 19 nt, Homo sapiens
gaacaggaagcggucauga

SEQ ID NO: 948272 - RNA, 19 nt, Homo sapiens
agaugaaauugcugccuua

SEQ ID NO: 948273 - RNA, 19 nt, Homo sapiens
acaaagacccggaagcuau

SEQ ID NO: 948274 - RNA, 19 nt, Homo sapiens
ggauggcaguuauggcuau

SEQ ID NO: 948275 - RNA, 19 nt, Homo sapiens
gagccacacuccugagaca

SEQ ID NO: 948276 - RNA, 19 nt, Homo sapiens
gaacuugaggcagaaagaa

SEQ ID NO: 948277 - RNA, 19 nt, Homo sapiens
gaaauugcugccuuauuca

SEQ ID NO: 948278 - RNA, 19 nt, Homo sapiens
gcagcuagaccaaugugaa

SEQ ID NO: 948279 - RNA, 19 nt, Homo sapiens
ggugagaaauauaaauagg

SEQ ID NO: 948280 - RNA, 19 nt, Homo sapiens
acaggaagcggucaugaaa

SEQ ID NO: 948281 - RNA, 19 nt, Homo sapiens
gaacuucagcaagaaaugu

SEQ ID NO: 948282 - RNA, 19 nt, Homo sapiens
ucuaugaacuuugggaaga

SEQ ID NO: 948283 - RNA, 19 nt, Homo sapiens
ugauacaacuugggcacua

SEQ ID NO: 948284 - RNA, 19 nt, Homo sapiens
gcacuccuguaacaaacau

SEQ ID NO: 948285 - RNA, 19 nt, Homo sapiens
augaagaccuugaacacaa

SEQ ID NO: 948286 - RNA, 19 nt, Homo sapiens
ggagcucuaugaacuuugg

SEQ ID NO: 948287 - RNA, 19 nt, Homo sapiens
gcugccuuauucagauuua

SEQ ID NO: 948288 - RNA, 19 nt, Homo sapiens
uaguccagcuuguuucuga

SEQ ID NO: 948289 - RNA, 19 nt, Homo sapiens
ugacuuaauuaccgauauc

SEQ ID NO: 948290 - RNA, 19 nt, Homo sapiens
cuagaccaaugugaaauga

SEQ ID NO: 948291 - RNA, 19 nt, Homo sapiens
cgaacuggcuggguauaca

SEQ ID NO: 948292 - RNA, 19 nt, Homo sapiens
gugcagaagccaaauuugu

SEQ ID NO: 948293 - RNA, 19 nt, Homo sapiens
agaaaugugauacaacuug

SEQ ID NO: 948294 - RNA, 19 nt, Homo sapiens
aaggagcucuaugaacuuu

SEQ ID NO: 948295 - RNA, 19 nt, Homo sapiens
cagaaaggagcucuaugaa

SEQ ID NO: 948296 - RNA, 19 nt, Homo sapiens
ugagccagauuuugaauuu

SEQ ID NO: 948297 - RNA, 19 nt, Homo sapiens
aaagugccauggaugaaca

SEQ ID NO: 948298 - RNA, 19 nt, Homo sapiens
aggaagcggucaugaaagu

SEQ ID NO: 948299 - RNA, 19 nt, Homo sapiens
uagggcagcucaagagagu

SEQ ID NO: 948300 - RNA, 19 nt, Homo sapiens
uggcuauggugaucaaaga

SEQ ID NO: 948301 - RNA, 19 nt, Homo sapiens
cagcuagaccaaugugaaa

SEQ ID NO: 948302 - RNA, 19 nt, Homo sapiens
caaagacccggaagcuaug

SEQ ID NO: 948303 - RNA, 19 nt, Homo sapiens
cuauggugaucaaagauga

SEQ ID NO: 948304 - RNA, 19 nt, Homo sapiens
agaugaccgucuuaacaaa

SEQ ID NO: 948305 - RNA, 19 nt, Homo sapiens
uucccugucugacuuauaa

SEQ ID NO: 948306 - RNA, 19 nt, Homo sapiens
ggagagcguuucagaucac

SEQ ID NO: 948307 - RNA, 19 nt, Homo sapiens
cgaaggcuagguucauuga

SEQ ID NO: 948308 - RNA, 19 nt, Homo sapiens
ugcaagacuucuaugauuc

SEQ ID NO: 948309 - RNA, 19 nt, Homo sapiens
cggaagcuaugaagcagau

SEQ ID NO: 948310 - RNA, 19 nt, Homo sapiens
ccauuucauuguauugugu

SEQ ID NO: 948311 - RNA, 19 nt, Homo sapiens
guacgagacccaaucuagu

SEQ ID NO: 948312 - RNA, 19 nt, Homo sapiens
ucagguagggaauauauca

SEQ ID NO: 948313 - RNA, 19 nt, Homo sapiens
gcaagaaaugugauacaac

SEQ ID NO: 948314 - RNA, 19 nt, Homo sapiens
gcugcacuccuguaacaaa

SEQ ID NO: 948315 - RNA, 19 nt, Homo sapiens
cggagagcguuucagauca

SEQ ID NO: 948316 - RNA, 19 nt, Homo sapiens
ggagacugcaagacuucua

SEQ ID NO: 948317 - RNA, 19 nt, Homo sapiens
gcuagaccaaugugaaaug

SEQ ID NO: 948318 - RNA, 19 nt, Homo sapiens
ccgauuucuuccucucuuu

SEQ ID NO: 948319 - RNA, 19 nt, Homo sapiens
cuuguaaaccuacuaauag

SEQ ID NO: 948320 - RNA, 19 nt, Homo sapiens
caagagagucccacgaacu

SEQ ID NO: 948321 - RNA, 19 nt, Homo sapiens
cagcuuguuucugaacuug

SEQ ID NO: 948322 - RNA, 19 nt, Homo sapiens
ucaaucacccugagauagu

SEQ ID NO: 948323 - RNA, 19 nt, Homo sapiens
uauaucaacccgauuucuu

SEQ ID NO: 948324 - RNA, 19 nt, Homo sapiens
uaacaaagacccggaagcu

SEQ ID NO: 948325 - RNA, 19 nt, Homo sapiens
cagcugauuuagugauaag

SEQ ID NO: 948326 - RNA, 19 nt, Homo sapiens
gagcguuucagaucacaug

SEQ ID NO: 948327 - RNA, 19 nt, Homo sapiens
ccucagguagggaauauau

SEQ ID NO: 948328 - RNA, 19 nt, Homo sapiens
ucagcugauuuagugauaa

SEQ ID NO: 948329 - RNA, 19 nt, Homo sapiens
gaaagugccauggaugaac

SEQ ID NO: 948330 - RNA, 19 nt, Homo sapiens
gaagaguacgagacccaau

SEQ ID NO: 948331 - RNA, 19 nt, Homo sapiens
gaaaauguacuagugaugu

SEQ ID NO: 948332 - RNA, 19 nt, Homo sapiens
gcugauuuagugauaagaa

SEQ ID NO: 948333 - RNA, 19 nt, Homo sapiens
auucagauuuacucucuug

SEQ ID NO: 948334 - RNA, 19 nt, Homo sapiens
uugcugcacuccuguaaca

SEQ ID NO: 948335 - RNA, 19 nt, Homo sapiens
aagaagcacuaacauagcu

SEQ ID NO: 948336 - RNA, 19 nt, Homo sapiens
gagacugcaagacuucuau

SEQ ID NO: 948337 - RNA, 19 nt, Homo sapiens
agcaagaaaugugauacaa

SEQ ID NO: 948338 - RNA, 19 nt, Homo sapiens
ccggagagcguuucagauc

SEQ ID NO: 948339 - RNA, 19 nt, Homo sapiens
ccagcuuguuucugaacuu

SEQ ID NO: 948340 - RNA, 19 nt, Homo sapiens
ugagauaguccagcuuguu

SEQ ID NO: 948341 - RNA, 19 nt, Homo sapiens
gcuauggugaucaaagaug

SEQ ID NO: 948342 - RNA, 19 nt, Homo sapiens
ggaauauaucaacccgauu

SEQ ID NO: 948343 - RNA, 19 nt, Homo sapiens
aaucuugagaccuuuauug

SEQ ID NO: 948344 - RNA, 19 nt, Homo sapiens
gaucacaaaugcugagaga

SEQ ID NO: 948345 - RNA, 19 nt, Homo sapiens
uaaauggaguauccugaaa

SEQ ID NO: 948346 - RNA, 19 nt, Homo sapiens
gcagguucuuucuguguuu

SEQ ID NO: 948347 - RNA, 19 nt, Homo sapiens
ucacuacucuccucugcaa

SEQ ID NO: 948348 - RNA, 19 nt, Homo sapiens
cagcugggcuccuaugauc

SEQ ID NO: 948349 - RNA, 19 nt, Homo sapiens
gcaccaaucggccguucua

SEQ ID NO: 948350 - RNA, 19 nt, Homo sapiens
gaaaacagaugcagaagcu

SEQ ID NO: 948351 - RNA, 19 nt, Homo sapiens
gcccaacagucauggagaa

SEQ ID NO: 948352 - RNA, 19 nt, Homo sapiens
gaaacgggcacgugaaguc

SEQ ID NO: 948353 - RNA, 19 nt, Homo sapiens
gcugagagacugcgaagga

SEQ ID NO: 948354 - RNA, 19 nt, Homo sapiens
gggcuccuaugauccauug

SEQ ID NO: 948355 - RNA, 19 nt, Homo sapiens
gcagcgaucuuaauuuugu

SEQ ID NO: 948356 - RNA, 19 nt, Homo sapiens
gagcauagcagugggaaca

SEQ ID NO: 948357 - RNA, 19 nt, Homo sapiens
aaacauaaaugagcugacu

SEQ ID NO: 948358 - RNA, 19 nt, Homo sapiens
gacaggauccgucauugga

SEQ ID NO: 948359 - RNA, 19 nt, Homo sapiens
aaacacugcagcgaucuua

SEQ ID NO: 948360 - RNA, 19 nt, Homo sapiens
gcuugcagguucuuucugu

SEQ ID NO: 948361 - RNA, 19 nt, Homo sapiens
uacagaggcuacagaaaca

SEQ ID NO: 948362 - RNA, 19 nt, Homo sapiens
gcuacagaaacauaaauga

SEQ ID NO: 948363 - RNA, 19 nt, Homo sapiens
acauaaaugagcugacuuu

SEQ ID NO: 948364 - RNA, 19 nt, Homo sapiens
cagaggcuacagaaacaua

SEQ ID NO: 948365 - RNA, 19 nt, Homo sapiens
ggauggccguuucguagag

SEQ ID NO: 948366 - RNA, 19 nt, Homo sapiens
gaugcagaagcuacagaua

SEQ ID NO: 948367 - RNA, 19 nt, Homo sapiens
ugcagaagcuacagauaca

SEQ ID NO: 948368 - RNA, 19 nt, Homo sapiens
gcauagcagugggaacaag

SEQ ID NO: 948369 - RNA, 19 nt, Homo sapiens
gauacagaggcuacagaaa

SEQ ID NO: 948370 - RNA, 19 nt, Homo sapiens
uaugauccauugcccaaca

SEQ ID NO: 948371 - RNA, 19 nt, Homo sapiens
cugcagcgaucuuaauuuu

SEQ ID NO: 948372 - RNA, 19 nt, Homo sapiens
gaaacacugcagcgaucuu

SEQ ID NO: 948373 - RNA, 19 nt, Homo sapiens
ucacaaaugcugagagacu

SEQ ID NO: 948374 - RNA, 19 nt, Homo sapiens
cuagacaggauccgucauu

SEQ ID NO: 948375 - RNA, 19 nt, Homo sapiens
gcacgugaaguccuguuag

SEQ ID NO: 948376 - RNA, 19 nt, Homo sapiens
uagacaggauccgucauug

SEQ ID NO: 948377 - RNA, 19 nt, Homo sapiens
cagaagcuacagauacaga

SEQ ID NO: 948378 - RNA, 19 nt, Homo sapiens
gcagugggaacaaggucaa

SEQ ID NO: 948379 - RNA, 19 nt, Homo sapiens
gaggcuacagaaacauaaa

SEQ ID NO: 948380 - RNA, 19 nt, Homo sapiens
uuuguuagauuuggaguuc

SEQ ID NO: 948381 - RNA, 19 nt, Homo sapiens
cuacagaaacauaaaugag

SEQ ID NO: 948382 - RNA, 19 nt, Homo sapiens
auacagaggcuacagaaac

SEQ ID NO: 948383 - RNA, 19 nt, Homo sapiens
gcagcugggcuccuaugau

SEQ ID NO: 948384 - RNA, 19 nt, Homo sapiens
auaaauggaguauccugaa

SEQ ID NO: 948385 - RNA, 19 nt, Homo sapiens
ucucuaagccuauggaaaa

SEQ ID NO: 948386 - RNA, 19 nt, Homo sapiens
gggauggccguuucguaga

SEQ ID NO: 948387 - RNA, 19 nt, Homo sapiens
uguuagauuuggaguucaa

SEQ ID NO: 948388 - RNA, 19 nt, Homo sapiens
ugagagacugcgaaggaaa

SEQ ID NO: 948389 - RNA, 19 nt, Homo sapiens
cgugaaguccuguuagcuu

SEQ ID NO: 948390 - RNA, 19 nt, Homo sapiens
ggcacgugaaguccuguua

SEQ ID NO: 948391 - RNA, 19 nt, Homo sapiens
ccaccucucuaagccuaug

SEQ ID NO: 948392 - RNA, 19 nt, Homo sapiens
acacugcagcgaucuuaau

SEQ ID NO: 948393 - RNA, 19 nt, Homo sapiens
gagagacugcgaaggaaac

SEQ ID NO: 948394 - RNA, 19 nt, Homo sapiens
cugagagacugcgaaggaa

SEQ ID NO: 948395 - RNA, 19 nt, Homo sapiens
gaaaagcuucugggucuug

SEQ ID NO: 948396 - RNA, 19 nt, Homo sapiens
cagggauggccguuucgua

SEQ ID NO: 948397 - RNA, 19 nt, Homo sapiens
caacagcaaucgcccauuu

SEQ ID NO: 948398 - RNA, 19 nt, Homo sapiens
aaacaucucugugcuaauu

SEQ ID NO: 948399 - RNA, 19 nt, Homo sapiens
caucaucuuuggagaauuu

SEQ ID NO: 948400 - RNA, 19 nt, Homo sapiens
ggauauauuuaggcucuua

SEQ ID NO: 948401 - RNA, 19 nt, Homo sapiens
ggaaauaaucuuugucuuc

SEQ ID NO: 948402 - RNA, 19 nt, Homo sapiens
ugaaacaucucugugcuaa

SEQ ID NO: 948403 - RNA, 19 nt, Homo sapiens
gaacuggaccugcuugaau

SEQ ID NO: 948404 - RNA, 19 nt, Homo sapiens
caaaaugacuggugaaaga

SEQ ID NO: 948405 - RNA, 19 nt, Homo sapiens
gcuaguacagugucaguua

SEQ ID NO: 948406 - RNA, 19 nt, Homo sapiens
ggagagcaauacaucauca

SEQ ID NO: 948407 - RNA, 19 nt, Homo sapiens
gagcgucccuaaaccuaaa

SEQ ID NO: 948408 - RNA, 19 nt, Homo sapiens
ccaaagccauggugaaaca

SEQ ID NO: 948409 - RNA, 19 nt, Homo sapiens
ccaagaauauuugucaaug

SEQ ID NO: 948410 - RNA, 19 nt, Homo sapiens
gaugaacccucgagauaag

SEQ ID NO: 948411 - RNA, 19 nt, Homo sapiens
guacagugucaguuauuua

SEQ ID NO: 948412 - RNA, 19 nt, Homo sapiens
gcaauacaucaucaucuuu

SEQ ID NO: 948413 - RNA, 19 nt, Homo sapiens
ggaugaacccucgagauaa

SEQ ID NO: 948414 - RNA, 19 nt, Homo sapiens
cuaauaaguuugcuaguac

SEQ ID NO: 948415 - RNA, 19 nt, Homo sapiens
cggaugaacccucgagaua

SEQ ID NO: 948416 - RNA, 19 nt, Homo sapiens
cugaguggcuuaaauaauc

SEQ ID NO: 948417 - RNA, 19 nt, Homo sapiens
gaaaauugcucccacuagu

SEQ ID NO: 948418 - RNA, 19 nt, Homo sapiens
ucucugugcuaauuucuuu

SEQ ID NO: 948419 - RNA, 19 nt, Homo sapiens
aaauugcgguggaaaccua

SEQ ID NO: 948420 - RNA, 19 nt, Homo sapiens
caagaauauuugucaaugg

SEQ ID NO: 948421 - RNA, 19 nt, Homo sapiens
gcaccacuuugauucuguu

SEQ ID NO: 948422 - RNA, 19 nt, Homo sapiens
cucauaggcuucacaaaga

SEQ ID NO: 948423 - RNA, 19 nt, Homo sapiens
ggugggaaauaaucuuugu

SEQ ID NO: 948424 - RNA, 19 nt, Homo sapiens
ggaccugcuugaauaugga

SEQ ID NO: 948425 - RNA, 19 nt, Homo sapiens
aacuggaccugcuugaaua

SEQ ID NO: 948426 - RNA, 19 nt, Homo sapiens
caauacaucaucaucuuug

SEQ ID NO: 948427 - RNA, 19 nt, Homo sapiens
cgaggaggauggagagcaa

SEQ ID NO: 948428 - RNA, 19 nt, Homo sapiens
uguaacagguaguuggaaa

SEQ ID NO: 948429 - RNA, 19 nt, Homo sapiens
gcaaucgcccauuuccaaa

SEQ ID NO: 948430 - RNA, 19 nt, Homo sapiens
gggaaauaaucuuugucuu

SEQ ID NO: 948431 - RNA, 19 nt, Homo sapiens
ucauaggcuucacaaagaa

SEQ ID NO: 948432 - RNA, 19 nt, Homo sapiens
ggcagguggugggaaauaa

SEQ ID NO: 948433 - RNA, 19 nt, Homo sapiens
gaaccagauccaagaaaca

SEQ ID NO: 948434 - RNA, 19 nt, Homo sapiens
acagguaguuggaaacauc

SEQ ID NO: 948435 - RNA, 19 nt, Homo sapiens
ucacaaagaaggaaaauug

SEQ ID NO: 948436 - RNA, 19 nt, Homo sapiens
ccagauccaagaaacaauu

SEQ ID NO: 948437 - RNA, 19 nt, Homo sapiens
gguaaugcccgauaauguc

SEQ ID NO: 948438 - RNA, 19 nt, Homo sapiens
cuaguacagugucaguuau

SEQ ID NO: 948439 - RNA, 19 nt, Homo sapiens
gauaauuguguggugauuu

SEQ ID NO: 948440 - RNA, 19 nt, Homo sapiens
ccaauauccccauaauuua

SEQ ID NO: 948441 - RNA, 19 nt, Homo sapiens
ccacuuugauucuguuuug

SEQ ID NO: 948442 - RNA, 19 nt, Homo sapiens
ggaacuggaccugcuugaa

SEQ ID NO: 948443 - RNA, 19 nt, Homo sapiens
ugaaccagauccaagaaac

SEQ ID NO: 948444 - RNA, 19 nt, Homo sapiens
agcaauacaucaucaucuu

SEQ ID NO: 948445 - RNA, 19 nt, Homo sapiens
gagcaauacaucaucaucu

SEQ ID NO: 948446 - RNA, 19 nt, Homo sapiens
cagugucaguuauuuaaag

SEQ ID NO: 948447 - RNA, 19 nt, Homo sapiens
caucaucaucuuuggagaa

SEQ ID NO: 948448 - RNA, 19 nt, Homo sapiens
caucugaggcaccacuuug

SEQ ID NO: 948449 - RNA, 19 nt, Homo sapiens
uuuaggcucuuauuucauc

SEQ ID NO: 948450 - RNA, 19 nt, Homo sapiens
cccaauauccccauaauuu

SEQ ID NO: 948451 - RNA, 19 nt, Homo sapiens
ucacgaagaagauguaaaa

SEQ ID NO: 948452 - RNA, 19 nt, Homo sapiens
guuccaagaauauuuguca

SEQ ID NO: 948453 - RNA, 19 nt, Homo sapiens
gcagguggugggaaauaau

SEQ ID NO: 948454 - RNA, 19 nt, Homo sapiens
cuuauuucauccacacaaa

SEQ ID NO: 948455 - RNA, 19 nt, Homo sapiens
gaggugcaacugacacuca

SEQ ID NO: 948456 - RNA, 19 nt, Homo sapiens
aaagugguaaugcccgaua

SEQ ID NO: 948457 - RNA, 19 nt, Homo sapiens
aguacagugucaguuauuu

SEQ ID NO: 948458 - RNA, 19 nt, Homo sapiens
gugaaacaucucugugcua

SEQ ID NO: 948459 - RNA, 19 nt, Homo sapiens
aaauugcucccacuaguuc

SEQ ID NO: 948460 - RNA, 19 nt, Homo sapiens
ugauaauuguguggugauu

SEQ ID NO: 948461 - RNA, 19 nt, Homo sapiens
uaacagguaguuggaaaca

SEQ ID NO: 948462 - RNA, 19 nt, Homo sapiens
cagauccaagaaacaauuu

SEQ ID NO: 948463 - RNA, 19 nt, Homo sapiens
ggguggcacucgcuggaau

SEQ ID NO: 948464 - RNA, 19 nt, Homo sapiens
acucauaggcuucacaaag

SEQ ID NO: 948465 - RNA, 19 nt, Homo sapiens
guaaugcccgauaaugucu

SEQ ID NO: 948466 - RNA, 19 nt, Homo sapiens
guggugggaaauaaucuuu

SEQ ID NO: 948467 - RNA, 19 nt, Homo sapiens
gaggauggagagcaauaca

SEQ ID NO: 948468 - RNA, 19 nt, Homo sapiens
gaaacaucucugugcuaau

SEQ ID NO: 948469 - RNA, 19 nt, Homo sapiens
ugaggcaccacuuugauuc

SEQ ID NO: 948470 - RNA, 19 nt, Homo sapiens
aaugcccgauaaugucuuu

SEQ ID NO: 948471 - RNA, 19 nt, Homo sapiens
gguaguuggaaacaucuga

SEQ ID NO: 948472 - RNA, 19 nt, Homo sapiens
acuauaaagugguggaacu

SEQ ID NO: 948473 - RNA, 19 nt, Homo sapiens
gugaaccagauccaagaaa

SEQ ID NO: 948474 - RNA, 19 nt, Homo sapiens
aaauacaugcauugucuuc

SEQ ID NO: 948475 - RNA, 19 nt, Homo sapiens
gcuuaaauaauccugucaa

SEQ ID NO: 948476 - RNA, 19 nt, Homo sapiens
caagugccugggagccuuu

SEQ ID NO: 948477 - RNA, 19 nt, Homo sapiens
ggcaccacuuugauucugu

SEQ ID NO: 948478 - RNA, 19 nt, Homo sapiens
caugcauugucuucacgaa

SEQ ID NO: 948479 - RNA, 19 nt, Homo sapiens
acaucucugugcuaauuuc

SEQ ID NO: 948480 - RNA, 19 nt, Homo sapiens
gcccgauaaugucuuuuaa

SEQ ID NO: 948481 - RNA, 19 nt, Homo sapiens
aagugguaaugcccgauaa

SEQ ID NO: 948482 - RNA, 19 nt, Homo sapiens
ccaaauagcucauacaaua

SEQ ID NO: 948483 - RNA, 19 nt, Homo sapiens
uaagagagcucaaauaaug

SEQ ID NO: 948484 - RNA, 19 nt, Homo sapiens
ggagugagguaaagaauga

SEQ ID NO: 948485 - RNA, 19 nt, Homo sapiens
caucagauaucgggaauaa

SEQ ID NO: 948486 - RNA, 19 nt, Homo sapiens
gaaaggaaguggaagaaac

SEQ ID NO: 948487 - RNA, 19 nt, Homo sapiens
guggaaagcauguagauua

SEQ ID NO: 948488 - RNA, 19 nt, Homo sapiens
caacagguauccagcaaug

SEQ ID NO: 948489 - RNA, 19 nt, Homo sapiens
ggaagaaacagaaagaaau

SEQ ID NO: 948490 - RNA, 19 nt, Homo sapiens
aaauguaucuuguguggaa

SEQ ID NO: 948491 - RNA, 19 nt, Homo sapiens
gaagaaacagaaagaaauc

SEQ ID NO: 948492 - RNA, 19 nt, Homo sapiens
auacaaggauccugcauau

SEQ ID NO: 948493 - RNA, 19 nt, Homo sapiens
ucaaaccaguagugucuuu

SEQ ID NO: 948494 - RNA, 19 nt, Homo sapiens
caaggacccuaaaguuugu

SEQ ID NO: 948495 - RNA, 19 nt, Homo sapiens
gggaagaaacagaaagaaa

SEQ ID NO: 948496 - RNA, 19 nt, Homo sapiens
ccaguuuguuucuccauuu

SEQ ID NO: 948497 - RNA, 19 nt, Homo sapiens
ucagauaucgggaauaaau

SEQ ID NO: 948498 - RNA, 19 nt, Homo sapiens
ucaaggacccuaaaguuug

SEQ ID NO: 948499 - RNA, 19 nt, Homo sapiens
ggaaagcauguagauuaua

SEQ ID NO: 948500 - RNA, 19 nt, Homo sapiens
uaucuucccuuuguagaaa

SEQ ID NO: 948501 - RNA, 19 nt, Homo sapiens
gcucauacaauaauccauu

SEQ ID NO: 948502 - RNA, 19 nt, Homo sapiens
ucugugugauugucauuua

SEQ ID NO: 948503 - RNA, 19 nt, Homo sapiens
gcaauuaagagagcucaaa

SEQ ID NO: 948504 - RNA, 19 nt, Homo sapiens
agagaugauuuacaccuaa

SEQ ID NO: 948505 - RNA, 19 nt, Homo sapiens
ucuaucacguuaccacuaa

SEQ ID NO: 948506 - RNA, 19 nt, Homo sapiens
caguuuguuucuccauuua

SEQ ID NO: 948507 - RNA, 19 nt, Homo sapiens
gagaugauuuacaccuaau

SEQ ID NO: 948508 - RNA, 19 nt, Homo sapiens
uggaaagcauguagauuau

SEQ ID NO: 948509 - RNA, 19 nt, Homo sapiens
auauaaguaugccugguua

SEQ ID NO: 948510 - RNA, 19 nt, Homo sapiens
gcacauuacaggucuuugu

SEQ ID NO: 948511 - RNA, 19 nt, Homo sapiens
ggauaguggugcugucaca

SEQ ID NO: 948512 - RNA, 19 nt, Homo sapiens
uguuaacacucaucacauu

SEQ ID NO: 948513 - RNA, 19 nt, Homo sapiens
ggaggaagaaguugacaca

SEQ ID NO: 948514 - RNA, 19 nt, Homo sapiens
ggacucacacggugcuuug

SEQ ID NO: 948515 - RNA, 19 nt, Homo sapiens
ccuaaaguuuguaacauca

SEQ ID NO: 948516 - RNA, 19 nt, Homo sapiens
aagagaugauuuacaccua

SEQ ID NO: 948517 - RNA, 19 nt, Homo sapiens
ccaacuagcaaauauaagu

SEQ ID NO: 948518 - RNA, 19 nt, Homo sapiens
acaaggauccugcauaucu

SEQ ID NO: 948519 - RNA, 19 nt, Homo sapiens
gaaacagaaagaaaucaca

SEQ ID NO: 948520 - RNA, 19 nt, Homo sapiens
cauacaaggauccugcaua

SEQ ID NO: 948521 - RNA, 19 nt, Homo sapiens
gaaccucuuaagaaaugua

SEQ ID NO: 948522 - RNA, 19 nt, Homo sapiens
acaguaagugguuguauga

SEQ ID NO: 948523 - RNA, 19 nt, Homo sapiens
ucucaaggacccuaaaguu

SEQ ID NO: 948524 - RNA, 19 nt, Homo sapiens
uaaguaugccugguuaaga

SEQ ID NO: 948525 - RNA, 19 nt, Homo sapiens
cacaacagguauccagcaa

SEQ ID NO: 948526 - RNA, 19 nt, Homo sapiens
gauuuacaccuaauagaca

SEQ ID NO: 948527 - RNA, 19 nt, Homo sapiens
aaguaugccugguuaagau

SEQ ID NO: 948528 - RNA, 19 nt, Homo sapiens
aguaagugguuguaugaug

SEQ ID NO: 948529 - RNA, 19 nt, Homo sapiens
cagaaugauuuuccaacua

SEQ ID NO: 948530 - RNA, 19 nt, Homo sapiens
guuaacacucaucacauuu

SEQ ID NO: 948531 - RNA, 19 nt, Homo sapiens
gaaugacacuuccccuuca

SEQ ID NO: 948532 - RNA, 19 nt, Homo sapiens
ucacguuaccacuaauaaa

SEQ ID NO: 948533 - RNA, 19 nt, Homo sapiens
caaggauccugcauaucuc

SEQ ID NO: 948534 - RNA, 19 nt, Homo sapiens
uaaauucuaucacguuacc

SEQ ID NO: 948535 - RNA, 19 nt, Homo sapiens
cucaaggacccuaaaguuu

SEQ ID NO: 948536 - RNA, 19 nt, Homo sapiens
caauuaagagagcucaaau

SEQ ID NO: 948537 - RNA, 19 nt, Homo sapiens
gaugauuuacaccuaauag

SEQ ID NO: 948538 - RNA, 19 nt, Homo sapiens
uaucacguuaccacuaaua

SEQ ID NO: 948539 - RNA, 19 nt, Homo sapiens
gauaucuucccuuuguaga

SEQ ID NO: 948540 - RNA, 19 nt, Homo sapiens
augaggaccugcccauuuc

SEQ ID NO: 948541 - RNA, 19 nt, Homo sapiens
ggaagaaacgcggaaccau

SEQ ID NO: 948542 - RNA, 19 nt, Homo sapiens
ccauuuacuggaugcauuu

SEQ ID NO: 948543 - RNA, 19 nt, Homo sapiens
gaggagugagguaaagaau

SEQ ID NO: 948544 - RNA, 19 nt, Homo sapiens
uauaucugauccccaaaua

SEQ ID NO: 948545 - RNA, 19 nt, Homo sapiens
cagauaucgggaauaaauu

SEQ ID NO: 948546 - RNA, 19 nt, Homo sapiens
uaucuuguguggaaagcau

SEQ ID NO: 948547 - RNA, 19 nt, Homo sapiens
gacccuaaaguuuguaaca

SEQ ID NO: 948548 - RNA, 19 nt, Homo sapiens
ccucaaaccaguagugucu

SEQ ID NO: 948549 - RNA, 19 nt, Homo sapiens
gugguuguaugaugccaau

SEQ ID NO: 948550 - RNA, 19 nt, Homo sapiens
cguuaccacuaauaaacuu

SEQ ID NO: 948551 - RNA, 19 nt, Homo sapiens
aggaagaaguugacacacu

SEQ ID NO: 948552 - RNA, 19 nt, Homo sapiens
cccuaaaguuuguaacauc

SEQ ID NO: 948553 - RNA, 19 nt, Homo sapiens
uuuacuggaugcauuuaug

SEQ ID NO: 948554 - RNA, 19 nt, Homo sapiens
augaagagaugauuuacac

SEQ ID NO: 948555 - RNA, 19 nt, Homo sapiens
gggccuuucggaacgauuu

SEQ ID NO: 948556 - RNA, 19 nt, Homo sapiens
gugggaagaaacagaaaga

SEQ ID NO: 948557 - RNA, 19 nt, Homo sapiens
aauauaaguaugccugguu

SEQ ID NO: 948558 - RNA, 19 nt, Homo sapiens
acacggugcuuuggagaag

SEQ ID NO: 948559 - RNA, 19 nt, Homo sapiens
gcgguggucuagggaggaa

SEQ ID NO: 948560 - RNA, 19 nt, Homo sapiens
aguagugucuuuuacauga

SEQ ID NO: 948561 - RNA, 19 nt, Homo sapiens
ugaggagugagguaaagaa

SEQ ID NO: 948562 - RNA, 19 nt, Homo sapiens
agaaagaaaucacaaaagc

SEQ ID NO: 948563 - RNA, 19 nt, Homo sapiens
ggagaagagguuguucaca

SEQ ID NO: 948564 - RNA, 19 nt, Homo sapiens
caauacugacucaaaccaa

SEQ ID NO: 948565 - RNA, 19 nt, Homo sapiens
gaggaccugcccauuucaa

SEQ ID NO: 948566 - RNA, 19 nt, Homo sapiens
gcucaaauaaugggguuua

SEQ ID NO: 948567 - RNA, 19 nt, Homo sapiens
gaaagaaaucacaaaagca

SEQ ID NO: 948568 - RNA, 19 nt, Homo sapiens
ggucuagggaggaagaagu

SEQ ID NO: 948569 - RNA, 19 nt, Homo sapiens
acacaucccgggacucaca

SEQ ID NO: 948570 - RNA, 19 nt, Homo sapiens
uuacacaucccgggacuca

SEQ ID NO: 948571 - RNA, 19 nt, Homo sapiens
agaaugauuuuccaacuag

SEQ ID NO: 948572 - RNA, 19 nt, Homo sapiens
ugaacgagcuggugucugu

SEQ ID NO: 948573 - RNA, 19 nt, Homo sapiens
ggacaagguacaaugauga

SEQ ID NO: 948574 - RNA, 19 nt, Homo sapiens
gaacaaccaggccaaggaa

SEQ ID NO: 948575 - RNA, 19 nt, Homo sapiens
uggaggaccugcugaaguu

SEQ ID NO: 948576 - RNA, 19 nt, Homo sapiens
acaaggccaugaagaaaga

SEQ ID NO: 948577 - RNA, 19 nt, Homo sapiens
gaacuaccggcucaaggaa

SEQ ID NO: 948578 - RNA, 19 nt, Homo sapiens
ggaacuaccggcucaagga

SEQ ID NO: 948579 - RNA, 19 nt, Homo sapiens
cgagaaggccuuaaaguac

SEQ ID NO: 948580 - RNA, 19 nt, Homo sapiens
ggaauacgagaaggccuua

SEQ ID NO: 948581 - RNA, 19 nt, Homo sapiens
ugggaugaguguaaauaaa

SEQ ID NO: 948582 - RNA, 19 nt, Homo sapiens
gcggguugcugcagacaga

SEQ ID NO: 948583 - RNA, 19 nt, Homo sapiens
acgagaaggccuuaaagua

SEQ ID NO: 948584 - RNA, 19 nt, Homo sapiens
ugacaaggccaugaagaaa

SEQ ID NO: 948585 - RNA, 19 nt, Homo sapiens
acuaccggcucaaggaaua

SEQ ID NO: 948586 - RNA, 19 nt, Homo sapiens
ccaagagcacgcaguuuga

SEQ ID NO: 948587 - RNA, 19 nt, Homo sapiens
gggauuacgucuucuaccu

SEQ ID NO: 948588 - RNA, 19 nt, Homo sapiens
cggacaagguacaaugaug

SEQ ID NO: 948589 - RNA, 19 nt, Homo sapiens
gcuuugggaugaguguaaa

SEQ ID NO: 948590 - RNA, 19 nt, Homo sapiens
gacaaggccaugaagaaag

SEQ ID NO: 948591 - RNA, 19 nt, Homo sapiens
gcucaaggaauacgagaag

SEQ ID NO: 948592 - RNA, 19 nt, Homo sapiens
acagcgggauuacgucuuc

SEQ ID NO: 948593 - RNA, 19 nt, Homo sapiens
gcugaaguuugaaaagaaa

SEQ ID NO: 948594 - RNA, 19 nt, Homo sapiens
gaggaccugcugaaguuug

SEQ ID NO: 948595 - RNA, 19 nt, Homo sapiens
agacagagccccagaacaa

SEQ ID NO: 948596 - RNA, 19 nt, Homo sapiens
gggaugaguguaaauaaaa

SEQ ID NO: 948597 - RNA, 19 nt, Homo sapiens
agagcacgcaguuugagua

SEQ ID NO: 948598 - RNA, 19 nt, Homo sapiens
uccaagagcacgcaguuug

SEQ ID NO: 948599 - RNA, 19 nt, Homo sapiens
caagguacaaugaugacau

SEQ ID NO: 948600 - RNA, 19 nt, Homo sapiens
aauacgagaaggccuuaaa

SEQ ID NO: 948601 - RNA, 19 nt, Homo sapiens
aggaggaacagcgggauua

SEQ ID NO: 948602 - RNA, 19 nt, Homo sapiens
cauccucgcuguccuuucc

SEQ ID NO: 948603 - RNA, 19 nt, Homo sapiens
agaacaaccaggccaagga

SEQ ID NO: 948604 - RNA, 19 nt, Homo sapiens
ucuguggccuucagcuaau

SEQ ID NO: 948605 - RNA, 19 nt, Homo sapiens
ccauggaggccgugcugaa

SEQ ID NO: 948606 - RNA, 19 nt, Homo sapiens
ggaggaccugcugaaguuu

SEQ ID NO: 948607 - RNA, 19 nt, Homo sapiens
gaccugcugaaguuugaaa

SEQ ID NO: 948608 - RNA, 19 nt, Homo sapiens
gaggagcugcugcccaaag

SEQ ID NO: 948609 - RNA, 19 nt, Homo sapiens
gugcggacaagguacaaug

SEQ ID NO: 948610 - RNA, 19 nt, Homo sapiens
ucgcuguccuuucccuguu

SEQ ID NO: 948611 - RNA, 19 nt, Homo sapiens
uugacaaggccaugaagaa

SEQ ID NO: 948612 - RNA, 19 nt, Homo sapiens
aggaccugcugaaguuuga

SEQ ID NO: 948613 - RNA, 19 nt, Homo sapiens
gaagaacuaugaacacuua

SEQ ID NO: 948614 - RNA, 19 nt, Homo sapiens
caaaggagcgccuggauga

SEQ ID NO: 948615 - RNA, 19 nt, Homo sapiens
cugaggagguccagaagaa

SEQ ID NO: 948616 - RNA, 19 nt, Homo sapiens
cggcugccauggccaagua

SEQ ID NO: 948617 - RNA, 19 nt, Homo sapiens
ccaggaagucggaguuuga

SEQ ID NO: 948618 - RNA, 19 nt, Homo sapiens
caaaggugguccgcgcaaa

SEQ ID NO: 948619 - RNA, 19 nt, Homo sapiens
uaaggugaaugauaaaucc

SEQ ID NO: 948620 - RNA, 19 nt, Homo sapiens
ccuucuaccugcagucaaa

SEQ ID NO: 948621 - RNA, 19 nt, Homo sapiens
cagaagaacuaugaacacu

SEQ ID NO: 948622 - RNA, 19 nt, Homo sapiens
gccaggaagucggaguuug

SEQ ID NO: 948623 - RNA, 19 nt, Homo sapiens
cacagcagauucucaacgu

SEQ ID NO: 948624 - RNA, 19 nt, Homo sapiens
gcccugaggagguccagaa

SEQ ID NO: 948625 - RNA, 19 nt, Homo sapiens
ccaggaggcacagcagauu

SEQ ID NO: 948626 - RNA, 19 nt, Homo sapiens
gaggagguccagaagaacu

SEQ ID NO: 948627 - RNA, 19 nt, Homo sapiens
ggaauuagaucauuuguag

SEQ ID NO: 948628 - RNA, 19 nt, Homo sapiens
ggaaagacuugguguauag

SEQ ID NO: 948629 - RNA, 19 nt, Homo sapiens
gguuuagucuuaaggauua

SEQ ID NO: 948630 - RNA, 19 nt, Homo sapiens
gaaauagcuuguaauguuc

SEQ ID NO: 948631 - RNA, 19 nt, Homo sapiens
gcaacaauaugguauaaca

SEQ ID NO: 948632 - RNA, 19 nt, Homo sapiens
uaagggacaucuguauuua

SEQ ID NO: 948633 - RNA, 19 nt, Homo sapiens
uagcuugucucauugaaua

SEQ ID NO: 948634 - RNA, 19 nt, Homo sapiens
gaggugaaauccauguuaa

SEQ ID NO: 948635 - RNA, 19 nt, Homo sapiens
gaaauacugcugcuuuaaa

SEQ ID NO: 948636 - RNA, 19 nt, Homo sapiens
gagagaggcuggagcaguu

SEQ ID NO: 948637 - RNA, 19 nt, Homo sapiens
gggaugauauugacaaaug

SEQ ID NO: 948638 - RNA, 19 nt, Homo sapiens
ggcaugaucuucgaaauuu

SEQ ID NO: 948639 - RNA, 19 nt, Homo sapiens
uuucauagcuugucucauu

SEQ ID NO: 948640 - RNA, 19 nt, Homo sapiens
ggaaugggauuaacaggau

SEQ ID NO: 948641 - RNA, 19 nt, Homo sapiens
gaccaugaaugaaguaguu

SEQ ID NO: 948642 - RNA, 19 nt, Homo sapiens
guuguuggcuuuauuagaa

SEQ ID NO: 948643 - RNA, 19 nt, Homo sapiens
guauuuaacuccuuuguag

SEQ ID NO: 948644 - RNA, 19 nt, Homo sapiens
gauaaucucccaguccuua

SEQ ID NO: 948645 - RNA, 19 nt, Homo sapiens
guaagggacaucuguauuu

SEQ ID NO: 948646 - RNA, 19 nt, Homo sapiens
gaaguaguuuguuucauag

SEQ ID NO: 948647 - RNA, 19 nt, Homo sapiens
ugucuuaccucucaauaaa

SEQ ID NO: 948648 - RNA, 19 nt, Homo sapiens
cuaaguaucugucuauauc

SEQ ID NO: 948649 - RNA, 19 nt, Homo sapiens
acuccuaccucaauaguua

SEQ ID NO: 948650 - RNA, 19 nt, Homo sapiens
gaacuguggugccuguuuc

SEQ ID NO: 948651 - RNA, 19 nt, Homo sapiens
gaagaagucagcaagcaaa

SEQ ID NO: 948652 - RNA, 19 nt, Homo sapiens
uuaaaugagucugcaguua

SEQ ID NO: 948653 - RNA, 19 nt, Homo sapiens
ugugacagcuuuaguggua

SEQ ID NO: 948654 - RNA, 19 nt, Homo sapiens
uaaaugagucugcaguuaa

SEQ ID NO: 948655 - RNA, 19 nt, Homo sapiens
gcaagaauaguaucugcua

SEQ ID NO: 948656 - RNA, 19 nt, Homo sapiens
gcaugaucuucgaaauuua

SEQ ID NO: 948657 - RNA, 19 nt, Homo sapiens
cuacauagccuuaaguguu

SEQ ID NO: 948658 - RNA, 19 nt, Homo sapiens
ggagaaagcaacaauaugg

SEQ ID NO: 948659 - RNA, 19 nt, Homo sapiens
uacauagccuuaaguguuu

SEQ ID NO: 948660 - RNA, 19 nt, Homo sapiens
ggacaucuguauuuaacuc

SEQ ID NO: 948661 - RNA, 19 nt, Homo sapiens
gaacucuguuacacauauu

SEQ ID NO: 948662 - RNA, 19 nt, Homo sapiens
ugaaaggguuugauaaucu

SEQ ID NO: 948663 - RNA, 19 nt, Homo sapiens
guagaacucuguuacacau

SEQ ID NO: 948664 - RNA, 19 nt, Homo sapiens
uacaagaugugacagcuuu

SEQ ID NO: 948665 - RNA, 19 nt, Homo sapiens
gaagaauauucagcacaaa

SEQ ID NO: 948666 - RNA, 19 nt, Homo sapiens
caagaauaguaucugcuaa

SEQ ID NO: 948667 - RNA, 19 nt, Homo sapiens
acagagaacucccaaucuu

SEQ ID NO: 948668 - RNA, 19 nt, Homo sapiens
uauauaaggugcccuguag

SEQ ID NO: 948669 - RNA, 19 nt, Homo sapiens
cuacucaagugaacuaaga

SEQ ID NO: 948670 - RNA, 19 nt, Homo sapiens
gaaagcaacaauaugguau

SEQ ID NO: 948671 - RNA, 19 nt, Homo sapiens
cugaaauacugcugcuuua

SEQ ID NO: 948672 - RNA, 19 nt, Homo sapiens
auacauacuuugaggauug

SEQ ID NO: 948673 - RNA, 19 nt, Homo sapiens
uguauagugugaugguuua

SEQ ID NO: 948674 - RNA, 19 nt, Homo sapiens
gcagcaaauuagcaaagaa

SEQ ID NO: 948675 - RNA, 19 nt, Homo sapiens
caaaguaccagcagcaaau

SEQ ID NO: 948676 - RNA, 19 nt, Homo sapiens
uuggaucccuccuaaauuu

SEQ ID NO: 948677 - RNA, 19 nt, Homo sapiens
gaaaggguuugauaaucuc

SEQ ID NO: 948678 - RNA, 19 nt, Homo sapiens
caaucuugcucaucuaaau

SEQ ID NO: 948679 - RNA, 19 nt, Homo sapiens
gaaaaugggaugauauuga

SEQ ID NO: 948680 - RNA, 19 nt, Homo sapiens
cuaaagucauuucacugua

SEQ ID NO: 948681 - RNA, 19 nt, Homo sapiens
ugagagaggugaaauccau

SEQ ID NO: 948682 - RNA, 19 nt, Homo sapiens
ggauugacuuuauauaagg

SEQ ID NO: 948683 - RNA, 19 nt, Homo sapiens
ggagagugucaaauacaua

SEQ ID NO: 948684 - RNA, 19 nt, Homo sapiens
gguacuugcauuugacuua

SEQ ID NO: 948685 - RNA, 19 nt, Homo sapiens
uagcaguggcuuauuauuu

SEQ ID NO: 948686 - RNA, 19 nt, Homo sapiens
gauacuaaaugaugcaaac

SEQ ID NO: 948687 - RNA, 19 nt, Homo sapiens
agaaagaacauucagauuc

SEQ ID NO: 948688 - RNA, 19 nt, Homo sapiens
gaaaaggucuaauacuaca

SEQ ID NO: 948689 - RNA, 19 nt, Homo sapiens
gaaagcacuauacauccua

SEQ ID NO: 948690 - RNA, 19 nt, Homo sapiens
acaaagcacuacuggcuau

SEQ ID NO: 948691 - RNA, 19 nt, Homo sapiens
ucgauuggauugugucauu

SEQ ID NO: 948692 - RNA, 19 nt, Homo sapiens
gugugaugguuuagucuua

SEQ ID NO: 948693 - RNA, 19 nt, Homo sapiens
cuuaagaacaugacacuaa

SEQ ID NO: 948694 - RNA, 19 nt, Homo sapiens
gagcauccauaggcauuug

SEQ ID NO: 948695 - RNA, 19 nt, Homo sapiens
uagcaaagaagcagugaaa

SEQ ID NO: 948696 - RNA, 19 nt, Homo sapiens
auacuagucugcugauaga

SEQ ID NO: 948697 - RNA, 19 nt, Homo sapiens
caagugaacuaagaagaag

SEQ ID NO: 948698 - RNA, 19 nt, Homo sapiens
gaaaacaggcuucuacuca

SEQ ID NO: 948699 - RNA, 19 nt, Homo sapiens
acguauagccuacaaagua

SEQ ID NO: 948700 - RNA, 19 nt, Homo sapiens
auacuugucuuaccucuca

SEQ ID NO: 948701 - RNA, 19 nt, Homo sapiens
gaaugggauuaacaggauu

SEQ ID NO: 948702 - RNA, 19 nt, Homo sapiens
aaaugagucugcaguuaau

SEQ ID NO: 948703 - RNA, 19 nt, Homo sapiens
ccaccguugcugauuauua

SEQ ID NO: 948704 - RNA, 19 nt, Homo sapiens
ggucauucuuuacuaacuu

SEQ ID NO: 948705 - RNA, 19 nt, Homo sapiens
uggaagugaugcaugaauu

SEQ ID NO: 948706 - RNA, 19 nt, Homo sapiens
gcuaaagucauuucacugu

SEQ ID NO: 948707 - RNA, 19 nt, Homo sapiens
agcaguggcuuauuauuug

SEQ ID NO: 948708 - RNA, 19 nt, Homo sapiens
ccacugucagauuauauua

SEQ ID NO: 948709 - RNA, 19 nt, Homo sapiens
aggaaagacuugguguaua

SEQ ID NO: 948710 - RNA, 19 nt, Homo sapiens
gcaguggcuuauuauuugu

SEQ ID NO: 948711 - RNA, 19 nt, Homo sapiens
aaagcauucuugaccauga

SEQ ID NO: 948712 - RNA, 19 nt, Homo sapiens
gaagucagcaagcaaacug

SEQ ID NO: 948713 - RNA, 19 nt, Homo sapiens
ucaagugaacuaagaagaa

SEQ ID NO: 948714 - RNA, 19 nt, Homo sapiens
guccuuggaucccuccuaa

SEQ ID NO: 948715 - RNA, 19 nt, Homo sapiens
agaacucuguuacacauau

SEQ ID NO: 948716 - RNA, 19 nt, Homo sapiens
gcacuacuggcuauuggaa

SEQ ID NO: 948717 - RNA, 19 nt, Homo sapiens
gaaugaaguaguuuguuuc

SEQ ID NO: 948718 - RNA, 19 nt, Homo sapiens
gaauucgauuggauugugu

SEQ ID NO: 948719 - RNA, 19 nt, Homo sapiens
aaacucagccauccuuaga

SEQ ID NO: 948720 - RNA, 19 nt, Homo sapiens
gaaggcuauuuguguuguu

SEQ ID NO: 948721 - RNA, 19 nt, Homo sapiens
guagauaaaguuggagaaa

SEQ ID NO: 948722 - RNA, 19 nt, Homo sapiens
cacuauacauccuauuguu

SEQ ID NO: 948723 - RNA, 19 nt, Homo sapiens
gcacuauacauccuauugu

SEQ ID NO: 948724 - RNA, 19 nt, Homo sapiens
uaacuccuuuguagacaug

SEQ ID NO: 948725 - RNA, 19 nt, Homo sapiens
agaauaguaucugcuaaug

SEQ ID NO: 948726 - RNA, 19 nt, Homo sapiens
ggaagugaugcaugaauuc

SEQ ID NO: 948727 - RNA, 19 nt, Homo sapiens
gcccggauguuccauguua

SEQ ID NO: 948728 - RNA, 19 nt, Homo sapiens
caccagaccugaugaguug

SEQ ID NO: 948729 - RNA, 19 nt, Homo sapiens
ggaaacaauccuauacauu

SEQ ID NO: 948730 - RNA, 19 nt, Homo sapiens
cauguuaaaucgugacaga

SEQ ID NO: 948731 - RNA, 19 nt, Homo sapiens
guuaaaucgugacagaauu

SEQ ID NO: 948732 - RNA, 19 nt, Homo sapiens
agagaagaaucacucacua

SEQ ID NO: 948733 - RNA, 19 nt, Homo sapiens
caacuugcuucaggucaaa

SEQ ID NO: 948734 - RNA, 19 nt, Homo sapiens
gcaccagaccugaugaguu

SEQ ID NO: 948735 - RNA, 19 nt, Homo sapiens
uacauacucuccgaagaua

SEQ ID NO: 948736 - RNA, 19 nt, Homo sapiens
gauguuccauguuaaaucg

SEQ ID NO: 948737 - RNA, 19 nt, Homo sapiens
gaagaaucacucacuacug

SEQ ID NO: 948738 - RNA, 19 nt, Homo sapiens
gcugggugagcacgaauua

SEQ ID NO: 948739 - RNA, 19 nt, Homo sapiens
cugaugaguuggaaacaau

SEQ ID NO: 948740 - RNA, 19 nt, Homo sapiens
cauacauacucuccgaaga

SEQ ID NO: 948741 - RNA, 19 nt, Homo sapiens
guggugagcucucguuucg

SEQ ID NO: 948742 - RNA, 19 nt, Homo sapiens
uugauacaguccaggauuu

SEQ ID NO: 948743 - RNA, 19 nt, Homo sapiens
acucucagcuggacacuag

SEQ ID NO: 948744 - RNA, 19 nt, Homo sapiens
uggaaacaauccuauacau

SEQ ID NO: 948745 - RNA, 19 nt, Homo sapiens
ucaaagugaacccgagaaa

SEQ ID NO: 948746 - RNA, 19 nt, Homo sapiens
ccucacuccuggcgucuga

SEQ ID NO: 948747 - RNA, 19 nt, Homo sapiens
gagaagaaucacucacuac

SEQ ID NO: 948748 - RNA, 19 nt, Homo sapiens
cuccgaagauagcaacuug

SEQ ID NO: 948749 - RNA, 19 nt, Homo sapiens
uuaccgaggccuucccuuu

SEQ ID NO: 948750 - RNA, 19 nt, Homo sapiens
uuaaaucgugacagaauug

SEQ ID NO: 948751 - RNA, 19 nt, Homo sapiens
ggacccaggauccgaaugg

SEQ ID NO: 948752 - RNA, 19 nt, Homo sapiens
ggauguuccauguuaaauc

SEQ ID NO: 948753 - RNA, 19 nt, Homo sapiens
ccugaugaguuggaaacaa

SEQ ID NO: 948754 - RNA, 19 nt, Homo sapiens
gcucuugcccuggacuauu

SEQ ID NO: 948755 - RNA, 19 nt, Homo sapiens
accgaggccuucccuuuga

SEQ ID NO: 948756 - RNA, 19 nt, Homo sapiens
gaauugcaccagaccugau

SEQ ID NO: 948757 - RNA, 19 nt, Homo sapiens
cagcccggauguuccaugu

SEQ ID NO: 948758 - RNA, 19 nt, Homo sapiens
gaacaagaaaacucuagga

SEQ ID NO: 948759 - RNA, 19 nt, Homo sapiens
auacauacucuccgaagau

SEQ ID NO: 948760 - RNA, 19 nt, Homo sapiens
cgaggccuucccuuugaua

SEQ ID NO: 948761 - RNA, 19 nt, Homo sapiens
uaccgaggccuucccuuug

SEQ ID NO: 948762 - RNA, 19 nt, Homo sapiens
ugaguuggaaacaauccua

SEQ ID NO: 948763 - RNA, 19 nt, Homo sapiens
caggauuuguaagggauga

SEQ ID NO: 948764 - RNA, 19 nt, Homo sapiens
uguuaaaucgugacagaau

SEQ ID NO: 948765 - RNA, 19 nt, Homo sapiens
ggccuucccuuugauacag

SEQ ID NO: 948766 - RNA, 19 nt, Homo sapiens
caaagaagaugggagaaua

SEQ ID NO: 948767 - RNA, 19 nt, Homo sapiens
gcagaacccucagaguuua

SEQ ID NO: 948768 - RNA, 19 nt, Homo sapiens
caaagaacauggccagauu

SEQ ID NO: 948769 - RNA, 19 nt, Homo sapiens
caaagaaccuggcccauuc

SEQ ID NO: 948770 - RNA, 19 nt, Homo sapiens
gggaauagcuaacccaguu

SEQ ID NO: 948771 - RNA, 19 nt, Homo sapiens
gcacugaaauugccucuca

SEQ ID NO: 948772 - RNA, 19 nt, Homo sapiens
gaucaaggcuaaggaaaug

SEQ ID NO: 948773 - RNA, 19 nt, Homo sapiens
gggaaugucuguccuccua

SEQ ID NO: 948774 - RNA, 19 nt, Homo sapiens
aauaagggcuguaggaauu

SEQ ID NO: 948775 - RNA, 19 nt, Homo sapiens
gcaggugccuuuagaggaa

SEQ ID NO: 948776 - RNA, 19 nt, Homo sapiens
acaacuggcuggaauauug

SEQ ID NO: 948777 - RNA, 19 nt, Homo sapiens
gaagaccucagcaaacuaa

SEQ ID NO: 948778 - RNA, 19 nt, Homo sapiens
gaaaggaaacuggaagaaa

SEQ ID NO: 948779 - RNA, 19 nt, Homo sapiens
ggaaaugacacaaagaaga

SEQ ID NO: 948780 - RNA, 19 nt, Homo sapiens
aaaccgagcucgaggaaug

SEQ ID NO: 948781 - RNA, 19 nt, Homo sapiens
gaacauggccagauugagu

SEQ ID NO: 948782 - RNA, 19 nt, Homo sapiens
aaagagaaguugcauguuc

SEQ ID NO: 948783 - RNA, 19 nt, Homo sapiens
cuaaggaaaugguggaauu

SEQ ID NO: 948784 - RNA, 19 nt, Homo sapiens
gaaguugcauguucagaca

SEQ ID NO: 948785 - RNA, 19 nt, Homo sapiens
cagacagguuagauuauua

SEQ ID NO: 948786 - RNA, 19 nt, Homo sapiens
ccaaacaacuggcuggaau

SEQ ID NO: 948787 - RNA, 19 nt, Homo sapiens
gaaaugacacaaagaagau

SEQ ID NO: 948788 - RNA, 19 nt, Homo sapiens
uaagaacuccuacaucaaa

SEQ ID NO: 948789 - RNA, 19 nt, Homo sapiens
guucagacagguuagauua

SEQ ID NO: 948790 - RNA, 19 nt, Homo sapiens
caaauaugguccaggaaau

SEQ ID NO: 948791 - RNA, 19 nt, Homo sapiens
ggaaaugguggaauuauca

SEQ ID NO: 948792 - RNA, 19 nt, Homo sapiens
gcucucaccagaagauuua

SEQ ID NO: 948793 - RNA, 19 nt, Homo sapiens
gaauugcucucaccagaag

SEQ ID NO: 948794 - RNA, 19 nt, Homo sapiens
ggaauuguagguauugaaa

SEQ ID NO: 948795 - RNA, 19 nt, Homo sapiens
gaauauugcaggugccuuu

SEQ ID NO: 948796 - RNA, 19 nt, Homo sapiens
caaacucuccuucaaagaa

SEQ ID NO: 948797 - RNA, 19 nt, Homo sapiens
aguaagaacuccuacauca

SEQ ID NO: 948798 - RNA, 19 nt, Homo sapiens
ucagacagguuagauuauu

SEQ ID NO: 948799 - RNA, 19 nt, Homo sapiens
ucacggagguguacugcuu

SEQ ID NO: 948800 - RNA, 19 nt, Homo sapiens
aaacauuucugaggccuuu

SEQ ID NO: 948801 - RNA, 19 nt, Homo sapiens
gggagaauaugccaguuuc

SEQ ID NO: 948802 - RNA, 19 nt, Homo sapiens
gaggaaaugacacaaagaa

SEQ ID NO: 948803 - RNA, 19 nt, Homo sapiens
gacauugagcuaagagaua

SEQ ID NO: 948804 - RNA, 19 nt, Homo sapiens
gaacuucacagugcaaugu

SEQ ID NO: 948805 - RNA, 19 nt, Homo sapiens
acauugagcuaagagauaa

SEQ ID NO: 948806 - RNA, 19 nt, Homo sapiens
gaacaggcggcuggaauug

SEQ ID NO: 948807 - RNA, 19 nt, Homo sapiens
uggcaacugugguccauuu

SEQ ID NO: 948808 - RNA, 19 nt, Homo sapiens
gagaauuuauuggaacuuc

SEQ ID NO: 948809 - RNA, 19 nt, Homo sapiens
gggacucuccuucuuagua

SEQ ID NO: 948810 - RNA, 19 nt, Homo sapiens
gaauaagggcuguaggaau

SEQ ID NO: 948811 - RNA, 19 nt, Homo sapiens
uaaaagaaauggcaacugu

SEQ ID NO: 948812 - RNA, 19 nt, Homo sapiens
ccaaauaugguccaggaaa

SEQ ID NO: 948813 - RNA, 19 nt, Homo sapiens
cgacugauuuggagagauc

SEQ ID NO: 948814 - RNA, 19 nt, Homo sapiens
caucagaagaguuugcuaa

SEQ ID NO: 948815 - RNA, 19 nt, Homo sapiens
ggacucuccuucuuaguac

SEQ ID NO: 948816 - RNA, 19 nt, Homo sapiens
gaccucagcaaacuaauga

SEQ ID NO: 948817 - RNA, 19 nt, Homo sapiens
aaaggaaacuggaagaaaa

SEQ ID NO: 948818 - RNA, 19 nt, Homo sapiens
gugcagaacccucagaguu

SEQ ID NO: 948819 - RNA, 19 nt, Homo sapiens
gcuaaggguuuuguauuua

SEQ ID NO: 948820 - RNA, 19 nt, Homo sapiens
gacaguggcgucaugguaa

SEQ ID NO: 948821 - RNA, 19 nt, Homo sapiens
cagaggaaaugacacaaag

SEQ ID NO: 948822 - RNA, 19 nt, Homo sapiens
caucaaacucuccuucaaa

SEQ ID NO: 948823 - RNA, 19 nt, Homo sapiens
guacacaccgacugauuug

SEQ ID NO: 948824 - RNA, 19 nt, Homo sapiens
cagaagaguuugcuaagcu

SEQ ID NO: 948825 - RNA, 19 nt, Homo sapiens
ccuaacaucagaagaguuu

SEQ ID NO: 948826 - RNA, 19 nt, Homo sapiens
caaacaacuggcuggaaua

SEQ ID NO: 948827 - RNA, 19 nt, Homo sapiens
gcugggacucuccuucuua

SEQ ID NO: 948828 - RNA, 19 nt, Homo sapiens
uaaggaaaugguggaauua

SEQ ID NO: 948829 - RNA, 19 nt, Homo sapiens
gauaaaccccgaucaauug

SEQ ID NO: 948830 - RNA, 19 nt, Homo sapiens
gcuggaagcacugaaauug

SEQ ID NO: 948831 - RNA, 19 nt, Homo sapiens
uaucuagguuucucuuugu

SEQ ID NO: 948832 - RNA, 19 nt, Homo sapiens
gaaaagugaaugccaauau

SEQ ID NO: 948833 - RNA, 19 nt, Homo sapiens
ggaauugcucucaccagaa

SEQ ID NO: 948834 - RNA, 19 nt, Homo sapiens
gaaaugguggaauuaucaa

SEQ ID NO: 948835 - RNA, 19 nt, Homo sapiens
ucagcaaacuaaugaucaa

SEQ ID NO: 948836 - RNA, 19 nt, Homo sapiens
ggacugggcauuuaaaaga

SEQ ID NO: 948837 - RNA, 19 nt, Homo sapiens
gcauggccauucuccuuuc

SEQ ID NO: 948838 - RNA, 19 nt, Homo sapiens
uugcuaagcuugugggaau

SEQ ID NO: 948839 - RNA, 19 nt, Homo sapiens
cuaucuagguuucucuuug

SEQ ID NO: 948840 - RNA, 19 nt, Homo sapiens
gagaccaucagguuuaaau

SEQ ID NO: 948841 - RNA, 19 nt, Homo sapiens
aagagaaguugcauguuca

SEQ ID NO: 948842 - RNA, 19 nt, Homo sapiens
cuuggaauauaguggauuu

SEQ ID NO: 948843 - RNA, 19 nt, Homo sapiens
cagaagauuuagugaaugc

SEQ ID NO: 948844 - RNA, 19 nt, Homo sapiens
guaagaacuccuacaucaa

SEQ ID NO: 948845 - RNA, 19 nt, Homo sapiens
aaagugaaugccaauauga

SEQ ID NO: 948846 - RNA, 19 nt, Homo sapiens
acaugcagcuggccaaaca

SEQ ID NO: 948847 - RNA, 19 nt, Homo sapiens
uguaggaauuguagguauu

SEQ ID NO: 948848 - RNA, 19 nt, Homo sapiens
gagguuguaugacauugag

SEQ ID NO: 948849 - RNA, 19 nt, Homo sapiens
ccagaagauuuagugaaug

SEQ ID NO: 948850 - RNA, 19 nt, Homo sapiens
accagaagauuuagugaau

SEQ ID NO: 948851 - RNA, 19 nt, Homo sapiens
acaaagaaccuggcccauu

SEQ ID NO: 948852 - RNA, 19 nt, Homo sapiens
aaauagugguucaucuuca

SEQ ID NO: 948853 - RNA, 19 nt, Homo sapiens
gugaaugccaauaugaauu

SEQ ID NO: 948854 - RNA, 19 nt, Homo sapiens
guaaaccgagcucgaggaa

SEQ ID NO: 948855 - RNA, 19 nt, Homo sapiens
ccaucagguuuaaauccua

SEQ ID NO: 948856 - RNA, 19 nt, Homo sapiens
gaauuuaguuuugcagaga

SEQ ID NO: 948857 - RNA, 19 nt, Homo sapiens
ggaaaauucagaaaaguga

SEQ ID NO: 948858 - RNA, 19 nt, Homo sapiens
gcuucagucucacaaggaa

SEQ ID NO: 948859 - RNA, 19 nt, Homo sapiens
cccaaauuguguucauuga

SEQ ID NO: 948860 - RNA, 19 nt, Homo sapiens
uagaagcagucauagacau

SEQ ID NO: 948861 - RNA, 19 nt, Homo sapiens
ugcagaacccucagaguuu

SEQ ID NO: 948862 - RNA, 19 nt, Homo sapiens
guagagguuguaugacauu

SEQ ID NO: 948863 - RNA, 19 nt, Homo sapiens
acacagagcuaaggguuuu

SEQ ID NO: 948864 - RNA, 19 nt, Homo sapiens
gccauucuccuuucccaaa

SEQ ID NO: 948865 - RNA, 19 nt, Homo sapiens
ggaagaauaagggcuguag

SEQ ID NO: 948866 - RNA, 19 nt, Homo sapiens
gaauauaccucauccauug

SEQ ID NO: 948867 - RNA, 19 nt, Homo sapiens
guaagaagcugcccuaugu

SEQ ID NO: 948868 - RNA, 19 nt, Homo sapiens
uacaagcucuguuaaguua

SEQ ID NO: 948869 - RNA, 19 nt, Homo sapiens
gccaagaacuccaggauga

SEQ ID NO: 948870 - RNA, 19 nt, Homo sapiens
gaagcauccuuuagauauu

SEQ ID NO: 948871 - RNA, 19 nt, Homo sapiens
ccuagaagaugauauagaa

SEQ ID NO: 948872 - RNA, 19 nt, Homo sapiens
gcagagaauuugcuuaugg

SEQ ID NO: 948873 - RNA, 19 nt, Homo sapiens
gcgccacacuaaacuauaa

SEQ ID NO: 948874 - RNA, 19 nt, Homo sapiens
uaucuuguaucgcuguuua

SEQ ID NO: 948875 - RNA, 19 nt, Homo sapiens
gagaagcauccuuuagaua

SEQ ID NO: 948876 - RNA, 19 nt, Homo sapiens
aaacagagaagcauccuuu

SEQ ID NO: 948877 - RNA, 19 nt, Homo sapiens
gguaaucuuuguauacuuc

SEQ ID NO: 948878 - RNA, 19 nt, Homo sapiens
gcucaggauuauauuugua

SEQ ID NO: 948879 - RNA, 19 nt, Homo sapiens
auaaaugucuccaaaguca

SEQ ID NO: 948880 - RNA, 19 nt, Homo sapiens
gcauaaauaggcacacaaa

SEQ ID NO: 948881 - RNA, 19 nt, Homo sapiens
aggaaaugcuucugaacua

SEQ ID NO: 948882 - RNA, 19 nt, Homo sapiens
ggaaaugcuucugaacuag

SEQ ID NO: 948883 - RNA, 19 nt, Homo sapiens
caaagucacacauucagaa

SEQ ID NO: 948884 - RNA, 19 nt, Homo sapiens
gagcacggacuuccuagaa

SEQ ID NO: 948885 - RNA, 19 nt, Homo sapiens
ugaagucuauggcagagaa

SEQ ID NO: 948886 - RNA, 19 nt, Homo sapiens
caaaggcaaugcuuaucau

SEQ ID NO: 948887 - RNA, 19 nt, Homo sapiens
caagcucuguuaaguuaug

SEQ ID NO: 948888 - RNA, 19 nt, Homo sapiens
caacguguacgacauguau

SEQ ID NO: 948889 - RNA, 19 nt, Homo sapiens
cagagaagcauccuuuaga

SEQ ID NO: 948890 - RNA, 19 nt, Homo sapiens
uauacaagcucuguuaagu

SEQ ID NO: 948891 - RNA, 19 nt, Homo sapiens
cuauaaaugucuccaaagu

SEQ ID NO: 948892 - RNA, 19 nt, Homo sapiens
ucgaauaucacuagagaaa

SEQ ID NO: 948893 - RNA, 19 nt, Homo sapiens
gcagguaaucuuuguauac

SEQ ID NO: 948894 - RNA, 19 nt, Homo sapiens
ggcagguaaucuuuguaua

SEQ ID NO: 948895 - RNA, 19 nt, Homo sapiens
gggagaacuuuguaagaag

SEQ ID NO: 948896 - RNA, 19 nt, Homo sapiens
agaagcauccuuuagauau

SEQ ID NO: 948897 - RNA, 19 nt, Homo sapiens
agggagaacuuuguaagaa

SEQ ID NO: 948898 - RNA, 19 nt, Homo sapiens
agagaagcauccuuuagau

SEQ ID NO: 948899 - RNA, 19 nt, Homo sapiens
gaauaucacuagagaaaag

SEQ ID NO: 948900 - RNA, 19 nt, Homo sapiens
gagggagaacuuuguaaga

SEQ ID NO: 948901 - RNA, 19 nt, Homo sapiens
cgaauauaccucauccauu

SEQ ID NO: 948902 - RNA, 19 nt, Homo sapiens
agucgaauaucacuagaga

SEQ ID NO: 948903 - RNA, 19 nt, Homo sapiens
agaguugccucccgaagga

SEQ ID NO: 948904 - RNA, 19 nt, Homo sapiens
gaauacaaaggcaaugcuu

SEQ ID NO: 948905 - RNA, 19 nt, Homo sapiens
gcagucgaauaucacuaga

SEQ ID NO: 948906 - RNA, 19 nt, Homo sapiens
cagcucaggauuauauuug

SEQ ID NO: 948907 - RNA, 19 nt, Homo sapiens
aagaagcugcccuauguuu

SEQ ID NO: 948908 - RNA, 19 nt, Homo sapiens
ggaggaagcagaggaugug

SEQ ID NO: 948909 - RNA, 19 nt, Homo sapiens
guaucgcuguuuacaaauc

SEQ ID NO: 948910 - RNA, 19 nt, Homo sapiens
ggagggagaacuuuguaag

SEQ ID NO: 948911 - RNA, 19 nt, Homo sapiens
gcaggagggagaacuuugu

SEQ ID NO: 948912 - RNA, 19 nt, Homo sapiens
uagaagaacugggaaaaga

SEQ ID NO: 948913 - RNA, 19 nt, Homo sapiens
cgacauguauuggaugaac

SEQ ID NO: 948914 - RNA, 19 nt, Homo sapiens
gcccugcagucuaguguca

SEQ ID NO: 948915 - RNA, 19 nt, Homo sapiens
cagagaauuugcuuauggu

SEQ ID NO: 948916 - RNA, 19 nt, Homo sapiens
gcucuguuaaguuauguuu

SEQ ID NO: 948917 - RNA, 19 nt, Homo sapiens
auacaaaggcaaugcuuau

SEQ ID NO: 948918 - RNA, 19 nt, Homo sapiens
caccaucaccugcuucaga

SEQ ID NO: 948919 - RNA, 19 nt, Homo sapiens
cagguaaucuuuguauacu

SEQ ID NO: 948920 - RNA, 19 nt, Homo sapiens
ucuccaaagucacacauuc

SEQ ID NO: 948921 - RNA, 19 nt, Homo sapiens
acaaaggcaaugcuuauca

SEQ ID NO: 948922 - RNA, 19 nt, Homo sapiens
uaguggugcucaacgugua

SEQ ID NO: 948923 - RNA, 19 nt, Homo sapiens
cagcuccuguauacccuuu

SEQ ID NO: 948924 - RNA, 19 nt, Homo sapiens
aauacaaaggcaaugcuua

SEQ ID NO: 948925 - RNA, 19 nt, Homo sapiens
uacgacauguauuggauga

SEQ ID NO: 948926 - RNA, 19 nt, Homo sapiens
uggcagagaauuugcuuau

SEQ ID NO: 948927 - RNA, 19 nt, Homo sapiens
cccaggaaaugcuucugaa

SEQ ID NO: 948928 - RNA, 19 nt, Homo sapiens
uuaggcagguaaucuuugu

SEQ ID NO: 948929 - RNA, 19 nt, Homo sapiens
ggcagagaauuugcuuaug

SEQ ID NO: 948930 - RNA, 19 nt, Homo sapiens
gcucaacguguacgacaug

SEQ ID NO: 948931 - RNA, 19 nt, Homo sapiens
ggacuccugccacagugaa

SEQ ID NO: 948932 - RNA, 19 nt, Homo sapiens
aaacaguuauagucaccau

SEQ ID NO: 948933 - RNA, 19 nt, Homo sapiens
uuucagcucaggauuauau

SEQ ID NO: 948934 - RNA, 19 nt, Homo sapiens
aaaugcuucugaacuagga

SEQ ID NO: 948935 - RNA, 19 nt, Homo sapiens
agucacacauucagaacug

SEQ ID NO: 948936 - RNA, 19 nt, Homo sapiens
ccacacuaaacuauaaaug

SEQ ID NO: 948937 - RNA, 19 nt, Homo sapiens
gagauuccucgcuggauca

SEQ ID NO: 948938 - RNA, 19 nt, Homo sapiens
agagauucuuugugggaaa

SEQ ID NO: 948939 - RNA, 19 nt, Homo sapiens
caggagggagaacuuugua

SEQ ID NO: 948940 - RNA, 19 nt, Homo sapiens
accaucaccugcuucagaa

SEQ ID NO: 948941 - RNA, 19 nt, Homo sapiens
uguacgacauguauuggau

SEQ ID NO: 948942 - RNA, 19 nt, Homo sapiens
auacaagcucuguuaaguu

SEQ ID NO: 948943 - RNA, 19 nt, Homo sapiens
gcgcaggagggagaacuuu

SEQ ID NO: 948944 - RNA, 19 nt, Homo sapiens
ccaaagucacacauucaga

SEQ ID NO: 948945 - RNA, 19 nt, Homo sapiens
caucaccugcuucagaaug

SEQ ID NO: 948946 - RNA, 19 nt, Homo sapiens
ccaagaacuccaggaugaa

SEQ ID NO: 948947 - RNA, 19 nt, Homo sapiens
gaagaacugggaaaagaau

SEQ ID NO: 948948 - RNA, 19 nt, Homo sapiens
acaguuauagucaccauca

SEQ ID NO: 948949 - RNA, 19 nt, Homo sapiens
uaagaagcugcccuauguu

SEQ ID NO: 948950 - RNA, 19 nt, Homo sapiens
uguaagaagcugcccuaug

SEQ ID NO: 948951 - RNA, 19 nt, Homo sapiens
acagagaagcauccuuuag

SEQ ID NO: 948952 - RNA, 19 nt, Homo sapiens
agagaaaaguaaacagaga

SEQ ID NO: 948953 - RNA, 19 nt, Homo sapiens
ggagcacggacuuccuaga

SEQ ID NO: 948954 - RNA, 19 nt, Homo sapiens
ucagcucaggauuauauuu

SEQ ID NO: 948955 - RNA, 19 nt, Homo sapiens
ccccuuuucuggaauauuu

SEQ ID NO: 948956 - RNA, 19 nt, Homo sapiens
cuggauuuauuucuucugu

SEQ ID NO: 948957 - RNA, 19 nt, Homo sapiens
caggaaaugcuucugaacu

SEQ ID NO: 948958 - RNA, 19 nt, Homo sapiens
gagaaaaguaaacagagaa

SEQ ID NO: 948959 - RNA, 19 nt, Homo sapiens
ggcagucgaauaucacuag

SEQ ID NO: 948960 - RNA, 19 nt, Homo sapiens
uggcauaaauaggcacaca

SEQ ID NO: 948961 - RNA, 19 nt, Homo sapiens
uaucgcuguuuacaaaucu

SEQ ID NO: 948962 - RNA, 19 nt, Homo sapiens
gcuccuguauacccuuucu

SEQ ID NO: 948963 - RNA, 19 nt, Homo sapiens
ccaucaagcuuuccacuua

SEQ ID NO: 948964 - RNA, 19 nt, Homo sapiens
gggaacaacugaagagauu

SEQ ID NO: 948965 - RNA, 19 nt, Homo sapiens
gcauuauucucaugucaua

SEQ ID NO: 948966 - RNA, 19 nt, Homo sapiens
ucucaaagcucuauauguu

SEQ ID NO: 948967 - RNA, 19 nt, Homo sapiens
gaagaggagacgacuaaua

SEQ ID NO: 948968 - RNA, 19 nt, Homo sapiens
gaagauguuucacuguuug

SEQ ID NO: 948969 - RNA, 19 nt, Homo sapiens
ggaaauuucuuagacguau

SEQ ID NO: 948970 - RNA, 19 nt, Homo sapiens
cagcauggcuacuucauau

SEQ ID NO: 948971 - RNA, 19 nt, Homo sapiens
aaacagaccaucaagcuuu

SEQ ID NO: 948972 - RNA, 19 nt, Homo sapiens
gaauagagaaagcuuaugu

SEQ ID NO: 948973 - RNA, 19 nt, Homo sapiens
gcauggcuacuucauauuu

SEQ ID NO: 948974 - RNA, 19 nt, Homo sapiens
gcaaucaucgucuaucuuc

SEQ ID NO: 948975 - RNA, 19 nt, Homo sapiens
guaggcaucuguaaauucu

SEQ ID NO: 948976 - RNA, 19 nt, Homo sapiens
guggaaucaucauaguuua

SEQ ID NO: 948977 - RNA, 19 nt, Homo sapiens
gugaggcacuuugggcuua

SEQ ID NO: 948978 - RNA, 19 nt, Homo sapiens
gguguaaggugcgcaagaa

SEQ ID NO: 948979 - RNA, 19 nt, Homo sapiens
ucacauugaugaagaugga

SEQ ID NO: 948980 - RNA, 19 nt, Homo sapiens
gagcauuauucucauguca

SEQ ID NO: 948981 - RNA, 19 nt, Homo sapiens
ccagugguauuaacuacuu

SEQ ID NO: 948982 - RNA, 19 nt, Homo sapiens
aaagagccauuggguguuu

SEQ ID NO: 948983 - RNA, 19 nt, Homo sapiens
uaaggaauacccagagauu

SEQ ID NO: 948984 - RNA, 19 nt, Homo sapiens
cagcaaauacuuccguaaa

SEQ ID NO: 948985 - RNA, 19 nt, Homo sapiens
gcucuucaguggaccuuga

SEQ ID NO: 948986 - RNA, 19 nt, Homo sapiens
gaaugucacagguagacua

SEQ ID NO: 948987 - RNA, 19 nt, Homo sapiens
gaaauuucuuagacguaug

SEQ ID NO: 948988 - RNA, 19 nt, Homo sapiens
gcagcuuuauuaccuguau

SEQ ID NO: 948989 - RNA, 19 nt, Homo sapiens
ugacguggcucccggaagu

SEQ ID NO: 948990 - RNA, 19 nt, Homo sapiens
ggugauauuugccuuuagu

SEQ ID NO: 948991 - RNA, 19 nt, Homo sapiens
guaaugaugacacugaaga

SEQ ID NO: 948992 - RNA, 19 nt, Homo sapiens
gaggaguguuggcuuuguu

SEQ ID NO: 948993 - RNA, 19 nt, Homo sapiens
cggaagaggagacgacuaa

SEQ ID NO: 948994 - RNA, 19 nt, Homo sapiens
uaaguggaaucaucauagu

SEQ ID NO: 948995 - RNA, 19 nt, Homo sapiens
gcacuuugggcuuauguau

SEQ ID NO: 948996 - RNA, 19 nt, Homo sapiens
uaaccagcauggcuacuuc

SEQ ID NO: 948997 - RNA, 19 nt, Homo sapiens
ugucacagguagacuaaug

SEQ ID NO: 948998 - RNA, 19 nt, Homo sapiens
ugaugacacugaagauguu

SEQ ID NO: 948999 - RNA, 19 nt, Homo sapiens
acaauuagggccaguggua

SEQ ID NO: 949000 - RNA, 19 nt, Homo sapiens
guucuuagucugucucaaa

SEQ ID NO: 949001 - RNA, 19 nt, Homo sapiens
ccaaguuaaugaaaguguu

SEQ ID NO: 949002 - RNA, 19 nt, Homo sapiens
guauaucccaaguuaauga

SEQ ID NO: 949003 - RNA, 19 nt, Homo sapiens
uaucauggguguggugcua

SEQ ID NO: 949004 - RNA, 19 nt, Homo sapiens
caucgucuaucuucucugu

SEQ ID NO: 949005 - RNA, 19 nt, Homo sapiens
aaucagacauccaguagca

SEQ ID NO: 949006 - RNA, 19 nt, Homo sapiens
gccauuggguguuugaauc

SEQ ID NO: 949007 - RNA, 19 nt, Homo sapiens
gcuaauagaucuuuuacca

SEQ ID NO: 949008 - RNA, 19 nt, Homo sapiens
gcagcaggauaguaaugau

SEQ ID NO: 949009 - RNA, 19 nt, Homo sapiens
gcaagcaagugaaaacaau

SEQ ID NO: 949010 - RNA, 19 nt, Homo sapiens
cccaauaccuuuccuuguc

SEQ ID NO: 949011 - RNA, 19 nt, Homo sapiens
gaacaacugaagagauucu

SEQ ID NO: 949012 - RNA, 19 nt, Homo sapiens
ugggugauauuugccuuua

SEQ ID NO: 949013 - RNA, 19 nt, Homo sapiens
cucagcagcagcuuuauua

SEQ ID NO: 949014 - RNA, 19 nt, Homo sapiens
cgacuaauagaccaagaaa

SEQ ID NO: 949015 - RNA, 19 nt, Homo sapiens
aaagagcauuauucucaug

SEQ ID NO: 949016 - RNA, 19 nt, Homo sapiens
uaaggcccaguuaauauaa

SEQ ID NO: 949017 - RNA, 19 nt, Homo sapiens
gaaagagccauuggguguu

SEQ ID NO: 949018 - RNA, 19 nt, Homo sapiens
ucagugcaaucaucgucua

SEQ ID NO: 949019 - RNA, 19 nt, Homo sapiens
gaggcugaaucaagaaucu

SEQ ID NO: 949020 - RNA, 19 nt, Homo sapiens
cagacuuccugaauagaga

SEQ ID NO: 949021 - RNA, 19 nt, Homo sapiens
guacugugggugauauuug

SEQ ID NO: 949022 - RNA, 19 nt, Homo sapiens
aagaggagacgacuaauag

SEQ ID NO: 949023 - RNA, 19 nt, Homo sapiens
caguggaccuugagcuaau

SEQ ID NO: 949024 - RNA, 19 nt, Homo sapiens
ggaaucaucauaguuuaag

SEQ ID NO: 949025 - RNA, 19 nt, Homo sapiens
caucaagcuuuccacuuag

SEQ ID NO: 949026 - RNA, 19 nt, Homo sapiens
gggaaauuucuuagacgua

SEQ ID NO: 949027 - RNA, 19 nt, Homo sapiens
uguaaauucuguuguaggu

SEQ ID NO: 949028 - RNA, 19 nt, Homo sapiens
gagcuuaguccauguugca

SEQ ID NO: 949029 - RNA, 19 nt, Homo sapiens
uuagugcacucuucuccuu

SEQ ID NO: 949030 - RNA, 19 nt, Homo sapiens
ccaguacugugggugauau

SEQ ID NO: 949031 - RNA, 19 nt, Homo sapiens
gcucagcagcagcuuuauu

SEQ ID NO: 949032 - RNA, 19 nt, Homo sapiens
gggcugaggcucuuacagu

SEQ ID NO: 949033 - RNA, 19 nt, Homo sapiens
uuauuggagugauagcuuu

SEQ ID NO: 949034 - RNA, 19 nt, Homo sapiens
gcaaucuauguaacuguaa

SEQ ID NO: 949035 - RNA, 19 nt, Homo sapiens
agcaaucuauguaacugua

SEQ ID NO: 949036 - RNA, 19 nt, Homo sapiens
ggauaguaaugaugacacu

SEQ ID NO: 949037 - RNA, 19 nt, Homo sapiens
gcagauuauguugugaaua

SEQ ID NO: 949038 - RNA, 19 nt, Homo sapiens
gaagaaugucacagguaga

SEQ ID NO: 949039 - RNA, 19 nt, Homo sapiens
ccuguauggugacaauuau

SEQ ID NO: 949040 - RNA, 19 nt, Homo sapiens
ucgucuaucuucucuguga

SEQ ID NO: 949041 - RNA, 19 nt, Homo sapiens
gugcaaucaucgucuaucu

SEQ ID NO: 949042 - RNA, 19 nt, Homo sapiens
cuacguugguggaaucaca

SEQ ID NO: 949043 - RNA, 19 nt, Homo sapiens
guuguugucgugugacuuu

SEQ ID NO: 949044 - RNA, 19 nt, Homo sapiens
gaggauguucuuagucugu

SEQ ID NO: 949045 - RNA, 19 nt, Homo sapiens
ccagcauggcuacuucaua

SEQ ID NO: 949046 - RNA, 19 nt, Homo sapiens
aaagcaaucuauguaacug

SEQ ID NO: 949047 - RNA, 19 nt, Homo sapiens
aguggaaucaucauaguuu

SEQ ID NO: 949048 - RNA, 19 nt, Homo sapiens
ggagaccuuugcauuuuga

SEQ ID NO: 949049 - RNA, 19 nt, Homo sapiens
guucugugguguagguaug

SEQ ID NO: 949050 - RNA, 19 nt, Homo sapiens
gcaaauacuuccguaaaac

SEQ ID NO: 949051 - RNA, 19 nt, Homo sapiens
ccaguuaauauaaguggaa

SEQ ID NO: 949052 - RNA, 19 nt, Homo sapiens
gacauccaguagcaucguu

SEQ ID NO: 949053 - RNA, 19 nt, Homo sapiens
caaaaucagacauccagua

SEQ ID NO: 949054 - RNA, 19 nt, Homo sapiens
gggauauuguaaauuaugc

SEQ ID NO: 949055 - RNA, 19 nt, Homo sapiens
ggaccuugagcuaauagau

SEQ ID NO: 949056 - RNA, 19 nt, Homo sapiens
cauaggaggauguucuuag

SEQ ID NO: 949057 - RNA, 19 nt, Homo sapiens
guaugcacacggccaugua

SEQ ID NO: 949058 - RNA, 19 nt, Homo sapiens
aacgaggaguguuggcuuu

SEQ ID NO: 949059 - RNA, 19 nt, Homo sapiens
ggccuacguugguggaauc

SEQ ID NO: 949060 - RNA, 19 nt, Homo sapiens
uuaccuguauggugacaau

SEQ ID NO: 949061 - RNA, 19 nt, Homo sapiens
uaguaaugaugacacugaa

SEQ ID NO: 949062 - RNA, 19 nt, Homo sapiens
caaguuaaugaaaguguuc

SEQ ID NO: 949063 - RNA, 19 nt, Homo sapiens
gcaagugaauccacauuaa

SEQ ID NO: 949064 - RNA, 19 nt, Homo sapiens
ugaaagcucugauguaauu

SEQ ID NO: 949065 - RNA, 19 nt, Homo sapiens
ucagucagauccuguauua

SEQ ID NO: 949066 - RNA, 19 nt, Homo sapiens
aaaguaagcuucugaaauc

SEQ ID NO: 949067 - RNA, 19 nt, Homo sapiens
gaaaugagccugcgaccuu

SEQ ID NO: 949068 - RNA, 19 nt, Homo sapiens
gaaauggccuggacuuuac

SEQ ID NO: 949069 - RNA, 19 nt, Homo sapiens
gaacugacuuacaauuaug

SEQ ID NO: 949070 - RNA, 19 nt, Homo sapiens
gaagcaaauuguuggauga

SEQ ID NO: 949071 - RNA, 19 nt, Homo sapiens
gaaaguaagcuucugaaau

SEQ ID NO: 949072 - RNA, 19 nt, Homo sapiens
ggacuuuacuauugucauu

SEQ ID NO: 949073 - RNA, 19 nt, Homo sapiens
ggacugcgcauucuguaua

SEQ ID NO: 949074 - RNA, 19 nt, Homo sapiens
gaaagaguugccagacuua

SEQ ID NO: 949075 - RNA, 19 nt, Homo sapiens
uaaugaggcugacaccuuu

SEQ ID NO: 949076 - RNA, 19 nt, Homo sapiens
gcaaugacuuuaugggaau

SEQ ID NO: 949077 - RNA, 19 nt, Homo sapiens
cgaaauggccuggacuuua

SEQ ID NO: 949078 - RNA, 19 nt, Homo sapiens
gcucuucuauugucuuauu

SEQ ID NO: 949079 - RNA, 19 nt, Homo sapiens
ggccuggacuuuacuauug

SEQ ID NO: 949080 - RNA, 19 nt, Homo sapiens
gagaacgccugcuguaauc

SEQ ID NO: 949081 - RNA, 19 nt, Homo sapiens
gaaucacgcucgcuucuag

SEQ ID NO: 949082 - RNA, 19 nt, Homo sapiens
gagcaagccucugugauuc

SEQ ID NO: 949083 - RNA, 19 nt, Homo sapiens
acccaaagcuucagguuaa

SEQ ID NO: 949084 - RNA, 19 nt, Homo sapiens
ggauauaaguucuauuugc

SEQ ID NO: 949085 - RNA, 19 nt, Homo sapiens
ucgcagaacugacuuacaa

SEQ ID NO: 949086 - RNA, 19 nt, Homo sapiens
acgauacgcucuucuauug

SEQ ID NO: 949087 - RNA, 19 nt, Homo sapiens
gagagcagcugugcaagug

SEQ ID NO: 949088 - RNA, 19 nt, Homo sapiens
gcagauuuguguauuucaa

SEQ ID NO: 949089 - RNA, 19 nt, Homo sapiens
gaacuacugguguaaucua

SEQ ID NO: 949090 - RNA, 19 nt, Homo sapiens
cagaacugacuuacaauua

SEQ ID NO: 949091 - RNA, 19 nt, Homo sapiens
gagcagcugugcaagugaa

SEQ ID NO: 949092 - RNA, 19 nt, Homo sapiens
gcucugauguaauuuagga

SEQ ID NO: 949093 - RNA, 19 nt, Homo sapiens
uuugaaagcucugauguaa

SEQ ID NO: 949094 - RNA, 19 nt, Homo sapiens
ggaugaagcauuucgagaa

SEQ ID NO: 949095 - RNA, 19 nt, Homo sapiens
ggacaugaaauuugcuuug

SEQ ID NO: 949096 - RNA, 19 nt, Homo sapiens
agaaagaguugccagacuu

SEQ ID NO: 949097 - RNA, 19 nt, Homo sapiens
guauauaacuguguuggau

SEQ ID NO: 949098 - RNA, 19 nt, Homo sapiens
guagagaacgccugcugua

SEQ ID NO: 949099 - RNA, 19 nt, Homo sapiens
gcagaacugacuuacaauu

SEQ ID NO: 949100 - RNA, 19 nt, Homo sapiens
gcaggaucuucccuuguuu

SEQ ID NO: 949101 - RNA, 19 nt, Homo sapiens
cuagacggcuaaagaagaa

SEQ ID NO: 949102 - RNA, 19 nt, Homo sapiens
gagcuucuuucuguguaua

SEQ ID NO: 949103 - RNA, 19 nt, Homo sapiens
ggaaugagugugugacguu

SEQ ID NO: 949104 - RNA, 19 nt, Homo sapiens
gaaaggaaugaguguguga

SEQ ID NO: 949105 - RNA, 19 nt, Homo sapiens
caaacacaauaaacccaaa

SEQ ID NO: 949106 - RNA, 19 nt, Homo sapiens
cugcaaagcugccuguaau

SEQ ID NO: 949107 - RNA, 19 nt, Homo sapiens
gaacgccugcuguaaucua

SEQ ID NO: 949108 - RNA, 19 nt, Homo sapiens
gacaugaaauuugcuuugu

SEQ ID NO: 949109 - RNA, 19 nt, Homo sapiens
gaugggaaauggaguaaaa

SEQ ID NO: 949110 - RNA, 19 nt, Homo sapiens
gaaggacacaccacuuuca

SEQ ID NO: 949111 - RNA, 19 nt, Homo sapiens
caaccugggugacagaaca

SEQ ID NO: 949112 - RNA, 19 nt, Homo sapiens
gauacgcucuucuauuguc

SEQ ID NO: 949113 - RNA, 19 nt, Homo sapiens
ccucaaauuucaccuuaau

SEQ ID NO: 949114 - RNA, 19 nt, Homo sapiens
agucagauccuguauuaaa

SEQ ID NO: 949115 - RNA, 19 nt, Homo sapiens
gguguaaucuacugggaau

SEQ ID NO: 949116 - RNA, 19 nt, Homo sapiens
gauuugggccugaggauga

SEQ ID NO: 949117 - RNA, 19 nt, Homo sapiens
caucaugugagauuucuuu

SEQ ID NO: 949118 - RNA, 19 nt, Homo sapiens
gggaggauauaaguucuau

SEQ ID NO: 949119 - RNA, 19 nt, Homo sapiens
acuacaagcuuggcaauga

SEQ ID NO: 949120 - RNA, 19 nt, Homo sapiens
gaaauggaguaaaacaaug

SEQ ID NO: 949121 - RNA, 19 nt, Homo sapiens
cuuacuugcuuucacauuu

SEQ ID NO: 949122 - RNA, 19 nt, Homo sapiens
gaugaagcauuucgagaac

SEQ ID NO: 949123 - RNA, 19 nt, Homo sapiens
ggccugaggaugaucauuu

SEQ ID NO: 949124 - RNA, 19 nt, Homo sapiens
gcaugaggaauuugaagaa

SEQ ID NO: 949125 - RNA, 19 nt, Homo sapiens
gcaacuccuuuagguauuc

SEQ ID NO: 949126 - RNA, 19 nt, Homo sapiens
gcgagcuucuuucugugua

SEQ ID NO: 949127 - RNA, 19 nt, Homo sapiens
guaagcuucugaaaucaag

SEQ ID NO: 949128 - RNA, 19 nt, Homo sapiens
ugaagcauuucgagaacuu

SEQ ID NO: 949129 - RNA, 19 nt, Homo sapiens
ugacggacaugaaauuugc

SEQ ID NO: 949130 - RNA, 19 nt, Homo sapiens
gcuccagccuugagagugu

SEQ ID NO: 949131 - RNA, 19 nt, Homo sapiens
gacgauacgcucuucuauu

SEQ ID NO: 949132 - RNA, 19 nt, Homo sapiens
ccaauaaaugcucuucuga

SEQ ID NO: 949133 - RNA, 19 nt, Homo sapiens
caauaaacccaaagcuuca

SEQ ID NO: 949134 - RNA, 19 nt, Homo sapiens
ggaaguugcagaagguguu

SEQ ID NO: 949135 - RNA, 19 nt, Homo sapiens
guaaaacaauggugggauu

SEQ ID NO: 949136 - RNA, 19 nt, Homo sapiens
ggugacagaacaagacaaa

SEQ ID NO: 949137 - RNA, 19 nt, Homo sapiens
cacucgaaauggaauuaua

SEQ ID NO: 949138 - RNA, 19 nt, Homo sapiens
uuuaaucacucgaaaugga

SEQ ID NO: 949139 - RNA, 19 nt, Homo sapiens
caagugaauccacauuaau

SEQ ID NO: 949140 - RNA, 19 nt, Homo sapiens
gugcagauuuguguauuuc

SEQ ID NO: 949141 - RNA, 19 nt, Homo sapiens
ggaaggacacaccacuuuc

SEQ ID NO: 949142 - RNA, 19 nt, Homo sapiens
ggagcgcgcuucuguucca

SEQ ID NO: 949143 - RNA, 19 nt, Homo sapiens
ggcaacuccuuuagguauu

SEQ ID NO: 949144 - RNA, 19 nt, Homo sapiens
uaguuaggguuaccucuga

SEQ ID NO: 949145 - RNA, 19 nt, Homo sapiens
aagauacacuggguaauca

SEQ ID NO: 949146 - RNA, 19 nt, Homo sapiens
guaaucuacugggaaugaa

SEQ ID NO: 949147 - RNA, 19 nt, Homo sapiens
ugugcgagcuucuuucugu

SEQ ID NO: 949148 - RNA, 19 nt, Homo sapiens
agacuuagaagacuugaug

SEQ ID NO: 949149 - RNA, 19 nt, Homo sapiens
gacggaaguugcagaaggu

SEQ ID NO: 949150 - RNA, 19 nt, Homo sapiens
gcaaagcugccuguaaugg

SEQ ID NO: 949151 - RNA, 19 nt, Homo sapiens
gaugagugacagaugauug

SEQ ID NO: 949152 - RNA, 19 nt, Homo sapiens
auauaacuguguuggauga

SEQ ID NO: 949153 - RNA, 19 nt, Homo sapiens
ccaaucaugaguccaggua

SEQ ID NO: 949154 - RNA, 19 nt, Homo sapiens
cgugucaguucccaauaaa

SEQ ID NO: 949155 - RNA, 19 nt, Homo sapiens
ugaagguucugcggcauga

SEQ ID NO: 949156 - RNA, 19 nt, Homo sapiens
cggaaggacacaccacuuu

SEQ ID NO: 949157 - RNA, 19 nt, Homo sapiens
ggauuaaacgauuucuuca

SEQ ID NO: 949158 - RNA, 19 nt, Homo sapiens
uacacuggguaaucacuaa

SEQ ID NO: 949159 - RNA, 19 nt, Homo sapiens
aaucaugaguccagguaga

SEQ ID NO: 949160 - RNA, 19 nt, Homo sapiens
ggaaucacgcucgcuucua

SEQ ID NO: 949161 - RNA, 19 nt, Homo sapiens
gaaacagaaaggaaugagu

SEQ ID NO: 949162 - RNA, 19 nt, Homo sapiens
gaggaaacagaaaggaaug

SEQ ID NO: 949163 - RNA, 19 nt, Homo sapiens
gcaaauaacuaaccaaaag

SEQ ID NO: 949164 - RNA, 19 nt, Homo sapiens
ggacacaccaugauuagga

SEQ ID NO: 949165 - RNA, 19 nt, Homo sapiens
gucagugucucuaagauug

SEQ ID NO: 949166 - RNA, 19 nt, Homo sapiens
ucacgcgggucuccaacua

SEQ ID NO: 949167 - RNA, 19 nt, Homo sapiens
uacaacgacuggaucaauu

SEQ ID NO: 949168 - RNA, 19 nt, Homo sapiens
gcaccauucuacccaacaa

SEQ ID NO: 949169 - RNA, 19 nt, Homo sapiens
ggaaaggucacagaaggaa

SEQ ID NO: 949170 - RNA, 19 nt, Homo sapiens
gaagacgaauaugaucugu

SEQ ID NO: 949171 - RNA, 19 nt, Homo sapiens
gcagcaccgugaagacgaa

SEQ ID NO: 949172 - RNA, 19 nt, Homo sapiens
ccacuuacgcgccugauau

SEQ ID NO: 949173 - RNA, 19 nt, Homo sapiens
ggugauugcaaauaacuaa

SEQ ID NO: 949174 - RNA, 19 nt, Homo sapiens
cgacauugcccugcucaaa

SEQ ID NO: 949175 - RNA, 19 nt, Homo sapiens
gaaaggucacagaaggaaa

SEQ ID NO: 949176 - RNA, 19 nt, Homo sapiens
cuacaagcccuccaucuuc

SEQ ID NO: 949177 - RNA, 19 nt, Homo sapiens
auucggugauugcaaauaa

SEQ ID NO: 949178 - RNA, 19 nt, Homo sapiens
ccacggacacaccaugauu

SEQ ID NO: 949179 - RNA, 19 nt, Homo sapiens
uacaagcccuccaucuuca

SEQ ID NO: 949180 - RNA, 19 nt, Homo sapiens
gcaccgugaagacgaauau

SEQ ID NO: 949181 - RNA, 19 nt, Homo sapiens
ccaaccaggucuccaaagg

SEQ ID NO: 949182 - RNA, 19 nt, Homo sapiens
ggucacagaaggaaaauaa

SEQ ID NO: 949183 - RNA, 19 nt, Homo sapiens
gaagaagcgaggcccaaca

SEQ ID NO: 949184 - RNA, 19 nt, Homo sapiens
aaagugacaacuaugcaaa

SEQ ID NO: 949185 - RNA, 19 nt, Homo sapiens
cacggacacaccaugauua

SEQ ID NO: 949186 - RNA, 19 nt, Homo sapiens
uaaagugacaacuaugcaa

SEQ ID NO: 949187 - RNA, 19 nt, Homo sapiens
ugacaacuaugcaaaucac

SEQ ID NO: 949188 - RNA, 19 nt, Homo sapiens
gcuccaauggccaguggua

SEQ ID NO: 949189 - RNA, 19 nt, Homo sapiens
cuacaacgacuggaucaau

SEQ ID NO: 949190 - RNA, 19 nt, Homo sapiens
ggugauggcgugauaugca

SEQ ID NO: 949191 - RNA, 19 nt, Homo sapiens
caacggggcucucccugau

SEQ ID NO: 949192 - RNA, 19 nt, Homo sapiens
cgccugauaugucuaggau

SEQ ID NO: 949193 - RNA, 19 nt, Homo sapiens
uuacgcgccugauaugucu

SEQ ID NO: 949194 - RNA, 19 nt, Homo sapiens
gauugcaaauaacuaacca

SEQ ID NO: 949195 - RNA, 19 nt, Homo sapiens
gguccuugguugcaacuac

SEQ ID NO: 949196 - RNA, 19 nt, Homo sapiens
ugauaugucuaggaugcuu

SEQ ID NO: 949197 - RNA, 19 nt, Homo sapiens
ccaaagggaacgacauugc

SEQ ID NO: 949198 - RNA, 19 nt, Homo sapiens
gguugcaacuacuacuaca

SEQ ID NO: 949199 - RNA, 19 nt, Homo sapiens
cgucagugucucuaagauu

SEQ ID NO: 949200 - RNA, 19 nt, Homo sapiens
uaggaugcuuggaggugaa

SEQ ID NO: 949201 - RNA, 19 nt, Homo sapiens
gguugcugguuguggacua

SEQ ID NO: 949202 - RNA, 19 nt, Homo sapiens
acauugcccugcucaaacu

SEQ ID NO: 949203 - RNA, 19 nt, Homo sapiens
gacauugcccugcucaaac

SEQ ID NO: 949204 - RNA, 19 nt, Homo sapiens
ugaagacgaauaugaucug

SEQ ID NO: 949205 - RNA, 19 nt, Homo sapiens
gcuggagcccucaguugug

SEQ ID NO: 949206 - RNA, 19 nt, Homo sapiens
ccauucuacccaacaacua

SEQ ID NO: 949207 - RNA, 19 nt, Homo sapiens
caggaucuaccgcgugaug

SEQ ID NO: 949208 - RNA, 19 nt, Homo sapiens
ggccgucagugucucuaag

SEQ ID NO: 949209 - RNA, 19 nt, Homo sapiens
ugacaucuccuuccuaaua

SEQ ID NO: 949210 - RNA, 19 nt, Homo sapiens
gacaucuccuuccuaauaa

SEQ ID NO: 949211 - RNA, 19 nt, Homo sapiens
ggguauggcugcaagacua

SEQ ID NO: 949212 - RNA, 19 nt, Homo sapiens
ggacgagccuuuagagacu

SEQ ID NO: 949213 - RNA, 19 nt, Homo sapiens
agacaaagaguuagagaaa

SEQ ID NO: 949214 - RNA, 19 nt, Homo sapiens
gaaagacaggaacaaacua

SEQ ID NO: 949215 - RNA, 19 nt, Homo sapiens
ccaccaagcgggaguauga

SEQ ID NO: 949216 - RNA, 19 nt, Homo sapiens
gcagccagacaaagaguua

SEQ ID NO: 949217 - RNA, 19 nt, Homo sapiens
ggaaaaggccgaggaguua

SEQ ID NO: 949218 - RNA, 19 nt, Homo sapiens
ggaguuagcagccagacaa

SEQ ID NO: 949219 - RNA, 19 nt, Homo sapiens
gaggagaggcggagggaaa

SEQ ID NO: 949220 - RNA, 19 nt, Homo sapiens
gaacaaacuaagaggaugu

SEQ ID NO: 949221 - RNA, 19 nt, Homo sapiens
ggaaagacaggaacaaacu

SEQ ID NO: 949222 - RNA, 19 nt, Homo sapiens
gcagagagagccaagaagu

SEQ ID NO: 949223 - RNA, 19 nt, Homo sapiens
gagaggaacgggaggcauu

SEQ ID NO: 949224 - RNA, 19 nt, Homo sapiens
acugacaucuccuuccuaa

SEQ ID NO: 949225 - RNA, 19 nt, Homo sapiens
gagacaagggcaagaguug

SEQ ID NO: 949226 - RNA, 19 nt, Homo sapiens
gaggaaagacaggaacaaa

SEQ ID NO: 949227 - RNA, 19 nt, Homo sapiens
auaaauagacccugaguuc

SEQ ID NO: 949228 - RNA, 19 nt, Homo sapiens
gacagcggcuacaggaaga

SEQ ID NO: 949229 - RNA, 19 nt, Homo sapiens
gcgggagcgugaagaaaga

SEQ ID NO: 949230 - RNA, 19 nt, Homo sapiens
gcacugacaucuccuuccu

SEQ ID NO: 949231 - RNA, 19 nt, Homo sapiens
aaagacaggaacaaacuaa

SEQ ID NO: 949232 - RNA, 19 nt, Homo sapiens
cagagagagccaagaagua

SEQ ID NO: 949233 - RNA, 19 nt, Homo sapiens
aaggagggaugcaaagaga

SEQ ID NO: 949234 - RNA, 19 nt, Homo sapiens
aaacuaagaggauguugga

SEQ ID NO: 949235 - RNA, 19 nt, Homo sapiens
ggagacaagggcaagaguu

SEQ ID NO: 949236 - RNA, 19 nt, Homo sapiens
gaaaccaggacuagaaacu

SEQ ID NO: 949237 - RNA, 19 nt, Homo sapiens
guuagcagccagacaaaga

SEQ ID NO: 949238 - RNA, 19 nt, Homo sapiens
ccagaugggaccucacuga

SEQ ID NO: 949239 - RNA, 19 nt, Homo sapiens
ggaacgggaggcauuggaa

SEQ ID NO: 949240 - RNA, 19 nt, Homo sapiens
ggugcaaggccaggaauuu

SEQ ID NO: 949241 - RNA, 19 nt, Homo sapiens
gcgggaguaugaccagugu

SEQ ID NO: 949242 - RNA, 19 nt, Homo sapiens
agagagagccaagaaguau

SEQ ID NO: 949243 - RNA, 19 nt, Homo sapiens
gagggccuuugucccauug

SEQ ID NO: 949244 - RNA, 19 nt, Homo sapiens
gagaaggcaaacccgcuuu

SEQ ID NO: 949245 - RNA, 19 nt, Homo sapiens
agacaggaacaaacuaaga

SEQ ID NO: 949246 - RNA, 19 nt, Homo sapiens
guucaagccuguuuucuuc

SEQ ID NO: 949247 - RNA, 19 nt, Homo sapiens
uagaaaccaggacuagaaa

SEQ ID NO: 949248 - RNA, 19 nt, Homo sapiens
gcagcgggagcgugaagaa

SEQ ID NO: 949249 - RNA, 19 nt, Homo sapiens
aaauagacccugaguucug

SEQ ID NO: 949250 - RNA, 19 nt, Homo sapiens
gauaaagcacugacaucuc

SEQ ID NO: 949251 - RNA, 19 nt, Homo sapiens
ggaaaaggagggaugcaaa

SEQ ID NO: 949252 - RNA, 19 nt, Homo sapiens
ggagggaugcaaagagaag

SEQ ID NO: 949253 - RNA, 19 nt, Homo sapiens
gacaaagaguuagagaaaa

SEQ ID NO: 949254 - RNA, 19 nt, Homo sapiens
aauagacccugaguucugu

SEQ ID NO: 949255 - RNA, 19 nt, Homo sapiens
aagcagagagagccaagaa

SEQ ID NO: 949256 - RNA, 19 nt, Homo sapiens
ugagggccuuugucccauu

SEQ ID NO: 949257 - RNA, 19 nt, Homo sapiens
gccuucugcuguucucauu

SEQ ID NO: 949258 - RNA, 19 nt, Homo sapiens
cgauguggacgagccuuua

SEQ ID NO: 949259 - RNA, 19 nt, Homo sapiens
ccagacgggccuucucaga

SEQ ID NO: 949260 - RNA, 19 nt, Homo sapiens
gacccugaguucuguaaaa

SEQ ID NO: 949261 - RNA, 19 nt, Homo sapiens
gagagagccaagaaguaug

SEQ ID NO: 949262 - RNA, 19 nt, Homo sapiens
gacaggaacaaacuaagag

SEQ ID NO: 949263 - RNA, 19 nt, Homo sapiens
cuucugcuguucucauugu

SEQ ID NO: 949264 - RNA, 19 nt, Homo sapiens
acucgugccuucugcuguu

SEQ ID NO: 949265 - RNA, 19 nt, Homo sapiens
acaaagaguuagagaaaag

SEQ ID NO: 949266 - RNA, 19 nt, Homo sapiens
cagacaaagaguuagagaa

SEQ ID NO: 949267 - RNA, 19 nt, Homo sapiens
gggaaaaggccgaggaguu

SEQ ID NO: 949268 - RNA, 19 nt, Homo sapiens
ugaagaggaaagacaggaa

SEQ ID NO: 949269 - RNA, 19 nt, Homo sapiens
gcuacaggaagaugagaug

SEQ ID NO: 949270 - RNA, 19 nt, Homo sapiens
gagggacaaagcagagaga

SEQ ID NO: 949271 - RNA, 19 nt, Homo sapiens
gaucgagagggacaaagca

SEQ ID NO: 949272 - RNA, 19 nt, Homo sapiens
ccagacaaagaguuagaga

SEQ ID NO: 949273 - RNA, 19 nt, Homo sapiens
gaguuagcagccagacaaa

SEQ ID NO: 949274 - RNA, 19 nt, Homo sapiens
uaaauagacccugaguucu

SEQ ID NO: 949275 - RNA, 19 nt, Homo sapiens
ucuccuuccuaauaaauag

SEQ ID NO: 949276 - RNA, 19 nt, Homo sapiens
agacuagaaaccaggacua

SEQ ID NO: 949277 - RNA, 19 nt, Homo sapiens
uauagagccgggugagaga

SEQ ID NO: 949278 - RNA, 19 nt, Homo sapiens
acaucuccuuccuaauaaa

SEQ ID NO: 949279 - RNA, 19 nt, Homo sapiens
ugauaaagcacugacaucu

SEQ ID NO: 949280 - RNA, 19 nt, Homo sapiens
gaaggggcuuugugaacau

SEQ ID NO: 949281 - RNA, 19 nt, Homo sapiens
gauguggacgagccuuuag

SEQ ID NO: 949282 - RNA, 19 nt, Homo sapiens
gaaaaggagggaugcaaag

SEQ ID NO: 949283 - RNA, 19 nt, Homo sapiens
gcaggagggucuauucuuu

SEQ ID NO: 949284 - RNA, 19 nt, Homo sapiens
gcaauucaaucuuucauuc

SEQ ID NO: 949285 - RNA, 19 nt, Homo sapiens
aaaguucacucgcauauau

SEQ ID NO: 949286 - RNA, 19 nt, Homo sapiens
gcaaacgagugcagucaau

SEQ ID NO: 949287 - RNA, 19 nt, Homo sapiens
gcacagaggaauuuaaagu

SEQ ID NO: 949288 - RNA, 19 nt, Homo sapiens
gagagaaguuggugcucaa

SEQ ID NO: 949289 - RNA, 19 nt, Homo sapiens
gguaaccaauuccugacua

SEQ ID NO: 949290 - RNA, 19 nt, Homo sapiens
guaaaugaaucucgaaagc

SEQ ID NO: 949291 - RNA, 19 nt, Homo sapiens
cauagaaccuggagaggau

SEQ ID NO: 949292 - RNA, 19 nt, Homo sapiens
gaaaguucacucgcauaua

SEQ ID NO: 949293 - RNA, 19 nt, Homo sapiens
ggacugggaugccgagaac

SEQ ID NO: 949294 - RNA, 19 nt, Homo sapiens
gcaagaggagaaagagaaa

SEQ ID NO: 949295 - RNA, 19 nt, Homo sapiens
ggugagaaauaggaaagaa

SEQ ID NO: 949296 - RNA, 19 nt, Homo sapiens
gcgcacagaggaauuuaaa

SEQ ID NO: 949297 - RNA, 19 nt, Homo sapiens
ggacagggguaaccaauuc

SEQ ID NO: 949298 - RNA, 19 nt, Homo sapiens
ucgcauauauuaggcaauu

SEQ ID NO: 949299 - RNA, 19 nt, Homo sapiens
acagaggaauuuaaagugu

SEQ ID NO: 949300 - RNA, 19 nt, Homo sapiens
cagacuaguugggucauuu

SEQ ID NO: 949301 - RNA, 19 nt, Homo sapiens
gggaguuggugaugucaga

SEQ ID NO: 949302 - RNA, 19 nt, Homo sapiens
uaaaagcacuucuucuugu

SEQ ID NO: 949303 - RNA, 19 nt, Homo sapiens
gaaaggcgcacagaggaau

SEQ ID NO: 949304 - RNA, 19 nt, Homo sapiens
ggugaugucagacuaguug

SEQ ID NO: 949305 - RNA, 19 nt, Homo sapiens
gcauauauuaggcaauuca

SEQ ID NO: 949306 - RNA, 19 nt, Homo sapiens
cgaaaguucacucgcauau

SEQ ID NO: 949307 - RNA, 19 nt, Homo sapiens
ggguagccauucucuguuc

SEQ ID NO: 949308 - RNA, 19 nt, Homo sapiens
cuaguugggucauuugaag

SEQ ID NO: 949309 - RNA, 19 nt, Homo sapiens
aaucuuucauucuguguga

SEQ ID NO: 949310 - RNA, 19 nt, Homo sapiens
aagcacuucuucuuguauu

SEQ ID NO: 949311 - RNA, 19 nt, Homo sapiens
caauuuaacagacagaaag

SEQ ID NO: 949312 - RNA, 19 nt, Homo sapiens
acuguggaauggaaaguuu

SEQ ID NO: 949313 - RNA, 19 nt, Homo sapiens
cggguaggguucaccgaaa

SEQ ID NO: 949314 - RNA, 19 nt, Homo sapiens
guaaccaauuccugacuac

SEQ ID NO: 949315 - RNA, 19 nt, Homo sapiens
gugagaauccugggaguug

SEQ ID NO: 949316 - RNA, 19 nt, Homo sapiens
gagcaaacgagugcaguca

SEQ ID NO: 949317 - RNA, 19 nt, Homo sapiens
caaacgagugcagucaauu

SEQ ID NO: 949318 - RNA, 19 nt, Homo sapiens
gugagaaauaggaaagaaa

SEQ ID NO: 949319 - RNA, 19 nt, Homo sapiens
gcacuucuucuuguauugu

SEQ ID NO: 949320 - RNA, 19 nt, Homo sapiens
aaaagcacuucuucuugua

SEQ ID NO: 949321 - RNA, 19 nt, Homo sapiens
gcguaaagggagagaaguu

SEQ ID NO: 949322 - RNA, 19 nt, Homo sapiens
ccaauuuaacagacagaaa

SEQ ID NO: 949323 - RNA, 19 nt, Homo sapiens
aaacgagugcagucaauuc

SEQ ID NO: 949324 - RNA, 19 nt, Homo sapiens
cagaaguaguaggaaguga

SEQ ID NO: 949325 - RNA, 19 nt, Homo sapiens
gaacaccguuuuccaagcu

SEQ ID NO: 949326 - RNA, 19 nt, Homo sapiens
aaaagacuguggaauggaa

SEQ ID NO: 949327 - RNA, 19 nt, Homo sapiens
caggagggucuauucuuug

SEQ ID NO: 949328 - RNA, 19 nt, Homo sapiens
ggguaggguucaccgaaag

SEQ ID NO: 949329 - RNA, 19 nt, Homo sapiens
uugggucauuugaagguua

SEQ ID NO: 949330 - RNA, 19 nt, Homo sapiens
gacagaaguaguaggaagu

SEQ ID NO: 949331 - RNA, 19 nt, Homo sapiens
ggcaauucaaucuuucauu

SEQ ID NO: 949332 - RNA, 19 nt, Homo sapiens
gaggcaggagggucuauuc

SEQ ID NO: 949333 - RNA, 19 nt, Homo sapiens
ggcaggagggucuauucuu

SEQ ID NO: 949334 - RNA, 19 nt, Homo sapiens
uuuaagcucugugagaauc

SEQ ID NO: 949335 - RNA, 19 nt, Homo sapiens
ugcaagaggagaaagagaa

SEQ ID NO: 949336 - RNA, 19 nt, Homo sapiens
uuaggcaauucaaucuuuc

SEQ ID NO: 949337 - RNA, 19 nt, Homo sapiens
cacagaggaauuuaaagug

SEQ ID NO: 949338 - RNA, 19 nt, Homo sapiens
auuccugacuacucuauau

SEQ ID NO: 949339 - RNA, 19 nt, Homo sapiens
ucagacuaguugggucauu

SEQ ID NO: 949340 - RNA, 19 nt, Homo sapiens
aguaggaagugagcuguuc

SEQ ID NO: 949341 - RNA, 19 nt, Homo sapiens
uaaggugagaaauaggaaa

SEQ ID NO: 949342 - RNA, 19 nt, Homo sapiens
aguucacucgcauauauua

SEQ ID NO: 949343 - RNA, 19 nt, Homo sapiens
ccugggaguuggugauguc

SEQ ID NO: 949344 - RNA, 19 nt, Homo sapiens
cguaaagggagagaaguug

SEQ ID NO: 949345 - RNA, 19 nt, Homo sapiens
agaaaggcgcacagaggaa

SEQ ID NO: 949346 - RNA, 19 nt, Homo sapiens
guagccauucucuguucua

SEQ ID NO: 949347 - RNA, 19 nt, Homo sapiens
uaaaggaacuggacaaaga

SEQ ID NO: 949348 - RNA, 19 nt, Homo sapiens
ccacugaggucccugagau

SEQ ID NO: 949349 - RNA, 19 nt, Homo sapiens
gcaccgagcgcacucucua

SEQ ID NO: 949350 - RNA, 19 nt, Homo sapiens
gcgagguacuucaucgauu

SEQ ID NO: 949351 - RNA, 19 nt, Homo sapiens
ggaacuggacaaagagaaa

SEQ ID NO: 949352 - RNA, 19 nt, Homo sapiens
cgagguacuucaucgauuc

SEQ ID NO: 949353 - RNA, 19 nt, Homo sapiens
gacauggccugaagaugca

SEQ ID NO: 949354 - RNA, 19 nt, Homo sapiens
gauccaaagaccacaagaa

SEQ ID NO: 949355 - RNA, 19 nt, Homo sapiens
cagaggaauugcccaugga

SEQ ID NO: 949356 - RNA, 19 nt, Homo sapiens
gacagugacgcaaggacua

SEQ ID NO: 949357 - RNA, 19 nt, Homo sapiens
caauaaaggaacuggacaa

SEQ ID NO: 949358 - RNA, 19 nt, Homo sapiens
ggacuuggaugagauucac

SEQ ID NO: 949359 - RNA, 19 nt, Homo sapiens
ggauaccucuaccugacau

SEQ ID NO: 949360 - RNA, 19 nt, Homo sapiens
cagcggguaugggauccua

SEQ ID NO: 949361 - RNA, 19 nt, Homo sapiens
ggccggacuuggaugagau

SEQ ID NO: 949362 - RNA, 19 nt, Homo sapiens
ggaauugcccauggacagu

SEQ ID NO: 949363 - RNA, 19 nt, Homo sapiens
gaugcagggcagaggaauu

SEQ ID NO: 949364 - RNA, 19 nt, Homo sapiens
uaccugacauggccugaag

SEQ ID NO: 949365 - RNA, 19 nt, Homo sapiens
gcgucgagcccuacaguca

SEQ ID NO: 949366 - RNA, 19 nt, Homo sapiens
ccaaagaccacaagaaaag

SEQ ID NO: 949367 - RNA, 19 nt, Homo sapiens
ugaggucccugagauggau

SEQ ID NO: 949368 - RNA, 19 nt, Homo sapiens
auccaaagaccacaagaaa

SEQ ID NO: 949369 - RNA, 19 nt, Homo sapiens
aauaaaggaacuggacaaa

SEQ ID NO: 949370 - RNA, 19 nt, Homo sapiens
gagcgucgagcccuacagu

SEQ ID NO: 949371 - RNA, 19 nt, Homo sapiens
gaacuggacaaagagaaaa

SEQ ID NO: 949372 - RNA, 19 nt, Homo sapiens
gcagugcccacggaagugu

SEQ ID NO: 949373 - RNA, 19 nt, Homo sapiens
gaagaugaaaugaguguaa

SEQ ID NO: 949374 - RNA, 19 nt, Homo sapiens
agucaucccucaauaagua

SEQ ID NO: 949375 - RNA, 19 nt, Homo sapiens
ggacgcagggccuugaaua

SEQ ID NO: 949376 - RNA, 19 nt, Homo sapiens
ucaagaagcuuuucacuga

SEQ ID NO: 949377 - RNA, 19 nt, Homo sapiens
caaacugccucgccacaug

SEQ ID NO: 949378 - RNA, 19 nt, Homo sapiens
ggucugcgguguucgauuc

SEQ ID NO: 949379 - RNA, 19 nt, Homo sapiens
ugaaaugaguguaaaguac

SEQ ID NO: 949380 - RNA, 19 nt, Homo sapiens
gaaccucaguuuccuuguc

SEQ ID NO: 949381 - RNA, 19 nt, Homo sapiens
ccagagcccucauuccaau

SEQ ID NO: 949382 - RNA, 19 nt, Homo sapiens
ccaaggagugauacauaua

SEQ ID NO: 949383 - RNA, 19 nt, Homo sapiens
ucaguuuccuugucuguga

SEQ ID NO: 949384 - RNA, 19 nt, Homo sapiens
ggagugauacauauauugu

SEQ ID NO: 949385 - RNA, 19 nt, Homo sapiens
gccauggaguccucuuaaa

SEQ ID NO: 949386 - RNA, 19 nt, Homo sapiens
gcccaucccuugaccuaug

SEQ ID NO: 949387 - RNA, 19 nt, Homo sapiens
ugugugagcuggacuuugu

SEQ ID NO: 949388 - RNA, 19 nt, Homo sapiens
gcugagcgcucuuaaucuc

SEQ ID NO: 949389 - RNA, 19 nt, Homo sapiens
gggcugagcgcucuuaauc

SEQ ID NO: 949390 - RNA, 19 nt, Homo sapiens
gcagggcagugggcuagaa

SEQ ID NO: 949391 - RNA, 19 nt, Homo sapiens
caaggagugauacauauau

SEQ ID NO: 949392 - RNA, 19 nt, Homo sapiens
gcuacgaccucaagaacca

SEQ ID NO: 949393 - RNA, 19 nt, Homo sapiens
aagaagaggagcugguaua

SEQ ID NO: 949394 - RNA, 19 nt, Homo sapiens
gaaaugaguguaaaguacu

SEQ ID NO: 949395 - RNA, 19 nt, Homo sapiens
gcacagcuacgaccucaag

SEQ ID NO: 949396 - RNA, 19 nt, Homo sapiens
aagaggagcugguauaucc

SEQ ID NO: 949397 - RNA, 19 nt, Homo sapiens
gcagucaucccucaauaag

SEQ ID NO: 949398 - RNA, 19 nt, Homo sapiens
cccaaggagugauacauau

SEQ ID NO: 949399 - RNA, 19 nt, Homo sapiens
agaggguucuggaagauga

SEQ ID NO: 949400 - RNA, 19 nt, Homo sapiens
ggagaucccgugugucauc

SEQ ID NO: 949401 - RNA, 19 nt, Homo sapiens
ggccagagcaaaccaccua

SEQ ID NO: 949402 - RNA, 19 nt, Homo sapiens
ggcagaggcuccccaaauu

SEQ ID NO: 949403 - RNA, 19 nt, Homo sapiens
ggaacgacaagcugaagau

SEQ ID NO: 949404 - RNA, 19 nt, Homo sapiens
gaccugauggccuaccuaa

SEQ ID NO: 949405 - RNA, 19 nt, Homo sapiens
gaagaagaggagcugguau

SEQ ID NO: 949406 - RNA, 19 nt, Homo sapiens
gaagaggagcugguauauc

SEQ ID NO: 949407 - RNA, 19 nt, Homo sapiens
ucuggaagaugaaaugagu

SEQ ID NO: 949408 - RNA, 19 nt, Homo sapiens
gcaaacgccgcucccagau

SEQ ID NO: 949409 - RNA, 19 nt, Homo sapiens
gaugaaaugaguguaaagu

SEQ ID NO: 949410 - RNA, 19 nt, Homo sapiens
ggacgagggccagacugaa

SEQ ID NO: 949411 - RNA, 19 nt, Homo sapiens
agaagaagaggagcuggua

SEQ ID NO: 949412 - RNA, 19 nt, Homo sapiens
ucauuccaauuccaagcua

SEQ ID NO: 949413 - RNA, 19 nt, Homo sapiens
gaacgacaagcugaagauc

SEQ ID NO: 949414 - RNA, 19 nt, Homo sapiens
ccagagcuacgaacccuau

SEQ ID NO: 949415 - RNA, 19 nt, Homo sapiens
augcagucaucccucaaua

SEQ ID NO: 949416 - RNA, 19 nt, Homo sapiens
ggcuaaaguugguccucuu

SEQ ID NO: 949417 - RNA, 19 nt, Homo sapiens
cuaugagggugaggaagaa

SEQ ID NO: 949418 - RNA, 19 nt, Homo sapiens
aagcuuuccugcaaaccaa

SEQ ID NO: 949419 - RNA, 19 nt, Homo sapiens
ccucuggaguucccaaugg

SEQ ID NO: 949420 - RNA, 19 nt, Homo sapiens
ggagcacgcaggacagaca

SEQ ID NO: 949421 - RNA, 19 nt, Homo sapiens
aaacugccucgccacauga

SEQ ID NO: 949422 - RNA, 19 nt, Homo sapiens
ccuaugagggugaggaaga

SEQ ID NO: 949423 - RNA, 19 nt, Homo sapiens
auuccaagcuaagaaggua

SEQ ID NO: 949424 - RNA, 19 nt, Homo sapiens
ugaugacgaugaggaggaa

SEQ ID NO: 949425 - RNA, 19 nt, Homo sapiens
caaacgccgcucccagaug

SEQ ID NO: 949426 - RNA, 19 nt, Homo sapiens
uaaguauuggcuaaaguug

SEQ ID NO: 949427 - RNA, 19 nt, Homo sapiens
ggaagaugaaaugagugua

SEQ ID NO: 949428 - RNA, 19 nt, Homo sapiens
ccauggaguccucuuaaag

SEQ ID NO: 949429 - RNA, 19 nt, Homo sapiens
gccucgaccucuccaaugg

SEQ ID NO: 949430 - RNA, 19 nt, Homo sapiens
aguauuggcuaaaguuggu

SEQ ID NO: 949431 - RNA, 19 nt, Homo sapiens
cauuccaauuccaagcuaa

SEQ ID NO: 949432 - RNA, 19 nt, Homo sapiens
gacgagggccagacugaag

SEQ ID NO: 949433 - RNA, 19 nt, Homo sapiens
acgacaagcugaagaucca

SEQ ID NO: 949434 - RNA, 19 nt, Homo sapiens
agaagaggagcugguauau

SEQ ID NO: 949435 - RNA, 19 nt, Homo sapiens
gugccauggaguccucuua

SEQ ID NO: 949436 - RNA, 19 nt, Homo sapiens
gagcuacgaacccuaugag

SEQ ID NO: 949437 - RNA, 19 nt, Homo sapiens
cuggagaucccguguguca

SEQ ID NO: 949438 - RNA, 19 nt, Homo sapiens
ccagcugggccaccuaugu

SEQ ID NO: 949439 - RNA, 19 nt, Homo sapiens
ccaauuccaagcuaagaag

SEQ ID NO: 949440 - RNA, 19 nt, Homo sapiens
acagggcuuucgccaagga

SEQ ID NO: 949441 - RNA, 19 nt, Homo sapiens
ccaggaacgacaagcugaa

SEQ ID NO: 949442 - RNA, 19 nt, Homo sapiens
gcaaacugccucgccacau

SEQ ID NO: 949443 - RNA, 19 nt, Homo sapiens
ucccugaggugcccacagu

SEQ ID NO: 949444 - RNA, 19 nt, Homo sapiens
cggacgaggaugacuguga

SEQ ID NO: 949445 - RNA, 19 nt, Homo sapiens
gccuauacagccacacuga

SEQ ID NO: 949446 - RNA, 19 nt, Homo sapiens
cagcugggccaccuaugug

SEQ ID NO: 949447 - RNA, 19 nt, Homo sapiens
gcagaggcuccccaaauug

SEQ ID NO: 949448 - RNA, 19 nt, Homo sapiens
ggacaccuuccgccucucu

SEQ ID NO: 949449 - RNA, 19 nt, Homo sapiens
cccaucccuugaccuauga

SEQ ID NO: 949450 - RNA, 19 nt, Homo sapiens
gaucacagcucucuaagua

SEQ ID NO: 949451 - RNA, 19 nt, Homo sapiens
gaagcaacaucaaagaauu

SEQ ID NO: 949452 - RNA, 19 nt, Homo sapiens
cuucaucacucauaucuua

SEQ ID NO: 949453 - RNA, 19 nt, Homo sapiens
guacaagugucaagaaugu

SEQ ID NO: 949454 - RNA, 19 nt, Homo sapiens
gaagagaaaccauacaaau

SEQ ID NO: 949455 - RNA, 19 nt, Homo sapiens
gagaauaucccuacaagug

SEQ ID NO: 949456 - RNA, 19 nt, Homo sapiens
gaacaacaggcaaugaauu

SEQ ID NO: 949457 - RNA, 19 nt, Homo sapiens
gagcacaagcuaagucaua

SEQ ID NO: 949458 - RNA, 19 nt, Homo sapiens
ccucaaagcuucaggaaca

SEQ ID NO: 949459 - RNA, 19 nt, Homo sapiens
ugaagaaugugggaaagua

SEQ ID NO: 949460 - RNA, 19 nt, Homo sapiens
ccauagacauuucccauga

SEQ ID NO: 949461 - RNA, 19 nt, Homo sapiens
acaggaacaucuagaaauu

SEQ ID NO: 949462 - RNA, 19 nt, Homo sapiens
ucaggaacaucaaacaauu

SEQ ID NO: 949463 - RNA, 19 nt, Homo sapiens
ugacaagugugaagaaugu

SEQ ID NO: 949464 - RNA, 19 nt, Homo sapiens
ccucagaucuucagcauca

SEQ ID NO: 949465 - RNA, 19 nt, Homo sapiens
caacaggcaaugaauuuaa

SEQ ID NO: 949466 - RNA, 19 nt, Homo sapiens
gagagaaaccauacaaaug

SEQ ID NO: 949467 - RNA, 19 nt, Homo sapiens
caaagcaguucauacuaga

SEQ ID NO: 949468 - RNA, 19 nt, Homo sapiens
ggagagaaaccauacaaau

SEQ ID NO: 949469 - RNA, 19 nt, Homo sapiens
ucacagcucucuaaguaug

SEQ ID NO: 949470 - RNA, 19 nt, Homo sapiens
gagagaaacccuacaagug

SEQ ID NO: 949471 - RNA, 19 nt, Homo sapiens
gaggaacccuacuacuuug

SEQ ID NO: 949472 - RNA, 19 nt, Homo sapiens
gagaggaacccuacuacuu

SEQ ID NO: 949473 - RNA, 19 nt, Homo sapiens
guuuaaagcuccuuguaug

SEQ ID NO: 949474 - RNA, 19 nt, Homo sapiens
cuuuaucacucguuucuua

SEQ ID NO: 949475 - RNA, 19 nt, Homo sapiens
gaaaagacaucaaauccau

SEQ ID NO: 949476 - RNA, 19 nt, Homo sapiens
auacuggaguuaaaccuua

SEQ ID NO: 949477 - RNA, 19 nt, Homo sapiens
ucacucauaucuuaggaaa

SEQ ID NO: 949478 - RNA, 19 nt, Homo sapiens
uguaugcuguccacucuua

SEQ ID NO: 949479 - RNA, 19 nt, Homo sapiens
gagaaaccauacaaaugug

SEQ ID NO: 949480 - RNA, 19 nt, Homo sapiens
gagaaaccauacaaaugug

SEQ ID NO: 949481 - RNA, 19 nt, Homo sapiens
gacaucaaaucauccauuc

SEQ ID NO: 949482 - RNA, 19 nt, Homo sapiens
gcuguccacucuuaagaaa

SEQ ID NO: 949483 - RNA, 19 nt, Homo sapiens
gagagaaaccauacaagug

SEQ ID NO: 949484 - RNA, 19 nt, Homo sapiens
gagagaaacccuacaugug

SEQ ID NO: 949485 - RNA, 19 nt, Homo sapiens
auacaaaugugaagagugu

SEQ ID NO: 949486 - RNA, 19 nt, Homo sapiens
gagaggaacauacaagugu

SEQ ID NO: 949487 - RNA, 19 nt, Homo sapiens
acaaagcaguucauacuag

SEQ ID NO: 949488 - RNA, 19 nt, Homo sapiens
cuacaagugugaagagugu

SEQ ID NO: 949489 - RNA, 19 nt, Homo sapiens
agacaaacccuacaagugu

SEQ ID NO: 949490 - RNA, 19 nt, Homo sapiens
gagacaaacccuacaagug

SEQ ID NO: 949491 - RNA, 19 nt, Homo sapiens
agaggaacccuacuacuuu

SEQ ID NO: 949492 - RNA, 19 nt, Homo sapiens
ggcaaugaauuuaacaauc

SEQ ID NO: 949493 - RNA, 19 nt, Homo sapiens
cagcauaaaggaauugauu

SEQ ID NO: 949494 - RNA, 19 nt, Homo sapiens
uaaccagcauaaaggaauu

SEQ ID NO: 949495 - RNA, 19 nt, Homo sapiens
ggagagaaacccuacaagu

SEQ ID NO: 949496 - RNA, 19 nt, Homo sapiens
gaguuaaaccuuacaagug

SEQ ID NO: 949497 - RNA, 19 nt, Homo sapiens
ggaaacaccaggcaguuca

SEQ ID NO: 949498 - RNA, 19 nt, Homo sapiens
ggaguuaaaccuuacaagu

SEQ ID NO: 949499 - RNA, 19 nt, Homo sapiens
uaacauuucuggagcaaaa

SEQ ID NO: 949500 - RNA, 19 nt, Homo sapiens
auacaagugugaccaaugu

SEQ ID NO: 949501 - RNA, 19 nt, Homo sapiens
caucaaauccauuccauag

SEQ ID NO: 949502 - RNA, 19 nt, Homo sapiens
uuacaagugugaagagugu

SEQ ID NO: 949503 - RNA, 19 nt, Homo sapiens
gaagaaugugggaaaguau

SEQ ID NO: 949504 - RNA, 19 nt, Homo sapiens
auacaaaugugaggaaugu

SEQ ID NO: 949505 - RNA, 19 nt, Homo sapiens
agagaaaccauacaaaugu

SEQ ID NO: 949506 - RNA, 19 nt, Homo sapiens
agagaaaccauacaaaugu

SEQ ID NO: 949507 - RNA, 19 nt, Homo sapiens
agcagucgcucaucacuuu

SEQ ID NO: 949508 - RNA, 19 nt, Homo sapiens
gggaugugaugcuggagaa

SEQ ID NO: 949509 - RNA, 19 nt, Homo sapiens
ccaugaguguguauaaugu

SEQ ID NO: 949510 - RNA, 19 nt, Homo sapiens
acucauaucuuaggaaaca

SEQ ID NO: 949511 - RNA, 19 nt, Homo sapiens
ccaaacaucagccaccauu

SEQ ID NO: 949512 - RNA, 19 nt, Homo sapiens
ugggaaaugucuguucuuu

SEQ ID NO: 949513 - RNA, 19 nt, Homo sapiens
uaugaagacugucacaaag

SEQ ID NO: 949514 - RNA, 19 nt, Homo sapiens
ucaaauccauuccauagac

SEQ ID NO: 949515 - RNA, 19 nt, Homo sapiens
aaucauccauucugaagau

SEQ ID NO: 949516 - RNA, 19 nt, Homo sapiens
gaagucagucucuacaagu

SEQ ID NO: 949517 - RNA, 19 nt, Homo sapiens
agagaaacccuacaugugu

SEQ ID NO: 949518 - RNA, 19 nt, Homo sapiens
agagaaacccuacaagugu

SEQ ID NO: 949519 - RNA, 19 nt, Homo sapiens
gaucuucagcaucaucaaa

SEQ ID NO: 949520 - RNA, 19 nt, Homo sapiens
gggauguggccauugauuu

SEQ ID NO: 949521 - RNA, 19 nt, Homo sapiens
ugaagaguaugggaaaugu

SEQ ID NO: 949522 - RNA, 19 nt, Homo sapiens
gaaauucauacuggagaaa

SEQ ID NO: 949523 - RNA, 19 nt, Homo sapiens
ugcuaucguucauaucuua

SEQ ID NO: 949524 - RNA, 19 nt, Homo sapiens
caaauccauuccauagaca

SEQ ID NO: 949525 - RNA, 19 nt, Homo sapiens
ucaagaauguggcaaaucc

SEQ ID NO: 949526 - RNA, 19 nt, Homo sapiens
gaaaccauacaaaugugaa

SEQ ID NO: 949527 - RNA, 19 nt, Homo sapiens
caccagaaauaucauacug

SEQ ID NO: 949528 - RNA, 19 nt, Homo sapiens
ggaacaacaggcaaugaau

SEQ ID NO: 949529 - RNA, 19 nt, Homo sapiens
ggagaggaacauacaagug

SEQ ID NO: 949530 - RNA, 19 nt, Homo sapiens
ugaagucagucucuacaag

SEQ ID NO: 949531 - RNA, 19 nt, Homo sapiens
cuggagaaaucauacaaau

SEQ ID NO: 949532 - RNA, 19 nt, Homo sapiens
acacugaagagaaaccaua

SEQ ID NO: 949533 - RNA, 19 nt, Homo sapiens
caaaucauccauucugaag

SEQ ID NO: 949534 - RNA, 19 nt, Homo sapiens
gaagagugugggaaauguu

SEQ ID NO: 949535 - RNA, 19 nt, Homo sapiens
aguuaaaccuuacaagugu

SEQ ID NO: 949536 - RNA, 19 nt, Homo sapiens
ccucugcuuucuuucuuaa

SEQ ID NO: 949537 - RNA, 19 nt, Homo sapiens
gcucaucacuuuuaauaca

SEQ ID NO: 949538 - RNA, 19 nt, Homo sapiens
ggagacaaacccuacaagu

SEQ ID NO: 949539 - RNA, 19 nt, Homo sapiens
aggaacaucuagaaauuca

SEQ ID NO: 949540 - RNA, 19 nt, Homo sapiens
ugaagagugugggaaaugu

SEQ ID NO: 949541 - RNA, 19 nt, Homo sapiens
gaacccuacuacuuugaag

SEQ ID NO: 949542 - RNA, 19 nt, Homo sapiens
gcugugcucucccguugga

SEQ ID NO: 949543 - RNA, 19 nt, Homo sapiens
gacaucaaauccauuccau

SEQ ID NO: 949544 - RNA, 19 nt, Homo sapiens
aagagaaaccauacaaaug

SEQ ID NO: 949545 - RNA, 19 nt, Homo sapiens
ucucugacauggaggaaau

SEQ ID NO: 949546 - RNA, 19 nt, Homo sapiens
cuacaagugcgaagaaugu

SEQ ID NO: 949547 - RNA, 19 nt, Homo sapiens
agagaaaccauacaagugu

SEQ ID NO: 949548 - RNA, 19 nt, Homo sapiens
agaaauucauacuggagaa

SEQ ID NO: 949549 - RNA, 19 nt, Homo sapiens
acacaaagcaguucauacu

SEQ ID NO: 949550 - RNA, 19 nt, Homo sapiens
gaaaggagguuauuugugu

SEQ ID NO: 949551 - RNA, 19 nt, Homo sapiens
ggacagagcuaaagaaaca

SEQ ID NO: 949552 - RNA, 19 nt, Homo sapiens
ggaagaaucucaacuuguu

SEQ ID NO: 949553 - RNA, 19 nt, Homo sapiens
gcacagguauucuuaugua

SEQ ID NO: 949554 - RNA, 19 nt, Homo sapiens
gugaagagauccacuugua

SEQ ID NO: 949555 - RNA, 19 nt, Homo sapiens
ggacuaugcugcuaacgaa

SEQ ID NO: 949556 - RNA, 19 nt, Homo sapiens
ccagaugugucacccauua

SEQ ID NO: 949557 - RNA, 19 nt, Homo sapiens
gagaaugucuuauaaggau

SEQ ID NO: 949558 - RNA, 19 nt, Homo sapiens
gaacacagaggucaguuaa

SEQ ID NO: 949559 - RNA, 19 nt, Homo sapiens
caucaggucuucaaacauu

SEQ ID NO: 949560 - RNA, 19 nt, Homo sapiens
uuaaauagcugccuuccaa

SEQ ID NO: 949561 - RNA, 19 nt, Homo sapiens
cauuagcgcuuauuaacua

SEQ ID NO: 949562 - RNA, 19 nt, Homo sapiens
gaauagaacccuagagaau

SEQ ID NO: 949563 - RNA, 19 nt, Homo sapiens
cgaaaugguuugaaguauu

SEQ ID NO: 949564 - RNA, 19 nt, Homo sapiens
gguuuagacuugauugaua

SEQ ID NO: 949565 - RNA, 19 nt, Homo sapiens
gaaccaaauuuaccaccaa

SEQ ID NO: 949566 - RNA, 19 nt, Homo sapiens
gagcacagguauucuuaug

SEQ ID NO: 949567 - RNA, 19 nt, Homo sapiens
ggaaauauaaugcaacaug

SEQ ID NO: 949568 - RNA, 19 nt, Homo sapiens
gccauaagcuaauugcaaa

SEQ ID NO: 949569 - RNA, 19 nt, Homo sapiens
ccagacagauaauaacauu

SEQ ID NO: 949570 - RNA, 19 nt, Homo sapiens
agaucgaacuguaacauua

SEQ ID NO: 949571 - RNA, 19 nt, Homo sapiens
gugcuuagaucgaacugua

SEQ ID NO: 949572 - RNA, 19 nt, Homo sapiens
gcaagaaguucaggagaga

SEQ ID NO: 949573 - RNA, 19 nt, Homo sapiens
ccuagagaaugucuuauaa

SEQ ID NO: 949574 - RNA, 19 nt, Homo sapiens
gaagagauccacuuguaug

SEQ ID NO: 949575 - RNA, 19 nt, Homo sapiens
gcacccagcuguuguuuac

SEQ ID NO: 949576 - RNA, 19 nt, Homo sapiens
gcaaaguguuagugcguuu

SEQ ID NO: 949577 - RNA, 19 nt, Homo sapiens
acaacaaucucuugacuau

SEQ ID NO: 949578 - RNA, 19 nt, Homo sapiens
acaaauaggagcauucuuu

SEQ ID NO: 949579 - RNA, 19 nt, Homo sapiens
gacaacugaugcacuauga

SEQ ID NO: 949580 - RNA, 19 nt, Homo sapiens
guucaaguguucaucauau

SEQ ID NO: 949581 - RNA, 19 nt, Homo sapiens
gaacucaaacgccaauuuc

SEQ ID NO: 949582 - RNA, 19 nt, Homo sapiens
aaaccaaucuuaccaccuu

SEQ ID NO: 949583 - RNA, 19 nt, Homo sapiens
ggaaacaaauaggagcauu

SEQ ID NO: 949584 - RNA, 19 nt, Homo sapiens
gaggaaaggagguuauuug

SEQ ID NO: 949585 - RNA, 19 nt, Homo sapiens
uaugaagacuagagcuaua

SEQ ID NO: 949586 - RNA, 19 nt, Homo sapiens
gacgagaaauagauaaauc

SEQ ID NO: 949587 - RNA, 19 nt, Homo sapiens
caagaauaguguucggauu

SEQ ID NO: 949588 - RNA, 19 nt, Homo sapiens
ggauuccggucacaauuug

SEQ ID NO: 949589 - RNA, 19 nt, Homo sapiens
gaagacuagagcuauauuu

SEQ ID NO: 949590 - RNA, 19 nt, Homo sapiens
aacaaucucuugacuauuc

SEQ ID NO: 949591 - RNA, 19 nt, Homo sapiens
caacugaugcacuaugauu

SEQ ID NO: 949592 - RNA, 19 nt, Homo sapiens
caagcaaugcaaaguguua

SEQ ID NO: 949593 - RNA, 19 nt, Homo sapiens
caaccacacagauauguuu

SEQ ID NO: 949594 - RNA, 19 nt, Homo sapiens
aggauugucugccauuuaa

SEQ ID NO: 949595 - RNA, 19 nt, Homo sapiens
ccacaugguuuagacuuga

SEQ ID NO: 949596 - RNA, 19 nt, Homo sapiens
aaagagauguuggaaggaa

SEQ ID NO: 949597 - RNA, 19 nt, Homo sapiens
gcaugucgauguaauaaaa

SEQ ID NO: 949598 - RNA, 19 nt, Homo sapiens
acaagaaacacgugaauau

SEQ ID NO: 949599 - RNA, 19 nt, Homo sapiens
gggaagggcucaccaagcu

SEQ ID NO: 949600 - RNA, 19 nt, Homo sapiens
ggaaggaaaaccaaucuua

SEQ ID NO: 949601 - RNA, 19 nt, Homo sapiens
ggagauuagaguucauuaa

SEQ ID NO: 949602 - RNA, 19 nt, Homo sapiens
gcaaauuccaagaagguuu

SEQ ID NO: 949603 - RNA, 19 nt, Homo sapiens
agaaagaagucauaaccau

SEQ ID NO: 949604 - RNA, 19 nt, Homo sapiens
agacaguauuggagaagua

SEQ ID NO: 949605 - RNA, 19 nt, Homo sapiens
gaauagccuucagaauaga

SEQ ID NO: 949606 - RNA, 19 nt, Homo sapiens
gaggggagaugcuuuuaaa

SEQ ID NO: 949607 - RNA, 19 nt, Homo sapiens
gaagaaucucaacuuguuu

SEQ ID NO: 949608 - RNA, 19 nt, Homo sapiens
gcaagccuuuucuaaauuu

SEQ ID NO: 949609 - RNA, 19 nt, Homo sapiens
cagccucucuuauuugguu

SEQ ID NO: 949610 - RNA, 19 nt, Homo sapiens
ggagagaaagaagucauaa

SEQ ID NO: 949611 - RNA, 19 nt, Homo sapiens
aaauacaguucaaguguuc

SEQ ID NO: 949612 - RNA, 19 nt, Homo sapiens
cagaauagaacccuagaga

SEQ ID NO: 949613 - RNA, 19 nt, Homo sapiens
guucuugggcugcuucaua

SEQ ID NO: 949614 - RNA, 19 nt, Homo sapiens
uagagaaugucuuauaagg

SEQ ID NO: 949615 - RNA, 19 nt, Homo sapiens
gagaagcacccagcuguug

SEQ ID NO: 949616 - RNA, 19 nt, Homo sapiens
ggaaaggagguuauuugug

SEQ ID NO: 949617 - RNA, 19 nt, Homo sapiens
gaaacaaauaggagcauuc

SEQ ID NO: 949618 - RNA, 19 nt, Homo sapiens
ucuagugggugcaaaguga

SEQ ID NO: 949619 - RNA, 19 nt, Homo sapiens
ucaggaccguaacaacuuu

SEQ ID NO: 949620 - RNA, 19 nt, Homo sapiens
ggucacuucuuccagaugu

SEQ ID NO: 949621 - RNA, 19 nt, Homo sapiens
cccaggaacuccaagagaa

SEQ ID NO: 949622 - RNA, 19 nt, Homo sapiens
acacacacacacauauaua

SEQ ID NO: 949623 - RNA, 19 nt, Homo sapiens
ggacagcaaauccgguuau

SEQ ID NO: 949624 - RNA, 19 nt, Homo sapiens
caaaggacagagcuaaaga

SEQ ID NO: 949625 - RNA, 19 nt, Homo sapiens
uaagaacuccaaacggaaa

SEQ ID NO: 949626 - RNA, 19 nt, Homo sapiens
ggucacaauuugcgcugaa

SEQ ID NO: 949627 - RNA, 19 nt, Homo sapiens
gaucgaacuguaacauuau

SEQ ID NO: 949628 - RNA, 19 nt, Homo sapiens
uaaauccugugcuuagauc

SEQ ID NO: 949629 - RNA, 19 nt, Homo sapiens
caagaaacacgugaauaug

SEQ ID NO: 949630 - RNA, 19 nt, Homo sapiens
caggacagaugcauugaag

SEQ ID NO: 949631 - RNA, 19 nt, Homo sapiens
aaacauuugucaccuaaac

SEQ ID NO: 949632 - RNA, 19 nt, Homo sapiens
acacagaggucaguuaaaa

SEQ ID NO: 949633 - RNA, 19 nt, Homo sapiens
agugggauccugacauuua

SEQ ID NO: 949634 - RNA, 19 nt, Homo sapiens
gggauuccggucacaauuu

SEQ ID NO: 949635 - RNA, 19 nt, Homo sapiens
gacagcaaauccgguuauu

SEQ ID NO: 949636 - RNA, 19 nt, Homo sapiens
aauaaacugccucucauuu

SEQ ID NO: 949637 - RNA, 19 nt, Homo sapiens
gaagccacaugguuuagac

SEQ ID NO: 949638 - RNA, 19 nt, Homo sapiens
gcauugaagccacaugguu

SEQ ID NO: 949639 - RNA, 19 nt, Homo sapiens
gacacacacuuuuagauuu

SEQ ID NO: 949640 - RNA, 19 nt, Homo sapiens
uaauauuugugcugugguu

SEQ ID NO: 949641 - RNA, 19 nt, Homo sapiens
ggacaacugaugcacuaug

SEQ ID NO: 949642 - RNA, 19 nt, Homo sapiens
acacacacacacacauaua

SEQ ID NO: 949643 - RNA, 19 nt, Homo sapiens
ccgguuauuugggagauua

SEQ ID NO: 949644 - RNA, 19 nt, Homo sapiens
cauccucccugcuucuuug

SEQ ID NO: 949645 - RNA, 19 nt, Homo sapiens
agggauaagugaaguaugu

SEQ ID NO: 949646 - RNA, 19 nt, Homo sapiens
gcaaaggacagagcuaaag

SEQ ID NO: 949647 - RNA, 19 nt, Homo sapiens
gaaguucaggagagaaaga

SEQ ID NO: 949648 - RNA, 19 nt, Homo sapiens
ugcaacaugucaacaggua

SEQ ID NO: 949649 - RNA, 19 nt, Homo sapiens
ggggagaugcuuuuaaaua

SEQ ID NO: 949650 - RNA, 19 nt, Homo sapiens
ggaaaucacucccaauuaa

SEQ ID NO: 949651 - RNA, 19 nt, Homo sapiens
gaaaagaacugucucaaaa

SEQ ID NO: 949652 - RNA, 19 nt, Homo sapiens
gaaguuugcuuauuaggaa

SEQ ID NO: 949653 - RNA, 19 nt, Homo sapiens
ugacaacggugguacauaa

SEQ ID NO: 949654 - RNA, 19 nt, Homo sapiens
ucgagaaguuugcuuauua

SEQ ID NO: 949655 - RNA, 19 nt, Homo sapiens
gaaggagacuuuagaacga

SEQ ID NO: 949656 - RNA, 19 nt, Homo sapiens
ggacagcccucuccaguag

SEQ ID NO: 949657 - RNA, 19 nt, Homo sapiens
ggaaauacaaccguaguua

SEQ ID NO: 949658 - RNA, 19 nt, Homo sapiens
gaagaggaccacuguuuaa

SEQ ID NO: 949659 - RNA, 19 nt, Homo sapiens
gaaauacaaccguaguuaa

SEQ ID NO: 949660 - RNA, 19 nt, Homo sapiens
gaagggugcggaagauuua

SEQ ID NO: 949661 - RNA, 19 nt, Homo sapiens
gaggaccacuguuuaacua

SEQ ID NO: 949662 - RNA, 19 nt, Homo sapiens
caacggugguacauaagua

SEQ ID NO: 949663 - RNA, 19 nt, Homo sapiens
uuaggucucuucuguguua

SEQ ID NO: 949664 - RNA, 19 nt, Homo sapiens
uaacuaacaucuacuccaa

SEQ ID NO: 949665 - RNA, 19 nt, Homo sapiens
gaacgaguuuaauagauuc

SEQ ID NO: 949666 - RNA, 19 nt, Homo sapiens
gaucaaggaccucaucauu

SEQ ID NO: 949667 - RNA, 19 nt, Homo sapiens
gagaugcggugagguguuu

SEQ ID NO: 949668 - RNA, 19 nt, Homo sapiens
caagauggauucgauagga

SEQ ID NO: 949669 - RNA, 19 nt, Homo sapiens
gguaucacauuaaagagaa

SEQ ID NO: 949670 - RNA, 19 nt, Homo sapiens
ggacaucuacgcaacuaaa

SEQ ID NO: 949671 - RNA, 19 nt, Homo sapiens
cuuaagacgucuauaggua

SEQ ID NO: 949672 - RNA, 19 nt, Homo sapiens
auaaguaggucucaagcua

SEQ ID NO: 949673 - RNA, 19 nt, Homo sapiens
gaacauucucacaacguua

SEQ ID NO: 949674 - RNA, 19 nt, Homo sapiens
cgacacagguacucuagug

SEQ ID NO: 949675 - RNA, 19 nt, Homo sapiens
acacaaagaacacaacgua

SEQ ID NO: 949676 - RNA, 19 nt, Homo sapiens
ugaagaggaccacuguuua

SEQ ID NO: 949677 - RNA, 19 nt, Homo sapiens
caaagaacacaacguagaa

SEQ ID NO: 949678 - RNA, 19 nt, Homo sapiens
uuaaggaaguguaacaaga

SEQ ID NO: 949679 - RNA, 19 nt, Homo sapiens
aaagauuccucguuccaaa

SEQ ID NO: 949680 - RNA, 19 nt, Homo sapiens
ggugagguguuuacuacaa

SEQ ID NO: 949681 - RNA, 19 nt, Homo sapiens
ugaguuguccucuacuuua

SEQ ID NO: 949682 - RNA, 19 nt, Homo sapiens
ggaaguguaacaagagaaa

SEQ ID NO: 949683 - RNA, 19 nt, Homo sapiens
uaagaaccaacacuaagua

SEQ ID NO: 949684 - RNA, 19 nt, Homo sapiens
uaaagacucuaccuacaag

SEQ ID NO: 949685 - RNA, 19 nt, Homo sapiens
ggaagcuccugacaucuag

SEQ ID NO: 949686 - RNA, 19 nt, Homo sapiens
gugaagaggaccacuguuu

SEQ ID NO: 949687 - RNA, 19 nt, Homo sapiens
uagguaaugugccucaauu

SEQ ID NO: 949688 - RNA, 19 nt, Homo sapiens
acguagaucucccggguua

SEQ ID NO: 949689 - RNA, 19 nt, Homo sapiens
gcggugagguguuuacuac

SEQ ID NO: 949690 - RNA, 19 nt, Homo sapiens
uaacaucuacuccaagaau

SEQ ID NO: 949691 - RNA, 19 nt, Homo sapiens
cgagaaguuugcuuauuag

SEQ ID NO: 949692 - RNA, 19 nt, Homo sapiens
caagaaggagacuuuagaa

SEQ ID NO: 949693 - RNA, 19 nt, Homo sapiens
caacgucgaguaauucaau

SEQ ID NO: 949694 - RNA, 19 nt, Homo sapiens
ccaaggauguagguaaugu

SEQ ID NO: 949695 - RNA, 19 nt, Homo sapiens
guacauaaguaggucucaa

SEQ ID NO: 949696 - RNA, 19 nt, Homo sapiens
acgcgacgcuugugacuug

SEQ ID NO: 949697 - RNA, 19 nt, Homo sapiens
gacuuuagaacgaguuuaa

SEQ ID NO: 949698 - RNA, 19 nt, Homo sapiens
ucaagaaggagacuuuaga

SEQ ID NO: 949699 - RNA, 19 nt, Homo sapiens
gaaccaacacuaaguaagc

SEQ ID NO: 949700 - RNA, 19 nt, Homo sapiens
uaaguaggucucaagcuaa

SEQ ID NO: 949701 - RNA, 19 nt, Homo sapiens
acaaagaacacaacguaga

SEQ ID NO: 949702 - RNA, 19 nt, Homo sapiens
uaaaguagguucucaaaac

SEQ ID NO: 949703 - RNA, 19 nt, Homo sapiens
gugagguguuuacuacaaa

SEQ ID NO: 949704 - RNA, 19 nt, Homo sapiens
gcaucucacggccuuuaua

SEQ ID NO: 949705 - RNA, 19 nt, Homo sapiens
ggaaaagaacugucucaaa

SEQ ID NO: 949706 - RNA, 19 nt, Homo sapiens
aaaccauuaugcugaguga

SEQ ID NO: 949707 - RNA, 19 nt, Homo sapiens
uuuaacggguccuaguaua

SEQ ID NO: 949708 - RNA, 19 nt, Homo sapiens
cgggauaucacucagcaua

SEQ ID NO: 949709 - RNA, 19 nt, Homo sapiens
aacuauagcuuaaggaagu

SEQ ID NO: 949710 - RNA, 19 nt, Homo sapiens
ccauuaugcugagugauau

SEQ ID NO: 949711 - RNA, 19 nt, Homo sapiens
cuaaagacucuaccuacaa

SEQ ID NO: 949712 - RNA, 19 nt, Homo sapiens
ucuaaagacucuaccuaca

SEQ ID NO: 949713 - RNA, 19 nt, Homo sapiens
caacguagaaggacauguc

SEQ ID NO: 949714 - RNA, 19 nt, Homo sapiens
acuaacaucuacuccaaga

SEQ ID NO: 949715 - RNA, 19 nt, Homo sapiens
guaguuaaggacaaagauu

SEQ ID NO: 949716 - RNA, 19 nt, Homo sapiens
ggaccacuguuuaacuaac

SEQ ID NO: 949717 - RNA, 19 nt, Homo sapiens
gaaaucacucccaauuaac

SEQ ID NO: 949718 - RNA, 19 nt, Homo sapiens
caaccguaguuaaggacaa

SEQ ID NO: 949719 - RNA, 19 nt, Homo sapiens
ugcggaagauuuaugagaa

SEQ ID NO: 949720 - RNA, 19 nt, Homo sapiens
gaacaaagugaaaaccauu

SEQ ID NO: 949721 - RNA, 19 nt, Homo sapiens
ccaguagacauaccaauca

SEQ ID NO: 949722 - RNA, 19 nt, Homo sapiens
cggaagcuccugacaucua

SEQ ID NO: 949723 - RNA, 19 nt, Homo sapiens
gaccccagcuuacugaaaa

SEQ ID NO: 949724 - RNA, 19 nt, Homo sapiens
uaagacgucuauagguagu

SEQ ID NO: 949725 - RNA, 19 nt, Homo sapiens
auacaaccguaguuaagga

SEQ ID NO: 949726 - RNA, 19 nt, Homo sapiens
agaagggugcggaagauuu

SEQ ID NO: 949727 - RNA, 19 nt, Homo sapiens
acgaaggguuucaggacua

SEQ ID NO: 949728 - RNA, 19 nt, Homo sapiens
gaacacgugggacaucuac

SEQ ID NO: 949729 - RNA, 19 nt, Homo sapiens
cgaacuauagcuuaaggaa

SEQ ID NO: 949730 - RNA, 19 nt, Homo sapiens
aaugugagaccgaagguaa

SEQ ID NO: 949731 - RNA, 19 nt, Homo sapiens
ucaagggaguaagaacuga

SEQ ID NO: 949732 - RNA, 19 nt, Homo sapiens
uguuguagguggaaagguu

SEQ ID NO: 949733 - RNA, 19 nt, Homo sapiens
caguagacauaccaaucaa

SEQ ID NO: 949734 - RNA, 19 nt, Homo sapiens
ccucugaguuguccucuac

SEQ ID NO: 949735 - RNA, 19 nt, Homo sapiens
ggacuaccgggugugcaua

SEQ ID NO: 949736 - RNA, 19 nt, Homo sapiens
uuaacggguccuaguauaa

SEQ ID NO: 949737 - RNA, 19 nt, Homo sapiens
ggaguaagaacugaagaca

SEQ ID NO: 949738 - RNA, 19 nt, Homo sapiens
gaguuguccucuacuuuac

SEQ ID NO: 949739 - RNA, 19 nt, Homo sapiens
guuccaaggauguagguaa

SEQ ID NO: 949740 - RNA, 19 nt, Homo sapiens
ucacaacgucgaguaauuc

SEQ ID NO: 949741 - RNA, 19 nt, Homo sapiens
cuagaagggugcggaagau

SEQ ID NO: 949742 - RNA, 19 nt, Homo sapiens
ugccauagcuauucgaacu

SEQ ID NO: 949743 - RNA, 19 nt, Homo sapiens
ccacgggaacguuaaagau

SEQ ID NO: 949744 - RNA, 19 nt, Homo sapiens
cgacgcuugugacuugaga

SEQ ID NO: 949745 - RNA, 19 nt, Homo sapiens
cucacaacgucgaguaauu

SEQ ID NO: 949746 - RNA, 19 nt, Homo sapiens
cagguucugucaagaugga

SEQ ID NO: 949747 - RNA, 19 nt, Homo sapiens
ccucuacuuuacacacaaa

SEQ ID NO: 949748 - RNA, 19 nt, Homo sapiens
guucaagaaggagacuuua

SEQ ID NO: 949749 - RNA, 19 nt, Homo sapiens
gguucaagaaggagacuuu

SEQ ID NO: 949750 - RNA, 19 nt, Homo sapiens
ggaggaagccgcaguauug

SEQ ID NO: 949751 - RNA, 19 nt, Homo sapiens
caaaggcaguuccuaauga

SEQ ID NO: 949752 - RNA, 19 nt, Homo sapiens
gcacaacugcuccaucuuu

SEQ ID NO: 949753 - RNA, 19 nt, Homo sapiens
guaagugccuccaaauuuc

SEQ ID NO: 949754 - RNA, 19 nt, Homo sapiens
ggagguugcuguuuggaaa

SEQ ID NO: 949755 - RNA, 19 nt, Homo sapiens
gguaagugccuccaaauuu

SEQ ID NO: 949756 - RNA, 19 nt, Homo sapiens
guauuuccuucaagucuua

SEQ ID NO: 949757 - RNA, 19 nt, Homo sapiens
gagcugacguucuauuaca

SEQ ID NO: 949758 - RNA, 19 nt, Homo sapiens
gaccacacccaguucauua

SEQ ID NO: 949759 - RNA, 19 nt, Homo sapiens
cuucagagcuggagaacuu

SEQ ID NO: 949760 - RNA, 19 nt, Homo sapiens
cacaacugcuccaucuuua

SEQ ID NO: 949761 - RNA, 19 nt, Homo sapiens
ccucauagauuagccauug

SEQ ID NO: 949762 - RNA, 19 nt, Homo sapiens
gagcaugggcgguucguuu

SEQ ID NO: 949763 - RNA, 19 nt, Homo sapiens
uagauaacauugcuucaga

SEQ ID NO: 949764 - RNA, 19 nt, Homo sapiens
gcaaaggcaguuccuaaug

SEQ ID NO: 949765 - RNA, 19 nt, Homo sapiens
ggucuuggguggagucaug

SEQ ID NO: 949766 - RNA, 19 nt, Homo sapiens
aaauauagaucccuguauc

SEQ ID NO: 949767 - RNA, 19 nt, Homo sapiens
aaacuguguugcagaggua

SEQ ID NO: 949768 - RNA, 19 nt, Homo sapiens
cccuguaucuuaggaauua

SEQ ID NO: 949769 - RNA, 19 nt, Homo sapiens
aaagguagacuaaacaaga

SEQ ID NO: 949770 - RNA, 19 nt, Homo sapiens
uguaucaacucaaagcaaa

SEQ ID NO: 949771 - RNA, 19 nt, Homo sapiens
aaacuuggcuucccuagcu

SEQ ID NO: 949772 - RNA, 19 nt, Homo sapiens
cagcaaaggcaguuccuaa

SEQ ID NO: 949773 - RNA, 19 nt, Homo sapiens
ccaguucauuauaguguuu

SEQ ID NO: 949774 - RNA, 19 nt, Homo sapiens
uacaggauuugcacuauug

SEQ ID NO: 949775 - RNA, 19 nt, Homo sapiens
ccaaguaugucacccuuac

SEQ ID NO: 949776 - RNA, 19 nt, Homo sapiens
gauuagccauuguuaacau

SEQ ID NO: 949777 - RNA, 19 nt, Homo sapiens
gcagcgugcuuaugaaacu

SEQ ID NO: 949778 - RNA, 19 nt, Homo sapiens
cuuaggagguugcuguuug

SEQ ID NO: 949779 - RNA, 19 nt, Homo sapiens
uucaugagcugacguucua

SEQ ID NO: 949780 - RNA, 19 nt, Homo sapiens
ucacuugucguuuguaaga

SEQ ID NO: 949781 - RNA, 19 nt, Homo sapiens
ccacacccaguucauuaua

SEQ ID NO: 949782 - RNA, 19 nt, Homo sapiens
uuacaggauuugcacuauu

SEQ ID NO: 949783 - RNA, 19 nt, Homo sapiens
cuaaugagauggagaaaau

SEQ ID NO: 949784 - RNA, 19 nt, Homo sapiens
gcaaugcagaaaggaauuu

SEQ ID NO: 949785 - RNA, 19 nt, Homo sapiens
ugacugggcuacgugaaga

SEQ ID NO: 949786 - RNA, 19 nt, Homo sapiens
guugaauuguucucacuug

SEQ ID NO: 949787 - RNA, 19 nt, Homo sapiens
gauguuaucacccuuacug

SEQ ID NO: 949788 - RNA, 19 nt, Homo sapiens
ggaccacacccaguucauu

SEQ ID NO: 949789 - RNA, 19 nt, Homo sapiens
gcuaauuggcagucuggua

SEQ ID NO: 949790 - RNA, 19 nt, Homo sapiens
cgucagccuuagcuaauug

SEQ ID NO: 949791 - RNA, 19 nt, Homo sapiens
uaaaagacguucccuacau

SEQ ID NO: 949792 - RNA, 19 nt, Homo sapiens
gggccauacugucuguuga

SEQ ID NO: 949793 - RNA, 19 nt, Homo sapiens
gaauuagaaaggcagcaaa

SEQ ID NO: 949794 - RNA, 19 nt, Homo sapiens
cauagauuagccauuguua

SEQ ID NO: 949795 - RNA, 19 nt, Homo sapiens
guugacagagcauauuaaa

SEQ ID NO: 949796 - RNA, 19 nt, Homo sapiens
caacugcuccaucuuuaag

SEQ ID NO: 949797 - RNA, 19 nt, Homo sapiens
gguagacuaaacaagauaa

SEQ ID NO: 949798 - RNA, 19 nt, Homo sapiens
uaucacccuuacuggauuu

SEQ ID NO: 949799 - RNA, 19 nt, Homo sapiens
ucucacuugucguuuguaa

SEQ ID NO: 949800 - RNA, 19 nt, Homo sapiens
cuaauuggcagucugguau

SEQ ID NO: 949801 - RNA, 19 nt, Homo sapiens
uaaaauaaccgugggcuuu

SEQ ID NO: 949802 - RNA, 19 nt, Homo sapiens
gaaagaaacccggauucac

SEQ ID NO: 949803 - RNA, 19 nt, Homo sapiens
ccugugaaaucauuguuag

SEQ ID NO: 949804 - RNA, 19 nt, Homo sapiens
ggguaagugccuccaaauu

SEQ ID NO: 949805 - RNA, 19 nt, Homo sapiens
aaggguaagugccuccaaa

SEQ ID NO: 949806 - RNA, 19 nt, Homo sapiens
gaagauccgccauucucau

SEQ ID NO: 949807 - RNA, 19 nt, Homo sapiens
gagauguuaucacccuuac

SEQ ID NO: 949808 - RNA, 19 nt, Homo sapiens
caccugccguugaauuguu

SEQ ID NO: 949809 - RNA, 19 nt, Homo sapiens
gcagucugguauuuaugau

SEQ ID NO: 949810 - RNA, 19 nt, Homo sapiens
ggaauuagaaaggcagcaa

SEQ ID NO: 949811 - RNA, 19 nt, Homo sapiens
ugccugugcugcucgagua

SEQ ID NO: 949812 - RNA, 19 nt, Homo sapiens
agcccucccugccuuguua

SEQ ID NO: 949813 - RNA, 19 nt, Homo sapiens
ugacagagcauauuaaaag

SEQ ID NO: 949814 - RNA, 19 nt, Homo sapiens
guguguaccuuugcauaug

SEQ ID NO: 949815 - RNA, 19 nt, Homo sapiens
cagccuguguguaccuuug

SEQ ID NO: 949816 - RNA, 19 nt, Homo sapiens
gcuuuucacuggaggauaa

SEQ ID NO: 949817 - RNA, 19 nt, Homo sapiens
uguaagaauccaaguaugu

SEQ ID NO: 949818 - RNA, 19 nt, Homo sapiens
ggcagucugguauuuauga

SEQ ID NO: 949819 - RNA, 19 nt, Homo sapiens
aaaagacguucccuacauu

SEQ ID NO: 949820 - RNA, 19 nt, Homo sapiens
aaaggaggaagccgcagua

SEQ ID NO: 949821 - RNA, 19 nt, Homo sapiens
guucucacuugucguuugu

SEQ ID NO: 949822 - RNA, 19 nt, Homo sapiens
ucauaaauuacgcacagua

SEQ ID NO: 949823 - RNA, 19 nt, Homo sapiens
ccuguuguuugcauauuau

SEQ ID NO: 949824 - RNA, 19 nt, Homo sapiens
ggcaguuccuaaugagaug

SEQ ID NO: 949825 - RNA, 19 nt, Homo sapiens
uagauuagccauuguuaac

SEQ ID NO: 949826 - RNA, 19 nt, Homo sapiens
aggauuugcacuauugaua

SEQ ID NO: 949827 - RNA, 19 nt, Homo sapiens
ccaagaaugacagcaguug

SEQ ID NO: 949828 - RNA, 19 nt, Homo sapiens
aagguagacuaaacaagau

SEQ ID NO: 949829 - RNA, 19 nt, Homo sapiens
aaacccggauucacgagau

SEQ ID NO: 949830 - RNA, 19 nt, Homo sapiens
ucaggaugcuguacucacu

SEQ ID NO: 949831 - RNA, 19 nt, Homo sapiens
caaggguugcguugucuga

SEQ ID NO: 949832 - RNA, 19 nt, Homo sapiens
agagauguuaucacccuua

SEQ ID NO: 949833 - RNA, 19 nt, Homo sapiens
acaauccccuuucaaugua

SEQ ID NO: 949834 - RNA, 19 nt, Homo sapiens
guaagaauccaaguauguc

SEQ ID NO: 949835 - RNA, 19 nt, Homo sapiens
guguaccuuugcauaugua

SEQ ID NO: 949836 - RNA, 19 nt, Homo sapiens
agaaagaaacccggauuca

SEQ ID NO: 949837 - RNA, 19 nt, Homo sapiens
acgcacaacugcuccaucu

SEQ ID NO: 949838 - RNA, 19 nt, Homo sapiens
gcacaguaaaaucccauua

SEQ ID NO: 949839 - RNA, 19 nt, Homo sapiens
aaaggcaguuccuaaugag

SEQ ID NO: 949840 - RNA, 19 nt, Homo sapiens
gcugacguucuauuacaaa

SEQ ID NO: 949841 - RNA, 19 nt, Homo sapiens
gugaagauccgccauucuc

SEQ ID NO: 949842 - RNA, 19 nt, Homo sapiens
acacccaguucauuauagu

SEQ ID NO: 949843 - RNA, 19 nt, Homo sapiens
uugccaggcuuuaagugaa

SEQ ID NO: 949844 - RNA, 19 nt, Homo sapiens
uuaagauauuggagugaga

SEQ ID NO: 949845 - RNA, 19 nt, Homo sapiens
uuaucacccuuacuggauu

SEQ ID NO: 949846 - RNA, 19 nt, Homo sapiens
guuaucacccuuacuggau

SEQ ID NO: 949847 - RNA, 19 nt, Homo sapiens
gcagcuagaaggguaagug

SEQ ID NO: 949848 - RNA, 19 nt, Homo sapiens
gacagagcauauuaaaaga

SEQ ID NO: 949849 - RNA, 19 nt, Homo sapiens
gauuuugccucaucaguca

SEQ ID NO: 949850 - RNA, 19 nt, Homo sapiens
ccauggaccuucuuacuua

SEQ ID NO: 949851 - RNA, 19 nt, Homo sapiens
caaacuaccuguacugguu

SEQ ID NO: 949852 - RNA, 19 nt, Homo sapiens
gaagauaucgcucuauucu

SEQ ID NO: 949853 - RNA, 19 nt, Homo sapiens
gcaaugcucccaaaugaug

SEQ ID NO: 949854 - RNA, 19 nt, Homo sapiens
guacugacaaucuguguuu

SEQ ID NO: 949855 - RNA, 19 nt, Homo sapiens
gcucccaaaugaugucuuu

SEQ ID NO: 949856 - RNA, 19 nt, Homo sapiens
gaaagcacaauuagauuca

SEQ ID NO: 949857 - RNA, 19 nt, Homo sapiens
ugaagaaagucaaaucaag

SEQ ID NO: 949858 - RNA, 19 nt, Homo sapiens
ugucuagcauguuuguuua

SEQ ID NO: 949859 - RNA, 19 nt, Homo sapiens
gacccuaacucuaccuuuc

SEQ ID NO: 949860 - RNA, 19 nt, Homo sapiens
gaagcaccauauaaaguag

SEQ ID NO: 949861 - RNA, 19 nt, Homo sapiens
uggaagauaucgcucuauu

SEQ ID NO: 949862 - RNA, 19 nt, Homo sapiens
gagaagcaccauauaaagu

SEQ ID NO: 949863 - RNA, 19 nt, Homo sapiens
gaugcgcaauucauacuug

SEQ ID NO: 949864 - RNA, 19 nt, Homo sapiens
caaccaauaauuucacuga

SEQ ID NO: 949865 - RNA, 19 nt, Homo sapiens
uaaacucgguggccucuuc

SEQ ID NO: 949866 - RNA, 19 nt, Homo sapiens
agaagcaccauauaaagua

SEQ ID NO: 949867 - RNA, 19 nt, Homo sapiens
gacaugaucgccauucuug

SEQ ID NO: 949868 - RNA, 19 nt, Homo sapiens
aaagucaaaucaagcaaug

SEQ ID NO: 949869 - RNA, 19 nt, Homo sapiens
ggagaagcaccauauaaag

SEQ ID NO: 949870 - RNA, 19 nt, Homo sapiens
ugaucgccauucuugauua

SEQ ID NO: 949871 - RNA, 19 nt, Homo sapiens
gaucgccauucuugauuau

SEQ ID NO: 949872 - RNA, 19 nt, Homo sapiens
gaaagucaaaucaagcaau

SEQ ID NO: 949873 - RNA, 19 nt, Homo sapiens
ggaugaaaaucuugcaaaa

SEQ ID NO: 949874 - RNA, 19 nt, Homo sapiens
gauguccuaugagauguuu

SEQ ID NO: 949875 - RNA, 19 nt, Homo sapiens
ccagauguccuaugagaug

SEQ ID NO: 949876 - RNA, 19 nt, Homo sapiens
ugaagcagcucugaaagca

SEQ ID NO: 949877 - RNA, 19 nt, Homo sapiens
gcagugcacuccuguucuc

SEQ ID NO: 949878 - RNA, 19 nt, Homo sapiens
gaagugaaagauuaugcuu

SEQ ID NO: 949879 - RNA, 19 nt, Homo sapiens
uggagaagcaccauauaaa

SEQ ID NO: 949880 - RNA, 19 nt, Homo sapiens
guguuugucuagcauguuu

SEQ ID NO: 949881 - RNA, 19 nt, Homo sapiens
gagagaauuuugcacauau

SEQ ID NO: 949882 - RNA, 19 nt, Homo sapiens
gcauguuuguuuaauccuu

SEQ ID NO: 949883 - RNA, 19 nt, Homo sapiens
gccaugguaugaugaagug

SEQ ID NO: 949884 - RNA, 19 nt, Homo sapiens
ggaccuucuuacuuacuga

SEQ ID NO: 949885 - RNA, 19 nt, Homo sapiens
cuauacaaaguuccucuua

SEQ ID NO: 949886 - RNA, 19 nt, Homo sapiens
gauuggagaagcaccauau

SEQ ID NO: 949887 - RNA, 19 nt, Homo sapiens
gucaagccaugguaugaug

SEQ ID NO: 949888 - RNA, 19 nt, Homo sapiens
ggaagauaucgcucuauuc

SEQ ID NO: 949889 - RNA, 19 nt, Homo sapiens
caauuagauucagcggaua

SEQ ID NO: 949890 - RNA, 19 nt, Homo sapiens
guggucaugcuguuuauuu

SEQ ID NO: 949891 - RNA, 19 nt, Homo sapiens
uaccuguacugguuuaaau

SEQ ID NO: 949892 - RNA, 19 nt, Homo sapiens
ugaaagcacaauuagauuc

SEQ ID NO: 949893 - RNA, 19 nt, Homo sapiens
acucuaccuuucugcuuua

SEQ ID NO: 949894 - RNA, 19 nt, Homo sapiens
auacaaaguuccucuuagg

SEQ ID NO: 949895 - RNA, 19 nt, Homo sapiens
gguaugaugaagugaaaga

SEQ ID NO: 949896 - RNA, 19 nt, Homo sapiens
uguacgcacuggaagauau

SEQ ID NO: 949897 - RNA, 19 nt, Homo sapiens
cggcagcaaauauggaaua

SEQ ID NO: 949898 - RNA, 19 nt, Homo sapiens
ucugaaagcacaauuagau

SEQ ID NO: 949899 - RNA, 19 nt, Homo sapiens
uauacaaaguuccucuuag

SEQ ID NO: 949900 - RNA, 19 nt, Homo sapiens
ucacuuggugugucuauau

SEQ ID NO: 949901 - RNA, 19 nt, Homo sapiens
gacauuaucagcacauucu

SEQ ID NO: 949902 - RNA, 19 nt, Homo sapiens
gauaggaugcgcaauucau

SEQ ID NO: 949903 - RNA, 19 nt, Homo sapiens
gguaccauguucaucuugu

SEQ ID NO: 949904 - RNA, 19 nt, Homo sapiens
gcaguuuacuugguaugca

SEQ ID NO: 949905 - RNA, 19 nt, Homo sapiens
uuaguggucaugcuguuua

SEQ ID NO: 949906 - RNA, 19 nt, Homo sapiens
cggauaggaugcgcaauuc

SEQ ID NO: 949907 - RNA, 19 nt, Homo sapiens
uauugaagcagcucugaaa

SEQ ID NO: 949908 - RNA, 19 nt, Homo sapiens
gcacacauuauacgcagau

SEQ ID NO: 949909 - RNA, 19 nt, Homo sapiens
gcucuauucuccaguuggu

SEQ ID NO: 949910 - RNA, 19 nt, Homo sapiens
gcucugaaagcacaauuag

SEQ ID NO: 949911 - RNA, 19 nt, Homo sapiens
uguuaccugugauucauuu

SEQ ID NO: 949912 - RNA, 19 nt, Homo sapiens
gguuaguggucaugcuguu

SEQ ID NO: 949913 - RNA, 19 nt, Homo sapiens
cuucuuacuuacugagauu

SEQ ID NO: 949914 - RNA, 19 nt, Homo sapiens
aauauaugguuugggauga

SEQ ID NO: 949915 - RNA, 19 nt, Homo sapiens
cauacccucuggcccuauu

SEQ ID NO: 949916 - RNA, 19 nt, Homo sapiens
guuuaauccuuugggaauu

SEQ ID NO: 949917 - RNA, 19 nt, Homo sapiens
ccuguacugguuuaaauaa

SEQ ID NO: 949918 - RNA, 19 nt, Homo sapiens
uauaugguuugggaugaaa

SEQ ID NO: 949919 - RNA, 19 nt, Homo sapiens
ggcggaagcgcuacauuuc

SEQ ID NO: 949920 - RNA, 19 nt, Homo sapiens
gauauugaagcagcucuga

SEQ ID NO: 949921 - RNA, 19 nt, Homo sapiens
cauuauacgcagaugguuu

SEQ ID NO: 949922 - RNA, 19 nt, Homo sapiens
ucucuguuguuaccuguga

SEQ ID NO: 949923 - RNA, 19 nt, Homo sapiens
gggccaaaaucuaucugua

SEQ ID NO: 949924 - RNA, 19 nt, Homo sapiens
uaucagcacauucucuguu

SEQ ID NO: 949925 - RNA, 19 nt, Homo sapiens
guuguuaccugugauucau

SEQ ID NO: 949926 - RNA, 19 nt, Homo sapiens
caguuuacuugguaugcaa

SEQ ID NO: 949927 - RNA, 19 nt, Homo sapiens
gaccauggaccuucuuacu

SEQ ID NO: 949928 - RNA, 19 nt, Homo sapiens
caugaucgccauucuugau

SEQ ID NO: 949929 - RNA, 19 nt, Homo sapiens
aacucuaccuuucugcuuu

SEQ ID NO: 949930 - RNA, 19 nt, Homo sapiens
uagcauguuuguuuaaucc

SEQ ID NO: 949931 - RNA, 19 nt, Homo sapiens
uuccaggaguuacgucaaa

SEQ ID NO: 949932 - RNA, 19 nt, Homo sapiens
cagcacauucucuguuguu

SEQ ID NO: 949933 - RNA, 19 nt, Homo sapiens
auaggaugcgcaauucaua

SEQ ID NO: 949934 - RNA, 19 nt, Homo sapiens
ucggauaggaugcgcaauu

SEQ ID NO: 949935 - RNA, 19 nt, Homo sapiens
cagcagugcacuccuguuc

SEQ ID NO: 949936 - RNA, 19 nt, Homo sapiens
guaccauguucaucuuguc

SEQ ID NO: 949937 - RNA, 19 nt, Homo sapiens
uuggagaagcaccauauaa

SEQ ID NO: 949938 - RNA, 19 nt, Homo sapiens
gcgacgugcaguuuacuug

SEQ ID NO: 949939 - RNA, 19 nt, Homo sapiens
ucucugcuauacaaaguuc

SEQ ID NO: 949940 - RNA, 19 nt, Homo sapiens
gggaccauggaccuucuua

SEQ ID NO: 949941 - RNA, 19 nt, Homo sapiens
agagagaauuuugcacaua

SEQ ID NO: 949942 - RNA, 19 nt, Homo sapiens
ggauuggagaagcaccaua

SEQ ID NO: 949943 - RNA, 19 nt, Homo sapiens
gacgugcaguuuacuuggu

SEQ ID NO: 949944 - RNA, 19 nt, Homo sapiens
acuggaagauaucgcucua

SEQ ID NO: 949945 - RNA, 19 nt, Homo sapiens
gcgcuacauuucgcagaau

SEQ ID NO: 949946 - RNA, 19 nt, Homo sapiens
aggcggaagcgcuacauuu

SEQ ID NO: 949947 - RNA, 19 nt, Homo sapiens
ucaauuccacugacucauc

SEQ ID NO: 949948 - RNA, 19 nt, Homo sapiens
uaacucuaccuuucugcuu

SEQ ID NO: 949949 - RNA, 19 nt, Homo sapiens
gcacauucucuguuguuac

SEQ ID NO: 949950 - RNA, 19 nt, Homo sapiens
acaucaauccugccuggua

SEQ ID NO: 949951 - RNA, 19 nt, Homo sapiens
gcaaagccauguauaugaa

SEQ ID NO: 949952 - RNA, 19 nt, Homo sapiens
gaagaacucugaagaugau

SEQ ID NO: 949953 - RNA, 19 nt, Homo sapiens
ggagaaaggcgcuguauga

SEQ ID NO: 949954 - RNA, 19 nt, Homo sapiens
gugaaccucuggauaauuu

SEQ ID NO: 949955 - RNA, 19 nt, Homo sapiens
gaauaguucugucccaaga

SEQ ID NO: 949956 - RNA, 19 nt, Homo sapiens
gcgaggugcugcagccaua

SEQ ID NO: 949957 - RNA, 19 nt, Homo sapiens
cagaacauguacaguauau

SEQ ID NO: 949958 - RNA, 19 nt, Homo sapiens
gaacauguacaguauaugg

SEQ ID NO: 949959 - RNA, 19 nt, Homo sapiens
agaaguagcagaacaugua

SEQ ID NO: 949960 - RNA, 19 nt, Homo sapiens
agaagaaacuguugaggau

SEQ ID NO: 949961 - RNA, 19 nt, Homo sapiens
ggagucauuugaucuuaug

SEQ ID NO: 949962 - RNA, 19 nt, Homo sapiens
gcaucuggaucucuuguug

SEQ ID NO: 949963 - RNA, 19 nt, Homo sapiens
ggaaggaaguggcagaaaa

SEQ ID NO: 949964 - RNA, 19 nt, Homo sapiens
gcagaaacaagaagaaauc

SEQ ID NO: 949965 - RNA, 19 nt, Homo sapiens
guauauggcagagcuaaua

SEQ ID NO: 949966 - RNA, 19 nt, Homo sapiens
uagcagaacauguacagua

SEQ ID NO: 949967 - RNA, 19 nt, Homo sapiens
auaaagaacuggcagaagu

SEQ ID NO: 949968 - RNA, 19 nt, Homo sapiens
guggaagacucagaaauug

SEQ ID NO: 949969 - RNA, 19 nt, Homo sapiens
uaaagaacuggcagaagua

SEQ ID NO: 949970 - RNA, 19 nt, Homo sapiens
aagaagaacucugaagaug

SEQ ID NO: 949971 - RNA, 19 nt, Homo sapiens
uugaaucacuggauaauca

SEQ ID NO: 949972 - RNA, 19 nt, Homo sapiens
gaauaaagaacuggcagaa

SEQ ID NO: 949973 - RNA, 19 nt, Homo sapiens
uaggugagcuguggccuuu

SEQ ID NO: 949974 - RNA, 19 nt, Homo sapiens
gcagaacauguacaguaua

SEQ ID NO: 949975 - RNA, 19 nt, Homo sapiens
gagcgucuccacccaguaa

SEQ ID NO: 949976 - RNA, 19 nt, Homo sapiens
guaugaagcacuuaaggaa

SEQ ID NO: 949977 - RNA, 19 nt, Homo sapiens
ccaagaagaacucugaaga

SEQ ID NO: 949978 - RNA, 19 nt, Homo sapiens
guaugaagcagaaacaaga

SEQ ID NO: 949979 - RNA, 19 nt, Homo sapiens
ugccaacucuggaaucaaa

SEQ ID NO: 949980 - RNA, 19 nt, Homo sapiens
gaaaauccauccucucagu

SEQ ID NO: 949981 - RNA, 19 nt, Homo sapiens
caggagucauuugaucuua

SEQ ID NO: 949982 - RNA, 19 nt, Homo sapiens
gaugcaaagccauguauau

SEQ ID NO: 949983 - RNA, 19 nt, Homo sapiens
aaguuuaccuccacuaguu

SEQ ID NO: 949984 - RNA, 19 nt, Homo sapiens
gagaaaggcgcuguaugaa

SEQ ID NO: 949985 - RNA, 19 nt, Homo sapiens
aagaaacuguugaggauuc

SEQ ID NO: 949986 - RNA, 19 nt, Homo sapiens
caagaagaacucugaagau

SEQ ID NO: 949987 - RNA, 19 nt, Homo sapiens
gaacaaaaggacaaugaaa

SEQ ID NO: 949988 - RNA, 19 nt, Homo sapiens
caagaagaaaucaaagaga

SEQ ID NO: 949989 - RNA, 19 nt, Homo sapiens
gaagcagaaacaagaagaa

SEQ ID NO: 949990 - RNA, 19 nt, Homo sapiens
agccaugacuuauguuuau

SEQ ID NO: 949991 - RNA, 19 nt, Homo sapiens
gaagccgcguccuacuuug

SEQ ID NO: 949992 - RNA, 19 nt, Homo sapiens
gaagaaacuguugaggauu

SEQ ID NO: 949993 - RNA, 19 nt, Homo sapiens
gcuaauagagagacugaau

SEQ ID NO: 949994 - RNA, 19 nt, Homo sapiens
gagcuaauagagagacuga

SEQ ID NO: 949995 - RNA, 19 nt, Homo sapiens
gcaagaggcggcaggaagu

SEQ ID NO: 949996 - RNA, 19 nt, Homo sapiens
cugggacccuauugcauua

SEQ ID NO: 949997 - RNA, 19 nt, Homo sapiens
ugaggauucucuaguggaa

SEQ ID NO: 949998 - RNA, 19 nt, Homo sapiens
gugcuucaccaucuacaua

SEQ ID NO: 949999 - RNA, 19 nt, Homo sapiens
gggacccuauugcauuaaa

SEQ ID NO: 950000 - RNA, 19 nt, Homo sapiens
gaauuuuacugccgaaguu

SEQ ID NO: 950001 - RNA, 19 nt, Homo sapiens
ugaagccgcguccuacuuu

SEQ ID NO: 950002 - RNA, 19 nt, Homo sapiens
caacucuggaaucaaauuu

SEQ ID NO: 950003 - RNA, 19 nt, Homo sapiens
ggccuggucuucugugcuu

SEQ ID NO: 950004 - RNA, 19 nt, Homo sapiens
ccauguauaugaaaugcau

SEQ ID NO: 950005 - RNA, 19 nt, Homo sapiens
uggauaaucaggaauuuga

SEQ ID NO: 950006 - RNA, 19 nt, Homo sapiens
gaauaggauuuucucaguu

SEQ ID NO: 950007 - RNA, 19 nt, Homo sapiens
ggaugcaaagccauguaua

SEQ ID NO: 950008 - RNA, 19 nt, Homo sapiens
agaagaacucugaagauga

SEQ ID NO: 950009 - RNA, 19 nt, Homo sapiens
cagccaugacuuauguuua

SEQ ID NO: 950010 - RNA, 19 nt, Homo sapiens
gaaguuuaccuccacuagu

SEQ ID NO: 950011 - RNA, 19 nt, Homo sapiens
ggaguuagcagggcuuuac

SEQ ID NO: 950012 - RNA, 19 nt, Homo sapiens
auaaugaaucccaguauga

SEQ ID NO: 950013 - RNA, 19 nt, Homo sapiens
uaaugaaucccaguaugaa

SEQ ID NO: 950014 - RNA, 19 nt, Homo sapiens
aguggaagacucagaaauu

SEQ ID NO: 950015 - RNA, 19 nt, Homo sapiens
aaaggagaauaaagaacug

SEQ ID NO: 950016 - RNA, 19 nt, Homo sapiens
gccaugacuuauguuuauu

SEQ ID NO: 950017 - RNA, 19 nt, Homo sapiens
caaagccauguauaugaaa

SEQ ID NO: 950018 - RNA, 19 nt, Homo sapiens
agcagaacauguacaguau

SEQ ID NO: 950019 - RNA, 19 nt, Homo sapiens
ccuauugcauuaaaguaca

SEQ ID NO: 950020 - RNA, 19 nt, Homo sapiens
ugcaaagccauguauauga

SEQ ID NO: 950021 - RNA, 19 nt, Homo sapiens
uaauagagagacugaaugg

SEQ ID NO: 950022 - RNA, 19 nt, Homo sapiens
gucccagaaucuagugaaa

SEQ ID NO: 950023 - RNA, 19 nt, Homo sapiens
gauucagccuucugcaucu

SEQ ID NO: 950024 - RNA, 19 nt, Homo sapiens
ucuaugaugguuuauguga

SEQ ID NO: 950025 - RNA, 19 nt, Homo sapiens
cauaaugccaacucuggaa

SEQ ID NO: 950026 - RNA, 19 nt, Homo sapiens
uggcagaaguagcagaaca

SEQ ID NO: 950027 - RNA, 19 nt, Homo sapiens
aggauucucuaguggaaga

SEQ ID NO: 950028 - RNA, 19 nt, Homo sapiens
gcagaaguagcagaacaug

SEQ ID NO: 950029 - RNA, 19 nt, Homo sapiens
uaugaagcacuuaaggaaa

SEQ ID NO: 950030 - RNA, 19 nt, Homo sapiens
ggacccuauugcauuaaag

SEQ ID NO: 950031 - RNA, 19 nt, Homo sapiens
ccugggacccuauugcauu

SEQ ID NO: 950032 - RNA, 19 nt, Homo sapiens
guuauugucccagaaucua

SEQ ID NO: 950033 - RNA, 19 nt, Homo sapiens
ugaauaggauuuucucagu

SEQ ID NO: 950034 - RNA, 19 nt, Homo sapiens
cuaugaugguuuaugugaa

SEQ ID NO: 950035 - RNA, 19 nt, Homo sapiens
ccaacucuggaaucaaauu

SEQ ID NO: 950036 - RNA, 19 nt, Homo sapiens
ugaagcagaaacaagaaga

SEQ ID NO: 950037 - RNA, 19 nt, Homo sapiens
gaaguagcagaacauguac

SEQ ID NO: 950038 - RNA, 19 nt, Homo sapiens
aauccauccucucaguauu

SEQ ID NO: 950039 - RNA, 19 nt, Homo sapiens
ucacccaggagucauuuga

SEQ ID NO: 950040 - RNA, 19 nt, Homo sapiens
gcuucaccaucuacauaau

SEQ ID NO: 950041 - RNA, 19 nt, Homo sapiens
ggugaaccucuggauaauu

SEQ ID NO: 950042 - RNA, 19 nt, Homo sapiens
ccaggagucauuugaucuu

SEQ ID NO: 950043 - RNA, 19 nt, Homo sapiens
uguugaggauucucuagug

SEQ ID NO: 950044 - RNA, 19 nt, Homo sapiens
auggugaaccucuggauaa

SEQ ID NO: 950045 - RNA, 19 nt, Homo sapiens
gagacugaauggugaaccu

SEQ ID NO: 950046 - RNA, 19 nt, Homo sapiens
uucaccaucuacauaauga

SEQ ID NO: 950047 - RNA, 19 nt, Homo sapiens
aagcagaaacaagaagaaa

SEQ ID NO: 950048 - RNA, 19 nt, Homo sapiens
aaauccauccucucaguau

SEQ ID NO: 950049 - RNA, 19 nt, Homo sapiens
ccucugaagccgcguccua

SEQ ID NO: 950050 - RNA, 19 nt, Homo sapiens
acaagaagaaaucaaagag

SEQ ID NO: 950051 - RNA, 19 nt, Homo sapiens
ggaaauaaauggugaggaa

SEQ ID NO: 950052 - RNA, 19 nt, Homo sapiens
gaagaugccuggaaagguu

SEQ ID NO: 950053 - RNA, 19 nt, Homo sapiens
ggaauaaagugcuaaagug

SEQ ID NO: 950054 - RNA, 19 nt, Homo sapiens
gaaggaagauagaauggaa

SEQ ID NO: 950055 - RNA, 19 nt, Homo sapiens
gaagugugccugaaagaua

SEQ ID NO: 950056 - RNA, 19 nt, Homo sapiens
gagauagacugcagcauau

SEQ ID NO: 950057 - RNA, 19 nt, Homo sapiens
gaacuuugcugaaaucaac

SEQ ID NO: 950058 - RNA, 19 nt, Homo sapiens
gaauugaugugggaacuuu

SEQ ID NO: 950059 - RNA, 19 nt, Homo sapiens
ccagaaggauaaagaguuu

SEQ ID NO: 950060 - RNA, 19 nt, Homo sapiens
gaaguucauucuguagaua

SEQ ID NO: 950061 - RNA, 19 nt, Homo sapiens
gauaaagaguuugcugaaa

SEQ ID NO: 950062 - RNA, 19 nt, Homo sapiens
gaauaacgcauaugguaaa

SEQ ID NO: 950063 - RNA, 19 nt, Homo sapiens
caacugguguguccaauuc

SEQ ID NO: 950064 - RNA, 19 nt, Homo sapiens
ggaagaaauccuaaugaaa

SEQ ID NO: 950065 - RNA, 19 nt, Homo sapiens
gaagaaugcaugcagauug

SEQ ID NO: 950066 - RNA, 19 nt, Homo sapiens
gcuggaaucugaugagguu

SEQ ID NO: 950067 - RNA, 19 nt, Homo sapiens
gaaaucaaccuguaauacu

SEQ ID NO: 950068 - RNA, 19 nt, Homo sapiens
gcaaagggagcauacaaau

SEQ ID NO: 950069 - RNA, 19 nt, Homo sapiens
ggaggaaggcaaagaaguu

SEQ ID NO: 950070 - RNA, 19 nt, Homo sapiens
gaauaaagugcuaaagugu

SEQ ID NO: 950071 - RNA, 19 nt, Homo sapiens
aaagacaguuugagagaga

SEQ ID NO: 950072 - RNA, 19 nt, Homo sapiens
ggaaucugaugagguugua

SEQ ID NO: 950073 - RNA, 19 nt, Homo sapiens
agagauagacugcagcaua

SEQ ID NO: 950074 - RNA, 19 nt, Homo sapiens
gaggaaggcaaagaaguua

SEQ ID NO: 950075 - RNA, 19 nt, Homo sapiens
ucaaguugcucuccagaau

SEQ ID NO: 950076 - RNA, 19 nt, Homo sapiens
cguccaaggugaaauaaug

SEQ ID NO: 950077 - RNA, 19 nt, Homo sapiens
gaguugagcacuugugaaa

SEQ ID NO: 950078 - RNA, 19 nt, Homo sapiens
gcugugaccuccuuguuca

SEQ ID NO: 950079 - RNA, 19 nt, Homo sapiens
gggcaacuccauccuauga

SEQ ID NO: 950080 - RNA, 19 nt, Homo sapiens
aaacggaguugagcacuug

SEQ ID NO: 950081 - RNA, 19 nt, Homo sapiens
ugaaaacacugaaaacuug

SEQ ID NO: 950082 - RNA, 19 nt, Homo sapiens
ggauaaagaguuugcugaa

SEQ ID NO: 950083 - RNA, 19 nt, Homo sapiens
cauacuggacgcuuuauaa

SEQ ID NO: 950084 - RNA, 19 nt, Homo sapiens
gaaacauccuauuauacca

SEQ ID NO: 950085 - RNA, 19 nt, Homo sapiens
gcaacuccauccuaugaag

SEQ ID NO: 950086 - RNA, 19 nt, Homo sapiens
cugaugagguuguaugaug

SEQ ID NO: 950087 - RNA, 19 nt, Homo sapiens
aaacuuggcccuacagugu

SEQ ID NO: 950088 - RNA, 19 nt, Homo sapiens
ccagaagagugaaaggaau

SEQ ID NO: 950089 - RNA, 19 nt, Homo sapiens
ggacccagaaggauaaaga

SEQ ID NO: 950090 - RNA, 19 nt, Homo sapiens
guaggacccagaaggauaa

SEQ ID NO: 950091 - RNA, 19 nt, Homo sapiens
ggcagcaccuccuaacuuc

SEQ ID NO: 950092 - RNA, 19 nt, Homo sapiens
gugaaauaaugaaggaaga

SEQ ID NO: 950093 - RNA, 19 nt, Homo sapiens
uggaagcccagacuauuua

SEQ ID NO: 950094 - RNA, 19 nt, Homo sapiens
ugaauaacgcauaugguaa

SEQ ID NO: 950095 - RNA, 19 nt, Homo sapiens
caaacggaguugagcacuu

SEQ ID NO: 950096 - RNA, 19 nt, Homo sapiens
ggaagaaugcaugcagauu

SEQ ID NO: 950097 - RNA, 19 nt, Homo sapiens
gaaaagacaguuugagaga

SEQ ID NO: 950098 - RNA, 19 nt, Homo sapiens
caaauggcagucugugaaa

SEQ ID NO: 950099 - RNA, 19 nt, Homo sapiens
gggaauaaagugcuaaagu

SEQ ID NO: 950100 - RNA, 19 nt, Homo sapiens
gggcagcaccuccuaacuu

SEQ ID NO: 950101 - RNA, 19 nt, Homo sapiens
cugaauaacgcauauggua

SEQ ID NO: 950102 - RNA, 19 nt, Homo sapiens
gcgggaacaccaucuauug

SEQ ID NO: 950103 - RNA, 19 nt, Homo sapiens
ggcagucugugaaauugaa

SEQ ID NO: 950104 - RNA, 19 nt, Homo sapiens
uaauauaaccguccaaggu

SEQ ID NO: 950105 - RNA, 19 nt, Homo sapiens
aaagggagcauacaaaugg

SEQ ID NO: 950106 - RNA, 19 nt, Homo sapiens
caccauggcuggguaguuc

SEQ ID NO: 950107 - RNA, 19 nt, Homo sapiens
caaagggagcauacaaaug

SEQ ID NO: 950108 - RNA, 19 nt, Homo sapiens
ggaaaaggauauccagaca

SEQ ID NO: 950109 - RNA, 19 nt, Homo sapiens
ugaagaccuuggaagaaug

SEQ ID NO: 950110 - RNA, 19 nt, Homo sapiens
ccagaagugugccugaaag

SEQ ID NO: 950111 - RNA, 19 nt, Homo sapiens
aacacaagcuuuagugaca

SEQ ID NO: 950112 - RNA, 19 nt, Homo sapiens
cagcauaucaagugaggaa

SEQ ID NO: 950113 - RNA, 19 nt, Homo sapiens
cugaagaccuuggaagaau

SEQ ID NO: 950114 - RNA, 19 nt, Homo sapiens
caaaaugucagaacuaaga

SEQ ID NO: 950115 - RNA, 19 nt, Homo sapiens
aauaaauggugaggaagaa

SEQ ID NO: 950116 - RNA, 19 nt, Homo sapiens
gcucaaguccagcaagaug

SEQ ID NO: 950117 - RNA, 19 nt, Homo sapiens
uugcugaaaucaaccugua

SEQ ID NO: 950118 - RNA, 19 nt, Homo sapiens
ugugggaacuuugcugaaa

SEQ ID NO: 950119 - RNA, 19 nt, Homo sapiens
acaaauggcagucugugaa

SEQ ID NO: 950120 - RNA, 19 nt, Homo sapiens
ccuccuaacuucagggaau

SEQ ID NO: 950121 - RNA, 19 nt, Homo sapiens
ggccauacuggacgcuuua

SEQ ID NO: 950122 - RNA, 19 nt, Homo sapiens
gaagaagcagauggccaua

SEQ ID NO: 950123 - RNA, 19 nt, Homo sapiens
gcggauguagcccagguua

SEQ ID NO: 950124 - RNA, 19 nt, Homo sapiens
uuaccacucuccagaagau

SEQ ID NO: 950125 - RNA, 19 nt, Homo sapiens
gugcugugguuccaguauu

SEQ ID NO: 950126 - RNA, 19 nt, Homo sapiens
uaucccaacuuucuuuagu

SEQ ID NO: 950127 - RNA, 19 nt, Homo sapiens
ggaaggcaaagaaguuauc

SEQ ID NO: 950128 - RNA, 19 nt, Homo sapiens
gaaaggcaaacggaguuga

SEQ ID NO: 950129 - RNA, 19 nt, Homo sapiens
caaaagaagugaccacaac

SEQ ID NO: 950130 - RNA, 19 nt, Homo sapiens
agacaaacuuggcccuaca

SEQ ID NO: 950131 - RNA, 19 nt, Homo sapiens
cacaagcuuuagugacauu

SEQ ID NO: 950132 - RNA, 19 nt, Homo sapiens
ugcugugguuccaguauua

SEQ ID NO: 950133 - RNA, 19 nt, Homo sapiens
ccaacuuucuuuaguacca

SEQ ID NO: 950134 - RNA, 19 nt, Homo sapiens
gagaaaagacaguuugaga

SEQ ID NO: 950135 - RNA, 19 nt, Homo sapiens
aaggugaaauaaugaagga

SEQ ID NO: 950136 - RNA, 19 nt, Homo sapiens
ggccagaagugugccugaa

SEQ ID NO: 950137 - RNA, 19 nt, Homo sapiens
uaagggcaacuccauccua

SEQ ID NO: 950138 - RNA, 19 nt, Homo sapiens
uaacgcauaugguaaaaca

SEQ ID NO: 950139 - RNA, 19 nt, Homo sapiens
cgacugaagcccucuugug

SEQ ID NO: 950140 - RNA, 19 nt, Homo sapiens
uaaauggugaggaagaaau

SEQ ID NO: 950141 - RNA, 19 nt, Homo sapiens
aaauaaauggugaggaaga

SEQ ID NO: 950142 - RNA, 19 nt, Homo sapiens
gugggaacuuugcugaaau

SEQ ID NO: 950143 - RNA, 19 nt, Homo sapiens
gaagcccagacuauuuauu

SEQ ID NO: 950144 - RNA, 19 nt, Homo sapiens
gaaguccagaagagugaaa

SEQ ID NO: 950145 - RNA, 19 nt, Homo sapiens
aagggcaacuccauccuau

SEQ ID NO: 950146 - RNA, 19 nt, Homo sapiens
ugacauugaacuucuggaa

SEQ ID NO: 950147 - RNA, 19 nt, Homo sapiens
acaacgaaguccagaagag

SEQ ID NO: 950148 - RNA, 19 nt, Homo sapiens
agaagcagauggccauacu

SEQ ID NO: 950149 - RNA, 19 nt, Homo sapiens
aagcccagacuauuuauug

SEQ ID NO: 950150 - RNA, 19 nt, Homo sapiens
gaagcauucuuggcaucau

SEQ ID NO: 950151 - RNA, 19 nt, Homo sapiens
gcacagucuucuuggauua

SEQ ID NO: 950152 - RNA, 19 nt, Homo sapiens
caaguaaacuaacugaaca

SEQ ID NO: 950153 - RNA, 19 nt, Homo sapiens
gggcucaucuuuaacagaa

SEQ ID NO: 950154 - RNA, 19 nt, Homo sapiens
gagcuaaagcaguguauaa

SEQ ID NO: 950155 - RNA, 19 nt, Homo sapiens
ccucuuacagcaauaauua

SEQ ID NO: 950156 - RNA, 19 nt, Homo sapiens
gaacauauuccucugacau

SEQ ID NO: 950157 - RNA, 19 nt, Homo sapiens
cuaaacuccucaccuauau

SEQ ID NO: 950158 - RNA, 19 nt, Homo sapiens
ggacaaguaaacuaacuga

SEQ ID NO: 950159 - RNA, 19 nt, Homo sapiens
uaacagaacugggccuagu

SEQ ID NO: 950160 - RNA, 19 nt, Homo sapiens
gcuaaagcaguguauaauu

SEQ ID NO: 950161 - RNA, 19 nt, Homo sapiens
ccuaaacuccucaccuaua

SEQ ID NO: 950162 - RNA, 19 nt, Homo sapiens
ggacaaagcagcgcacagu

SEQ ID NO: 950163 - RNA, 19 nt, Homo sapiens
uuggauuacuguccucuua

SEQ ID NO: 950164 - RNA, 19 nt, Homo sapiens
cagcucacguaauuuaaau

SEQ ID NO: 950165 - RNA, 19 nt, Homo sapiens
ggauuacuguccucuuaca

SEQ ID NO: 950166 - RNA, 19 nt, Homo sapiens
gagccuaggaacacaauga

SEQ ID NO: 950167 - RNA, 19 nt, Homo sapiens
ugaugggccuggugucauu

SEQ ID NO: 950168 - RNA, 19 nt, Homo sapiens
ggcaucgggucccaucuga

SEQ ID NO: 950169 - RNA, 19 nt, Homo sapiens
gcaauaauuaccuguggau

SEQ ID NO: 950170 - RNA, 19 nt, Homo sapiens
caaagcagcgcacagucuu

SEQ ID NO: 950171 - RNA, 19 nt, Homo sapiens
ccacaggagccaucuagga

SEQ ID NO: 950172 - RNA, 19 nt, Homo sapiens
cugcagaacugaugagcau

SEQ ID NO: 950173 - RNA, 19 nt, Homo sapiens
gcagcgcacagucuucuug

SEQ ID NO: 950174 - RNA, 19 nt, Homo sapiens
gaauugcacaggcuuccuu

SEQ ID NO: 950175 - RNA, 19 nt, Homo sapiens
aaacuccucaccuauauca

SEQ ID NO: 950176 - RNA, 19 nt, Homo sapiens
ggugucauuuggagagaau

SEQ ID NO: 950177 - RNA, 19 nt, Homo sapiens
cacaggagccaucuaggaa

SEQ ID NO: 950178 - RNA, 19 nt, Homo sapiens
uggaacaacucacagaaaa

SEQ ID NO: 950179 - RNA, 19 nt, Homo sapiens
caggagccaucuaggaaag

SEQ ID NO: 950180 - RNA, 19 nt, Homo sapiens
cugagaugcuggcacuuug

SEQ ID NO: 950181 - RNA, 19 nt, Homo sapiens
gggaauggaaacugagaug

SEQ ID NO: 950182 - RNA, 19 nt, Homo sapiens
gagcuugagccuaggaaca

SEQ ID NO: 950183 - RNA, 19 nt, Homo sapiens
gaagagcuugagccuagga

SEQ ID NO: 950184 - RNA, 19 nt, Homo sapiens
ccuagugucuggaacaacu

SEQ ID NO: 950185 - RNA, 19 nt, Homo sapiens
caggacaaguaaacuaacu

SEQ ID NO: 950186 - RNA, 19 nt, Homo sapiens
gcucaucuuuaacagaacu

SEQ ID NO: 950187 - RNA, 19 nt, Homo sapiens
caauaauuaccuguggaua

SEQ ID NO: 950188 - RNA, 19 nt, Homo sapiens
cgcacagucuucuuggauu

SEQ ID NO: 950189 - RNA, 19 nt, Homo sapiens
gcgcacagucuucuuggau

SEQ ID NO: 950190 - RNA, 19 nt, Homo sapiens
gaauggaaacugagaugcu

SEQ ID NO: 950191 - RNA, 19 nt, Homo sapiens
acaaguaaacuaacugaac

SEQ ID NO: 950192 - RNA, 19 nt, Homo sapiens
gcucacguaauuuaaaugg

SEQ ID NO: 950193 - RNA, 19 nt, Homo sapiens
ggccuagugucuggaacaa

SEQ ID NO: 950194 - RNA, 19 nt, Homo sapiens
aaaggggaauggaaacuga

SEQ ID NO: 950195 - RNA, 19 nt, Homo sapiens
acagcucacguaauuuaaa

SEQ ID NO: 950196 - RNA, 19 nt, Homo sapiens
caucgggucccaucugaca

SEQ ID NO: 950197 - RNA, 19 nt, Homo sapiens
acauauuccucugacauca

SEQ ID NO: 950198 - RNA, 19 nt, Homo sapiens
aaaugccaaucucuuuaca

SEQ ID NO: 950199 - RNA, 19 nt, Homo sapiens
gacaaguaaacuaacugaa

SEQ ID NO: 950200 - RNA, 19 nt, Homo sapiens
uuucaggacaaguaaacua

SEQ ID NO: 950201 - RNA, 19 nt, Homo sapiens
ccccuaaacuccucaccua

SEQ ID NO: 950202 - RNA, 19 nt, Homo sapiens
gacaaaggaugguauuuaa

SEQ ID NO: 950203 - RNA, 19 nt, Homo sapiens
gggaggagcugcaacuaua

SEQ ID NO: 950204 - RNA, 19 nt, Homo sapiens
caagacagguuguagauug

SEQ ID NO: 950205 - RNA, 19 nt, Homo sapiens
gagagagacuuugaacaua

SEQ ID NO: 950206 - RNA, 19 nt, Homo sapiens
caucaaggcuucugcaaau

SEQ ID NO: 950207 - RNA, 19 nt, Homo sapiens
gaacaugagcaaacugaaa

SEQ ID NO: 950208 - RNA, 19 nt, Homo sapiens
ggaagaccauccagguuga

SEQ ID NO: 950209 - RNA, 19 nt, Homo sapiens
ggauguagcuuugggauca

SEQ ID NO: 950210 - RNA, 19 nt, Homo sapiens
ugaaagaauucguaacuca

SEQ ID NO: 950211 - RNA, 19 nt, Homo sapiens
gcaaagcucuauggaagug

SEQ ID NO: 950212 - RNA, 19 nt, Homo sapiens
caucagagcugcuguugca

SEQ ID NO: 950213 - RNA, 19 nt, Homo sapiens
gcaaauauggaccucauga

SEQ ID NO: 950214 - RNA, 19 nt, Homo sapiens
ccacaaggacucucauuga

SEQ ID NO: 950215 - RNA, 19 nt, Homo sapiens
agacaaaggaugguauuua

SEQ ID NO: 950216 - RNA, 19 nt, Homo sapiens
ugaauacgaugaccuaaag

SEQ ID NO: 950217 - RNA, 19 nt, Homo sapiens
agagagacuuugaacauau

SEQ ID NO: 950218 - RNA, 19 nt, Homo sapiens
ucaagacaaugcuuaguuc

SEQ ID NO: 950219 - RNA, 19 nt, Homo sapiens
aaacuggcaugaaggcaaa

SEQ ID NO: 950220 - RNA, 19 nt, Homo sapiens
gugggcacauuuagacaua

SEQ ID NO: 950221 - RNA, 19 nt, Homo sapiens
gauaaauuguuagcuggaa

SEQ ID NO: 950222 - RNA, 19 nt, Homo sapiens
agacaaugcuuaguucaga

SEQ ID NO: 950223 - RNA, 19 nt, Homo sapiens
cgugucugcugcaaaguua

SEQ ID NO: 950224 - RNA, 19 nt, Homo sapiens
agacauagcaggcgugaug

SEQ ID NO: 950225 - RNA, 19 nt, Homo sapiens
ccgaaauuauugagaagaa

SEQ ID NO: 950226 - RNA, 19 nt, Homo sapiens
gagagacuuugaacauauc

SEQ ID NO: 950227 - RNA, 19 nt, Homo sapiens
acuaugcacuugucagaaa

SEQ ID NO: 950228 - RNA, 19 nt, Homo sapiens
gaagcaaaauuguaacuca

SEQ ID NO: 950229 - RNA, 19 nt, Homo sapiens
caaaagugcuaguaguaaa

SEQ ID NO: 950230 - RNA, 19 nt, Homo sapiens
gaaaauuacuaugcacuug

SEQ ID NO: 950231 - RNA, 19 nt, Homo sapiens
gguuguagauugccagcuu

SEQ ID NO: 950232 - RNA, 19 nt, Homo sapiens
ccucaaugccgccaccuua

SEQ ID NO: 950233 - RNA, 19 nt, Homo sapiens
caaggcuucugcaaauaug

SEQ ID NO: 950234 - RNA, 19 nt, Homo sapiens
ggagacaaaggaugguauu

SEQ ID NO: 950235 - RNA, 19 nt, Homo sapiens
gaaagaauucguaacucau

SEQ ID NO: 950236 - RNA, 19 nt, Homo sapiens
gagcggugcuuggucucua

SEQ ID NO: 950237 - RNA, 19 nt, Homo sapiens
cgucguguauugaauccua

SEQ ID NO: 950238 - RNA, 19 nt, Homo sapiens
caucgugucugcugcaaag

SEQ ID NO: 950239 - RNA, 19 nt, Homo sapiens
ugagagagacuuugaacau

SEQ ID NO: 950240 - RNA, 19 nt, Homo sapiens
gaccaacaaagaugaaguu

SEQ ID NO: 950241 - RNA, 19 nt, Homo sapiens
ggaugccucucuucgaaca

SEQ ID NO: 950242 - RNA, 19 nt, Homo sapiens
uaacaggugccauggaugu

SEQ ID NO: 950243 - RNA, 19 nt, Homo sapiens
uggcugaugcgcucuguua

SEQ ID NO: 950244 - RNA, 19 nt, Homo sapiens
agggaagacucgaaccuuu

SEQ ID NO: 950245 - RNA, 19 nt, Homo sapiens
ccaaccagauuugccgaaa

SEQ ID NO: 950246 - RNA, 19 nt, Homo sapiens
ugucuucacucugucuuaa

SEQ ID NO: 950247 - RNA, 19 nt, Homo sapiens
ggaagacucgaaccuuuua

SEQ ID NO: 950248 - RNA, 19 nt, Homo sapiens
caagugcaggagagaauuu

SEQ ID NO: 950249 - RNA, 19 nt, Homo sapiens
guucuuacuucguuucagu

SEQ ID NO: 950250 - RNA, 19 nt, Homo sapiens
cauccuggcucuggaacaa

SEQ ID NO: 950251 - RNA, 19 nt, Homo sapiens
gagaugacgccaaccagau

SEQ ID NO: 950252 - RNA, 19 nt, Homo sapiens
uagcaggcgugaugaccaa

SEQ ID NO: 950253 - RNA, 19 nt, Homo sapiens
cauccuaagugggcacauu

SEQ ID NO: 950254 - RNA, 19 nt, Homo sapiens
ugccauggauguagcuuug

SEQ ID NO: 950255 - RNA, 19 nt, Homo sapiens
gaaauuuguaugccuugau

SEQ ID NO: 950256 - RNA, 19 nt, Homo sapiens
ucagucaagacaaugcuua

SEQ ID NO: 950257 - RNA, 19 nt, Homo sapiens
gaugacgccaaccagauuu

SEQ ID NO: 950258 - RNA, 19 nt, Homo sapiens
ugcuuggucucuaugaaua

SEQ ID NO: 950259 - RNA, 19 nt, Homo sapiens
gacaaugcuuaguucagau

SEQ ID NO: 950260 - RNA, 19 nt, Homo sapiens
caaagaugaaguucccuau

SEQ ID NO: 950261 - RNA, 19 nt, Homo sapiens
ggaggagcugcaacuauau

SEQ ID NO: 950262 - RNA, 19 nt, Homo sapiens
ucaaggcuucugcaaauau

SEQ ID NO: 950263 - RNA, 19 nt, Homo sapiens
cuuggaaauucacuacaaa

SEQ ID NO: 950264 - RNA, 19 nt, Homo sapiens
aaaccgagguccauaucag

SEQ ID NO: 950265 - RNA, 19 nt, Homo sapiens
ggaaucgacgaacaggaaa

SEQ ID NO: 950266 - RNA, 19 nt, Homo sapiens
gagacaaaggaugguauuu

SEQ ID NO: 950267 - RNA, 19 nt, Homo sapiens
ggauguuguuagagccaaa

SEQ ID NO: 950268 - RNA, 19 nt, Homo sapiens
cagcuggaaucgacgaaca

SEQ ID NO: 950269 - RNA, 19 nt, Homo sapiens
gucaagacaaugcuuaguu

SEQ ID NO: 950270 - RNA, 19 nt, Homo sapiens
uuacuucguuucagucaag

SEQ ID NO: 950271 - RNA, 19 nt, Homo sapiens
gcuggaaagcugagagaga

SEQ ID NO: 950272 - RNA, 19 nt, Homo sapiens
cuuaacaggugccauggau

SEQ ID NO: 950273 - RNA, 19 nt, Homo sapiens
gaauucguaacucauccua

SEQ ID NO: 950274 - RNA, 19 nt, Homo sapiens
cugcagcauuccugaaaga

SEQ ID NO: 950275 - RNA, 19 nt, Homo sapiens
acaaugcuuaguucagaua

SEQ ID NO: 950276 - RNA, 19 nt, Homo sapiens
ucuuggaaauucacuacaa

SEQ ID NO: 950277 - RNA, 19 nt, Homo sapiens
ccagucuucuuggaaauuc

SEQ ID NO: 950278 - RNA, 19 nt, Homo sapiens
ggugcuuggucucuaugaa

SEQ ID NO: 950279 - RNA, 19 nt, Homo sapiens
ugaaauuuguaugccuuga

SEQ ID NO: 950280 - RNA, 19 nt, Homo sapiens
cgaaggucauccucaaugc

SEQ ID NO: 950281 - RNA, 19 nt, Homo sapiens
guuacgcacacacguuuaa

SEQ ID NO: 950282 - RNA, 19 nt, Homo sapiens
gaggagcugcaacuauaug

SEQ ID NO: 950283 - RNA, 19 nt, Homo sapiens
acucagauuugugaugcua

SEQ ID NO: 950284 - RNA, 19 nt, Homo sapiens
ggaaagcugagagagacuu

SEQ ID NO: 950285 - RNA, 19 nt, Homo sapiens
caggagagaauuuugauaa

SEQ ID NO: 950286 - RNA, 19 nt, Homo sapiens
uugccgaaauuauugagaa

SEQ ID NO: 950287 - RNA, 19 nt, Homo sapiens
uggagacgccagccaauga

SEQ ID NO: 950288 - RNA, 19 nt, Homo sapiens
uggaaucgacgaacaggaa

SEQ ID NO: 950289 - RNA, 19 nt, Homo sapiens
gcuaggaacaugagcaaac

SEQ ID NO: 950290 - RNA, 19 nt, Homo sapiens
gugccacaguucacaagug

SEQ ID NO: 950291 - RNA, 19 nt, Homo sapiens
ccaucaaggcuucugcaaa

SEQ ID NO: 950292 - RNA, 19 nt, Homo sapiens
agucuuggauugaggaaca

SEQ ID NO: 950293 - RNA, 19 nt, Homo sapiens
guauugaauccuagacuca

SEQ ID NO: 950294 - RNA, 19 nt, Homo sapiens
aaauuacuaugcacuuguc

SEQ ID NO: 950295 - RNA, 19 nt, Homo sapiens
ggaacaugagcaaacugaa

SEQ ID NO: 950296 - RNA, 19 nt, Homo sapiens
guaacucagauuugugaug

SEQ ID NO: 950297 - RNA, 19 nt, Homo sapiens
gucuuaaauuggacaguug

SEQ ID NO: 950298 - RNA, 19 nt, Homo sapiens
gaugaccaacaaagaugaa

SEQ ID NO: 950299 - RNA, 19 nt, Homo sapiens
gugaugaccaacaaagaug

SEQ ID NO: 950300 - RNA, 19 nt, Homo sapiens
gcccauuaauauuauaggu

SEQ ID NO: 950301 - RNA, 19 nt, Homo sapiens
uacgaugaccuaaagcaaa

SEQ ID NO: 950302 - RNA, 19 nt, Homo sapiens
gaagacucauuuccagaua

SEQ ID NO: 950303 - RNA, 19 nt, Homo sapiens
gagaucaaaucagcaaaua

SEQ ID NO: 950304 - RNA, 19 nt, Homo sapiens
uaaauagacugguagagaa

SEQ ID NO: 950305 - RNA, 19 nt, Homo sapiens
gcaggaauguuacugaaga

SEQ ID NO: 950306 - RNA, 19 nt, Homo sapiens
gauggagucuucugaugua

SEQ ID NO: 950307 - RNA, 19 nt, Homo sapiens
gaauggcucuucuaacaga

SEQ ID NO: 950308 - RNA, 19 nt, Homo sapiens
gaauguuacugaagacaaa

SEQ ID NO: 950309 - RNA, 19 nt, Homo sapiens
gaauaccacuaaagucaaa

SEQ ID NO: 950310 - RNA, 19 nt, Homo sapiens
caacaaagaauacugaaug

SEQ ID NO: 950311 - RNA, 19 nt, Homo sapiens
agacaucuguucuggauuu

SEQ ID NO: 950312 - RNA, 19 nt, Homo sapiens
gaucaaaucagcaaauaug

SEQ ID NO: 950313 - RNA, 19 nt, Homo sapiens
gaagcucacuccagagaga

SEQ ID NO: 950314 - RNA, 19 nt, Homo sapiens
caagaccacuucuggauuc

SEQ ID NO: 950315 - RNA, 19 nt, Homo sapiens
gaugguuucuaucauguaa

SEQ ID NO: 950316 - RNA, 19 nt, Homo sapiens
ggacagagccaaucuacuc

SEQ ID NO: 950317 - RNA, 19 nt, Homo sapiens
ggucugguguaaacauuaa

SEQ ID NO: 950318 - RNA, 19 nt, Homo sapiens
gaacaggaaaucagagaug

SEQ ID NO: 950319 - RNA, 19 nt, Homo sapiens
cagaaggaaugaacuugaa

SEQ ID NO: 950320 - RNA, 19 nt, Homo sapiens
gacuagagguucugaguuc

SEQ ID NO: 950321 - RNA, 19 nt, Homo sapiens
gaaaacugccuucuucaua

SEQ ID NO: 950322 - RNA, 19 nt, Homo sapiens
gagagaagacggcagagaa

SEQ ID NO: 950323 - RNA, 19 nt, Homo sapiens
ucaaggagaagacucauuu

SEQ ID NO: 950324 - RNA, 19 nt, Homo sapiens
uagcugaaguggcaagaaa

SEQ ID NO: 950325 - RNA, 19 nt, Homo sapiens
uaaaccaucuucuuagaca

SEQ ID NO: 950326 - RNA, 19 nt, Homo sapiens
guagugauaucuaugaucu

SEQ ID NO: 950327 - RNA, 19 nt, Homo sapiens
gcaccaaacagccuuauca

SEQ ID NO: 950328 - RNA, 19 nt, Homo sapiens
caagagacaguaugaauca

SEQ ID NO: 950329 - RNA, 19 nt, Homo sapiens
aaagacaucuguucuggau

SEQ ID NO: 950330 - RNA, 19 nt, Homo sapiens
gcaaauaugcaaggagauu

SEQ ID NO: 950331 - RNA, 19 nt, Homo sapiens
ugagaucuaugaggcaaua

SEQ ID NO: 950332 - RNA, 19 nt, Homo sapiens
caacuguguucaugauaga

SEQ ID NO: 950333 - RNA, 19 nt, Homo sapiens
cugaauggcucuucuaaca

SEQ ID NO: 950334 - RNA, 19 nt, Homo sapiens
ucucagccuuggauuauaa

SEQ ID NO: 950335 - RNA, 19 nt, Homo sapiens
ggaauaaaauccagugugu

SEQ ID NO: 950336 - RNA, 19 nt, Homo sapiens
cgugaccucuuuauggaua

SEQ ID NO: 950337 - RNA, 19 nt, Homo sapiens
gcuaucaacuguguucaug

SEQ ID NO: 950338 - RNA, 19 nt, Homo sapiens
cagaauaccacuaaaguca

SEQ ID NO: 950339 - RNA, 19 nt, Homo sapiens
ucuccuagcuguugacguu

SEQ ID NO: 950340 - RNA, 19 nt, Homo sapiens
ccagggagacucugcaauu

SEQ ID NO: 950341 - RNA, 19 nt, Homo sapiens
gaggggauaugcuaaauga

SEQ ID NO: 950342 - RNA, 19 nt, Homo sapiens
gacaucaucuuccaguaca

SEQ ID NO: 950343 - RNA, 19 nt, Homo sapiens
ucacuuuggucugguguaa

SEQ ID NO: 950344 - RNA, 19 nt, Homo sapiens
caaggagauucuuccauca

SEQ ID NO: 950345 - RNA, 19 nt, Homo sapiens
caaaucagcaaauaugcaa

SEQ ID NO: 950346 - RNA, 19 nt, Homo sapiens
ugaagguagugauaucuau

SEQ ID NO: 950347 - RNA, 19 nt, Homo sapiens
uguaaaccaucuucuuaga

SEQ ID NO: 950348 - RNA, 19 nt, Homo sapiens
ccagcagucuuguucaaau

SEQ ID NO: 950349 - RNA, 19 nt, Homo sapiens
caaggggaguugcaaauuu

SEQ ID NO: 950350 - RNA, 19 nt, Homo sapiens
ugggugugcuguuguuuaa

SEQ ID NO: 950351 - RNA, 19 nt, Homo sapiens
gcagaagacggagaacuga

SEQ ID NO: 950352 - RNA, 19 nt, Homo sapiens
gacaaauaauugacagaag

SEQ ID NO: 950353 - RNA, 19 nt, Homo sapiens
ggagauucuuccaucacuu

SEQ ID NO: 950354 - RNA, 19 nt, Homo sapiens
gaaggacagagccaaucua

SEQ ID NO: 950355 - RNA, 19 nt, Homo sapiens
caauaaacaagacaacaga

SEQ ID NO: 950356 - RNA, 19 nt, Homo sapiens
aaucagagauggugguucu

SEQ ID NO: 950357 - RNA, 19 nt, Homo sapiens
gagaacaggaaaucagaga

SEQ ID NO: 950358 - RNA, 19 nt, Homo sapiens
auggauagcuccucagguu

SEQ ID NO: 950359 - RNA, 19 nt, Homo sapiens
ggguuaugcucaaggaaga

SEQ ID NO: 950360 - RNA, 19 nt, Homo sapiens
gacaacagagcgacaucua

SEQ ID NO: 950361 - RNA, 19 nt, Homo sapiens
ggagucuucugauguaaac

SEQ ID NO: 950362 - RNA, 19 nt, Homo sapiens
ccacagacauauuuuacaa

SEQ ID NO: 950363 - RNA, 19 nt, Homo sapiens
gagauucuuccaucacuug

SEQ ID NO: 950364 - RNA, 19 nt, Homo sapiens
ggccaccagugcuuuauca

SEQ ID NO: 950365 - RNA, 19 nt, Homo sapiens
gaagguagugauaucuaug

SEQ ID NO: 950366 - RNA, 19 nt, Homo sapiens
ggacagaggggauaugcua

SEQ ID NO: 950367 - RNA, 19 nt, Homo sapiens
cagcaugagcgccauugua

SEQ ID NO: 950368 - RNA, 19 nt, Homo sapiens
uaucuaugaucuccucuuc

SEQ ID NO: 950369 - RNA, 19 nt, Homo sapiens
cagcagucuuguucaaaug

SEQ ID NO: 950370 - RNA, 19 nt, Homo sapiens
ucaacuguguucaugauag

SEQ ID NO: 950371 - RNA, 19 nt, Homo sapiens
ccaacccacagacauauuu

SEQ ID NO: 950372 - RNA, 19 nt, Homo sapiens
gaggacagcugggccugau

SEQ ID NO: 950373 - RNA, 19 nt, Homo sapiens
ucagaagggugaagguagu

SEQ ID NO: 950374 - RNA, 19 nt, Homo sapiens
uuaugaaacucaccguaga

SEQ ID NO: 950375 - RNA, 19 nt, Homo sapiens
aaacugccuucuucauauc

SEQ ID NO: 950376 - RNA, 19 nt, Homo sapiens
gaaaucagagauggugguu

SEQ ID NO: 950377 - RNA, 19 nt, Homo sapiens
gcagagaacaggaaaucag

SEQ ID NO: 950378 - RNA, 19 nt, Homo sapiens
ggauauucauuaccuugca

SEQ ID NO: 950379 - RNA, 19 nt, Homo sapiens
ggacagcugggccugauag

SEQ ID NO: 950380 - RNA, 19 nt, Homo sapiens
ggauagcuccucagguugu

SEQ ID NO: 950381 - RNA, 19 nt, Homo sapiens
acauucagcucuucucaca

SEQ ID NO: 950382 - RNA, 19 nt, Homo sapiens
gaacuuuugccuucauuaa

SEQ ID NO: 950383 - RNA, 19 nt, Homo sapiens
ggaauguuacugaagacaa

SEQ ID NO: 950384 - RNA, 19 nt, Homo sapiens
ggccacuggucaacgauga

SEQ ID NO: 950385 - RNA, 19 nt, Homo sapiens
gcucgugaccucuuuaugg

SEQ ID NO: 950386 - RNA, 19 nt, Homo sapiens
ggaauauagagaucaaauc

SEQ ID NO: 950387 - RNA, 19 nt, Homo sapiens
cuucuaugcuccaacaaga

SEQ ID NO: 950388 - RNA, 19 nt, Homo sapiens
agccuuggauuauaagauu

SEQ ID NO: 950389 - RNA, 19 nt, Homo sapiens
caaauaauugacagaagga

SEQ ID NO: 950390 - RNA, 19 nt, Homo sapiens
ugaauuggcacuagcugaa

SEQ ID NO: 950391 - RNA, 19 nt, Homo sapiens
gcauuucuccuagcuguug

SEQ ID NO: 950392 - RNA, 19 nt, Homo sapiens
cagggagacucugcaauuc

SEQ ID NO: 950393 - RNA, 19 nt, Homo sapiens
acaucuagcuaucaacugu

SEQ ID NO: 950394 - RNA, 19 nt, Homo sapiens
uaauaccuguaaugcagaa

SEQ ID NO: 950395 - RNA, 19 nt, Homo sapiens
aagacucauuuccagauaa

SEQ ID NO: 950396 - RNA, 19 nt, Homo sapiens
aaagagcuagugacauuga

SEQ ID NO: 950397 - RNA, 19 nt, Homo sapiens
ggugugcuguuguuuaaac

SEQ ID NO: 950398 - RNA, 19 nt, Homo sapiens
auucagcucuucucacaga

SEQ ID NO: 950399 - RNA, 19 nt, Homo sapiens
gggagacucugcaauucag

SEQ ID NO: 950400 - RNA, 19 nt, Homo sapiens
cuccguaaguguagacaaa

SEQ ID NO: 950401 - RNA, 19 nt, Homo sapiens
gauuaaacucuuagcacaa

SEQ ID NO: 950402 - RNA, 19 nt, Homo sapiens
ggagugaccuucucaaugg

SEQ ID NO: 950403 - RNA, 19 nt, Homo sapiens
gggcggaccuucagcgaua

SEQ ID NO: 950404 - RNA, 19 nt, Homo sapiens
gagaagcccuuuauaugug

SEQ ID NO: 950405 - RNA, 19 nt, Homo sapiens
gagagacccuaaccuauug

SEQ ID NO: 950406 - RNA, 19 nt, Homo sapiens
gcaagaaacucauccaaaa

SEQ ID NO: 950407 - RNA, 19 nt, Homo sapiens
ggcaaaaccuucaauaaua

SEQ ID NO: 950408 - RNA, 19 nt, Homo sapiens
gaugagaagcccuuuauau

SEQ ID NO: 950409 - RNA, 19 nt, Homo sapiens
caacuuugcuucuagaucu

SEQ ID NO: 950410 - RNA, 19 nt, Homo sapiens
gaaauaggguaggcucaga

SEQ ID NO: 950411 - RNA, 19 nt, Homo sapiens
gaggagggacucuggaaua

SEQ ID NO: 950412 - RNA, 19 nt, Homo sapiens
gaagagaaacacuacaaau

SEQ ID NO: 950413 - RNA, 19 nt, Homo sapiens
gagcgaggguucagagaug

SEQ ID NO: 950414 - RNA, 19 nt, Homo sapiens
guucagagaugggcaguga

SEQ ID NO: 950415 - RNA, 19 nt, Homo sapiens
ugagaagccuuacaagugu

SEQ ID NO: 950416 - RNA, 19 nt, Homo sapiens
ccauguuuguuacuuguua

SEQ ID NO: 950417 - RNA, 19 nt, Homo sapiens
ucugugaacugcuuaggua

SEQ ID NO: 950418 - RNA, 19 nt, Homo sapiens
uuacaaguguucugaaugu

SEQ ID NO: 950419 - RNA, 19 nt, Homo sapiens
gaacaggcugggaaagauu

SEQ ID NO: 950420 - RNA, 19 nt, Homo sapiens
ccagagugauuagcaguaa

SEQ ID NO: 950421 - RNA, 19 nt, Homo sapiens
ggaagagaaacacuacaaa

SEQ ID NO: 950422 - RNA, 19 nt, Homo sapiens
ggucccaccuuagaaauga

SEQ ID NO: 950423 - RNA, 19 nt, Homo sapiens
gaagucaggaucucaggaa

SEQ ID NO: 950424 - RNA, 19 nt, Homo sapiens
ugagagacccuaaccuauu

SEQ ID NO: 950425 - RNA, 19 nt, Homo sapiens
gugagaagccuuacaagug

SEQ ID NO: 950426 - RNA, 19 nt, Homo sapiens
ugaagguucuccaaauugu

SEQ ID NO: 950427 - RNA, 19 nt, Homo sapiens
gagggacucuggaauaaaa

SEQ ID NO: 950428 - RNA, 19 nt, Homo sapiens
ugagaagcccuuuauaugu

SEQ ID NO: 950429 - RNA, 19 nt, Homo sapiens
gcagaugagaagcccuuua

SEQ ID NO: 950430 - RNA, 19 nt, Homo sapiens
ucugaagguucuccaaauu

SEQ ID NO: 950431 - RNA, 19 nt, Homo sapiens
gauccacacuggugagaag

SEQ ID NO: 950432 - RNA, 19 nt, Homo sapiens
aagagagccugucggauga

SEQ ID NO: 950433 - RNA, 19 nt, Homo sapiens
ggagaaugguuuuguauag

SEQ ID NO: 950434 - RNA, 19 nt, Homo sapiens
gagaagccuuacaaguguu

SEQ ID NO: 950435 - RNA, 19 nt, Homo sapiens
cgaacaggcugggaaagau

SEQ ID NO: 950436 - RNA, 19 nt, Homo sapiens
gcaaaaccuucaauaauac

SEQ ID NO: 950437 - RNA, 19 nt, Homo sapiens
ucccggagcucgaaucuca

SEQ ID NO: 950438 - RNA, 19 nt, Homo sapiens
ucagcgauaucuccaacuu

SEQ ID NO: 950439 - RNA, 19 nt, Homo sapiens
ggugagagaccuuaugagu

SEQ ID NO: 950440 - RNA, 19 nt, Homo sapiens
aggagggacucuggaauaa

SEQ ID NO: 950441 - RNA, 19 nt, Homo sapiens
cggaugaacugcaagaaac

SEQ ID NO: 950442 - RNA, 19 nt, Homo sapiens
cagaugagaagcccuuuau

SEQ ID NO: 950443 - RNA, 19 nt, Homo sapiens
gaaggagcaugggcaagag

SEQ ID NO: 950444 - RNA, 19 nt, Homo sapiens
aagagaaacacuacaaaug

SEQ ID NO: 950445 - RNA, 19 nt, Homo sapiens
agcgauaucuccaacuuug

SEQ ID NO: 950446 - RNA, 19 nt, Homo sapiens
aggaaguacuuaugagaug

SEQ ID NO: 950447 - RNA, 19 nt, Homo sapiens
gaggaaguacuuaugagau

SEQ ID NO: 950448 - RNA, 19 nt, Homo sapiens
agucuuggcuuuacuuucu

SEQ ID NO: 950449 - RNA, 19 nt, Homo sapiens
gaacugcaagaaacucauc

SEQ ID NO: 950450 - RNA, 19 nt, Homo sapiens
gcgaacaggcugggaaaga

SEQ ID NO: 950451 - RNA, 19 nt, Homo sapiens
ggagggacucuggaauaaa

SEQ ID NO: 950452 - RNA, 19 nt, Homo sapiens
gaggagugaccuucucaau

SEQ ID NO: 950453 - RNA, 19 nt, Homo sapiens
gugaacugcuuagguagga

SEQ ID NO: 950454 - RNA, 19 nt, Homo sapiens
ccacuuuggagaaugguuu

SEQ ID NO: 950455 - RNA, 19 nt, Homo sapiens
ugaaggagagccccauuua

SEQ ID NO: 950456 - RNA, 19 nt, Homo sapiens
gcaccagcaagaucaccua

SEQ ID NO: 950457 - RNA, 19 nt, Homo sapiens
ggugagaagccuuacaagu

SEQ ID NO: 950458 - RNA, 19 nt, Homo sapiens
cagagugauuagcaguaaa

SEQ ID NO: 950459 - RNA, 19 nt, Homo sapiens
caaggcaugaggcagauga

SEQ ID NO: 950460 - RNA, 19 nt, Homo sapiens
acacuggugagaagccuua

SEQ ID NO: 950461 - RNA, 19 nt, Homo sapiens
gucugaagguucuccaaau

SEQ ID NO: 950462 - RNA, 19 nt, Homo sapiens
gcaugaggcagaugagaag

SEQ ID NO: 950463 - RNA, 19 nt, Homo sapiens
gaaggagcagaguccagaa

SEQ ID NO: 950464 - RNA, 19 nt, Homo sapiens
ccacgcaccagcaagauca

SEQ ID NO: 950465 - RNA, 19 nt, Homo sapiens
ggagcagaguccagaacca

SEQ ID NO: 950466 - RNA, 19 nt, Homo sapiens
gugagagacccuaaccuau

SEQ ID NO: 950467 - RNA, 19 nt, Homo sapiens
cuacaucugcugugagugu

SEQ ID NO: 950468 - RNA, 19 nt, Homo sapiens
ggcaugaggcagaugagaa

SEQ ID NO: 950469 - RNA, 19 nt, Homo sapiens
ucagagaugggcagugaga

SEQ ID NO: 950470 - RNA, 19 nt, Homo sapiens
ugaggaaguacuuaugaga

SEQ ID NO: 950471 - RNA, 19 nt, Homo sapiens
uguauagccucugaaguca

SEQ ID NO: 950472 - RNA, 19 nt, Homo sapiens
augagaagcccuuuauaug

SEQ ID NO: 950473 - RNA, 19 nt, Homo sapiens
agagaaacacuacaaaugc

SEQ ID NO: 950474 - RNA, 19 nt, Homo sapiens
ccuuacaaguguucugaau

SEQ ID NO: 950475 - RNA, 19 nt, Homo sapiens
ccaaauugucugugaacug

SEQ ID NO: 950476 - RNA, 19 nt, Homo sapiens
agaaggagcaugggcaaga

SEQ ID NO: 950477 - RNA, 19 nt, Homo sapiens
gucaggaucucaggaaguc

SEQ ID NO: 950478 - RNA, 19 nt, Homo sapiens
agugagagacccuaaccua

SEQ ID NO: 950479 - RNA, 19 nt, Homo sapiens
ggagcgaggguucagagau

SEQ ID NO: 950480 - RNA, 19 nt, Homo sapiens
ggagccagcacccuacauc

SEQ ID NO: 950481 - RNA, 19 nt, Homo sapiens
ugugacaucuguggcaaga

SEQ ID NO: 950482 - RNA, 19 nt, Homo sapiens
caguaaaacccuucaauga

SEQ ID NO: 950483 - RNA, 19 nt, Homo sapiens
gagugaccuucucaaugga

SEQ ID NO: 950484 - RNA, 19 nt, Homo sapiens
ccucuuuccaggccaauuu

SEQ ID NO: 950485 - RNA, 19 nt, Homo sapiens
gggcgaacaggcugggaaa

SEQ ID NO: 950486 - RNA, 19 nt, Homo sapiens
gaacacaccagcggaucca

SEQ ID NO: 950487 - RNA, 19 nt, Homo sapiens
gcaguaaaacccuucaaug

SEQ ID NO: 950488 - RNA, 19 nt, Homo sapiens
ugcaagaaacucauccaaa

SEQ ID NO: 950489 - RNA, 19 nt, Homo sapiens
cuuuauaugugcccagugu

SEQ ID NO: 950490 - RNA, 19 nt, Homo sapiens
gaccuuaugagugcacuga

SEQ ID NO: 950491 - RNA, 19 nt, Homo sapiens
cacccuacaucugcuguga

SEQ ID NO: 950492 - RNA, 19 nt, Homo sapiens
ccauaccgcugugacaucu

SEQ ID NO: 950493 - RNA, 19 nt, Homo sapiens
aaagauuccagcugaagga

SEQ ID NO: 950494 - RNA, 19 nt, Homo sapiens
ucaccacgcaccagcaaga

SEQ ID NO: 950495 - RNA, 19 nt, Homo sapiens
ccaagugccaggagagcuu

SEQ ID NO: 950496 - RNA, 19 nt, Homo sapiens
uggaagagaaacacuacaa

SEQ ID NO: 950497 - RNA, 19 nt, Homo sapiens
ccuccaaccugagaacaca

SEQ ID NO: 950498 - RNA, 19 nt, Homo sapiens
gacccagucuuggcuuuac

SEQ ID NO: 950499 - RNA, 19 nt, Homo sapiens
ucucauccgccaccagaaa

SEQ ID NO: 950500 - RNA, 19 nt, Homo sapiens
gaauguggcaagagcuucu

SEQ ID NO: 950501 - RNA, 19 nt, Homo sapiens
cugaagguucuccaaauug

SEQ ID NO: 950502 - RNA, 19 nt, Homo sapiens
gaccagaucucuucauaga

SEQ ID NO: 950503 - RNA, 19 nt, Homo sapiens
uaagcuaacuugugacuuu

SEQ ID NO: 950504 - RNA, 19 nt, Homo sapiens
gagaggauguuuagaggaa

SEQ ID NO: 950505 - RNA, 19 nt, Homo sapiens
aaacuggacuuccuaaugu

SEQ ID NO: 950506 - RNA, 19 nt, Homo sapiens
caaagggcaugccuaaaga

SEQ ID NO: 950507 - RNA, 19 nt, Homo sapiens
ggaaagggaagcaguuuga

SEQ ID NO: 950508 - RNA, 19 nt, Homo sapiens
ggaucuugcucucaacuuu

SEQ ID NO: 950509 - RNA, 19 nt, Homo sapiens
gaugacacagcauuuaaua

SEQ ID NO: 950510 - RNA, 19 nt, Homo sapiens
gggcaugccuaaagacuug

SEQ ID NO: 950511 - RNA, 19 nt, Homo sapiens
agaaucagauggacacauu

SEQ ID NO: 950512 - RNA, 19 nt, Homo sapiens
gaaaccaaaggucuuaauu

SEQ ID NO: 950513 - RNA, 19 nt, Homo sapiens
ggaaaccacagguaguuaa

SEQ ID NO: 950514 - RNA, 19 nt, Homo sapiens
gaaaguaacacaaguuugc

SEQ ID NO: 950515 - RNA, 19 nt, Homo sapiens
ggacacauuugcagauuuu

SEQ ID NO: 950516 - RNA, 19 nt, Homo sapiens
guugugaacuuaucugugu

SEQ ID NO: 950517 - RNA, 19 nt, Homo sapiens
ugacacagcauuuaauaga

SEQ ID NO: 950518 - RNA, 19 nt, Homo sapiens
ggaguuguuucuacccauu

SEQ ID NO: 950519 - RNA, 19 nt, Homo sapiens
gagggucucucucaacauc

SEQ ID NO: 950520 - RNA, 19 nt, Homo sapiens
gaacucaacaggccagcaa

SEQ ID NO: 950521 - RNA, 19 nt, Homo sapiens
uaugaugccuucuguauac

SEQ ID NO: 950522 - RNA, 19 nt, Homo sapiens
gcagaccuccggcugguaa

SEQ ID NO: 950523 - RNA, 19 nt, Homo sapiens
gaaaucauucaacacauuc

SEQ ID NO: 950524 - RNA, 19 nt, Homo sapiens
uccauuagcucuuuaccuu

SEQ ID NO: 950525 - RNA, 19 nt, Homo sapiens
ccaaagggcaugccuaaag

SEQ ID NO: 950526 - RNA, 19 nt, Homo sapiens
gaucgguuauuggaugaaa

SEQ ID NO: 950527 - RNA, 19 nt, Homo sapiens
aagcagggcucuggaguug

SEQ ID NO: 950528 - RNA, 19 nt, Homo sapiens
ggcaggcacuuccaucaug

SEQ ID NO: 950529 - RNA, 19 nt, Homo sapiens
gcagcaagauggagguuuu

SEQ ID NO: 950530 - RNA, 19 nt, Homo sapiens
agaggaggcugcugaagau

SEQ ID NO: 950531 - RNA, 19 nt, Homo sapiens
ucacuaaguuaaccaaguc

SEQ ID NO: 950532 - RNA, 19 nt, Homo sapiens
cagaaaguaacacaaguuu

SEQ ID NO: 950533 - RNA, 19 nt, Homo sapiens
caccuugcauuauggauga

SEQ ID NO: 950534 - RNA, 19 nt, Homo sapiens
gaggauguuuagaggaaga

SEQ ID NO: 950535 - RNA, 19 nt, Homo sapiens
gaagcagggcucuggaguu

SEQ ID NO: 950536 - RNA, 19 nt, Homo sapiens
cgaauuagguaaaaggaaa

SEQ ID NO: 950537 - RNA, 19 nt, Homo sapiens
gaagaaaauuuggaagaug

SEQ ID NO: 950538 - RNA, 19 nt, Homo sapiens
ucauagagcacuugaggaa

SEQ ID NO: 950539 - RNA, 19 nt, Homo sapiens
aggaccagaucucuucaua

SEQ ID NO: 950540 - RNA, 19 nt, Homo sapiens
gaaaccacagguaguuaau

SEQ ID NO: 950541 - RNA, 19 nt, Homo sapiens
ggacacacagaaaguaaca

SEQ ID NO: 950542 - RNA, 19 nt, Homo sapiens
ggaagaaaauuuggaagau

SEQ ID NO: 950543 - RNA, 19 nt, Homo sapiens
cuucagauaugcacagcaa

SEQ ID NO: 950544 - RNA, 19 nt, Homo sapiens
guugaaaccaaaggucuua

SEQ ID NO: 950545 - RNA, 19 nt, Homo sapiens
cagaggaggcugcugaaga

SEQ ID NO: 950546 - RNA, 19 nt, Homo sapiens
ucaccuccauuagcucuuu

SEQ ID NO: 950547 - RNA, 19 nt, Homo sapiens
uugaguguuugcuguauaa

SEQ ID NO: 950548 - RNA, 19 nt, Homo sapiens
uaugacggaucgguuauug

SEQ ID NO: 950549 - RNA, 19 nt, Homo sapiens
gcacccguuuguucgaaga

SEQ ID NO: 950550 - RNA, 19 nt, Homo sapiens
uaaguuaaccaagucugua

SEQ ID NO: 950551 - RNA, 19 nt, Homo sapiens
ggaagucuugcacccguuu

SEQ ID NO: 950552 - RNA, 19 nt, Homo sapiens
ccugaaggcuguggagguu

SEQ ID NO: 950553 - RNA, 19 nt, Homo sapiens
uguacaaccucuccauauc

SEQ ID NO: 950554 - RNA, 19 nt, Homo sapiens
ugacggaucgguuauugga

SEQ ID NO: 950555 - RNA, 19 nt, Homo sapiens
ggaauucaccugguugucu

SEQ ID NO: 950556 - RNA, 19 nt, Homo sapiens
ucucaucugugcccaagga

SEQ ID NO: 950557 - RNA, 19 nt, Homo sapiens
gacacagcauuuaauagag

SEQ ID NO: 950558 - RNA, 19 nt, Homo sapiens
ggaugacacagcauuuaau

SEQ ID NO: 950559 - RNA, 19 nt, Homo sapiens
gaggguggacacacagaaa

SEQ ID NO: 950560 - RNA, 19 nt, Homo sapiens
aauaugaugccuucuguau

SEQ ID NO: 950561 - RNA, 19 nt, Homo sapiens
uguggagguugugaacuua

SEQ ID NO: 950562 - RNA, 19 nt, Homo sapiens
ugaaggcuguggagguugu

SEQ ID NO: 950563 - RNA, 19 nt, Homo sapiens
cccggaggcuaaacauaaa

SEQ ID NO: 950564 - RNA, 19 nt, Homo sapiens
caaagcgguucaccuugca

SEQ ID NO: 950565 - RNA, 19 nt, Homo sapiens
gugccugaauugagcugua

SEQ ID NO: 950566 - RNA, 19 nt, Homo sapiens
gaucuugcucucaacuuug

SEQ ID NO: 950567 - RNA, 19 nt, Homo sapiens
auaauaugaugccuucugu

SEQ ID NO: 950568 - RNA, 19 nt, Homo sapiens
gaugaggaagucagugaga

SEQ ID NO: 950569 - RNA, 19 nt, Homo sapiens
ucccggaggcuaaacauaa

SEQ ID NO: 950570 - RNA, 19 nt, Homo sapiens
ccauaucccgaauuaggua

SEQ ID NO: 950571 - RNA, 19 nt, Homo sapiens
gaaucagauggacacauuu

SEQ ID NO: 950572 - RNA, 19 nt, Homo sapiens
ggaagaggaagaaaauuug

SEQ ID NO: 950573 - RNA, 19 nt, Homo sapiens
gaaugugggucagcaagcu

SEQ ID NO: 950574 - RNA, 19 nt, Homo sapiens
ucagauaugcacagcaaga

SEQ ID NO: 950575 - RNA, 19 nt, Homo sapiens
ccuagaggguggacacaca

SEQ ID NO: 950576 - RNA, 19 nt, Homo sapiens
gggauccuuuggaguuguu

SEQ ID NO: 950577 - RNA, 19 nt, Homo sapiens
cccaggaucuugcucucaa

SEQ ID NO: 950578 - RNA, 19 nt, Homo sapiens
cacagaaaguaacacaagu

SEQ ID NO: 950579 - RNA, 19 nt, Homo sapiens
gcuucucucaccuccauua

SEQ ID NO: 950580 - RNA, 19 nt, Homo sapiens
ccuaaugucugaaaagaau

SEQ ID NO: 950581 - RNA, 19 nt, Homo sapiens
ggagguggcacucacuaag

SEQ ID NO: 950582 - RNA, 19 nt, Homo sapiens
ucagugagaggauguuuag

SEQ ID NO: 950583 - RNA, 19 nt, Homo sapiens
cauuagcucuuuaccuuuu

SEQ ID NO: 950584 - RNA, 19 nt, Homo sapiens
gcuaacuugugacuuuuaa

SEQ ID NO: 950585 - RNA, 19 nt, Homo sapiens
uggacacauuugcagauuu

SEQ ID NO: 950586 - RNA, 19 nt, Homo sapiens
gguggcacucacuaaguua

SEQ ID NO: 950587 - RNA, 19 nt, Homo sapiens
gaagucagugagaggaugu

SEQ ID NO: 950588 - RNA, 19 nt, Homo sapiens
uggaugacacagcauuuaa

SEQ ID NO: 950589 - RNA, 19 nt, Homo sapiens
gguggacacacagaaagua

SEQ ID NO: 950590 - RNA, 19 nt, Homo sapiens
ggagauaguuuuagaugcu

SEQ ID NO: 950591 - RNA, 19 nt, Homo sapiens
acacagaaaguaacacaag

SEQ ID NO: 950592 - RNA, 19 nt, Homo sapiens
acagaaaguaacacaaguu

SEQ ID NO: 950593 - RNA, 19 nt, Homo sapiens
guggacacacagaaaguaa

SEQ ID NO: 950594 - RNA, 19 nt, Homo sapiens
ccaccugucucccuuucuc

SEQ ID NO: 950595 - RNA, 19 nt, Homo sapiens
cgguucaccuugcauuaug

SEQ ID NO: 950596 - RNA, 19 nt, Homo sapiens
gcaaagccaaagcgguuca

SEQ ID NO: 950597 - RNA, 19 nt, Homo sapiens
gcaagcucuuuccaacagu

SEQ ID NO: 950598 - RNA, 19 nt, Homo sapiens
ggaccagaucucuucauag

SEQ ID NO: 950599 - RNA, 19 nt, Homo sapiens
gaaagggaagcaguuugau

SEQ ID NO: 950600 - RNA, 19 nt, Homo sapiens
gauggacacauuugcagau

SEQ ID NO: 950601 - RNA, 19 nt, Homo sapiens
gggagguggcacucacuaa

SEQ ID NO: 950602 - RNA, 19 nt, Homo sapiens
gaagaugaauuguaacaug

SEQ ID NO: 950603 - RNA, 19 nt, Homo sapiens
ggaaucaucuagaacaauu

SEQ ID NO: 950604 - RNA, 19 nt, Homo sapiens
uaacaucacuuccuucaga

SEQ ID NO: 950605 - RNA, 19 nt, Homo sapiens
ucagaacucucccauaauu

SEQ ID NO: 950606 - RNA, 19 nt, Homo sapiens
gaaggaagcucaggaaagg

SEQ ID NO: 950607 - RNA, 19 nt, Homo sapiens
ggugaugccuucagaaaga

SEQ ID NO: 950608 - RNA, 19 nt, Homo sapiens
uuucagaacucucccauaa

SEQ ID NO: 950609 - RNA, 19 nt, Homo sapiens
ggaagggaauauugaggaa

SEQ ID NO: 950610 - RNA, 19 nt, Homo sapiens
ccacauccgucuaacauca

SEQ ID NO: 950611 - RNA, 19 nt, Homo sapiens
ucaccuaaaugucaacuug

SEQ ID NO: 950612 - RNA, 19 nt, Homo sapiens
uacgugaucugcaccuuua

SEQ ID NO: 950613 - RNA, 19 nt, Homo sapiens
gaagaggaacccaaagaug

SEQ ID NO: 950614 - RNA, 19 nt, Homo sapiens
caauuaagccgaccaggaa

SEQ ID NO: 950615 - RNA, 19 nt, Homo sapiens
caagucaucaacuguauuu

SEQ ID NO: 950616 - RNA, 19 nt, Homo sapiens
cagaaguagcuuaucauua

SEQ ID NO: 950617 - RNA, 19 nt, Homo sapiens
gcagaaguagcuuaucauu

SEQ ID NO: 950618 - RNA, 19 nt, Homo sapiens
ugguaaaucuugaggauga

SEQ ID NO: 950619 - RNA, 19 nt, Homo sapiens
ggagacuaguagcaucuuu

SEQ ID NO: 950620 - RNA, 19 nt, Homo sapiens
gaagcuggucugcauguuu

SEQ ID NO: 950621 - RNA, 19 nt, Homo sapiens
gaggaaucaucuagaacaa

SEQ ID NO: 950622 - RNA, 19 nt, Homo sapiens
caaggugcauccugaaauc

SEQ ID NO: 950623 - RNA, 19 nt, Homo sapiens
gaaaccucauuccuaccua

SEQ ID NO: 950624 - RNA, 19 nt, Homo sapiens
ggacauaaugggcuuggaa

SEQ ID NO: 950625 - RNA, 19 nt, Homo sapiens
gcagggaagggaauauuga

SEQ ID NO: 950626 - RNA, 19 nt, Homo sapiens
gcucuaaagcccaaauuug

SEQ ID NO: 950627 - RNA, 19 nt, Homo sapiens
aaugaaaccuucugacaca

SEQ ID NO: 950628 - RNA, 19 nt, Homo sapiens
gaaaggagacuaguagcau

SEQ ID NO: 950629 - RNA, 19 nt, Homo sapiens
gcccaaauuugcagaaucu

SEQ ID NO: 950630 - RNA, 19 nt, Homo sapiens
ccacuuuacucaccuuagu

SEQ ID NO: 950631 - RNA, 19 nt, Homo sapiens
gcaaggugcauccugaaau

SEQ ID NO: 950632 - RNA, 19 nt, Homo sapiens
acccaaagaugaagauuuc

SEQ ID NO: 950633 - RNA, 19 nt, Homo sapiens
ugcuugagcuucccuguuu

SEQ ID NO: 950634 - RNA, 19 nt, Homo sapiens
aagaggaacccaaagauga

SEQ ID NO: 950635 - RNA, 19 nt, Homo sapiens
ggaugaagaggaacccaaa

SEQ ID NO: 950636 - RNA, 19 nt, Homo sapiens
ccaaggauaucagccuguu

SEQ ID NO: 950637 - RNA, 19 nt, Homo sapiens
gagaguggcagacuuucuu

SEQ ID NO: 950638 - RNA, 19 nt, Homo sapiens
cccauuuccucccacuuua

SEQ ID NO: 950639 - RNA, 19 nt, Homo sapiens
aagcuggucugcauguuug

SEQ ID NO: 950640 - RNA, 19 nt, Homo sapiens
cgucuaacaucacuuccuu

SEQ ID NO: 950641 - RNA, 19 nt, Homo sapiens
gcggagaguggcagacuuu

SEQ ID NO: 950642 - RNA, 19 nt, Homo sapiens
gaaggagcgcucucacugu

SEQ ID NO: 950643 - RNA, 19 nt, Homo sapiens
gaugaaggaagcucaggaa

SEQ ID NO: 950644 - RNA, 19 nt, Homo sapiens
gaagaugggaagaaagaag

SEQ ID NO: 950645 - RNA, 19 nt, Homo sapiens
ugagccacuuggauguuua

SEQ ID NO: 950646 - RNA, 19 nt, Homo sapiens
cuacggaaauuucagaacu

SEQ ID NO: 950647 - RNA, 19 nt, Homo sapiens
gagaaacucaaaccuucaa

SEQ ID NO: 950648 - RNA, 19 nt, Homo sapiens
gaauaauugugggcuucuu

SEQ ID NO: 950649 - RNA, 19 nt, Homo sapiens
ggugaaaggagacuaguag

SEQ ID NO: 950650 - RNA, 19 nt, Homo sapiens
gaaaccuucugacacaaaa

SEQ ID NO: 950651 - RNA, 19 nt, Homo sapiens
uaugguaaaucuugaggau

SEQ ID NO: 950652 - RNA, 19 nt, Homo sapiens
cagaaucuacggaaauuuc

SEQ ID NO: 950653 - RNA, 19 nt, Homo sapiens
uugcagaaguagcuuauca

SEQ ID NO: 950654 - RNA, 19 nt, Homo sapiens
ggagaaacucaaaccuuca

SEQ ID NO: 950655 - RNA, 19 nt, Homo sapiens
gacauaaugggcuuggaaa

SEQ ID NO: 950656 - RNA, 19 nt, Homo sapiens
gucaagucaucaacuguau

SEQ ID NO: 950657 - RNA, 19 nt, Homo sapiens
ccucuuuccucuucucaug

SEQ ID NO: 950658 - RNA, 19 nt, Homo sapiens
uggaagaguucugcuaaca

SEQ ID NO: 950659 - RNA, 19 nt, Homo sapiens
gaauauugaggaaucaucu

SEQ ID NO: 950660 - RNA, 19 nt, Homo sapiens
ugcagaaucuacggaaauu

SEQ ID NO: 950661 - RNA, 19 nt, Homo sapiens
gacgggugaugccuucaga

SEQ ID NO: 950662 - RNA, 19 nt, Homo sapiens
caacaacaacaacaauaac

SEQ ID NO: 950663 - RNA, 19 nt, Homo sapiens
aagggaauauugaggaauc

SEQ ID NO: 950664 - RNA, 19 nt, Homo sapiens
ggagaucauauucauugga

SEQ ID NO: 950665 - RNA, 19 nt, Homo sapiens
agcaugcuuucccuuguua

SEQ ID NO: 950666 - RNA, 19 nt, Homo sapiens
gcagaaucuacggaaauuu

SEQ ID NO: 950667 - RNA, 19 nt, Homo sapiens
ugucaagucaucaacugua

SEQ ID NO: 950668 - RNA, 19 nt, Homo sapiens
caucuuuucuacaacguua

SEQ ID NO: 950669 - RNA, 19 nt, Homo sapiens
ugaaaccuucugacacaaa

SEQ ID NO: 950670 - RNA, 19 nt, Homo sapiens
ugaggaaucaucuagaaca

SEQ ID NO: 950671 - RNA, 19 nt, Homo sapiens
gguaaaucuugaggaugaa

SEQ ID NO: 950672 - RNA, 19 nt, Homo sapiens
uggaagaugggaagaaaga

SEQ ID NO: 950673 - RNA, 19 nt, Homo sapiens
acuggaagaugggaagaaa

SEQ ID NO: 950674 - RNA, 19 nt, Homo sapiens
guuuacuccucgcacuuaa

SEQ ID NO: 950675 - RNA, 19 nt, Homo sapiens
gcagacuuucuucuccuuu

SEQ ID NO: 950676 - RNA, 19 nt, Homo sapiens
gaaaggcugacgggugaug

SEQ ID NO: 950677 - RNA, 19 nt, Homo sapiens
uacagccucuuuccucuuc

SEQ ID NO: 950678 - RNA, 19 nt, Homo sapiens
auugaggaaucaucuagaa

SEQ ID NO: 950679 - RNA, 19 nt, Homo sapiens
ggaauauugaggaaucauc

SEQ ID NO: 950680 - RNA, 19 nt, Homo sapiens
ugaaggaagcucaggaaag

SEQ ID NO: 950681 - RNA, 19 nt, Homo sapiens
gaacccaaagaugaagauu

SEQ ID NO: 950682 - RNA, 19 nt, Homo sapiens
agaggaacccaaagaugaa

SEQ ID NO: 950683 - RNA, 19 nt, Homo sapiens
ucacuuccuucagaguuug

SEQ ID NO: 950684 - RNA, 19 nt, Homo sapiens
ccuaaguguaaaucaguua

SEQ ID NO: 950685 - RNA, 19 nt, Homo sapiens
uccucgcacuuaaguauuu

SEQ ID NO: 950686 - RNA, 19 nt, Homo sapiens
ccucucaccuaaaugucaa

SEQ ID NO: 950687 - RNA, 19 nt, Homo sapiens
gugaugccuucagaaagaa

SEQ ID NO: 950688 - RNA, 19 nt, Homo sapiens
ugaagaggaacccaaagau

SEQ ID NO: 950689 - RNA, 19 nt, Homo sapiens
cagaacucucccauaauuu

SEQ ID NO: 950690 - RNA, 19 nt, Homo sapiens
uuggagaucauauucauug

SEQ ID NO: 950691 - RNA, 19 nt, Homo sapiens
ggaaaggguuuuggagauc

SEQ ID NO: 950692 - RNA, 19 nt, Homo sapiens
gaaaggguuuuggagauca

SEQ ID NO: 950693 - RNA, 19 nt, Homo sapiens
caucacuuccuucagaguu

SEQ ID NO: 950694 - RNA, 19 nt, Homo sapiens
ggcagacuuucuucuccuu

SEQ ID NO: 950695 - RNA, 19 nt, Homo sapiens
ggugcauccugaaaucauc

SEQ ID NO: 950696 - RNA, 19 nt, Homo sapiens
ggaagaugggaagaaagaa

SEQ ID NO: 950697 - RNA, 19 nt, Homo sapiens
aaauuucuacagccucuuu

SEQ ID NO: 950698 - RNA, 19 nt, Homo sapiens
ggaagaguucugcuaacag

SEQ ID NO: 950699 - RNA, 19 nt, Homo sapiens
uguggaagaguucugcuaa

SEQ ID NO: 950700 - RNA, 19 nt, Homo sapiens
gaagggaauauugaggaau

SEQ ID NO: 950701 - RNA, 19 nt, Homo sapiens
cagcagggaagggaauauu

SEQ ID NO: 950702 - RNA, 19 nt, Homo sapiens
aaagaaagauuaccuagga

SEQ ID NO: 950703 - RNA, 19 nt, Homo sapiens
caacaagacucucaacauc

SEQ ID NO: 950704 - RNA, 19 nt, Homo sapiens
cagcagcucuggauucuuu

SEQ ID NO: 950705 - RNA, 19 nt, Homo sapiens
ccacucaggugaaagaauu

SEQ ID NO: 950706 - RNA, 19 nt, Homo sapiens
gaaaggaccuaagugugaa

SEQ ID NO: 950707 - RNA, 19 nt, Homo sapiens
gcaagagucuccugcugaa

SEQ ID NO: 950708 - RNA, 19 nt, Homo sapiens
gaacaggacagacuaacuu

SEQ ID NO: 950709 - RNA, 19 nt, Homo sapiens
gaagaaaucagaggugaaa

SEQ ID NO: 950710 - RNA, 19 nt, Homo sapiens
gaaacugagagcagaaaua

SEQ ID NO: 950711 - RNA, 19 nt, Homo sapiens
gaagaaaugugagguugau

SEQ ID NO: 950712 - RNA, 19 nt, Homo sapiens
gaccagcgcuguuucuguu

SEQ ID NO: 950713 - RNA, 19 nt, Homo sapiens
gaaagaagaaucucauuac

SEQ ID NO: 950714 - RNA, 19 nt, Homo sapiens
gaacagguaucucuuucca

SEQ ID NO: 950715 - RNA, 19 nt, Homo sapiens
gaaaggaccagcgcuguuu

SEQ ID NO: 950716 - RNA, 19 nt, Homo sapiens
gagaacacguggcucaaga

SEQ ID NO: 950717 - RNA, 19 nt, Homo sapiens
guacugcucuucuucuaug

SEQ ID NO: 950718 - RNA, 19 nt, Homo sapiens
agaagaaucucauuacauc

SEQ ID NO: 950719 - RNA, 19 nt, Homo sapiens
caugagugcuguuuacauu

SEQ ID NO: 950720 - RNA, 19 nt, Homo sapiens
caagucggcuuucagauca

SEQ ID NO: 950721 - RNA, 19 nt, Homo sapiens
ggauugacgugucucagaa

SEQ ID NO: 950722 - RNA, 19 nt, Homo sapiens
ugaacaaggugucuuugaa

SEQ ID NO: 950723 - RNA, 19 nt, Homo sapiens
gaaacugguauccuuagua

SEQ ID NO: 950724 - RNA, 19 nt, Homo sapiens
acaagacucucaacaucua

SEQ ID NO: 950725 - RNA, 19 nt, Homo sapiens
ggacaugacuagcacaaac

SEQ ID NO: 950726 - RNA, 19 nt, Homo sapiens
gagcagaccuuuuaucaug

SEQ ID NO: 950727 - RNA, 19 nt, Homo sapiens
caacgucugugaacucugu

SEQ ID NO: 950728 - RNA, 19 nt, Homo sapiens
ggagagagagauccagaaa

SEQ ID NO: 950729 - RNA, 19 nt, Homo sapiens
aaacugagagcagaaauaa

SEQ ID NO: 950730 - RNA, 19 nt, Homo sapiens
caacacaucacuugucuuc

SEQ ID NO: 950731 - RNA, 19 nt, Homo sapiens
ggaccuaagugugaaauac

SEQ ID NO: 950732 - RNA, 19 nt, Homo sapiens
gaaaccacuucucuacauc

SEQ ID NO: 950733 - RNA, 19 nt, Homo sapiens
gggcagggauggagcugaa

SEQ ID NO: 950734 - RNA, 19 nt, Homo sapiens
ugaugaagcucacccuaga

SEQ ID NO: 950735 - RNA, 19 nt, Homo sapiens
agaaaggaccuaaguguga

SEQ ID NO: 950736 - RNA, 19 nt, Homo sapiens
caacagaaaggaccuaagu

SEQ ID NO: 950737 - RNA, 19 nt, Homo sapiens
gaaaaggcaucucauugga

SEQ ID NO: 950738 - RNA, 19 nt, Homo sapiens
cagcugagaacaucuguaa

SEQ ID NO: 950739 - RNA, 19 nt, Homo sapiens
ugagugcuguuuacauuga

SEQ ID NO: 950740 - RNA, 19 nt, Homo sapiens
cagaucagguguuguuugu

SEQ ID NO: 950741 - RNA, 19 nt, Homo sapiens
gaacaaggugucuuugaag

SEQ ID NO: 950742 - RNA, 19 nt, Homo sapiens
ugaaaccacuucucuacau

SEQ ID NO: 950743 - RNA, 19 nt, Homo sapiens
agagagagauccagaaacu

SEQ ID NO: 950744 - RNA, 19 nt, Homo sapiens
ucagagcgaggcagucuua

SEQ ID NO: 950745 - RNA, 19 nt, Homo sapiens
gagcuccacucaggugaaa

SEQ ID NO: 950746 - RNA, 19 nt, Homo sapiens
cuacacagcugagaacauc

SEQ ID NO: 950747 - RNA, 19 nt, Homo sapiens
caucccaucucaaucagaa

SEQ ID NO: 950748 - RNA, 19 nt, Homo sapiens
gcaagucggcuuucagauc

SEQ ID NO: 950749 - RNA, 19 nt, Homo sapiens
gaaguggccuuggaguaca

SEQ ID NO: 950750 - RNA, 19 nt, Homo sapiens
gaauaacgagcugaagaaa

SEQ ID NO: 950751 - RNA, 19 nt, Homo sapiens
agugacaacugauaccuuu

SEQ ID NO: 950752 - RNA, 19 nt, Homo sapiens
ggcaauuguugacgugaaa

SEQ ID NO: 950753 - RNA, 19 nt, Homo sapiens
ggccugagcugcagaacca

SEQ ID NO: 950754 - RNA, 19 nt, Homo sapiens
ggagaacaggacagacuaa

SEQ ID NO: 950755 - RNA, 19 nt, Homo sapiens
caucgacucugaacaaggu

SEQ ID NO: 950756 - RNA, 19 nt, Homo sapiens
gcauguugcaggaccauaa

SEQ ID NO: 950757 - RNA, 19 nt, Homo sapiens
agagucuccugcugaauaa

SEQ ID NO: 950758 - RNA, 19 nt, Homo sapiens
aaacugguauccuuaguac

SEQ ID NO: 950759 - RNA, 19 nt, Homo sapiens
auaaacaucuugcgaaacu

SEQ ID NO: 950760 - RNA, 19 nt, Homo sapiens
ccuaggaacaguacgauuu

SEQ ID NO: 950761 - RNA, 19 nt, Homo sapiens
gaugaaaccacuucucuac

SEQ ID NO: 950762 - RNA, 19 nt, Homo sapiens
agagagauccagaaacuga

SEQ ID NO: 950763 - RNA, 19 nt, Homo sapiens
gaaguggacaugacuagca

SEQ ID NO: 950764 - RNA, 19 nt, Homo sapiens
gaaagauuaccuaggaaca

SEQ ID NO: 950765 - RNA, 19 nt, Homo sapiens
cuucuucaccucagcauua

SEQ ID NO: 950766 - RNA, 19 nt, Homo sapiens
ccaaagcaagcacugauga

SEQ ID NO: 950767 - RNA, 19 nt, Homo sapiens
auaacgagcugaagaaagg

SEQ ID NO: 950768 - RNA, 19 nt, Homo sapiens
aagagucuccugcugaaua

SEQ ID NO: 950769 - RNA, 19 nt, Homo sapiens
gcugagaacaucuguaagu

SEQ ID NO: 950770 - RNA, 19 nt, Homo sapiens
gaacuacacagcugagaac

SEQ ID NO: 950771 - RNA, 19 nt, Homo sapiens
ugaauaacgagcugaagaa

SEQ ID NO: 950772 - RNA, 19 nt, Homo sapiens
acauagacauuucaacaca

SEQ ID NO: 950773 - RNA, 19 nt, Homo sapiens
aaacuacgagccuggagua

SEQ ID NO: 950774 - RNA, 19 nt, Homo sapiens
cuacaucccaucucaauca

SEQ ID NO: 950775 - RNA, 19 nt, Homo sapiens
guucccgucucagcauuua

SEQ ID NO: 950776 - RNA, 19 nt, Homo sapiens
aaacuucagcguucucuau

SEQ ID NO: 950777 - RNA, 19 nt, Homo sapiens
cgacugggagcauguaaug

SEQ ID NO: 950778 - RNA, 19 nt, Homo sapiens
gaaccaacaagacucucaa

SEQ ID NO: 950779 - RNA, 19 nt, Homo sapiens
gcuacuacacugcauguug

SEQ ID NO: 950780 - RNA, 19 nt, Homo sapiens
gaacacguggcucaagauc

SEQ ID NO: 950781 - RNA, 19 nt, Homo sapiens
caucagacagcauagaaug

SEQ ID NO: 950782 - RNA, 19 nt, Homo sapiens
ccucagcauuacauucauu

SEQ ID NO: 950783 - RNA, 19 nt, Homo sapiens
gaaaucagaggugaaaauu

SEQ ID NO: 950784 - RNA, 19 nt, Homo sapiens
gaagcucacccuagagucu

SEQ ID NO: 950785 - RNA, 19 nt, Homo sapiens
caaagcaagcacugaugaa

SEQ ID NO: 950786 - RNA, 19 nt, Homo sapiens
ccaacaagacucucaacau

SEQ ID NO: 950787 - RNA, 19 nt, Homo sapiens
uagacgagaucaccgaagu

SEQ ID NO: 950788 - RNA, 19 nt, Homo sapiens
ggaccaaucgaauacaaag

SEQ ID NO: 950789 - RNA, 19 nt, Homo sapiens
gcuuucagaucagguguug

SEQ ID NO: 950790 - RNA, 19 nt, Homo sapiens
gaaguggcucugcccaguu

SEQ ID NO: 950791 - RNA, 19 nt, Homo sapiens
agaaucucauuacaucuug

SEQ ID NO: 950792 - RNA, 19 nt, Homo sapiens
ucaccgaaguggccuugga

SEQ ID NO: 950793 - RNA, 19 nt, Homo sapiens
uugcgaaacugguauccuu

SEQ ID NO: 950794 - RNA, 19 nt, Homo sapiens
gcuggccgaugccucagaa

SEQ ID NO: 950795 - RNA, 19 nt, Homo sapiens
cagcaagucggcuuucaga

SEQ ID NO: 950796 - RNA, 19 nt, Homo sapiens
cuacgagccuggaguacuc

SEQ ID NO: 950797 - RNA, 19 nt, Homo sapiens
aaucagaggugaaaauugu

SEQ ID NO: 950798 - RNA, 19 nt, Homo sapiens
gcuccucgcccucaaguuc

SEQ ID NO: 950799 - RNA, 19 nt, Homo sapiens
gaugugauaauaccagcaa

SEQ ID NO: 950800 - RNA, 19 nt, Homo sapiens
gagcauguaaugucggaau

SEQ ID NO: 950801 - RNA, 19 nt, Homo sapiens
acagaaaggaccuaagugu

SEQ ID NO: 950802 - RNA, 19 nt, Homo sapiens
ggaagaaucugugaagcua

SEQ ID NO: 950803 - RNA, 19 nt, Homo sapiens
ccaaacaccugcaacuuaa

SEQ ID NO: 950804 - RNA, 19 nt, Homo sapiens
caauaaaccugaugguaaa

SEQ ID NO: 950805 - RNA, 19 nt, Homo sapiens
gaaccagcaugaagaacua

SEQ ID NO: 950806 - RNA, 19 nt, Homo sapiens
cuaucaaggugaagaauua

SEQ ID NO: 950807 - RNA, 19 nt, Homo sapiens
ggagugaaaucuuccuuau

SEQ ID NO: 950808 - RNA, 19 nt, Homo sapiens
ggaaucuacugaacaauca

SEQ ID NO: 950809 - RNA, 19 nt, Homo sapiens
cagcagaagcuaacaauuu

SEQ ID NO: 950810 - RNA, 19 nt, Homo sapiens
ucaaagugcuuccaucaga

SEQ ID NO: 950811 - RNA, 19 nt, Homo sapiens
gcaguguuauugauggaua

SEQ ID NO: 950812 - RNA, 19 nt, Homo sapiens
ucaauaaaccugaugguaa

SEQ ID NO: 950813 - RNA, 19 nt, Homo sapiens
agcagaagcuaacaauuua

SEQ ID NO: 950814 - RNA, 19 nt, Homo sapiens
gauauggagugaaaucuuc

SEQ ID NO: 950815 - RNA, 19 nt, Homo sapiens
guuuggauaugcucauuua

SEQ ID NO: 950816 - RNA, 19 nt, Homo sapiens
ccacaggaauucagauaug

SEQ ID NO: 950817 - RNA, 19 nt, Homo sapiens
aaacauuccugaagccauu

SEQ ID NO: 950818 - RNA, 19 nt, Homo sapiens
gaguuucacugcauuguau

SEQ ID NO: 950819 - RNA, 19 nt, Homo sapiens
caaaugacuugcagaccaa

SEQ ID NO: 950820 - RNA, 19 nt, Homo sapiens
ggaccaccauggccaagaa

SEQ ID NO: 950821 - RNA, 19 nt, Homo sapiens
caugugauauuccacguuu

SEQ ID NO: 950822 - RNA, 19 nt, Homo sapiens
gcaguuggagagugaaaua

SEQ ID NO: 950823 - RNA, 19 nt, Homo sapiens
gcacaaugaucagcucaau

SEQ ID NO: 950824 - RNA, 19 nt, Homo sapiens
gcuagccuaugcaauauga

SEQ ID NO: 950825 - RNA, 19 nt, Homo sapiens
cuucaaggcuuauauaaag

SEQ ID NO: 950826 - RNA, 19 nt, Homo sapiens
agugaaaucuuccuuauca

SEQ ID NO: 950827 - RNA, 19 nt, Homo sapiens
gaauucagauauggaguga

SEQ ID NO: 950828 - RNA, 19 nt, Homo sapiens
caaggagguuguugcugua

SEQ ID NO: 950829 - RNA, 19 nt, Homo sapiens
guacacguguucugcuuga

SEQ ID NO: 950830 - RNA, 19 nt, Homo sapiens
caaagugcuuccaucagaa

SEQ ID NO: 950831 - RNA, 19 nt, Homo sapiens
guacuucaaggcuuauaua

SEQ ID NO: 950832 - RNA, 19 nt, Homo sapiens
gaaguacaaaugaggcuuu

SEQ ID NO: 950833 - RNA, 19 nt, Homo sapiens
gagccuagauauuaaagag

SEQ ID NO: 950834 - RNA, 19 nt, Homo sapiens
gaucagcucaauacaggua

SEQ ID NO: 950835 - RNA, 19 nt, Homo sapiens
gcugggagcuguaauagac

SEQ ID NO: 950836 - RNA, 19 nt, Homo sapiens
guagucaucuuuaucacau

SEQ ID NO: 950837 - RNA, 19 nt, Homo sapiens
ccgagagccuagauauuaa

SEQ ID NO: 950838 - RNA, 19 nt, Homo sapiens
cccgagagccuagauauua

SEQ ID NO: 950839 - RNA, 19 nt, Homo sapiens
aaagaucuaucaaggugaa

SEQ ID NO: 950840 - RNA, 19 nt, Homo sapiens
cauguacaauuuccugauu

SEQ ID NO: 950841 - RNA, 19 nt, Homo sapiens
ugacuggauucauugguuu

SEQ ID NO: 950842 - RNA, 19 nt, Homo sapiens
caagcacaaugauagcaaa

SEQ ID NO: 950843 - RNA, 19 nt, Homo sapiens
caacugccaaggacacaua

SEQ ID NO: 950844 - RNA, 19 nt, Homo sapiens
uggaguacuucaaggcuua

SEQ ID NO: 950845 - RNA, 19 nt, Homo sapiens
caaggacacauacaacaaa

SEQ ID NO: 950846 - RNA, 19 nt, Homo sapiens
gaguuucccauacgaauuu

SEQ ID NO: 950847 - RNA, 19 nt, Homo sapiens
gaccacaggaauucagaua

SEQ ID NO: 950848 - RNA, 19 nt, Homo sapiens
ugagauacauguacaacca

SEQ ID NO: 950849 - RNA, 19 nt, Homo sapiens
uaaugggacugacccuuau

SEQ ID NO: 950850 - RNA, 19 nt, Homo sapiens
aagaaucugugaagcuauu

SEQ ID NO: 950851 - RNA, 19 nt, Homo sapiens
ggugaagaauuaccacauc

SEQ ID NO: 950852 - RNA, 19 nt, Homo sapiens
gaacgagagaccacaggaa

SEQ ID NO: 950853 - RNA, 19 nt, Homo sapiens
ugaccauuccuuugaguua

SEQ ID NO: 950854 - RNA, 19 nt, Homo sapiens
acaggugcaugaccaauug

SEQ ID NO: 950855 - RNA, 19 nt, Homo sapiens
gaagauggguggggaagaa

SEQ ID NO: 950856 - RNA, 19 nt, Homo sapiens
acacauccauuccuguuuc

SEQ ID NO: 950857 - RNA, 19 nt, Homo sapiens
caaagucggaaucuacuga

SEQ ID NO: 950858 - RNA, 19 nt, Homo sapiens
gaccagggaaguacaaaug

SEQ ID NO: 950859 - RNA, 19 nt, Homo sapiens
gaaaagacauaugaaugga

SEQ ID NO: 950860 - RNA, 19 nt, Homo sapiens
caauauaucaagcacaaug

SEQ ID NO: 950861 - RNA, 19 nt, Homo sapiens
aaagagaucaaugggaaua

SEQ ID NO: 950862 - RNA, 19 nt, Homo sapiens
cugauuccuuggcuacuua

SEQ ID NO: 950863 - RNA, 19 nt, Homo sapiens
ggagguuguugcuguaucu

SEQ ID NO: 950864 - RNA, 19 nt, Homo sapiens
gaagaggaggagccaguga

SEQ ID NO: 950865 - RNA, 19 nt, Homo sapiens
gugacuggauucauugguu

SEQ ID NO: 950866 - RNA, 19 nt, Homo sapiens
agagaucaaugggaauaaa

SEQ ID NO: 950867 - RNA, 19 nt, Homo sapiens
gagacuggaguuucccaua

SEQ ID NO: 950868 - RNA, 19 nt, Homo sapiens
agucugauauuucuuguuc

SEQ ID NO: 950869 - RNA, 19 nt, Homo sapiens
gcccuuagcacaaugauca

SEQ ID NO: 950870 - RNA, 19 nt, Homo sapiens
gagauucagccacaguauu

SEQ ID NO: 950871 - RNA, 19 nt, Homo sapiens
guacaaccaggaaucaguu

SEQ ID NO: 950872 - RNA, 19 nt, Homo sapiens
aaacacagcaucauaacuc

SEQ ID NO: 950873 - RNA, 19 nt, Homo sapiens
gaugaaacugcauuaaauc

SEQ ID NO: 950874 - RNA, 19 nt, Homo sapiens
caccauuagccauuuguua

SEQ ID NO: 950875 - RNA, 19 nt, Homo sapiens
auaagcagauguauguaug

SEQ ID NO: 950876 - RNA, 19 nt, Homo sapiens
auaaugggacugacccuua

SEQ ID NO: 950877 - RNA, 19 nt, Homo sapiens
agaauuaccacaucccaaa

SEQ ID NO: 950878 - RNA, 19 nt, Homo sapiens
gagagauucagccacagua

SEQ ID NO: 950879 - RNA, 19 nt, Homo sapiens
gaagacugcaaacuggauu

SEQ ID NO: 950880 - RNA, 19 nt, Homo sapiens
uccaauauaucaagcacaa

SEQ ID NO: 950881 - RNA, 19 nt, Homo sapiens
accaaacaccugcaacuua

SEQ ID NO: 950882 - RNA, 19 nt, Homo sapiens
gccuagauauuaaagagau

SEQ ID NO: 950883 - RNA, 19 nt, Homo sapiens
ggaguuucccauacgaauu

SEQ ID NO: 950884 - RNA, 19 nt, Homo sapiens
cugauggacuucauguuga

SEQ ID NO: 950885 - RNA, 19 nt, Homo sapiens
uagcuagccuaugcaauau

SEQ ID NO: 950886 - RNA, 19 nt, Homo sapiens
agauucagccacaguauuu

SEQ ID NO: 950887 - RNA, 19 nt, Homo sapiens
gggcauauauccgguacuc

SEQ ID NO: 950888 - RNA, 19 nt, Homo sapiens
gcagggacagaaacaguug

SEQ ID NO: 950889 - RNA, 19 nt, Homo sapiens
ccaaggacacauacaacaa

SEQ ID NO: 950890 - RNA, 19 nt, Homo sapiens
ucaucaagcuuucccuaca

SEQ ID NO: 950891 - RNA, 19 nt, Homo sapiens
aagaugaccauuccuuuga

SEQ ID NO: 950892 - RNA, 19 nt, Homo sapiens
gguuguugcuguaucuguu

SEQ ID NO: 950893 - RNA, 19 nt, Homo sapiens
gucggaaucuacugaacaa

SEQ ID NO: 950894 - RNA, 19 nt, Homo sapiens
ucaaagaugaccauuccuu

SEQ ID NO: 950895 - RNA, 19 nt, Homo sapiens
cgaugguggugccaaauuc

SEQ ID NO: 950896 - RNA, 19 nt, Homo sapiens
acaaugaucagcucaauac

SEQ ID NO: 950897 - RNA, 19 nt, Homo sapiens
cagggaaccuuugauaguc

SEQ ID NO: 950898 - RNA, 19 nt, Homo sapiens
gaagcaggcagcgcaguga

SEQ ID NO: 950899 - RNA, 19 nt, Homo sapiens
cgagagaccacaggaauuc

SEQ ID NO: 950900 - RNA, 19 nt, Homo sapiens
gguuggagacuacaaugaa

SEQ ID NO: 950901 - RNA, 19 nt, Homo sapiens
agacaucuguaucaucaag

SEQ ID NO: 950902 - RNA, 19 nt, Homo sapiens
ccaagugccucaagcauua

SEQ ID NO: 950903 - RNA, 19 nt, Homo sapiens
caacaaggaugaugaggaa

SEQ ID NO: 950904 - RNA, 19 nt, Homo sapiens
gagcaaggaugugaugauu

SEQ ID NO: 950905 - RNA, 19 nt, Homo sapiens
gcaaggaugugaugauuuu

SEQ ID NO: 950906 - RNA, 19 nt, Homo sapiens
gccaggagcuguucucugu

SEQ ID NO: 950907 - RNA, 19 nt, Homo sapiens
ggacagacccaguagacaa

SEQ ID NO: 950908 - RNA, 19 nt, Homo sapiens
gaaaggaccacaaggcaau

SEQ ID NO: 950909 - RNA, 19 nt, Homo sapiens
gcaguuaacauguaucuag

SEQ ID NO: 950910 - RNA, 19 nt, Homo sapiens
ccagugggcuccuuuaugg

SEQ ID NO: 950911 - RNA, 19 nt, Homo sapiens
gaacuuccgcuuccuguca

SEQ ID NO: 950912 - RNA, 19 nt, Homo sapiens
acauguaucuagcugcaua

SEQ ID NO: 950913 - RNA, 19 nt, Homo sapiens
ggaacugauugccaacuuc

SEQ ID NO: 950914 - RNA, 19 nt, Homo sapiens
ucuaugcaguuaacaugua

SEQ ID NO: 950915 - RNA, 19 nt, Homo sapiens
gaccaaggcagaauaaucu

SEQ ID NO: 950916 - RNA, 19 nt, Homo sapiens
gcucacauccauaucagaa

SEQ ID NO: 950917 - RNA, 19 nt, Homo sapiens
gcugggaggcugcuggaua

SEQ ID NO: 950918 - RNA, 19 nt, Homo sapiens
cagaauaaucuccggauga

SEQ ID NO: 950919 - RNA, 19 nt, Homo sapiens
guaaauggcacuacuuggu

SEQ ID NO: 950920 - RNA, 19 nt, Homo sapiens
ucaccggcgucuacuugua

SEQ ID NO: 950921 - RNA, 19 nt, Homo sapiens
ggugcucgcugccaacaau

SEQ ID NO: 950922 - RNA, 19 nt, Homo sapiens
ccucuggccuuauuuuaua

SEQ ID NO: 950923 - RNA, 19 nt, Homo sapiens
ggaaacaccaggccaacca

SEQ ID NO: 950924 - RNA, 19 nt, Homo sapiens
ccagaccaaggcagaauaa

SEQ ID NO: 950925 - RNA, 19 nt, Homo sapiens
gcuuaugucugugcucuca

SEQ ID NO: 950926 - RNA, 19 nt, Homo sapiens
ggauggacacggcaaggaa

SEQ ID NO: 950927 - RNA, 19 nt, Homo sapiens
ccaaugaggaccagcuguu

SEQ ID NO: 950928 - RNA, 19 nt, Homo sapiens
cuggugcucuucaucauug

SEQ ID NO: 950929 - RNA, 19 nt, Homo sapiens
caagagcaaggaugugaug

SEQ ID NO: 950930 - RNA, 19 nt, Homo sapiens
agaauaaucuccggaugag

SEQ ID NO: 950931 - RNA, 19 nt, Homo sapiens
gccgcaggcucagguauga

SEQ ID NO: 950932 - RNA, 19 nt, Homo sapiens
caucaccggcgucuacuug

SEQ ID NO: 950933 - RNA, 19 nt, Homo sapiens
gauggacacggcaaggaaa

SEQ ID NO: 950934 - RNA, 19 nt, Homo sapiens
cccaugcucuuuguaaaug

SEQ ID NO: 950935 - RNA, 19 nt, Homo sapiens
gaugaugaggaacugauug

SEQ ID NO: 950936 - RNA, 19 nt, Homo sapiens
ccugucaccuggucuguca

SEQ ID NO: 950937 - RNA, 19 nt, Homo sapiens
gguguggacagacccagua

SEQ ID NO: 950938 - RNA, 19 nt, Homo sapiens
cauuacugcucaccacuca

SEQ ID NO: 950939 - RNA, 19 nt, Homo sapiens
guaugagucccagcucuuu

SEQ ID NO: 950940 - RNA, 19 nt, Homo sapiens
ucaacaaccacaccuggaa

SEQ ID NO: 950941 - RNA, 19 nt, Homo sapiens
ggaugaugaggaacugauu

SEQ ID NO: 950942 - RNA, 19 nt, Homo sapiens
caaggaugaugaggaacug

SEQ ID NO: 950943 - RNA, 19 nt, Homo sapiens
gcuccuuuaugguacucua

SEQ ID NO: 950944 - RNA, 19 nt, Homo sapiens
gacagacccaguagacaau

SEQ ID NO: 950945 - RNA, 19 nt, Homo sapiens
uggugaggcuuaugucugu

SEQ ID NO: 950946 - RNA, 19 nt, Homo sapiens
cuaugcaguuaacauguau

SEQ ID NO: 950947 - RNA, 19 nt, Homo sapiens
gguacucuaugcaguuaac

SEQ ID NO: 950948 - RNA, 19 nt, Homo sapiens
cugggaggcugcuggauag

SEQ ID NO: 950949 - RNA, 19 nt, Homo sapiens
gguaugagucccagcucuu

SEQ ID NO: 950950 - RNA, 19 nt, Homo sapiens
gcaucauccucaacaacca

SEQ ID NO: 950951 - RNA, 19 nt, Homo sapiens
ucaccagugggcuccuuua

SEQ ID NO: 950952 - RNA, 19 nt, Homo sapiens
uggcaccgcugagccuuug

SEQ ID NO: 950953 - RNA, 19 nt, Homo sapiens
agaccaaggcagaauaauc

SEQ ID NO: 950954 - RNA, 19 nt, Homo sapiens
ccaccuuccuccuucuaag

SEQ ID NO: 950955 - RNA, 19 nt, Homo sapiens
ugcagccucuggccuuauu

SEQ ID NO: 950956 - RNA, 19 nt, Homo sapiens
gaggguuagauuagucuga

SEQ ID NO: 950957 - RNA, 19 nt, Homo sapiens
augguacucuaugcaguua

SEQ ID NO: 950958 - RNA, 19 nt, Homo sapiens
gugcuucccaugcucuuug

SEQ ID NO: 950959 - RNA, 19 nt, Homo sapiens
aggaacugauugccaacuu

SEQ ID NO: 950960 - RNA, 19 nt, Homo sapiens
cuucaucauuggcaucauc

SEQ ID NO: 950961 - RNA, 19 nt, Homo sapiens
aggguuagauuagucugaa

SEQ ID NO: 950962 - RNA, 19 nt, Homo sapiens
gcucaccagugggcuccuu

SEQ ID NO: 950963 - RNA, 19 nt, Homo sapiens
ucauuggcaucauccucaa

SEQ ID NO: 950964 - RNA, 19 nt, Homo sapiens
agugggcuccuuuauggua

SEQ ID NO: 950965 - RNA, 19 nt, Homo sapiens
gaccaagugccucaagcau

SEQ ID NO: 950966 - RNA, 19 nt, Homo sapiens
uaacagggaucaugaaaga

SEQ ID NO: 950967 - RNA, 19 nt, Homo sapiens
gaaagacaguggaaacaag

SEQ ID NO: 950968 - RNA, 19 nt, Homo sapiens
gacuauacauggcaaauga

SEQ ID NO: 950969 - RNA, 19 nt, Homo sapiens
aggaagacguccaccauua

SEQ ID NO: 950970 - RNA, 19 nt, Homo sapiens
ccguggagcucuucuauga

SEQ ID NO: 950971 - RNA, 19 nt, Homo sapiens
ggacucggauuucucuauc

SEQ ID NO: 950972 - RNA, 19 nt, Homo sapiens
auacauggcaaaugacuua

SEQ ID NO: 950973 - RNA, 19 nt, Homo sapiens
guggcaaccuuuacuucua

SEQ ID NO: 950974 - RNA, 19 nt, Homo sapiens
agagaaggcugguaugucu

SEQ ID NO: 950975 - RNA, 19 nt, Homo sapiens
gaacaagcccagggacuuc

SEQ ID NO: 950976 - RNA, 19 nt, Homo sapiens
uggccaaacccacauguua

SEQ ID NO: 950977 - RNA, 19 nt, Homo sapiens
acccuuggcuccaccauaa

SEQ ID NO: 950978 - RNA, 19 nt, Homo sapiens
aaggauuucuugucuguga

SEQ ID NO: 950979 - RNA, 19 nt, Homo sapiens
ggaagacguccaccauuag

SEQ ID NO: 950980 - RNA, 19 nt, Homo sapiens
ugaagaaccagcucaagga

SEQ ID NO: 950981 - RNA, 19 nt, Homo sapiens
gaaguggaugggcccuaua

SEQ ID NO: 950982 - RNA, 19 nt, Homo sapiens
gccaaacccacauguuauu

SEQ ID NO: 950983 - RNA, 19 nt, Homo sapiens
caauucugcuuucccacaa

SEQ ID NO: 950984 - RNA, 19 nt, Homo sapiens
ccugggagcugucugucuu

SEQ ID NO: 950985 - RNA, 19 nt, Homo sapiens
gcacugggacucggauuuc

SEQ ID NO: 950986 - RNA, 19 nt, Homo sapiens
gcagagaaggcugguaugu

SEQ ID NO: 950987 - RNA, 19 nt, Homo sapiens
acuuaaagcuccugagaca

SEQ ID NO: 950988 - RNA, 19 nt, Homo sapiens
cauggcaaaugacuuaaag

SEQ ID NO: 950989 - RNA, 19 nt, Homo sapiens
uggcaaccuuuacuucuau

SEQ ID NO: 950990 - RNA, 19 nt, Homo sapiens
ggccaaacccacauguuau

SEQ ID NO: 950991 - RNA, 19 nt, Homo sapiens
cauaacagggaucaugaaa

SEQ ID NO: 950992 - RNA, 19 nt, Homo sapiens
uuacuucuaugccucacaa

SEQ ID NO: 950993 - RNA, 19 nt, Homo sapiens
aaacccacauguuauuugg

SEQ ID NO: 950994 - RNA, 19 nt, Homo sapiens
cgccaaaggugaagaacca

SEQ ID NO: 950995 - RNA, 19 nt, Homo sapiens
ggacuauacauggcaaaug

SEQ ID NO: 950996 - RNA, 19 nt, Homo sapiens
ccgcaaaggacuauacaug

SEQ ID NO: 950997 - RNA, 19 nt, Homo sapiens
ccaaacccacauguuauuu

SEQ ID NO: 950998 - RNA, 19 nt, Homo sapiens
gucaaggaaugaagacauc

SEQ ID NO: 950999 - RNA, 19 nt, Homo sapiens
ugacuuaaagcuccugaga

SEQ ID NO: 951000 - RNA, 19 nt, Homo sapiens
ugguaugucugcagaacaa

SEQ ID NO: 951001 - RNA, 19 nt, Homo sapiens
cacaagugccuuucagaga

SEQ ID NO: 951002 - RNA, 19 nt, Homo sapiens
cagagaugcuggagaaagc

SEQ ID NO: 951003 - RNA, 19 nt, Homo sapiens
cgugaaugccagacuuuaa

SEQ ID NO: 951004 - RNA, 19 nt, Homo sapiens
caacgccaaaggugaagaa

SEQ ID NO: 951005 - RNA, 19 nt, Homo sapiens
agaaguggaugggcccuau

SEQ ID NO: 951006 - RNA, 19 nt, Homo sapiens
ugaaagacaguggaaacaa

SEQ ID NO: 951007 - RNA, 19 nt, Homo sapiens
gagauccugugccgguauc

SEQ ID NO: 951008 - RNA, 19 nt, Homo sapiens
cugcagauacggagccuuu

SEQ ID NO: 951009 - RNA, 19 nt, Homo sapiens
augccagacuuuaagauug

SEQ ID NO: 951010 - RNA, 19 nt, Homo sapiens
gcagauacggagccuuugg

SEQ ID NO: 951011 - RNA, 19 nt, Homo sapiens
ggucaaggaaugaagacau

SEQ ID NO: 951012 - RNA, 19 nt, Homo sapiens
gcaccguggagcucuucua

SEQ ID NO: 951013 - RNA, 19 nt, Homo sapiens
caggaagacguccaccauu

SEQ ID NO: 951014 - RNA, 19 nt, Homo sapiens
gggacucggauuucucuau

SEQ ID NO: 951015 - RNA, 19 nt, Homo sapiens
ccaggaagacguccaccau

SEQ ID NO: 951016 - RNA, 19 nt, Homo sapiens
gaaugccagacuuuaagau

SEQ ID NO: 951017 - RNA, 19 nt, Homo sapiens
ugaaugccagacuuuaaga

SEQ ID NO: 951018 - RNA, 19 nt, Homo sapiens
gugaaugccagacuuuaag

SEQ ID NO: 951019 - RNA, 19 nt, Homo sapiens
ccucauaacagggaucaug

SEQ ID NO: 951020 - RNA, 19 nt, Homo sapiens
gaagacguccaccauuagc

SEQ ID NO: 951021 - RNA, 19 nt, Homo sapiens
ugauagagguauuuucugu

SEQ ID NO: 951022 - RNA, 19 nt, Homo sapiens
ucaccgagccgcagagcau

SEQ ID NO: 951023 - RNA, 19 nt, Homo sapiens
acagggaucaugaaagaca

SEQ ID NO: 951024 - RNA, 19 nt, Homo sapiens
ccagauucccauccacuuc

SEQ ID NO: 951025 - RNA, 19 nt, Homo sapiens
caugaaagacaguggaaac

SEQ ID NO: 951026 - RNA, 19 nt, Homo sapiens
ggcacugggacucggauuu

SEQ ID NO: 951027 - RNA, 19 nt, Homo sapiens
ggaacaucaaccugcaguu

SEQ ID NO: 951028 - RNA, 19 nt, Homo sapiens
ucgcaacgccaaaggugaa

SEQ ID NO: 951029 - RNA, 19 nt, Homo sapiens
gcugguaugucugcagaac

SEQ ID NO: 951030 - RNA, 19 nt, Homo sapiens
gaauaucuggaacaucaac

SEQ ID NO: 951031 - RNA, 19 nt, Homo sapiens
aaugccagacuuuaagauu

SEQ ID NO: 951032 - RNA, 19 nt, Homo sapiens
agaacaagcccagggacuu

SEQ ID NO: 951033 - RNA, 19 nt, Homo sapiens
cugcagagaaggcugguau

SEQ ID NO: 951034 - RNA, 19 nt, Homo sapiens
ggauuucuugucugugaug

SEQ ID NO: 951035 - RNA, 19 nt, Homo sapiens
ucaaacagcuuccugaauu

SEQ ID NO: 951036 - RNA, 19 nt, Homo sapiens
gaagaaagcaacacuaaug

SEQ ID NO: 951037 - RNA, 19 nt, Homo sapiens
acagaaggguguucauuua

SEQ ID NO: 951038 - RNA, 19 nt, Homo sapiens
gaaagcaacacuaaugauu

SEQ ID NO: 951039 - RNA, 19 nt, Homo sapiens
gaaggguguucauuuagaa

SEQ ID NO: 951040 - RNA, 19 nt, Homo sapiens
caaacagcuuccugaauuu

SEQ ID NO: 951041 - RNA, 19 nt, Homo sapiens
cagcaguaaucuccuauuu

SEQ ID NO: 951042 - RNA, 19 nt, Homo sapiens
gcaguaaucuccuauuuug

SEQ ID NO: 951043 - RNA, 19 nt, Homo sapiens
caacaugccuuuggcuaga

SEQ ID NO: 951044 - RNA, 19 nt, Homo sapiens
gccuuuggcuagagauuua

SEQ ID NO: 951045 - RNA, 19 nt, Homo sapiens
guacaaaguccaaauucuu

SEQ ID NO: 951046 - RNA, 19 nt, Homo sapiens
gacagugguucuuugugua

SEQ ID NO: 951047 - RNA, 19 nt, Homo sapiens
uagaagaaagcaacacuaa

SEQ ID NO: 951048 - RNA, 19 nt, Homo sapiens
cacagaaagccuuaucaua

SEQ ID NO: 951049 - RNA, 19 nt, Homo sapiens
gcaacacuaaugauucaaa

SEQ ID NO: 951050 - RNA, 19 nt, Homo sapiens
aagcaacacuaaugauuca

SEQ ID NO: 951051 - RNA, 19 nt, Homo sapiens
agaaggguguucauuuaga

SEQ ID NO: 951052 - RNA, 19 nt, Homo sapiens
agacagugguucuuugugu

SEQ ID NO: 951053 - RNA, 19 nt, Homo sapiens
aaagaaacgccuaguacaa

SEQ ID NO: 951054 - RNA, 19 nt, Homo sapiens
ggcuagagauuuacuacau

SEQ ID NO: 951055 - RNA, 19 nt, Homo sapiens
ccagguugcuacaagauca

SEQ ID NO: 951056 - RNA, 19 nt, Homo sapiens
cacagaaggguguucauuu

SEQ ID NO: 951057 - RNA, 19 nt, Homo sapiens
gcucagacagugguucuuu

SEQ ID NO: 951058 - RNA, 19 nt, Homo sapiens
gcuagagauuuacuacauc

SEQ ID NO: 951059 - RNA, 19 nt, Homo sapiens
caacacuaaugauucaaac

SEQ ID NO: 951060 - RNA, 19 nt, Homo sapiens
aagaaacgccuaguacaaa

SEQ ID NO: 951061 - RNA, 19 nt, Homo sapiens
auacagcaguaaucuccua

SEQ ID NO: 951062 - RNA, 19 nt, Homo sapiens
gaaaggccagacucacaga

SEQ ID NO: 951063 - RNA, 19 nt, Homo sapiens
uacaagaucaccacgguuu

SEQ ID NO: 951064 - RNA, 19 nt, Homo sapiens
ggaggaaaggccagacuca

SEQ ID NO: 951065 - RNA, 19 nt, Homo sapiens
gauguaaaauguccagguu

SEQ ID NO: 951066 - RNA, 19 nt, Homo sapiens
ccaaauucuuacuuuaugg

SEQ ID NO: 951067 - RNA, 19 nt, Homo sapiens
gguguucauuuagaagaaa

SEQ ID NO: 951068 - RNA, 19 nt, Homo sapiens
aagaaagcaacacuaauga

SEQ ID NO: 951069 - RNA, 19 nt, Homo sapiens
ggguguucauuuagaagaa

SEQ ID NO: 951070 - RNA, 19 nt, Homo sapiens
ucacagaaggguguucauu

SEQ ID NO: 951071 - RNA, 19 nt, Homo sapiens
agaaacgccuaguacaaag

SEQ ID NO: 951072 - RNA, 19 nt, Homo sapiens
aaagcaacacuaaugauuc

SEQ ID NO: 951073 - RNA, 19 nt, Homo sapiens
gaaacgccuaguacaaagu

SEQ ID NO: 951074 - RNA, 19 nt, Homo sapiens
cuaguacaaaguccaaauu

SEQ ID NO: 951075 - RNA, 19 nt, Homo sapiens
uaagguauacagcaguaau

SEQ ID NO: 951076 - RNA, 19 nt, Homo sapiens
ucacagaaagccuuaucau

SEQ ID NO: 951077 - RNA, 19 nt, Homo sapiens
cagaaggguguucauuuag

SEQ ID NO: 951078 - RNA, 19 nt, Homo sapiens
uuagaagaaagcaacacua

SEQ ID NO: 951079 - RNA, 19 nt, Homo sapiens
agaagaaagcaacacuaau

SEQ ID NO: 951080 - RNA, 19 nt, Homo sapiens
uguccagguugcuacaaga

SEQ ID NO: 951081 - RNA, 19 nt, Homo sapiens
ucagacagugguucuuugu

SEQ ID NO: 951082 - RNA, 19 nt, Homo sapiens
aguacaaaguccaaauucu

SEQ ID NO: 951083 - RNA, 19 nt, Homo sapiens
agaaagcaacacuaaugau

SEQ ID NO: 951084 - RNA, 19 nt, Homo sapiens
uuucagccaugcucagaca

SEQ ID NO: 951085 - RNA, 19 nt, Homo sapiens
ucacagaaguucacuauug

SEQ ID NO: 951086 - RNA, 19 nt, Homo sapiens
ccagggagcuccuugcuaa

SEQ ID NO: 951087 - RNA, 19 nt, Homo sapiens
gcugagggcuuuaccacua

SEQ ID NO: 951088 - RNA, 19 nt, Homo sapiens
agaagaagcuguugcacuu

SEQ ID NO: 951089 - RNA, 19 nt, Homo sapiens
gagaaaaccucuuuaagga

SEQ ID NO: 951090 - RNA, 19 nt, Homo sapiens
uaauucagcuauacccauu

SEQ ID NO: 951091 - RNA, 19 nt, Homo sapiens
gcuauacccauuccuguaa

SEQ ID NO: 951092 - RNA, 19 nt, Homo sapiens
gauaagcgaguggacauuu

SEQ ID NO: 951093 - RNA, 19 nt, Homo sapiens
ggacuauccugagcgguau

SEQ ID NO: 951094 - RNA, 19 nt, Homo sapiens
ggucaaggaaugccacaaa

SEQ ID NO: 951095 - RNA, 19 nt, Homo sapiens
gcagaggacagauauucuu

SEQ ID NO: 951096 - RNA, 19 nt, Homo sapiens
ccacaggcccuucccagaa

SEQ ID NO: 951097 - RNA, 19 nt, Homo sapiens
ucaagguccuccgauguuu

SEQ ID NO: 951098 - RNA, 19 nt, Homo sapiens
cuggagaccuuuagugaau

SEQ ID NO: 951099 - RNA, 19 nt, Homo sapiens
aaaaccagcuuaucaucua

SEQ ID NO: 951100 - RNA, 19 nt, Homo sapiens
cagcagcgccagaccauug

SEQ ID NO: 951101 - RNA, 19 nt, Homo sapiens
cauuucaacccuuuacuaa

SEQ ID NO: 951102 - RNA, 19 nt, Homo sapiens
guggacauuucaacccuuu

SEQ ID NO: 951103 - RNA, 19 nt, Homo sapiens
cagaaguucacuauuggua

SEQ ID NO: 951104 - RNA, 19 nt, Homo sapiens
gcuccuugcuaaagccaaa

SEQ ID NO: 951105 - RNA, 19 nt, Homo sapiens
ggacaucaagguucaaggu

SEQ ID NO: 951106 - RNA, 19 nt, Homo sapiens
cagauauucuucccaccuu

SEQ ID NO: 951107 - RNA, 19 nt, Homo sapiens
gggcagaggacagauauuc

SEQ ID NO: 951108 - RNA, 19 nt, Homo sapiens
uggagagacugcccagcua

SEQ ID NO: 951109 - RNA, 19 nt, Homo sapiens
gagaugcccuccccaguug

SEQ ID NO: 951110 - RNA, 19 nt, Homo sapiens
cacagaaguucacuauugg

SEQ ID NO: 951111 - RNA, 19 nt, Homo sapiens
gucaaggaaugccacaaau

SEQ ID NO: 951112 - RNA, 19 nt, Homo sapiens
uggcauguccuuccagaaa

SEQ ID NO: 951113 - RNA, 19 nt, Homo sapiens
gagccugccauucacguuu

SEQ ID NO: 951114 - RNA, 19 nt, Homo sapiens
uguuugaguuugugucuga

SEQ ID NO: 951115 - RNA, 19 nt, Homo sapiens
caaggaaugccacaaaugc

SEQ ID NO: 951116 - RNA, 19 nt, Homo sapiens
ggagaaaaccucuuuaagg

SEQ ID NO: 951117 - RNA, 19 nt, Homo sapiens
gauauucuucccaccuuug

SEQ ID NO: 951118 - RNA, 19 nt, Homo sapiens
ggaagacaccaggaaguuc

SEQ ID NO: 951119 - RNA, 19 nt, Homo sapiens
ggagagacugcccagcuau

SEQ ID NO: 951120 - RNA, 19 nt, Homo sapiens
ucagcuuuguggacucuaa

SEQ ID NO: 951121 - RNA, 19 nt, Homo sapiens
cagcuuaucaucuaucaag

SEQ ID NO: 951122 - RNA, 19 nt, Homo sapiens
cagcuccucugguggaauc

SEQ ID NO: 951123 - RNA, 19 nt, Homo sapiens
aaaccagcuuaucaucuau

SEQ ID NO: 951124 - RNA, 19 nt, Homo sapiens
gcuguaccaucgugugaca

SEQ ID NO: 951125 - RNA, 19 nt, Homo sapiens
aggcgaagaugcagcacuu

SEQ ID NO: 951126 - RNA, 19 nt, Homo sapiens
acucgucacuggucaagga

SEQ ID NO: 951127 - RNA, 19 nt, Homo sapiens
gguaccaaggaaagacuua

SEQ ID NO: 951128 - RNA, 19 nt, Homo sapiens
ccucacagaaguucacuau

SEQ ID NO: 951129 - RNA, 19 nt, Homo sapiens
ugacucauauguuuaaccu

SEQ ID NO: 951130 - RNA, 19 nt, Homo sapiens
gccaagcagucccggagau

SEQ ID NO: 951131 - RNA, 19 nt, Homo sapiens
ucaaggaaugccacaaaug

SEQ ID NO: 951132 - RNA, 19 nt, Homo sapiens
ggacauuucaacccuuuac

SEQ ID NO: 951133 - RNA, 19 nt, Homo sapiens
cuauacccauuccuguaaa

SEQ ID NO: 951134 - RNA, 19 nt, Homo sapiens
ggaagauggccgacacucu

SEQ ID NO: 951135 - RNA, 19 nt, Homo sapiens
ucagggagagggaacaaga

SEQ ID NO: 951136 - RNA, 19 nt, Homo sapiens
gcuaaagccaaaggagaaa

SEQ ID NO: 951137 - RNA, 19 nt, Homo sapiens
cgucacuggucaaggaaug

SEQ ID NO: 951138 - RNA, 19 nt, Homo sapiens
gcucugggacaucaagguu

SEQ ID NO: 951139 - RNA, 19 nt, Homo sapiens
gagagacugcccagcuaug

SEQ ID NO: 951140 - RNA, 19 nt, Homo sapiens
guucacuguuggcugcauu

SEQ ID NO: 951141 - RNA, 19 nt, Homo sapiens
gucaucauguggaagaaca

SEQ ID NO: 951142 - RNA, 19 nt, Homo sapiens
cauccagcuugucaucaug

SEQ ID NO: 951143 - RNA, 19 nt, Homo sapiens
ucauccagcuugucaucau

SEQ ID NO: 951144 - RNA, 19 nt, Homo sapiens
gggagaagaagcuguugca

SEQ ID NO: 951145 - RNA, 19 nt, Homo sapiens
gauggccgacacucucuga

SEQ ID NO: 951146 - RNA, 19 nt, Homo sapiens
uguaccaucgugugacaua

SEQ ID NO: 951147 - RNA, 19 nt, Homo sapiens
agauauucuucccaccuuu

SEQ ID NO: 951148 - RNA, 19 nt, Homo sapiens
guucaagguccuccgaugu

SEQ ID NO: 951149 - RNA, 19 nt, Homo sapiens
ucugggacaucaagguuca

SEQ ID NO: 951150 - RNA, 19 nt, Homo sapiens
acauuucaacccuuuacua

SEQ ID NO: 951151 - RNA, 19 nt, Homo sapiens
ggauaagcgaguggacauu

SEQ ID NO: 951152 - RNA, 19 nt, Homo sapiens
auaagcgaguggacauuuc

SEQ ID NO: 951153 - RNA, 19 nt, Homo sapiens
cgguauugcuguggcugua

SEQ ID NO: 951154 - RNA, 19 nt, Homo sapiens
gccagaccauugagcugau

SEQ ID NO: 951155 - RNA, 19 nt, Homo sapiens
uaagcgaguggacauuuca

SEQ ID NO: 951156 - RNA, 19 nt, Homo sapiens
ggagaccuuuagugaaucc

SEQ ID NO: 951157 - RNA, 19 nt, Homo sapiens
cagaggacagauauucuuc

SEQ ID NO: 951158 - RNA, 19 nt, Homo sapiens
cauacaaacccuggcaugu

SEQ ID NO: 951159 - RNA, 19 nt, Homo sapiens
guaccaucgugugacauag

SEQ ID NO: 951160 - RNA, 19 nt, Homo sapiens
gaacuuagaccuuugcuua

SEQ ID NO: 951161 - RNA, 19 nt, Homo sapiens
caaauaaacuuacccauca

SEQ ID NO: 951162 - RNA, 19 nt, Homo sapiens
gauaagacaucuccauuug

SEQ ID NO: 951163 - RNA, 19 nt, Homo sapiens
guacaaagcuugauuacca

SEQ ID NO: 951164 - RNA, 19 nt, Homo sapiens
gaguguaccuuaauuacua

SEQ ID NO: 951165 - RNA, 19 nt, Homo sapiens
gaacaaguguccuagauac

SEQ ID NO: 951166 - RNA, 19 nt, Homo sapiens
gaagauguauuuggaauca

SEQ ID NO: 951167 - RNA, 19 nt, Homo sapiens
uaagacaucuccauuugaa

SEQ ID NO: 951168 - RNA, 19 nt, Homo sapiens
gagcaaagcugggaaaguc

SEQ ID NO: 951169 - RNA, 19 nt, Homo sapiens
ggaaucaccguuacucuaa

SEQ ID NO: 951170 - RNA, 19 nt, Homo sapiens
uaacaaauccugagagugu

SEQ ID NO: 951171 - RNA, 19 nt, Homo sapiens
cagcauaaaucaccaacaa

SEQ ID NO: 951172 - RNA, 19 nt, Homo sapiens
gagaagauguauuuggaau

SEQ ID NO: 951173 - RNA, 19 nt, Homo sapiens
gaauggacuuuccuuacuu

SEQ ID NO: 951174 - RNA, 19 nt, Homo sapiens
ggacuaggacucaguguga

SEQ ID NO: 951175 - RNA, 19 nt, Homo sapiens
caaguugacuggagaagau

SEQ ID NO: 951176 - RNA, 19 nt, Homo sapiens
ggaacaaguguccuagaua

SEQ ID NO: 951177 - RNA, 19 nt, Homo sapiens
ggacuuuccuuacuuaaaa

SEQ ID NO: 951178 - RNA, 19 nt, Homo sapiens
gaacugaccaucauuacca

SEQ ID NO: 951179 - RNA, 19 nt, Homo sapiens
aaagguaccugaagcuguu

SEQ ID NO: 951180 - RNA, 19 nt, Homo sapiens
gauguacaaagcuugauua

SEQ ID NO: 951181 - RNA, 19 nt, Homo sapiens
gagcuuggccgaguucuuu

SEQ ID NO: 951182 - RNA, 19 nt, Homo sapiens
caagaauggacuuuccuua

SEQ ID NO: 951183 - RNA, 19 nt, Homo sapiens
guacacaagcccuuuauca

SEQ ID NO: 951184 - RNA, 19 nt, Homo sapiens
ucccagagauugaucauau

SEQ ID NO: 951185 - RNA, 19 nt, Homo sapiens
ggaaauuuaggucaucauu

SEQ ID NO: 951186 - RNA, 19 nt, Homo sapiens
cuaaaucucucaguauugu

SEQ ID NO: 951187 - RNA, 19 nt, Homo sapiens
ugacuucuauuaccucuuc

SEQ ID NO: 951188 - RNA, 19 nt, Homo sapiens
uaaaauggcuucaguugug

SEQ ID NO: 951189 - RNA, 19 nt, Homo sapiens
gaaggcggagucagcauaa

SEQ ID NO: 951190 - RNA, 19 nt, Homo sapiens
uagagaguguaccuuaauu

SEQ ID NO: 951191 - RNA, 19 nt, Homo sapiens
gcauaaaucaccaacaagu

SEQ ID NO: 951192 - RNA, 19 nt, Homo sapiens
uggagaagauguauuugga

SEQ ID NO: 951193 - RNA, 19 nt, Homo sapiens
gcuaaucaccagcagcuuu

SEQ ID NO: 951194 - RNA, 19 nt, Homo sapiens
gaaaaguccuucugguugu

SEQ ID NO: 951195 - RNA, 19 nt, Homo sapiens
aauggacuuuccuuacuua

SEQ ID NO: 951196 - RNA, 19 nt, Homo sapiens
ggacaacauauucucaaga

SEQ ID NO: 951197 - RNA, 19 nt, Homo sapiens
cauaaaucaccaacaagua

SEQ ID NO: 951198 - RNA, 19 nt, Homo sapiens
gacuggagaagauguauuu

SEQ ID NO: 951199 - RNA, 19 nt, Homo sapiens
agacaucuccauuugaauu

SEQ ID NO: 951200 - RNA, 19 nt, Homo sapiens
gcaacgcuguuuggcuaaa

SEQ ID NO: 951201 - RNA, 19 nt, Homo sapiens
guauuuggaaucaccguua

SEQ ID NO: 951202 - RNA, 19 nt, Homo sapiens
caucuccauuugaauugua

SEQ ID NO: 951203 - RNA, 19 nt, Homo sapiens
gaaucaccguuacucuaau

SEQ ID NO: 951204 - RNA, 19 nt, Homo sapiens
uacccuaaaucucucagua

SEQ ID NO: 951205 - RNA, 19 nt, Homo sapiens
gagguaguguaaggaauug

SEQ ID NO: 951206 - RNA, 19 nt, Homo sapiens
guuuaaagaagcuccauuu

SEQ ID NO: 951207 - RNA, 19 nt, Homo sapiens
uaagggaaauuuaggucau

SEQ ID NO: 951208 - RNA, 19 nt, Homo sapiens
guaccuuaauuacuacugu

SEQ ID NO: 951209 - RNA, 19 nt, Homo sapiens
cccuaaaucucucaguauu

SEQ ID NO: 951210 - RNA, 19 nt, Homo sapiens
ggacgagaaggauuggauu

SEQ ID NO: 951211 - RNA, 19 nt, Homo sapiens
gaucaacuaggcaacauca

SEQ ID NO: 951212 - RNA, 19 nt, Homo sapiens
gcuaaaagguguacacaag

SEQ ID NO: 951213 - RNA, 19 nt, Homo sapiens
agagaguguaccuuaauua

SEQ ID NO: 951214 - RNA, 19 nt, Homo sapiens
cuccagaacuuagaccuuu

SEQ ID NO: 951215 - RNA, 19 nt, Homo sapiens
cacuggaggucaugucuga

SEQ ID NO: 951216 - RNA, 19 nt, Homo sapiens
aaucaccguuacucuaauu

SEQ ID NO: 951217 - RNA, 19 nt, Homo sapiens
ggagaagauguauuuggaa

SEQ ID NO: 951218 - RNA, 19 nt, Homo sapiens
ucaugugggucaucuacuu

SEQ ID NO: 951219 - RNA, 19 nt, Homo sapiens
gaaacgacuggcagcagaa

SEQ ID NO: 951220 - RNA, 19 nt, Homo sapiens
ccaggccuaugacuucuau

SEQ ID NO: 951221 - RNA, 19 nt, Homo sapiens
uuucaggguuaaucucuuu

SEQ ID NO: 951222 - RNA, 19 nt, Homo sapiens
agaauggacuuuccuuacu

SEQ ID NO: 951223 - RNA, 19 nt, Homo sapiens
aggauuggauucugcuaaa

SEQ ID NO: 951224 - RNA, 19 nt, Homo sapiens
gcagcugcaugucaaagag

SEQ ID NO: 951225 - RNA, 19 nt, Homo sapiens
ucacugugcuggacaacuc

SEQ ID NO: 951226 - RNA, 19 nt, Homo sapiens
aaagcuugauuaccauaga

SEQ ID NO: 951227 - RNA, 19 nt, Homo sapiens
aggauucaguggaaaggua

SEQ ID NO: 951228 - RNA, 19 nt, Homo sapiens
gagaguguuuuaauuguug

SEQ ID NO: 951229 - RNA, 19 nt, Homo sapiens
uggaacaaguguccuagau

SEQ ID NO: 951230 - RNA, 19 nt, Homo sapiens
caugucugaucaggaguua

SEQ ID NO: 951231 - RNA, 19 nt, Homo sapiens
acacaagcccuuuaucaca

SEQ ID NO: 951232 - RNA, 19 nt, Homo sapiens
cagcagaaguaacaaagcu

SEQ ID NO: 951233 - RNA, 19 nt, Homo sapiens
ucagacaacccgaggauuc

SEQ ID NO: 951234 - RNA, 19 nt, Homo sapiens
gcuccaggccuaugacuuc

SEQ ID NO: 951235 - RNA, 19 nt, Homo sapiens
gcaugagcuuggccgaguu

SEQ ID NO: 951236 - RNA, 19 nt, Homo sapiens
gagaguguaccuuaauuac

SEQ ID NO: 951237 - RNA, 19 nt, Homo sapiens
guagugaugaggaacaaug

SEQ ID NO: 951238 - RNA, 19 nt, Homo sapiens
uuuagagaguguaccuuaa

SEQ ID NO: 951239 - RNA, 19 nt, Homo sapiens
gugaugaggaacaaugaaa

SEQ ID NO: 951240 - RNA, 19 nt, Homo sapiens
ccuucugguuguccaaaua

SEQ ID NO: 951241 - RNA, 19 nt, Homo sapiens
ugucugaucaggaguuaaa

SEQ ID NO: 951242 - RNA, 19 nt, Homo sapiens
aaggaacugaccaucauua

SEQ ID NO: 951243 - RNA, 19 nt, Homo sapiens
augcugcuuuccuaucuua

SEQ ID NO: 951244 - RNA, 19 nt, Homo sapiens
caaguaacaaauccugaga

SEQ ID NO: 951245 - RNA, 19 nt, Homo sapiens
gaucaggaguuaaaagagu

SEQ ID NO: 951246 - RNA, 19 nt, Homo sapiens
gguguacacaagcccuuua

SEQ ID NO: 951247 - RNA, 19 nt, Homo sapiens
aaacuuacccaucauucau

SEQ ID NO: 951248 - RNA, 19 nt, Homo sapiens
uaaacuuacccaucauuca

SEQ ID NO: 951249 - RNA, 19 nt, Homo sapiens
cuuuagagaguguaccuua

SEQ ID NO: 951250 - RNA, 19 nt, Homo sapiens
gugcuccacuuuagagagu

SEQ ID NO: 951251 - RNA, 19 nt, Homo sapiens
aggguuggcuccagaacuu

SEQ ID NO: 951252 - RNA, 19 nt, Homo sapiens
gaagcuccauuuucugaau

SEQ ID NO: 951253 - RNA, 19 nt, Homo sapiens
aggccuaugacuucuauua

SEQ ID NO: 951254 - RNA, 19 nt, Homo sapiens
agaaggcggagucagcaua

SEQ ID NO: 951255 - RNA, 19 nt, Homo sapiens
caccguuacucuaauuaca

SEQ ID NO: 951256 - RNA, 19 nt, Homo sapiens
ucaacuaggcaacaucaug

SEQ ID NO: 951257 - RNA, 19 nt, Homo sapiens
gaccaucauuaccaagucu

SEQ ID NO: 951258 - RNA, 19 nt, Homo sapiens
aaagagguaguguaaggaa

SEQ ID NO: 951259 - RNA, 19 nt, Homo sapiens
aaaugcugcuuuccuaucu

SEQ ID NO: 951260 - RNA, 19 nt, Homo sapiens
gcacaaagccugggaaaua

SEQ ID NO: 951261 - RNA, 19 nt, Homo sapiens
gaaauuaggguucaguuua

SEQ ID NO: 951262 - RNA, 19 nt, Homo sapiens
gaagacaucugaaaugaau

SEQ ID NO: 951263 - RNA, 19 nt, Homo sapiens
ugaaagagcuugcaagaga

SEQ ID NO: 951264 - RNA, 19 nt, Homo sapiens
gaaggagcaccucgaauua

SEQ ID NO: 951265 - RNA, 19 nt, Homo sapiens
gaaaggcaauaccaagauu

SEQ ID NO: 951266 - RNA, 19 nt, Homo sapiens
gaaagauuauggagaaugu

SEQ ID NO: 951267 - RNA, 19 nt, Homo sapiens
ggacagaguuaccuuaagu

SEQ ID NO: 951268 - RNA, 19 nt, Homo sapiens
gcaugaagauaauggcuaa

SEQ ID NO: 951269 - RNA, 19 nt, Homo sapiens
ccagggaacuucuugcuuu

SEQ ID NO: 951270 - RNA, 19 nt, Homo sapiens
caucaaugcugacauaaug

SEQ ID NO: 951271 - RNA, 19 nt, Homo sapiens
ccaaacagcuagaggaguu

SEQ ID NO: 951272 - RNA, 19 nt, Homo sapiens
gaacagaucaccauuaaaa

SEQ ID NO: 951273 - RNA, 19 nt, Homo sapiens
cguagaaacuggaaauuga

SEQ ID NO: 951274 - RNA, 19 nt, Homo sapiens
ugaagaaggugcaucaaug

SEQ ID NO: 951275 - RNA, 19 nt, Homo sapiens
agaaagaggugaugaaugg

SEQ ID NO: 951276 - RNA, 19 nt, Homo sapiens
caaacaaugucaaagguau

SEQ ID NO: 951277 - RNA, 19 nt, Homo sapiens
cagcauaguccaagauaua

SEQ ID NO: 951278 - RNA, 19 nt, Homo sapiens
acagaacgauggaguauau

SEQ ID NO: 951279 - RNA, 19 nt, Homo sapiens
ugaaagaccauaugaagaa

SEQ ID NO: 951280 - RNA, 19 nt, Homo sapiens
ugaagaagaugaggcaauu

SEQ ID NO: 951281 - RNA, 19 nt, Homo sapiens
gaauuagucuggcugagau

SEQ ID NO: 951282 - RNA, 19 nt, Homo sapiens
gauacagugugcuuuagaa

SEQ ID NO: 951283 - RNA, 19 nt, Homo sapiens
gaauccagcaugaagauaa

SEQ ID NO: 951284 - RNA, 19 nt, Homo sapiens
gcaaauagagacucguuau

SEQ ID NO: 951285 - RNA, 19 nt, Homo sapiens
ggauacagaugaugaaagg

SEQ ID NO: 951286 - RNA, 19 nt, Homo sapiens
gaugugguauuaaucaaga

SEQ ID NO: 951287 - RNA, 19 nt, Homo sapiens
caagauauccauaguaaca

SEQ ID NO: 951288 - RNA, 19 nt, Homo sapiens
aguaagagcuaauucauuc

SEQ ID NO: 951289 - RNA, 19 nt, Homo sapiens
aaggaaagauuauggagaa

SEQ ID NO: 951290 - RNA, 19 nt, Homo sapiens
guuguagacuguuuccaua

SEQ ID NO: 951291 - RNA, 19 nt, Homo sapiens
uacaugggcuuaagaaguu

SEQ ID NO: 951292 - RNA, 19 nt, Homo sapiens
ggaaggcugugauucaagu

SEQ ID NO: 951293 - RNA, 19 nt, Homo sapiens
gaguagaagcuaaggauuu

SEQ ID NO: 951294 - RNA, 19 nt, Homo sapiens
gcuuguagaugcaggcuuu

SEQ ID NO: 951295 - RNA, 19 nt, Homo sapiens
gcaguaggaggaaauauau

SEQ ID NO: 951296 - RNA, 19 nt, Homo sapiens
gaaccagauuugugugugu

SEQ ID NO: 951297 - RNA, 19 nt, Homo sapiens
gcaaacaaugucaaaggua

SEQ ID NO: 951298 - RNA, 19 nt, Homo sapiens
gaaguaaaguggacaucag

SEQ ID NO: 951299 - RNA, 19 nt, Homo sapiens
uugaacagaucaccauuaa

SEQ ID NO: 951300 - RNA, 19 nt, Homo sapiens
ggaaauuaggguucaguuu

SEQ ID NO: 951301 - RNA, 19 nt, Homo sapiens
cuagaggaguuuauuguga

SEQ ID NO: 951302 - RNA, 19 nt, Homo sapiens
guuccaauaugcaaggaua

SEQ ID NO: 951303 - RNA, 19 nt, Homo sapiens
ggacaucagccaagguauu

SEQ ID NO: 951304 - RNA, 19 nt, Homo sapiens
auaaagagauugagcaagu

SEQ ID NO: 951305 - RNA, 19 nt, Homo sapiens
gagauguuguagacuguuu

SEQ ID NO: 951306 - RNA, 19 nt, Homo sapiens
ggagucacccuuucaauag

SEQ ID NO: 951307 - RNA, 19 nt, Homo sapiens
cucaagauauccauaguaa

SEQ ID NO: 951308 - RNA, 19 nt, Homo sapiens
auacaaagcaucacaaaga

SEQ ID NO: 951309 - RNA, 19 nt, Homo sapiens
gcaaguaagagcuaauuca

SEQ ID NO: 951310 - RNA, 19 nt, Homo sapiens
cacuaaaucuucaagcaaa

SEQ ID NO: 951311 - RNA, 19 nt, Homo sapiens
ugaaggagcaccucgaauu

SEQ ID NO: 951312 - RNA, 19 nt, Homo sapiens
ugacaccgaugaugaagga

SEQ ID NO: 951313 - RNA, 19 nt, Homo sapiens
cacaaagacugaucucuca

SEQ ID NO: 951314 - RNA, 19 nt, Homo sapiens
gaagaugaggcaauucgaa

SEQ ID NO: 951315 - RNA, 19 nt, Homo sapiens
aaacauggauacagaugau

SEQ ID NO: 951316 - RNA, 19 nt, Homo sapiens
gagaaaacauggauacaga

SEQ ID NO: 951317 - RNA, 19 nt, Homo sapiens
gaaacuggaaauugaaaga

SEQ ID NO: 951318 - RNA, 19 nt, Homo sapiens
gugcuggaaugauaucaaa

SEQ ID NO: 951319 - RNA, 19 nt, Homo sapiens
gaauggugcuauccuucaa

SEQ ID NO: 951320 - RNA, 19 nt, Homo sapiens
gaaggaauuuucucucuau

SEQ ID NO: 951321 - RNA, 19 nt, Homo sapiens
gauccacuuuacaucauuu

SEQ ID NO: 951322 - RNA, 19 nt, Homo sapiens
gaacguucacuaaaucuuc

SEQ ID NO: 951323 - RNA, 19 nt, Homo sapiens
guccaaauccugccaauau

SEQ ID NO: 951324 - RNA, 19 nt, Homo sapiens
ggucgaauuucuucagugu

SEQ ID NO: 951325 - RNA, 19 nt, Homo sapiens
gaugaauggugcuauccuu

SEQ ID NO: 951326 - RNA, 19 nt, Homo sapiens
gauccaauuucuauaagca

SEQ ID NO: 951327 - RNA, 19 nt, Homo sapiens
cacaaagccugggaaauau

SEQ ID NO: 951328 - RNA, 19 nt, Homo sapiens
uauaugaggcacuguagua

SEQ ID NO: 951329 - RNA, 19 nt, Homo sapiens
uuaagugucucuacuaucu

SEQ ID NO: 951330 - RNA, 19 nt, Homo sapiens
aaacaagucucgauuucgu

SEQ ID NO: 951331 - RNA, 19 nt, Homo sapiens
gaaagaccauaugaagaag

SEQ ID NO: 951332 - RNA, 19 nt, Homo sapiens
guauaguacucuggaugua

SEQ ID NO: 951333 - RNA, 19 nt, Homo sapiens
uggcugagaugcuugaaga

SEQ ID NO: 951334 - RNA, 19 nt, Homo sapiens
augaggcacuguaguauuu

SEQ ID NO: 951335 - RNA, 19 nt, Homo sapiens
gagaauguaguuguuauug

SEQ ID NO: 951336 - RNA, 19 nt, Homo sapiens
agaguuaccuuaagugucu

SEQ ID NO: 951337 - RNA, 19 nt, Homo sapiens
uuaaguaugccgcaaguaa

SEQ ID NO: 951338 - RNA, 19 nt, Homo sapiens
ugagugugguguuccgaua

SEQ ID NO: 951339 - RNA, 19 nt, Homo sapiens
ggccaacuguaacuuaaau

SEQ ID NO: 951340 - RNA, 19 nt, Homo sapiens
guagaugcaggcuuuguuu

SEQ ID NO: 951341 - RNA, 19 nt, Homo sapiens
gccaagguauuccgaaaca

SEQ ID NO: 951342 - RNA, 19 nt, Homo sapiens
gccacuaaauaaagagauu

SEQ ID NO: 951343 - RNA, 19 nt, Homo sapiens
gaaagugacaccgaugaug

SEQ ID NO: 951344 - RNA, 19 nt, Homo sapiens
ucuacuaucuggaacaguu

SEQ ID NO: 951345 - RNA, 19 nt, Homo sapiens
guuuaucacuggacauuca

SEQ ID NO: 951346 - RNA, 19 nt, Homo sapiens
gcuuugagguuuuagauaa

SEQ ID NO: 951347 - RNA, 19 nt, Homo sapiens
gcagcauaguccaagauau

SEQ ID NO: 951348 - RNA, 19 nt, Homo sapiens
caaggauaauguugucugu

SEQ ID NO: 951349 - RNA, 19 nt, Homo sapiens
ggagauugccauagaguag

SEQ ID NO: 951350 - RNA, 19 nt, Homo sapiens
ccaaauguguggagauugc

SEQ ID NO: 951351 - RNA, 19 nt, Homo sapiens
uaaaacagauggauagcuu

SEQ ID NO: 951352 - RNA, 19 nt, Homo sapiens
cagccaagguauuccgaaa

SEQ ID NO: 951353 - RNA, 19 nt, Homo sapiens
cagauagaguuccagaugu

SEQ ID NO: 951354 - RNA, 19 nt, Homo sapiens
gguguuaggguuugauuug

SEQ ID NO: 951355 - RNA, 19 nt, Homo sapiens
ugcaggugcuggaaugaua

SEQ ID NO: 951356 - RNA, 19 nt, Homo sapiens
ccaugugugccacuaaaua

SEQ ID NO: 951357 - RNA, 19 nt, Homo sapiens
ggagaauguaguuguuauu

SEQ ID NO: 951358 - RNA, 19 nt, Homo sapiens
aaagugacaccgaugauga

SEQ ID NO: 951359 - RNA, 19 nt, Homo sapiens
aaagacugaucucucaaga

SEQ ID NO: 951360 - RNA, 19 nt, Homo sapiens
gauacaaucuugaacucua

SEQ ID NO: 951361 - RNA, 19 nt, Homo sapiens
caacguugaucauaacaaa

SEQ ID NO: 951362 - RNA, 19 nt, Homo sapiens
ggaagagucguaccaagua

SEQ ID NO: 951363 - RNA, 19 nt, Homo sapiens
ugauaucccuguacucuaa

SEQ ID NO: 951364 - RNA, 19 nt, Homo sapiens
caacagcccucugccuuga

SEQ ID NO: 951365 - RNA, 19 nt, Homo sapiens
uauccaacguugaucauaa

SEQ ID NO: 951366 - RNA, 19 nt, Homo sapiens
gcaacguuaucgaaugauu

SEQ ID NO: 951367 - RNA, 19 nt, Homo sapiens
ucaacaacguggaaaguga

SEQ ID NO: 951368 - RNA, 19 nt, Homo sapiens
caagcaacguuaucgaaug

SEQ ID NO: 951369 - RNA, 19 nt, Homo sapiens
gaacaauggccuccuccaa

SEQ ID NO: 951370 - RNA, 19 nt, Homo sapiens
ggagaagguuauccaaguc

SEQ ID NO: 951371 - RNA, 19 nt, Homo sapiens
cuugaacucuaaccacaua

SEQ ID NO: 951372 - RNA, 19 nt, Homo sapiens
aagcaacguuaucgaauga

SEQ ID NO: 951373 - RNA, 19 nt, Homo sapiens
caaagcugauaucccugua

SEQ ID NO: 951374 - RNA, 19 nt, Homo sapiens
uuacuucuguggcccuuaa

SEQ ID NO: 951375 - RNA, 19 nt, Homo sapiens
gcccaguucuuacuucugu

SEQ ID NO: 951376 - RNA, 19 nt, Homo sapiens
gaccaagucaggacccuuu

SEQ ID NO: 951377 - RNA, 19 nt, Homo sapiens
ugauugacuuucugcguuu

SEQ ID NO: 951378 - RNA, 19 nt, Homo sapiens
uuauccagcugcccucuaa

SEQ ID NO: 951379 - RNA, 19 nt, Homo sapiens
gaauccgggugcaugguau

SEQ ID NO: 951380 - RNA, 19 nt, Homo sapiens
acaauggccuccuccaaca

SEQ ID NO: 951381 - RNA, 19 nt, Homo sapiens
agacauagcucugguugcu

SEQ ID NO: 951382 - RNA, 19 nt, Homo sapiens
guaagggugucgugcugau

SEQ ID NO: 951383 - RNA, 19 nt, Homo sapiens
caugaagaguuacgugaag

SEQ ID NO: 951384 - RNA, 19 nt, Homo sapiens
ggaaacgugcguagcaaca

SEQ ID NO: 951385 - RNA, 19 nt, Homo sapiens
aggagaagguuauccaagu

SEQ ID NO: 951386 - RNA, 19 nt, Homo sapiens
caacguuaucgaaugauug

SEQ ID NO: 951387 - RNA, 19 nt, Homo sapiens
caugcaggcuggagauaca

SEQ ID NO: 951388 - RNA, 19 nt, Homo sapiens
ccaacuuuguguccuggaa

SEQ ID NO: 951389 - RNA, 19 nt, Homo sapiens
gcaacaguaggccgaguau

SEQ ID NO: 951390 - RNA, 19 nt, Homo sapiens
guuaucgaaugauugacuu

SEQ ID NO: 951391 - RNA, 19 nt, Homo sapiens
ccgcccagaugaugaacaa

SEQ ID NO: 951392 - RNA, 19 nt, Homo sapiens
ggcccuuaaugccaacuuu

SEQ ID NO: 951393 - RNA, 19 nt, Homo sapiens
gcccagaugaugaacaaug

SEQ ID NO: 951394 - RNA, 19 nt, Homo sapiens
cgaauccgggugcauggua

SEQ ID NO: 951395 - RNA, 19 nt, Homo sapiens
cauaacaaacgggucauug

SEQ ID NO: 951396 - RNA, 19 nt, Homo sapiens
aaacgugcguagcaacagu

SEQ ID NO: 951397 - RNA, 19 nt, Homo sapiens
gcugauaucccuguacucu

SEQ ID NO: 951398 - RNA, 19 nt, Homo sapiens
cacaagcaacguuaucgaa

SEQ ID NO: 951399 - RNA, 19 nt, Homo sapiens
gcuggaucaucgccacaga

SEQ ID NO: 951400 - RNA, 19 nt, Homo sapiens
ccaugaagaguuacgugaa

SEQ ID NO: 951401 - RNA, 19 nt, Homo sapiens
cagugaagaugaggaaguc

SEQ ID NO: 951402 - RNA, 19 nt, Homo sapiens
guauccaacguugaucaua

SEQ ID NO: 951403 - RNA, 19 nt, Homo sapiens
gaguauccaacguugauca

SEQ ID NO: 951404 - RNA, 19 nt, Homo sapiens
gcuggaaacgugcguagca

SEQ ID NO: 951405 - RNA, 19 nt, Homo sapiens
gcagaugcaggugcuggaa

SEQ ID NO: 951406 - RNA, 19 nt, Homo sapiens
caggacccuuugaggagaa

SEQ ID NO: 951407 - RNA, 19 nt, Homo sapiens
ccgagcagcuuggcuaaaa

SEQ ID NO: 951408 - RNA, 19 nt, Homo sapiens
ccaagucaggacccuuuga

SEQ ID NO: 951409 - RNA, 19 nt, Homo sapiens
acaagcaacguuaucgaau

SEQ ID NO: 951410 - RNA, 19 nt, Homo sapiens
ccacaagcaacguuaucga

SEQ ID NO: 951411 - RNA, 19 nt, Homo sapiens
aaacaugcaggcuggagau

SEQ ID NO: 951412 - RNA, 19 nt, Homo sapiens
uggaucaucgccacagaaa

SEQ ID NO: 951413 - RNA, 19 nt, Homo sapiens
cccagaugaugaacaaugg

SEQ ID NO: 951414 - RNA, 19 nt, Homo sapiens
ucgaaugauugacuuucug

SEQ ID NO: 951415 - RNA, 19 nt, Homo sapiens
uuacaccagugaagaugag

SEQ ID NO: 951416 - RNA, 19 nt, Homo sapiens
aagcugauaucccuguacu

SEQ ID NO: 951417 - RNA, 19 nt, Homo sapiens
caucaacaacguggaaagu

SEQ ID NO: 951418 - RNA, 19 nt, Homo sapiens
acagcccucugccuugaug

SEQ ID NO: 951419 - RNA, 19 nt, Homo sapiens
uggaagagucguaccaagu

SEQ ID NO: 951420 - RNA, 19 nt, Homo sapiens
ccagugaagaugaggaagu

SEQ ID NO: 951421 - RNA, 19 nt, Homo sapiens
ucaagugauugucccauuu

SEQ ID NO: 951422 - RNA, 19 nt, Homo sapiens
ccagauggcuaccuguaug

SEQ ID NO: 951423 - RNA, 19 nt, Homo sapiens
gaugaaggccuacgagaag

SEQ ID NO: 951424 - RNA, 19 nt, Homo sapiens
ggacuucgacugcuguugu

SEQ ID NO: 951425 - RNA, 19 nt, Homo sapiens
gugaggccauccuggagua

SEQ ID NO: 951426 - RNA, 19 nt, Homo sapiens
caaguaaggacaaggacaa

SEQ ID NO: 951427 - RNA, 19 nt, Homo sapiens
ccgaguagcugggauuaca

SEQ ID NO: 951428 - RNA, 19 nt, Homo sapiens
guaaggacaaggacaaagu

SEQ ID NO: 951429 - RNA, 19 nt, Homo sapiens
gggaugccgugaaggacuu

SEQ ID NO: 951430 - RNA, 19 nt, Homo sapiens
gagaaggagucggcuaucg

SEQ ID NO: 951431 - RNA, 19 nt, Homo sapiens
cauuucagccucccgagua

SEQ ID NO: 951432 - RNA, 19 nt, Homo sapiens
gugcaauggugcgaucuug

SEQ ID NO: 951433 - RNA, 19 nt, Homo sapiens
cagcccagaugauguccaa

SEQ ID NO: 951434 - RNA, 19 nt, Homo sapiens
gaugcaggccugagugugu

SEQ ID NO: 951435 - RNA, 19 nt, Homo sapiens
gcaccagcccagaugaugu

SEQ ID NO: 951436 - RNA, 19 nt, Homo sapiens
acaccuaccacgagaagaa

SEQ ID NO: 951437 - RNA, 19 nt, Homo sapiens
caagugauugucccauuuc

SEQ ID NO: 951438 - RNA, 19 nt, Homo sapiens
ucacagaccgcgacaucau

SEQ ID NO: 951439 - RNA, 19 nt, Homo sapiens
gggagucguuagugagagu

SEQ ID NO: 951440 - RNA, 19 nt, Homo sapiens
ggugcgaucuuggcucauc

SEQ ID NO: 951441 - RNA, 19 nt, Homo sapiens
ugccuaggcuggagugcaa

SEQ ID NO: 951442 - RNA, 19 nt, Homo sapiens
guguggguccuccaaguaa

SEQ ID NO: 951443 - RNA, 19 nt, Homo sapiens
gcugcaagcggagaaauca

SEQ ID NO: 951444 - RNA, 19 nt, Homo sapiens
agaugaaggccuacgagaa

SEQ ID NO: 951445 - RNA, 19 nt, Homo sapiens
cccugugacuggagacaaa

SEQ ID NO: 951446 - RNA, 19 nt, Homo sapiens
uaaggacaaggacaaagug

SEQ ID NO: 951447 - RNA, 19 nt, Homo sapiens
acccagaacauucgacuga

SEQ ID NO: 951448 - RNA, 19 nt, Homo sapiens
gaagcugcaagcggagaaa

SEQ ID NO: 951449 - RNA, 19 nt, Homo sapiens
cagauggcuaccuguauga

SEQ ID NO: 951450 - RNA, 19 nt, Homo sapiens
caguguggguccuccaagu

SEQ ID NO: 951451 - RNA, 19 nt, Homo sapiens
uucaagugauugucccauu

SEQ ID NO: 951452 - RNA, 19 nt, Homo sapiens
gugcgggagaccaaauaaa

SEQ ID NO: 951453 - RNA, 19 nt, Homo sapiens
uagaagaucugcacuauua

SEQ ID NO: 951454 - RNA, 19 nt, Homo sapiens
gaucugcacuauuaacuuu

SEQ ID NO: 951455 - RNA, 19 nt, Homo sapiens
gggaagcccuguaugauga

SEQ ID NO: 951456 - RNA, 19 nt, Homo sapiens
caaaggcucuguuauaaag

SEQ ID NO: 951457 - RNA, 19 nt, Homo sapiens
gaacuuggaacucuuacua

SEQ ID NO: 951458 - RNA, 19 nt, Homo sapiens
gaaaucgacgugguaauua

SEQ ID NO: 951459 - RNA, 19 nt, Homo sapiens
ccagaacucuuucgaauag

SEQ ID NO: 951460 - RNA, 19 nt, Homo sapiens
gcaccgagcucgaccuuag

SEQ ID NO: 951461 - RNA, 19 nt, Homo sapiens
gaagauggagcuacagaaa

SEQ ID NO: 951462 - RNA, 19 nt, Homo sapiens
gugaagaguuucuccuaaa

SEQ ID NO: 951463 - RNA, 19 nt, Homo sapiens
ugauacaucuuccaacauu

SEQ ID NO: 951464 - RNA, 19 nt, Homo sapiens
gcuguuaccuuuauagauc

SEQ ID NO: 951465 - RNA, 19 nt, Homo sapiens
gaacuuaauggaauggaaa

SEQ ID NO: 951466 - RNA, 19 nt, Homo sapiens
cuauaaagccaguaugaua

SEQ ID NO: 951467 - RNA, 19 nt, Homo sapiens
ggagaacuuggaacucuua

SEQ ID NO: 951468 - RNA, 19 nt, Homo sapiens
gcuuggcucucucuuguaa

SEQ ID NO: 951469 - RNA, 19 nt, Homo sapiens
gauaggcgcuuuuauuaau

SEQ ID NO: 951470 - RNA, 19 nt, Homo sapiens
aaaucgacgugguaauuaa

SEQ ID NO: 951471 - RNA, 19 nt, Homo sapiens
ggacagacucauuugaaga

SEQ ID NO: 951472 - RNA, 19 nt, Homo sapiens
uucaaaggcucuguuauaa

SEQ ID NO: 951473 - RNA, 19 nt, Homo sapiens
cuaccgaacuuaauggaau

SEQ ID NO: 951474 - RNA, 19 nt, Homo sapiens
uggaagauaugcagcuuau

SEQ ID NO: 951475 - RNA, 19 nt, Homo sapiens
ucaugugacuggaagauau

SEQ ID NO: 951476 - RNA, 19 nt, Homo sapiens
gcaaacucauccacaugug

SEQ ID NO: 951477 - RNA, 19 nt, Homo sapiens
uggcauuccucucuuuaaa

SEQ ID NO: 951478 - RNA, 19 nt, Homo sapiens
auuaagaccucuacuggaa

SEQ ID NO: 951479 - RNA, 19 nt, Homo sapiens
gauaaaggcauuacuacag

SEQ ID NO: 951480 - RNA, 19 nt, Homo sapiens
gcugaagccagaacucuuu

SEQ ID NO: 951481 - RNA, 19 nt, Homo sapiens
uuagagauuucuucuggaa

SEQ ID NO: 951482 - RNA, 19 nt, Homo sapiens
ucagaaugguaacagcuuu

SEQ ID NO: 951483 - RNA, 19 nt, Homo sapiens
aaugguagcuuugauaaca

SEQ ID NO: 951484 - RNA, 19 nt, Homo sapiens
guuaaugguagcuuugaua

SEQ ID NO: 951485 - RNA, 19 nt, Homo sapiens
gaucuuccaaugucuuaaa

SEQ ID NO: 951486 - RNA, 19 nt, Homo sapiens
cagauuggcuguggaagau

SEQ ID NO: 951487 - RNA, 19 nt, Homo sapiens
gauuagaagagaucagauu

SEQ ID NO: 951488 - RNA, 19 nt, Homo sapiens
caugauaaaggcauuacua

SEQ ID NO: 951489 - RNA, 19 nt, Homo sapiens
agauggagcuacagaaauc

SEQ ID NO: 951490 - RNA, 19 nt, Homo sapiens
auucaaaggcucuguuaua

SEQ ID NO: 951491 - RNA, 19 nt, Homo sapiens
uaacuggcauuccucucuu

SEQ ID NO: 951492 - RNA, 19 nt, Homo sapiens
agaggcagauuuaccauca

SEQ ID NO: 951493 - RNA, 19 nt, Homo sapiens
acauugagaggcagauuua

SEQ ID NO: 951494 - RNA, 19 nt, Homo sapiens
aggaggagcuuggagauga

SEQ ID NO: 951495 - RNA, 19 nt, Homo sapiens
cccgguagcuauaguaaug

SEQ ID NO: 951496 - RNA, 19 nt, Homo sapiens
uaauaucccuguggcauca

SEQ ID NO: 951497 - RNA, 19 nt, Homo sapiens
ugugaagaguuucuccuaa

SEQ ID NO: 951498 - RNA, 19 nt, Homo sapiens
gccagaacucuuucgaaua

SEQ ID NO: 951499 - RNA, 19 nt, Homo sapiens
agaaaucgacgugguaauu

SEQ ID NO: 951500 - RNA, 19 nt, Homo sapiens
gaacucuuacuaaugucua

SEQ ID NO: 951501 - RNA, 19 nt, Homo sapiens
gaucagauuggcuguggaa

SEQ ID NO: 951502 - RNA, 19 nt, Homo sapiens
gaagacacgauuagaagag

SEQ ID NO: 951503 - RNA, 19 nt, Homo sapiens
ucaaaggcucuguuauaaa

SEQ ID NO: 951504 - RNA, 19 nt, Homo sapiens
aaagcaaacucauccacau

SEQ ID NO: 951505 - RNA, 19 nt, Homo sapiens
uuggaacucuuacuaaugu

SEQ ID NO: 951506 - RNA, 19 nt, Homo sapiens
cagcuggacagacucauuu

SEQ ID NO: 951507 - RNA, 19 nt, Homo sapiens
cgaacuuaauggaauggaa

SEQ ID NO: 951508 - RNA, 19 nt, Homo sapiens
cuuccaaugucuuaaauca

SEQ ID NO: 951509 - RNA, 19 nt, Homo sapiens
caggagaacuuggaacucu

SEQ ID NO: 951510 - RNA, 19 nt, Homo sapiens
ugaugagauucgucaguuu

SEQ ID NO: 951511 - RNA, 19 nt, Homo sapiens
ggaagauggagcuacagaa

SEQ ID NO: 951512 - RNA, 19 nt, Homo sapiens
aggcacaucugaaaugauc

SEQ ID NO: 951513 - RNA, 19 nt, Homo sapiens
guagguaacuggcauuccu

SEQ ID NO: 951514 - RNA, 19 nt, Homo sapiens
ggaggcauccgcagugcaa

SEQ ID NO: 951515 - RNA, 19 nt, Homo sapiens
acuagaagaucugcacuau

SEQ ID NO: 951516 - RNA, 19 nt, Homo sapiens
gcacaucugaaaugaucuu

SEQ ID NO: 951517 - RNA, 19 nt, Homo sapiens
uccaaugucuuaaaucagu

SEQ ID NO: 951518 - RNA, 19 nt, Homo sapiens
gacauugagaggcagauuu

SEQ ID NO: 951519 - RNA, 19 nt, Homo sapiens
uauauuagcgacaggagaa

SEQ ID NO: 951520 - RNA, 19 nt, Homo sapiens
gaugagauucgucaguuuc

SEQ ID NO: 951521 - RNA, 19 nt, Homo sapiens
gaagaucugcacuauuaac

SEQ ID NO: 951522 - RNA, 19 nt, Homo sapiens
guacucugcucucggacau

SEQ ID NO: 951523 - RNA, 19 nt, Homo sapiens
gcucuguuauaaagccaaa

SEQ ID NO: 951524 - RNA, 19 nt, Homo sapiens
gcgcugcuguaacgacuuc

SEQ ID NO: 951525 - RNA, 19 nt, Homo sapiens
agccagaacucuuucgaau

SEQ ID NO: 951526 - RNA, 19 nt, Homo sapiens
gaaaagaaacaguaaaugc

SEQ ID NO: 951527 - RNA, 19 nt, Homo sapiens
gcagauuuaccaucaugug

SEQ ID NO: 951528 - RNA, 19 nt, Homo sapiens
gauacaucuuccaacauuc

SEQ ID NO: 951529 - RNA, 19 nt, Homo sapiens
uauaaagccaguaugauag

SEQ ID NO: 951530 - RNA, 19 nt, Homo sapiens
gcauuccucucuuuaaaau

SEQ ID NO: 951531 - RNA, 19 nt, Homo sapiens
gcacuauuaacuuugugaa

SEQ ID NO: 951532 - RNA, 19 nt, Homo sapiens
gcugcaggcuguaauaucc

SEQ ID NO: 951533 - RNA, 19 nt, Homo sapiens
caagcagugugcccuagca

SEQ ID NO: 951534 - RNA, 19 nt, Homo sapiens
ugaagaguuucuccuaaaa

SEQ ID NO: 951535 - RNA, 19 nt, Homo sapiens
auaugcagcuuaucaugau

SEQ ID NO: 951536 - RNA, 19 nt, Homo sapiens
ucgaauaggugccaguacu

SEQ ID NO: 951537 - RNA, 19 nt, Homo sapiens
gaaaacuggaaacaagaua

SEQ ID NO: 951538 - RNA, 19 nt, Homo sapiens
ggauaggcgcuuuuauuaa

SEQ ID NO: 951539 - RNA, 19 nt, Homo sapiens
uaucaugaucuuccaaugu

SEQ ID NO: 951540 - RNA, 19 nt, Homo sapiens
ggacauugagaggcagauu

SEQ ID NO: 951541 - RNA, 19 nt, Homo sapiens
ggaggagcuuggagaugag

SEQ ID NO: 951542 - RNA, 19 nt, Homo sapiens
uaagaccucuacuggaaaa

SEQ ID NO: 951543 - RNA, 19 nt, Homo sapiens
uggauaggcgcuuuuauua

SEQ ID NO: 951544 - RNA, 19 nt, Homo sapiens
guaacuggcauuccucucu

SEQ ID NO: 951545 - RNA, 19 nt, Homo sapiens
gauuuaccaucaugugacu

SEQ ID NO: 951546 - RNA, 19 nt, Homo sapiens
cagauuuaccaucauguga

SEQ ID NO: 951547 - RNA, 19 nt, Homo sapiens
uugcuuggcucucucuugu

SEQ ID NO: 951548 - RNA, 19 nt, Homo sapiens
ccaguaugauagcaaugau

SEQ ID NO: 951549 - RNA, 19 nt, Homo sapiens
ugaagacacgauuagaaga

SEQ ID NO: 951550 - RNA, 19 nt, Homo sapiens
gaagccagaacucuuucga

SEQ ID NO: 951551 - RNA, 19 nt, Homo sapiens
cgcaagcgcugcuguaacg

SEQ ID NO: 951552 - RNA, 19 nt, Homo sapiens
acauucaaaggcucuguua

SEQ ID NO: 951553 - RNA, 19 nt, Homo sapiens
ucacagagcuccagaagaa

SEQ ID NO: 951554 - RNA, 19 nt, Homo sapiens
caacagauaccuucuauuu

SEQ ID NO: 951555 - RNA, 19 nt, Homo sapiens
gcacauauauuccgcuuuc

SEQ ID NO: 951556 - RNA, 19 nt, Homo sapiens
gcagacagaugaagaugaa

SEQ ID NO: 951557 - RNA, 19 nt, Homo sapiens
ggucaaagguuccguuaca

SEQ ID NO: 951558 - RNA, 19 nt, Homo sapiens
ggaaaacucuucaguaaau

SEQ ID NO: 951559 - RNA, 19 nt, Homo sapiens
gaagaugaacacaguauug

SEQ ID NO: 951560 - RNA, 19 nt, Homo sapiens
gcagacuugugcacauaua

SEQ ID NO: 951561 - RNA, 19 nt, Homo sapiens
aaggaugaguuuaccauua

SEQ ID NO: 951562 - RNA, 19 nt, Homo sapiens
gcaagacaguucagugagu

SEQ ID NO: 951563 - RNA, 19 nt, Homo sapiens
caaguggauccgucuauua

SEQ ID NO: 951564 - RNA, 19 nt, Homo sapiens
aaggaaggcuggcaucaaa

SEQ ID NO: 951565 - RNA, 19 nt, Homo sapiens
gaugaacacaguauugaaa

SEQ ID NO: 951566 - RNA, 19 nt, Homo sapiens
ccagaagaauggaaugaau

SEQ ID NO: 951567 - RNA, 19 nt, Homo sapiens
ggagauuuauagauccauu

SEQ ID NO: 951568 - RNA, 19 nt, Homo sapiens
ucuauuacccggagaauuu

SEQ ID NO: 951569 - RNA, 19 nt, Homo sapiens
gcuagaagguuggcuuuca

SEQ ID NO: 951570 - RNA, 19 nt, Homo sapiens
cagaagaauggaaugaaua

SEQ ID NO: 951571 - RNA, 19 nt, Homo sapiens
ccauugaacaucuagauaa

SEQ ID NO: 951572 - RNA, 19 nt, Homo sapiens
caagacaguucagugaguu

SEQ ID NO: 951573 - RNA, 19 nt, Homo sapiens
uguaugaccuucguauuga

SEQ ID NO: 951574 - RNA, 19 nt, Homo sapiens
uguaguccuuccuuaauuu

SEQ ID NO: 951575 - RNA, 19 nt, Homo sapiens
ucugaaaccucaaacuaau

SEQ ID NO: 951576 - RNA, 19 nt, Homo sapiens
guacaacagauaccuucua

SEQ ID NO: 951577 - RNA, 19 nt, Homo sapiens
guguaguccuuccuuaauu

SEQ ID NO: 951578 - RNA, 19 nt, Homo sapiens
ggguaugaguauuauagaa

SEQ ID NO: 951579 - RNA, 19 nt, Homo sapiens
uacaacagauaccuucuau

SEQ ID NO: 951580 - RNA, 19 nt, Homo sapiens
ggaugaguuuaccauuauu

SEQ ID NO: 951581 - RNA, 19 nt, Homo sapiens
gaaggaaggcuggcaucaa

SEQ ID NO: 951582 - RNA, 19 nt, Homo sapiens
uguagaaacuggcaagaca

SEQ ID NO: 951583 - RNA, 19 nt, Homo sapiens
aauuagacccuguaucuuu

SEQ ID NO: 951584 - RNA, 19 nt, Homo sapiens
gaacaauuagacccuguau

SEQ ID NO: 951585 - RNA, 19 nt, Homo sapiens
caaagguuccguuacaguu

SEQ ID NO: 951586 - RNA, 19 nt, Homo sapiens
ucuaguagguguaguccuu

SEQ ID NO: 951587 - RNA, 19 nt, Homo sapiens
aguaaucucuuugugguuu

SEQ ID NO: 951588 - RNA, 19 nt, Homo sapiens
aggaugaguuuaccauuau

SEQ ID NO: 951589 - RNA, 19 nt, Homo sapiens
aaagguuccguuacaguua

SEQ ID NO: 951590 - RNA, 19 nt, Homo sapiens
gugcugcccaugcuuauaa

SEQ ID NO: 951591 - RNA, 19 nt, Homo sapiens
ugaacacaguauugaaaug

SEQ ID NO: 951592 - RNA, 19 nt, Homo sapiens
ggaagacaggaauguuuga

SEQ ID NO: 951593 - RNA, 19 nt, Homo sapiens
acaauuagacccuguaucu

SEQ ID NO: 951594 - RNA, 19 nt, Homo sapiens
cuccaguuauagucaauua

SEQ ID NO: 951595 - RNA, 19 nt, Homo sapiens
gauaaaauggguaugagua

SEQ ID NO: 951596 - RNA, 19 nt, Homo sapiens
ucggaaaacucuucaguaa

SEQ ID NO: 951597 - RNA, 19 nt, Homo sapiens
gaagacaggaauguuugaa

SEQ ID NO: 951598 - RNA, 19 nt, Homo sapiens
ggucccagccuagccuuua

SEQ ID NO: 951599 - RNA, 19 nt, Homo sapiens
cauuauuccuguacugguu

SEQ ID NO: 951600 - RNA, 19 nt, Homo sapiens
gaacacaguauugaaaugc

SEQ ID NO: 951601 - RNA, 19 nt, Homo sapiens
guggaagacaggaauguuu

SEQ ID NO: 951602 - RNA, 19 nt, Homo sapiens
gcacaggcaccaagauguc

SEQ ID NO: 951603 - RNA, 19 nt, Homo sapiens
uagguguaguccuuccuua

SEQ ID NO: 951604 - RNA, 19 nt, Homo sapiens
cgaguggucugccgagaag

SEQ ID NO: 951605 - RNA, 19 nt, Homo sapiens
agaugaagaugaacacagu

SEQ ID NO: 951606 - RNA, 19 nt, Homo sapiens
acaaguggauccgucuauu

SEQ ID NO: 951607 - RNA, 19 nt, Homo sapiens
auaaagggcuacacaacuc

SEQ ID NO: 951608 - RNA, 19 nt, Homo sapiens
gcuaauaaagggcuacaca

SEQ ID NO: 951609 - RNA, 19 nt, Homo sapiens
caauguaaaggcucaguug

SEQ ID NO: 951610 - RNA, 19 nt, Homo sapiens
gaagguuggcuuucacaag

SEQ ID NO: 951611 - RNA, 19 nt, Homo sapiens
aagguuggcuuucacaagu

SEQ ID NO: 951612 - RNA, 19 nt, Homo sapiens
gaugccaccugcacauucu

SEQ ID NO: 951613 - RNA, 19 nt, Homo sapiens
ggaaagccauaaggaugag

SEQ ID NO: 951614 - RNA, 19 nt, Homo sapiens
ucaauuacuacccauguug

SEQ ID NO: 951615 - RNA, 19 nt, Homo sapiens
gguguaguccuuccuuaau

SEQ ID NO: 951616 - RNA, 19 nt, Homo sapiens
agaauggaaugaauaugag

SEQ ID NO: 951617 - RNA, 19 nt, Homo sapiens
gaacaggaauucggaaaac

SEQ ID NO: 951618 - RNA, 19 nt, Homo sapiens
gucaauuacuacccauguu

SEQ ID NO: 951619 - RNA, 19 nt, Homo sapiens
uccuaaauuugcacucuuu

SEQ ID NO: 951620 - RNA, 19 nt, Homo sapiens
ccaccugcacauucucaua

SEQ ID NO: 951621 - RNA, 19 nt, Homo sapiens
ucacaaguacagucuacaa

SEQ ID NO: 951622 - RNA, 19 nt, Homo sapiens
cauauauuccgcuuucaga

SEQ ID NO: 951623 - RNA, 19 nt, Homo sapiens
ggaaggaaggcuggcauca

SEQ ID NO: 951624 - RNA, 19 nt, Homo sapiens
uggaaagccauaaggauga

SEQ ID NO: 951625 - RNA, 19 nt, Homo sapiens
auaggacaccucuguauga

SEQ ID NO: 951626 - RNA, 19 nt, Homo sapiens
ugaaaccucaaacuaauag

SEQ ID NO: 951627 - RNA, 19 nt, Homo sapiens
gcacucacgguccacugaa

SEQ ID NO: 951628 - RNA, 19 nt, Homo sapiens
gaagaauggaaugaauaug

SEQ ID NO: 951629 - RNA, 19 nt, Homo sapiens
gaugaagaugaacacagua

SEQ ID NO: 951630 - RNA, 19 nt, Homo sapiens
ccaaaagauuuacggagaa

SEQ ID NO: 951631 - RNA, 19 nt, Homo sapiens
uaccauauccuaaauuugc

SEQ ID NO: 951632 - RNA, 19 nt, Homo sapiens
cgauacugguccugguuug

SEQ ID NO: 951633 - RNA, 19 nt, Homo sapiens
uggcaagacaguucaguga

SEQ ID NO: 951634 - RNA, 19 nt, Homo sapiens
ggauccuaguaaucucuuu

SEQ ID NO: 951635 - RNA, 19 nt, Homo sapiens
cugaaaccucaaacuaaua

SEQ ID NO: 951636 - RNA, 19 nt, Homo sapiens
gcacauucucauacucugu

SEQ ID NO: 951637 - RNA, 19 nt, Homo sapiens
ggaugccaccugcacauuc

SEQ ID NO: 951638 - RNA, 19 nt, Homo sapiens
ccauugggguguuauuaaa

SEQ ID NO: 951639 - RNA, 19 nt, Homo sapiens
gauccuaguaaucucuuug

SEQ ID NO: 951640 - RNA, 19 nt, Homo sapiens
uauauaggacaccucugua

SEQ ID NO: 951641 - RNA, 19 nt, Homo sapiens
uaauaaagggcuacacaac

SEQ ID NO: 951642 - RNA, 19 nt, Homo sapiens
cuaauaaagggcuacacaa

SEQ ID NO: 951643 - RNA, 19 nt, Homo sapiens
agacuugugcacauauauu

SEQ ID NO: 951644 - RNA, 19 nt, Homo sapiens
gagauuuauagauccauug

SEQ ID NO: 951645 - RNA, 19 nt, Homo sapiens
guaaucucuuugugguuuc

SEQ ID NO: 951646 - RNA, 19 nt, Homo sapiens
gagcucugagugagucaaa

SEQ ID NO: 951647 - RNA, 19 nt, Homo sapiens
uaaggaugaguuuaccauu

SEQ ID NO: 951648 - RNA, 19 nt, Homo sapiens
aagaugaacacaguauuga

SEQ ID NO: 951649 - RNA, 19 nt, Homo sapiens
cacaaguacagucuacaaa

SEQ ID NO: 951650 - RNA, 19 nt, Homo sapiens
gguaugaguauuauagaac

SEQ ID NO: 951651 - RNA, 19 nt, Homo sapiens
ugugguuucuucugauuuc

SEQ ID NO: 951652 - RNA, 19 nt, Homo sapiens
gaugaguuuaccauuauuc

SEQ ID NO: 951653 - RNA, 19 nt, Homo sapiens
ugacagagcuggcgcacua

SEQ ID NO: 951654 - RNA, 19 nt, Homo sapiens
agaauuagcuaugccaaga

SEQ ID NO: 951655 - RNA, 19 nt, Homo sapiens
ccucuaggcuuaagaccuu

SEQ ID NO: 951656 - RNA, 19 nt, Homo sapiens
ggacauacugcaccagguu

SEQ ID NO: 951657 - RNA, 19 nt, Homo sapiens
gcuuaagaccuucaacuug

SEQ ID NO: 951658 - RNA, 19 nt, Homo sapiens
gcaggacucacguuacaga

SEQ ID NO: 951659 - RNA, 19 nt, Homo sapiens
uggcaggacucacguuaca

SEQ ID NO: 951660 - RNA, 19 nt, Homo sapiens
guugcuauguggcagaaga

SEQ ID NO: 951661 - RNA, 19 nt, Homo sapiens
caucauggacucccuagag

SEQ ID NO: 951662 - RNA, 19 nt, Homo sapiens
ucaagagaauuagcuaugc

SEQ ID NO: 951663 - RNA, 19 nt, Homo sapiens
ggacgaccugcacaucaug

SEQ ID NO: 951664 - RNA, 19 nt, Homo sapiens
ggcuuaagaccuucaacuu

SEQ ID NO: 951665 - RNA, 19 nt, Homo sapiens
guacuccucguggacuuaa

SEQ ID NO: 951666 - RNA, 19 nt, Homo sapiens
gccuaaaugugcacagcau

SEQ ID NO: 951667 - RNA, 19 nt, Homo sapiens
ggcgcugggucucaaagug

SEQ ID NO: 951668 - RNA, 19 nt, Homo sapiens
gaacuucaagagaauuagc

SEQ ID NO: 951669 - RNA, 19 nt, Homo sapiens
ccacaaguuacuacuacau

SEQ ID NO: 951670 - RNA, 19 nt, Homo sapiens
cuauguggcagaagaacuu

SEQ ID NO: 951671 - RNA, 19 nt, Homo sapiens
ccaccggagacccacagua

SEQ ID NO: 951672 - RNA, 19 nt, Homo sapiens
ugacagagcuggcgcacua

SEQ ID NO: 951673 - RNA, 19 nt, Homo sapiens
agaauuagcuaugccaaga

SEQ ID NO: 951674 - RNA, 19 nt, Homo sapiens
ccucuaggcuuaagaccuu

SEQ ID NO: 951675 - RNA, 19 nt, Homo sapiens
ggacauacugcaccagguu

SEQ ID NO: 951676 - RNA, 19 nt, Homo sapiens
gcuuaagaccuucaacuug

SEQ ID NO: 951677 - RNA, 19 nt, Homo sapiens
gcaggacucacguuacaga

SEQ ID NO: 951678 - RNA, 19 nt, Homo sapiens
uggcaggacucacguuaca

SEQ ID NO: 951679 - RNA, 19 nt, Homo sapiens
guugcuauguggcagaaga

SEQ ID NO: 951680 - RNA, 19 nt, Homo sapiens
caucauggacucccuagag

SEQ ID NO: 951681 - RNA, 19 nt, Homo sapiens
ucaagagaauuagcuaugc

SEQ ID NO: 951682 - RNA, 19 nt, Homo sapiens
ggacgaccugcacaucaug

SEQ ID NO: 951683 - RNA, 19 nt, Homo sapiens
ggcuuaagaccuucaacuu

SEQ ID NO: 951684 - RNA, 19 nt, Homo sapiens
guacuccucguggacuuaa

SEQ ID NO: 951685 - RNA, 19 nt, Homo sapiens
gccuaaaugugcacagcau

SEQ ID NO: 951686 - RNA, 19 nt, Homo sapiens
ggcgcugggucucaaagug

SEQ ID NO: 951687 - RNA, 19 nt, Homo sapiens
gaacuucaagagaauuagc

SEQ ID NO: 951688 - RNA, 19 nt, Homo sapiens
ccacaaguuacuacuacau

SEQ ID NO: 951689 - RNA, 19 nt, Homo sapiens
cuauguggcagaagaacuu

SEQ ID NO: 951690 - RNA, 19 nt, Homo sapiens
ccaccggagacccacagua

SEQ ID NO: 951691 - RNA, 19 nt, Homo sapiens
ugacagagcuggcgcacua

SEQ ID NO: 951692 - RNA, 19 nt, Homo sapiens
caaagucaccucugucaaa

SEQ ID NO: 951693 - RNA, 19 nt, Homo sapiens
ucaaggaggauaaagauaa

SEQ ID NO: 951694 - RNA, 19 nt, Homo sapiens
gaugguggcucacgcuugu

SEQ ID NO: 951695 - RNA, 19 nt, Homo sapiens
agaauuagcuaugccaaga

SEQ ID NO: 951696 - RNA, 19 nt, Homo sapiens
gaaucaaggaggauaaaga

SEQ ID NO: 951697 - RNA, 19 nt, Homo sapiens
gacaugagccuaagucaag

SEQ ID NO: 951698 - RNA, 19 nt, Homo sapiens
ggccaaggcugcagugagu

SEQ ID NO: 951699 - RNA, 19 nt, Homo sapiens
ccucuaggcuuaagaccuu

SEQ ID NO: 951700 - RNA, 19 nt, Homo sapiens
ggacauacugcaccagguu

SEQ ID NO: 951701 - RNA, 19 nt, Homo sapiens
gcuccaaagucaccucugu

SEQ ID NO: 951702 - RNA, 19 nt, Homo sapiens
gcuuaagaccuucaacuug

SEQ ID NO: 951703 - RNA, 19 nt, Homo sapiens
gcaggacucacguuacaga

SEQ ID NO: 951704 - RNA, 19 nt, Homo sapiens
ccaccucucucaggaugaa

SEQ ID NO: 951705 - RNA, 19 nt, Homo sapiens
gcucccaucuguacuaaaa

SEQ ID NO: 951706 - RNA, 19 nt, Homo sapiens
uggcaggacucacguuaca

SEQ ID NO: 951707 - RNA, 19 nt, Homo sapiens
caaggcagucugggcaaua

SEQ ID NO: 951708 - RNA, 19 nt, Homo sapiens
ugugcaggcuccgcuguua

SEQ ID NO: 951709 - RNA, 19 nt, Homo sapiens
aaucacagcgguucaaauc

SEQ ID NO: 951710 - RNA, 19 nt, Homo sapiens
ucgcaccacugcacccaaa

SEQ ID NO: 951711 - RNA, 19 nt, Homo sapiens
uagugaggcucccaucugu

SEQ ID NO: 951712 - RNA, 19 nt, Homo sapiens
guugcuauguggcagaaga

SEQ ID NO: 951713 - RNA, 19 nt, Homo sapiens
cugcugggcucacaaaguc

SEQ ID NO: 951714 - RNA, 19 nt, Homo sapiens
aaagucaccucugucaaag

SEQ ID NO: 951715 - RNA, 19 nt, Homo sapiens
gaggcucccaucuguacua

SEQ ID NO: 951716 - RNA, 19 nt, Homo sapiens
cgacaugagccuaagucaa

SEQ ID NO: 951717 - RNA, 19 nt, Homo sapiens
gcaccuguagucccagcua

SEQ ID NO: 951718 - RNA, 19 nt, Homo sapiens
guggcgaugugcaccugua

SEQ ID NO: 951719 - RNA, 19 nt, Homo sapiens
acaaagggacuccgaugug

SEQ ID NO: 951720 - RNA, 19 nt, Homo sapiens
gugacgaucucuguaagca

SEQ ID NO: 951721 - RNA, 19 nt, Homo sapiens
gcucacaaagucacacuag

SEQ ID NO: 951722 - RNA, 19 nt, Homo sapiens
gauggcgacaugagccuaa

SEQ ID NO: 951723 - RNA, 19 nt, Homo sapiens
gaaucacagcgguucaaau

SEQ ID NO: 951724 - RNA, 19 nt, Homo sapiens
caucauggacucccuagag

SEQ ID NO: 951725 - RNA, 19 nt, Homo sapiens
ucaagagaauuagcuaugc

SEQ ID NO: 951726 - RNA, 19 nt, Homo sapiens
ucccugcccucccgucauu

SEQ ID NO: 951727 - RNA, 19 nt, Homo sapiens
ggacgaccugcacaucaug

SEQ ID NO: 951728 - RNA, 19 nt, Homo sapiens
aaucaaggaggauaaagau

SEQ ID NO: 951729 - RNA, 19 nt, Homo sapiens
ggcuuaagaccuucaacuu

SEQ ID NO: 951730 - RNA, 19 nt, Homo sapiens
guacuccucguggacuuaa

SEQ ID NO: 951731 - RNA, 19 nt, Homo sapiens
gccuaaaugugcacagcau

SEQ ID NO: 951732 - RNA, 19 nt, Homo sapiens
ccaaggcagucugggcaau

SEQ ID NO: 951733 - RNA, 19 nt, Homo sapiens
cuuguaaucccaguacuuu

SEQ ID NO: 951734 - RNA, 19 nt, Homo sapiens
aggcuccgcuguuagaauc

SEQ ID NO: 951735 - RNA, 19 nt, Homo sapiens
ggcgcugggucucaaagug

SEQ ID NO: 951736 - RNA, 19 nt, Homo sapiens
ucacaaagucacacuagac

SEQ ID NO: 951737 - RNA, 19 nt, Homo sapiens
gggcugcugggcucacaaa

SEQ ID NO: 951738 - RNA, 19 nt, Homo sapiens
gaacuucaagagaauuagc

SEQ ID NO: 951739 - RNA, 19 nt, Homo sapiens
gucaaguccugucccucaa

SEQ ID NO: 951740 - RNA, 19 nt, Homo sapiens
ccacaaguuacuacuacau

SEQ ID NO: 951741 - RNA, 19 nt, Homo sapiens
aaggcagucugggcaauau

SEQ ID NO: 951742 - RNA, 19 nt, Homo sapiens
cuauguggcagaagaacuu

SEQ ID NO: 951743 - RNA, 19 nt, Homo sapiens
cagugacgaucucuguaag

SEQ ID NO: 951744 - RNA, 19 nt, Homo sapiens
cuccuuggccagaggcuua

SEQ ID NO: 951745 - RNA, 19 nt, Homo sapiens
ccaaagucaccucugucaa

SEQ ID NO: 951746 - RNA, 19 nt, Homo sapiens
ccaaggcugcagugaguca

SEQ ID NO: 951747 - RNA, 19 nt, Homo sapiens
gcgaugugcaccuguaguc

SEQ ID NO: 951748 - RNA, 19 nt, Homo sapiens
ccaccggagacccacagua

SEQ ID NO: 951749 - RNA, 19 nt, Homo sapiens
gagaagacccucaaagaua

SEQ ID NO: 951750 - RNA, 19 nt, Homo sapiens
ggucagacgucauggagua

SEQ ID NO: 951751 - RNA, 19 nt, Homo sapiens
ggacgggaguuuaaaauua

SEQ ID NO: 951752 - RNA, 19 nt, Homo sapiens
uagaauggcucaugcaaug

SEQ ID NO: 951753 - RNA, 19 nt, Homo sapiens
uaaagaugcuggugauaau

SEQ ID NO: 951754 - RNA, 19 nt, Homo sapiens
gagauaaagcuaaacguaa

SEQ ID NO: 951755 - RNA, 19 nt, Homo sapiens
acaaggagcauccaagaua

SEQ ID NO: 951756 - RNA, 19 nt, Homo sapiens
gcuacuaauuugccacuaa

SEQ ID NO: 951757 - RNA, 19 nt, Homo sapiens
gaagacauguuuguuugug

SEQ ID NO: 951758 - RNA, 19 nt, Homo sapiens
caugaaugcuuacacaaug

SEQ ID NO: 951759 - RNA, 19 nt, Homo sapiens
ggagaagacccucaaagau

SEQ ID NO: 951760 - RNA, 19 nt, Homo sapiens
ggacaaggagcauccaaga

SEQ ID NO: 951761 - RNA, 19 nt, Homo sapiens
cugaaucucuucugacauu

SEQ ID NO: 951762 - RNA, 19 nt, Homo sapiens
gaauacaccugaggagaag

SEQ ID NO: 951763 - RNA, 19 nt, Homo sapiens
cuacuaauuugccacuaaa

SEQ ID NO: 951764 - RNA, 19 nt, Homo sapiens
agaagacccucaaagauag

SEQ ID NO: 951765 - RNA, 19 nt, Homo sapiens
gcaggugcagugauucaua

SEQ ID NO: 951766 - RNA, 19 nt, Homo sapiens
gcauggcgaugaaaucuac

SEQ ID NO: 951767 - RNA, 19 nt, Homo sapiens
cugaagacauguuuguuug

SEQ ID NO: 951768 - RNA, 19 nt, Homo sapiens
cgaaagccgugcggagauu

SEQ ID NO: 951769 - RNA, 19 nt, Homo sapiens
gaggaggaauuagcuugaa

SEQ ID NO: 951770 - RNA, 19 nt, Homo sapiens
gcgaugaaaucuacauugc

SEQ ID NO: 951771 - RNA, 19 nt, Homo sapiens
cggaggguauuauagauau

SEQ ID NO: 951772 - RNA, 19 nt, Homo sapiens
uuaaagaugcuggugauaa

SEQ ID NO: 951773 - RNA, 19 nt, Homo sapiens
uaaaugagggcacagugaa

SEQ ID NO: 951774 - RNA, 19 nt, Homo sapiens
caaggagcauccaagauac

SEQ ID NO: 951775 - RNA, 19 nt, Homo sapiens
gcaaauggucacccugaau

SEQ ID NO: 951776 - RNA, 19 nt, Homo sapiens
agagauaaagcuaaacgua

SEQ ID NO: 951777 - RNA, 19 nt, Homo sapiens
ggaggaggaauuagcuuga

SEQ ID NO: 951778 - RNA, 19 nt, Homo sapiens
ucaugaugcuacuaauuug

SEQ ID NO: 951779 - RNA, 19 nt, Homo sapiens
ggaauugucuaagccaaaa

SEQ ID NO: 951780 - RNA, 19 nt, Homo sapiens
gauagaauggcucaugcaa

SEQ ID NO: 951781 - RNA, 19 nt, Homo sapiens
cauuggauguuauuugcuu

SEQ ID NO: 951782 - RNA, 19 nt, Homo sapiens
caaauggucacccugaauc

SEQ ID NO: 951783 - RNA, 19 nt, Homo sapiens
guacuggucagacgucaug

SEQ ID NO: 951784 - RNA, 19 nt, Homo sapiens
ccugaagacauguuuguuu

SEQ ID NO: 951785 - RNA, 19 nt, Homo sapiens
ccagaacuuugcaaacagu

SEQ ID NO: 951786 - RNA, 19 nt, Homo sapiens
agaauacaccugaggagaa

SEQ ID NO: 951787 - RNA, 19 nt, Homo sapiens
guacuuccggaggguauua

SEQ ID NO: 951788 - RNA, 19 nt, Homo sapiens
gauggccacacuucucuuu

SEQ ID NO: 951789 - RNA, 19 nt, Homo sapiens
gaagcauggcgaugaaauc

SEQ ID NO: 951790 - RNA, 19 nt, Homo sapiens
gggacuggaggaggaauua

SEQ ID NO: 951791 - RNA, 19 nt, Homo sapiens
ggaggguauuauagauaug

SEQ ID NO: 951792 - RNA, 19 nt, Homo sapiens
cucuaaagcugcugugaug

SEQ ID NO: 951793 - RNA, 19 nt, Homo sapiens
aggagcaggugcagugauu

SEQ ID NO: 951794 - RNA, 19 nt, Homo sapiens
guacuccucuuuucaugaa

SEQ ID NO: 951795 - RNA, 19 nt, Homo sapiens
ucccagaacuuugcaaaca

SEQ ID NO: 951796 - RNA, 19 nt, Homo sapiens
cagacgucauggaguauau

SEQ ID NO: 951797 - RNA, 19 nt, Homo sapiens
gaucccagaacuuugcaaa

SEQ ID NO: 951798 - RNA, 19 nt, Homo sapiens
aagaugcuggugauaauaa

SEQ ID NO: 951799 - RNA, 19 nt, Homo sapiens
gccacuaaauacugcaaau

SEQ ID NO: 951800 - RNA, 19 nt, Homo sapiens
gaggguauuauagauauga

SEQ ID NO: 951801 - RNA, 19 nt, Homo sapiens
gagcaggugcagugauuca

SEQ ID NO: 951802 - RNA, 19 nt, Homo sapiens
cacccugaaucucuucuga

SEQ ID NO: 951803 - RNA, 19 nt, Homo sapiens
aaagauagaauggcucaug

SEQ ID NO: 951804 - RNA, 19 nt, Homo sapiens
gaagacccucaaagauaga

SEQ ID NO: 951805 - RNA, 19 nt, Homo sapiens
agacauguuuguuugugau

SEQ ID NO: 951806 - RNA, 19 nt, Homo sapiens
aaagaugcuggugauaaua

SEQ ID NO: 951807 - RNA, 19 nt, Homo sapiens
uaccugaucccagaacuuu

SEQ ID NO: 951808 - RNA, 19 nt, Homo sapiens
gugaguguuaugacuauuu

SEQ ID NO: 951809 - RNA, 19 nt, Homo sapiens
gugugaguguuaugacuau

SEQ ID NO: 951810 - RNA, 19 nt, Homo sapiens
ugagcauucucuuguuuua

SEQ ID NO: 951811 - RNA, 19 nt, Homo sapiens
aaaccaugugugaguguua

SEQ ID NO: 951812 - RNA, 19 nt, Homo sapiens
aggagaagacccucaaaga

SEQ ID NO: 951813 - RNA, 19 nt, Homo sapiens
ugauucauacccacucuaa

SEQ ID NO: 951814 - RNA, 19 nt, Homo sapiens
uuaaaugagggcacaguga

SEQ ID NO: 951815 - RNA, 19 nt, Homo sapiens
ccguaucaaugaagaaagu

SEQ ID NO: 951816 - RNA, 19 nt, Homo sapiens
uuagugguacccauuauug

SEQ ID NO: 951817 - RNA, 19 nt, Homo sapiens
ccggaggguauuauagaua

SEQ ID NO: 951818 - RNA, 19 nt, Homo sapiens
gaaagccgugcggagauug

SEQ ID NO: 951819 - RNA, 19 nt, Homo sapiens
uuucaugaaugcuuacaca

SEQ ID NO: 951820 - RNA, 19 nt, Homo sapiens
gacauguuuguuugugaua

SEQ ID NO: 951821 - RNA, 19 nt, Homo sapiens
cgucauggaguauaugugu

SEQ ID NO: 951822 - RNA, 19 nt, Homo sapiens
caggugcagugauucauac

SEQ ID NO: 951823 - RNA, 19 nt, Homo sapiens
aagacauguuuguuuguga

SEQ ID NO: 951824 - RNA, 19 nt, Homo sapiens
agaugcuggugauaauaaa

SEQ ID NO: 951825 - RNA, 19 nt, Homo sapiens
ccacuaaauacugcaaaug

SEQ ID NO: 951826 - RNA, 19 nt, Homo sapiens
ucaugaaugcuuacacaau

SEQ ID NO: 951827 - RNA, 19 nt, Homo sapiens
cuugaagcauggcgaugaa

SEQ ID NO: 951828 - RNA, 19 nt, Homo sapiens
gagggcacagugaaaugaa

SEQ ID NO: 951829 - RNA, 19 nt, Homo sapiens
gacaaggagcauccaagau

SEQ ID NO: 951830 - RNA, 19 nt, Homo sapiens
caagagaugauaaaaggaa

SEQ ID NO: 951831 - RNA, 19 nt, Homo sapiens
augaaugcuuacacaauga

SEQ ID NO: 951832 - RNA, 19 nt, Homo sapiens
ggcgaugaaaucuacauug

SEQ ID NO: 951833 - RNA, 19 nt, Homo sapiens
cccagacuccugugcagua

SEQ ID NO: 951834 - RNA, 19 nt, Homo sapiens
gaaaucuacauugcuccuu

SEQ ID NO: 951835 - RNA, 19 nt, Homo sapiens
guuagugguacccauuauu

SEQ ID NO: 951836 - RNA, 19 nt, Homo sapiens
ugagggcacagugaaauga

SEQ ID NO: 951837 - RNA, 19 nt, Homo sapiens
acuaaauacugcaaauggu

SEQ ID NO: 951838 - RNA, 19 nt, Homo sapiens
aaaugagggcacagugaaa

SEQ ID NO: 951839 - RNA, 19 nt, Homo sapiens
cccugaaucucuucugaca

SEQ ID NO: 951840 - RNA, 19 nt, Homo sapiens
gccaaaagaaagucuaauu

SEQ ID NO: 951841 - RNA, 19 nt, Homo sapiens
agacuccugugcaguacug

SEQ ID NO: 951842 - RNA, 19 nt, Homo sapiens
uaauguuggugucagaaaa

SEQ ID NO: 951843 - RNA, 19 nt, Homo sapiens
aaucucuucugacauugga

SEQ ID NO: 951844 - RNA, 19 nt, Homo sapiens
aaucuacauugcuccuuca

SEQ ID NO: 951845 - RNA, 19 nt, Homo sapiens
ugaagcauggcgaugaaau

SEQ ID NO: 951846 - RNA, 19 nt, Homo sapiens
ucagacgucauggaguaua

SEQ ID NO: 951847 - RNA, 19 nt, Homo sapiens
gugguacccauuauugaga

SEQ ID NO: 951848 - RNA, 19 nt, Homo sapiens
ugcaaauggucacccugaa

SEQ ID NO: 951849 - RNA, 19 nt, Homo sapiens
agaaagagaucucauagga

SEQ ID NO: 951850 - RNA, 19 nt, Homo sapiens
caacauauaggcaacauuu

SEQ ID NO: 951851 - RNA, 19 nt, Homo sapiens
gauccgagaauuuaacuua

SEQ ID NO: 951852 - RNA, 19 nt, Homo sapiens
aauagaggcuugagacuuu

SEQ ID NO: 951853 - RNA, 19 nt, Homo sapiens
caaagaaagagaucucaua

SEQ ID NO: 951854 - RNA, 19 nt, Homo sapiens
ucagacaucuccaugguuu

SEQ ID NO: 951855 - RNA, 19 nt, Homo sapiens
ggccacagauugacaagaa

SEQ ID NO: 951856 - RNA, 19 nt, Homo sapiens
caucauuccuucuuaguug

SEQ ID NO: 951857 - RNA, 19 nt, Homo sapiens
uaauugcucucguguauuc

SEQ ID NO: 951858 - RNA, 19 nt, Homo sapiens
ucacuuggauuguggaguu

SEQ ID NO: 951859 - RNA, 19 nt, Homo sapiens
gagaaaccuuuaaccacaa

SEQ ID NO: 951860 - RNA, 19 nt, Homo sapiens
uaaaguggccaacacaauu

SEQ ID NO: 951861 - RNA, 19 nt, Homo sapiens
guauagaacgcuaagaauu

SEQ ID NO: 951862 - RNA, 19 nt, Homo sapiens
guuaacugcuuaucagcua

SEQ ID NO: 951863 - RNA, 19 nt, Homo sapiens
gcaugcagcuucugauuuu

SEQ ID NO: 951864 - RNA, 19 nt, Homo sapiens
gaaugugauccgagaauuu

SEQ ID NO: 951865 - RNA, 19 nt, Homo sapiens
ggucuuggcaccucuaauu

SEQ ID NO: 951866 - RNA, 19 nt, Homo sapiens
gaccuagauuuaacccuaa

SEQ ID NO: 951867 - RNA, 19 nt, Homo sapiens
gcugaccucucccuuaaau

SEQ ID NO: 951868 - RNA, 19 nt, Homo sapiens
ucuaauugcucucguguau

SEQ ID NO: 951869 - RNA, 19 nt, Homo sapiens
gaaaggacgggcugucuca

SEQ ID NO: 951870 - RNA, 19 nt, Homo sapiens
guugauggcuuuccguaau

SEQ ID NO: 951871 - RNA, 19 nt, Homo sapiens
gguaggacuuggaggagaa

SEQ ID NO: 951872 - RNA, 19 nt, Homo sapiens
gaauagaggcuugagacuu

SEQ ID NO: 951873 - RNA, 19 nt, Homo sapiens
gaccugcacagcuugguua

SEQ ID NO: 951874 - RNA, 19 nt, Homo sapiens
gcaacucccuacccugauc

SEQ ID NO: 951875 - RNA, 19 nt, Homo sapiens
gcucucugcugccuuccua

SEQ ID NO: 951876 - RNA, 19 nt, Homo sapiens
ccauugugaugaugaagaa

SEQ ID NO: 951877 - RNA, 19 nt, Homo sapiens
gaacuagaacgggacaaga

SEQ ID NO: 951878 - RNA, 19 nt, Homo sapiens
uaucagcuauucagacauc

SEQ ID NO: 951879 - RNA, 19 nt, Homo sapiens
uuacaucacacucugcaua

SEQ ID NO: 951880 - RNA, 19 nt, Homo sapiens
gcuugagacuuuccuuugu

SEQ ID NO: 951881 - RNA, 19 nt, Homo sapiens
aaugugauccgagaauuua

SEQ ID NO: 951882 - RNA, 19 nt, Homo sapiens
gcccugaguauaucaagua

SEQ ID NO: 951883 - RNA, 19 nt, Homo sapiens
guaaaguggccaacacaau

SEQ ID NO: 951884 - RNA, 19 nt, Homo sapiens
ggagagaaguggagauccu

SEQ ID NO: 951885 - RNA, 19 nt, Homo sapiens
ggguauagaacgcuaagaa

SEQ ID NO: 951886 - RNA, 19 nt, Homo sapiens
agauuuaacccuaagguaa

SEQ ID NO: 951887 - RNA, 19 nt, Homo sapiens
uugguuagaccuagauuua

SEQ ID NO: 951888 - RNA, 19 nt, Homo sapiens
aaagaggcaucuagggaau

SEQ ID NO: 951889 - RNA, 19 nt, Homo sapiens
guuggacgcuauacugaug

SEQ ID NO: 951890 - RNA, 19 nt, Homo sapiens
ggaguucuuugccaauugg

SEQ ID NO: 951891 - RNA, 19 nt, Homo sapiens
guauaagccuaacuuuguc

SEQ ID NO: 951892 - RNA, 19 nt, Homo sapiens
caaccuuacuaccuucugu

SEQ ID NO: 951893 - RNA, 19 nt, Homo sapiens
guacaaagugagcacauca

SEQ ID NO: 951894 - RNA, 19 nt, Homo sapiens
gcaugggccuacuuuacau

SEQ ID NO: 951895 - RNA, 19 nt, Homo sapiens
augcugaccucucccuuaa

SEQ ID NO: 951896 - RNA, 19 nt, Homo sapiens
aguauaagccuaacuuugu

SEQ ID NO: 951897 - RNA, 19 nt, Homo sapiens
guacagggcuaaauuuugg

SEQ ID NO: 951898 - RNA, 19 nt, Homo sapiens
uugauggcuuuccguaaua

SEQ ID NO: 951899 - RNA, 19 nt, Homo sapiens
acacccaguugauggcuuu

SEQ ID NO: 951900 - RNA, 19 nt, Homo sapiens
gagaaugugauccgagaau

SEQ ID NO: 951901 - RNA, 19 nt, Homo sapiens
gagggucacuuggauugug

SEQ ID NO: 951902 - RNA, 19 nt, Homo sapiens
gaaguggagauccugaugu

SEQ ID NO: 951903 - RNA, 19 nt, Homo sapiens
cguuuauggucuucauuaa

SEQ ID NO: 951904 - RNA, 19 nt, Homo sapiens
aaagaaagagaucucauag

SEQ ID NO: 951905 - RNA, 19 nt, Homo sapiens
caaaggcuggagacaauau

SEQ ID NO: 951906 - RNA, 19 nt, Homo sapiens
gacuuuccuuuguguggua

SEQ ID NO: 951907 - RNA, 19 nt, Homo sapiens
agaaaccuuuaaccacaaa

SEQ ID NO: 951908 - RNA, 19 nt, Homo sapiens
auuccaggcucuuuccaua

SEQ ID NO: 951909 - RNA, 19 nt, Homo sapiens
agaaugugauccgagaauu

SEQ ID NO: 951910 - RNA, 19 nt, Homo sapiens
guggagauccugauguuuc

SEQ ID NO: 951911 - RNA, 19 nt, Homo sapiens
ucucauggaccuucucuga

SEQ ID NO: 951912 - RNA, 19 nt, Homo sapiens
aaguggagauccugauguu

SEQ ID NO: 951913 - RNA, 19 nt, Homo sapiens
gguauagaacgcuaagaau

SEQ ID NO: 951914 - RNA, 19 nt, Homo sapiens
gauguuggacgcuauacug

SEQ ID NO: 951915 - RNA, 19 nt, Homo sapiens
guggaguucuuugccaauu

SEQ ID NO: 951916 - RNA, 19 nt, Homo sapiens
gggccuacuuuacaucaca

SEQ ID NO: 951917 - RNA, 19 nt, Homo sapiens
uaguugaccugcacagcuu

SEQ ID NO: 951918 - RNA, 19 nt, Homo sapiens
guuucaucauuccuucuua

SEQ ID NO: 951919 - RNA, 19 nt, Homo sapiens
cuuaucagcuauucagaca

SEQ ID NO: 951920 - RNA, 19 nt, Homo sapiens
agaggcaucuagggaauug

SEQ ID NO: 951921 - RNA, 19 nt, Homo sapiens
gccaagaaacuaucaaagg

SEQ ID NO: 951922 - RNA, 19 nt, Homo sapiens
ugauggcuuuccguaauaa

SEQ ID NO: 951923 - RNA, 19 nt, Homo sapiens
gacuuugacuggagagaag

SEQ ID NO: 951924 - RNA, 19 nt, Homo sapiens
gauuuaacccuaagguaag

SEQ ID NO: 951925 - RNA, 19 nt, Homo sapiens
acucugugguuucaucauu

SEQ ID NO: 951926 - RNA, 19 nt, Homo sapiens
gcaaagaaagagaucucau

SEQ ID NO: 951927 - RNA, 19 nt, Homo sapiens
gggccaagaaacuaucaaa

SEQ ID NO: 951928 - RNA, 19 nt, Homo sapiens
gccacagauugacaagaaa

SEQ ID NO: 951929 - RNA, 19 nt, Homo sapiens
gguaacccgugugacuuug

SEQ ID NO: 951930 - RNA, 19 nt, Homo sapiens
ggagaaauccccuggacuu

SEQ ID NO: 951931 - RNA, 19 nt, Homo sapiens
ucagugccauugugaugau

SEQ ID NO: 951932 - RNA, 19 nt, Homo sapiens
cagcaugcagcuucugauu

SEQ ID NO: 951933 - RNA, 19 nt, Homo sapiens
gaggugcagcuuuuauuua

SEQ ID NO: 951934 - RNA, 19 nt, Homo sapiens
gggaaaacaagaaggauaa

SEQ ID NO: 951935 - RNA, 19 nt, Homo sapiens
gagcaaagaaagagaucuc

SEQ ID NO: 951936 - RNA, 19 nt, Homo sapiens
gguacaaagugagcacauc

SEQ ID NO: 951937 - RNA, 19 nt, Homo sapiens
gccaauuggucuaaugacu

SEQ ID NO: 951938 - RNA, 19 nt, Homo sapiens
ugcauaguguuccugauga

SEQ ID NO: 951939 - RNA, 19 nt, Homo sapiens
aggaaggccugccaugcuu

SEQ ID NO: 951940 - RNA, 19 nt, Homo sapiens
aucaaaggcuggagacaau

SEQ ID NO: 951941 - RNA, 19 nt, Homo sapiens
uaugcugaccucucccuua

SEQ ID NO: 951942 - RNA, 19 nt, Homo sapiens
gcccuucuggcuucguuua

SEQ ID NO: 951943 - RNA, 19 nt, Homo sapiens
cagcuugguuagaccuaga

SEQ ID NO: 951944 - RNA, 19 nt, Homo sapiens
caguggccguuacgccuaa

SEQ ID NO: 951945 - RNA, 19 nt, Homo sapiens
ucacuggagcaaagaaaga

SEQ ID NO: 951946 - RNA, 19 nt, Homo sapiens
uaucaaaggcuggagacaa

SEQ ID NO: 951947 - RNA, 19 nt, Homo sapiens
ugaccucucccuuaaauac

SEQ ID NO: 951948 - RNA, 19 nt, Homo sapiens
aaccauugaugaggaacua

SEQ ID NO: 951949 - RNA, 19 nt, Homo sapiens
ggaaugaaguuucgaaauu

SEQ ID NO: 951950 - RNA, 19 nt, Homo sapiens
caaagaacauccuggugua

SEQ ID NO: 951951 - RNA, 19 nt, Homo sapiens
ggaugaagguagaacuaua

SEQ ID NO: 951952 - RNA, 19 nt, Homo sapiens
uaacagaugugaccaaagu

SEQ ID NO: 951953 - RNA, 19 nt, Homo sapiens
ggaauuaauugaugaacug

SEQ ID NO: 951954 - RNA, 19 nt, Homo sapiens
gaauucagagugugacuua

SEQ ID NO: 951955 - RNA, 19 nt, Homo sapiens
ggucugugcuucuuccaua

SEQ ID NO: 951956 - RNA, 19 nt, Homo sapiens
guaaggacuuugaaugcua

SEQ ID NO: 951957 - RNA, 19 nt, Homo sapiens
gaacuauaaucugcaauuc

SEQ ID NO: 951958 - RNA, 19 nt, Homo sapiens
gaauauucccuaaagguaa

SEQ ID NO: 951959 - RNA, 19 nt, Homo sapiens
gaagguagaacuauaaucu

SEQ ID NO: 951960 - RNA, 19 nt, Homo sapiens
ggaaguuuguguugauuca

SEQ ID NO: 951961 - RNA, 19 nt, Homo sapiens
gaugaagguagaacuauaa

SEQ ID NO: 951962 - RNA, 19 nt, Homo sapiens
ugaaugcuaucgcaaagaa

SEQ ID NO: 951963 - RNA, 19 nt, Homo sapiens
ggaaucagcugugaaugca

SEQ ID NO: 951964 - RNA, 19 nt, Homo sapiens
gacugaagauggacacauu

SEQ ID NO: 951965 - RNA, 19 nt, Homo sapiens
gguaacagaugugaccaaa

SEQ ID NO: 951966 - RNA, 19 nt, Homo sapiens
gagauacagucacuuccuu

SEQ ID NO: 951967 - RNA, 19 nt, Homo sapiens
agacagaaaucuacaaagg

SEQ ID NO: 951968 - RNA, 19 nt, Homo sapiens
gccaggaggugguauaaca

SEQ ID NO: 951969 - RNA, 19 nt, Homo sapiens
gaugaaggcugacauucgu

SEQ ID NO: 951970 - RNA, 19 nt, Homo sapiens
aaucugcaauucucuauga

SEQ ID NO: 951971 - RNA, 19 nt, Homo sapiens
acaaagagcuguguauguc

SEQ ID NO: 951972 - RNA, 19 nt, Homo sapiens
aaacagagauacagucacu

SEQ ID NO: 951973 - RNA, 19 nt, Homo sapiens
gaagauggacacauugaca

SEQ ID NO: 951974 - RNA, 19 nt, Homo sapiens
gaagcagaguguucagauc

SEQ ID NO: 951975 - RNA, 19 nt, Homo sapiens
guagaacuauaaucugcaa

SEQ ID NO: 951976 - RNA, 19 nt, Homo sapiens
acagaaaucuacaaaggau

SEQ ID NO: 951977 - RNA, 19 nt, Homo sapiens
guaugucccuuauggcuau

SEQ ID NO: 951978 - RNA, 19 nt, Homo sapiens
cagcauggguguccuucaa

SEQ ID NO: 951979 - RNA, 19 nt, Homo sapiens
gagaaugugcccaagaaga

SEQ ID NO: 951980 - RNA, 19 nt, Homo sapiens
ccaccgagccuuugacaug

SEQ ID NO: 951981 - RNA, 19 nt, Homo sapiens
ucaguggaauuaauugaug

SEQ ID NO: 951982 - RNA, 19 nt, Homo sapiens
uggagaaugugcccaagaa

SEQ ID NO: 951983 - RNA, 19 nt, Homo sapiens
ggcauugacugaagaugga

SEQ ID NO: 951984 - RNA, 19 nt, Homo sapiens
uaaggacuuugaaugcuau

SEQ ID NO: 951985 - RNA, 19 nt, Homo sapiens
gacaaagagcuguguaugu

SEQ ID NO: 951986 - RNA, 19 nt, Homo sapiens
gugcugaucggauugaauu

SEQ ID NO: 951987 - RNA, 19 nt, Homo sapiens
agaauauucccuaaaggua

SEQ ID NO: 951988 - RNA, 19 nt, Homo sapiens
cauggaaguuuguguugau

SEQ ID NO: 951989 - RNA, 19 nt, Homo sapiens
agaaugugcccaagaagaa

SEQ ID NO: 951990 - RNA, 19 nt, Homo sapiens
ggguucaggugcuacagaa

SEQ ID NO: 951991 - RNA, 19 nt, Homo sapiens
ccucuuaaccuugggauuu

SEQ ID NO: 951992 - RNA, 19 nt, Homo sapiens
ugacaguucagcauuagaa

SEQ ID NO: 951993 - RNA, 19 nt, Homo sapiens
ggauuucucauggaaguuu

SEQ ID NO: 951994 - RNA, 19 nt, Homo sapiens
acuuaagggucaauucaaa

SEQ ID NO: 951995 - RNA, 19 nt, Homo sapiens
caggacagucgcaaucuuu

SEQ ID NO: 951996 - RNA, 19 nt, Homo sapiens
gcucagaauauucccuaaa

SEQ ID NO: 951997 - RNA, 19 nt, Homo sapiens
guucaggugcuacagaauu

SEQ ID NO: 951998 - RNA, 19 nt, Homo sapiens
gacagaaaucuacaaagga

SEQ ID NO: 951999 - RNA, 19 nt, Homo sapiens
gcauggguguccuucaagu

SEQ ID NO: 952000 - RNA, 19 nt, Homo sapiens
gaaugugcccaagaagaaa

SEQ ID NO: 952001 - RNA, 19 nt, Homo sapiens
gaugugacaguucagcauu

SEQ ID NO: 952002 - RNA, 19 nt, Homo sapiens
gagcuguguaugucccuua

SEQ ID NO: 952003 - RNA, 19 nt, Homo sapiens
gauacagucacuuccuuug

SEQ ID NO: 952004 - RNA, 19 nt, Homo sapiens
ccaggacagucgcaaucuu

SEQ ID NO: 952005 - RNA, 19 nt, Homo sapiens
uuucgaaauucaucuguug

SEQ ID NO: 952006 - RNA, 19 nt, Homo sapiens
gaaagaggaggugcugauc

SEQ ID NO: 952007 - RNA, 19 nt, Homo sapiens
uaacugcaugguaugaauu

SEQ ID NO: 952008 - RNA, 19 nt, Homo sapiens
caguggaauuaauugauga

SEQ ID NO: 952009 - RNA, 19 nt, Homo sapiens
ucacuuccuuugcuuaguc

SEQ ID NO: 952010 - RNA, 19 nt, Homo sapiens
gaacgcguggagcaugaaa

SEQ ID NO: 952011 - RNA, 19 nt, Homo sapiens
gggaaugaaguuucgaaau

SEQ ID NO: 952012 - RNA, 19 nt, Homo sapiens
acuagagacucgggaauga

SEQ ID NO: 952013 - RNA, 19 nt, Homo sapiens
gacagucgcaaucuuuguu

SEQ ID NO: 952014 - RNA, 19 nt, Homo sapiens
acagaugugaccaaaguaa

SEQ ID NO: 952015 - RNA, 19 nt, Homo sapiens
ucaguggaaucagcuguga

SEQ ID NO: 952016 - RNA, 19 nt, Homo sapiens
uggagacccucuuaaccuu

SEQ ID NO: 952017 - RNA, 19 nt, Homo sapiens
ugaaacagagauacaguca

SEQ ID NO: 952018 - RNA, 19 nt, Homo sapiens
ggacagucgcaaucuuugu

SEQ ID NO: 952019 - RNA, 19 nt, Homo sapiens
acuauaaucugcaauucuc

SEQ ID NO: 952020 - RNA, 19 nt, Homo sapiens
ucauggaaguuuguguuga

SEQ ID NO: 952021 - RNA, 19 nt, Homo sapiens
uuaacugcaugguaugaau

SEQ ID NO: 952022 - RNA, 19 nt, Homo sapiens
gaucggauugaauuauguu

SEQ ID NO: 952023 - RNA, 19 nt, Homo sapiens
caugggagccucacuuucu

SEQ ID NO: 952024 - RNA, 19 nt, Homo sapiens
guagugaagcagaguguuc

SEQ ID NO: 952025 - RNA, 19 nt, Homo sapiens
uuccauagacagaagcuua

SEQ ID NO: 952026 - RNA, 19 nt, Homo sapiens
gaaggccggagcagcaaau

SEQ ID NO: 952027 - RNA, 19 nt, Homo sapiens
caggaugaagguagaacua

SEQ ID NO: 952028 - RNA, 19 nt, Homo sapiens
cagaauauucccuaaaggu

SEQ ID NO: 952029 - RNA, 19 nt, Homo sapiens
gccaugggagccucacuuu

SEQ ID NO: 952030 - RNA, 19 nt, Homo sapiens
uaacagacagaaaucuaca

SEQ ID NO: 952031 - RNA, 19 nt, Homo sapiens
ggugaugaaggcugacauu

SEQ ID NO: 952032 - RNA, 19 nt, Homo sapiens
cugaucggauugaauuaug

SEQ ID NO: 952033 - RNA, 19 nt, Homo sapiens
ugagagacauggauaucac

SEQ ID NO: 952034 - RNA, 19 nt, Homo sapiens
gguauaacagacagaaauc

SEQ ID NO: 952035 - RNA, 19 nt, Homo sapiens
ugacaaagagcuguguaug

SEQ ID NO: 952036 - RNA, 19 nt, Homo sapiens
uuauggugcugaugguuug

SEQ ID NO: 952037 - RNA, 19 nt, Homo sapiens
acacagcuuuaaccuucuu

SEQ ID NO: 952038 - RNA, 19 nt, Homo sapiens
ggccggagcagcaaaugga

SEQ ID NO: 952039 - RNA, 19 nt, Homo sapiens
aggaggugcugaucggauu

SEQ ID NO: 952040 - RNA, 19 nt, Homo sapiens
cggauugaauuauguucug

SEQ ID NO: 952041 - RNA, 19 nt, Homo sapiens
acagacagaaaucuacaaa

SEQ ID NO: 952042 - RNA, 19 nt, Homo sapiens
caguggaugugacaguuca

SEQ ID NO: 952043 - RNA, 19 nt, Homo sapiens
cucagaauauucccuaaag

SEQ ID NO: 952044 - RNA, 19 nt, Homo sapiens
gagacucgggaaugaaguu

SEQ ID NO: 952045 - RNA, 19 nt, Homo sapiens
gcucuggagacccucuuaa

SEQ ID NO: 952046 - RNA, 19 nt, Homo sapiens
guaugaauucagaguguga

SEQ ID NO: 952047 - RNA, 19 nt, Homo sapiens
ugcaugguaugaauucaga

SEQ ID NO: 952048 - RNA, 19 nt, Homo sapiens
gcugaucggauugaauuau

SEQ ID NO: 952049 - RNA, 19 nt, Homo sapiens
gaucagaggcuuaaagaaa

SEQ ID NO: 952050 - RNA, 19 nt, Homo sapiens
cagcauaaguguuacauug

SEQ ID NO: 952051 - RNA, 19 nt, Homo sapiens
ccaacacccuuccugcuua

SEQ ID NO: 952052 - RNA, 19 nt, Homo sapiens
uccaagauuugaacgauua

SEQ ID NO: 952053 - RNA, 19 nt, Homo sapiens
gaacggaugccagaugauu

SEQ ID NO: 952054 - RNA, 19 nt, Homo sapiens
ccaaguguaucccauguau

SEQ ID NO: 952055 - RNA, 19 nt, Homo sapiens
gaaggaucccagcgcauua

SEQ ID NO: 952056 - RNA, 19 nt, Homo sapiens
ggaaguaugcgaccaugaa

SEQ ID NO: 952057 - RNA, 19 nt, Homo sapiens
uauaaccgauuguguaaug

SEQ ID NO: 952058 - RNA, 19 nt, Homo sapiens
gcauaaguguuacauugug

SEQ ID NO: 952059 - RNA, 19 nt, Homo sapiens
caaaggaaccuaugcagau

SEQ ID NO: 952060 - RNA, 19 nt, Homo sapiens
aaccauagauacaacauug

SEQ ID NO: 952061 - RNA, 19 nt, Homo sapiens
ugccaaggauccaagauuu

SEQ ID NO: 952062 - RNA, 19 nt, Homo sapiens
gagaucagaggcuuaaaga

SEQ ID NO: 952063 - RNA, 19 nt, Homo sapiens
gauccaagauuugaacgau

SEQ ID NO: 952064 - RNA, 19 nt, Homo sapiens
ucgaguggcucuaaggauu

SEQ ID NO: 952065 - RNA, 19 nt, Homo sapiens
ggaagaauauguuuuaugc

SEQ ID NO: 952066 - RNA, 19 nt, Homo sapiens
cgaccaacuuucucuuguu

SEQ ID NO: 952067 - RNA, 19 nt, Homo sapiens
gaugccagaugauuaugga

SEQ ID NO: 952068 - RNA, 19 nt, Homo sapiens
gaugacugcuuaguacaga

SEQ ID NO: 952069 - RNA, 19 nt, Homo sapiens
caacacccuuccugcuuau

SEQ ID NO: 952070 - RNA, 19 nt, Homo sapiens
uuugaacgauuaccaugua

SEQ ID NO: 952071 - RNA, 19 nt, Homo sapiens
uguaauggcugaaauugag

SEQ ID NO: 952072 - RNA, 19 nt, Homo sapiens
guuccuaucauguacauuu

SEQ ID NO: 952073 - RNA, 19 nt, Homo sapiens
aaguguaucccauguauaa

SEQ ID NO: 952074 - RNA, 19 nt, Homo sapiens
ccaaggauccaagauuuga

SEQ ID NO: 952075 - RNA, 19 nt, Homo sapiens
gcgaaugcuuagucucaga

SEQ ID NO: 952076 - RNA, 19 nt, Homo sapiens
aaaggaaccuaugcagaug

SEQ ID NO: 952077 - RNA, 19 nt, Homo sapiens
aaagaagaauccguaagau

SEQ ID NO: 952078 - RNA, 19 nt, Homo sapiens
ccuaucauguacauuucua

SEQ ID NO: 952079 - RNA, 19 nt, Homo sapiens
gugccuauacuuaauaaug

SEQ ID NO: 952080 - RNA, 19 nt, Homo sapiens
acacaguuccucugccuuu

SEQ ID NO: 952081 - RNA, 19 nt, Homo sapiens
ucagagaucagaggcuuaa

SEQ ID NO: 952082 - RNA, 19 nt, Homo sapiens
uguauaaccgauuguguaa

SEQ ID NO: 952083 - RNA, 19 nt, Homo sapiens
gggcccaccuuaccacauc

SEQ ID NO: 952084 - RNA, 19 nt, Homo sapiens
ucucagacaggaagaauau

SEQ ID NO: 952085 - RNA, 19 nt, Homo sapiens
agacaggaagaauauguuu

SEQ ID NO: 952086 - RNA, 19 nt, Homo sapiens
ccauagauacaacauugaa

SEQ ID NO: 952087 - RNA, 19 nt, Homo sapiens
aagccaaacuggacuuagu

SEQ ID NO: 952088 - RNA, 19 nt, Homo sapiens
uugaacggaugccagauga

SEQ ID NO: 952089 - RNA, 19 nt, Homo sapiens
ucauguacauuucuaacca

SEQ ID NO: 952090 - RNA, 19 nt, Homo sapiens
uaccacauccucguugaua

SEQ ID NO: 952091 - RNA, 19 nt, Homo sapiens
ucucaucacagaaauguau

SEQ ID NO: 952092 - RNA, 19 nt, Homo sapiens
cgauuaccauguacacaca

SEQ ID NO: 952093 - RNA, 19 nt, Homo sapiens
caaaggguauaaaaucuca

SEQ ID NO: 952094 - RNA, 19 nt, Homo sapiens
gaaguaugcgaccaugaag

SEQ ID NO: 952095 - RNA, 19 nt, Homo sapiens
caaguguaucccauguaua

SEQ ID NO: 952096 - RNA, 19 nt, Homo sapiens
aaugauggacugucuguau

SEQ ID NO: 952097 - RNA, 19 nt, Homo sapiens
gaucccagcgcauuaaagg

SEQ ID NO: 952098 - RNA, 19 nt, Homo sapiens
ucagacaggaagaauaugu

SEQ ID NO: 952099 - RNA, 19 nt, Homo sapiens
gccaaggauccaagauuug

SEQ ID NO: 952100 - RNA, 19 nt, Homo sapiens
ucccauguauaaccgauug

SEQ ID NO: 952101 - RNA, 19 nt, Homo sapiens
uugcauauguuaacuagcu

SEQ ID NO: 952102 - RNA, 19 nt, Homo sapiens
ggucaaaggguauaaaauc

SEQ ID NO: 952103 - RNA, 19 nt, Homo sapiens
agaaggaucccagcgcauu

SEQ ID NO: 952104 - RNA, 19 nt, Homo sapiens
gaguuccuaucauguacau

SEQ ID NO: 952105 - RNA, 19 nt, Homo sapiens
aaaagaagaauccguaaga

SEQ ID NO: 952106 - RNA, 19 nt, Homo sapiens
gaacgauuaccauguacac

SEQ ID NO: 952107 - RNA, 19 nt, Homo sapiens
ugccuauacuuaauaaugg

SEQ ID NO: 952108 - RNA, 19 nt, Homo sapiens
guggugccuauacuuaaua

SEQ ID NO: 952109 - RNA, 19 nt, Homo sapiens
aaagagaaguuccccaaca

SEQ ID NO: 952110 - RNA, 19 nt, Homo sapiens
uaagauuccuggaguuccu

SEQ ID NO: 952111 - RNA, 19 nt, Homo sapiens
uguggugccuauacuuaau

SEQ ID NO: 952112 - RNA, 19 nt, Homo sapiens
aguguggugccuauacuua

SEQ ID NO: 952113 - RNA, 19 nt, Homo sapiens
guacaguguggugccuaua

SEQ ID NO: 952114 - RNA, 19 nt, Homo sapiens
gcgcauuaaaggaaagaga

SEQ ID NO: 952115 - RNA, 19 nt, Homo sapiens
ucgaccaacuuucucuugu

SEQ ID NO: 952116 - RNA, 19 nt, Homo sapiens
acacccuuccugcuuauuu

SEQ ID NO: 952117 - RNA, 19 nt, Homo sapiens
cgaguggcucuaaggauug

SEQ ID NO: 952118 - RNA, 19 nt, Homo sapiens
guguggugccuauacuuaa

SEQ ID NO: 952119 - RNA, 19 nt, Homo sapiens
gauggucaaaggguauaaa

SEQ ID NO: 952120 - RNA, 19 nt, Homo sapiens
guacacacaaaggaaccua

SEQ ID NO: 952121 - RNA, 19 nt, Homo sapiens
ccauguacacacaaaggaa

SEQ ID NO: 952122 - RNA, 19 nt, Homo sapiens
caaggauccaagauuugaa

SEQ ID NO: 952123 - RNA, 19 nt, Homo sapiens
ucuaaggauugccaaggau

SEQ ID NO: 952124 - RNA, 19 nt, Homo sapiens
gaaauuggggcagaaguau

SEQ ID NO: 952125 - RNA, 19 nt, Homo sapiens
guguaauggcugaaauuga

SEQ ID NO: 952126 - RNA, 19 nt, Homo sapiens
caaaagaaaacaaggaagu

SEQ ID NO: 952127 - RNA, 19 nt, Homo sapiens
uggugccuauacuuaauaa

SEQ ID NO: 952128 - RNA, 19 nt, Homo sapiens
cagacaggaagaauauguu

SEQ ID NO: 952129 - RNA, 19 nt, Homo sapiens
ucuuguugccaguucauua

SEQ ID NO: 952130 - RNA, 19 nt, Homo sapiens
ucccagcgcauuaaaggaa

SEQ ID NO: 952131 - RNA, 19 nt, Homo sapiens
gcauuaaaggaaagagaag

SEQ ID NO: 952132 - RNA, 19 nt, Homo sapiens
ucaaugauggacugucugu

SEQ ID NO: 952133 - RNA, 19 nt, Homo sapiens
caguuccucugccuuucuu

SEQ ID NO: 952134 - RNA, 19 nt, Homo sapiens
aacggaugccagaugauua

SEQ ID NO: 952135 - RNA, 19 nt, Homo sapiens
cauguacauuucuaaccau

SEQ ID NO: 952136 - RNA, 19 nt, Homo sapiens
guaauggcugaaauugaga

SEQ ID NO: 952137 - RNA, 19 nt, Homo sapiens
caaggaaguaugcgaccau

SEQ ID NO: 952138 - RNA, 19 nt, Homo sapiens
augauggacugucuguaug

SEQ ID NO: 952139 - RNA, 19 nt, Homo sapiens
gccaaguguaucccaugua

SEQ ID NO: 952140 - RNA, 19 nt, Homo sapiens
cuggaguuccuaucaugua

SEQ ID NO: 952141 - RNA, 19 nt, Homo sapiens
guaacucagcauaaguguu

SEQ ID NO: 952142 - RNA, 19 nt, Homo sapiens
acacaaaggaaccuaugca

SEQ ID NO: 952143 - RNA, 19 nt, Homo sapiens
acacacaaaggaaccuaug

SEQ ID NO: 952144 - RNA, 19 nt, Homo sapiens
gcaagaggcugaagaaaga

SEQ ID NO: 952145 - RNA, 19 nt, Homo sapiens
aaagacagcuucuccaaga

SEQ ID NO: 952146 - RNA, 19 nt, Homo sapiens
gaagaaagauguggaacca

SEQ ID NO: 952147 - RNA, 19 nt, Homo sapiens
ccucccagcucaucacuua

SEQ ID NO: 952148 - RNA, 19 nt, Homo sapiens
gcaagccgaugcacagaga

SEQ ID NO: 952149 - RNA, 19 nt, Homo sapiens
gggagcagguggagaagaa

SEQ ID NO: 952150 - RNA, 19 nt, Homo sapiens
gauaagaguggcauuucua

SEQ ID NO: 952151 - RNA, 19 nt, Homo sapiens
gaacacaggcgugguggaa

SEQ ID NO: 952152 - RNA, 19 nt, Homo sapiens
gcugaauucugaaggcaaa

SEQ ID NO: 952153 - RNA, 19 nt, Homo sapiens
caagaguguuguccagaug

SEQ ID NO: 952154 - RNA, 19 nt, Homo sapiens
cagagaguguggcuucauu

SEQ ID NO: 952155 - RNA, 19 nt, Homo sapiens
gcauuucuauggaugacuu

SEQ ID NO: 952156 - RNA, 19 nt, Homo sapiens
cgacacagccaaugacuca

SEQ ID NO: 952157 - RNA, 19 nt, Homo sapiens
gagcagaucacccggaagu

SEQ ID NO: 952158 - RNA, 19 nt, Homo sapiens
ucacuucauucguacaguu

SEQ ID NO: 952159 - RNA, 19 nt, Homo sapiens
gcagaucacccggaaguuc

SEQ ID NO: 952160 - RNA, 19 nt, Homo sapiens
ccacagaugcuggcgauga

SEQ ID NO: 952161 - RNA, 19 nt, Homo sapiens
ucaagaguguuguccagau

SEQ ID NO: 952162 - RNA, 19 nt, Homo sapiens
uuuaucggcucacuucauu

SEQ ID NO: 952163 - RNA, 19 nt, Homo sapiens
ccaaagacagcuucuccaa

SEQ ID NO: 952164 - RNA, 19 nt, Homo sapiens
gccaaugacucagcaucuu

SEQ ID NO: 952165 - RNA, 19 nt, Homo sapiens
gaagaacggcgagcugaag

SEQ ID NO: 952166 - RNA, 19 nt, Homo sapiens
gcaagcugcucugcaaggu

SEQ ID NO: 952167 - RNA, 19 nt, Homo sapiens
gaugagcugaggagaguga

SEQ ID NO: 952168 - RNA, 19 nt, Homo sapiens
gcaaauuuaucggcucacu

SEQ ID NO: 952169 - RNA, 19 nt, Homo sapiens
gcgaugagagcgccacuuc

SEQ ID NO: 952170 - RNA, 19 nt, Homo sapiens
acacaggcgugguggaagu

SEQ ID NO: 952171 - RNA, 19 nt, Homo sapiens
gagcauuucaccaaagaca

SEQ ID NO: 952172 - RNA, 19 nt, Homo sapiens
ucggcucacuucauucgua

SEQ ID NO: 952173 - RNA, 19 nt, Homo sapiens
uggaugagcugaggagagu

SEQ ID NO: 952174 - RNA, 19 nt, Homo sapiens
ucgacucacugcacuccua

SEQ ID NO: 952175 - RNA, 19 nt, Homo sapiens
aaauuuaucggcucacuuc

SEQ ID NO: 952176 - RNA, 19 nt, Homo sapiens
ucaccguccucgaguggaa

SEQ ID NO: 952177 - RNA, 19 nt, Homo sapiens
agaguggcauuucuaugga

SEQ ID NO: 952178 - RNA, 19 nt, Homo sapiens
ucacgucaccuacaagaag

SEQ ID NO: 952179 - RNA, 19 nt, Homo sapiens
ugcggaagcuacaggagaa

SEQ ID NO: 952180 - RNA, 19 nt, Homo sapiens
gagcagguggagaagaaga

SEQ ID NO: 952181 - RNA, 19 nt, Homo sapiens
acagauaagaguggcauuu

SEQ ID NO: 952182 - RNA, 19 nt, Homo sapiens
gcugaagaaagauguggaa

SEQ ID NO: 952183 - RNA, 19 nt, Homo sapiens
ccaaugacucagcaucuuc

SEQ ID NO: 952184 - RNA, 19 nt, Homo sapiens
ccagagucccgcagguuga

SEQ ID NO: 952185 - RNA, 19 nt, Homo sapiens
uacaggagaagcuggauga

SEQ ID NO: 952186 - RNA, 19 nt, Homo sapiens
ucugcaggcucaagagugu

SEQ ID NO: 952187 - RNA, 19 nt, Homo sapiens
cagaucacccggaaguuca

SEQ ID NO: 952188 - RNA, 19 nt, Homo sapiens
gcaagcucaucgacucacu

SEQ ID NO: 952189 - RNA, 19 nt, Homo sapiens
gaguggcauuucuauggau

SEQ ID NO: 952190 - RNA, 19 nt, Homo sapiens
uggaggagguucacaucuc

SEQ ID NO: 952191 - RNA, 19 nt, Homo sapiens
agauaagaguggcauuucu

SEQ ID NO: 952192 - RNA, 19 nt, Homo sapiens
cagauaagaguggcauuuc

SEQ ID NO: 952193 - RNA, 19 nt, Homo sapiens
agaguguuguccagauguu

SEQ ID NO: 952194 - RNA, 19 nt, Homo sapiens
gaauucugaaggcaaacuu

SEQ ID NO: 952195 - RNA, 19 nt, Homo sapiens
gaugagagcgccacuuccu

SEQ ID NO: 952196 - RNA, 19 nt, Homo sapiens
aagaguggcauuucuaugg

SEQ ID NO: 952197 - RNA, 19 nt, Homo sapiens
caaugacucagcaucuuca

SEQ ID NO: 952198 - RNA, 19 nt, Homo sapiens
uaagaguggcauuucuaug

SEQ ID NO: 952199 - RNA, 19 nt, Homo sapiens
cgcaagaggcugaagaaag

SEQ ID NO: 952200 - RNA, 19 nt, Homo sapiens
gggcgugacagauaagagu

SEQ ID NO: 952201 - RNA, 19 nt, Homo sapiens
caaauuuaucggcucacuu

SEQ ID NO: 952202 - RNA, 19 nt, Homo sapiens
ccaaggagccccacguaga

SEQ ID NO: 952203 - RNA, 19 nt, Homo sapiens
caaccacgacacagccaau

SEQ ID NO: 952204 - RNA, 19 nt, Homo sapiens
cacagaugcuggcgaugag

SEQ ID NO: 952205 - RNA, 19 nt, Homo sapiens
ccguaaaccuagagcuucu

SEQ ID NO: 952206 - RNA, 19 nt, Homo sapiens
gcaccuggcuccuuugaga

SEQ ID NO: 952207 - RNA, 19 nt, Homo sapiens
ccacugggacggaauaaau

SEQ ID NO: 952208 - RNA, 19 nt, Homo sapiens
ggaggaggccaucaucaug

SEQ ID NO: 952209 - RNA, 19 nt, Homo sapiens
ggagcauaaugaaguggaa

SEQ ID NO: 952210 - RNA, 19 nt, Homo sapiens
gcgagggccuauaaugcaa

SEQ ID NO: 952211 - RNA, 19 nt, Homo sapiens
uacgggcacuggagcauaa

SEQ ID NO: 952212 - RNA, 19 nt, Homo sapiens
ggaccggaagugugggaua

SEQ ID NO: 952213 - RNA, 19 nt, Homo sapiens
caucauggcgguggcagua

SEQ ID NO: 952214 - RNA, 19 nt, Homo sapiens
ugaacgcgagggccuauaa

SEQ ID NO: 952215 - RNA, 19 nt, Homo sapiens
ggauuggaacccugaucua

SEQ ID NO: 952216 - RNA, 19 nt, Homo sapiens
gcaggcgccuacaaaucga

SEQ ID NO: 952217 - RNA, 19 nt, Homo sapiens
gagggccuauaaugcaaga

SEQ ID NO: 952218 - RNA, 19 nt, Homo sapiens
gaacgcgagggccuauaau

SEQ ID NO: 952219 - RNA, 19 nt, Homo sapiens
gcacuggagcauaaugaag

SEQ ID NO: 952220 - RNA, 19 nt, Homo sapiens
caagaaccaaggcgaguca

SEQ ID NO: 952221 - RNA, 19 nt, Homo sapiens
gggcacuggagcauaauga

SEQ ID NO: 952222 - RNA, 19 nt, Homo sapiens
gaccggaagugugggauac

SEQ ID NO: 952223 - RNA, 19 nt, Homo sapiens
ggaggaggaggccaucauc

SEQ ID NO: 952224 - RNA, 19 nt, Homo sapiens
uuugagagcucggaguuuc

SEQ ID NO: 952225 - RNA, 19 nt, Homo sapiens
cggaccaucucaagugcuu

SEQ ID NO: 952226 - RNA, 19 nt, Homo sapiens
gaggaggaggccaucauca

SEQ ID NO: 952227 - RNA, 19 nt, Homo sapiens
gccuacaaaucgaggacuu

SEQ ID NO: 952228 - RNA, 19 nt, Homo sapiens
gcagaugcuucgggagaac

SEQ ID NO: 952229 - RNA, 19 nt, Homo sapiens
ggaggaccuugcagaugcu

SEQ ID NO: 952230 - RNA, 19 nt, Homo sapiens
gggcaccuggcuccuuuga

SEQ ID NO: 952231 - RNA, 19 nt, Homo sapiens
ccgcggaccaucucaagug

SEQ ID NO: 952232 - RNA, 19 nt, Homo sapiens
gauuggaacccugaucuac

SEQ ID NO: 952233 - RNA, 19 nt, Homo sapiens
cgacuacaaacggaacuug

SEQ ID NO: 952234 - RNA, 19 nt, Homo sapiens
ggaagcaguuugagaagua

SEQ ID NO: 952235 - RNA, 19 nt, Homo sapiens
ggagagaaacgcagauuua

SEQ ID NO: 952236 - RNA, 19 nt, Homo sapiens
gaaacuggcuggaggaaau

SEQ ID NO: 952237 - RNA, 19 nt, Homo sapiens
ggauguaguuccuuuguaa

SEQ ID NO: 952238 - RNA, 19 nt, Homo sapiens
uaacugaggaggagaaaua

SEQ ID NO: 952239 - RNA, 19 nt, Homo sapiens
gggcaggccucguaagaaa

SEQ ID NO: 952240 - RNA, 19 nt, Homo sapiens
gggcggaccuuuggacaua

SEQ ID NO: 952241 - RNA, 19 nt, Homo sapiens
agaaagauguagcagcaua

SEQ ID NO: 952242 - RNA, 19 nt, Homo sapiens
ccagaucccucaugauuca

SEQ ID NO: 952243 - RNA, 19 nt, Homo sapiens
gauaggaggaaacaaagua

SEQ ID NO: 952244 - RNA, 19 nt, Homo sapiens
gaugauaggaggaaacaaa

SEQ ID NO: 952245 - RNA, 19 nt, Homo sapiens
gagaaacgcagauuuagga

SEQ ID NO: 952246 - RNA, 19 nt, Homo sapiens
cauauucacuauccguuaa

SEQ ID NO: 952247 - RNA, 19 nt, Homo sapiens
caaguucuguguuugaaga

SEQ ID NO: 952248 - RNA, 19 nt, Homo sapiens
ccagaucaguggagagaaa

SEQ ID NO: 952249 - RNA, 19 nt, Homo sapiens
ggacacugaugccggagaa

SEQ ID NO: 952250 - RNA, 19 nt, Homo sapiens
cggagaagcugucacacaa

SEQ ID NO: 952251 - RNA, 19 nt, Homo sapiens
cacauugacuugggaauuu

SEQ ID NO: 952252 - RNA, 19 nt, Homo sapiens
guaaagagggagcacauug

SEQ ID NO: 952253 - RNA, 19 nt, Homo sapiens
ggccagaucccucaugauu

SEQ ID NO: 952254 - RNA, 19 nt, Homo sapiens
gcauauucacuauccguua

SEQ ID NO: 952255 - RNA, 19 nt, Homo sapiens
caagaaacagugugagcua

SEQ ID NO: 952256 - RNA, 19 nt, Homo sapiens
caagaagacucagcucauc

SEQ ID NO: 952257 - RNA, 19 nt, Homo sapiens
gaagacccagucaucagua

SEQ ID NO: 952258 - RNA, 19 nt, Homo sapiens
ggaggaaauaggcuuguuu

SEQ ID NO: 952259 - RNA, 19 nt, Homo sapiens
ggaagcaguuuuaguauca

SEQ ID NO: 952260 - RNA, 19 nt, Homo sapiens
gcacauugacuugggaauu

SEQ ID NO: 952261 - RNA, 19 nt, Homo sapiens
gccaugaaguggaugauca

SEQ ID NO: 952262 - RNA, 19 nt, Homo sapiens
aaaggaagcaguuugagaa

SEQ ID NO: 952263 - RNA, 19 nt, Homo sapiens
uuccagaguuguccuuaua

SEQ ID NO: 952264 - RNA, 19 nt, Homo sapiens
gcggaccuuuggacauaua

SEQ ID NO: 952265 - RNA, 19 nt, Homo sapiens
guuaauccuucuuucuuug

SEQ ID NO: 952266 - RNA, 19 nt, Homo sapiens
cguuaauccuucuuucuuu

SEQ ID NO: 952267 - RNA, 19 nt, Homo sapiens
uaaagagggagcacauuga

SEQ ID NO: 952268 - RNA, 19 nt, Homo sapiens
gaaagauguagcagcauau

SEQ ID NO: 952269 - RNA, 19 nt, Homo sapiens
gaaaacuaccuguggguua

SEQ ID NO: 952270 - RNA, 19 nt, Homo sapiens
uaaauucaccaacaugaug

SEQ ID NO: 952271 - RNA, 19 nt, Homo sapiens
agacucagcucaucaaagc

SEQ ID NO: 952272 - RNA, 19 nt, Homo sapiens
ucaccaacaugaugaugau

SEQ ID NO: 952273 - RNA, 19 nt, Homo sapiens
gcuauaguccugaauucaa

SEQ ID NO: 952274 - RNA, 19 nt, Homo sapiens
acaaaguacuggccagauc

SEQ ID NO: 952275 - RNA, 19 nt, Homo sapiens
aaaggaagcaguuuuagua

SEQ ID NO: 952276 - RNA, 19 nt, Homo sapiens
guagcagcauauucacuau

SEQ ID NO: 952277 - RNA, 19 nt, Homo sapiens
gcaggccucguaagaaaga

SEQ ID NO: 952278 - RNA, 19 nt, Homo sapiens
ggaacaggcaaccaucgaa

SEQ ID NO: 952279 - RNA, 19 nt, Homo sapiens
gagagaaacgcagauuuag

SEQ ID NO: 952280 - RNA, 19 nt, Homo sapiens
caagggaggccguuucuac

SEQ ID NO: 952281 - RNA, 19 nt, Homo sapiens
ucaguaaauucaccaacau

SEQ ID NO: 952282 - RNA, 19 nt, Homo sapiens
gaagacucagcucaucaaa

SEQ ID NO: 952283 - RNA, 19 nt, Homo sapiens
ccagaguuguccuuauaca

SEQ ID NO: 952284 - RNA, 19 nt, Homo sapiens
ggaagcaugacuugcacaa

SEQ ID NO: 952285 - RNA, 19 nt, Homo sapiens
acgcugaacugguguagca

SEQ ID NO: 952286 - RNA, 19 nt, Homo sapiens
gcuguuuucucuucccuua

SEQ ID NO: 952287 - RNA, 19 nt, Homo sapiens
guaaauucaccaacaugau

SEQ ID NO: 952288 - RNA, 19 nt, Homo sapiens
ccagucaucaguaaauuca

SEQ ID NO: 952289 - RNA, 19 nt, Homo sapiens
ccuauuuccuuguaaagag

SEQ ID NO: 952290 - RNA, 19 nt, Homo sapiens
uguagcagcauauucacua

SEQ ID NO: 952291 - RNA, 19 nt, Homo sapiens
aaacugugagccuaugauu

SEQ ID NO: 952292 - RNA, 19 nt, Homo sapiens
gagccgcuauaguccugaa

SEQ ID NO: 952293 - RNA, 19 nt, Homo sapiens
ccgcuauaguccugaauuc

SEQ ID NO: 952294 - RNA, 19 nt, Homo sapiens
gcuggaacuugcucucucu

SEQ ID NO: 952295 - RNA, 19 nt, Homo sapiens
agauguagcagcauauuca

SEQ ID NO: 952296 - RNA, 19 nt, Homo sapiens
aaaacuaccuguggguuaa

SEQ ID NO: 952297 - RNA, 19 nt, Homo sapiens
gaagcaguuugagaaguac

SEQ ID NO: 952298 - RNA, 19 nt, Homo sapiens
agagggagcacauugacuu

SEQ ID NO: 952299 - RNA, 19 nt, Homo sapiens
gagcuacugccacgcugaa

SEQ ID NO: 952300 - RNA, 19 nt, Homo sapiens
cuauaguccugaauucaag

SEQ ID NO: 952301 - RNA, 19 nt, Homo sapiens
aagacccagucaucaguaa

SEQ ID NO: 952302 - RNA, 19 nt, Homo sapiens
ccaacaugaugaugauagg

SEQ ID NO: 952303 - RNA, 19 nt, Homo sapiens
gacccagucaucaguaaau

SEQ ID NO: 952304 - RNA, 19 nt, Homo sapiens
gagggagcacauugacuug

SEQ ID NO: 952305 - RNA, 19 nt, Homo sapiens
gagauggagccgcuauagu

SEQ ID NO: 952306 - RNA, 19 nt, Homo sapiens
acagggagggcaaggguuu

SEQ ID NO: 952307 - RNA, 19 nt, Homo sapiens
ucaagaagacucagcucau

SEQ ID NO: 952308 - RNA, 19 nt, Homo sapiens
aaacuggcuggaggaaaua

SEQ ID NO: 952309 - RNA, 19 nt, Homo sapiens
cauauaaaggaagcaguuu

SEQ ID NO: 952310 - RNA, 19 nt, Homo sapiens
ccuacaccaucuuccauca

SEQ ID NO: 952311 - RNA, 19 nt, Homo sapiens
agauggagccgcuauaguc

SEQ ID NO: 952312 - RNA, 19 nt, Homo sapiens
gaggaggagaaauauguuc

SEQ ID NO: 952313 - RNA, 19 nt, Homo sapiens
ucaagaggaagcaugacuu

SEQ ID NO: 952314 - RNA, 19 nt, Homo sapiens
acauauaaaggaagcaguu

SEQ ID NO: 952315 - RNA, 19 nt, Homo sapiens
ggaccuuuggacauauaaa

SEQ ID NO: 952316 - RNA, 19 nt, Homo sapiens
aaagauguagcagcauauu

SEQ ID NO: 952317 - RNA, 19 nt, Homo sapiens
ugaucaagaggaagcauga

SEQ ID NO: 952318 - RNA, 19 nt, Homo sapiens
cugaggaggagaaauaugu

SEQ ID NO: 952319 - RNA, 19 nt, Homo sapiens
aggcuuguuuccagaguug

SEQ ID NO: 952320 - RNA, 19 nt, Homo sapiens
uacaccaucuuccaucaag

SEQ ID NO: 952321 - RNA, 19 nt, Homo sapiens
aaauucaccaacaugauga

SEQ ID NO: 952322 - RNA, 19 nt, Homo sapiens
gugggcaggccucguaaga

SEQ ID NO: 952323 - RNA, 19 nt, Homo sapiens
agaagacucagcucaucaa

SEQ ID NO: 952324 - RNA, 19 nt, Homo sapiens
agaggaagcaugacuugca

SEQ ID NO: 952325 - RNA, 19 nt, Homo sapiens
ggagaagcugucacacaag

SEQ ID NO: 952326 - RNA, 19 nt, Homo sapiens
ugaagacccagucaucagu

SEQ ID NO: 952327 - RNA, 19 nt, Homo sapiens
aaaagcaguuucuggugaa

SEQ ID NO: 952328 - RNA, 19 nt, Homo sapiens
guucgggagcucaagaaga

SEQ ID NO: 952329 - RNA, 19 nt, Homo sapiens
gcugguacccauccucaag

SEQ ID NO: 952330 - RNA, 19 nt, Homo sapiens
ugaaaaggaagcaguuuga

SEQ ID NO: 952331 - RNA, 19 nt, Homo sapiens
aguaaauucaccaacauga

SEQ ID NO: 952332 - RNA, 19 nt, Homo sapiens
uagcauguggugcagcauu

SEQ ID NO: 952333 - RNA, 19 nt, Homo sapiens
ccguuaauccuucuuucuu

SEQ ID NO: 952334 - RNA, 19 nt, Homo sapiens
gaagacagcccuggaaaug

SEQ ID NO: 952335 - RNA, 19 nt, Homo sapiens
gaaccucuguauucuucua

SEQ ID NO: 952336 - RNA, 19 nt, Homo sapiens
gcagaacccagaauuagaa

SEQ ID NO: 952337 - RNA, 19 nt, Homo sapiens
gaaauucucuacguuacau

SEQ ID NO: 952338 - RNA, 19 nt, Homo sapiens
gaacccagaauuagaaguu

SEQ ID NO: 952339 - RNA, 19 nt, Homo sapiens
gaccauacccuaggaaauu

SEQ ID NO: 952340 - RNA, 19 nt, Homo sapiens
gaagaacccggaaguggaa

SEQ ID NO: 952341 - RNA, 19 nt, Homo sapiens
gcauaaaggacuauaagga

SEQ ID NO: 952342 - RNA, 19 nt, Homo sapiens
ggaagaccauacccuagga

SEQ ID NO: 952343 - RNA, 19 nt, Homo sapiens
guuggaaucucugcaagaa

SEQ ID NO: 952344 - RNA, 19 nt, Homo sapiens
uaggaaauucucuacguua

SEQ ID NO: 952345 - RNA, 19 nt, Homo sapiens
gaaguggaauuuugugguu

SEQ ID NO: 952346 - RNA, 19 nt, Homo sapiens
ggugcagaacccagaauua

SEQ ID NO: 952347 - RNA, 19 nt, Homo sapiens
gccaacaugugcuugacaa

SEQ ID NO: 952348 - RNA, 19 nt, Homo sapiens
gaacccggaaguggaauuu

SEQ ID NO: 952349 - RNA, 19 nt, Homo sapiens
ggaagacagcccuggaaau

SEQ ID NO: 952350 - RNA, 19 nt, Homo sapiens
cuaggaaauucucuacguu

SEQ ID NO: 952351 - RNA, 19 nt, Homo sapiens
gaauuagaaguuugugguu

SEQ ID NO: 952352 - RNA, 19 nt, Homo sapiens
cauaaaggacuauaaggau

SEQ ID NO: 952353 - RNA, 19 nt, Homo sapiens
agacagcccuggaaauggu

SEQ ID NO: 952354 - RNA, 19 nt, Homo sapiens
aucaggagcuggagagaaa

SEQ ID NO: 952355 - RNA, 19 nt, Homo sapiens
ugcaagaaccucuguauuc

SEQ ID NO: 952356 - RNA, 19 nt, Homo sapiens
aaagcaagcagaaaugaau

SEQ ID NO: 952357 - RNA, 19 nt, Homo sapiens
gaggaagacagcccuggaa

SEQ ID NO: 952358 - RNA, 19 nt, Homo sapiens
ucuaguccuuuaugcagua

SEQ ID NO: 952359 - RNA, 19 nt, Homo sapiens
uaaaggacuauaaggauca

SEQ ID NO: 952360 - RNA, 19 nt, Homo sapiens
caaguuugaggccagcaua

SEQ ID NO: 952361 - RNA, 19 nt, Homo sapiens
ggaaauucucuacguuaca

SEQ ID NO: 952362 - RNA, 19 nt, Homo sapiens
gugcagaacccagaauuag

SEQ ID NO: 952363 - RNA, 19 nt, Homo sapiens
gaucaggagcuggagagaa

SEQ ID NO: 952364 - RNA, 19 nt, Homo sapiens
ccuaggaaauucucuacgu

SEQ ID NO: 952365 - RNA, 19 nt, Homo sapiens
gaagaccauacccuaggaa

SEQ ID NO: 952366 - RNA, 19 nt, Homo sapiens
cagcauaaaggacuauaag

SEQ ID NO: 952367 - RNA, 19 nt, Homo sapiens
gcugaaggcgagaggaaga

SEQ ID NO: 952368 - RNA, 19 nt, Homo sapiens
ccuugcagcuguuggaauc

SEQ ID NO: 952369 - RNA, 19 nt, Homo sapiens
cagcauacucuguccuuca

SEQ ID NO: 952370 - RNA, 19 nt, Homo sapiens
gcuguugagccauuucaga

SEQ ID NO: 952371 - RNA, 19 nt, Homo sapiens
cuacgacccauccuucaga

SEQ ID NO: 952372 - RNA, 19 nt, Homo sapiens
ucucuacguuacaugauca

SEQ ID NO: 952373 - RNA, 19 nt, Homo sapiens
gcgugauucuagcuguuga

SEQ ID NO: 952374 - RNA, 19 nt, Homo sapiens
ggauauucucuuccugaug

SEQ ID NO: 952375 - RNA, 19 nt, Homo sapiens
ccagcauaaaggacuauaa

SEQ ID NO: 952376 - RNA, 19 nt, Homo sapiens
gaaaggcgugauucuagcu

SEQ ID NO: 952377 - RNA, 19 nt, Homo sapiens
ccacauucuaguccuuuau

SEQ ID NO: 952378 - RNA, 19 nt, Homo sapiens
uccacauucuaguccuuua

SEQ ID NO: 952379 - RNA, 19 nt, Homo sapiens
gaagaccucaauggcugaa

SEQ ID NO: 952380 - RNA, 19 nt, Homo sapiens
ucaugaaugucugccaaca

SEQ ID NO: 952381 - RNA, 19 nt, Homo sapiens
aguuugugguuacagcaua

SEQ ID NO: 952382 - RNA, 19 nt, Homo sapiens
aacccagaauuagaaguuu

SEQ ID NO: 952383 - RNA, 19 nt, Homo sapiens
aaaggacuauaaggaucaa

SEQ ID NO: 952384 - RNA, 19 nt, Homo sapiens
aggaaauucucuacguuac

SEQ ID NO: 952385 - RNA, 19 nt, Homo sapiens
gcuguuggaaucucugcaa

SEQ ID NO: 952386 - RNA, 19 nt, Homo sapiens
acccagaauuagaaguuug

SEQ ID NO: 952387 - RNA, 19 nt, Homo sapiens
uuuaugcaguauacaagga

SEQ ID NO: 952388 - RNA, 19 nt, Homo sapiens
gaagucaaaccuuaagaua

SEQ ID NO: 952389 - RNA, 19 nt, Homo sapiens
gcuguaaccugaagucaaa

SEQ ID NO: 952390 - RNA, 19 nt, Homo sapiens
gcccgaagaugacaugaaa

SEQ ID NO: 952391 - RNA, 19 nt, Homo sapiens
gauaaucuucggccaauuu

SEQ ID NO: 952392 - RNA, 19 nt, Homo sapiens
ucauugaguuucugucuuu

SEQ ID NO: 952393 - RNA, 19 nt, Homo sapiens
aaccugaagucaaaccuua

SEQ ID NO: 952394 - RNA, 19 nt, Homo sapiens
caugaaaccaggaagcuuu

SEQ ID NO: 952395 - RNA, 19 nt, Homo sapiens
agaauggccucaccagcaa

SEQ ID NO: 952396 - RNA, 19 nt, Homo sapiens
gauguuguguuguuaucau

SEQ ID NO: 952397 - RNA, 19 nt, Homo sapiens
gccaauuuaugcagaguca

SEQ ID NO: 952398 - RNA, 19 nt, Homo sapiens
agccauuccuguucucuuu

SEQ ID NO: 952399 - RNA, 19 nt, Homo sapiens
gccuugauguuguguuguu

SEQ ID NO: 952400 - RNA, 19 nt, Homo sapiens
ggauaaucuucggccaauu

SEQ ID NO: 952401 - RNA, 19 nt, Homo sapiens
guccauaccugaaaacaau

SEQ ID NO: 952402 - RNA, 19 nt, Homo sapiens
uggauaaucuucggccaau

SEQ ID NO: 952403 - RNA, 19 nt, Homo sapiens
uaucaugcgcacaaucauu

SEQ ID NO: 952404 - RNA, 19 nt, Homo sapiens
ggucauucagcgacaagaa

SEQ ID NO: 952405 - RNA, 19 nt, Homo sapiens
ccuguucucuuugccuuga

SEQ ID NO: 952406 - RNA, 19 nt, Homo sapiens
aaucuucggccaauuuaug

SEQ ID NO: 952407 - RNA, 19 nt, Homo sapiens
guuugucugugugcuguaa

SEQ ID NO: 952408 - RNA, 19 nt, Homo sapiens
gaugacaugaaaccaggaa

SEQ ID NO: 952409 - RNA, 19 nt, Homo sapiens
auaaucuucggccaauuua

SEQ ID NO: 952410 - RNA, 19 nt, Homo sapiens
ugaagucaaaccuuaagau

SEQ ID NO: 952411 - RNA, 19 nt, Homo sapiens
aauaucaugcgcacaauca

SEQ ID NO: 952412 - RNA, 19 nt, Homo sapiens
ccuugauguuguguuguua

SEQ ID NO: 952413 - RNA, 19 nt, Homo sapiens
aacaauaucaugcgcacaa

SEQ ID NO: 952414 - RNA, 19 nt, Homo sapiens
gucaaaccuuaagauaaug

SEQ ID NO: 952415 - RNA, 19 nt, Homo sapiens
gagccuccugggcauguuu

SEQ ID NO: 952416 - RNA, 19 nt, Homo sapiens
uugaguuucugucuuucuu

SEQ ID NO: 952417 - RNA, 19 nt, Homo sapiens
gaacaacagcugcucauuu

SEQ ID NO: 952418 - RNA, 19 nt, Homo sapiens
gcaugaaggucccugauga

SEQ ID NO: 952419 - RNA, 19 nt, Homo sapiens
gcaggcagguucucugaaa

SEQ ID NO: 952420 - RNA, 19 nt, Homo sapiens
gcagauaaccuggagauuu

SEQ ID NO: 952421 - RNA, 19 nt, Homo sapiens
ucaguuagauuccaucauu

SEQ ID NO: 952422 - RNA, 19 nt, Homo sapiens
gaaaggagaugaaguugcu

SEQ ID NO: 952423 - RNA, 19 nt, Homo sapiens
gaacugaagaagaagauuu

SEQ ID NO: 952424 - RNA, 19 nt, Homo sapiens
cgagugaucuuaagcaguu

SEQ ID NO: 952425 - RNA, 19 nt, Homo sapiens
cagauaaccuggagauuuc

SEQ ID NO: 952426 - RNA, 19 nt, Homo sapiens
ucuaaucccuuucugagua

SEQ ID NO: 952427 - RNA, 19 nt, Homo sapiens
cagaagaucuagaacugaa

SEQ ID NO: 952428 - RNA, 19 nt, Homo sapiens
gagcagcugucacucauca

SEQ ID NO: 952429 - RNA, 19 nt, Homo sapiens
cagaagguauguuaagcua

SEQ ID NO: 952430 - RNA, 19 nt, Homo sapiens
gaagguauguuaagcuacu

SEQ ID NO: 952431 - RNA, 19 nt, Homo sapiens
ggugaucguuggcagaauu

SEQ ID NO: 952432 - RNA, 19 nt, Homo sapiens
gaaacucuaugacauugag

SEQ ID NO: 952433 - RNA, 19 nt, Homo sapiens
caaugcagaagguauguua

SEQ ID NO: 952434 - RNA, 19 nt, Homo sapiens
ucucaugccuuccaaguug

SEQ ID NO: 952435 - RNA, 19 nt, Homo sapiens
uaagcuggcugucuugugu

SEQ ID NO: 952436 - RNA, 19 nt, Homo sapiens
gaagagcagcugucacuca

SEQ ID NO: 952437 - RNA, 19 nt, Homo sapiens
guaccucaguggagucauu

SEQ ID NO: 952438 - RNA, 19 nt, Homo sapiens
gaacacugcaagcccuuaa

SEQ ID NO: 952439 - RNA, 19 nt, Homo sapiens
cauccacccuucuagcuuu

SEQ ID NO: 952440 - RNA, 19 nt, Homo sapiens
aacaacagcugcucauuuc

SEQ ID NO: 952441 - RNA, 19 nt, Homo sapiens
ucagaaaggagaugaaguu

SEQ ID NO: 952442 - RNA, 19 nt, Homo sapiens
gaauucgugucuccuagug

SEQ ID NO: 952443 - RNA, 19 nt, Homo sapiens
aaacauguccuacagacuu

SEQ ID NO: 952444 - RNA, 19 nt, Homo sapiens
gugaaacucuaugacauug

SEQ ID NO: 952445 - RNA, 19 nt, Homo sapiens
gaucuagaacugaagaaga

SEQ ID NO: 952446 - RNA, 19 nt, Homo sapiens
gaagaucuagaacugaaga

SEQ ID NO: 952447 - RNA, 19 nt, Homo sapiens
ugaggcaccuaccuucauu

SEQ ID NO: 952448 - RNA, 19 nt, Homo sapiens
cccagugaauuucuuguaa

SEQ ID NO: 952449 - RNA, 19 nt, Homo sapiens
ucaugagacucgccaaguu

SEQ ID NO: 952450 - RNA, 19 nt, Homo sapiens
gauaaggaacgcccuggaa

SEQ ID NO: 952451 - RNA, 19 nt, Homo sapiens
ccagugaauuucuuguaau

SEQ ID NO: 952452 - RNA, 19 nt, Homo sapiens
ggacgagugccucaugaga

SEQ ID NO: 952453 - RNA, 19 nt, Homo sapiens
ugaagaagauugggacagu

SEQ ID NO: 952454 - RNA, 19 nt, Homo sapiens
ggugaaacucuaugacauu

SEQ ID NO: 952455 - RNA, 19 nt, Homo sapiens
cagugaauuucuuguaaug

SEQ ID NO: 952456 - RNA, 19 nt, Homo sapiens
gaacccacgcccugaugaa

SEQ ID NO: 952457 - RNA, 19 nt, Homo sapiens
gagcaggcagguucucuga

SEQ ID NO: 952458 - RNA, 19 nt, Homo sapiens
gugaauuucuuguaaugca

SEQ ID NO: 952459 - RNA, 19 nt, Homo sapiens
gaaaccaugcaucucaaug

SEQ ID NO: 952460 - RNA, 19 nt, Homo sapiens
caauauccaagaagcagua

SEQ ID NO: 952461 - RNA, 19 nt, Homo sapiens
ucagcuugauugcauuuga

SEQ ID NO: 952462 - RNA, 19 nt, Homo sapiens
guagucugcccgucacuuu

SEQ ID NO: 952463 - RNA, 19 nt, Homo sapiens
gcuaguggaggaaggaauu

SEQ ID NO: 952464 - RNA, 19 nt, Homo sapiens
gaucguuggcagaauuaaa

SEQ ID NO: 952465 - RNA, 19 nt, Homo sapiens
caucagugguugucccaau

SEQ ID NO: 952466 - RNA, 19 nt, Homo sapiens
gagcaacagcagauaagga

SEQ ID NO: 952467 - RNA, 19 nt, Homo sapiens
cgacugggccaugcuguuu

SEQ ID NO: 952468 - RNA, 19 nt, Homo sapiens
ucuaugacauugagcaaca

SEQ ID NO: 952469 - RNA, 19 nt, Homo sapiens
cagcagcacuugcguucuc

SEQ ID NO: 952470 - RNA, 19 nt, Homo sapiens
cagauacagcgaaggcaua

SEQ ID NO: 952471 - RNA, 19 nt, Homo sapiens
uuaaaacucuguacccauu

SEQ ID NO: 952472 - RNA, 19 nt, Homo sapiens
uuaagcaguuccacuucuu

SEQ ID NO: 952473 - RNA, 19 nt, Homo sapiens
uccagaagaucuagaacug

SEQ ID NO: 952474 - RNA, 19 nt, Homo sapiens
gccagugauuguaguuuca

SEQ ID NO: 952475 - RNA, 19 nt, Homo sapiens
gguagcagcccacggagau

SEQ ID NO: 952476 - RNA, 19 nt, Homo sapiens
ccacugcugagaagguuaa

SEQ ID NO: 952477 - RNA, 19 nt, Homo sapiens
gaccugggaccuugucaug

SEQ ID NO: 952478 - RNA, 19 nt, Homo sapiens
ggaacacugcaagcccuua

SEQ ID NO: 952479 - RNA, 19 nt, Homo sapiens
uaagcuacugcgacagaua

SEQ ID NO: 952480 - RNA, 19 nt, Homo sapiens
caugagacucgccaaguug

SEQ ID NO: 952481 - RNA, 19 nt, Homo sapiens
guuaagcuacugcgacaga

SEQ ID NO: 952482 - RNA, 19 nt, Homo sapiens
ggaaaccaugcaucucaau

SEQ ID NO: 952483 - RNA, 19 nt, Homo sapiens
gcaguuccacuucuugucu

SEQ ID NO: 952484 - RNA, 19 nt, Homo sapiens
caguuagauuccaucauug

SEQ ID NO: 952485 - RNA, 19 nt, Homo sapiens
gcuuccaggugaaacucua

SEQ ID NO: 952486 - RNA, 19 nt, Homo sapiens
aacauguccuacagacuuu

SEQ ID NO: 952487 - RNA, 19 nt, Homo sapiens
ccugggaccuugucauguc

SEQ ID NO: 952488 - RNA, 19 nt, Homo sapiens
aucuagaacugaagaagaa

SEQ ID NO: 952489 - RNA, 19 nt, Homo sapiens
gggcagauaaccuggagau

SEQ ID NO: 952490 - RNA, 19 nt, Homo sapiens
ucgccaaguugaagaguca

SEQ ID NO: 952491 - RNA, 19 nt, Homo sapiens
gaggaaggaauucgugucu

SEQ ID NO: 952492 - RNA, 19 nt, Homo sapiens
cccacgcccugaugaagaa

SEQ ID NO: 952493 - RNA, 19 nt, Homo sapiens
ggccacugcugagaagguu

SEQ ID NO: 952494 - RNA, 19 nt, Homo sapiens
uggaaaccaugcaucucaa

SEQ ID NO: 952495 - RNA, 19 nt, Homo sapiens
gugaucguuggcagaauua

SEQ ID NO: 952496 - RNA, 19 nt, Homo sapiens
aagagcagcugucacucau

SEQ ID NO: 952497 - RNA, 19 nt, Homo sapiens
ggaacgcccuggaaaacau

SEQ ID NO: 952498 - RNA, 19 nt, Homo sapiens
gcagaagguauguuaagcu

SEQ ID NO: 952499 - RNA, 19 nt, Homo sapiens
ggaauucgugucuccuagu

SEQ ID NO: 952500 - RNA, 19 nt, Homo sapiens
ugaaccgccugcaauaugc

SEQ ID NO: 952501 - RNA, 19 nt, Homo sapiens
auaaggaacgcccuggaaa

SEQ ID NO: 952502 - RNA, 19 nt, Homo sapiens
gaagguuaaccaggacaug

SEQ ID NO: 952503 - RNA, 19 nt, Homo sapiens
gcauccacccuucuagcuu

SEQ ID NO: 952504 - RNA, 19 nt, Homo sapiens
cuacgacaguggacagaac

SEQ ID NO: 952505 - RNA, 19 nt, Homo sapiens
ccagaagaucuagaacuga

SEQ ID NO: 952506 - RNA, 19 nt, Homo sapiens
cuuaaucagcccucuguga

SEQ ID NO: 952507 - RNA, 19 nt, Homo sapiens
caggugaaacucuaugaca

SEQ ID NO: 952508 - RNA, 19 nt, Homo sapiens
gaccuugucaugucagaag

SEQ ID NO: 952509 - RNA, 19 nt, Homo sapiens
aucagugguugucccaaua

SEQ ID NO: 952510 - RNA, 19 nt, Homo sapiens
gugauuguaguuucauguu

SEQ ID NO: 952511 - RNA, 19 nt, Homo sapiens
cauaaaacauguccuacag

SEQ ID NO: 952512 - RNA, 19 nt, Homo sapiens
ccaugcgaguccagaagga

SEQ ID NO: 952513 - RNA, 19 nt, Homo sapiens
gcagcugucacucaucagu

SEQ ID NO: 952514 - RNA, 19 nt, Homo sapiens
ugaaaggcucccugagugu

SEQ ID NO: 952515 - RNA, 19 nt, Homo sapiens
cuagcuuucugucucuaug

SEQ ID NO: 952516 - RNA, 19 nt, Homo sapiens
ugaugacccggagcacuua

SEQ ID NO: 952517 - RNA, 19 nt, Homo sapiens
gaagacagcugaguacauc

SEQ ID NO: 952518 - RNA, 19 nt, Homo sapiens
ccacagcggucacuucaug

SEQ ID NO: 952519 - RNA, 19 nt, Homo sapiens
gacacucucuucaccauga

SEQ ID NO: 952520 - RNA, 19 nt, Homo sapiens
gcccaugccuucaaacuuc

SEQ ID NO: 952521 - RNA, 19 nt, Homo sapiens
ggaggaugcuguuuaucug

SEQ ID NO: 952522 - RNA, 19 nt, Homo sapiens
ggagacagucccugaauuc

SEQ ID NO: 952523 - RNA, 19 nt, Homo sapiens
gaaagaggaggaugcuguu

SEQ ID NO: 952524 - RNA, 19 nt, Homo sapiens
gggcaggcaucaugugugu

SEQ ID NO: 952525 - RNA, 19 nt, Homo sapiens
ggaccgcuguguuucaauc

SEQ ID NO: 952526 - RNA, 19 nt, Homo sapiens
acaagaagcggcuccguaa

SEQ ID NO: 952527 - RNA, 19 nt, Homo sapiens
gacaagauccgccugaaca

SEQ ID NO: 952528 - RNA, 19 nt, Homo sapiens
agaggaggaugcuguuuau

SEQ ID NO: 952529 - RNA, 19 nt, Homo sapiens
gagacauguuugaugacua

SEQ ID NO: 952530 - RNA, 19 nt, Homo sapiens
ucucuucucucccagguuu

SEQ ID NO: 952531 - RNA, 19 nt, Homo sapiens
gguccagguuucacacuug

SEQ ID NO: 952532 - RNA, 19 nt, Homo sapiens
gagacaagauccgccugaa

SEQ ID NO: 952533 - RNA, 19 nt, Homo sapiens
ggagcaggguccagguuuc

SEQ ID NO: 952534 - RNA, 19 nt, Homo sapiens
acaaguggcgcaucuacua

SEQ ID NO: 952535 - RNA, 19 nt, Homo sapiens
gggcacaucuaccaguauc

SEQ ID NO: 952536 - RNA, 19 nt, Homo sapiens
aagaggaggaugcuguuua

SEQ ID NO: 952537 - RNA, 19 nt, Homo sapiens
cggcaaugcugacaugauc

SEQ ID NO: 952538 - RNA, 19 nt, Homo sapiens
ucucagauuucuuuaccaa

SEQ ID NO: 952539 - RNA, 19 nt, Homo sapiens
ugcgagacauguuugauga

SEQ ID NO: 952540 - RNA, 19 nt, Homo sapiens
ugacucguccgcugucuuu

SEQ ID NO: 952541 - RNA, 19 nt, Homo sapiens
ccagaugcgagacauguuu

SEQ ID NO: 952542 - RNA, 19 nt, Homo sapiens
gcagaagacagcugaguac

SEQ ID NO: 952543 - RNA, 19 nt, Homo sapiens
gcaggcaucaugugugugu

SEQ ID NO: 952544 - RNA, 19 nt, Homo sapiens
agacauguuugaugacuac

SEQ ID NO: 952545 - RNA, 19 nt, Homo sapiens
ucagauuucuuuaccaacu

SEQ ID NO: 952546 - RNA, 19 nt, Homo sapiens
cagcagggcaggcaucaug

SEQ ID NO: 952547 - RNA, 19 nt, Homo sapiens
acagcugaguacauccuua

SEQ ID NO: 952548 - RNA, 19 nt, Homo sapiens
ccaaguggaagaauuucaa

SEQ ID NO: 952549 - RNA, 19 nt, Homo sapiens
aaaacugucugcugguuaa

SEQ ID NO: 952550 - RNA, 19 nt, Homo sapiens
caaguggaagaauuucaaa

SEQ ID NO: 952551 - RNA, 19 nt, Homo sapiens
gugguugacucccucuuca

SEQ ID NO: 952552 - RNA, 19 nt, Homo sapiens
ggaugcuguuuaucuguca

SEQ ID NO: 952553 - RNA, 19 nt, Homo sapiens
uggcgcaucuacuacaaga

SEQ ID NO: 952554 - RNA, 19 nt, Homo sapiens
cuaccacgcugcagaagac

SEQ ID NO: 952555 - RNA, 19 nt, Homo sapiens
cgucggcaaugcugacaug

SEQ ID NO: 952556 - RNA, 19 nt, Homo sapiens
gcgcaucuacuacaagaag

SEQ ID NO: 952557 - RNA, 19 nt, Homo sapiens
ggccaacuguccugaacuc

SEQ ID NO: 952558 - RNA, 19 nt, Homo sapiens
aggagacagucccugaauu

SEQ ID NO: 952559 - RNA, 19 nt, Homo sapiens
ucucccaaguggaagaauu

SEQ ID NO: 952560 - RNA, 19 nt, Homo sapiens
gaccagaugcgagacaugu

SEQ ID NO: 952561 - RNA, 19 nt, Homo sapiens
gcgccuuccugaguucuga

SEQ ID NO: 952562 - RNA, 19 nt, Homo sapiens
cagacacucucuucaccau

SEQ ID NO: 952563 - RNA, 19 nt, Homo sapiens
cuuggcagcugugacauug

SEQ ID NO: 952564 - RNA, 19 nt, Homo sapiens
gagcaggguccagguuuca

SEQ ID NO: 952565 - RNA, 19 nt, Homo sapiens
guacgcugcacaacuggaa

SEQ ID NO: 952566 - RNA, 19 nt, Homo sapiens
gaacccguacgcugcacaa

SEQ ID NO: 952567 - RNA, 19 nt, Homo sapiens
cagcugaguacauccuuau

SEQ ID NO: 952568 - RNA, 19 nt, Homo sapiens
ugguauauccaguauguga

SEQ ID NO: 952569 - RNA, 19 nt, Homo sapiens
gagcagagaagcagaaaag

SEQ ID NO: 952570 - RNA, 19 nt, Homo sapiens
ccacacgggcagucacaga

SEQ ID NO: 952571 - RNA, 19 nt, Homo sapiens
ccucauccggccucuguuu

SEQ ID NO: 952572 - RNA, 19 nt, Homo sapiens
cgagacauguuugaugacu

SEQ ID NO: 952573 - RNA, 19 nt, Homo sapiens
gcagcugcgggaugagauu

SEQ ID NO: 952574 - RNA, 19 nt, Homo sapiens
gaauuucaaaggccucaag

SEQ ID NO: 952575 - RNA, 19 nt, Homo sapiens
gaguucugauuuccuccuu

SEQ ID NO: 952576 - RNA, 19 nt, Homo sapiens
caucucagacacucucuuc

SEQ ID NO: 952577 - RNA, 19 nt, Homo sapiens
gaggaugcuguuuaucugu

SEQ ID NO: 952578 - RNA, 19 nt, Homo sapiens
ccccaccucugcugcauua

SEQ ID NO: 952579 - RNA, 19 nt, Homo sapiens
gggcucaacgguggaaaga

SEQ ID NO: 952580 - RNA, 19 nt, Homo sapiens
gaagguucaaucagcagau

SEQ ID NO: 952581 - RNA, 19 nt, Homo sapiens
ggguccagguuucacacuu

SEQ ID NO: 952582 - RNA, 19 nt, Homo sapiens
agacccugcugcucacuca

SEQ ID NO: 952583 - RNA, 19 nt, Homo sapiens
cccguacgcugcacaacug

SEQ ID NO: 952584 - RNA, 19 nt, Homo sapiens
gguauauccaguaugugaa

SEQ ID NO: 952585 - RNA, 19 nt, Homo sapiens
agccaagccuggaugacuu

SEQ ID NO: 952586 - RNA, 19 nt, Homo sapiens
gcagagaagcagaaaagga

SEQ ID NO: 952587 - RNA, 19 nt, Homo sapiens
ugaguacauccuuaugcua

SEQ ID NO: 952588 - RNA, 19 nt, Homo sapiens
uaugugaagcggaggaaga

SEQ ID NO: 952589 - RNA, 19 nt, Homo sapiens
gacaccagggccagaguga

SEQ ID NO: 952590 - RNA, 19 nt, Homo sapiens
ugcagaagacagcugagua

SEQ ID NO: 952591 - RNA, 19 nt, Homo sapiens
uggcaccacccacugcuuu

SEQ ID NO: 952592 - RNA, 19 nt, Homo sapiens
ggccaugacccaccucucu

SEQ ID NO: 952593 - RNA, 19 nt, Homo sapiens
gauguguguguguggguuu

SEQ ID NO: 952594 - RNA, 19 nt, Homo sapiens
guacauccuuaugcuacag

SEQ ID NO: 952595 - RNA, 19 nt, Homo sapiens
gcaaugcugacaugaucca

SEQ ID NO: 952596 - RNA, 19 nt, Homo sapiens
aagcuggugucucccaagu

SEQ ID NO: 952597 - RNA, 19 nt, Homo sapiens
gcagggcaggcaucaugug

SEQ ID NO: 952598 - RNA, 19 nt, Homo sapiens
gcaggguccagguuucaca

SEQ ID NO: 952599 - RNA, 19 nt, Homo sapiens
gcuugagccuggccuacag

SEQ ID NO: 952600 - RNA, 19 nt, Homo sapiens
caacaaccccugccucaca

SEQ ID NO: 952601 - RNA, 19 nt, Homo sapiens
ccagcgccuuccugaguuc

SEQ ID NO: 952602 - RNA, 19 nt, Homo sapiens
ccacagcggucacuucaug

SEQ ID NO: 952603 - RNA, 19 nt, Homo sapiens
gacacucucuucaccauga

SEQ ID NO: 952604 - RNA, 19 nt, Homo sapiens
gcccaugccuucaaacuuc

SEQ ID NO: 952605 - RNA, 19 nt, Homo sapiens
ggaggaugcuguuuaucug

SEQ ID NO: 952606 - RNA, 19 nt, Homo sapiens
ggagacagucccugaauuc

SEQ ID NO: 952607 - RNA, 19 nt, Homo sapiens
gaaagaggaggaugcuguu

SEQ ID NO: 952608 - RNA, 19 nt, Homo sapiens
gggcaggcaucaugugugu

SEQ ID NO: 952609 - RNA, 19 nt, Homo sapiens
ggaccgcuguguuucaauc

SEQ ID NO: 952610 - RNA, 19 nt, Homo sapiens
acaagaagcggcuccguaa

SEQ ID NO: 952611 - RNA, 19 nt, Homo sapiens
gacaagauccgccugaaca

SEQ ID NO: 952612 - RNA, 19 nt, Homo sapiens
agaggaggaugcuguuuau

SEQ ID NO: 952613 - RNA, 19 nt, Homo sapiens
gagacauguuugaugacua

SEQ ID NO: 952614 - RNA, 19 nt, Homo sapiens
ucucuucucucccagguuu

SEQ ID NO: 952615 - RNA, 19 nt, Homo sapiens
gguccagguuucacacuug

SEQ ID NO: 952616 - RNA, 19 nt, Homo sapiens
gagacaagauccgccugaa

SEQ ID NO: 952617 - RNA, 19 nt, Homo sapiens
ggagcaggguccagguuuc

SEQ ID NO: 952618 - RNA, 19 nt, Homo sapiens
acaaguggcgcaucuacua

SEQ ID NO: 952619 - RNA, 19 nt, Homo sapiens
gggcacaucuaccaguauc

SEQ ID NO: 952620 - RNA, 19 nt, Homo sapiens
aagaggaggaugcuguuua

SEQ ID NO: 952621 - RNA, 19 nt, Homo sapiens
cggcaaugcugacaugauc

SEQ ID NO: 952622 - RNA, 19 nt, Homo sapiens
ucucagauuucuuuaccaa

SEQ ID NO: 952623 - RNA, 19 nt, Homo sapiens
ugcgagacauguuugauga

SEQ ID NO: 952624 - RNA, 19 nt, Homo sapiens
ugacucguccgcugucuuu

SEQ ID NO: 952625 - RNA, 19 nt, Homo sapiens
ccagaugcgagacauguuu

SEQ ID NO: 952626 - RNA, 19 nt, Homo sapiens
gcaggcaucaugugugugu

SEQ ID NO: 952627 - RNA, 19 nt, Homo sapiens
agacauguuugaugacuac

SEQ ID NO: 952628 - RNA, 19 nt, Homo sapiens
ucagauuucuuuaccaacu

SEQ ID NO: 952629 - RNA, 19 nt, Homo sapiens
cagcagggcaggcaucaug

SEQ ID NO: 952630 - RNA, 19 nt, Homo sapiens
ccaaguggaagaauuucaa

SEQ ID NO: 952631 - RNA, 19 nt, Homo sapiens
aaaacugucugcugguuaa

SEQ ID NO: 952632 - RNA, 19 nt, Homo sapiens
caaguggaagaauuucaaa

SEQ ID NO: 952633 - RNA, 19 nt, Homo sapiens
gugguugacucccucuuca

SEQ ID NO: 952634 - RNA, 19 nt, Homo sapiens
ggaugcuguuuaucuguca

SEQ ID NO: 952635 - RNA, 19 nt, Homo sapiens
uggcgcaucuacuacaaga

SEQ ID NO: 952636 - RNA, 19 nt, Homo sapiens
cgucggcaaugcugacaug

SEQ ID NO: 952637 - RNA, 19 nt, Homo sapiens
gcgcaucuacuacaagaag

SEQ ID NO: 952638 - RNA, 19 nt, Homo sapiens
ggccaacuguccugaacuc

SEQ ID NO: 952639 - RNA, 19 nt, Homo sapiens
aggagacagucccugaauu

SEQ ID NO: 952640 - RNA, 19 nt, Homo sapiens
ucucccaaguggaagaauu

SEQ ID NO: 952641 - RNA, 19 nt, Homo sapiens
gaccagaugcgagacaugu

SEQ ID NO: 952642 - RNA, 19 nt, Homo sapiens
gcgccuuccugaguucuga

SEQ ID NO: 952643 - RNA, 19 nt, Homo sapiens
cagacacucucuucaccau

SEQ ID NO: 952644 - RNA, 19 nt, Homo sapiens
cuuggcagcugugacauug

SEQ ID NO: 952645 - RNA, 19 nt, Homo sapiens
gagcaggguccagguuuca

SEQ ID NO: 952646 - RNA, 19 nt, Homo sapiens
guacgcugcacaacuggaa

SEQ ID NO: 952647 - RNA, 19 nt, Homo sapiens
gaacccguacgcugcacaa

SEQ ID NO: 952648 - RNA, 19 nt, Homo sapiens
ugguauauccaguauguga

SEQ ID NO: 952649 - RNA, 19 nt, Homo sapiens
gagcagagaagcagaaaag

SEQ ID NO: 952650 - RNA, 19 nt, Homo sapiens
ccacacgggcagucacaga

SEQ ID NO: 952651 - RNA, 19 nt, Homo sapiens
ccucauccggccucuguuu

SEQ ID NO: 952652 - RNA, 19 nt, Homo sapiens
cgagacauguuugaugacu

SEQ ID NO: 952653 - RNA, 19 nt, Homo sapiens
gcagcugcgggaugagauu

SEQ ID NO: 952654 - RNA, 19 nt, Homo sapiens
gaguucugauuuccuccuu

SEQ ID NO: 952655 - RNA, 19 nt, Homo sapiens
gaauuucaaaggccucaag

SEQ ID NO: 952656 - RNA, 19 nt, Homo sapiens
caucucagacacucucuuc

SEQ ID NO: 952657 - RNA, 19 nt, Homo sapiens
gaggaugcuguuuaucugu

SEQ ID NO: 952658 - RNA, 19 nt, Homo sapiens
ccccaccucugcugcauua

SEQ ID NO: 952659 - RNA, 19 nt, Homo sapiens
gggcucaacgguggaaaga

SEQ ID NO: 952660 - RNA, 19 nt, Homo sapiens
gaagguucaaucagcagau

SEQ ID NO: 952661 - RNA, 19 nt, Homo sapiens
gguauauccaguaugugaa

SEQ ID NO: 952662 - RNA, 19 nt, Homo sapiens
ggguccagguuucacacuu

SEQ ID NO: 952663 - RNA, 19 nt, Homo sapiens
agacccugcugcucacuca

SEQ ID NO: 952664 - RNA, 19 nt, Homo sapiens
cccguacgcugcacaacug

SEQ ID NO: 952665 - RNA, 19 nt, Homo sapiens
agccaagccuggaugacuu

SEQ ID NO: 952666 - RNA, 19 nt, Homo sapiens
gcagagaagcagaaaagga

SEQ ID NO: 952667 - RNA, 19 nt, Homo sapiens
uaugugaagcggaggaaga

SEQ ID NO: 952668 - RNA, 19 nt, Homo sapiens
gacaccagggccagaguga

SEQ ID NO: 952669 - RNA, 19 nt, Homo sapiens
uggcaccacccacugcuuu

SEQ ID NO: 952670 - RNA, 19 nt, Homo sapiens
ggccaugacccaccucucu

SEQ ID NO: 952671 - RNA, 19 nt, Homo sapiens
gauguguguguguggguuu

SEQ ID NO: 952672 - RNA, 19 nt, Homo sapiens
gcaaugcugacaugaucca

SEQ ID NO: 952673 - RNA, 19 nt, Homo sapiens
gcagggcaggcaucaugug

SEQ ID NO: 952674 - RNA, 19 nt, Homo sapiens
gcuugagccuggccuacag

SEQ ID NO: 952675 - RNA, 19 nt, Homo sapiens
gcaggguccagguuucaca

SEQ ID NO: 952676 - RNA, 19 nt, Homo sapiens
caacaaccccugccucaca

SEQ ID NO: 952677 - RNA, 19 nt, Homo sapiens
ccagcgccuuccugaguuc

SEQ ID NO: 952678 - RNA, 19 nt, Homo sapiens
aagcuggugucucccaagu

SEQ ID NO: 952679 - RNA, 19 nt, Homo sapiens
gaagacagcugaguacauc

SEQ ID NO: 952680 - RNA, 19 nt, Homo sapiens
ccacagcggucacuucaug

SEQ ID NO: 952681 - RNA, 19 nt, Homo sapiens
gacacucucuucaccauga

SEQ ID NO: 952682 - RNA, 19 nt, Homo sapiens
gcccaugccuucaaacuuc

SEQ ID NO: 952683 - RNA, 19 nt, Homo sapiens
ggaggaugcuguuuaucug

SEQ ID NO: 952684 - RNA, 19 nt, Homo sapiens
ggagacagucccugaauuc

SEQ ID NO: 952685 - RNA, 19 nt, Homo sapiens
gaaagaggaggaugcuguu

SEQ ID NO: 952686 - RNA, 19 nt, Homo sapiens
gggcaggcaucaugugugu

SEQ ID NO: 952687 - RNA, 19 nt, Homo sapiens
ggaccgcuguguuucaauc

SEQ ID NO: 952688 - RNA, 19 nt, Homo sapiens
acaagaagcggcuccguaa

SEQ ID NO: 952689 - RNA, 19 nt, Homo sapiens
gacaagauccgccugaaca

SEQ ID NO: 952690 - RNA, 19 nt, Homo sapiens
agaggaggaugcuguuuau

SEQ ID NO: 952691 - RNA, 19 nt, Homo sapiens
gagacauguuugaugacua

SEQ ID NO: 952692 - RNA, 19 nt, Homo sapiens
ucucuucucucccagguuu

SEQ ID NO: 952693 - RNA, 19 nt, Homo sapiens
gguccagguuucacacuug

SEQ ID NO: 952694 - RNA, 19 nt, Homo sapiens
gagacaagauccgccugaa

SEQ ID NO: 952695 - RNA, 19 nt, Homo sapiens
ggagcaggguccagguuuc

SEQ ID NO: 952696 - RNA, 19 nt, Homo sapiens
acaaguggcgcaucuacua

SEQ ID NO: 952697 - RNA, 19 nt, Homo sapiens
gggcacaucuaccaguauc

SEQ ID NO: 952698 - RNA, 19 nt, Homo sapiens
aagaggaggaugcuguuua

SEQ ID NO: 952699 - RNA, 19 nt, Homo sapiens
cggcaaugcugacaugauc

SEQ ID NO: 952700 - RNA, 19 nt, Homo sapiens
ucucagauuucuuuaccaa

SEQ ID NO: 952701 - RNA, 19 nt, Homo sapiens
ugcgagacauguuugauga

SEQ ID NO: 952702 - RNA, 19 nt, Homo sapiens
ugacucguccgcugucuuu

SEQ ID NO: 952703 - RNA, 19 nt, Homo sapiens
ccagaugcgagacauguuu

SEQ ID NO: 952704 - RNA, 19 nt, Homo sapiens
gcagaagacagcugaguac

SEQ ID NO: 952705 - RNA, 19 nt, Homo sapiens
gcaggcaucaugugugugu

SEQ ID NO: 952706 - RNA, 19 nt, Homo sapiens
agacauguuugaugacuac

SEQ ID NO: 952707 - RNA, 19 nt, Homo sapiens
aacaagaaccggcguauca

SEQ ID NO: 952708 - RNA, 19 nt, Homo sapiens
ucagauuucuuuaccaacu

SEQ ID NO: 952709 - RNA, 19 nt, Homo sapiens
cagcagggcaggcaucaug

SEQ ID NO: 952710 - RNA, 19 nt, Homo sapiens
acagcugaguacauccuua

SEQ ID NO: 952711 - RNA, 19 nt, Homo sapiens
ccaaguggaagaauuucaa

SEQ ID NO: 952712 - RNA, 19 nt, Homo sapiens
aaaacugucugcugguuaa

SEQ ID NO: 952713 - RNA, 19 nt, Homo sapiens
caaguggaagaauuucaaa

SEQ ID NO: 952714 - RNA, 19 nt, Homo sapiens
gugguugacucccucuuca

SEQ ID NO: 952715 - RNA, 19 nt, Homo sapiens
ggaugcuguuuaucuguca

SEQ ID NO: 952716 - RNA, 19 nt, Homo sapiens
uggcgcaucuacuacaaga

SEQ ID NO: 952717 - RNA, 19 nt, Homo sapiens
cuaccacgcugcagaagac

SEQ ID NO: 952718 - RNA, 19 nt, Homo sapiens
gcaacaagaaccggcguau

SEQ ID NO: 952719 - RNA, 19 nt, Homo sapiens
cgucggcaaugcugacaug

SEQ ID NO: 952720 - RNA, 19 nt, Homo sapiens
gcgcaucuacuacaagaag

SEQ ID NO: 952721 - RNA, 19 nt, Homo sapiens
ggccaacuguccugaacuc

SEQ ID NO: 952722 - RNA, 19 nt, Homo sapiens
aggagacagucccugaauu

SEQ ID NO: 952723 - RNA, 19 nt, Homo sapiens
ucucccaaguggaagaauu

SEQ ID NO: 952724 - RNA, 19 nt, Homo sapiens
gaccagaugcgagacaugu

SEQ ID NO: 952725 - RNA, 19 nt, Homo sapiens
guccagacagcaacaagaa

SEQ ID NO: 952726 - RNA, 19 nt, Homo sapiens
gcgccuuccugaguucuga

SEQ ID NO: 952727 - RNA, 19 nt, Homo sapiens
cagacacucucuucaccau

SEQ ID NO: 952728 - RNA, 19 nt, Homo sapiens
cuuggcagcugugacauug

SEQ ID NO: 952729 - RNA, 19 nt, Homo sapiens
gagcaggguccagguuuca

SEQ ID NO: 952730 - RNA, 19 nt, Homo sapiens
guacgcugcacaacuggaa

SEQ ID NO: 952731 - RNA, 19 nt, Homo sapiens
gaacccguacgcugcacaa

SEQ ID NO: 952732 - RNA, 19 nt, Homo sapiens
cagcugaguacauccuuau

SEQ ID NO: 952733 - RNA, 19 nt, Homo sapiens
ugguauauccaguauguga

SEQ ID NO: 952734 - RNA, 19 nt, Homo sapiens
gagcagagaagcagaaaag

SEQ ID NO: 952735 - RNA, 19 nt, Homo sapiens
ccacacgggcagucacaga

SEQ ID NO: 952736 - RNA, 19 nt, Homo sapiens
ccucauccggccucuguuu

SEQ ID NO: 952737 - RNA, 19 nt, Homo sapiens
cgagacauguuugaugacu

SEQ ID NO: 952738 - RNA, 19 nt, Homo sapiens
gcagcugcgggaugagauu

SEQ ID NO: 952739 - RNA, 19 nt, Homo sapiens
caagaaccggcguaucaca

SEQ ID NO: 952740 - RNA, 19 nt, Homo sapiens
gaguucugauuuccuccuu

SEQ ID NO: 952741 - RNA, 19 nt, Homo sapiens
caucucagacacucucuuc

SEQ ID NO: 952742 - RNA, 19 nt, Homo sapiens
gaauuucaaaggccucaag

SEQ ID NO: 952743 - RNA, 19 nt, Homo sapiens
gaggaugcuguuuaucugu

SEQ ID NO: 952744 - RNA, 19 nt, Homo sapiens
ccccaccucugcugcauua

SEQ ID NO: 952745 - RNA, 19 nt, Homo sapiens
gggcucaacgguggaaaga

SEQ ID NO: 952746 - RNA, 19 nt, Homo sapiens
gaagguucaaucagcagau

SEQ ID NO: 952747 - RNA, 19 nt, Homo sapiens
ggguccagguuucacacuu

SEQ ID NO: 952748 - RNA, 19 nt, Homo sapiens
agacccugcugcucacuca

SEQ ID NO: 952749 - RNA, 19 nt, Homo sapiens
cccguacgcugcacaacug

SEQ ID NO: 952750 - RNA, 19 nt, Homo sapiens
gguauauccaguaugugaa

SEQ ID NO: 952751 - RNA, 19 nt, Homo sapiens
agccaagccuggaugacuu

SEQ ID NO: 952752 - RNA, 19 nt, Homo sapiens
gcagagaagcagaaaagga

SEQ ID NO: 952753 - RNA, 19 nt, Homo sapiens
ugaguacauccuuaugcua

SEQ ID NO: 952754 - RNA, 19 nt, Homo sapiens
uaugugaagcggaggaaga

SEQ ID NO: 952755 - RNA, 19 nt, Homo sapiens
gacaccagggccagaguga

SEQ ID NO: 952756 - RNA, 19 nt, Homo sapiens
ugcagaagacagcugagua

SEQ ID NO: 952757 - RNA, 19 nt, Homo sapiens
caacaagaaccggcguauc

SEQ ID NO: 952758 - RNA, 19 nt, Homo sapiens
uggcaccacccacugcuuu

SEQ ID NO: 952759 - RNA, 19 nt, Homo sapiens
ggccaugacccaccucucu

SEQ ID NO: 952760 - RNA, 19 nt, Homo sapiens
gauguguguguguggguuu

SEQ ID NO: 952761 - RNA, 19 nt, Homo sapiens
guacauccuuaugcuacag

SEQ ID NO: 952762 - RNA, 19 nt, Homo sapiens
gcaaugcugacaugaucca

SEQ ID NO: 952763 - RNA, 19 nt, Homo sapiens
aagcuggugucucccaagu

SEQ ID NO: 952764 - RNA, 19 nt, Homo sapiens
gcagggcaggcaucaugug

SEQ ID NO: 952765 - RNA, 19 nt, Homo sapiens
gcaggguccagguuucaca

SEQ ID NO: 952766 - RNA, 19 nt, Homo sapiens
gcuugagccuggccuacag

SEQ ID NO: 952767 - RNA, 19 nt, Homo sapiens
caacaaccccugccucaca

SEQ ID NO: 952768 - RNA, 19 nt, Homo sapiens
ccagcgccuuccugaguuc

SEQ ID NO: 952769 - RNA, 19 nt, Homo sapiens
ccacagcggucacuucaug

SEQ ID NO: 952770 - RNA, 19 nt, Homo sapiens
gacacucucuucaccauga

SEQ ID NO: 952771 - RNA, 19 nt, Homo sapiens
gcccaugccuucaaacuuc

SEQ ID NO: 952772 - RNA, 19 nt, Homo sapiens
ggaggaugcuguuuaucug

SEQ ID NO: 952773 - RNA, 19 nt, Homo sapiens
ggagacagucccugaauuc

SEQ ID NO: 952774 - RNA, 19 nt, Homo sapiens
gaaagaggaggaugcuguu

SEQ ID NO: 952775 - RNA, 19 nt, Homo sapiens
gggcaggcaucaugugugu

SEQ ID NO: 952776 - RNA, 19 nt, Homo sapiens
ggaccgcuguguuucaauc

SEQ ID NO: 952777 - RNA, 19 nt, Homo sapiens
acaagaagcggcuccguaa

SEQ ID NO: 952778 - RNA, 19 nt, Homo sapiens
gacaagauccgccugaaca

SEQ ID NO: 952779 - RNA, 19 nt, Homo sapiens
agaggaggaugcuguuuau

SEQ ID NO: 952780 - RNA, 19 nt, Homo sapiens
gagacauguuugaugacua

SEQ ID NO: 952781 - RNA, 19 nt, Homo sapiens
ucucuucucucccagguuu

SEQ ID NO: 952782 - RNA, 19 nt, Homo sapiens
gguccagguuucacacuug

SEQ ID NO: 952783 - RNA, 19 nt, Homo sapiens
gagacaagauccgccugaa

SEQ ID NO: 952784 - RNA, 19 nt, Homo sapiens
ggagcaggguccagguuuc

SEQ ID NO: 952785 - RNA, 19 nt, Homo sapiens
acaaguggcgcaucuacua

SEQ ID NO: 952786 - RNA, 19 nt, Homo sapiens
gggcacaucuaccaguauc

SEQ ID NO: 952787 - RNA, 19 nt, Homo sapiens
aagaggaggaugcuguuua

SEQ ID NO: 952788 - RNA, 19 nt, Homo sapiens
cggcaaugcugacaugauc

SEQ ID NO: 952789 - RNA, 19 nt, Homo sapiens
ucucagauuucuuuaccaa

SEQ ID NO: 952790 - RNA, 19 nt, Homo sapiens
ugcgagacauguuugauga

SEQ ID NO: 952791 - RNA, 19 nt, Homo sapiens
ugacucguccgcugucuuu

SEQ ID NO: 952792 - RNA, 19 nt, Homo sapiens
ccagaugcgagacauguuu

SEQ ID NO: 952793 - RNA, 19 nt, Homo sapiens
gcaggcaucaugugugugu

SEQ ID NO: 952794 - RNA, 19 nt, Homo sapiens
agacauguuugaugacuac

SEQ ID NO: 952795 - RNA, 19 nt, Homo sapiens
aacaagaaccggcguauca

SEQ ID NO: 952796 - RNA, 19 nt, Homo sapiens
ucagauuucuuuaccaacu

SEQ ID NO: 952797 - RNA, 19 nt, Homo sapiens
cagcagggcaggcaucaug

SEQ ID NO: 952798 - RNA, 19 nt, Homo sapiens
ccaaguggaagaauuucaa

SEQ ID NO: 952799 - RNA, 19 nt, Homo sapiens
aaaacugucugcugguuaa

SEQ ID NO: 952800 - RNA, 19 nt, Homo sapiens
caaguggaagaauuucaaa

SEQ ID NO: 952801 - RNA, 19 nt, Homo sapiens
gugguugacucccucuuca

SEQ ID NO: 952802 - RNA, 19 nt, Homo sapiens
ggaugcuguuuaucuguca

SEQ ID NO: 952803 - RNA, 19 nt, Homo sapiens
uggcgcaucuacuacaaga

SEQ ID NO: 952804 - RNA, 19 nt, Homo sapiens
gcaacaagaaccggcguau

SEQ ID NO: 952805 - RNA, 19 nt, Homo sapiens
cgucggcaaugcugacaug

SEQ ID NO: 952806 - RNA, 19 nt, Homo sapiens
gcgcaucuacuacaagaag

SEQ ID NO: 952807 - RNA, 19 nt, Homo sapiens
ggccaacuguccugaacuc

SEQ ID NO: 952808 - RNA, 19 nt, Homo sapiens
aggagacagucccugaauu

SEQ ID NO: 952809 - RNA, 19 nt, Homo sapiens
gaccagaugcgagacaugu

SEQ ID NO: 952810 - RNA, 19 nt, Homo sapiens
guccagacagcaacaagaa

SEQ ID NO: 952811 - RNA, 19 nt, Homo sapiens
gcgccuuccugaguucuga

SEQ ID NO: 952812 - RNA, 19 nt, Homo sapiens
ucucccaaguggaagaauu

SEQ ID NO: 952813 - RNA, 19 nt, Homo sapiens
cagacacucucuucaccau

SEQ ID NO: 952814 - RNA, 19 nt, Homo sapiens
cuuggcagcugugacauug

SEQ ID NO: 952815 - RNA, 19 nt, Homo sapiens
gagcaggguccagguuuca

SEQ ID NO: 952816 - RNA, 19 nt, Homo sapiens
guacgcugcacaacuggaa

SEQ ID NO: 952817 - RNA, 19 nt, Homo sapiens
gaacccguacgcugcacaa

SEQ ID NO: 952818 - RNA, 19 nt, Homo sapiens
ugguauauccaguauguga

SEQ ID NO: 952819 - RNA, 19 nt, Homo sapiens
gagcagagaagcagaaaag

SEQ ID NO: 952820 - RNA, 19 nt, Homo sapiens
ccacacgggcagucacaga

SEQ ID NO: 952821 - RNA, 19 nt, Homo sapiens
ccucauccggccucuguuu

SEQ ID NO: 952822 - RNA, 19 nt, Homo sapiens
cgagacauguuugaugacu

SEQ ID NO: 952823 - RNA, 19 nt, Homo sapiens
gcagcugcgggaugagauu

SEQ ID NO: 952824 - RNA, 19 nt, Homo sapiens
caagaaccggcguaucaca

SEQ ID NO: 952825 - RNA, 19 nt, Homo sapiens
gaauuucaaaggccucaag

SEQ ID NO: 952826 - RNA, 19 nt, Homo sapiens
gaguucugauuuccuccuu

SEQ ID NO: 952827 - RNA, 19 nt, Homo sapiens
caucucagacacucucuuc

SEQ ID NO: 952828 - RNA, 19 nt, Homo sapiens
gaggaugcuguuuaucugu

SEQ ID NO: 952829 - RNA, 19 nt, Homo sapiens
ccccaccucugcugcauua

SEQ ID NO: 952830 - RNA, 19 nt, Homo sapiens
gggcucaacgguggaaaga

SEQ ID NO: 952831 - RNA, 19 nt, Homo sapiens
gaagguucaaucagcagau

SEQ ID NO: 952832 - RNA, 19 nt, Homo sapiens
ggguccagguuucacacuu

SEQ ID NO: 952833 - RNA, 19 nt, Homo sapiens
agacccugcugcucacuca

SEQ ID NO: 952834 - RNA, 19 nt, Homo sapiens
cccguacgcugcacaacug

SEQ ID NO: 952835 - RNA, 19 nt, Homo sapiens
agccaagccuggaugacuu

SEQ ID NO: 952836 - RNA, 19 nt, Homo sapiens
gguauauccaguaugugaa

SEQ ID NO: 952837 - RNA, 19 nt, Homo sapiens
gcagagaagcagaaaagga

SEQ ID NO: 952838 - RNA, 19 nt, Homo sapiens
uaugugaagcggaggaaga

SEQ ID NO: 952839 - RNA, 19 nt, Homo sapiens
gacaccagggccagaguga

SEQ ID NO: 952840 - RNA, 19 nt, Homo sapiens
caacaagaaccggcguauc

SEQ ID NO: 952841 - RNA, 19 nt, Homo sapiens
uggcaccacccacugcuuu

SEQ ID NO: 952842 - RNA, 19 nt, Homo sapiens
ggccaugacccaccucucu

SEQ ID NO: 952843 - RNA, 19 nt, Homo sapiens
gauguguguguguggguuu

SEQ ID NO: 952844 - RNA, 19 nt, Homo sapiens
gcaaugcugacaugaucca

SEQ ID NO: 952845 - RNA, 19 nt, Homo sapiens
gcagggcaggcaucaugug

SEQ ID NO: 952846 - RNA, 19 nt, Homo sapiens
gcuugagccuggccuacag

SEQ ID NO: 952847 - RNA, 19 nt, Homo sapiens
gcaggguccagguuucaca

SEQ ID NO: 952848 - RNA, 19 nt, Homo sapiens
aagcuggugucucccaagu

SEQ ID NO: 952849 - RNA, 19 nt, Homo sapiens
caacaaccccugccucaca

SEQ ID NO: 952850 - RNA, 19 nt, Homo sapiens
ccagcgccuuccugaguuc

SEQ ID NO: 952851 - RNA, 19 nt, Homo sapiens
gaagacagcugaguacauc

SEQ ID NO: 952852 - RNA, 19 nt, Homo sapiens
ccacagcggucacuucaug

SEQ ID NO: 952853 - RNA, 19 nt, Homo sapiens
gacacucucuucaccauga

SEQ ID NO: 952854 - RNA, 19 nt, Homo sapiens
gcccaugccuucaaacuuc

SEQ ID NO: 952855 - RNA, 19 nt, Homo sapiens
ggaggaugcuguuuaucug

SEQ ID NO: 952856 - RNA, 19 nt, Homo sapiens
gaaagaggaggaugcuguu

SEQ ID NO: 952857 - RNA, 19 nt, Homo sapiens
gggcaggcaucaugugugu

SEQ ID NO: 952858 - RNA, 19 nt, Homo sapiens
ggaccgcuguguuucaauc

SEQ ID NO: 952859 - RNA, 19 nt, Homo sapiens
acaagaagcggcuccguaa

SEQ ID NO: 952860 - RNA, 19 nt, Homo sapiens
gacaagauccgccugaaca

SEQ ID NO: 952861 - RNA, 19 nt, Homo sapiens
agaggaggaugcuguuuau

SEQ ID NO: 952862 - RNA, 19 nt, Homo sapiens
gagacauguuugaugacua

SEQ ID NO: 952863 - RNA, 19 nt, Homo sapiens
ucucuucucucccagguuu

SEQ ID NO: 952864 - RNA, 19 nt, Homo sapiens
gguccagguuucacacuug

SEQ ID NO: 952865 - RNA, 19 nt, Homo sapiens
gagacaagauccgccugaa

SEQ ID NO: 952866 - RNA, 19 nt, Homo sapiens
ggagcaggguccagguuuc

SEQ ID NO: 952867 - RNA, 19 nt, Homo sapiens
acaaguggcgcaucuacua

SEQ ID NO: 952868 - RNA, 19 nt, Homo sapiens
gggcacaucuaccaguauc

SEQ ID NO: 952869 - RNA, 19 nt, Homo sapiens
aagaggaggaugcuguuua

SEQ ID NO: 952870 - RNA, 19 nt, Homo sapiens
cggcaaugcugacaugauc

SEQ ID NO: 952871 - RNA, 19 nt, Homo sapiens
ucucagauuucuuuaccaa

SEQ ID NO: 952872 - RNA, 19 nt, Homo sapiens
ugcgagacauguuugauga

SEQ ID NO: 952873 - RNA, 19 nt, Homo sapiens
ugacucguccgcugucuuu

SEQ ID NO: 952874 - RNA, 19 nt, Homo sapiens
ccagaugcgagacauguuu

SEQ ID NO: 952875 - RNA, 19 nt, Homo sapiens
gcagaagacagcugaguac

SEQ ID NO: 952876 - RNA, 19 nt, Homo sapiens
gcaggcaucaugugugugu

SEQ ID NO: 952877 - RNA, 19 nt, Homo sapiens
agacauguuugaugacuac

SEQ ID NO: 952878 - RNA, 19 nt, Homo sapiens
ucagauuucuuuaccaacu

SEQ ID NO: 952879 - RNA, 19 nt, Homo sapiens
cagcagggcaggcaucaug

SEQ ID NO: 952880 - RNA, 19 nt, Homo sapiens
acagcugaguacauccuua

SEQ ID NO: 952881 - RNA, 19 nt, Homo sapiens
ccaaguggaagaauuucaa

SEQ ID NO: 952882 - RNA, 19 nt, Homo sapiens
aaaacugucugcugguuaa

SEQ ID NO: 952883 - RNA, 19 nt, Homo sapiens
caaguggaagaauuucaaa

SEQ ID NO: 952884 - RNA, 19 nt, Homo sapiens
gugguugacucccucuuca

SEQ ID NO: 952885 - RNA, 19 nt, Homo sapiens
ggaugcuguuuaucuguca

SEQ ID NO: 952886 - RNA, 19 nt, Homo sapiens
uggcgcaucuacuacaaga

SEQ ID NO: 952887 - RNA, 19 nt, Homo sapiens
cuaccacgcugcagaagac

SEQ ID NO: 952888 - RNA, 19 nt, Homo sapiens
cgucggcaaugcugacaug

SEQ ID NO: 952889 - RNA, 19 nt, Homo sapiens
gcgcaucuacuacaagaag

SEQ ID NO: 952890 - RNA, 19 nt, Homo sapiens
ggccaacuguccugaacuc

SEQ ID NO: 952891 - RNA, 19 nt, Homo sapiens
gaccagaugcgagacaugu

SEQ ID NO: 952892 - RNA, 19 nt, Homo sapiens
gcgccuuccugaguucuga

SEQ ID NO: 952893 - RNA, 19 nt, Homo sapiens
ucucccaaguggaagaauu

SEQ ID NO: 952894 - RNA, 19 nt, Homo sapiens
cagacacucucuucaccau

SEQ ID NO: 952895 - RNA, 19 nt, Homo sapiens
cuuggcagcugugacauug

SEQ ID NO: 952896 - RNA, 19 nt, Homo sapiens
gagcaggguccagguuuca

SEQ ID NO: 952897 - RNA, 19 nt, Homo sapiens
guacgcugcacaacuggaa

SEQ ID NO: 952898 - RNA, 19 nt, Homo sapiens
gaacccguacgcugcacaa

SEQ ID NO: 952899 - RNA, 19 nt, Homo sapiens
cagcugaguacauccuuau

SEQ ID NO: 952900 - RNA, 19 nt, Homo sapiens
ugguauauccaguauguga

SEQ ID NO: 952901 - RNA, 19 nt, Homo sapiens
gagcagagaagcagaaaag

SEQ ID NO: 952902 - RNA, 19 nt, Homo sapiens
ccacacgggcagucacaga

SEQ ID NO: 952903 - RNA, 19 nt, Homo sapiens
ccucauccggccucuguuu

SEQ ID NO: 952904 - RNA, 19 nt, Homo sapiens
cgagacauguuugaugacu

SEQ ID NO: 952905 - RNA, 19 nt, Homo sapiens
gcagcugcgggaugagauu

SEQ ID NO: 952906 - RNA, 19 nt, Homo sapiens
gaguucugauuuccuccuu

SEQ ID NO: 952907 - RNA, 19 nt, Homo sapiens
gaauuucaaaggccucaag

SEQ ID NO: 952908 - RNA, 19 nt, Homo sapiens
caucucagacacucucuuc

SEQ ID NO: 952909 - RNA, 19 nt, Homo sapiens
gaggaugcuguuuaucugu

SEQ ID NO: 952910 - RNA, 19 nt, Homo sapiens
ccccaccucugcugcauua

SEQ ID NO: 952911 - RNA, 19 nt, Homo sapiens
gguauauccaguaugugaa

SEQ ID NO: 952912 - RNA, 19 nt, Homo sapiens
gggcucaacgguggaaaga

SEQ ID NO: 952913 - RNA, 19 nt, Homo sapiens
gaagguucaaucagcagau

SEQ ID NO: 952914 - RNA, 19 nt, Homo sapiens
ggguccagguuucacacuu

SEQ ID NO: 952915 - RNA, 19 nt, Homo sapiens
agacccugcugcucacuca

SEQ ID NO: 952916 - RNA, 19 nt, Homo sapiens
cccguacgcugcacaacug

SEQ ID NO: 952917 - RNA, 19 nt, Homo sapiens
agccaagccuggaugacuu

SEQ ID NO: 952918 - RNA, 19 nt, Homo sapiens
gcagagaagcagaaaagga

SEQ ID NO: 952919 - RNA, 19 nt, Homo sapiens
uaugugaagcggaggaaga

SEQ ID NO: 952920 - RNA, 19 nt, Homo sapiens
ugaguacauccuuaugcua

SEQ ID NO: 952921 - RNA, 19 nt, Homo sapiens
gacaccagggccagaguga

SEQ ID NO: 952922 - RNA, 19 nt, Homo sapiens
ugcagaagacagcugagua

SEQ ID NO: 952923 - RNA, 19 nt, Homo sapiens
uggcaccacccacugcuuu

SEQ ID NO: 952924 - RNA, 19 nt, Homo sapiens
ggccaugacccaccucucu

SEQ ID NO: 952925 - RNA, 19 nt, Homo sapiens
gauguguguguguggguuu

SEQ ID NO: 952926 - RNA, 19 nt, Homo sapiens
guacauccuuaugcuacag

SEQ ID NO: 952927 - RNA, 19 nt, Homo sapiens
gcaaugcugacaugaucca

SEQ ID NO: 952928 - RNA, 19 nt, Homo sapiens
gcagggcaggcaucaugug

SEQ ID NO: 952929 - RNA, 19 nt, Homo sapiens
gcuugagccuggccuacag

SEQ ID NO: 952930 - RNA, 19 nt, Homo sapiens
gcaggguccagguuucaca

SEQ ID NO: 952931 - RNA, 19 nt, Homo sapiens
aagcuggugucucccaagu

SEQ ID NO: 952932 - RNA, 19 nt, Homo sapiens
caacaaccccugccucaca

SEQ ID NO: 952933 - RNA, 19 nt, Homo sapiens
ccagcgccuuccugaguuc

SEQ ID NO: 952934 - RNA, 19 nt, Homo sapiens
gaaauuuggugcugaugua

SEQ ID NO: 952935 - RNA, 19 nt, Homo sapiens
gcuauggguuuauuucuua

SEQ ID NO: 952936 - RNA, 19 nt, Homo sapiens
ugacaaauauggcuaugua

SEQ ID NO: 952937 - RNA, 19 nt, Homo sapiens
gaaauugaguuccaugaga

SEQ ID NO: 952938 - RNA, 19 nt, Homo sapiens
ccaaagugcuggacaauau

SEQ ID NO: 952939 - RNA, 19 nt, Homo sapiens
ggagaaaggaagaaacuua

SEQ ID NO: 952940 - RNA, 19 nt, Homo sapiens
aaaggacgaugcagaaaua

SEQ ID NO: 952941 - RNA, 19 nt, Homo sapiens
gagcuaaugucaauauuca

SEQ ID NO: 952942 - RNA, 19 nt, Homo sapiens
gcagaugucuucagcuaug

SEQ ID NO: 952943 - RNA, 19 nt, Homo sapiens
gaacugcccuggagaaagg

SEQ ID NO: 952944 - RNA, 19 nt, Homo sapiens
gaauugcccuguaaugaau

SEQ ID NO: 952945 - RNA, 19 nt, Homo sapiens
uaauggagcugauaugaau

SEQ ID NO: 952946 - RNA, 19 nt, Homo sapiens
ucacacuccugaagcauua

SEQ ID NO: 952947 - RNA, 19 nt, Homo sapiens
ggcaagaaaucacauauuc

SEQ ID NO: 952948 - RNA, 19 nt, Homo sapiens
ucacauauucgaacucuua

SEQ ID NO: 952949 - RNA, 19 nt, Homo sapiens
ugacagaacuaaggaauau

SEQ ID NO: 952950 - RNA, 19 nt, Homo sapiens
caagaugaauugcccugua

SEQ ID NO: 952951 - RNA, 19 nt, Homo sapiens
uacaauagcuggccaccua

SEQ ID NO: 952952 - RNA, 19 nt, Homo sapiens
acacacccauugacaaaua

SEQ ID NO: 952953 - RNA, 19 nt, Homo sapiens
ggaauaugcucuaaaugca

SEQ ID NO: 952954 - RNA, 19 nt, Homo sapiens
gaagaugaccugcagauca

SEQ ID NO: 952955 - RNA, 19 nt, Homo sapiens
caagacagaauguauauga

SEQ ID NO: 952956 - RNA, 19 nt, Homo sapiens
gaaccaagacagaauguau

SEQ ID NO: 952957 - RNA, 19 nt, Homo sapiens
ccaaggaaaucauccaaau

SEQ ID NO: 952958 - RNA, 19 nt, Homo sapiens
ggaaaucauccaaauauca

SEQ ID NO: 952959 - RNA, 19 nt, Homo sapiens
gucagugaaucauauguua

SEQ ID NO: 952960 - RNA, 19 nt, Homo sapiens
gcagauauucuccuccuaa

SEQ ID NO: 952961 - RNA, 19 nt, Homo sapiens
ccaaauaucaggaacagaa

SEQ ID NO: 952962 - RNA, 19 nt, Homo sapiens
caaggauaaugcagaauug

SEQ ID NO: 952963 - RNA, 19 nt, Homo sapiens
gaacugacagcaacgauuc

SEQ ID NO: 952964 - RNA, 19 nt, Homo sapiens
gaauauauuuggcucugau

SEQ ID NO: 952965 - RNA, 19 nt, Homo sapiens
gacagaauguauaugaaga

SEQ ID NO: 952966 - RNA, 19 nt, Homo sapiens
gagugucucugcaacauug

SEQ ID NO: 952967 - RNA, 19 nt, Homo sapiens
gaaauuccauucgcucauc

SEQ ID NO: 952968 - RNA, 19 nt, Homo sapiens
gaauuggaauaugcucuaa

SEQ ID NO: 952969 - RNA, 19 nt, Homo sapiens
ggagucauguggcagcauu

SEQ ID NO: 952970 - RNA, 19 nt, Homo sapiens
gagcugauaugaaucuagu

SEQ ID NO: 952971 - RNA, 19 nt, Homo sapiens
caaggaaaucauccaaaua

SEQ ID NO: 952972 - RNA, 19 nt, Homo sapiens
gaaaucacauauucgaacu

SEQ ID NO: 952973 - RNA, 19 nt, Homo sapiens
gaagaacugcccuggagaa

SEQ ID NO: 952974 - RNA, 19 nt, Homo sapiens
uauguagacuuguguuuga

SEQ ID NO: 952975 - RNA, 19 nt, Homo sapiens
cccaugagcucaaugcauu

SEQ ID NO: 952976 - RNA, 19 nt, Homo sapiens
aagcagaugucuucagcua

SEQ ID NO: 952977 - RNA, 19 nt, Homo sapiens
aaauguaaguggugaaguu

SEQ ID NO: 952978 - RNA, 19 nt, Homo sapiens
gauaauggagcugauauga

SEQ ID NO: 952979 - RNA, 19 nt, Homo sapiens
ccauuucuguucucgauuu

SEQ ID NO: 952980 - RNA, 19 nt, Homo sapiens
caucucgacugacaagaaa

SEQ ID NO: 952981 - RNA, 19 nt, Homo sapiens
uaagaagucguuucgaauu

SEQ ID NO: 952982 - RNA, 19 nt, Homo sapiens
uaagagaccacaagaugaa

SEQ ID NO: 952983 - RNA, 19 nt, Homo sapiens
gaacugacagaacuaagga

SEQ ID NO: 952984 - RNA, 19 nt, Homo sapiens
gauuugugccuaaggaaua

SEQ ID NO: 952985 - RNA, 19 nt, Homo sapiens
uuaaguaucugcugcaaag

SEQ ID NO: 952986 - RNA, 19 nt, Homo sapiens
cagcaaagcagaugugaau

SEQ ID NO: 952987 - RNA, 19 nt, Homo sapiens
uuacaaggauaaugcagaa

SEQ ID NO: 952988 - RNA, 19 nt, Homo sapiens
gagaaaggaagaaacuuau

SEQ ID NO: 952989 - RNA, 19 nt, Homo sapiens
ugacagcuauggguuuauu

SEQ ID NO: 952990 - RNA, 19 nt, Homo sapiens
gcugaauuauguagacuug

SEQ ID NO: 952991 - RNA, 19 nt, Homo sapiens
aagaugaauugcccuguaa

SEQ ID NO: 952992 - RNA, 19 nt, Homo sapiens
aagaugagcagacauguuu

SEQ ID NO: 952993 - RNA, 19 nt, Homo sapiens
gcaagagcauugaccuagu

SEQ ID NO: 952994 - RNA, 19 nt, Homo sapiens
ugaaggaagacccgaauuu

SEQ ID NO: 952995 - RNA, 19 nt, Homo sapiens
caagucagauguggauaug

SEQ ID NO: 952996 - RNA, 19 nt, Homo sapiens
uauaagagaccacaagaug

SEQ ID NO: 952997 - RNA, 19 nt, Homo sapiens
cuagucaaauuucuucuug

SEQ ID NO: 952998 - RNA, 19 nt, Homo sapiens
ggacaccaugauauaguua

SEQ ID NO: 952999 - RNA, 19 nt, Homo sapiens
gaacucuuauguugaaagg

SEQ ID NO: 953000 - RNA, 19 nt, Homo sapiens
caagaaaucacauauucga

SEQ ID NO: 953001 - RNA, 19 nt, Homo sapiens
gaaauucucacuggcgaaa

SEQ ID NO: 953002 - RNA, 19 nt, Homo sapiens
ugaauuauguagacuugug

SEQ ID NO: 953003 - RNA, 19 nt, Homo sapiens
gaaauaguagcagcuuuga

SEQ ID NO: 953004 - RNA, 19 nt, Homo sapiens
ggacaauauuccucucaag

SEQ ID NO: 953005 - RNA, 19 nt, Homo sapiens
gagcugaugucuccugcau

SEQ ID NO: 953006 - RNA, 19 nt, Homo sapiens
cuauggacaugaacaggua

SEQ ID NO: 953007 - RNA, 19 nt, Homo sapiens
gcauuuagcaguuuacaag

SEQ ID NO: 953008 - RNA, 19 nt, Homo sapiens
gaaguugucaugaaguuag

SEQ ID NO: 953009 - RNA, 19 nt, Homo sapiens
aagaugaccugcagaucaa

SEQ ID NO: 953010 - RNA, 19 nt, Homo sapiens
gaucagaaugucauaaaca

SEQ ID NO: 953011 - RNA, 19 nt, Homo sapiens
ggaauauauuuggcucuga

SEQ ID NO: 953012 - RNA, 19 nt, Homo sapiens
gaugugaaugcucaagaua

SEQ ID NO: 953013 - RNA, 19 nt, Homo sapiens
ggaagaaggcagcaaagca

SEQ ID NO: 953014 - RNA, 19 nt, Homo sapiens
ggaaauggagccuaagucu

SEQ ID NO: 953015 - RNA, 19 nt, Homo sapiens
cgaaauaguagcagcuuug

SEQ ID NO: 953016 - RNA, 19 nt, Homo sapiens
gaagucguuucgaauugga

SEQ ID NO: 953017 - RNA, 19 nt, Homo sapiens
aauuauacaucgugacuug

SEQ ID NO: 953018 - RNA, 19 nt, Homo sapiens
gcuuccaacuauaacauuu

SEQ ID NO: 953019 - RNA, 19 nt, Homo sapiens
aagaagucguuucgaauug

SEQ ID NO: 953020 - RNA, 19 nt, Homo sapiens
agucagauguggauauguu

SEQ ID NO: 953021 - RNA, 19 nt, Homo sapiens
cuucagcucucagaaauug

SEQ ID NO: 953022 - RNA, 19 nt, Homo sapiens
caagagcauugaccuaguc

SEQ ID NO: 953023 - RNA, 19 nt, Homo sapiens
gaccaugucccacuccauu

SEQ ID NO: 953024 - RNA, 19 nt, Homo sapiens
acagguaacucgccuucuu

SEQ ID NO: 953025 - RNA, 19 nt, Homo sapiens
uauucgaacucuuauguug

SEQ ID NO: 953026 - RNA, 19 nt, Homo sapiens
caagauuucuacagucucu

SEQ ID NO: 953027 - RNA, 19 nt, Homo sapiens
gaacagucacaauauucuu

SEQ ID NO: 953028 - RNA, 19 nt, Homo sapiens
aaucaucccugcguaauuc

SEQ ID NO: 953029 - RNA, 19 nt, Homo sapiens
ugaauugcccuguaaugaa

SEQ ID NO: 953030 - RNA, 19 nt, Homo sapiens
gaucguuacuuggaaaugg

SEQ ID NO: 953031 - RNA, 19 nt, Homo sapiens
cagcagacauggcuuacca

SEQ ID NO: 953032 - RNA, 19 nt, Homo sapiens
gauauucuccuccuaagag

SEQ ID NO: 953033 - RNA, 19 nt, Homo sapiens
cagcaggucuaguggugaa

SEQ ID NO: 953034 - RNA, 19 nt, Homo sapiens
ggaauuugaugucguggaa

SEQ ID NO: 953035 - RNA, 19 nt, Homo sapiens
gcagaagccacuaauguaa

SEQ ID NO: 953036 - RNA, 19 nt, Homo sapiens
ggaaugacaccaaggaaga

SEQ ID NO: 953037 - RNA, 19 nt, Homo sapiens
gggagacuguggaauuuga

SEQ ID NO: 953038 - RNA, 19 nt, Homo sapiens
gauuccaacucaacucaaa

SEQ ID NO: 953039 - RNA, 19 nt, Homo sapiens
gcaacucccucccguaacu

SEQ ID NO: 953040 - RNA, 19 nt, Homo sapiens
ggagcgggcugaagacucu

SEQ ID NO: 953041 - RNA, 19 nt, Homo sapiens
gcgcagaagccacuaaugu

SEQ ID NO: 953042 - RNA, 19 nt, Homo sapiens
ccagacagcuauuaaaaga

SEQ ID NO: 953043 - RNA, 19 nt, Homo sapiens
cagcaacucccucccguaa

SEQ ID NO: 953044 - RNA, 19 nt, Homo sapiens
ccaccauccuggagugauu

SEQ ID NO: 953045 - RNA, 19 nt, Homo sapiens
caccugagccuccaguaaa

SEQ ID NO: 953046 - RNA, 19 nt, Homo sapiens
gagccauccuuacuguuca

SEQ ID NO: 953047 - RNA, 19 nt, Homo sapiens
ggagccauccuuacuguuc

SEQ ID NO: 953048 - RNA, 19 nt, Homo sapiens
cauccuuacuguucagaga

SEQ ID NO: 953049 - RNA, 19 nt, Homo sapiens
cgcagaagccacuaaugua

SEQ ID NO: 953050 - RNA, 19 nt, Homo sapiens
gagcugccaucugguaucu

SEQ ID NO: 953051 - RNA, 19 nt, Homo sapiens
gguagaacccaaagagaca

SEQ ID NO: 953052 - RNA, 19 nt, Homo sapiens
gguuacggauucaucaaca

SEQ ID NO: 953053 - RNA, 19 nt, Homo sapiens
gccagcagccuaccacaga

SEQ ID NO: 953054 - RNA, 19 nt, Homo sapiens
ggugguagcggugguggua

SEQ ID NO: 953055 - RNA, 19 nt, Homo sapiens
ccaccugagccuccaguaa

SEQ ID NO: 953056 - RNA, 19 nt, Homo sapiens
gugaagggcagccguuaug

SEQ ID NO: 953057 - RNA, 19 nt, Homo sapiens
ccagcagccuaccacagaa

SEQ ID NO: 953058 - RNA, 19 nt, Homo sapiens
ucaccagacagcuauuaaa

SEQ ID NO: 953059 - RNA, 19 nt, Homo sapiens
gaaacaaccccaggaaguu

SEQ ID NO: 953060 - RNA, 19 nt, Homo sapiens
ccugggcacugucaaaugg

SEQ ID NO: 953061 - RNA, 19 nt, Homo sapiens
guucaccagacagcuauua

SEQ ID NO: 953062 - RNA, 19 nt, Homo sapiens
ggaaccagccagcucuuac

SEQ ID NO: 953063 - RNA, 19 nt, Homo sapiens
ucaacguccggaaugguua

SEQ ID NO: 953064 - RNA, 19 nt, Homo sapiens
ucccauaauucaugacauc

SEQ ID NO: 953065 - RNA, 19 nt, Homo sapiens
ccaaccagcagcagccuau

SEQ ID NO: 953066 - RNA, 19 nt, Homo sapiens
gaaugacaccaaggaagau

SEQ ID NO: 953067 - RNA, 19 nt, Homo sapiens
agaagccacuaauguaacu

SEQ ID NO: 953068 - RNA, 19 nt, Homo sapiens
acaagccggugcuggcaau

SEQ ID NO: 953069 - RNA, 19 nt, Homo sapiens
gaccaagcccagccaaggu

SEQ ID NO: 953070 - RNA, 19 nt, Homo sapiens
caaagagacagccccauug

SEQ ID NO: 953071 - RNA, 19 nt, Homo sapiens
ccaaagagacagccccauu

SEQ ID NO: 953072 - RNA, 19 nt, Homo sapiens
ggagagaagggcgcagaag

SEQ ID NO: 953073 - RNA, 19 nt, Homo sapiens
caaggucccgcugaugguu

SEQ ID NO: 953074 - RNA, 19 nt, Homo sapiens
caaccagcagcagccuaua

SEQ ID NO: 953075 - RNA, 19 nt, Homo sapiens
ggaaagauaugaucccaaa

SEQ ID NO: 953076 - RNA, 19 nt, Homo sapiens
ggacaggcauaccuuaaua

SEQ ID NO: 953077 - RNA, 19 nt, Homo sapiens
gagauggacugaagacuuu

SEQ ID NO: 953078 - RNA, 19 nt, Homo sapiens
uaaaguggcucacaauuau

SEQ ID NO: 953079 - RNA, 19 nt, Homo sapiens
guaaagaguuugaugugaa

SEQ ID NO: 953080 - RNA, 19 nt, Homo sapiens
gaacagagacggaaagauc

SEQ ID NO: 953081 - RNA, 19 nt, Homo sapiens
ggacugaagacuuugaaua

SEQ ID NO: 953082 - RNA, 19 nt, Homo sapiens
guacagauuugcauaaagu

SEQ ID NO: 953083 - RNA, 19 nt, Homo sapiens
ugaaugcacuucuuacuug

SEQ ID NO: 953084 - RNA, 19 nt, Homo sapiens
gcaaagcucuuggcuagug

SEQ ID NO: 953085 - RNA, 19 nt, Homo sapiens
ggaaagaucuaaguaaacu

SEQ ID NO: 953086 - RNA, 19 nt, Homo sapiens
ggaauggacugcuguaugc

SEQ ID NO: 953087 - RNA, 19 nt, Homo sapiens
caacaagcauugaaaagua

SEQ ID NO: 953088 - RNA, 19 nt, Homo sapiens
gauggaaguucuugucuca

SEQ ID NO: 953089 - RNA, 19 nt, Homo sapiens
gaaguaccauuuauuacca

SEQ ID NO: 953090 - RNA, 19 nt, Homo sapiens
ggagcuaucugaacacagu

SEQ ID NO: 953091 - RNA, 19 nt, Homo sapiens
ggacuccaguagcaaauau

SEQ ID NO: 953092 - RNA, 19 nt, Homo sapiens
uaugaucuccguacaaaua

SEQ ID NO: 953093 - RNA, 19 nt, Homo sapiens
ggcaagacaagaagaaaua

SEQ ID NO: 953094 - RNA, 19 nt, Homo sapiens
caauaguagucagacauua

SEQ ID NO: 953095 - RNA, 19 nt, Homo sapiens
caucaagcaucaucuccua

SEQ ID NO: 953096 - RNA, 19 nt, Homo sapiens
uggcauucauguuucauua

SEQ ID NO: 953097 - RNA, 19 nt, Homo sapiens
cauaaacaguugugugaug

SEQ ID NO: 953098 - RNA, 19 nt, Homo sapiens
uuaauaccguggaggcuua

SEQ ID NO: 953099 - RNA, 19 nt, Homo sapiens
guagaagcaugcuguaagu

SEQ ID NO: 953100 - RNA, 19 nt, Homo sapiens
gacauaaacaguuguguga

SEQ ID NO: 953101 - RNA, 19 nt, Homo sapiens
auaaaguggcucacaauua

SEQ ID NO: 953102 - RNA, 19 nt, Homo sapiens
gcccaagguuguacagauu

SEQ ID NO: 953103 - RNA, 19 nt, Homo sapiens
cagacuguguggaaagaua

SEQ ID NO: 953104 - RNA, 19 nt, Homo sapiens
gcauauacuucucuugucu

SEQ ID NO: 953105 - RNA, 19 nt, Homo sapiens
acaguugugugauguaauu

SEQ ID NO: 953106 - RNA, 19 nt, Homo sapiens
aaacaguugugugauguaa

SEQ ID NO: 953107 - RNA, 19 nt, Homo sapiens
ggagugugaugccaccuau

SEQ ID NO: 953108 - RNA, 19 nt, Homo sapiens
acggaaagaucuaaguaaa

SEQ ID NO: 953109 - RNA, 19 nt, Homo sapiens
ggaaguucuugucucaaau

SEQ ID NO: 953110 - RNA, 19 nt, Homo sapiens
gaagguguagaaccaaauu

SEQ ID NO: 953111 - RNA, 19 nt, Homo sapiens
caagcaucaucuccuaauu

SEQ ID NO: 953112 - RNA, 19 nt, Homo sapiens
uggaaguucuugucucaaa

SEQ ID NO: 953113 - RNA, 19 nt, Homo sapiens
gaagcaugcuguaaguuuu

SEQ ID NO: 953114 - RNA, 19 nt, Homo sapiens
ggacugcuguaugcuauag

SEQ ID NO: 953115 - RNA, 19 nt, Homo sapiens
gauauagaaugucggaaac

SEQ ID NO: 953116 - RNA, 19 nt, Homo sapiens
cuaaugaggagacaauauu

SEQ ID NO: 953117 - RNA, 19 nt, Homo sapiens
uaauauugagugccuguua

SEQ ID NO: 953118 - RNA, 19 nt, Homo sapiens
gguauggcauucauguuuc

SEQ ID NO: 953119 - RNA, 19 nt, Homo sapiens
guucuugucucaaaucagu

SEQ ID NO: 953120 - RNA, 19 nt, Homo sapiens
caugauggcuggagcuauc

SEQ ID NO: 953121 - RNA, 19 nt, Homo sapiens
ugaauacuguagagugcua

SEQ ID NO: 953122 - RNA, 19 nt, Homo sapiens
agagagacgacccauguua

SEQ ID NO: 953123 - RNA, 19 nt, Homo sapiens
gaggagacaauauugaaug

SEQ ID NO: 953124 - RNA, 19 nt, Homo sapiens
gcaagacaagaagaaauaa

SEQ ID NO: 953125 - RNA, 19 nt, Homo sapiens
gaaaccaggaauuuguauu

SEQ ID NO: 953126 - RNA, 19 nt, Homo sapiens
aaggagagguggcguagga

SEQ ID NO: 953127 - RNA, 19 nt, Homo sapiens
ccagagagacgacccaugu

SEQ ID NO: 953128 - RNA, 19 nt, Homo sapiens
ccuagacgaucacuugguu

SEQ ID NO: 953129 - RNA, 19 nt, Homo sapiens
ucauggaaguaaucagaaa

SEQ ID NO: 953130 - RNA, 19 nt, Homo sapiens
ugaagacuuugaauacugu

SEQ ID NO: 953131 - RNA, 19 nt, Homo sapiens
aaucagaaaccaggaauuu

SEQ ID NO: 953132 - RNA, 19 nt, Homo sapiens
gagcauuucauggaaguaa

SEQ ID NO: 953133 - RNA, 19 nt, Homo sapiens
caaauucguugugguccuu

SEQ ID NO: 953134 - RNA, 19 nt, Homo sapiens
cguaaagaguuugauguga

SEQ ID NO: 953135 - RNA, 19 nt, Homo sapiens
gggcauauacuucucuugu

SEQ ID NO: 953136 - RNA, 19 nt, Homo sapiens
uacaguagguguggcagua

SEQ ID NO: 953137 - RNA, 19 nt, Homo sapiens
aguaugaucuccguacaaa

SEQ ID NO: 953138 - RNA, 19 nt, Homo sapiens
ggagcaacaagcauugaaa

SEQ ID NO: 953139 - RNA, 19 nt, Homo sapiens
uggcagacauggaaaauaa

SEQ ID NO: 953140 - RNA, 19 nt, Homo sapiens
uauauuaggcuaccucuuc

SEQ ID NO: 953141 - RNA, 19 nt, Homo sapiens
gacggaaagaucuaaguaa

SEQ ID NO: 953142 - RNA, 19 nt, Homo sapiens
gcucacaauuauacuaugg

SEQ ID NO: 953143 - RNA, 19 nt, Homo sapiens
gauuggugcucuccucugu

SEQ ID NO: 953144 - RNA, 19 nt, Homo sapiens
ccucugaagucccugcauu

SEQ ID NO: 953145 - RNA, 19 nt, Homo sapiens
ggaggugguuuggucauca

SEQ ID NO: 953146 - RNA, 19 nt, Homo sapiens
gauggacaggcauaccuua

SEQ ID NO: 953147 - RNA, 19 nt, Homo sapiens
ucucaaaucaguagaaugu

SEQ ID NO: 953148 - RNA, 19 nt, Homo sapiens
ucagaaaccaggaauuugu

SEQ ID NO: 953149 - RNA, 19 nt, Homo sapiens
gcugccauguuuacuaaug

SEQ ID NO: 953150 - RNA, 19 nt, Homo sapiens
ggauagaccagaaguggau

SEQ ID NO: 953151 - RNA, 19 nt, Homo sapiens
guaugugguuggaggaaga

SEQ ID NO: 953152 - RNA, 19 nt, Homo sapiens
cagaaaccaggaauuugua

SEQ ID NO: 953153 - RNA, 19 nt, Homo sapiens
gaugucugguucucguaaa

SEQ ID NO: 953154 - RNA, 19 nt, Homo sapiens
gcauaaaguggcucacaau

SEQ ID NO: 953155 - RNA, 19 nt, Homo sapiens
ccaagguuguacagauuug

SEQ ID NO: 953156 - RNA, 19 nt, Homo sapiens
agaagcaugcuguaaguuu

SEQ ID NO: 953157 - RNA, 19 nt, Homo sapiens
gaugauggcacuagugaag

SEQ ID NO: 953158 - RNA, 19 nt, Homo sapiens
ugaagucccugcauuugag

SEQ ID NO: 953159 - RNA, 19 nt, Homo sapiens
ugaacacaguggaaagaug

SEQ ID NO: 953160 - RNA, 19 nt, Homo sapiens
aggaagagauggacugaag

SEQ ID NO: 953161 - RNA, 19 nt, Homo sapiens
gucggaaacucauuaugga

SEQ ID NO: 953162 - RNA, 19 nt, Homo sapiens
ugcaggacuuccaauagua

SEQ ID NO: 953163 - RNA, 19 nt, Homo sapiens
ugauggcacuagugaagaa

SEQ ID NO: 953164 - RNA, 19 nt, Homo sapiens
gagcaaacggugggagaaa

SEQ ID NO: 953165 - RNA, 19 nt, Homo sapiens
caucaucuccuaauucuac

SEQ ID NO: 953166 - RNA, 19 nt, Homo sapiens
ggacugcaguagcauccau

SEQ ID NO: 953167 - RNA, 19 nt, Homo sapiens
uuacuuggguccgucauga

SEQ ID NO: 953168 - RNA, 19 nt, Homo sapiens
caaagcucuuggcuaguga

SEQ ID NO: 953169 - RNA, 19 nt, Homo sapiens
gaauuccagcucacagauu

SEQ ID NO: 953170 - RNA, 19 nt, Homo sapiens
ccaauaguagucagacauu

SEQ ID NO: 953171 - RNA, 19 nt, Homo sapiens
gauaugaucccaaaacaga

SEQ ID NO: 953172 - RNA, 19 nt, Homo sapiens
gaaguucuugucucaaauc

SEQ ID NO: 953173 - RNA, 19 nt, Homo sapiens
ugauauagaaugucggaaa

SEQ ID NO: 953174 - RNA, 19 nt, Homo sapiens
uugcugccauguuuacuaa

SEQ ID NO: 953175 - RNA, 19 nt, Homo sapiens
gcaaaucaguuuuaaguga

SEQ ID NO: 953176 - RNA, 19 nt, Homo sapiens
aaaccacucuccuuccuuu

SEQ ID NO: 953177 - RNA, 19 nt, Homo sapiens
ucagauggcuggcggcuau

SEQ ID NO: 953178 - RNA, 19 nt, Homo sapiens
ggucuucccucccugcauu

SEQ ID NO: 953179 - RNA, 19 nt, Homo sapiens
gaguucccgucgaaaguua

SEQ ID NO: 953180 - RNA, 19 nt, Homo sapiens
gcacaugggacgcaaagga

SEQ ID NO: 953181 - RNA, 19 nt, Homo sapiens
ccacucuccuuccuuuaaa

SEQ ID NO: 953182 - RNA, 19 nt, Homo sapiens
gguggugacuguuuuauuu

SEQ ID NO: 953183 - RNA, 19 nt, Homo sapiens
guauaagccuaacaagcaa

SEQ ID NO: 953184 - RNA, 19 nt, Homo sapiens
gcacuaaaugcacuaacaa

SEQ ID NO: 953185 - RNA, 19 nt, Homo sapiens
gcaaugcggccaccaguca

SEQ ID NO: 953186 - RNA, 19 nt, Homo sapiens
ccacugguguuaaugaucu

SEQ ID NO: 953187 - RNA, 19 nt, Homo sapiens
ccaagccucucucuguaau

SEQ ID NO: 953188 - RNA, 19 nt, Homo sapiens
gaucugaggcugugucucu

SEQ ID NO: 953189 - RNA, 19 nt, Homo sapiens
ucacagcgcuaaggaagca

SEQ ID NO: 953190 - RNA, 19 nt, Homo sapiens
caacagggacugcauuugc

SEQ ID NO: 953191 - RNA, 19 nt, Homo sapiens
ucccaagccucucucugua

SEQ ID NO: 953192 - RNA, 19 nt, Homo sapiens
cuaaaugcacuaacaagga

SEQ ID NO: 953193 - RNA, 19 nt, Homo sapiens
cuuauucaguggaagauga

SEQ ID NO: 953194 - RNA, 19 nt, Homo sapiens
ugacaaucguccucuucaa

SEQ ID NO: 953195 - RNA, 19 nt, Homo sapiens
gaucgccuauggagugagu

SEQ ID NO: 953196 - RNA, 19 nt, Homo sapiens
gcggcugccucguucuuug

SEQ ID NO: 953197 - RNA, 19 nt, Homo sapiens
gcaggcaucucggcuugca

SEQ ID NO: 953198 - RNA, 19 nt, Homo sapiens
ugagugccuucuucagcua

SEQ ID NO: 953199 - RNA, 19 nt, Homo sapiens
cguagcaccuuagucuuug

SEQ ID NO: 953200 - RNA, 19 nt, Homo sapiens
ggagugagugccuucuuca

SEQ ID NO: 953201 - RNA, 19 nt, Homo sapiens
cuacaucaccgccuucauc

SEQ ID NO: 953202 - RNA, 19 nt, Homo sapiens
gaaaccacucuccuuccuu

SEQ ID NO: 953203 - RNA, 19 nt, Homo sapiens
aguauaagccuaacaagca

SEQ ID NO: 953204 - RNA, 19 nt, Homo sapiens
acacguagcaccuuagucu

SEQ ID NO: 953205 - RNA, 19 nt, Homo sapiens
caacugcugagaccucuuc

SEQ ID NO: 953206 - RNA, 19 nt, Homo sapiens
ucccugcauuucagacaua

SEQ ID NO: 953207 - RNA, 19 nt, Homo sapiens
ugagcaagcuggugaaacc

SEQ ID NO: 953208 - RNA, 19 nt, Homo sapiens
uaacaagcaacacguagca

SEQ ID NO: 953209 - RNA, 19 nt, Homo sapiens
gauguucgucgcugucuuc

SEQ ID NO: 953210 - RNA, 19 nt, Homo sapiens
agcaacacguagcaccuua

SEQ ID NO: 953211 - RNA, 19 nt, Homo sapiens
cgucagacauaagcucuca

SEQ ID NO: 953212 - RNA, 19 nt, Homo sapiens
gccuauggcugggugaugu

SEQ ID NO: 953213 - RNA, 19 nt, Homo sapiens
ccucguucuuugcguguuu

SEQ ID NO: 953214 - RNA, 19 nt, Homo sapiens
ggcgaguugucaugugguu

SEQ ID NO: 953215 - RNA, 19 nt, Homo sapiens
uggagugagugccuucuuc

SEQ ID NO: 953216 - RNA, 19 nt, Homo sapiens
ggccacugguguuaaugau

SEQ ID NO: 953217 - RNA, 19 nt, Homo sapiens
cguaguauaagccuaacaa

SEQ ID NO: 953218 - RNA, 19 nt, Homo sapiens
gcgccaccguucucuacau

SEQ ID NO: 953219 - RNA, 19 nt, Homo sapiens
ugaaaccacucuccuuccu

SEQ ID NO: 953220 - RNA, 19 nt, Homo sapiens
ucucugccuugucuuuaga

SEQ ID NO: 953221 - RNA, 19 nt, Homo sapiens
gcuggcggcuaugccuaaa

SEQ ID NO: 953222 - RNA, 19 nt, Homo sapiens
caacacguagcaccuuagu

SEQ ID NO: 953223 - RNA, 19 nt, Homo sapiens
uggccgaguucccgucgaa

SEQ ID NO: 953224 - RNA, 19 nt, Homo sapiens
acguagcaccuuagucuuu

SEQ ID NO: 953225 - RNA, 19 nt, Homo sapiens
cuucaaccucuaccuguuu

SEQ ID NO: 953226 - RNA, 19 nt, Homo sapiens
ccaccuguauccggccuau

SEQ ID NO: 953227 - RNA, 19 nt, Homo sapiens
gacaaucguccucuucaac

SEQ ID NO: 953228 - RNA, 19 nt, Homo sapiens
ccuggccacugguguuaau

SEQ ID NO: 953229 - RNA, 19 nt, Homo sapiens
ucucuguaauacucccuuu

SEQ ID NO: 953230 - RNA, 19 nt, Homo sapiens
caagccucucucuguaaua

SEQ ID NO: 953231 - RNA, 19 nt, Homo sapiens
guagcaccuuagucuuugu

SEQ ID NO: 953232 - RNA, 19 nt, Homo sapiens
ggugacaaucguccucuuc

SEQ ID NO: 953233 - RNA, 19 nt, Homo sapiens
cgaguucccgucgaaaguu

SEQ ID NO: 953234 - RNA, 19 nt, Homo sapiens
gcucucacagcgcuaagga

SEQ ID NO: 953235 - RNA, 19 nt, Homo sapiens
gcaacacguagcaccuuag

SEQ ID NO: 953236 - RNA, 19 nt, Homo sapiens
ucuucaaccucuaccuguu

SEQ ID NO: 953237 - RNA, 19 nt, Homo sapiens
gaccagaaguccugcuuua

SEQ ID NO: 953238 - RNA, 19 nt, Homo sapiens
gaaugaagaugcaggaugu

SEQ ID NO: 953239 - RNA, 19 nt, Homo sapiens
cagcuuggcucgaugcuuu

SEQ ID NO: 953240 - RNA, 19 nt, Homo sapiens
gaucaaauggcuauaagaa

SEQ ID NO: 953241 - RNA, 19 nt, Homo sapiens
caagauguauccaggaaga

SEQ ID NO: 953242 - RNA, 19 nt, Homo sapiens
ugaaagcaguggaggcuaa

SEQ ID NO: 953243 - RNA, 19 nt, Homo sapiens
ccaaaggcaaaguauauua

SEQ ID NO: 953244 - RNA, 19 nt, Homo sapiens
ccaggaugcuucuucauga

SEQ ID NO: 953245 - RNA, 19 nt, Homo sapiens
gaccaaaggcaaaguauau

SEQ ID NO: 953246 - RNA, 19 nt, Homo sapiens
ucagaagccuacaaugaaa

SEQ ID NO: 953247 - RNA, 19 nt, Homo sapiens
aagggugccugauagauua

SEQ ID NO: 953248 - RNA, 19 nt, Homo sapiens
uaaagagagugaugacaau

SEQ ID NO: 953249 - RNA, 19 nt, Homo sapiens
gauguggaccuguucauaa

SEQ ID NO: 953250 - RNA, 19 nt, Homo sapiens
cagaaguccugcuuuaaau

SEQ ID NO: 953251 - RNA, 19 nt, Homo sapiens
guaaagagagugaugacaa

SEQ ID NO: 953252 - RNA, 19 nt, Homo sapiens
ggagugcagucuucaaagu

SEQ ID NO: 953253 - RNA, 19 nt, Homo sapiens
cugaagauguggauauuga

SEQ ID NO: 953254 - RNA, 19 nt, Homo sapiens
gaaagacuguugcauacac

SEQ ID NO: 953255 - RNA, 19 nt, Homo sapiens
ccagaaguccugcuuuaaa

SEQ ID NO: 953256 - RNA, 19 nt, Homo sapiens
gacauuccacauauaguua

SEQ ID NO: 953257 - RNA, 19 nt, Homo sapiens
gaagaacuggcugugauuu

SEQ ID NO: 953258 - RNA, 19 nt, Homo sapiens
uagaagaacuggcugugau

SEQ ID NO: 953259 - RNA, 19 nt, Homo sapiens
gaaguaaagagagugauga

SEQ ID NO: 953260 - RNA, 19 nt, Homo sapiens
gugaguggcuauacuuuca

SEQ ID NO: 953261 - RNA, 19 nt, Homo sapiens
ucacaaucccauaucuuua

SEQ ID NO: 953262 - RNA, 19 nt, Homo sapiens
aaugaaagacuguugcaua

SEQ ID NO: 953263 - RNA, 19 nt, Homo sapiens
gcuauaagaagcuacuaaa

SEQ ID NO: 953264 - RNA, 19 nt, Homo sapiens
gaaaucagcaagauguauc

SEQ ID NO: 953265 - RNA, 19 nt, Homo sapiens
uggagaagguucauucaug

SEQ ID NO: 953266 - RNA, 19 nt, Homo sapiens
gauaauguacuucuugaca

SEQ ID NO: 953267 - RNA, 19 nt, Homo sapiens
agagagugaugacaauuau

SEQ ID NO: 953268 - RNA, 19 nt, Homo sapiens
ccaaccaaauaaagaaguu

SEQ ID NO: 953269 - RNA, 19 nt, Homo sapiens
caagggugccugauagauu

SEQ ID NO: 953270 - RNA, 19 nt, Homo sapiens
cuaacucuguguuucuuaa

SEQ ID NO: 953271 - RNA, 19 nt, Homo sapiens
uccaguagguggugcuaua

SEQ ID NO: 953272 - RNA, 19 nt, Homo sapiens
gcugugauuugugcuaauu

SEQ ID NO: 953273 - RNA, 19 nt, Homo sapiens
gcaacugguaugagucuaa

SEQ ID NO: 953274 - RNA, 19 nt, Homo sapiens
guagccaacugcuuuguag

SEQ ID NO: 953275 - RNA, 19 nt, Homo sapiens
auaaagaaguugucagaag

SEQ ID NO: 953276 - RNA, 19 nt, Homo sapiens
ggacgauccggugauauuu

SEQ ID NO: 953277 - RNA, 19 nt, Homo sapiens
ugacaaaacugaagaugug

SEQ ID NO: 953278 - RNA, 19 nt, Homo sapiens
auaauuacccuugugcuua

SEQ ID NO: 953279 - RNA, 19 nt, Homo sapiens
ugucagaagccuacaauga

SEQ ID NO: 953280 - RNA, 19 nt, Homo sapiens
gaaauggcuuuaaaacuag

SEQ ID NO: 953281 - RNA, 19 nt, Homo sapiens
ggauguggaccuguucaua

SEQ ID NO: 953282 - RNA, 19 nt, Homo sapiens
gucagaagccuacaaugaa

SEQ ID NO: 953283 - RNA, 19 nt, Homo sapiens
guucagagcuuggacaaaa

SEQ ID NO: 953284 - RNA, 19 nt, Homo sapiens
caaaguguaugcaucucau

SEQ ID NO: 953285 - RNA, 19 nt, Homo sapiens
gcuccaagggugccugaua

SEQ ID NO: 953286 - RNA, 19 nt, Homo sapiens
aaacugaagauguggauau

SEQ ID NO: 953287 - RNA, 19 nt, Homo sapiens
agacuugacagguguuuaa

SEQ ID NO: 953288 - RNA, 19 nt, Homo sapiens
ccucuuggguccaugcaaa

SEQ ID NO: 953289 - RNA, 19 nt, Homo sapiens
ggaaaucagcaagauguau

SEQ ID NO: 953290 - RNA, 19 nt, Homo sapiens
aagagagugaugacaauua

SEQ ID NO: 953291 - RNA, 19 nt, Homo sapiens
gaaaagaacgaaguaaaga

SEQ ID NO: 953292 - RNA, 19 nt, Homo sapiens
ugacauuccacauauaguu

SEQ ID NO: 953293 - RNA, 19 nt, Homo sapiens
gugacgagcugcguacaga

SEQ ID NO: 953294 - RNA, 19 nt, Homo sapiens
aaagaacgaaguaaagaga

SEQ ID NO: 953295 - RNA, 19 nt, Homo sapiens
ucacucagcuuggcucgau

SEQ ID NO: 953296 - RNA, 19 nt, Homo sapiens
ggcucgaguugguagaaua

SEQ ID NO: 953297 - RNA, 19 nt, Homo sapiens
uaauguacuucuugacaca

SEQ ID NO: 953298 - RNA, 19 nt, Homo sapiens
cagcuucaccuucuuuaga

SEQ ID NO: 953299 - RNA, 19 nt, Homo sapiens
guagguggugcuauaauug

SEQ ID NO: 953300 - RNA, 19 nt, Homo sapiens
agauguggauauugaagaa

SEQ ID NO: 953301 - RNA, 19 nt, Homo sapiens
agagugaugacaauuauga

SEQ ID NO: 953302 - RNA, 19 nt, Homo sapiens
caucagccaucggaaugaa

SEQ ID NO: 953303 - RNA, 19 nt, Homo sapiens
aguagguggugcuauaauu

SEQ ID NO: 953304 - RNA, 19 nt, Homo sapiens
uaauuacccuugugcuuac

SEQ ID NO: 953305 - RNA, 19 nt, Homo sapiens
caggaaaucagcaagaugu

SEQ ID NO: 953306 - RNA, 19 nt, Homo sapiens
gaagauguggauauugaag

SEQ ID NO: 953307 - RNA, 19 nt, Homo sapiens
guuuaaaggcaguaagaaa

SEQ ID NO: 953308 - RNA, 19 nt, Homo sapiens
ugauauuucugcugugcaa

SEQ ID NO: 953309 - RNA, 19 nt, Homo sapiens
agaacuggcugugauuugu

SEQ ID NO: 953310 - RNA, 19 nt, Homo sapiens
gaaagcaguggaggcuaaa

SEQ ID NO: 953311 - RNA, 19 nt, Homo sapiens
gcucuagccuuuugaacaa

SEQ ID NO: 953312 - RNA, 19 nt, Homo sapiens
gaguggcuauacuuucaga

SEQ ID NO: 953313 - RNA, 19 nt, Homo sapiens
gaacuugggccugauugca

SEQ ID NO: 953314 - RNA, 19 nt, Homo sapiens
aaagaccaaaggcaaagua

SEQ ID NO: 953315 - RNA, 19 nt, Homo sapiens
aaucccauaucuuuagcua

SEQ ID NO: 953316 - RNA, 19 nt, Homo sapiens
gcuauaauugcuggcuuua

SEQ ID NO: 953317 - RNA, 19 nt, Homo sapiens
gugcagucuucaaagugua

SEQ ID NO: 953318 - RNA, 19 nt, Homo sapiens
gaacuggcugugauuugug

SEQ ID NO: 953319 - RNA, 19 nt, Homo sapiens
ugcauucuguguauucauu

SEQ ID NO: 953320 - RNA, 19 nt, Homo sapiens
cugauugcauucuguguau

SEQ ID NO: 953321 - RNA, 19 nt, Homo sapiens
caugaucacugcagguuuu

SEQ ID NO: 953322 - RNA, 19 nt, Homo sapiens
cuagauaauguacuucuug

SEQ ID NO: 953323 - RNA, 19 nt, Homo sapiens
ucagaggcuuuaugucaca

SEQ ID NO: 953324 - RNA, 19 nt, Homo sapiens
uauggcaacugguaugagu

SEQ ID NO: 953325 - RNA, 19 nt, Homo sapiens
guucauucauggcauugga

SEQ ID NO: 953326 - RNA, 19 nt, Homo sapiens
uaauugcuggcuuuaauga

SEQ ID NO: 953327 - RNA, 19 nt, Homo sapiens
uauugucacuuggaucaaa

SEQ ID NO: 953328 - RNA, 19 nt, Homo sapiens
uuucagaggcuuuauguca

SEQ ID NO: 953329 - RNA, 19 nt, Homo sapiens
cuuuagcuaugacacuuaa

SEQ ID NO: 953330 - RNA, 19 nt, Homo sapiens
aaagcuggcugguguccau

SEQ ID NO: 953331 - RNA, 19 nt, Homo sapiens
cgaaguaaagagagugaug

SEQ ID NO: 953332 - RNA, 19 nt, Homo sapiens
agaccaaaggcaaaguaua

SEQ ID NO: 953333 - RNA, 19 nt, Homo sapiens
ccugauagauuagaagaac

SEQ ID NO: 953334 - RNA, 19 nt, Homo sapiens
ccaaauaaagaaguuguca

SEQ ID NO: 953335 - RNA, 19 nt, Homo sapiens
auugcuggcuuuaaugauu

SEQ ID NO: 953336 - RNA, 19 nt, Homo sapiens
gaauagaugcuuuuguuca

SEQ ID NO: 953337 - RNA, 19 nt, Homo sapiens
gaagauagcuguauaaaug

SEQ ID NO: 953338 - RNA, 19 nt, Homo sapiens
gggaauaaaugcuggauua

SEQ ID NO: 953339 - RNA, 19 nt, Homo sapiens
gcaagcaguuuaaagauaa

SEQ ID NO: 953340 - RNA, 19 nt, Homo sapiens
caaagaagauagcuguaua

SEQ ID NO: 953341 - RNA, 19 nt, Homo sapiens
gugcugagguugagaaaua

SEQ ID NO: 953342 - RNA, 19 nt, Homo sapiens
gaccagaaguccugcuuua

SEQ ID NO: 953343 - RNA, 19 nt, Homo sapiens
gagaauggcugggaugaaa

SEQ ID NO: 953344 - RNA, 19 nt, Homo sapiens
gaaugaagaugcaggaugu

SEQ ID NO: 953345 - RNA, 19 nt, Homo sapiens
ggacagcaacaauuucuua

SEQ ID NO: 953346 - RNA, 19 nt, Homo sapiens
ggacaacucccacaacaaa

SEQ ID NO: 953347 - RNA, 19 nt, Homo sapiens
guagagugcuuccuccuaa

SEQ ID NO: 953348 - RNA, 19 nt, Homo sapiens
gaagcagagucaagguaua

SEQ ID NO: 953349 - RNA, 19 nt, Homo sapiens
gucauagccugaagauuua

SEQ ID NO: 953350 - RNA, 19 nt, Homo sapiens
caucaugacucagauaauu

SEQ ID NO: 953351 - RNA, 19 nt, Homo sapiens
ggucugaacuagccauuga

SEQ ID NO: 953352 - RNA, 19 nt, Homo sapiens
gagaaauacuccucuaaag

SEQ ID NO: 953353 - RNA, 19 nt, Homo sapiens
cagcuuggcucgaugcuuu

SEQ ID NO: 953354 - RNA, 19 nt, Homo sapiens
ugucauagccugaagauuu

SEQ ID NO: 953355 - RNA, 19 nt, Homo sapiens
gaucaaauggcuauaagaa

SEQ ID NO: 953356 - RNA, 19 nt, Homo sapiens
caagauguauccaggaaga

SEQ ID NO: 953357 - RNA, 19 nt, Homo sapiens
gcacagacaucaucaaaau

SEQ ID NO: 953358 - RNA, 19 nt, Homo sapiens
aaagagaaguuuaccauag

SEQ ID NO: 953359 - RNA, 19 nt, Homo sapiens
ugaaagcaguggaggcuaa

SEQ ID NO: 953360 - RNA, 19 nt, Homo sapiens
ccaaaggcaaaguauauua

SEQ ID NO: 953361 - RNA, 19 nt, Homo sapiens
gagucaagguauaaacuuu

SEQ ID NO: 953362 - RNA, 19 nt, Homo sapiens
ccaggaugcuucuucauga

SEQ ID NO: 953363 - RNA, 19 nt, Homo sapiens
gaccaaaggcaaaguauau

SEQ ID NO: 953364 - RNA, 19 nt, Homo sapiens
cuuacuggcuuuaacaaua

SEQ ID NO: 953365 - RNA, 19 nt, Homo sapiens
ucagaagccuacaaugaaa

SEQ ID NO: 953366 - RNA, 19 nt, Homo sapiens
aagggugccugauagauua

SEQ ID NO: 953367 - RNA, 19 nt, Homo sapiens
uaaccauucuuuaccguuu

SEQ ID NO: 953368 - RNA, 19 nt, Homo sapiens
uaaagagagugaugacaau

SEQ ID NO: 953369 - RNA, 19 nt, Homo sapiens
gauguggaccuguucauaa

SEQ ID NO: 953370 - RNA, 19 nt, Homo sapiens
gaauaucugucaauuaagc

SEQ ID NO: 953371 - RNA, 19 nt, Homo sapiens
caagcaagcaguuuaaaga

SEQ ID NO: 953372 - RNA, 19 nt, Homo sapiens
cagaaguccugcuuuaaau

SEQ ID NO: 953373 - RNA, 19 nt, Homo sapiens
gguagagaaugcuguguug

SEQ ID NO: 953374 - RNA, 19 nt, Homo sapiens
gaacuagccauugaugauu

SEQ ID NO: 953375 - RNA, 19 nt, Homo sapiens
guaaagagagugaugacaa

SEQ ID NO: 953376 - RNA, 19 nt, Homo sapiens
guacaagcaagcaguuuaa

SEQ ID NO: 953377 - RNA, 19 nt, Homo sapiens
ggagugcagucuucaaagu

SEQ ID NO: 953378 - RNA, 19 nt, Homo sapiens
ucucuuaggccacuaguua

SEQ ID NO: 953379 - RNA, 19 nt, Homo sapiens
cugaagauguggauauuga

SEQ ID NO: 953380 - RNA, 19 nt, Homo sapiens
gaaagacuguugcauacac

SEQ ID NO: 953381 - RNA, 19 nt, Homo sapiens
uaacagcccauugaacaua

SEQ ID NO: 953382 - RNA, 19 nt, Homo sapiens
ccaaagcuauguuucucaa

SEQ ID NO: 953383 - RNA, 19 nt, Homo sapiens
ccagaaguccugcuuuaaa

SEQ ID NO: 953384 - RNA, 19 nt, Homo sapiens
gauuuggaauuguaaccua

SEQ ID NO: 953385 - RNA, 19 nt, Homo sapiens
ggugcucacuggugcauuu

SEQ ID NO: 953386 - RNA, 19 nt, Homo sapiens
ggaauuguaaccuauguau

SEQ ID NO: 953387 - RNA, 19 nt, Homo sapiens
gacauuccacauauaguua

SEQ ID NO: 953388 - RNA, 19 nt, Homo sapiens
guuaacaucuagaggauag

SEQ ID NO: 953389 - RNA, 19 nt, Homo sapiens
gggcaaguguccagagaau

SEQ ID NO: 953390 - RNA, 19 nt, Homo sapiens
gaagaacuggcugugauuu

SEQ ID NO: 953391 - RNA, 19 nt, Homo sapiens
uagaagaacuggcugugau

SEQ ID NO: 953392 - RNA, 19 nt, Homo sapiens
ggaauaaaugcuggauuaa

SEQ ID NO: 953393 - RNA, 19 nt, Homo sapiens
ucuaagaauuccuucacua

SEQ ID NO: 953394 - RNA, 19 nt, Homo sapiens
uaaccagggucacggauuc

SEQ ID NO: 953395 - RNA, 19 nt, Homo sapiens
gaaguaaagagagugauga

SEQ ID NO: 953396 - RNA, 19 nt, Homo sapiens
gugaguggcuauacuuuca

SEQ ID NO: 953397 - RNA, 19 nt, Homo sapiens
ucacaaucccauaucuuua

SEQ ID NO: 953398 - RNA, 19 nt, Homo sapiens
aaugaaagacuguugcaua

SEQ ID NO: 953399 - RNA, 19 nt, Homo sapiens
gcuauaagaagcuacuaaa

SEQ ID NO: 953400 - RNA, 19 nt, Homo sapiens
gaaaucagcaagauguauc

SEQ ID NO: 953401 - RNA, 19 nt, Homo sapiens
guuacuaguuguuuguuga

SEQ ID NO: 953402 - RNA, 19 nt, Homo sapiens
uguaguaacucauuucaag

SEQ ID NO: 953403 - RNA, 19 nt, Homo sapiens
gauaauguacuucuugaca

SEQ ID NO: 953404 - RNA, 19 nt, Homo sapiens
agagagugaugacaauuau

SEQ ID NO: 953405 - RNA, 19 nt, Homo sapiens
ccaaccaaauaaagaaguu

SEQ ID NO: 953406 - RNA, 19 nt, Homo sapiens
cauuacagguucauucaug

SEQ ID NO: 953407 - RNA, 19 nt, Homo sapiens
caagggugccugauagauu

SEQ ID NO: 953408 - RNA, 19 nt, Homo sapiens
cuaacucuguguuucuuaa

SEQ ID NO: 953409 - RNA, 19 nt, Homo sapiens
cuaagaauuccuucacuaa

SEQ ID NO: 953410 - RNA, 19 nt, Homo sapiens
gagaaaauguuuacagaca

SEQ ID NO: 953411 - RNA, 19 nt, Homo sapiens
ggaagcagagucaagguau

SEQ ID NO: 953412 - RNA, 19 nt, Homo sapiens
gaaaugauaaggcuguagu

SEQ ID NO: 953413 - RNA, 19 nt, Homo sapiens
uccaguagguggugcuaua

SEQ ID NO: 953414 - RNA, 19 nt, Homo sapiens
gcugugauuugugcuaauu

SEQ ID NO: 953415 - RNA, 19 nt, Homo sapiens
gcaacugguaugagucuaa

SEQ ID NO: 953416 - RNA, 19 nt, Homo sapiens
guagccaacugcuuuguag

SEQ ID NO: 953417 - RNA, 19 nt, Homo sapiens
auugaaggcucuaagaauu

SEQ ID NO: 953418 - RNA, 19 nt, Homo sapiens
ggucacggauuccaaacau

SEQ ID NO: 953419 - RNA, 19 nt, Homo sapiens
ugagaaauacuccucuaaa

SEQ ID NO: 953420 - RNA, 19 nt, Homo sapiens
agcaagcaguuuaaagaua

SEQ ID NO: 953421 - RNA, 19 nt, Homo sapiens
auaaagaaguugucagaag

SEQ ID NO: 953422 - RNA, 19 nt, Homo sapiens
uguagagaaucuuaaguga

SEQ ID NO: 953423 - RNA, 19 nt, Homo sapiens
ggacgauccggugauauuu

SEQ ID NO: 953424 - RNA, 19 nt, Homo sapiens
uaacucauuucaagggaau

SEQ ID NO: 953425 - RNA, 19 nt, Homo sapiens
ggucagacauguguaaggu

SEQ ID NO: 953426 - RNA, 19 nt, Homo sapiens
gcaaguguccagagaaugg

SEQ ID NO: 953427 - RNA, 19 nt, Homo sapiens
ugacaaaacugaagaugug

SEQ ID NO: 953428 - RNA, 19 nt, Homo sapiens
auaauuacccuugugcuua

SEQ ID NO: 953429 - RNA, 19 nt, Homo sapiens
ugucagaagccuacaauga

SEQ ID NO: 953430 - RNA, 19 nt, Homo sapiens
guuaacagcccauugaaca

SEQ ID NO: 953431 - RNA, 19 nt, Homo sapiens
cugcauauauugguuaguu

SEQ ID NO: 953432 - RNA, 19 nt, Homo sapiens
cauagcaacuuucaguagu

SEQ ID NO: 953433 - RNA, 19 nt, Homo sapiens
gguuucuucuugaucauuu

SEQ ID NO: 953434 - RNA, 19 nt, Homo sapiens
gaaauggcuuuaaaacuag

SEQ ID NO: 953435 - RNA, 19 nt, Homo sapiens
ggauguggaccuguucaua

SEQ ID NO: 953436 - RNA, 19 nt, Homo sapiens
gucagaagccuacaaugaa

SEQ ID NO: 953437 - RNA, 19 nt, Homo sapiens
gcagaaagacgccgaguuu

SEQ ID NO: 953438 - RNA, 19 nt, Homo sapiens
gcacgcagcucuauuacau

SEQ ID NO: 953439 - RNA, 19 nt, Homo sapiens
gcacagcccugaugaugga

SEQ ID NO: 953440 - RNA, 19 nt, Homo sapiens
gcaaguaccucuaccaaaa

SEQ ID NO: 953441 - RNA, 19 nt, Homo sapiens
gaggauaacgugaaaggua

SEQ ID NO: 953442 - RNA, 19 nt, Homo sapiens
ucaggcaaguucuguguua

SEQ ID NO: 953443 - RNA, 19 nt, Homo sapiens
ccaagaacgucucgcagaa

SEQ ID NO: 953444 - RNA, 19 nt, Homo sapiens
ccaaugauuucgcuuccua

SEQ ID NO: 953445 - RNA, 19 nt, Homo sapiens
ugauuucgcuuccuacuug

SEQ ID NO: 953446 - RNA, 19 nt, Homo sapiens
cgacaucgauuccgacaag

SEQ ID NO: 953447 - RNA, 19 nt, Homo sapiens
gaccgagccugcccagaaa

SEQ ID NO: 953448 - RNA, 19 nt, Homo sapiens
gagcaguucagcuucaaua

SEQ ID NO: 953449 - RNA, 19 nt, Homo sapiens
uuacaacuauggcuccuuu

SEQ ID NO: 953450 - RNA, 19 nt, Homo sapiens
gcaaccugcuccuuuacuu

SEQ ID NO: 953451 - RNA, 19 nt, Homo sapiens
caccauugcugucuucuau

SEQ ID NO: 953452 - RNA, 19 nt, Homo sapiens
ggguauauuucucuccuuu

SEQ ID NO: 953453 - RNA, 19 nt, Homo sapiens
ggaaucaggacaucugcua

SEQ ID NO: 953454 - RNA, 19 nt, Homo sapiens
cgaccuggauacuuagaaa

SEQ ID NO: 953455 - RNA, 19 nt, Homo sapiens
ucuaugaccuggacaacaa

SEQ ID NO: 953456 - RNA, 19 nt, Homo sapiens
uaaccaaccagacucagua

SEQ ID NO: 953457 - RNA, 19 nt, Homo sapiens
ucagcacgcagcucuauua

SEQ ID NO: 953458 - RNA, 19 nt, Homo sapiens
gaagggaugugcuguuucc

SEQ ID NO: 953459 - RNA, 19 nt, Homo sapiens
augacgaccuggauacuua

SEQ ID NO: 953460 - RNA, 19 nt, Homo sapiens
ggaccucucuuacgguuac

SEQ ID NO: 953461 - RNA, 19 nt, Homo sapiens
ucugcaaccugcuccuuua

SEQ ID NO: 953462 - RNA, 19 nt, Homo sapiens
gcucagugcuugcuaucau

SEQ ID NO: 953463 - RNA, 19 nt, Homo sapiens
gaugugcuguuucccucua

SEQ ID NO: 953464 - RNA, 19 nt, Homo sapiens
gcaccaagcaauaccucua

SEQ ID NO: 953465 - RNA, 19 nt, Homo sapiens
agaaagacgccgaguuuga

SEQ ID NO: 953466 - RNA, 19 nt, Homo sapiens
cuauaccaauuuccaguuu

SEQ ID NO: 953467 - RNA, 19 nt, Homo sapiens
gcucagucaucuccauuca

SEQ ID NO: 953468 - RNA, 19 nt, Homo sapiens
ccuugaaguuuacaaagaa

SEQ ID NO: 953469 - RNA, 19 nt, Homo sapiens
ucaacaacauccucagcaa

SEQ ID NO: 953470 - RNA, 19 nt, Homo sapiens
gaaagacgccgaguuugag

SEQ ID NO: 953471 - RNA, 19 nt, Homo sapiens
gcauuuccguuuucuauga

SEQ ID NO: 953472 - RNA, 19 nt, Homo sapiens
ggacaucugcuacuacaac

SEQ ID NO: 953473 - RNA, 19 nt, Homo sapiens
ugucagugcuggugucuca

SEQ ID NO: 953474 - RNA, 19 nt, Homo sapiens
gaucgucuucuccaucauu

SEQ ID NO: 953475 - RNA, 19 nt, Homo sapiens
caggacaucugcuacuaca

SEQ ID NO: 953476 - RNA, 19 nt, Homo sapiens
ugaccgagccugcccagaa

SEQ ID NO: 953477 - RNA, 19 nt, Homo sapiens
cagagcgucuccaugcuau

SEQ ID NO: 953478 - RNA, 19 nt, Homo sapiens
ccuaugaaaccuugaaguu

SEQ ID NO: 953479 - RNA, 19 nt, Homo sapiens
aggaagggaugugcuguuu

SEQ ID NO: 953480 - RNA, 19 nt, Homo sapiens
ggaugacuacgacacauug

SEQ ID NO: 953481 - RNA, 19 nt, Homo sapiens
uuaugaggguuacaacuau

SEQ ID NO: 953482 - RNA, 19 nt, Homo sapiens
gcaaagacuuccccagcaa

SEQ ID NO: 953483 - RNA, 19 nt, Homo sapiens
agggcuggcuucuaaguuu

SEQ ID NO: 953484 - RNA, 19 nt, Homo sapiens
gcgagcuggucaacaucua

SEQ ID NO: 953485 - RNA, 19 nt, Homo sapiens
gaacauugccaccauugcu

SEQ ID NO: 953486 - RNA, 19 nt, Homo sapiens
gcacuggggaccucucuua

SEQ ID NO: 953487 - RNA, 19 nt, Homo sapiens
uugaagggcugggagauga

SEQ ID NO: 953488 - RNA, 19 nt, Homo sapiens
guucggguccuuccuggua

SEQ ID NO: 953489 - RNA, 19 nt, Homo sapiens
auaccaauuuccaguuuga

SEQ ID NO: 953490 - RNA, 19 nt, Homo sapiens
ggcguggacucgguaauug

SEQ ID NO: 953491 - RNA, 19 nt, Homo sapiens
agucggagauucaguucuu

SEQ ID NO: 953492 - RNA, 19 nt, Homo sapiens
caaguucuguguuagucau

SEQ ID NO: 953493 - RNA, 19 nt, Homo sapiens
caagaacgucucgcagaaa

SEQ ID NO: 953494 - RNA, 19 nt, Homo sapiens
gaugugcuguguccugucu

SEQ ID NO: 953495 - RNA, 19 nt, Homo sapiens
gggcuucgcgcucuucuuc

SEQ ID NO: 953496 - RNA, 19 nt, Homo sapiens
aacuauggcuccuuugaga

SEQ ID NO: 953497 - RNA, 19 nt, Homo sapiens
caacaacguagccuucauc

SEQ ID NO: 953498 - RNA, 19 nt, Homo sapiens
gucaacaucuacaccuuca

SEQ ID NO: 953499 - RNA, 19 nt, Homo sapiens
ggugaagaccgaagaccaa

SEQ ID NO: 953500 - RNA, 19 nt, Homo sapiens
caguucagcuucaauacca

SEQ ID NO: 953501 - RNA, 19 nt, Homo sapiens
gggagaggaucaagcucau

SEQ ID NO: 953502 - RNA, 19 nt, Homo sapiens
uuacuucgccuucuacauc

SEQ ID NO: 953503 - RNA, 19 nt, Homo sapiens
cuuaugaggguuacaacua

SEQ ID NO: 953504 - RNA, 19 nt, Homo sapiens
gaauuugcauacaauaacc

SEQ ID NO: 953505 - RNA, 19 nt, Homo sapiens
gggcuggcuucuaaguuuc

SEQ ID NO: 953506 - RNA, 19 nt, Homo sapiens
gcuucgcgcucuucuucuu

SEQ ID NO: 953507 - RNA, 19 nt, Homo sapiens
ugcugaagcucuaccagaa

SEQ ID NO: 953508 - RNA, 19 nt, Homo sapiens
ugaccucugugcccuggaa

SEQ ID NO: 953509 - RNA, 19 nt, Homo sapiens
aagaugaaccggucgauca

SEQ ID NO: 953510 - RNA, 19 nt, Homo sapiens
ggcgcagcguugaggauaa

SEQ ID NO: 953511 - RNA, 19 nt, Homo sapiens
gcgcaaguaccucuaccaa

SEQ ID NO: 953512 - RNA, 19 nt, Homo sapiens
caagcaauaccucuaugug

SEQ ID NO: 953513 - RNA, 19 nt, Homo sapiens
aagaacgucucgcagaaag

SEQ ID NO: 953514 - RNA, 19 nt, Homo sapiens
ucagagcgucuccaugcua

SEQ ID NO: 953515 - RNA, 19 nt, Homo sapiens
gcauggugcugcuggucau

SEQ ID NO: 953516 - RNA, 19 nt, Homo sapiens
gaucuacuucuggaacauu

SEQ ID NO: 953517 - RNA, 19 nt, Homo sapiens
gaggaugacuacgacacau

SEQ ID NO: 953518 - RNA, 19 nt, Homo sapiens
ucaagggcaccgccagaaa

SEQ ID NO: 953519 - RNA, 19 nt, Homo sapiens
accagacgaugaccaagaa

SEQ ID NO: 953520 - RNA, 19 nt, Homo sapiens
ucagccgcauggacgauuu

SEQ ID NO: 953521 - RNA, 19 nt, Homo sapiens
gaggugggucuggaucuuu

SEQ ID NO: 953522 - RNA, 19 nt, Homo sapiens
ugaacguccugaacaagca

SEQ ID NO: 953523 - RNA, 19 nt, Homo sapiens
caucugcuacuacaacuuc

SEQ ID NO: 953524 - RNA, 19 nt, Homo sapiens
ggaggaugacuacgacaca

SEQ ID NO: 953525 - RNA, 19 nt, Homo sapiens
cucaagcagucacgucuga

SEQ ID NO: 953526 - RNA, 19 nt, Homo sapiens
ugaccuggacaacaacgua

SEQ ID NO: 953527 - RNA, 19 nt, Homo sapiens
caagaaugagucggagauu

SEQ ID NO: 953528 - RNA, 19 nt, Homo sapiens
ggcaaguucuguguuaguc

SEQ ID NO: 953529 - RNA, 19 nt, Homo sapiens
uauaccaauuuccaguuug

SEQ ID NO: 953530 - RNA, 19 nt, Homo sapiens
gcugcucagugcuugcuau

SEQ ID NO: 953531 - RNA, 19 nt, Homo sapiens
caacaucuacaccuucaac

SEQ ID NO: 953532 - RNA, 19 nt, Homo sapiens
gggagcaguucagcuucaa

SEQ ID NO: 953533 - RNA, 19 nt, Homo sapiens
caauaaccaaccagacuca

SEQ ID NO: 953534 - RNA, 19 nt, Homo sapiens
gaugacgaccuggauacuu

SEQ ID NO: 953535 - RNA, 19 nt, Homo sapiens
ccaagaaugagucggagau

SEQ ID NO: 953536 - RNA, 19 nt, Homo sapiens
ggucaugggcaacgucauc

SEQ ID NO: 953537 - RNA, 19 nt, Homo sapiens
ugaagaagcugagugauuu

SEQ ID NO: 953538 - RNA, 19 nt, Homo sapiens
gccaugcccuggaggaaua

SEQ ID NO: 953539 - RNA, 19 nt, Homo sapiens
uggcgucacugcacuguua

SEQ ID NO: 953540 - RNA, 19 nt, Homo sapiens
agccagagcucccgacuaa

SEQ ID NO: 953541 - RNA, 19 nt, Homo sapiens
gcugacaccuucucacugu

SEQ ID NO: 953542 - RNA, 19 nt, Homo sapiens
caccacagcuggccacaau

SEQ ID NO: 953543 - RNA, 19 nt, Homo sapiens
cggcuucacuuccguaaga

SEQ ID NO: 953544 - RNA, 19 nt, Homo sapiens
gugaagaagcugagugauu

SEQ ID NO: 953545 - RNA, 19 nt, Homo sapiens
gcucauggcaggaagcauu

SEQ ID NO: 953546 - RNA, 19 nt, Homo sapiens
ugggagaguuggugaagaa

SEQ ID NO: 953547 - RNA, 19 nt, Homo sapiens
ccaagaagcagcaugagau

SEQ ID NO: 953548 - RNA, 19 nt, Homo sapiens
ccucagaauuccuggagaa

SEQ ID NO: 953549 - RNA, 19 nt, Homo sapiens
ccugaacucucucccagaa

SEQ ID NO: 953550 - RNA, 19 nt, Homo sapiens
agaaagaggagaagaggaa

SEQ ID NO: 953551 - RNA, 19 nt, Homo sapiens
ggccaucucucccgcuuca

SEQ ID NO: 953552 - RNA, 19 nt, Homo sapiens
aaacaugucaggcccaaga

SEQ ID NO: 953553 - RNA, 19 nt, Homo sapiens
gcaggaagcauuggaugga

SEQ ID NO: 953554 - RNA, 19 nt, Homo sapiens
gaaucuggcugcccuucag

SEQ ID NO: 953555 - RNA, 19 nt, Homo sapiens
ucagugggcugcugcuaca

SEQ ID NO: 953556 - RNA, 19 nt, Homo sapiens
ccagagcucccgacuaaca

SEQ ID NO: 953557 - RNA, 19 nt, Homo sapiens
gaaacgucgcgaccuguga

SEQ ID NO: 953558 - RNA, 19 nt, Homo sapiens
gagaguuggugaagaagcu

SEQ ID NO: 953559 - RNA, 19 nt, Homo sapiens
ggccagugauuccgagugu

SEQ ID NO: 953560 - RNA, 19 nt, Homo sapiens
cccgaggccucucucauga

SEQ ID NO: 953561 - RNA, 19 nt, Homo sapiens
ugcaggcucuggagaaaga

SEQ ID NO: 953562 - RNA, 19 nt, Homo sapiens
gacccuggaucccuguuca

SEQ ID NO: 953563 - RNA, 19 nt, Homo sapiens
gggucaggcucuuucuguu

SEQ ID NO: 953564 - RNA, 19 nt, Homo sapiens
ggagacgcuuauucuacug

SEQ ID NO: 953565 - RNA, 19 nt, Homo sapiens
caagauugaagaauaugug

SEQ ID NO: 953566 - RNA, 19 nt, Homo sapiens
gaagaagcugagugauuuc

SEQ ID NO: 953567 - RNA, 19 nt, Homo sapiens
guagugaggccagugauuc

SEQ ID NO: 953568 - RNA, 19 nt, Homo sapiens
gugggcugcugcuacauga

SEQ ID NO: 953569 - RNA, 19 nt, Homo sapiens
agcauuggauggacugaaa

SEQ ID NO: 953570 - RNA, 19 nt, Homo sapiens
gcacaguggcagaguacau

SEQ ID NO: 953571 - RNA, 19 nt, Homo sapiens
agagcacaguggcagagua

SEQ ID NO: 953572 - RNA, 19 nt, Homo sapiens
ugaacucucucccagaaac

SEQ ID NO: 953573 - RNA, 19 nt, Homo sapiens
ggacaccuccggcuucacu

SEQ ID NO: 953574 - RNA, 19 nt, Homo sapiens
gguggagacgcuuauucua

SEQ ID NO: 953575 - RNA, 19 nt, Homo sapiens
acucuaccguuccaucuug

SEQ ID NO: 953576 - RNA, 19 nt, Homo sapiens
uuucuguucuggagacuga

SEQ ID NO: 953577 - RNA, 19 nt, Homo sapiens
ggucaggcucuuucuguuc

SEQ ID NO: 953578 - RNA, 19 nt, Homo sapiens
cagcaucggaucccggaaa

SEQ ID NO: 953579 - RNA, 19 nt, Homo sapiens
gcccuggccuucgaacuca

SEQ ID NO: 953580 - RNA, 19 nt, Homo sapiens
caaaccagcccucgucacu

SEQ ID NO: 953581 - RNA, 19 nt, Homo sapiens
caagaagcagcaugagauc

SEQ ID NO: 953582 - RNA, 19 nt, Homo sapiens
gucggagacuggacccaaa

SEQ ID NO: 953583 - RNA, 19 nt, Homo sapiens
gguagugaggccagugauu

SEQ ID NO: 953584 - RNA, 19 nt, Homo sapiens
ccaaaacucuuccuguucu

SEQ ID NO: 953585 - RNA, 19 nt, Homo sapiens
uggagacgcuuauucuacu

SEQ ID NO: 953586 - RNA, 19 nt, Homo sapiens
gguccacgagcucaagauu

SEQ ID NO: 953587 - RNA, 19 nt, Homo sapiens
ccugguuccuucaguuuca

SEQ ID NO: 953588 - RNA, 19 nt, Homo sapiens
gcugagcggcuacagaaag

SEQ ID NO: 953589 - RNA, 19 nt, Homo sapiens
gagcacaguggcagaguac

SEQ ID NO: 953590 - RNA, 19 nt, Homo sapiens
gaugcagccugaggagaca

SEQ ID NO: 953591 - RNA, 19 nt, Homo sapiens
ggcccaagaagcagcauga

SEQ ID NO: 953592 - RNA, 19 nt, Homo sapiens
augccuacaucaucgaauu

SEQ ID NO: 953593 - RNA, 19 nt, Homo sapiens
gcacucuaccguuccaucu

SEQ ID NO: 953594 - RNA, 19 nt, Homo sapiens
gucaggcucuuucuguucu

SEQ ID NO: 953595 - RNA, 19 nt, Homo sapiens
gcugagcuccugcccaucu

SEQ ID NO: 953596 - RNA, 19 nt, Homo sapiens
ccagugauuccgagugugu

SEQ ID NO: 953597 - RNA, 19 nt, Homo sapiens
cuccuuccauggauuaugu

SEQ ID NO: 953598 - RNA, 19 nt, Homo sapiens
guggagacgcuuauucuac

SEQ ID NO: 953599 - RNA, 19 nt, Homo sapiens
ucugcaggcucuggagaaa

SEQ ID NO: 953600 - RNA, 19 nt, Homo sapiens
guaagaggagaggagugua

SEQ ID NO: 953601 - RNA, 19 nt, Homo sapiens
ucacccugcuggcccugaa

SEQ ID NO: 953602 - RNA, 19 nt, Homo sapiens
cgugugcccuggccuuuac

SEQ ID NO: 953603 - RNA, 19 nt, Homo sapiens
gcgugugcccuggccuuua

SEQ ID NO: 953604 - RNA, 19 nt, Homo sapiens
ucucuccuuccauggauua

SEQ ID NO: 953605 - RNA, 19 nt, Homo sapiens
gagaaacagcacccugcau

SEQ ID NO: 953606 - RNA, 19 nt, Homo sapiens
gcagaguacaucucaucca

SEQ ID NO: 953607 - RNA, 19 nt, Homo sapiens
gcuacaugaagcugaguga

SEQ ID NO: 953608 - RNA, 19 nt, Homo sapiens
gcuccauuccggaaacaug

SEQ ID NO: 953609 - RNA, 19 nt, Homo sapiens
gcaauaaacuuuccauuuc

SEQ ID NO: 953610 - RNA, 19 nt, Homo sapiens
aaagaaaccugcuaucauu

SEQ ID NO: 953611 - RNA, 19 nt, Homo sapiens
gaagagacuuggcauucaa

SEQ ID NO: 953612 - RNA, 19 nt, Homo sapiens
ggacccaucugcuugguuu

SEQ ID NO: 953613 - RNA, 19 nt, Homo sapiens
gaaggcggcuguacugaug

SEQ ID NO: 953614 - RNA, 19 nt, Homo sapiens
ggauugcucuucuaauuau

SEQ ID NO: 953615 - RNA, 19 nt, Homo sapiens
ccagaugucuucccacaaa

SEQ ID NO: 953616 - RNA, 19 nt, Homo sapiens
ggacaacgacuaucugcua

SEQ ID NO: 953617 - RNA, 19 nt, Homo sapiens
gcaaagacuaugauguuaa

SEQ ID NO: 953618 - RNA, 19 nt, Homo sapiens
ggcaauaaacuuuccauuu

SEQ ID NO: 953619 - RNA, 19 nt, Homo sapiens
gggauugcucuucuaauua

SEQ ID NO: 953620 - RNA, 19 nt, Homo sapiens
gaccaaauauguacuucau

SEQ ID NO: 953621 - RNA, 19 nt, Homo sapiens
ggacugggacucuucagaa

SEQ ID NO: 953622 - RNA, 19 nt, Homo sapiens
cuauguaucuugaugcaaa

SEQ ID NO: 953623 - RNA, 19 nt, Homo sapiens
gacaguacuuugaaacuca

SEQ ID NO: 953624 - RNA, 19 nt, Homo sapiens
uuauagagcaggaagaaua

SEQ ID NO: 953625 - RNA, 19 nt, Homo sapiens
uauaacaggccauccauuu

SEQ ID NO: 953626 - RNA, 19 nt, Homo sapiens
ggaagagucugaguugucu

SEQ ID NO: 953627 - RNA, 19 nt, Homo sapiens
gagaagggcaaacggguaa

SEQ ID NO: 953628 - RNA, 19 nt, Homo sapiens
gacaagagcaggcguguuc

SEQ ID NO: 953629 - RNA, 19 nt, Homo sapiens
ccacugggcaauaaacuuu

SEQ ID NO: 953630 - RNA, 19 nt, Homo sapiens
uggagaagauggaagaguu

SEQ ID NO: 953631 - RNA, 19 nt, Homo sapiens
ugaguugucuguuucuaga

SEQ ID NO: 953632 - RNA, 19 nt, Homo sapiens
guuccagucucaucagauu

SEQ ID NO: 953633 - RNA, 19 nt, Homo sapiens
gggccuggaucugcuuaua

SEQ ID NO: 953634 - RNA, 19 nt, Homo sapiens
gacugggacucuucagaaa

SEQ ID NO: 953635 - RNA, 19 nt, Homo sapiens
gaagugagaggaagagucu

SEQ ID NO: 953636 - RNA, 19 nt, Homo sapiens
ucuccaaccuucaggaauu

SEQ ID NO: 953637 - RNA, 19 nt, Homo sapiens
agggauugcucuucuaauu

SEQ ID NO: 953638 - RNA, 19 nt, Homo sapiens
guuggagggucaucccaua

SEQ ID NO: 953639 - RNA, 19 nt, Homo sapiens
ggagaagauggaagaguuu

SEQ ID NO: 953640 - RNA, 19 nt, Homo sapiens
ucacagagacaguacuuug

SEQ ID NO: 953641 - RNA, 19 nt, Homo sapiens
ugcaaagacuaugauguua

SEQ ID NO: 953642 - RNA, 19 nt, Homo sapiens
cagagacaguacuuugaaa

SEQ ID NO: 953643 - RNA, 19 nt, Homo sapiens
gagucugaguugucuguuu

SEQ ID NO: 953644 - RNA, 19 nt, Homo sapiens
cacuggagcuggccuuuau

SEQ ID NO: 953645 - RNA, 19 nt, Homo sapiens
gcuaaaggacaacgacuau

SEQ ID NO: 953646 - RNA, 19 nt, Homo sapiens
gccuggaucugcuuauaga

SEQ ID NO: 953647 - RNA, 19 nt, Homo sapiens
uacagaaacuggcaacauc

SEQ ID NO: 953648 - RNA, 19 nt, Homo sapiens
gacuuggcauucaaagauu

SEQ ID NO: 953649 - RNA, 19 nt, Homo sapiens
cugggacucuucagaaauu

SEQ ID NO: 953650 - RNA, 19 nt, Homo sapiens
gagaggaagagucugaguu

SEQ ID NO: 953651 - RNA, 19 nt, Homo sapiens
acccaaagcugaagaagag

SEQ ID NO: 953652 - RNA, 19 nt, Homo sapiens
gcugcaggguauugaggua

SEQ ID NO: 953653 - RNA, 19 nt, Homo sapiens
caacgacuaucugcuacau

SEQ ID NO: 953654 - RNA, 19 nt, Homo sapiens
gaagauggaagaguuugug

SEQ ID NO: 953655 - RNA, 19 nt, Homo sapiens
agaagagacuuggcauuca

SEQ ID NO: 953656 - RNA, 19 nt, Homo sapiens
ucauugcuauguaucuuga

SEQ ID NO: 953657 - RNA, 19 nt, Homo sapiens
uauagagcaggaagaauaa

SEQ ID NO: 953658 - RNA, 19 nt, Homo sapiens
cagaagagacuuggcauuc

SEQ ID NO: 953659 - RNA, 19 nt, Homo sapiens
ggaagaauaaagccaccaa

SEQ ID NO: 953660 - RNA, 19 nt, Homo sapiens
uuuguauccuggcuuauaa

SEQ ID NO: 953661 - RNA, 19 nt, Homo sapiens
agaauaaagccaccaacuu

SEQ ID NO: 953662 - RNA, 19 nt, Homo sapiens
ccucauggcugugauguac

SEQ ID NO: 953663 - RNA, 19 nt, Homo sapiens
uaaaggacaacgacuaucu

SEQ ID NO: 953664 - RNA, 19 nt, Homo sapiens
caauaaacuuuccauuucc

SEQ ID NO: 953665 - RNA, 19 nt, Homo sapiens
gauggaagaguuuguguac

SEQ ID NO: 953666 - RNA, 19 nt, Homo sapiens
agacuuggcauucaaagau

SEQ ID NO: 953667 - RNA, 19 nt, Homo sapiens
cggcuugucuaccaucaga

SEQ ID NO: 953668 - RNA, 19 nt, Homo sapiens
gaggaagagucugaguugu

SEQ ID NO: 953669 - RNA, 19 nt, Homo sapiens
ccuuuaugcugcucgaauu

SEQ ID NO: 953670 - RNA, 19 nt, Homo sapiens
gcucuauuauuccuucuac

SEQ ID NO: 953671 - RNA, 19 nt, Homo sapiens
caccgucuauugucauuca

SEQ ID NO: 953672 - RNA, 19 nt, Homo sapiens
gcucagaccaaauauguac

SEQ ID NO: 953673 - RNA, 19 nt, Homo sapiens
cagcagccuuuguccacuu

SEQ ID NO: 953674 - RNA, 19 nt, Homo sapiens
ggugguggcagcagccuuu

SEQ ID NO: 953675 - RNA, 19 nt, Homo sapiens
acauaugguuccagucuca

SEQ ID NO: 953676 - RNA, 19 nt, Homo sapiens
gaaaccugcuaucauugcu

SEQ ID NO: 953677 - RNA, 19 nt, Homo sapiens
agaggaagagucugaguug

SEQ ID NO: 953678 - RNA, 19 nt, Homo sapiens
cagcuucuccuggcucuuu

SEQ ID NO: 953679 - RNA, 19 nt, Homo sapiens
ugaccaugcucagaccaaa

SEQ ID NO: 953680 - RNA, 19 nt, Homo sapiens
agaauucaguaccaaccaa

SEQ ID NO: 953681 - RNA, 19 nt, Homo sapiens
gcauuucugccaucauugu

SEQ ID NO: 953682 - RNA, 19 nt, Homo sapiens
gaaaaugucccucccuuac

SEQ ID NO: 953683 - RNA, 19 nt, Homo sapiens
acagagacaguacuuugaa

SEQ ID NO: 953684 - RNA, 19 nt, Homo sapiens
uacuaucgcugagggcuuu

SEQ ID NO: 953685 - RNA, 19 nt, Homo sapiens
ccaccaugcacuuuacuau

SEQ ID NO: 953686 - RNA, 19 nt, Homo sapiens
ucagggauugcucuucuaa

SEQ ID NO: 953687 - RNA, 19 nt, Homo sapiens
ggcauucaaagauuucaaa

SEQ ID NO: 953688 - RNA, 19 nt, Homo sapiens
cugcuaucauugcuaugua

SEQ ID NO: 953689 - RNA, 19 nt, Homo sapiens
gcuuauagagcaggaagaa

SEQ ID NO: 953690 - RNA, 19 nt, Homo sapiens
aaacuuuccauuuccauuc

SEQ ID NO: 953691 - RNA, 19 nt, Homo sapiens
agucugaguugucuguuuc

SEQ ID NO: 953692 - RNA, 19 nt, Homo sapiens
ugaugacacccuucucuga

SEQ ID NO: 953693 - RNA, 19 nt, Homo sapiens
ugacauaugguuccagucu

SEQ ID NO: 953694 - RNA, 19 nt, Homo sapiens
cuauugucauucagagaaa

SEQ ID NO: 953695 - RNA, 19 nt, Homo sapiens
gagaagauggaagaguuug

SEQ ID NO: 953696 - RNA, 19 nt, Homo sapiens
augcaaagacuaugauguu

SEQ ID NO: 953697 - RNA, 19 nt, Homo sapiens
guaccagccagaugucuuc

SEQ ID NO: 953698 - RNA, 19 nt, Homo sapiens
ucacuggagcuggccuuua

SEQ ID NO: 953699 - RNA, 19 nt, Homo sapiens
gagacuuggcauucaaaga

SEQ ID NO: 953700 - RNA, 19 nt, Homo sapiens
aaagaaaguacagaagaga

SEQ ID NO: 953701 - RNA, 19 nt, Homo sapiens
aacuuuguauccuggcuua

SEQ ID NO: 953702 - RNA, 19 nt, Homo sapiens
cacagagacaguacuuuga

SEQ ID NO: 953703 - RNA, 19 nt, Homo sapiens
gaugcaaagacuaugaugu

SEQ ID NO: 953704 - RNA, 19 nt, Homo sapiens
agacaguacuuugaaacuc

SEQ ID NO: 953705 - RNA, 19 nt, Homo sapiens
uuagagaauucaguaccaa

SEQ ID NO: 953706 - RNA, 19 nt, Homo sapiens
ugagguaccagccagaugu

SEQ ID NO: 953707 - RNA, 19 nt, Homo sapiens
caucuggacccaucugcuu

SEQ ID NO: 953708 - RNA, 19 nt, Homo sapiens
ggcuaaaggacaacgacua

SEQ ID NO: 953709 - RNA, 19 nt, Homo sapiens
gcagagaucucacuauaaa

SEQ ID NO: 953710 - RNA, 19 nt, Homo sapiens
caaagagaaucacgaauua

SEQ ID NO: 953711 - RNA, 19 nt, Homo sapiens
caaagcagaucuuagaaua

SEQ ID NO: 953712 - RNA, 19 nt, Homo sapiens
gcaccaagcuacccaagua

SEQ ID NO: 953713 - RNA, 19 nt, Homo sapiens
caagaaagccucagaaaug

SEQ ID NO: 953714 - RNA, 19 nt, Homo sapiens
gaaaagcacggaacaauua

SEQ ID NO: 953715 - RNA, 19 nt, Homo sapiens
ugauguggcuccuuauaua

SEQ ID NO: 953716 - RNA, 19 nt, Homo sapiens
ggauugaugucaccacuga

SEQ ID NO: 953717 - RNA, 19 nt, Homo sapiens
ccucagaaaugacugcaua

SEQ ID NO: 953718 - RNA, 19 nt, Homo sapiens
gaguaaagccucaggauau

SEQ ID NO: 953719 - RNA, 19 nt, Homo sapiens
ugauucaccuuaucuauga

SEQ ID NO: 953720 - RNA, 19 nt, Homo sapiens
acgcagagaucucacuaua

SEQ ID NO: 953721 - RNA, 19 nt, Homo sapiens
ggaguaaagccucaggaua

SEQ ID NO: 953722 - RNA, 19 nt, Homo sapiens
gcagugagggauuuauuaa

SEQ ID NO: 953723 - RNA, 19 nt, Homo sapiens
caaauacaguuucacuuag

SEQ ID NO: 953724 - RNA, 19 nt, Homo sapiens
ucaaagagaaucacgaauu

SEQ ID NO: 953725 - RNA, 19 nt, Homo sapiens
gaaacccuaucaagacuuc

SEQ ID NO: 953726 - RNA, 19 nt, Homo sapiens
gcaagaaagccucagaaau

SEQ ID NO: 953727 - RNA, 19 nt, Homo sapiens
gguugaagaucgcgaaaga

SEQ ID NO: 953728 - RNA, 19 nt, Homo sapiens
uggaagacaugcugaggua

SEQ ID NO: 953729 - RNA, 19 nt, Homo sapiens
caacuacucguguauguga

SEQ ID NO: 953730 - RNA, 19 nt, Homo sapiens
gaagcaguaucuauucaca

SEQ ID NO: 953731 - RNA, 19 nt, Homo sapiens
ugaggugccuguaucauug

SEQ ID NO: 953732 - RNA, 19 nt, Homo sapiens
caguaucuauucacaauga

SEQ ID NO: 953733 - RNA, 19 nt, Homo sapiens
gagaaucacgaauuaagaa

SEQ ID NO: 953734 - RNA, 19 nt, Homo sapiens
aagaaagccucagaaauga

SEQ ID NO: 953735 - RNA, 19 nt, Homo sapiens
gcacuuuauuugacuacuu

SEQ ID NO: 953736 - RNA, 19 nt, Homo sapiens
ggauucggaugauaaacaa

SEQ ID NO: 953737 - RNA, 19 nt, Homo sapiens
gaggagcagugagggauuu

SEQ ID NO: 953738 - RNA, 19 nt, Homo sapiens
ggauuuggguggaacugaa

SEQ ID NO: 953739 - RNA, 19 nt, Homo sapiens
guucaugcuuguuuccuaa

SEQ ID NO: 953740 - RNA, 19 nt, Homo sapiens
aaccuuggcuuauuuauag

SEQ ID NO: 953741 - RNA, 19 nt, Homo sapiens
gaacgcagagaucucacua

SEQ ID NO: 953742 - RNA, 19 nt, Homo sapiens
gaagacaugcugagguaga

SEQ ID NO: 953743 - RNA, 19 nt, Homo sapiens
gcaaaaggcuuggcuggaa

SEQ ID NO: 953744 - RNA, 19 nt, Homo sapiens
gagguagaauuuacaacug

SEQ ID NO: 953745 - RNA, 19 nt, Homo sapiens
aguaaagccucaggauaua

SEQ ID NO: 953746 - RNA, 19 nt, Homo sapiens
gcuggaauaucaggagaaa

SEQ ID NO: 953747 - RNA, 19 nt, Homo sapiens
ggcaauaauuuccaaagca

SEQ ID NO: 953748 - RNA, 19 nt, Homo sapiens
aggcuuggcuggaauauca

SEQ ID NO: 953749 - RNA, 19 nt, Homo sapiens
guagauguuucugguauuc

SEQ ID NO: 953750 - RNA, 19 nt, Homo sapiens
cauaacaucuuuguacucu

SEQ ID NO: 953751 - RNA, 19 nt, Homo sapiens
gagaauacaagaggauuau

SEQ ID NO: 953752 - RNA, 19 nt, Homo sapiens
gauaaacaacagaggagaa

SEQ ID NO: 953753 - RNA, 19 nt, Homo sapiens
gagcagugagggauuuauu

SEQ ID NO: 953754 - RNA, 19 nt, Homo sapiens
caccuuaucuaugaucuug

SEQ ID NO: 953755 - RNA, 19 nt, Homo sapiens
uaucagaggcaauaauuuc

SEQ ID NO: 953756 - RNA, 19 nt, Homo sapiens
uaaaacugauggcuacuaa

SEQ ID NO: 953757 - RNA, 19 nt, Homo sapiens
caacugacuggcagaaaga

SEQ ID NO: 953758 - RNA, 19 nt, Homo sapiens
guauguaucagaggcaaua

SEQ ID NO: 953759 - RNA, 19 nt, Homo sapiens
gagcauuucugccagucau

SEQ ID NO: 953760 - RNA, 19 nt, Homo sapiens
gaauacaagaggauuaucu

SEQ ID NO: 953761 - RNA, 19 nt, Homo sapiens
uaccagacauaucagauuc

SEQ ID NO: 953762 - RNA, 19 nt, Homo sapiens
cuucugaguuacauaaaga

SEQ ID NO: 953763 - RNA, 19 nt, Homo sapiens
gaaaguuagauuuguugga

SEQ ID NO: 953764 - RNA, 19 nt, Homo sapiens
uaaagcaacagauaguuca

SEQ ID NO: 953765 - RNA, 19 nt, Homo sapiens
ugucaccacugauggaaga

SEQ ID NO: 953766 - RNA, 19 nt, Homo sapiens
gcugggauucggaugauaa

SEQ ID NO: 953767 - RNA, 19 nt, Homo sapiens
cuacucaaaugaaggagau

SEQ ID NO: 953768 - RNA, 19 nt, Homo sapiens
ugacaugcuaccagacaua

SEQ ID NO: 953769 - RNA, 19 nt, Homo sapiens
gggcuaugaugcaagaaag

SEQ ID NO: 953770 - RNA, 19 nt, Homo sapiens
ggaagcaauugcagaaaau

SEQ ID NO: 953771 - RNA, 19 nt, Homo sapiens
aaguagauguuucugguau

SEQ ID NO: 953772 - RNA, 19 nt, Homo sapiens
uguacucuaugagcaaaua

SEQ ID NO: 953773 - RNA, 19 nt, Homo sapiens
ugaugcaacuacucgugua

SEQ ID NO: 953774 - RNA, 19 nt, Homo sapiens
ccaaagcagaucuuagaau

SEQ ID NO: 953775 - RNA, 19 nt, Homo sapiens
caaaguacaagaugauguc

SEQ ID NO: 953776 - RNA, 19 nt, Homo sapiens
uaucuaugaucuugaugug

SEQ ID NO: 953777 - RNA, 19 nt, Homo sapiens
guugcagucucccgaauuc

SEQ ID NO: 953778 - RNA, 19 nt, Homo sapiens
uuacuacacuacggauuga

SEQ ID NO: 953779 - RNA, 19 nt, Homo sapiens
ucaaaugaaggagauguuu

SEQ ID NO: 953780 - RNA, 19 nt, Homo sapiens
caaguagauguuucuggua

SEQ ID NO: 953781 - RNA, 19 nt, Homo sapiens
gugacugccucuccagaug

SEQ ID NO: 953782 - RNA, 19 nt, Homo sapiens
gcauuucugccagucauaa

SEQ ID NO: 953783 - RNA, 19 nt, Homo sapiens
agagaauacaagaggauua

SEQ ID NO: 953784 - RNA, 19 nt, Homo sapiens
cagaggcaauaauuuccaa

SEQ ID NO: 953785 - RNA, 19 nt, Homo sapiens
agauguuucugguauucua

SEQ ID NO: 953786 - RNA, 19 nt, Homo sapiens
ucccaucaaugacaugcua

SEQ ID NO: 953787 - RNA, 19 nt, Homo sapiens
gaaagccucagaaaugacu

SEQ ID NO: 953788 - RNA, 19 nt, Homo sapiens
guaaguggccaugacauca

SEQ ID NO: 953789 - RNA, 19 nt, Homo sapiens
uaaagccucaggauauaga

SEQ ID NO: 953790 - RNA, 19 nt, Homo sapiens
ggacaugcuaaacagagaa

SEQ ID NO: 953791 - RNA, 19 nt, Homo sapiens
caaaugaaggagauguuuc

SEQ ID NO: 953792 - RNA, 19 nt, Homo sapiens
cugcaacccuccaaguaau

SEQ ID NO: 953793 - RNA, 19 nt, Homo sapiens
ucucaucauuuccaaagau

SEQ ID NO: 953794 - RNA, 19 nt, Homo sapiens
uacaagaugaugucacaaa

SEQ ID NO: 953795 - RNA, 19 nt, Homo sapiens
cuaaacagagaauacaaga

SEQ ID NO: 953796 - RNA, 19 nt, Homo sapiens
gagaucucacuauaaauuc

SEQ ID NO: 953797 - RNA, 19 nt, Homo sapiens
gggauucggaugauaaaca

SEQ ID NO: 953798 - RNA, 19 nt, Homo sapiens
uguaucagaggcaauaauu

SEQ ID NO: 953799 - RNA, 19 nt, Homo sapiens
gcuuguuuccuaaaguaua

SEQ ID NO: 953800 - RNA, 19 nt, Homo sapiens
acaacugacuggcagaaag

SEQ ID NO: 953801 - RNA, 19 nt, Homo sapiens
guaucagaggcaauaauuu

SEQ ID NO: 953802 - RNA, 19 nt, Homo sapiens
ggauaauggcaccaagcua

SEQ ID NO: 953803 - RNA, 19 nt, Homo sapiens
ggaccuugauaaaacaauu

SEQ ID NO: 953804 - RNA, 19 nt, Homo sapiens
ugaguuacauaaagaagac

SEQ ID NO: 953805 - RNA, 19 nt, Homo sapiens
uagggaaccugaugcaacu

SEQ ID NO: 953806 - RNA, 19 nt, Homo sapiens
accaugauccugagacuuu

SEQ ID NO: 953807 - RNA, 19 nt, Homo sapiens
agguagaauuuacaacuga

SEQ ID NO: 953808 - RNA, 19 nt, Homo sapiens
aguacaagaugaugucaca

SEQ ID NO: 953809 - RNA, 19 nt, Homo sapiens
gaaagaagcagucagauug

SEQ ID NO: 953810 - RNA, 19 nt, Homo sapiens
ggaagugccuuaacagauu

SEQ ID NO: 953811 - RNA, 19 nt, Homo sapiens
ggaugaagaugauuuguug

SEQ ID NO: 953812 - RNA, 19 nt, Homo sapiens
gcaaggcccugauguauag

SEQ ID NO: 953813 - RNA, 19 nt, Homo sapiens
ggaaaugguugacaugaug

SEQ ID NO: 953814 - RNA, 19 nt, Homo sapiens
gcaaaggacugggaauuuc

SEQ ID NO: 953815 - RNA, 19 nt, Homo sapiens
agagaagccugucuugaua

SEQ ID NO: 953816 - RNA, 19 nt, Homo sapiens
gcaagguucuuuaugucua

SEQ ID NO: 953817 - RNA, 19 nt, Homo sapiens
caugcuggcuggaaaguua

SEQ ID NO: 953818 - RNA, 19 nt, Homo sapiens
gaagugccuuaacagauuu

SEQ ID NO: 953819 - RNA, 19 nt, Homo sapiens
acagaaaucuuggcaauug

SEQ ID NO: 953820 - RNA, 19 nt, Homo sapiens
gaaggcaguuuauauggau

SEQ ID NO: 953821 - RNA, 19 nt, Homo sapiens
gaugugaacucaaggaagu

SEQ ID NO: 953822 - RNA, 19 nt, Homo sapiens
gaacuugguuacagguguu

SEQ ID NO: 953823 - RNA, 19 nt, Homo sapiens
gaacugauuggaagcauga

SEQ ID NO: 953824 - RNA, 19 nt, Homo sapiens
uguauagguugcaccauua

SEQ ID NO: 953825 - RNA, 19 nt, Homo sapiens
gagcggaggagacgaauga

SEQ ID NO: 953826 - RNA, 19 nt, Homo sapiens
gaugguugcuggauuagau

SEQ ID NO: 953827 - RNA, 19 nt, Homo sapiens
aaagaagaauuccaacaug

SEQ ID NO: 953828 - RNA, 19 nt, Homo sapiens
acucagaaguggagaauga

SEQ ID NO: 953829 - RNA, 19 nt, Homo sapiens
cuacagaaaucuuggcaau

SEQ ID NO: 953830 - RNA, 19 nt, Homo sapiens
ucucugaccuucaauccua

SEQ ID NO: 953831 - RNA, 19 nt, Homo sapiens
gaugaaggcaguuuauaug

SEQ ID NO: 953832 - RNA, 19 nt, Homo sapiens
ugugaugguugcuggauua

SEQ ID NO: 953833 - RNA, 19 nt, Homo sapiens
gaucucaucugugcaguuc

SEQ ID NO: 953834 - RNA, 19 nt, Homo sapiens
gaaugaggccggacuggaa

SEQ ID NO: 953835 - RNA, 19 nt, Homo sapiens
ugaagaagaugaagaugag

SEQ ID NO: 953836 - RNA, 19 nt, Homo sapiens
uggcauugcuggauauuug

SEQ ID NO: 953837 - RNA, 19 nt, Homo sapiens
agaagccugucuugauaua

SEQ ID NO: 953838 - RNA, 19 nt, Homo sapiens
guggagugguaaauauaua

SEQ ID NO: 953839 - RNA, 19 nt, Homo sapiens
cagagcaucuauuuggaaa

SEQ ID NO: 953840 - RNA, 19 nt, Homo sapiens
auaaacauguggcagcuuu

SEQ ID NO: 953841 - RNA, 19 nt, Homo sapiens
gaaguccaguugagucaca

SEQ ID NO: 953842 - RNA, 19 nt, Homo sapiens
gaagaccaaagaacugauu

SEQ ID NO: 953843 - RNA, 19 nt, Homo sapiens
acagcaagguucuuuaugu

SEQ ID NO: 953844 - RNA, 19 nt, Homo sapiens
ugaagaggaugaagaugau

SEQ ID NO: 953845 - RNA, 19 nt, Homo sapiens
aaacuuuccugaauaugug

SEQ ID NO: 953846 - RNA, 19 nt, Homo sapiens
cuaaagagacuauuugaag

SEQ ID NO: 953847 - RNA, 19 nt, Homo sapiens
gcuauaaugaacuugguua

SEQ ID NO: 953848 - RNA, 19 nt, Homo sapiens
gugaagaggaugaagauga

SEQ ID NO: 953849 - RNA, 19 nt, Homo sapiens
gcagucagauugguucauc

SEQ ID NO: 953850 - RNA, 19 nt, Homo sapiens
ggcaaggcccugauguaua

SEQ ID NO: 953851 - RNA, 19 nt, Homo sapiens
ugaaagaagcagucagauu

SEQ ID NO: 953852 - RNA, 19 nt, Homo sapiens
gcaucuauuuggaaagguu

SEQ ID NO: 953853 - RNA, 19 nt, Homo sapiens
ccaguugagucacaagaga

SEQ ID NO: 953854 - RNA, 19 nt, Homo sapiens
aaacuucccagucauuaaa

SEQ ID NO: 953855 - RNA, 19 nt, Homo sapiens
ugaaggcaguuuauaugga

SEQ ID NO: 953856 - RNA, 19 nt, Homo sapiens
ggauggagaaguuuauguu

SEQ ID NO: 953857 - RNA, 19 nt, Homo sapiens
uuacuucucugaccuucaa

SEQ ID NO: 953858 - RNA, 19 nt, Homo sapiens
gauggagaaguuuauguuu

SEQ ID NO: 953859 - RNA, 19 nt, Homo sapiens
gaagauagugaggagcuuu

SEQ ID NO: 953860 - RNA, 19 nt, Homo sapiens
gagcaucuauuuggaaagg

SEQ ID NO: 953861 - RNA, 19 nt, Homo sapiens
ggaauuucauauccacauc

SEQ ID NO: 953862 - RNA, 19 nt, Homo sapiens
aaacaaacccaaagccaau

SEQ ID NO: 953863 - RNA, 19 nt, Homo sapiens
gauuaagcauugccacauc

SEQ ID NO: 953864 - RNA, 19 nt, Homo sapiens
ugagagguuugaaagagaa

SEQ ID NO: 953865 - RNA, 19 nt, Homo sapiens
caagguucuuuaugucuau

SEQ ID NO: 953866 - RNA, 19 nt, Homo sapiens
ggacugggaauuucauauc

SEQ ID NO: 953867 - RNA, 19 nt, Homo sapiens
gaaaugguugacaugauga

SEQ ID NO: 953868 - RNA, 19 nt, Homo sapiens
gccaguaaugucuuaauaa

SEQ ID NO: 953869 - RNA, 19 nt, Homo sapiens
gugaggagcuuugaagucu

SEQ ID NO: 953870 - RNA, 19 nt, Homo sapiens
gugagagguuugaaagaga

SEQ ID NO: 953871 - RNA, 19 nt, Homo sapiens
ggaugaagaagaugaagau

SEQ ID NO: 953872 - RNA, 19 nt, Homo sapiens
uuacucagacuucuaaaga

SEQ ID NO: 953873 - RNA, 19 nt, Homo sapiens
agccaguaaugucuuaaua

SEQ ID NO: 953874 - RNA, 19 nt, Homo sapiens
caaacuucccagucauuaa

SEQ ID NO: 953875 - RNA, 19 nt, Homo sapiens
ucaaacuucccagucauua

SEQ ID NO: 953876 - RNA, 19 nt, Homo sapiens
cagcaagguucuuuauguc

SEQ ID NO: 953877 - RNA, 19 nt, Homo sapiens
cacauucucuucagauagu

SEQ ID NO: 953878 - RNA, 19 nt, Homo sapiens
ccacagcaagguucuuuau

SEQ ID NO: 953879 - RNA, 19 nt, Homo sapiens
agaugaagaugaggaaaug

SEQ ID NO: 953880 - RNA, 19 nt, Homo sapiens
gauauaucaucucagaaac

SEQ ID NO: 953881 - RNA, 19 nt, Homo sapiens
acucagacuucuaaagaga

SEQ ID NO: 953882 - RNA, 19 nt, Homo sapiens
ccauuacucagacuucuaa

SEQ ID NO: 953883 - RNA, 19 nt, Homo sapiens
caagugagagguuugaaag

SEQ ID NO: 953884 - RNA, 19 nt, Homo sapiens
gaggaaaugguugacauga

SEQ ID NO: 953885 - RNA, 19 nt, Homo sapiens
uuacagguguuacuucucu

SEQ ID NO: 953886 - RNA, 19 nt, Homo sapiens
agacucgggugacucagaa

SEQ ID NO: 953887 - RNA, 19 nt, Homo sapiens
gagaagccugucuugauau

SEQ ID NO: 953888 - RNA, 19 nt, Homo sapiens
gaccuucaauccuacuaca

SEQ ID NO: 953889 - RNA, 19 nt, Homo sapiens
ugaugaaggcaguuuauau

SEQ ID NO: 953890 - RNA, 19 nt, Homo sapiens
gcaaugaagaccaaagaac

SEQ ID NO: 953891 - RNA, 19 nt, Homo sapiens
gaacugccagcaugcgaau

SEQ ID NO: 953892 - RNA, 19 nt, Homo sapiens
caaaggacugggaauuuca

SEQ ID NO: 953893 - RNA, 19 nt, Homo sapiens
caguuuggguggaugaaga

SEQ ID NO: 953894 - RNA, 19 nt, Homo sapiens
gcugaacguccuacuguug

SEQ ID NO: 953895 - RNA, 19 nt, Homo sapiens
uggagaaguuuauguuugg

SEQ ID NO: 953896 - RNA, 19 nt, Homo sapiens
ugaugaaagugaagaggau

SEQ ID NO: 953897 - RNA, 19 nt, Homo sapiens
gguuacagguguuacuucu

SEQ ID NO: 953898 - RNA, 19 nt, Homo sapiens
aaaguuaauuccugugcau

SEQ ID NO: 953899 - RNA, 19 nt, Homo sapiens
gaagaugaagaugaggaaa

SEQ ID NO: 953900 - RNA, 19 nt, Homo sapiens
ugaagaugauuuguugcaa

SEQ ID NO: 953901 - RNA, 19 nt, Homo sapiens
guauguugcuugugguucu

SEQ ID NO: 953902 - RNA, 19 nt, Homo sapiens
guuaauuccugugcaucaa

SEQ ID NO: 953903 - RNA, 19 nt, Homo sapiens
gaagccaguuuggguggau

SEQ ID NO: 953904 - RNA, 19 nt, Homo sapiens
auggagaaguuuauguuug

SEQ ID NO: 953905 - RNA, 19 nt, Homo sapiens
uccacauucucuucagaua

SEQ ID NO: 953906 - RNA, 19 nt, Homo sapiens
caaugaagaccaaagaacu

SEQ ID NO: 953907 - RNA, 19 nt, Homo sapiens
aagccugucuugauauauc

SEQ ID NO: 953908 - RNA, 19 nt, Homo sapiens
ccaagaaacaaacccaaag

SEQ ID NO: 953909 - RNA, 19 nt, Homo sapiens
ggauacagcuuauaaguug

SEQ ID NO: 953910 - RNA, 19 nt, Homo sapiens
gaagguggccaauuucuua

SEQ ID NO: 953911 - RNA, 19 nt, Homo sapiens
ugagaaagcugcagacaaa

SEQ ID NO: 953912 - RNA, 19 nt, Homo sapiens
gguauugaguuuaguguua

SEQ ID NO: 953913 - RNA, 19 nt, Homo sapiens
guagaaacaugcugcuuaa

SEQ ID NO: 953914 - RNA, 19 nt, Homo sapiens
gaaacaugcugcuuaagug

SEQ ID NO: 953915 - RNA, 19 nt, Homo sapiens
acagagaacucauauuuga

SEQ ID NO: 953916 - RNA, 19 nt, Homo sapiens
caacguuacuuguaugaaa

SEQ ID NO: 953917 - RNA, 19 nt, Homo sapiens
gaccaacacugucaucuga

SEQ ID NO: 953918 - RNA, 19 nt, Homo sapiens
uagcagcucugaagucuaa

SEQ ID NO: 953919 - RNA, 19 nt, Homo sapiens
aagagaagguggccaauuu

SEQ ID NO: 953920 - RNA, 19 nt, Homo sapiens
ggcaucaccucuguuauua

SEQ ID NO: 953921 - RNA, 19 nt, Homo sapiens
ggaguaauauauaccagaa

SEQ ID NO: 953922 - RNA, 19 nt, Homo sapiens
caacugaaguaucaugaga

SEQ ID NO: 953923 - RNA, 19 nt, Homo sapiens
aaacaaggcccaacacaaa

SEQ ID NO: 953924 - RNA, 19 nt, Homo sapiens
ggacucaacguuacuugua

SEQ ID NO: 953925 - RNA, 19 nt, Homo sapiens
gaucugggaguaauauaua

SEQ ID NO: 953926 - RNA, 19 nt, Homo sapiens
gguagaaacaugcugcuua

SEQ ID NO: 953927 - RNA, 19 nt, Homo sapiens
uaaguggccuaaccuguuu

SEQ ID NO: 953928 - RNA, 19 nt, Homo sapiens
ucuaaacacuggaagaauu

SEQ ID NO: 953929 - RNA, 19 nt, Homo sapiens
ugacugcuguggaaaguuu

SEQ ID NO: 953930 - RNA, 19 nt, Homo sapiens
uaaugcaacugaaguauca

SEQ ID NO: 953931 - RNA, 19 nt, Homo sapiens
gucgggaacucaaagguua

SEQ ID NO: 953932 - RNA, 19 nt, Homo sapiens
uaacgugcgugaauuaaca

SEQ ID NO: 953933 - RNA, 19 nt, Homo sapiens
acucaaagguuauuccauu

SEQ ID NO: 953934 - RNA, 19 nt, Homo sapiens
ccaugacucuucuaaguga

SEQ ID NO: 953935 - RNA, 19 nt, Homo sapiens
ggaaucaccaguucaguau

SEQ ID NO: 953936 - RNA, 19 nt, Homo sapiens
uaaggaggacucaacguua

SEQ ID NO: 953937 - RNA, 19 nt, Homo sapiens
cagcuucucuauuugauau

SEQ ID NO: 953938 - RNA, 19 nt, Homo sapiens
cauacugucuugagccuuu

SEQ ID NO: 953939 - RNA, 19 nt, Homo sapiens
gaauuaacagcuucucuau

SEQ ID NO: 953940 - RNA, 19 nt, Homo sapiens
cuaaacacuggaagaauua

SEQ ID NO: 953941 - RNA, 19 nt, Homo sapiens
ggagaucagaguaauuuga

SEQ ID NO: 953942 - RNA, 19 nt, Homo sapiens
gaacuaaugcaacugaagu

SEQ ID NO: 953943 - RNA, 19 nt, Homo sapiens
gcuuauaaguugcuaucaa

SEQ ID NO: 953944 - RNA, 19 nt, Homo sapiens
uguccuagcuuacccuaaa

SEQ ID NO: 953945 - RNA, 19 nt, Homo sapiens
ccaaggcacugguacagau

SEQ ID NO: 953946 - RNA, 19 nt, Homo sapiens
gaagagaagguggccaauu

SEQ ID NO: 953947 - RNA, 19 nt, Homo sapiens
uaacagcuucucuauuuga

SEQ ID NO: 953948 - RNA, 19 nt, Homo sapiens
ucaaucgaauggugguuaa

SEQ ID NO: 953949 - RNA, 19 nt, Homo sapiens
gcacugguacagauaagaa

SEQ ID NO: 953950 - RNA, 19 nt, Homo sapiens
gaaaauggagccaguugua

SEQ ID NO: 953951 - RNA, 19 nt, Homo sapiens
cagccucgcuugaugaaau

SEQ ID NO: 953952 - RNA, 19 nt, Homo sapiens
gauugaugcugccucauuc

SEQ ID NO: 953953 - RNA, 19 nt, Homo sapiens
guaaggaggacucaacguu

SEQ ID NO: 953954 - RNA, 19 nt, Homo sapiens
gaucagaguaauuugagaa

SEQ ID NO: 953955 - RNA, 19 nt, Homo sapiens
caucaccucuguuauuaag

SEQ ID NO: 953956 - RNA, 19 nt, Homo sapiens
cagcagaucugggaguaau

SEQ ID NO: 953957 - RNA, 19 nt, Homo sapiens
caacaaacacgguauugag

SEQ ID NO: 953958 - RNA, 19 nt, Homo sapiens
agucagcaauuuaugguuu

SEQ ID NO: 953959 - RNA, 19 nt, Homo sapiens
caaagggguuuauaucauu

SEQ ID NO: 953960 - RNA, 19 nt, Homo sapiens
uagcuuacccuaaauuuca

SEQ ID NO: 953961 - RNA, 19 nt, Homo sapiens
ugaauuaacagcuucucua

SEQ ID NO: 953962 - RNA, 19 nt, Homo sapiens
ucauaacgugcgugaauua

SEQ ID NO: 953963 - RNA, 19 nt, Homo sapiens
caaaguugauugacagacu

SEQ ID NO: 953964 - RNA, 19 nt, Homo sapiens
ucaguaugcugcguaugua

SEQ ID NO: 953965 - RNA, 19 nt, Homo sapiens
gcucugaagucuaaacacu

SEQ ID NO: 953966 - RNA, 19 nt, Homo sapiens
cagauaagaacaaaccaaa

SEQ ID NO: 953967 - RNA, 19 nt, Homo sapiens
acacguauauacauagcaa

SEQ ID NO: 953968 - RNA, 19 nt, Homo sapiens
gaguguauguggaaacgau

SEQ ID NO: 953969 - RNA, 19 nt, Homo sapiens
gacauucuuuggucaagga

SEQ ID NO: 953970 - RNA, 19 nt, Homo sapiens
gaaguuggaaucaucaucu

SEQ ID NO: 953971 - RNA, 19 nt, Homo sapiens
cauggaagcccuaaaauaa

SEQ ID NO: 953972 - RNA, 19 nt, Homo sapiens
ggacuguuaccuaaguuga

SEQ ID NO: 953973 - RNA, 19 nt, Homo sapiens
uggagaaccuguaauaaaa

SEQ ID NO: 953974 - RNA, 19 nt, Homo sapiens
guauagugguagaaacaug

SEQ ID NO: 953975 - RNA, 19 nt, Homo sapiens
uuauggagaaccuguaaua

SEQ ID NO: 953976 - RNA, 19 nt, Homo sapiens
cgacggagcagaggccuuu

SEQ ID NO: 953977 - RNA, 19 nt, Homo sapiens
uuauuaagcugauguuugc

SEQ ID NO: 953978 - RNA, 19 nt, Homo sapiens
guuauuaagcugauguuug

SEQ ID NO: 953979 - RNA, 19 nt, Homo sapiens
gacucaacguuacuuguau

SEQ ID NO: 953980 - RNA, 19 nt, Homo sapiens
gaagucagcaauuuauggu

SEQ ID NO: 953981 - RNA, 19 nt, Homo sapiens
ggaagucagcaauuuaugg

SEQ ID NO: 953982 - RNA, 19 nt, Homo sapiens
aaaguuuccugacuauaca

SEQ ID NO: 953983 - RNA, 19 nt, Homo sapiens
gcagaucugggaguaauau

SEQ ID NO: 953984 - RNA, 19 nt, Homo sapiens
cuauaucugugacuagguu

SEQ ID NO: 953985 - RNA, 19 nt, Homo sapiens
uguuggaccugccgaugua

SEQ ID NO: 953986 - RNA, 19 nt, Homo sapiens
uuagaggaaucaccaguuc

SEQ ID NO: 953987 - RNA, 19 nt, Homo sapiens
acugaaguaucaugagaaa

SEQ ID NO: 953988 - RNA, 19 nt, Homo sapiens
uugagccuuugcuaaauua

SEQ ID NO: 953989 - RNA, 19 nt, Homo sapiens
guaagccugucugagugua

SEQ ID NO: 953990 - RNA, 19 nt, Homo sapiens
gggaagaccaacacuguca

SEQ ID NO: 953991 - RNA, 19 nt, Homo sapiens
ucaauugcguaggaccaua

SEQ ID NO: 953992 - RNA, 19 nt, Homo sapiens
cgaauggugguuaauguug

SEQ ID NO: 953993 - RNA, 19 nt, Homo sapiens
gcagccaugacucuucuaa

SEQ ID NO: 953994 - RNA, 19 nt, Homo sapiens
cguaggaccauaucgguuu

SEQ ID NO: 953995 - RNA, 19 nt, Homo sapiens
gugcgugaauuaacagcuu

SEQ ID NO: 953996 - RNA, 19 nt, Homo sapiens
gucauaacgugcgugaauu

SEQ ID NO: 953997 - RNA, 19 nt, Homo sapiens
guuauuagcagcucugaag

SEQ ID NO: 953998 - RNA, 19 nt, Homo sapiens
uugaugaaauggcuaaaca

SEQ ID NO: 953999 - RNA, 19 nt, Homo sapiens
caaggcacugguacagaua

SEQ ID NO: 954000 - RNA, 19 nt, Homo sapiens
ccaugguucuucuccuuug

SEQ ID NO: 954001 - RNA, 19 nt, Homo sapiens
gcugauguuugcaggacuu

SEQ ID NO: 954002 - RNA, 19 nt, Homo sapiens
ucugaugugucuguuguaa

SEQ ID NO: 954003 - RNA, 19 nt, Homo sapiens
aaaccugucccgcucauug

SEQ ID NO: 954004 - RNA, 19 nt, Homo sapiens
ccuggaagucagcaauuua

SEQ ID NO: 954005 - RNA, 19 nt, Homo sapiens
ggguugagcauucaugaug

SEQ ID NO: 954006 - RNA, 19 nt, Homo sapiens
cuugagccuuugcuaaauu

SEQ ID NO: 954007 - RNA, 19 nt, Homo sapiens
ccaacacugucaucugaag

SEQ ID NO: 954008 - RNA, 19 nt, Homo sapiens
uuugugagguuuggaauug

SEQ ID NO: 954009 - RNA, 19 nt, Homo sapiens
ggaaagcaguggaaacaau

SEQ ID NO: 954010 - RNA, 19 nt, Homo sapiens
gaauauggaaucaugguua

SEQ ID NO: 954011 - RNA, 19 nt, Homo sapiens
guauaugcaucuucuguaa

SEQ ID NO: 954012 - RNA, 19 nt, Homo sapiens
aaucacaucugagaaguua

SEQ ID NO: 954013 - RNA, 19 nt, Homo sapiens
uaaagaagcucuaguuucc

SEQ ID NO: 954014 - RNA, 19 nt, Homo sapiens
gaaguguggugauauucuu

SEQ ID NO: 954015 - RNA, 19 nt, Homo sapiens
uggcucagauuaccaauaa

SEQ ID NO: 954016 - RNA, 19 nt, Homo sapiens
ccacuuaacagacccauuu

SEQ ID NO: 954017 - RNA, 19 nt, Homo sapiens
gaaacagcauuccagaaca

SEQ ID NO: 954018 - RNA, 19 nt, Homo sapiens
aagaagaccuggaauuuua

SEQ ID NO: 954019 - RNA, 19 nt, Homo sapiens
ccaguaaacuaccaaagga

SEQ ID NO: 954020 - RNA, 19 nt, Homo sapiens
gaacaugacaucgauacaa

SEQ ID NO: 954021 - RNA, 19 nt, Homo sapiens
gcacggcuggcucagauua

SEQ ID NO: 954022 - RNA, 19 nt, Homo sapiens
guucagugaucaauauuug

SEQ ID NO: 954023 - RNA, 19 nt, Homo sapiens
agaagaauauggaaucaug

SEQ ID NO: 954024 - RNA, 19 nt, Homo sapiens
gaaaucacaucugagaagu

SEQ ID NO: 954025 - RNA, 19 nt, Homo sapiens
ugaagaagaccuggaauuu

SEQ ID NO: 954026 - RNA, 19 nt, Homo sapiens
caauaaguguacugaagaa

SEQ ID NO: 954027 - RNA, 19 nt, Homo sapiens
ggagcuauuugauuuagau

SEQ ID NO: 954028 - RNA, 19 nt, Homo sapiens
ggaaucaugguuaauaaug

SEQ ID NO: 954029 - RNA, 19 nt, Homo sapiens
gagaaagagcugcggagua

SEQ ID NO: 954030 - RNA, 19 nt, Homo sapiens
aaucauggauguuguuguu

SEQ ID NO: 954031 - RNA, 19 nt, Homo sapiens
aaacagcauuccagaacaa

SEQ ID NO: 954032 - RNA, 19 nt, Homo sapiens
ugacaucgauacaagugaa

SEQ ID NO: 954033 - RNA, 19 nt, Homo sapiens
caacaggaugccaaacaua

SEQ ID NO: 954034 - RNA, 19 nt, Homo sapiens
caggagacauccaccuaaa

SEQ ID NO: 954035 - RNA, 19 nt, Homo sapiens
gaagaaaacagcaaaauca

SEQ ID NO: 954036 - RNA, 19 nt, Homo sapiens
cauguucagugaucaauau

SEQ ID NO: 954037 - RNA, 19 nt, Homo sapiens
gaaagcaguggaaacaaug

SEQ ID NO: 954038 - RNA, 19 nt, Homo sapiens
caugagcucuggaagguau

SEQ ID NO: 954039 - RNA, 19 nt, Homo sapiens
caggaaguguggugauauu

SEQ ID NO: 954040 - RNA, 19 nt, Homo sapiens
agaaagagcugcggaguac

SEQ ID NO: 954041 - RNA, 19 nt, Homo sapiens
caccaacaauggcuacaaa

SEQ ID NO: 954042 - RNA, 19 nt, Homo sapiens
ggaguaaaacuguggauua

SEQ ID NO: 954043 - RNA, 19 nt, Homo sapiens
uaauaaugaugcugugguu

SEQ ID NO: 954044 - RNA, 19 nt, Homo sapiens
cagcauuccagaacaauuu

SEQ ID NO: 954045 - RNA, 19 nt, Homo sapiens
ggaguaaccaguaaacuac

SEQ ID NO: 954046 - RNA, 19 nt, Homo sapiens
cacauugagugucaugaaa

SEQ ID NO: 954047 - RNA, 19 nt, Homo sapiens
gaccaugccucuugaagcu

SEQ ID NO: 954048 - RNA, 19 nt, Homo sapiens
ccaggaacaugacaucgau

SEQ ID NO: 954049 - RNA, 19 nt, Homo sapiens
agagauuucugacuacaug

SEQ ID NO: 954050 - RNA, 19 nt, Homo sapiens
cugauucucucuuuguaaa

SEQ ID NO: 954051 - RNA, 19 nt, Homo sapiens
gaggaaagcaguggaaaca

SEQ ID NO: 954052 - RNA, 19 nt, Homo sapiens
ccaugccucuugaagcuuu

SEQ ID NO: 954053 - RNA, 19 nt, Homo sapiens
ccaauaaguguacugaaga

SEQ ID NO: 954054 - RNA, 19 nt, Homo sapiens
cuacacagccacccuauca

SEQ ID NO: 954055 - RNA, 19 nt, Homo sapiens
gucaggaaguguggugaua

SEQ ID NO: 954056 - RNA, 19 nt, Homo sapiens
gaagaagaccuggaauuuu

SEQ ID NO: 954057 - RNA, 19 nt, Homo sapiens
ucugucugcuucccacuua

SEQ ID NO: 954058 - RNA, 19 nt, Homo sapiens
ccaacaggaugccaaacau

SEQ ID NO: 954059 - RNA, 19 nt, Homo sapiens
gcucauccagccucaguuu

SEQ ID NO: 954060 - RNA, 19 nt, Homo sapiens
cuacaaauccaugcagaaa

SEQ ID NO: 954061 - RNA, 19 nt, Homo sapiens
ucacaucugagaaguuaaa

SEQ ID NO: 954062 - RNA, 19 nt, Homo sapiens
gguauaugcaucuucugua

SEQ ID NO: 954063 - RNA, 19 nt, Homo sapiens
gaaccaggaacaugacauc

SEQ ID NO: 954064 - RNA, 19 nt, Homo sapiens
uagccgagcugcaggaaag

SEQ ID NO: 954065 - RNA, 19 nt, Homo sapiens
cuaaagaagcucuaguuuc

SEQ ID NO: 954066 - RNA, 19 nt, Homo sapiens
ucacaaauauuuccauccu

SEQ ID NO: 954067 - RNA, 19 nt, Homo sapiens
ggaccaacaggaugccaaa

SEQ ID NO: 954068 - RNA, 19 nt, Homo sapiens
cggaguaauuggaagauuc

SEQ ID NO: 954069 - RNA, 19 nt, Homo sapiens
cagauuaccaauaagugua

SEQ ID NO: 954070 - RNA, 19 nt, Homo sapiens
gacaggagacauccaccua

SEQ ID NO: 954071 - RNA, 19 nt, Homo sapiens
gaaauugaaccaggaacau

SEQ ID NO: 954072 - RNA, 19 nt, Homo sapiens
ugguggaguucaagaaauu

SEQ ID NO: 954073 - RNA, 19 nt, Homo sapiens
ggugauauucuuggaguaa

SEQ ID NO: 954074 - RNA, 19 nt, Homo sapiens
ggaguaauuggaagauuca

SEQ ID NO: 954075 - RNA, 19 nt, Homo sapiens
gcugaggacccagagauuu

SEQ ID NO: 954076 - RNA, 19 nt, Homo sapiens
gcacgucuucuuccaagug

SEQ ID NO: 954077 - RNA, 19 nt, Homo sapiens
ggaagauucagagcuuaaa

SEQ ID NO: 954078 - RNA, 19 nt, Homo sapiens
ucaccuuuguguauccuuu

SEQ ID NO: 954079 - RNA, 19 nt, Homo sapiens
caucugagaaguuaaaugg

SEQ ID NO: 954080 - RNA, 19 nt, Homo sapiens
uggaguaaccaguaaacua

SEQ ID NO: 954081 - RNA, 19 nt, Homo sapiens
acacagccacccuaucaaa

SEQ ID NO: 954082 - RNA, 19 nt, Homo sapiens
uaaugaugcugugguuaga

SEQ ID NO: 954083 - RNA, 19 nt, Homo sapiens
cucuggagcuauuugauuu

SEQ ID NO: 954084 - RNA, 19 nt, Homo sapiens
ggacuuuaccacccucuuc

SEQ ID NO: 954085 - RNA, 19 nt, Homo sapiens
ccaggagagugaugagauc

SEQ ID NO: 954086 - RNA, 19 nt, Homo sapiens
ccuaaagaagcucuaguuu

SEQ ID NO: 954087 - RNA, 19 nt, Homo sapiens
uaaguguacugaagaagac

SEQ ID NO: 954088 - RNA, 19 nt, Homo sapiens
ccacauugagugucaugaa

SEQ ID NO: 954089 - RNA, 19 nt, Homo sapiens
gagcugcggaguaccauuc

SEQ ID NO: 954090 - RNA, 19 nt, Homo sapiens
ugaaaucacaucugagaag

SEQ ID NO: 954091 - RNA, 19 nt, Homo sapiens
gcucagauuaccaauaagu

SEQ ID NO: 954092 - RNA, 19 nt, Homo sapiens
gauauuuaccaccaacaau

SEQ ID NO: 954093 - RNA, 19 nt, Homo sapiens
gcucucaccuuuguguauc

SEQ ID NO: 954094 - RNA, 19 nt, Homo sapiens
cacaaauauuuccauccua

SEQ ID NO: 954095 - RNA, 19 nt, Homo sapiens
ugaaacagcauuccagaac

SEQ ID NO: 954096 - RNA, 19 nt, Homo sapiens
caagaaauugaaccaggaa

SEQ ID NO: 954097 - RNA, 19 nt, Homo sapiens
cuagaagaauauggaauca

SEQ ID NO: 954098 - RNA, 19 nt, Homo sapiens
ggaaguguggugauauucu

SEQ ID NO: 954099 - RNA, 19 nt, Homo sapiens
gugcuugguucaugucaca

SEQ ID NO: 954100 - RNA, 19 nt, Homo sapiens
gaugaggaaagcaguggaa

SEQ ID NO: 954101 - RNA, 19 nt, Homo sapiens
caacaauggcuacaaaucc

SEQ ID NO: 954102 - RNA, 19 nt, Homo sapiens
ggauguccuugugaugcua

SEQ ID NO: 954103 - RNA, 19 nt, Homo sapiens
gugguggaguucaagaaau

SEQ ID NO: 954104 - RNA, 19 nt, Homo sapiens
augaaacguucuccucuga

SEQ ID NO: 954105 - RNA, 19 nt, Homo sapiens
aguuugaaauccugaagaa

SEQ ID NO: 954106 - RNA, 19 nt, Homo sapiens
gcaaaaucauggauguugu

SEQ ID NO: 954107 - RNA, 19 nt, Homo sapiens
ggaguaccauucuuuucaa

SEQ ID NO: 954108 - RNA, 19 nt, Homo sapiens
acgagcagcuaaaugugaa

SEQ ID NO: 954109 - RNA, 19 nt, Homo sapiens
ggaauucacucacacauuu

SEQ ID NO: 954110 - RNA, 19 nt, Homo sapiens
uaaagaagcugaagagaag

SEQ ID NO: 954111 - RNA, 19 nt, Homo sapiens
caaccuagguggauucuug

SEQ ID NO: 954112 - RNA, 19 nt, Homo sapiens
gaccagaccuugcugauca

SEQ ID NO: 954113 - RNA, 19 nt, Homo sapiens
acacugaaguucucucaua

SEQ ID NO: 954114 - RNA, 19 nt, Homo sapiens
gcaggacccuuugguuuaa

SEQ ID NO: 954115 - RNA, 19 nt, Homo sapiens
cagaagaaguggagaauca

SEQ ID NO: 954116 - RNA, 19 nt, Homo sapiens
ugagacagcuuucaagaau

SEQ ID NO: 954117 - RNA, 19 nt, Homo sapiens
gaauucaaccagaaaguaa

SEQ ID NO: 954118 - RNA, 19 nt, Homo sapiens
cugaaguucucucauaaua

SEQ ID NO: 954119 - RNA, 19 nt, Homo sapiens
gagacagcuuucaagaaua

SEQ ID NO: 954120 - RNA, 19 nt, Homo sapiens
ugacagugaugcagaagaa

SEQ ID NO: 954121 - RNA, 19 nt, Homo sapiens
cagaagaauucaaccagaa

SEQ ID NO: 954122 - RNA, 19 nt, Homo sapiens
guucguauaucuaauggaa

SEQ ID NO: 954123 - RNA, 19 nt, Homo sapiens
gaucaagacagaccaauuc

SEQ ID NO: 954124 - RNA, 19 nt, Homo sapiens
agacagcuuucaagaauau

SEQ ID NO: 954125 - RNA, 19 nt, Homo sapiens
caaauaagacuccacuugu

SEQ ID NO: 954126 - RNA, 19 nt, Homo sapiens
gggaaaaccuggugacuga

SEQ ID NO: 954127 - RNA, 19 nt, Homo sapiens
caucaaggguuaaucaucu

SEQ ID NO: 954128 - RNA, 19 nt, Homo sapiens
gaagaguagugaauacaac

SEQ ID NO: 954129 - RNA, 19 nt, Homo sapiens
gaauucacucacacauuua

SEQ ID NO: 954130 - RNA, 19 nt, Homo sapiens
cgaaaguauucuucaaugu

SEQ ID NO: 954131 - RNA, 19 nt, Homo sapiens
uuuaaggccugauuucaaa

SEQ ID NO: 954132 - RNA, 19 nt, Homo sapiens
gagaugugcccuaggauug

SEQ ID NO: 954133 - RNA, 19 nt, Homo sapiens
ggagaucuuugcaccaaca

SEQ ID NO: 954134 - RNA, 19 nt, Homo sapiens
gaagaauggcuuuccuuuc

SEQ ID NO: 954135 - RNA, 19 nt, Homo sapiens
gaugaagaguagugaauac

SEQ ID NO: 954136 - RNA, 19 nt, Homo sapiens
ugauauaguuguucagcaa

SEQ ID NO: 954137 - RNA, 19 nt, Homo sapiens
ucaaauaagacuccacuug

SEQ ID NO: 954138 - RNA, 19 nt, Homo sapiens
gagaaucaguuuguggaau

SEQ ID NO: 954139 - RNA, 19 nt, Homo sapiens
gagaagauguuaaaaugug

SEQ ID NO: 954140 - RNA, 19 nt, Homo sapiens
ugacugauauaguuguuca

SEQ ID NO: 954141 - RNA, 19 nt, Homo sapiens
ccuggugacugauauaguu

SEQ ID NO: 954142 - RNA, 19 nt, Homo sapiens
gcaauaauucauagucugu

SEQ ID NO: 954143 - RNA, 19 nt, Homo sapiens
ggagaugugcccuaggauu

SEQ ID NO: 954144 - RNA, 19 nt, Homo sapiens
gcaccagcauccaguccuu

SEQ ID NO: 954145 - RNA, 19 nt, Homo sapiens
cagcauugacucccuuuaa

SEQ ID NO: 954146 - RNA, 19 nt, Homo sapiens
cacugaaguucucucauaa

SEQ ID NO: 954147 - RNA, 19 nt, Homo sapiens
ucacacauuuaaaccaguu

SEQ ID NO: 954148 - RNA, 19 nt, Homo sapiens
gcacauguuuucuuuagga

SEQ ID NO: 954149 - RNA, 19 nt, Homo sapiens
uuaaagaagcugaagagaa

SEQ ID NO: 954150 - RNA, 19 nt, Homo sapiens
cugaagcucugaugggaaa

SEQ ID NO: 954151 - RNA, 19 nt, Homo sapiens
cgaagacgauacugugaca

SEQ ID NO: 954152 - RNA, 19 nt, Homo sapiens
guggagaugugcccuagga

SEQ ID NO: 954153 - RNA, 19 nt, Homo sapiens
guucagcaauaauucauag

SEQ ID NO: 954154 - RNA, 19 nt, Homo sapiens
gacccagguuugacaguga

SEQ ID NO: 954155 - RNA, 19 nt, Homo sapiens
gacuauacuuugcacaugu

SEQ ID NO: 954156 - RNA, 19 nt, Homo sapiens
cugcauagauggcaauucu

SEQ ID NO: 954157 - RNA, 19 nt, Homo sapiens
aaauaagacuccacuuguc

SEQ ID NO: 954158 - RNA, 19 nt, Homo sapiens
ggccaaugcuccagcgaau

SEQ ID NO: 954159 - RNA, 19 nt, Homo sapiens
acgaaaguauucuucaaug

SEQ ID NO: 954160 - RNA, 19 nt, Homo sapiens
agaaucaguuuguggaauc

SEQ ID NO: 954161 - RNA, 19 nt, Homo sapiens
cugaagagaagauguuaaa

SEQ ID NO: 954162 - RNA, 19 nt, Homo sapiens
ugacuauacuuugcacaug

SEQ ID NO: 954163 - RNA, 19 nt, Homo sapiens
gaaaaccuggugacugaua

SEQ ID NO: 954164 - RNA, 19 nt, Homo sapiens
cagaucaaccagaagaauu

SEQ ID NO: 954165 - RNA, 19 nt, Homo sapiens
ugcaggacccuuugguuua

SEQ ID NO: 954166 - RNA, 19 nt, Homo sapiens
ugacucccuuuaacccuuu

SEQ ID NO: 954167 - RNA, 19 nt, Homo sapiens
agaagaauggcuuuccuuu

SEQ ID NO: 954168 - RNA, 19 nt, Homo sapiens
cauagucugugaugaagag

SEQ ID NO: 954169 - RNA, 19 nt, Homo sapiens
cagcaauaauucauagucu

SEQ ID NO: 954170 - RNA, 19 nt, Homo sapiens
gacagaccaauuccaguuu

SEQ ID NO: 954171 - RNA, 19 nt, Homo sapiens
gcacaaccuagguggauuc

SEQ ID NO: 954172 - RNA, 19 nt, Homo sapiens
gcagccuucuugacuauac

SEQ ID NO: 954173 - RNA, 19 nt, Homo sapiens
caaacgaaaguauucuuca

SEQ ID NO: 954174 - RNA, 19 nt, Homo sapiens
ggacacugaaguucucuca

SEQ ID NO: 954175 - RNA, 19 nt, Homo sapiens
gcagaucaaccagaagaau

SEQ ID NO: 954176 - RNA, 19 nt, Homo sapiens
ggugagacagcuuucaaga

SEQ ID NO: 954177 - RNA, 19 nt, Homo sapiens
uaagucuagugcagcguuu

SEQ ID NO: 954178 - RNA, 19 nt, Homo sapiens
agacagaccaauuccaguu

SEQ ID NO: 954179 - RNA, 19 nt, Homo sapiens
guaguagacccagguuuga

SEQ ID NO: 954180 - RNA, 19 nt, Homo sapiens
aaauauggacacugaaguu

SEQ ID NO: 954181 - RNA, 19 nt, Homo sapiens
agaauucaaccagaaagua

SEQ ID NO: 954182 - RNA, 19 nt, Homo sapiens
gaagaauucaaccagaaag

SEQ ID NO: 954183 - RNA, 19 nt, Homo sapiens
gcccgauccugcauagaug

SEQ ID NO: 954184 - RNA, 19 nt, Homo sapiens
acagaccaauuccaguuug

SEQ ID NO: 954185 - RNA, 19 nt, Homo sapiens
ggagaaucaguuuguggaa

SEQ ID NO: 954186 - RNA, 19 nt, Homo sapiens
gaaguggagaaucaguuug

SEQ ID NO: 954187 - RNA, 19 nt, Homo sapiens
ugaugaagaguagugaaua

SEQ ID NO: 954188 - RNA, 19 nt, Homo sapiens
ggugacugauauaguuguu

SEQ ID NO: 954189 - RNA, 19 nt, Homo sapiens
gaacacacugaagcucuga

SEQ ID NO: 954190 - RNA, 19 nt, Homo sapiens
gacauuccaguuucaguga

SEQ ID NO: 954191 - RNA, 19 nt, Homo sapiens
caaguggugagacagcuuu

SEQ ID NO: 954192 - RNA, 19 nt, Homo sapiens
gaagaaguggagaaucagu

SEQ ID NO: 954193 - RNA, 19 nt, Homo sapiens
cuauaucacaccuuaaaga

SEQ ID NO: 954194 - RNA, 19 nt, Homo sapiens
agaaguggagaaucaguuu

SEQ ID NO: 954195 - RNA, 19 nt, Homo sapiens
gaaguaguagacccagguu

SEQ ID NO: 954196 - RNA, 19 nt, Homo sapiens
gugagacagcuuucaagaa

SEQ ID NO: 954197 - RNA, 19 nt, Homo sapiens
guuuaaggccugauuucaa

SEQ ID NO: 954198 - RNA, 19 nt, Homo sapiens
ugaagaguagugaauacaa

SEQ ID NO: 954199 - RNA, 19 nt, Homo sapiens
agaagaauucaaccagaaa

SEQ ID NO: 954200 - RNA, 19 nt, Homo sapiens
acgucuauaucacaccuua

SEQ ID NO: 954201 - RNA, 19 nt, Homo sapiens
gaugugcccuaggauugga

SEQ ID NO: 954202 - RNA, 19 nt, Homo sapiens
auaugcagaucaaccagaa

SEQ ID NO: 954203 - RNA, 19 nt, Homo sapiens
cauggugcccuacgucuau

SEQ ID NO: 954204 - RNA, 19 nt, Homo sapiens
gcagcauugacucccuuua

SEQ ID NO: 954205 - RNA, 19 nt, Homo sapiens
gucuauaucacaccuuaaa

SEQ ID NO: 954206 - RNA, 19 nt, Homo sapiens
gauucuuggcugcugcuua

SEQ ID NO: 954207 - RNA, 19 nt, Homo sapiens
gguuauuugucccucugaa

SEQ ID NO: 954208 - RNA, 19 nt, Homo sapiens
gcugaagagaagauguuaa

SEQ ID NO: 954209 - RNA, 19 nt, Homo sapiens
ccaauaaaguugcauggua

SEQ ID NO: 954210 - RNA, 19 nt, Homo sapiens
agaauuggaugcucacuua

SEQ ID NO: 954211 - RNA, 19 nt, Homo sapiens
caauaaaguugcaugguaa

SEQ ID NO: 954212 - RNA, 19 nt, Homo sapiens
gaaaggaaacuauugcaaa

SEQ ID NO: 954213 - RNA, 19 nt, Homo sapiens
acuuagaacugcucaauua

SEQ ID NO: 954214 - RNA, 19 nt, Homo sapiens
ccaggguucucuaugauua

SEQ ID NO: 954215 - RNA, 19 nt, Homo sapiens
gcacaguguuaccaguaua

SEQ ID NO: 954216 - RNA, 19 nt, Homo sapiens
uaaagcagguuaaguaucu

SEQ ID NO: 954217 - RNA, 19 nt, Homo sapiens
ggaaucagcaguacacaug

SEQ ID NO: 954218 - RNA, 19 nt, Homo sapiens
cagaugaggugaucacugu

SEQ ID NO: 954219 - RNA, 19 nt, Homo sapiens
caaaugcgauugguucuuc

SEQ ID NO: 954220 - RNA, 19 nt, Homo sapiens
aaacgucagccuuaaauuu

SEQ ID NO: 954221 - RNA, 19 nt, Homo sapiens
uuaaguagguggacuaugg

SEQ ID NO: 954222 - RNA, 19 nt, Homo sapiens
uagaagcccagaugacuua

SEQ ID NO: 954223 - RNA, 19 nt, Homo sapiens
uagagaaccuccuuagcaa

SEQ ID NO: 954224 - RNA, 19 nt, Homo sapiens
gaaagguugcccaucauga

SEQ ID NO: 954225 - RNA, 19 nt, Homo sapiens
ccaauuaccuacuuagaac

SEQ ID NO: 954226 - RNA, 19 nt, Homo sapiens
gaacugcucaauuaaguag

SEQ ID NO: 954227 - RNA, 19 nt, Homo sapiens
ccagaugacuuacuaugca

SEQ ID NO: 954228 - RNA, 19 nt, Homo sapiens
aaacugaaguguuauugca

SEQ ID NO: 954229 - RNA, 19 nt, Homo sapiens
gaaaauaccagccaucaga

SEQ ID NO: 954230 - RNA, 19 nt, Homo sapiens
caccuucgcugucugaaug

SEQ ID NO: 954231 - RNA, 19 nt, Homo sapiens
acagagaacugauucaaac

SEQ ID NO: 954232 - RNA, 19 nt, Homo sapiens
agcaaacaguacugaauua

SEQ ID NO: 954233 - RNA, 19 nt, Homo sapiens
augagaaacuggauagaaa

SEQ ID NO: 954234 - RNA, 19 nt, Homo sapiens
uagaacugcucaauuaagu

SEQ ID NO: 954235 - RNA, 19 nt, Homo sapiens
gaaguuuuccauccaauua

SEQ ID NO: 954236 - RNA, 19 nt, Homo sapiens
cagcaaacaguacugaauu

SEQ ID NO: 954237 - RNA, 19 nt, Homo sapiens
guaaucaccucuccuucca

SEQ ID NO: 954238 - RNA, 19 nt, Homo sapiens
gagcuuucaugccaagaau

SEQ ID NO: 954239 - RNA, 19 nt, Homo sapiens
gcaaacaguacugaauuau

SEQ ID NO: 954240 - RNA, 19 nt, Homo sapiens
gauucaaacgucagccuua

SEQ ID NO: 954241 - RNA, 19 nt, Homo sapiens
aggaacagcuuaugguaau

SEQ ID NO: 954242 - RNA, 19 nt, Homo sapiens
gaucgucaagcagagauua

SEQ ID NO: 954243 - RNA, 19 nt, Homo sapiens
gguuaaguaucuuccaugu

SEQ ID NO: 954244 - RNA, 19 nt, Homo sapiens
gaaaggccaggguucucua

SEQ ID NO: 954245 - RNA, 19 nt, Homo sapiens
gguggacuauggaaagguu

SEQ ID NO: 954246 - RNA, 19 nt, Homo sapiens
gcagcaaacaguacugaau

SEQ ID NO: 954247 - RNA, 19 nt, Homo sapiens
aagcccagaugacuuacua

SEQ ID NO: 954248 - RNA, 19 nt, Homo sapiens
gaaacuagaaauucaucug

SEQ ID NO: 954249 - RNA, 19 nt, Homo sapiens
gcuaaagaaaggaaacuau

SEQ ID NO: 954250 - RNA, 19 nt, Homo sapiens
gacagagaacugauucaaa

SEQ ID NO: 954251 - RNA, 19 nt, Homo sapiens
caggauagaagaauuuguu

SEQ ID NO: 954252 - RNA, 19 nt, Homo sapiens
gccaauuaccuacuuagaa

SEQ ID NO: 954253 - RNA, 19 nt, Homo sapiens
gcagagauuaccagacuuc

SEQ ID NO: 954254 - RNA, 19 nt, Homo sapiens
aagcagagauuaccagacu

SEQ ID NO: 954255 - RNA, 19 nt, Homo sapiens
ggugccaauuaccuacuua

SEQ ID NO: 954256 - RNA, 19 nt, Homo sapiens
caaccucagugaccuuaag

SEQ ID NO: 954257 - RNA, 19 nt, Homo sapiens
auaagagacuggauuugga

SEQ ID NO: 954258 - RNA, 19 nt, Homo sapiens
gcagacagagaacugauuc

SEQ ID NO: 954259 - RNA, 19 nt, Homo sapiens
gcaguacacaugcccauca

SEQ ID NO: 954260 - RNA, 19 nt, Homo sapiens
ccaggaacagcuuauggua

SEQ ID NO: 954261 - RNA, 19 nt, Homo sapiens
uaucuuccauguuaaugug

SEQ ID NO: 954262 - RNA, 19 nt, Homo sapiens
gagaaccuccuuagcaaag

SEQ ID NO: 954263 - RNA, 19 nt, Homo sapiens
gauucagacuggcuaaugg

SEQ ID NO: 954264 - RNA, 19 nt, Homo sapiens
guucaguguuguuggaaug

SEQ ID NO: 954265 - RNA, 19 nt, Homo sapiens
guacugaauuaucacuucu

SEQ ID NO: 954266 - RNA, 19 nt, Homo sapiens
ugugacaccuguaccauca

SEQ ID NO: 954267 - RNA, 19 nt, Homo sapiens
uaacaacaaucagacuucu

SEQ ID NO: 954268 - RNA, 19 nt, Homo sapiens
caaaugccaggauagaaga

SEQ ID NO: 954269 - RNA, 19 nt, Homo sapiens
ggaaagguugcccaucaug

SEQ ID NO: 954270 - RNA, 19 nt, Homo sapiens
auaaacaacccagaacuuu

SEQ ID NO: 954271 - RNA, 19 nt, Homo sapiens
acuuaaagcagaacuguuu

SEQ ID NO: 954272 - RNA, 19 nt, Homo sapiens
ucaacaaguggccuaguaa

SEQ ID NO: 954273 - RNA, 19 nt, Homo sapiens
ugccauggcuucaacaagu

SEQ ID NO: 954274 - RNA, 19 nt, Homo sapiens
ugcagaaacuagaaauuca

SEQ ID NO: 954275 - RNA, 19 nt, Homo sapiens
agaaggagauuacaaaaca

SEQ ID NO: 954276 - RNA, 19 nt, Homo sapiens
gguugcccaucaugacuuu

SEQ ID NO: 954277 - RNA, 19 nt, Homo sapiens
caauuaaguagguggacua

SEQ ID NO: 954278 - RNA, 19 nt, Homo sapiens
acaaguggccuaguaauca

SEQ ID NO: 954279 - RNA, 19 nt, Homo sapiens
uucaacaaguggccuagua

SEQ ID NO: 954280 - RNA, 19 nt, Homo sapiens
guaacaacaaucagacuuc

SEQ ID NO: 954281 - RNA, 19 nt, Homo sapiens
ggcaaaagcugcagaaacu

SEQ ID NO: 954282 - RNA, 19 nt, Homo sapiens
ucaaacgucagccuuaaau

SEQ ID NO: 954283 - RNA, 19 nt, Homo sapiens
caggaacagcuuaugguaa

SEQ ID NO: 954284 - RNA, 19 nt, Homo sapiens
ggccaggguucucuaugau

SEQ ID NO: 954285 - RNA, 19 nt, Homo sapiens
caacaaguggccuaguaau

SEQ ID NO: 954286 - RNA, 19 nt, Homo sapiens
cuagagggaaucagcagua

SEQ ID NO: 954287 - RNA, 19 nt, Homo sapiens
ggaacagcuuaugguaaug

SEQ ID NO: 954288 - RNA, 19 nt, Homo sapiens
ccaaaugccaggauagaag

SEQ ID NO: 954289 - RNA, 19 nt, Homo sapiens
caacuuaaagcagaacugu

SEQ ID NO: 954290 - RNA, 19 nt, Homo sapiens
caaacaguacugaauuauc

SEQ ID NO: 954291 - RNA, 19 nt, Homo sapiens
uauaaacaacccagaacuu

SEQ ID NO: 954292 - RNA, 19 nt, Homo sapiens
ggauucagacuggcuaaug

SEQ ID NO: 954293 - RNA, 19 nt, Homo sapiens
aggccaggguucucuauga

SEQ ID NO: 954294 - RNA, 19 nt, Homo sapiens
ccauccaauuaucuuagua

SEQ ID NO: 954295 - RNA, 19 nt, Homo sapiens
guagaagcccagaugacuu

SEQ ID NO: 954296 - RNA, 19 nt, Homo sapiens
gcagaaacuagaaauucau

SEQ ID NO: 954297 - RNA, 19 nt, Homo sapiens
uuagagaaccuccuuagca

SEQ ID NO: 954298 - RNA, 19 nt, Homo sapiens
gaacuuuugggacaauaua

SEQ ID NO: 954299 - RNA, 19 nt, Homo sapiens
gcuccaagucguauaaaca

SEQ ID NO: 954300 - RNA, 19 nt, Homo sapiens
ccaucaugacuuuguauuu

SEQ ID NO: 954301 - RNA, 19 nt, Homo sapiens
caucugaacaggaauuaag

SEQ ID NO: 954302 - RNA, 19 nt, Homo sapiens
gacuuacuaugcacagugu

SEQ ID NO: 954303 - RNA, 19 nt, Homo sapiens
caaaauaagagacuggauu

SEQ ID NO: 954304 - RNA, 19 nt, Homo sapiens
caaacgucagccuuaaauu

SEQ ID NO: 954305 - RNA, 19 nt, Homo sapiens
guagguggacuauggaaag

SEQ ID NO: 954306 - RNA, 19 nt, Homo sapiens
uggaacagcagacagagaa

SEQ ID NO: 954307 - RNA, 19 nt, Homo sapiens
uaugagaaacuggauagaa

SEQ ID NO: 954308 - RNA, 19 nt, Homo sapiens
gaaccuccuuagcaaagcu

SEQ ID NO: 954309 - RNA, 19 nt, Homo sapiens
gaacaggcagcacguauua

SEQ ID NO: 954310 - RNA, 19 nt, Homo sapiens
gaaacaaacuucagaccuu

SEQ ID NO: 954311 - RNA, 19 nt, Homo sapiens
gguaaagugucuucaagua

SEQ ID NO: 954312 - RNA, 19 nt, Homo sapiens
gaaggaaacaugaagaauu

SEQ ID NO: 954313 - RNA, 19 nt, Homo sapiens
caaagaaaccaucuaauug

SEQ ID NO: 954314 - RNA, 19 nt, Homo sapiens
ccaaagaaaccaucuaauu

SEQ ID NO: 954315 - RNA, 19 nt, Homo sapiens
caaagaggguggcaaacuu

SEQ ID NO: 954316 - RNA, 19 nt, Homo sapiens
uaaauacccuguagaaugg

SEQ ID NO: 954317 - RNA, 19 nt, Homo sapiens
ccagaagacugcaacuaaa

SEQ ID NO: 954318 - RNA, 19 nt, Homo sapiens
acauucaccuggaaacuua

SEQ ID NO: 954319 - RNA, 19 nt, Homo sapiens
ggaagagaauggagguguu

SEQ ID NO: 954320 - RNA, 19 nt, Homo sapiens
gaaggacauucaccuggaa

SEQ ID NO: 954321 - RNA, 19 nt, Homo sapiens
aaacauauacugagagcua

SEQ ID NO: 954322 - RNA, 19 nt, Homo sapiens
cuaaauacccuguagaaug

SEQ ID NO: 954323 - RNA, 19 nt, Homo sapiens
aaggaaacaugaagaauuc

SEQ ID NO: 954324 - RNA, 19 nt, Homo sapiens
gccagaagacugcaacuaa

SEQ ID NO: 954325 - RNA, 19 nt, Homo sapiens
aucaggaucuucacgauua

SEQ ID NO: 954326 - RNA, 19 nt, Homo sapiens
agaauucauugcuaccaua

SEQ ID NO: 954327 - RNA, 19 nt, Homo sapiens
gagaaggaaacaugaagaa

SEQ ID NO: 954328 - RNA, 19 nt, Homo sapiens
acagagagcugaaggaacu

SEQ ID NO: 954329 - RNA, 19 nt, Homo sapiens
aaagccaaguucagaguuu

SEQ ID NO: 954330 - RNA, 19 nt, Homo sapiens
gagcacauccucuaguuag

SEQ ID NO: 954331 - RNA, 19 nt, Homo sapiens
gacugugcaucuucccuua

SEQ ID NO: 954332 - RNA, 19 nt, Homo sapiens
ugcaggagcuaaugucaaa

SEQ ID NO: 954333 - RNA, 19 nt, Homo sapiens
ggaacugcaucaucaggau

SEQ ID NO: 954334 - RNA, 19 nt, Homo sapiens
cuacagauaccaaaggaaa

SEQ ID NO: 954335 - RNA, 19 nt, Homo sapiens
ggacccauuugccagaaga

SEQ ID NO: 954336 - RNA, 19 nt, Homo sapiens
caagauuuguggaagaaca

SEQ ID NO: 954337 - RNA, 19 nt, Homo sapiens
caggugugcuuacaaacaa

SEQ ID NO: 954338 - RNA, 19 nt, Homo sapiens
ccaccuaguuuggcaagaa

SEQ ID NO: 954339 - RNA, 19 nt, Homo sapiens
gaauucauugcuaccauaa

SEQ ID NO: 954340 - RNA, 19 nt, Homo sapiens
gagaauuguuaccuugcaa

SEQ ID NO: 954341 - RNA, 19 nt, Homo sapiens
ggccagaaccaccaaagaa

SEQ ID NO: 954342 - RNA, 19 nt, Homo sapiens
ggagaauuguuaccuugca

SEQ ID NO: 954343 - RNA, 19 nt, Homo sapiens
cacauccucuaguuaguuu

SEQ ID NO: 954344 - RNA, 19 nt, Homo sapiens
gcacauccucuaguuaguu

SEQ ID NO: 954345 - RNA, 19 nt, Homo sapiens
gaagagaauggagguguug

SEQ ID NO: 954346 - RNA, 19 nt, Homo sapiens
ggagaaggaaacaugaaga

SEQ ID NO: 954347 - RNA, 19 nt, Homo sapiens
gacuaaauacccuguagaa

SEQ ID NO: 954348 - RNA, 19 nt, Homo sapiens
caccaaagaaaccaucuaa

SEQ ID NO: 954349 - RNA, 19 nt, Homo sapiens
ggaaauauuaaaggcauug

SEQ ID NO: 954350 - RNA, 19 nt, Homo sapiens
aagaaaccaucuaauugga

SEQ ID NO: 954351 - RNA, 19 nt, Homo sapiens
aaagaaaccaucuaauugg

SEQ ID NO: 954352 - RNA, 19 nt, Homo sapiens
gccagaaccaccaaagaaa

SEQ ID NO: 954353 - RNA, 19 nt, Homo sapiens
aagccaaguucagaguuua

SEQ ID NO: 954354 - RNA, 19 nt, Homo sapiens
auuguuaccuugcaagauu

SEQ ID NO: 954355 - RNA, 19 nt, Homo sapiens
gcagcugauagacauauaa

SEQ ID NO: 954356 - RNA, 19 nt, Homo sapiens
aaaugcagcugauagacau

SEQ ID NO: 954357 - RNA, 19 nt, Homo sapiens
cuucuuaugauccugauua

SEQ ID NO: 954358 - RNA, 19 nt, Homo sapiens
ggacuaaauacccuguaga

SEQ ID NO: 954359 - RNA, 19 nt, Homo sapiens
ucaaguagcagcucuuugg

SEQ ID NO: 954360 - RNA, 19 nt, Homo sapiens
cagguaaagugucuucaag

SEQ ID NO: 954361 - RNA, 19 nt, Homo sapiens
gggacuaaauacccuguag

SEQ ID NO: 954362 - RNA, 19 nt, Homo sapiens
guaaagugucuucaaguag

SEQ ID NO: 954363 - RNA, 19 nt, Homo sapiens
uggagggacuggaagagaa

SEQ ID NO: 954364 - RNA, 19 nt, Homo sapiens
gagcugaaggaacugauau

SEQ ID NO: 954365 - RNA, 19 nt, Homo sapiens
uguagaaugggccaaauuu

SEQ ID NO: 954366 - RNA, 19 nt, Homo sapiens
ccuuaaugguggaaauauu

SEQ ID NO: 954367 - RNA, 19 nt, Homo sapiens
cgaaauuccacaccaccua

SEQ ID NO: 954368 - RNA, 19 nt, Homo sapiens
gaauuguuaccuugcaaga

SEQ ID NO: 954369 - RNA, 19 nt, Homo sapiens
uaaaggcauugaaggacau

SEQ ID NO: 954370 - RNA, 19 nt, Homo sapiens
caccuaguuuggcaagaaa

SEQ ID NO: 954371 - RNA, 19 nt, Homo sapiens
guguguauguuuauaugug

SEQ ID NO: 954372 - RNA, 19 nt, Homo sapiens
auucauugcuaccauaaga

SEQ ID NO: 954373 - RNA, 19 nt, Homo sapiens
guagguguuccuucaggua

SEQ ID NO: 954374 - RNA, 19 nt, Homo sapiens
aggcagcacguauuaguaa

SEQ ID NO: 954375 - RNA, 19 nt, Homo sapiens
cagcugauagacauauaaa

SEQ ID NO: 954376 - RNA, 19 nt, Homo sapiens
ugucagaggagauucaaug

SEQ ID NO: 954377 - RNA, 19 nt, Homo sapiens
guuggagaauuguuaccuu

SEQ ID NO: 954378 - RNA, 19 nt, Homo sapiens
ccaucuaauuggagaagga

SEQ ID NO: 954379 - RNA, 19 nt, Homo sapiens
gacauucaccuggaaacuu

SEQ ID NO: 954380 - RNA, 19 nt, Homo sapiens
ggagguguuguccaaguug

SEQ ID NO: 954381 - RNA, 19 nt, Homo sapiens
agacagagagcugaaggaa

SEQ ID NO: 954382 - RNA, 19 nt, Homo sapiens
gcagcucuuugggaaacaa

SEQ ID NO: 954383 - RNA, 19 nt, Homo sapiens
ggagggacuggaagagaau

SEQ ID NO: 954384 - RNA, 19 nt, Homo sapiens
gcuauauaauguguguaug

SEQ ID NO: 954385 - RNA, 19 nt, Homo sapiens
ccuggaaacuuaccaaaau

SEQ ID NO: 954386 - RNA, 19 nt, Homo sapiens
uauuaaaggcauugaagga

SEQ ID NO: 954387 - RNA, 19 nt, Homo sapiens
caucaggaucuucacgauu

SEQ ID NO: 954388 - RNA, 19 nt, Homo sapiens
gcugaaggaacugauauuc

SEQ ID NO: 954389 - RNA, 19 nt, Homo sapiens
ugcaagauuuguggaagaa

SEQ ID NO: 954390 - RNA, 19 nt, Homo sapiens
cagcuaaaggccuugauca

SEQ ID NO: 954391 - RNA, 19 nt, Homo sapiens
ggcuauauaauguguguau

SEQ ID NO: 954392 - RNA, 19 nt, Homo sapiens
ccaaguucagaguuuauga

SEQ ID NO: 954393 - RNA, 19 nt, Homo sapiens
cuacauagccaggccagau

SEQ ID NO: 954394 - RNA, 19 nt, Homo sapiens
ccaggugugcuuacaaaca

SEQ ID NO: 954395 - RNA, 19 nt, Homo sapiens
uagcagcucuuugggaaac

SEQ ID NO: 954396 - RNA, 19 nt, Homo sapiens
uguuguagguguuccuuca

SEQ ID NO: 954397 - RNA, 19 nt, Homo sapiens
gaaggggaauuuucuacag

SEQ ID NO: 954398 - RNA, 19 nt, Homo sapiens
cauauugucagaggagauu

SEQ ID NO: 954399 - RNA, 19 nt, Homo sapiens
gaagaauucauugcuacca

SEQ ID NO: 954400 - RNA, 19 nt, Homo sapiens
cagaguuuaugauuauugc

SEQ ID NO: 954401 - RNA, 19 nt, Homo sapiens
caaguucagaguuuaugau

SEQ ID NO: 954402 - RNA, 19 nt, Homo sapiens
ccaaaauucugccaugagu

SEQ ID NO: 954403 - RNA, 19 nt, Homo sapiens
uugcaagauuuguggaaga

SEQ ID NO: 954404 - RNA, 19 nt, Homo sapiens
caggcagcacguauuagua

SEQ ID NO: 954405 - RNA, 19 nt, Homo sapiens
gcagcuaaaggccuugauc

SEQ ID NO: 954406 - RNA, 19 nt, Homo sapiens
ggggaauuuucuacagaua

SEQ ID NO: 954407 - RNA, 19 nt, Homo sapiens
uaccauaagagcagcuaaa

SEQ ID NO: 954408 - RNA, 19 nt, Homo sapiens
ccaugagugugggacuaaa

SEQ ID NO: 954409 - RNA, 19 nt, Homo sapiens
ggagcuagcugcugugaga

SEQ ID NO: 954410 - RNA, 19 nt, Homo sapiens
gaggaaccaugguaaccua

SEQ ID NO: 954411 - RNA, 19 nt, Homo sapiens
caaaagagcuggagugaca

SEQ ID NO: 954412 - RNA, 19 nt, Homo sapiens
gccuuaagguaucuaauaa

SEQ ID NO: 954413 - RNA, 19 nt, Homo sapiens
uaagaaggcccgaaaugaa

SEQ ID NO: 954414 - RNA, 19 nt, Homo sapiens
caaagcagauucucaccau

SEQ ID NO: 954415 - RNA, 19 nt, Homo sapiens
gaucagauguccgugugaa

SEQ ID NO: 954416 - RNA, 19 nt, Homo sapiens
caauccaucugacauaaau

SEQ ID NO: 954417 - RNA, 19 nt, Homo sapiens
gagcugauccucacacugu

SEQ ID NO: 954418 - RNA, 19 nt, Homo sapiens
ucacugccucuuccuauua

SEQ ID NO: 954419 - RNA, 19 nt, Homo sapiens
ucucaaacuucgaggcuuu

SEQ ID NO: 954420 - RNA, 19 nt, Homo sapiens
gagcuaagaaggcccgaaa

SEQ ID NO: 954421 - RNA, 19 nt, Homo sapiens
gcuaagaaggcccgaaaug

SEQ ID NO: 954422 - RNA, 19 nt, Homo sapiens
cgagugacaucccucuuca

SEQ ID NO: 954423 - RNA, 19 nt, Homo sapiens
gcaaaugcugguuuaggaa

SEQ ID NO: 954424 - RNA, 19 nt, Homo sapiens
cuaagaaggcccgaaauga

SEQ ID NO: 954425 - RNA, 19 nt, Homo sapiens
cuaccagucugccuuggaa

SEQ ID NO: 954426 - RNA, 19 nt, Homo sapiens
ggcaagcggucauccagau

SEQ ID NO: 954427 - RNA, 19 nt, Homo sapiens
uaucaauccaucugacaua

SEQ ID NO: 954428 - RNA, 19 nt, Homo sapiens
aagaaggcccgaaaugaaa

SEQ ID NO: 954429 - RNA, 19 nt, Homo sapiens
gagcaugucaucacagaag

SEQ ID NO: 954430 - RNA, 19 nt, Homo sapiens
gaccugauauccagaagcu

SEQ ID NO: 954431 - RNA, 19 nt, Homo sapiens
ugaacugccugcuguugga

SEQ ID NO: 954432 - RNA, 19 nt, Homo sapiens
cuaauaaagucugaacucu

SEQ ID NO: 954433 - RNA, 19 nt, Homo sapiens
gguaucuaauaaagucuga

SEQ ID NO: 954434 - RNA, 19 nt, Homo sapiens
ggauguugauggacuucga

SEQ ID NO: 954435 - RNA, 19 nt, Homo sapiens
ucugaacucucccuuccaa

SEQ ID NO: 954436 - RNA, 19 nt, Homo sapiens
gcggugggcagcaauguga

SEQ ID NO: 954437 - RNA, 19 nt, Homo sapiens
cagaagaggagcuaagaag

SEQ ID NO: 954438 - RNA, 19 nt, Homo sapiens
gggccagccuuaagguauc

SEQ ID NO: 954439 - RNA, 19 nt, Homo sapiens
ccuaagaaccaucaaugug

SEQ ID NO: 954440 - RNA, 19 nt, Homo sapiens
ggccuaagaaccaucaaug

SEQ ID NO: 954441 - RNA, 19 nt, Homo sapiens
gcugugagaggaucagaug

SEQ ID NO: 954442 - RNA, 19 nt, Homo sapiens
aggaagcacugauccaagu

SEQ ID NO: 954443 - RNA, 19 nt, Homo sapiens
ggagggaacgaagguguug

SEQ ID NO: 954444 - RNA, 19 nt, Homo sapiens
gaagcacugauccaaguuc

SEQ ID NO: 954445 - RNA, 19 nt, Homo sapiens
gcaugugggucugcaguac

SEQ ID NO: 954446 - RNA, 19 nt, Homo sapiens
guccagaccaguucaagga

SEQ ID NO: 954447 - RNA, 19 nt, Homo sapiens
ccuacaggauguugaugga

SEQ ID NO: 954448 - RNA, 19 nt, Homo sapiens
ggaagcacugauccaaguu

SEQ ID NO: 954449 - RNA, 19 nt, Homo sapiens
agccuuaagguaucuaaua

SEQ ID NO: 954450 - RNA, 19 nt, Homo sapiens
ggcuugcucucaacugugu

SEQ ID NO: 954451 - RNA, 19 nt, Homo sapiens
cagccaaggucgucgaacu

SEQ ID NO: 954452 - RNA, 19 nt, Homo sapiens
guccgagacagaccugaua

SEQ ID NO: 954453 - RNA, 19 nt, Homo sapiens
ugauccaaguuccgaguga

SEQ ID NO: 954454 - RNA, 19 nt, Homo sapiens
ccaaggucgucgaacucaa

SEQ ID NO: 954455 - RNA, 19 nt, Homo sapiens
cugagcaugucaucacaga

SEQ ID NO: 954456 - RNA, 19 nt, Homo sapiens
ucagauguccgugugaaga

SEQ ID NO: 954457 - RNA, 19 nt, Homo sapiens
ggaccgaggcuguguucag

SEQ ID NO: 954458 - RNA, 19 nt, Homo sapiens
ggaaccaugguaaccuaug

SEQ ID NO: 954459 - RNA, 19 nt, Homo sapiens
aaacuucuuuaaggacaug

SEQ ID NO: 954460 - RNA, 19 nt, Homo sapiens
cgaggaagcacugauccaa

SEQ ID NO: 954461 - RNA, 19 nt, Homo sapiens
ucaauccaucugacauaaa

SEQ ID NO: 954462 - RNA, 19 nt, Homo sapiens
guugauggacuucgagcaa

SEQ ID NO: 954463 - RNA, 19 nt, Homo sapiens
ucacaguccagaccaguuc

SEQ ID NO: 954464 - RNA, 19 nt, Homo sapiens
caucacagaagaggagcua

SEQ ID NO: 954465 - RNA, 19 nt, Homo sapiens
caaugugguccgagacaga

SEQ ID NO: 954466 - RNA, 19 nt, Homo sapiens
gugaagccagccacgguuu

SEQ ID NO: 954467 - RNA, 19 nt, Homo sapiens
caaggucgucgaacucaag

SEQ ID NO: 954468 - RNA, 19 nt, Homo sapiens
gcacagccuacaggauguu

SEQ ID NO: 954469 - RNA, 19 nt, Homo sapiens
aagcagauucucaccaugu

SEQ ID NO: 954470 - RNA, 19 nt, Homo sapiens
gagcugcugcgccaguuag

SEQ ID NO: 954471 - RNA, 19 nt, Homo sapiens
gcaaugugaccgggcugaa

SEQ ID NO: 954472 - RNA, 19 nt, Homo sapiens
ucacagaagaggagcuaag

SEQ ID NO: 954473 - RNA, 19 nt, Homo sapiens
gcguggaggaaccauggua

SEQ ID NO: 954474 - RNA, 19 nt, Homo sapiens
cagagcugcugcgccaguu

SEQ ID NO: 954475 - RNA, 19 nt, Homo sapiens
aucaauccaucugacauaa

SEQ ID NO: 954476 - RNA, 19 nt, Homo sapiens
cacagaagaggagcuaaga

SEQ ID NO: 954477 - RNA, 19 nt, Homo sapiens
gagacagaccugauaucca

SEQ ID NO: 954478 - RNA, 19 nt, Homo sapiens
gccuaagaaccaucaaugu

SEQ ID NO: 954479 - RNA, 19 nt, Homo sapiens
cgaaucagauguauaguua

SEQ ID NO: 954480 - RNA, 19 nt, Homo sapiens
gcaaggagaucaccagaaa

SEQ ID NO: 954481 - RNA, 19 nt, Homo sapiens
ggaaagaagauuuggauaa

SEQ ID NO: 954482 - RNA, 19 nt, Homo sapiens
gaaagaagauuuggauaag

SEQ ID NO: 954483 - RNA, 19 nt, Homo sapiens
guacuagcaucuacaauga

SEQ ID NO: 954484 - RNA, 19 nt, Homo sapiens
gaaguugcuuuggauauaa

SEQ ID NO: 954485 - RNA, 19 nt, Homo sapiens
ggaagaaacuuacauuuug

SEQ ID NO: 954486 - RNA, 19 nt, Homo sapiens
cagaagaauuugccuauga

SEQ ID NO: 954487 - RNA, 19 nt, Homo sapiens
ggacagugacuucugauaa

SEQ ID NO: 954488 - RNA, 19 nt, Homo sapiens
ggagaagccugauguuagu

SEQ ID NO: 954489 - RNA, 19 nt, Homo sapiens
gagcuuaacccaaggcuuu

SEQ ID NO: 954490 - RNA, 19 nt, Homo sapiens
ggacgaaucagauguauag

SEQ ID NO: 954491 - RNA, 19 nt, Homo sapiens
ggauucaccuuggcugaua

SEQ ID NO: 954492 - RNA, 19 nt, Homo sapiens
uaaccaaagugcacugcua

SEQ ID NO: 954493 - RNA, 19 nt, Homo sapiens
gaggagaagccugauguua

SEQ ID NO: 954494 - RNA, 19 nt, Homo sapiens
agaaguugcuuuggauaua

SEQ ID NO: 954495 - RNA, 19 nt, Homo sapiens
ggccuuggauggugaauau

SEQ ID NO: 954496 - RNA, 19 nt, Homo sapiens
aggcagaagugaaguguuu

SEQ ID NO: 954497 - RNA, 19 nt, Homo sapiens
ggcaaagccuccucacaga

SEQ ID NO: 954498 - RNA, 19 nt, Homo sapiens
caccuuggcugauaaagug

SEQ ID NO: 954499 - RNA, 19 nt, Homo sapiens
ucaaggaggacacagauuu

SEQ ID NO: 954500 - RNA, 19 nt, Homo sapiens
aaagugcacugcuauaugg

SEQ ID NO: 954501 - RNA, 19 nt, Homo sapiens
gacagugacuucugauaag

SEQ ID NO: 954502 - RNA, 19 nt, Homo sapiens
gauguuaguuucgauaaag

SEQ ID NO: 954503 - RNA, 19 nt, Homo sapiens
agaagaauuugccuaugaa

SEQ ID NO: 954504 - RNA, 19 nt, Homo sapiens
acuagcaucuacaaugaua

SEQ ID NO: 954505 - RNA, 19 nt, Homo sapiens
aagaagauuuggauaagug

SEQ ID NO: 954506 - RNA, 19 nt, Homo sapiens
gauguauaguuacuucaug

SEQ ID NO: 954507 - RNA, 19 nt, Homo sapiens
gggcaagaauaaccaaagu

SEQ ID NO: 954508 - RNA, 19 nt, Homo sapiens
gauaaagcaauuagagaug

SEQ ID NO: 954509 - RNA, 19 nt, Homo sapiens
acagagcccuggcacuuga

SEQ ID NO: 954510 - RNA, 19 nt, Homo sapiens
gguacuagcaucuacaaug

SEQ ID NO: 954511 - RNA, 19 nt, Homo sapiens
ucagauguauaguuacuuc

SEQ ID NO: 954512 - RNA, 19 nt, Homo sapiens
gaagaauuugccuaugaaa

SEQ ID NO: 954513 - RNA, 19 nt, Homo sapiens
caaagugcacugcuauaug

SEQ ID NO: 954514 - RNA, 19 nt, Homo sapiens
gaucucuucuauaggauuc

SEQ ID NO: 954515 - RNA, 19 nt, Homo sapiens
ggaggacacagauuucuuc

SEQ ID NO: 954516 - RNA, 19 nt, Homo sapiens
cgaaguggguacugugcaa

SEQ ID NO: 954517 - RNA, 19 nt, Homo sapiens
ugauccagcucauacagaa

SEQ ID NO: 954518 - RNA, 19 nt, Homo sapiens
cgacagagcccuggcacuu

SEQ ID NO: 954519 - RNA, 19 nt, Homo sapiens
ggaagaauuuugccacuca

SEQ ID NO: 954520 - RNA, 19 nt, Homo sapiens
gaagccugauguuaguuuc

SEQ ID NO: 954521 - RNA, 19 nt, Homo sapiens
ugaaacacuuagagcaguu

SEQ ID NO: 954522 - RNA, 19 nt, Homo sapiens
agcaugagcuuccgcuuga

SEQ ID NO: 954523 - RNA, 19 nt, Homo sapiens
gaggacgaaucagauguau

SEQ ID NO: 954524 - RNA, 19 nt, Homo sapiens
uggguacugugcaaugaua

SEQ ID NO: 954525 - RNA, 19 nt, Homo sapiens
uaaauuagccuuggaacgu

SEQ ID NO: 954526 - RNA, 19 nt, Homo sapiens
ggagaucaccagaaagaag

SEQ ID NO: 954527 - RNA, 19 nt, Homo sapiens
gcagaguauuccaguaguc

SEQ ID NO: 954528 - RNA, 19 nt, Homo sapiens
gccaacuucugccuuguau

SEQ ID NO: 954529 - RNA, 19 nt, Homo sapiens
guaccucucucaggauugu

SEQ ID NO: 954530 - RNA, 19 nt, Homo sapiens
ccaaagugcacugcuauau

SEQ ID NO: 954531 - RNA, 19 nt, Homo sapiens
gaaauuguggaucauugga

SEQ ID NO: 954532 - RNA, 19 nt, Homo sapiens
gaugaagcaauauaccauu

SEQ ID NO: 954533 - RNA, 19 nt, Homo sapiens
gauucaccuuggcugauaa

SEQ ID NO: 954534 - RNA, 19 nt, Homo sapiens
uuggauaaguggacaguga

SEQ ID NO: 954535 - RNA, 19 nt, Homo sapiens
gggaaagaagauuuggaua

SEQ ID NO: 954536 - RNA, 19 nt, Homo sapiens
ccaggaagaaacuuacauu

SEQ ID NO: 954537 - RNA, 19 nt, Homo sapiens
aggaugaaauuguggauca

SEQ ID NO: 954538 - RNA, 19 nt, Homo sapiens
caggaagaaacuuacauuu

SEQ ID NO: 954539 - RNA, 19 nt, Homo sapiens
gcaauuagagaugaagcaa

SEQ ID NO: 954540 - RNA, 19 nt, Homo sapiens
ugugaccucggguaaauua

SEQ ID NO: 954541 - RNA, 19 nt, Homo sapiens
cuucgucucuauaauugaa

SEQ ID NO: 954542 - RNA, 19 nt, Homo sapiens
cgauaaagcaauuagagau

SEQ ID NO: 954543 - RNA, 19 nt, Homo sapiens
gagaucaccagaaagaagu

SEQ ID NO: 954544 - RNA, 19 nt, Homo sapiens
ccaagguugucuggcaauu

SEQ ID NO: 954545 - RNA, 19 nt, Homo sapiens
guugugagccgucagugaa

SEQ ID NO: 954546 - RNA, 19 nt, Homo sapiens
aaggagaucaccagaaaga

SEQ ID NO: 954547 - RNA, 19 nt, Homo sapiens
gguagaauugggcuauuug

SEQ ID NO: 954548 - RNA, 19 nt, Homo sapiens
gagcuuccgcuugauaaga

SEQ ID NO: 954549 - RNA, 19 nt, Homo sapiens
caugagcuuccgcuugaua

SEQ ID NO: 954550 - RNA, 19 nt, Homo sapiens
caaggaggacacagauuuc

SEQ ID NO: 954551 - RNA, 19 nt, Homo sapiens
acagugacuucugauaaga

SEQ ID NO: 954552 - RNA, 19 nt, Homo sapiens
uuauuggcguguuuacuga

SEQ ID NO: 954553 - RNA, 19 nt, Homo sapiens
gcacugcuauauggaacuc

SEQ ID NO: 954554 - RNA, 19 nt, Homo sapiens
gagaugaagcaauauacca

SEQ ID NO: 954555 - RNA, 19 nt, Homo sapiens
ccaguagucuucagaaacc

SEQ ID NO: 954556 - RNA, 19 nt, Homo sapiens
ugguagaauugggcuauuu

SEQ ID NO: 954557 - RNA, 19 nt, Homo sapiens
uaguaccucucucaggauu

SEQ ID NO: 954558 - RNA, 19 nt, Homo sapiens
gcucauacagaagaauuug

SEQ ID NO: 954559 - RNA, 19 nt, Homo sapiens
ucuggcacaugguagaauu

SEQ ID NO: 954560 - RNA, 19 nt, Homo sapiens
agaauugggcuauuugcuu

SEQ ID NO: 954561 - RNA, 19 nt, Homo sapiens
ugugugaccucggguaaau

SEQ ID NO: 954562 - RNA, 19 nt, Homo sapiens
uaaggguacuagcaucuac

SEQ ID NO: 954563 - RNA, 19 nt, Homo sapiens
ggucccaguucaauacucu

SEQ ID NO: 954564 - RNA, 19 nt, Homo sapiens
aauaauaguaccucucuca

SEQ ID NO: 954565 - RNA, 19 nt, Homo sapiens
uuugaaggaugaaauugug

SEQ ID NO: 954566 - RNA, 19 nt, Homo sapiens
ggcaggaggucaagauucc

SEQ ID NO: 954567 - RNA, 19 nt, Homo sapiens
cagcucauacagaagaauu

SEQ ID NO: 954568 - RNA, 19 nt, Homo sapiens
ucaguuucuucgucucuau

SEQ ID NO: 954569 - RNA, 19 nt, Homo sapiens
agaggacgaaucagaugua

SEQ ID NO: 954570 - RNA, 19 nt, Homo sapiens
acagaagaauuugccuaug

SEQ ID NO: 954571 - RNA, 19 nt, Homo sapiens
uccgggauguucagcauga

SEQ ID NO: 954572 - RNA, 19 nt, Homo sapiens
guauaguuacuucauguuc

SEQ ID NO: 954573 - RNA, 19 nt, Homo sapiens
ucacagaggaagacugaag

SEQ ID NO: 954574 - RNA, 19 nt, Homo sapiens
gaaaauucuccagagcuua

SEQ ID NO: 954575 - RNA, 19 nt, Homo sapiens
uagcccaggaagaaacuua

SEQ ID NO: 954576 - RNA, 19 nt, Homo sapiens
ccagaggacgaaucagaug

SEQ ID NO: 954577 - RNA, 19 nt, Homo sapiens
gauuggaggcagaagugaa

SEQ ID NO: 954578 - RNA, 19 nt, Homo sapiens
gacagagcccuggcacuug

SEQ ID NO: 954579 - RNA, 19 nt, Homo sapiens
gauaaccucuccaguauua

SEQ ID NO: 954580 - RNA, 19 nt, Homo sapiens
ggacuaggaucacggauua

SEQ ID NO: 954581 - RNA, 19 nt, Homo sapiens
gaaauacacuuuacucuuc

SEQ ID NO: 954582 - RNA, 19 nt, Homo sapiens
gaucacggauuaauuguaa

SEQ ID NO: 954583 - RNA, 19 nt, Homo sapiens
ggagauugcuucaaaauua

SEQ ID NO: 954584 - RNA, 19 nt, Homo sapiens
cagaauugcuuguauguuu

SEQ ID NO: 954585 - RNA, 19 nt, Homo sapiens
ccaaugauccuuucaaauu

SEQ ID NO: 954586 - RNA, 19 nt, Homo sapiens
acaaugauguggaacuuua

SEQ ID NO: 954587 - RNA, 19 nt, Homo sapiens
gacaguaucuugaaagguu

SEQ ID NO: 954588 - RNA, 19 nt, Homo sapiens
gaaccucuaugcagacauu

SEQ ID NO: 954589 - RNA, 19 nt, Homo sapiens
gguacuauguauuccauua

SEQ ID NO: 954590 - RNA, 19 nt, Homo sapiens
uaagauaaccucuccagua

SEQ ID NO: 954591 - RNA, 19 nt, Homo sapiens
cgaguugccuuuccugaua

SEQ ID NO: 954592 - RNA, 19 nt, Homo sapiens
caacagaauugcuuguaug

SEQ ID NO: 954593 - RNA, 19 nt, Homo sapiens
gaacuggugcagaaacaua

SEQ ID NO: 954594 - RNA, 19 nt, Homo sapiens
ccaaggagaccuacuguuu

SEQ ID NO: 954595 - RNA, 19 nt, Homo sapiens
gcuauugaguguuucauga

SEQ ID NO: 954596 - RNA, 19 nt, Homo sapiens
gauuauauauggccaaagu

SEQ ID NO: 954597 - RNA, 19 nt, Homo sapiens
ugagagugcugcuguuauu

SEQ ID NO: 954598 - RNA, 19 nt, Homo sapiens
aagauaaccucuccaguau

SEQ ID NO: 954599 - RNA, 19 nt, Homo sapiens
ggaacuuuauggacaguau

SEQ ID NO: 954600 - RNA, 19 nt, Homo sapiens
aaacuuauuugcucuccaa

SEQ ID NO: 954601 - RNA, 19 nt, Homo sapiens
cacaggaacuggugcagaa

SEQ ID NO: 954602 - RNA, 19 nt, Homo sapiens
aagaugcuauugaguguuu

SEQ ID NO: 954603 - RNA, 19 nt, Homo sapiens
caaugacgguacuauguau

SEQ ID NO: 954604 - RNA, 19 nt, Homo sapiens
gugcagagcaugaauaauc

SEQ ID NO: 954605 - RNA, 19 nt, Homo sapiens
ggaucuugcugcucgauau

SEQ ID NO: 954606 - RNA, 19 nt, Homo sapiens
ggacuuuacaucugucuga

SEQ ID NO: 954607 - RNA, 19 nt, Homo sapiens
gauccaacuuacacacuga

SEQ ID NO: 954608 - RNA, 19 nt, Homo sapiens
uaccaaugauccuuucaaa

SEQ ID NO: 954609 - RNA, 19 nt, Homo sapiens
cgaaauacacuuuacucuu

SEQ ID NO: 954610 - RNA, 19 nt, Homo sapiens
gagcaggucacaaugaugu

SEQ ID NO: 954611 - RNA, 19 nt, Homo sapiens
uuaccaaacuuaacuggau

SEQ ID NO: 954612 - RNA, 19 nt, Homo sapiens
ucaaugacgguacuaugua

SEQ ID NO: 954613 - RNA, 19 nt, Homo sapiens
guacguuguucacccaaug

SEQ ID NO: 954614 - RNA, 19 nt, Homo sapiens
uaaagaagggaagugauuu

SEQ ID NO: 954615 - RNA, 19 nt, Homo sapiens
ugaaggagcaggucacaau

SEQ ID NO: 954616 - RNA, 19 nt, Homo sapiens
ggaaacccacagagaagaa

SEQ ID NO: 954617 - RNA, 19 nt, Homo sapiens
ccaaugcgaaauacacuuu

SEQ ID NO: 954618 - RNA, 19 nt, Homo sapiens
uggaaaugcuguugaucuu

SEQ ID NO: 954619 - RNA, 19 nt, Homo sapiens
ggucuacaguuuucaauga

SEQ ID NO: 954620 - RNA, 19 nt, Homo sapiens
cacauggccucgcauuguu

SEQ ID NO: 954621 - RNA, 19 nt, Homo sapiens
agaauugcuuguauguuug

SEQ ID NO: 954622 - RNA, 19 nt, Homo sapiens
uaucuucucuuuaccaaac

SEQ ID NO: 954623 - RNA, 19 nt, Homo sapiens
cuugaaagguugaaacagu

SEQ ID NO: 954624 - RNA, 19 nt, Homo sapiens
uaggaucacggauuaauug

SEQ ID NO: 954625 - RNA, 19 nt, Homo sapiens
uuacauaggacuaggauca

SEQ ID NO: 954626 - RNA, 19 nt, Homo sapiens
gaaggagcaggucacaaug

SEQ ID NO: 954627 - RNA, 19 nt, Homo sapiens
ugagcuauguugccucuuc

SEQ ID NO: 954628 - RNA, 19 nt, Homo sapiens
uccauuaucuucucuuuac

SEQ ID NO: 954629 - RNA, 19 nt, Homo sapiens
caaaguauagggacaguac

SEQ ID NO: 954630 - RNA, 19 nt, Homo sapiens
ggaucacggauuaauugua

SEQ ID NO: 954631 - RNA, 19 nt, Homo sapiens
acacuuuacucuucucaca

SEQ ID NO: 954632 - RNA, 19 nt, Homo sapiens
ggaaaugcuguugaucuug

SEQ ID NO: 954633 - RNA, 19 nt, Homo sapiens
gaagugauuuucucaaggu

SEQ ID NO: 954634 - RNA, 19 nt, Homo sapiens
auaaagaagggaagugauu

SEQ ID NO: 954635 - RNA, 19 nt, Homo sapiens
gugauuauauauggccaaa

SEQ ID NO: 954636 - RNA, 19 nt, Homo sapiens
gcagaacgcgagcucuugu

SEQ ID NO: 954637 - RNA, 19 nt, Homo sapiens
guucacccaaugcgaaaua

SEQ ID NO: 954638 - RNA, 19 nt, Homo sapiens
caguaaaggcaacagaauu

SEQ ID NO: 954639 - RNA, 19 nt, Homo sapiens
uaccaaacuuaacuggauu

SEQ ID NO: 954640 - RNA, 19 nt, Homo sapiens
uugaaagguugaaacaguu

SEQ ID NO: 954641 - RNA, 19 nt, Homo sapiens
uauggacaguaucuugaaa

SEQ ID NO: 954642 - RNA, 19 nt, Homo sapiens
ucacauggccucgcauugu

SEQ ID NO: 954643 - RNA, 19 nt, Homo sapiens
gggaaugcgaguugccuuu

SEQ ID NO: 954644 - RNA, 19 nt, Homo sapiens
gugcugcuguuauucuuca

SEQ ID NO: 954645 - RNA, 19 nt, Homo sapiens
gcuuguauguuuguacguu

SEQ ID NO: 954646 - RNA, 19 nt, Homo sapiens
gagugcugcuguuauucuu

SEQ ID NO: 954647 - RNA, 19 nt, Homo sapiens
uaugagagugcugcuguua

SEQ ID NO: 954648 - RNA, 19 nt, Homo sapiens
gaaagccggacgcguugga

SEQ ID NO: 954649 - RNA, 19 nt, Homo sapiens
caggggagauugcuucaaa

SEQ ID NO: 954650 - RNA, 19 nt, Homo sapiens
cugcuuggcuugcucuuag

SEQ ID NO: 954651 - RNA, 19 nt, Homo sapiens
gagcagcuuuuacauagga

SEQ ID NO: 954652 - RNA, 19 nt, Homo sapiens
uuacucuucucacauggaa

SEQ ID NO: 954653 - RNA, 19 nt, Homo sapiens
caaugcgaaauacacuuua

SEQ ID NO: 954654 - RNA, 19 nt, Homo sapiens
aguaaaggcaacagaauug

SEQ ID NO: 954655 - RNA, 19 nt, Homo sapiens
gaagggaagugauuuucuc

SEQ ID NO: 954656 - RNA, 19 nt, Homo sapiens
uaaccucuccaguauuaau

SEQ ID NO: 954657 - RNA, 19 nt, Homo sapiens
gaugcauucccaaacauug

SEQ ID NO: 954658 - RNA, 19 nt, Homo sapiens
caaaugagcagcuuuuaca

SEQ ID NO: 954659 - RNA, 19 nt, Homo sapiens
gagccucucuggguugaag

SEQ ID NO: 954660 - RNA, 19 nt, Homo sapiens
gcguuggacuuuacaucug

SEQ ID NO: 954661 - RNA, 19 nt, Homo sapiens
cagagcaugaauaaucuuu

SEQ ID NO: 954662 - RNA, 19 nt, Homo sapiens
gagcuauguugccucuucu

SEQ ID NO: 954663 - RNA, 19 nt, Homo sapiens
acauggaaaugcuguugau

SEQ ID NO: 954664 - RNA, 19 nt, Homo sapiens
gaauugcuuguauguuugu

SEQ ID NO: 954665 - RNA, 19 nt, Homo sapiens
ccaguaaaggcaacagaau

SEQ ID NO: 954666 - RNA, 19 nt, Homo sapiens
gacuuuacaucugucugaa

SEQ ID NO: 954667 - RNA, 19 nt, Homo sapiens
ggcaguauucuucuagaga

SEQ ID NO: 954668 - RNA, 19 nt, Homo sapiens
ggaaugcgaguugccuuuc

SEQ ID NO: 954669 - RNA, 19 nt, Homo sapiens
gggaaacccacagagaaga

SEQ ID NO: 954670 - RNA, 19 nt, Homo sapiens
cagcagaacgcgagcucuu

SEQ ID NO: 954671 - RNA, 19 nt, Homo sapiens
gugcagaaacauaaagaag

SEQ ID NO: 954672 - RNA, 19 nt, Homo sapiens
caaggagaccuacuguuuu

SEQ ID NO: 954673 - RNA, 19 nt, Homo sapiens
caggugcagagcaugaaua

SEQ ID NO: 954674 - RNA, 19 nt, Homo sapiens
ccgggaaacccacagagaa

SEQ ID NO: 954675 - RNA, 19 nt, Homo sapiens
gagauugcuucaaaauuag

SEQ ID NO: 954676 - RNA, 19 nt, Homo sapiens
gaguguuucaugacuagaa

SEQ ID NO: 954677 - RNA, 19 nt, Homo sapiens
gcgaaauacacuuuacucu

SEQ ID NO: 954678 - RNA, 19 nt, Homo sapiens
aaaagaugcuauugagugu

SEQ ID NO: 954679 - RNA, 19 nt, Homo sapiens
ucagaaaccugcacuguua

SEQ ID NO: 954680 - RNA, 19 nt, Homo sapiens
gcaaagagagcucgacuua

SEQ ID NO: 954681 - RNA, 19 nt, Homo sapiens
gaggaaacuucaacuugua

SEQ ID NO: 954682 - RNA, 19 nt, Homo sapiens
agacaaagaucacuacaga

SEQ ID NO: 954683 - RNA, 19 nt, Homo sapiens
ggaggaaacuucaacuugu

SEQ ID NO: 954684 - RNA, 19 nt, Homo sapiens
caagauuacugguuuguug

SEQ ID NO: 954685 - RNA, 19 nt, Homo sapiens
gagagaaagugguuuaaag

SEQ ID NO: 954686 - RNA, 19 nt, Homo sapiens
ggagaauacuuucccauca

SEQ ID NO: 954687 - RNA, 19 nt, Homo sapiens
aagaagaucucagcguuua

SEQ ID NO: 954688 - RNA, 19 nt, Homo sapiens
ugacuggaauagcugauua

SEQ ID NO: 954689 - RNA, 19 nt, Homo sapiens
uaauacaagucgaggauuu

SEQ ID NO: 954690 - RNA, 19 nt, Homo sapiens
gcuaacagcaauaaagaua

SEQ ID NO: 954691 - RNA, 19 nt, Homo sapiens
ccacuaagcugguguuguc

SEQ ID NO: 954692 - RNA, 19 nt, Homo sapiens
gagaaagugguuuaaagua

SEQ ID NO: 954693 - RNA, 19 nt, Homo sapiens
gaagauuccugcugauuuu

SEQ ID NO: 954694 - RNA, 19 nt, Homo sapiens
gacaugaacaguuuaauug

SEQ ID NO: 954695 - RNA, 19 nt, Homo sapiens
aaagagagcucgacuuaac

SEQ ID NO: 954696 - RNA, 19 nt, Homo sapiens
uuggauagcuuuagucaaa

SEQ ID NO: 954697 - RNA, 19 nt, Homo sapiens
uaucucagcuuucuucuuc

SEQ ID NO: 954698 - RNA, 19 nt, Homo sapiens
gagagcacauuaucaaaca

SEQ ID NO: 954699 - RNA, 19 nt, Homo sapiens
gaugagagaaagugguuua

SEQ ID NO: 954700 - RNA, 19 nt, Homo sapiens
guagagaacguuccaaaga

SEQ ID NO: 954701 - RNA, 19 nt, Homo sapiens
gggaaaguauucuccauca

SEQ ID NO: 954702 - RNA, 19 nt, Homo sapiens
gcaacucguuucaggcaaa

SEQ ID NO: 954703 - RNA, 19 nt, Homo sapiens
ggauaaagaugagagaaag

SEQ ID NO: 954704 - RNA, 19 nt, Homo sapiens
gaagaagaucucagcguuu

SEQ ID NO: 954705 - RNA, 19 nt, Homo sapiens
gcacuguuauccucaacuu

SEQ ID NO: 954706 - RNA, 19 nt, Homo sapiens
gagcucgacuuaacaagau

SEQ ID NO: 954707 - RNA, 19 nt, Homo sapiens
gaaggaagaucugccuaca

SEQ ID NO: 954708 - RNA, 19 nt, Homo sapiens
ggaguaauucaguuguuua

SEQ ID NO: 954709 - RNA, 19 nt, Homo sapiens
gcaagaaaugcaaacauga

SEQ ID NO: 954710 - RNA, 19 nt, Homo sapiens
agcaauagcugauggaaga

SEQ ID NO: 954711 - RNA, 19 nt, Homo sapiens
gaaaguauucuccaucagu

SEQ ID NO: 954712 - RNA, 19 nt, Homo sapiens
auacacagaugcuuccaaa

SEQ ID NO: 954713 - RNA, 19 nt, Homo sapiens
uaacaagauuacugguuug

SEQ ID NO: 954714 - RNA, 19 nt, Homo sapiens
gaaaugcaaacaugaaucu

SEQ ID NO: 954715 - RNA, 19 nt, Homo sapiens
caagaaaugcaaacaugaa

SEQ ID NO: 954716 - RNA, 19 nt, Homo sapiens
ccagagagcacauuaucaa

SEQ ID NO: 954717 - RNA, 19 nt, Homo sapiens
gagagaagagagacaaaga

SEQ ID NO: 954718 - RNA, 19 nt, Homo sapiens
gaagagagaagagagacaa

SEQ ID NO: 954719 - RNA, 19 nt, Homo sapiens
aaagaucacuacagaccaa

SEQ ID NO: 954720 - RNA, 19 nt, Homo sapiens
gcaggugacuggaauagcu

SEQ ID NO: 954721 - RNA, 19 nt, Homo sapiens
aaaggaagacuacaaugaa

SEQ ID NO: 954722 - RNA, 19 nt, Homo sapiens
ggaaagaagagagaagaga

SEQ ID NO: 954723 - RNA, 19 nt, Homo sapiens
aaaguauucuccaucaguu

SEQ ID NO: 954724 - RNA, 19 nt, Homo sapiens
uagagaacguuccaaagau

SEQ ID NO: 954725 - RNA, 19 nt, Homo sapiens
caccagacguagagaagaa

SEQ ID NO: 954726 - RNA, 19 nt, Homo sapiens
gguuuaaaguaccuucaaa

SEQ ID NO: 954727 - RNA, 19 nt, Homo sapiens
uaccagaggugccugaugu

SEQ ID NO: 954728 - RNA, 19 nt, Homo sapiens
gcaauuaacaaagaaggaa

SEQ ID NO: 954729 - RNA, 19 nt, Homo sapiens
aaggaagacuacaaugaaa

SEQ ID NO: 954730 - RNA, 19 nt, Homo sapiens
gagaauacuuucccaucag

SEQ ID NO: 954731 - RNA, 19 nt, Homo sapiens
gcacauuugccacuugaga

SEQ ID NO: 954732 - RNA, 19 nt, Homo sapiens
ggaaacuucaacuuguaua

SEQ ID NO: 954733 - RNA, 19 nt, Homo sapiens
ugaagauuccugcugauuu

SEQ ID NO: 954734 - RNA, 19 nt, Homo sapiens
gauaaggaaagaagagaga

SEQ ID NO: 954735 - RNA, 19 nt, Homo sapiens
cgugauugcuaaaguauuc

SEQ ID NO: 954736 - RNA, 19 nt, Homo sapiens
ccaaauccuucuuccaaag

SEQ ID NO: 954737 - RNA, 19 nt, Homo sapiens
gagaagagagacaaagauc

SEQ ID NO: 954738 - RNA, 19 nt, Homo sapiens
gacccugucucccucuuga

SEQ ID NO: 954739 - RNA, 19 nt, Homo sapiens
gcuuucuucuucagugaua

SEQ ID NO: 954740 - RNA, 19 nt, Homo sapiens
gaagcugacauuagcaguu

SEQ ID NO: 954741 - RNA, 19 nt, Homo sapiens
aggaagaucugccuacauc

SEQ ID NO: 954742 - RNA, 19 nt, Homo sapiens
agaaagugguuuaaaguac

SEQ ID NO: 954743 - RNA, 19 nt, Homo sapiens
gaaaucccagcauccacua

SEQ ID NO: 954744 - RNA, 19 nt, Homo sapiens
ggaagacuacaaugaaaca

SEQ ID NO: 954745 - RNA, 19 nt, Homo sapiens
agagaacguuccaaagaug

SEQ ID NO: 954746 - RNA, 19 nt, Homo sapiens
gcgcuaacagcaauaaaga

SEQ ID NO: 954747 - RNA, 19 nt, Homo sapiens
gacaaaagcucaacagcau

SEQ ID NO: 954748 - RNA, 19 nt, Homo sapiens
agaaggaacauuuacaguu

SEQ ID NO: 954749 - RNA, 19 nt, Homo sapiens
caaagaaggaacauuuaca

SEQ ID NO: 954750 - RNA, 19 nt, Homo sapiens
acacagaugcuuccaaauc

SEQ ID NO: 954751 - RNA, 19 nt, Homo sapiens
gcaggcgauuucaccuaaa

SEQ ID NO: 954752 - RNA, 19 nt, Homo sapiens
ccuagaccuuucaagcaua

SEQ ID NO: 954753 - RNA, 19 nt, Homo sapiens
ggaaggcucgcagcaagaa

SEQ ID NO: 954754 - RNA, 19 nt, Homo sapiens
gagcaggcgauuucaccua

SEQ ID NO: 954755 - RNA, 19 nt, Homo sapiens
caaugaaacagcuccaaug

SEQ ID NO: 954756 - RNA, 19 nt, Homo sapiens
gggaagugaggauuggaua

SEQ ID NO: 954757 - RNA, 19 nt, Homo sapiens
gaacaaaacagggaguaaa

SEQ ID NO: 954758 - RNA, 19 nt, Homo sapiens
agaacuggauggagaauac

SEQ ID NO: 954759 - RNA, 19 nt, Homo sapiens
gaagagagacaaagaucac

SEQ ID NO: 954760 - RNA, 19 nt, Homo sapiens
ccacugaugggaaaguauu

SEQ ID NO: 954761 - RNA, 19 nt, Homo sapiens
caaagagagcucgacuuaa

SEQ ID NO: 954762 - RNA, 19 nt, Homo sapiens
cuacaucuagugaaacauu

SEQ ID NO: 954763 - RNA, 19 nt, Homo sapiens
gaaacuucaacuuguauag

SEQ ID NO: 954764 - RNA, 19 nt, Homo sapiens
gaaccagcgcuaacagcaa

SEQ ID NO: 954765 - RNA, 19 nt, Homo sapiens
caaaggaacaacucaggau

SEQ ID NO: 954766 - RNA, 19 nt, Homo sapiens
aaagugaaauuggaagaca

SEQ ID NO: 954767 - RNA, 19 nt, Homo sapiens
ggagauucuucugggugua

SEQ ID NO: 954768 - RNA, 19 nt, Homo sapiens
caccuaaaccucaaaguca

SEQ ID NO: 954769 - RNA, 19 nt, Homo sapiens
uggaguaauucaguuguuu

SEQ ID NO: 954770 - RNA, 19 nt, Homo sapiens
gaucguguaaccagucuau

SEQ ID NO: 954771 - RNA, 19 nt, Homo sapiens
agucgugauugcuaaagua

SEQ ID NO: 954772 - RNA, 19 nt, Homo sapiens
agcaagaaaugcaaacaug

SEQ ID NO: 954773 - RNA, 19 nt, Homo sapiens
cauuuggacuucauguaga

SEQ ID NO: 954774 - RNA, 19 nt, Homo sapiens
agucgugguucagaaguua

SEQ ID NO: 954775 - RNA, 19 nt, Homo sapiens
cgacuuaacaagauuacug

SEQ ID NO: 954776 - RNA, 19 nt, Homo sapiens
uggaauagcugauuaaaac

SEQ ID NO: 954777 - RNA, 19 nt, Homo sapiens
ggaaaguauucuccaucag

SEQ ID NO: 954778 - RNA, 19 nt, Homo sapiens
gauuucaccuaaaccucaa

SEQ ID NO: 954779 - RNA, 19 nt, Homo sapiens
gcacuucacucccuugaua

SEQ ID NO: 954780 - RNA, 19 nt, Homo sapiens
gaccagaugugacuuauuu

SEQ ID NO: 954781 - RNA, 19 nt, Homo sapiens
cgacacaucuuuacaauuc

SEQ ID NO: 954782 - RNA, 19 nt, Homo sapiens
ccacaacucuuugcauaua

SEQ ID NO: 954783 - RNA, 19 nt, Homo sapiens
cagauaagauuguaaggaa

SEQ ID NO: 954784 - RNA, 19 nt, Homo sapiens
gcagaacucagaugacuuu

SEQ ID NO: 954785 - RNA, 19 nt, Homo sapiens
gaaaaggacacucgauuua

SEQ ID NO: 954786 - RNA, 19 nt, Homo sapiens
aaaggacacucgauuuauu

SEQ ID NO: 954787 - RNA, 19 nt, Homo sapiens
gaacucagaugacuuugac

SEQ ID NO: 954788 - RNA, 19 nt, Homo sapiens
ggaagaugauccuccaaau

SEQ ID NO: 954789 - RNA, 19 nt, Homo sapiens
cgaacgagcuaucacagaa

SEQ ID NO: 954790 - RNA, 19 nt, Homo sapiens
gacaaaugcuuauguuuac

SEQ ID NO: 954791 - RNA, 19 nt, Homo sapiens
gaagaacucaagcgaagaa

SEQ ID NO: 954792 - RNA, 19 nt, Homo sapiens
gcauauaauuucagagaag

SEQ ID NO: 954793 - RNA, 19 nt, Homo sapiens
cguagucgccucucuguua

SEQ ID NO: 954794 - RNA, 19 nt, Homo sapiens
gaagaugauccuccaaaug

SEQ ID NO: 954795 - RNA, 19 nt, Homo sapiens
acguggagcuucuuauaua

SEQ ID NO: 954796 - RNA, 19 nt, Homo sapiens
cgacgucgcugaacuucug

SEQ ID NO: 954797 - RNA, 19 nt, Homo sapiens
gcugacagauaagauugua

SEQ ID NO: 954798 - RNA, 19 nt, Homo sapiens
gagaauuguucauggagau

SEQ ID NO: 954799 - RNA, 19 nt, Homo sapiens
gcaaucugacaaaugcuua

SEQ ID NO: 954800 - RNA, 19 nt, Homo sapiens
gcaagcagcgaacgagcua

SEQ ID NO: 954801 - RNA, 19 nt, Homo sapiens
gacuugaggcugacagaua

SEQ ID NO: 954802 - RNA, 19 nt, Homo sapiens
guagucgccucucuguuau

SEQ ID NO: 954803 - RNA, 19 nt, Homo sapiens
aaggaaagcuggcaaucug

SEQ ID NO: 954804 - RNA, 19 nt, Homo sapiens
acccacaacucuuugcaua

SEQ ID NO: 954805 - RNA, 19 nt, Homo sapiens
gaacuucuggugguugaaa

SEQ ID NO: 954806 - RNA, 19 nt, Homo sapiens
cgagaaaucauuaaguugu

SEQ ID NO: 954807 - RNA, 19 nt, Homo sapiens
gagccucugugauguauac

SEQ ID NO: 954808 - RNA, 19 nt, Homo sapiens
cuacguggagcuucuuaua

SEQ ID NO: 954809 - RNA, 19 nt, Homo sapiens
guauuucaguuccgaagga

SEQ ID NO: 954810 - RNA, 19 nt, Homo sapiens
gagauggaccuuuuguuua

SEQ ID NO: 954811 - RNA, 19 nt, Homo sapiens
gcgagcagccuaccagaug

SEQ ID NO: 954812 - RNA, 19 nt, Homo sapiens
aagaugauccuccaaaugu

SEQ ID NO: 954813 - RNA, 19 nt, Homo sapiens
gggaagaugauccuccaaa

SEQ ID NO: 954814 - RNA, 19 nt, Homo sapiens
acuugaggcugacagauaa

SEQ ID NO: 954815 - RNA, 19 nt, Homo sapiens
ccuaccagaugucgauuug

SEQ ID NO: 954816 - RNA, 19 nt, Homo sapiens
gacauagacccuacucuuc

SEQ ID NO: 954817 - RNA, 19 nt, Homo sapiens
ugauacagcccaagauaga

SEQ ID NO: 954818 - RNA, 19 nt, Homo sapiens
ucgauuuauuccuggauua

SEQ ID NO: 954819 - RNA, 19 nt, Homo sapiens
cuauacagcuuggcagaga

SEQ ID NO: 954820 - RNA, 19 nt, Homo sapiens
cacaacucuuugcauauaa

SEQ ID NO: 954821 - RNA, 19 nt, Homo sapiens
caagauagagcagccauuc

SEQ ID NO: 954822 - RNA, 19 nt, Homo sapiens
gauaagauuguaaggaaag

SEQ ID NO: 954823 - RNA, 19 nt, Homo sapiens
gaugaagacccacaacucu

SEQ ID NO: 954824 - RNA, 19 nt, Homo sapiens
gaacgagcuaucacagaau

SEQ ID NO: 954825 - RNA, 19 nt, Homo sapiens
aauauuuccuguagagaug

SEQ ID NO: 954826 - RNA, 19 nt, Homo sapiens
ccuccaaauguacauauua

SEQ ID NO: 954827 - RNA, 19 nt, Homo sapiens
cagaaugacgauacaaaug

SEQ ID NO: 954828 - RNA, 19 nt, Homo sapiens
agacauagacccuacucuu

SEQ ID NO: 954829 - RNA, 19 nt, Homo sapiens
gaagguccugggugaggua

SEQ ID NO: 954830 - RNA, 19 nt, Homo sapiens
agaugauccuccaaaugua

SEQ ID NO: 954831 - RNA, 19 nt, Homo sapiens
ggagcuucuuauauaggua

SEQ ID NO: 954832 - RNA, 19 nt, Homo sapiens
aggaugacgcagagaauua

SEQ ID NO: 954833 - RNA, 19 nt, Homo sapiens
gggaaucacaagaucuauu

SEQ ID NO: 954834 - RNA, 19 nt, Homo sapiens
ucugacaaaugcuuauguu

SEQ ID NO: 954835 - RNA, 19 nt, Homo sapiens
gcucaguaccucugcaaug

SEQ ID NO: 954836 - RNA, 19 nt, Homo sapiens
agaauuuccuccuggacuu

SEQ ID NO: 954837 - RNA, 19 nt, Homo sapiens
gaggaugacgcagagaauu

SEQ ID NO: 954838 - RNA, 19 nt, Homo sapiens
caguaccucugcaauguuc

SEQ ID NO: 954839 - RNA, 19 nt, Homo sapiens
aaacugagaauuguucaug

SEQ ID NO: 954840 - RNA, 19 nt, Homo sapiens
caucgagggcucagaaugu

SEQ ID NO: 954841 - RNA, 19 nt, Homo sapiens
uguuucaacuccacugauu

SEQ ID NO: 954842 - RNA, 19 nt, Homo sapiens
gggaaacugagaauuguuc

SEQ ID NO: 954843 - RNA, 19 nt, Homo sapiens
gcacgggcaggcuguuaga

SEQ ID NO: 954844 - RNA, 19 nt, Homo sapiens
aacgagcuaucacagaauu

SEQ ID NO: 954845 - RNA, 19 nt, Homo sapiens
gauggugcuugccgcguau

SEQ ID NO: 954846 - RNA, 19 nt, Homo sapiens
gaggcugacagauaagauu

SEQ ID NO: 954847 - RNA, 19 nt, Homo sapiens
uagguacucuuuugucuuu

SEQ ID NO: 954848 - RNA, 19 nt, Homo sapiens
cgggcaggcuguuagaguu

SEQ ID NO: 954849 - RNA, 19 nt, Homo sapiens
agagagacuugcagccaau

SEQ ID NO: 954850 - RNA, 19 nt, Homo sapiens
ccugggaaacugagaauug

SEQ ID NO: 954851 - RNA, 19 nt, Homo sapiens
ucucuguuauggcucagua

SEQ ID NO: 954852 - RNA, 19 nt, Homo sapiens
ggaaaucugccuuuuagug

SEQ ID NO: 954853 - RNA, 19 nt, Homo sapiens
ggaagcaaacagcguaguc

SEQ ID NO: 954854 - RNA, 19 nt, Homo sapiens
agauagagcagccauucaa

SEQ ID NO: 954855 - RNA, 19 nt, Homo sapiens
guucgacacaucuuuacaa

SEQ ID NO: 954856 - RNA, 19 nt, Homo sapiens
ucagaugacuuugacuuuu

SEQ ID NO: 954857 - RNA, 19 nt, Homo sapiens
gaaaucugccuuuuagugu

SEQ ID NO: 954858 - RNA, 19 nt, Homo sapiens
ugacagauaagauuguaag

SEQ ID NO: 954859 - RNA, 19 nt, Homo sapiens
ccaaugaccagaugugacu

SEQ ID NO: 954860 - RNA, 19 nt, Homo sapiens
cgagcagccuaccagaugu

SEQ ID NO: 954861 - RNA, 19 nt, Homo sapiens
gcgaacgagcuaucacaga

SEQ ID NO: 954862 - RNA, 19 nt, Homo sapiens
gcaccugggaaacugagaa

SEQ ID NO: 954863 - RNA, 19 nt, Homo sapiens
caaaugcuuauguuuacga

SEQ ID NO: 954864 - RNA, 19 nt, Homo sapiens
caaaugccaaugaccagau

SEQ ID NO: 954865 - RNA, 19 nt, Homo sapiens
gaaagcuggcaaucugaca

SEQ ID NO: 954866 - RNA, 19 nt, Homo sapiens
gcucuccaucucacacuuu

SEQ ID NO: 954867 - RNA, 19 nt, Homo sapiens
cauucaagcugguggaaaa

SEQ ID NO: 954868 - RNA, 19 nt, Homo sapiens
gagagacuugcagccaaua

SEQ ID NO: 954869 - RNA, 19 nt, Homo sapiens
guuuauggcagaacucaga

SEQ ID NO: 954870 - RNA, 19 nt, Homo sapiens
uacagaaugacgauacaaa

SEQ ID NO: 954871 - RNA, 19 nt, Homo sapiens
cguggagcuucuuauauag

SEQ ID NO: 954872 - RNA, 19 nt, Homo sapiens
cgagggcucagaauguuau

SEQ ID NO: 954873 - RNA, 19 nt, Homo sapiens
cucaguaccucugcaaugu

SEQ ID NO: 954874 - RNA, 19 nt, Homo sapiens
aaaggaaguggcagagaga

SEQ ID NO: 954875 - RNA, 19 nt, Homo sapiens
uggcagaacucagaugacu

SEQ ID NO: 954876 - RNA, 19 nt, Homo sapiens
agauggaccuuuuguuuau

SEQ ID NO: 954877 - RNA, 19 nt, Homo sapiens
ggaaacugagaauuguuca

SEQ ID NO: 954878 - RNA, 19 nt, Homo sapiens
aaaugccaaugaccagaug

SEQ ID NO: 954879 - RNA, 19 nt, Homo sapiens
ggaaggaagugcauguuug

SEQ ID NO: 954880 - RNA, 19 nt, Homo sapiens
cagcgcagcucuuguguaa

SEQ ID NO: 954881 - RNA, 19 nt, Homo sapiens
ggaguuguguucuuugaug

SEQ ID NO: 954882 - RNA, 19 nt, Homo sapiens
ggagggaggagguauauug

SEQ ID NO: 954883 - RNA, 19 nt, Homo sapiens
ggaccuaguuuagccauug

SEQ ID NO: 954884 - RNA, 19 nt, Homo sapiens
gggaggagguauauuggaa

SEQ ID NO: 954885 - RNA, 19 nt, Homo sapiens
ggacugaucgccugacaga

SEQ ID NO: 954886 - RNA, 19 nt, Homo sapiens
agacuaccaugacaucgua

SEQ ID NO: 954887 - RNA, 19 nt, Homo sapiens
gcgcagcucuuguguaagg

SEQ ID NO: 954888 - RNA, 19 nt, Homo sapiens
gccauuauccugcuccaua

SEQ ID NO: 954889 - RNA, 19 nt, Homo sapiens
aguggugucuucucuguua

SEQ ID NO: 954890 - RNA, 19 nt, Homo sapiens
gcggggagguuuucuauaa

SEQ ID NO: 954891 - RNA, 19 nt, Homo sapiens
ggaacuggcauuacuggaa

SEQ ID NO: 954892 - RNA, 19 nt, Homo sapiens
gaacucuucuaaccuccuu

SEQ ID NO: 954893 - RNA, 19 nt, Homo sapiens
uaauggaggcucaaggaua

SEQ ID NO: 954894 - RNA, 19 nt, Homo sapiens
ccucauggcugggcucauu

SEQ ID NO: 954895 - RNA, 19 nt, Homo sapiens
uagaugagcucugaguuuc

SEQ ID NO: 954896 - RNA, 19 nt, Homo sapiens
gaaggcagaugagggguua

SEQ ID NO: 954897 - RNA, 19 nt, Homo sapiens
ggagguauauuggaacucu

SEQ ID NO: 954898 - RNA, 19 nt, Homo sapiens
uaucaucaguggugucuuc

SEQ ID NO: 954899 - RNA, 19 nt, Homo sapiens
aaggauagaugagcucuga

SEQ ID NO: 954900 - RNA, 19 nt, Homo sapiens
ggguuugaaucugcacuua

SEQ ID NO: 954901 - RNA, 19 nt, Homo sapiens
cauggagacucacccuauu

SEQ ID NO: 954902 - RNA, 19 nt, Homo sapiens
ugucuucucuguuaucaau

SEQ ID NO: 954903 - RNA, 19 nt, Homo sapiens
ccauugcccuggagaugaa

SEQ ID NO: 954904 - RNA, 19 nt, Homo sapiens
gaaaagggaccuaguuuag

SEQ ID NO: 954905 - RNA, 19 nt, Homo sapiens
cuacugacaucgggacuga

SEQ ID NO: 954906 - RNA, 19 nt, Homo sapiens
gagacucacccuauuacuu

SEQ ID NO: 954907 - RNA, 19 nt, Homo sapiens
gaaggaagugcauguuugg

SEQ ID NO: 954908 - RNA, 19 nt, Homo sapiens
ccagauggccuauguuucu

SEQ ID NO: 954909 - RNA, 19 nt, Homo sapiens
guuugaaucugcacuuauc

SEQ ID NO: 954910 - RNA, 19 nt, Homo sapiens
aauggaggcucaaggauag

SEQ ID NO: 954911 - RNA, 19 nt, Homo sapiens
ccuauuacuuccugacuuc

SEQ ID NO: 954912 - RNA, 19 nt, Homo sapiens
cagugcagguugccaagaa

SEQ ID NO: 954913 - RNA, 19 nt, Homo sapiens
ggaggacagucgggugaug

SEQ ID NO: 954914 - RNA, 19 nt, Homo sapiens
cccacuaccuccaggguuu

SEQ ID NO: 954915 - RNA, 19 nt, Homo sapiens
gcucugggccuucaucaca

SEQ ID NO: 954916 - RNA, 19 nt, Homo sapiens
caggagguguuccgcuuug

SEQ ID NO: 954917 - RNA, 19 nt, Homo sapiens
ucucaguacucccucaaga

SEQ ID NO: 954918 - RNA, 19 nt, Homo sapiens
caucaguggugucuucucu

SEQ ID NO: 954919 - RNA, 19 nt, Homo sapiens
ccaguacggccuccugauu

SEQ ID NO: 954920 - RNA, 19 nt, Homo sapiens
agacucacccuauuacuuc

SEQ ID NO: 954921 - RNA, 19 nt, Homo sapiens
ucaguggugucuucucugu

SEQ ID NO: 954922 - RNA, 19 nt, Homo sapiens
ucaaggugauugugauuuu

SEQ ID NO: 954923 - RNA, 19 nt, Homo sapiens
gaugagcucugaguuucuc

SEQ ID NO: 954924 - RNA, 19 nt, Homo sapiens
gcucucacccugcccaaga

SEQ ID NO: 954925 - RNA, 19 nt, Homo sapiens
gcucuuguguaaggacuga

SEQ ID NO: 954926 - RNA, 19 nt, Homo sapiens
caguacggccuccugauuu

SEQ ID NO: 954927 - RNA, 19 nt, Homo sapiens
uaaccuccuugggcuauau

SEQ ID NO: 954928 - RNA, 19 nt, Homo sapiens
uuacuggaacuaaugguuu

SEQ ID NO: 954929 - RNA, 19 nt, Homo sapiens
ggaaaggaaggaagugcau

SEQ ID NO: 954930 - RNA, 19 nt, Homo sapiens
gaggagguauauuggaacu

SEQ ID NO: 954931 - RNA, 19 nt, Homo sapiens
acagucgggugauggugua

SEQ ID NO: 954932 - RNA, 19 nt, Homo sapiens
ugacaucgggacugacauu

SEQ ID NO: 954933 - RNA, 19 nt, Homo sapiens
gauagaugagcucugaguu

SEQ ID NO: 954934 - RNA, 19 nt, Homo sapiens
ggauagaugagcucugagu

SEQ ID NO: 954935 - RNA, 19 nt, Homo sapiens
gguggagugucccauccuu

SEQ ID NO: 954936 - RNA, 19 nt, Homo sapiens
ugauaaauacccuaaacug

SEQ ID NO: 954937 - RNA, 19 nt, Homo sapiens
auagaugagcucugaguuu

SEQ ID NO: 954938 - RNA, 19 nt, Homo sapiens
gaaauuaauggaggcucaa

SEQ ID NO: 954939 - RNA, 19 nt, Homo sapiens
ccauggagacucacccuau

SEQ ID NO: 954940 - RNA, 19 nt, Homo sapiens
ggugugauaaauacccuaa

SEQ ID NO: 954941 - RNA, 19 nt, Homo sapiens
gcccuggagaugaaauuaa

SEQ ID NO: 954942 - RNA, 19 nt, Homo sapiens
cccuggagaugaaauuaau

SEQ ID NO: 954943 - RNA, 19 nt, Homo sapiens
ggucucuccuucgguauca

SEQ ID NO: 954944 - RNA, 19 nt, Homo sapiens
ugugauaaauacccuaaac

SEQ ID NO: 954945 - RNA, 19 nt, Homo sapiens
gacuggacaucuuggucuu

SEQ ID NO: 954946 - RNA, 19 nt, Homo sapiens
gagugaggacggaagauca

SEQ ID NO: 954947 - RNA, 19 nt, Homo sapiens
ugucagugcucugcucuca

SEQ ID NO: 954948 - RNA, 19 nt, Homo sapiens
gcccaucuaugcagucacu

SEQ ID NO: 954949 - RNA, 19 nt, Homo sapiens
ggguucagccagucaguga

SEQ ID NO: 954950 - RNA, 19 nt, Homo sapiens
cugacuaccuggacugauc

SEQ ID NO: 954951 - RNA, 19 nt, Homo sapiens
ggugucuucucuguuauca

SEQ ID NO: 954952 - RNA, 19 nt, Homo sapiens
ccauuauccugcuccauac

SEQ ID NO: 954953 - RNA, 19 nt, Homo sapiens
ugggauccauggagacuca

SEQ ID NO: 954954 - RNA, 19 nt, Homo sapiens
ggagugucccauccuuuua

SEQ ID NO: 954955 - RNA, 19 nt, Homo sapiens
gggacccgcuucgcguuau

SEQ ID NO: 954956 - RNA, 19 nt, Homo sapiens
caagaaaagggaccuaguu

SEQ ID NO: 954957 - RNA, 19 nt, Homo sapiens
ggacccgcuucgcguuauc

SEQ ID NO: 954958 - RNA, 19 nt, Homo sapiens
agaaaagggaccuaguuua

SEQ ID NO: 954959 - RNA, 19 nt, Homo sapiens
guauucagcgcagcucuug

SEQ ID NO: 954960 - RNA, 19 nt, Homo sapiens
aaaggaaggaagugcaugu

SEQ ID NO: 954961 - RNA, 19 nt, Homo sapiens
gagguauauuggaacucuu

SEQ ID NO: 954962 - RNA, 19 nt, Homo sapiens
gaggcucaaggauagauga

SEQ ID NO: 954963 - RNA, 19 nt, Homo sapiens
cugauguccucgcccugua

SEQ ID NO: 954964 - RNA, 19 nt, Homo sapiens
gucgggugaugguguauuc

SEQ ID NO: 954965 - RNA, 19 nt, Homo sapiens
gcucauuucggucccuuuc

SEQ ID NO: 954966 - RNA, 19 nt, Homo sapiens
gccauugcccuggagauga

SEQ ID NO: 954967 - RNA, 19 nt, Homo sapiens
gauguccucgcccuguauu

SEQ ID NO: 954968 - RNA, 19 nt, Homo sapiens
aggaaggaagugcauguuu

SEQ ID NO: 954969 - RNA, 19 nt, Homo sapiens
uauuggaacucuucuaacc

SEQ ID NO: 954970 - RNA, 19 nt, Homo sapiens
gagggaggagguauauugg

SEQ ID NO: 954971 - RNA, 19 nt, Homo sapiens
gguugggagucaccuacug

SEQ ID NO: 954972 - RNA, 19 nt, Homo sapiens
ucuguggucugguucaucu

SEQ ID NO: 954973 - RNA, 19 nt, Homo sapiens
guauauuggaacucuucua

SEQ ID NO: 954974 - RNA, 19 nt, Homo sapiens
gggaccuaguuuagccauu

SEQ ID NO: 954975 - RNA, 19 nt, Homo sapiens
guccacugcccaugacuga

SEQ ID NO: 954976 - RNA, 19 nt, Homo sapiens
caucgggacugacauuccu

SEQ ID NO: 954977 - RNA, 19 nt, Homo sapiens
cuaaccuccuugggcuaua

SEQ ID NO: 954978 - RNA, 19 nt, Homo sapiens
gguuagcaucgcugaguga

SEQ ID NO: 954979 - RNA, 19 nt, Homo sapiens
gaacacagaucuucuuaaa

SEQ ID NO: 954980 - RNA, 19 nt, Homo sapiens
ccacagacuucuugauuua

SEQ ID NO: 954981 - RNA, 19 nt, Homo sapiens
ggaagaggcucaauguuug

SEQ ID NO: 954982 - RNA, 19 nt, Homo sapiens
caauaaagcuguccauuca

SEQ ID NO: 954983 - RNA, 19 nt, Homo sapiens
gagaaaccaucagaaauuu

SEQ ID NO: 954984 - RNA, 19 nt, Homo sapiens
ggagaaaccaucagaaauu

SEQ ID NO: 954985 - RNA, 19 nt, Homo sapiens
gaauaugguuugaugaaga

SEQ ID NO: 954986 - RNA, 19 nt, Homo sapiens
acacagaucuucuuaaaca

SEQ ID NO: 954987 - RNA, 19 nt, Homo sapiens
ccaaagagcagagcauuua

SEQ ID NO: 954988 - RNA, 19 nt, Homo sapiens
gcaggucacacuccaauua

SEQ ID NO: 954989 - RNA, 19 nt, Homo sapiens
caauaaagcugccuugucu

SEQ ID NO: 954990 - RNA, 19 nt, Homo sapiens
ggaccgccauucuaaauau

SEQ ID NO: 954991 - RNA, 19 nt, Homo sapiens
ccaagaauaugguuugaug

SEQ ID NO: 954992 - RNA, 19 nt, Homo sapiens
ccacugauauucuuucaug

SEQ ID NO: 954993 - RNA, 19 nt, Homo sapiens
ggaugacgcugucuuuguu

SEQ ID NO: 954994 - RNA, 19 nt, Homo sapiens
ccaaauaguagcauuauga

SEQ ID NO: 954995 - RNA, 19 nt, Homo sapiens
ucaaguaagugaaguacaa

SEQ ID NO: 954996 - RNA, 19 nt, Homo sapiens
uaucaacucuuuacucaga

SEQ ID NO: 954997 - RNA, 19 nt, Homo sapiens
ggacagaacugggaagaac

SEQ ID NO: 954998 - RNA, 19 nt, Homo sapiens
ccaauaucuuccacuguua

SEQ ID NO: 954999 - RNA, 19 nt, Homo sapiens
gcaauaaagcuguccauuc

SEQ ID NO: 955000 - RNA, 19 nt, Homo sapiens
gaaaccaaauccacucaca

SEQ ID NO: 955001 - RNA, 19 nt, Homo sapiens
cauaauaagaguuggguua

SEQ ID NO: 955002 - RNA, 19 nt, Homo sapiens
caauaaccaucguggauau

SEQ ID NO: 955003 - RNA, 19 nt, Homo sapiens
acaaauacuuagcaccaua

SEQ ID NO: 955004 - RNA, 19 nt, Homo sapiens
ccagguguuucauuaagua

SEQ ID NO: 955005 - RNA, 19 nt, Homo sapiens
gaaugacgcagacaauuug

SEQ ID NO: 955006 - RNA, 19 nt, Homo sapiens
gugagugccuccaaccaua

SEQ ID NO: 955007 - RNA, 19 nt, Homo sapiens
ucauccagguguuucauua

SEQ ID NO: 955008 - RNA, 19 nt, Homo sapiens
gggagauuauugcaaauug

SEQ ID NO: 955009 - RNA, 19 nt, Homo sapiens
gaacugggaagaacaagug

SEQ ID NO: 955010 - RNA, 19 nt, Homo sapiens
aaucugaaguucucugaaa

SEQ ID NO: 955011 - RNA, 19 nt, Homo sapiens
gcucuucccugaaauccuu

SEQ ID NO: 955012 - RNA, 19 nt, Homo sapiens
agaguuggguuaugugauu

SEQ ID NO: 955013 - RNA, 19 nt, Homo sapiens
gcucauagaagucaucaga

SEQ ID NO: 955014 - RNA, 19 nt, Homo sapiens
uaagguauagccacugaua

SEQ ID NO: 955015 - RNA, 19 nt, Homo sapiens
ggaagagggucuguguuca

SEQ ID NO: 955016 - RNA, 19 nt, Homo sapiens
gucaucagaucaacacauu

SEQ ID NO: 955017 - RNA, 19 nt, Homo sapiens
gaaggcgacauguauaaug

SEQ ID NO: 955018 - RNA, 19 nt, Homo sapiens
ugaauagucugccugaagu

SEQ ID NO: 955019 - RNA, 19 nt, Homo sapiens
ccuaucgggucuugaaauu

SEQ ID NO: 955020 - RNA, 19 nt, Homo sapiens
agagagaaauuaugcgaau

SEQ ID NO: 955021 - RNA, 19 nt, Homo sapiens
cagaaaugcugccauagag

SEQ ID NO: 955022 - RNA, 19 nt, Homo sapiens
aagcagaagugauggaugu

SEQ ID NO: 955023 - RNA, 19 nt, Homo sapiens
gguauaaaggcgaauuaaa

SEQ ID NO: 955024 - RNA, 19 nt, Homo sapiens
cuucaggaguacccaaaua

SEQ ID NO: 955025 - RNA, 19 nt, Homo sapiens
gaagaacaagugaauaguc

SEQ ID NO: 955026 - RNA, 19 nt, Homo sapiens
caacagagagaaauuaugc

SEQ ID NO: 955027 - RNA, 19 nt, Homo sapiens
gcuuggcucuucccugaaa

SEQ ID NO: 955028 - RNA, 19 nt, Homo sapiens
ggacucauucccagacaaa

SEQ ID NO: 955029 - RNA, 19 nt, Homo sapiens
ccaauuaugauggaagaua

SEQ ID NO: 955030 - RNA, 19 nt, Homo sapiens
ggucacacuccaauuauga

SEQ ID NO: 955031 - RNA, 19 nt, Homo sapiens
cgacauguauaaugacuac

SEQ ID NO: 955032 - RNA, 19 nt, Homo sapiens
gggaagaacaagugaauag

SEQ ID NO: 955033 - RNA, 19 nt, Homo sapiens
auacuuagcaccauagauu

SEQ ID NO: 955034 - RNA, 19 nt, Homo sapiens
agaaugacgcagacaauuu

SEQ ID NO: 955035 - RNA, 19 nt, Homo sapiens
aggaagaggcucaauguuu

SEQ ID NO: 955036 - RNA, 19 nt, Homo sapiens
agaaagaggaaaugagaaa

SEQ ID NO: 955037 - RNA, 19 nt, Homo sapiens
gcagucauaauaagaguug

SEQ ID NO: 955038 - RNA, 19 nt, Homo sapiens
ucauagaagucaucagauc

SEQ ID NO: 955039 - RNA, 19 nt, Homo sapiens
gguguuucauuaaguauuc

SEQ ID NO: 955040 - RNA, 19 nt, Homo sapiens
gagaaugacgcagacaauu

SEQ ID NO: 955041 - RNA, 19 nt, Homo sapiens
ccagaaaugcugccauaga

SEQ ID NO: 955042 - RNA, 19 nt, Homo sapiens
cagaagugauggauguuca

SEQ ID NO: 955043 - RNA, 19 nt, Homo sapiens
guuagacugucaagcagaa

SEQ ID NO: 955044 - RNA, 19 nt, Homo sapiens
gaggaaaugagaaaacuua

SEQ ID NO: 955045 - RNA, 19 nt, Homo sapiens
ggaacacagaucuucuuaa

SEQ ID NO: 955046 - RNA, 19 nt, Homo sapiens
caaagagcagagcauuuaa

SEQ ID NO: 955047 - RNA, 19 nt, Homo sapiens
guacccaaauaguagcauu

SEQ ID NO: 955048 - RNA, 19 nt, Homo sapiens
caggaguacccaaauagua

SEQ ID NO: 955049 - RNA, 19 nt, Homo sapiens
uuugaagacuggcaauaaa

SEQ ID NO: 955050 - RNA, 19 nt, Homo sapiens
guucagaguuaccuugauc

SEQ ID NO: 955051 - RNA, 19 nt, Homo sapiens
aaacaacagcauugagaaa

SEQ ID NO: 955052 - RNA, 19 nt, Homo sapiens
acagaaaugucaauaugag

SEQ ID NO: 955053 - RNA, 19 nt, Homo sapiens
ucaauaaccaucguggaua

SEQ ID NO: 955054 - RNA, 19 nt, Homo sapiens
gaggaacccauuagcaaga

SEQ ID NO: 955055 - RNA, 19 nt, Homo sapiens
auaaagcuguccauucaau

SEQ ID NO: 955056 - RNA, 19 nt, Homo sapiens
aaggcgacauguauaauga

SEQ ID NO: 955057 - RNA, 19 nt, Homo sapiens
gugaaggcgacauguauaa

SEQ ID NO: 955058 - RNA, 19 nt, Homo sapiens
cagaguccuugguauaaau

SEQ ID NO: 955059 - RNA, 19 nt, Homo sapiens
cccacagacuucuugauuu

SEQ ID NO: 955060 - RNA, 19 nt, Homo sapiens
ccacucacauuuccuaucg

SEQ ID NO: 955061 - RNA, 19 nt, Homo sapiens
gugcaacagagagaaauua

SEQ ID NO: 955062 - RNA, 19 nt, Homo sapiens
acccagaaaugcugccaua

SEQ ID NO: 955063 - RNA, 19 nt, Homo sapiens
ugguuuggcuucaggagua

SEQ ID NO: 955064 - RNA, 19 nt, Homo sapiens
gggagaaaccaucagaaau

SEQ ID NO: 955065 - RNA, 19 nt, Homo sapiens
gauauggcagcuucagaaa

SEQ ID NO: 955066 - RNA, 19 nt, Homo sapiens
uaucgggucuugaaauucu

SEQ ID NO: 955067 - RNA, 19 nt, Homo sapiens
accaauaucuuccacuguu

SEQ ID NO: 955068 - RNA, 19 nt, Homo sapiens
ccacauccucacaccaaua

SEQ ID NO: 955069 - RNA, 19 nt, Homo sapiens
cccauuagcaagaucaaua

SEQ ID NO: 955070 - RNA, 19 nt, Homo sapiens
aaacccagccucauucaga

SEQ ID NO: 955071 - RNA, 19 nt, Homo sapiens
ugauuuaggugcuggagau

SEQ ID NO: 955072 - RNA, 19 nt, Homo sapiens
caucagaucaacacauuca

SEQ ID NO: 955073 - RNA, 19 nt, Homo sapiens
uauguuauccucacuacuu

SEQ ID NO: 955074 - RNA, 19 nt, Homo sapiens
uauagccacugauauucuu

SEQ ID NO: 955075 - RNA, 19 nt, Homo sapiens
aaagauaucagaagugucu

SEQ ID NO: 955076 - RNA, 19 nt, Homo sapiens
uaaacaacagcauugagaa

SEQ ID NO: 955077 - RNA, 19 nt, Homo sapiens
caacagcauugagaaaucg

SEQ ID NO: 955078 - RNA, 19 nt, Homo sapiens
acagaguccuugguauaaa

SEQ ID NO: 955079 - RNA, 19 nt, Homo sapiens
ggacugauauugguaauua

SEQ ID NO: 955080 - RNA, 19 nt, Homo sapiens
gagaggagcucgaguauau

SEQ ID NO: 955081 - RNA, 19 nt, Homo sapiens
ggagaauacuggaagauaa

SEQ ID NO: 955082 - RNA, 19 nt, Homo sapiens
gaagacagcagauggcuuu

SEQ ID NO: 955083 - RNA, 19 nt, Homo sapiens
caaaggaagucuaaggaau

SEQ ID NO: 955084 - RNA, 19 nt, Homo sapiens
caaaugaaaugcugcaaag

SEQ ID NO: 955085 - RNA, 19 nt, Homo sapiens
uaagaagacccucauauga

SEQ ID NO: 955086 - RNA, 19 nt, Homo sapiens
gaaggagaauacuggaaga

SEQ ID NO: 955087 - RNA, 19 nt, Homo sapiens
caucaaggauaguaaaugu

SEQ ID NO: 955088 - RNA, 19 nt, Homo sapiens
ggaaggagacagccaaaga

SEQ ID NO: 955089 - RNA, 19 nt, Homo sapiens
aaacuggaccugucugaua

SEQ ID NO: 955090 - RNA, 19 nt, Homo sapiens
gcacuuguuuugaccauua

SEQ ID NO: 955091 - RNA, 19 nt, Homo sapiens
caaccagucuucacuucaa

SEQ ID NO: 955092 - RNA, 19 nt, Homo sapiens
ugaaagaaacuacuaccua

SEQ ID NO: 955093 - RNA, 19 nt, Homo sapiens
gauaagaagacccucauau

SEQ ID NO: 955094 - RNA, 19 nt, Homo sapiens
aaggaagucuaaggaauua

SEQ ID NO: 955095 - RNA, 19 nt, Homo sapiens
cugaugaggucuuaacaaa

SEQ ID NO: 955096 - RNA, 19 nt, Homo sapiens
aggauuaacuagcccuuua

SEQ ID NO: 955097 - RNA, 19 nt, Homo sapiens
ggaccacagucuucacuuc

SEQ ID NO: 955098 - RNA, 19 nt, Homo sapiens
gcaaaugaaaugcugcaaa

SEQ ID NO: 955099 - RNA, 19 nt, Homo sapiens
ccagugccauccagucuuu

SEQ ID NO: 955100 - RNA, 19 nt, Homo sapiens
gaggagcucgaguauauuu

SEQ ID NO: 955101 - RNA, 19 nt, Homo sapiens
gaaaagcaccuccacguuu

SEQ ID NO: 955102 - RNA, 19 nt, Homo sapiens
ggaccugucugauacuaag

SEQ ID NO: 955103 - RNA, 19 nt, Homo sapiens
ugaagggacuaguuaagga

SEQ ID NO: 955104 - RNA, 19 nt, Homo sapiens
cauccagucuuuaugcaaa

SEQ ID NO: 955105 - RNA, 19 nt, Homo sapiens
ggaggucaguaguucaaga

SEQ ID NO: 955106 - RNA, 19 nt, Homo sapiens
aacagaaggucuugagauu

SEQ ID NO: 955107 - RNA, 19 nt, Homo sapiens
gcacaucaccugggaagga

SEQ ID NO: 955108 - RNA, 19 nt, Homo sapiens
uagagaaacuaaaggaauc

SEQ ID NO: 955109 - RNA, 19 nt, Homo sapiens
uaacccaucugcugcuaga

SEQ ID NO: 955110 - RNA, 19 nt, Homo sapiens
caacaaugcaggagugaug

SEQ ID NO: 955111 - RNA, 19 nt, Homo sapiens
ccacagucuucacuucuga

SEQ ID NO: 955112 - RNA, 19 nt, Homo sapiens
guucggcacucaucuuuca

SEQ ID NO: 955113 - RNA, 19 nt, Homo sapiens
ggagugugcuauucuaaaa

SEQ ID NO: 955114 - RNA, 19 nt, Homo sapiens
cacaguacuucuugucaaa

SEQ ID NO: 955115 - RNA, 19 nt, Homo sapiens
aaaggaagucuaaggaauu

SEQ ID NO: 955116 - RNA, 19 nt, Homo sapiens
aaccucagcuuaacaugaa

SEQ ID NO: 955117 - RNA, 19 nt, Homo sapiens
uagcagggaugauuuaugc

SEQ ID NO: 955118 - RNA, 19 nt, Homo sapiens
uaaaaugucugugccaaaa

SEQ ID NO: 955119 - RNA, 19 nt, Homo sapiens
ucagagaggagcucgagua

SEQ ID NO: 955120 - RNA, 19 nt, Homo sapiens
gagaauacuggaagauaau

SEQ ID NO: 955121 - RNA, 19 nt, Homo sapiens
gcaaagggaagcagauucu

SEQ ID NO: 955122 - RNA, 19 nt, Homo sapiens
cuagagauaucauaauagg

SEQ ID NO: 955123 - RNA, 19 nt, Homo sapiens
cuaaaaggcucuggcguua

SEQ ID NO: 955124 - RNA, 19 nt, Homo sapiens
aaucagagauggagcaaac

SEQ ID NO: 955125 - RNA, 19 nt, Homo sapiens
cagcuuaacaugaauaaca

SEQ ID NO: 955126 - RNA, 19 nt, Homo sapiens
caaccucagcuuaacauga

SEQ ID NO: 955127 - RNA, 19 nt, Homo sapiens
gaaggucuugagauucuaa

SEQ ID NO: 955128 - RNA, 19 nt, Homo sapiens
ucacuucugauacuuguaa

SEQ ID NO: 955129 - RNA, 19 nt, Homo sapiens
ggauaagaagacccucaua

SEQ ID NO: 955130 - RNA, 19 nt, Homo sapiens
uaacagaaggucuugagau

SEQ ID NO: 955131 - RNA, 19 nt, Homo sapiens
cuaagucuauucgagcuuu

SEQ ID NO: 955132 - RNA, 19 nt, Homo sapiens
caggacugaugaggucuua

SEQ ID NO: 955133 - RNA, 19 nt, Homo sapiens
caagagggccacacugcaa

SEQ ID NO: 955134 - RNA, 19 nt, Homo sapiens
acacaguacuucuugucaa

SEQ ID NO: 955135 - RNA, 19 nt, Homo sapiens
ggaaacuggaccugucuga

SEQ ID NO: 955136 - RNA, 19 nt, Homo sapiens
acacugcaaccucagcuua

SEQ ID NO: 955137 - RNA, 19 nt, Homo sapiens
cagggaugauuuaugcaaa

SEQ ID NO: 955138 - RNA, 19 nt, Homo sapiens
gcagggaugauuuaugcaa

SEQ ID NO: 955139 - RNA, 19 nt, Homo sapiens
gcuauagcagggaugauuu

SEQ ID NO: 955140 - RNA, 19 nt, Homo sapiens
agauggaugugguggcuuu

SEQ ID NO: 955141 - RNA, 19 nt, Homo sapiens
gcucgaguauauuuagcuu

SEQ ID NO: 955142 - RNA, 19 nt, Homo sapiens
ccaaaggaagucuaaggaa

SEQ ID NO: 955143 - RNA, 19 nt, Homo sapiens
gcccaggcaugguggauca

SEQ ID NO: 955144 - RNA, 19 nt, Homo sapiens
gaaggagacagccaaagag

SEQ ID NO: 955145 - RNA, 19 nt, Homo sapiens
gcagcagacuacacaguac

SEQ ID NO: 955146 - RNA, 19 nt, Homo sapiens
gggcauuuccuuacauugu

SEQ ID NO: 955147 - RNA, 19 nt, Homo sapiens
uaggagaaucuaagcuaua

SEQ ID NO: 955148 - RNA, 19 nt, Homo sapiens
cuaggagaaucuaagcuau

SEQ ID NO: 955149 - RNA, 19 nt, Homo sapiens
gacagcagauggcuuugag

SEQ ID NO: 955150 - RNA, 19 nt, Homo sapiens
uacaucaacuguucagcuu

SEQ ID NO: 955151 - RNA, 19 nt, Homo sapiens
gagaaucuaagcuauagca

SEQ ID NO: 955152 - RNA, 19 nt, Homo sapiens
aaacuacuaccuaggagaa

SEQ ID NO: 955153 - RNA, 19 nt, Homo sapiens
aguccaaucugaacugguu

SEQ ID NO: 955154 - RNA, 19 nt, Homo sapiens
caaaacagccacaauaauc

SEQ ID NO: 955155 - RNA, 19 nt, Homo sapiens
ccugcuugguguccaguua

SEQ ID NO: 955156 - RNA, 19 nt, Homo sapiens
gugggaaucauuucaguga

SEQ ID NO: 955157 - RNA, 19 nt, Homo sapiens
ugucuucccucgcacauca

SEQ ID NO: 955158 - RNA, 19 nt, Homo sapiens
ucaaggauaguaaaugugu

SEQ ID NO: 955159 - RNA, 19 nt, Homo sapiens
caaaaguaaugcugccaaa

SEQ ID NO: 955160 - RNA, 19 nt, Homo sapiens
uuggagacuucuuaucaaa

SEQ ID NO: 955161 - RNA, 19 nt, Homo sapiens
gaagggacuaguuaaggau

SEQ ID NO: 955162 - RNA, 19 nt, Homo sapiens
aaaaugaagggacuaguua

SEQ ID NO: 955163 - RNA, 19 nt, Homo sapiens
cuauagcagggaugauuua

SEQ ID NO: 955164 - RNA, 19 nt, Homo sapiens
auaagaagacccucauaug

SEQ ID NO: 955165 - RNA, 19 nt, Homo sapiens
cauaauaggauaagaagac

SEQ ID NO: 955166 - RNA, 19 nt, Homo sapiens
guguguacaucaacuguuc

SEQ ID NO: 955167 - RNA, 19 nt, Homo sapiens
gcuuugagaugcacauagg

SEQ ID NO: 955168 - RNA, 19 nt, Homo sapiens
cugauaauagugcagaaua

SEQ ID NO: 955169 - RNA, 19 nt, Homo sapiens
guucaaaacagccacaaua

SEQ ID NO: 955170 - RNA, 19 nt, Homo sapiens
uugugugucuuccuguuua

SEQ ID NO: 955171 - RNA, 19 nt, Homo sapiens
ccuaggagaaucuaagcua

SEQ ID NO: 955172 - RNA, 19 nt, Homo sapiens
gauuuacuuugcuucuguu

SEQ ID NO: 955173 - RNA, 19 nt, Homo sapiens
gggaaucauuucagugacu

SEQ ID NO: 955174 - RNA, 19 nt, Homo sapiens
aaguaaugcugccaaagga

SEQ ID NO: 955175 - RNA, 19 nt, Homo sapiens
ggacugaugaggucuuaac

SEQ ID NO: 955176 - RNA, 19 nt, Homo sapiens
gagaaggagaauacuggaa

SEQ ID NO: 955177 - RNA, 19 nt, Homo sapiens
caccggaggucaguaguuc

SEQ ID NO: 955178 - RNA, 19 nt, Homo sapiens
uuacuuugcuucuguuacu

SEQ ID NO: 955179 - RNA, 19 nt, Homo sapiens
ucacauggcucuacucuua

SEQ ID NO: 955180 - RNA, 19 nt, Homo sapiens
gaacaacgguauuugaaga

SEQ ID NO: 955181 - RNA, 19 nt, Homo sapiens
gcagcaaauucuuacauua

SEQ ID NO: 955182 - RNA, 19 nt, Homo sapiens
uugaagaccucuaugauua

SEQ ID NO: 955183 - RNA, 19 nt, Homo sapiens
gacacuaccuauugcauua

SEQ ID NO: 955184 - RNA, 19 nt, Homo sapiens
gaagaccucuaugauuaua

SEQ ID NO: 955185 - RNA, 19 nt, Homo sapiens
gaauacuccugagaauuua

SEQ ID NO: 955186 - RNA, 19 nt, Homo sapiens
gaaauggagagcaacaaua

SEQ ID NO: 955187 - RNA, 19 nt, Homo sapiens
gaauacaucagcuguuuaa

SEQ ID NO: 955188 - RNA, 19 nt, Homo sapiens
gagaugugauuaagacuga

SEQ ID NO: 955189 - RNA, 19 nt, Homo sapiens
caacacagauccugacaag

SEQ ID NO: 955190 - RNA, 19 nt, Homo sapiens
ggacauggcccaguaauuc

SEQ ID NO: 955191 - RNA, 19 nt, Homo sapiens
cagaauacaucagcuguuu

SEQ ID NO: 955192 - RNA, 19 nt, Homo sapiens
gggaauggcugcuguacug

SEQ ID NO: 955193 - RNA, 19 nt, Homo sapiens
ggccguuaguuaucuauua

SEQ ID NO: 955194 - RNA, 19 nt, Homo sapiens
guacauaauugcuuugucu

SEQ ID NO: 955195 - RNA, 19 nt, Homo sapiens
ggcuaaacauaaucucuua

SEQ ID NO: 955196 - RNA, 19 nt, Homo sapiens
caagaauacuccugagaau

SEQ ID NO: 955197 - RNA, 19 nt, Homo sapiens
acacagauccugacaagaa

SEQ ID NO: 955198 - RNA, 19 nt, Homo sapiens
agaauacuccugagaauuu

SEQ ID NO: 955199 - RNA, 19 nt, Homo sapiens
ggaaggaacaacgguauuu

SEQ ID NO: 955200 - RNA, 19 nt, Homo sapiens
ucucuaaccuugucuucua

SEQ ID NO: 955201 - RNA, 19 nt, Homo sapiens
ccauaacucuguaucaugu

SEQ ID NO: 955202 - RNA, 19 nt, Homo sapiens
ccucaacccuugucucuau

SEQ ID NO: 955203 - RNA, 19 nt, Homo sapiens
uaacagcacagauuucuau

SEQ ID NO: 955204 - RNA, 19 nt, Homo sapiens
gaaagauggagaugugauu

SEQ ID NO: 955205 - RNA, 19 nt, Homo sapiens
cauaauugcuuugucuuga

SEQ ID NO: 955206 - RNA, 19 nt, Homo sapiens
uaaagcaggcucuaacuga

SEQ ID NO: 955207 - RNA, 19 nt, Homo sapiens
cuaugcaccuuuacucuuu

SEQ ID NO: 955208 - RNA, 19 nt, Homo sapiens
ucauaaugcugaagcuaaa

SEQ ID NO: 955209 - RNA, 19 nt, Homo sapiens
gcauaggagauauuuguaa

SEQ ID NO: 955210 - RNA, 19 nt, Homo sapiens
caugaaauggcuaaacaua

SEQ ID NO: 955211 - RNA, 19 nt, Homo sapiens
ccugagaauuuacaugaaa

SEQ ID NO: 955212 - RNA, 19 nt, Homo sapiens
cgagagcagcaaauucuua

SEQ ID NO: 955213 - RNA, 19 nt, Homo sapiens
gagagaagaaauuauagga

SEQ ID NO: 955214 - RNA, 19 nt, Homo sapiens
agauuucuaugcaccuuua

SEQ ID NO: 955215 - RNA, 19 nt, Homo sapiens
cagcacagauuucuaugca

SEQ ID NO: 955216 - RNA, 19 nt, Homo sapiens
aagcucaucuuuaguuuca

SEQ ID NO: 955217 - RNA, 19 nt, Homo sapiens
uaacacagcaauccaggaa

SEQ ID NO: 955218 - RNA, 19 nt, Homo sapiens
ggaaauggagagcaacaau

SEQ ID NO: 955219 - RNA, 19 nt, Homo sapiens
ccucagagagaagaaauua

SEQ ID NO: 955220 - RNA, 19 nt, Homo sapiens
acacagcaauccaggaaau

SEQ ID NO: 955221 - RNA, 19 nt, Homo sapiens
aaagcaggcucuaacugaa

SEQ ID NO: 955222 - RNA, 19 nt, Homo sapiens
gcucaucuuuaguuucaga

SEQ ID NO: 955223 - RNA, 19 nt, Homo sapiens
gaaauggaaagcucaucuu

SEQ ID NO: 955224 - RNA, 19 nt, Homo sapiens
uauaggaaauggagagcaa

SEQ ID NO: 955225 - RNA, 19 nt, Homo sapiens
gugagaacuuugagaaauc

SEQ ID NO: 955226 - RNA, 19 nt, Homo sapiens
gaaggaacaacgguauuug

SEQ ID NO: 955227 - RNA, 19 nt, Homo sapiens
uaucaugacuaucuauugg

SEQ ID NO: 955228 - RNA, 19 nt, Homo sapiens
cgugagaacuuugagaaau

SEQ ID NO: 955229 - RNA, 19 nt, Homo sapiens
uacaugaaauggcuaaaca

SEQ ID NO: 955230 - RNA, 19 nt, Homo sapiens
ugagggagccacucuaaga

SEQ ID NO: 955231 - RNA, 19 nt, Homo sapiens
ucugaaagauggagaugug

SEQ ID NO: 955232 - RNA, 19 nt, Homo sapiens
cacagauccugacaagaaa

SEQ ID NO: 955233 - RNA, 19 nt, Homo sapiens
auaaugacacuaccuauug

SEQ ID NO: 955234 - RNA, 19 nt, Homo sapiens
acaauacauuucucacaga

SEQ ID NO: 955235 - RNA, 19 nt, Homo sapiens
caacaauacauuucucaca

SEQ ID NO: 955236 - RNA, 19 nt, Homo sapiens
ucaauaaugacacuaccua

SEQ ID NO: 955237 - RNA, 19 nt, Homo sapiens
ggaggcauaggagauauuu

SEQ ID NO: 955238 - RNA, 19 nt, Homo sapiens
aaauggagagcaacaauau

SEQ ID NO: 955239 - RNA, 19 nt, Homo sapiens
ggagauauuuguaaaagca

SEQ ID NO: 955240 - RNA, 19 nt, Homo sapiens
uugagagaaugguauguuu

SEQ ID NO: 955241 - RNA, 19 nt, Homo sapiens
aaagauggagaugugauua

SEQ ID NO: 955242 - RNA, 19 nt, Homo sapiens
acaagaauacuccugagaa

SEQ ID NO: 955243 - RNA, 19 nt, Homo sapiens
agaccucuaugauuauaug

SEQ ID NO: 955244 - RNA, 19 nt, Homo sapiens
ucaugacuaucuauugguu

SEQ ID NO: 955245 - RNA, 19 nt, Homo sapiens
aaccuugucuucuaacguu

SEQ ID NO: 955246 - RNA, 19 nt, Homo sapiens
gaaauggcuaaacauaauc

SEQ ID NO: 955247 - RNA, 19 nt, Homo sapiens
ugagaacuuugagaaauca

SEQ ID NO: 955248 - RNA, 19 nt, Homo sapiens
uaauugcuuugucuugaug

SEQ ID NO: 955249 - RNA, 19 nt, Homo sapiens
uacaucagcuguuuaaagc

SEQ ID NO: 955250 - RNA, 19 nt, Homo sapiens
ggaacaacgguauuugaag

SEQ ID NO: 955251 - RNA, 19 nt, Homo sapiens
agaggaaaaugcuaucuuu

SEQ ID NO: 955252 - RNA, 19 nt, Homo sapiens
gagcagcaaauucuuacau

SEQ ID NO: 955253 - RNA, 19 nt, Homo sapiens
uccaggacauggcccagua

SEQ ID NO: 955254 - RNA, 19 nt, Homo sapiens
acccuugucucuaucugua

SEQ ID NO: 955255 - RNA, 19 nt, Homo sapiens
caccaacaccuaccuagug

SEQ ID NO: 955256 - RNA, 19 nt, Homo sapiens
ccaggaaauuguagugacu

SEQ ID NO: 955257 - RNA, 19 nt, Homo sapiens
ugacacuaccuauugcauu

SEQ ID NO: 955258 - RNA, 19 nt, Homo sapiens
gcaccaacaccuaccuagu

SEQ ID NO: 955259 - RNA, 19 nt, Homo sapiens
gcccaguaauucauaaugc

SEQ ID NO: 955260 - RNA, 19 nt, Homo sapiens
ugaagaccucuaugauuau

SEQ ID NO: 955261 - RNA, 19 nt, Homo sapiens
agaauacaucagcuguuua

SEQ ID NO: 955262 - RNA, 19 nt, Homo sapiens
gacauggcccaguaauuca

SEQ ID NO: 955263 - RNA, 19 nt, Homo sapiens
gguauuugaagaccucuau

SEQ ID NO: 955264 - RNA, 19 nt, Homo sapiens
ggcauaggagauauuugua

SEQ ID NO: 955265 - RNA, 19 nt, Homo sapiens
gggaaggaacaacgguauu

SEQ ID NO: 955266 - RNA, 19 nt, Homo sapiens
ggaauccucagagagaaga

SEQ ID NO: 955267 - RNA, 19 nt, Homo sapiens
cacuaccuauugcauuaaa

SEQ ID NO: 955268 - RNA, 19 nt, Homo sapiens
gguauaccacaaaugauuc

SEQ ID NO: 955269 - RNA, 19 nt, Homo sapiens
gccguuaguuaucuauuac

SEQ ID NO: 955270 - RNA, 19 nt, Homo sapiens
agcagcaaauucuuacauu

SEQ ID NO: 955271 - RNA, 19 nt, Homo sapiens
gaucacauggcucuacucu

SEQ ID NO: 955272 - RNA, 19 nt, Homo sapiens
gauggagaugugauuaaga

SEQ ID NO: 955273 - RNA, 19 nt, Homo sapiens
gucucuaucuguacauaau

SEQ ID NO: 955274 - RNA, 19 nt, Homo sapiens
gagagcagcaaauucuuac

SEQ ID NO: 955275 - RNA, 19 nt, Homo sapiens
uaaugacacuaccuauugc

SEQ ID NO: 955276 - RNA, 19 nt, Homo sapiens
acaguaauggagcuuguaa

SEQ ID NO: 955277 - RNA, 19 nt, Homo sapiens
agaucauucuggaggcaua

SEQ ID NO: 955278 - RNA, 19 nt, Homo sapiens
caauaaugacacuaccuau

SEQ ID NO: 955279 - RNA, 19 nt, Homo sapiens
uaagaaagaugaacacuug

SEQ ID NO: 955280 - RNA, 19 nt, Homo sapiens
ggagaaagccuucaaaugu

SEQ ID NO: 955281 - RNA, 19 nt, Homo sapiens
gagaaagccuucaaauguu

SEQ ID NO: 955282 - RNA, 19 nt, Homo sapiens
caacaacccugugagauuu

SEQ ID NO: 955283 - RNA, 19 nt, Homo sapiens
gaacagugccguauuguga

SEQ ID NO: 955284 - RNA, 19 nt, Homo sapiens
gagagaacauugaaaguau

SEQ ID NO: 955285 - RNA, 19 nt, Homo sapiens
gaggagaacaugcuacuua

SEQ ID NO: 955286 - RNA, 19 nt, Homo sapiens
gaaaguaggaguaaagaug

SEQ ID NO: 955287 - RNA, 19 nt, Homo sapiens
gaacgaagacuaaacaaag

SEQ ID NO: 955288 - RNA, 19 nt, Homo sapiens
gaaaguauucucuaagcua

SEQ ID NO: 955289 - RNA, 19 nt, Homo sapiens
gacagaaguuagaaaguuu

SEQ ID NO: 955290 - RNA, 19 nt, Homo sapiens
ggagagaacauugaaagua

SEQ ID NO: 955291 - RNA, 19 nt, Homo sapiens
gaaugucacugccaugaau

SEQ ID NO: 955292 - RNA, 19 nt, Homo sapiens
gaggcaaguugucuaauga

SEQ ID NO: 955293 - RNA, 19 nt, Homo sapiens
gaacagauguaaugguaac

SEQ ID NO: 955294 - RNA, 19 nt, Homo sapiens
ggaggcaaguugucuaaug

SEQ ID NO: 955295 - RNA, 19 nt, Homo sapiens
gaagcaaccucugagauuc

SEQ ID NO: 955296 - RNA, 19 nt, Homo sapiens
uauaaagugugcuucagua

SEQ ID NO: 955297 - RNA, 19 nt, Homo sapiens
gagaggaggucgaacagau

SEQ ID NO: 955298 - RNA, 19 nt, Homo sapiens
gcagauaccacucaggaaa

SEQ ID NO: 955299 - RNA, 19 nt, Homo sapiens
ucgaacagauguaauggua

SEQ ID NO: 955300 - RNA, 19 nt, Homo sapiens
ggacugaguagaauuaaau

SEQ ID NO: 955301 - RNA, 19 nt, Homo sapiens
uagcaaauauggacucaga

SEQ ID NO: 955302 - RNA, 19 nt, Homo sapiens
agaaagccuucaaauguuu

SEQ ID NO: 955303 - RNA, 19 nt, Homo sapiens
ccaaggucaucauauguuu

SEQ ID NO: 955304 - RNA, 19 nt, Homo sapiens
aaagugugcuucaguaguu

SEQ ID NO: 955305 - RNA, 19 nt, Homo sapiens
ggacucagagaaacagaua

SEQ ID NO: 955306 - RNA, 19 nt, Homo sapiens
gaagguguuucccaugaug

SEQ ID NO: 955307 - RNA, 19 nt, Homo sapiens
agacagaaguuagaaaguu

SEQ ID NO: 955308 - RNA, 19 nt, Homo sapiens
gaaagcacauccuguuugc

SEQ ID NO: 955309 - RNA, 19 nt, Homo sapiens
ggaaagcacauccuguuug

SEQ ID NO: 955310 - RNA, 19 nt, Homo sapiens
cauaacccguguagcauaa

SEQ ID NO: 955311 - RNA, 19 nt, Homo sapiens
gcuaaguccugcaagaaga

SEQ ID NO: 955312 - RNA, 19 nt, Homo sapiens
ucucuaagcuauuugaaga

SEQ ID NO: 955313 - RNA, 19 nt, Homo sapiens
ugaagagagugacuaaaug

SEQ ID NO: 955314 - RNA, 19 nt, Homo sapiens
gcggagcuuugaaauauug

SEQ ID NO: 955315 - RNA, 19 nt, Homo sapiens
gagaagaaacccuaaaugg

SEQ ID NO: 955316 - RNA, 19 nt, Homo sapiens
gaaaacgacuucaguguca

SEQ ID NO: 955317 - RNA, 19 nt, Homo sapiens
gaacuaaaggaaguaauug

SEQ ID NO: 955318 - RNA, 19 nt, Homo sapiens
ccaagaacaugguggugaa

SEQ ID NO: 955319 - RNA, 19 nt, Homo sapiens
cauugaaccuggagaagaa

SEQ ID NO: 955320 - RNA, 19 nt, Homo sapiens
gcaggaagaacuaaaggaa

SEQ ID NO: 955321 - RNA, 19 nt, Homo sapiens
ucgaggagcucaaggcauu

SEQ ID NO: 955322 - RNA, 19 nt, Homo sapiens
caacaagaguuagucaauc

SEQ ID NO: 955323 - RNA, 19 nt, Homo sapiens
gugccuagccaguuuguua

SEQ ID NO: 955324 - RNA, 19 nt, Homo sapiens
ggaaguaauugaacguuuu

SEQ ID NO: 955325 - RNA, 19 nt, Homo sapiens
ggacagagucgcuauguac

SEQ ID NO: 955326 - RNA, 19 nt, Homo sapiens
gcauaacccguguagcaua

SEQ ID NO: 955327 - RNA, 19 nt, Homo sapiens
gaaagagaagaaacccuaa

SEQ ID NO: 955328 - RNA, 19 nt, Homo sapiens
gcaaauauggacucagaga

SEQ ID NO: 955329 - RNA, 19 nt, Homo sapiens
gaacaacaagaguuaguca

SEQ ID NO: 955330 - RNA, 19 nt, Homo sapiens
gagugaacaacaagaguua

SEQ ID NO: 955331 - RNA, 19 nt, Homo sapiens
ccucugagauacugauuau

SEQ ID NO: 955332 - RNA, 19 nt, Homo sapiens
ggcaagaucugauggaaac

SEQ ID NO: 955333 - RNA, 19 nt, Homo sapiens
caggagaaauuauucaaag

SEQ ID NO: 955334 - RNA, 19 nt, Homo sapiens
aaaggacugaguagaauua

SEQ ID NO: 955335 - RNA, 19 nt, Homo sapiens
cuaaagcaguagacucuug

SEQ ID NO: 955336 - RNA, 19 nt, Homo sapiens
gagaaaggaaagagaagaa

SEQ ID NO: 955337 - RNA, 19 nt, Homo sapiens
guuccaaggucaucauaug

SEQ ID NO: 955338 - RNA, 19 nt, Homo sapiens
gagucucacuugucucuga

SEQ ID NO: 955339 - RNA, 19 nt, Homo sapiens
guaccguccucuagacuau

SEQ ID NO: 955340 - RNA, 19 nt, Homo sapiens
gaaccuggagaagaaauuu

SEQ ID NO: 955341 - RNA, 19 nt, Homo sapiens
uugcggagcuuugaaauau

SEQ ID NO: 955342 - RNA, 19 nt, Homo sapiens
gcaggagaaauuauucaaa

SEQ ID NO: 955343 - RNA, 19 nt, Homo sapiens
gaugaacacuuggagaaag

SEQ ID NO: 955344 - RNA, 19 nt, Homo sapiens
gguucuugaucccuauuua

SEQ ID NO: 955345 - RNA, 19 nt, Homo sapiens
gcaaguaaguaagggagau

SEQ ID NO: 955346 - RNA, 19 nt, Homo sapiens
gaagaacuaaaggaaguaa

SEQ ID NO: 955347 - RNA, 19 nt, Homo sapiens
cauuaacuguugacuguug

SEQ ID NO: 955348 - RNA, 19 nt, Homo sapiens
gauugcagaccuaauugua

SEQ ID NO: 955349 - RNA, 19 nt, Homo sapiens
cuacagagaauccugaaga

SEQ ID NO: 955350 - RNA, 19 nt, Homo sapiens
gugaauggcaggagaaaug

SEQ ID NO: 955351 - RNA, 19 nt, Homo sapiens
gagacuucuuggcaccuua

SEQ ID NO: 955352 - RNA, 19 nt, Homo sapiens
guaaagauggaaaggagaa

SEQ ID NO: 955353 - RNA, 19 nt, Homo sapiens
gagagagacagaaguuaga

SEQ ID NO: 955354 - RNA, 19 nt, Homo sapiens
gaucugauggaaacugaaa

SEQ ID NO: 955355 - RNA, 19 nt, Homo sapiens
aaauauggacucagagaaa

SEQ ID NO: 955356 - RNA, 19 nt, Homo sapiens
cgagauacagcauguguga

SEQ ID NO: 955357 - RNA, 19 nt, Homo sapiens
guaccagacucagaauugu

SEQ ID NO: 955358 - RNA, 19 nt, Homo sapiens
cgacuucagugucauguac

SEQ ID NO: 955359 - RNA, 19 nt, Homo sapiens
caaguugucuaaugaccau

SEQ ID NO: 955360 - RNA, 19 nt, Homo sapiens
aacaagaguuagucaauca

SEQ ID NO: 955361 - RNA, 19 nt, Homo sapiens
gaagagagugacuaaaugc

SEQ ID NO: 955362 - RNA, 19 nt, Homo sapiens
gagaaauggaggcaaguug

SEQ ID NO: 955363 - RNA, 19 nt, Homo sapiens
uguauuggcuacuccagaa

SEQ ID NO: 955364 - RNA, 19 nt, Homo sapiens
gugaugaugucgcuaaguc

SEQ ID NO: 955365 - RNA, 19 nt, Homo sapiens
gaaggcaggaagaacuaaa

SEQ ID NO: 955366 - RNA, 19 nt, Homo sapiens
gagucagaguccaagcaua

SEQ ID NO: 955367 - RNA, 19 nt, Homo sapiens
aaagagaaaggaaagagaa

SEQ ID NO: 955368 - RNA, 19 nt, Homo sapiens
agaagcaaccucugagauu

SEQ ID NO: 955369 - RNA, 19 nt, Homo sapiens
uuauggagauggguucuuu

SEQ ID NO: 955370 - RNA, 19 nt, Homo sapiens
caugauugcagaccuaauu

SEQ ID NO: 955371 - RNA, 19 nt, Homo sapiens
acaacaacccugugagauu

SEQ ID NO: 955372 - RNA, 19 nt, Homo sapiens
ggaggucgaacagauguaa

SEQ ID NO: 955373 - RNA, 19 nt, Homo sapiens
caaagagaaaggaaagaga

SEQ ID NO: 955374 - RNA, 19 nt, Homo sapiens
agaaagaagcaaccucuga

SEQ ID NO: 955375 - RNA, 19 nt, Homo sapiens
ggagauuugauaagcauau

SEQ ID NO: 955376 - RNA, 19 nt, Homo sapiens
uaagggagauuugauaagc

SEQ ID NO: 955377 - RNA, 19 nt, Homo sapiens
gucaaucugucagcucuaa

SEQ ID NO: 955378 - RNA, 19 nt, Homo sapiens
agaccuaauuguaaguuug

SEQ ID NO: 955379 - RNA, 19 nt, Homo sapiens
gaaagagccuaaaguaguu

SEQ ID NO: 955380 - RNA, 19 nt, Homo sapiens
uaagaaagaugaacacuug

SEQ ID NO: 955381 - RNA, 19 nt, Homo sapiens
gcuaagcgcuugagguuaa

SEQ ID NO: 955382 - RNA, 19 nt, Homo sapiens
ggagaaagccuucaaaugu

SEQ ID NO: 955383 - RNA, 19 nt, Homo sapiens
ggaaaagacucuauagaua

SEQ ID NO: 955384 - RNA, 19 nt, Homo sapiens
gagaaagccuucaaauguu

SEQ ID NO: 955385 - RNA, 19 nt, Homo sapiens
caacaacccugugagauuu

SEQ ID NO: 955386 - RNA, 19 nt, Homo sapiens
gaauggagguggaugacua

SEQ ID NO: 955387 - RNA, 19 nt, Homo sapiens
uagcaaagcuuaauaaugg

SEQ ID NO: 955388 - RNA, 19 nt, Homo sapiens
gagagaacauugaaaguau

SEQ ID NO: 955389 - RNA, 19 nt, Homo sapiens
gaggagaacaugcuacuua

SEQ ID NO: 955390 - RNA, 19 nt, Homo sapiens
cauacugacucaauucuua

SEQ ID NO: 955391 - RNA, 19 nt, Homo sapiens
caucuaagcuaacucauau

SEQ ID NO: 955392 - RNA, 19 nt, Homo sapiens
guacagugauagcaacuuu

SEQ ID NO: 955393 - RNA, 19 nt, Homo sapiens
gaaaguauucucuaagcua

SEQ ID NO: 955394 - RNA, 19 nt, Homo sapiens
ggagagaacauugaaagua

SEQ ID NO: 955395 - RNA, 19 nt, Homo sapiens
cauaguagcagcauauuaa

SEQ ID NO: 955396 - RNA, 19 nt, Homo sapiens
gaaaauaacucugggauuc

SEQ ID NO: 955397 - RNA, 19 nt, Homo sapiens
gaggcaaguugucuaauga

SEQ ID NO: 955398 - RNA, 19 nt, Homo sapiens
gaacagauguaaugguaac

SEQ ID NO: 955399 - RNA, 19 nt, Homo sapiens
ggaggcaaguugucuaaug

SEQ ID NO: 955400 - RNA, 19 nt, Homo sapiens
guaaagcccuguuguaaaa

SEQ ID NO: 955401 - RNA, 19 nt, Homo sapiens
ugacuaugaugaugacuuu

SEQ ID NO: 955402 - RNA, 19 nt, Homo sapiens
gauagcaacuuuccacaca

SEQ ID NO: 955403 - RNA, 19 nt, Homo sapiens
caaaugaccaagagaauga

SEQ ID NO: 955404 - RNA, 19 nt, Homo sapiens
gagaggaggucgaacagau

SEQ ID NO: 955405 - RNA, 19 nt, Homo sapiens
ucagcuggcucuuuaauau

SEQ ID NO: 955406 - RNA, 19 nt, Homo sapiens
gaccugggauaacuacuuu

SEQ ID NO: 955407 - RNA, 19 nt, Homo sapiens
ggaagaaaguacagaugau

SEQ ID NO: 955408 - RNA, 19 nt, Homo sapiens
gcaaagaccaugacaacga

SEQ ID NO: 955409 - RNA, 19 nt, Homo sapiens
cgauaacaaucucuaugua

SEQ ID NO: 955410 - RNA, 19 nt, Homo sapiens
gcagauaccacucaggaaa

SEQ ID NO: 955411 - RNA, 19 nt, Homo sapiens
ucgaacagauguaauggua

SEQ ID NO: 955412 - RNA, 19 nt, Homo sapiens
uagcaaauauggacucaga

SEQ ID NO: 955413 - RNA, 19 nt, Homo sapiens
agaaagccuucaaauguuu

SEQ ID NO: 955414 - RNA, 19 nt, Homo sapiens
gacaucagauagcuucaaa

SEQ ID NO: 955415 - RNA, 19 nt, Homo sapiens
gaggcaaagugucauaaga

SEQ ID NO: 955416 - RNA, 19 nt, Homo sapiens
gaaacuuaguacugaaaga

SEQ ID NO: 955417 - RNA, 19 nt, Homo sapiens
ggacucagagaaacagaua

SEQ ID NO: 955418 - RNA, 19 nt, Homo sapiens
gaagaaaguacagaugauu

SEQ ID NO: 955419 - RNA, 19 nt, Homo sapiens
aggaagaacuggcucauga

SEQ ID NO: 955420 - RNA, 19 nt, Homo sapiens
ugaagagagugacuaaaug

SEQ ID NO: 955421 - RNA, 19 nt, Homo sapiens
ggagguggaugacuauagu

SEQ ID NO: 955422 - RNA, 19 nt, Homo sapiens
ucucuaagcuauuugaaga

SEQ ID NO: 955423 - RNA, 19 nt, Homo sapiens
caaagugucauaagaguga

SEQ ID NO: 955424 - RNA, 19 nt, Homo sapiens
caaucuaugucaagaauuc

SEQ ID NO: 955425 - RNA, 19 nt, Homo sapiens
gcaaugaucuuuggcuuuu

SEQ ID NO: 955426 - RNA, 19 nt, Homo sapiens
guagaaaguguacagcaua

SEQ ID NO: 955427 - RNA, 19 nt, Homo sapiens
ccaagaacaugguggugaa

SEQ ID NO: 955428 - RNA, 19 nt, Homo sapiens
gaaaacgacuucaguguca

SEQ ID NO: 955429 - RNA, 19 nt, Homo sapiens
gaacuaaaggaaguaauug

SEQ ID NO: 955430 - RNA, 19 nt, Homo sapiens
ccaagagaaugauggaaug

SEQ ID NO: 955431 - RNA, 19 nt, Homo sapiens
gaaggaggccucugacauc

SEQ ID NO: 955432 - RNA, 19 nt, Homo sapiens
cauugaaccuggagaagaa

SEQ ID NO: 955433 - RNA, 19 nt, Homo sapiens
ucagauagcuucaaaacaa

SEQ ID NO: 955434 - RNA, 19 nt, Homo sapiens
cgaaaugggaaacuuagua

SEQ ID NO: 955435 - RNA, 19 nt, Homo sapiens
gcaggaagaacuaaaggaa

SEQ ID NO: 955436 - RNA, 19 nt, Homo sapiens
ucgaggagcucaaggcauu

SEQ ID NO: 955437 - RNA, 19 nt, Homo sapiens
gcuaauaucaccagcaaug

SEQ ID NO: 955438 - RNA, 19 nt, Homo sapiens
caaagaccaugacaacgau

SEQ ID NO: 955439 - RNA, 19 nt, Homo sapiens
ugaaagagccuaaaguagu

SEQ ID NO: 955440 - RNA, 19 nt, Homo sapiens
ggaaguaauugaacguuuu

SEQ ID NO: 955441 - RNA, 19 nt, Homo sapiens
ggacagagucgcuauguac

SEQ ID NO: 955442 - RNA, 19 nt, Homo sapiens
gguaaagcccuguuguaaa

SEQ ID NO: 955443 - RNA, 19 nt, Homo sapiens
gcaaaagaaugcuucaaga

SEQ ID NO: 955444 - RNA, 19 nt, Homo sapiens
gcaaauauggacucagaga

SEQ ID NO: 955445 - RNA, 19 nt, Homo sapiens
caggagaaauuauucaaag

SEQ ID NO: 955446 - RNA, 19 nt, Homo sapiens
gagucagauugguuucuua

SEQ ID NO: 955447 - RNA, 19 nt, Homo sapiens
gagguaaagcccuguugua

SEQ ID NO: 955448 - RNA, 19 nt, Homo sapiens
ucacuuaucagcauacuau

SEQ ID NO: 955449 - RNA, 19 nt, Homo sapiens
ggagucagauugguuucuu

SEQ ID NO: 955450 - RNA, 19 nt, Homo sapiens
guuaauaucgcaaaccauu

SEQ ID NO: 955451 - RNA, 19 nt, Homo sapiens
gcaaaauuguacagugaua

SEQ ID NO: 955452 - RNA, 19 nt, Homo sapiens
ucuauugucccuucacuua

SEQ ID NO: 955453 - RNA, 19 nt, Homo sapiens
gcagugauccucuuucucu

SEQ ID NO: 955454 - RNA, 19 nt, Homo sapiens
gaagaacuggcucaugaga

SEQ ID NO: 955455 - RNA, 19 nt, Homo sapiens
ggcaaucuaugucaagaau

SEQ ID NO: 955456 - RNA, 19 nt, Homo sapiens
agcaucagcuggcucuuua

SEQ ID NO: 955457 - RNA, 19 nt, Homo sapiens
gcacaguuaauccuagaaa

SEQ ID NO: 955458 - RNA, 19 nt, Homo sapiens
aagguaugaugcacaguua

SEQ ID NO: 955459 - RNA, 19 nt, Homo sapiens
gcaagcggcuggagcaaaa

SEQ ID NO: 955460 - RNA, 19 nt, Homo sapiens
gaaccuggagaagaaauuu

SEQ ID NO: 955461 - RNA, 19 nt, Homo sapiens
aaauaaaggcucaagcaaa

SEQ ID NO: 955462 - RNA, 19 nt, Homo sapiens
uacgugcaauucugaguua

SEQ ID NO: 955463 - RNA, 19 nt, Homo sapiens
gagaagagaagaucagucu

SEQ ID NO: 955464 - RNA, 19 nt, Homo sapiens
gaggaugacuaugaugaug

SEQ ID NO: 955465 - RNA, 19 nt, Homo sapiens
aaacaaaugaccaagagaa

SEQ ID NO: 955466 - RNA, 19 nt, Homo sapiens
gcaggagaaauuauucaaa

SEQ ID NO: 955467 - RNA, 19 nt, Homo sapiens
gaugaacacuuggagaaag

SEQ ID NO: 955468 - RNA, 19 nt, Homo sapiens
gguucuugaucccuauuua

SEQ ID NO: 955469 - RNA, 19 nt, Homo sapiens
ggacaagaacaaaucugaa

SEQ ID NO: 955470 - RNA, 19 nt, Homo sapiens
gaagaacuaaaggaaguaa

SEQ ID NO: 955471 - RNA, 19 nt, Homo sapiens
uuaaauagccuucuuacgu

SEQ ID NO: 955472 - RNA, 19 nt, Homo sapiens
acucaauucuuaagucuga

SEQ ID NO: 955473 - RNA, 19 nt, Homo sapiens
gauugcagaccuaauugua

SEQ ID NO: 955474 - RNA, 19 nt, Homo sapiens
ucaauuauuccucaacuga

SEQ ID NO: 955475 - RNA, 19 nt, Homo sapiens
guagcaaagcuuaauaaug

SEQ ID NO: 955476 - RNA, 19 nt, Homo sapiens
gaaccaaauacguugaaug

SEQ ID NO: 955477 - RNA, 19 nt, Homo sapiens
ggaggccucugacaucaag

SEQ ID NO: 955478 - RNA, 19 nt, Homo sapiens
gugaauggcaggagaaaug

SEQ ID NO: 955479 - RNA, 19 nt, Homo sapiens
gcaagauccuggccaauuu

SEQ ID NO: 955480 - RNA, 19 nt, Homo sapiens
caacaacgcugccgugugu

SEQ ID NO: 955481 - RNA, 19 nt, Homo sapiens
ccagggagaugcaguuaaa

SEQ ID NO: 955482 - RNA, 19 nt, Homo sapiens
ucacagagaucuuaaggau

SEQ ID NO: 955483 - RNA, 19 nt, Homo sapiens
ccacaggagucgcuggaua

SEQ ID NO: 955484 - RNA, 19 nt, Homo sapiens
gaaacgcaguggccaacaa

SEQ ID NO: 955485 - RNA, 19 nt, Homo sapiens
gcaaagagacaaguccuaa

SEQ ID NO: 955486 - RNA, 19 nt, Homo sapiens
gaaauuagacggacuacag

SEQ ID NO: 955487 - RNA, 19 nt, Homo sapiens
gagcaaggcuuagcagaag

SEQ ID NO: 955488 - RNA, 19 nt, Homo sapiens
gcacauccaggcaguguuu

SEQ ID NO: 955489 - RNA, 19 nt, Homo sapiens
acgcggagcuucagcagua

SEQ ID NO: 955490 - RNA, 19 nt, Homo sapiens
gagaugcaguuaaagacuu

SEQ ID NO: 955491 - RNA, 19 nt, Homo sapiens
cagaauaacuuugcagaag

SEQ ID NO: 955492 - RNA, 19 nt, Homo sapiens
cuaaucagcugcagaaacu

SEQ ID NO: 955493 - RNA, 19 nt, Homo sapiens
gaaacugugucuugaagcu

SEQ ID NO: 955494 - RNA, 19 nt, Homo sapiens
ggauuucccuccagauugg

SEQ ID NO: 955495 - RNA, 19 nt, Homo sapiens
ggagcaaggcuuagcagaa

SEQ ID NO: 955496 - RNA, 19 nt, Homo sapiens
ccagaaugcugagauggaa

SEQ ID NO: 955497 - RNA, 19 nt, Homo sapiens
ggacuucuucgacuccuuu

SEQ ID NO: 955498 - RNA, 19 nt, Homo sapiens
ucacggagcaugcagaaga

SEQ ID NO: 955499 - RNA, 19 nt, Homo sapiens
caauuuggagcaaggcuua

SEQ ID NO: 955500 - RNA, 19 nt, Homo sapiens
caaacugucugcuccugau

SEQ ID NO: 955501 - RNA, 19 nt, Homo sapiens
gcagaauaacuuugcagaa

SEQ ID NO: 955502 - RNA, 19 nt, Homo sapiens
ggaggaaaccaucgaucuu

SEQ ID NO: 955503 - RNA, 19 nt, Homo sapiens
gaggaaaccaucgaucuug

SEQ ID NO: 955504 - RNA, 19 nt, Homo sapiens
cggacaagcugaacgaaca

SEQ ID NO: 955505 - RNA, 19 nt, Homo sapiens
gagaaaguaacacagaaau

SEQ ID NO: 955506 - RNA, 19 nt, Homo sapiens
augcugagauggaauuuga

SEQ ID NO: 955507 - RNA, 19 nt, Homo sapiens
agccagaucuuuauuacga

SEQ ID NO: 955508 - RNA, 19 nt, Homo sapiens
aaagagacaaguccuaaau

SEQ ID NO: 955509 - RNA, 19 nt, Homo sapiens
caauaaaacuccugcuuca

SEQ ID NO: 955510 - RNA, 19 nt, Homo sapiens
caaagagacaaguccuaaa

SEQ ID NO: 955511 - RNA, 19 nt, Homo sapiens
cugcagcucugguuuguca

SEQ ID NO: 955512 - RNA, 19 nt, Homo sapiens
guucuucacagagaucuua

SEQ ID NO: 955513 - RNA, 19 nt, Homo sapiens
uaaaacuccugcuucaaaa

SEQ ID NO: 955514 - RNA, 19 nt, Homo sapiens
cuagugaaguugggccuuu

SEQ ID NO: 955515 - RNA, 19 nt, Homo sapiens
aucauucgguuaucaagua

SEQ ID NO: 955516 - RNA, 19 nt, Homo sapiens
gaguuuggauccgaagaga

SEQ ID NO: 955517 - RNA, 19 nt, Homo sapiens
ugacauggaggaacucaau

SEQ ID NO: 955518 - RNA, 19 nt, Homo sapiens
uagacggacuacaggguaa

SEQ ID NO: 955519 - RNA, 19 nt, Homo sapiens
gaacccuucggaaaucuug

SEQ ID NO: 955520 - RNA, 19 nt, Homo sapiens
ugagaaaguaacacagaaa

SEQ ID NO: 955521 - RNA, 19 nt, Homo sapiens
cacagguucuucacagaga

SEQ ID NO: 955522 - RNA, 19 nt, Homo sapiens
agagacaaguccuaaaugc

SEQ ID NO: 955523 - RNA, 19 nt, Homo sapiens
ucagccagaucuuuauuac

SEQ ID NO: 955524 - RNA, 19 nt, Homo sapiens
gugcggacgucuccucaca

SEQ ID NO: 955525 - RNA, 19 nt, Homo sapiens
gacauggaggaacucaaua

SEQ ID NO: 955526 - RNA, 19 nt, Homo sapiens
ccaacacacuacgucagaa

SEQ ID NO: 955527 - RNA, 19 nt, Homo sapiens
caagauccuggccaauuug

SEQ ID NO: 955528 - RNA, 19 nt, Homo sapiens
gcugaacgaacacaugaug

SEQ ID NO: 955529 - RNA, 19 nt, Homo sapiens
acauggaggaacucaauaa

SEQ ID NO: 955530 - RNA, 19 nt, Homo sapiens
caacacacagugccucaag

SEQ ID NO: 955531 - RNA, 19 nt, Homo sapiens
cacggagcaugcagaagaa

SEQ ID NO: 955532 - RNA, 19 nt, Homo sapiens
guugagaaaguaacacaga

SEQ ID NO: 955533 - RNA, 19 nt, Homo sapiens
uggauagacugcacaaggu

SEQ ID NO: 955534 - RNA, 19 nt, Homo sapiens
cauggaggaacucaauaaa

SEQ ID NO: 955535 - RNA, 19 nt, Homo sapiens
ggagcaugcagaagaaaca

SEQ ID NO: 955536 - RNA, 19 nt, Homo sapiens
aacugugucuugaagcuaa

SEQ ID NO: 955537 - RNA, 19 nt, Homo sapiens
uugagaaaguaacacagaa

SEQ ID NO: 955538 - RNA, 19 nt, Homo sapiens
ugaacgaacacaugaugga

SEQ ID NO: 955539 - RNA, 19 nt, Homo sapiens
caagacguugagaaaguaa

SEQ ID NO: 955540 - RNA, 19 nt, Homo sapiens
gcguaucauucgguuauca

SEQ ID NO: 955541 - RNA, 19 nt, Homo sapiens
aagcugaacgaacacauga

SEQ ID NO: 955542 - RNA, 19 nt, Homo sapiens
agaugcaguuaaagacuug

SEQ ID NO: 955543 - RNA, 19 nt, Homo sapiens
ggagaugcaguuaaagacu

SEQ ID NO: 955544 - RNA, 19 nt, Homo sapiens
uggcggagaugaguuugga

SEQ ID NO: 955545 - RNA, 19 nt, Homo sapiens
ugcacaaggugaagacugu

SEQ ID NO: 955546 - RNA, 19 nt, Homo sapiens
caagcugaacgaacacaug

SEQ ID NO: 955547 - RNA, 19 nt, Homo sapiens
agaaugcugagauggaauu

SEQ ID NO: 955548 - RNA, 19 nt, Homo sapiens
ucacugcagcucugguuug

SEQ ID NO: 955549 - RNA, 19 nt, Homo sapiens
acagaaauuagacggacua

SEQ ID NO: 955550 - RNA, 19 nt, Homo sapiens
caacacacuacgucagaag

SEQ ID NO: 955551 - RNA, 19 nt, Homo sapiens
gcuaaucagcugcagaaac

SEQ ID NO: 955552 - RNA, 19 nt, Homo sapiens
uugaaacugugucuugaag

SEQ ID NO: 955553 - RNA, 19 nt, Homo sapiens
aauuugaacccuucggaaa

SEQ ID NO: 955554 - RNA, 19 nt, Homo sapiens
ggccucagguucgacaaca

SEQ ID NO: 955555 - RNA, 19 nt, Homo sapiens
cuuugaaacugugucuuga

SEQ ID NO: 955556 - RNA, 19 nt, Homo sapiens
gggacagcuucaacacaca

SEQ ID NO: 955557 - RNA, 19 nt, Homo sapiens
caaccugaccaccauguac

SEQ ID NO: 955558 - RNA, 19 nt, Homo sapiens
cuucaccucgggcagaaua

SEQ ID NO: 955559 - RNA, 19 nt, Homo sapiens
ucauucgguuaucaaguau

SEQ ID NO: 955560 - RNA, 19 nt, Homo sapiens
gggcagacaagccucuauc

SEQ ID NO: 955561 - RNA, 19 nt, Homo sapiens
cgacucaguggaacaaucu

SEQ ID NO: 955562 - RNA, 19 nt, Homo sapiens
ggacuacaggguaaaauca

SEQ ID NO: 955563 - RNA, 19 nt, Homo sapiens
cggauuucccuccagauug

SEQ ID NO: 955564 - RNA, 19 nt, Homo sapiens
caaguauuacccagagcaa

SEQ ID NO: 955565 - RNA, 19 nt, Homo sapiens
gaaugcugagauggaauuu

SEQ ID NO: 955566 - RNA, 19 nt, Homo sapiens
ccggauuucccuccagauu

SEQ ID NO: 955567 - RNA, 19 nt, Homo sapiens
aguauuacccagagcaaga

SEQ ID NO: 955568 - RNA, 19 nt, Homo sapiens
gaaagaaacuccuggaacu

SEQ ID NO: 955569 - RNA, 19 nt, Homo sapiens
cagaacaccugaacucaaa

SEQ ID NO: 955570 - RNA, 19 nt, Homo sapiens
gcaaguaagcugucccuuu

SEQ ID NO: 955571 - RNA, 19 nt, Homo sapiens
gaaguagccuaucuaugga

SEQ ID NO: 955572 - RNA, 19 nt, Homo sapiens
gauuucaggugagaaguua

SEQ ID NO: 955573 - RNA, 19 nt, Homo sapiens
acaagucgcugccaccuuu

SEQ ID NO: 955574 - RNA, 19 nt, Homo sapiens
ggaagucgaccucccagua

SEQ ID NO: 955575 - RNA, 19 nt, Homo sapiens
caaguaagcugucccuuuu

SEQ ID NO: 955576 - RNA, 19 nt, Homo sapiens
ggacugacuggauuucaua

SEQ ID NO: 955577 - RNA, 19 nt, Homo sapiens
ggaagaaucgcguccagaa

SEQ ID NO: 955578 - RNA, 19 nt, Homo sapiens
ugacuggauuucauacuuu

SEQ ID NO: 955579 - RNA, 19 nt, Homo sapiens
gugaagaacugcugugaag

SEQ ID NO: 955580 - RNA, 19 nt, Homo sapiens
cuacagccauggcaauauu

SEQ ID NO: 955581 - RNA, 19 nt, Homo sapiens
gaagaacugcugugaagug

SEQ ID NO: 955582 - RNA, 19 nt, Homo sapiens
gcaauauugugaagaacug

SEQ ID NO: 955583 - RNA, 19 nt, Homo sapiens
ggaacuaccgcuacuucua

SEQ ID NO: 955584 - RNA, 19 nt, Homo sapiens
ucauagaaauggagauaga

SEQ ID NO: 955585 - RNA, 19 nt, Homo sapiens
gggcucagcucauguuucu

SEQ ID NO: 955586 - RNA, 19 nt, Homo sapiens
caggaaggauguucaguuc

SEQ ID NO: 955587 - RNA, 19 nt, Homo sapiens
ggagauagaagcuaccaau

SEQ ID NO: 955588 - RNA, 19 nt, Homo sapiens
ggaagagacuuuuguuugu

SEQ ID NO: 955589 - RNA, 19 nt, Homo sapiens
agaaguagccuaucuaugg

SEQ ID NO: 955590 - RNA, 19 nt, Homo sapiens
gaauuccaaucaugucugu

SEQ ID NO: 955591 - RNA, 19 nt, Homo sapiens
gagcaggaauuccaaucau

SEQ ID NO: 955592 - RNA, 19 nt, Homo sapiens
cagcaucugugacaacugu

SEQ ID NO: 955593 - RNA, 19 nt, Homo sapiens
ucaguucaccucuggauaa

SEQ ID NO: 955594 - RNA, 19 nt, Homo sapiens
ggaaggauguucaguucac

SEQ ID NO: 955595 - RNA, 19 nt, Homo sapiens
gaacuaccgcuacuucuac

SEQ ID NO: 955596 - RNA, 19 nt, Homo sapiens
ggaauuguguuggaaagag

SEQ ID NO: 955597 - RNA, 19 nt, Homo sapiens
ccagauaaacaaccagauu

SEQ ID NO: 955598 - RNA, 19 nt, Homo sapiens
caagggcaguggccaggaa

SEQ ID NO: 955599 - RNA, 19 nt, Homo sapiens
gaacaccugaacucaaaug

SEQ ID NO: 955600 - RNA, 19 nt, Homo sapiens
caggcaacgugauuucaaa

SEQ ID NO: 955601 - RNA, 19 nt, Homo sapiens
gggaggagauugucuucca

SEQ ID NO: 955602 - RNA, 19 nt, Homo sapiens
gcugagaaguagccuaucu

SEQ ID NO: 955603 - RNA, 19 nt, Homo sapiens
gaaauggagauagaagcua

SEQ ID NO: 955604 - RNA, 19 nt, Homo sapiens
cagcagcacucccgaagag

SEQ ID NO: 955605 - RNA, 19 nt, Homo sapiens
guccucauuugcuucuuua

SEQ ID NO: 955606 - RNA, 19 nt, Homo sapiens
uuggagacauugaaagaaa

SEQ ID NO: 955607 - RNA, 19 nt, Homo sapiens
gacaaccaaugaagacauc

SEQ ID NO: 955608 - RNA, 19 nt, Homo sapiens
gcaauuggacuuuugauga

SEQ ID NO: 955609 - RNA, 19 nt, Homo sapiens
uagaaguccucauuugcuu

SEQ ID NO: 955610 - RNA, 19 nt, Homo sapiens
ggacauguacacucuucuu

SEQ ID NO: 955611 - RNA, 19 nt, Homo sapiens
gcaggaauuccaaucaugu

SEQ ID NO: 955612 - RNA, 19 nt, Homo sapiens
gaagaaucgcguccagaau

SEQ ID NO: 955613 - RNA, 19 nt, Homo sapiens
gcucagcucauguuucuuc

SEQ ID NO: 955614 - RNA, 19 nt, Homo sapiens
caaugaagacaucaaagga

SEQ ID NO: 955615 - RNA, 19 nt, Homo sapiens
ugacccagcggcaggaaua

SEQ ID NO: 955616 - RNA, 19 nt, Homo sapiens
gaucauggacagggaagaa

SEQ ID NO: 955617 - RNA, 19 nt, Homo sapiens
cagauaaacaaccagauug

SEQ ID NO: 955618 - RNA, 19 nt, Homo sapiens
cagugacccuggagugauu

SEQ ID NO: 955619 - RNA, 19 nt, Homo sapiens
gcaacgugauuucaaagcu

SEQ ID NO: 955620 - RNA, 19 nt, Homo sapiens
guucaccucuggauaaacu

SEQ ID NO: 955621 - RNA, 19 nt, Homo sapiens
ggucuuuagucacccaguu

SEQ ID NO: 955622 - RNA, 19 nt, Homo sapiens
ugagagauuucaggugaga

SEQ ID NO: 955623 - RNA, 19 nt, Homo sapiens
ccacagaacaccugaacuc

SEQ ID NO: 955624 - RNA, 19 nt, Homo sapiens
ugaaauacuguuacacaug

SEQ ID NO: 955625 - RNA, 19 nt, Homo sapiens
cgccucguaucaagaauuu

SEQ ID NO: 955626 - RNA, 19 nt, Homo sapiens
gcaggcaacgugauuucaa

SEQ ID NO: 955627 - RNA, 19 nt, Homo sapiens
ccaggaaggauguucaguu

SEQ ID NO: 955628 - RNA, 19 nt, Homo sapiens
gaggaacuaccgcuacuuc

SEQ ID NO: 955629 - RNA, 19 nt, Homo sapiens
cuccauggcuacacuguug

SEQ ID NO: 955630 - RNA, 19 nt, Homo sapiens
ggagcaggaauuccaauca

SEQ ID NO: 955631 - RNA, 19 nt, Homo sapiens
ugagacagagagcaaguaa

SEQ ID NO: 955632 - RNA, 19 nt, Homo sapiens
gaagucgaccucccaguac

SEQ ID NO: 955633 - RNA, 19 nt, Homo sapiens
gagauagaagcuaccaaug

SEQ ID NO: 955634 - RNA, 19 nt, Homo sapiens
cagcucauguuucuucucu

SEQ ID NO: 955635 - RNA, 19 nt, Homo sapiens
uaauuagggcuaugagaga

SEQ ID NO: 955636 - RNA, 19 nt, Homo sapiens
ucaaccagacaaccaauga

SEQ ID NO: 955637 - RNA, 19 nt, Homo sapiens
gggacugacuggauuucau

SEQ ID NO: 955638 - RNA, 19 nt, Homo sapiens
agaaacuccuggaacuguu

SEQ ID NO: 955639 - RNA, 19 nt, Homo sapiens
uuucuucucucguguaauc

SEQ ID NO: 955640 - RNA, 19 nt, Homo sapiens
uuagggcuaugagagauuu

SEQ ID NO: 955641 - RNA, 19 nt, Homo sapiens
gaagagacuuuuguuugug

SEQ ID NO: 955642 - RNA, 19 nt, Homo sapiens
caguucaccucuggauaaa

SEQ ID NO: 955643 - RNA, 19 nt, Homo sapiens
gagaaguagccuaucuaug

SEQ ID NO: 955644 - RNA, 19 nt, Homo sapiens
guucuagaaguccucauuu

SEQ ID NO: 955645 - RNA, 19 nt, Homo sapiens
gaaggugacacggaaaugg

SEQ ID NO: 955646 - RNA, 19 nt, Homo sapiens
gacuggauuucauacuuuc

SEQ ID NO: 955647 - RNA, 19 nt, Homo sapiens
gaaacugaaauacuguuac

SEQ ID NO: 955648 - RNA, 19 nt, Homo sapiens
ugagaaguagccuaucuau

SEQ ID NO: 955649 - RNA, 19 nt, Homo sapiens
ccaaugaagacaucaaagg

SEQ ID NO: 955650 - RNA, 19 nt, Homo sapiens
cugacuggauuucauacuu

SEQ ID NO: 955651 - RNA, 19 nt, Homo sapiens
caaccagacaaccaaugaa

SEQ ID NO: 955652 - RNA, 19 nt, Homo sapiens
gcagcacucccgaagagau

SEQ ID NO: 955653 - RNA, 19 nt, Homo sapiens
gccgcuaccuggcuguuca

SEQ ID NO: 955654 - RNA, 19 nt, Homo sapiens
aagaaucgcguccagaauc

SEQ ID NO: 955655 - RNA, 19 nt, Homo sapiens
caaccagauugugaaacug

SEQ ID NO: 955656 - RNA, 19 nt, Homo sapiens
agacagagagcaaguaagc

SEQ ID NO: 955657 - RNA, 19 nt, Homo sapiens
gaagacaucaaaggaucau

SEQ ID NO: 955658 - RNA, 19 nt, Homo sapiens
cugaaauacuguuacacau

SEQ ID NO: 955659 - RNA, 19 nt, Homo sapiens
uuucuuuggucuuuaguca

SEQ ID NO: 955660 - RNA, 19 nt, Homo sapiens
acagaacaccugaacucaa

SEQ ID NO: 955661 - RNA, 19 nt, Homo sapiens
gaauagcaggcaacgugau

SEQ ID NO: 955662 - RNA, 19 nt, Homo sapiens
caaccaaugaagacaucaa

SEQ ID NO: 955663 - RNA, 19 nt, Homo sapiens
caauuggacuuuugaugau

SEQ ID NO: 955664 - RNA, 19 nt, Homo sapiens
aguccucauuugcuucuuu

SEQ ID NO: 955665 - RNA, 19 nt, Homo sapiens
ugucuucgccuucaacauc

SEQ ID NO: 955666 - RNA, 19 nt, Homo sapiens
uugugaaacugaaauacug

SEQ ID NO: 955667 - RNA, 19 nt, Homo sapiens
gacauguacacucuucuuc

SEQ ID NO: 955668 - RNA, 19 nt, Homo sapiens
gacagaagcugcucaguug

SEQ ID NO: 955669 - RNA, 19 nt, Homo sapiens
gaacugaacccuaaagaug

SEQ ID NO: 955670 - RNA, 19 nt, Homo sapiens
gaaaugccuugguaucaaa

SEQ ID NO: 955671 - RNA, 19 nt, Homo sapiens
caauugaacugaacccuaa

SEQ ID NO: 955672 - RNA, 19 nt, Homo sapiens
gagaagaauugagaacuuu

SEQ ID NO: 955673 - RNA, 19 nt, Homo sapiens
gcaaaugcauauaucauca

SEQ ID NO: 955674 - RNA, 19 nt, Homo sapiens
cauaagagugguagaaaua

SEQ ID NO: 955675 - RNA, 19 nt, Homo sapiens
ggaaagacauacuugaaac

SEQ ID NO: 955676 - RNA, 19 nt, Homo sapiens
agccaaaguugaagaaaua

SEQ ID NO: 955677 - RNA, 19 nt, Homo sapiens
aagugaagaugcagaguua

SEQ ID NO: 955678 - RNA, 19 nt, Homo sapiens
caauucaccuuauggguau

SEQ ID NO: 955679 - RNA, 19 nt, Homo sapiens
gaaagcaauugaacugaac

SEQ ID NO: 955680 - RNA, 19 nt, Homo sapiens
uuagugauguuggagauua

SEQ ID NO: 955681 - RNA, 19 nt, Homo sapiens
guaugaagcccuagaguau

SEQ ID NO: 955682 - RNA, 19 nt, Homo sapiens
gcuaauaaacauugccuuu

SEQ ID NO: 955683 - RNA, 19 nt, Homo sapiens
cagaacaaguggauccaaa

SEQ ID NO: 955684 - RNA, 19 nt, Homo sapiens
ugagaagaauugagaacuu

SEQ ID NO: 955685 - RNA, 19 nt, Homo sapiens
agaggaggauaaacagaua

SEQ ID NO: 955686 - RNA, 19 nt, Homo sapiens
cgaaaugccuugguaucaa

SEQ ID NO: 955687 - RNA, 19 nt, Homo sapiens
cuaggcuucuucacaaaua

SEQ ID NO: 955688 - RNA, 19 nt, Homo sapiens
ucucagcuuugucguauuu

SEQ ID NO: 955689 - RNA, 19 nt, Homo sapiens
agaaagcaauugaacugaa

SEQ ID NO: 955690 - RNA, 19 nt, Homo sapiens
caaggaaagugaagaugca

SEQ ID NO: 955691 - RNA, 19 nt, Homo sapiens
gaaagcggagaaacagaaa

SEQ ID NO: 955692 - RNA, 19 nt, Homo sapiens
gcagacuaccuguaugaaa

SEQ ID NO: 955693 - RNA, 19 nt, Homo sapiens
guagcugccugaaguagug

SEQ ID NO: 955694 - RNA, 19 nt, Homo sapiens
uaaauaaucgccauaagag

SEQ ID NO: 955695 - RNA, 19 nt, Homo sapiens
cuacuucaauucaccuuau

SEQ ID NO: 955696 - RNA, 19 nt, Homo sapiens
cccaggaacuuucaacaga

SEQ ID NO: 955697 - RNA, 19 nt, Homo sapiens
gcaaucugccuuagugaug

SEQ ID NO: 955698 - RNA, 19 nt, Homo sapiens
cagacuaccuguaugaaag

SEQ ID NO: 955699 - RNA, 19 nt, Homo sapiens
auaaacagauacagacaga

SEQ ID NO: 955700 - RNA, 19 nt, Homo sapiens
gaggauaaacagauacaga

SEQ ID NO: 955701 - RNA, 19 nt, Homo sapiens
cuaaagaugcuacuucaau

SEQ ID NO: 955702 - RNA, 19 nt, Homo sapiens
ccauaagagugguagaaau

SEQ ID NO: 955703 - RNA, 19 nt, Homo sapiens
gcugcuuucuggcuaauga

SEQ ID NO: 955704 - RNA, 19 nt, Homo sapiens
cagccaaaguugaagaaau

SEQ ID NO: 955705 - RNA, 19 nt, Homo sapiens
agacauacuugaaacuaca

SEQ ID NO: 955706 - RNA, 19 nt, Homo sapiens
ucacagggcagaacaagug

SEQ ID NO: 955707 - RNA, 19 nt, Homo sapiens
uaugcaaucugccuuagug

SEQ ID NO: 955708 - RNA, 19 nt, Homo sapiens
cucaguugcuuacaaguuu

SEQ ID NO: 955709 - RNA, 19 nt, Homo sapiens
acacagaggaggauaaaca

SEQ ID NO: 955710 - RNA, 19 nt, Homo sapiens
agacagaagcugcucaguu

SEQ ID NO: 955711 - RNA, 19 nt, Homo sapiens
augcauauaucaucaagga

SEQ ID NO: 955712 - RNA, 19 nt, Homo sapiens
gaagaugcagaguuacugu

SEQ ID NO: 955713 - RNA, 19 nt, Homo sapiens
ugaaagcggagaaacagaa

SEQ ID NO: 955714 - RNA, 19 nt, Homo sapiens
gagaaagcaauugaacuga

SEQ ID NO: 955715 - RNA, 19 nt, Homo sapiens
uaaugaaagccaaggacua

SEQ ID NO: 955716 - RNA, 19 nt, Homo sapiens
gaacaaguggauccaaacu

SEQ ID NO: 955717 - RNA, 19 nt, Homo sapiens
ugagaaagcaauugaacug

SEQ ID NO: 955718 - RNA, 19 nt, Homo sapiens
caagcagacuaccuguaug

SEQ ID NO: 955719 - RNA, 19 nt, Homo sapiens
ucagugagaagaauugaga

SEQ ID NO: 955720 - RNA, 19 nt, Homo sapiens
gcucaguugcuuacaaguu

SEQ ID NO: 955721 - RNA, 19 nt, Homo sapiens
caaggagcauuuugagaaa

SEQ ID NO: 955722 - RNA, 19 nt, Homo sapiens
uagcagaaccucagaagag

SEQ ID NO: 955723 - RNA, 19 nt, Homo sapiens
acaagcagacuaccuguau

SEQ ID NO: 955724 - RNA, 19 nt, Homo sapiens
gaaagacauacuugaaacu

SEQ ID NO: 955725 - RNA, 19 nt, Homo sapiens
uaggaaagacauacuugaa

SEQ ID NO: 955726 - RNA, 19 nt, Homo sapiens
uuugaaacuuaccagguua

SEQ ID NO: 955727 - RNA, 19 nt, Homo sapiens
cagaguuacuguggcguuu

SEQ ID NO: 955728 - RNA, 19 nt, Homo sapiens
aaacagauacagacagaag

SEQ ID NO: 955729 - RNA, 19 nt, Homo sapiens
gcacacacagaggaggaua

SEQ ID NO: 955730 - RNA, 19 nt, Homo sapiens
uguaugaagcccuagagua

SEQ ID NO: 955731 - RNA, 19 nt, Homo sapiens
gcugcucaguugcuuacaa

SEQ ID NO: 955732 - RNA, 19 nt, Homo sapiens
gcuucgagguaaugggaaa

SEQ ID NO: 955733 - RNA, 19 nt, Homo sapiens
auucuaggcuucuucacaa

SEQ ID NO: 955734 - RNA, 19 nt, Homo sapiens
cuuacaaguuucagugaga

SEQ ID NO: 955735 - RNA, 19 nt, Homo sapiens
guaugaaagcggagaaaca

SEQ ID NO: 955736 - RNA, 19 nt, Homo sapiens
uuacaaguuucagugagaa

SEQ ID NO: 955737 - RNA, 19 nt, Homo sapiens
augaaggcaucaaggcuaa

SEQ ID NO: 955738 - RNA, 19 nt, Homo sapiens
caaucugccuuagugaugu

SEQ ID NO: 955739 - RNA, 19 nt, Homo sapiens
gaauugagaacuuuucaga

SEQ ID NO: 955740 - RNA, 19 nt, Homo sapiens
ggauaaacagauacagaca

SEQ ID NO: 955741 - RNA, 19 nt, Homo sapiens
aggaaagacauacuugaaa

SEQ ID NO: 955742 - RNA, 19 nt, Homo sapiens
cccuaaagaugcuacuuca

SEQ ID NO: 955743 - RNA, 19 nt, Homo sapiens
acucucagcuuugucguau

SEQ ID NO: 955744 - RNA, 19 nt, Homo sapiens
gccauaagagugguagaaa

SEQ ID NO: 955745 - RNA, 19 nt, Homo sapiens
ggacuauccagcacacaca

SEQ ID NO: 955746 - RNA, 19 nt, Homo sapiens
aagcagacuaccuguauga

SEQ ID NO: 955747 - RNA, 19 nt, Homo sapiens
cuccguagcugccugaagu

SEQ ID NO: 955748 - RNA, 19 nt, Homo sapiens
uugccgaaaugccuuggua

SEQ ID NO: 955749 - RNA, 19 nt, Homo sapiens
aaagugaagaugcagaguu

SEQ ID NO: 955750 - RNA, 19 nt, Homo sapiens
caaguuucagugagaagaa

SEQ ID NO: 955751 - RNA, 19 nt, Homo sapiens
cagaggaggauaaacagau

SEQ ID NO: 955752 - RNA, 19 nt, Homo sapiens
gaguuacuguggcguuugg

SEQ ID NO: 955753 - RNA, 19 nt, Homo sapiens
aaacuuaccagguuaucuc

SEQ ID NO: 955754 - RNA, 19 nt, Homo sapiens
uaggcuucuucacaaauaa

SEQ ID NO: 955755 - RNA, 19 nt, Homo sapiens
aaugaaagccaaggacuau

SEQ ID NO: 955756 - RNA, 19 nt, Homo sapiens
gccuugguaucaaagaaga

SEQ ID NO: 955757 - RNA, 19 nt, Homo sapiens
aaagaugcuacuucaauuc

SEQ ID NO: 955758 - RNA, 19 nt, Homo sapiens
gguaugcaaucugccuuag

SEQ ID NO: 955759 - RNA, 19 nt, Homo sapiens
ccaauacaaggaaagugaa

SEQ ID NO: 955760 - RNA, 19 nt, Homo sapiens
cccaauacaaggaaaguga

SEQ ID NO: 955761 - RNA, 19 nt, Homo sapiens
cuuaccagguuaucucuca

SEQ ID NO: 955762 - RNA, 19 nt, Homo sapiens
acacacagaggaggauaaa

SEQ ID NO: 955763 - RNA, 19 nt, Homo sapiens
ccuccuaguuccaccuaug

SEQ ID NO: 955764 - RNA, 19 nt, Homo sapiens
caacagaggccuuuuacuc

SEQ ID NO: 955765 - RNA, 19 nt, Homo sapiens
uugcaucucauaaguggua

SEQ ID NO: 955766 - RNA, 19 nt, Homo sapiens
ccacagccaaaguugaaga

SEQ ID NO: 955767 - RNA, 19 nt, Homo sapiens
acuugaaacuacacaacaa

SEQ ID NO: 955768 - RNA, 19 nt, Homo sapiens
ggcaucaucuuguuuauaa

SEQ ID NO: 955769 - RNA, 19 nt, Homo sapiens
gaacauggcccgugacugu

SEQ ID NO: 955770 - RNA, 19 nt, Homo sapiens
gaacuucaccgcccacaug

SEQ ID NO: 955771 - RNA, 19 nt, Homo sapiens
ccucagucguuguuacuua

SEQ ID NO: 955772 - RNA, 19 nt, Homo sapiens
ggaccaacguugccaugug

SEQ ID NO: 955773 - RNA, 19 nt, Homo sapiens
caagcacucugacuucuuc

SEQ ID NO: 955774 - RNA, 19 nt, Homo sapiens
gcaccgauuucaacgacaa

SEQ ID NO: 955775 - RNA, 19 nt, Homo sapiens
uuacucagcugaugucaca

SEQ ID NO: 955776 - RNA, 19 nt, Homo sapiens
gcaguucucguaccugauu

SEQ ID NO: 955777 - RNA, 19 nt, Homo sapiens
ggaccucaguggcugguau

SEQ ID NO: 955778 - RNA, 19 nt, Homo sapiens
ggacagccaggccagauga

SEQ ID NO: 955779 - RNA, 19 nt, Homo sapiens
ggacagcaccgauuucaac

SEQ ID NO: 955780 - RNA, 19 nt, Homo sapiens
gcaaccggcaguucucgua

SEQ ID NO: 955781 - RNA, 19 nt, Homo sapiens
gagagacgcagccaagaug

SEQ ID NO: 955782 - RNA, 19 nt, Homo sapiens
gggcaucaucuuguuuaua

SEQ ID NO: 955783 - RNA, 19 nt, Homo sapiens
ccucaucaccuacccugua

SEQ ID NO: 955784 - RNA, 19 nt, Homo sapiens
gauuucaacgacaagauuu

SEQ ID NO: 955785 - RNA, 19 nt, Homo sapiens
caaugucaaggaacuguuu

SEQ ID NO: 955786 - RNA, 19 nt, Homo sapiens
gcacucugacuucuucaau

SEQ ID NO: 955787 - RNA, 19 nt, Homo sapiens
gaagcgcgacggcccuuau

SEQ ID NO: 955788 - RNA, 19 nt, Homo sapiens
acucugacuucuucaaugu

SEQ ID NO: 955789 - RNA, 19 nt, Homo sapiens
gaggacagcaccgauuuca

SEQ ID NO: 955790 - RNA, 19 nt, Homo sapiens
cgacaucaucgaccuggaa

SEQ ID NO: 955791 - RNA, 19 nt, Homo sapiens
cuucuucaaugucaaggaa

SEQ ID NO: 955792 - RNA, 19 nt, Homo sapiens
gcagguugaggcucucuau

SEQ ID NO: 955793 - RNA, 19 nt, Homo sapiens
ugccggaccucaucaucuu

SEQ ID NO: 955794 - RNA, 19 nt, Homo sapiens
aagggcaucaucuuguuua

SEQ ID NO: 955795 - RNA, 19 nt, Homo sapiens
uauggagccguacaucuuu

SEQ ID NO: 955796 - RNA, 19 nt, Homo sapiens
cgauuucaacgacaagauu

SEQ ID NO: 955797 - RNA, 19 nt, Homo sapiens
guaccugauugagaacaug

SEQ ID NO: 955798 - RNA, 19 nt, Homo sapiens
gagacgcagccaagaugaa

SEQ ID NO: 955799 - RNA, 19 nt, Homo sapiens
cggaggacagcaccgauuu

SEQ ID NO: 955800 - RNA, 19 nt, Homo sapiens
caaucuaaaugccuuucag

SEQ ID NO: 955801 - RNA, 19 nt, Homo sapiens
ucacucuccucccaaagca

SEQ ID NO: 955802 - RNA, 19 nt, Homo sapiens
acgacaagauuuugaauga

SEQ ID NO: 955803 - RNA, 19 nt, Homo sapiens
ggaggacagcaccgauuuc

SEQ ID NO: 955804 - RNA, 19 nt, Homo sapiens
uuauggagccguacaucuu

SEQ ID NO: 955805 - RNA, 19 nt, Homo sapiens
gcagacauccaccguucca

SEQ ID NO: 955806 - RNA, 19 nt, Homo sapiens
ccucaagcacucugacuuc

SEQ ID NO: 955807 - RNA, 19 nt, Homo sapiens
ugagagacgcagccaagau

SEQ ID NO: 955808 - RNA, 19 nt, Homo sapiens
gcgcgacggcccuuaugau

SEQ ID NO: 955809 - RNA, 19 nt, Homo sapiens
cacucugacuucuucaaug

SEQ ID NO: 955810 - RNA, 19 nt, Homo sapiens
ggagaagcggcagcagguu

SEQ ID NO: 955811 - RNA, 19 nt, Homo sapiens
gcacacgcucaacaacauc

SEQ ID NO: 955812 - RNA, 19 nt, Homo sapiens
guuacuuacucagcugaug

SEQ ID NO: 955813 - RNA, 19 nt, Homo sapiens
agaagcggcagcagguuga

SEQ ID NO: 955814 - RNA, 19 nt, Homo sapiens
ugcacacgcucaacaacau

SEQ ID NO: 955815 - RNA, 19 nt, Homo sapiens
cgcccacacucgcuacuuc

SEQ ID NO: 955816 - RNA, 19 nt, Homo sapiens
gcaucaucuuguuuauaag

SEQ ID NO: 955817 - RNA, 19 nt, Homo sapiens
ggagcuagcguauguaauu

SEQ ID NO: 955818 - RNA, 19 nt, Homo sapiens
gaaccaugcaugaacagua

SEQ ID NO: 955819 - RNA, 19 nt, Homo sapiens
ggagaaccaugcaugaaca

SEQ ID NO: 955820 - RNA, 19 nt, Homo sapiens
cauccugggugcauucuuu

SEQ ID NO: 955821 - RNA, 19 nt, Homo sapiens
ggaggcgagugugugaaua

SEQ ID NO: 955822 - RNA, 19 nt, Homo sapiens
gggaggagcugggcauuac

SEQ ID NO: 955823 - RNA, 19 nt, Homo sapiens
gaggagcuagcguauguaa

SEQ ID NO: 955824 - RNA, 19 nt, Homo sapiens
gaggugacauggcgagagu

SEQ ID NO: 955825 - RNA, 19 nt, Homo sapiens
gaggcgagugugugaauaa

SEQ ID NO: 955826 - RNA, 19 nt, Homo sapiens
gagcuagcguauguaauuc

SEQ ID NO: 955827 - RNA, 19 nt, Homo sapiens
gaauaaaggcucccaucag

SEQ ID NO: 955828 - RNA, 19 nt, Homo sapiens
caaggagaaccaugcauga

SEQ ID NO: 955829 - RNA, 19 nt, Homo sapiens
gggagaucguggugaaaug

SEQ ID NO: 955830 - RNA, 19 nt, Homo sapiens
ugacauggcgagagucuug

SEQ ID NO: 955831 - RNA, 19 nt, Homo sapiens
gcgagugugugaauaaagg

SEQ ID NO: 955832 - RNA, 19 nt, Homo sapiens
aaccaugcaugaacaguau

SEQ ID NO: 955833 - RNA, 19 nt, Homo sapiens
ccucuucuuugaacacuga

SEQ ID NO: 955834 - RNA, 19 nt, Homo sapiens
agacuggccugcccaugug

SEQ ID NO: 955835 - RNA, 19 nt, Homo sapiens
augaggagcuagcguaugu

SEQ ID NO: 955836 - RNA, 19 nt, Homo sapiens
gggcuacacccaauuccaa

SEQ ID NO: 955837 - RNA, 19 nt, Homo sapiens
gacccuuggacaacauuua

SEQ ID NO: 955838 - RNA, 19 nt, Homo sapiens
gaaaaccggcuguggagaa

SEQ ID NO: 955839 - RNA, 19 nt, Homo sapiens
ugaauaaaggcucccauca

SEQ ID NO: 955840 - RNA, 19 nt, Homo sapiens
gcagggagcaagcaguaca

SEQ ID NO: 955841 - RNA, 19 nt, Homo sapiens
gugcuggucucggaguuga

SEQ ID NO: 955842 - RNA, 19 nt, Homo sapiens
gaucguggugaaaugguuu

SEQ ID NO: 955843 - RNA, 19 nt, Homo sapiens
cguagacgguagacaguuc

SEQ ID NO: 955844 - RNA, 19 nt, Homo sapiens
ccaaaagccugagaagaga

SEQ ID NO: 955845 - RNA, 19 nt, Homo sapiens
uccucaaccuguacuauga

SEQ ID NO: 955846 - RNA, 19 nt, Homo sapiens
ggaggugcacgacaugcuu

SEQ ID NO: 955847 - RNA, 19 nt, Homo sapiens
ccgcagggagcaagcagua

SEQ ID NO: 955848 - RNA, 19 nt, Homo sapiens
cggcgauggcgcucuauaa

SEQ ID NO: 955849 - RNA, 19 nt, Homo sapiens
agacaguucgcgugcguuu

SEQ ID NO: 955850 - RNA, 19 nt, Homo sapiens
gggaggcgagugugugaau

SEQ ID NO: 955851 - RNA, 19 nt, Homo sapiens
cagacuggccugcccaugu

SEQ ID NO: 955852 - RNA, 19 nt, Homo sapiens
ucccuugacuaccuuuguu

SEQ ID NO: 955853 - RNA, 19 nt, Homo sapiens
ggagaucguggugaaaugg

SEQ ID NO: 955854 - RNA, 19 nt, Homo sapiens
gcgaguaucuccguuuccu

SEQ ID NO: 955855 - RNA, 19 nt, Homo sapiens
agugagggcuacacccaau

SEQ ID NO: 955856 - RNA, 19 nt, Homo sapiens
ucagucgucugggcucaug

SEQ ID NO: 955857 - RNA, 19 nt, Homo sapiens
guuugaggcuguccagacu

SEQ ID NO: 955858 - RNA, 19 nt, Homo sapiens
gcguuuccuucgccuacuu

SEQ ID NO: 955859 - RNA, 19 nt, Homo sapiens
gcuagcguauguaauucag

SEQ ID NO: 955860 - RNA, 19 nt, Homo sapiens
guaucuccguuuccuggau

SEQ ID NO: 955861 - RNA, 19 nt, Homo sapiens
cuuuguuccucuucuuuga

SEQ ID NO: 955862 - RNA, 19 nt, Homo sapiens
gggcucccuugacuaccuu

SEQ ID NO: 955863 - RNA, 19 nt, Homo sapiens
ucgcgaguaucuccguuuc

SEQ ID NO: 955864 - RNA, 19 nt, Homo sapiens
aggcgagugugugaauaaa

SEQ ID NO: 955865 - RNA, 19 nt, Homo sapiens
uuggaucgguggacguaga

SEQ ID NO: 955866 - RNA, 19 nt, Homo sapiens
caggcuggguguccucaca

SEQ ID NO: 955867 - RNA, 19 nt, Homo sapiens
accagcagcuacccaagga

SEQ ID NO: 955868 - RNA, 19 nt, Homo sapiens
cgggaggagcugggcauua

SEQ ID NO: 955869 - RNA, 19 nt, Homo sapiens
gagaagaaauuguucguua

SEQ ID NO: 955870 - RNA, 19 nt, Homo sapiens
gaacucaggacgucaaaua

SEQ ID NO: 955871 - RNA, 19 nt, Homo sapiens
aaaggaaguugaacaguuu

SEQ ID NO: 955872 - RNA, 19 nt, Homo sapiens
caaauuccauuacuccaaa

SEQ ID NO: 955873 - RNA, 19 nt, Homo sapiens
gcgaauagcuaaagaaagg

SEQ ID NO: 955874 - RNA, 19 nt, Homo sapiens
ggacuuaagcgaauagcua

SEQ ID NO: 955875 - RNA, 19 nt, Homo sapiens
ugaaaggaguuaccaauca

SEQ ID NO: 955876 - RNA, 19 nt, Homo sapiens
caggauggaguacauauua

SEQ ID NO: 955877 - RNA, 19 nt, Homo sapiens
gaacaacuaaagcugauga

SEQ ID NO: 955878 - RNA, 19 nt, Homo sapiens
ggauagagaccuugcagaa

SEQ ID NO: 955879 - RNA, 19 nt, Homo sapiens
caacuaaagcugaugagaa

SEQ ID NO: 955880 - RNA, 19 nt, Homo sapiens
ggacgucaaauauauagaa

SEQ ID NO: 955881 - RNA, 19 nt, Homo sapiens
gaaaggaguuaccaaucag

SEQ ID NO: 955882 - RNA, 19 nt, Homo sapiens
gcagaugacuaccguaaaa

SEQ ID NO: 955883 - RNA, 19 nt, Homo sapiens
gaagaggguugcagaagcu

SEQ ID NO: 955884 - RNA, 19 nt, Homo sapiens
cagaugaauucuacuacaa

SEQ ID NO: 955885 - RNA, 19 nt, Homo sapiens
caacagaacaagcaugugu

SEQ ID NO: 955886 - RNA, 19 nt, Homo sapiens
caaacacgcaaagaucuua

SEQ ID NO: 955887 - RNA, 19 nt, Homo sapiens
gaaagugaaggugaagaaa

SEQ ID NO: 955888 - RNA, 19 nt, Homo sapiens
caaaaugacucggguuaaa

SEQ ID NO: 955889 - RNA, 19 nt, Homo sapiens
gauaagccuugucauucug

SEQ ID NO: 955890 - RNA, 19 nt, Homo sapiens
gauagagaccuugcagaaa

SEQ ID NO: 955891 - RNA, 19 nt, Homo sapiens
uaaggagacuaaggaagaa

SEQ ID NO: 955892 - RNA, 19 nt, Homo sapiens
ggauggaguacauauuauu

SEQ ID NO: 955893 - RNA, 19 nt, Homo sapiens
acgcaaagaucuuauggau

SEQ ID NO: 955894 - RNA, 19 nt, Homo sapiens
gaaguugaacaguuugaug

SEQ ID NO: 955895 - RNA, 19 nt, Homo sapiens
aaacaagaauaccucaaag

SEQ ID NO: 955896 - RNA, 19 nt, Homo sapiens
aagugaaggugaagaaaga

SEQ ID NO: 955897 - RNA, 19 nt, Homo sapiens
ggauugaacgagagaagaa

SEQ ID NO: 955898 - RNA, 19 nt, Homo sapiens
agacuggacuuaagcgaau

SEQ ID NO: 955899 - RNA, 19 nt, Homo sapiens
ccagaugaauucuacuaca

SEQ ID NO: 955900 - RNA, 19 nt, Homo sapiens
auagagaccuugcagaaag

SEQ ID NO: 955901 - RNA, 19 nt, Homo sapiens
gcuagucgacagagucuuu

SEQ ID NO: 955902 - RNA, 19 nt, Homo sapiens
ggaagcaacagaacaagca

SEQ ID NO: 955903 - RNA, 19 nt, Homo sapiens
uuaaggagacuaaggaaga

SEQ ID NO: 955904 - RNA, 19 nt, Homo sapiens
ggauaaaacucagaaagug

SEQ ID NO: 955905 - RNA, 19 nt, Homo sapiens
cagaacaacuaaagcugau

SEQ ID NO: 955906 - RNA, 19 nt, Homo sapiens
gaacgagagaagaaauugu

SEQ ID NO: 955907 - RNA, 19 nt, Homo sapiens
gucgacagagucuuuaaua

SEQ ID NO: 955908 - RNA, 19 nt, Homo sapiens
uuacaaacuucgugcagau

SEQ ID NO: 955909 - RNA, 19 nt, Homo sapiens
ccaaggcuguacagacaug

SEQ ID NO: 955910 - RNA, 19 nt, Homo sapiens
uagauaagccuugucauuc

SEQ ID NO: 955911 - RNA, 19 nt, Homo sapiens
ccaaucagacuggacuuaa

SEQ ID NO: 955912 - RNA, 19 nt, Homo sapiens
cucaggacgucaaauauau

SEQ ID NO: 955913 - RNA, 19 nt, Homo sapiens
ggagacuaaggaagaagua

SEQ ID NO: 955914 - RNA, 19 nt, Homo sapiens
cgacagagucuuuaauagg

SEQ ID NO: 955915 - RNA, 19 nt, Homo sapiens
gacuuaagcgaauagcuaa

SEQ ID NO: 955916 - RNA, 19 nt, Homo sapiens
uagagaccuugcagaaaga

SEQ ID NO: 955917 - RNA, 19 nt, Homo sapiens
aaaaggaaguugaacaguu

SEQ ID NO: 955918 - RNA, 19 nt, Homo sapiens
gugcagaugacuaccguaa

SEQ ID NO: 955919 - RNA, 19 nt, Homo sapiens
caaucagacuggacuuaag

SEQ ID NO: 955920 - RNA, 19 nt, Homo sapiens
acucaggacgucaaauaua

SEQ ID NO: 955921 - RNA, 19 nt, Homo sapiens
auagauaagccuugucauu

SEQ ID NO: 955922 - RNA, 19 nt, Homo sapiens
agauaagccuugucauucu

SEQ ID NO: 955923 - RNA, 19 nt, Homo sapiens
ucaggacgucaaauauaua

SEQ ID NO: 955924 - RNA, 19 nt, Homo sapiens
ucuaguaacuucaaauucc

SEQ ID NO: 955925 - RNA, 19 nt, Homo sapiens
guucguuauugcucagaaa

SEQ ID NO: 955926 - RNA, 19 nt, Homo sapiens
gaaauuguucguuauugcu

SEQ ID NO: 955927 - RNA, 19 nt, Homo sapiens
uuaagcgaauagcuaaaga

SEQ ID NO: 955928 - RNA, 19 nt, Homo sapiens
agaaagugaaggugaagaa

SEQ ID NO: 955929 - RNA, 19 nt, Homo sapiens
gcaacucaccugcaaacag

SEQ ID NO: 955930 - RNA, 19 nt, Homo sapiens
ugucgcaacucaccugcaa

SEQ ID NO: 955931 - RNA, 19 nt, Homo sapiens
gaagaaagaaacggugaac

SEQ ID NO: 955932 - RNA, 19 nt, Homo sapiens
aagcgaauagcuaaagaaa

SEQ ID NO: 955933 - RNA, 19 nt, Homo sapiens
aacuaaagcugaugagaac

SEQ ID NO: 955934 - RNA, 19 nt, Homo sapiens
aaaucucccucccuucugu

SEQ ID NO: 955935 - RNA, 19 nt, Homo sapiens
ucaaauuccauuacuccaa

SEQ ID NO: 955936 - RNA, 19 nt, Homo sapiens
agaaagaaacggugaacuc

SEQ ID NO: 955937 - RNA, 19 nt, Homo sapiens
agaaauuguucguuauugc

SEQ ID NO: 955938 - RNA, 19 nt, Homo sapiens
aaauccagaugaauucuac

SEQ ID NO: 955939 - RNA, 19 nt, Homo sapiens
cucccucccuucuguaauu

SEQ ID NO: 955940 - RNA, 19 nt, Homo sapiens
uuccaaggcuguacagaca

SEQ ID NO: 955941 - RNA, 19 nt, Homo sapiens
gacuggacuuaagcgaaua

SEQ ID NO: 955942 - RNA, 19 nt, Homo sapiens
ucgacagagucuuuaauag

SEQ ID NO: 955943 - RNA, 19 nt, Homo sapiens
gagacuaaggaagaaguaa

SEQ ID NO: 955944 - RNA, 19 nt, Homo sapiens
gauaaaacucagaaaguga

SEQ ID NO: 955945 - RNA, 19 nt, Homo sapiens
uaagcgaauagcuaaagaa

SEQ ID NO: 955946 - RNA, 19 nt, Homo sapiens
gugaaaggaguuaccaauc

SEQ ID NO: 955947 - RNA, 19 nt, Homo sapiens
uuaauaggcccaggauaga

SEQ ID NO: 955948 - RNA, 19 nt, Homo sapiens
uuuaauaggcccaggauag

SEQ ID NO: 955949 - RNA, 19 nt, Homo sapiens
uaagccuugucauucugua

SEQ ID NO: 955950 - RNA, 19 nt, Homo sapiens
gaacuccccagcuauuuau

SEQ ID NO: 955951 - RNA, 19 nt, Homo sapiens
gaaaggcaaaagcaguaua

SEQ ID NO: 955952 - RNA, 19 nt, Homo sapiens
gagaacucaggacgucaaa

SEQ ID NO: 955953 - RNA, 19 nt, Homo sapiens
ucaaacacgcaaagaucuu

SEQ ID NO: 955954 - RNA, 19 nt, Homo sapiens
ugaacgagagaagaaauug

SEQ ID NO: 955955 - RNA, 19 nt, Homo sapiens
aggauggaguacauauuau

SEQ ID NO: 955956 - RNA, 19 nt, Homo sapiens
gguugcagaagcuaagaaa

SEQ ID NO: 955957 - RNA, 19 nt, Homo sapiens
ggaguacauauuauuaagg

SEQ ID NO: 955958 - RNA, 19 nt, Homo sapiens
cuaguaacuucaaauucca

SEQ ID NO: 955959 - RNA, 19 nt, Homo sapiens
gugaaggugaagaaagaaa

SEQ ID NO: 955960 - RNA, 19 nt, Homo sapiens
cgcaaagaucuuauggaua

SEQ ID NO: 955961 - RNA, 19 nt, Homo sapiens
ccaggauggaguacauauu

SEQ ID NO: 955962 - RNA, 19 nt, Homo sapiens
cucagaaagugaaggugaa

SEQ ID NO: 955963 - RNA, 19 nt, Homo sapiens
acaaacuucgugcagauga

SEQ ID NO: 955964 - RNA, 19 nt, Homo sapiens
gagagaagaaauuguucgu

SEQ ID NO: 955965 - RNA, 19 nt, Homo sapiens
gauugaacgagagaagaaa

SEQ ID NO: 955966 - RNA, 19 nt, Homo sapiens
gaaagauuacaaacuucgu

SEQ ID NO: 955967 - RNA, 19 nt, Homo sapiens
uuaaaucucccucccuucu

SEQ ID NO: 955968 - RNA, 19 nt, Homo sapiens
aaagugaaggugaagaaag

SEQ ID NO: 955969 - RNA, 19 nt, Homo sapiens
gcaagaagcugaaagaaaa

SEQ ID NO: 955970 - RNA, 19 nt, Homo sapiens
gaacagaugaccaaacuga

SEQ ID NO: 955971 - RNA, 19 nt, Homo sapiens
gcaaggcuuuccuacauaa

SEQ ID NO: 955972 - RNA, 19 nt, Homo sapiens
agaaggagaugagaaauuu

SEQ ID NO: 955973 - RNA, 19 nt, Homo sapiens
uaaaggagaaguucaagua

SEQ ID NO: 955974 - RNA, 19 nt, Homo sapiens
cgaaaucgccugcuacaaa

SEQ ID NO: 955975 - RNA, 19 nt, Homo sapiens
uggaugauguuccugauua

SEQ ID NO: 955976 - RNA, 19 nt, Homo sapiens
gauagaacgugcucacaug

SEQ ID NO: 955977 - RNA, 19 nt, Homo sapiens
ugaaggacauccacuauuc

SEQ ID NO: 955978 - RNA, 19 nt, Homo sapiens
ucugaaagauguagaagaa

SEQ ID NO: 955979 - RNA, 19 nt, Homo sapiens
gaugcuucauuucuacuua

SEQ ID NO: 955980 - RNA, 19 nt, Homo sapiens
aaaggaaacuaaaggcaaa

SEQ ID NO: 955981 - RNA, 19 nt, Homo sapiens
cagcaaggcuuuccuacau

SEQ ID NO: 955982 - RNA, 19 nt, Homo sapiens
ugaccaaacugaaaucugu

SEQ ID NO: 955983 - RNA, 19 nt, Homo sapiens
guaagcagauuuugacuaa

SEQ ID NO: 955984 - RNA, 19 nt, Homo sapiens
guacaguagaguaagauua

SEQ ID NO: 955985 - RNA, 19 nt, Homo sapiens
ccaaauacuugcuuaaacu

SEQ ID NO: 955986 - RNA, 19 nt, Homo sapiens
cgacggcacuguuucaugu

SEQ ID NO: 955987 - RNA, 19 nt, Homo sapiens
gaaaucgccugcuacaaaa

SEQ ID NO: 955988 - RNA, 19 nt, Homo sapiens
gaagugauaaagcaguuaa

SEQ ID NO: 955989 - RNA, 19 nt, Homo sapiens
gaaaacauaugaugcuuca

SEQ ID NO: 955990 - RNA, 19 nt, Homo sapiens
gaaacuaaaggcaaagguu

SEQ ID NO: 955991 - RNA, 19 nt, Homo sapiens
aaaggaagaucucaucagu

SEQ ID NO: 955992 - RNA, 19 nt, Homo sapiens
ggaaguacucaaucugaaa

SEQ ID NO: 955993 - RNA, 19 nt, Homo sapiens
caacuggagcagauguuua

SEQ ID NO: 955994 - RNA, 19 nt, Homo sapiens
gaacaugcugccauaacuu

SEQ ID NO: 955995 - RNA, 19 nt, Homo sapiens
gcagacaaaugugugaauc

SEQ ID NO: 955996 - RNA, 19 nt, Homo sapiens
cauugaacaugcugccaua

SEQ ID NO: 955997 - RNA, 19 nt, Homo sapiens
ggcaagaagcugaaagaaa

SEQ ID NO: 955998 - RNA, 19 nt, Homo sapiens
gaacagccgcgaugucgau

SEQ ID NO: 955999 - RNA, 19 nt, Homo sapiens
acacacaacuggagcagau

SEQ ID NO: 956000 - RNA, 19 nt, Homo sapiens
gagaugagaaauuugaaug

SEQ ID NO: 956001 - RNA, 19 nt, Homo sapiens
gaaugacacccaucaaucu

SEQ ID NO: 956002 - RNA, 19 nt, Homo sapiens
ggaugauguuccugauuau

SEQ ID NO: 956003 - RNA, 19 nt, Homo sapiens
uuagaaaucguaugucuga

SEQ ID NO: 956004 - RNA, 19 nt, Homo sapiens
uuagggacauugcaacuau

SEQ ID NO: 956005 - RNA, 19 nt, Homo sapiens
ccauacaccgugauccuua

SEQ ID NO: 956006 - RNA, 19 nt, Homo sapiens
gaaacaaagagaccauaca

SEQ ID NO: 956007 - RNA, 19 nt, Homo sapiens
aaacugaaaucuguaagca

SEQ ID NO: 956008 - RNA, 19 nt, Homo sapiens
agaagaaggagaugagaaa

SEQ ID NO: 956009 - RNA, 19 nt, Homo sapiens
ucucaugccuugauagcuu

SEQ ID NO: 956010 - RNA, 19 nt, Homo sapiens
gaaagauguagaagaagga

SEQ ID NO: 956011 - RNA, 19 nt, Homo sapiens
ccgagaaauugaugagcua

SEQ ID NO: 956012 - RNA, 19 nt, Homo sapiens
aggagaaguucaaguauca

SEQ ID NO: 956013 - RNA, 19 nt, Homo sapiens
gccaaauacuugcuuaaac

SEQ ID NO: 956014 - RNA, 19 nt, Homo sapiens
ggacauugcaacuauugug

SEQ ID NO: 956015 - RNA, 19 nt, Homo sapiens
ggucauagaaagugaagau

SEQ ID NO: 956016 - RNA, 19 nt, Homo sapiens
gaugagaaauuugaaugac

SEQ ID NO: 956017 - RNA, 19 nt, Homo sapiens
gaucaaggucauagaaagu

SEQ ID NO: 956018 - RNA, 19 nt, Homo sapiens
uaaagaaagacacacacaa

SEQ ID NO: 956019 - RNA, 19 nt, Homo sapiens
ucaaggucauagaaaguga

SEQ ID NO: 956020 - RNA, 19 nt, Homo sapiens
guacaaaacagcaggcuuu

SEQ ID NO: 956021 - RNA, 19 nt, Homo sapiens
gaaguacucaaucugaaag

SEQ ID NO: 956022 - RNA, 19 nt, Homo sapiens
ucaagccacugaucaaggu

SEQ ID NO: 956023 - RNA, 19 nt, Homo sapiens
guucauccuuccagucaau

SEQ ID NO: 956024 - RNA, 19 nt, Homo sapiens
ggaagugauaaagcaguua

SEQ ID NO: 956025 - RNA, 19 nt, Homo sapiens
acaccgugauccuuauuga

SEQ ID NO: 956026 - RNA, 19 nt, Homo sapiens
uaauguaaagcuuggauga

SEQ ID NO: 956027 - RNA, 19 nt, Homo sapiens
gaagaaggagaugagaaau

SEQ ID NO: 956028 - RNA, 19 nt, Homo sapiens
gugugaauccugaaacaaa

SEQ ID NO: 956029 - RNA, 19 nt, Homo sapiens
gugccggacuuaccuuuca

SEQ ID NO: 956030 - RNA, 19 nt, Homo sapiens
cuugauagcuuuccaaaau

SEQ ID NO: 956031 - RNA, 19 nt, Homo sapiens
ucaaucucuucaccucuaa

SEQ ID NO: 956032 - RNA, 19 nt, Homo sapiens
ggagaugagaaauuugaau

SEQ ID NO: 956033 - RNA, 19 nt, Homo sapiens
uggaaguacucaaucugaa

SEQ ID NO: 956034 - RNA, 19 nt, Homo sapiens
gaaaagcucaagccacuga

SEQ ID NO: 956035 - RNA, 19 nt, Homo sapiens
uggaacagaugaccaaacu

SEQ ID NO: 956036 - RNA, 19 nt, Homo sapiens
acagaugaccaaacugaaa

SEQ ID NO: 956037 - RNA, 19 nt, Homo sapiens
gcugccauaacuuagauua

SEQ ID NO: 956038 - RNA, 19 nt, Homo sapiens
ugaacaugcugccauaacu

SEQ ID NO: 956039 - RNA, 19 nt, Homo sapiens
guaaagcuuggaugauguu

SEQ ID NO: 956040 - RNA, 19 nt, Homo sapiens
aggcuuuccuacauaagua

SEQ ID NO: 956041 - RNA, 19 nt, Homo sapiens
gaaggagaugagaaauuug

SEQ ID NO: 956042 - RNA, 19 nt, Homo sapiens
gagaaguucaaguaucaga

SEQ ID NO: 956043 - RNA, 19 nt, Homo sapiens
cugagaaacagauauagaa

SEQ ID NO: 956044 - RNA, 19 nt, Homo sapiens
ugacacccaucaaucucuu

SEQ ID NO: 956045 - RNA, 19 nt, Homo sapiens
ugaaugacacccaucaauc

SEQ ID NO: 956046 - RNA, 19 nt, Homo sapiens
gcuucgaaaucgccugcua

SEQ ID NO: 956047 - RNA, 19 nt, Homo sapiens
ugaucaaggucauagaaag

SEQ ID NO: 956048 - RNA, 19 nt, Homo sapiens
cagcaggcuuuggaaguga

SEQ ID NO: 956049 - RNA, 19 nt, Homo sapiens
ggucuaaauccuaaagcaa

SEQ ID NO: 956050 - RNA, 19 nt, Homo sapiens
gauuauggccaacaguuag

SEQ ID NO: 956051 - RNA, 19 nt, Homo sapiens
cauacaccgugauccuuau

SEQ ID NO: 956052 - RNA, 19 nt, Homo sapiens
aaggagaaguucaaguauc

SEQ ID NO: 956053 - RNA, 19 nt, Homo sapiens
aacaugcugccauaacuua

SEQ ID NO: 956054 - RNA, 19 nt, Homo sapiens
gaaacuccaagaugcaaag

SEQ ID NO: 956055 - RNA, 19 nt, Homo sapiens
gucuaaauccuaaagcaaa

SEQ ID NO: 956056 - RNA, 19 nt, Homo sapiens
agcaaggcuuuccuacaua

SEQ ID NO: 956057 - RNA, 19 nt, Homo sapiens
cagauccgccuaaccaaug

SEQ ID NO: 956058 - RNA, 19 nt, Homo sapiens
aagaaggagaugagaaauu

SEQ ID NO: 956059 - RNA, 19 nt, Homo sapiens
gggcugcuuccgagaaauu

SEQ ID NO: 956060 - RNA, 19 nt, Homo sapiens
uguaaagcuuggaugaugu

SEQ ID NO: 956061 - RNA, 19 nt, Homo sapiens
aaauugaaacuccaagaug

SEQ ID NO: 956062 - RNA, 19 nt, Homo sapiens
guauaauaaugugggaaug

SEQ ID NO: 956063 - RNA, 19 nt, Homo sapiens
gaccaaacugaaaucugua

SEQ ID NO: 956064 - RNA, 19 nt, Homo sapiens
agauuauggccaacaguua

SEQ ID NO: 956065 - RNA, 19 nt, Homo sapiens
ccaugaaggacauccacua

SEQ ID NO: 956066 - RNA, 19 nt, Homo sapiens
acucaguguuuguaaaugu

SEQ ID NO: 956067 - RNA, 19 nt, Homo sapiens
ggugaaaaguuauuuguac

SEQ ID NO: 956068 - RNA, 19 nt, Homo sapiens
acuaaaguguuuccguuuc

SEQ ID NO: 956069 - RNA, 19 nt, Homo sapiens
cuacaaaggucagcaaauu

SEQ ID NO: 956070 - RNA, 19 nt, Homo sapiens
gcaggaagaucaugucauc

SEQ ID NO: 956071 - RNA, 19 nt, Homo sapiens
ccacauaguauuugcauug

SEQ ID NO: 956072 - RNA, 19 nt, Homo sapiens
gaauaaauagaaccuguug

SEQ ID NO: 956073 - RNA, 19 nt, Homo sapiens
gagaaaggcaaauauaaag

SEQ ID NO: 956074 - RNA, 19 nt, Homo sapiens
gaaaagagaaaggcaaaua

SEQ ID NO: 956075 - RNA, 19 nt, Homo sapiens
aauagaaccuguugugcaa

SEQ ID NO: 956076 - RNA, 19 nt, Homo sapiens
ccgcaaacgucacuucaau

SEQ ID NO: 956077 - RNA, 19 nt, Homo sapiens
gcuaggguguguuucuuuc

SEQ ID NO: 956078 - RNA, 19 nt, Homo sapiens
ggaauaaauagaaccuguu

SEQ ID NO: 956079 - RNA, 19 nt, Homo sapiens
ucagcaaauuggcaaggua

SEQ ID NO: 956080 - RNA, 19 nt, Homo sapiens
gcaaacgucacuucaaugc

SEQ ID NO: 956081 - RNA, 19 nt, Homo sapiens
guacagaaagaaauauguc

SEQ ID NO: 956082 - RNA, 19 nt, Homo sapiens
gaaaugcuuccuaauucca

SEQ ID NO: 956083 - RNA, 19 nt, Homo sapiens
ggagggucaccaugaaguu

SEQ ID NO: 956084 - RNA, 19 nt, Homo sapiens
gccggagggucaccaugaa

SEQ ID NO: 956085 - RNA, 19 nt, Homo sapiens
ggucugaggcagcuaguag

SEQ ID NO: 956086 - RNA, 19 nt, Homo sapiens
caagcaaggugguuaucac

SEQ ID NO: 956087 - RNA, 19 nt, Homo sapiens
auaaauagaaccuguugug

SEQ ID NO: 956088 - RNA, 19 nt, Homo sapiens
ccagguguacagaaagaaa

SEQ ID NO: 956089 - RNA, 19 nt, Homo sapiens
guguguuucuuucgaacuu

SEQ ID NO: 956090 - RNA, 19 nt, Homo sapiens
cagaaagaaauaugucauc

SEQ ID NO: 956091 - RNA, 19 nt, Homo sapiens
cacauaguauuugcauugu

SEQ ID NO: 956092 - RNA, 19 nt, Homo sapiens
acaaaggucagcaaauugg

SEQ ID NO: 956093 - RNA, 19 nt, Homo sapiens
uacaaaggucagcaaauug

SEQ ID NO: 956094 - RNA, 19 nt, Homo sapiens
uugagaaaaugcaggaaua

SEQ ID NO: 956095 - RNA, 19 nt, Homo sapiens
ccuaauuccacauaguauu

SEQ ID NO: 956096 - RNA, 19 nt, Homo sapiens
ggcuaaaacuggacaagga

SEQ ID NO: 956097 - RNA, 19 nt, Homo sapiens
ugucuggaacauuucauuu

SEQ ID NO: 956098 - RNA, 19 nt, Homo sapiens
ccucacacgugcgcaggaa

SEQ ID NO: 956099 - RNA, 19 nt, Homo sapiens
uaccugugccucuguaaau

SEQ ID NO: 956100 - RNA, 19 nt, Homo sapiens
ucacacgugcgcaggaaga

SEQ ID NO: 956101 - RNA, 19 nt, Homo sapiens
cgacgagguccagguaguu

SEQ ID NO: 956102 - RNA, 19 nt, Homo sapiens
uaggguguguuucuuucga

SEQ ID NO: 956103 - RNA, 19 nt, Homo sapiens
gagaaaaugcaggaauaaa

SEQ ID NO: 956104 - RNA, 19 nt, Homo sapiens
gcgcaggaagaucauguca

SEQ ID NO: 956105 - RNA, 19 nt, Homo sapiens
ccaagcaaggugguuauca

SEQ ID NO: 956106 - RNA, 19 nt, Homo sapiens
uaacauaucuccucacuga

SEQ ID NO: 956107 - RNA, 19 nt, Homo sapiens
gcucaaagcucaugauuuc

SEQ ID NO: 956108 - RNA, 19 nt, Homo sapiens
gaacaagcauuggaagaga

SEQ ID NO: 956109 - RNA, 19 nt, Homo sapiens
caccaagccuucccaguua

SEQ ID NO: 956110 - RNA, 19 nt, Homo sapiens
gaaaagagauucagaacga

SEQ ID NO: 956111 - RNA, 19 nt, Homo sapiens
cuauaaagcuacaccuuaa

SEQ ID NO: 956112 - RNA, 19 nt, Homo sapiens
gcaccaagccuucccaguu

SEQ ID NO: 956113 - RNA, 19 nt, Homo sapiens
ugaagaugcugcuggaauu

SEQ ID NO: 956114 - RNA, 19 nt, Homo sapiens
ccaagauacugaggucaua

SEQ ID NO: 956115 - RNA, 19 nt, Homo sapiens
aaauggagauucacaaaca

SEQ ID NO: 956116 - RNA, 19 nt, Homo sapiens
caaagcucaugauuucuga

SEQ ID NO: 956117 - RNA, 19 nt, Homo sapiens
uggaagagaugaagaccaa

SEQ ID NO: 956118 - RNA, 19 nt, Homo sapiens
gcgacuagauguacagcuu

SEQ ID NO: 956119 - RNA, 19 nt, Homo sapiens
gcggauugcuguggaauuc

SEQ ID NO: 956120 - RNA, 19 nt, Homo sapiens
ccaguuaucccagcacuuu

SEQ ID NO: 956121 - RNA, 19 nt, Homo sapiens
uacauaguauuccucagua

SEQ ID NO: 956122 - RNA, 19 nt, Homo sapiens
guagaagucucaggcaaca

SEQ ID NO: 956123 - RNA, 19 nt, Homo sapiens
aauuguugcuucagcuuua

SEQ ID NO: 956124 - RNA, 19 nt, Homo sapiens
guggaaggauuaacauauc

SEQ ID NO: 956125 - RNA, 19 nt, Homo sapiens
gcucaugauuucugaacug

SEQ ID NO: 956126 - RNA, 19 nt, Homo sapiens
ggucauaaucagaagcuaa

SEQ ID NO: 956127 - RNA, 19 nt, Homo sapiens
gaaaccccaucucuacuaa

SEQ ID NO: 956128 - RNA, 19 nt, Homo sapiens
gucaggagauugagaccuu

SEQ ID NO: 956129 - RNA, 19 nt, Homo sapiens
acuauaaagcuacaccuua

SEQ ID NO: 956130 - RNA, 19 nt, Homo sapiens
aaccagcagugacuauaaa

SEQ ID NO: 956131 - RNA, 19 nt, Homo sapiens
gaagaugcugcuggaauug

SEQ ID NO: 956132 - RNA, 19 nt, Homo sapiens
guacagcuugcaaguagaa

SEQ ID NO: 956133 - RNA, 19 nt, Homo sapiens
cagccacccugcuuccauu

SEQ ID NO: 956134 - RNA, 19 nt, Homo sapiens
gagauucacaaacaccaaa

SEQ ID NO: 956135 - RNA, 19 nt, Homo sapiens
aagcuacaccuuaaucaaa

SEQ ID NO: 956136 - RNA, 19 nt, Homo sapiens
uaaaccagcagugacuaua

SEQ ID NO: 956137 - RNA, 19 nt, Homo sapiens
guucugggauucucugaag

SEQ ID NO: 956138 - RNA, 19 nt, Homo sapiens
caugauuucugaacuggau

SEQ ID NO: 956139 - RNA, 19 nt, Homo sapiens
gaugauauacagcaauuac

SEQ ID NO: 956140 - RNA, 19 nt, Homo sapiens
aaaccagcagugacuauaa

SEQ ID NO: 956141 - RNA, 19 nt, Homo sapiens
gauguacagcuugcaagua

SEQ ID NO: 956142 - RNA, 19 nt, Homo sapiens
ugaaaucguaggacaguga

SEQ ID NO: 956143 - RNA, 19 nt, Homo sapiens
ggaacaagcauuggaagag

SEQ ID NO: 956144 - RNA, 19 nt, Homo sapiens
gaaaucguaggacagugaa

SEQ ID NO: 956145 - RNA, 19 nt, Homo sapiens
gcugccgggugaaaucgua

SEQ ID NO: 956146 - RNA, 19 nt, Homo sapiens
gaagaccaaaccacuguag

SEQ ID NO: 956147 - RNA, 19 nt, Homo sapiens
gcaugguguggaaggauua

SEQ ID NO: 956148 - RNA, 19 nt, Homo sapiens
gaagagaugaagaccaaac

SEQ ID NO: 956149 - RNA, 19 nt, Homo sapiens
caugaggucaggagauuga

SEQ ID NO: 956150 - RNA, 19 nt, Homo sapiens
gauacugaggucauaauca

SEQ ID NO: 956151 - RNA, 19 nt, Homo sapiens
cucaguaucuauuccaaga

SEQ ID NO: 956152 - RNA, 19 nt, Homo sapiens
ucacaaacaccaaaguucu

SEQ ID NO: 956153 - RNA, 19 nt, Homo sapiens
caagauacugaggucauaa

SEQ ID NO: 956154 - RNA, 19 nt, Homo sapiens
ccauuugguucaacaacug

SEQ ID NO: 956155 - RNA, 19 nt, Homo sapiens
cagauuaaaccagcaguga

SEQ ID NO: 956156 - RNA, 19 nt, Homo sapiens
ugaauggcgacuagaugua

SEQ ID NO: 956157 - RNA, 19 nt, Homo sapiens
cgaggugggcaaaucauga

SEQ ID NO: 956158 - RNA, 19 nt, Homo sapiens
caccaaaguucugcagaca

SEQ ID NO: 956159 - RNA, 19 nt, Homo sapiens
uaaagcuacaccuuaauca

SEQ ID NO: 956160 - RNA, 19 nt, Homo sapiens
agucucaggcaacagauua

SEQ ID NO: 956161 - RNA, 19 nt, Homo sapiens
aaagagauucagaacgauu

SEQ ID NO: 956162 - RNA, 19 nt, Homo sapiens
ucaaagcucaugauuucug

SEQ ID NO: 956163 - RNA, 19 nt, Homo sapiens
gugaagaugcugcuggaau

SEQ ID NO: 956164 - RNA, 19 nt, Homo sapiens
caaaauggagauucacaaa

SEQ ID NO: 956165 - RNA, 19 nt, Homo sapiens
ccgaggagcauaaggaaca

SEQ ID NO: 956166 - RNA, 19 nt, Homo sapiens
ggaauuguccgaggagcau

SEQ ID NO: 956167 - RNA, 19 nt, Homo sapiens
ccacccugcuuccauuugg

SEQ ID NO: 956168 - RNA, 19 nt, Homo sapiens
gauuaaaccagcagugacu

SEQ ID NO: 956169 - RNA, 19 nt, Homo sapiens
ggagauucacaaacaccaa

SEQ ID NO: 956170 - RNA, 19 nt, Homo sapiens
agaagucucaggcaacaga

SEQ ID NO: 956171 - RNA, 19 nt, Homo sapiens
gaauggcgacuagauguac

SEQ ID NO: 956172 - RNA, 19 nt, Homo sapiens
caaauuguugcuucagcuu

SEQ ID NO: 956173 - RNA, 19 nt, Homo sapiens
uaguauuccucaguaucua

SEQ ID NO: 956174 - RNA, 19 nt, Homo sapiens
guaccaguuuuaagguuuu

SEQ ID NO: 956175 - RNA, 19 nt, Homo sapiens
agaccaaaccacuguagga

SEQ ID NO: 956176 - RNA, 19 nt, Homo sapiens
aaagcuacaccuuaaucaa

SEQ ID NO: 956177 - RNA, 19 nt, Homo sapiens
uguggaaggauuaacauau

SEQ ID NO: 956178 - RNA, 19 nt, Homo sapiens
agcagugacuauaaagcua

SEQ ID NO: 956179 - RNA, 19 nt, Homo sapiens
guaggacagugaagaugcu

SEQ ID NO: 956180 - RNA, 19 nt, Homo sapiens
cauccaguaguaccaguuu

SEQ ID NO: 956181 - RNA, 19 nt, Homo sapiens
acauaguauuccucaguau

SEQ ID NO: 956182 - RNA, 19 nt, Homo sapiens
acaacuggaacaagcauug

SEQ ID NO: 956183 - RNA, 19 nt, Homo sapiens
auguacagcuugcaaguag

SEQ ID NO: 956184 - RNA, 19 nt, Homo sapiens
guauuccucaguaucuauu

SEQ ID NO: 956185 - RNA, 19 nt, Homo sapiens
gacuauaaagcuacaccuu

SEQ ID NO: 956186 - RNA, 19 nt, Homo sapiens
ggugaaaucguaggacagu

SEQ ID NO: 956187 - RNA, 19 nt, Homo sapiens
uggaaggauuaacauaucu

SEQ ID NO: 956188 - RNA, 19 nt, Homo sapiens
ggacaacagaaaagagauu

SEQ ID NO: 956189 - RNA, 19 nt, Homo sapiens
uucgcaacauccaguagua

SEQ ID NO: 956190 - RNA, 19 nt, Homo sapiens
agaccuuccuggcuaacau

SEQ ID NO: 956191 - RNA, 19 nt, Homo sapiens
caacaacuggaacaagcau

SEQ ID NO: 956192 - RNA, 19 nt, Homo sapiens
ggauuuccaagacucuguu

SEQ ID NO: 956193 - RNA, 19 nt, Homo sapiens
cauaguauuccucaguauc

SEQ ID NO: 956194 - RNA, 19 nt, Homo sapiens
aaaccacuguaggagaguu

SEQ ID NO: 956195 - RNA, 19 nt, Homo sapiens
gcauuggaagagaugaaga

SEQ ID NO: 956196 - RNA, 19 nt, Homo sapiens
guguggaaggauuaacaua

SEQ ID NO: 956197 - RNA, 19 nt, Homo sapiens
ggauugcuguggaauuccu

SEQ ID NO: 956198 - RNA, 19 nt, Homo sapiens
gaauuguccgaggagcaua

SEQ ID NO: 956199 - RNA, 19 nt, Homo sapiens
aaccuugaauggcgacuag

SEQ ID NO: 956200 - RNA, 19 nt, Homo sapiens
caaagacaauucuguguaa

SEQ ID NO: 956201 - RNA, 19 nt, Homo sapiens
ugccaaagcugccuuaaua

SEQ ID NO: 956202 - RNA, 19 nt, Homo sapiens
gcaaagacaauucugugua

SEQ ID NO: 956203 - RNA, 19 nt, Homo sapiens
ccaaagcugccuuaauaua

SEQ ID NO: 956204 - RNA, 19 nt, Homo sapiens
uaacauaccugcgcugcuu

SEQ ID NO: 956205 - RNA, 19 nt, Homo sapiens
caaagcugccuuaauauau

SEQ ID NO: 956206 - RNA, 19 nt, Homo sapiens
gaaacaaggacaugaccaa

SEQ ID NO: 956207 - RNA, 19 nt, Homo sapiens
ccaaaaggcugcugccaaa

SEQ ID NO: 956208 - RNA, 19 nt, Homo sapiens
agacaauucuguguaaaug

SEQ ID NO: 956209 - RNA, 19 nt, Homo sapiens
gugaauucaugacaccuuu

SEQ ID NO: 956210 - RNA, 19 nt, Homo sapiens
gagcaagcauccuaagacu

SEQ ID NO: 956211 - RNA, 19 nt, Homo sapiens
guacuuugauuuacgacau

SEQ ID NO: 956212 - RNA, 19 nt, Homo sapiens
ggcauaagguuguuuacag

SEQ ID NO: 956213 - RNA, 19 nt, Homo sapiens
guacaguugacucugauuu

SEQ ID NO: 956214 - RNA, 19 nt, Homo sapiens
guuuacaggugaauucaug

SEQ ID NO: 956215 - RNA, 19 nt, Homo sapiens
gaauucaugacaccuuuga

SEQ ID NO: 956216 - RNA, 19 nt, Homo sapiens
uccacuuccuccagaauua

SEQ ID NO: 956217 - RNA, 19 nt, Homo sapiens
aaucaguccauccuuguua

SEQ ID NO: 956218 - RNA, 19 nt, Homo sapiens
gaagaaacaaggacaugac

SEQ ID NO: 956219 - RNA, 19 nt, Homo sapiens
aauguacaguugacucuga

SEQ ID NO: 956220 - RNA, 19 nt, Homo sapiens
gagagcaagcauccuaaga

SEQ ID NO: 956221 - RNA, 19 nt, Homo sapiens
uaaaggggcuacagaaaca

SEQ ID NO: 956222 - RNA, 19 nt, Homo sapiens
auauauaccugcacugucu

SEQ ID NO: 956223 - RNA, 19 nt, Homo sapiens
ucaggcauaagguuguuua

SEQ ID NO: 956224 - RNA, 19 nt, Homo sapiens
gcuacagaaacacucauuu

SEQ ID NO: 956225 - RNA, 19 nt, Homo sapiens
caaaugccagacccuaaga

SEQ ID NO: 956226 - RNA, 19 nt, Homo sapiens
aaagcaagcuggacaaaag

SEQ ID NO: 956227 - RNA, 19 nt, Homo sapiens
caugacaccuuugacucuu

SEQ ID NO: 956228 - RNA, 19 nt, Homo sapiens
aaacaaggacaugaccaaa

SEQ ID NO: 956229 - RNA, 19 nt, Homo sapiens
cacaaaugccagacccuaa

SEQ ID NO: 956230 - RNA, 19 nt, Homo sapiens
uuuaugcuguucccucuug

SEQ ID NO: 956231 - RNA, 19 nt, Homo sapiens
ugacucuucuacugucuca

SEQ ID NO: 956232 - RNA, 19 nt, Homo sapiens
uaauauauaccugcacugu

SEQ ID NO: 956233 - RNA, 19 nt, Homo sapiens
aguccauccuuguuauaaa

SEQ ID NO: 956234 - RNA, 19 nt, Homo sapiens
acaaacuguugaucagcaa

SEQ ID NO: 956235 - RNA, 19 nt, Homo sapiens
gauguucaggcauaagguu

SEQ ID NO: 956236 - RNA, 19 nt, Homo sapiens
guucaggcauaagguuguu

SEQ ID NO: 956237 - RNA, 19 nt, Homo sapiens
uuuacgacaucacaggaaa

SEQ ID NO: 956238 - RNA, 19 nt, Homo sapiens
gccaaagcugccuuaauau

SEQ ID NO: 956239 - RNA, 19 nt, Homo sapiens
agaagaaacaaggacauga

SEQ ID NO: 956240 - RNA, 19 nt, Homo sapiens
ucaguccauccuuguuaua

SEQ ID NO: 956241 - RNA, 19 nt, Homo sapiens
aguugacucugauuuggaa

SEQ ID NO: 956242 - RNA, 19 nt, Homo sapiens
acaguugacucugauuugg

SEQ ID NO: 956243 - RNA, 19 nt, Homo sapiens
uaaauguacaguugacucu

SEQ ID NO: 956244 - RNA, 19 nt, Homo sapiens
cuacagaaacacucauuuu

SEQ ID NO: 956245 - RNA, 19 nt, Homo sapiens
gcgcugcuuuucuaacaaa

SEQ ID NO: 956246 - RNA, 19 nt, Homo sapiens
guccauccuuguuauaaaa

SEQ ID NO: 956247 - RNA, 19 nt, Homo sapiens
gacaauucuguguaaaugu

SEQ ID NO: 956248 - RNA, 19 nt, Homo sapiens
gaccuucaagcagcacuuu

SEQ ID NO: 956249 - RNA, 19 nt, Homo sapiens
caguccauccuuguuauaa

SEQ ID NO: 956250 - RNA, 19 nt, Homo sapiens
uaccugcgcugcuuuucua

SEQ ID NO: 956251 - RNA, 19 nt, Homo sapiens
ugacaccuuugacucuucu

SEQ ID NO: 956252 - RNA, 19 nt, Homo sapiens
acaaggacaugaccaaaag

SEQ ID NO: 956253 - RNA, 19 nt, Homo sapiens
aaauucagucucagcagaa

SEQ ID NO: 956254 - RNA, 19 nt, Homo sapiens
cagaauuagcugauguuca

SEQ ID NO: 956255 - RNA, 19 nt, Homo sapiens
ugccagacccuaagaccuu

SEQ ID NO: 956256 - RNA, 19 nt, Homo sapiens
cucuugggcuucaugcaaa

SEQ ID NO: 956257 - RNA, 19 nt, Homo sapiens
gcagaaagguugaaacuau

SEQ ID NO: 956258 - RNA, 19 nt, Homo sapiens
ggaauuaaaucacagcuaa

SEQ ID NO: 956259 - RNA, 19 nt, Homo sapiens
caagaagacuguuuauugu

SEQ ID NO: 956260 - RNA, 19 nt, Homo sapiens
gagaagagccgggaauuaa

SEQ ID NO: 956261 - RNA, 19 nt, Homo sapiens
ccaagaagacuguuuauug

SEQ ID NO: 956262 - RNA, 19 nt, Homo sapiens
ggacauugaugcuggauag

SEQ ID NO: 956263 - RNA, 19 nt, Homo sapiens
ggagugugauucuuaauuc

SEQ ID NO: 956264 - RNA, 19 nt, Homo sapiens
ggacuggaauaucugauug

SEQ ID NO: 956265 - RNA, 19 nt, Homo sapiens
agaauggcaucuuuguuua

SEQ ID NO: 956266 - RNA, 19 nt, Homo sapiens
uaagcuccuugguuaauua

SEQ ID NO: 956267 - RNA, 19 nt, Homo sapiens
gcuccuugguuaauuauuu

SEQ ID NO: 956268 - RNA, 19 nt, Homo sapiens
ggacaugccaguagaaguu

SEQ ID NO: 956269 - RNA, 19 nt, Homo sapiens
caagagcaguccuaaacaa

SEQ ID NO: 956270 - RNA, 19 nt, Homo sapiens
uaauuugccugaaugauga

SEQ ID NO: 956271 - RNA, 19 nt, Homo sapiens
gagcaguccuaaacaauca

SEQ ID NO: 956272 - RNA, 19 nt, Homo sapiens
ggagaagagccgggaauua

SEQ ID NO: 956273 - RNA, 19 nt, Homo sapiens
gaugagagugccauugaua

SEQ ID NO: 956274 - RNA, 19 nt, Homo sapiens
caacuuagccaugauguga

SEQ ID NO: 956275 - RNA, 19 nt, Homo sapiens
ccagggaauugguggauuu

SEQ ID NO: 956276 - RNA, 19 nt, Homo sapiens
uagaauggcaucuuuguuu

SEQ ID NO: 956277 - RNA, 19 nt, Homo sapiens
gguguagaauggcaucuuu

SEQ ID NO: 956278 - RNA, 19 nt, Homo sapiens
gaagacuguuuauugugaa

SEQ ID NO: 956279 - RNA, 19 nt, Homo sapiens
agaagacuguuuauuguga

SEQ ID NO: 956280 - RNA, 19 nt, Homo sapiens
gagagugccauugauaaua

SEQ ID NO: 956281 - RNA, 19 nt, Homo sapiens
uaacaauucuuuccaugca

SEQ ID NO: 956282 - RNA, 19 nt, Homo sapiens
gaaccuuauucgaucugua

SEQ ID NO: 956283 - RNA, 19 nt, Homo sapiens
ucuauugucucagcuauaa

SEQ ID NO: 956284 - RNA, 19 nt, Homo sapiens
gccaugaugugagugguua

SEQ ID NO: 956285 - RNA, 19 nt, Homo sapiens
gaagagccgggaauuaaau

SEQ ID NO: 956286 - RNA, 19 nt, Homo sapiens
gaagaggacaugccaguag

SEQ ID NO: 956287 - RNA, 19 nt, Homo sapiens
ggcaaacaaucucacaaga

SEQ ID NO: 956288 - RNA, 19 nt, Homo sapiens
cagaaagguugaaacuaug

SEQ ID NO: 956289 - RNA, 19 nt, Homo sapiens
gaacagaccagggaauugg

SEQ ID NO: 956290 - RNA, 19 nt, Homo sapiens
ucacagcuaaugaaccuua

SEQ ID NO: 956291 - RNA, 19 nt, Homo sapiens
gggaauugguggauuugga

SEQ ID NO: 956292 - RNA, 19 nt, Homo sapiens
guuucaaccuuucugcaua

SEQ ID NO: 956293 - RNA, 19 nt, Homo sapiens
ucagucacaugaugauuau

SEQ ID NO: 956294 - RNA, 19 nt, Homo sapiens
gaauaucaguggagaaaau

SEQ ID NO: 956295 - RNA, 19 nt, Homo sapiens
uaagaaccgugaugagagu

SEQ ID NO: 956296 - RNA, 19 nt, Homo sapiens
gaaagguugaaacuaugua

SEQ ID NO: 956297 - RNA, 19 nt, Homo sapiens
gaugagaccagaccagugu

SEQ ID NO: 956298 - RNA, 19 nt, Homo sapiens
ugucucagcuauaaauuca

SEQ ID NO: 956299 - RNA, 19 nt, Homo sapiens
gguugaaacuauguaaaug

SEQ ID NO: 956300 - RNA, 19 nt, Homo sapiens
guuugccuaucucauaaua

SEQ ID NO: 956301 - RNA, 19 nt, Homo sapiens
ucucagggaugaaauucuu

SEQ ID NO: 956302 - RNA, 19 nt, Homo sapiens
cuaaugaaccuuauucgau

SEQ ID NO: 956303 - RNA, 19 nt, Homo sapiens
gucagucacaugaugauua

SEQ ID NO: 956304 - RNA, 19 nt, Homo sapiens
gaauggcaucuuuguuuau

SEQ ID NO: 956305 - RNA, 19 nt, Homo sapiens
ccuaaacaaucacaauuac

SEQ ID NO: 956306 - RNA, 19 nt, Homo sapiens
gaccagugucuacagauuu

SEQ ID NO: 956307 - RNA, 19 nt, Homo sapiens
agagugccauugauaauag

SEQ ID NO: 956308 - RNA, 19 nt, Homo sapiens
uuucaaccuuucugcauaa

SEQ ID NO: 956309 - RNA, 19 nt, Homo sapiens
acacuguacuacccaagaa

SEQ ID NO: 956310 - RNA, 19 nt, Homo sapiens
gauagguugucuuuuguuu

SEQ ID NO: 956311 - RNA, 19 nt, Homo sapiens
uagcuuggcugaccuugca

SEQ ID NO: 956312 - RNA, 19 nt, Homo sapiens
gugaugagagugccauuga

SEQ ID NO: 956313 - RNA, 19 nt, Homo sapiens
gggaacagaccagggaauu

SEQ ID NO: 956314 - RNA, 19 nt, Homo sapiens
cauugaugcuggauagguu

SEQ ID NO: 956315 - RNA, 19 nt, Homo sapiens
gcacuuguaguuucauuac

SEQ ID NO: 956316 - RNA, 19 nt, Homo sapiens
uggcugaccuugcacuugu

SEQ ID NO: 956317 - RNA, 19 nt, Homo sapiens
ggaacagaccagggaauug

SEQ ID NO: 956318 - RNA, 19 nt, Homo sapiens
guuuauaggagaacauuug

SEQ ID NO: 956319 - RNA, 19 nt, Homo sapiens
guaaauauuagcccacaag

SEQ ID NO: 956320 - RNA, 19 nt, Homo sapiens
ggguuucuauuuaucuguu

SEQ ID NO: 956321 - RNA, 19 nt, Homo sapiens
gacaugccaguagaaguua

SEQ ID NO: 956322 - RNA, 19 nt, Homo sapiens
aagaggacaugccaguaga

SEQ ID NO: 956323 - RNA, 19 nt, Homo sapiens
agaagagccgggaauuaaa

SEQ ID NO: 956324 - RNA, 19 nt, Homo sapiens
uguggagugugauucuuaa

SEQ ID NO: 956325 - RNA, 19 nt, Homo sapiens
uuaauuugccugaaugaug

SEQ ID NO: 956326 - RNA, 19 nt, Homo sapiens
cacaagagcaguccuaaac

SEQ ID NO: 956327 - RNA, 19 nt, Homo sapiens
ccacaagagcaguccuaaa

SEQ ID NO: 956328 - RNA, 19 nt, Homo sapiens
gcuaaugaaccuuauucga

SEQ ID NO: 956329 - RNA, 19 nt, Homo sapiens
gggagaauucugucaguca

SEQ ID NO: 956330 - RNA, 19 nt, Homo sapiens
uaauguugcacuuguaguu

SEQ ID NO: 956331 - RNA, 19 nt, Homo sapiens
uuacuuuggucauuauugg

SEQ ID NO: 956332 - RNA, 19 nt, Homo sapiens
guagaauggcaucuuuguu

SEQ ID NO: 956333 - RNA, 19 nt, Homo sapiens
uacccaagaagacuguuua

SEQ ID NO: 956334 - RNA, 19 nt, Homo sapiens
agagaaaucgcuuggacuu

SEQ ID NO: 956335 - RNA, 19 nt, Homo sapiens
gagcgauuccucaagaaca

SEQ ID NO: 956336 - RNA, 19 nt, Homo sapiens
gugugauucuuaauucuuc

SEQ ID NO: 956337 - RNA, 19 nt, Homo sapiens
cuacagauuuucauuguca

SEQ ID NO: 956338 - RNA, 19 nt, Homo sapiens
ugauugcucaguguuaaua

SEQ ID NO: 956339 - RNA, 19 nt, Homo sapiens
uugccuaucucauaauaca

SEQ ID NO: 956340 - RNA, 19 nt, Homo sapiens
uguaagaaccgugaugaga

SEQ ID NO: 956341 - RNA, 19 nt, Homo sapiens
aaucacagcuaaugaaccu

SEQ ID NO: 956342 - RNA, 19 nt, Homo sapiens
ccaugcacuuguuauuuua

SEQ ID NO: 956343 - RNA, 19 nt, Homo sapiens
gggaauuaaaucacagcua

SEQ ID NO: 956344 - RNA, 19 nt, Homo sapiens
ccauuuacauaguuucaac

SEQ ID NO: 956345 - RNA, 19 nt, Homo sapiens
cagcuaaugaaccuuauuc

SEQ ID NO: 956346 - RNA, 19 nt, Homo sapiens
gagugugauucuuaauucu

SEQ ID NO: 956347 - RNA, 19 nt, Homo sapiens
ugugaagcauuuaccuuuc

SEQ ID NO: 956348 - RNA, 19 nt, Homo sapiens
guccuaaacaaucacaauu

SEQ ID NO: 956349 - RNA, 19 nt, Homo sapiens
ccauggccuuuacccugua

SEQ ID NO: 956350 - RNA, 19 nt, Homo sapiens
ugagagugccauugauaau

SEQ ID NO: 956351 - RNA, 19 nt, Homo sapiens
aaccuuauucgaucuguaa

SEQ ID NO: 956352 - RNA, 19 nt, Homo sapiens
gaagcauuuaccuuucaaa

SEQ ID NO: 956353 - RNA, 19 nt, Homo sapiens
uaaauauuagcccacaaga

SEQ ID NO: 956354 - RNA, 19 nt, Homo sapiens
acaacagcguaaauauuag

SEQ ID NO: 956355 - RNA, 19 nt, Homo sapiens
cagggagaauucugucagu

SEQ ID NO: 956356 - RNA, 19 nt, Homo sapiens
ucacuucucagggaugaaa

SEQ ID NO: 956357 - RNA, 19 nt, Homo sapiens
ugaagaaagucuccaaaua

SEQ ID NO: 956358 - RNA, 19 nt, Homo sapiens
caacaaaucccauaaguau

SEQ ID NO: 956359 - RNA, 19 nt, Homo sapiens
gaagauaaaccgaagaauu

SEQ ID NO: 956360 - RNA, 19 nt, Homo sapiens
guaggacucuguaaucuuu

SEQ ID NO: 956361 - RNA, 19 nt, Homo sapiens
uaccaugacucaaaucuua

SEQ ID NO: 956362 - RNA, 19 nt, Homo sapiens
gaagaucuaugcuccacaa

SEQ ID NO: 956363 - RNA, 19 nt, Homo sapiens
gaaagucuccaaauacauu

SEQ ID NO: 956364 - RNA, 19 nt, Homo sapiens
gaagaaagucuccaaauac

SEQ ID NO: 956365 - RNA, 19 nt, Homo sapiens
gugcaaagcuuguuaucug

SEQ ID NO: 956366 - RNA, 19 nt, Homo sapiens
gagcaucauuccuuucuau

SEQ ID NO: 956367 - RNA, 19 nt, Homo sapiens
gagcgaggacugcgaguua

SEQ ID NO: 956368 - RNA, 19 nt, Homo sapiens
guaauagugugucugcauu

SEQ ID NO: 956369 - RNA, 19 nt, Homo sapiens
ggaauaagcagguauaaaa

SEQ ID NO: 956370 - RNA, 19 nt, Homo sapiens
ggagagagaaaccauuaaa

SEQ ID NO: 956371 - RNA, 19 nt, Homo sapiens
ggauuucgucucagauuua

SEQ ID NO: 956372 - RNA, 19 nt, Homo sapiens
guaaaacucucaagucuga

SEQ ID NO: 956373 - RNA, 19 nt, Homo sapiens
caugagcaguggaagauaa

SEQ ID NO: 956374 - RNA, 19 nt, Homo sapiens
ggacugcgaguuauugaaa

SEQ ID NO: 956375 - RNA, 19 nt, Homo sapiens
gcuuaugccuuucguuuau

SEQ ID NO: 956376 - RNA, 19 nt, Homo sapiens
gcucaaguacaguaaguua

SEQ ID NO: 956377 - RNA, 19 nt, Homo sapiens
caaaccaucagacacauaa

SEQ ID NO: 956378 - RNA, 19 nt, Homo sapiens
gcauauaccaucuuccuau

SEQ ID NO: 956379 - RNA, 19 nt, Homo sapiens
ccggaaagguguucauuca

SEQ ID NO: 956380 - RNA, 19 nt, Homo sapiens
ucagugcacagaaaucuua

SEQ ID NO: 956381 - RNA, 19 nt, Homo sapiens
gauauggaauaagcaggua

SEQ ID NO: 956382 - RNA, 19 nt, Homo sapiens
uaaaguggaugccaaacca

SEQ ID NO: 956383 - RNA, 19 nt, Homo sapiens
ggacucacuuucuaaaauu

SEQ ID NO: 956384 - RNA, 19 nt, Homo sapiens
gauuucgucucagauuuaa

SEQ ID NO: 956385 - RNA, 19 nt, Homo sapiens
aagaaagucuccaaauaca

SEQ ID NO: 956386 - RNA, 19 nt, Homo sapiens
uaggagagagaaaccauua

SEQ ID NO: 956387 - RNA, 19 nt, Homo sapiens
gauacgugcugcuuguuca

SEQ ID NO: 956388 - RNA, 19 nt, Homo sapiens
gcaccucccagauuucaaa

SEQ ID NO: 956389 - RNA, 19 nt, Homo sapiens
ucaccaguguucuaucuug

SEQ ID NO: 956390 - RNA, 19 nt, Homo sapiens
gaauuaaagaucccacuuc

SEQ ID NO: 956391 - RNA, 19 nt, Homo sapiens
ucaguaagcacaauaaagu

SEQ ID NO: 956392 - RNA, 19 nt, Homo sapiens
ucaacaaaucccauaagua

SEQ ID NO: 956393 - RNA, 19 nt, Homo sapiens
ccucccagauuucaaagaa

SEQ ID NO: 956394 - RNA, 19 nt, Homo sapiens
gaagguuguuuggcuuguu

SEQ ID NO: 956395 - RNA, 19 nt, Homo sapiens
uccaaggacucacuuucua

SEQ ID NO: 956396 - RNA, 19 nt, Homo sapiens
ucccagauuucaaagaauu

SEQ ID NO: 956397 - RNA, 19 nt, Homo sapiens
ucaacaagccguaucuuca

SEQ ID NO: 956398 - RNA, 19 nt, Homo sapiens
caaggacucacuuucuaaa

SEQ ID NO: 956399 - RNA, 19 nt, Homo sapiens
ccaaggacucacuuucuaa

SEQ ID NO: 956400 - RNA, 19 nt, Homo sapiens
caucauuccuuucuaucug

SEQ ID NO: 956401 - RNA, 19 nt, Homo sapiens
ugucagagauauuguaggu

SEQ ID NO: 956402 - RNA, 19 nt, Homo sapiens
cuuaugacccacagaauuu

SEQ ID NO: 956403 - RNA, 19 nt, Homo sapiens
uaacuaucccuaaggcaaa

SEQ ID NO: 956404 - RNA, 19 nt, Homo sapiens
caauaaaguggaugccaaa

SEQ ID NO: 956405 - RNA, 19 nt, Homo sapiens
cgucucagauuuaauuucu

SEQ ID NO: 956406 - RNA, 19 nt, Homo sapiens
gagccacggugccauuuac

SEQ ID NO: 956407 - RNA, 19 nt, Homo sapiens
uaugauacgugcugcuugu

SEQ ID NO: 956408 - RNA, 19 nt, Homo sapiens
guuagucauucaacaaauc

SEQ ID NO: 956409 - RNA, 19 nt, Homo sapiens
caagucugaguccauauuu

SEQ ID NO: 956410 - RNA, 19 nt, Homo sapiens
gugcacagaaaucuuauga

SEQ ID NO: 956411 - RNA, 19 nt, Homo sapiens
caaguucccugcggaugga

SEQ ID NO: 956412 - RNA, 19 nt, Homo sapiens
cuugaauguuggaaagaua

SEQ ID NO: 956413 - RNA, 19 nt, Homo sapiens
ccaguguucuaucuuguuc

SEQ ID NO: 956414 - RNA, 19 nt, Homo sapiens
gagauauuguaggugcuaa

SEQ ID NO: 956415 - RNA, 19 nt, Homo sapiens
cuuaagaucuguuucuacu

SEQ ID NO: 956416 - RNA, 19 nt, Homo sapiens
uggauuucgucucagauuu

SEQ ID NO: 956417 - RNA, 19 nt, Homo sapiens
aguauucagugcacagaaa

SEQ ID NO: 956418 - RNA, 19 nt, Homo sapiens
ccagucauaucucgaaggu

SEQ ID NO: 956419 - RNA, 19 nt, Homo sapiens
gcaauuuccaguuauuucu

SEQ ID NO: 956420 - RNA, 19 nt, Homo sapiens
aauacuggauuucgucuca

SEQ ID NO: 956421 - RNA, 19 nt, Homo sapiens
auggagaaccggauugaua

SEQ ID NO: 956422 - RNA, 19 nt, Homo sapiens
ccaaaccaucagacacaua

SEQ ID NO: 956423 - RNA, 19 nt, Homo sapiens
ggauugauaggcagcaguu

SEQ ID NO: 956424 - RNA, 19 nt, Homo sapiens
caaacugaagcuuauugaa

SEQ ID NO: 956425 - RNA, 19 nt, Homo sapiens
cuucucagguggcuuuaga

SEQ ID NO: 956426 - RNA, 19 nt, Homo sapiens
aagguuguuuggcuuguuu

SEQ ID NO: 956427 - RNA, 19 nt, Homo sapiens
uaccauuuaugaagacaga

SEQ ID NO: 956428 - RNA, 19 nt, Homo sapiens
ggauggagaaccggauuga

SEQ ID NO: 956429 - RNA, 19 nt, Homo sapiens
gauaugauacgugcugcuu

SEQ ID NO: 956430 - RNA, 19 nt, Homo sapiens
uaaccuuuaugcagaagca

SEQ ID NO: 956431 - RNA, 19 nt, Homo sapiens
cagcuucucagguggcuuu

SEQ ID NO: 956432 - RNA, 19 nt, Homo sapiens
guauuugggagagaguuua

SEQ ID NO: 956433 - RNA, 19 nt, Homo sapiens
ucaagucugaguccauauu

SEQ ID NO: 956434 - RNA, 19 nt, Homo sapiens
uauggaauaagcagguaua

SEQ ID NO: 956435 - RNA, 19 nt, Homo sapiens
uauaccaucuuccuaugca

SEQ ID NO: 956436 - RNA, 19 nt, Homo sapiens
uccagagcaucauuccuuu

SEQ ID NO: 956437 - RNA, 19 nt, Homo sapiens
uaauagugugucugcauuu

SEQ ID NO: 956438 - RNA, 19 nt, Homo sapiens
gauuggcucaaguacagua

SEQ ID NO: 956439 - RNA, 19 nt, Homo sapiens
gucccuggauauggaauaa

SEQ ID NO: 956440 - RNA, 19 nt, Homo sapiens
uaucuucaccaguguucua

SEQ ID NO: 956441 - RNA, 19 nt, Homo sapiens
agaaugagaagaucuaugc

SEQ ID NO: 956442 - RNA, 19 nt, Homo sapiens
ccuuaugacccacagaauu

SEQ ID NO: 956443 - RNA, 19 nt, Homo sapiens
uaacagcauauaccaucuu

SEQ ID NO: 956444 - RNA, 19 nt, Homo sapiens
gaauguuggaaagauauga

SEQ ID NO: 956445 - RNA, 19 nt, Homo sapiens
aggcagcaguuugaagaaa

SEQ ID NO: 956446 - RNA, 19 nt, Homo sapiens
gcaugagcaguggaagaua

SEQ ID NO: 956447 - RNA, 19 nt, Homo sapiens
gaggacugcgaguuauuga

SEQ ID NO: 956448 - RNA, 19 nt, Homo sapiens
gcgaggacugcgaguuauu

SEQ ID NO: 956449 - RNA, 19 nt, Homo sapiens
gagagaaaccauuaaaagu

SEQ ID NO: 956450 - RNA, 19 nt, Homo sapiens
cugcuuaugccuuucguuu

SEQ ID NO: 956451 - RNA, 19 nt, Homo sapiens
uaagcacaauaaaguggau

SEQ ID NO: 956452 - RNA, 19 nt, Homo sapiens
gaucuguuucuacuauuca

SEQ ID NO: 956453 - RNA, 19 nt, Homo sapiens
ccagagccacggugccauu

SEQ ID NO: 956454 - RNA, 19 nt, Homo sapiens
acugcgaguuauugaaauu

SEQ ID NO: 956455 - RNA, 19 nt, Homo sapiens
guuugagagcgcuguauuu

SEQ ID NO: 956456 - RNA, 19 nt, Homo sapiens
uucaagagcagaaugagaa

SEQ ID NO: 956457 - RNA, 19 nt, Homo sapiens
gcagaaggcucaguagcua

SEQ ID NO: 956458 - RNA, 19 nt, Homo sapiens
gagaagaaauccaucauac

SEQ ID NO: 956459 - RNA, 19 nt, Homo sapiens
gagaaccacugcugcauau

SEQ ID NO: 956460 - RNA, 19 nt, Homo sapiens
guaagacccugccucaaga

SEQ ID NO: 956461 - RNA, 19 nt, Homo sapiens
gaugaggacgcuuaugaua

SEQ ID NO: 956462 - RNA, 19 nt, Homo sapiens
gaaguuuguuagucauuug

SEQ ID NO: 956463 - RNA, 19 nt, Homo sapiens
gaaauccaucauaccauua

SEQ ID NO: 956464 - RNA, 19 nt, Homo sapiens
ugaggacgcuuaugauaug

SEQ ID NO: 956465 - RNA, 19 nt, Homo sapiens
uaacuuggauccacuuaca

SEQ ID NO: 956466 - RNA, 19 nt, Homo sapiens
gaaccacugcugcauauau

SEQ ID NO: 956467 - RNA, 19 nt, Homo sapiens
gaagaaauccaucauacca

SEQ ID NO: 956468 - RNA, 19 nt, Homo sapiens
cagauacucuagaugcuuu

SEQ ID NO: 956469 - RNA, 19 nt, Homo sapiens
agaaauccaucauaccauu

SEQ ID NO: 956470 - RNA, 19 nt, Homo sapiens
ggacggucauagaguacua

SEQ ID NO: 956471 - RNA, 19 nt, Homo sapiens
aagaguaucuaaccaaguu

SEQ ID NO: 956472 - RNA, 19 nt, Homo sapiens
uacagaaacuuaugggauu

SEQ ID NO: 956473 - RNA, 19 nt, Homo sapiens
guggagaauuaauggguua

SEQ ID NO: 956474 - RNA, 19 nt, Homo sapiens
gcagcuaggucagaaggaa

SEQ ID NO: 956475 - RNA, 19 nt, Homo sapiens
gaaggaaacauaccacucu

SEQ ID NO: 956476 - RNA, 19 nt, Homo sapiens
agaaagaaaggguggauuu

SEQ ID NO: 956477 - RNA, 19 nt, Homo sapiens
ucaacaacauuaacuugga

SEQ ID NO: 956478 - RNA, 19 nt, Homo sapiens
caacaacauuaacuuggau

SEQ ID NO: 956479 - RNA, 19 nt, Homo sapiens
uaaagcagaaggcucagua

SEQ ID NO: 956480 - RNA, 19 nt, Homo sapiens
gaauuucgacgccuugguu

SEQ ID NO: 956481 - RNA, 19 nt, Homo sapiens
uggguuauauuauggguaa

SEQ ID NO: 956482 - RNA, 19 nt, Homo sapiens
aaacuuaugggauuccuuu

SEQ ID NO: 956483 - RNA, 19 nt, Homo sapiens
ggagcucuauuaggagaaa

SEQ ID NO: 956484 - RNA, 19 nt, Homo sapiens
ggaugauucuggagcucua

SEQ ID NO: 956485 - RNA, 19 nt, Homo sapiens
gaugcuuuauggacaauau

SEQ ID NO: 956486 - RNA, 19 nt, Homo sapiens
ugugaggccugaagacauu

SEQ ID NO: 956487 - RNA, 19 nt, Homo sapiens
ccagaguauuucauuguug

SEQ ID NO: 956488 - RNA, 19 nt, Homo sapiens
gccagaguauuucauuguu

SEQ ID NO: 956489 - RNA, 19 nt, Homo sapiens
ucucaugguucauaguauu

SEQ ID NO: 956490 - RNA, 19 nt, Homo sapiens
ugagaagaaauccaucaua

SEQ ID NO: 956491 - RNA, 19 nt, Homo sapiens
auaggacggucauagagua

SEQ ID NO: 956492 - RNA, 19 nt, Homo sapiens
ccagggauacugagaagaa

SEQ ID NO: 956493 - RNA, 19 nt, Homo sapiens
ugcagaagcugaagcacaa

SEQ ID NO: 956494 - RNA, 19 nt, Homo sapiens
guucauaguauucacugua

SEQ ID NO: 956495 - RNA, 19 nt, Homo sapiens
ggccugaagacauugaaua

SEQ ID NO: 956496 - RNA, 19 nt, Homo sapiens
cuuaugggauuccuuucua

SEQ ID NO: 956497 - RNA, 19 nt, Homo sapiens
gaaacauaccacucucaug

SEQ ID NO: 956498 - RNA, 19 nt, Homo sapiens
ggagaauuaauggguuaua

SEQ ID NO: 956499 - RNA, 19 nt, Homo sapiens
ggccaaggcaggcugauug

SEQ ID NO: 956500 - RNA, 19 nt, Homo sapiens
ugagaaccacugcugcaua

SEQ ID NO: 956501 - RNA, 19 nt, Homo sapiens
gccugaagacauugaauaa

SEQ ID NO: 956502 - RNA, 19 nt, Homo sapiens
aaccacugcugcauauauu

SEQ ID NO: 956503 - RNA, 19 nt, Homo sapiens
aaaggcagcuaggucagaa

SEQ ID NO: 956504 - RNA, 19 nt, Homo sapiens
ggaaacauaccacucucau

SEQ ID NO: 956505 - RNA, 19 nt, Homo sapiens
ccaaguugcaguuaacaug

SEQ ID NO: 956506 - RNA, 19 nt, Homo sapiens
aguauucacuguauguaug

SEQ ID NO: 956507 - RNA, 19 nt, Homo sapiens
uauuauggguaaagcagaa

SEQ ID NO: 956508 - RNA, 19 nt, Homo sapiens
ugggauuccuuucuaccua

SEQ ID NO: 956509 - RNA, 19 nt, Homo sapiens
caaggcaggcugauugcuu

SEQ ID NO: 956510 - RNA, 19 nt, Homo sapiens
ccacugcugcauauauuug

SEQ ID NO: 956511 - RNA, 19 nt, Homo sapiens
ccaguuagcaauaucauac

SEQ ID NO: 956512 - RNA, 19 nt, Homo sapiens
cuagaugcuuuauggacaa

SEQ ID NO: 956513 - RNA, 19 nt, Homo sapiens
caguuaacauguacaagca

SEQ ID NO: 956514 - RNA, 19 nt, Homo sapiens
gaaagaaaggguggauuuu

SEQ ID NO: 956515 - RNA, 19 nt, Homo sapiens
uaggucagaaggaaacaua

SEQ ID NO: 956516 - RNA, 19 nt, Homo sapiens
gcagauacucuagaugcuu

SEQ ID NO: 956517 - RNA, 19 nt, Homo sapiens
gaggacgcuuaugauauga

SEQ ID NO: 956518 - RNA, 19 nt, Homo sapiens
uauauaggacggucauaga

SEQ ID NO: 956519 - RNA, 19 nt, Homo sapiens
uaacauguacaagcaguug

SEQ ID NO: 956520 - RNA, 19 nt, Homo sapiens
cuauuaaagcuguucauug

SEQ ID NO: 956521 - RNA, 19 nt, Homo sapiens
ccacuuacagaaacuuaug

SEQ ID NO: 956522 - RNA, 19 nt, Homo sapiens
aaguugcaguuaacaugua

SEQ ID NO: 956523 - RNA, 19 nt, Homo sapiens
gaagcugaagcacaagaau

SEQ ID NO: 956524 - RNA, 19 nt, Homo sapiens
cagggauacugagaagaaa

SEQ ID NO: 956525 - RNA, 19 nt, Homo sapiens
cugaugaggacgcuuauga

SEQ ID NO: 956526 - RNA, 19 nt, Homo sapiens
ggccagaguauuucauugu

SEQ ID NO: 956527 - RNA, 19 nt, Homo sapiens
caaguugcaguuaacaugu

SEQ ID NO: 956528 - RNA, 19 nt, Homo sapiens
ccagucuccuccucaguuc

SEQ ID NO: 956529 - RNA, 19 nt, Homo sapiens
ccacucucaugguucauag

SEQ ID NO: 956530 - RNA, 19 nt, Homo sapiens
uuaggcagauacucuagau

SEQ ID NO: 956531 - RNA, 19 nt, Homo sapiens
ggaguuacuagaggagauu

SEQ ID NO: 956532 - RNA, 19 nt, Homo sapiens
cucaguagcuagggaagaa

SEQ ID NO: 956533 - RNA, 19 nt, Homo sapiens
caucauaccauuaccucau

SEQ ID NO: 956534 - RNA, 19 nt, Homo sapiens
gaacuguuaauugaagcuu

SEQ ID NO: 956535 - RNA, 19 nt, Homo sapiens
gacgaccuguuccgcuuca

SEQ ID NO: 956536 - RNA, 19 nt, Homo sapiens
gggauacugagaagaaauc

SEQ ID NO: 956537 - RNA, 19 nt, Homo sapiens
guauauaggacggucauag

SEQ ID NO: 956538 - RNA, 19 nt, Homo sapiens
aagcugaagcacaagaauu

SEQ ID NO: 956539 - RNA, 19 nt, Homo sapiens
uucuggagcucuauuagga

SEQ ID NO: 956540 - RNA, 19 nt, Homo sapiens
ugauucuggagcucuauua

SEQ ID NO: 956541 - RNA, 19 nt, Homo sapiens
acagaaacuuaugggauuc

SEQ ID NO: 956542 - RNA, 19 nt, Homo sapiens
cccacuggccagaguauuu

SEQ ID NO: 956543 - RNA, 19 nt, Homo sapiens
cugaagacauugaauaacc

SEQ ID NO: 956544 - RNA, 19 nt, Homo sapiens
uggccaaaaucuauacuaa

SEQ ID NO: 956545 - RNA, 19 nt, Homo sapiens
uguaagaguaucuaaccaa

SEQ ID NO: 956546 - RNA, 19 nt, Homo sapiens
ucucauuguuuccaguuag

SEQ ID NO: 956547 - RNA, 19 nt, Homo sapiens
uacucuagaugcuuuaugg

SEQ ID NO: 956548 - RNA, 19 nt, Homo sapiens
guucuuaggcagauacucu

SEQ ID NO: 956549 - RNA, 19 nt, Homo sapiens
aguaagacccugccucaag

SEQ ID NO: 956550 - RNA, 19 nt, Homo sapiens
ggauuccuuucuaccuaca

SEQ ID NO: 956551 - RNA, 19 nt, Homo sapiens
cuucaacaacauuaacuug

SEQ ID NO: 956552 - RNA, 19 nt, Homo sapiens
ccuauuaaagcuguucauu

SEQ ID NO: 956553 - RNA, 19 nt, Homo sapiens
ugcuugaggucaggaguuu

SEQ ID NO: 956554 - RNA, 19 nt, Homo sapiens
acucucaugguucauagua

SEQ ID NO: 956555 - RNA, 19 nt, Homo sapiens
uggccagaguauuucauug

SEQ ID NO: 956556 - RNA, 19 nt, Homo sapiens
ccacuggccagaguauuuc

SEQ ID NO: 956557 - RNA, 19 nt, Homo sapiens
gcauugugcuggaguuuga

SEQ ID NO: 956558 - RNA, 19 nt, Homo sapiens
ggugugggccuucugcuua

SEQ ID NO: 956559 - RNA, 19 nt, Homo sapiens
ccaugugggugaaaggaua

SEQ ID NO: 956560 - RNA, 19 nt, Homo sapiens
gaagcuacgugcuccaucu

SEQ ID NO: 956561 - RNA, 19 nt, Homo sapiens
gugaaaggauagacacaga

SEQ ID NO: 956562 - RNA, 19 nt, Homo sapiens
gcuaagaggcuuucuagag

SEQ ID NO: 956563 - RNA, 19 nt, Homo sapiens
ggaagaacaacgugagugu

SEQ ID NO: 956564 - RNA, 19 nt, Homo sapiens
ggucccaccugcacaccua

SEQ ID NO: 956565 - RNA, 19 nt, Homo sapiens
gagcggagagaacgcauug

SEQ ID NO: 956566 - RNA, 19 nt, Homo sapiens
guacuuauccaccuucucu

SEQ ID NO: 956567 - RNA, 19 nt, Homo sapiens
ccaaguacuuauccaccuu

SEQ ID NO: 956568 - RNA, 19 nt, Homo sapiens
uugagaagaugaaccucua

SEQ ID NO: 956569 - RNA, 19 nt, Homo sapiens
ugaccaagguggccgagau

SEQ ID NO: 956570 - RNA, 19 nt, Homo sapiens
gaggugggcaugaacauca

SEQ ID NO: 956571 - RNA, 19 nt, Homo sapiens
ccaaccggcugcugaccaa

SEQ ID NO: 956572 - RNA, 19 nt, Homo sapiens
ccaucugucuggauuacuu

SEQ ID NO: 956573 - RNA, 19 nt, Homo sapiens
ggacagauugaagugcuaa

SEQ ID NO: 956574 - RNA, 19 nt, Homo sapiens
ggacaacgugagccggaaa

SEQ ID NO: 956575 - RNA, 19 nt, Homo sapiens
cuguggaacucgccagaaa

SEQ ID NO: 956576 - RNA, 19 nt, Homo sapiens
cagcaaggaccgauuugug

SEQ ID NO: 956577 - RNA, 19 nt, Homo sapiens
gaaccucuaccugguggaa

SEQ ID NO: 956578 - RNA, 19 nt, Homo sapiens
gugcuaagaggcuuucuag

SEQ ID NO: 956579 - RNA, 19 nt, Homo sapiens
gcggagagaacgcauugug

SEQ ID NO: 956580 - RNA, 19 nt, Homo sapiens
gcuccuggcucugcagaag

SEQ ID NO: 956581 - RNA, 19 nt, Homo sapiens
uggaggaggacauggagua

SEQ ID NO: 956582 - RNA, 19 nt, Homo sapiens
gaggcuuucuagaggaugu

SEQ ID NO: 956583 - RNA, 19 nt, Homo sapiens
cagaguucccggacagauu

SEQ ID NO: 956584 - RNA, 19 nt, Homo sapiens
gugcuggaguuugagaaga

SEQ ID NO: 956585 - RNA, 19 nt, Homo sapiens
ggaccgauuuguggcuuac

SEQ ID NO: 956586 - RNA, 19 nt, Homo sapiens
ccuaccuccuccuguauga

SEQ ID NO: 956587 - RNA, 19 nt, Homo sapiens
gaggauguggugccugaug

SEQ ID NO: 956588 - RNA, 19 nt, Homo sapiens
gcaucuuccuggacuucga

SEQ ID NO: 956589 - RNA, 19 nt, Homo sapiens
auggucaucuccacaguga

SEQ ID NO: 956590 - RNA, 19 nt, Homo sapiens
cauggaggcuguggaacuc

SEQ ID NO: 956591 - RNA, 19 nt, Homo sapiens
gcagcaaggaccgauuugu

SEQ ID NO: 956592 - RNA, 19 nt, Homo sapiens
cggacagauugaagugcua

SEQ ID NO: 956593 - RNA, 19 nt, Homo sapiens
agaguucccggacagauug

SEQ ID NO: 956594 - RNA, 19 nt, Homo sapiens
caaccagacccaggacugu

SEQ ID NO: 956595 - RNA, 19 nt, Homo sapiens
ccagggaggagcagagcuu

SEQ ID NO: 956596 - RNA, 19 nt, Homo sapiens
gaccaagguggccgagaug

SEQ ID NO: 956597 - RNA, 19 nt, Homo sapiens
gaagcuggaggaggacaug

SEQ ID NO: 956598 - RNA, 19 nt, Homo sapiens
gaagugcuaagaggcuuuc

SEQ ID NO: 956599 - RNA, 19 nt, Homo sapiens
gcuggaguuugagaagaug

SEQ ID NO: 956600 - RNA, 19 nt, Homo sapiens
gcagaguucccggacagau

SEQ ID NO: 956601 - RNA, 19 nt, Homo sapiens
gaagagagguugcgagaga

SEQ ID NO: 956602 - RNA, 19 nt, Homo sapiens
gaacuugauucacuaauga

SEQ ID NO: 956603 - RNA, 19 nt, Homo sapiens
caaguaaguuugaguauca

SEQ ID NO: 956604 - RNA, 19 nt, Homo sapiens
gaguauaucucugaaagaa

SEQ ID NO: 956605 - RNA, 19 nt, Homo sapiens
gcaugacguuuacaacuuu

SEQ ID NO: 956606 - RNA, 19 nt, Homo sapiens
gagcaacuuuccagcagua

SEQ ID NO: 956607 - RNA, 19 nt, Homo sapiens
caacaugcauaacuugaau

SEQ ID NO: 956608 - RNA, 19 nt, Homo sapiens
gcaaacgucaugcaauaaa

SEQ ID NO: 956609 - RNA, 19 nt, Homo sapiens
uagauuauauguccaccua

SEQ ID NO: 956610 - RNA, 19 nt, Homo sapiens
ccaccuaucuuaaguguac

SEQ ID NO: 956611 - RNA, 19 nt, Homo sapiens
gagagauguuugguuuaua

SEQ ID NO: 956612 - RNA, 19 nt, Homo sapiens
cgagagauguuugguuuau

SEQ ID NO: 956613 - RNA, 19 nt, Homo sapiens
agaagaacuugauucacua

SEQ ID NO: 956614 - RNA, 19 nt, Homo sapiens
gggaguauaucucugaaag

SEQ ID NO: 956615 - RNA, 19 nt, Homo sapiens
gaagaacuugauucacuaa

SEQ ID NO: 956616 - RNA, 19 nt, Homo sapiens
uaaugugccuauacugauu

SEQ ID NO: 956617 - RNA, 19 nt, Homo sapiens
gaaaggcuguuagagucaa

SEQ ID NO: 956618 - RNA, 19 nt, Homo sapiens
ggcaugacguuuacaacuu

SEQ ID NO: 956619 - RNA, 19 nt, Homo sapiens
gauuauauguccaccuauc

SEQ ID NO: 956620 - RNA, 19 nt, Homo sapiens
cacaguacauugauuaaca

SEQ ID NO: 956621 - RNA, 19 nt, Homo sapiens
gcuaaugugccuauacuga

SEQ ID NO: 956622 - RNA, 19 nt, Homo sapiens
aagaagaacuugauucacu

SEQ ID NO: 956623 - RNA, 19 nt, Homo sapiens
guauaucucugaaagaacu

SEQ ID NO: 956624 - RNA, 19 nt, Homo sapiens
cagaugaaaccauugcuaa

SEQ ID NO: 956625 - RNA, 19 nt, Homo sapiens
gaaaacugguaaacuggua

SEQ ID NO: 956626 - RNA, 19 nt, Homo sapiens
gcccgacccuuagaaguuu

SEQ ID NO: 956627 - RNA, 19 nt, Homo sapiens
ugcgagagauguuugguuu

SEQ ID NO: 956628 - RNA, 19 nt, Homo sapiens
ugacagacuuggacaacau

SEQ ID NO: 956629 - RNA, 19 nt, Homo sapiens
aaacugguauuucuuggau

SEQ ID NO: 956630 - RNA, 19 nt, Homo sapiens
uaagaaaacugguaaacug

SEQ ID NO: 956631 - RNA, 19 nt, Homo sapiens
gcuaaaagaugacagacuu

SEQ ID NO: 956632 - RNA, 19 nt, Homo sapiens
guaucacaauguuagcuuu

SEQ ID NO: 956633 - RNA, 19 nt, Homo sapiens
ucacaauguuagcuuucua

SEQ ID NO: 956634 - RNA, 19 nt, Homo sapiens
ccgaagaacugaccauugc

SEQ ID NO: 956635 - RNA, 19 nt, Homo sapiens
caacauugcuacacaugcu

SEQ ID NO: 956636 - RNA, 19 nt, Homo sapiens
gguaaacugguauuucuug

SEQ ID NO: 956637 - RNA, 19 nt, Homo sapiens
ucgcagacccuaucagauu

SEQ ID NO: 956638 - RNA, 19 nt, Homo sapiens
aagacaagguuacggagaa

SEQ ID NO: 956639 - RNA, 19 nt, Homo sapiens
caacauuacaucccacuuc

SEQ ID NO: 956640 - RNA, 19 nt, Homo sapiens
agaacuugauucacuaaug

SEQ ID NO: 956641 - RNA, 19 nt, Homo sapiens
uauauguccaccuaucuua

SEQ ID NO: 956642 - RNA, 19 nt, Homo sapiens
ggauggcacaguacauuga

SEQ ID NO: 956643 - RNA, 19 nt, Homo sapiens
guacggccaacgccaagua

SEQ ID NO: 956644 - RNA, 19 nt, Homo sapiens
uaacacaaacucacauugg

SEQ ID NO: 956645 - RNA, 19 nt, Homo sapiens
cgcagacccuaucagauuu

SEQ ID NO: 956646 - RNA, 19 nt, Homo sapiens
gauguuugguuuauauggu

SEQ ID NO: 956647 - RNA, 19 nt, Homo sapiens
aaacaacauugcuacacau

SEQ ID NO: 956648 - RNA, 19 nt, Homo sapiens
uggcacaguacauugauua

SEQ ID NO: 956649 - RNA, 19 nt, Homo sapiens
gauuggauuuacagugguu

SEQ ID NO: 956650 - RNA, 19 nt, Homo sapiens
caugaugccuuacaguuuu

SEQ ID NO: 956651 - RNA, 19 nt, Homo sapiens
gcgagagauguuugguuua

SEQ ID NO: 956652 - RNA, 19 nt, Homo sapiens
gaaaacugauucaaguaag

SEQ ID NO: 956653 - RNA, 19 nt, Homo sapiens
ggaguauaucucugaaaga

SEQ ID NO: 956654 - RNA, 19 nt, Homo sapiens
gcucaacaugcauaacuug

SEQ ID NO: 956655 - RNA, 19 nt, Homo sapiens
aaaacuaccuuccugcuau

SEQ ID NO: 956656 - RNA, 19 nt, Homo sapiens
caaacgucaugcaauaaaa

SEQ ID NO: 956657 - RNA, 19 nt, Homo sapiens
uaagaucgacagaccugaa

SEQ ID NO: 956658 - RNA, 19 nt, Homo sapiens
cugguaaacugguauuucu

SEQ ID NO: 956659 - RNA, 19 nt, Homo sapiens
gaaugagaauugaaaacug

SEQ ID NO: 956660 - RNA, 19 nt, Homo sapiens
gugccuauacugauucuug

SEQ ID NO: 956661 - RNA, 19 nt, Homo sapiens
ucacuaaugacagaugaaa

SEQ ID NO: 956662 - RNA, 19 nt, Homo sapiens
cuaccuuccugcuaucaau

SEQ ID NO: 956663 - RNA, 19 nt, Homo sapiens
ccauaaaaguacuugguuu

SEQ ID NO: 956664 - RNA, 19 nt, Homo sapiens
guuugaguaucacaauguu

SEQ ID NO: 956665 - RNA, 19 nt, Homo sapiens
guucaggcuuacucagaga

SEQ ID NO: 956666 - RNA, 19 nt, Homo sapiens
gauuggauaaugcaggaaa

SEQ ID NO: 956667 - RNA, 19 nt, Homo sapiens
gucucaacguucaggcuua

SEQ ID NO: 956668 - RNA, 19 nt, Homo sapiens
acugguauuucuuggauug

SEQ ID NO: 956669 - RNA, 19 nt, Homo sapiens
ccagcgccauuuguaaaga

SEQ ID NO: 956670 - RNA, 19 nt, Homo sapiens
gguuccaggucucaacguu

SEQ ID NO: 956671 - RNA, 19 nt, Homo sapiens
gaagccaucagugaagaga

SEQ ID NO: 956672 - RNA, 19 nt, Homo sapiens
uugauucacuaaugacaga

SEQ ID NO: 956673 - RNA, 19 nt, Homo sapiens
ggauugugcagaccacgaa

SEQ ID NO: 956674 - RNA, 19 nt, Homo sapiens
aaacuaccuuccugcuauc

SEQ ID NO: 956675 - RNA, 19 nt, Homo sapiens
gaucuggguggacauguuc

SEQ ID NO: 956676 - RNA, 19 nt, Homo sapiens
guccaccuaucuuaagugu

SEQ ID NO: 956677 - RNA, 19 nt, Homo sapiens
gcagacccuaucagauuug

SEQ ID NO: 956678 - RNA, 19 nt, Homo sapiens
uuucuuggauuggauaaug

SEQ ID NO: 956679 - RNA, 19 nt, Homo sapiens
caggcuuacucagagauuu

SEQ ID NO: 956680 - RNA, 19 nt, Homo sapiens
acacaaacucacauugguu

SEQ ID NO: 956681 - RNA, 19 nt, Homo sapiens
acugaaugcccgacccuua

SEQ ID NO: 956682 - RNA, 19 nt, Homo sapiens
ugaucuggguggacauguu

SEQ ID NO: 956683 - RNA, 19 nt, Homo sapiens
ccaucgcgcuuugcaguuc

SEQ ID NO: 956684 - RNA, 19 nt, Homo sapiens
gguauuucuuggauuggau

SEQ ID NO: 956685 - RNA, 19 nt, Homo sapiens
ggacauguucaagcucgaa

SEQ ID NO: 956686 - RNA, 19 nt, Homo sapiens
caacaugaaacuauaaacc

SEQ ID NO: 956687 - RNA, 19 nt, Homo sapiens
caacuuuccagcaguacau

SEQ ID NO: 956688 - RNA, 19 nt, Homo sapiens
gacccuaucagauuuggau

SEQ ID NO: 956689 - RNA, 19 nt, Homo sapiens
gaaugcccgacccuuagaa

SEQ ID NO: 956690 - RNA, 19 nt, Homo sapiens
cgaaaggcuguuagaguca

SEQ ID NO: 956691 - RNA, 19 nt, Homo sapiens
caguacauuugaagcacuu

SEQ ID NO: 956692 - RNA, 19 nt, Homo sapiens
gacuuuugcugguuauaaa

SEQ ID NO: 956693 - RNA, 19 nt, Homo sapiens
uuacucagagauuugauug

SEQ ID NO: 956694 - RNA, 19 nt, Homo sapiens
guauuucuuggauuggaua

SEQ ID NO: 956695 - RNA, 19 nt, Homo sapiens
cacgaaaggcuguuagagu

SEQ ID NO: 956696 - RNA, 19 nt, Homo sapiens
guagugugcucaaaagaca

SEQ ID NO: 956697 - RNA, 19 nt, Homo sapiens
acagaugaaaccauugcua

SEQ ID NO: 956698 - RNA, 19 nt, Homo sapiens
gccuuacaguuuucaauaa

SEQ ID NO: 956699 - RNA, 19 nt, Homo sapiens
caacguucaggcuuacuca

SEQ ID NO: 956700 - RNA, 19 nt, Homo sapiens
gcacaguacauugauuaac

SEQ ID NO: 956701 - RNA, 19 nt, Homo sapiens
gauggaggcuggacaguaa

SEQ ID NO: 956702 - RNA, 19 nt, Homo sapiens
gaaagaggcugcccgagau

SEQ ID NO: 956703 - RNA, 19 nt, Homo sapiens
gaucgaggcugcaggauau

SEQ ID NO: 956704 - RNA, 19 nt, Homo sapiens
gggcggagcucacagaguu

SEQ ID NO: 956705 - RNA, 19 nt, Homo sapiens
gacaagaacugcgccaaga

SEQ ID NO: 956706 - RNA, 19 nt, Homo sapiens
gaggcagaguggacuauuu

SEQ ID NO: 956707 - RNA, 19 nt, Homo sapiens
acaagcaccuagaccauga

SEQ ID NO: 956708 - RNA, 19 nt, Homo sapiens
caagaugaccucagaugga

SEQ ID NO: 956709 - RNA, 19 nt, Homo sapiens
cagaguggacuauuugaaa

SEQ ID NO: 956710 - RNA, 19 nt, Homo sapiens
cagcagcggcagaagcuua

SEQ ID NO: 956711 - RNA, 19 nt, Homo sapiens
gaauucagcaucugcaaag

SEQ ID NO: 956712 - RNA, 19 nt, Homo sapiens
caagcaggcgccaauggua

SEQ ID NO: 956713 - RNA, 19 nt, Homo sapiens
uuggugaacugcaagauga

SEQ ID NO: 956714 - RNA, 19 nt, Homo sapiens
gcagaguggacuauuugaa

SEQ ID NO: 956715 - RNA, 19 nt, Homo sapiens
acacgacugugauccgauu

SEQ ID NO: 956716 - RNA, 19 nt, Homo sapiens
gauaugcucagacucuaga

SEQ ID NO: 956717 - RNA, 19 nt, Homo sapiens
gaacagcaggauccagcaa

SEQ ID NO: 956718 - RNA, 19 nt, Homo sapiens
ggacucagagggaccacuu

SEQ ID NO: 956719 - RNA, 19 nt, Homo sapiens
gagaaggugcauagcauca

SEQ ID NO: 956720 - RNA, 19 nt, Homo sapiens
gcgaggacacggccuauag

SEQ ID NO: 956721 - RNA, 19 nt, Homo sapiens
ucuggaggcuggugguuug

SEQ ID NO: 956722 - RNA, 19 nt, Homo sapiens
gcucccaggcuaccuaaga

SEQ ID NO: 956723 - RNA, 19 nt, Homo sapiens
gcaggccaccaccauguug

SEQ ID NO: 956724 - RNA, 19 nt, Homo sapiens
uggagaaggugcauagcau

SEQ ID NO: 956725 - RNA, 19 nt, Homo sapiens
ggagaggcagaguggacua

SEQ ID NO: 956726 - RNA, 19 nt, Homo sapiens
cgacugugauccgauucuu

SEQ ID NO: 956727 - RNA, 19 nt, Homo sapiens
cgaauucagcaucugcaaa

SEQ ID NO: 956728 - RNA, 19 nt, Homo sapiens
ccacuugggaccaggauca

SEQ ID NO: 956729 - RNA, 19 nt, Homo sapiens
ucauggugcuggugcuguu

SEQ ID NO: 956730 - RNA, 19 nt, Homo sapiens
ugacccggcucacaauguc

SEQ ID NO: 956731 - RNA, 19 nt, Homo sapiens
caacucaaggcucagaaca

SEQ ID NO: 956732 - RNA, 19 nt, Homo sapiens
guccaccgaccucccguua

SEQ ID NO: 956733 - RNA, 19 nt, Homo sapiens
gaauaaaagcaaccucaga

SEQ ID NO: 956734 - RNA, 19 nt, Homo sapiens
gacacaagcaggcgccaau

SEQ ID NO: 956735 - RNA, 19 nt, Homo sapiens
acugcaagaugaccucaga

SEQ ID NO: 956736 - RNA, 19 nt, Homo sapiens
caagaccacgacuggagaa

SEQ ID NO: 956737 - RNA, 19 nt, Homo sapiens
uccagcaacucuuccacaa

SEQ ID NO: 956738 - RNA, 19 nt, Homo sapiens
caggauaugcucagacucu

SEQ ID NO: 956739 - RNA, 19 nt, Homo sapiens
ccacaagcaccuagaccau

SEQ ID NO: 956740 - RNA, 19 nt, Homo sapiens
aaagcaaccucagaacacu

SEQ ID NO: 956741 - RNA, 19 nt, Homo sapiens
agaucgaggcugcaggaua

SEQ ID NO: 956742 - RNA, 19 nt, Homo sapiens
gggauugccaggagcuguu

SEQ ID NO: 956743 - RNA, 19 nt, Homo sapiens
ccgaggauguggccaagac

SEQ ID NO: 956744 - RNA, 19 nt, Homo sapiens
gcaccugcagccauuccaa

SEQ ID NO: 956745 - RNA, 19 nt, Homo sapiens
aggcagaguggacuauuug

SEQ ID NO: 956746 - RNA, 19 nt, Homo sapiens
cacgaaagacggugacucu

SEQ ID NO: 956747 - RNA, 19 nt, Homo sapiens
gucccaggcccacgaaaga

SEQ ID NO: 956748 - RNA, 19 nt, Homo sapiens
ccaccaccauguugaucca

SEQ ID NO: 956749 - RNA, 19 nt, Homo sapiens
gaggcuggacaguaauuca

SEQ ID NO: 956750 - RNA, 19 nt, Homo sapiens
gacugugauccgauucuuu

SEQ ID NO: 956751 - RNA, 19 nt, Homo sapiens
ggauaugcucagacucuag

SEQ ID NO: 956752 - RNA, 19 nt, Homo sapiens
gauggaggcuggacaguaa

SEQ ID NO: 956753 - RNA, 19 nt, Homo sapiens
gaaagaggcugcccgagau

SEQ ID NO: 956754 - RNA, 19 nt, Homo sapiens
gaucgaggcugcaggauau

SEQ ID NO: 956755 - RNA, 19 nt, Homo sapiens
gggcggagcucacagaguu

SEQ ID NO: 956756 - RNA, 19 nt, Homo sapiens
gacaagaacugcgccaaga

SEQ ID NO: 956757 - RNA, 19 nt, Homo sapiens
gaggcagaguggacuauuu

SEQ ID NO: 956758 - RNA, 19 nt, Homo sapiens
ggaaacuuguggacagaga

SEQ ID NO: 956759 - RNA, 19 nt, Homo sapiens
acaagcaccuagaccauga

SEQ ID NO: 956760 - RNA, 19 nt, Homo sapiens
caagaugaccucagaugga

SEQ ID NO: 956761 - RNA, 19 nt, Homo sapiens
cagaguggacuauuugaaa

SEQ ID NO: 956762 - RNA, 19 nt, Homo sapiens
cagcagcggcagaagcuua

SEQ ID NO: 956763 - RNA, 19 nt, Homo sapiens
gaauucagcaucugcaaag

SEQ ID NO: 956764 - RNA, 19 nt, Homo sapiens
caagcaggcgccaauggua

SEQ ID NO: 956765 - RNA, 19 nt, Homo sapiens
uuggugaacugcaagauga

SEQ ID NO: 956766 - RNA, 19 nt, Homo sapiens
gcagaguggacuauuugaa

SEQ ID NO: 956767 - RNA, 19 nt, Homo sapiens
acacgacugugauccgauu

SEQ ID NO: 956768 - RNA, 19 nt, Homo sapiens
gauaugcucagacucuaga

SEQ ID NO: 956769 - RNA, 19 nt, Homo sapiens
gaagaccacgacuggagaa

SEQ ID NO: 956770 - RNA, 19 nt, Homo sapiens
gaacagcaggauccagcaa

SEQ ID NO: 956771 - RNA, 19 nt, Homo sapiens
ggacucagagggaccacuu

SEQ ID NO: 956772 - RNA, 19 nt, Homo sapiens
gagaaggugcauagcauca

SEQ ID NO: 956773 - RNA, 19 nt, Homo sapiens
gcgaggacacggccuauag

SEQ ID NO: 956774 - RNA, 19 nt, Homo sapiens
ucuggaggcuggugguuug

SEQ ID NO: 956775 - RNA, 19 nt, Homo sapiens
gaaacuuguggacagagaa

SEQ ID NO: 956776 - RNA, 19 nt, Homo sapiens
gcucccaggcuaccuaaga

SEQ ID NO: 956777 - RNA, 19 nt, Homo sapiens
gcaggccaccaccauguug

SEQ ID NO: 956778 - RNA, 19 nt, Homo sapiens
uggagaaggugcauagcau

SEQ ID NO: 956779 - RNA, 19 nt, Homo sapiens
ggagaggcagaguggacua

SEQ ID NO: 956780 - RNA, 19 nt, Homo sapiens
cgacugugauccgauucuu

SEQ ID NO: 956781 - RNA, 19 nt, Homo sapiens
cgaauucagcaucugcaaa

SEQ ID NO: 956782 - RNA, 19 nt, Homo sapiens
ccacuugggaccaggauca

SEQ ID NO: 956783 - RNA, 19 nt, Homo sapiens
ucauggugcuggugcuguu

SEQ ID NO: 956784 - RNA, 19 nt, Homo sapiens
guccaccgaccucccguua

SEQ ID NO: 956785 - RNA, 19 nt, Homo sapiens
ugacccggcucacaauguc

SEQ ID NO: 956786 - RNA, 19 nt, Homo sapiens
caacucaaggcucagaaca

SEQ ID NO: 956787 - RNA, 19 nt, Homo sapiens
caaccucagaacacuuaaa

SEQ ID NO: 956788 - RNA, 19 nt, Homo sapiens
gaauaaaagcaaccucaga

SEQ ID NO: 956789 - RNA, 19 nt, Homo sapiens
gacacaagcaggcgccaau

SEQ ID NO: 956790 - RNA, 19 nt, Homo sapiens
acugcaagaugaccucaga

SEQ ID NO: 956791 - RNA, 19 nt, Homo sapiens
uccagcaacucuuccacaa

SEQ ID NO: 956792 - RNA, 19 nt, Homo sapiens
caggauaugcucagacucu

SEQ ID NO: 956793 - RNA, 19 nt, Homo sapiens
ccacaagcaccuagaccau

SEQ ID NO: 956794 - RNA, 19 nt, Homo sapiens
aaagcaaccucagaacacu

SEQ ID NO: 956795 - RNA, 19 nt, Homo sapiens
agcaaccucagaacacuua

SEQ ID NO: 956796 - RNA, 19 nt, Homo sapiens
agaucgaggcugcaggaua

SEQ ID NO: 956797 - RNA, 19 nt, Homo sapiens
gggauugccaggagcuguu

SEQ ID NO: 956798 - RNA, 19 nt, Homo sapiens
gcaccugcagccauuccaa

SEQ ID NO: 956799 - RNA, 19 nt, Homo sapiens
aggcagaguggacuauuug

SEQ ID NO: 956800 - RNA, 19 nt, Homo sapiens
cacgaaagacggugacucu

SEQ ID NO: 956801 - RNA, 19 nt, Homo sapiens
gucccaggcccacgaaaga

SEQ ID NO: 956802 - RNA, 19 nt, Homo sapiens
ccaccaccauguugaucca

SEQ ID NO: 956803 - RNA, 19 nt, Homo sapiens
gaggcuggacaguaauuca

SEQ ID NO: 956804 - RNA, 19 nt, Homo sapiens
gacugugauccgauucuuu

SEQ ID NO: 956805 - RNA, 19 nt, Homo sapiens
ggauaugcucagacucuag

SEQ ID NO: 956806 - RNA, 19 nt, Homo sapiens
gaaauucgguccagucuaa

SEQ ID NO: 956807 - RNA, 19 nt, Homo sapiens
gcauaaagcuucacuggaa

SEQ ID NO: 956808 - RNA, 19 nt, Homo sapiens
ccagaagccuacauaauua

SEQ ID NO: 956809 - RNA, 19 nt, Homo sapiens
caacuagccuucccaguaa

SEQ ID NO: 956810 - RNA, 19 nt, Homo sapiens
gaggaaagguugcucauug

SEQ ID NO: 956811 - RNA, 19 nt, Homo sapiens
ucacaacucuguagaaugu

SEQ ID NO: 956812 - RNA, 19 nt, Homo sapiens
gaagauugccuagaaauau

SEQ ID NO: 956813 - RNA, 19 nt, Homo sapiens
gguguagaaucuguuauua

SEQ ID NO: 956814 - RNA, 19 nt, Homo sapiens
gaaauauggagcccagaua

SEQ ID NO: 956815 - RNA, 19 nt, Homo sapiens
cuagaaagcuugagcauac

SEQ ID NO: 956816 - RNA, 19 nt, Homo sapiens
ggaaggcaauguuaaaguc

SEQ ID NO: 956817 - RNA, 19 nt, Homo sapiens
gugcaaaugucaauuguca

SEQ ID NO: 956818 - RNA, 19 nt, Homo sapiens
gauguuacuucuagugcua

SEQ ID NO: 956819 - RNA, 19 nt, Homo sapiens
ggaaucacaccuuuauuug

SEQ ID NO: 956820 - RNA, 19 nt, Homo sapiens
gcaacuacuuuagaagaaa

SEQ ID NO: 956821 - RNA, 19 nt, Homo sapiens
gcaguuaccuauucaugca

SEQ ID NO: 956822 - RNA, 19 nt, Homo sapiens
gcuacacccuuguucauug

SEQ ID NO: 956823 - RNA, 19 nt, Homo sapiens
gaccagccauuucggugua

SEQ ID NO: 956824 - RNA, 19 nt, Homo sapiens
gcuaauaaacugugauguu

SEQ ID NO: 956825 - RNA, 19 nt, Homo sapiens
gaagaaacgacaccauugu

SEQ ID NO: 956826 - RNA, 19 nt, Homo sapiens
guagaauguuugcaaaugu

SEQ ID NO: 956827 - RNA, 19 nt, Homo sapiens
ggauaaaucagugaaacua

SEQ ID NO: 956828 - RNA, 19 nt, Homo sapiens
gaaagcuugagcauacuua

SEQ ID NO: 956829 - RNA, 19 nt, Homo sapiens
caacugugguguagaaucu

SEQ ID NO: 956830 - RNA, 19 nt, Homo sapiens
uaucuucacuuuggaguuu

SEQ ID NO: 956831 - RNA, 19 nt, Homo sapiens
gcagacuggucaaacaaau

SEQ ID NO: 956832 - RNA, 19 nt, Homo sapiens
acaugaagauugccuagaa

SEQ ID NO: 956833 - RNA, 19 nt, Homo sapiens
ggaaugccaggaugacuuu

SEQ ID NO: 956834 - RNA, 19 nt, Homo sapiens
acaacuagccuucccagua

SEQ ID NO: 956835 - RNA, 19 nt, Homo sapiens
cccagaagccuacauaauu

SEQ ID NO: 956836 - RNA, 19 nt, Homo sapiens
gcaauuaaagcacaagcaa

SEQ ID NO: 956837 - RNA, 19 nt, Homo sapiens
gaaauauuacuccggaaug

SEQ ID NO: 956838 - RNA, 19 nt, Homo sapiens
gacacgugcucuacaguug

SEQ ID NO: 956839 - RNA, 19 nt, Homo sapiens
caucaccaguacauuauau

SEQ ID NO: 956840 - RNA, 19 nt, Homo sapiens
acacugggcuaaacaaagu

SEQ ID NO: 956841 - RNA, 19 nt, Homo sapiens
ugaggacaguuggcaguua

SEQ ID NO: 956842 - RNA, 19 nt, Homo sapiens
caggaugacuuuggaauca

SEQ ID NO: 956843 - RNA, 19 nt, Homo sapiens
ggacagauagauguguuaa

SEQ ID NO: 956844 - RNA, 19 nt, Homo sapiens
ggauucaguucuccugugu

SEQ ID NO: 956845 - RNA, 19 nt, Homo sapiens
ugaagauugccuagaaaua

SEQ ID NO: 956846 - RNA, 19 nt, Homo sapiens
caugaagauugccuagaaa

SEQ ID NO: 956847 - RNA, 19 nt, Homo sapiens
uggaaucacaccuuuauuu

SEQ ID NO: 956848 - RNA, 19 nt, Homo sapiens
agacuugacuaucucuuau

SEQ ID NO: 956849 - RNA, 19 nt, Homo sapiens
gcucagaauggaaugcaua

SEQ ID NO: 956850 - RNA, 19 nt, Homo sapiens
ugcuaaacauggcauauuu

SEQ ID NO: 956851 - RNA, 19 nt, Homo sapiens
gaacgucuacggucugaca

SEQ ID NO: 956852 - RNA, 19 nt, Homo sapiens
uaucacaacucuguagaau

SEQ ID NO: 956853 - RNA, 19 nt, Homo sapiens
guucauugcugcucaagag

SEQ ID NO: 956854 - RNA, 19 nt, Homo sapiens
gcaaaugucaauugucaag

SEQ ID NO: 956855 - RNA, 19 nt, Homo sapiens
gaaucacaccuuuauuugu

SEQ ID NO: 956856 - RNA, 19 nt, Homo sapiens
cuucaucaccaguacauua

SEQ ID NO: 956857 - RNA, 19 nt, Homo sapiens
ggacacgugcucuacaguu

SEQ ID NO: 956858 - RNA, 19 nt, Homo sapiens
ccauuucgguguagaagug

SEQ ID NO: 956859 - RNA, 19 nt, Homo sapiens
gcaucucgcugcaagucaa

SEQ ID NO: 956860 - RNA, 19 nt, Homo sapiens
ugacccaucuuugucguuu

SEQ ID NO: 956861 - RNA, 19 nt, Homo sapiens
acauuaagaugaagaccuu

SEQ ID NO: 956862 - RNA, 19 nt, Homo sapiens
gggccgaagugucgauguu

SEQ ID NO: 956863 - RNA, 19 nt, Homo sapiens
cauggcauauuuccaccua

SEQ ID NO: 956864 - RNA, 19 nt, Homo sapiens
cuacuuaacacagcuaauu

SEQ ID NO: 956865 - RNA, 19 nt, Homo sapiens
ggauuugacccacugauuc

SEQ ID NO: 956866 - RNA, 19 nt, Homo sapiens
acaacucuguagaauguuu

SEQ ID NO: 956867 - RNA, 19 nt, Homo sapiens
ccaccuaugauucguguuu

SEQ ID NO: 956868 - RNA, 19 nt, Homo sapiens
ucagugagaauguuuaugu

SEQ ID NO: 956869 - RNA, 19 nt, Homo sapiens
gcuagaaagcuugagcaua

SEQ ID NO: 956870 - RNA, 19 nt, Homo sapiens
aggcaauguuaaagucuua

SEQ ID NO: 956871 - RNA, 19 nt, Homo sapiens
acagauagauguguuaagg

SEQ ID NO: 956872 - RNA, 19 nt, Homo sapiens
uagaagaaacgacaccauu

SEQ ID NO: 956873 - RNA, 19 nt, Homo sapiens
ggauggaugccaauucaug

SEQ ID NO: 956874 - RNA, 19 nt, Homo sapiens
gguauuaggagcucagaau

SEQ ID NO: 956875 - RNA, 19 nt, Homo sapiens
guaguucagugagaauguu

SEQ ID NO: 956876 - RNA, 19 nt, Homo sapiens
aaauauggagcccagauaa

SEQ ID NO: 956877 - RNA, 19 nt, Homo sapiens
gaaaauggacagauagaug

SEQ ID NO: 956878 - RNA, 19 nt, Homo sapiens
gauggaugccaauucauga

SEQ ID NO: 956879 - RNA, 19 nt, Homo sapiens
caccuaugauucguguuua

SEQ ID NO: 956880 - RNA, 19 nt, Homo sapiens
gaacuggcagcuauucaag

SEQ ID NO: 956881 - RNA, 19 nt, Homo sapiens
gaggauguaugaaguucca

SEQ ID NO: 956882 - RNA, 19 nt, Homo sapiens
gaacuucauuuggcauacu

SEQ ID NO: 956883 - RNA, 19 nt, Homo sapiens
uguagaauguuugcaaaug

SEQ ID NO: 956884 - RNA, 19 nt, Homo sapiens
gugucgauguugcugauaa

SEQ ID NO: 956885 - RNA, 19 nt, Homo sapiens
cuuuggaguuuacuaauug

SEQ ID NO: 956886 - RNA, 19 nt, Homo sapiens
ucacuuuggaguuuacuaa

SEQ ID NO: 956887 - RNA, 19 nt, Homo sapiens
gaggacaguuggcaguuac

SEQ ID NO: 956888 - RNA, 19 nt, Homo sapiens
uagacuugacuaucucuua

SEQ ID NO: 956889 - RNA, 19 nt, Homo sapiens
gccaguaguucagugagaa

SEQ ID NO: 956890 - RNA, 19 nt, Homo sapiens
ucagugaaacuacuuaaca

SEQ ID NO: 956891 - RNA, 19 nt, Homo sapiens
gcauugacacccuuaucuu

SEQ ID NO: 956892 - RNA, 19 nt, Homo sapiens
cagcuuaucacaacucugu

SEQ ID NO: 956893 - RNA, 19 nt, Homo sapiens
ggaugacuuuggaaucaca

SEQ ID NO: 956894 - RNA, 19 nt, Homo sapiens
gaagguuucugugcuuugc

SEQ ID NO: 956895 - RNA, 19 nt, Homo sapiens
ccagggaaggcaauguuaa

SEQ ID NO: 956896 - RNA, 19 nt, Homo sapiens
aaacugugauguuacuucu

SEQ ID NO: 956897 - RNA, 19 nt, Homo sapiens
gaagacguucugaggaugu

SEQ ID NO: 956898 - RNA, 19 nt, Homo sapiens
ggucugacaguuauauuag

SEQ ID NO: 956899 - RNA, 19 nt, Homo sapiens
gcaagucaaggacauugga

SEQ ID NO: 956900 - RNA, 19 nt, Homo sapiens
cagaauggaaugcauaaag

SEQ ID NO: 956901 - RNA, 19 nt, Homo sapiens
cagggaaggcaauguuaaa

SEQ ID NO: 956902 - RNA, 19 nt, Homo sapiens
ggccaguaguucagugaga

SEQ ID NO: 956903 - RNA, 19 nt, Homo sapiens
ggaaauucgguccagucua

SEQ ID NO: 956904 - RNA, 19 nt, Homo sapiens
cucaaacgcuuggauucua

SEQ ID NO: 956905 - RNA, 19 nt, Homo sapiens
caauuaaagcacaagcaaa

SEQ ID NO: 956906 - RNA, 19 nt, Homo sapiens
gaaauucgguccagucuaa

SEQ ID NO: 956907 - RNA, 19 nt, Homo sapiens
gcauaaagcuucacuggaa

SEQ ID NO: 956908 - RNA, 19 nt, Homo sapiens
ccagaagccuacauaauua

SEQ ID NO: 956909 - RNA, 19 nt, Homo sapiens
caacuagccuucccaguaa

SEQ ID NO: 956910 - RNA, 19 nt, Homo sapiens
gaggaaagguugcucauug

SEQ ID NO: 956911 - RNA, 19 nt, Homo sapiens
gaagauugccuagaaauau

SEQ ID NO: 956912 - RNA, 19 nt, Homo sapiens
gguguagaaucuguuauua

SEQ ID NO: 956913 - RNA, 19 nt, Homo sapiens
gaaauauggagcccagaua

SEQ ID NO: 956914 - RNA, 19 nt, Homo sapiens
cuagaaagcuugagcauac

SEQ ID NO: 956915 - RNA, 19 nt, Homo sapiens
gugcaaaugucaauuguca

SEQ ID NO: 956916 - RNA, 19 nt, Homo sapiens
gauguuacuucuagugcua

SEQ ID NO: 956917 - RNA, 19 nt, Homo sapiens
ggaaucacaccuuuauuug

SEQ ID NO: 956918 - RNA, 19 nt, Homo sapiens
gcaacuacuuuagaagaaa

SEQ ID NO: 956919 - RNA, 19 nt, Homo sapiens
gcaguuaccuauucaugca

SEQ ID NO: 956920 - RNA, 19 nt, Homo sapiens
gcuacacccuuguucauug

SEQ ID NO: 956921 - RNA, 19 nt, Homo sapiens
gcuaauaaacugugauguu

SEQ ID NO: 956922 - RNA, 19 nt, Homo sapiens
gaccagccauuucggugua

SEQ ID NO: 956923 - RNA, 19 nt, Homo sapiens
gaagaaacgacaccauugu

SEQ ID NO: 956924 - RNA, 19 nt, Homo sapiens
ggauaaaucagugaaacua

SEQ ID NO: 956925 - RNA, 19 nt, Homo sapiens
gaaagcuugagcauacuua

SEQ ID NO: 956926 - RNA, 19 nt, Homo sapiens
caacugugguguagaaucu

SEQ ID NO: 956927 - RNA, 19 nt, Homo sapiens
uaucuucacuuuggaguuu

SEQ ID NO: 956928 - RNA, 19 nt, Homo sapiens
acaugaagauugccuagaa

SEQ ID NO: 956929 - RNA, 19 nt, Homo sapiens
ggaaugccaggaugacuuu

SEQ ID NO: 956930 - RNA, 19 nt, Homo sapiens
acaacuagccuucccagua

SEQ ID NO: 956931 - RNA, 19 nt, Homo sapiens
cccagaagccuacauaauu

SEQ ID NO: 956932 - RNA, 19 nt, Homo sapiens
gcaauuaaagcacaagcaa

SEQ ID NO: 956933 - RNA, 19 nt, Homo sapiens
gaaauauuacuccggaaug

SEQ ID NO: 956934 - RNA, 19 nt, Homo sapiens
caucaccaguacauuauau

SEQ ID NO: 956935 - RNA, 19 nt, Homo sapiens
acacugggcuaaacaaagu

SEQ ID NO: 956936 - RNA, 19 nt, Homo sapiens
ugaggacaguuggcaguua

SEQ ID NO: 956937 - RNA, 19 nt, Homo sapiens
caggaugacuuuggaauca

SEQ ID NO: 956938 - RNA, 19 nt, Homo sapiens
ggacagauagauguguuaa

SEQ ID NO: 956939 - RNA, 19 nt, Homo sapiens
ggauucaguucuccugugu

SEQ ID NO: 956940 - RNA, 19 nt, Homo sapiens
ugaagauugccuagaaaua

SEQ ID NO: 956941 - RNA, 19 nt, Homo sapiens
caugaagauugccuagaaa

SEQ ID NO: 956942 - RNA, 19 nt, Homo sapiens
uggaaucacaccuuuauuu

SEQ ID NO: 956943 - RNA, 19 nt, Homo sapiens
agacuugacuaucucuuau

SEQ ID NO: 956944 - RNA, 19 nt, Homo sapiens
gcucagaauggaaugcaua

SEQ ID NO: 956945 - RNA, 19 nt, Homo sapiens
ugcuaaacauggcauauuu

SEQ ID NO: 956946 - RNA, 19 nt, Homo sapiens
gaacgucuacggucugaca

SEQ ID NO: 956947 - RNA, 19 nt, Homo sapiens
guucauugcugcucaagag

SEQ ID NO: 956948 - RNA, 19 nt, Homo sapiens
gcaaaugucaauugucaag

SEQ ID NO: 956949 - RNA, 19 nt, Homo sapiens
gaaucacaccuuuauuugu

SEQ ID NO: 956950 - RNA, 19 nt, Homo sapiens
cuucaucaccaguacauua

SEQ ID NO: 956951 - RNA, 19 nt, Homo sapiens
gcaucucgcugcaagucaa

SEQ ID NO: 956952 - RNA, 19 nt, Homo sapiens
ccauuucgguguagaagug

SEQ ID NO: 956953 - RNA, 19 nt, Homo sapiens
ugacccaucuuugucguuu

SEQ ID NO: 956954 - RNA, 19 nt, Homo sapiens
acauuaagaugaagaccuu

SEQ ID NO: 956955 - RNA, 19 nt, Homo sapiens
cauggcauauuuccaccua

SEQ ID NO: 956956 - RNA, 19 nt, Homo sapiens
cuacuuaacacagcuaauu

SEQ ID NO: 956957 - RNA, 19 nt, Homo sapiens
ggauuugacccacugauuc

SEQ ID NO: 956958 - RNA, 19 nt, Homo sapiens
ccaccuaugauucguguuu

SEQ ID NO: 956959 - RNA, 19 nt, Homo sapiens
ucagugagaauguuuaugu

SEQ ID NO: 956960 - RNA, 19 nt, Homo sapiens
gcuagaaagcuugagcaua

SEQ ID NO: 956961 - RNA, 19 nt, Homo sapiens
acagauagauguguuaagg

SEQ ID NO: 956962 - RNA, 19 nt, Homo sapiens
uagaagaaacgacaccauu

SEQ ID NO: 956963 - RNA, 19 nt, Homo sapiens
gguauuaggagcucagaau

SEQ ID NO: 956964 - RNA, 19 nt, Homo sapiens
guaguucagugagaauguu

SEQ ID NO: 956965 - RNA, 19 nt, Homo sapiens
aaauauggagcccagauaa

SEQ ID NO: 956966 - RNA, 19 nt, Homo sapiens
gaaaauggacagauagaug

SEQ ID NO: 956967 - RNA, 19 nt, Homo sapiens
caccuaugauucguguuua

SEQ ID NO: 956968 - RNA, 19 nt, Homo sapiens
gaacuggcagcuauucaag

SEQ ID NO: 956969 - RNA, 19 nt, Homo sapiens
gaggauguaugaaguucca

SEQ ID NO: 956970 - RNA, 19 nt, Homo sapiens
gaacuucauuuggcauacu

SEQ ID NO: 956971 - RNA, 19 nt, Homo sapiens
cuuuggaguuuacuaauug

SEQ ID NO: 956972 - RNA, 19 nt, Homo sapiens
ucacuuuggaguuuacuaa

SEQ ID NO: 956973 - RNA, 19 nt, Homo sapiens
gaggacaguuggcaguuac

SEQ ID NO: 956974 - RNA, 19 nt, Homo sapiens
uagacuugacuaucucuua

SEQ ID NO: 956975 - RNA, 19 nt, Homo sapiens
gccaguaguucagugagaa

SEQ ID NO: 956976 - RNA, 19 nt, Homo sapiens
ucagugaaacuacuuaaca

SEQ ID NO: 956977 - RNA, 19 nt, Homo sapiens
gcauugacacccuuaucuu

SEQ ID NO: 956978 - RNA, 19 nt, Homo sapiens
gaagguuucugugcuuugc

SEQ ID NO: 956979 - RNA, 19 nt, Homo sapiens
ggaugacuuuggaaucaca

SEQ ID NO: 956980 - RNA, 19 nt, Homo sapiens
aaacugugauguuacuucu

SEQ ID NO: 956981 - RNA, 19 nt, Homo sapiens
gaagacguucugaggaugu

SEQ ID NO: 956982 - RNA, 19 nt, Homo sapiens
ggucugacaguuauauuag

SEQ ID NO: 956983 - RNA, 19 nt, Homo sapiens
gcaagucaaggacauugga

SEQ ID NO: 956984 - RNA, 19 nt, Homo sapiens
cagaauggaaugcauaaag

SEQ ID NO: 956985 - RNA, 19 nt, Homo sapiens
caacuacuuuagaagaaac

SEQ ID NO: 956986 - RNA, 19 nt, Homo sapiens
ggccaguaguucagugaga

SEQ ID NO: 956987 - RNA, 19 nt, Homo sapiens
ggaaauucgguccagucua

SEQ ID NO: 956988 - RNA, 19 nt, Homo sapiens
cucaaacgcuuggauucua

SEQ ID NO: 956989 - RNA, 19 nt, Homo sapiens
caauuaaagcacaagcaaa

SEQ ID NO: 956990 - RNA, 19 nt, Homo sapiens
agaagaaacgacaccauug

SEQ ID NO: 956991 - RNA, 19 nt, Homo sapiens
gacugugaguucuuuggaa

SEQ ID NO: 956992 - RNA, 19 nt, Homo sapiens
cagugagaauguuuauguu

SEQ ID NO: 956993 - RNA, 19 nt, Homo sapiens
ugagauagguuagguuuug

SEQ ID NO: 956994 - RNA, 19 nt, Homo sapiens
acacggagcaaauguuaau

SEQ ID NO: 956995 - RNA, 19 nt, Homo sapiens
uguuaaggcuguugcuuca

SEQ ID NO: 956996 - RNA, 19 nt, Homo sapiens
ugugaguucuuuggaauug

SEQ ID NO: 956997 - RNA, 19 nt, Homo sapiens
ggacugugaguucuuugga

SEQ ID NO: 956998 - RNA, 19 nt, Homo sapiens
acaaaguaagcccuguuua

SEQ ID NO: 956999 - RNA, 19 nt, Homo sapiens
cggagcaaauguuaaugga

SEQ ID NO: 957000 - RNA, 19 nt, Homo sapiens
ugcaacuacuuuagaagaa

SEQ ID NO: 957001 - RNA, 19 nt, Homo sapiens
caccagcuguugaaaggau

SEQ ID NO: 957002 - RNA, 19 nt, Homo sapiens
gagcccagauaaaugaacu

SEQ ID NO: 957003 - RNA, 19 nt, Homo sapiens
gggugcaaaugucaauugu

SEQ ID NO: 957004 - RNA, 19 nt, Homo sapiens
caaaagagccacagaguac

SEQ ID NO: 957005 - RNA, 19 nt, Homo sapiens
caaaauauaaggagugguu

SEQ ID NO: 957006 - RNA, 19 nt, Homo sapiens
ccaaagaugucgaauauaa

SEQ ID NO: 957007 - RNA, 19 nt, Homo sapiens
uaucaucccugucuuauua

SEQ ID NO: 957008 - RNA, 19 nt, Homo sapiens
ccacacaucuuuagaacua

SEQ ID NO: 957009 - RNA, 19 nt, Homo sapiens
aagcaggacuucuuaauua

SEQ ID NO: 957010 - RNA, 19 nt, Homo sapiens
gaauauagcugcucaugag

SEQ ID NO: 957011 - RNA, 19 nt, Homo sapiens
gaucuuaugucaaguucua

SEQ ID NO: 957012 - RNA, 19 nt, Homo sapiens
gaaggaaguugaaaugcaa

SEQ ID NO: 957013 - RNA, 19 nt, Homo sapiens
caugauagccucuuagaua

SEQ ID NO: 957014 - RNA, 19 nt, Homo sapiens
gauagccucuuagauauaa

SEQ ID NO: 957015 - RNA, 19 nt, Homo sapiens
caagagucaugucaaauug

SEQ ID NO: 957016 - RNA, 19 nt, Homo sapiens
ccgaaacaaugaaauguaa

SEQ ID NO: 957017 - RNA, 19 nt, Homo sapiens
ggaaggaaguugaaaugca

SEQ ID NO: 957018 - RNA, 19 nt, Homo sapiens
ggaugagacuuacuucaga

SEQ ID NO: 957019 - RNA, 19 nt, Homo sapiens
uaagacaagugaaagaaga

SEQ ID NO: 957020 - RNA, 19 nt, Homo sapiens
ggaguucgaggaauuuaua

SEQ ID NO: 957021 - RNA, 19 nt, Homo sapiens
gagaauuguuugcuguauu

SEQ ID NO: 957022 - RNA, 19 nt, Homo sapiens
gagacuuacuucagaauca

SEQ ID NO: 957023 - RNA, 19 nt, Homo sapiens
gaaggaagagauugagcua

SEQ ID NO: 957024 - RNA, 19 nt, Homo sapiens
cagcagcucuucccuguuc

SEQ ID NO: 957025 - RNA, 19 nt, Homo sapiens
gaugagacuuacuucagaa

SEQ ID NO: 957026 - RNA, 19 nt, Homo sapiens
ccaagagucaugucaaauu

SEQ ID NO: 957027 - RNA, 19 nt, Homo sapiens
caauaucaucccugucuua

SEQ ID NO: 957028 - RNA, 19 nt, Homo sapiens
gucaaguucuacaucaaua

SEQ ID NO: 957029 - RNA, 19 nt, Homo sapiens
gcaccuaguaugcucagua

SEQ ID NO: 957030 - RNA, 19 nt, Homo sapiens
gaaauccacacaucuuuag

SEQ ID NO: 957031 - RNA, 19 nt, Homo sapiens
ugaaauccacacaucuuua

SEQ ID NO: 957032 - RNA, 19 nt, Homo sapiens
gaaucagacuaugaagaaa

SEQ ID NO: 957033 - RNA, 19 nt, Homo sapiens
caccuaguaugcucaguaa

SEQ ID NO: 957034 - RNA, 19 nt, Homo sapiens
auagagaucuuaugucaag

SEQ ID NO: 957035 - RNA, 19 nt, Homo sapiens
gauguggaaucaguaaaga

SEQ ID NO: 957036 - RNA, 19 nt, Homo sapiens
caagaaggacgacgcaguu

SEQ ID NO: 957037 - RNA, 19 nt, Homo sapiens
gaggaaggaaguugaaaug

SEQ ID NO: 957038 - RNA, 19 nt, Homo sapiens
ggaagagauugagcuacuu

SEQ ID NO: 957039 - RNA, 19 nt, Homo sapiens
ugauggaguucgaggaauu

SEQ ID NO: 957040 - RNA, 19 nt, Homo sapiens
aaagaaauccagagaggaa

SEQ ID NO: 957041 - RNA, 19 nt, Homo sapiens
gaacuagucgucuccucuu

SEQ ID NO: 957042 - RNA, 19 nt, Homo sapiens
ucaguuggauauuucauuc

SEQ ID NO: 957043 - RNA, 19 nt, Homo sapiens
gaaaucgggagugcacuuu

SEQ ID NO: 957044 - RNA, 19 nt, Homo sapiens
agaaucagacuaugaagaa

SEQ ID NO: 957045 - RNA, 19 nt, Homo sapiens
cuacuuacagcccaugaua

SEQ ID NO: 957046 - RNA, 19 nt, Homo sapiens
guucgaagacacauuugua

SEQ ID NO: 957047 - RNA, 19 nt, Homo sapiens
uauaauguccuguacuuug

SEQ ID NO: 957048 - RNA, 19 nt, Homo sapiens
uauuagggauuaccauuuc

SEQ ID NO: 957049 - RNA, 19 nt, Homo sapiens
cuucaggacuuguggaaug

SEQ ID NO: 957050 - RNA, 19 nt, Homo sapiens
gagaucuuaugucaaguuc

SEQ ID NO: 957051 - RNA, 19 nt, Homo sapiens
ugagcuacuucaggacuua

SEQ ID NO: 957052 - RNA, 19 nt, Homo sapiens
gcaguugaaggaagagauu

SEQ ID NO: 957053 - RNA, 19 nt, Homo sapiens
uggaaucaguaaagaaaga

SEQ ID NO: 957054 - RNA, 19 nt, Homo sapiens
gcucuucccuguucuuacu

SEQ ID NO: 957055 - RNA, 19 nt, Homo sapiens
ucaagcagcaauagagaaa

SEQ ID NO: 957056 - RNA, 19 nt, Homo sapiens
cuaguaugcucaguaaaug

SEQ ID NO: 957057 - RNA, 19 nt, Homo sapiens
caggacuucuuaauuacuu

SEQ ID NO: 957058 - RNA, 19 nt, Homo sapiens
aaagaaagaaauccagaga

SEQ ID NO: 957059 - RNA, 19 nt, Homo sapiens
ggcagcaguugaaggaaga

SEQ ID NO: 957060 - RNA, 19 nt, Homo sapiens
gagaauauagcugcucaug

SEQ ID NO: 957061 - RNA, 19 nt, Homo sapiens
guucuuaaccuuugauucu

SEQ ID NO: 957062 - RNA, 19 nt, Homo sapiens
cgaauauaauguccuguac

SEQ ID NO: 957063 - RNA, 19 nt, Homo sapiens
gugaaauccacacaucuuu

SEQ ID NO: 957064 - RNA, 19 nt, Homo sapiens
caccgugggaugugauuua

SEQ ID NO: 957065 - RNA, 19 nt, Homo sapiens
caaaggcaccaaaccacaa

SEQ ID NO: 957066 - RNA, 19 nt, Homo sapiens
gcuguauucuucaggacuu

SEQ ID NO: 957067 - RNA, 19 nt, Homo sapiens
ggaauaagugcauaaaaug

SEQ ID NO: 957068 - RNA, 19 nt, Homo sapiens
ggauuaccauuuccuaagc

SEQ ID NO: 957069 - RNA, 19 nt, Homo sapiens
caaaguucauucaauucca

SEQ ID NO: 957070 - RNA, 19 nt, Homo sapiens
uauagcugcucaugagaau

SEQ ID NO: 957071 - RNA, 19 nt, Homo sapiens
gcacaaucagagaauauag

SEQ ID NO: 957072 - RNA, 19 nt, Homo sapiens
auucaugcaucucaacaaa

SEQ ID NO: 957073 - RNA, 19 nt, Homo sapiens
cauaagacaagugaaagaa

SEQ ID NO: 957074 - RNA, 19 nt, Homo sapiens
cgacgcaguuccacagucu

SEQ ID NO: 957075 - RNA, 19 nt, Homo sapiens
uagcugcucaugagaauug

SEQ ID NO: 957076 - RNA, 19 nt, Homo sapiens
augauagccucuuagauau

SEQ ID NO: 957077 - RNA, 19 nt, Homo sapiens
ccccaaagaugucgaauau

SEQ ID NO: 957078 - RNA, 19 nt, Homo sapiens
ccuaguaugcucaguaaau

SEQ ID NO: 957079 - RNA, 19 nt, Homo sapiens
gagaccaggcugugaaauc

SEQ ID NO: 957080 - RNA, 19 nt, Homo sapiens
ccagagaccaggcugugaa

SEQ ID NO: 957081 - RNA, 19 nt, Homo sapiens
ggaaguugaaaugcaaauu

SEQ ID NO: 957082 - RNA, 19 nt, Homo sapiens
ccacuuaauccugauagaa

SEQ ID NO: 957083 - RNA, 19 nt, Homo sapiens
ugauagccucuuagauaua

SEQ ID NO: 957084 - RNA, 19 nt, Homo sapiens
gacaaaguucauucaauuc

SEQ ID NO: 957085 - RNA, 19 nt, Homo sapiens
aaagguggcagcaguugaa

SEQ ID NO: 957086 - RNA, 19 nt, Homo sapiens
ucaugcaucucaacaaagg

SEQ ID NO: 957087 - RNA, 19 nt, Homo sapiens
gcucaaagugcuaaauuuu

SEQ ID NO: 957088 - RNA, 19 nt, Homo sapiens
cgcucaaagugcuaaauuu

SEQ ID NO: 957089 - RNA, 19 nt, Homo sapiens
ggaaucaguaaagaaagaa

SEQ ID NO: 957090 - RNA, 19 nt, Homo sapiens
ugagaauuguuugcuguau

SEQ ID NO: 957091 - RNA, 19 nt, Homo sapiens
ucgaggaauuuauaaacug

SEQ ID NO: 957092 - RNA, 19 nt, Homo sapiens
ucgaauauaauguccugua

SEQ ID NO: 957093 - RNA, 19 nt, Homo sapiens
agccaagagucaugucaaa

SEQ ID NO: 957094 - RNA, 19 nt, Homo sapiens
cagaaucagacuaugaaga

SEQ ID NO: 957095 - RNA, 19 nt, Homo sapiens
gauggaguucgaggaauuu

SEQ ID NO: 957096 - RNA, 19 nt, Homo sapiens
gaaggacgacgcaguucca

SEQ ID NO: 957097 - RNA, 19 nt, Homo sapiens
gggauuaccauuuccuaag

SEQ ID NO: 957098 - RNA, 19 nt, Homo sapiens
cuucaggacuuaaaacaaa

SEQ ID NO: 957099 - RNA, 19 nt, Homo sapiens
gguggcagcaguugaagga

SEQ ID NO: 957100 - RNA, 19 nt, Homo sapiens
gaagagcauggcagacaca

SEQ ID NO: 957101 - RNA, 19 nt, Homo sapiens
guacagccacccgaaacaa

SEQ ID NO: 957102 - RNA, 19 nt, Homo sapiens
guaaggugucuuucagguu

SEQ ID NO: 957103 - RNA, 19 nt, Homo sapiens
uguggaaucaguaaagaaa

SEQ ID NO: 957104 - RNA, 19 nt, Homo sapiens
caggacuuguggaauguga

SEQ ID NO: 957105 - RNA, 19 nt, Homo sapiens
caguaaauguuuguggaau

SEQ ID NO: 957106 - RNA, 19 nt, Homo sapiens
gaaacuagcucagauuuau

SEQ ID NO: 957107 - RNA, 19 nt, Homo sapiens
ccacgaagaucucaucaua

SEQ ID NO: 957108 - RNA, 19 nt, Homo sapiens
caacaaacuucguaaacua

SEQ ID NO: 957109 - RNA, 19 nt, Homo sapiens
gagaaaguguuguguaauu

SEQ ID NO: 957110 - RNA, 19 nt, Homo sapiens
gaagaagauuauaggcuua

SEQ ID NO: 957111 - RNA, 19 nt, Homo sapiens
gaagucagauggaccgauu

SEQ ID NO: 957112 - RNA, 19 nt, Homo sapiens
gaaggaagcucaucaucag

SEQ ID NO: 957113 - RNA, 19 nt, Homo sapiens
cagagaaaguguuguguaa

SEQ ID NO: 957114 - RNA, 19 nt, Homo sapiens
gaacauccuuugguaaaug

SEQ ID NO: 957115 - RNA, 19 nt, Homo sapiens
acagagaccuccaaccaua

SEQ ID NO: 957116 - RNA, 19 nt, Homo sapiens
cauaguaucucaucucaga

SEQ ID NO: 957117 - RNA, 19 nt, Homo sapiens
gaagaucucaucauaguau

SEQ ID NO: 957118 - RNA, 19 nt, Homo sapiens
uaaauaaccugagugaaga

SEQ ID NO: 957119 - RNA, 19 nt, Homo sapiens
aaacaacacugucaccuau

SEQ ID NO: 957120 - RNA, 19 nt, Homo sapiens
cagauucaguuuagagaua

SEQ ID NO: 957121 - RNA, 19 nt, Homo sapiens
ggaggagacucuucagaug

SEQ ID NO: 957122 - RNA, 19 nt, Homo sapiens
guaacaaccugaauugagu

SEQ ID NO: 957123 - RNA, 19 nt, Homo sapiens
ggaaauacaacaagaagug

SEQ ID NO: 957124 - RNA, 19 nt, Homo sapiens
guaaauaaccugagugaag

SEQ ID NO: 957125 - RNA, 19 nt, Homo sapiens
gcacagcgcagaagucaga

SEQ ID NO: 957126 - RNA, 19 nt, Homo sapiens
gagugguacuuaaauguaa

SEQ ID NO: 957127 - RNA, 19 nt, Homo sapiens
uaaaugaggaugaugauga

SEQ ID NO: 957128 - RNA, 19 nt, Homo sapiens
gaagcuuucuaucaauuug

SEQ ID NO: 957129 - RNA, 19 nt, Homo sapiens
gacuacaucuguugcaauu

SEQ ID NO: 957130 - RNA, 19 nt, Homo sapiens
gagaauaucggcagagaga

SEQ ID NO: 957131 - RNA, 19 nt, Homo sapiens
gauaaauguuaacccguaa

SEQ ID NO: 957132 - RNA, 19 nt, Homo sapiens
cuagaggacucaccaaaga

SEQ ID NO: 957133 - RNA, 19 nt, Homo sapiens
gcaacaaacuucguaaacu

SEQ ID NO: 957134 - RNA, 19 nt, Homo sapiens
cguagaaucuuaaauacug

SEQ ID NO: 957135 - RNA, 19 nt, Homo sapiens
cugcaucgaucgcugguua

SEQ ID NO: 957136 - RNA, 19 nt, Homo sapiens
caacugaagcguuaacaga

SEQ ID NO: 957137 - RNA, 19 nt, Homo sapiens
aaacaggaaucacuugcuu

SEQ ID NO: 957138 - RNA, 19 nt, Homo sapiens
aagaacagauugacaacuu

SEQ ID NO: 957139 - RNA, 19 nt, Homo sapiens
ggacagagaccuccaacca

SEQ ID NO: 957140 - RNA, 19 nt, Homo sapiens
gagaaaauguggaaaacaa

SEQ ID NO: 957141 - RNA, 19 nt, Homo sapiens
ccaaagaacagauugacaa

SEQ ID NO: 957142 - RNA, 19 nt, Homo sapiens
cuacaucuguugcaauuca

SEQ ID NO: 957143 - RNA, 19 nt, Homo sapiens
gggccugaguugcuaagua

SEQ ID NO: 957144 - RNA, 19 nt, Homo sapiens
gauuucagauucaguuuag

SEQ ID NO: 957145 - RNA, 19 nt, Homo sapiens
gcaaagaggaaaccaaucu

SEQ ID NO: 957146 - RNA, 19 nt, Homo sapiens
gcaauucagaccauguuaa

SEQ ID NO: 957147 - RNA, 19 nt, Homo sapiens
cagaugaugugucuaaugg

SEQ ID NO: 957148 - RNA, 19 nt, Homo sapiens
aauucuaccuguccuauuu

SEQ ID NO: 957149 - RNA, 19 nt, Homo sapiens
guacagugauagcgacuca

SEQ ID NO: 957150 - RNA, 19 nt, Homo sapiens
cagacaaacuggaaauaca

SEQ ID NO: 957151 - RNA, 19 nt, Homo sapiens
gugagaaccuaugucagua

SEQ ID NO: 957152 - RNA, 19 nt, Homo sapiens
gaagauuauaggcuuauga

SEQ ID NO: 957153 - RNA, 19 nt, Homo sapiens
uaagugagacuacaucugu

SEQ ID NO: 957154 - RNA, 19 nt, Homo sapiens
caaacaacacugucaccua

SEQ ID NO: 957155 - RNA, 19 nt, Homo sapiens
gaaccuaugucaguaccau

SEQ ID NO: 957156 - RNA, 19 nt, Homo sapiens
gaggagacucuucagauga

SEQ ID NO: 957157 - RNA, 19 nt, Homo sapiens
guguuugcauuacagaaua

SEQ ID NO: 957158 - RNA, 19 nt, Homo sapiens
acaacacugucaccuauga

SEQ ID NO: 957159 - RNA, 19 nt, Homo sapiens
agacgacuacagcaaauua

SEQ ID NO: 957160 - RNA, 19 nt, Homo sapiens
caaaggaaguggugaucag

SEQ ID NO: 957161 - RNA, 19 nt, Homo sapiens
gaucgcugguuaucugaga

SEQ ID NO: 957162 - RNA, 19 nt, Homo sapiens
acgaagaucucaucauagu

SEQ ID NO: 957163 - RNA, 19 nt, Homo sapiens
ggucaccucugcauccaau

SEQ ID NO: 957164 - RNA, 19 nt, Homo sapiens
uagacuggcuuaacucugu

SEQ ID NO: 957165 - RNA, 19 nt, Homo sapiens
uaaccugagugaagaagau

SEQ ID NO: 957166 - RNA, 19 nt, Homo sapiens
gagugaaauuccacgaaga

SEQ ID NO: 957167 - RNA, 19 nt, Homo sapiens
aaaguaacaaccugaauug

SEQ ID NO: 957168 - RNA, 19 nt, Homo sapiens
ccagucacauuugaugaaa

SEQ ID NO: 957169 - RNA, 19 nt, Homo sapiens
ggccugaguugcuaaguag

SEQ ID NO: 957170 - RNA, 19 nt, Homo sapiens
cagaaacuagcucagauuu

SEQ ID NO: 957171 - RNA, 19 nt, Homo sapiens
gaaagugaacgaggagguu

SEQ ID NO: 957172 - RNA, 19 nt, Homo sapiens
agcaagagcugaaagaagu

SEQ ID NO: 957173 - RNA, 19 nt, Homo sapiens
gcaagagcugaaagaagua

SEQ ID NO: 957174 - RNA, 19 nt, Homo sapiens
gagacuacaucuguugcaa

SEQ ID NO: 957175 - RNA, 19 nt, Homo sapiens
gcaaggccaucuagaucag

SEQ ID NO: 957176 - RNA, 19 nt, Homo sapiens
auuauaggcuuaugagaga

SEQ ID NO: 957177 - RNA, 19 nt, Homo sapiens
ugaaggcaguaaugaagga

SEQ ID NO: 957178 - RNA, 19 nt, Homo sapiens
ucaaggagcagguucuuca

SEQ ID NO: 957179 - RNA, 19 nt, Homo sapiens
gggcaaagaggaaaccaau

SEQ ID NO: 957180 - RNA, 19 nt, Homo sapiens
gcaaaacucagaugaaaau

SEQ ID NO: 957181 - RNA, 19 nt, Homo sapiens
ugaaggaagcucaucauca

SEQ ID NO: 957182 - RNA, 19 nt, Homo sapiens
agaaacuagcucagauuua

SEQ ID NO: 957183 - RNA, 19 nt, Homo sapiens
aaacucagauuccaaugac

SEQ ID NO: 957184 - RNA, 19 nt, Homo sapiens
ggagcagguucuucagaca

SEQ ID NO: 957185 - RNA, 19 nt, Homo sapiens
gaaauuccacgaagaucuc

SEQ ID NO: 957186 - RNA, 19 nt, Homo sapiens
gaucagaacgaaauucaac

SEQ ID NO: 957187 - RNA, 19 nt, Homo sapiens
ugagugguacuuaaaugua

SEQ ID NO: 957188 - RNA, 19 nt, Homo sapiens
ggcagauaaugacagguuu

SEQ ID NO: 957189 - RNA, 19 nt, Homo sapiens
ccauaguccuugaucuuca

SEQ ID NO: 957190 - RNA, 19 nt, Homo sapiens
gagcaagagcugaaagaag

SEQ ID NO: 957191 - RNA, 19 nt, Homo sapiens
gaagugggcaaagaggaaa

SEQ ID NO: 957192 - RNA, 19 nt, Homo sapiens
ucaaccagcuacucauugg

SEQ ID NO: 957193 - RNA, 19 nt, Homo sapiens
ggucagaggagggcaagaa

SEQ ID NO: 957194 - RNA, 19 nt, Homo sapiens
auaauagacuggcuuaacu

SEQ ID NO: 957195 - RNA, 19 nt, Homo sapiens
gacuacagcaaauuaaaga

SEQ ID NO: 957196 - RNA, 19 nt, Homo sapiens
ugagacgacuacagcaaau

SEQ ID NO: 957197 - RNA, 19 nt, Homo sapiens
ggaaucacuugcuuuuaug

SEQ ID NO: 957198 - RNA, 19 nt, Homo sapiens
gggcaaacaggaaucacuu

SEQ ID NO: 957199 - RNA, 19 nt, Homo sapiens
guaauuaagaucugaacuc

SEQ ID NO: 957200 - RNA, 19 nt, Homo sapiens
agaacagauugacaacuug

SEQ ID NO: 957201 - RNA, 19 nt, Homo sapiens
ccaucuagaucagaacgaa

SEQ ID NO: 957202 - RNA, 19 nt, Homo sapiens
aacaagaagugggcaaaga

SEQ ID NO: 957203 - RNA, 19 nt, Homo sapiens
cuucagaugaugugucuaa

SEQ ID NO: 957204 - RNA, 19 nt, Homo sapiens
acagagaaaguguugugua

SEQ ID NO: 957205 - RNA, 19 nt, Homo sapiens
gaauucuaccuguccuauu

SEQ ID NO: 957206 - RNA, 19 nt, Homo sapiens
gaacagaaauguagaaaga

SEQ ID NO: 957207 - RNA, 19 nt, Homo sapiens
uaacugaacuguaucauga

SEQ ID NO: 957208 - RNA, 19 nt, Homo sapiens
ggacugcaguucugaauuu

SEQ ID NO: 957209 - RNA, 19 nt, Homo sapiens
gcaaaguguuuaccagaua

SEQ ID NO: 957210 - RNA, 19 nt, Homo sapiens
gaaagaaaguucccuaucu

SEQ ID NO: 957211 - RNA, 19 nt, Homo sapiens
ggaaugaucuucagguuuc

SEQ ID NO: 957212 - RNA, 19 nt, Homo sapiens
aagaagagcuacucaaauu

SEQ ID NO: 957213 - RNA, 19 nt, Homo sapiens
ggaacugacucaccuggua

SEQ ID NO: 957214 - RNA, 19 nt, Homo sapiens
gaaaugacauaggaccuuu

SEQ ID NO: 957215 - RNA, 19 nt, Homo sapiens
gaagaaaggaggauuugaa

SEQ ID NO: 957216 - RNA, 19 nt, Homo sapiens
agaaagagcugucccugaa

SEQ ID NO: 957217 - RNA, 19 nt, Homo sapiens
gcaauugucuguguuugaa

SEQ ID NO: 957218 - RNA, 19 nt, Homo sapiens
gaaacuggugcuauauuua

SEQ ID NO: 957219 - RNA, 19 nt, Homo sapiens
gcaagcauuagcaauauua

SEQ ID NO: 957220 - RNA, 19 nt, Homo sapiens
gaugcucucuucuuuauug

SEQ ID NO: 957221 - RNA, 19 nt, Homo sapiens
ugaaacuggugcuauauuu

SEQ ID NO: 957222 - RNA, 19 nt, Homo sapiens
aauacaagcugaagugaaa

SEQ ID NO: 957223 - RNA, 19 nt, Homo sapiens
gaagugaaauuggaguguu

SEQ ID NO: 957224 - RNA, 19 nt, Homo sapiens
cgggaucacuccauuagua

SEQ ID NO: 957225 - RNA, 19 nt, Homo sapiens
gacaaacucuuauguggau

SEQ ID NO: 957226 - RNA, 19 nt, Homo sapiens
gagcaucccuuuagaucau

SEQ ID NO: 957227 - RNA, 19 nt, Homo sapiens
ucaaauuacucgaucaaug

SEQ ID NO: 957228 - RNA, 19 nt, Homo sapiens
guacuacaauauccucauu

SEQ ID NO: 957229 - RNA, 19 nt, Homo sapiens
gauccaggcuguugacugu

SEQ ID NO: 957230 - RNA, 19 nt, Homo sapiens
gcuguaagaaugugaauuu

SEQ ID NO: 957231 - RNA, 19 nt, Homo sapiens
gaacgaguagcuuuaaaug

SEQ ID NO: 957232 - RNA, 19 nt, Homo sapiens
guaacacgauucagaggaa

SEQ ID NO: 957233 - RNA, 19 nt, Homo sapiens
gaagaagagcuacucaaau

SEQ ID NO: 957234 - RNA, 19 nt, Homo sapiens
agaugaaacuggugcuaua

SEQ ID NO: 957235 - RNA, 19 nt, Homo sapiens
ucacauaauugucuuugga

SEQ ID NO: 957236 - RNA, 19 nt, Homo sapiens
uagaugcucucuucuuuau

SEQ ID NO: 957237 - RNA, 19 nt, Homo sapiens
uugcuaaccugucuuguuu

SEQ ID NO: 957238 - RNA, 19 nt, Homo sapiens
gaggaaugaucucuacuca

SEQ ID NO: 957239 - RNA, 19 nt, Homo sapiens
acaaauggcaguauucaaa

SEQ ID NO: 957240 - RNA, 19 nt, Homo sapiens
aaacaagugucagugguaa

SEQ ID NO: 957241 - RNA, 19 nt, Homo sapiens
gcucucuucuuuauuggua

SEQ ID NO: 957242 - RNA, 19 nt, Homo sapiens
cuucagguuucuacaaaua

SEQ ID NO: 957243 - RNA, 19 nt, Homo sapiens
uugaugaggugcuauguuu

SEQ ID NO: 957244 - RNA, 19 nt, Homo sapiens
caugaggccuuacagagaa

SEQ ID NO: 957245 - RNA, 19 nt, Homo sapiens
caaauuacucgaucaaugu

SEQ ID NO: 957246 - RNA, 19 nt, Homo sapiens
cgaagaagagcuacucaaa

SEQ ID NO: 957247 - RNA, 19 nt, Homo sapiens
uuacugcucugaguguuua

SEQ ID NO: 957248 - RNA, 19 nt, Homo sapiens
uguagaugcucucuucuuu

SEQ ID NO: 957249 - RNA, 19 nt, Homo sapiens
gggagaauuucaacacuuc

SEQ ID NO: 957250 - RNA, 19 nt, Homo sapiens
caaaguguuuaccagauau

SEQ ID NO: 957251 - RNA, 19 nt, Homo sapiens
uauagggacuuccagacua

SEQ ID NO: 957252 - RNA, 19 nt, Homo sapiens
caagauguuguuccuauaa

SEQ ID NO: 957253 - RNA, 19 nt, Homo sapiens
uuuaguaccucaagacaaa

SEQ ID NO: 957254 - RNA, 19 nt, Homo sapiens
ucaagauguuguuccuaua

SEQ ID NO: 957255 - RNA, 19 nt, Homo sapiens
gagaguagcaucaucuugu

SEQ ID NO: 957256 - RNA, 19 nt, Homo sapiens
agggaaagcuguaccaguu

SEQ ID NO: 957257 - RNA, 19 nt, Homo sapiens
agaauuggauaguggauug

SEQ ID NO: 957258 - RNA, 19 nt, Homo sapiens
gaagagcuacucaaauuac

SEQ ID NO: 957259 - RNA, 19 nt, Homo sapiens
ugacacugcuggaucauuc

SEQ ID NO: 957260 - RNA, 19 nt, Homo sapiens
guagaugcucucuucuuua

SEQ ID NO: 957261 - RNA, 19 nt, Homo sapiens
gauauuugaugaggugcua

SEQ ID NO: 957262 - RNA, 19 nt, Homo sapiens
agagaagcaucuuguauca

SEQ ID NO: 957263 - RNA, 19 nt, Homo sapiens
ggaaguggaagugaaauug

SEQ ID NO: 957264 - RNA, 19 nt, Homo sapiens
aaagaaaguucccuaucug

SEQ ID NO: 957265 - RNA, 19 nt, Homo sapiens
gacaaaagaacuagacuua

SEQ ID NO: 957266 - RNA, 19 nt, Homo sapiens
gcuaaccugucuuguuuca

SEQ ID NO: 957267 - RNA, 19 nt, Homo sapiens
uagcaagcauuagcaauau

SEQ ID NO: 957268 - RNA, 19 nt, Homo sapiens
ggagugaguauuaauguuc

SEQ ID NO: 957269 - RNA, 19 nt, Homo sapiens
caaaagaacuagacuuaag

SEQ ID NO: 957270 - RNA, 19 nt, Homo sapiens
gaggugcuauguuugugaa

SEQ ID NO: 957271 - RNA, 19 nt, Homo sapiens
gggaauguaauauaucuga

SEQ ID NO: 957272 - RNA, 19 nt, Homo sapiens
gaaagagcugucccugaaa

SEQ ID NO: 957273 - RNA, 19 nt, Homo sapiens
agaagcaucuuguaucagu

SEQ ID NO: 957274 - RNA, 19 nt, Homo sapiens
gcuguugccucagagagua

SEQ ID NO: 957275 - RNA, 19 nt, Homo sapiens
caaguacauuuaacagauc

SEQ ID NO: 957276 - RNA, 19 nt, Homo sapiens
ggacuucauuuaguaucuu

SEQ ID NO: 957277 - RNA, 19 nt, Homo sapiens
uaacaucaguccagcaacu

SEQ ID NO: 957278 - RNA, 19 nt, Homo sapiens
gccagguucuacuccuuua

SEQ ID NO: 957279 - RNA, 19 nt, Homo sapiens
uuagcaagcauuagcaaua

SEQ ID NO: 957280 - RNA, 19 nt, Homo sapiens
aagaaggacugagagcuuu

SEQ ID NO: 957281 - RNA, 19 nt, Homo sapiens
gaaagucaugguagcuauu

SEQ ID NO: 957282 - RNA, 19 nt, Homo sapiens
gacaguaacacgauucaga

SEQ ID NO: 957283 - RNA, 19 nt, Homo sapiens
ggauuggacuaucgaacga

SEQ ID NO: 957284 - RNA, 19 nt, Homo sapiens
gggagugaguauuaauguu

SEQ ID NO: 957285 - RNA, 19 nt, Homo sapiens
acacuaguuuguucacuug

SEQ ID NO: 957286 - RNA, 19 nt, Homo sapiens
caagaaggacugagagcuu

SEQ ID NO: 957287 - RNA, 19 nt, Homo sapiens
cacgaaaggugcuaauagu

SEQ ID NO: 957288 - RNA, 19 nt, Homo sapiens
gagcaauugucuguguuug

SEQ ID NO: 957289 - RNA, 19 nt, Homo sapiens
gaauaguuguuucgguuac

SEQ ID NO: 957290 - RNA, 19 nt, Homo sapiens
cauagccacuuacgagaau

SEQ ID NO: 957291 - RNA, 19 nt, Homo sapiens
cuauggauaugguuaacaa

SEQ ID NO: 957292 - RNA, 19 nt, Homo sapiens
ucuuguaacugaacuguau

SEQ ID NO: 957293 - RNA, 19 nt, Homo sapiens
acgaguagcuuuaaaugca

SEQ ID NO: 957294 - RNA, 19 nt, Homo sapiens
cugagagcuuucacaguua

SEQ ID NO: 957295 - RNA, 19 nt, Homo sapiens
agaagagcuacucaaauua

SEQ ID NO: 957296 - RNA, 19 nt, Homo sapiens
gaaugugagggauccagua

SEQ ID NO: 957297 - RNA, 19 nt, Homo sapiens
cgaaaggugcuaauaguag

SEQ ID NO: 957298 - RNA, 19 nt, Homo sapiens
uaccagauaccacuaugua

SEQ ID NO: 957299 - RNA, 19 nt, Homo sapiens
ggaaaugacauaggaccuu

SEQ ID NO: 957300 - RNA, 19 nt, Homo sapiens
ucaccgaagucccguaaca

SEQ ID NO: 957301 - RNA, 19 nt, Homo sapiens
gauguuguuccuauaacua

SEQ ID NO: 957302 - RNA, 19 nt, Homo sapiens
uaucgaacgaguagcuuua

SEQ ID NO: 957303 - RNA, 19 nt, Homo sapiens
ggagcaauugucuguguuu

SEQ ID NO: 957304 - RNA, 19 nt, Homo sapiens
caauguuaccuuuaaguga

SEQ ID NO: 957305 - RNA, 19 nt, Homo sapiens
gcauagccacuuacgagaa

SEQ ID NO: 957306 - RNA, 19 nt, Homo sapiens
ggaauaagcuucaaaguga

SEQ ID NO: 957307 - RNA, 19 nt, Homo sapiens
gaaaucaggucuuaaauag

SEQ ID NO: 957308 - RNA, 19 nt, Homo sapiens
gaacauacauuucucaagu

SEQ ID NO: 957309 - RNA, 19 nt, Homo sapiens
gcauaaagcugaacgagaa

SEQ ID NO: 957310 - RNA, 19 nt, Homo sapiens
gagaaugacuugcugaauu

SEQ ID NO: 957311 - RNA, 19 nt, Homo sapiens
gaaauacccuuggaaagaa

SEQ ID NO: 957312 - RNA, 19 nt, Homo sapiens
aaacagaaaucaggucuua

SEQ ID NO: 957313 - RNA, 19 nt, Homo sapiens
ggaaauaacagacaucaaa

SEQ ID NO: 957314 - RNA, 19 nt, Homo sapiens
gaaucuagaugaagaggua

SEQ ID NO: 957315 - RNA, 19 nt, Homo sapiens
ggaggaagauaaagaagaa

SEQ ID NO: 957316 - RNA, 19 nt, Homo sapiens
gaacugcggucacuuaagu

SEQ ID NO: 957317 - RNA, 19 nt, Homo sapiens
gaaaugaaacugcagauau

SEQ ID NO: 957318 - RNA, 19 nt, Homo sapiens
gaucgugaauuaauacgua

SEQ ID NO: 957319 - RNA, 19 nt, Homo sapiens
aaacaagaaugccgaaauu

SEQ ID NO: 957320 - RNA, 19 nt, Homo sapiens
ucaagcaccuguuuaauga

SEQ ID NO: 957321 - RNA, 19 nt, Homo sapiens
auacacaucuucugguuua

SEQ ID NO: 957322 - RNA, 19 nt, Homo sapiens
ggaaauacccuuggaaaga

SEQ ID NO: 957323 - RNA, 19 nt, Homo sapiens
gagaacagauuagcagauu

SEQ ID NO: 957324 - RNA, 19 nt, Homo sapiens
guaaccagcugcuuaaugu

SEQ ID NO: 957325 - RNA, 19 nt, Homo sapiens
gaugaaagguuacgaugug

SEQ ID NO: 957326 - RNA, 19 nt, Homo sapiens
gcuaagagcccaaauacaa

SEQ ID NO: 957327 - RNA, 19 nt, Homo sapiens
cagaagagaucaccaggaa

SEQ ID NO: 957328 - RNA, 19 nt, Homo sapiens
ggaagaguaugcacguauu

SEQ ID NO: 957329 - RNA, 19 nt, Homo sapiens
gcacauaauuaaagagcuu

SEQ ID NO: 957330 - RNA, 19 nt, Homo sapiens
gaacagauuagcagauuug

SEQ ID NO: 957331 - RNA, 19 nt, Homo sapiens
auaauaagcuucgcuauga

SEQ ID NO: 957332 - RNA, 19 nt, Homo sapiens
aaagugaacuggauggauu

SEQ ID NO: 957333 - RNA, 19 nt, Homo sapiens
gaacucaagcaccuguuua

SEQ ID NO: 957334 - RNA, 19 nt, Homo sapiens
agaaaaggaucgugaauua

SEQ ID NO: 957335 - RNA, 19 nt, Homo sapiens
gaucuuaugaccuacuuua

SEQ ID NO: 957336 - RNA, 19 nt, Homo sapiens
gacaaugguuugagaaugu

SEQ ID NO: 957337 - RNA, 19 nt, Homo sapiens
acacaagguugcagaauga

SEQ ID NO: 957338 - RNA, 19 nt, Homo sapiens
ccuaaagaauguaaaggua

SEQ ID NO: 957339 - RNA, 19 nt, Homo sapiens
caaacaaacuggaaauaac

SEQ ID NO: 957340 - RNA, 19 nt, Homo sapiens
ggaaaugguggagagauua

SEQ ID NO: 957341 - RNA, 19 nt, Homo sapiens
gaacuggaaacaacacaaa

SEQ ID NO: 957342 - RNA, 19 nt, Homo sapiens
gaaagaagaauuggaaaca

SEQ ID NO: 957343 - RNA, 19 nt, Homo sapiens
ucacaaagugcucuuagua

SEQ ID NO: 957344 - RNA, 19 nt, Homo sapiens
ggaacaacuugcucgagaa

SEQ ID NO: 957345 - RNA, 19 nt, Homo sapiens
uaucaauccuguuagcuuu

SEQ ID NO: 957346 - RNA, 19 nt, Homo sapiens
gaaaugguggagagauuaa

SEQ ID NO: 957347 - RNA, 19 nt, Homo sapiens
gaauacaggugcggcaguu

SEQ ID NO: 957348 - RNA, 19 nt, Homo sapiens
ggaaaaugcccaaagaaua

SEQ ID NO: 957349 - RNA, 19 nt, Homo sapiens
gaacaacuugcucgagaaa

SEQ ID NO: 957350 - RNA, 19 nt, Homo sapiens
ugaaguuggugacucagua

SEQ ID NO: 957351 - RNA, 19 nt, Homo sapiens
gaaaagacauuggaagaga

SEQ ID NO: 957352 - RNA, 19 nt, Homo sapiens
aaaugaaaguggaacauga

SEQ ID NO: 957353 - RNA, 19 nt, Homo sapiens
gacaguggauugacagguu

SEQ ID NO: 957354 - RNA, 19 nt, Homo sapiens
gauauacagagaagacaua

SEQ ID NO: 957355 - RNA, 19 nt, Homo sapiens
gagcugcaauugcccagaa

SEQ ID NO: 957356 - RNA, 19 nt, Homo sapiens
acaaagugcucuuaguaga

SEQ ID NO: 957357 - RNA, 19 nt, Homo sapiens
agagugagcuagaaagaga

SEQ ID NO: 957358 - RNA, 19 nt, Homo sapiens
gaggagaauuaguagagaa

SEQ ID NO: 957359 - RNA, 19 nt, Homo sapiens
caaaccaaaugcugaagga

SEQ ID NO: 957360 - RNA, 19 nt, Homo sapiens
gaaaggaauaagcuucaaa

SEQ ID NO: 957361 - RNA, 19 nt, Homo sapiens
ccagaacugcggucacuua

SEQ ID NO: 957362 - RNA, 19 nt, Homo sapiens
uagaagaacuggaaacaac

SEQ ID NO: 957363 - RNA, 19 nt, Homo sapiens
caaagaagaagguuaucaa

SEQ ID NO: 957364 - RNA, 19 nt, Homo sapiens
gcugaacgagaaauaaaua

SEQ ID NO: 957365 - RNA, 19 nt, Homo sapiens
uuaccgauauggacacuuu

SEQ ID NO: 957366 - RNA, 19 nt, Homo sapiens
gcaucuaucaauccuguua

SEQ ID NO: 957367 - RNA, 19 nt, Homo sapiens
cauaaugaauuucgaaguc

SEQ ID NO: 957368 - RNA, 19 nt, Homo sapiens
agaaacagauacagugguu

SEQ ID NO: 957369 - RNA, 19 nt, Homo sapiens
gaagagaaacagauacagu

SEQ ID NO: 957370 - RNA, 19 nt, Homo sapiens
ggaucaguaugaagagaaa

SEQ ID NO: 957371 - RNA, 19 nt, Homo sapiens
aaagugcucuuaguagaaa

SEQ ID NO: 957372 - RNA, 19 nt, Homo sapiens
gaagaguaugcacguauuu

SEQ ID NO: 957373 - RNA, 19 nt, Homo sapiens
gaauuagaaacuccaauga

SEQ ID NO: 957374 - RNA, 19 nt, Homo sapiens
uaauuuggcuuccugagau

SEQ ID NO: 957375 - RNA, 19 nt, Homo sapiens
caaucaagcuaaggagaaa

SEQ ID NO: 957376 - RNA, 19 nt, Homo sapiens
caagaaugccgaaauuuua

SEQ ID NO: 957377 - RNA, 19 nt, Homo sapiens
aguacaagcugccaaagaa

SEQ ID NO: 957378 - RNA, 19 nt, Homo sapiens
cuacguaaccagcugcuua

SEQ ID NO: 957379 - RNA, 19 nt, Homo sapiens
ggaacuaguuagagucaag

SEQ ID NO: 957380 - RNA, 19 nt, Homo sapiens
ugaaguagcggaauuaaag

SEQ ID NO: 957381 - RNA, 19 nt, Homo sapiens
agaacuaagaggagaauua

SEQ ID NO: 957382 - RNA, 19 nt, Homo sapiens
cuagaaagagaaaggaaua

SEQ ID NO: 957383 - RNA, 19 nt, Homo sapiens
caacaagaauuagaaacuc

SEQ ID NO: 957384 - RNA, 19 nt, Homo sapiens
aagaagaauuggaaacaga

SEQ ID NO: 957385 - RNA, 19 nt, Homo sapiens
gauaaagaagaacuacgua

SEQ ID NO: 957386 - RNA, 19 nt, Homo sapiens
uugaggaucuuaugaccua

SEQ ID NO: 957387 - RNA, 19 nt, Homo sapiens
gaaguuggugacucaguaa

SEQ ID NO: 957388 - RNA, 19 nt, Homo sapiens
acagaaaucaggucuuaaa

SEQ ID NO: 957389 - RNA, 19 nt, Homo sapiens
gaugcaggcuacagucaga

SEQ ID NO: 957390 - RNA, 19 nt, Homo sapiens
uuaggaaucuagaugaaga

SEQ ID NO: 957391 - RNA, 19 nt, Homo sapiens
aaagucagccuaaagaaug

SEQ ID NO: 957392 - RNA, 19 nt, Homo sapiens
uuccugagauucugccuua

SEQ ID NO: 957393 - RNA, 19 nt, Homo sapiens
gcaaacgaguggaacaacu

SEQ ID NO: 957394 - RNA, 19 nt, Homo sapiens
ggaagauaaagaagaacua

SEQ ID NO: 957395 - RNA, 19 nt, Homo sapiens
ccauacacaucuucugguu

SEQ ID NO: 957396 - RNA, 19 nt, Homo sapiens
uagaggaacuuggaucuuc

SEQ ID NO: 957397 - RNA, 19 nt, Homo sapiens
caaagugcucuuaguagaa

SEQ ID NO: 957398 - RNA, 19 nt, Homo sapiens
auacauuucucaagucaga

SEQ ID NO: 957399 - RNA, 19 nt, Homo sapiens
ggaaacaacacaaagaaaa

SEQ ID NO: 957400 - RNA, 19 nt, Homo sapiens
gaagaaaaguacaaucaag

SEQ ID NO: 957401 - RNA, 19 nt, Homo sapiens
caaugaaauucucaaagca

SEQ ID NO: 957402 - RNA, 19 nt, Homo sapiens
gagaaaggaauaagcuuca

SEQ ID NO: 957403 - RNA, 19 nt, Homo sapiens
uaaagcugaacgagaaaua

SEQ ID NO: 957404 - RNA, 19 nt, Homo sapiens
caaaagaggugaaguuggu

SEQ ID NO: 957405 - RNA, 19 nt, Homo sapiens
caugaugucuggaggcaau

SEQ ID NO: 957406 - RNA, 19 nt, Homo sapiens
gcaguuugaucaagaaaua

SEQ ID NO: 957407 - RNA, 19 nt, Homo sapiens
gaaagggccugaccuaauc

SEQ ID NO: 957408 - RNA, 19 nt, Homo sapiens
ugacaaaguugaaggaauu

SEQ ID NO: 957409 - RNA, 19 nt, Homo sapiens
gagacuccaucauaaauaa

SEQ ID NO: 957410 - RNA, 19 nt, Homo sapiens
gcaggacagugguuauuaa

SEQ ID NO: 957411 - RNA, 19 nt, Homo sapiens
uuaggaagcugucagauuu

SEQ ID NO: 957412 - RNA, 19 nt, Homo sapiens
gcuaauaucugcugugcuu

SEQ ID NO: 957413 - RNA, 19 nt, Homo sapiens
gugcuggacuucuaauaua

SEQ ID NO: 957414 - RNA, 19 nt, Homo sapiens
gaaacacucugaucugaag

SEQ ID NO: 957415 - RNA, 19 nt, Homo sapiens
acaccuaucucaaccauuu

SEQ ID NO: 957416 - RNA, 19 nt, Homo sapiens
gaacgacccauuucuguug

SEQ ID NO: 957417 - RNA, 19 nt, Homo sapiens
cuaauacacuaccuucuaa

SEQ ID NO: 957418 - RNA, 19 nt, Homo sapiens
gcaaucauuuaaccacaaa

SEQ ID NO: 957419 - RNA, 19 nt, Homo sapiens
aauaagagcccagacauua

SEQ ID NO: 957420 - RNA, 19 nt, Homo sapiens
gaugaccucugcuuaguau

SEQ ID NO: 957421 - RNA, 19 nt, Homo sapiens
gaagaauucuccuuguaag

SEQ ID NO: 957422 - RNA, 19 nt, Homo sapiens
gaagaugaacaaacccaua

SEQ ID NO: 957423 - RNA, 19 nt, Homo sapiens
aaggagauuugaagcauua

SEQ ID NO: 957424 - RNA, 19 nt, Homo sapiens
caagaaggauggaagaagu

SEQ ID NO: 957425 - RNA, 19 nt, Homo sapiens
ggaacugaauucugccaaa

SEQ ID NO: 957426 - RNA, 19 nt, Homo sapiens
cacaugagaugcaagauug

SEQ ID NO: 957427 - RNA, 19 nt, Homo sapiens
gggaggauuuggaguugua

SEQ ID NO: 957428 - RNA, 19 nt, Homo sapiens
ggacagugguuauuaaagc

SEQ ID NO: 957429 - RNA, 19 nt, Homo sapiens
gaaauaacacccaaaucug

SEQ ID NO: 957430 - RNA, 19 nt, Homo sapiens
ugacauuacuacugaagaa

SEQ ID NO: 957431 - RNA, 19 nt, Homo sapiens
gcuaauacacuaccuucua

SEQ ID NO: 957432 - RNA, 19 nt, Homo sapiens
gccaccauaucaacacuua

SEQ ID NO: 957433 - RNA, 19 nt, Homo sapiens
gcacaugagaugcaagauu

SEQ ID NO: 957434 - RNA, 19 nt, Homo sapiens
gggcaggaauagaagauga

SEQ ID NO: 957435 - RNA, 19 nt, Homo sapiens
ccucaguuauugcuagaua

SEQ ID NO: 957436 - RNA, 19 nt, Homo sapiens
gagaugaccucugcuuagu

SEQ ID NO: 957437 - RNA, 19 nt, Homo sapiens
gaauuuggcagaugcaguu

SEQ ID NO: 957438 - RNA, 19 nt, Homo sapiens
guaaagcuuuggacauaca

SEQ ID NO: 957439 - RNA, 19 nt, Homo sapiens
cuguaaagcuuuggacaua

SEQ ID NO: 957440 - RNA, 19 nt, Homo sapiens
ccagcugacuccacuacua

SEQ ID NO: 957441 - RNA, 19 nt, Homo sapiens
gagaugacagcuucuuaaa

SEQ ID NO: 957442 - RNA, 19 nt, Homo sapiens
gaaauaauaacuggacuuc

SEQ ID NO: 957443 - RNA, 19 nt, Homo sapiens
cuaauuugcuguaaagcuu

SEQ ID NO: 957444 - RNA, 19 nt, Homo sapiens
ggagaaauaacacccaaau

SEQ ID NO: 957445 - RNA, 19 nt, Homo sapiens
guucacagcaaucauuuaa

SEQ ID NO: 957446 - RNA, 19 nt, Homo sapiens
acacuuagcccuacccauu

SEQ ID NO: 957447 - RNA, 19 nt, Homo sapiens
cagcuaauggcaucaauuu

SEQ ID NO: 957448 - RNA, 19 nt, Homo sapiens
ggcaaagugucaacaugaa

SEQ ID NO: 957449 - RNA, 19 nt, Homo sapiens
gaugacaccugugcagaau

SEQ ID NO: 957450 - RNA, 19 nt, Homo sapiens
guucugugcuggacuucua

SEQ ID NO: 957451 - RNA, 19 nt, Homo sapiens
uguaagccuugaagaagua

SEQ ID NO: 957452 - RNA, 19 nt, Homo sapiens
aaauagagccaccauauca

SEQ ID NO: 957453 - RNA, 19 nt, Homo sapiens
acaccuggauuucagcuuu

SEQ ID NO: 957454 - RNA, 19 nt, Homo sapiens
ugacuccacuacuaauuug

SEQ ID NO: 957455 - RNA, 19 nt, Homo sapiens
ccucaauguuggacuaauu

SEQ ID NO: 957456 - RNA, 19 nt, Homo sapiens
gagggaggauuuggaguug

SEQ ID NO: 957457 - RNA, 19 nt, Homo sapiens
gacaaagacaggacauuga

SEQ ID NO: 957458 - RNA, 19 nt, Homo sapiens
caguuaagguuccuaaaca

SEQ ID NO: 957459 - RNA, 19 nt, Homo sapiens
cuacuaauuugcuguaaag

SEQ ID NO: 957460 - RNA, 19 nt, Homo sapiens
gcccagacauuaagaaggu

SEQ ID NO: 957461 - RNA, 19 nt, Homo sapiens
gcaaagugucaacaugaaa

SEQ ID NO: 957462 - RNA, 19 nt, Homo sapiens
ccauaacaccaucaacaua

SEQ ID NO: 957463 - RNA, 19 nt, Homo sapiens
aaauaacacccaaaucuga

SEQ ID NO: 957464 - RNA, 19 nt, Homo sapiens
caaauaucuuacuggauga

SEQ ID NO: 957465 - RNA, 19 nt, Homo sapiens
ggagaugaccucugcuuag

SEQ ID NO: 957466 - RNA, 19 nt, Homo sapiens
guauauaaaggcuacguaa

SEQ ID NO: 957467 - RNA, 19 nt, Homo sapiens
gaaguuagugauacacguu

SEQ ID NO: 957468 - RNA, 19 nt, Homo sapiens
gaacugaauucugccaaaa

SEQ ID NO: 957469 - RNA, 19 nt, Homo sapiens
cauaacaccaucaacauau

SEQ ID NO: 957470 - RNA, 19 nt, Homo sapiens
uaaggagauuugaagcauu

SEQ ID NO: 957471 - RNA, 19 nt, Homo sapiens
uaugugcgcugccucaaug

SEQ ID NO: 957472 - RNA, 19 nt, Homo sapiens
ggaaacacucugaucugaa

SEQ ID NO: 957473 - RNA, 19 nt, Homo sapiens
ugaaagggccugaccuaau

SEQ ID NO: 957474 - RNA, 19 nt, Homo sapiens
uggaaacacucugaucuga

SEQ ID NO: 957475 - RNA, 19 nt, Homo sapiens
agaaauaacacccaaaucu

SEQ ID NO: 957476 - RNA, 19 nt, Homo sapiens
caccacaaauugcacaguu

SEQ ID NO: 957477 - RNA, 19 nt, Homo sapiens
gaugacagcuucuuaaaac

SEQ ID NO: 957478 - RNA, 19 nt, Homo sapiens
gggaacaacagcuuauaug

SEQ ID NO: 957479 - RNA, 19 nt, Homo sapiens
ggauuuggaguuguauaua

SEQ ID NO: 957480 - RNA, 19 nt, Homo sapiens
aaagacaggacauugauga

SEQ ID NO: 957481 - RNA, 19 nt, Homo sapiens
ggauuucagcuuugcauga

SEQ ID NO: 957482 - RNA, 19 nt, Homo sapiens
gugagccacuaauaacauu

SEQ ID NO: 957483 - RNA, 19 nt, Homo sapiens
uuacaugccuaaugguuca

SEQ ID NO: 957484 - RNA, 19 nt, Homo sapiens
guaugagaaucuaucuguu

SEQ ID NO: 957485 - RNA, 19 nt, Homo sapiens
gauuucagcuuugcaugau

SEQ ID NO: 957486 - RNA, 19 nt, Homo sapiens
agaccuaccuuccaguugu

SEQ ID NO: 957487 - RNA, 19 nt, Homo sapiens
ggaacaacagcuuauaugg

SEQ ID NO: 957488 - RNA, 19 nt, Homo sapiens
gaaaccccgucucuacuaa

SEQ ID NO: 957489 - RNA, 19 nt, Homo sapiens
gaauagaagaugaacaaac

SEQ ID NO: 957490 - RNA, 19 nt, Homo sapiens
aaagaugaaugaugcugau

SEQ ID NO: 957491 - RNA, 19 nt, Homo sapiens
ccacuuucuuggcacauga

SEQ ID NO: 957492 - RNA, 19 nt, Homo sapiens
ugacaaagacaggacauug

SEQ ID NO: 957493 - RNA, 19 nt, Homo sapiens
gcuauaacaguucagcaaa

SEQ ID NO: 957494 - RNA, 19 nt, Homo sapiens
cuaaagaagcuauaacagu

SEQ ID NO: 957495 - RNA, 19 nt, Homo sapiens
caaaacugcuaauacacua

SEQ ID NO: 957496 - RNA, 19 nt, Homo sapiens
ugagacuccaucauaaaua

SEQ ID NO: 957497 - RNA, 19 nt, Homo sapiens
gcuggacuucuaauauaua

SEQ ID NO: 957498 - RNA, 19 nt, Homo sapiens
caagcacuuuguaaauugu

SEQ ID NO: 957499 - RNA, 19 nt, Homo sapiens
cagcugacuccacuacuaa

SEQ ID NO: 957500 - RNA, 19 nt, Homo sapiens
gcuauguacucuggugcua

SEQ ID NO: 957501 - RNA, 19 nt, Homo sapiens
guaaaucccagcacuuugg

SEQ ID NO: 957502 - RNA, 19 nt, Homo sapiens
ggccugaccuaauccaagu

SEQ ID NO: 957503 - RNA, 19 nt, Homo sapiens
acaaucaguuucacauaag

SEQ ID NO: 957504 - RNA, 19 nt, Homo sapiens
ugacaccugugcagaaucu

SEQ ID NO: 957505 - RNA, 19 nt, Homo sapiens
ugcaugauccucaguauga

SEQ ID NO: 957506 - RNA, 19 nt, Homo sapiens
caucacaccuucaaauaua

SEQ ID NO: 957507 - RNA, 19 nt, Homo sapiens
gaaauuagaacuagugguu

SEQ ID NO: 957508 - RNA, 19 nt, Homo sapiens
guaacuagauggagucuug

SEQ ID NO: 957509 - RNA, 19 nt, Homo sapiens
cagauaaacuccauaccua

SEQ ID NO: 957510 - RNA, 19 nt, Homo sapiens
gcagaacugugauuucaga

SEQ ID NO: 957511 - RNA, 19 nt, Homo sapiens
aaugcaagcuccagaaaua

SEQ ID NO: 957512 - RNA, 19 nt, Homo sapiens
guucagauguggaugauau

SEQ ID NO: 957513 - RNA, 19 nt, Homo sapiens
aagcaaggcugacugauga

SEQ ID NO: 957514 - RNA, 19 nt, Homo sapiens
ugcaugaccuuaugguuua

SEQ ID NO: 957515 - RNA, 19 nt, Homo sapiens
gaauugggcugcuaacaac

SEQ ID NO: 957516 - RNA, 19 nt, Homo sapiens
ggaauugggcugcuaacaa

SEQ ID NO: 957517 - RNA, 19 nt, Homo sapiens
gauaaacuccauaccuaaa

SEQ ID NO: 957518 - RNA, 19 nt, Homo sapiens
gaagagugcaugaccuuau

SEQ ID NO: 957519 - RNA, 19 nt, Homo sapiens
gaagcaaggcugacugaug

SEQ ID NO: 957520 - RNA, 19 nt, Homo sapiens
gcaagcuccagaaauauaa

SEQ ID NO: 957521 - RNA, 19 nt, Homo sapiens
uuagagaacucagguauuc

SEQ ID NO: 957522 - RNA, 19 nt, Homo sapiens
ggacuuaugauccaauuca

SEQ ID NO: 957523 - RNA, 19 nt, Homo sapiens
gguauucuuuccugacauu

SEQ ID NO: 957524 - RNA, 19 nt, Homo sapiens
gaauuccgcuaucucuuca

SEQ ID NO: 957525 - RNA, 19 nt, Homo sapiens
gaacucagguauucuuucc

SEQ ID NO: 957526 - RNA, 19 nt, Homo sapiens
uacugaggaugauacauua

SEQ ID NO: 957527 - RNA, 19 nt, Homo sapiens
cauaaugacuacugauaag

SEQ ID NO: 957528 - RNA, 19 nt, Homo sapiens
uagauggagucuugggaua

SEQ ID NO: 957529 - RNA, 19 nt, Homo sapiens
uaaacuccauaccuaaaga

SEQ ID NO: 957530 - RNA, 19 nt, Homo sapiens
gauaaggcaucagaaugga

SEQ ID NO: 957531 - RNA, 19 nt, Homo sapiens
gugcaugaccuuaugguuu

SEQ ID NO: 957532 - RNA, 19 nt, Homo sapiens
gaauguaggacuuaugauc

SEQ ID NO: 957533 - RNA, 19 nt, Homo sapiens
gacagaggccugaagcaaa

SEQ ID NO: 957534 - RNA, 19 nt, Homo sapiens
gcauauaacaggaauuucu

SEQ ID NO: 957535 - RNA, 19 nt, Homo sapiens
cagcauauaacaggaauuu

SEQ ID NO: 957536 - RNA, 19 nt, Homo sapiens
ugguuucgcuaccuuauaa

SEQ ID NO: 957537 - RNA, 19 nt, Homo sapiens
gcaaggcugacugaugaua

SEQ ID NO: 957538 - RNA, 19 nt, Homo sapiens
gcuuuacucuaccucauau

SEQ ID NO: 957539 - RNA, 19 nt, Homo sapiens
ucuaaggguuacugguaua

SEQ ID NO: 957540 - RNA, 19 nt, Homo sapiens
ccuaaagaaugugcagaaa

SEQ ID NO: 957541 - RNA, 19 nt, Homo sapiens
cuccauaccuaaagaaugu

SEQ ID NO: 957542 - RNA, 19 nt, Homo sapiens
uuacugaggaugauacauu

SEQ ID NO: 957543 - RNA, 19 nt, Homo sapiens
gagacaguguucagaugug

SEQ ID NO: 957544 - RNA, 19 nt, Homo sapiens
uagaauguaggacuuauga

SEQ ID NO: 957545 - RNA, 19 nt, Homo sapiens
cugcagaacugugauuuca

SEQ ID NO: 957546 - RNA, 19 nt, Homo sapiens
acaggaauuucucuuggaa

SEQ ID NO: 957547 - RNA, 19 nt, Homo sapiens
caauaugucaagcugaauu

SEQ ID NO: 957548 - RNA, 19 nt, Homo sapiens
aaucuaaggguuacuggua

SEQ ID NO: 957549 - RNA, 19 nt, Homo sapiens
ccaauucaccaaaagauua

SEQ ID NO: 957550 - RNA, 19 nt, Homo sapiens
acagaggccugaagcaaag

SEQ ID NO: 957551 - RNA, 19 nt, Homo sapiens
cagaccauauaaacaaaug

SEQ ID NO: 957552 - RNA, 19 nt, Homo sapiens
gaccuuaugguuuaacaga

SEQ ID NO: 957553 - RNA, 19 nt, Homo sapiens
gcaagagacaguguucaga

SEQ ID NO: 957554 - RNA, 19 nt, Homo sapiens
gguauaugcuuuuagaaga

SEQ ID NO: 957555 - RNA, 19 nt, Homo sapiens
ugaggaugauacauuauag

SEQ ID NO: 957556 - RNA, 19 nt, Homo sapiens
gagaaaacauguccacucu

SEQ ID NO: 957557 - RNA, 19 nt, Homo sapiens
caagagacaguguucagau

SEQ ID NO: 957558 - RNA, 19 nt, Homo sapiens
gcaugaccuuaugguuuaa

SEQ ID NO: 957559 - RNA, 19 nt, Homo sapiens
agauguggaugauauuugu

SEQ ID NO: 957560 - RNA, 19 nt, Homo sapiens
ggauacugcuggcuuuacu

SEQ ID NO: 957561 - RNA, 19 nt, Homo sapiens
uaaggcaucagaauggauu

SEQ ID NO: 957562 - RNA, 19 nt, Homo sapiens
caucaugccuuuuaaaucu

SEQ ID NO: 957563 - RNA, 19 nt, Homo sapiens
cugcaguguuaaauuguaa

SEQ ID NO: 957564 - RNA, 19 nt, Homo sapiens
aagagacaguguucagaug

SEQ ID NO: 957565 - RNA, 19 nt, Homo sapiens
gaaguauuuuggauuguug

SEQ ID NO: 957566 - RNA, 19 nt, Homo sapiens
ggaaguauuuuggauuguu

SEQ ID NO: 957567 - RNA, 19 nt, Homo sapiens
ccagaugguuuuagaaugu

SEQ ID NO: 957568 - RNA, 19 nt, Homo sapiens
ccuuaugguuuaacagaga

SEQ ID NO: 957569 - RNA, 19 nt, Homo sapiens
aagagugcaugaccuuaug

SEQ ID NO: 957570 - RNA, 19 nt, Homo sapiens
gagcgucaaacuuguuaug

SEQ ID NO: 957571 - RNA, 19 nt, Homo sapiens
cugaggaugauacauuaua

SEQ ID NO: 957572 - RNA, 19 nt, Homo sapiens
gcgucaaacuuguuaugca

SEQ ID NO: 957573 - RNA, 19 nt, Homo sapiens
cagcauauauuuugugaag

SEQ ID NO: 957574 - RNA, 19 nt, Homo sapiens
ugucaauacuaccgaacuu

SEQ ID NO: 957575 - RNA, 19 nt, Homo sapiens
gguuacugguauaugcuuu

SEQ ID NO: 957576 - RNA, 19 nt, Homo sapiens
ugcaagcuccagaaauaua

SEQ ID NO: 957577 - RNA, 19 nt, Homo sapiens
gaaaaugcaagcuccagaa

SEQ ID NO: 957578 - RNA, 19 nt, Homo sapiens
uaggacuuaugauccaauu

SEQ ID NO: 957579 - RNA, 19 nt, Homo sapiens
agauaaacuccauaccuaa

SEQ ID NO: 957580 - RNA, 19 nt, Homo sapiens
caaccuaauguauaugcaa

SEQ ID NO: 957581 - RNA, 19 nt, Homo sapiens
ggucaugagaggagacaga

SEQ ID NO: 957582 - RNA, 19 nt, Homo sapiens
ucaucacaccuucaaauau

SEQ ID NO: 957583 - RNA, 19 nt, Homo sapiens
gauuucagaccauauaaac

SEQ ID NO: 957584 - RNA, 19 nt, Homo sapiens
ccacucugcagaacuguga

SEQ ID NO: 957585 - RNA, 19 nt, Homo sapiens
gcauauauuuugugaagag

SEQ ID NO: 957586 - RNA, 19 nt, Homo sapiens
gggcaucugagaacuuuca

SEQ ID NO: 957587 - RNA, 19 nt, Homo sapiens
agacagguuuuacgaauau

SEQ ID NO: 957588 - RNA, 19 nt, Homo sapiens
gauggagucuugggauacu

SEQ ID NO: 957589 - RNA, 19 nt, Homo sapiens
gaacuagugguuuuagaga

SEQ ID NO: 957590 - RNA, 19 nt, Homo sapiens
cagacagguuuuacgaaua

SEQ ID NO: 957591 - RNA, 19 nt, Homo sapiens
cacccuguguuuuaaaaua

SEQ ID NO: 957592 - RNA, 19 nt, Homo sapiens
agacagaggccugaagcaa

SEQ ID NO: 957593 - RNA, 19 nt, Homo sapiens
cuucuuucaucaugccuuu

SEQ ID NO: 957594 - RNA, 19 nt, Homo sapiens
gagauguucauauccagau

SEQ ID NO: 957595 - RNA, 19 nt, Homo sapiens
gugaagcaaggcugacuga

SEQ ID NO: 957596 - RNA, 19 nt, Homo sapiens
ugugauuucagaccauaua

SEQ ID NO: 957597 - RNA, 19 nt, Homo sapiens
ugaagagugcaugaccuua

SEQ ID NO: 957598 - RNA, 19 nt, Homo sapiens
cagauguggaugauauuug

SEQ ID NO: 957599 - RNA, 19 nt, Homo sapiens
ggcuuuacucuaccucaua

SEQ ID NO: 957600 - RNA, 19 nt, Homo sapiens
auucugagcgucaaacuug

SEQ ID NO: 957601 - RNA, 19 nt, Homo sapiens
agaauuccgcuaucucuuc

SEQ ID NO: 957602 - RNA, 19 nt, Homo sapiens
acugcaguguuaaauugua

SEQ ID NO: 957603 - RNA, 19 nt, Homo sapiens
gugaagagugcaugaccuu

SEQ ID NO: 957604 - RNA, 19 nt, Homo sapiens
ucagauguggaugauauuu

SEQ ID NO: 957605 - RNA, 19 nt, Homo sapiens
aaaugaaaccacccugugu

SEQ ID NO: 957606 - RNA, 19 nt, Homo sapiens
gauagcaucucaaaugaua

SEQ ID NO: 957607 - RNA, 19 nt, Homo sapiens
gcacacaucuuccuaacuu

SEQ ID NO: 957608 - RNA, 19 nt, Homo sapiens
gaagaagauuggagaaaug

SEQ ID NO: 957609 - RNA, 19 nt, Homo sapiens
aaacagaggugaaauaucu

SEQ ID NO: 957610 - RNA, 19 nt, Homo sapiens
acaaugagcucucuuacaa

SEQ ID NO: 957611 - RNA, 19 nt, Homo sapiens
gaagauugcuaggcuauau

SEQ ID NO: 957612 - RNA, 19 nt, Homo sapiens
gcagguugcuuccauaaga

SEQ ID NO: 957613 - RNA, 19 nt, Homo sapiens
ccaaagaaaucuaucacuu

SEQ ID NO: 957614 - RNA, 19 nt, Homo sapiens
ugaaauaucuguggcuaaa

SEQ ID NO: 957615 - RNA, 19 nt, Homo sapiens
ccacgaaagugaaagacua

SEQ ID NO: 957616 - RNA, 19 nt, Homo sapiens
caucguugcuucagaauga

SEQ ID NO: 957617 - RNA, 19 nt, Homo sapiens
uaagcuaacucagauguuu

SEQ ID NO: 957618 - RNA, 19 nt, Homo sapiens
ggaaguacaagcauuuaaa

SEQ ID NO: 957619 - RNA, 19 nt, Homo sapiens
ggcagaggcuuacauaaau

SEQ ID NO: 957620 - RNA, 19 nt, Homo sapiens
gacagcaucuugcaucuau

SEQ ID NO: 957621 - RNA, 19 nt, Homo sapiens
cagaacaacuagaagcuuu

SEQ ID NO: 957622 - RNA, 19 nt, Homo sapiens
ccagauugauggaauaguu

SEQ ID NO: 957623 - RNA, 19 nt, Homo sapiens
ggaaaucaacuucaagaau

SEQ ID NO: 957624 - RNA, 19 nt, Homo sapiens
gagacuuacuugaagauug

SEQ ID NO: 957625 - RNA, 19 nt, Homo sapiens
gaaaggugccagcaacuug

SEQ ID NO: 957626 - RNA, 19 nt, Homo sapiens
ggcuauaucuggaggauga

SEQ ID NO: 957627 - RNA, 19 nt, Homo sapiens
guauuaagcuaacucagau

SEQ ID NO: 957628 - RNA, 19 nt, Homo sapiens
gcaggaaguacaagcauuu

SEQ ID NO: 957629 - RNA, 19 nt, Homo sapiens
caucaugaccuuauacauu

SEQ ID NO: 957630 - RNA, 19 nt, Homo sapiens
ccaaaugugguuauucuaa

SEQ ID NO: 957631 - RNA, 19 nt, Homo sapiens
gcagaucaguuucacuauc

SEQ ID NO: 957632 - RNA, 19 nt, Homo sapiens
aaacaugcuuugcacugua

SEQ ID NO: 957633 - RNA, 19 nt, Homo sapiens
cagaaugaaucaaccaaug

SEQ ID NO: 957634 - RNA, 19 nt, Homo sapiens
uggaagcaaugguaaauga

SEQ ID NO: 957635 - RNA, 19 nt, Homo sapiens
ggacguaugaauggauuua

SEQ ID NO: 957636 - RNA, 19 nt, Homo sapiens
gauaggaucaucagaggaa

SEQ ID NO: 957637 - RNA, 19 nt, Homo sapiens
gauccagccuagagucauu

SEQ ID NO: 957638 - RNA, 19 nt, Homo sapiens
cuuccuaacuugccugaua

SEQ ID NO: 957639 - RNA, 19 nt, Homo sapiens
gaacuucugugcacaugac

SEQ ID NO: 957640 - RNA, 19 nt, Homo sapiens
cagaggaaaucaacuucaa

SEQ ID NO: 957641 - RNA, 19 nt, Homo sapiens
caaagaaaucuaucacuuc

SEQ ID NO: 957642 - RNA, 19 nt, Homo sapiens
gcagaggcuuacauaaauc

SEQ ID NO: 957643 - RNA, 19 nt, Homo sapiens
caucuugcaucuauauaug

SEQ ID NO: 957644 - RNA, 19 nt, Homo sapiens
gaaugucagucucgugauc

SEQ ID NO: 957645 - RNA, 19 nt, Homo sapiens
ugaccagauugauggaaua

SEQ ID NO: 957646 - RNA, 19 nt, Homo sapiens
gaaugaaucaaccaaugaa

SEQ ID NO: 957647 - RNA, 19 nt, Homo sapiens
gaaaugcagcccaaguguu

SEQ ID NO: 957648 - RNA, 19 nt, Homo sapiens
agaagaagauuggagaaau

SEQ ID NO: 957649 - RNA, 19 nt, Homo sapiens
cuucaugccucuccaaaug

SEQ ID NO: 957650 - RNA, 19 nt, Homo sapiens
ccagauggcucagugaauc

SEQ ID NO: 957651 - RNA, 19 nt, Homo sapiens
aagcagauccaaucacuuu

SEQ ID NO: 957652 - RNA, 19 nt, Homo sapiens
gguacaaugagcucucuua

SEQ ID NO: 957653 - RNA, 19 nt, Homo sapiens
cagggucucuguguauuaa

SEQ ID NO: 957654 - RNA, 19 nt, Homo sapiens
gaggaaaucaacuucaaga

SEQ ID NO: 957655 - RNA, 19 nt, Homo sapiens
gcacguguucuugauuaua

SEQ ID NO: 957656 - RNA, 19 nt, Homo sapiens
gaagcaaugguaaaugaga

SEQ ID NO: 957657 - RNA, 19 nt, Homo sapiens
ggauuccguuuaaagaaga

SEQ ID NO: 957658 - RNA, 19 nt, Homo sapiens
gugcagaucaguuucacua

SEQ ID NO: 957659 - RNA, 19 nt, Homo sapiens
ugaauaaccuuuuggagaa

SEQ ID NO: 957660 - RNA, 19 nt, Homo sapiens
uaugcuggauuccguuuaa

SEQ ID NO: 957661 - RNA, 19 nt, Homo sapiens
gcauuugcaucaugaccuu

SEQ ID NO: 957662 - RNA, 19 nt, Homo sapiens
gacaauaguccacgaaagu

SEQ ID NO: 957663 - RNA, 19 nt, Homo sapiens
gaacaacuagaagcuuuga

SEQ ID NO: 957664 - RNA, 19 nt, Homo sapiens
cuagagucauuucauuuga

SEQ ID NO: 957665 - RNA, 19 nt, Homo sapiens
ccuaugggauccuagagaa

SEQ ID NO: 957666 - RNA, 19 nt, Homo sapiens
cauugaagcugcacaaagg

SEQ ID NO: 957667 - RNA, 19 nt, Homo sapiens
ccaaucacuuuguuuccaa

SEQ ID NO: 957668 - RNA, 19 nt, Homo sapiens
gcacagccaaagaaaucua

SEQ ID NO: 957669 - RNA, 19 nt, Homo sapiens
ugugauaacuuuguaguca

SEQ ID NO: 957670 - RNA, 19 nt, Homo sapiens
ucaaacagcaccagaaugg

SEQ ID NO: 957671 - RNA, 19 nt, Homo sapiens
gguaugcuaugcacguguu

SEQ ID NO: 957672 - RNA, 19 nt, Homo sapiens
gagaaaugcagcccaagug

SEQ ID NO: 957673 - RNA, 19 nt, Homo sapiens
uaaaugagaaugucagucu

SEQ ID NO: 957674 - RNA, 19 nt, Homo sapiens
uggcccagcucaugaauuc

SEQ ID NO: 957675 - RNA, 19 nt, Homo sapiens
ccaggcagaggcuuacaua

SEQ ID NO: 957676 - RNA, 19 nt, Homo sapiens
gauagcacagccaaagaaa

SEQ ID NO: 957677 - RNA, 19 nt, Homo sapiens
gugaauccuugcagaacuu

SEQ ID NO: 957678 - RNA, 19 nt, Homo sapiens
gauccaaucacuuuguuuc

SEQ ID NO: 957679 - RNA, 19 nt, Homo sapiens
guaguucccauauauuuca

SEQ ID NO: 957680 - RNA, 19 nt, Homo sapiens
gcagauccaaucacuuugu

SEQ ID NO: 957681 - RNA, 19 nt, Homo sapiens
augcacguguucuugauua

SEQ ID NO: 957682 - RNA, 19 nt, Homo sapiens
aggcagaggcuuacauaaa

SEQ ID NO: 957683 - RNA, 19 nt, Homo sapiens
cagauccaaucacuuuguu

SEQ ID NO: 957684 - RNA, 19 nt, Homo sapiens
aaaugcagcccaaguguug

SEQ ID NO: 957685 - RNA, 19 nt, Homo sapiens
gcaucuugcaucuauauau

SEQ ID NO: 957686 - RNA, 19 nt, Homo sapiens
ggacagcacaagccaugga

SEQ ID NO: 957687 - RNA, 19 nt, Homo sapiens
acaacuagaagcuuugaaa

SEQ ID NO: 957688 - RNA, 19 nt, Homo sapiens
caucagaggaaaucaacuu

SEQ ID NO: 957689 - RNA, 19 nt, Homo sapiens
gaucaucagaggaaaucaa

SEQ ID NO: 957690 - RNA, 19 nt, Homo sapiens
uagcacagccaaagaaauc

SEQ ID NO: 957691 - RNA, 19 nt, Homo sapiens
ugaaucaaccaaugaacaa

SEQ ID NO: 957692 - RNA, 19 nt, Homo sapiens
ugauaacuuuguagucaug

SEQ ID NO: 957693 - RNA, 19 nt, Homo sapiens
ggagaaaauuagucaaaca

SEQ ID NO: 957694 - RNA, 19 nt, Homo sapiens
ggagaaaugcagcccaagu

SEQ ID NO: 957695 - RNA, 19 nt, Homo sapiens
gaaaagauccagccuagag

SEQ ID NO: 957696 - RNA, 19 nt, Homo sapiens
agaucuggcuggcaaguau

SEQ ID NO: 957697 - RNA, 19 nt, Homo sapiens
gaaagacuagaggccuuaa

SEQ ID NO: 957698 - RNA, 19 nt, Homo sapiens
aagcaaugguaaaugagaa

SEQ ID NO: 957699 - RNA, 19 nt, Homo sapiens
gcuaugcacguguucuuga

SEQ ID NO: 957700 - RNA, 19 nt, Homo sapiens
ccaaugaacaauuacagau

SEQ ID NO: 957701 - RNA, 19 nt, Homo sapiens
agaaugaaucaaccaauga

SEQ ID NO: 957702 - RNA, 19 nt, Homo sapiens
ugaaagacuagaggccuua

SEQ ID NO: 957703 - RNA, 19 nt, Homo sapiens
caguuucacuaucuccaaa

SEQ ID NO: 957704 - RNA, 19 nt, Homo sapiens
gaaggacguaugaauggau

SEQ ID NO: 957705 - RNA, 19 nt, Homo sapiens
cgaaggacguaugaaugga

SEQ ID NO: 957706 - RNA, 19 nt, Homo sapiens
ggauuucgauaacaacaua

SEQ ID NO: 957707 - RNA, 19 nt, Homo sapiens
ucacucaacugcuaguaua

SEQ ID NO: 957708 - RNA, 19 nt, Homo sapiens
gaugugaaaugguagauau

SEQ ID NO: 957709 - RNA, 19 nt, Homo sapiens
ggagaaccacauaaauuua

SEQ ID NO: 957710 - RNA, 19 nt, Homo sapiens
ugacagacaucuaggagaa

SEQ ID NO: 957711 - RNA, 19 nt, Homo sapiens
caacaaaacuucagacugu

SEQ ID NO: 957712 - RNA, 19 nt, Homo sapiens
uggaguauuucuugcauua

SEQ ID NO: 957713 - RNA, 19 nt, Homo sapiens
gcccauauauuucaucugu

SEQ ID NO: 957714 - RNA, 19 nt, Homo sapiens
guacgaauguaaaguuauc

SEQ ID NO: 957715 - RNA, 19 nt, Homo sapiens
uaaaguggauuucgauaac

SEQ ID NO: 957716 - RNA, 19 nt, Homo sapiens
gcuaguauauaaugguguu

SEQ ID NO: 957717 - RNA, 19 nt, Homo sapiens
ccauauauuucaucuguca

SEQ ID NO: 957718 - RNA, 19 nt, Homo sapiens
agagagugguccaguguaa

SEQ ID NO: 957719 - RNA, 19 nt, Homo sapiens
gugauugcuucaucuguaa

SEQ ID NO: 957720 - RNA, 19 nt, Homo sapiens
gucgacaacuggcaaugua

SEQ ID NO: 957721 - RNA, 19 nt, Homo sapiens
guagcagucuuuguuggua

SEQ ID NO: 957722 - RNA, 19 nt, Homo sapiens
cagaaaaucucaucaggaa

SEQ ID NO: 957723 - RNA, 19 nt, Homo sapiens
aaacauuggucgacaacug

SEQ ID NO: 957724 - RNA, 19 nt, Homo sapiens
caacugcuaguauauaaug

SEQ ID NO: 957725 - RNA, 19 nt, Homo sapiens
uaggagaaccacauaaauu

SEQ ID NO: 957726 - RNA, 19 nt, Homo sapiens
guaaaucaguuguaaaccu

SEQ ID NO: 957727 - RNA, 19 nt, Homo sapiens
aaaaggaugugaaauggua

SEQ ID NO: 957728 - RNA, 19 nt, Homo sapiens
acacacauauuacugcaau

SEQ ID NO: 957729 - RNA, 19 nt, Homo sapiens
ugugauugcuucaucugua

SEQ ID NO: 957730 - RNA, 19 nt, Homo sapiens
ugaauggcguguguguaua

SEQ ID NO: 957731 - RNA, 19 nt, Homo sapiens
uuugauagaucuagaagug

SEQ ID NO: 957732 - RNA, 19 nt, Homo sapiens
gaguauuucuugcauuagu

SEQ ID NO: 957733 - RNA, 19 nt, Homo sapiens
ggacuuaguggaaauaaaa

SEQ ID NO: 957734 - RNA, 19 nt, Homo sapiens
gaauggcguguguguauau

SEQ ID NO: 957735 - RNA, 19 nt, Homo sapiens
gaaaaucucaucaggaaug

SEQ ID NO: 957736 - RNA, 19 nt, Homo sapiens
gggaaacauuggucgacaa

SEQ ID NO: 957737 - RNA, 19 nt, Homo sapiens
gaguaggaauugccuucuu

SEQ ID NO: 957738 - RNA, 19 nt, Homo sapiens
aggagaaccacauaaauuu

SEQ ID NO: 957739 - RNA, 19 nt, Homo sapiens
guuaaugugccaagauauu

SEQ ID NO: 957740 - RNA, 19 nt, Homo sapiens
cuaaaguggauuucgauaa

SEQ ID NO: 957741 - RNA, 19 nt, Homo sapiens
cagaguauaagaaugcuuu

SEQ ID NO: 957742 - RNA, 19 nt, Homo sapiens
agugugaacuugaugauuc

SEQ ID NO: 957743 - RNA, 19 nt, Homo sapiens
caagauauuguuccuguca

SEQ ID NO: 957744 - RNA, 19 nt, Homo sapiens
guauaagaaugcuuugaac

SEQ ID NO: 957745 - RNA, 19 nt, Homo sapiens
guaaaguuaucgcagaaaa

SEQ ID NO: 957746 - RNA, 19 nt, Homo sapiens
gcauaacaaugggaaacau

SEQ ID NO: 957747 - RNA, 19 nt, Homo sapiens
cucaacugcuaguauauaa

SEQ ID NO: 957748 - RNA, 19 nt, Homo sapiens
caacuguggucacucaacu

SEQ ID NO: 957749 - RNA, 19 nt, Homo sapiens
gugcuaaaguggauuucga

SEQ ID NO: 957750 - RNA, 19 nt, Homo sapiens
ggacugugguggacuuuug

SEQ ID NO: 957751 - RNA, 19 nt, Homo sapiens
uaacggcuuucugaaccua

SEQ ID NO: 957752 - RNA, 19 nt, Homo sapiens
gcuaaaguggauuucgaua

SEQ ID NO: 957753 - RNA, 19 nt, Homo sapiens
gcaagcaucuuuucuucug

SEQ ID NO: 957754 - RNA, 19 nt, Homo sapiens
aaguguggcccauauauuu

SEQ ID NO: 957755 - RNA, 19 nt, Homo sapiens
cuauguucguucuugguua

SEQ ID NO: 957756 - RNA, 19 nt, Homo sapiens
ccagauuuccucuauguuc

SEQ ID NO: 957757 - RNA, 19 nt, Homo sapiens
acauauuacugcaaucugu

SEQ ID NO: 957758 - RNA, 19 nt, Homo sapiens
ggcaauguacgaauguaaa

SEQ ID NO: 957759 - RNA, 19 nt, Homo sapiens
uguggucacucaacugcua

SEQ ID NO: 957760 - RNA, 19 nt, Homo sapiens
uaaaucaugccagugcuaa

SEQ ID NO: 957761 - RNA, 19 nt, Homo sapiens
caagaugugguaccguuga

SEQ ID NO: 957762 - RNA, 19 nt, Homo sapiens
caucuaggagaaccacaua

SEQ ID NO: 957763 - RNA, 19 nt, Homo sapiens
cagcugugauuggguuauu

SEQ ID NO: 957764 - RNA, 19 nt, Homo sapiens
aagcgucagucuuugauuc

SEQ ID NO: 957765 - RNA, 19 nt, Homo sapiens
aguaggaauugccuucuug

SEQ ID NO: 957766 - RNA, 19 nt, Homo sapiens
ucacagacaguugagcuuu

SEQ ID NO: 957767 - RNA, 19 nt, Homo sapiens
cguugaagcgucagucuuu

SEQ ID NO: 957768 - RNA, 19 nt, Homo sapiens
uacuucagauucagagaaa

SEQ ID NO: 957769 - RNA, 19 nt, Homo sapiens
gcaauguacgaauguaaag

SEQ ID NO: 957770 - RNA, 19 nt, Homo sapiens
uggcaacuguggucacuca

SEQ ID NO: 957771 - RNA, 19 nt, Homo sapiens
cuucaucuguaaaucaguu

SEQ ID NO: 957772 - RNA, 19 nt, Homo sapiens
guguguguauauauggaua

SEQ ID NO: 957773 - RNA, 19 nt, Homo sapiens
ggaugugaaaugguagaua

SEQ ID NO: 957774 - RNA, 19 nt, Homo sapiens
guacagaaaagcaagauga

SEQ ID NO: 957775 - RNA, 19 nt, Homo sapiens
ucuaggagaaccacauaaa

SEQ ID NO: 957776 - RNA, 19 nt, Homo sapiens
uggcguguguguauauaug

SEQ ID NO: 957777 - RNA, 19 nt, Homo sapiens
auguuaaugugccaagaua

SEQ ID NO: 957778 - RNA, 19 nt, Homo sapiens
uaaaacaugccauacauug

SEQ ID NO: 957779 - RNA, 19 nt, Homo sapiens
gccagagugugaacuugau

SEQ ID NO: 957780 - RNA, 19 nt, Homo sapiens
cagaaaagcaagaugaaaa

SEQ ID NO: 957781 - RNA, 19 nt, Homo sapiens
aaaguguggcccauauauu

SEQ ID NO: 957782 - RNA, 19 nt, Homo sapiens
cuugaugauucgaggagua

SEQ ID NO: 957783 - RNA, 19 nt, Homo sapiens
cuccagauuuccucuaugu

SEQ ID NO: 957784 - RNA, 19 nt, Homo sapiens
cagauucagagaaauguga

SEQ ID NO: 957785 - RNA, 19 nt, Homo sapiens
gaagcgucagucuuugauu

SEQ ID NO: 957786 - RNA, 19 nt, Homo sapiens
gcuggaggcauaacaaugg

SEQ ID NO: 957787 - RNA, 19 nt, Homo sapiens
aaagagagugguccagugu

SEQ ID NO: 957788 - RNA, 19 nt, Homo sapiens
guaggacuuaguggaaaua

SEQ ID NO: 957789 - RNA, 19 nt, Homo sapiens
gcagaaggagagacagagu

SEQ ID NO: 957790 - RNA, 19 nt, Homo sapiens
ucuuuaggcuuacuguugu

SEQ ID NO: 957791 - RNA, 19 nt, Homo sapiens
caacuggcaauguacgaau

SEQ ID NO: 957792 - RNA, 19 nt, Homo sapiens
uagcagucuuuguugguau

SEQ ID NO: 957793 - RNA, 19 nt, Homo sapiens
gauucgaggaguagugcua

SEQ ID NO: 957794 - RNA, 19 nt, Homo sapiens
guugaagcgucagucuuug

SEQ ID NO: 957795 - RNA, 19 nt, Homo sapiens
aacauacaguugucucuca

SEQ ID NO: 957796 - RNA, 19 nt, Homo sapiens
guguguagcagucuuuguu

SEQ ID NO: 957797 - RNA, 19 nt, Homo sapiens
caaacaaacaaaaggcaua

SEQ ID NO: 957798 - RNA, 19 nt, Homo sapiens
agauauuguuccugucaug

SEQ ID NO: 957799 - RNA, 19 nt, Homo sapiens
caauguuaaugugccaaga

SEQ ID NO: 957800 - RNA, 19 nt, Homo sapiens
uugaauggcguguguguau

SEQ ID NO: 957801 - RNA, 19 nt, Homo sapiens
agagucaccugggcccaaa

SEQ ID NO: 957802 - RNA, 19 nt, Homo sapiens
aaaguggauuucgauaaca

SEQ ID NO: 957803 - RNA, 19 nt, Homo sapiens
gcugugauuggguuauuau

SEQ ID NO: 957804 - RNA, 19 nt, Homo sapiens
guuccugucaugcagagua

SEQ ID NO: 957805 - RNA, 19 nt, Homo sapiens
ggaaacauuggucgacaac

SEQ ID NO: 957806 - RNA, 19 nt, Homo sapiens
aaucagcucucauaacuaa

SEQ ID NO: 957807 - RNA, 19 nt, Homo sapiens
ucaaugaggugcugaaaca

SEQ ID NO: 957808 - RNA, 19 nt, Homo sapiens
gaaccagggugacaucaag

SEQ ID NO: 957809 - RNA, 19 nt, Homo sapiens
ggauuggccuaaugaagaa

SEQ ID NO: 957810 - RNA, 19 nt, Homo sapiens
gcagcagccuugccucuau

SEQ ID NO: 957811 - RNA, 19 nt, Homo sapiens
uuaaaccucuccugucauu

SEQ ID NO: 957812 - RNA, 19 nt, Homo sapiens
ucuaugagaucaaacaguu

SEQ ID NO: 957813 - RNA, 19 nt, Homo sapiens
ccaagucgcuuagcucuuc

SEQ ID NO: 957814 - RNA, 19 nt, Homo sapiens
gcaaacggauuggccuaau

SEQ ID NO: 957815 - RNA, 19 nt, Homo sapiens
gugaggguauaaaguguaa

SEQ ID NO: 957816 - RNA, 19 nt, Homo sapiens
caaacggauuggccuaaug

SEQ ID NO: 957817 - RNA, 19 nt, Homo sapiens
gaauugauagugaggguau

SEQ ID NO: 957818 - RNA, 19 nt, Homo sapiens
aaacggauuggccuaauga

SEQ ID NO: 957819 - RNA, 19 nt, Homo sapiens
aaacagugccgacuugcaa

SEQ ID NO: 957820 - RNA, 19 nt, Homo sapiens
cacauugggucacgccauu

SEQ ID NO: 957821 - RNA, 19 nt, Homo sapiens
cuuccuugcuucagaauug

SEQ ID NO: 957822 - RNA, 19 nt, Homo sapiens
guauaaaguguaaccauca

SEQ ID NO: 957823 - RNA, 19 nt, Homo sapiens
cggauuggccuaaugaaga

SEQ ID NO: 957824 - RNA, 19 nt, Homo sapiens
gaaguucaaccuggagaga

SEQ ID NO: 957825 - RNA, 19 nt, Homo sapiens
cugaaacagugccgacuug

SEQ ID NO: 957826 - RNA, 19 nt, Homo sapiens
aguuaaaccucuccuguca

SEQ ID NO: 957827 - RNA, 19 nt, Homo sapiens
uaaaguguaaccaucaguu

SEQ ID NO: 957828 - RNA, 19 nt, Homo sapiens
aaaaucagcucucauaacu

SEQ ID NO: 957829 - RNA, 19 nt, Homo sapiens
gcuuagcucuucggugguu

SEQ ID NO: 957830 - RNA, 19 nt, Homo sapiens
gauagugaggguauaaagu

SEQ ID NO: 957831 - RNA, 19 nt, Homo sapiens
ggccugacaucacuuacca

SEQ ID NO: 957832 - RNA, 19 nt, Homo sapiens
uagcuuccuugcuucagaa

SEQ ID NO: 957833 - RNA, 19 nt, Homo sapiens
gaaacagugccgacuugca

SEQ ID NO: 957834 - RNA, 19 nt, Homo sapiens
ucugugaggguuucaauga

SEQ ID NO: 957835 - RNA, 19 nt, Homo sapiens
cagcagccuugccucuaug

SEQ ID NO: 957836 - RNA, 19 nt, Homo sapiens
cgaggccugacaucacuua

SEQ ID NO: 957837 - RNA, 19 nt, Homo sapiens
auuccuagcuuccuugcuu

SEQ ID NO: 957838 - RNA, 19 nt, Homo sapiens
ggaaaaucagcucucauaa

SEQ ID NO: 957839 - RNA, 19 nt, Homo sapiens
caucugcaguuggcucuuc

SEQ ID NO: 957840 - RNA, 19 nt, Homo sapiens
cuagcuuccuugcuucaga

SEQ ID NO: 957841 - RNA, 19 nt, Homo sapiens
caaccuggagagauggaaa

SEQ ID NO: 957842 - RNA, 19 nt, Homo sapiens
gaaaaucagcucucauaac

SEQ ID NO: 957843 - RNA, 19 nt, Homo sapiens
gcugaaacagugccgacuu

SEQ ID NO: 957844 - RNA, 19 nt, Homo sapiens
uggaaaaucagcucucaua

SEQ ID NO: 957845 - RNA, 19 nt, Homo sapiens
cuccuuaaacuagcuguua

SEQ ID NO: 957846 - RNA, 19 nt, Homo sapiens
ugucauuccuagcuuccuu

SEQ ID NO: 957847 - RNA, 19 nt, Homo sapiens
cuggagagauggaaaauca

SEQ ID NO: 957848 - RNA, 19 nt, Homo sapiens
uagugaggguauaaagugu

SEQ ID NO: 957849 - RNA, 19 nt, Homo sapiens
cagccuugccucuaugaga

SEQ ID NO: 957850 - RNA, 19 nt, Homo sapiens
uauaaaguguaaccaucag

SEQ ID NO: 957851 - RNA, 19 nt, Homo sapiens
auagugaggguauaaagug

SEQ ID NO: 957852 - RNA, 19 nt, Homo sapiens
caagcucugugaggguuuc

SEQ ID NO: 957853 - RNA, 19 nt, Homo sapiens
aacuagcuguuauguuaug

SEQ ID NO: 957854 - RNA, 19 nt, Homo sapiens
uguguggccuccuuaaacu

SEQ ID NO: 957855 - RNA, 19 nt, Homo sapiens
ccuaggaugccgcguggaa

SEQ ID NO: 957856 - RNA, 19 nt, Homo sapiens
gauggaaaaucagcucuca

SEQ ID NO: 957857 - RNA, 19 nt, Homo sapiens
gaagaggauuggaauauuu

SEQ ID NO: 957858 - RNA, 19 nt, Homo sapiens
gaaagaacaugacuacaga

SEQ ID NO: 957859 - RNA, 19 nt, Homo sapiens
gaacaugacuacagagaug

SEQ ID NO: 957860 - RNA, 19 nt, Homo sapiens
gaucagguguuucuuauga

SEQ ID NO: 957861 - RNA, 19 nt, Homo sapiens
gcaaauuucuucaacaguu

SEQ ID NO: 957862 - RNA, 19 nt, Homo sapiens
ggaaaaggaugcaguauuu

SEQ ID NO: 957863 - RNA, 19 nt, Homo sapiens
agacaaagaugacagugua

SEQ ID NO: 957864 - RNA, 19 nt, Homo sapiens
gaaaaucccuccugaagaa

SEQ ID NO: 957865 - RNA, 19 nt, Homo sapiens
ggacugcuuuggauucuuu

SEQ ID NO: 957866 - RNA, 19 nt, Homo sapiens
ggaagaggauuggaauauu

SEQ ID NO: 957867 - RNA, 19 nt, Homo sapiens
gaauagaggaguauaagaa

SEQ ID NO: 957868 - RNA, 19 nt, Homo sapiens
gaaggauacucuaguuaug

SEQ ID NO: 957869 - RNA, 19 nt, Homo sapiens
gcagaacuagacagaauua

SEQ ID NO: 957870 - RNA, 19 nt, Homo sapiens
cggauacacuuacacauaa

SEQ ID NO: 957871 - RNA, 19 nt, Homo sapiens
gaaaguuuguacaugagaa

SEQ ID NO: 957872 - RNA, 19 nt, Homo sapiens
gaacaaaaguugauuagag

SEQ ID NO: 957873 - RNA, 19 nt, Homo sapiens
gaucaaacaagauguaaug

SEQ ID NO: 957874 - RNA, 19 nt, Homo sapiens
gaaagcacacugccuaaau

SEQ ID NO: 957875 - RNA, 19 nt, Homo sapiens
gaagaaauacugcgucaca

SEQ ID NO: 957876 - RNA, 19 nt, Homo sapiens
uuagagacuuccaagaaua

SEQ ID NO: 957877 - RNA, 19 nt, Homo sapiens
uagagaacauguugacaaa

SEQ ID NO: 957878 - RNA, 19 nt, Homo sapiens
gaaaggaagaggauuggaa

SEQ ID NO: 957879 - RNA, 19 nt, Homo sapiens
gaugaucagguguuucuua

SEQ ID NO: 957880 - RNA, 19 nt, Homo sapiens
gcggauacacuuacacaua

SEQ ID NO: 957881 - RNA, 19 nt, Homo sapiens
gaaauacugcgucacaaga

SEQ ID NO: 957882 - RNA, 19 nt, Homo sapiens
gauuagagacuuccaagaa

SEQ ID NO: 957883 - RNA, 19 nt, Homo sapiens
ccagaagccugucuuagau

SEQ ID NO: 957884 - RNA, 19 nt, Homo sapiens
cuacagagaugaacauuuu

SEQ ID NO: 957885 - RNA, 19 nt, Homo sapiens
gaaaugggcaaguguuguu

SEQ ID NO: 957886 - RNA, 19 nt, Homo sapiens
gagaacauguugacaaacu

SEQ ID NO: 957887 - RNA, 19 nt, Homo sapiens
gggcaaguguuguuagaga

SEQ ID NO: 957888 - RNA, 19 nt, Homo sapiens
ucacugauccuguaaguug

SEQ ID NO: 957889 - RNA, 19 nt, Homo sapiens
uaagauuccugcuguuguu

SEQ ID NO: 957890 - RNA, 19 nt, Homo sapiens
acacauaacuugggcauuc

SEQ ID NO: 957891 - RNA, 19 nt, Homo sapiens
agacagggaugaucaaaca

SEQ ID NO: 957892 - RNA, 19 nt, Homo sapiens
ccaaauagaucuguaucau

SEQ ID NO: 957893 - RNA, 19 nt, Homo sapiens
gaagacaucauaacuaaac

SEQ ID NO: 957894 - RNA, 19 nt, Homo sapiens
ggauuucccuauaagauuc

SEQ ID NO: 957895 - RNA, 19 nt, Homo sapiens
gcacaccacaauaaaugua

SEQ ID NO: 957896 - RNA, 19 nt, Homo sapiens
uggccaagguguugcuuua

SEQ ID NO: 957897 - RNA, 19 nt, Homo sapiens
gaagaaaugaaacaaaugg

SEQ ID NO: 957898 - RNA, 19 nt, Homo sapiens
gaaauacagccaugugauc

SEQ ID NO: 957899 - RNA, 19 nt, Homo sapiens
ggcauugacugacuuggaa

SEQ ID NO: 957900 - RNA, 19 nt, Homo sapiens
cagauggacuaaauuuaug

SEQ ID NO: 957901 - RNA, 19 nt, Homo sapiens
gaaggaaauuauggcagaa

SEQ ID NO: 957902 - RNA, 19 nt, Homo sapiens
guacaugagaaggaaauua

SEQ ID NO: 957903 - RNA, 19 nt, Homo sapiens
ggagaaagaacaugacuac

SEQ ID NO: 957904 - RNA, 19 nt, Homo sapiens
gaacauguugacaaacuga

SEQ ID NO: 957905 - RNA, 19 nt, Homo sapiens
gaaauuauggcagaagaug

SEQ ID NO: 957906 - RNA, 19 nt, Homo sapiens
guacuuaaaugugcaugau

SEQ ID NO: 957907 - RNA, 19 nt, Homo sapiens
aaagcacacugccuaaaug

SEQ ID NO: 957908 - RNA, 19 nt, Homo sapiens
ccuguaaguugucaucaaa

SEQ ID NO: 957909 - RNA, 19 nt, Homo sapiens
uaggauugcuguuugcauu

SEQ ID NO: 957910 - RNA, 19 nt, Homo sapiens
gaaggagccguacagaaga

SEQ ID NO: 957911 - RNA, 19 nt, Homo sapiens
gaaguaacaaucuuuggau

SEQ ID NO: 957912 - RNA, 19 nt, Homo sapiens
gauagcguuugauacacua

SEQ ID NO: 957913 - RNA, 19 nt, Homo sapiens
gaugaucaaacaagaugua

SEQ ID NO: 957914 - RNA, 19 nt, Homo sapiens
cacggaauaugcuaagaaa

SEQ ID NO: 957915 - RNA, 19 nt, Homo sapiens
gccagaagccugucuuaga

SEQ ID NO: 957916 - RNA, 19 nt, Homo sapiens
uaaaccaccuguucgaaag

SEQ ID NO: 957917 - RNA, 19 nt, Homo sapiens
uaacuugggcauuccagua

SEQ ID NO: 957918 - RNA, 19 nt, Homo sapiens
uaagaaaggaagaggauug

SEQ ID NO: 957919 - RNA, 19 nt, Homo sapiens
gauaccaaauaaagccauu

SEQ ID NO: 957920 - RNA, 19 nt, Homo sapiens
gcaaagcaaccaccaacug

SEQ ID NO: 957921 - RNA, 19 nt, Homo sapiens
gauguaauguuuggaucuu

SEQ ID NO: 957922 - RNA, 19 nt, Homo sapiens
ucagauagcguuugauaca

SEQ ID NO: 957923 - RNA, 19 nt, Homo sapiens
aaauuuaugucgugugugu

SEQ ID NO: 957924 - RNA, 19 nt, Homo sapiens
gggcauuccaguacuagua

SEQ ID NO: 957925 - RNA, 19 nt, Homo sapiens
gugaaggcguucuggcaaa

SEQ ID NO: 957926 - RNA, 19 nt, Homo sapiens
ggaauagaggaguauaaga

SEQ ID NO: 957927 - RNA, 19 nt, Homo sapiens
cuaaauuuaugucgugugu

SEQ ID NO: 957928 - RNA, 19 nt, Homo sapiens
gaagacagggaugaucaaa

SEQ ID NO: 957929 - RNA, 19 nt, Homo sapiens
uaaaugugcaugaugaaga

SEQ ID NO: 957930 - RNA, 19 nt, Homo sapiens
uauguaggauugcuguuug

SEQ ID NO: 957931 - RNA, 19 nt, Homo sapiens
uaaacaugccucugccuuu

SEQ ID NO: 957932 - RNA, 19 nt, Homo sapiens
ccacgaacaccaaauagau

SEQ ID NO: 957933 - RNA, 19 nt, Homo sapiens
agaagaugaucagguguuu

SEQ ID NO: 957934 - RNA, 19 nt, Homo sapiens
auacaucguucagaaacua

SEQ ID NO: 957935 - RNA, 19 nt, Homo sapiens
uuacagaaaugggcaagug

SEQ ID NO: 957936 - RNA, 19 nt, Homo sapiens
ccucgcacauuuagucuug

SEQ ID NO: 957937 - RNA, 19 nt, Homo sapiens
ugaaggauacucuaguuau

SEQ ID NO: 957938 - RNA, 19 nt, Homo sapiens
auauaucgcuuugccuuaa

SEQ ID NO: 957939 - RNA, 19 nt, Homo sapiens
gaucgaucauauucuaaag

SEQ ID NO: 957940 - RNA, 19 nt, Homo sapiens
gaacuagacagaauuacac

SEQ ID NO: 957941 - RNA, 19 nt, Homo sapiens
guucgaaaguuuguacaug

SEQ ID NO: 957942 - RNA, 19 nt, Homo sapiens
gcacuuauuuacacuucag

SEQ ID NO: 957943 - RNA, 19 nt, Homo sapiens
caaagaugacaguguaguu

SEQ ID NO: 957944 - RNA, 19 nt, Homo sapiens
ggagaccuauaucacaaag

SEQ ID NO: 957945 - RNA, 19 nt, Homo sapiens
gcauugccauuuugcauaa

SEQ ID NO: 957946 - RNA, 19 nt, Homo sapiens
ggcaaguguuguuagagaa

SEQ ID NO: 957947 - RNA, 19 nt, Homo sapiens
acuuaaaugugcaugauga

SEQ ID NO: 957948 - RNA, 19 nt, Homo sapiens
ucugaaggauacucuaguu

SEQ ID NO: 957949 - RNA, 19 nt, Homo sapiens
agaaggagccguacagaag

SEQ ID NO: 957950 - RNA, 19 nt, Homo sapiens
ugucuuagauguucaugca

SEQ ID NO: 957951 - RNA, 19 nt, Homo sapiens
ucacauauccggaaguuuu

SEQ ID NO: 957952 - RNA, 19 nt, Homo sapiens
agaugacaguguaguugua

SEQ ID NO: 957953 - RNA, 19 nt, Homo sapiens
gaagcuacagucccuuuua

SEQ ID NO: 957954 - RNA, 19 nt, Homo sapiens
ggugggauaaugauaagaa

SEQ ID NO: 957955 - RNA, 19 nt, Homo sapiens
gcagggugggauaaugaua

SEQ ID NO: 957956 - RNA, 19 nt, Homo sapiens
guucagaaacuauauggau

SEQ ID NO: 957957 - RNA, 19 nt, Homo sapiens
caugauaacugcauuguaa

SEQ ID NO: 957958 - RNA, 19 nt, Homo sapiens
gaagcuauaugguaugauu

SEQ ID NO: 957959 - RNA, 19 nt, Homo sapiens
gcauauuucuucucaguuu

SEQ ID NO: 957960 - RNA, 19 nt, Homo sapiens
acagguagcuauugauaua

SEQ ID NO: 957961 - RNA, 19 nt, Homo sapiens
gaacuaagcaugauaacug

SEQ ID NO: 957962 - RNA, 19 nt, Homo sapiens
ggaagaauguaaucucaga

SEQ ID NO: 957963 - RNA, 19 nt, Homo sapiens
ggccuuagcuucuggcuuu

SEQ ID NO: 957964 - RNA, 19 nt, Homo sapiens
gaagaacuaagcaugauaa

SEQ ID NO: 957965 - RNA, 19 nt, Homo sapiens
gaaaucggcaucuuaguga

SEQ ID NO: 957966 - RNA, 19 nt, Homo sapiens
ggagaucgauuugauuugu

SEQ ID NO: 957967 - RNA, 19 nt, Homo sapiens
gcaaagcacccuacugguu

SEQ ID NO: 957968 - RNA, 19 nt, Homo sapiens
caagaaccauugcuguuga

SEQ ID NO: 957969 - RNA, 19 nt, Homo sapiens
ucucaaaccugccuucuug

SEQ ID NO: 957970 - RNA, 19 nt, Homo sapiens
gaaauaugcagcaagaaga

SEQ ID NO: 957971 - RNA, 19 nt, Homo sapiens
uaucaaggguagcuaauga

SEQ ID NO: 957972 - RNA, 19 nt, Homo sapiens
ugacauauauucuggauac

SEQ ID NO: 957973 - RNA, 19 nt, Homo sapiens
uaucgaagcuauaugguau

SEQ ID NO: 957974 - RNA, 19 nt, Homo sapiens
ggauaaacuugaccagguu

SEQ ID NO: 957975 - RNA, 19 nt, Homo sapiens
caaagcacccuacugguuu

SEQ ID NO: 957976 - RNA, 19 nt, Homo sapiens
gacacaggcuaguccuaua

SEQ ID NO: 957977 - RNA, 19 nt, Homo sapiens
gggccaaaguguacauuga

SEQ ID NO: 957978 - RNA, 19 nt, Homo sapiens
uaagaugacacaauuggua

SEQ ID NO: 957979 - RNA, 19 nt, Homo sapiens
acacugcaauuuacaaaga

SEQ ID NO: 957980 - RNA, 19 nt, Homo sapiens
caagaagaacuaagcauga

SEQ ID NO: 957981 - RNA, 19 nt, Homo sapiens
gaagaaauggagaucgauu

SEQ ID NO: 957982 - RNA, 19 nt, Homo sapiens
aaccauugcuguugacuuu

SEQ ID NO: 957983 - RNA, 19 nt, Homo sapiens
ugugaagucugcaauuaaa

SEQ ID NO: 957984 - RNA, 19 nt, Homo sapiens
gggaacaccuaauagaaag

SEQ ID NO: 957985 - RNA, 19 nt, Homo sapiens
aaaccugccuucuuggauu

SEQ ID NO: 957986 - RNA, 19 nt, Homo sapiens
cuacaaaacuggcuaaaau

SEQ ID NO: 957987 - RNA, 19 nt, Homo sapiens
guagauuucuucucucagu

SEQ ID NO: 957988 - RNA, 19 nt, Homo sapiens
gcuaucagcaucauuaugu

SEQ ID NO: 957989 - RNA, 19 nt, Homo sapiens
gaacucaccaagaaagaau

SEQ ID NO: 957990 - RNA, 19 nt, Homo sapiens
gggcuauucugaacauuuc

SEQ ID NO: 957991 - RNA, 19 nt, Homo sapiens
aaugauagacucaagcaua

SEQ ID NO: 957992 - RNA, 19 nt, Homo sapiens
cagaauaaagguugucauu

SEQ ID NO: 957993 - RNA, 19 nt, Homo sapiens
gggaaugucguaugaguau

SEQ ID NO: 957994 - RNA, 19 nt, Homo sapiens
ggaauuauuucugacacau

SEQ ID NO: 957995 - RNA, 19 nt, Homo sapiens
gagaucgauuugauuuguu

SEQ ID NO: 957996 - RNA, 19 nt, Homo sapiens
guagugaggccuaguggaa

SEQ ID NO: 957997 - RNA, 19 nt, Homo sapiens
uaacuuguauggagaacuc

SEQ ID NO: 957998 - RNA, 19 nt, Homo sapiens
acacccagcugccuuuguu

SEQ ID NO: 957999 - RNA, 19 nt, Homo sapiens
cagaagaguuagcaaagca

SEQ ID NO: 958000 - RNA, 19 nt, Homo sapiens
gcaguugucacagguagua

SEQ ID NO: 958001 - RNA, 19 nt, Homo sapiens
ugugaaauaugcagcaaga

SEQ ID NO: 958002 - RNA, 19 nt, Homo sapiens
ucaauacugugaaauaugc

SEQ ID NO: 958003 - RNA, 19 nt, Homo sapiens
aaggguagcuaaugacaug

SEQ ID NO: 958004 - RNA, 19 nt, Homo sapiens
augauagacucaagcauaa

SEQ ID NO: 958005 - RNA, 19 nt, Homo sapiens
uauagcaaaucacagaaug

SEQ ID NO: 958006 - RNA, 19 nt, Homo sapiens
uaggaagaauguaaucuca

SEQ ID NO: 958007 - RNA, 19 nt, Homo sapiens
caaccaugguauacaacaa

SEQ ID NO: 958008 - RNA, 19 nt, Homo sapiens
uuugugaagucugcaauua

SEQ ID NO: 958009 - RNA, 19 nt, Homo sapiens
gacaagaaccauugcuguu

SEQ ID NO: 958010 - RNA, 19 nt, Homo sapiens
acuaaacuaugcuuuccua

SEQ ID NO: 958011 - RNA, 19 nt, Homo sapiens
gagcaagggcgucuuugug

SEQ ID NO: 958012 - RNA, 19 nt, Homo sapiens
auggagaacucaccaagaa

SEQ ID NO: 958013 - RNA, 19 nt, Homo sapiens
gccaaaguguacauugaga

SEQ ID NO: 958014 - RNA, 19 nt, Homo sapiens
ggagaacucaccaagaaag

SEQ ID NO: 958015 - RNA, 19 nt, Homo sapiens
cugaaacccugacccagaa

SEQ ID NO: 958016 - RNA, 19 nt, Homo sapiens
gguagcuaaugacaugaaa

SEQ ID NO: 958017 - RNA, 19 nt, Homo sapiens
uggacaaugugaucaagaa

SEQ ID NO: 958018 - RNA, 19 nt, Homo sapiens
caccaguagauuuguauua

SEQ ID NO: 958019 - RNA, 19 nt, Homo sapiens
aaagauaaaugggccaaag

SEQ ID NO: 958020 - RNA, 19 nt, Homo sapiens
gaccuugucauuucaauag

SEQ ID NO: 958021 - RNA, 19 nt, Homo sapiens
ggacaaugugaucaagaaa

SEQ ID NO: 958022 - RNA, 19 nt, Homo sapiens
cguaugaguauccugaaua

SEQ ID NO: 958023 - RNA, 19 nt, Homo sapiens
ccaauauugaucacacaua

SEQ ID NO: 958024 - RNA, 19 nt, Homo sapiens
gaagcccacuaaacuaugc

SEQ ID NO: 958025 - RNA, 19 nt, Homo sapiens
ggaauuguucuuuaucaag

SEQ ID NO: 958026 - RNA, 19 nt, Homo sapiens
gaacaccuaauagaaagga

SEQ ID NO: 958027 - RNA, 19 nt, Homo sapiens
aggcuuggcuggucuugaa

SEQ ID NO: 958028 - RNA, 19 nt, Homo sapiens
gacuuugcaucagaagaua

SEQ ID NO: 958029 - RNA, 19 nt, Homo sapiens
uaaaugggccaaaguguac

SEQ ID NO: 958030 - RNA, 19 nt, Homo sapiens
caugaagcccacuaaacua

SEQ ID NO: 958031 - RNA, 19 nt, Homo sapiens
uagcaaagcauggaaugaa

SEQ ID NO: 958032 - RNA, 19 nt, Homo sapiens
uaccuagcccugcguauuu

SEQ ID NO: 958033 - RNA, 19 nt, Homo sapiens
auaaaugggccaaagugua

SEQ ID NO: 958034 - RNA, 19 nt, Homo sapiens
cuuccaguuuguacauuua

SEQ ID NO: 958035 - RNA, 19 nt, Homo sapiens
guacugauggaauuggaaa

SEQ ID NO: 958036 - RNA, 19 nt, Homo sapiens
cgggaacaccuaauagaaa

SEQ ID NO: 958037 - RNA, 19 nt, Homo sapiens
ugaaaucggcaucuuagug

SEQ ID NO: 958038 - RNA, 19 nt, Homo sapiens
gcagaagaguuagcaaagc

SEQ ID NO: 958039 - RNA, 19 nt, Homo sapiens
gaagaauguaaucucagaa

SEQ ID NO: 958040 - RNA, 19 nt, Homo sapiens
ugccuuuguuucugcauua

SEQ ID NO: 958041 - RNA, 19 nt, Homo sapiens
gauaaaugggccaaagugu

SEQ ID NO: 958042 - RNA, 19 nt, Homo sapiens
cagacacacugcaauuuac

SEQ ID NO: 958043 - RNA, 19 nt, Homo sapiens
ccaagacuuuuguagauuu

SEQ ID NO: 958044 - RNA, 19 nt, Homo sapiens
gagaacucaccaagaaaga

SEQ ID NO: 958045 - RNA, 19 nt, Homo sapiens
cugcaaccaugguauacaa

SEQ ID NO: 958046 - RNA, 19 nt, Homo sapiens
auaacugcauuguaacuug

SEQ ID NO: 958047 - RNA, 19 nt, Homo sapiens
gcaugauaacugcauugua

SEQ ID NO: 958048 - RNA, 19 nt, Homo sapiens
acacaggcuaguccuauaa

SEQ ID NO: 958049 - RNA, 19 nt, Homo sapiens
ccugauccaugcucuuaug

SEQ ID NO: 958050 - RNA, 19 nt, Homo sapiens
cuaucagcaucauuaugua

SEQ ID NO: 958051 - RNA, 19 nt, Homo sapiens
gcuucuggcuuuuaauuuu

SEQ ID NO: 958052 - RNA, 19 nt, Homo sapiens
aagaagaacuaagcaugau

SEQ ID NO: 958053 - RNA, 19 nt, Homo sapiens
gcagaucaaaggauaaacu

SEQ ID NO: 958054 - RNA, 19 nt, Homo sapiens
gguugucauuuaaguugaa

SEQ ID NO: 958055 - RNA, 19 nt, Homo sapiens
ucgaagcuauaugguauga

SEQ ID NO: 958056 - RNA, 19 nt, Homo sapiens
caauguccagcuacucuuu

SEQ ID NO: 958057 - RNA, 19 nt, Homo sapiens
ggacuaauuucaagguuua

SEQ ID NO: 958058 - RNA, 19 nt, Homo sapiens
gaaagggucgucccaauug

SEQ ID NO: 958059 - RNA, 19 nt, Homo sapiens
gcucaugccuguaaucuca

SEQ ID NO: 958060 - RNA, 19 nt, Homo sapiens
gacaagcaguucuuuaaau

SEQ ID NO: 958061 - RNA, 19 nt, Homo sapiens
uaacugaaggcucacauua

SEQ ID NO: 958062 - RNA, 19 nt, Homo sapiens
ggauuucacuugucaacuu

SEQ ID NO: 958063 - RNA, 19 nt, Homo sapiens
ggaaaugugucagagagaa

SEQ ID NO: 958064 - RNA, 19 nt, Homo sapiens
uuaaagcugucaccaaauu

SEQ ID NO: 958065 - RNA, 19 nt, Homo sapiens
gauuucacuugucaacuua

SEQ ID NO: 958066 - RNA, 19 nt, Homo sapiens
ccacagaauucuaacugaa

SEQ ID NO: 958067 - RNA, 19 nt, Homo sapiens
gacuugagauugcucuuaa

SEQ ID NO: 958068 - RNA, 19 nt, Homo sapiens
gaaagaugccuuaaauucu

SEQ ID NO: 958069 - RNA, 19 nt, Homo sapiens
ggucaaccuuucauaauuc

SEQ ID NO: 958070 - RNA, 19 nt, Homo sapiens
aauccacucugcuuacuua

SEQ ID NO: 958071 - RNA, 19 nt, Homo sapiens
ggacaagcaguucuuuaaa

SEQ ID NO: 958072 - RNA, 19 nt, Homo sapiens
gccauagacuuuccauuga

SEQ ID NO: 958073 - RNA, 19 nt, Homo sapiens
ugaaagaugccuuaaauuc

SEQ ID NO: 958074 - RNA, 19 nt, Homo sapiens
caauguguguucccgauuu

SEQ ID NO: 958075 - RNA, 19 nt, Homo sapiens
ugucuuaccugaaaccaaa

SEQ ID NO: 958076 - RNA, 19 nt, Homo sapiens
guaagcaaagcaacauaua

SEQ ID NO: 958077 - RNA, 19 nt, Homo sapiens
acaagcaguucuuuaaaug

SEQ ID NO: 958078 - RNA, 19 nt, Homo sapiens
cucaaugggugaccaguua

SEQ ID NO: 958079 - RNA, 19 nt, Homo sapiens
ccuguaaucucagaacuuu

SEQ ID NO: 958080 - RNA, 19 nt, Homo sapiens
ucaauaauccugugacuca

SEQ ID NO: 958081 - RNA, 19 nt, Homo sapiens
acugaaggcucacauuauu

SEQ ID NO: 958082 - RNA, 19 nt, Homo sapiens
acugaaagaugccuuaaau

SEQ ID NO: 958083 - RNA, 19 nt, Homo sapiens
uuacuuaccuccaaagaag

SEQ ID NO: 958084 - RNA, 19 nt, Homo sapiens
ucauugagcucacccuaga

SEQ ID NO: 958085 - RNA, 19 nt, Homo sapiens
gcaggagaaucacuuguac

SEQ ID NO: 958086 - RNA, 19 nt, Homo sapiens
gagacuggauuucacuugu

SEQ ID NO: 958087 - RNA, 19 nt, Homo sapiens
ccauagacuuuccauugaa

SEQ ID NO: 958088 - RNA, 19 nt, Homo sapiens
cgaacaaugaguuauguaa

SEQ ID NO: 958089 - RNA, 19 nt, Homo sapiens
ggaagagacuggauuucac

SEQ ID NO: 958090 - RNA, 19 nt, Homo sapiens
gagggaaagugccuucagu

SEQ ID NO: 958091 - RNA, 19 nt, Homo sapiens
gaacaaugaguuauguaag

SEQ ID NO: 958092 - RNA, 19 nt, Homo sapiens
caauggggauuuaugguua

SEQ ID NO: 958093 - RNA, 19 nt, Homo sapiens
cggucaaccuuucauaauu

SEQ ID NO: 958094 - RNA, 19 nt, Homo sapiens
guucuuuccuucauauguu

SEQ ID NO: 958095 - RNA, 19 nt, Homo sapiens
ggaccugacugccauagac

SEQ ID NO: 958096 - RNA, 19 nt, Homo sapiens
cuagaugaguccuuugguu

SEQ ID NO: 958097 - RNA, 19 nt, Homo sapiens
ccagguucuuuccuucaua

SEQ ID NO: 958098 - RNA, 19 nt, Homo sapiens
uuacaacacuuuacacacu

SEQ ID NO: 958099 - RNA, 19 nt, Homo sapiens
gaaaccccaucucuacuaa

SEQ ID NO: 958100 - RNA, 19 nt, Homo sapiens
cucauaaucuugacuaauc

SEQ ID NO: 958101 - RNA, 19 nt, Homo sapiens
gagcaagcggucaaccuuu

SEQ ID NO: 958102 - RNA, 19 nt, Homo sapiens
uaugucaaguuuccaauuc

SEQ ID NO: 958103 - RNA, 19 nt, Homo sapiens
cgaggcagguggaucacaa

SEQ ID NO: 958104 - RNA, 19 nt, Homo sapiens
ggcaggagaaucacuugua

SEQ ID NO: 958105 - RNA, 19 nt, Homo sapiens
caucaccacgagucauuua

SEQ ID NO: 958106 - RNA, 19 nt, Homo sapiens
ggagcaagcggucaaccuu

SEQ ID NO: 958107 - RNA, 19 nt, Homo sapiens
aagauacguuuguuuagga

SEQ ID NO: 958108 - RNA, 19 nt, Homo sapiens
gcggugaacugagauugug

SEQ ID NO: 958109 - RNA, 19 nt, Homo sapiens
gaucacaaggucaggaguu

SEQ ID NO: 958110 - RNA, 19 nt, Homo sapiens
cccuucauguucauuaaua

SEQ ID NO: 958111 - RNA, 19 nt, Homo sapiens
cauauguuguguguacuuu

SEQ ID NO: 958112 - RNA, 19 nt, Homo sapiens
cuucauauguuguguguac

SEQ ID NO: 958113 - RNA, 19 nt, Homo sapiens
caagguuuacaacacuuua

SEQ ID NO: 958114 - RNA, 19 nt, Homo sapiens
aagaaagggucgucccaau

SEQ ID NO: 958115 - RNA, 19 nt, Homo sapiens
aacgagcucuucauuacaa

SEQ ID NO: 958116 - RNA, 19 nt, Homo sapiens
gugggcaacucgcugcaaa

SEQ ID NO: 958117 - RNA, 19 nt, Homo sapiens
gagugagacuucuuuuaaa

SEQ ID NO: 958118 - RNA, 19 nt, Homo sapiens
gacagagugagacuucuuu

SEQ ID NO: 958119 - RNA, 19 nt, Homo sapiens
cuucuagacucauaaucuu

SEQ ID NO: 958120 - RNA, 19 nt, Homo sapiens
cuucuuccauugaauucua

SEQ ID NO: 958121 - RNA, 19 nt, Homo sapiens
uaacaccccuucuuccauu

SEQ ID NO: 958122 - RNA, 19 nt, Homo sapiens
ccaauuggagcguucgaaa

SEQ ID NO: 958123 - RNA, 19 nt, Homo sapiens
aaagauacguuuguuuagg

SEQ ID NO: 958124 - RNA, 19 nt, Homo sapiens
ugccauagacuuuccauug

SEQ ID NO: 958125 - RNA, 19 nt, Homo sapiens
caaaaccacagaauucuaa

SEQ ID NO: 958126 - RNA, 19 nt, Homo sapiens
agaaagggucgucccaauu

SEQ ID NO: 958127 - RNA, 19 nt, Homo sapiens
cagguucuuuccuucauau

SEQ ID NO: 958128 - RNA, 19 nt, Homo sapiens
cacccuagaugaguccuuu

SEQ ID NO: 958129 - RNA, 19 nt, Homo sapiens
gaagagacuggauuucacu

SEQ ID NO: 958130 - RNA, 19 nt, Homo sapiens
aggacaagcaguucuuuaa

SEQ ID NO: 958131 - RNA, 19 nt, Homo sapiens
uaauguaggacaagcaguu

SEQ ID NO: 958132 - RNA, 19 nt, Homo sapiens
gacuggauuucacuuguca

SEQ ID NO: 958133 - RNA, 19 nt, Homo sapiens
aaaacgagcucuucauuac

SEQ ID NO: 958134 - RNA, 19 nt, Homo sapiens
gcggucaaccuuucauaau

SEQ ID NO: 958135 - RNA, 19 nt, Homo sapiens
caccaaauucuuaagcauu

SEQ ID NO: 958136 - RNA, 19 nt, Homo sapiens
uuaaaugccagauggauuc

SEQ ID NO: 958137 - RNA, 19 nt, Homo sapiens
gacucauaaucuugacuaa

SEQ ID NO: 958138 - RNA, 19 nt, Homo sapiens
cacagaauucuaacugaaa

SEQ ID NO: 958139 - RNA, 19 nt, Homo sapiens
aauauucuccgcucuucua

SEQ ID NO: 958140 - RNA, 19 nt, Homo sapiens
gugggaaccuguggucuca

SEQ ID NO: 958141 - RNA, 19 nt, Homo sapiens
aaugccagauggauucuug

SEQ ID NO: 958142 - RNA, 19 nt, Homo sapiens
uaagcugauuucccaaaca

SEQ ID NO: 958143 - RNA, 19 nt, Homo sapiens
gccaaucgcaaagcgcuua

SEQ ID NO: 958144 - RNA, 19 nt, Homo sapiens
ucucugcccuccuucuaga

SEQ ID NO: 958145 - RNA, 19 nt, Homo sapiens
uaggacaagcaguucuuua

SEQ ID NO: 958146 - RNA, 19 nt, Homo sapiens
guaacgccagccacgauuu

SEQ ID NO: 958147 - RNA, 19 nt, Homo sapiens
ggagguugcggugaacuga

SEQ ID NO: 958148 - RNA, 19 nt, Homo sapiens
augaggaugaggcuaauua

SEQ ID NO: 958149 - RNA, 19 nt, Homo sapiens
uaacugaaagaugccuuaa

SEQ ID NO: 958150 - RNA, 19 nt, Homo sapiens
ucaccaaauucuuaagcau

SEQ ID NO: 958151 - RNA, 19 nt, Homo sapiens
gcaauguguguucccgauu

SEQ ID NO: 958152 - RNA, 19 nt, Homo sapiens
aggacuaauuucaagguuu

SEQ ID NO: 958153 - RNA, 19 nt, Homo sapiens
aagauuccuuccagcugua

SEQ ID NO: 958154 - RNA, 19 nt, Homo sapiens
gaaaugugucagagagaag

SEQ ID NO: 958155 - RNA, 19 nt, Homo sapiens
cuaacugaaagaugccuua

SEQ ID NO: 958156 - RNA, 19 nt, Homo sapiens
acagaauucuaacugaaag

SEQ ID NO: 958157 - RNA, 19 nt, Homo sapiens
gaaauacgguggcaucuac

SEQ ID NO: 958158 - RNA, 19 nt, Homo sapiens
gaaguuaggcucugauuca

SEQ ID NO: 958159 - RNA, 19 nt, Homo sapiens
gaacauauccuucuuacac

SEQ ID NO: 958160 - RNA, 19 nt, Homo sapiens
gagccaagcuucaaugucu

SEQ ID NO: 958161 - RNA, 19 nt, Homo sapiens
gguguaaacuugaagacuu

SEQ ID NO: 958162 - RNA, 19 nt, Homo sapiens
ccacaccgaugcccucaaa

SEQ ID NO: 958163 - RNA, 19 nt, Homo sapiens
ugaagggucuuacugauuc

SEQ ID NO: 958164 - RNA, 19 nt, Homo sapiens
gaaacuggcuccacaucag

SEQ ID NO: 958165 - RNA, 19 nt, Homo sapiens
ccagcugccucuucuguuu

SEQ ID NO: 958166 - RNA, 19 nt, Homo sapiens
acaaggauguugaggguau

SEQ ID NO: 958167 - RNA, 19 nt, Homo sapiens
cuagagaccucagagagaa

SEQ ID NO: 958168 - RNA, 19 nt, Homo sapiens
gcacagagaagaggacaug

SEQ ID NO: 958169 - RNA, 19 nt, Homo sapiens
ggaaauacgguggcaucua

SEQ ID NO: 958170 - RNA, 19 nt, Homo sapiens
ugaagacacaccauuguuu

SEQ ID NO: 958171 - RNA, 19 nt, Homo sapiens
ugaaaaggcugcuugaaga

SEQ ID NO: 958172 - RNA, 19 nt, Homo sapiens
gcaacacacugguggaaaa

SEQ ID NO: 958173 - RNA, 19 nt, Homo sapiens
gguaugguguaaacuugaa

SEQ ID NO: 958174 - RNA, 19 nt, Homo sapiens
ggguccagguaacaaauaa

SEQ ID NO: 958175 - RNA, 19 nt, Homo sapiens
gcuagaaguuaggcucuga

SEQ ID NO: 958176 - RNA, 19 nt, Homo sapiens
ccaaggcccugaguugaug

SEQ ID NO: 958177 - RNA, 19 nt, Homo sapiens
ccugugguguucuuuauga

SEQ ID NO: 958178 - RNA, 19 nt, Homo sapiens
ggcauuguguuucuagaga

SEQ ID NO: 958179 - RNA, 19 nt, Homo sapiens
ucuguguucuccuugguua

SEQ ID NO: 958180 - RNA, 19 nt, Homo sapiens
gaagacacaccauuguuuu

SEQ ID NO: 958181 - RNA, 19 nt, Homo sapiens
ggccugugguguucuuuau

SEQ ID NO: 958182 - RNA, 19 nt, Homo sapiens
aaagauagaccugccaaga

SEQ ID NO: 958183 - RNA, 19 nt, Homo sapiens
gccaagacgugagaucugu

SEQ ID NO: 958184 - RNA, 19 nt, Homo sapiens
gcccugaguugaugacaag

SEQ ID NO: 958185 - RNA, 19 nt, Homo sapiens
agagucugcugccaagauu

SEQ ID NO: 958186 - RNA, 19 nt, Homo sapiens
aagcuucaaugucucuuau

SEQ ID NO: 958187 - RNA, 19 nt, Homo sapiens
gaggguaugguguaaacuu

SEQ ID NO: 958188 - RNA, 19 nt, Homo sapiens
uaugaagggucuuacugau

SEQ ID NO: 958189 - RNA, 19 nt, Homo sapiens
gguaacaaauaaagcuaac

SEQ ID NO: 958190 - RNA, 19 nt, Homo sapiens
caagcuucaaugucucuua

SEQ ID NO: 958191 - RNA, 19 nt, Homo sapiens
gcauuugcagcuagaaguu

SEQ ID NO: 958192 - RNA, 19 nt, Homo sapiens
gccaagauuuauccugagu

SEQ ID NO: 958193 - RNA, 19 nt, Homo sapiens
ccucuucccuuuggauaug

SEQ ID NO: 958194 - RNA, 19 nt, Homo sapiens
gagaguggaggcgcuacua

SEQ ID NO: 958195 - RNA, 19 nt, Homo sapiens
gggaaugcauggaaaacuu

SEQ ID NO: 958196 - RNA, 19 nt, Homo sapiens
gagaaacuggcuccacauc

SEQ ID NO: 958197 - RNA, 19 nt, Homo sapiens
gcuugaagacacaccauug

SEQ ID NO: 958198 - RNA, 19 nt, Homo sapiens
gaucuguguucuccuuggu

SEQ ID NO: 958199 - RNA, 19 nt, Homo sapiens
ugaguggccugugguguuc

SEQ ID NO: 958200 - RNA, 19 nt, Homo sapiens
agucugcugccaagauuua

SEQ ID NO: 958201 - RNA, 19 nt, Homo sapiens
gaguggaggcgcuacuaug

SEQ ID NO: 958202 - RNA, 19 nt, Homo sapiens
gacguggcauuguguuucu

SEQ ID NO: 958203 - RNA, 19 nt, Homo sapiens
gugauuagaggaagcaaca

SEQ ID NO: 958204 - RNA, 19 nt, Homo sapiens
gacgugagaucuguguucu

SEQ ID NO: 958205 - RNA, 19 nt, Homo sapiens
auaaagcuaacacucguuu

SEQ ID NO: 958206 - RNA, 19 nt, Homo sapiens
gcuucaaugucucuuaugc

SEQ ID NO: 958207 - RNA, 19 nt, Homo sapiens
uggaggcgcuacuaugaag

SEQ ID NO: 958208 - RNA, 19 nt, Homo sapiens
gcaaccaaggcccugaguu

SEQ ID NO: 958209 - RNA, 19 nt, Homo sapiens
gccaucaucuggaaauacg

SEQ ID NO: 958210 - RNA, 19 nt, Homo sapiens
aggcucugauucacuguuu

SEQ ID NO: 958211 - RNA, 19 nt, Homo sapiens
gauuagaggaagcaacaca

SEQ ID NO: 958212 - RNA, 19 nt, Homo sapiens
aagaggacaugcggaagga

SEQ ID NO: 958213 - RNA, 19 nt, Homo sapiens
ucugaacauauccuucuua

SEQ ID NO: 958214 - RNA, 19 nt, Homo sapiens
caacgccagcgcagagaga

SEQ ID NO: 958215 - RNA, 19 nt, Homo sapiens
ggucuccuguuccguagag

SEQ ID NO: 958216 - RNA, 19 nt, Homo sapiens
gcugcaguguggaaaugga

SEQ ID NO: 958217 - RNA, 19 nt, Homo sapiens
uuaugaagggucuuacuga

SEQ ID NO: 958218 - RNA, 19 nt, Homo sapiens
gaguugaugacaaggaugu

SEQ ID NO: 958219 - RNA, 19 nt, Homo sapiens
gagcaggcuggcacagaga

SEQ ID NO: 958220 - RNA, 19 nt, Homo sapiens
cauuugcagcuagaaguua

SEQ ID NO: 958221 - RNA, 19 nt, Homo sapiens
gauacagagccaagcuuca

SEQ ID NO: 958222 - RNA, 19 nt, Homo sapiens
cugaacauauccuucuuac

SEQ ID NO: 958223 - RNA, 19 nt, Homo sapiens
aggguaugguguaaacuug

SEQ ID NO: 958224 - RNA, 19 nt, Homo sapiens
ggcccugaguugaugacaa

SEQ ID NO: 958225 - RNA, 19 nt, Homo sapiens
ggaaugcauggaaaacuuu

SEQ ID NO: 958226 - RNA, 19 nt, Homo sapiens
agacaacguuuuccucuuc

SEQ ID NO: 958227 - RNA, 19 nt, Homo sapiens
ucuagagaccucagagaga

SEQ ID NO: 958228 - RNA, 19 nt, Homo sapiens
cagguaacaaauaaagcua

SEQ ID NO: 958229 - RNA, 19 nt, Homo sapiens
auacagagccaagcuucaa

SEQ ID NO: 958230 - RNA, 19 nt, Homo sapiens
caaggauguugaggguaug

SEQ ID NO: 958231 - RNA, 19 nt, Homo sapiens
caagacgugagaucugugu

SEQ ID NO: 958232 - RNA, 19 nt, Homo sapiens
gauuuuaccccaucuccua

SEQ ID NO: 958233 - RNA, 19 nt, Homo sapiens
gcccaucccugaggagaac

SEQ ID NO: 958234 - RNA, 19 nt, Homo sapiens
caugguacaaucaaaucaa

SEQ ID NO: 958235 - RNA, 19 nt, Homo sapiens
cccauuuggucuccuguuc

SEQ ID NO: 958236 - RNA, 19 nt, Homo sapiens
gaggcgcuacuaugaagug

SEQ ID NO: 958237 - RNA, 19 nt, Homo sapiens
aguggaggcgcuacuauga

SEQ ID NO: 958238 - RNA, 19 nt, Homo sapiens
uggccaucaucuggaaaua

SEQ ID NO: 958239 - RNA, 19 nt, Homo sapiens
guggaggcgcuacuaugaa

SEQ ID NO: 958240 - RNA, 19 nt, Homo sapiens
cugauucacuguuuuguau

SEQ ID NO: 958241 - RNA, 19 nt, Homo sapiens
ggguaugguguaaacuuga

SEQ ID NO: 958242 - RNA, 19 nt, Homo sapiens
guggcuuccucuaccaguu

SEQ ID NO: 958243 - RNA, 19 nt, Homo sapiens
gcaggcuucucgguacucu

SEQ ID NO: 958244 - RNA, 19 nt, Homo sapiens
gccuggccaucaucuggaa

SEQ ID NO: 958245 - RNA, 19 nt, Homo sapiens
uagaaguuaggcucugauu

SEQ ID NO: 958246 - RNA, 19 nt, Homo sapiens
gcagauaacucacauguaa

SEQ ID NO: 958247 - RNA, 19 nt, Homo sapiens
gaacuuggguagguaaaua

SEQ ID NO: 958248 - RNA, 19 nt, Homo sapiens
gaacccaccuauugccuuu

SEQ ID NO: 958249 - RNA, 19 nt, Homo sapiens
acacagaccuggcccguuu

SEQ ID NO: 958250 - RNA, 19 nt, Homo sapiens
ugaggucggugcuguauuu

SEQ ID NO: 958251 - RNA, 19 nt, Homo sapiens
ugacagcucuuccagcaaa

SEQ ID NO: 958252 - RNA, 19 nt, Homo sapiens
gcacaaguccugaguaugg

SEQ ID NO: 958253 - RNA, 19 nt, Homo sapiens
gcgcacaaguccugaguau

SEQ ID NO: 958254 - RNA, 19 nt, Homo sapiens
aaaccuucccuuugaauua

SEQ ID NO: 958255 - RNA, 19 nt, Homo sapiens
ccaacgaacccaccuauug

SEQ ID NO: 958256 - RNA, 19 nt, Homo sapiens
ggaauuuggugacgacaag

SEQ ID NO: 958257 - RNA, 19 nt, Homo sapiens
gaacggaagaagaaauaga

SEQ ID NO: 958258 - RNA, 19 nt, Homo sapiens
aacauuaucuggacaguau

SEQ ID NO: 958259 - RNA, 19 nt, Homo sapiens
caagguggaaugcagauaa

SEQ ID NO: 958260 - RNA, 19 nt, Homo sapiens
ccucugauguguuggauau

SEQ ID NO: 958261 - RNA, 19 nt, Homo sapiens
ggaccuagaccaaagaaca

SEQ ID NO: 958262 - RNA, 19 nt, Homo sapiens
gagagaugauuggcuguga

SEQ ID NO: 958263 - RNA, 19 nt, Homo sapiens
ccuaugagaugguggacaa

SEQ ID NO: 958264 - RNA, 19 nt, Homo sapiens
gaacauuaucuggacagua

SEQ ID NO: 958265 - RNA, 19 nt, Homo sapiens
ggaagaagaaauagauaag

SEQ ID NO: 958266 - RNA, 19 nt, Homo sapiens
caaguuggccacugaguau

SEQ ID NO: 958267 - RNA, 19 nt, Homo sapiens
gaaugcagauaacucacau

SEQ ID NO: 958268 - RNA, 19 nt, Homo sapiens
aagaaaggccggacucaaa

SEQ ID NO: 958269 - RNA, 19 nt, Homo sapiens
ucuccuugcuuuguauuua

SEQ ID NO: 958270 - RNA, 19 nt, Homo sapiens
aggcugaaauugacaaguu

SEQ ID NO: 958271 - RNA, 19 nt, Homo sapiens
ggagaaacagauugaguca

SEQ ID NO: 958272 - RNA, 19 nt, Homo sapiens
ggaccugaaggcugaaauu

SEQ ID NO: 958273 - RNA, 19 nt, Homo sapiens
aaaggaacuuggguaggua

SEQ ID NO: 958274 - RNA, 19 nt, Homo sapiens
aagaacggaagaagaaaua

SEQ ID NO: 958275 - RNA, 19 nt, Homo sapiens
caacccugauuguuccauu

SEQ ID NO: 958276 - RNA, 19 nt, Homo sapiens
gaugguggacaaacacauu

SEQ ID NO: 958277 - RNA, 19 nt, Homo sapiens
cggaagaagaaauagauaa

SEQ ID NO: 958278 - RNA, 19 nt, Homo sapiens
ccaagacugcccagaagaa

SEQ ID NO: 958279 - RNA, 19 nt, Homo sapiens
uccauucccuuccugcuuu

SEQ ID NO: 958280 - RNA, 19 nt, Homo sapiens
ugagggaccuagaccaaag

SEQ ID NO: 958281 - RNA, 19 nt, Homo sapiens
ggaaugcagauaacucaca

SEQ ID NO: 958282 - RNA, 19 nt, Homo sapiens
uaucuggacaguauugaaa

SEQ ID NO: 958283 - RNA, 19 nt, Homo sapiens
ccacugaguauaugaguag

SEQ ID NO: 958284 - RNA, 19 nt, Homo sapiens
uaacucacauguaaaagga

SEQ ID NO: 958285 - RNA, 19 nt, Homo sapiens
caagaacggaagaagaaau

SEQ ID NO: 958286 - RNA, 19 nt, Homo sapiens
cccaagaacggaagaagaa

SEQ ID NO: 958287 - RNA, 19 nt, Homo sapiens
ccauugagugguuccauuu

SEQ ID NO: 958288 - RNA, 19 nt, Homo sapiens
gccacugaguauaugagua

SEQ ID NO: 958289 - RNA, 19 nt, Homo sapiens
ucauucuccuugcuuugua

SEQ ID NO: 958290 - RNA, 19 nt, Homo sapiens
gaagaagaaauagauaagg

SEQ ID NO: 958291 - RNA, 19 nt, Homo sapiens
caacgaacccaccuauugc

SEQ ID NO: 958292 - RNA, 19 nt, Homo sapiens
ggcugaaauugacaaguug

SEQ ID NO: 958293 - RNA, 19 nt, Homo sapiens
gaucaacacuuuucuucuc

SEQ ID NO: 958294 - RNA, 19 nt, Homo sapiens
aaaauuggcccuucucaaa

SEQ ID NO: 958295 - RNA, 19 nt, Homo sapiens
ggucggugcuguauuucag

SEQ ID NO: 958296 - RNA, 19 nt, Homo sapiens
gguaugugcucuccuucag

SEQ ID NO: 958297 - RNA, 19 nt, Homo sapiens
ccugaaggcugaaauugac

SEQ ID NO: 958298 - RNA, 19 nt, Homo sapiens
gcaagguggaaugcagaua

SEQ ID NO: 958299 - RNA, 19 nt, Homo sapiens
gcaagugcaaggaauuugg

SEQ ID NO: 958300 - RNA, 19 nt, Homo sapiens
gaccugaaggcugaaauug

SEQ ID NO: 958301 - RNA, 19 nt, Homo sapiens
agacugcccagaagaaguu

SEQ ID NO: 958302 - RNA, 19 nt, Homo sapiens
acaaguuggccacugagua

SEQ ID NO: 958303 - RNA, 19 nt, Homo sapiens
uugaaaaccuucccuuuga

SEQ ID NO: 958304 - RNA, 19 nt, Homo sapiens
gcugugacaacccugauug

SEQ ID NO: 958305 - RNA, 19 nt, Homo sapiens
cuccuugcuuuguauuuaa

SEQ ID NO: 958306 - RNA, 19 nt, Homo sapiens
gccuguggaucccaacgaa

SEQ ID NO: 958307 - RNA, 19 nt, Homo sapiens
ggaacauuaucuggacagu

SEQ ID NO: 958308 - RNA, 19 nt, Homo sapiens
ccacgcugcucccaagaac

SEQ ID NO: 958309 - RNA, 19 nt, Homo sapiens
uugacaaguuggccacuga

SEQ ID NO: 958310 - RNA, 19 nt, Homo sapiens
cagauaacucacauguaaa

SEQ ID NO: 958311 - RNA, 19 nt, Homo sapiens
ggacaguauugaaaaccuu

SEQ ID NO: 958312 - RNA, 19 nt, Homo sapiens
gcuagugggcagaggaaug

SEQ ID NO: 958313 - RNA, 19 nt, Homo sapiens
gagaugauuggcugugaca

SEQ ID NO: 958314 - RNA, 19 nt, Homo sapiens
uaugggaugcccucaguga

SEQ ID NO: 958315 - RNA, 19 nt, Homo sapiens
aauuggcccuucucaaaca

SEQ ID NO: 958316 - RNA, 19 nt, Homo sapiens
ccuuugaauuacagagaaa

SEQ ID NO: 958317 - RNA, 19 nt, Homo sapiens
caugagggaccuagaccaa

SEQ ID NO: 958318 - RNA, 19 nt, Homo sapiens
ggauccaccaggucaucua

SEQ ID NO: 958319 - RNA, 19 nt, Homo sapiens
ggugagggcuaggugugau

SEQ ID NO: 958320 - RNA, 19 nt, Homo sapiens
agccugagcuccgaggaaa

SEQ ID NO: 958321 - RNA, 19 nt, Homo sapiens
ccaagaacggaagaagaaa

SEQ ID NO: 958322 - RNA, 19 nt, Homo sapiens
ugaaaaccuucccuuugaa

SEQ ID NO: 958323 - RNA, 19 nt, Homo sapiens
guggaaugcagauaacuca

SEQ ID NO: 958324 - RNA, 19 nt, Homo sapiens
uccauugagugguuccauu

SEQ ID NO: 958325 - RNA, 19 nt, Homo sapiens
uuaaagcucgugcgcacaa

SEQ ID NO: 958326 - RNA, 19 nt, Homo sapiens
aaagaaaggccggacucaa

SEQ ID NO: 958327 - RNA, 19 nt, Homo sapiens
uauggcaagugcaaggaau

SEQ ID NO: 958328 - RNA, 19 nt, Homo sapiens
ggacucaaaaggagaagaa

SEQ ID NO: 958329 - RNA, 19 nt, Homo sapiens
ggaacuuggguagguaaau

SEQ ID NO: 958330 - RNA, 19 nt, Homo sapiens
ggucuugcccacuguccuu

SEQ ID NO: 958331 - RNA, 19 nt, Homo sapiens
gaugauuggcugugacaac

SEQ ID NO: 958332 - RNA, 19 nt, Homo sapiens
gucaccaggucuccuaugg

SEQ ID NO: 958333 - RNA, 19 nt, Homo sapiens
aaaaggaacuuggguaggu

SEQ ID NO: 958334 - RNA, 19 nt, Homo sapiens
gaaaaccuucccuuugaau

SEQ ID NO: 958335 - RNA, 19 nt, Homo sapiens
aguaugggaugcccucagu

SEQ ID NO: 958336 - RNA, 19 nt, Homo sapiens
guuggccacugaguauaug

SEQ ID NO: 958337 - RNA, 19 nt, Homo sapiens
aaagaacagaggaccugaa

SEQ ID NO: 958338 - RNA, 19 nt, Homo sapiens
gcugaggucggugcuguau

SEQ ID NO: 958339 - RNA, 19 nt, Homo sapiens
gagggaccuagaccaaaga

SEQ ID NO: 958340 - RNA, 19 nt, Homo sapiens
caugcagaccuaugagaug

SEQ ID NO: 958341 - RNA, 19 nt, Homo sapiens
caggaagccuauggcaagu

SEQ ID NO: 958342 - RNA, 19 nt, Homo sapiens
gcaggaagcccucaccuuu

SEQ ID NO: 958343 - RNA, 19 nt, Homo sapiens
caaagaaaggcaccaguuu

SEQ ID NO: 958344 - RNA, 19 nt, Homo sapiens
cagaccagcuugcuuucua

SEQ ID NO: 958345 - RNA, 19 nt, Homo sapiens
uaagaggcccagcaagaua

SEQ ID NO: 958346 - RNA, 19 nt, Homo sapiens
gggcagaccagcuugcuuu

SEQ ID NO: 958347 - RNA, 19 nt, Homo sapiens
caacuacacuuggccuuuc

SEQ ID NO: 958348 - RNA, 19 nt, Homo sapiens
gaucuaccuuggacggaaa

SEQ ID NO: 958349 - RNA, 19 nt, Homo sapiens
gcaaugagcaccguuaugg

SEQ ID NO: 958350 - RNA, 19 nt, Homo sapiens
gcaagcugcuggccucaca

SEQ ID NO: 958351 - RNA, 19 nt, Homo sapiens
gacgaggucuuugucauca

SEQ ID NO: 958352 - RNA, 19 nt, Homo sapiens
ccaaagaaaggcaccaguu

SEQ ID NO: 958353 - RNA, 19 nt, Homo sapiens
ggccgacuauauccuguuu

SEQ ID NO: 958354 - RNA, 19 nt, Homo sapiens
gaucuuggaagcacuagug

SEQ ID NO: 958355 - RNA, 19 nt, Homo sapiens
gaugcuggauggcucaaca

SEQ ID NO: 958356 - RNA, 19 nt, Homo sapiens
ccagcaagauaggguuuga

SEQ ID NO: 958357 - RNA, 19 nt, Homo sapiens
gcacuggaccaaagaaagg

SEQ ID NO: 958358 - RNA, 19 nt, Homo sapiens
ggauguggaggcagagaaa

SEQ ID NO: 958359 - RNA, 19 nt, Homo sapiens
gaggaugacgugcgcuuug

SEQ ID NO: 958360 - RNA, 19 nt, Homo sapiens
ggccucagcucaugugacu

SEQ ID NO: 958361 - RNA, 19 nt, Homo sapiens
acaacauucugaccaacaa

SEQ ID NO: 958362 - RNA, 19 nt, Homo sapiens
ucuaagaggcccagcaaga

SEQ ID NO: 958363 - RNA, 19 nt, Homo sapiens
ugaaugugccggugaaauc

SEQ ID NO: 958364 - RNA, 19 nt, Homo sapiens
ucaggaaccucggcguaga

SEQ ID NO: 958365 - RNA, 19 nt, Homo sapiens
gcagacacagacaacauuc

SEQ ID NO: 958366 - RNA, 19 nt, Homo sapiens
gcaguacaaggcacacuuc

SEQ ID NO: 958367 - RNA, 19 nt, Homo sapiens
gacgagagggucaacuuca

SEQ ID NO: 958368 - RNA, 19 nt, Homo sapiens
gcaccguuauggguacaug

SEQ ID NO: 958369 - RNA, 19 nt, Homo sapiens
caucaucgucuucgccuau

SEQ ID NO: 958370 - RNA, 19 nt, Homo sapiens
gaccuacuacuccaacuuc

SEQ ID NO: 958371 - RNA, 19 nt, Homo sapiens
caggaagcccucaccuuug

SEQ ID NO: 958372 - RNA, 19 nt, Homo sapiens
cccaagcacuggaccaaag

SEQ ID NO: 958373 - RNA, 19 nt, Homo sapiens
gaugacgugcgcuuugaga

SEQ ID NO: 958374 - RNA, 19 nt, Homo sapiens
cguuauggguacaugaaug

SEQ ID NO: 958375 - RNA, 19 nt, Homo sapiens
ccacaucccaacuacacuu

SEQ ID NO: 958376 - RNA, 19 nt, Homo sapiens
caacuucauccaccugauc

SEQ ID NO: 958377 - RNA, 19 nt, Homo sapiens
gacaacauucugaccaaca

SEQ ID NO: 958378 - RNA, 19 nt, Homo sapiens
aggaugacgugcgcuuuga

SEQ ID NO: 958379 - RNA, 19 nt, Homo sapiens
cuaagaggcccagcaagau

SEQ ID NO: 958380 - RNA, 19 nt, Homo sapiens
ggcaccaguuucugaugga

SEQ ID NO: 958381 - RNA, 19 nt, Homo sapiens
gacgaguuccugcccauca

SEQ ID NO: 958382 - RNA, 19 nt, Homo sapiens
ggaccugaucuaccuugga

SEQ ID NO: 958383 - RNA, 19 nt, Homo sapiens
ccgcacagccgaguacuuc

SEQ ID NO: 958384 - RNA, 19 nt, Homo sapiens
ccaagcacuggaccaaaga

SEQ ID NO: 958385 - RNA, 19 nt, Homo sapiens
gugacucggcccucuaaga

SEQ ID NO: 958386 - RNA, 19 nt, Homo sapiens
ucagugacacggagacauc

SEQ ID NO: 958387 - RNA, 19 nt, Homo sapiens
cgggcuaccaggacccuua

SEQ ID NO: 958388 - RNA, 19 nt, Homo sapiens
ccgacuauauccuguuugc

SEQ ID NO: 958389 - RNA, 19 nt, Homo sapiens
aggcagagaaacugucuug

SEQ ID NO: 958390 - RNA, 19 nt, Homo sapiens
aggaagcccucaccuuugc

SEQ ID NO: 958391 - RNA, 19 nt, Homo sapiens
ggaggcagagaaacugucu

SEQ ID NO: 958392 - RNA, 19 nt, Homo sapiens
gcaggccucagcucaugug

SEQ ID NO: 958393 - RNA, 19 nt, Homo sapiens
gcacaggccucaagagaag

SEQ ID NO: 958394 - RNA, 19 nt, Homo sapiens
gcaaacagccuucauccaa

SEQ ID NO: 958395 - RNA, 19 nt, Homo sapiens
caaacagccuucauccaaa

SEQ ID NO: 958396 - RNA, 19 nt, Homo sapiens
gucaagaccugccuagaaa

SEQ ID NO: 958397 - RNA, 19 nt, Homo sapiens
ggaaggaacaggagugugu

SEQ ID NO: 958398 - RNA, 19 nt, Homo sapiens
gagcacaggccucaagaga

SEQ ID NO: 958399 - RNA, 19 nt, Homo sapiens
cagccaaggucucuucaga

SEQ ID NO: 958400 - RNA, 19 nt, Homo sapiens
gggacuggcagguuauuaa

SEQ ID NO: 958401 - RNA, 19 nt, Homo sapiens
agacuucgaugaugaugug

SEQ ID NO: 958402 - RNA, 19 nt, Homo sapiens
cuaugugaccucuuuauaa

SEQ ID NO: 958403 - RNA, 19 nt, Homo sapiens
uaaucgagauacacuuguu

SEQ ID NO: 958404 - RNA, 19 nt, Homo sapiens
gaacuggagcuggaaggaa

SEQ ID NO: 958405 - RNA, 19 nt, Homo sapiens
uaugugaccucuuuauaac

SEQ ID NO: 958406 - RNA, 19 nt, Homo sapiens
ggacuggcagguuauuaau

SEQ ID NO: 958407 - RNA, 19 nt, Homo sapiens
acgacuaugugaccucuuu

SEQ ID NO: 958408 - RNA, 19 nt, Homo sapiens
ugacauggaaggugaaaca

SEQ ID NO: 958409 - RNA, 19 nt, Homo sapiens
cgagauacacuuguuagga

SEQ ID NO: 958410 - RNA, 19 nt, Homo sapiens
cuucgaugaugauguguga

SEQ ID NO: 958411 - RNA, 19 nt, Homo sapiens
gagcagccaaggucucuuc

SEQ ID NO: 958412 - RNA, 19 nt, Homo sapiens
uuacagccacauccucuaa

SEQ ID NO: 958413 - RNA, 19 nt, Homo sapiens
aaacagccuucauccaaaa

SEQ ID NO: 958414 - RNA, 19 nt, Homo sapiens
agucaagaccugccuagaa

SEQ ID NO: 958415 - RNA, 19 nt, Homo sapiens
gguuauuaaucgagauaca

SEQ ID NO: 958416 - RNA, 19 nt, Homo sapiens
gaucugggacuggcagguu

SEQ ID NO: 958417 - RNA, 19 nt, Homo sapiens
ugugaccucuuuauaacug

SEQ ID NO: 958418 - RNA, 19 nt, Homo sapiens
cgauuuguccugccaccua

SEQ ID NO: 958419 - RNA, 19 nt, Homo sapiens
caggagaacucugcagacu

SEQ ID NO: 958420 - RNA, 19 nt, Homo sapiens
gagaggccuugcgggaaga

SEQ ID NO: 958421 - RNA, 19 nt, Homo sapiens
acagccacauccucuaaau

SEQ ID NO: 958422 - RNA, 19 nt, Homo sapiens
aaucgagauacacuuguua

SEQ ID NO: 958423 - RNA, 19 nt, Homo sapiens
aggaguguguuucagcaaa

SEQ ID NO: 958424 - RNA, 19 nt, Homo sapiens
gcagguuauuaaucgagau

SEQ ID NO: 958425 - RNA, 19 nt, Homo sapiens
acuaugugaccucuuuaua

SEQ ID NO: 958426 - RNA, 19 nt, Homo sapiens
cagguuauuaaucgagaua

SEQ ID NO: 958427 - RNA, 19 nt, Homo sapiens
cgacuaugugaccucuuua

SEQ ID NO: 958428 - RNA, 19 nt, Homo sapiens
aaagauacucuguaagaac

SEQ ID NO: 958429 - RNA, 19 nt, Homo sapiens
ucuguaagaaccauuaaca

SEQ ID NO: 958430 - RNA, 19 nt, Homo sapiens
gacuaugugaccucuuuau

SEQ ID NO: 958431 - RNA, 19 nt, Homo sapiens
ccagagcacaggccucaag

SEQ ID NO: 958432 - RNA, 19 nt, Homo sapiens
ggaaaugaguagccaggaa

SEQ ID NO: 958433 - RNA, 19 nt, Homo sapiens
ccgaggaggugcucaagua

SEQ ID NO: 958434 - RNA, 19 nt, Homo sapiens
ggaggaagcugauggucau

SEQ ID NO: 958435 - RNA, 19 nt, Homo sapiens
gauuaaacuucgcuggaaa

SEQ ID NO: 958436 - RNA, 19 nt, Homo sapiens
aaacuucgcuggaaaugag

SEQ ID NO: 958437 - RNA, 19 nt, Homo sapiens
ugacaagaaucacauacau

SEQ ID NO: 958438 - RNA, 19 nt, Homo sapiens
ggaccuggguggcuuugau

SEQ ID NO: 958439 - RNA, 19 nt, Homo sapiens
gggugaagcuggagaugga

SEQ ID NO: 958440 - RNA, 19 nt, Homo sapiens
ggaggcagaccgacuguga

SEQ ID NO: 958441 - RNA, 19 nt, Homo sapiens
cuugaaaacugaacgauua

SEQ ID NO: 958442 - RNA, 19 nt, Homo sapiens
gaacgaggccaagcagaug

SEQ ID NO: 958443 - RNA, 19 nt, Homo sapiens
gcucaacgaggaacucaaa

SEQ ID NO: 958444 - RNA, 19 nt, Homo sapiens
gggcaguccuucugaugga

SEQ ID NO: 958445 - RNA, 19 nt, Homo sapiens
cgaaaucucgcuucaguca

SEQ ID NO: 958446 - RNA, 19 nt, Homo sapiens
gacaagaaucacauacauu

SEQ ID NO: 958447 - RNA, 19 nt, Homo sapiens
caacgaggaacucaaagug

SEQ ID NO: 958448 - RNA, 19 nt, Homo sapiens
gccaggacauugacgacaa

SEQ ID NO: 958449 - RNA, 19 nt, Homo sapiens
gcuccuccauuuccuugaa

SEQ ID NO: 958450 - RNA, 19 nt, Homo sapiens
ggacgaggaaacacaggaa

SEQ ID NO: 958451 - RNA, 19 nt, Homo sapiens
agauuaaacuucgcuggaa

SEQ ID NO: 958452 - RNA, 19 nt, Homo sapiens
agaacgaaaucucgcuuca

SEQ ID NO: 958453 - RNA, 19 nt, Homo sapiens
ccaacagggaggagaauga

SEQ ID NO: 958454 - RNA, 19 nt, Homo sapiens
caaaguggacgaggaaaca

SEQ ID NO: 958455 - RNA, 19 nt, Homo sapiens
guaaaggccauagcgagaa

SEQ ID NO: 958456 - RNA, 19 nt, Homo sapiens
aacgaaaucucgcuucagu

SEQ ID NO: 958457 - RNA, 19 nt, Homo sapiens
uaaaggccauagcgagaag

SEQ ID NO: 958458 - RNA, 19 nt, Homo sapiens
ggacgaguauaaggugaag

SEQ ID NO: 958459 - RNA, 19 nt, Homo sapiens
gacgacaacugggugaaag

SEQ ID NO: 958460 - RNA, 19 nt, Homo sapiens
ugucuugggacgaguauaa

SEQ ID NO: 958461 - RNA, 19 nt, Homo sapiens
gagaugcagcgcuggauca

SEQ ID NO: 958462 - RNA, 19 nt, Homo sapiens
ggaccaggacggugacaag

SEQ ID NO: 958463 - RNA, 19 nt, Homo sapiens
caagguggaugugaacacu

SEQ ID NO: 958464 - RNA, 19 nt, Homo sapiens
gagagagaguagccaacag

SEQ ID NO: 958465 - RNA, 19 nt, Homo sapiens
ggagagcaagacacacuuc

SEQ ID NO: 958466 - RNA, 19 nt, Homo sapiens
gaggagagcaagacacacu

SEQ ID NO: 958467 - RNA, 19 nt, Homo sapiens
gaucagugccaaggagaug

SEQ ID NO: 958468 - RNA, 19 nt, Homo sapiens
gaacacugaccggaagauc

SEQ ID NO: 958469 - RNA, 19 nt, Homo sapiens
ggaagaucagugccaagga

SEQ ID NO: 958470 - RNA, 19 nt, Homo sapiens
gcucaaguacagcgaguuc

SEQ ID NO: 958471 - RNA, 19 nt, Homo sapiens
cagcagggccaggacauug

SEQ ID NO: 958472 - RNA, 19 nt, Homo sapiens
caacugggugaaagacaga

SEQ ID NO: 958473 - RNA, 19 nt, Homo sapiens
gugacaagcagcucucugu

SEQ ID NO: 958474 - RNA, 19 nt, Homo sapiens
aaaucucgcuucagucacu

SEQ ID NO: 958475 - RNA, 19 nt, Homo sapiens
ucaaguacagcgaguucuu

SEQ ID NO: 958476 - RNA, 19 nt, Homo sapiens
ugaacgaggccaagcagau

SEQ ID NO: 958477 - RNA, 19 nt, Homo sapiens
ggagccaggaccucacuuc

SEQ ID NO: 958478 - RNA, 19 nt, Homo sapiens
aaacagcuccuccauuucc

SEQ ID NO: 958479 - RNA, 19 nt, Homo sapiens
agguggaugugaacacuga

SEQ ID NO: 958480 - RNA, 19 nt, Homo sapiens
gauggacgggcaccucaau

SEQ ID NO: 958481 - RNA, 19 nt, Homo sapiens
gaccgacugugagcugcuu

SEQ ID NO: 958482 - RNA, 19 nt, Homo sapiens
gcagcgugcacgaggaguu

SEQ ID NO: 958483 - RNA, 19 nt, Homo sapiens
gaggaggugcucaaguaca

SEQ ID NO: 958484 - RNA, 19 nt, Homo sapiens
gggacggucacgugucuug

SEQ ID NO: 958485 - RNA, 19 nt, Homo sapiens
gcugagaaaaugcaaauau

SEQ ID NO: 958486 - RNA, 19 nt, Homo sapiens
gaacgaaaucucgcuucag

SEQ ID NO: 958487 - RNA, 19 nt, Homo sapiens
caaguacagcgaguucuuc

SEQ ID NO: 958488 - RNA, 19 nt, Homo sapiens
ugacgacaacugggugaaa

SEQ ID NO: 958489 - RNA, 19 nt, Homo sapiens
cgagagagaguagccaaca

SEQ ID NO: 958490 - RNA, 19 nt, Homo sapiens
uaaacuucgcuggaaauga

SEQ ID NO: 958491 - RNA, 19 nt, Homo sapiens
caaggaccuggguggcuuu

SEQ ID NO: 958492 - RNA, 19 nt, Homo sapiens
caacagggaggagaaugag

SEQ ID NO: 958493 - RNA, 19 nt, Homo sapiens
cagcgugcacgaggaguuu

SEQ ID NO: 958494 - RNA, 19 nt, Homo sapiens
agaagacggccgagcacuu

SEQ ID NO: 958495 - RNA, 19 nt, Homo sapiens
ggaaacugaacgauuauua

SEQ ID NO: 958496 - RNA, 19 nt, Homo sapiens
ccaauaggcaccuuaaaua

SEQ ID NO: 958497 - RNA, 19 nt, Homo sapiens
ggaaaugaguagccaggaa

SEQ ID NO: 958498 - RNA, 19 nt, Homo sapiens
cuuggaaacugaacgauua

SEQ ID NO: 958499 - RNA, 19 nt, Homo sapiens
ccgaggaggugcucaagua

SEQ ID NO: 958500 - RNA, 19 nt, Homo sapiens
ggaggaagcugauggucau

SEQ ID NO: 958501 - RNA, 19 nt, Homo sapiens
aaacuucgcuggaaaugag

SEQ ID NO: 958502 - RNA, 19 nt, Homo sapiens
ugacaagaaucacaaacau

SEQ ID NO: 958503 - RNA, 19 nt, Homo sapiens
uagauaaacuucgcuggaa

SEQ ID NO: 958504 - RNA, 19 nt, Homo sapiens
ggaccuggguggcuuugau

SEQ ID NO: 958505 - RNA, 19 nt, Homo sapiens
gggugaagcuggagaugga

SEQ ID NO: 958506 - RNA, 19 nt, Homo sapiens
ggaggcagaccgacuguga

SEQ ID NO: 958507 - RNA, 19 nt, Homo sapiens
gaacgaggccaagcagaug

SEQ ID NO: 958508 - RNA, 19 nt, Homo sapiens
gcucaacgaggaacucaaa

SEQ ID NO: 958509 - RNA, 19 nt, Homo sapiens
gggcaguccuucugaugga

SEQ ID NO: 958510 - RNA, 19 nt, Homo sapiens
cgaaaucucgcuucaguca

SEQ ID NO: 958511 - RNA, 19 nt, Homo sapiens
gacaagaaucacaaacauu

SEQ ID NO: 958512 - RNA, 19 nt, Homo sapiens
gccaauaggcaccuuaaau

SEQ ID NO: 958513 - RNA, 19 nt, Homo sapiens
caacgaggaacucaaagug

SEQ ID NO: 958514 - RNA, 19 nt, Homo sapiens
caauaggcaccuuaaauag

SEQ ID NO: 958515 - RNA, 19 nt, Homo sapiens
gccaggacauugacgacaa

SEQ ID NO: 958516 - RNA, 19 nt, Homo sapiens
gauaaacuucgcuggaaau

SEQ ID NO: 958517 - RNA, 19 nt, Homo sapiens
ccgaggagcuggagaacgu

SEQ ID NO: 958518 - RNA, 19 nt, Homo sapiens
agauaaacuucgcuggaaa

SEQ ID NO: 958519 - RNA, 19 nt, Homo sapiens
ggacgaggaaacacaggaa

SEQ ID NO: 958520 - RNA, 19 nt, Homo sapiens
caccuuaaauagccacuuc

SEQ ID NO: 958521 - RNA, 19 nt, Homo sapiens
ccaacagggaggagaauga

SEQ ID NO: 958522 - RNA, 19 nt, Homo sapiens
agaacgaaaucucgcuuca

SEQ ID NO: 958523 - RNA, 19 nt, Homo sapiens
caaaguggacgaggaaaca

SEQ ID NO: 958524 - RNA, 19 nt, Homo sapiens
guaaaggccauagcgagaa

SEQ ID NO: 958525 - RNA, 19 nt, Homo sapiens
aacgaaaucucgcuucagu

SEQ ID NO: 958526 - RNA, 19 nt, Homo sapiens
uaaaggccauagcgagaag

SEQ ID NO: 958527 - RNA, 19 nt, Homo sapiens
ggacgaguauaaggugaag

SEQ ID NO: 958528 - RNA, 19 nt, Homo sapiens
gacgacaacugggugaaag

SEQ ID NO: 958529 - RNA, 19 nt, Homo sapiens
ugucuugggacgaguauaa

SEQ ID NO: 958530 - RNA, 19 nt, Homo sapiens
gagaugcagcgcuggauca

SEQ ID NO: 958531 - RNA, 19 nt, Homo sapiens
ggaccaggacggugacaag

SEQ ID NO: 958532 - RNA, 19 nt, Homo sapiens
caagguggaugugaacacu

SEQ ID NO: 958533 - RNA, 19 nt, Homo sapiens
gcagccaauaggcaccuua

SEQ ID NO: 958534 - RNA, 19 nt, Homo sapiens
gagagagaguagccaacag

SEQ ID NO: 958535 - RNA, 19 nt, Homo sapiens
ggagagcaagacacacuuc

SEQ ID NO: 958536 - RNA, 19 nt, Homo sapiens
gaggagagcaagacacacu

SEQ ID NO: 958537 - RNA, 19 nt, Homo sapiens
gaucagugccaaggagaug

SEQ ID NO: 958538 - RNA, 19 nt, Homo sapiens
gaacacugaccggaagauc

SEQ ID NO: 958539 - RNA, 19 nt, Homo sapiens
ggaagaucagugccaagga

SEQ ID NO: 958540 - RNA, 19 nt, Homo sapiens
gcucaaguacagcgaguuc

SEQ ID NO: 958541 - RNA, 19 nt, Homo sapiens
cagcagggccaggacauug

SEQ ID NO: 958542 - RNA, 19 nt, Homo sapiens
caacugggugaaagacaga

SEQ ID NO: 958543 - RNA, 19 nt, Homo sapiens
gugacaagcagcucucugu

SEQ ID NO: 958544 - RNA, 19 nt, Homo sapiens
aaaucucgcuucagucacu

SEQ ID NO: 958545 - RNA, 19 nt, Homo sapiens
ucaaguacagcgaguucuu

SEQ ID NO: 958546 - RNA, 19 nt, Homo sapiens
ugaacgaggccaagcagau

SEQ ID NO: 958547 - RNA, 19 nt, Homo sapiens
cagccaauaggcaccuuaa

SEQ ID NO: 958548 - RNA, 19 nt, Homo sapiens
ggagccaggaccucacuuc

SEQ ID NO: 958549 - RNA, 19 nt, Homo sapiens
aaacagcuccuccauuucc

SEQ ID NO: 958550 - RNA, 19 nt, Homo sapiens
agguggaugugaacacuga

SEQ ID NO: 958551 - RNA, 19 nt, Homo sapiens
gauggacgggcaccucaau

SEQ ID NO: 958552 - RNA, 19 nt, Homo sapiens
gcagcugccucugagaaaa

SEQ ID NO: 958553 - RNA, 19 nt, Homo sapiens
gcagcgugcacgaggaguu

SEQ ID NO: 958554 - RNA, 19 nt, Homo sapiens
gaggaggugcucaaguaca

SEQ ID NO: 958555 - RNA, 19 nt, Homo sapiens
gaccgacugugagcugcuu

SEQ ID NO: 958556 - RNA, 19 nt, Homo sapiens
gggacggucacgugucuug

SEQ ID NO: 958557 - RNA, 19 nt, Homo sapiens
gaacgaaaucucgcuucag

SEQ ID NO: 958558 - RNA, 19 nt, Homo sapiens
caaguacagcgaguucuuc

SEQ ID NO: 958559 - RNA, 19 nt, Homo sapiens
cgagagagaguagccaaca

SEQ ID NO: 958560 - RNA, 19 nt, Homo sapiens
ugacgacaacugggugaaa

SEQ ID NO: 958561 - RNA, 19 nt, Homo sapiens
uaaacuucgcuggaaauga

SEQ ID NO: 958562 - RNA, 19 nt, Homo sapiens
caaggaccuggguggcuuu

SEQ ID NO: 958563 - RNA, 19 nt, Homo sapiens
caacagggaggagaaugag

SEQ ID NO: 958564 - RNA, 19 nt, Homo sapiens
agaagacggccgagcacuu

SEQ ID NO: 958565 - RNA, 19 nt, Homo sapiens
cagcgugcacgaggaguuu

SEQ ID NO: 958566 - RNA, 19 nt, Homo sapiens
caucaaagccuacuuauuu

SEQ ID NO: 958567 - RNA, 19 nt, Homo sapiens
gaacaugccuccucacuac

SEQ ID NO: 958568 - RNA, 19 nt, Homo sapiens
ccacagaguuucucaucua

SEQ ID NO: 958569 - RNA, 19 nt, Homo sapiens
uggauuaggucaauaaaga

SEQ ID NO: 958570 - RNA, 19 nt, Homo sapiens
cagauggaauguacgagua

SEQ ID NO: 958571 - RNA, 19 nt, Homo sapiens
gaguaugguucuaucaaga

SEQ ID NO: 958572 - RNA, 19 nt, Homo sapiens
ccuuuaaccucauuacuga

SEQ ID NO: 958573 - RNA, 19 nt, Homo sapiens
gaagcugguuugggccaua

SEQ ID NO: 958574 - RNA, 19 nt, Homo sapiens
auaaaucccuagcugauga

SEQ ID NO: 958575 - RNA, 19 nt, Homo sapiens
cgaaagaggagucgagguu

SEQ ID NO: 958576 - RNA, 19 nt, Homo sapiens
ccacuaccaugcccucuuc

SEQ ID NO: 958577 - RNA, 19 nt, Homo sapiens
ugagagcacuggugaacau

SEQ ID NO: 958578 - RNA, 19 nt, Homo sapiens
guacgaguaugguucuauc

SEQ ID NO: 958579 - RNA, 19 nt, Homo sapiens
ucaggacccuccauuguca

SEQ ID NO: 958580 - RNA, 19 nt, Homo sapiens
guacagaauuccaggucau

SEQ ID NO: 958581 - RNA, 19 nt, Homo sapiens
gcauggcucuguaccucaa

SEQ ID NO: 958582 - RNA, 19 nt, Homo sapiens
aaagagacaaugacccuaa

SEQ ID NO: 958583 - RNA, 19 nt, Homo sapiens
uuagauauguggauuaggu

SEQ ID NO: 958584 - RNA, 19 nt, Homo sapiens
gauaggcuguugcuuuguc

SEQ ID NO: 958585 - RNA, 19 nt, Homo sapiens
cugauaggcuguugcuuug

SEQ ID NO: 958586 - RNA, 19 nt, Homo sapiens
guucaucugugcaguaucu

SEQ ID NO: 958587 - RNA, 19 nt, Homo sapiens
gcccaucaaagccuacuua

SEQ ID NO: 958588 - RNA, 19 nt, Homo sapiens
gauaggugucguucucuuu

SEQ ID NO: 958589 - RNA, 19 nt, Homo sapiens
cugcauuggugcucacuuu

SEQ ID NO: 958590 - RNA, 19 nt, Homo sapiens
gugcaucaacuccguguuu

SEQ ID NO: 958591 - RNA, 19 nt, Homo sapiens
caugauaggugucguucuc

SEQ ID NO: 958592 - RNA, 19 nt, Homo sapiens
gagucgagguuggauguug

SEQ ID NO: 958593 - RNA, 19 nt, Homo sapiens
cagaguuucucaucuacga

SEQ ID NO: 958594 - RNA, 19 nt, Homo sapiens
ccaaggaggaagcugguuu

SEQ ID NO: 958595 - RNA, 19 nt, Homo sapiens
ccagcacccuguacacugu

SEQ ID NO: 958596 - RNA, 19 nt, Homo sapiens
cacgggauauuugcuguuu

SEQ ID NO: 958597 - RNA, 19 nt, Homo sapiens
aagagacaaugacccuaaa

SEQ ID NO: 958598 - RNA, 19 nt, Homo sapiens
cgaguaugguucuaucaag

SEQ ID NO: 958599 - RNA, 19 nt, Homo sapiens
ccauaagugucaccaugau

SEQ ID NO: 958600 - RNA, 19 nt, Homo sapiens
uguacacugugcccuuuaa

SEQ ID NO: 958601 - RNA, 19 nt, Homo sapiens
gucaauaaagagacaauga

SEQ ID NO: 958602 - RNA, 19 nt, Homo sapiens
ggaauguacgaguaugguu

SEQ ID NO: 958603 - RNA, 19 nt, Homo sapiens
cauaagugucaccaugaua

SEQ ID NO: 958604 - RNA, 19 nt, Homo sapiens
caauggggcuacuguugua

SEQ ID NO: 958605 - RNA, 19 nt, Homo sapiens
acugauaggcuguugcuuu

SEQ ID NO: 958606 - RNA, 19 nt, Homo sapiens
gauggaauguacgaguaug

SEQ ID NO: 958607 - RNA, 19 nt, Homo sapiens
gauuaggucaauaaagaga

SEQ ID NO: 958608 - RNA, 19 nt, Homo sapiens
uuacuucacgggauauuug

SEQ ID NO: 958609 - RNA, 19 nt, Homo sapiens
ggccauggguagcaacagu

SEQ ID NO: 958610 - RNA, 19 nt, Homo sapiens
gccauaagugucaccauga

SEQ ID NO: 958611 - RNA, 19 nt, Homo sapiens
caaggaggaagcugguuug

SEQ ID NO: 958612 - RNA, 19 nt, Homo sapiens
cagccuguuugguguaaug

SEQ ID NO: 958613 - RNA, 19 nt, Homo sapiens
agaagggccuccacuacca

SEQ ID NO: 958614 - RNA, 19 nt, Homo sapiens
gcugccgacuucauugaug

SEQ ID NO: 958615 - RNA, 19 nt, Homo sapiens
ugaacaugccuccucacua

SEQ ID NO: 958616 - RNA, 19 nt, Homo sapiens
gugcucacuuuguguuuua

SEQ ID NO: 958617 - RNA, 19 nt, Homo sapiens
gugucguucucuuugauuu

SEQ ID NO: 958618 - RNA, 19 nt, Homo sapiens
cuuugucgcucucuuuguu

SEQ ID NO: 958619 - RNA, 19 nt, Homo sapiens
ccagcagacucaucaugca

SEQ ID NO: 958620 - RNA, 19 nt, Homo sapiens
ccuguacacugugcccuuu

SEQ ID NO: 958621 - RNA, 19 nt, Homo sapiens
guucuucacagauuucaug

SEQ ID NO: 958622 - RNA, 19 nt, Homo sapiens
aaagccuacuuauuugaug

SEQ ID NO: 958623 - RNA, 19 nt, Homo sapiens
gcauuggugcucacuuugu

SEQ ID NO: 958624 - RNA, 19 nt, Homo sapiens
ccaucaaagccuacuuauu

SEQ ID NO: 958625 - RNA, 19 nt, Homo sapiens
cgggauauuugcuguuugg

SEQ ID NO: 958626 - RNA, 19 nt, Homo sapiens
gucuuuacuucacgggaua

SEQ ID NO: 958627 - RNA, 19 nt, Homo sapiens
cauuggugcucacuuugug

SEQ ID NO: 958628 - RNA, 19 nt, Homo sapiens
uaggugucguucucuuuga

SEQ ID NO: 958629 - RNA, 19 nt, Homo sapiens
gagguggccugggcuuucu

SEQ ID NO: 958630 - RNA, 19 nt, Homo sapiens
gcgccacccucacaugcau

SEQ ID NO: 958631 - RNA, 19 nt, Homo sapiens
ccucaggacccuccauugu

SEQ ID NO: 958632 - RNA, 19 nt, Homo sapiens
ugauaggugucguucucuu

SEQ ID NO: 958633 - RNA, 19 nt, Homo sapiens
cagaauuccaggucauguu

SEQ ID NO: 958634 - RNA, 19 nt, Homo sapiens
uguuguagcagcuuugauu

SEQ ID NO: 958635 - RNA, 19 nt, Homo sapiens
cuauaaaucccuagcugau

SEQ ID NO: 958636 - RNA, 19 nt, Homo sapiens
caucagccaccucauugga

SEQ ID NO: 958637 - RNA, 19 nt, Homo sapiens
caugcccucuucacagguu

SEQ ID NO: 958638 - RNA, 19 nt, Homo sapiens
ccagcagccuguacagcau

SEQ ID NO: 958639 - RNA, 19 nt, Homo sapiens
gcacugauaggcuguugcu

SEQ ID NO: 958640 - RNA, 19 nt, Homo sapiens
ggagcugggaagacuguug

SEQ ID NO: 958641 - RNA, 19 nt, Homo sapiens
uauguggauuaggucaaua

SEQ ID NO: 958642 - RNA, 19 nt, Homo sapiens
gccgccacaucuauaaauc

SEQ ID NO: 958643 - RNA, 19 nt, Homo sapiens
uguacagcauugugugguu

SEQ ID NO: 958644 - RNA, 19 nt, Homo sapiens
guucuucuucucugcauug

SEQ ID NO: 958645 - RNA, 19 nt, Homo sapiens
ggucauguucuucuucucu

SEQ ID NO: 958646 - RNA, 19 nt, Homo sapiens
aagcugguuugggccauaa

SEQ ID NO: 958647 - RNA, 19 nt, Homo sapiens
gauauguggauuaggucaa

SEQ ID NO: 958648 - RNA, 19 nt, Homo sapiens
ucgcucucuuuguuagaua

SEQ ID NO: 958649 - RNA, 19 nt, Homo sapiens
gauuucaugggccagauug

SEQ ID NO: 958650 - RNA, 19 nt, Homo sapiens
uguuagauauguggauuag

SEQ ID NO: 958651 - RNA, 19 nt, Homo sapiens
cagacucgcagggcaauga

SEQ ID NO: 958652 - RNA, 19 nt, Homo sapiens
caggucauguucuucuucu

SEQ ID NO: 958653 - RNA, 19 nt, Homo sapiens
uuaggucaauaaagagaca

SEQ ID NO: 958654 - RNA, 19 nt, Homo sapiens
cgucugcgguggcacugau

SEQ ID NO: 958655 - RNA, 19 nt, Homo sapiens
gguccugugcagccuguuu

SEQ ID NO: 958656 - RNA, 19 nt, Homo sapiens
gcucccaucaggacaagga

SEQ ID NO: 958657 - RNA, 19 nt, Homo sapiens
ggauuaggucaauaaagag

SEQ ID NO: 958658 - RNA, 19 nt, Homo sapiens
cacagaguuucucaucuac

SEQ ID NO: 958659 - RNA, 19 nt, Homo sapiens
gugcacacaacuccacaga

SEQ ID NO: 958660 - RNA, 19 nt, Homo sapiens
ccucacuaccgcuaccuuu

SEQ ID NO: 958661 - RNA, 19 nt, Homo sapiens
gaagggccuccacuaccau

SEQ ID NO: 958662 - RNA, 19 nt, Homo sapiens
aagccuacuuauuugaugu

SEQ ID NO: 958663 - RNA, 19 nt, Homo sapiens
gaacacaggucauuuguaa

SEQ ID NO: 958664 - RNA, 19 nt, Homo sapiens
caacacaucuucucaccuu

SEQ ID NO: 958665 - RNA, 19 nt, Homo sapiens
uuacagagccucaaaguau

SEQ ID NO: 958666 - RNA, 19 nt, Homo sapiens
uuaaacagcugacauuugg

SEQ ID NO: 958667 - RNA, 19 nt, Homo sapiens
ggucauuuguaaaguugua

SEQ ID NO: 958668 - RNA, 19 nt, Homo sapiens
ucaaagagacauaaaguca

SEQ ID NO: 958669 - RNA, 19 nt, Homo sapiens
uaaccaggcccacacuuaa

SEQ ID NO: 958670 - RNA, 19 nt, Homo sapiens
gaccaugucuuccuaacca

SEQ ID NO: 958671 - RNA, 19 nt, Homo sapiens
ugaccaggcccgugauaua

SEQ ID NO: 958672 - RNA, 19 nt, Homo sapiens
gaccacaauuuaccagguu

SEQ ID NO: 958673 - RNA, 19 nt, Homo sapiens
gcugacauuugggcaauuu

SEQ ID NO: 958674 - RNA, 19 nt, Homo sapiens
aaugaugacuugguuguuu

SEQ ID NO: 958675 - RNA, 19 nt, Homo sapiens
aaagugagguggccugaca

SEQ ID NO: 958676 - RNA, 19 nt, Homo sapiens
gaucaggccccacuaauaa

SEQ ID NO: 958677 - RNA, 19 nt, Homo sapiens
gaggcuacaggaagacuua

SEQ ID NO: 958678 - RNA, 19 nt, Homo sapiens
guucaaagucucauuacaa

SEQ ID NO: 958679 - RNA, 19 nt, Homo sapiens
cugaucaggucccaaauga

SEQ ID NO: 958680 - RNA, 19 nt, Homo sapiens
aggaguaaccagauauuua

SEQ ID NO: 958681 - RNA, 19 nt, Homo sapiens
guaauggagacaaaucaaa

SEQ ID NO: 958682 - RNA, 19 nt, Homo sapiens
gggaccauuuggcagauaa

SEQ ID NO: 958683 - RNA, 19 nt, Homo sapiens
ccaggcccgugauauauug

SEQ ID NO: 958684 - RNA, 19 nt, Homo sapiens
ggcagugguucuucuguug

SEQ ID NO: 958685 - RNA, 19 nt, Homo sapiens
cuaauaaagccaccacuga

SEQ ID NO: 958686 - RNA, 19 nt, Homo sapiens
gaccaagucccacugauca

SEQ ID NO: 958687 - RNA, 19 nt, Homo sapiens
ggaacacaggucauuugua

SEQ ID NO: 958688 - RNA, 19 nt, Homo sapiens
cugacaagaccacaauuua

SEQ ID NO: 958689 - RNA, 19 nt, Homo sapiens
cuaaccaggcccacacuua

SEQ ID NO: 958690 - RNA, 19 nt, Homo sapiens
guucccagcuccacacuca

SEQ ID NO: 958691 - RNA, 19 nt, Homo sapiens
gacauaaagucagcuugga

SEQ ID NO: 958692 - RNA, 19 nt, Homo sapiens
cacagaggcuacaggaaga

SEQ ID NO: 958693 - RNA, 19 nt, Homo sapiens
ucagggcccuucccacaga

SEQ ID NO: 958694 - RNA, 19 nt, Homo sapiens
ggaagggagggaccauuug

SEQ ID NO: 958695 - RNA, 19 nt, Homo sapiens
cgugauauauuguguaugc

SEQ ID NO: 958696 - RNA, 19 nt, Homo sapiens
caugaaaugcuaaaucuag

SEQ ID NO: 958697 - RNA, 19 nt, Homo sapiens
gaccaggcccgugauauau

SEQ ID NO: 958698 - RNA, 19 nt, Homo sapiens
gacguggccuuuccuccaa

SEQ ID NO: 958699 - RNA, 19 nt, Homo sapiens
caggucauuuguaaaguug

SEQ ID NO: 958700 - RNA, 19 nt, Homo sapiens
augaugacuugguuguuua

SEQ ID NO: 958701 - RNA, 19 nt, Homo sapiens
gaggaguaaccagauauuu

SEQ ID NO: 958702 - RNA, 19 nt, Homo sapiens
gaucuaaagacacaacaca

SEQ ID NO: 958703 - RNA, 19 nt, Homo sapiens
acaggucauuuguaaaguu

SEQ ID NO: 958704 - RNA, 19 nt, Homo sapiens
caucuacccuauucugagu

SEQ ID NO: 958705 - RNA, 19 nt, Homo sapiens
ccacagagccccgaucuaa

SEQ ID NO: 958706 - RNA, 19 nt, Homo sapiens
acugaacaauucuccauga

SEQ ID NO: 958707 - RNA, 19 nt, Homo sapiens
gaagggagggaccauuugg

SEQ ID NO: 958708 - RNA, 19 nt, Homo sapiens
ccacugaccaggcuuccaa

SEQ ID NO: 958709 - RNA, 19 nt, Homo sapiens
uuugcaagauccacuuaaa

SEQ ID NO: 958710 - RNA, 19 nt, Homo sapiens
acacaggucauuuguaaag

SEQ ID NO: 958711 - RNA, 19 nt, Homo sapiens
uaaaucuaguggguucuga

SEQ ID NO: 958712 - RNA, 19 nt, Homo sapiens
gacaaaucaaagagacaua

SEQ ID NO: 958713 - RNA, 19 nt, Homo sapiens
uccaugaaaugcuaaaucu

SEQ ID NO: 958714 - RNA, 19 nt, Homo sapiens
ugacaagaccacaauuuac

SEQ ID NO: 958715 - RNA, 19 nt, Homo sapiens
ccacugacaagaccacaau

SEQ ID NO: 958716 - RNA, 19 nt, Homo sapiens
cagcugacauuugggcaau

SEQ ID NO: 958717 - RNA, 19 nt, Homo sapiens
guauuggauucaacacauc

SEQ ID NO: 958718 - RNA, 19 nt, Homo sapiens
gcccuuugcuuaguuucuu

SEQ ID NO: 958719 - RNA, 19 nt, Homo sapiens
gguucaaagucucauuaca

SEQ ID NO: 958720 - RNA, 19 nt, Homo sapiens
ugaccaggcuuccaaugac

SEQ ID NO: 958721 - RNA, 19 nt, Homo sapiens
cugaacaauucuccaugaa

SEQ ID NO: 958722 - RNA, 19 nt, Homo sapiens
gccagguacugacaaacug

SEQ ID NO: 958723 - RNA, 19 nt, Homo sapiens
ugacauuugggcaauuuga

SEQ ID NO: 958724 - RNA, 19 nt, Homo sapiens
guggaacacaggucauuug

SEQ ID NO: 958725 - RNA, 19 nt, Homo sapiens
gaguaauggagacaaauca

SEQ ID NO: 958726 - RNA, 19 nt, Homo sapiens
aggaagacuuaauccagaa

SEQ ID NO: 958727 - RNA, 19 nt, Homo sapiens
caagcaguauuggauucaa

SEQ ID NO: 958728 - RNA, 19 nt, Homo sapiens
caggccagguacugacaaa

SEQ ID NO: 958729 - RNA, 19 nt, Homo sapiens
gccagggaccacaugagua

SEQ ID NO: 958730 - RNA, 19 nt, Homo sapiens
ucuacccuauucugaguuu

SEQ ID NO: 958731 - RNA, 19 nt, Homo sapiens
acaccaccaucuacccuau

SEQ ID NO: 958732 - RNA, 19 nt, Homo sapiens
gccucaaaguaucuccaua

SEQ ID NO: 958733 - RNA, 19 nt, Homo sapiens
uacagagccucaaaguauc

SEQ ID NO: 958734 - RNA, 19 nt, Homo sapiens
uggcagugguucuucuguu

SEQ ID NO: 958735 - RNA, 19 nt, Homo sapiens
ucuaaagacacaacacaga

SEQ ID NO: 958736 - RNA, 19 nt, Homo sapiens
gcugaucaggucccaaaug

SEQ ID NO: 958737 - RNA, 19 nt, Homo sapiens
cccgugauauauuguguau

SEQ ID NO: 958738 - RNA, 19 nt, Homo sapiens
uaauggagacaaaucaaag

SEQ ID NO: 958739 - RNA, 19 nt, Homo sapiens
gaccaggcuuccaaugacu

SEQ ID NO: 958740 - RNA, 19 nt, Homo sapiens
auaaagccaccacugacua

SEQ ID NO: 958741 - RNA, 19 nt, Homo sapiens
cugaccagguucccaguga

SEQ ID NO: 958742 - RNA, 19 nt, Homo sapiens
ucaaugaugacuugguugu

SEQ ID NO: 958743 - RNA, 19 nt, Homo sapiens
acacagggagagacaguug

SEQ ID NO: 958744 - RNA, 19 nt, Homo sapiens
aguauuggauucaacacau

SEQ ID NO: 958745 - RNA, 19 nt, Homo sapiens
ggccuaaucuuggggaauu

SEQ ID NO: 958746 - RNA, 19 nt, Homo sapiens
cuccaccucugcuucuaaa

SEQ ID NO: 958747 - RNA, 19 nt, Homo sapiens
gcuccaccucugcuucuaa

SEQ ID NO: 958748 - RNA, 19 nt, Homo sapiens
gcuacaggaagacuuaauc

SEQ ID NO: 958749 - RNA, 19 nt, Homo sapiens
gagggaccauuuggcagau

SEQ ID NO: 958750 - RNA, 19 nt, Homo sapiens
caagacacagggagagaca

SEQ ID NO: 958751 - RNA, 19 nt, Homo sapiens
uaaagccaccacugacuag

SEQ ID NO: 958752 - RNA, 19 nt, Homo sapiens
ucccagugaugaagugaug

SEQ ID NO: 958753 - RNA, 19 nt, Homo sapiens
gaccagguucccagugaug

SEQ ID NO: 958754 - RNA, 19 nt, Homo sapiens
ccagggaccacaugaguac

SEQ ID NO: 958755 - RNA, 19 nt, Homo sapiens
aggaagggagggaccauuu

SEQ ID NO: 958756 - RNA, 19 nt, Homo sapiens
gguggaacacaggucauuu

SEQ ID NO: 958757 - RNA, 19 nt, Homo sapiens
gcaacgggguucaaagucu

SEQ ID NO: 958758 - RNA, 19 nt, Homo sapiens
ccacugaacaauucuccau

SEQ ID NO: 958759 - RNA, 19 nt, Homo sapiens
uuuaaacagcugacauuug

SEQ ID NO: 958760 - RNA, 19 nt, Homo sapiens
ugaggaguaaccagauauu

SEQ ID NO: 958761 - RNA, 19 nt, Homo sapiens
ccaugaaaugcuaaaucua

SEQ ID NO: 958762 - RNA, 19 nt, Homo sapiens
ucaucacugucaccuuaga

SEQ ID NO: 958763 - RNA, 19 nt, Homo sapiens
gcacugaccuccuguaaag

SEQ ID NO: 958764 - RNA, 19 nt, Homo sapiens
gguaugagauggcugaauu

SEQ ID NO: 958765 - RNA, 19 nt, Homo sapiens
gaaagggacucgggacuga

SEQ ID NO: 958766 - RNA, 19 nt, Homo sapiens
gaaagucuccuuaaccaaa

SEQ ID NO: 958767 - RNA, 19 nt, Homo sapiens
ggagacgacuugccagaga

SEQ ID NO: 958768 - RNA, 19 nt, Homo sapiens
caaaggaagaggugaauga

SEQ ID NO: 958769 - RNA, 19 nt, Homo sapiens
ugagauggcugaauucaag

SEQ ID NO: 958770 - RNA, 19 nt, Homo sapiens
aagaaaggcuuggaauuga

SEQ ID NO: 958771 - RNA, 19 nt, Homo sapiens
ucaaauacaugugggauuc

SEQ ID NO: 958772 - RNA, 19 nt, Homo sapiens
gaccuccuguaaagaauaa

SEQ ID NO: 958773 - RNA, 19 nt, Homo sapiens
cgacaagaaagucuccuua

SEQ ID NO: 958774 - RNA, 19 nt, Homo sapiens
cauaaggucaggagauuaa

SEQ ID NO: 958775 - RNA, 19 nt, Homo sapiens
ucaaggugaccaucaaaua

SEQ ID NO: 958776 - RNA, 19 nt, Homo sapiens
gaaaggcuuggaauugaaa

SEQ ID NO: 958777 - RNA, 19 nt, Homo sapiens
gacaagaaagucuccuuaa

SEQ ID NO: 958778 - RNA, 19 nt, Homo sapiens
gcacaaaggaagaggugaa

SEQ ID NO: 958779 - RNA, 19 nt, Homo sapiens
gcagaugggagacgacuug

SEQ ID NO: 958780 - RNA, 19 nt, Homo sapiens
ugacucugcugucugacua

SEQ ID NO: 958781 - RNA, 19 nt, Homo sapiens
gacugaaggucuccuggaa

SEQ ID NO: 958782 - RNA, 19 nt, Homo sapiens
uuaagaccauccuggcuaa

SEQ ID NO: 958783 - RNA, 19 nt, Homo sapiens
ggaacaugaugggcacuga

SEQ ID NO: 958784 - RNA, 19 nt, Homo sapiens
cagaagaugaugacugaaa

SEQ ID NO: 958785 - RNA, 19 nt, Homo sapiens
cgcccgagcugguaacaaa

SEQ ID NO: 958786 - RNA, 19 nt, Homo sapiens
agaaaggcuuggaauugaa

SEQ ID NO: 958787 - RNA, 19 nt, Homo sapiens
caagagagguguggugacu

SEQ ID NO: 958788 - RNA, 19 nt, Homo sapiens
gcaggagaaucacuugaac

SEQ ID NO: 958789 - RNA, 19 nt, Homo sapiens
gaucauaaggucaggagau

SEQ ID NO: 958790 - RNA, 19 nt, Homo sapiens
cgaaauacacagaaaugga

SEQ ID NO: 958791 - RNA, 19 nt, Homo sapiens
ugaggugggucuccuguuc

SEQ ID NO: 958792 - RNA, 19 nt, Homo sapiens
gaaaccccgucucuacuaa

SEQ ID NO: 958793 - RNA, 19 nt, Homo sapiens
aagaaagucuccuuaacca

SEQ ID NO: 958794 - RNA, 19 nt, Homo sapiens
augagugguucacgaaaua

SEQ ID NO: 958795 - RNA, 19 nt, Homo sapiens
acaagaaagucuccuuaac

SEQ ID NO: 958796 - RNA, 19 nt, Homo sapiens
cgaggugggcagaucauaa

SEQ ID NO: 958797 - RNA, 19 nt, Homo sapiens
gaaggucuccuggaagcuu

SEQ ID NO: 958798 - RNA, 19 nt, Homo sapiens
gaaugagugguucacgaaa

SEQ ID NO: 958799 - RNA, 19 nt, Homo sapiens
gcacagccggauguucuuu

SEQ ID NO: 958800 - RNA, 19 nt, Homo sapiens
ggcuuggaauugaaacaaa

SEQ ID NO: 958801 - RNA, 19 nt, Homo sapiens
gucaggagauuaagaccau

SEQ ID NO: 958802 - RNA, 19 nt, Homo sapiens
gggcacugaccuccuguaa

SEQ ID NO: 958803 - RNA, 19 nt, Homo sapiens
caaggugaccaucaaauac

SEQ ID NO: 958804 - RNA, 19 nt, Homo sapiens
agaagaugaugacugaaag

SEQ ID NO: 958805 - RNA, 19 nt, Homo sapiens
gaauucaaggugaccauca

SEQ ID NO: 958806 - RNA, 19 nt, Homo sapiens
gcucgcguccugaagcuuu

SEQ ID NO: 958807 - RNA, 19 nt, Homo sapiens
aaccaaaacugccaagaaa

SEQ ID NO: 958808 - RNA, 19 nt, Homo sapiens
acaaguaccuuuucaucuu

SEQ ID NO: 958809 - RNA, 19 nt, Homo sapiens
ggcaggagaaucacuugaa

SEQ ID NO: 958810 - RNA, 19 nt, Homo sapiens
ggagguugccgugaguuga

SEQ ID NO: 958811 - RNA, 19 nt, Homo sapiens
aauccaagcgcgacaagaa

SEQ ID NO: 958812 - RNA, 19 nt, Homo sapiens
ucagcgcgaugcccaaauc

SEQ ID NO: 958813 - RNA, 19 nt, Homo sapiens
aacaaaaccugauagaaga

SEQ ID NO: 958814 - RNA, 19 nt, Homo sapiens
caagaaagucuccuuaacc

SEQ ID NO: 958815 - RNA, 19 nt, Homo sapiens
guagacagggaacaugaug

SEQ ID NO: 958816 - RNA, 19 nt, Homo sapiens
aaugagugguucacgaaau

SEQ ID NO: 958817 - RNA, 19 nt, Homo sapiens
gaaacaaaaccugauagaa

SEQ ID NO: 958818 - RNA, 19 nt, Homo sapiens
gaggugggcagaucauaag

SEQ ID NO: 958819 - RNA, 19 nt, Homo sapiens
ucaccaaccgcacaaagga

SEQ ID NO: 958820 - RNA, 19 nt, Homo sapiens
aaacaaaaccugauagaag

SEQ ID NO: 958821 - RNA, 19 nt, Homo sapiens
gcgcgaugcccaaauccaa

SEQ ID NO: 958822 - RNA, 19 nt, Homo sapiens
uggugacucugcugucuga

SEQ ID NO: 958823 - RNA, 19 nt, Homo sapiens
cacgaaauacacagaaaug

SEQ ID NO: 958824 - RNA, 19 nt, Homo sapiens
ucacgaaauacacagaaau

SEQ ID NO: 958825 - RNA, 19 nt, Homo sapiens
gguggagguugccgugagu

SEQ ID NO: 958826 - RNA, 19 nt, Homo sapiens
ucauaaggucaggagauua

SEQ ID NO: 958827 - RNA, 19 nt, Homo sapiens
ugaccuccuguaaagaaua

SEQ ID NO: 958828 - RNA, 19 nt, Homo sapiens
gaagaugaugacugaaagg

SEQ ID NO: 958829 - RNA, 19 nt, Homo sapiens
uaaggucaggagauuaaga

SEQ ID NO: 958830 - RNA, 19 nt, Homo sapiens
caaguaccuuuucaucuuc

SEQ ID NO: 958831 - RNA, 19 nt, Homo sapiens
aauucaaggugaccaucaa

SEQ ID NO: 958832 - RNA, 19 nt, Homo sapiens
ggaagcacagccggauguu

SEQ ID NO: 958833 - RNA, 19 nt, Homo sapiens
gccgugaguugagauugga

SEQ ID NO: 958834 - RNA, 19 nt, Homo sapiens
ggcacugaccuccuguaaa

SEQ ID NO: 958835 - RNA, 19 nt, Homo sapiens
gcuuggaauugaaacaaaa

SEQ ID NO: 958836 - RNA, 19 nt, Homo sapiens
ucugaugaauacaaagaca

SEQ ID NO: 958837 - RNA, 19 nt, Homo sapiens
gaagcacagccggauguuc

SEQ ID NO: 958838 - RNA, 19 nt, Homo sapiens
cagccugggcaacagagua

SEQ ID NO: 958839 - RNA, 19 nt, Homo sapiens
aucauaaggucaggagauu

SEQ ID NO: 958840 - RNA, 19 nt, Homo sapiens
uaaccaaaacugccaagaa

SEQ ID NO: 958841 - RNA, 19 nt, Homo sapiens
gaggugggucuccuguuca

SEQ ID NO: 958842 - RNA, 19 nt, Homo sapiens
aagcacagccggauguucu

SEQ ID NO: 958843 - RNA, 19 nt, Homo sapiens
aggaauagcucccgaguuu

SEQ ID NO: 958844 - RNA, 19 nt, Homo sapiens
gaagggagaaggugauauu

SEQ ID NO: 958845 - RNA, 19 nt, Homo sapiens
gggagaaggugauauucau

SEQ ID NO: 958846 - RNA, 19 nt, Homo sapiens
ggagacuucuuagaucuga

SEQ ID NO: 958847 - RNA, 19 nt, Homo sapiens
gagaaggugauauucauga

SEQ ID NO: 958848 - RNA, 19 nt, Homo sapiens
gagccugacuguacaucuu

SEQ ID NO: 958849 - RNA, 19 nt, Homo sapiens
ccagugccauccagaagaa

SEQ ID NO: 958850 - RNA, 19 nt, Homo sapiens
gaagcaagcuccggagacu

SEQ ID NO: 958851 - RNA, 19 nt, Homo sapiens
gaacaaccugugaggaaga

SEQ ID NO: 958852 - RNA, 19 nt, Homo sapiens
cuugagaacugcacaacuu

SEQ ID NO: 958853 - RNA, 19 nt, Homo sapiens
gaaggugauauucaugaaa

SEQ ID NO: 958854 - RNA, 19 nt, Homo sapiens
gcuguuggguguggaguuu

SEQ ID NO: 958855 - RNA, 19 nt, Homo sapiens
cagaacaaccugugaggaa

SEQ ID NO: 958856 - RNA, 19 nt, Homo sapiens
caaaauggccucuaauauc

SEQ ID NO: 958857 - RNA, 19 nt, Homo sapiens
gacuguacaucuucuugga

SEQ ID NO: 958858 - RNA, 19 nt, Homo sapiens
agaaggugauauucaugaa

SEQ ID NO: 958859 - RNA, 19 nt, Homo sapiens
guacaucuucuuggauuug

SEQ ID NO: 958860 - RNA, 19 nt, Homo sapiens
cgucuuggguuagcucuga

SEQ ID NO: 958861 - RNA, 19 nt, Homo sapiens
aauggccucuaauaucuuu

SEQ ID NO: 958862 - RNA, 19 nt, Homo sapiens
ggagaaggugauauucaug

SEQ ID NO: 958863 - RNA, 19 nt, Homo sapiens
gaauagcucccgaguuuug

SEQ ID NO: 958864 - RNA, 19 nt, Homo sapiens
caacuugagccugacugua

SEQ ID NO: 958865 - RNA, 19 nt, Homo sapiens
ccacaaccaccaccuucaa

SEQ ID NO: 958866 - RNA, 19 nt, Homo sapiens
aaaauggccucuaauaucu

SEQ ID NO: 958867 - RNA, 19 nt, Homo sapiens
cuguacaucuucuuggauu

SEQ ID NO: 958868 - RNA, 19 nt, Homo sapiens
agaacaaaauggccucuaa

SEQ ID NO: 958869 - RNA, 19 nt, Homo sapiens
caucuucuuggauuuguuu

SEQ ID NO: 958870 - RNA, 19 nt, Homo sapiens
gcaggugccaagucuagug

SEQ ID NO: 958871 - RNA, 19 nt, Homo sapiens
ccagccucgucuuggguua

SEQ ID NO: 958872 - RNA, 19 nt, Homo sapiens
aagcuccggagacuucuua

SEQ ID NO: 958873 - RNA, 19 nt, Homo sapiens
ccggagacuucuuagaucu

SEQ ID NO: 958874 - RNA, 19 nt, Homo sapiens
ccuccaugcuugagaacug

SEQ ID NO: 958875 - RNA, 19 nt, Homo sapiens
cagcaggugccaagucuag

SEQ ID NO: 958876 - RNA, 19 nt, Homo sapiens
gaacaaaauggccucuaau

SEQ ID NO: 958877 - RNA, 19 nt, Homo sapiens
ccaggugguggauccaauu

SEQ ID NO: 958878 - RNA, 19 nt, Homo sapiens
ugagaacugcacaacuuga

SEQ ID NO: 958879 - RNA, 19 nt, Homo sapiens
gcaaguccagccucgucuu

SEQ ID NO: 958880 - RNA, 19 nt, Homo sapiens
gucagcaggugccaagucu

SEQ ID NO: 958881 - RNA, 19 nt, Homo sapiens
uguacaucuucuuggauuu

SEQ ID NO: 958882 - RNA, 19 nt, Homo sapiens
gagaacugcacaacuugag

SEQ ID NO: 958883 - RNA, 19 nt, Homo sapiens
ggacugcagagaaggaacu

SEQ ID NO: 958884 - RNA, 19 nt, Homo sapiens
ugaugaaccaacagaacaa

SEQ ID NO: 958885 - RNA, 19 nt, Homo sapiens
gcugucguucugucuguuu

SEQ ID NO: 958886 - RNA, 19 nt, Homo sapiens
gagacuucuuagaucugaa

SEQ ID NO: 958887 - RNA, 19 nt, Homo sapiens
caggugguggauccaauuu

SEQ ID NO: 958888 - RNA, 19 nt, Homo sapiens
gcaggaaucuugucagaaa

SEQ ID NO: 958889 - RNA, 19 nt, Homo sapiens
gaagaaaucuccaaguauc

SEQ ID NO: 958890 - RNA, 19 nt, Homo sapiens
gaacagugauugaaguuga

SEQ ID NO: 958891 - RNA, 19 nt, Homo sapiens
ggacagugcugaaccuuau

SEQ ID NO: 958892 - RNA, 19 nt, Homo sapiens
gaagaaaccucuggaaugc

SEQ ID NO: 958893 - RNA, 19 nt, Homo sapiens
ugucagaaauuacugcuua

SEQ ID NO: 958894 - RNA, 19 nt, Homo sapiens
gaauccgacucuccuauaa

SEQ ID NO: 958895 - RNA, 19 nt, Homo sapiens
ggaaucuugucagaaauua

SEQ ID NO: 958896 - RNA, 19 nt, Homo sapiens
acaaagaccuuaggcgaua

SEQ ID NO: 958897 - RNA, 19 nt, Homo sapiens
caaggagacuucaaacuuc

SEQ ID NO: 958898 - RNA, 19 nt, Homo sapiens
gugcugaaccuuauauaua

SEQ ID NO: 958899 - RNA, 19 nt, Homo sapiens
gcaugcugcuuaagacuuu

SEQ ID NO: 958900 - RNA, 19 nt, Homo sapiens
gguaagaggcgaauuauag

SEQ ID NO: 958901 - RNA, 19 nt, Homo sapiens
gaacaggaaggaagucuug

SEQ ID NO: 958902 - RNA, 19 nt, Homo sapiens
ggaaggaggccaagggaaa

SEQ ID NO: 958903 - RNA, 19 nt, Homo sapiens
cagaauggcaugcugcuua

SEQ ID NO: 958904 - RNA, 19 nt, Homo sapiens
agagaaggcuacuaaguga

SEQ ID NO: 958905 - RNA, 19 nt, Homo sapiens
uaaauuaggcacaguaaga

SEQ ID NO: 958906 - RNA, 19 nt, Homo sapiens
gcacugcaauaccauaaca

SEQ ID NO: 958907 - RNA, 19 nt, Homo sapiens
ggaagaaaucuccaaguau

SEQ ID NO: 958908 - RNA, 19 nt, Homo sapiens
ccaaaaggcucaugaauca

SEQ ID NO: 958909 - RNA, 19 nt, Homo sapiens
gauuacaucuuguucaaag

SEQ ID NO: 958910 - RNA, 19 nt, Homo sapiens
gcuccugccuucccucuuu

SEQ ID NO: 958911 - RNA, 19 nt, Homo sapiens
caagcuagaucagaaguau

SEQ ID NO: 958912 - RNA, 19 nt, Homo sapiens
gauuaauccugaaaccaaa

SEQ ID NO: 958913 - RNA, 19 nt, Homo sapiens
ccaaggagacuucaaacuu

SEQ ID NO: 958914 - RNA, 19 nt, Homo sapiens
gaccuuaggcgauauaugu

SEQ ID NO: 958915 - RNA, 19 nt, Homo sapiens
gcacuucgcguguaguaga

SEQ ID NO: 958916 - RNA, 19 nt, Homo sapiens
cauaagcacuucgcgugua

SEQ ID NO: 958917 - RNA, 19 nt, Homo sapiens
gcaauaccauaacagucaa

SEQ ID NO: 958918 - RNA, 19 nt, Homo sapiens
ugaagaaaccucuggaaug

SEQ ID NO: 958919 - RNA, 19 nt, Homo sapiens
agaauggcaugcugcuuaa

SEQ ID NO: 958920 - RNA, 19 nt, Homo sapiens
aaacugcccuaccaaggaa

SEQ ID NO: 958921 - RNA, 19 nt, Homo sapiens
ggauaagggaggacuacua

SEQ ID NO: 958922 - RNA, 19 nt, Homo sapiens
uuuaggguguucucaaaua

SEQ ID NO: 958923 - RNA, 19 nt, Homo sapiens
caaguuugccuccaccuuu

SEQ ID NO: 958924 - RNA, 19 nt, Homo sapiens
caggagcacccaggaauua

SEQ ID NO: 958925 - RNA, 19 nt, Homo sapiens
uaacugagacugcagaaag

SEQ ID NO: 958926 - RNA, 19 nt, Homo sapiens
caaaguggaccggccauuu

SEQ ID NO: 958927 - RNA, 19 nt, Homo sapiens
aaagaacagugauugaagu

SEQ ID NO: 958928 - RNA, 19 nt, Homo sapiens
guggagacauggcucagaa

SEQ ID NO: 958929 - RNA, 19 nt, Homo sapiens
gacaaguacaagaccauua

SEQ ID NO: 958930 - RNA, 19 nt, Homo sapiens
guaagaggcgaauuauaga

SEQ ID NO: 958931 - RNA, 19 nt, Homo sapiens
gaccggccauuucauuuca

SEQ ID NO: 958932 - RNA, 19 nt, Homo sapiens
gauugaaguugaugaaagg

SEQ ID NO: 958933 - RNA, 19 nt, Homo sapiens
agacauggcucagaaacau

SEQ ID NO: 958934 - RNA, 19 nt, Homo sapiens
agaaaccucuggaaugcuu

SEQ ID NO: 958935 - RNA, 19 nt, Homo sapiens
uuaggguguucucaaauaa

SEQ ID NO: 958936 - RNA, 19 nt, Homo sapiens
acaaguacaagaccauuaa

SEQ ID NO: 958937 - RNA, 19 nt, Homo sapiens
gugagcuggugauuccuua

SEQ ID NO: 958938 - RNA, 19 nt, Homo sapiens
ccauuaaggugcccaugau

SEQ ID NO: 958939 - RNA, 19 nt, Homo sapiens
gaggcacgauggcaacaug

SEQ ID NO: 958940 - RNA, 19 nt, Homo sapiens
gcaagauuccaucccacua

SEQ ID NO: 958941 - RNA, 19 nt, Homo sapiens
aagacuaccugaccacaga

SEQ ID NO: 958942 - RNA, 19 nt, Homo sapiens
caaacugcccuaccaagga

SEQ ID NO: 958943 - RNA, 19 nt, Homo sapiens
uaagggaggacuacuacaa

SEQ ID NO: 958944 - RNA, 19 nt, Homo sapiens
caaagaacagugauugaag

SEQ ID NO: 958945 - RNA, 19 nt, Homo sapiens
gcagaugggaaucagaaga

SEQ ID NO: 958946 - RNA, 19 nt, Homo sapiens
uggauuacaucuuguucaa

SEQ ID NO: 958947 - RNA, 19 nt, Homo sapiens
cagagugcgugccuaugaa

SEQ ID NO: 958948 - RNA, 19 nt, Homo sapiens
uagagaaggcuacuaagug

SEQ ID NO: 958949 - RNA, 19 nt, Homo sapiens
uuauagagaaggcuacuaa

SEQ ID NO: 958950 - RNA, 19 nt, Homo sapiens
ugaauccgacucuccuaua

SEQ ID NO: 958951 - RNA, 19 nt, Homo sapiens
agagagggcuccacuugca

SEQ ID NO: 958952 - RNA, 19 nt, Homo sapiens
gauaagggaggacuacuac

SEQ ID NO: 958953 - RNA, 19 nt, Homo sapiens
cuugaaaggcuugauauuu

SEQ ID NO: 958954 - RNA, 19 nt, Homo sapiens
ugaccaugguuaacugaga

SEQ ID NO: 958955 - RNA, 19 nt, Homo sapiens
gcuuaagacuuuuagauug

SEQ ID NO: 958956 - RNA, 19 nt, Homo sapiens
ggaccggccauuucauuuc

SEQ ID NO: 958957 - RNA, 19 nt, Homo sapiens
gaaauuacugcuuauucca

SEQ ID NO: 958958 - RNA, 19 nt, Homo sapiens
uggcaggaaucuugucaga

SEQ ID NO: 958959 - RNA, 19 nt, Homo sapiens
ugauugaaguugaugaaag

SEQ ID NO: 958960 - RNA, 19 nt, Homo sapiens
uuaaggugcccaugaugua

SEQ ID NO: 958961 - RNA, 19 nt, Homo sapiens
gaugagauuaauccugaaa

SEQ ID NO: 958962 - RNA, 19 nt, Homo sapiens
cgacugaaacccagaucaa

SEQ ID NO: 958963 - RNA, 19 nt, Homo sapiens
gcaggacaagcuccaagaa

SEQ ID NO: 958964 - RNA, 19 nt, Homo sapiens
acaaagaacagugauugaa

SEQ ID NO: 958965 - RNA, 19 nt, Homo sapiens
uuacaaagaacagugauug

SEQ ID NO: 958966 - RNA, 19 nt, Homo sapiens
agaaguaugagaugcauga

SEQ ID NO: 958967 - RNA, 19 nt, Homo sapiens
ggacaaguacaagaccauu

SEQ ID NO: 958968 - RNA, 19 nt, Homo sapiens
ccacagggccgacugaaac

SEQ ID NO: 958969 - RNA, 19 nt, Homo sapiens
gaaagcaaaaccauggaua

SEQ ID NO: 958970 - RNA, 19 nt, Homo sapiens
uagacaguguggagacauu

SEQ ID NO: 958971 - RNA, 19 nt, Homo sapiens
cagaaauuacugcuuauuc

SEQ ID NO: 958972 - RNA, 19 nt, Homo sapiens
caugcuggaugguguccua

SEQ ID NO: 958973 - RNA, 19 nt, Homo sapiens
caaagaccuuaggcgauau

SEQ ID NO: 958974 - RNA, 19 nt, Homo sapiens
cagaugggaaucagaagaa

SEQ ID NO: 958975 - RNA, 19 nt, Homo sapiens
aggacaagcuccaagaaca

SEQ ID NO: 958976 - RNA, 19 nt, Homo sapiens
caaaggguuggguagauga

SEQ ID NO: 958977 - RNA, 19 nt, Homo sapiens
caggugagcuggugauucc

SEQ ID NO: 958978 - RNA, 19 nt, Homo sapiens
ggcaguggcaggaaucuug

SEQ ID NO: 958979 - RNA, 19 nt, Homo sapiens
acucucagcuacuggaaga

SEQ ID NO: 958980 - RNA, 19 nt, Homo sapiens
gaaguuuucuuuccgaagu

SEQ ID NO: 958981 - RNA, 19 nt, Homo sapiens
ccugaaaccaaauuaauuc

SEQ ID NO: 958982 - RNA, 19 nt, Homo sapiens
ggguaagaggcgaauuaua

SEQ ID NO: 958983 - RNA, 19 nt, Homo sapiens
gugaccaccucgcccuuga

SEQ ID NO: 958984 - RNA, 19 nt, Homo sapiens
ucuuguggauuacaucuug

SEQ ID NO: 958985 - RNA, 19 nt, Homo sapiens
acagagugcgugccuauga

SEQ ID NO: 958986 - RNA, 19 nt, Homo sapiens
ggaggaagaggaagaugag

SEQ ID NO: 958987 - RNA, 19 nt, Homo sapiens
caaacugauuauagagaag

SEQ ID NO: 958988 - RNA, 19 nt, Homo sapiens
guaaagagguaaacagauu

SEQ ID NO: 958989 - RNA, 19 nt, Homo sapiens
gagcaucauuccuuccuua

SEQ ID NO: 958990 - RNA, 19 nt, Homo sapiens
gggaagagaugauaaagag

SEQ ID NO: 958991 - RNA, 19 nt, Homo sapiens
ggagguaccuagagaggaa

SEQ ID NO: 958992 - RNA, 19 nt, Homo sapiens
gaaaagcccuagugaaaug

SEQ ID NO: 958993 - RNA, 19 nt, Homo sapiens
guguauagauguaguaaga

SEQ ID NO: 958994 - RNA, 19 nt, Homo sapiens
aagaagaaaccacagauua

SEQ ID NO: 958995 - RNA, 19 nt, Homo sapiens
gaaggcauuugagccauuu

SEQ ID NO: 958996 - RNA, 19 nt, Homo sapiens
gaagaaaccacagauuaga

SEQ ID NO: 958997 - RNA, 19 nt, Homo sapiens
gcacaaaggguaacaagca

SEQ ID NO: 958998 - RNA, 19 nt, Homo sapiens
ucuaagauguaaagaggua

SEQ ID NO: 958999 - RNA, 19 nt, Homo sapiens
gcacgugcgccuccacuaa

SEQ ID NO: 959000 - RNA, 19 nt, Homo sapiens
ggcacggucugguucauuu

SEQ ID NO: 959001 - RNA, 19 nt, Homo sapiens
gacgauggguuccguagug

SEQ ID NO: 959002 - RNA, 19 nt, Homo sapiens
aaacagauuuagggauuga

SEQ ID NO: 959003 - RNA, 19 nt, Homo sapiens
ugagggaggccacggaaua

SEQ ID NO: 959004 - RNA, 19 nt, Homo sapiens
gggaggccacggaauauga

SEQ ID NO: 959005 - RNA, 19 nt, Homo sapiens
guaacaagcagugauagug

SEQ ID NO: 959006 - RNA, 19 nt, Homo sapiens
gguagucaguggcgcacaa

SEQ ID NO: 959007 - RNA, 19 nt, Homo sapiens
ggggaugcuuuccauuuua

SEQ ID NO: 959008 - RNA, 19 nt, Homo sapiens
ggagaggugacuagacuuc

SEQ ID NO: 959009 - RNA, 19 nt, Homo sapiens
gaaaccacagauuagagaa

SEQ ID NO: 959010 - RNA, 19 nt, Homo sapiens
gauguagaccaaagucguu

SEQ ID NO: 959011 - RNA, 19 nt, Homo sapiens
aaagaagaaaccacagauu

SEQ ID NO: 959012 - RNA, 19 nt, Homo sapiens
agaagaaaccacagauuag

SEQ ID NO: 959013 - RNA, 19 nt, Homo sapiens
ggugcuaaguguaggaaca

SEQ ID NO: 959014 - RNA, 19 nt, Homo sapiens
gcugugugauguagaccaa

SEQ ID NO: 959015 - RNA, 19 nt, Homo sapiens
aaacauuccgcacuccaaa

SEQ ID NO: 959016 - RNA, 19 nt, Homo sapiens
ggagcaucauuccuuccuu

SEQ ID NO: 959017 - RNA, 19 nt, Homo sapiens
aaagggaggagcaucauuc

SEQ ID NO: 959018 - RNA, 19 nt, Homo sapiens
ggaggccacggaauaugaa

SEQ ID NO: 959019 - RNA, 19 nt, Homo sapiens
caaagggaggagcaucauu

SEQ ID NO: 959020 - RNA, 19 nt, Homo sapiens
gagggaggccacggaauau

SEQ ID NO: 959021 - RNA, 19 nt, Homo sapiens
ccacacagcgucacucacu

SEQ ID NO: 959022 - RNA, 19 nt, Homo sapiens
gaaguggcaauuuuaacua

SEQ ID NO: 959023 - RNA, 19 nt, Homo sapiens
aaccacagauuagagaaau

SEQ ID NO: 959024 - RNA, 19 nt, Homo sapiens
agaaaccacagauuagaga

SEQ ID NO: 959025 - RNA, 19 nt, Homo sapiens
uggaaaagcccuagugaaa

SEQ ID NO: 959026 - RNA, 19 nt, Homo sapiens
ccgacccuuugcucaauaa

SEQ ID NO: 959027 - RNA, 19 nt, Homo sapiens
aaaccacagauuagagaaa

SEQ ID NO: 959028 - RNA, 19 nt, Homo sapiens
aaaggaaguggcaauuuua

SEQ ID NO: 959029 - RNA, 19 nt, Homo sapiens
gcaaagggaggggaaguaa

SEQ ID NO: 959030 - RNA, 19 nt, Homo sapiens
uguaggaacaggauggaaa

SEQ ID NO: 959031 - RNA, 19 nt, Homo sapiens
acccuuugcucaauaaaca

SEQ ID NO: 959032 - RNA, 19 nt, Homo sapiens
gggcuggagucacaguuuu

SEQ ID NO: 959033 - RNA, 19 nt, Homo sapiens
guaccuagagaggaaguga

SEQ ID NO: 959034 - RNA, 19 nt, Homo sapiens
ggaaaagcccuagugaaau

SEQ ID NO: 959035 - RNA, 19 nt, Homo sapiens
uaaacauuccgcacuccaa

SEQ ID NO: 959036 - RNA, 19 nt, Homo sapiens
gguaacaagcagugauagu

SEQ ID NO: 959037 - RNA, 19 nt, Homo sapiens
gauguaaagagguaaacag

SEQ ID NO: 959038 - RNA, 19 nt, Homo sapiens
cccgacccuuugcucaaua

SEQ ID NO: 959039 - RNA, 19 nt, Homo sapiens
ggagaaaagggaagaaaag

SEQ ID NO: 959040 - RNA, 19 nt, Homo sapiens
agaggugacuagacuucga

SEQ ID NO: 959041 - RNA, 19 nt, Homo sapiens
ggucugguucauuucugua

SEQ ID NO: 959042 - RNA, 19 nt, Homo sapiens
uaaaaggaaguggcaauuu

SEQ ID NO: 959043 - RNA, 19 nt, Homo sapiens
gcgcacaaaggguaacaag

SEQ ID NO: 959044 - RNA, 19 nt, Homo sapiens
cagauuuagggauugauug

SEQ ID NO: 959045 - RNA, 19 nt, Homo sapiens
gaacaaccaaguaggauua

SEQ ID NO: 959046 - RNA, 19 nt, Homo sapiens
gaaugcugcugaucaaaua

SEQ ID NO: 959047 - RNA, 19 nt, Homo sapiens
gaaaauggcuacaugaaaa

SEQ ID NO: 959048 - RNA, 19 nt, Homo sapiens
auaaugagcugcagacuuu

SEQ ID NO: 959049 - RNA, 19 nt, Homo sapiens
caucauaucguauaccuua

SEQ ID NO: 959050 - RNA, 19 nt, Homo sapiens
guugaaagcuuaagaaucu

SEQ ID NO: 959051 - RNA, 19 nt, Homo sapiens
guauuggacuucaucauuu

SEQ ID NO: 959052 - RNA, 19 nt, Homo sapiens
gcaugacacucuauccuuu

SEQ ID NO: 959053 - RNA, 19 nt, Homo sapiens
gagaacaggucaucaugug

SEQ ID NO: 959054 - RNA, 19 nt, Homo sapiens
ggguuuaucuucauucauu

SEQ ID NO: 959055 - RNA, 19 nt, Homo sapiens
aaacaacacucaagcacaa

SEQ ID NO: 959056 - RNA, 19 nt, Homo sapiens
uccaaaggguuauguguua

SEQ ID NO: 959057 - RNA, 19 nt, Homo sapiens
gguuauguguuacuuauga

SEQ ID NO: 959058 - RNA, 19 nt, Homo sapiens
caaaaucuguuccccuuua

SEQ ID NO: 959059 - RNA, 19 nt, Homo sapiens
gaucuuugcuuugcacuug

SEQ ID NO: 959060 - RNA, 19 nt, Homo sapiens
ggaaaacuguuauggaaaa

SEQ ID NO: 959061 - RNA, 19 nt, Homo sapiens
caacagaggauuuaauauc

SEQ ID NO: 959062 - RNA, 19 nt, Homo sapiens
gaaaauuccugucacuauu

SEQ ID NO: 959063 - RNA, 19 nt, Homo sapiens
ccacacaaggcuaauauuu

SEQ ID NO: 959064 - RNA, 19 nt, Homo sapiens
cacauugacuuaauagcua

SEQ ID NO: 959065 - RNA, 19 nt, Homo sapiens
caaaugagcuauguauggu

SEQ ID NO: 959066 - RNA, 19 nt, Homo sapiens
ggacuuggagccauuauuc

SEQ ID NO: 959067 - RNA, 19 nt, Homo sapiens
ugacugaaaugaagaacau

SEQ ID NO: 959068 - RNA, 19 nt, Homo sapiens
gcuuauacacauugacuua

SEQ ID NO: 959069 - RNA, 19 nt, Homo sapiens
caaccaaguaggauuaauu

SEQ ID NO: 959070 - RNA, 19 nt, Homo sapiens
gcucaagguucuuaauuac

SEQ ID NO: 959071 - RNA, 19 nt, Homo sapiens
uuugauaacuucaggacua

SEQ ID NO: 959072 - RNA, 19 nt, Homo sapiens
cagaggauuuaauaucuug

SEQ ID NO: 959073 - RNA, 19 nt, Homo sapiens
ccaaguaggauuaauuugu

SEQ ID NO: 959074 - RNA, 19 nt, Homo sapiens
gacacucuauccuuucuug

SEQ ID NO: 959075 - RNA, 19 nt, Homo sapiens
ggaaugcugcugaucaaau

SEQ ID NO: 959076 - RNA, 19 nt, Homo sapiens
cuaaauaugaccacauuga

SEQ ID NO: 959077 - RNA, 19 nt, Homo sapiens
ugcucaagguucuuaauua

SEQ ID NO: 959078 - RNA, 19 nt, Homo sapiens
aaugagcuauguaugguuu

SEQ ID NO: 959079 - RNA, 19 nt, Homo sapiens
gcagagagccaaauauagc

SEQ ID NO: 959080 - RNA, 19 nt, Homo sapiens
gcacaacuguuuuacuuuc

SEQ ID NO: 959081 - RNA, 19 nt, Homo sapiens
ggaacaaccaaguaggauu

SEQ ID NO: 959082 - RNA, 19 nt, Homo sapiens
caucuuauuugaccugcuu

SEQ ID NO: 959083 - RNA, 19 nt, Homo sapiens
acacaaggcuaauauuuug

SEQ ID NO: 959084 - RNA, 19 nt, Homo sapiens
guagcaagucauaauguuu

SEQ ID NO: 959085 - RNA, 19 nt, Homo sapiens
ggacuacagaugcgugcua

SEQ ID NO: 959086 - RNA, 19 nt, Homo sapiens
ggaguagcaagucauaaug

SEQ ID NO: 959087 - RNA, 19 nt, Homo sapiens
gacgggauuucaccauguu

SEQ ID NO: 959088 - RNA, 19 nt, Homo sapiens
gggaguagcaagucauaau

SEQ ID NO: 959089 - RNA, 19 nt, Homo sapiens
cuaccuacaacaauuagua

SEQ ID NO: 959090 - RNA, 19 nt, Homo sapiens
ggacuaaucaaggaucaau

SEQ ID NO: 959091 - RNA, 19 nt, Homo sapiens
gcaacagaggauuuaauau

SEQ ID NO: 959092 - RNA, 19 nt, Homo sapiens
uugcagagagccaaauaua

SEQ ID NO: 959093 - RNA, 19 nt, Homo sapiens
caaguuuggcugugacuga

SEQ ID NO: 959094 - RNA, 19 nt, Homo sapiens
uauuugaccugcuuauaca

SEQ ID NO: 959095 - RNA, 19 nt, Homo sapiens
agauuagagucaacagaaa

SEQ ID NO: 959096 - RNA, 19 nt, Homo sapiens
ucaaaugagcuauguaugg

SEQ ID NO: 959097 - RNA, 19 nt, Homo sapiens
acaguaacauauucaaugg

SEQ ID NO: 959098 - RNA, 19 nt, Homo sapiens
ggagaacaggucaucaugu

SEQ ID NO: 959099 - RNA, 19 nt, Homo sapiens
cuucaggacuaaucaagga

SEQ ID NO: 959100 - RNA, 19 nt, Homo sapiens
gggaaaauaucguuaaguc

SEQ ID NO: 959101 - RNA, 19 nt, Homo sapiens
aaaagaaaauggcuacaug

SEQ ID NO: 959102 - RNA, 19 nt, Homo sapiens
uauagcaacagaggauuua

SEQ ID NO: 959103 - RNA, 19 nt, Homo sapiens
cugcagacuuuguucgaaa

SEQ ID NO: 959104 - RNA, 19 nt, Homo sapiens
guggaaaacuguuauggaa

SEQ ID NO: 959105 - RNA, 19 nt, Homo sapiens
uagcaagucauaauguuug

SEQ ID NO: 959106 - RNA, 19 nt, Homo sapiens
aaucgagaacggacuauuu

SEQ ID NO: 959107 - RNA, 19 nt, Homo sapiens
cuccaagcaucuuauuuga

SEQ ID NO: 959108 - RNA, 19 nt, Homo sapiens
gauuagagucaacagaaau

SEQ ID NO: 959109 - RNA, 19 nt, Homo sapiens
agcaacagaggauuuaaua

SEQ ID NO: 959110 - RNA, 19 nt, Homo sapiens
gauuacaggcauaagcauu

SEQ ID NO: 959111 - RNA, 19 nt, Homo sapiens
gauaacuucaggacuaauc

SEQ ID NO: 959112 - RNA, 19 nt, Homo sapiens
aagauuagagucaacagaa

SEQ ID NO: 959113 - RNA, 19 nt, Homo sapiens
gcuuuaaacuccccuauuc

SEQ ID NO: 959114 - RNA, 19 nt, Homo sapiens
ucuccaagcaucuuauuug

SEQ ID NO: 959115 - RNA, 19 nt, Homo sapiens
uaugugccauuuuguguua

SEQ ID NO: 959116 - RNA, 19 nt, Homo sapiens
agucaaagauuagagucaa

SEQ ID NO: 959117 - RNA, 19 nt, Homo sapiens
gcugcagacuuuguucgaa

SEQ ID NO: 959118 - RNA, 19 nt, Homo sapiens
cuccaucugcuaucaguua

SEQ ID NO: 959119 - RNA, 19 nt, Homo sapiens
gaaucacuccaucugcuau

SEQ ID NO: 959120 - RNA, 19 nt, Homo sapiens
aguagcaagucauaauguu

SEQ ID NO: 959121 - RNA, 19 nt, Homo sapiens
gaguagcaagucauaaugu

SEQ ID NO: 959122 - RNA, 19 nt, Homo sapiens
gagaacggacuauuucacu

SEQ ID NO: 959123 - RNA, 19 nt, Homo sapiens
caguaagucugggaaaaua

SEQ ID NO: 959124 - RNA, 19 nt, Homo sapiens
aaauauagcaacagaggau

SEQ ID NO: 959125 - RNA, 19 nt, Homo sapiens
gaugcgugcuaccacacaa

SEQ ID NO: 959126 - RNA, 19 nt, Homo sapiens
uguaaagaagguauccaua

SEQ ID NO: 959127 - RNA, 19 nt, Homo sapiens
ugaccugcuuauacacauu

SEQ ID NO: 959128 - RNA, 19 nt, Homo sapiens
aggguuauguguuacuuau

SEQ ID NO: 959129 - RNA, 19 nt, Homo sapiens
gccauuauucuaccuacaa

SEQ ID NO: 959130 - RNA, 19 nt, Homo sapiens
guacaagagacuauuugca

SEQ ID NO: 959131 - RNA, 19 nt, Homo sapiens
agacgggauuucaccaugu

SEQ ID NO: 959132 - RNA, 19 nt, Homo sapiens
uugauaacuucaggacuaa

SEQ ID NO: 959133 - RNA, 19 nt, Homo sapiens
aguauuggacuucaucauu

SEQ ID NO: 959134 - RNA, 19 nt, Homo sapiens
agccaaauauagcaacaga

SEQ ID NO: 959135 - RNA, 19 nt, Homo sapiens
aagcacaacuguuuuacuu

SEQ ID NO: 959136 - RNA, 19 nt, Homo sapiens
agcuaaauaugaccacauu

SEQ ID NO: 959137 - RNA, 19 nt, Homo sapiens
gauaagaaaauuccuguca

SEQ ID NO: 959138 - RNA, 19 nt, Homo sapiens
gggauuacaggcauaagca

SEQ ID NO: 959139 - RNA, 19 nt, Homo sapiens
ccuauuccuucuguugaaa

SEQ ID NO: 959140 - RNA, 19 nt, Homo sapiens
ucuuguggaucuugcuaaa

SEQ ID NO: 959141 - RNA, 19 nt, Homo sapiens
cuggaaugcugcugaucaa

SEQ ID NO: 959142 - RNA, 19 nt, Homo sapiens
ugaaucacuccaucugcua

SEQ ID NO: 959143 - RNA, 19 nt, Homo sapiens
ggaacuuagacccaucuug

SEQ ID NO: 959144 - RNA, 19 nt, Homo sapiens
caucaugugcagauucuuc

SEQ ID NO: 959145 - RNA, 19 nt, Homo sapiens
gaagugaaguuguacaaga

SEQ ID NO: 959146 - RNA, 19 nt, Homo sapiens
ggaacaagccggagcugua

SEQ ID NO: 959147 - RNA, 19 nt, Homo sapiens
gcucagaaaucagcucuau

SEQ ID NO: 959148 - RNA, 19 nt, Homo sapiens
ucagaaaucagcucuauug

SEQ ID NO: 959149 - RNA, 19 nt, Homo sapiens
ggagaaggccuacaucaag

SEQ ID NO: 959150 - RNA, 19 nt, Homo sapiens
gaacaagccggagcuguau

SEQ ID NO: 959151 - RNA, 19 nt, Homo sapiens
ggagaaguacgacaacaug

SEQ ID NO: 959152 - RNA, 19 nt, Homo sapiens
aaucagcucuauugacgaa

SEQ ID NO: 959153 - RNA, 19 nt, Homo sapiens
guccagggcucagaaauca

SEQ ID NO: 959154 - RNA, 19 nt, Homo sapiens
gcaugucggcgucagauga

SEQ ID NO: 959155 - RNA, 19 nt, Homo sapiens
gcacagaagggcagagucu

SEQ ID NO: 959156 - RNA, 19 nt, Homo sapiens
gcacuagcccuugcacaga

SEQ ID NO: 959157 - RNA, 19 nt, Homo sapiens
ucagcucuauugacgaauu

SEQ ID NO: 959158 - RNA, 19 nt, Homo sapiens
gagccuagaggauguuuca

SEQ ID NO: 959159 - RNA, 19 nt, Homo sapiens
aagugaaguuguacaagaa

SEQ ID NO: 959160 - RNA, 19 nt, Homo sapiens
gacguggucucgcucuuca

SEQ ID NO: 959161 - RNA, 19 nt, Homo sapiens
augaggaagugaaguugua

SEQ ID NO: 959162 - RNA, 19 nt, Homo sapiens
gacgaauucugccgcaagu

SEQ ID NO: 959163 - RNA, 19 nt, Homo sapiens
ccauggagcggaucaagga

SEQ ID NO: 959164 - RNA, 19 nt, Homo sapiens
ggagcuguaugaggaagug

SEQ ID NO: 959165 - RNA, 19 nt, Homo sapiens
cacuagcccuugcacagaa

SEQ ID NO: 959166 - RNA, 19 nt, Homo sapiens
cgaauucugccgcaaguuc

SEQ ID NO: 959167 - RNA, 19 nt, Homo sapiens
ccaccucccacccgacuuu

SEQ ID NO: 959168 - RNA, 19 nt, Homo sapiens
gcuccugguccaauacaaa

SEQ ID NO: 959169 - RNA, 19 nt, Homo sapiens
cagaaaucagcucuauuga

SEQ ID NO: 959170 - RNA, 19 nt, Homo sapiens
gcagguccagggcucagaa

SEQ ID NO: 959171 - RNA, 19 nt, Homo sapiens
gguccagggcucagaaauc

SEQ ID NO: 959172 - RNA, 19 nt, Homo sapiens
gaugcucuccgaccuucaa

SEQ ID NO: 959173 - RNA, 19 nt, Homo sapiens
caaugcaagcccuggagaa

SEQ ID NO: 959174 - RNA, 19 nt, Homo sapiens
acaagccggagcuguauga

SEQ ID NO: 959175 - RNA, 19 nt, Homo sapiens
ucaucacggucauggacaa

SEQ ID NO: 959176 - RNA, 19 nt, Homo sapiens
cagcucuauugacgaauuc

SEQ ID NO: 959177 - RNA, 19 nt, Homo sapiens
gccuagaggauguuucaug

SEQ ID NO: 959178 - RNA, 19 nt, Homo sapiens
uguaugaggaagugaaguu

SEQ ID NO: 959179 - RNA, 19 nt, Homo sapiens
uggagaaggccuacaucaa

SEQ ID NO: 959180 - RNA, 19 nt, Homo sapiens
gggagaaguacgacaacau

SEQ ID NO: 959181 - RNA, 19 nt, Homo sapiens
ggaagugaaguuguacaag

SEQ ID NO: 959182 - RNA, 19 nt, Homo sapiens
gggagagggagaaguacga

SEQ ID NO: 959183 - RNA, 19 nt, Homo sapiens
cgacaagggcaaccucaac

SEQ ID NO: 959184 - RNA, 19 nt, Homo sapiens
cccagagccuagaggaugu

SEQ ID NO: 959185 - RNA, 19 nt, Homo sapiens
agagggagaaguacgacaa

SEQ ID NO: 959186 - RNA, 19 nt, Homo sapiens
cccgggagagggagaagua

SEQ ID NO: 959187 - RNA, 19 nt, Homo sapiens
gaagagccguucaguguuu

SEQ ID NO: 959188 - RNA, 19 nt, Homo sapiens
gcacuuggccucuccauaa

SEQ ID NO: 959189 - RNA, 19 nt, Homo sapiens
ggaagguucuggauuuauu

SEQ ID NO: 959190 - RNA, 19 nt, Homo sapiens
ggaaaccacccaaguuaua

SEQ ID NO: 959191 - RNA, 19 nt, Homo sapiens
gaaagugggugagggauug

SEQ ID NO: 959192 - RNA, 19 nt, Homo sapiens
gaggaaaccacccaaguua

SEQ ID NO: 959193 - RNA, 19 nt, Homo sapiens
ggauuaaguuugaucacua

SEQ ID NO: 959194 - RNA, 19 nt, Homo sapiens
gggagaggauuaaguuuga

SEQ ID NO: 959195 - RNA, 19 nt, Homo sapiens
ggacaagccuggacuucug

SEQ ID NO: 959196 - RNA, 19 nt, Homo sapiens
gggaagagccguucagugu

SEQ ID NO: 959197 - RNA, 19 nt, Homo sapiens
cgagaggccucaugcaugu

SEQ ID NO: 959198 - RNA, 19 nt, Homo sapiens
gcccagagauggagcugaa

SEQ ID NO: 959199 - RNA, 19 nt, Homo sapiens
uaaauacguuagcacuuga

SEQ ID NO: 959200 - RNA, 19 nt, Homo sapiens
gaccuacucugaagaucuu

SEQ ID NO: 959201 - RNA, 19 nt, Homo sapiens
ucacugggcucaccugcuu

SEQ ID NO: 959202 - RNA, 19 nt, Homo sapiens
agacccaccugcugacuuu

SEQ ID NO: 959203 - RNA, 19 nt, Homo sapiens
auaaauacguuagcacuug

SEQ ID NO: 959204 - RNA, 19 nt, Homo sapiens
gggcucaccugcuucugaa

SEQ ID NO: 959205 - RNA, 19 nt, Homo sapiens
uaucuucucugccuucaau

SEQ ID NO: 959206 - RNA, 19 nt, Homo sapiens
ggaggaacaagaugaguug

SEQ ID NO: 959207 - RNA, 19 nt, Homo sapiens
ggugagggauugcacuuca

SEQ ID NO: 959208 - RNA, 19 nt, Homo sapiens
guaccaugcuucuguccuu

SEQ ID NO: 959209 - RNA, 19 nt, Homo sapiens
gaaaacggcucccugucuu

SEQ ID NO: 959210 - RNA, 19 nt, Homo sapiens
ccagaggccaccaccuuua

SEQ ID NO: 959211 - RNA, 19 nt, Homo sapiens
ugagagcauuaaagaugua

SEQ ID NO: 959212 - RNA, 19 nt, Homo sapiens
ucucuccacugcauuguuu

SEQ ID NO: 959213 - RNA, 19 nt, Homo sapiens
gguagggcagcaucuguua

SEQ ID NO: 959214 - RNA, 19 nt, Homo sapiens
gguaguguaugcagaccuu

SEQ ID NO: 959215 - RNA, 19 nt, Homo sapiens
ccaccuccaucccaucuau

SEQ ID NO: 959216 - RNA, 19 nt, Homo sapiens
gugagagcauuaaagaugu

SEQ ID NO: 959217 - RNA, 19 nt, Homo sapiens
ggaagagccguucaguguu

SEQ ID NO: 959218 - RNA, 19 nt, Homo sapiens
ccgcuaauguggaggaaau

SEQ ID NO: 959219 - RNA, 19 nt, Homo sapiens
cgugagagcauuaaagaug

SEQ ID NO: 959220 - RNA, 19 nt, Homo sapiens
gauuuauucccuccucuaa

SEQ ID NO: 959221 - RNA, 19 nt, Homo sapiens
gaaaccacccaaguuauag

SEQ ID NO: 959222 - RNA, 19 nt, Homo sapiens
gcagagacagaccacaaga

SEQ ID NO: 959223 - RNA, 19 nt, Homo sapiens
ccacggaggaacaagauga

SEQ ID NO: 959224 - RNA, 19 nt, Homo sapiens
ggagggaaaggccuaggaa

SEQ ID NO: 959225 - RNA, 19 nt, Homo sapiens
gucaagaccuacucugaag

SEQ ID NO: 959226 - RNA, 19 nt, Homo sapiens
agaagaggcuggagaagcu

SEQ ID NO: 959227 - RNA, 19 nt, Homo sapiens
gguauguaguggagcauca

SEQ ID NO: 959228 - RNA, 19 nt, Homo sapiens
gggcagagacagaccacaa

SEQ ID NO: 959229 - RNA, 19 nt, Homo sapiens
gagauggagcugaaacugu

SEQ ID NO: 959230 - RNA, 19 nt, Homo sapiens
gagaggaaaccacccaagu

SEQ ID NO: 959231 - RNA, 19 nt, Homo sapiens
cagcacagcgggcagaaug

SEQ ID NO: 959232 - RNA, 19 nt, Homo sapiens
guccagaucccucacauca

SEQ ID NO: 959233 - RNA, 19 nt, Homo sapiens
gaggaugcagggcuucauu

SEQ ID NO: 959234 - RNA, 19 nt, Homo sapiens
cagaggccaccaccuuuaa

SEQ ID NO: 959235 - RNA, 19 nt, Homo sapiens
gccguucaguguuuagaga

SEQ ID NO: 959236 - RNA, 19 nt, Homo sapiens
gagcaucaggguaggcuau

SEQ ID NO: 959237 - RNA, 19 nt, Homo sapiens
gaaugagauuguccacacu

SEQ ID NO: 959238 - RNA, 19 nt, Homo sapiens
agaagaagaggcuggagaa

SEQ ID NO: 959239 - RNA, 19 nt, Homo sapiens
gccaccaccuuuaaugaca

SEQ ID NO: 959240 - RNA, 19 nt, Homo sapiens
ggauuuauucccuccucua

SEQ ID NO: 959241 - RNA, 19 nt, Homo sapiens
gaagguucuggauuuauuc

SEQ ID NO: 959242 - RNA, 19 nt, Homo sapiens
ccuggaaccugccacagau

SEQ ID NO: 959243 - RNA, 19 nt, Homo sapiens
gcacacaagcaugcacaga

SEQ ID NO: 959244 - RNA, 19 nt, Homo sapiens
caagaccuacucugaagau

SEQ ID NO: 959245 - RNA, 19 nt, Homo sapiens
ggagaggauuaaguuugau

SEQ ID NO: 959246 - RNA, 19 nt, Homo sapiens
gcaagccauugggcagaga

SEQ ID NO: 959247 - RNA, 19 nt, Homo sapiens
ggucugagggcaguaauca

SEQ ID NO: 959248 - RNA, 19 nt, Homo sapiens
agaggaaaccacccaaguu

SEQ ID NO: 959249 - RNA, 19 nt, Homo sapiens
ggggaagguucuggauuua

SEQ ID NO: 959250 - RNA, 19 nt, Homo sapiens
gcaaggaugccaggagaag

SEQ ID NO: 959251 - RNA, 19 nt, Homo sapiens
ccaucacggugccuacaga

SEQ ID NO: 959252 - RNA, 19 nt, Homo sapiens
caggaauucaggaugcaua

SEQ ID NO: 959253 - RNA, 19 nt, Homo sapiens
ccacaagagcagggcauuu

SEQ ID NO: 959254 - RNA, 19 nt, Homo sapiens
cacgugagagcauuaaaga

SEQ ID NO: 959255 - RNA, 19 nt, Homo sapiens
ggaggaaaugagggagaua

SEQ ID NO: 959256 - RNA, 19 nt, Homo sapiens
gccgggagaggauuaaguu

SEQ ID NO: 959257 - RNA, 19 nt, Homo sapiens
gaagaggcuggagaagcua

SEQ ID NO: 959258 - RNA, 19 nt, Homo sapiens
gaggccaccaccuuuaaug

SEQ ID NO: 959259 - RNA, 19 nt, Homo sapiens
gagaugggucccugcacuu

SEQ ID NO: 959260 - RNA, 19 nt, Homo sapiens
aagagccguucaguguuua

SEQ ID NO: 959261 - RNA, 19 nt, Homo sapiens
cgggagaggauuaaguuug

SEQ ID NO: 959262 - RNA, 19 nt, Homo sapiens
gaauucaggaugcauacag

SEQ ID NO: 959263 - RNA, 19 nt, Homo sapiens
ugucaagaccuacucugaa

SEQ ID NO: 959264 - RNA, 19 nt, Homo sapiens
gacaagccuggacuucuga

SEQ ID NO: 959265 - RNA, 19 nt, Homo sapiens
gccaaugccauccaugugu

SEQ ID NO: 959266 - RNA, 19 nt, Homo sapiens
ugaaagugggugagggauu

SEQ ID NO: 959267 - RNA, 19 nt, Homo sapiens
guuagggagagaccuguuu

SEQ ID NO: 959268 - RNA, 19 nt, Homo sapiens
gcuaauguggaggaaauga

SEQ ID NO: 959269 - RNA, 19 nt, Homo sapiens
caucucacccacagacaga

SEQ ID NO: 959270 - RNA, 19 nt, Homo sapiens
gggaauggaaguggaagga

SEQ ID NO: 959271 - RNA, 19 nt, Homo sapiens
ccaggguccauccauacua

SEQ ID NO: 959272 - RNA, 19 nt, Homo sapiens
gcccugagaagcccagaga

SEQ ID NO: 959273 - RNA, 19 nt, Homo sapiens
agccuggacuucugauaga

SEQ ID NO: 959274 - RNA, 19 nt, Homo sapiens
uggggaagguucuggauuu

SEQ ID NO: 959275 - RNA, 19 nt, Homo sapiens
caggguccauccauacuac

SEQ ID NO: 959276 - RNA, 19 nt, Homo sapiens
uuaccgauguggccaaugc

SEQ ID NO: 959277 - RNA, 19 nt, Homo sapiens
gaagaagaggcuggagaag

SEQ ID NO: 959278 - RNA, 19 nt, Homo sapiens
ccacgugagagcauuaaag

SEQ ID NO: 959279 - RNA, 19 nt, Homo sapiens
gggaagguucuggauuuau

SEQ ID NO: 959280 - RNA, 19 nt, Homo sapiens
ggaaggaaguaggggaaug

SEQ ID NO: 959281 - RNA, 19 nt, Homo sapiens
uaccaugcuucuguccuuu

SEQ ID NO: 959282 - RNA, 19 nt, Homo sapiens
gagagcauuaaagauguaa

SEQ ID NO: 959283 - RNA, 19 nt, Homo sapiens
ggagaggcuguuggucuga

SEQ ID NO: 959284 - RNA, 19 nt, Homo sapiens
guuccucucuccacugcau

SEQ ID NO: 959285 - RNA, 19 nt, Homo sapiens
ccugagaagcccagagaug

SEQ ID NO: 959286 - RNA, 19 nt, Homo sapiens
gagaggauuaaguuugauc

SEQ ID NO: 959287 - RNA, 19 nt, Homo sapiens
gcugggaucuucucuguga

SEQ ID NO: 959288 - RNA, 19 nt, Homo sapiens
gggcugggaucuucucugu

SEQ ID NO: 959289 - RNA, 19 nt, Homo sapiens
gggaugggcugggaucuuc

SEQ ID NO: 959290 - RNA, 19 nt, Homo sapiens
guggaugaaugcagugcua

SEQ ID NO: 959291 - RNA, 19 nt, Homo sapiens
agucagauguggaugaaug

SEQ ID NO: 959292 - RNA, 19 nt, Homo sapiens
gcaccuaccgaaccaucua

SEQ ID NO: 959293 - RNA, 19 nt, Homo sapiens
ugauguggcuucugguguu

SEQ ID NO: 959294 - RNA, 19 nt, Homo sapiens
ggaguggacagugcaauga

SEQ ID NO: 959295 - RNA, 19 nt, Homo sapiens
ccagucagauguggaugaa

SEQ ID NO: 959296 - RNA, 19 nt, Homo sapiens
gaucuucucugugaaucca

SEQ ID NO: 959297 - RNA, 19 nt, Homo sapiens
acagugcaaugaaggaaga

SEQ ID NO: 959298 - RNA, 19 nt, Homo sapiens
ggacagugcaaugaaggaa

SEQ ID NO: 959299 - RNA, 19 nt, Homo sapiens
gcaagaaagacucgugacu

SEQ ID NO: 959300 - RNA, 19 nt, Homo sapiens
gauguggcuucugguguug

SEQ ID NO: 959301 - RNA, 19 nt, Homo sapiens
gcagggccuuccuccucuu

SEQ ID NO: 959302 - RNA, 19 nt, Homo sapiens
guccugcuccugcaagaaa

SEQ ID NO: 959303 - RNA, 19 nt, Homo sapiens
gaugaaugcagugcuagga

SEQ ID NO: 959304 - RNA, 19 nt, Homo sapiens
gcgagcagauuuccuuccu

SEQ ID NO: 959305 - RNA, 19 nt, Homo sapiens
ugagcgagcagauuuccuu

SEQ ID NO: 959306 - RNA, 19 nt, Homo sapiens
gaguggacagugcaaugaa

SEQ ID NO: 959307 - RNA, 19 nt, Homo sapiens
uaccgaaccaucuauagga

SEQ ID NO: 959308 - RNA, 19 nt, Homo sapiens
ucccugagcgagcagauuu

SEQ ID NO: 959309 - RNA, 19 nt, Homo sapiens
acacuugccagucagaugu

SEQ ID NO: 959310 - RNA, 19 nt, Homo sapiens
ggccuguggagcagcaaua

SEQ ID NO: 959311 - RNA, 19 nt, Homo sapiens
gggaucuucucugugaauc

SEQ ID NO: 959312 - RNA, 19 nt, Homo sapiens
aggaggugcugcugaugug

SEQ ID NO: 959313 - RNA, 19 nt, Homo sapiens
gccagucagauguggauga

SEQ ID NO: 959314 - RNA, 19 nt, Homo sapiens
gacaaaugcuuaccacaua

SEQ ID NO: 959315 - RNA, 19 nt, Homo sapiens
gcacauaguggcaugaaua

SEQ ID NO: 959316 - RNA, 19 nt, Homo sapiens
ccauguaacuuuaguguaa

SEQ ID NO: 959317 - RNA, 19 nt, Homo sapiens
ggaggaaucaagccauuua

SEQ ID NO: 959318 - RNA, 19 nt, Homo sapiens
cggaugaucuuauuaaugu

SEQ ID NO: 959319 - RNA, 19 nt, Homo sapiens
gauauugaauggcucacua

SEQ ID NO: 959320 - RNA, 19 nt, Homo sapiens
gaguauauaucaugugaga

SEQ ID NO: 959321 - RNA, 19 nt, Homo sapiens
gacuuuaucuuuaggcuuu

SEQ ID NO: 959322 - RNA, 19 nt, Homo sapiens
ugaucaagcuucugaguuu

SEQ ID NO: 959323 - RNA, 19 nt, Homo sapiens
uaaccaaggugccauugaa

SEQ ID NO: 959324 - RNA, 19 nt, Homo sapiens
gauauauucuugucucaug

SEQ ID NO: 959325 - RNA, 19 nt, Homo sapiens
uggaaucucugguaucuuu

SEQ ID NO: 959326 - RNA, 19 nt, Homo sapiens
gagaagaccagagugaaua

SEQ ID NO: 959327 - RNA, 19 nt, Homo sapiens
caaaugcagcugauucaua

SEQ ID NO: 959328 - RNA, 19 nt, Homo sapiens
gacaagaaguggaaaauaa

SEQ ID NO: 959329 - RNA, 19 nt, Homo sapiens
gaacaugaaccugaacaaa

SEQ ID NO: 959330 - RNA, 19 nt, Homo sapiens
gaagaugaagauaguauug

SEQ ID NO: 959331 - RNA, 19 nt, Homo sapiens
gaccagagugaauauaaua

SEQ ID NO: 959332 - RNA, 19 nt, Homo sapiens
ugaagaggcugagugauga

SEQ ID NO: 959333 - RNA, 19 nt, Homo sapiens
caucugcucugucuucuau

SEQ ID NO: 959334 - RNA, 19 nt, Homo sapiens
gauuguaucuucugaugau

SEQ ID NO: 959335 - RNA, 19 nt, Homo sapiens
gaggaggaaucaagccauu

SEQ ID NO: 959336 - RNA, 19 nt, Homo sapiens
agaagaagaugaagauagu

SEQ ID NO: 959337 - RNA, 19 nt, Homo sapiens
acaugaaccugaacaaaga

SEQ ID NO: 959338 - RNA, 19 nt, Homo sapiens
ugaagcagccuauagauau

SEQ ID NO: 959339 - RNA, 19 nt, Homo sapiens
gaaguuugccgccuugaug

SEQ ID NO: 959340 - RNA, 19 nt, Homo sapiens
gcucuaugauuguaucuuc

SEQ ID NO: 959341 - RNA, 19 nt, Homo sapiens
gaagauaguauuguaagug

SEQ ID NO: 959342 - RNA, 19 nt, Homo sapiens
aaaugcagcugauucauag

SEQ ID NO: 959343 - RNA, 19 nt, Homo sapiens
ggacaaaugcuuaccacau

SEQ ID NO: 959344 - RNA, 19 nt, Homo sapiens
gaagaagaagaugaagaua

SEQ ID NO: 959345 - RNA, 19 nt, Homo sapiens
gaaucaugaucucaagguu

SEQ ID NO: 959346 - RNA, 19 nt, Homo sapiens
agaagaagguaugaaagaa

SEQ ID NO: 959347 - RNA, 19 nt, Homo sapiens
gugccuggccgacaauuua

SEQ ID NO: 959348 - RNA, 19 nt, Homo sapiens
gaaccugaacaaagaaaga

SEQ ID NO: 959349 - RNA, 19 nt, Homo sapiens
gcugagugaugaacaugaa

SEQ ID NO: 959350 - RNA, 19 nt, Homo sapiens
caccacacccggcuaauuu

SEQ ID NO: 959351 - RNA, 19 nt, Homo sapiens
aggaugauguggagaguaa

SEQ ID NO: 959352 - RNA, 19 nt, Homo sapiens
caugcaaggugggauuaua

SEQ ID NO: 959353 - RNA, 19 nt, Homo sapiens
caacuuggcaucauagaca

SEQ ID NO: 959354 - RNA, 19 nt, Homo sapiens
aagguuccauguaacuuua

SEQ ID NO: 959355 - RNA, 19 nt, Homo sapiens
cugauuacuuggaauauga

SEQ ID NO: 959356 - RNA, 19 nt, Homo sapiens
ggagugcaauggcgugauc

SEQ ID NO: 959357 - RNA, 19 nt, Homo sapiens
cagaagaagguaugaaaga

SEQ ID NO: 959358 - RNA, 19 nt, Homo sapiens
ggacagacagccagagcaa

SEQ ID NO: 959359 - RNA, 19 nt, Homo sapiens
ucugcucugucuucuauua

SEQ ID NO: 959360 - RNA, 19 nt, Homo sapiens
gaagaccagagugaauaua

SEQ ID NO: 959361 - RNA, 19 nt, Homo sapiens
ggagaagaccagagugaau

SEQ ID NO: 959362 - RNA, 19 nt, Homo sapiens
ggaauaugccagaaaauaa

SEQ ID NO: 959363 - RNA, 19 nt, Homo sapiens
cuacggaugaucuuauuaa

SEQ ID NO: 959364 - RNA, 19 nt, Homo sapiens
gcccaaguaucgucacaug

SEQ ID NO: 959365 - RNA, 19 nt, Homo sapiens
ggauuauagugcaacagaa

SEQ ID NO: 959366 - RNA, 19 nt, Homo sapiens
gaucucaagguuccaugua

SEQ ID NO: 959367 - RNA, 19 nt, Homo sapiens
gaagaagguaugaaagaag

SEQ ID NO: 959368 - RNA, 19 nt, Homo sapiens
ucauguguguggugaauau

SEQ ID NO: 959369 - RNA, 19 nt, Homo sapiens
caagguuccauguaacuuu

SEQ ID NO: 959370 - RNA, 19 nt, Homo sapiens
ucucaaaccuacuuauugg

SEQ ID NO: 959371 - RNA, 19 nt, Homo sapiens
gaaucucugguaucuuuaa

SEQ ID NO: 959372 - RNA, 19 nt, Homo sapiens
gguggaaucucugguaucu

SEQ ID NO: 959373 - RNA, 19 nt, Homo sapiens
gaagaagaugaagauagua

SEQ ID NO: 959374 - RNA, 19 nt, Homo sapiens
ugaagaagaagaugaagau

SEQ ID NO: 959375 - RNA, 19 nt, Homo sapiens
gagcaucucaaaccuacuu

SEQ ID NO: 959376 - RNA, 19 nt, Homo sapiens
caugauuggccaagaagua

SEQ ID NO: 959377 - RNA, 19 nt, Homo sapiens
gagaggacuuaaccaaggu

SEQ ID NO: 959378 - RNA, 19 nt, Homo sapiens
gaucaagcuucugaguuuc

SEQ ID NO: 959379 - RNA, 19 nt, Homo sapiens
gccaagaaguauauaucau

SEQ ID NO: 959380 - RNA, 19 nt, Homo sapiens
aggaguauauaucauguga

SEQ ID NO: 959381 - RNA, 19 nt, Homo sapiens
cuaaagugcugggauuaca

SEQ ID NO: 959382 - RNA, 19 nt, Homo sapiens
ugaugaacaugaaccugaa

SEQ ID NO: 959383 - RNA, 19 nt, Homo sapiens
caaguaucgucacaugcaa

SEQ ID NO: 959384 - RNA, 19 nt, Homo sapiens
gauccuagcaagccacaga

SEQ ID NO: 959385 - RNA, 19 nt, Homo sapiens
gaagguaugaaagaaguau

SEQ ID NO: 959386 - RNA, 19 nt, Homo sapiens
caucucaaaccuacuuauu

SEQ ID NO: 959387 - RNA, 19 nt, Homo sapiens
caucuacaaucaggaguau

SEQ ID NO: 959388 - RNA, 19 nt, Homo sapiens
gaaaccaugaagccucaaa

SEQ ID NO: 959389 - RNA, 19 nt, Homo sapiens
cuucuaaagugcugggauu

SEQ ID NO: 959390 - RNA, 19 nt, Homo sapiens
gccaggcucuaugauugua

SEQ ID NO: 959391 - RNA, 19 nt, Homo sapiens
cuucugaguuucugcaguu

SEQ ID NO: 959392 - RNA, 19 nt, Homo sapiens
uggcaccaaacauuuauua

SEQ ID NO: 959393 - RNA, 19 nt, Homo sapiens
gcaagccacagacacaaau

SEQ ID NO: 959394 - RNA, 19 nt, Homo sapiens
aagaagguaugaaagaagu

SEQ ID NO: 959395 - RNA, 19 nt, Homo sapiens
gggauuauagugcaacaga

SEQ ID NO: 959396 - RNA, 19 nt, Homo sapiens
ggcuacggaugaucuuauu

SEQ ID NO: 959397 - RNA, 19 nt, Homo sapiens
ucucaugauuggccaagaa

SEQ ID NO: 959398 - RNA, 19 nt, Homo sapiens
caucauguguguggugaau

SEQ ID NO: 959399 - RNA, 19 nt, Homo sapiens
aauaauggccugcaugcaa

SEQ ID NO: 959400 - RNA, 19 nt, Homo sapiens
ccagugcuccugauuacuu

SEQ ID NO: 959401 - RNA, 19 nt, Homo sapiens
ucucugguaucuuuaaauc

SEQ ID NO: 959402 - RNA, 19 nt, Homo sapiens
caccuagacuggagugcaa

SEQ ID NO: 959403 - RNA, 19 nt, Homo sapiens
cauuuacgcugcaguggau

SEQ ID NO: 959404 - RNA, 19 nt, Homo sapiens
cagcaucaggcaaaggaua

SEQ ID NO: 959405 - RNA, 19 nt, Homo sapiens
uugccaggcucuaugauug

SEQ ID NO: 959406 - RNA, 19 nt, Homo sapiens
gcucugucuucuauuaauc

SEQ ID NO: 959407 - RNA, 19 nt, Homo sapiens
agaccagagugaauauaau

SEQ ID NO: 959408 - RNA, 19 nt, Homo sapiens
agacacaaaugcagcugau

SEQ ID NO: 959409 - RNA, 19 nt, Homo sapiens
cuucagauauuagagauag

SEQ ID NO: 959410 - RNA, 19 nt, Homo sapiens
agccagagcaaccaaauuu

SEQ ID NO: 959411 - RNA, 19 nt, Homo sapiens
gaaguccagcugccucaga

SEQ ID NO: 959412 - RNA, 19 nt, Homo sapiens
ucaggaguauauaucaugu

SEQ ID NO: 959413 - RNA, 19 nt, Homo sapiens
uaaugacucuggagaagac

SEQ ID NO: 959414 - RNA, 19 nt, Homo sapiens
gagaauagcuucauauguu

SEQ ID NO: 959415 - RNA, 19 nt, Homo sapiens
caaacuaacuugcagaaua

SEQ ID NO: 959416 - RNA, 19 nt, Homo sapiens
gcagguagcugguauuuau

SEQ ID NO: 959417 - RNA, 19 nt, Homo sapiens
ggacgauccugacauuaua

SEQ ID NO: 959418 - RNA, 19 nt, Homo sapiens
ccacacagcuuccagauga

SEQ ID NO: 959419 - RNA, 19 nt, Homo sapiens
ggacaaauauggucuugga

SEQ ID NO: 959420 - RNA, 19 nt, Homo sapiens
gaauagaugugccaauugu

SEQ ID NO: 959421 - RNA, 19 nt, Homo sapiens
guacaaaggucaagccaau

SEQ ID NO: 959422 - RNA, 19 nt, Homo sapiens
ugaaaucacugcuccauau

SEQ ID NO: 959423 - RNA, 19 nt, Homo sapiens
ggcagaaccucaagacuuu

SEQ ID NO: 959424 - RNA, 19 nt, Homo sapiens
cauuaggccuuguuuauaa

SEQ ID NO: 959425 - RNA, 19 nt, Homo sapiens
gaaacaguccuacagagua

SEQ ID NO: 959426 - RNA, 19 nt, Homo sapiens
gaaaagaacccaaagaaaa

SEQ ID NO: 959427 - RNA, 19 nt, Homo sapiens
cuacagcuuuggaaacuua

SEQ ID NO: 959428 - RNA, 19 nt, Homo sapiens
ugccauagauuuccauaua

SEQ ID NO: 959429 - RNA, 19 nt, Homo sapiens
gaacugcggucgcuggaau

SEQ ID NO: 959430 - RNA, 19 nt, Homo sapiens
uaauagagccacugguuua

SEQ ID NO: 959431 - RNA, 19 nt, Homo sapiens
ggaaaauacucaucucuaa

SEQ ID NO: 959432 - RNA, 19 nt, Homo sapiens
ccacaaacaucuucugauc

SEQ ID NO: 959433 - RNA, 19 nt, Homo sapiens
gagguggacucccauuauu

SEQ ID NO: 959434 - RNA, 19 nt, Homo sapiens
aaacaguccuacagaguaa

SEQ ID NO: 959435 - RNA, 19 nt, Homo sapiens
gcuggucgcugucaauuau

SEQ ID NO: 959436 - RNA, 19 nt, Homo sapiens
caagauagguuuuagugua

SEQ ID NO: 959437 - RNA, 19 nt, Homo sapiens
caacgucaaucaaauucaa

SEQ ID NO: 959438 - RNA, 19 nt, Homo sapiens
gaauacagaugggacauag

SEQ ID NO: 959439 - RNA, 19 nt, Homo sapiens
acaaacaucuucugaucaa

SEQ ID NO: 959440 - RNA, 19 nt, Homo sapiens
gauggguaauuacagauuu

SEQ ID NO: 959441 - RNA, 19 nt, Homo sapiens
gccauagauuuccauauaa

SEQ ID NO: 959442 - RNA, 19 nt, Homo sapiens
ggacagagagguacuccuu

SEQ ID NO: 959443 - RNA, 19 nt, Homo sapiens
gcuagagccuacugugaaa

SEQ ID NO: 959444 - RNA, 19 nt, Homo sapiens
ggaccggguucucuaucua

SEQ ID NO: 959445 - RNA, 19 nt, Homo sapiens
cacaacggaugaacaaauu

SEQ ID NO: 959446 - RNA, 19 nt, Homo sapiens
agacaaaucuguagcuagu

SEQ ID NO: 959447 - RNA, 19 nt, Homo sapiens
aagaauagaugugccaauu

SEQ ID NO: 959448 - RNA, 19 nt, Homo sapiens
ggaaaguuagaucccauua

SEQ ID NO: 959449 - RNA, 19 nt, Homo sapiens
gcaaguagcccacaguucu

SEQ ID NO: 959450 - RNA, 19 nt, Homo sapiens
caguuaaguuguucuguuu

SEQ ID NO: 959451 - RNA, 19 nt, Homo sapiens
gggcauagaguagagaaua

SEQ ID NO: 959452 - RNA, 19 nt, Homo sapiens
uuacagauuugcagacuau

SEQ ID NO: 959453 - RNA, 19 nt, Homo sapiens
uauaugugaugcaguguaa

SEQ ID NO: 959454 - RNA, 19 nt, Homo sapiens
gagcuaagugucaugcaua

SEQ ID NO: 959455 - RNA, 19 nt, Homo sapiens
ccacaguucuggccuaaca

SEQ ID NO: 959456 - RNA, 19 nt, Homo sapiens
ggacacguauuaguuguuc

SEQ ID NO: 959457 - RNA, 19 nt, Homo sapiens
gcacuacggaauucuauug

SEQ ID NO: 959458 - RNA, 19 nt, Homo sapiens
gaucagaaagagauaaaga

SEQ ID NO: 959459 - RNA, 19 nt, Homo sapiens
gacacuaaauuguacucua

SEQ ID NO: 959460 - RNA, 19 nt, Homo sapiens
gagggcagaucccaaagga

SEQ ID NO: 959461 - RNA, 19 nt, Homo sapiens
gcauauuugugaagaaaca

SEQ ID NO: 959462 - RNA, 19 nt, Homo sapiens
cuaagugucaugcauauuu

SEQ ID NO: 959463 - RNA, 19 nt, Homo sapiens
ggaaaugggcauagaguag

SEQ ID NO: 959464 - RNA, 19 nt, Homo sapiens
cuacggaauucuauugcua

SEQ ID NO: 959465 - RNA, 19 nt, Homo sapiens
gaauuuaacccaacgucaa

SEQ ID NO: 959466 - RNA, 19 nt, Homo sapiens
gcucuauccucgccacaaa

SEQ ID NO: 959467 - RNA, 19 nt, Homo sapiens
gcacgacguagaaacuaua

SEQ ID NO: 959468 - RNA, 19 nt, Homo sapiens
cuaagaaagugggagcaua

SEQ ID NO: 959469 - RNA, 19 nt, Homo sapiens
gaagugagaaucaugucaa

SEQ ID NO: 959470 - RNA, 19 nt, Homo sapiens
ccaugaagaaagccuauua

SEQ ID NO: 959471 - RNA, 19 nt, Homo sapiens
cuucauauguuuacacguu

SEQ ID NO: 959472 - RNA, 19 nt, Homo sapiens
gaaaugggcauagaguaga

SEQ ID NO: 959473 - RNA, 19 nt, Homo sapiens
gaaaucacugcuccauauu

SEQ ID NO: 959474 - RNA, 19 nt, Homo sapiens
ccacaauacccagggauua

SEQ ID NO: 959475 - RNA, 19 nt, Homo sapiens
acagagagguacuccuuga

SEQ ID NO: 959476 - RNA, 19 nt, Homo sapiens
caacuagcauucuuuccau

SEQ ID NO: 959477 - RNA, 19 nt, Homo sapiens
ucaguuaaguuguucuguu

SEQ ID NO: 959478 - RNA, 19 nt, Homo sapiens
gcuggugcauccaucagua

SEQ ID NO: 959479 - RNA, 19 nt, Homo sapiens
uaagugucaugcauauuug

SEQ ID NO: 959480 - RNA, 19 nt, Homo sapiens
cuuguaagcuucccuugaa

SEQ ID NO: 959481 - RNA, 19 nt, Homo sapiens
gaaacuggcacgacguaga

SEQ ID NO: 959482 - RNA, 19 nt, Homo sapiens
aaucacugcuccauauuug

SEQ ID NO: 959483 - RNA, 19 nt, Homo sapiens
ugagcaagccagaauuuaa

SEQ ID NO: 959484 - RNA, 19 nt, Homo sapiens
gaaugaccgguuacuguuu

SEQ ID NO: 959485 - RNA, 19 nt, Homo sapiens
gaagcaaacaauuacaugu

SEQ ID NO: 959486 - RNA, 19 nt, Homo sapiens
aaacauaucccuucauugc

SEQ ID NO: 959487 - RNA, 19 nt, Homo sapiens
uagagccacugguuuaaug

SEQ ID NO: 959488 - RNA, 19 nt, Homo sapiens
acaaaggucaagccaauuu

SEQ ID NO: 959489 - RNA, 19 nt, Homo sapiens
ucacuaaggaucacaaugu

SEQ ID NO: 959490 - RNA, 19 nt, Homo sapiens
gagcauaggcaaggcauug

SEQ ID NO: 959491 - RNA, 19 nt, Homo sapiens
caacggaugaacaaauuga

SEQ ID NO: 959492 - RNA, 19 nt, Homo sapiens
gagagguacuccuugaucu

SEQ ID NO: 959493 - RNA, 19 nt, Homo sapiens
cuacugaccuuuucuuuug

SEQ ID NO: 959494 - RNA, 19 nt, Homo sapiens
guagaccugcuguuaauga

SEQ ID NO: 959495 - RNA, 19 nt, Homo sapiens
guauuuaccaccugagaaa

SEQ ID NO: 959496 - RNA, 19 nt, Homo sapiens
gcagcauaauuccauccua

SEQ ID NO: 959497 - RNA, 19 nt, Homo sapiens
ucagaaaggccaacaaagu

SEQ ID NO: 959498 - RNA, 19 nt, Homo sapiens
uuacaaauccaguugagaa

SEQ ID NO: 959499 - RNA, 19 nt, Homo sapiens
ccugaagacuauuauacaa

SEQ ID NO: 959500 - RNA, 19 nt, Homo sapiens
gagguacuccuugaucuuu

SEQ ID NO: 959501 - RNA, 19 nt, Homo sapiens
uauauuagaugaggugcaa

SEQ ID NO: 959502 - RNA, 19 nt, Homo sapiens
accugcagcuggugaauua

SEQ ID NO: 959503 - RNA, 19 nt, Homo sapiens
gaacccugcacguugagua

SEQ ID NO: 959504 - RNA, 19 nt, Homo sapiens
gagaggaucagaaagagau

SEQ ID NO: 959505 - RNA, 19 nt, Homo sapiens
guagagaauagcuucauau

SEQ ID NO: 959506 - RNA, 19 nt, Homo sapiens
gcaaacaauuacaugucau

SEQ ID NO: 959507 - RNA, 19 nt, Homo sapiens
cagaaaggccaacaaagug

SEQ ID NO: 959508 - RNA, 19 nt, Homo sapiens
agaaggagaggaucagaaa

SEQ ID NO: 959509 - RNA, 19 nt, Homo sapiens
aaaguuagaucccauuagc

SEQ ID NO: 959510 - RNA, 19 nt, Homo sapiens
aaguaugggucucaucauu

SEQ ID NO: 959511 - RNA, 19 nt, Homo sapiens
uaacccaacgucaaucaaa

SEQ ID NO: 959512 - RNA, 19 nt, Homo sapiens
gggcauggcagacaaaucu

SEQ ID NO: 959513 - RNA, 19 nt, Homo sapiens
ccaagaccaccaugaagaa

SEQ ID NO: 959514 - RNA, 19 nt, Homo sapiens
gaaaugaacacugguauua

SEQ ID NO: 959515 - RNA, 19 nt, Homo sapiens
ccacugggcugcaacauua

SEQ ID NO: 959516 - RNA, 19 nt, Homo sapiens
gaccaugacugacauauug

SEQ ID NO: 959517 - RNA, 19 nt, Homo sapiens
gagaagagaugaugaagag

SEQ ID NO: 959518 - RNA, 19 nt, Homo sapiens
ggaaagaccauccaauuug

SEQ ID NO: 959519 - RNA, 19 nt, Homo sapiens
gguauuagcacaacuuaua

SEQ ID NO: 959520 - RNA, 19 nt, Homo sapiens
ugacgaggcucuuugguuu

SEQ ID NO: 959521 - RNA, 19 nt, Homo sapiens
uaaagugccucuaaauuca

SEQ ID NO: 959522 - RNA, 19 nt, Homo sapiens
ucuaugagcuugcaagaaa

SEQ ID NO: 959523 - RNA, 19 nt, Homo sapiens
caacauuucuuuccaugga

SEQ ID NO: 959524 - RNA, 19 nt, Homo sapiens
gaagaaaugaacacuggua

SEQ ID NO: 959525 - RNA, 19 nt, Homo sapiens
gagauaauguccuccuaga

SEQ ID NO: 959526 - RNA, 19 nt, Homo sapiens
uggccaaacuguauuuaua

SEQ ID NO: 959527 - RNA, 19 nt, Homo sapiens
gcagacaagugguuaacug

SEQ ID NO: 959528 - RNA, 19 nt, Homo sapiens
gaaacucauuaaccaguga

SEQ ID NO: 959529 - RNA, 19 nt, Homo sapiens
gcaacaacccuacuggaaa

SEQ ID NO: 959530 - RNA, 19 nt, Homo sapiens
gauaauguccuccuagaug

SEQ ID NO: 959531 - RNA, 19 nt, Homo sapiens
gaacacugguauuagacuu

SEQ ID NO: 959532 - RNA, 19 nt, Homo sapiens
agagagcacuucaguauuc

SEQ ID NO: 959533 - RNA, 19 nt, Homo sapiens
cauacaaguuucaacauug

SEQ ID NO: 959534 - RNA, 19 nt, Homo sapiens
gcaguaagcuacgaucaca

SEQ ID NO: 959535 - RNA, 19 nt, Homo sapiens
ucaaacauguccuaucugu

SEQ ID NO: 959536 - RNA, 19 nt, Homo sapiens
uagacaggguuauugauuu

SEQ ID NO: 959537 - RNA, 19 nt, Homo sapiens
ggauguggccuuccaggua

SEQ ID NO: 959538 - RNA, 19 nt, Homo sapiens
gacaagugguuaacugguu

SEQ ID NO: 959539 - RNA, 19 nt, Homo sapiens
gaagaugauccuuacuauu

SEQ ID NO: 959540 - RNA, 19 nt, Homo sapiens
gauguggccuuccagguau

SEQ ID NO: 959541 - RNA, 19 nt, Homo sapiens
ccagaaggaugcaauacug

SEQ ID NO: 959542 - RNA, 19 nt, Homo sapiens
caacaacccuacuggaaac

SEQ ID NO: 959543 - RNA, 19 nt, Homo sapiens
ucccauaaauugucuuuga

SEQ ID NO: 959544 - RNA, 19 nt, Homo sapiens
ggccaaacuguauuuauaa

SEQ ID NO: 959545 - RNA, 19 nt, Homo sapiens
uguccuaucuguaguaguu

SEQ ID NO: 959546 - RNA, 19 nt, Homo sapiens
aaacauguccuaucuguag

SEQ ID NO: 959547 - RNA, 19 nt, Homo sapiens
guagacaggguuauugauu

SEQ ID NO: 959548 - RNA, 19 nt, Homo sapiens
ccucaaacauguccuaucu

SEQ ID NO: 959549 - RNA, 19 nt, Homo sapiens
aaugaacacugguauuaga

SEQ ID NO: 959550 - RNA, 19 nt, Homo sapiens
ggaaaucuaugagcuugca

SEQ ID NO: 959551 - RNA, 19 nt, Homo sapiens
gagacauacuuuccagaug

SEQ ID NO: 959552 - RNA, 19 nt, Homo sapiens
uagaugaaccugcuuauuc

SEQ ID NO: 959553 - RNA, 19 nt, Homo sapiens
gaucauuaauccuggagau

SEQ ID NO: 959554 - RNA, 19 nt, Homo sapiens
gcuccuagcccuuacuuga

SEQ ID NO: 959555 - RNA, 19 nt, Homo sapiens
ccaaaacccuuaauagaga

SEQ ID NO: 959556 - RNA, 19 nt, Homo sapiens
agaagaugauccuuacuau

SEQ ID NO: 959557 - RNA, 19 nt, Homo sapiens
guaguugcuuuguaauuuc

SEQ ID NO: 959558 - RNA, 19 nt, Homo sapiens
ggagggaggaucacuugaa

SEQ ID NO: 959559 - RNA, 19 nt, Homo sapiens
gcucagcuccuagcccuua

SEQ ID NO: 959560 - RNA, 19 nt, Homo sapiens
uaacugguuuggcagaaug

SEQ ID NO: 959561 - RNA, 19 nt, Homo sapiens
uuaaagugccucuaaauuc

SEQ ID NO: 959562 - RNA, 19 nt, Homo sapiens
caaaaucgaugaucuccuu

SEQ ID NO: 959563 - RNA, 19 nt, Homo sapiens
cuccuuggcugguggcuua

SEQ ID NO: 959564 - RNA, 19 nt, Homo sapiens
uagaagaugauccuuacua

SEQ ID NO: 959565 - RNA, 19 nt, Homo sapiens
caggaacucuucaaagucu

SEQ ID NO: 959566 - RNA, 19 nt, Homo sapiens
uguaagguguuugaaauga

SEQ ID NO: 959567 - RNA, 19 nt, Homo sapiens
ggacaaauggaucuaugug

SEQ ID NO: 959568 - RNA, 19 nt, Homo sapiens
gaugaaagugggauuguuc

SEQ ID NO: 959569 - RNA, 19 nt, Homo sapiens
uuauuaauguugccaguga

SEQ ID NO: 959570 - RNA, 19 nt, Homo sapiens
ggagaagagaugaugaaga

SEQ ID NO: 959571 - RNA, 19 nt, Homo sapiens
ggaccaugacugacauauu

SEQ ID NO: 959572 - RNA, 19 nt, Homo sapiens
gcuuuguaauuucccauaa

SEQ ID NO: 959573 - RNA, 19 nt, Homo sapiens
ucagauggccaaacuguau

SEQ ID NO: 959574 - RNA, 19 nt, Homo sapiens
acaagugguuaacugguuu

SEQ ID NO: 959575 - RNA, 19 nt, Homo sapiens
agacaggguuauugauuuc

SEQ ID NO: 959576 - RNA, 19 nt, Homo sapiens
uuaaccagcucaugauauc

SEQ ID NO: 959577 - RNA, 19 nt, Homo sapiens
guaagguguuugaaaugau

SEQ ID NO: 959578 - RNA, 19 nt, Homo sapiens
acacugguauuagacuuaa

SEQ ID NO: 959579 - RNA, 19 nt, Homo sapiens
auaauguccuccuagauga

SEQ ID NO: 959580 - RNA, 19 nt, Homo sapiens
ggaauucaggcugcaguaa

SEQ ID NO: 959581 - RNA, 19 nt, Homo sapiens
gaggagggaggaucacuug

SEQ ID NO: 959582 - RNA, 19 nt, Homo sapiens
uauuaaugcucccuggaaa

SEQ ID NO: 959583 - RNA, 19 nt, Homo sapiens
gggagaagaagguuucaug

SEQ ID NO: 959584 - RNA, 19 nt, Homo sapiens
guaccaacauuucuuucca

SEQ ID NO: 959585 - RNA, 19 nt, Homo sapiens
aauagaagaugauccuuac

SEQ ID NO: 959586 - RNA, 19 nt, Homo sapiens
uaaccagaaggaugcaaua

SEQ ID NO: 959587 - RNA, 19 nt, Homo sapiens
gaaaccagaagaugcaaag

SEQ ID NO: 959588 - RNA, 19 nt, Homo sapiens
cuuuguaguugcuuuguaa

SEQ ID NO: 959589 - RNA, 19 nt, Homo sapiens
gagggaggaucacuugaac

SEQ ID NO: 959590 - RNA, 19 nt, Homo sapiens
ccuauaaucccagcacuuu

SEQ ID NO: 959591 - RNA, 19 nt, Homo sapiens
gcucauguagacaggguua

SEQ ID NO: 959592 - RNA, 19 nt, Homo sapiens
caacccuacuggaaacuca

SEQ ID NO: 959593 - RNA, 19 nt, Homo sapiens
ucauuaauccuggagauaa

SEQ ID NO: 959594 - RNA, 19 nt, Homo sapiens
uaagguguuugaaaugauc

SEQ ID NO: 959595 - RNA, 19 nt, Homo sapiens
auaauccacuuaggcauuu

SEQ ID NO: 959596 - RNA, 19 nt, Homo sapiens
ggacuugacgaggcucuuu

SEQ ID NO: 959597 - RNA, 19 nt, Homo sapiens
ggcaacaacccuacuggaa

SEQ ID NO: 959598 - RNA, 19 nt, Homo sapiens
gcaaagaauccccagaaaa

SEQ ID NO: 959599 - RNA, 19 nt, Homo sapiens
caaauggaucuauguguca

SEQ ID NO: 959600 - RNA, 19 nt, Homo sapiens
ucacuugaacccaggaauu

SEQ ID NO: 959601 - RNA, 19 nt, Homo sapiens
cccauaaauugucuuugaa

SEQ ID NO: 959602 - RNA, 19 nt, Homo sapiens
guucaggguaccaacauuu

SEQ ID NO: 959603 - RNA, 19 nt, Homo sapiens
cguaaucacuguagaaaau

SEQ ID NO: 959604 - RNA, 19 nt, Homo sapiens
uauaauccacuuaggcauu

SEQ ID NO: 959605 - RNA, 19 nt, Homo sapiens
guauuaaugcucccuggaa

SEQ ID NO: 959606 - RNA, 19 nt, Homo sapiens
uaccaaauccaaacauguu

SEQ ID NO: 959607 - RNA, 19 nt, Homo sapiens
cucaaccacugaagaagaa

SEQ ID NO: 959608 - RNA, 19 nt, Homo sapiens
accagaagaugcaaagaau

SEQ ID NO: 959609 - RNA, 19 nt, Homo sapiens
augcuuggcugucagaaga

SEQ ID NO: 959610 - RNA, 19 nt, Homo sapiens
acaggguuauugauuucua

SEQ ID NO: 959611 - RNA, 19 nt, Homo sapiens
ggaaaccagaagaugcaaa

SEQ ID NO: 959612 - RNA, 19 nt, Homo sapiens
gaauucaggcugcaguaag

SEQ ID NO: 959613 - RNA, 19 nt, Homo sapiens
caugauaucacagcuucua

SEQ ID NO: 959614 - RNA, 19 nt, Homo sapiens
gaaaggaucuaacgggauu

SEQ ID NO: 959615 - RNA, 19 nt, Homo sapiens
gcagaagccuuauggauug

SEQ ID NO: 959616 - RNA, 19 nt, Homo sapiens
ugaaguaacugaagaagaa

SEQ ID NO: 959617 - RNA, 19 nt, Homo sapiens
caaagaagguccuaguuau

SEQ ID NO: 959618 - RNA, 19 nt, Homo sapiens
gaaaucaaauguuccuuca

SEQ ID NO: 959619 - RNA, 19 nt, Homo sapiens
cauacaggauucuuuguua

SEQ ID NO: 959620 - RNA, 19 nt, Homo sapiens
uauuugaccuggaaaguua

SEQ ID NO: 959621 - RNA, 19 nt, Homo sapiens
ccaaagaagguccuaguua

SEQ ID NO: 959622 - RNA, 19 nt, Homo sapiens
ggaacaggcuucacaccaa

SEQ ID NO: 959623 - RNA, 19 nt, Homo sapiens
gaacgucccuucccagucu

SEQ ID NO: 959624 - RNA, 19 nt, Homo sapiens
gagcugucauuguccuuua

SEQ ID NO: 959625 - RNA, 19 nt, Homo sapiens
aagcugauguucuucaaua

SEQ ID NO: 959626 - RNA, 19 nt, Homo sapiens
aaacagggcagaagccuua

SEQ ID NO: 959627 - RNA, 19 nt, Homo sapiens
ggauaucaauuuagacuca

SEQ ID NO: 959628 - RNA, 19 nt, Homo sapiens
gaacaggcuucacaccaau

SEQ ID NO: 959629 - RNA, 19 nt, Homo sapiens
gaagauguuacucaugaua

SEQ ID NO: 959630 - RNA, 19 nt, Homo sapiens
cagauacacuugccaaaga

SEQ ID NO: 959631 - RNA, 19 nt, Homo sapiens
caccagcucuucuuucuga

SEQ ID NO: 959632 - RNA, 19 nt, Homo sapiens
cuacagaaagugccaguua

SEQ ID NO: 959633 - RNA, 19 nt, Homo sapiens
gaauacuucuugggacuuu

SEQ ID NO: 959634 - RNA, 19 nt, Homo sapiens
uggagaagaugaacuaaug

SEQ ID NO: 959635 - RNA, 19 nt, Homo sapiens
gcccuuauauggaguauca

SEQ ID NO: 959636 - RNA, 19 nt, Homo sapiens
acaaauacauacaggauuc

SEQ ID NO: 959637 - RNA, 19 nt, Homo sapiens
aagacuggauguugaauuu

SEQ ID NO: 959638 - RNA, 19 nt, Homo sapiens
gccaugagguucaggaaga

SEQ ID NO: 959639 - RNA, 19 nt, Homo sapiens
gaguaagguugcugcauga

SEQ ID NO: 959640 - RNA, 19 nt, Homo sapiens
agaaagugccaguuaauuu

SEQ ID NO: 959641 - RNA, 19 nt, Homo sapiens
uaaaccugcuguucugaaa

SEQ ID NO: 959642 - RNA, 19 nt, Homo sapiens
ugaauuaugcuuugacuga

SEQ ID NO: 959643 - RNA, 19 nt, Homo sapiens
aggaagauguuacucauga

SEQ ID NO: 959644 - RNA, 19 nt, Homo sapiens
caaggaagauguuacucau

SEQ ID NO: 959645 - RNA, 19 nt, Homo sapiens
gcauaagagguuucguuua

SEQ ID NO: 959646 - RNA, 19 nt, Homo sapiens
gcagcaggaucagauggua

SEQ ID NO: 959647 - RNA, 19 nt, Homo sapiens
ggcagaagccuuauggauu

SEQ ID NO: 959648 - RNA, 19 nt, Homo sapiens
uauccaaguuccaagaauu

SEQ ID NO: 959649 - RNA, 19 nt, Homo sapiens
ggacaaauccaaaguucuc

SEQ ID NO: 959650 - RNA, 19 nt, Homo sapiens
gcaaacagggacauauuuc

SEQ ID NO: 959651 - RNA, 19 nt, Homo sapiens
gagguuucguuuauaaugu

SEQ ID NO: 959652 - RNA, 19 nt, Homo sapiens
caacaaauacauacaggau

SEQ ID NO: 959653 - RNA, 19 nt, Homo sapiens
cagaaauaguaaagccaua

SEQ ID NO: 959654 - RNA, 19 nt, Homo sapiens
uacagaaagugccaguuaa

SEQ ID NO: 959655 - RNA, 19 nt, Homo sapiens
gcagaaacaauuauuaagg

SEQ ID NO: 959656 - RNA, 19 nt, Homo sapiens
gaacuuaagaaacacaaca

SEQ ID NO: 959657 - RNA, 19 nt, Homo sapiens
gaagaagaacuuaagaaac

SEQ ID NO: 959658 - RNA, 19 nt, Homo sapiens
caaggaaagauacagguuu

SEQ ID NO: 959659 - RNA, 19 nt, Homo sapiens
ccauugccauauauacuaa

SEQ ID NO: 959660 - RNA, 19 nt, Homo sapiens
aaucaaauguuccuucagu

SEQ ID NO: 959661 - RNA, 19 nt, Homo sapiens
ggaaagugaagcugauguu

SEQ ID NO: 959662 - RNA, 19 nt, Homo sapiens
ggauaugcauaagagguuu

SEQ ID NO: 959663 - RNA, 19 nt, Homo sapiens
cagguaacuucuuggcuuu

SEQ ID NO: 959664 - RNA, 19 nt, Homo sapiens
gcugcaugaucucaacuuu

SEQ ID NO: 959665 - RNA, 19 nt, Homo sapiens
uaagguugcugcaugaucu

SEQ ID NO: 959666 - RNA, 19 nt, Homo sapiens
aaggaaagauacagguuug

SEQ ID NO: 959667 - RNA, 19 nt, Homo sapiens
guuccaaacagacucuuua

SEQ ID NO: 959668 - RNA, 19 nt, Homo sapiens
aaaggcagguuaauugaag

SEQ ID NO: 959669 - RNA, 19 nt, Homo sapiens
cagcucuucuuucugaauu

SEQ ID NO: 959670 - RNA, 19 nt, Homo sapiens
cagcaccuauuucugaaug

SEQ ID NO: 959671 - RNA, 19 nt, Homo sapiens
gaauuaugcuuugacugau

SEQ ID NO: 959672 - RNA, 19 nt, Homo sapiens
aaaguucucgucugcauuu

SEQ ID NO: 959673 - RNA, 19 nt, Homo sapiens
ccaaaguucucgucugcau

SEQ ID NO: 959674 - RNA, 19 nt, Homo sapiens
ggcaaacagggacauauuu

SEQ ID NO: 959675 - RNA, 19 nt, Homo sapiens
uaccucaagcuaccuauua

SEQ ID NO: 959676 - RNA, 19 nt, Homo sapiens
cauuaaaccugcuguucug

SEQ ID NO: 959677 - RNA, 19 nt, Homo sapiens
caguacagguaacuucuug

SEQ ID NO: 959678 - RNA, 19 nt, Homo sapiens
gaauccagccuucaguuuc

SEQ ID NO: 959679 - RNA, 19 nt, Homo sapiens
gcaccuauuucugaaugga

SEQ ID NO: 959680 - RNA, 19 nt, Homo sapiens
gacuggauguugaauuugu

SEQ ID NO: 959681 - RNA, 19 nt, Homo sapiens
ggagaagccaauuggagaa

SEQ ID NO: 959682 - RNA, 19 nt, Homo sapiens
ccaccaagcacucaucuuc

SEQ ID NO: 959683 - RNA, 19 nt, Homo sapiens
guucaucguugggucaauu

SEQ ID NO: 959684 - RNA, 19 nt, Homo sapiens
ggagaagaugaacuaauga

SEQ ID NO: 959685 - RNA, 19 nt, Homo sapiens
caaguuccaagaauuagaa

SEQ ID NO: 959686 - RNA, 19 nt, Homo sapiens
ggaagauguuacucaugau

SEQ ID NO: 959687 - RNA, 19 nt, Homo sapiens
gcugaaagaaugccugguu

SEQ ID NO: 959688 - RNA, 19 nt, Homo sapiens
acaggauucuuuguuauga

SEQ ID NO: 959689 - RNA, 19 nt, Homo sapiens
uaacuucuuggcuuucuuu

SEQ ID NO: 959690 - RNA, 19 nt, Homo sapiens
aagugaagcugauguucuu

SEQ ID NO: 959691 - RNA, 19 nt, Homo sapiens
uuuauaaugucagcccuua

SEQ ID NO: 959692 - RNA, 19 nt, Homo sapiens
gcaacauguuuaccucaag

SEQ ID NO: 959693 - RNA, 19 nt, Homo sapiens
gaaagugaagcugauguuc

SEQ ID NO: 959694 - RNA, 19 nt, Homo sapiens
ggcaacauguuuaccucaa

SEQ ID NO: 959695 - RNA, 19 nt, Homo sapiens
auacgaggcuuuucuguuu

SEQ ID NO: 959696 - RNA, 19 nt, Homo sapiens
gaugauuguuggauaugca

SEQ ID NO: 959697 - RNA, 19 nt, Homo sapiens
gcugauguucuucaauaaa

SEQ ID NO: 959698 - RNA, 19 nt, Homo sapiens
ccaguucuucccaacaaua

SEQ ID NO: 959699 - RNA, 19 nt, Homo sapiens
ccauugggcaacauguuua

SEQ ID NO: 959700 - RNA, 19 nt, Homo sapiens
ccaaggaagauguuacuca

SEQ ID NO: 959701 - RNA, 19 nt, Homo sapiens
gagagcagcaggaucagau

SEQ ID NO: 959702 - RNA, 19 nt, Homo sapiens
gcacuuguguuuuaugaca

SEQ ID NO: 959703 - RNA, 19 nt, Homo sapiens
gaccagugccauuuacaga

SEQ ID NO: 959704 - RNA, 19 nt, Homo sapiens
caaacagggacauauuuca

SEQ ID NO: 959705 - RNA, 19 nt, Homo sapiens
accuguaucugguuccuua

SEQ ID NO: 959706 - RNA, 19 nt, Homo sapiens
cagaaagugccaguuaauu

SEQ ID NO: 959707 - RNA, 19 nt, Homo sapiens
gggcagaagccuuauggau

SEQ ID NO: 959708 - RNA, 19 nt, Homo sapiens
gauaaaagacuggauguug

SEQ ID NO: 959709 - RNA, 19 nt, Homo sapiens
gccuucaguuucuuaaaug

SEQ ID NO: 959710 - RNA, 19 nt, Homo sapiens
gagaagccaauuggagaaa

SEQ ID NO: 959711 - RNA, 19 nt, Homo sapiens
agauacacuugccaaagaa

SEQ ID NO: 959712 - RNA, 19 nt, Homo sapiens
aauccaugcugaaagaaug

SEQ ID NO: 959713 - RNA, 19 nt, Homo sapiens
guucucgucugcauuugug

SEQ ID NO: 959714 - RNA, 19 nt, Homo sapiens
ccacaagggugacaucaua

SEQ ID NO: 959715 - RNA, 19 nt, Homo sapiens
gcacagagacucaugaauu

SEQ ID NO: 959716 - RNA, 19 nt, Homo sapiens
gcauacagcuuugcagaua

SEQ ID NO: 959717 - RNA, 19 nt, Homo sapiens
gcagauauccuguuuguga

SEQ ID NO: 959718 - RNA, 19 nt, Homo sapiens
gaagagauaugugcugaga

SEQ ID NO: 959719 - RNA, 19 nt, Homo sapiens
ggauaaacauuccagagaa

SEQ ID NO: 959720 - RNA, 19 nt, Homo sapiens
ggaggagucuggugaaguu

SEQ ID NO: 959721 - RNA, 19 nt, Homo sapiens
gauaaacauuccagagaaa

SEQ ID NO: 959722 - RNA, 19 nt, Homo sapiens
acaaguaccuucucaaguu

SEQ ID NO: 959723 - RNA, 19 nt, Homo sapiens
ccaaaguacuugacucuga

SEQ ID NO: 959724 - RNA, 19 nt, Homo sapiens
ggaauuaccacaucuucua

SEQ ID NO: 959725 - RNA, 19 nt, Homo sapiens
gaagacagcaggauaaaca

SEQ ID NO: 959726 - RNA, 19 nt, Homo sapiens
ggaacuacaucgugcagaa

SEQ ID NO: 959727 - RNA, 19 nt, Homo sapiens
gcuggaggcugcuguauau

SEQ ID NO: 959728 - RNA, 19 nt, Homo sapiens
guacauccgugagcagaua

SEQ ID NO: 959729 - RNA, 19 nt, Homo sapiens
aaacagaaccagugcauaa

SEQ ID NO: 959730 - RNA, 19 nt, Homo sapiens
gaacuggccucugccuuug

SEQ ID NO: 959731 - RNA, 19 nt, Homo sapiens
gaauguuacugccaaguug

SEQ ID NO: 959732 - RNA, 19 nt, Homo sapiens
ucaaguuugugucugauua

SEQ ID NO: 959733 - RNA, 19 nt, Homo sapiens
gaacccauaccaaauguuu

SEQ ID NO: 959734 - RNA, 19 nt, Homo sapiens
ucaagacccugguagauga

SEQ ID NO: 959735 - RNA, 19 nt, Homo sapiens
gaccacaccuuccuacaga

SEQ ID NO: 959736 - RNA, 19 nt, Homo sapiens
ggacagcgaccuaugagaa

SEQ ID NO: 959737 - RNA, 19 nt, Homo sapiens
caaguaccuucucaaguuu

SEQ ID NO: 959738 - RNA, 19 nt, Homo sapiens
gaacggaaccucaucuaca

SEQ ID NO: 959739 - RNA, 19 nt, Homo sapiens
gcagaaggcaggaccauga

SEQ ID NO: 959740 - RNA, 19 nt, Homo sapiens
ggaaaagccuucuuggaaa

SEQ ID NO: 959741 - RNA, 19 nt, Homo sapiens
gagaaugagcuauauguga

SEQ ID NO: 959742 - RNA, 19 nt, Homo sapiens
gaaggagccaggucucuuu

SEQ ID NO: 959743 - RNA, 19 nt, Homo sapiens
cacagagacucaugaauug

SEQ ID NO: 959744 - RNA, 19 nt, Homo sapiens
ccacacagcagaucaagaa

SEQ ID NO: 959745 - RNA, 19 nt, Homo sapiens
ggaacaagaugcacuccau

SEQ ID NO: 959746 - RNA, 19 nt, Homo sapiens
gaaaagccuucuuggaaaa

SEQ ID NO: 959747 - RNA, 19 nt, Homo sapiens
uagaggagaugaauuaugg

SEQ ID NO: 959748 - RNA, 19 nt, Homo sapiens
cuccguggcuucuucauua

SEQ ID NO: 959749 - RNA, 19 nt, Homo sapiens
agaagacgcugucggagaa

SEQ ID NO: 959750 - RNA, 19 nt, Homo sapiens
cacagcagaucaagaauau

SEQ ID NO: 959751 - RNA, 19 nt, Homo sapiens
ggaggcagcaguaguggua

SEQ ID NO: 959752 - RNA, 19 nt, Homo sapiens
gcacaugcccaaaguacuu

SEQ ID NO: 959753 - RNA, 19 nt, Homo sapiens
gaagacccauccugaacug

SEQ ID NO: 959754 - RNA, 19 nt, Homo sapiens
gaagaaggacucugacuac

SEQ ID NO: 959755 - RNA, 19 nt, Homo sapiens
gcaaagucaugccaaacau

SEQ ID NO: 959756 - RNA, 19 nt, Homo sapiens
caaacgagaaccuucagua

SEQ ID NO: 959757 - RNA, 19 nt, Homo sapiens
gagcagcuguguauuaacu

SEQ ID NO: 959758 - RNA, 19 nt, Homo sapiens
gaaagagcgaugcagauga

SEQ ID NO: 959759 - RNA, 19 nt, Homo sapiens
ggaaccucaucuacacaua

SEQ ID NO: 959760 - RNA, 19 nt, Homo sapiens
gggcgaguauuaugacuau

SEQ ID NO: 959761 - RNA, 19 nt, Homo sapiens
ggacgugguggaagagaua

SEQ ID NO: 959762 - RNA, 19 nt, Homo sapiens
agagguggcuggagacauu

SEQ ID NO: 959763 - RNA, 19 nt, Homo sapiens
ggacauuagcauugaguuu

SEQ ID NO: 959764 - RNA, 19 nt, Homo sapiens
gacgugggcugcuucaaug

SEQ ID NO: 959765 - RNA, 19 nt, Homo sapiens
cgugaucucuggugccaua

SEQ ID NO: 959766 - RNA, 19 nt, Homo sapiens
ggaaguuuguggaaaucuu

SEQ ID NO: 959767 - RNA, 19 nt, Homo sapiens
ggagucggcuucggccuuu

SEQ ID NO: 959768 - RNA, 19 nt, Homo sapiens
uaacagagaguaagcacuu

SEQ ID NO: 959769 - RNA, 19 nt, Homo sapiens
agagauaugugcugagaug

SEQ ID NO: 959770 - RNA, 19 nt, Homo sapiens
cagcagaucaagaauauug

SEQ ID NO: 959771 - RNA, 19 nt, Homo sapiens
ccacaauggccucaacuuu

SEQ ID NO: 959772 - RNA, 19 nt, Homo sapiens
ugaagcagaucacagacaa

SEQ ID NO: 959773 - RNA, 19 nt, Homo sapiens
gcgggaaaguguucaugaa

SEQ ID NO: 959774 - RNA, 19 nt, Homo sapiens
ggacagcaacccaccaaga

SEQ ID NO: 959775 - RNA, 19 nt, Homo sapiens
ggaggaagaugaggagaag

SEQ ID NO: 959776 - RNA, 19 nt, Homo sapiens
gagagcauguccugaaucu

SEQ ID NO: 959777 - RNA, 19 nt, Homo sapiens
ggaaagagcgaugcagaug

SEQ ID NO: 959778 - RNA, 19 nt, Homo sapiens
gaaccagggugggaacugu

SEQ ID NO: 959779 - RNA, 19 nt, Homo sapiens
gauggaagacagcaggaua

SEQ ID NO: 959780 - RNA, 19 nt, Homo sapiens
gaaagaugaguaggaguuu

SEQ ID NO: 959781 - RNA, 19 nt, Homo sapiens
gauuucuggucuuugguua

SEQ ID NO: 959782 - RNA, 19 nt, Homo sapiens
gcccuuacauguccuccua

SEQ ID NO: 959783 - RNA, 19 nt, Homo sapiens
caaaguacuugacucugau

SEQ ID NO: 959784 - RNA, 19 nt, Homo sapiens
gagcgaugcagaugacuuu

SEQ ID NO: 959785 - RNA, 19 nt, Homo sapiens
gaaguuuguggaaaucuuu

SEQ ID NO: 959786 - RNA, 19 nt, Homo sapiens
ggaguuugcuaagaauaga

SEQ ID NO: 959787 - RNA, 19 nt, Homo sapiens
ggucuuugguuauuucugu

SEQ ID NO: 959788 - RNA, 19 nt, Homo sapiens
acucuacgcucaacucuga

SEQ ID NO: 959789 - RNA, 19 nt, Homo sapiens
ucaucucacugaagccuua

SEQ ID NO: 959790 - RNA, 19 nt, Homo sapiens
ggagaagaaagccaagaaa

SEQ ID NO: 959791 - RNA, 19 nt, Homo sapiens
gaaccucucaggaucaaug

SEQ ID NO: 959792 - RNA, 19 nt, Homo sapiens
cacccaagaucuccaagaa

SEQ ID NO: 959793 - RNA, 19 nt, Homo sapiens
acaaguuccuggacaagaa

SEQ ID NO: 959794 - RNA, 19 nt, Homo sapiens
gaaccagugcauaaucauu

SEQ ID NO: 959795 - RNA, 19 nt, Homo sapiens
cagaaccagugcauaauca

SEQ ID NO: 959796 - RNA, 19 nt, Homo sapiens
gcccugaggccuucaauga

SEQ ID NO: 959797 - RNA, 19 nt, Homo sapiens
ggacgugggcugcuucaau

SEQ ID NO: 959798 - RNA, 19 nt, Homo sapiens
ggacaagaaccacgaccaa

SEQ ID NO: 959799 - RNA, 19 nt, Homo sapiens
ggaggaugccuaacagaga

SEQ ID NO: 959800 - RNA, 19 nt, Homo sapiens
caagaagacccauccugaa

SEQ ID NO: 959801 - RNA, 19 nt, Homo sapiens
caggaaggauggcgggaaa

SEQ ID NO: 959802 - RNA, 19 nt, Homo sapiens
ggacucggaugaggacaug

SEQ ID NO: 959803 - RNA, 19 nt, Homo sapiens
gagaucaccuuugcugaca

SEQ ID NO: 959804 - RNA, 19 nt, Homo sapiens
gcugagaccuacuacuauc

SEQ ID NO: 959805 - RNA, 19 nt, Homo sapiens
ugagaagccugaagaagag

SEQ ID NO: 959806 - RNA, 19 nt, Homo sapiens
gagcagcaaggcauggaua

SEQ ID NO: 959807 - RNA, 19 nt, Homo sapiens
gauguacccuacuuugauc

SEQ ID NO: 959808 - RNA, 19 nt, Homo sapiens
gcaggaggagcaacucaaa

SEQ ID NO: 959809 - RNA, 19 nt, Homo sapiens
caagauggccaccgacaug

SEQ ID NO: 959810 - RNA, 19 nt, Homo sapiens
gaaguuccggucccuggua

SEQ ID NO: 959811 - RNA, 19 nt, Homo sapiens
cgagaggaauuaccacauc

SEQ ID NO: 959812 - RNA, 19 nt, Homo sapiens
cggagcaggugcagcagua

SEQ ID NO: 959813 - RNA, 19 nt, Homo sapiens
aguaggaguuugcuaagaa

SEQ ID NO: 959814 - RNA, 19 nt, Homo sapiens
acaaauaacuggagucaaa

SEQ ID NO: 959815 - RNA, 19 nt, Homo sapiens
ggaaacagcugccaaaugc

SEQ ID NO: 959816 - RNA, 19 nt, Homo sapiens
gcacauuucuggacuacaa

SEQ ID NO: 959817 - RNA, 19 nt, Homo sapiens
caacaugucuguguccuaa

SEQ ID NO: 959818 - RNA, 19 nt, Homo sapiens
acaaauggcagcaauaaua

SEQ ID NO: 959819 - RNA, 19 nt, Homo sapiens
gccaaaagcugauuacaua

SEQ ID NO: 959820 - RNA, 19 nt, Homo sapiens
gagagaauguacccacaaa

SEQ ID NO: 959821 - RNA, 19 nt, Homo sapiens
caaauggcagcaauaauaa

SEQ ID NO: 959822 - RNA, 19 nt, Homo sapiens
gaaauuggagauguuagua

SEQ ID NO: 959823 - RNA, 19 nt, Homo sapiens
gagacugacugccuaugaa

SEQ ID NO: 959824 - RNA, 19 nt, Homo sapiens
gcagaaauuggagauguua

SEQ ID NO: 959825 - RNA, 19 nt, Homo sapiens
gagaauguacccacaaaug

SEQ ID NO: 959826 - RNA, 19 nt, Homo sapiens
acuucaagcucucuaaaua

SEQ ID NO: 959827 - RNA, 19 nt, Homo sapiens
ugaacuggcugccuuacaa

SEQ ID NO: 959828 - RNA, 19 nt, Homo sapiens
gaaggugaaggcagaaauu

SEQ ID NO: 959829 - RNA, 19 nt, Homo sapiens
caaguuugcugcuguugga

SEQ ID NO: 959830 - RNA, 19 nt, Homo sapiens
ccacaaauggcagcaauaa

SEQ ID NO: 959831 - RNA, 19 nt, Homo sapiens
gcaggaggauguccagaag

SEQ ID NO: 959832 - RNA, 19 nt, Homo sapiens
cacaagauccucagauuga

SEQ ID NO: 959833 - RNA, 19 nt, Homo sapiens
gcaauaagcaccuaguuuu

SEQ ID NO: 959834 - RNA, 19 nt, Homo sapiens
uaacaacauuggaaaggau

SEQ ID NO: 959835 - RNA, 19 nt, Homo sapiens
uaaggagaauugagagaau

SEQ ID NO: 959836 - RNA, 19 nt, Homo sapiens
ggaggaaacagcugccaaa

SEQ ID NO: 959837 - RNA, 19 nt, Homo sapiens
agaggugacuuuaaggaaa

SEQ ID NO: 959838 - RNA, 19 nt, Homo sapiens
acagagaaauaccuuuaga

SEQ ID NO: 959839 - RNA, 19 nt, Homo sapiens
ggauacacguguugcaagu

SEQ ID NO: 959840 - RNA, 19 nt, Homo sapiens
ucuaauagugccagaauuu

SEQ ID NO: 959841 - RNA, 19 nt, Homo sapiens
cguaaacacuggcuucauc

SEQ ID NO: 959842 - RNA, 19 nt, Homo sapiens
gaacuggcugccuuacaaa

SEQ ID NO: 959843 - RNA, 19 nt, Homo sapiens
uacacaagauccucagauu

SEQ ID NO: 959844 - RNA, 19 nt, Homo sapiens
uuacagcucugcaaagaag

SEQ ID NO: 959845 - RNA, 19 nt, Homo sapiens
ggauauaaauaagcaugga

SEQ ID NO: 959846 - RNA, 19 nt, Homo sapiens
ggagacugacugccuauga

SEQ ID NO: 959847 - RNA, 19 nt, Homo sapiens
gaaacuucaagcucucuaa

SEQ ID NO: 959848 - RNA, 19 nt, Homo sapiens
agaucgagcuacccucuaa

SEQ ID NO: 959849 - RNA, 19 nt, Homo sapiens
aaauaaugcugguguaguc

SEQ ID NO: 959850 - RNA, 19 nt, Homo sapiens
ugaaauuucuucuggacau

SEQ ID NO: 959851 - RNA, 19 nt, Homo sapiens
caaaagggaugaaauuucu

SEQ ID NO: 959852 - RNA, 19 nt, Homo sapiens
uggcucaccugaaggcuuu

SEQ ID NO: 959853 - RNA, 19 nt, Homo sapiens
uacuaccacuuguucuuua

SEQ ID NO: 959854 - RNA, 19 nt, Homo sapiens
gcuguuggauuucauaaaa

SEQ ID NO: 959855 - RNA, 19 nt, Homo sapiens
gggagaagcaggaggaugu

SEQ ID NO: 959856 - RNA, 19 nt, Homo sapiens
ggcagaaauuggagauguu

SEQ ID NO: 959857 - RNA, 19 nt, Homo sapiens
agagauaccucacauucca

SEQ ID NO: 959858 - RNA, 19 nt, Homo sapiens
ugaauaucaugaacucuca

SEQ ID NO: 959859 - RNA, 19 nt, Homo sapiens
gauuuaaggagaauugaga

SEQ ID NO: 959860 - RNA, 19 nt, Homo sapiens
cuagugguauuucacaaug

SEQ ID NO: 959861 - RNA, 19 nt, Homo sapiens
ugacugagcagaagaugau

SEQ ID NO: 959862 - RNA, 19 nt, Homo sapiens
acaugucuguguccuaauu

SEQ ID NO: 959863 - RNA, 19 nt, Homo sapiens
cuggcugccuuacaaauaa

SEQ ID NO: 959864 - RNA, 19 nt, Homo sapiens
gggacugggugccaagguu

SEQ ID NO: 959865 - RNA, 19 nt, Homo sapiens
gaaauuucuucuggacauc

SEQ ID NO: 959866 - RNA, 19 nt, Homo sapiens
gaggauguccagaagaaau

SEQ ID NO: 959867 - RNA, 19 nt, Homo sapiens
aggaggauguccagaagaa

SEQ ID NO: 959868 - RNA, 19 nt, Homo sapiens
gcaaccgagaagauauuua

SEQ ID NO: 959869 - RNA, 19 nt, Homo sapiens
uugaugcaguuauuggaua

SEQ ID NO: 959870 - RNA, 19 nt, Homo sapiens
aaacacuggcuucaucaaa

SEQ ID NO: 959871 - RNA, 19 nt, Homo sapiens
caaccgagaagauauuuac

SEQ ID NO: 959872 - RNA, 19 nt, Homo sapiens
gcagcaaccgagaagauau

SEQ ID NO: 959873 - RNA, 19 nt, Homo sapiens
cugcaaugacgaagaauaa

SEQ ID NO: 959874 - RNA, 19 nt, Homo sapiens
caagauccucagauugaaa

SEQ ID NO: 959875 - RNA, 19 nt, Homo sapiens
ggugaaggcagaaauugga

SEQ ID NO: 959876 - RNA, 19 nt, Homo sapiens
cugguucucugggauauaa

SEQ ID NO: 959877 - RNA, 19 nt, Homo sapiens
ugaaggcuuugcaaaauuu

SEQ ID NO: 959878 - RNA, 19 nt, Homo sapiens
cuuuggcagucuucauuua

SEQ ID NO: 959879 - RNA, 19 nt, Homo sapiens
ugcaugggauucugacuga

SEQ ID NO: 959880 - RNA, 19 nt, Homo sapiens
ggaacccgaggaaguggua

SEQ ID NO: 959881 - RNA, 19 nt, Homo sapiens
guuugcugcuguuggauuu

SEQ ID NO: 959882 - RNA, 19 nt, Homo sapiens
gaggugacuuuaaggaaaa

SEQ ID NO: 959883 - RNA, 19 nt, Homo sapiens
gagcguuuccuggcaguuu

SEQ ID NO: 959884 - RNA, 19 nt, Homo sapiens
aaacagcugccaaaugcaa

SEQ ID NO: 959885 - RNA, 19 nt, Homo sapiens
cuucaagcucucuaaauaa

SEQ ID NO: 959886 - RNA, 19 nt, Homo sapiens
aagaauaaccauggccaua

SEQ ID NO: 959887 - RNA, 19 nt, Homo sapiens
ccacaaaagggaugaaauu

SEQ ID NO: 959888 - RNA, 19 nt, Homo sapiens
uaaugcugguguagucuau

SEQ ID NO: 959889 - RNA, 19 nt, Homo sapiens
gaaggcagaaauuggagau

SEQ ID NO: 959890 - RNA, 19 nt, Homo sapiens
ccuaugaauuugcuaaacu

SEQ ID NO: 959891 - RNA, 19 nt, Homo sapiens
gcagcaauaauaaauggau

SEQ ID NO: 959892 - RNA, 19 nt, Homo sapiens
gguuucauccuacccauug

SEQ ID NO: 959893 - RNA, 19 nt, Homo sapiens
gagcuacccucuaaaagca

SEQ ID NO: 959894 - RNA, 19 nt, Homo sapiens
uggcagucuucauuuacua

SEQ ID NO: 959895 - RNA, 19 nt, Homo sapiens
aaugaaagcgcaauaagca

SEQ ID NO: 959896 - RNA, 19 nt, Homo sapiens
uuaacaacauuggaaagga

SEQ ID NO: 959897 - RNA, 19 nt, Homo sapiens
guaaacacuggcuucauca

SEQ ID NO: 959898 - RNA, 19 nt, Homo sapiens
cauaaaacuuugacagaug

SEQ ID NO: 959899 - RNA, 19 nt, Homo sapiens
acaagauccucagauugaa

SEQ ID NO: 959900 - RNA, 19 nt, Homo sapiens
aguaaauaaugcuggugua

SEQ ID NO: 959901 - RNA, 19 nt, Homo sapiens
cagcaaccgagaagauauu

SEQ ID NO: 959902 - RNA, 19 nt, Homo sapiens
ggagaauugagagaaugua

SEQ ID NO: 959903 - RNA, 19 nt, Homo sapiens
acacguguugcaaguauaa

SEQ ID NO: 959904 - RNA, 19 nt, Homo sapiens
aaacuucaagcucucuaaa

SEQ ID NO: 959905 - RNA, 19 nt, Homo sapiens
cgcaauaagcaccuaguuu

SEQ ID NO: 959906 - RNA, 19 nt, Homo sapiens
ugaugcaguuauuggauau

SEQ ID NO: 959907 - RNA, 19 nt, Homo sapiens
ggacuacaaaggcauuucu

SEQ ID NO: 959908 - RNA, 19 nt, Homo sapiens
acacaagauccucagauug

SEQ ID NO: 959909 - RNA, 19 nt, Homo sapiens
uacaggagcugggcaugga

SEQ ID NO: 959910 - RNA, 19 nt, Homo sapiens
uggcagcaauaauaaaugg

SEQ ID NO: 959911 - RNA, 19 nt, Homo sapiens
cuuacuggcuuacuguuca

SEQ ID NO: 959912 - RNA, 19 nt, Homo sapiens
cagauuuguuugcuacaca

SEQ ID NO: 959913 - RNA, 19 nt, Homo sapiens
ccuacucuuucugguguua

SEQ ID NO: 959914 - RNA, 19 nt, Homo sapiens
cgauaucccuuccugauuu

SEQ ID NO: 959915 - RNA, 19 nt, Homo sapiens
ugaagacccugguuucuga

SEQ ID NO: 959916 - RNA, 19 nt, Homo sapiens
gaaagaggcccagaguaga

SEQ ID NO: 959917 - RNA, 19 nt, Homo sapiens
ggaaguccagccucuauug

SEQ ID NO: 959918 - RNA, 19 nt, Homo sapiens
ggacguacaccuugaccaa

SEQ ID NO: 959919 - RNA, 19 nt, Homo sapiens
ucaggaagaugaugugaag

SEQ ID NO: 959920 - RNA, 19 nt, Homo sapiens
ugaaagaggcccagaguag

SEQ ID NO: 959921 - RNA, 19 nt, Homo sapiens
ggaugaaaguccauauggu

SEQ ID NO: 959922 - RNA, 19 nt, Homo sapiens
gaaguccagccucuauuga

SEQ ID NO: 959923 - RNA, 19 nt, Homo sapiens
uaacagccaugaccaaagc

SEQ ID NO: 959924 - RNA, 19 nt, Homo sapiens
gauaucccuuccugauuuc

SEQ ID NO: 959925 - RNA, 19 nt, Homo sapiens
gagaccauccgccgauuug

SEQ ID NO: 959926 - RNA, 19 nt, Homo sapiens
gaugugaagacccugguuu

SEQ ID NO: 959927 - RNA, 19 nt, Homo sapiens
ugauuucucucauuucuac

SEQ ID NO: 959928 - RNA, 19 nt, Homo sapiens
gcggaagagucaagggaau

SEQ ID NO: 959929 - RNA, 19 nt, Homo sapiens
ccaggcaguucccuaugug

SEQ ID NO: 959930 - RNA, 19 nt, Homo sapiens
ucaagggaaugucaucaac

SEQ ID NO: 959931 - RNA, 19 nt, Homo sapiens
caaacuccaaccuguauca

SEQ ID NO: 959932 - RNA, 19 nt, Homo sapiens
gaguagagagagagagaga

SEQ ID NO: 959933 - RNA, 19 nt, Homo sapiens
agagagagagaccgacgua

SEQ ID NO: 959934 - RNA, 19 nt, Homo sapiens
uuccugauuucucucauuu

SEQ ID NO: 959935 - RNA, 19 nt, Homo sapiens
ggaagagucaagggaaugu

SEQ ID NO: 959936 - RNA, 19 nt, Homo sapiens
gugaaagaggcccagagua

SEQ ID NO: 959937 - RNA, 19 nt, Homo sapiens
ccugauuucucucauuucu

SEQ ID NO: 959938 - RNA, 19 nt, Homo sapiens
acuccaaccuguaucagau

SEQ ID NO: 959939 - RNA, 19 nt, Homo sapiens
cagaguagagagagagaga

SEQ ID NO: 959940 - RNA, 19 nt, Homo sapiens
ggugaaagaggcccagagu

SEQ ID NO: 959941 - RNA, 19 nt, Homo sapiens
cccuggagcugucuuuauc

SEQ ID NO: 959942 - RNA, 19 nt, Homo sapiens
ugaugugacucaggaagau

SEQ ID NO: 959943 - RNA, 19 nt, Homo sapiens
cccaggcaguucccuaugu

SEQ ID NO: 959944 - RNA, 19 nt, Homo sapiens
caagggaaugucaucaaca

SEQ ID NO: 959945 - RNA, 19 nt, Homo sapiens
agagagagaccgacguaca

SEQ ID NO: 959946 - RNA, 19 nt, Homo sapiens
ccgauaucccuuccugauu

SEQ ID NO: 959947 - RNA, 19 nt, Homo sapiens
gagagagaccgacguacac

SEQ ID NO: 959948 - RNA, 19 nt, Homo sapiens
guaacagccaugaccaaag

SEQ ID NO: 959949 - RNA, 19 nt, Homo sapiens
cccugcagguucccauaaa

SEQ ID NO: 959950 - RNA, 19 nt, Homo sapiens
cccaaacuccaaccuguau

SEQ ID NO: 959951 - RNA, 19 nt, Homo sapiens
cagccaugaccaaagcuuu

SEQ ID NO: 959952 - RNA, 19 nt, Homo sapiens
ugagaccauccgccgauuu

SEQ ID NO: 959953 - RNA, 19 nt, Homo sapiens
gugaagacccugguuucug

SEQ ID NO: 959954 - RNA, 19 nt, Homo sapiens
gugaugugacucaggaaga

SEQ ID NO: 959955 - RNA, 19 nt, Homo sapiens
uuuauccucugugauguga

SEQ ID NO: 959956 - RNA, 19 nt, Homo sapiens
gauuugcagccagaagaaa

SEQ ID NO: 959957 - RNA, 19 nt, Homo sapiens
cuuccugauuucucucauu

SEQ ID NO: 959958 - RNA, 19 nt, Homo sapiens
aaagaggcccagaguagag

SEQ ID NO: 959959 - RNA, 19 nt, Homo sapiens
ugacucaggaagaugaugu

SEQ ID NO: 959960 - RNA, 19 nt, Homo sapiens
caacugcagugaagagugu

SEQ ID NO: 959961 - RNA, 19 nt, Homo sapiens
gcaaauuugugaaugugau

SEQ ID NO: 959962 - RNA, 19 nt, Homo sapiens
agaauucgauuuccuguca

SEQ ID NO: 959963 - RNA, 19 nt, Homo sapiens
ucacuggauuugccaacua

SEQ ID NO: 959964 - RNA, 19 nt, Homo sapiens
ggagacagguuccuuuagc

SEQ ID NO: 959965 - RNA, 19 nt, Homo sapiens
ccagaggcguuguaagugu

SEQ ID NO: 959966 - RNA, 19 nt, Homo sapiens
gcagccaaguuccugauag

SEQ ID NO: 959967 - RNA, 19 nt, Homo sapiens
ccaguuacccgucagauca

SEQ ID NO: 959968 - RNA, 19 nt, Homo sapiens
gcaucaaccugugggaaau

SEQ ID NO: 959969 - RNA, 19 nt, Homo sapiens
gagacagguuccuuuagca

SEQ ID NO: 959970 - RNA, 19 nt, Homo sapiens
gagccaagccacagagugu

SEQ ID NO: 959971 - RNA, 19 nt, Homo sapiens
ccaacuagaauucgauuuc

SEQ ID NO: 959972 - RNA, 19 nt, Homo sapiens
ggacacugagaacccauuu

SEQ ID NO: 959973 - RNA, 19 nt, Homo sapiens
ucguguggcugauucguaa

SEQ ID NO: 959974 - RNA, 19 nt, Homo sapiens
guaagugugagcaccauug

SEQ ID NO: 959975 - RNA, 19 nt, Homo sapiens
ggauuugccaacuagaauu

SEQ ID NO: 959976 - RNA, 19 nt, Homo sapiens
gcacgucgcgaaagcuugu

SEQ ID NO: 959977 - RNA, 19 nt, Homo sapiens
uagcaaauuugugaaugug

SEQ ID NO: 959978 - RNA, 19 nt, Homo sapiens
gcaccuucgugucgcacuu

SEQ ID NO: 959979 - RNA, 19 nt, Homo sapiens
acagguuccuuuagcaaau

SEQ ID NO: 959980 - RNA, 19 nt, Homo sapiens
gacagguuccuuuagcaaa

SEQ ID NO: 959981 - RNA, 19 nt, Homo sapiens
aggaggugcuggacacuga

SEQ ID NO: 959982 - RNA, 19 nt, Homo sapiens
ggaagcuccuuggaagaag

SEQ ID NO: 959983 - RNA, 19 nt, Homo sapiens
ugcagcgucuccagaguaa

SEQ ID NO: 959984 - RNA, 19 nt, Homo sapiens
ggcaucaaccugugggaaa

SEQ ID NO: 959985 - RNA, 19 nt, Homo sapiens
cagguuccuuuagcaaauu

SEQ ID NO: 959986 - RNA, 19 nt, Homo sapiens
acacugagaacccauuugu

SEQ ID NO: 959987 - RNA, 19 nt, Homo sapiens
aauucgauuuccugucaua

SEQ ID NO: 959988 - RNA, 19 nt, Homo sapiens
cggaguuccugcugaaaca

SEQ ID NO: 959989 - RNA, 19 nt, Homo sapiens
aauggaagcaucuacauca

SEQ ID NO: 959990 - RNA, 19 nt, Homo sapiens
caacuagaauucgauuucc

SEQ ID NO: 959991 - RNA, 19 nt, Homo sapiens
ccaucuggguguccucaau

SEQ ID NO: 959992 - RNA, 19 nt, Homo sapiens
ugugggaaauggcggaguu

SEQ ID NO: 959993 - RNA, 19 nt, Homo sapiens
uggcggaguuccugcugaa

SEQ ID NO: 959994 - RNA, 19 nt, Homo sapiens
guaauggaagcaucuacau

SEQ ID NO: 959995 - RNA, 19 nt, Homo sapiens
gauuugccaacuagaauuc

SEQ ID NO: 959996 - RNA, 19 nt, Homo sapiens
ggagcagcguggcaucaac

SEQ ID NO: 959997 - RNA, 19 nt, Homo sapiens
gaccucaucacuggauuug

SEQ ID NO: 959998 - RNA, 19 nt, Homo sapiens
acgggaccuuggccaguua

SEQ ID NO: 959999 - RNA, 19 nt, Homo sapiens
ccaaugcaccgggcacuuc

SEQ ID NO: 960000 - RNA, 19 nt, Homo sapiens
gaaacaggacguggucaac

SEQ ID NO: 960001 - RNA, 19 nt, Homo sapiens
ugaaacaggacguggucaa

SEQ ID NO: 960002 - RNA, 19 nt, Homo sapiens
aagggcagcuggugcucuu

SEQ ID NO: 960003 - RNA, 19 nt, Homo sapiens
gaauucgauuuccugucau

SEQ ID NO: 960004 - RNA, 19 nt, Homo sapiens
cagcuggugcucuuucaug

SEQ ID NO: 960005 - RNA, 19 nt, Homo sapiens
ccgcgacgacgacuugcua

SEQ ID NO: 960006 - RNA, 19 nt, Homo sapiens
ugccagaggcguuguaagu

SEQ ID NO: 960007 - RNA, 19 nt, Homo sapiens
ggcagcuggugcucuuuca

SEQ ID NO: 960008 - RNA, 19 nt, Homo sapiens
gcaccugcaacccuagcaa

SEQ ID NO: 960009 - RNA, 19 nt, Homo sapiens
cagcgucuccagaguaaag

SEQ ID NO: 960010 - RNA, 19 nt, Homo sapiens
cugcagcgucuccagagua

SEQ ID NO: 960011 - RNA, 19 nt, Homo sapiens
ggcagccaaguuccugaua

SEQ ID NO: 960012 - RNA, 19 nt, Homo sapiens
ggguccaacugcagugaag

SEQ ID NO: 960013 - RNA, 19 nt, Homo sapiens
agacagguuccuuuagcaa

SEQ ID NO: 960014 - RNA, 19 nt, Homo sapiens
ggaaggaaguggagaaaug

SEQ ID NO: 960015 - RNA, 19 nt, Homo sapiens
gacagaugcucauuucuaa

SEQ ID NO: 960016 - RNA, 19 nt, Homo sapiens
ggaaacaacugggcauaug

SEQ ID NO: 960017 - RNA, 19 nt, Homo sapiens
ugagaagucugcaguguug

SEQ ID NO: 960018 - RNA, 19 nt, Homo sapiens
gaaauauggucaacaugca

SEQ ID NO: 960019 - RNA, 19 nt, Homo sapiens
ggaagaagguauugauagg

SEQ ID NO: 960020 - RNA, 19 nt, Homo sapiens
caacagccaguucuuagua

SEQ ID NO: 960021 - RNA, 19 nt, Homo sapiens
aagcagaucuccuuuagug

SEQ ID NO: 960022 - RNA, 19 nt, Homo sapiens
gggaaggcauggaauaugu

SEQ ID NO: 960023 - RNA, 19 nt, Homo sapiens
gggcacaggaucaggauua

SEQ ID NO: 960024 - RNA, 19 nt, Homo sapiens
gaagaucaguacucaaacu

SEQ ID NO: 960025 - RNA, 19 nt, Homo sapiens
ggacuuccuccucuuagua

SEQ ID NO: 960026 - RNA, 19 nt, Homo sapiens
cagggacucugcucuauga

SEQ ID NO: 960027 - RNA, 19 nt, Homo sapiens
gugcaaaacugaugaauau

SEQ ID NO: 960028 - RNA, 19 nt, Homo sapiens
gaacauaauccggaaggaa

SEQ ID NO: 960029 - RNA, 19 nt, Homo sapiens
gcaugaagaaucuauaaug

SEQ ID NO: 960030 - RNA, 19 nt, Homo sapiens
gacauggaacccaaaguua

SEQ ID NO: 960031 - RNA, 19 nt, Homo sapiens
ucacaugucugagaauuca

SEQ ID NO: 960032 - RNA, 19 nt, Homo sapiens
cagaucuccuuuagugaua

SEQ ID NO: 960033 - RNA, 19 nt, Homo sapiens
gugcagauguggagggauu

SEQ ID NO: 960034 - RNA, 19 nt, Homo sapiens
ucaagcagaucuccuuuag

SEQ ID NO: 960035 - RNA, 19 nt, Homo sapiens
uagaagaucaguacucaaa

SEQ ID NO: 960036 - RNA, 19 nt, Homo sapiens
ggauuaggagcuuucguua

SEQ ID NO: 960037 - RNA, 19 nt, Homo sapiens
gcauaugguuacucuguuc

SEQ ID NO: 960038 - RNA, 19 nt, Homo sapiens
ugagagagaaugaggcaua

SEQ ID NO: 960039 - RNA, 19 nt, Homo sapiens
gaaggcauggaauauguuu

SEQ ID NO: 960040 - RNA, 19 nt, Homo sapiens
acaaggaccugcauuuuaa

SEQ ID NO: 960041 - RNA, 19 nt, Homo sapiens
gcauguauggccuccuuua

SEQ ID NO: 960042 - RNA, 19 nt, Homo sapiens
gagagagaaugaggcauau

SEQ ID NO: 960043 - RNA, 19 nt, Homo sapiens
gagcuuucguuacacagaa

SEQ ID NO: 960044 - RNA, 19 nt, Homo sapiens
gcaaagauggaagaaggua

SEQ ID NO: 960045 - RNA, 19 nt, Homo sapiens
gaaauccacuaggagacuu

SEQ ID NO: 960046 - RNA, 19 nt, Homo sapiens
cagauuauuuggccuuaug

SEQ ID NO: 960047 - RNA, 19 nt, Homo sapiens
aaaugucucucaacaagga

SEQ ID NO: 960048 - RNA, 19 nt, Homo sapiens
agacagaugcucauuucua

SEQ ID NO: 960049 - RNA, 19 nt, Homo sapiens
gaauuuagaagaucaguac

SEQ ID NO: 960050 - RNA, 19 nt, Homo sapiens
gagagaaugaggcauauca

SEQ ID NO: 960051 - RNA, 19 nt, Homo sapiens
aagccuacauucaucagua

SEQ ID NO: 960052 - RNA, 19 nt, Homo sapiens
uguauggccuccuuuauca

SEQ ID NO: 960053 - RNA, 19 nt, Homo sapiens
gaacuggugagguuauugu

SEQ ID NO: 960054 - RNA, 19 nt, Homo sapiens
gaucaguacucaaacucau

SEQ ID NO: 960055 - RNA, 19 nt, Homo sapiens
gcauacaccacauuuacuu

SEQ ID NO: 960056 - RNA, 19 nt, Homo sapiens
gcagaucuccuuuagugau

SEQ ID NO: 960057 - RNA, 19 nt, Homo sapiens
aaacaagguucuggaaaca

SEQ ID NO: 960058 - RNA, 19 nt, Homo sapiens
uuaaagauccagcucugua

SEQ ID NO: 960059 - RNA, 19 nt, Homo sapiens
acacuuccauugcuaacuu

SEQ ID NO: 960060 - RNA, 19 nt, Homo sapiens
gaaugaggcauaucaagca

SEQ ID NO: 960061 - RNA, 19 nt, Homo sapiens
guggagggauuuaaagauc

SEQ ID NO: 960062 - RNA, 19 nt, Homo sapiens
cagacgaaauccacuagga

SEQ ID NO: 960063 - RNA, 19 nt, Homo sapiens
ugacauggaacccaaaguu

SEQ ID NO: 960064 - RNA, 19 nt, Homo sapiens
ucaacaaggaccugcauuu

SEQ ID NO: 960065 - RNA, 19 nt, Homo sapiens
gaucaggauuaggagcuuu

SEQ ID NO: 960066 - RNA, 19 nt, Homo sapiens
gaaggaaguggagaaaugu

SEQ ID NO: 960067 - RNA, 19 nt, Homo sapiens
caugcaugcuucugucaaa

SEQ ID NO: 960068 - RNA, 19 nt, Homo sapiens
cagcaacagccaguucuua

SEQ ID NO: 960069 - RNA, 19 nt, Homo sapiens
uaaaaugucucucaacaag

SEQ ID NO: 960070 - RNA, 19 nt, Homo sapiens
uuauggaacuggugagguu

SEQ ID NO: 960071 - RNA, 19 nt, Homo sapiens
gcagauguggagggauuua

SEQ ID NO: 960072 - RNA, 19 nt, Homo sapiens
gucaaaggcugcccagucu

SEQ ID NO: 960073 - RNA, 19 nt, Homo sapiens
ggucauucuucgugggaaa

SEQ ID NO: 960074 - RNA, 19 nt, Homo sapiens
auuaggagcuuucguuaca

SEQ ID NO: 960075 - RNA, 19 nt, Homo sapiens
gggcauaugguuacucugu

SEQ ID NO: 960076 - RNA, 19 nt, Homo sapiens
uagcaaauaugagaagucu

SEQ ID NO: 960077 - RNA, 19 nt, Homo sapiens
aaagauccagcucuguaua

SEQ ID NO: 960078 - RNA, 19 nt, Homo sapiens
aaagauggaagaagguauu

SEQ ID NO: 960079 - RNA, 19 nt, Homo sapiens
gagaauucauuggcauaca

SEQ ID NO: 960080 - RNA, 19 nt, Homo sapiens
gcacaucagcugggaagug

SEQ ID NO: 960081 - RNA, 19 nt, Homo sapiens
acacagaauuuagaagauc

SEQ ID NO: 960082 - RNA, 19 nt, Homo sapiens
gaaacaacugggcauaugg

SEQ ID NO: 960083 - RNA, 19 nt, Homo sapiens
gauggaagaagguauugau

SEQ ID NO: 960084 - RNA, 19 nt, Homo sapiens
ucauuucacuacagacgaa

SEQ ID NO: 960085 - RNA, 19 nt, Homo sapiens
caacugggcauaugguuac

SEQ ID NO: 960086 - RNA, 19 nt, Homo sapiens
uggaauauguuugcuucaa

SEQ ID NO: 960087 - RNA, 19 nt, Homo sapiens
ggaaggcauggaauauguu

SEQ ID NO: 960088 - RNA, 19 nt, Homo sapiens
uaaagauccagcucuguau

SEQ ID NO: 960089 - RNA, 19 nt, Homo sapiens
gguugaagccuguuaaugc

SEQ ID NO: 960090 - RNA, 19 nt, Homo sapiens
cacaucagcugggaagugu

SEQ ID NO: 960091 - RNA, 19 nt, Homo sapiens
ggcauaugguuacucuguu

SEQ ID NO: 960092 - RNA, 19 nt, Homo sapiens
uaugagaagucugcagugu

SEQ ID NO: 960093 - RNA, 19 nt, Homo sapiens
ugggaaagaugugcaaagu

SEQ ID NO: 960094 - RNA, 19 nt, Homo sapiens
gggcuguucuuguugacau

SEQ ID NO: 960095 - RNA, 19 nt, Homo sapiens
gagaaugaggcauaucaag

SEQ ID NO: 960096 - RNA, 19 nt, Homo sapiens
cacagaauuuagaagauca

SEQ ID NO: 960097 - RNA, 19 nt, Homo sapiens
guugggaaggcauggaaua

SEQ ID NO: 960098 - RNA, 19 nt, Homo sapiens
acaacugggcauaugguua

SEQ ID NO: 960099 - RNA, 19 nt, Homo sapiens
aacagccaguucuuaguaa

SEQ ID NO: 960100 - RNA, 19 nt, Homo sapiens
gcaacagccaguucuuagu

SEQ ID NO: 960101 - RNA, 19 nt, Homo sapiens
caacaaggaccugcauuuu

SEQ ID NO: 960102 - RNA, 19 nt, Homo sapiens
uccauaagaucugugcaaa

SEQ ID NO: 960103 - RNA, 19 nt, Homo sapiens
cagacgcccuccuucuuca

SEQ ID NO: 960104 - RNA, 19 nt, Homo sapiens
gacacuuucucacuuguac

SEQ ID NO: 960105 - RNA, 19 nt, Homo sapiens
cuggugagguuauuguuca

SEQ ID NO: 960106 - RNA, 19 nt, Homo sapiens
uuuagaagaucaguacuca

SEQ ID NO: 960107 - RNA, 19 nt, Homo sapiens
uagacaguuucacgucauu

SEQ ID NO: 960108 - RNA, 19 nt, Homo sapiens
ccacuugauaugauuguug

SEQ ID NO: 960109 - RNA, 19 nt, Homo sapiens
uuuaacacuuccauugcua

SEQ ID NO: 960110 - RNA, 19 nt, Homo sapiens
gacuuccuccucuuaguaa

SEQ ID NO: 960111 - RNA, 19 nt, Homo sapiens
ugaggcauaucaagcaucu

SEQ ID NO: 960112 - RNA, 19 nt, Homo sapiens
cuacagacgaaauccacua

SEQ ID NO: 960113 - RNA, 19 nt, Homo sapiens
gcagguuguugccaguuac

SEQ ID NO: 960114 - RNA, 19 nt, Homo sapiens
cgaaacagcucaucacuga

SEQ ID NO: 960115 - RNA, 19 nt, Homo sapiens
gcacugaugugucuucaau

SEQ ID NO: 960116 - RNA, 19 nt, Homo sapiens
ggacuuggcacauuucuuu

SEQ ID NO: 960117 - RNA, 19 nt, Homo sapiens
caaagagucugguuacuuc

SEQ ID NO: 960118 - RNA, 19 nt, Homo sapiens
guacaacugugaagccaaa

SEQ ID NO: 960119 - RNA, 19 nt, Homo sapiens
gaaaggaauuuaugaugag

SEQ ID NO: 960120 - RNA, 19 nt, Homo sapiens
gagauaacauaguucuuga

SEQ ID NO: 960121 - RNA, 19 nt, Homo sapiens
uaacauuccuccuagaaga

SEQ ID NO: 960122 - RNA, 19 nt, Homo sapiens
cagaagcugugucaucuuu

SEQ ID NO: 960123 - RNA, 19 nt, Homo sapiens
gaagcugugucaucuuuau

SEQ ID NO: 960124 - RNA, 19 nt, Homo sapiens
ugaauaacauuguggcaaa

SEQ ID NO: 960125 - RNA, 19 nt, Homo sapiens
cgagcagucuugauugaua

SEQ ID NO: 960126 - RNA, 19 nt, Homo sapiens
guacaaauuucagaucuuc

SEQ ID NO: 960127 - RNA, 19 nt, Homo sapiens
gaucuggacuuggcacauu

SEQ ID NO: 960128 - RNA, 19 nt, Homo sapiens
ggugaauucuggaaaguug

SEQ ID NO: 960129 - RNA, 19 nt, Homo sapiens
ucaugaggcucuacaagaa

SEQ ID NO: 960130 - RNA, 19 nt, Homo sapiens
gggccauucucauucguua

SEQ ID NO: 960131 - RNA, 19 nt, Homo sapiens
gcaugaauuuaguuccuuu

SEQ ID NO: 960132 - RNA, 19 nt, Homo sapiens
ggaacaggaucuggacuug

SEQ ID NO: 960133 - RNA, 19 nt, Homo sapiens
uguaauagccaccaacuuu

SEQ ID NO: 960134 - RNA, 19 nt, Homo sapiens
gaaguauacagauuuguga

SEQ ID NO: 960135 - RNA, 19 nt, Homo sapiens
gaagacgaauucccagaag

SEQ ID NO: 960136 - RNA, 19 nt, Homo sapiens
ucaaacauuucucuucaga

SEQ ID NO: 960137 - RNA, 19 nt, Homo sapiens
ccagaaguauacagauuug

SEQ ID NO: 960138 - RNA, 19 nt, Homo sapiens
gagcagucuugauugauau

SEQ ID NO: 960139 - RNA, 19 nt, Homo sapiens
gcaugcagacuguguauug

SEQ ID NO: 960140 - RNA, 19 nt, Homo sapiens
gcaaugaaggaacuuaaug

SEQ ID NO: 960141 - RNA, 19 nt, Homo sapiens
ccucauauuuaggcauuua

SEQ ID NO: 960142 - RNA, 19 nt, Homo sapiens
gaucuucguagaaauauug

SEQ ID NO: 960143 - RNA, 19 nt, Homo sapiens
gaucagauguuuucagaug

SEQ ID NO: 960144 - RNA, 19 nt, Homo sapiens
acugaugugucuucaauaa

SEQ ID NO: 960145 - RNA, 19 nt, Homo sapiens
caauuugucuccuggaauc

SEQ ID NO: 960146 - RNA, 19 nt, Homo sapiens
ucagaucuucguagaaaua

SEQ ID NO: 960147 - RNA, 19 nt, Homo sapiens
gaagauuggaucagauguu

SEQ ID NO: 960148 - RNA, 19 nt, Homo sapiens
uaacaccucuguauacacu

SEQ ID NO: 960149 - RNA, 19 nt, Homo sapiens
gauuugugacuuccauuua

SEQ ID NO: 960150 - RNA, 19 nt, Homo sapiens
ggccgugggucacaaaguu

SEQ ID NO: 960151 - RNA, 19 nt, Homo sapiens
gaauaacauuguggcaaau

SEQ ID NO: 960152 - RNA, 19 nt, Homo sapiens
gaaggaacuuaaugagcau

SEQ ID NO: 960153 - RNA, 19 nt, Homo sapiens
uaaccucaccuuauaauag

SEQ ID NO: 960154 - RNA, 19 nt, Homo sapiens
cuuaguaccuuaacuucaa

SEQ ID NO: 960155 - RNA, 19 nt, Homo sapiens
aagauuggaucagauguuu

SEQ ID NO: 960156 - RNA, 19 nt, Homo sapiens
aacgagcucugcaagauuu

SEQ ID NO: 960157 - RNA, 19 nt, Homo sapiens
caaugaaggaacuuaauga

SEQ ID NO: 960158 - RNA, 19 nt, Homo sapiens
aauagcaucuuggcaauga

SEQ ID NO: 960159 - RNA, 19 nt, Homo sapiens
ggaguagaagaacacaaua

SEQ ID NO: 960160 - RNA, 19 nt, Homo sapiens
caaauuugcuccucaaccu

SEQ ID NO: 960161 - RNA, 19 nt, Homo sapiens
gugauugcuugcaguguuu

SEQ ID NO: 960162 - RNA, 19 nt, Homo sapiens
guaauaccaaugugugaaa

SEQ ID NO: 960163 - RNA, 19 nt, Homo sapiens
cauaagaagcccuuugaug

SEQ ID NO: 960164 - RNA, 19 nt, Homo sapiens
gcacgagcagucuugauug

SEQ ID NO: 960165 - RNA, 19 nt, Homo sapiens
ggugaugguggaaguauuu

SEQ ID NO: 960166 - RNA, 19 nt, Homo sapiens
ccuagaagauuggaucaga

SEQ ID NO: 960167 - RNA, 19 nt, Homo sapiens
cuaacgagcucugcaagau

SEQ ID NO: 960168 - RNA, 19 nt, Homo sapiens
guauacagauuugugacuu

SEQ ID NO: 960169 - RNA, 19 nt, Homo sapiens
cuucaaacauuucucuuca

SEQ ID NO: 960170 - RNA, 19 nt, Homo sapiens
gugaaaucuuaguaccuua

SEQ ID NO: 960171 - RNA, 19 nt, Homo sapiens
gcacucaugguuagaggaa

SEQ ID NO: 960172 - RNA, 19 nt, Homo sapiens
uguauacacugacagaugu

SEQ ID NO: 960173 - RNA, 19 nt, Homo sapiens
agacgaauucccagaagua

SEQ ID NO: 960174 - RNA, 19 nt, Homo sapiens
ugagauaacauaguucuug

SEQ ID NO: 960175 - RNA, 19 nt, Homo sapiens
cagaaaggaauuuaugaug

SEQ ID NO: 960176 - RNA, 19 nt, Homo sapiens
gggaguagaagaacacaau

SEQ ID NO: 960177 - RNA, 19 nt, Homo sapiens
ccaaagagucugguuacuu

SEQ ID NO: 960178 - RNA, 19 nt, Homo sapiens
cacgagcagucuugauuga

SEQ ID NO: 960179 - RNA, 19 nt, Homo sapiens
cagcacucauacaggaaua

SEQ ID NO: 960180 - RNA, 19 nt, Homo sapiens
uuucagaugccuuuaguaa

SEQ ID NO: 960181 - RNA, 19 nt, Homo sapiens
gaagcccuuugaugcaaug

SEQ ID NO: 960182 - RNA, 19 nt, Homo sapiens
gaauuuaugaugaggcaau

SEQ ID NO: 960183 - RNA, 19 nt, Homo sapiens
acugagagauguauuugau

SEQ ID NO: 960184 - RNA, 19 nt, Homo sapiens
gaguagaagaacacaauau

SEQ ID NO: 960185 - RNA, 19 nt, Homo sapiens
aaucgcaauuuguugguaa

SEQ ID NO: 960186 - RNA, 19 nt, Homo sapiens
acaggaauaugaccaacug

SEQ ID NO: 960187 - RNA, 19 nt, Homo sapiens
ccauucucauucguuauua

SEQ ID NO: 960188 - RNA, 19 nt, Homo sapiens
uaacauuguggcaaauuug

SEQ ID NO: 960189 - RNA, 19 nt, Homo sapiens
aaaucgaccucauggugaa

SEQ ID NO: 960190 - RNA, 19 nt, Homo sapiens
ucccagaaguauacagauu

SEQ ID NO: 960191 - RNA, 19 nt, Homo sapiens
uuucugaccuuucuguuuc

SEQ ID NO: 960192 - RNA, 19 nt, Homo sapiens
aggcucaccuucaucacua

SEQ ID NO: 960193 - RNA, 19 nt, Homo sapiens
uaucucgugucaagccuaa

SEQ ID NO: 960194 - RNA, 19 nt, Homo sapiens
gacuguguauugcccauug

SEQ ID NO: 960195 - RNA, 19 nt, Homo sapiens
guaguuauugggaguagaa

SEQ ID NO: 960196 - RNA, 19 nt, Homo sapiens
gcccuuugaugcaaugaau

SEQ ID NO: 960197 - RNA, 19 nt, Homo sapiens
uaaugagcaugcagacugu

SEQ ID NO: 960198 - RNA, 19 nt, Homo sapiens
ggaagaccagccuguguuc

SEQ ID NO: 960199 - RNA, 19 nt, Homo sapiens
gaaauguggacaccagagu

SEQ ID NO: 960200 - RNA, 19 nt, Homo sapiens
uaacgagcucugcaagauu

SEQ ID NO: 960201 - RNA, 19 nt, Homo sapiens
cgaauucccagaaguauac

SEQ ID NO: 960202 - RNA, 19 nt, Homo sapiens
aaaggugcuugaagacgaa

SEQ ID NO: 960203 - RNA, 19 nt, Homo sapiens
gccauucucauucguuauu

SEQ ID NO: 960204 - RNA, 19 nt, Homo sapiens
ccuaacaccucuguauaca

SEQ ID NO: 960205 - RNA, 19 nt, Homo sapiens
uaagaagcccuuugaugca

SEQ ID NO: 960206 - RNA, 19 nt, Homo sapiens
caaccagaaaggaauuuau

SEQ ID NO: 960207 - RNA, 19 nt, Homo sapiens
guuauugggaguagaagaa

SEQ ID NO: 960208 - RNA, 19 nt, Homo sapiens
ucaucacuaucuacaaguu

SEQ ID NO: 960209 - RNA, 19 nt, Homo sapiens
ucaccuucaucacuaucua

SEQ ID NO: 960210 - RNA, 19 nt, Homo sapiens
uaaucgcaauuuguuggua

SEQ ID NO: 960211 - RNA, 19 nt, Homo sapiens
caaauuucagaucuucgua

SEQ ID NO: 960212 - RNA, 19 nt, Homo sapiens
guuaacauuccuccuagaa

SEQ ID NO: 960213 - RNA, 19 nt, Homo sapiens
aagaagcccuuugaugcaa

SEQ ID NO: 960214 - RNA, 19 nt, Homo sapiens
guaaguggcuucucuguga

SEQ ID NO: 960215 - RNA, 19 nt, Homo sapiens
gaacgagucugaaaucauc

SEQ ID NO: 960216 - RNA, 19 nt, Homo sapiens
gcaauuggcagcccuauuu

SEQ ID NO: 960217 - RNA, 19 nt, Homo sapiens
gaaaggagcaggagccaaa

SEQ ID NO: 960218 - RNA, 19 nt, Homo sapiens
ggaaguggacguuucguua

SEQ ID NO: 960219 - RNA, 19 nt, Homo sapiens
gugaagagcaggcuaaaua

SEQ ID NO: 960220 - RNA, 19 nt, Homo sapiens
uagagacgcugauccauaa

SEQ ID NO: 960221 - RNA, 19 nt, Homo sapiens
caguagagcuaaauaaaug

SEQ ID NO: 960222 - RNA, 19 nt, Homo sapiens
gagcauugauguacccauu

SEQ ID NO: 960223 - RNA, 19 nt, Homo sapiens
gcacuugaauuguuauuac

SEQ ID NO: 960224 - RNA, 19 nt, Homo sapiens
gagagaaacuacaggaauc

SEQ ID NO: 960225 - RNA, 19 nt, Homo sapiens
aaagaaagacagcuacaua

SEQ ID NO: 960226 - RNA, 19 nt, Homo sapiens
gauggaagcuuguugaaaa

SEQ ID NO: 960227 - RNA, 19 nt, Homo sapiens
caguaaaccuuaacagaug

SEQ ID NO: 960228 - RNA, 19 nt, Homo sapiens
gcagcccuauuucaguuua

SEQ ID NO: 960229 - RNA, 19 nt, Homo sapiens
caagagacaauuaugguaa

SEQ ID NO: 960230 - RNA, 19 nt, Homo sapiens
gaagagcaggcuaaauauu

SEQ ID NO: 960231 - RNA, 19 nt, Homo sapiens
aagagcaggcuaaauauua

SEQ ID NO: 960232 - RNA, 19 nt, Homo sapiens
gaauaacgacccauacaug

SEQ ID NO: 960233 - RNA, 19 nt, Homo sapiens
gcccagcacuugaauuguu

SEQ ID NO: 960234 - RNA, 19 nt, Homo sapiens
gcaagagacaauuauggua

SEQ ID NO: 960235 - RNA, 19 nt, Homo sapiens
cgauuuagcugacaucaag

SEQ ID NO: 960236 - RNA, 19 nt, Homo sapiens
cgaagaggaaggcgauuua

SEQ ID NO: 960237 - RNA, 19 nt, Homo sapiens
ggaacacugacaucaauuu

SEQ ID NO: 960238 - RNA, 19 nt, Homo sapiens
gaaugucguugcugagugu

SEQ ID NO: 960239 - RNA, 19 nt, Homo sapiens
gagccaaguuccaaaauaa

SEQ ID NO: 960240 - RNA, 19 nt, Homo sapiens
gaugucaacuccaaacaag

SEQ ID NO: 960241 - RNA, 19 nt, Homo sapiens
gaauuagcacggaaagaaa

SEQ ID NO: 960242 - RNA, 19 nt, Homo sapiens
gaaguggacguuucguuau

SEQ ID NO: 960243 - RNA, 19 nt, Homo sapiens
ggagauggaagcuuguuga

SEQ ID NO: 960244 - RNA, 19 nt, Homo sapiens
gaaagacagcuacauaugc

SEQ ID NO: 960245 - RNA, 19 nt, Homo sapiens
gcacgaacccuuccaacuc

SEQ ID NO: 960246 - RNA, 19 nt, Homo sapiens
gaagaggaagagagagaaa

SEQ ID NO: 960247 - RNA, 19 nt, Homo sapiens
aaagacagcuacauaugca

SEQ ID NO: 960248 - RNA, 19 nt, Homo sapiens
uagcugacaucaagucuuc

SEQ ID NO: 960249 - RNA, 19 nt, Homo sapiens
cagagcaucuugcauccaa

SEQ ID NO: 960250 - RNA, 19 nt, Homo sapiens
gagaacaucaaauaaagug

SEQ ID NO: 960251 - RNA, 19 nt, Homo sapiens
ucaaauggaucucuuucuc

SEQ ID NO: 960252 - RNA, 19 nt, Homo sapiens
ugaauuagcacggaaagaa

SEQ ID NO: 960253 - RNA, 19 nt, Homo sapiens
ccgagaacaucaaauaaag

SEQ ID NO: 960254 - RNA, 19 nt, Homo sapiens
ugaauugccuguaacacau

SEQ ID NO: 960255 - RNA, 19 nt, Homo sapiens
gaauugccuguaacacaua

SEQ ID NO: 960256 - RNA, 19 nt, Homo sapiens
cuagagacgcugauccaua

SEQ ID NO: 960257 - RNA, 19 nt, Homo sapiens
gaagagagagaaacuacag

SEQ ID NO: 960258 - RNA, 19 nt, Homo sapiens
gcccaaaacugucauccua

SEQ ID NO: 960259 - RNA, 19 nt, Homo sapiens
cccagcacuugaauuguua

SEQ ID NO: 960260 - RNA, 19 nt, Homo sapiens
auccaaaccuguaaccuuu

SEQ ID NO: 960261 - RNA, 19 nt, Homo sapiens
aaggaacacugacaucaau

SEQ ID NO: 960262 - RNA, 19 nt, Homo sapiens
aaugacagcugccuacauc

SEQ ID NO: 960263 - RNA, 19 nt, Homo sapiens
agagcaggcuaaauauuau

SEQ ID NO: 960264 - RNA, 19 nt, Homo sapiens
aaacugucauccuaacguu

SEQ ID NO: 960265 - RNA, 19 nt, Homo sapiens
gcaagagccaaguuccaaa

SEQ ID NO: 960266 - RNA, 19 nt, Homo sapiens
gcugauccauaaagacaau

SEQ ID NO: 960267 - RNA, 19 nt, Homo sapiens
caaaggaacacugacauca

SEQ ID NO: 960268 - RNA, 19 nt, Homo sapiens
gcuaucaaccagauucuug

SEQ ID NO: 960269 - RNA, 19 nt, Homo sapiens
gcaaccagcuauccaucag

SEQ ID NO: 960270 - RNA, 19 nt, Homo sapiens
cgucacacaucccaucaga

SEQ ID NO: 960271 - RNA, 19 nt, Homo sapiens
gaucagucaucccgaagag

SEQ ID NO: 960272 - RNA, 19 nt, Homo sapiens
ggacccuccucugcacuuu

SEQ ID NO: 960273 - RNA, 19 nt, Homo sapiens
acacuuccauguccagguu

SEQ ID NO: 960274 - RNA, 19 nt, Homo sapiens
cuccugauaucccuacuuu

SEQ ID NO: 960275 - RNA, 19 nt, Homo sapiens
gauggaggccucuacaaca

SEQ ID NO: 960276 - RNA, 19 nt, Homo sapiens
gacacgagguggccagaca

SEQ ID NO: 960277 - RNA, 19 nt, Homo sapiens
cauccuaacguuugucauu

SEQ ID NO: 960278 - RNA, 19 nt, Homo sapiens
uggaggaguucauggaaga

SEQ ID NO: 960279 - RNA, 19 nt, Homo sapiens
gaaagaaagacagcuacau

SEQ ID NO: 960280 - RNA, 19 nt, Homo sapiens
uuaagaagccucugaaugc

SEQ ID NO: 960281 - RNA, 19 nt, Homo sapiens
uaacgacccauacauguca

SEQ ID NO: 960282 - RNA, 19 nt, Homo sapiens
ugccaaauaugaauaacga

SEQ ID NO: 960283 - RNA, 19 nt, Homo sapiens
gcauugauguacccauuuu

SEQ ID NO: 960284 - RNA, 19 nt, Homo sapiens
ugaaaguucuggaaaaguu

SEQ ID NO: 960285 - RNA, 19 nt, Homo sapiens
gcaaggucagccuguauau

SEQ ID NO: 960286 - RNA, 19 nt, Homo sapiens
ggcaaggucagccuguaua

SEQ ID NO: 960287 - RNA, 19 nt, Homo sapiens
gaucacacccgucacacau

SEQ ID NO: 960288 - RNA, 19 nt, Homo sapiens
uggcagcccuauuucaguu

SEQ ID NO: 960289 - RNA, 19 nt, Homo sapiens
agacgcugauccauaaaga

SEQ ID NO: 960290 - RNA, 19 nt, Homo sapiens
gaaaacaaacuacuaaguc

SEQ ID NO: 960291 - RNA, 19 nt, Homo sapiens
ggaaagaaagacagcuaca

SEQ ID NO: 960292 - RNA, 19 nt, Homo sapiens
gugcagcuaucaaccagau

SEQ ID NO: 960293 - RNA, 19 nt, Homo sapiens
aaagaccucacauuaagaa

SEQ ID NO: 960294 - RNA, 19 nt, Homo sapiens
guucaguagagcuaaauaa

SEQ ID NO: 960295 - RNA, 19 nt, Homo sapiens
agaaagacagcuacauaug

SEQ ID NO: 960296 - RNA, 19 nt, Homo sapiens
gaaagaaaugagagcgaau

SEQ ID NO: 960297 - RNA, 19 nt, Homo sapiens
gcacuuuucuccaggauca

SEQ ID NO: 960298 - RNA, 19 nt, Homo sapiens
gguguucaguagagcuaaa

SEQ ID NO: 960299 - RNA, 19 nt, Homo sapiens
cuuguaagguguucaguag

SEQ ID NO: 960300 - RNA, 19 nt, Homo sapiens
gguacagguccaagaauga

SEQ ID NO: 960301 - RNA, 19 nt, Homo sapiens
gguacauaaugaugccaaa

SEQ ID NO: 960302 - RNA, 19 nt, Homo sapiens
uaaguggcuucucugugaa

SEQ ID NO: 960303 - RNA, 19 nt, Homo sapiens
gagauggaagcuuguugaa

SEQ ID NO: 960304 - RNA, 19 nt, Homo sapiens
gagagagaaacuacaggaa

SEQ ID NO: 960305 - RNA, 19 nt, Homo sapiens
ugaagagcaggcuaaauau

SEQ ID NO: 960306 - RNA, 19 nt, Homo sapiens
acaguaaaccuuaacagau

SEQ ID NO: 960307 - RNA, 19 nt, Homo sapiens
gaacacugacaucaauuuu

SEQ ID NO: 960308 - RNA, 19 nt, Homo sapiens
aagaaagacagcuacauau

SEQ ID NO: 960309 - RNA, 19 nt, Homo sapiens
gcagcuaucaaccagauuc

SEQ ID NO: 960310 - RNA, 19 nt, Homo sapiens
ccucauccagcuauuguaa

SEQ ID NO: 960311 - RNA, 19 nt, Homo sapiens
gucauuccaguuugaguua

SEQ ID NO: 960312 - RNA, 19 nt, Homo sapiens
gacagcugccuacaucuga

SEQ ID NO: 960313 - RNA, 19 nt, Homo sapiens
ucauccagcuauuguaaca

SEQ ID NO: 960314 - RNA, 19 nt, Homo sapiens
ggagaggcaucaucgaauu

SEQ ID NO: 960315 - RNA, 19 nt, Homo sapiens
gagaaggaaucguggauca

SEQ ID NO: 960316 - RNA, 19 nt, Homo sapiens
ugagagaccuguacagaca

SEQ ID NO: 960317 - RNA, 19 nt, Homo sapiens
gugaagagcuccggaaguc

SEQ ID NO: 960318 - RNA, 19 nt, Homo sapiens
gaaggaaucguggaucaau

SEQ ID NO: 960319 - RNA, 19 nt, Homo sapiens
gaggaggacagcuaucuug

SEQ ID NO: 960320 - RNA, 19 nt, Homo sapiens
uggaugaggucaccguuga

SEQ ID NO: 960321 - RNA, 19 nt, Homo sapiens
gaaaccggagcuacaaaga

SEQ ID NO: 960322 - RNA, 19 nt, Homo sapiens
ggaggagacucaggagcuu

SEQ ID NO: 960323 - RNA, 19 nt, Homo sapiens
gaucaaugcccucaacucu

SEQ ID NO: 960324 - RNA, 19 nt, Homo sapiens
ggguugaccuggacaaguc

SEQ ID NO: 960325 - RNA, 19 nt, Homo sapiens
ggaaugaugaagaagaaca

SEQ ID NO: 960326 - RNA, 19 nt, Homo sapiens
ugggaaugaugaagaagaa

SEQ ID NO: 960327 - RNA, 19 nt, Homo sapiens
gaaugaugaagaagaacaa

SEQ ID NO: 960328 - RNA, 19 nt, Homo sapiens
gcagugaguccagaagaga

SEQ ID NO: 960329 - RNA, 19 nt, Homo sapiens
uauuugaccugagugacua

SEQ ID NO: 960330 - RNA, 19 nt, Homo sapiens
gcugagagaccuguacaga

SEQ ID NO: 960331 - RNA, 19 nt, Homo sapiens
gcuauguggugcugaaagg

SEQ ID NO: 960332 - RNA, 19 nt, Homo sapiens
ugaugaagaagaacaauuc

SEQ ID NO: 960333 - RNA, 19 nt, Homo sapiens
cgaauuggagccaggcaaa

SEQ ID NO: 960334 - RNA, 19 nt, Homo sapiens
gagaggcaucaucgaauug

SEQ ID NO: 960335 - RNA, 19 nt, Homo sapiens
agaaggagguaaaagauga

SEQ ID NO: 960336 - RNA, 19 nt, Homo sapiens
gggaccagcucuacaucuc

SEQ ID NO: 960337 - RNA, 19 nt, Homo sapiens
ggaaacuggaggagacuca

SEQ ID NO: 960338 - RNA, 19 nt, Homo sapiens
cggaugggaugcugaccuu

SEQ ID NO: 960339 - RNA, 19 nt, Homo sapiens
agaaccguaucuuggauga

SEQ ID NO: 960340 - RNA, 19 nt, Homo sapiens
caagagcaggagcaagaaa

SEQ ID NO: 960341 - RNA, 19 nt, Homo sapiens
aaccggagcuacaaagaag

SEQ ID NO: 960342 - RNA, 19 nt, Homo sapiens
gcccucaacucugccauca

SEQ ID NO: 960343 - RNA, 19 nt, Homo sapiens
gggagaggcaucaucgaau

SEQ ID NO: 960344 - RNA, 19 nt, Homo sapiens
aaaccggagcuacaaagaa

SEQ ID NO: 960345 - RNA, 19 nt, Homo sapiens
cggguuggacagacucuua

SEQ ID NO: 960346 - RNA, 19 nt, Homo sapiens
ggaccugguagcaaggaaa

SEQ ID NO: 960347 - RNA, 19 nt, Homo sapiens
uccaagagcaggagcaaga

SEQ ID NO: 960348 - RNA, 19 nt, Homo sapiens
gagugacuaugagaagugu

SEQ ID NO: 960349 - RNA, 19 nt, Homo sapiens
ggaagcgaaaggccaagga

SEQ ID NO: 960350 - RNA, 19 nt, Homo sapiens
aaucauagcaaguuuacuc

SEQ ID NO: 960351 - RNA, 19 nt, Homo sapiens
ggagguaaaagaugagaaa

SEQ ID NO: 960352 - RNA, 19 nt, Homo sapiens
gagugaaaccggagcuaca

SEQ ID NO: 960353 - RNA, 19 nt, Homo sapiens
ggcagugaguccagaagag

SEQ ID NO: 960354 - RNA, 19 nt, Homo sapiens
ggagaugggaagcgaaagg

SEQ ID NO: 960355 - RNA, 19 nt, Homo sapiens
gagcugagagaccuguaca

SEQ ID NO: 960356 - RNA, 19 nt, Homo sapiens
gaggcaucaucgaauugga

SEQ ID NO: 960357 - RNA, 19 nt, Homo sapiens
gaugcugaccuuggacuug

SEQ ID NO: 960358 - RNA, 19 nt, Homo sapiens
gugacuaugagaaguguga

SEQ ID NO: 960359 - RNA, 19 nt, Homo sapiens
gaccugagugacuaugaga

SEQ ID NO: 960360 - RNA, 19 nt, Homo sapiens
cacagucaguaccggaaga

SEQ ID NO: 960361 - RNA, 19 nt, Homo sapiens
aaggaaucguggaucaaug

SEQ ID NO: 960362 - RNA, 19 nt, Homo sapiens
ucuccguguugcuggauaa

SEQ ID NO: 960363 - RNA, 19 nt, Homo sapiens
augcugaccuuggacuuga

SEQ ID NO: 960364 - RNA, 19 nt, Homo sapiens
guggaucaaugcccucaac

SEQ ID NO: 960365 - RNA, 19 nt, Homo sapiens
ugaccugagugacuaugag

SEQ ID NO: 960366 - RNA, 19 nt, Homo sapiens
ccaaacagcccgguaacac

SEQ ID NO: 960367 - RNA, 19 nt, Homo sapiens
guucagggacugggagaug

SEQ ID NO: 960368 - RNA, 19 nt, Homo sapiens
cccaggcacccaagaaguu

SEQ ID NO: 960369 - RNA, 19 nt, Homo sapiens
gugaaaccggagcuacaaa

SEQ ID NO: 960370 - RNA, 19 nt, Homo sapiens
ggaaugaucucuccugguu

SEQ ID NO: 960371 - RNA, 19 nt, Homo sapiens
caaaugaguuccacacuuc

SEQ ID NO: 960372 - RNA, 19 nt, Homo sapiens
agaauaagguccagaaaug

SEQ ID NO: 960373 - RNA, 19 nt, Homo sapiens
gaacuuaacacuaacagau

SEQ ID NO: 960374 - RNA, 19 nt, Homo sapiens
gagagcagcugucuaaguc

SEQ ID NO: 960375 - RNA, 19 nt, Homo sapiens
gcccauauuucccacauuu

SEQ ID NO: 960376 - RNA, 19 nt, Homo sapiens
gguaauaacuuuggauaca

SEQ ID NO: 960377 - RNA, 19 nt, Homo sapiens
caacauugcagcauuuaaa

SEQ ID NO: 960378 - RNA, 19 nt, Homo sapiens
ugacaacauugcagcauuu

SEQ ID NO: 960379 - RNA, 19 nt, Homo sapiens
gcacuucucucugcuggaa

SEQ ID NO: 960380 - RNA, 19 nt, Homo sapiens
aggaggaacuuaacacuaa

SEQ ID NO: 960381 - RNA, 19 nt, Homo sapiens
gcugguaucugcuacauca

SEQ ID NO: 960382 - RNA, 19 nt, Homo sapiens
ugagaucaaucgaaacuug

SEQ ID NO: 960383 - RNA, 19 nt, Homo sapiens
aaaagaggaugcagaguua

SEQ ID NO: 960384 - RNA, 19 nt, Homo sapiens
gaaauguccuugguguguu

SEQ ID NO: 960385 - RNA, 19 nt, Homo sapiens
gaaaugagcacagcaagag

SEQ ID NO: 960386 - RNA, 19 nt, Homo sapiens
acuaacagaucuucaauca

SEQ ID NO: 960387 - RNA, 19 nt, Homo sapiens
gaaaccaguugaggaggaa

SEQ ID NO: 960388 - RNA, 19 nt, Homo sapiens
gagcagcugucuaagucaa

SEQ ID NO: 960389 - RNA, 19 nt, Homo sapiens
ucgcugagaucaaucgaaa

SEQ ID NO: 960390 - RNA, 19 nt, Homo sapiens
gaucuucaaucaccuaaaa

SEQ ID NO: 960391 - RNA, 19 nt, Homo sapiens
gccuaaaucuuccucugaa

SEQ ID NO: 960392 - RNA, 19 nt, Homo sapiens
gaucucuccugguuucaga

SEQ ID NO: 960393 - RNA, 19 nt, Homo sapiens
cuacaucaccagcacauuu

SEQ ID NO: 960394 - RNA, 19 nt, Homo sapiens
ggaaaugagcacagcaaga

SEQ ID NO: 960395 - RNA, 19 nt, Homo sapiens
acaaaugaguuccacacuu

SEQ ID NO: 960396 - RNA, 19 nt, Homo sapiens
gguccgaacuggcaaugau

SEQ ID NO: 960397 - RNA, 19 nt, Homo sapiens
caacaggcgacaugacauu

SEQ ID NO: 960398 - RNA, 19 nt, Homo sapiens
gaggaggaacuuaacacua

SEQ ID NO: 960399 - RNA, 19 nt, Homo sapiens
ggaagacauuagaauaagg

SEQ ID NO: 960400 - RNA, 19 nt, Homo sapiens
gguagaaucccuagguuuc

SEQ ID NO: 960401 - RNA, 19 nt, Homo sapiens
caaaaggacagaucauuaa

SEQ ID NO: 960402 - RNA, 19 nt, Homo sapiens
gaauaagguccagaaaugu

SEQ ID NO: 960403 - RNA, 19 nt, Homo sapiens
ggacuggaagacauuagaa

SEQ ID NO: 960404 - RNA, 19 nt, Homo sapiens
caauugaugcuuugacaga

SEQ ID NO: 960405 - RNA, 19 nt, Homo sapiens
aaauguccuugguguguuu

SEQ ID NO: 960406 - RNA, 19 nt, Homo sapiens
gaagugguggcugcuguaa

SEQ ID NO: 960407 - RNA, 19 nt, Homo sapiens
gaagacauuagaauaaggu

SEQ ID NO: 960408 - RNA, 19 nt, Homo sapiens
ucaaaaggacagaucauua

SEQ ID NO: 960409 - RNA, 19 nt, Homo sapiens
guugcucucuugccuaaau

SEQ ID NO: 960410 - RNA, 19 nt, Homo sapiens
aaugaucucuccugguuuc

SEQ ID NO: 960411 - RNA, 19 nt, Homo sapiens
guucuugcuucaauugaug

SEQ ID NO: 960412 - RNA, 19 nt, Homo sapiens
gcuguagccuugaagacau

SEQ ID NO: 960413 - RNA, 19 nt, Homo sapiens
cuggaagacauuagaauaa

SEQ ID NO: 960414 - RNA, 19 nt, Homo sapiens
uccaugcccuucuuuguau

SEQ ID NO: 960415 - RNA, 19 nt, Homo sapiens
gacaacauugcagcauuua

SEQ ID NO: 960416 - RNA, 19 nt, Homo sapiens
cgcgagagcagcugucuaa

SEQ ID NO: 960417 - RNA, 19 nt, Homo sapiens
gaugcagaguuagcuguga

SEQ ID NO: 960418 - RNA, 19 nt, Homo sapiens
ggagaucagugccccuauu

SEQ ID NO: 960419 - RNA, 19 nt, Homo sapiens
uugcuucaauugaugcuuu

SEQ ID NO: 960420 - RNA, 19 nt, Homo sapiens
caaaagaggaugcagaguu

SEQ ID NO: 960421 - RNA, 19 nt, Homo sapiens
gacaugacauucgaaacca

SEQ ID NO: 960422 - RNA, 19 nt, Homo sapiens
uagaauaagguccagaaau

SEQ ID NO: 960423 - RNA, 19 nt, Homo sapiens
cacugacuauuauauguug

SEQ ID NO: 960424 - RNA, 19 nt, Homo sapiens
caaacucacagcacagugu

SEQ ID NO: 960425 - RNA, 19 nt, Homo sapiens
ccgaaggccuccgaugguu

SEQ ID NO: 960426 - RNA, 19 nt, Homo sapiens
uaagucaacucgggauuuu

SEQ ID NO: 960427 - RNA, 19 nt, Homo sapiens
uggaagacauuagaauaag

SEQ ID NO: 960428 - RNA, 19 nt, Homo sapiens
guccagaaauguccuuggu

SEQ ID NO: 960429 - RNA, 19 nt, Homo sapiens
gagguucuugcuucaauug

SEQ ID NO: 960430 - RNA, 19 nt, Homo sapiens
auaacucgauugcccauca

SEQ ID NO: 960431 - RNA, 19 nt, Homo sapiens
gggaaaugcaauaccuuau

SEQ ID NO: 960432 - RNA, 19 nt, Homo sapiens
aaagggaaaugcaauaccu

SEQ ID NO: 960433 - RNA, 19 nt, Homo sapiens
ggaggaacuuaacacuaac

SEQ ID NO: 960434 - RNA, 19 nt, Homo sapiens
uagaaucccuagguuucaa

SEQ ID NO: 960435 - RNA, 19 nt, Homo sapiens
cagcugaacaaacaguuga

SEQ ID NO: 960436 - RNA, 19 nt, Homo sapiens
acuggaagacauuagaaua

SEQ ID NO: 960437 - RNA, 19 nt, Homo sapiens
uauugaagguggagcagau

SEQ ID NO: 960438 - RNA, 19 nt, Homo sapiens
ugagguucuugcuucaauu

SEQ ID NO: 960439 - RNA, 19 nt, Homo sapiens
guaauaacuuuggauacac

SEQ ID NO: 960440 - RNA, 19 nt, Homo sapiens
ggguagaaucccuagguuu

SEQ ID NO: 960441 - RNA, 19 nt, Homo sapiens
gaggcagcuugaugagguu

SEQ ID NO: 960442 - RNA, 19 nt, Homo sapiens
gaaugaucucuccugguuu

SEQ ID NO: 960443 - RNA, 19 nt, Homo sapiens
gcagcugaacaaacaguug

SEQ ID NO: 960444 - RNA, 19 nt, Homo sapiens
aaaggacagaucauuaaug

SEQ ID NO: 960445 - RNA, 19 nt, Homo sapiens
cgagagcagcugucuaagu

SEQ ID NO: 960446 - RNA, 19 nt, Homo sapiens
acaggaggaucacaaacuc

SEQ ID NO: 960447 - RNA, 19 nt, Homo sapiens
agugguggcugcuguaaag

SEQ ID NO: 960448 - RNA, 19 nt, Homo sapiens
agggaaaugcaauaccuua

SEQ ID NO: 960449 - RNA, 19 nt, Homo sapiens
caccagaaccacaauccaa

SEQ ID NO: 960450 - RNA, 19 nt, Homo sapiens
cacgcgggaugacaacauu

SEQ ID NO: 960451 - RNA, 19 nt, Homo sapiens
ccugaggacuggaagacau

SEQ ID NO: 960452 - RNA, 19 nt, Homo sapiens
agaaauguccuuggugugu

SEQ ID NO: 960453 - RNA, 19 nt, Homo sapiens
gaagguggagcagaugaca

SEQ ID NO: 960454 - RNA, 19 nt, Homo sapiens
cauauuucccacauuucua

SEQ ID NO: 960455 - RNA, 19 nt, Homo sapiens
gguucuugcuucaauugau

SEQ ID NO: 960456 - RNA, 19 nt, Homo sapiens
gcagcuugaugagguucuu

SEQ ID NO: 960457 - RNA, 19 nt, Homo sapiens
gugggaggcagcuugauga

SEQ ID NO: 960458 - RNA, 19 nt, Homo sapiens
guccaggguaucauuguuu

SEQ ID NO: 960459 - RNA, 19 nt, Homo sapiens
cuaagucaacucgggauuu

SEQ ID NO: 960460 - RNA, 19 nt, Homo sapiens
gcacauuugccagcuguag

SEQ ID NO: 960461 - RNA, 19 nt, Homo sapiens
uaucauuguuuccaaccau

SEQ ID NO: 960462 - RNA, 19 nt, Homo sapiens
gauugcccaucauccugaa

SEQ ID NO: 960463 - RNA, 19 nt, Homo sapiens
ggaacuuaacacuaacaga

SEQ ID NO: 960464 - RNA, 19 nt, Homo sapiens
ggcaacaggcgacaugaca

SEQ ID NO: 960465 - RNA, 19 nt, Homo sapiens
guagaaucccuagguuuca

SEQ ID NO: 960466 - RNA, 19 nt, Homo sapiens
uugaguggcugcgucuaaa

SEQ ID NO: 960467 - RNA, 19 nt, Homo sapiens
gcugagaucaaucgaaacu

SEQ ID NO: 960468 - RNA, 19 nt, Homo sapiens
ccuuggagcuaagugcauu

SEQ ID NO: 960469 - RNA, 19 nt, Homo sapiens
ugaugagguucuugcuuca

SEQ ID NO: 960470 - RNA, 19 nt, Homo sapiens
ggacucaggcggaucuuga

SEQ ID NO: 960471 - RNA, 19 nt, Homo sapiens
ggugaacgccauccucuuu

SEQ ID NO: 960472 - RNA, 19 nt, Homo sapiens
gaccacggguuccacuuug

SEQ ID NO: 960473 - RNA, 19 nt, Homo sapiens
ccaaggugauggcccuaga

SEQ ID NO: 960474 - RNA, 19 nt, Homo sapiens
caaguuugcugagguagag

SEQ ID NO: 960475 - RNA, 19 nt, Homo sapiens
uaacuaaccauagcgucua

SEQ ID NO: 960476 - RNA, 19 nt, Homo sapiens
gaaccugcgugcggucauc

SEQ ID NO: 960477 - RNA, 19 nt, Homo sapiens
cccaaucccuccaauaaac

SEQ ID NO: 960478 - RNA, 19 nt, Homo sapiens
gauccgagugaaugcagua

SEQ ID NO: 960479 - RNA, 19 nt, Homo sapiens
cacaagauccgagugaaug

SEQ ID NO: 960480 - RNA, 19 nt, Homo sapiens
ccacaagauccgagugaau

SEQ ID NO: 960481 - RNA, 19 nt, Homo sapiens
ugaccacggguuccacuuu

SEQ ID NO: 960482 - RNA, 19 nt, Homo sapiens
ccacaaggccaagacuaug

SEQ ID NO: 960483 - RNA, 19 nt, Homo sapiens
acagauccuuugaggugaa

SEQ ID NO: 960484 - RNA, 19 nt, Homo sapiens
ggcaguaacuaaccauagc

SEQ ID NO: 960485 - RNA, 19 nt, Homo sapiens
gcugagcucccuccacaca

SEQ ID NO: 960486 - RNA, 19 nt, Homo sapiens
ccgagugaaugcaguaaac

SEQ ID NO: 960487 - RNA, 19 nt, Homo sapiens
gggcaguaacuaaccauag

SEQ ID NO: 960488 - RNA, 19 nt, Homo sapiens
ccguggaccugcuggugaa

SEQ ID NO: 960489 - RNA, 19 nt, Homo sapiens
gaaaauggauuacgugaua

SEQ ID NO: 960490 - RNA, 19 nt, Homo sapiens
caacaaacacugaugauaa

SEQ ID NO: 960491 - RNA, 19 nt, Homo sapiens
ugaaauagauacuggagaa

SEQ ID NO: 960492 - RNA, 19 nt, Homo sapiens
ggauggaucuuuacaugug

SEQ ID NO: 960493 - RNA, 19 nt, Homo sapiens
caaagauccuucaaacaug

SEQ ID NO: 960494 - RNA, 19 nt, Homo sapiens
gaaguuaacaguggaauau

SEQ ID NO: 960495 - RNA, 19 nt, Homo sapiens
guaucuagcuucugaguuc

SEQ ID NO: 960496 - RNA, 19 nt, Homo sapiens
cugcagcucuucuugcuua

SEQ ID NO: 960497 - RNA, 19 nt, Homo sapiens
gcugcuggauuuaauguuu

SEQ ID NO: 960498 - RNA, 19 nt, Homo sapiens
gaauauaucggguucuuuc

SEQ ID NO: 960499 - RNA, 19 nt, Homo sapiens
ggaacauccuuaucucuca

SEQ ID NO: 960500 - RNA, 19 nt, Homo sapiens
gaagcaggaauucuuauug

SEQ ID NO: 960501 - RNA, 19 nt, Homo sapiens
ccaaagauccuucaaacau

SEQ ID NO: 960502 - RNA, 19 nt, Homo sapiens
ggaagaacucugccaaaga

SEQ ID NO: 960503 - RNA, 19 nt, Homo sapiens
ggcagaagcuccagugauc

SEQ ID NO: 960504 - RNA, 19 nt, Homo sapiens
aaagauccuucaaacauga

SEQ ID NO: 960505 - RNA, 19 nt, Homo sapiens
cacaguaucuagcuucuga

SEQ ID NO: 960506 - RNA, 19 nt, Homo sapiens
uaacaucgguggugcacau

SEQ ID NO: 960507 - RNA, 19 nt, Homo sapiens
uacagcaacugauuaaaga

SEQ ID NO: 960508 - RNA, 19 nt, Homo sapiens
ccagacugauauuuaguaa

SEQ ID NO: 960509 - RNA, 19 nt, Homo sapiens
gggaagaacucugccaaag

SEQ ID NO: 960510 - RNA, 19 nt, Homo sapiens
ccaaagaggaaaccaaguu

SEQ ID NO: 960511 - RNA, 19 nt, Homo sapiens
agaaauacaucgcggaaag

SEQ ID NO: 960512 - RNA, 19 nt, Homo sapiens
ggaaguuaacaguggaaua

SEQ ID NO: 960513 - RNA, 19 nt, Homo sapiens
ugaagagauuguuggauug

SEQ ID NO: 960514 - RNA, 19 nt, Homo sapiens
ucaagaaacuggaaaaugu

SEQ ID NO: 960515 - RNA, 19 nt, Homo sapiens
cagaugauaucaacaaggu

SEQ ID NO: 960516 - RNA, 19 nt, Homo sapiens
gggcucagaugcaaaugau

SEQ ID NO: 960517 - RNA, 19 nt, Homo sapiens
ugaaagaaacggcacauuc

SEQ ID NO: 960518 - RNA, 19 nt, Homo sapiens
gaagauguugccagacuga

SEQ ID NO: 960519 - RNA, 19 nt, Homo sapiens
gaagacaacacacauugca

SEQ ID NO: 960520 - RNA, 19 nt, Homo sapiens
augaagagauuguuggauu

SEQ ID NO: 960521 - RNA, 19 nt, Homo sapiens
gaugaagugaucccuauug

SEQ ID NO: 960522 - RNA, 19 nt, Homo sapiens
cagaaaccuuagcacagua

SEQ ID NO: 960523 - RNA, 19 nt, Homo sapiens
gaaaugcgcgagccaugau

SEQ ID NO: 960524 - RNA, 19 nt, Homo sapiens
ggaaaugcgcgagccauga

SEQ ID NO: 960525 - RNA, 19 nt, Homo sapiens
gggcuggugugguugcaaa

SEQ ID NO: 960526 - RNA, 19 nt, Homo sapiens
aauagauacuggagaagaa

SEQ ID NO: 960527 - RNA, 19 nt, Homo sapiens
uagcuguucuuacuaugaa

SEQ ID NO: 960528 - RNA, 19 nt, Homo sapiens
gcaagccccuggaagcaua

SEQ ID NO: 960529 - RNA, 19 nt, Homo sapiens
gagcaagauuugaacuucu

SEQ ID NO: 960530 - RNA, 19 nt, Homo sapiens
ggacaagacuccccuacug

SEQ ID NO: 960531 - RNA, 19 nt, Homo sapiens
gauggaucuuuacauguga

SEQ ID NO: 960532 - RNA, 19 nt, Homo sapiens
gaaacggcacauucuguau

SEQ ID NO: 960533 - RNA, 19 nt, Homo sapiens
gggaaauuacgauaugaaa

SEQ ID NO: 960534 - RNA, 19 nt, Homo sapiens
ggauuuacagcagaugaua

SEQ ID NO: 960535 - RNA, 19 nt, Homo sapiens
gcgaaacauucuuugucaa

SEQ ID NO: 960536 - RNA, 19 nt, Homo sapiens
cagaagauguugccagacu

SEQ ID NO: 960537 - RNA, 19 nt, Homo sapiens
guguauaagugguguuugu

SEQ ID NO: 960538 - RNA, 19 nt, Homo sapiens
gacaugcacagaucaagaa

SEQ ID NO: 960539 - RNA, 19 nt, Homo sapiens
uauaugaagggcaagauuu

SEQ ID NO: 960540 - RNA, 19 nt, Homo sapiens
ucaacaaacacugaugaua

SEQ ID NO: 960541 - RNA, 19 nt, Homo sapiens
gauagcaucuuaguguuuu

SEQ ID NO: 960542 - RNA, 19 nt, Homo sapiens
cuccagcuguuguugcuua

SEQ ID NO: 960543 - RNA, 19 nt, Homo sapiens
gcaacugauuaaagaucuu

SEQ ID NO: 960544 - RNA, 19 nt, Homo sapiens
ccaaagcuacagcaacuga

SEQ ID NO: 960545 - RNA, 19 nt, Homo sapiens
aacgaacagugcugaagua

SEQ ID NO: 960546 - RNA, 19 nt, Homo sapiens
acagaaaccuuagcacagu

SEQ ID NO: 960547 - RNA, 19 nt, Homo sapiens
guugccagacugauauuua

SEQ ID NO: 960548 - RNA, 19 nt, Homo sapiens
aaugggaaauuacgauaug

SEQ ID NO: 960549 - RNA, 19 nt, Homo sapiens
cagcagaugauaucaacaa

SEQ ID NO: 960550 - RNA, 19 nt, Homo sapiens
gcucagaugcaaaugaugu

SEQ ID NO: 960551 - RNA, 19 nt, Homo sapiens
guauugggcucagaugcaa

SEQ ID NO: 960552 - RNA, 19 nt, Homo sapiens
gauguugccagacugauau

SEQ ID NO: 960553 - RNA, 19 nt, Homo sapiens
cgugauauauuagcuguuc

SEQ ID NO: 960554 - RNA, 19 nt, Homo sapiens
gugcugaaguagcgaaaca

SEQ ID NO: 960555 - RNA, 19 nt, Homo sapiens
cgcgagccaugaugaaauu

SEQ ID NO: 960556 - RNA, 19 nt, Homo sapiens
agaugcaaaugauguaguu

SEQ ID NO: 960557 - RNA, 19 nt, Homo sapiens
caucgguggugcacauuuc

SEQ ID NO: 960558 - RNA, 19 nt, Homo sapiens
aaacggcacauucuguauu

SEQ ID NO: 960559 - RNA, 19 nt, Homo sapiens
auacaucgcggaaaguaaa

SEQ ID NO: 960560 - RNA, 19 nt, Homo sapiens
uagagcugcuggauuuaau

SEQ ID NO: 960561 - RNA, 19 nt, Homo sapiens
gccagacugauauuuagua

SEQ ID NO: 960562 - RNA, 19 nt, Homo sapiens
agggauggaucuuuacaug

SEQ ID NO: 960563 - RNA, 19 nt, Homo sapiens
aagcaggaauucuuauugg

SEQ ID NO: 960564 - RNA, 19 nt, Homo sapiens
cugaugaagugaucccuau

SEQ ID NO: 960565 - RNA, 19 nt, Homo sapiens
uuacugucccguuugauuu

SEQ ID NO: 960566 - RNA, 19 nt, Homo sapiens
guacuccaggauuuagaua

SEQ ID NO: 960567 - RNA, 19 nt, Homo sapiens
cagugugccuugaacucua

SEQ ID NO: 960568 - RNA, 19 nt, Homo sapiens
cuacagcaacugauuaaag

SEQ ID NO: 960569 - RNA, 19 nt, Homo sapiens
agagcaagauuugaacuuc

SEQ ID NO: 960570 - RNA, 19 nt, Homo sapiens
gagccaugaugaaauuaac

SEQ ID NO: 960571 - RNA, 19 nt, Homo sapiens
ggaauauaucggguucuuu

SEQ ID NO: 960572 - RNA, 19 nt, Homo sapiens
gaaaaugaagagauuguug

SEQ ID NO: 960573 - RNA, 19 nt, Homo sapiens
gaaauacaucgcggaaagu

SEQ ID NO: 960574 - RNA, 19 nt, Homo sapiens
guauaagugguguuuguau

SEQ ID NO: 960575 - RNA, 19 nt, Homo sapiens
caaguuugcacagguugua

SEQ ID NO: 960576 - RNA, 19 nt, Homo sapiens
guccagagcaagauuugaa

SEQ ID NO: 960577 - RNA, 19 nt, Homo sapiens
ugaaguagcgaaacauucu

SEQ ID NO: 960578 - RNA, 19 nt, Homo sapiens
gcugaaguagcgaaacauu

SEQ ID NO: 960579 - RNA, 19 nt, Homo sapiens
aagcuacagcaacugauua

SEQ ID NO: 960580 - RNA, 19 nt, Homo sapiens
cuucuuuguucuccacuuu

SEQ ID NO: 960581 - RNA, 19 nt, Homo sapiens
aaauacaucgcggaaagua

SEQ ID NO: 960582 - RNA, 19 nt, Homo sapiens
uaacgaacagugcugaagu

SEQ ID NO: 960583 - RNA, 19 nt, Homo sapiens
cuucugaguuccaaagauc

SEQ ID NO: 960584 - RNA, 19 nt, Homo sapiens
ucgcggaaaguaaauguuu

SEQ ID NO: 960585 - RNA, 19 nt, Homo sapiens
aacaaacacugaugauaac

SEQ ID NO: 960586 - RNA, 19 nt, Homo sapiens
uggaauauaucggguucuu

SEQ ID NO: 960587 - RNA, 19 nt, Homo sapiens
uuauuacugucccguuuga

SEQ ID NO: 960588 - RNA, 19 nt, Homo sapiens
ugacaugcacagaucaaga

SEQ ID NO: 960589 - RNA, 19 nt, Homo sapiens
gagaagaccuagaauuuaa

SEQ ID NO: 960590 - RNA, 19 nt, Homo sapiens
gaagaaagcaugaacauug

SEQ ID NO: 960591 - RNA, 19 nt, Homo sapiens
ggaccuagauaacaaguaa

SEQ ID NO: 960592 - RNA, 19 nt, Homo sapiens
gaaacugacuaaagcuaua

SEQ ID NO: 960593 - RNA, 19 nt, Homo sapiens
gaacauucuucucuucaaa

SEQ ID NO: 960594 - RNA, 19 nt, Homo sapiens
ggagaagaccuagaauuua

SEQ ID NO: 960595 - RNA, 19 nt, Homo sapiens
caugaucucucuagaaauu

SEQ ID NO: 960596 - RNA, 19 nt, Homo sapiens
aaauggaucugcugaguaa

SEQ ID NO: 960597 - RNA, 19 nt, Homo sapiens
gccaugaucucucuagaaa

SEQ ID NO: 960598 - RNA, 19 nt, Homo sapiens
caaaggaacgugaagauga

SEQ ID NO: 960599 - RNA, 19 nt, Homo sapiens
gaacugucuuggccaugua

SEQ ID NO: 960600 - RNA, 19 nt, Homo sapiens
caaccggucuguccaaguu

SEQ ID NO: 960601 - RNA, 19 nt, Homo sapiens
ugaaaugaaugcacauaga

SEQ ID NO: 960602 - RNA, 19 nt, Homo sapiens
caggaugaaugaagaguuu

SEQ ID NO: 960603 - RNA, 19 nt, Homo sapiens
gaccacugcuuaucuguau

SEQ ID NO: 960604 - RNA, 19 nt, Homo sapiens
gcaaggauauauauaagac

SEQ ID NO: 960605 - RNA, 19 nt, Homo sapiens
caacggaggauugguauuu

SEQ ID NO: 960606 - RNA, 19 nt, Homo sapiens
cgagguggaugauguaaug

SEQ ID NO: 960607 - RNA, 19 nt, Homo sapiens
caggucagauugaguugua

SEQ ID NO: 960608 - RNA, 19 nt, Homo sapiens
cagcagaacacuucaacua

SEQ ID NO: 960609 - RNA, 19 nt, Homo sapiens
ucaagaaacugacuaaagc

SEQ ID NO: 960610 - RNA, 19 nt, Homo sapiens
gcagaacacuucaacuacu

SEQ ID NO: 960611 - RNA, 19 nt, Homo sapiens
gaaaugaaugcacauagau

SEQ ID NO: 960612 - RNA, 19 nt, Homo sapiens
uggaguacuuugccaauaa

SEQ ID NO: 960613 - RNA, 19 nt, Homo sapiens
ccagacauguauucuuuau

SEQ ID NO: 960614 - RNA, 19 nt, Homo sapiens
cagcaucacuuuagauuuu

SEQ ID NO: 960615 - RNA, 19 nt, Homo sapiens
ccucaugccugaaucaaau

SEQ ID NO: 960616 - RNA, 19 nt, Homo sapiens
uggagaagaccuagaauuu

SEQ ID NO: 960617 - RNA, 19 nt, Homo sapiens
uauguggacugauugauga

SEQ ID NO: 960618 - RNA, 19 nt, Homo sapiens
gcugcaaggauauauauaa

SEQ ID NO: 960619 - RNA, 19 nt, Homo sapiens
ggaguacuuugccaauaau

SEQ ID NO: 960620 - RNA, 19 nt, Homo sapiens
uucaaaggaugcaauagua

SEQ ID NO: 960621 - RNA, 19 nt, Homo sapiens
guggagucauucaaguuua

SEQ ID NO: 960622 - RNA, 19 nt, Homo sapiens
gguuaaggcuggucuaaac

SEQ ID NO: 960623 - RNA, 19 nt, Homo sapiens
guaaccaucuaaagagcuu

SEQ ID NO: 960624 - RNA, 19 nt, Homo sapiens
ccucuauguuugacgaaua

SEQ ID NO: 960625 - RNA, 19 nt, Homo sapiens
gaugagucuuccucuaugu

SEQ ID NO: 960626 - RNA, 19 nt, Homo sapiens
caaaggaugcaauaguaga

SEQ ID NO: 960627 - RNA, 19 nt, Homo sapiens
uauaacagcaucacuuuag

SEQ ID NO: 960628 - RNA, 19 nt, Homo sapiens
auccagacauguauucuuu

SEQ ID NO: 960629 - RNA, 19 nt, Homo sapiens
guuuauuucuggcaucuug

SEQ ID NO: 960630 - RNA, 19 nt, Homo sapiens
gguggagucauucaaguuu

SEQ ID NO: 960631 - RNA, 19 nt, Homo sapiens
gaucgagguggaugaugua

SEQ ID NO: 960632 - RNA, 19 nt, Homo sapiens
gaccuagaauuuaaagaac

SEQ ID NO: 960633 - RNA, 19 nt, Homo sapiens
aaagcuauauguggacuga

SEQ ID NO: 960634 - RNA, 19 nt, Homo sapiens
cauugcagcauauugauuu

SEQ ID NO: 960635 - RNA, 19 nt, Homo sapiens
aaaggaacgugaagaugag

SEQ ID NO: 960636 - RNA, 19 nt, Homo sapiens
uaaagagcuuguggccaaa

SEQ ID NO: 960637 - RNA, 19 nt, Homo sapiens
ggaugauucucugcgauuc

SEQ ID NO: 960638 - RNA, 19 nt, Homo sapiens
aggcuggucuaaacuuauu

SEQ ID NO: 960639 - RNA, 19 nt, Homo sapiens
gaagaccuagaauuuaaag

SEQ ID NO: 960640 - RNA, 19 nt, Homo sapiens
gcauauugauuuugccauu

SEQ ID NO: 960641 - RNA, 19 nt, Homo sapiens
ugaucgagguggaugaugu

SEQ ID NO: 960642 - RNA, 19 nt, Homo sapiens
aaacuucguucuuuaucag

SEQ ID NO: 960643 - RNA, 19 nt, Homo sapiens
gcauugcagcauauugauu

SEQ ID NO: 960644 - RNA, 19 nt, Homo sapiens
ucagucagaugaagaaagc

SEQ ID NO: 960645 - RNA, 19 nt, Homo sapiens
guggacugauugaugacua

SEQ ID NO: 960646 - RNA, 19 nt, Homo sapiens
aaaguaaccaucuaaagag

SEQ ID NO: 960647 - RNA, 19 nt, Homo sapiens
gagucuuccucuauguuug

SEQ ID NO: 960648 - RNA, 19 nt, Homo sapiens
cagaacacuucaacuacuc

SEQ ID NO: 960649 - RNA, 19 nt, Homo sapiens
agaaugccaggaugaauga

SEQ ID NO: 960650 - RNA, 19 nt, Homo sapiens
gaauuuaaagaaccaaagg

SEQ ID NO: 960651 - RNA, 19 nt, Homo sapiens
gcugacauccgggaacuga

SEQ ID NO: 960652 - RNA, 19 nt, Homo sapiens
cuacagcaugguucgauuu

SEQ ID NO: 960653 - RNA, 19 nt, Homo sapiens
uggagucauucaaguuuau

SEQ ID NO: 960654 - RNA, 19 nt, Homo sapiens
ccauguagaggacgacuau

SEQ ID NO: 960655 - RNA, 19 nt, Homo sapiens
cugcaaggauauauauaag

SEQ ID NO: 960656 - RNA, 19 nt, Homo sapiens
uaacagcaucacuuuagau

SEQ ID NO: 960657 - RNA, 19 nt, Homo sapiens
agaugagucuuccucuaug

SEQ ID NO: 960658 - RNA, 19 nt, Homo sapiens
gaaccaaaggaacgugaag

SEQ ID NO: 960659 - RNA, 19 nt, Homo sapiens
gauccagacauguauucuu

SEQ ID NO: 960660 - RNA, 19 nt, Homo sapiens
auaacagcaucacuuuaga

SEQ ID NO: 960661 - RNA, 19 nt, Homo sapiens
ccaaaggaacgugaagaug

SEQ ID NO: 960662 - RNA, 19 nt, Homo sapiens
ugaagaaagcaugaacauu

SEQ ID NO: 960663 - RNA, 19 nt, Homo sapiens
gaugaagaaagcaugaaca

SEQ ID NO: 960664 - RNA, 19 nt, Homo sapiens
gaaauuccgcaagucaaca

SEQ ID NO: 960665 - RNA, 19 nt, Homo sapiens
ucuuggaccuagauaacaa

SEQ ID NO: 960666 - RNA, 19 nt, Homo sapiens
aaagcugcaaggauauaua

SEQ ID NO: 960667 - RNA, 19 nt, Homo sapiens
ggccaaaccagcagaacau

SEQ ID NO: 960668 - RNA, 19 nt, Homo sapiens
ugagucuuccucuauguuu

SEQ ID NO: 960669 - RNA, 19 nt, Homo sapiens
gaaagcaugaacauugcau

SEQ ID NO: 960670 - RNA, 19 nt, Homo sapiens
aagaaagcaugaacauugc

SEQ ID NO: 960671 - RNA, 19 nt, Homo sapiens
aaaggaugcaauaguagaa

SEQ ID NO: 960672 - RNA, 19 nt, Homo sapiens
ucaagaaugccaggaugaa

SEQ ID NO: 960673 - RNA, 19 nt, Homo sapiens
cuagaaauuccgcaaguca

SEQ ID NO: 960674 - RNA, 19 nt, Homo sapiens
ugagugccaugaucucucu

SEQ ID NO: 960675 - RNA, 19 nt, Homo sapiens
caagaaugccaggaugaau

SEQ ID NO: 960676 - RNA, 19 nt, Homo sapiens
ucaauauggagaagaccua

SEQ ID NO: 960677 - RNA, 19 nt, Homo sapiens
aagaaugccaggaugaaug

SEQ ID NO: 960678 - RNA, 19 nt, Homo sapiens
agcuauauguggacugauu

SEQ ID NO: 960679 - RNA, 19 nt, Homo sapiens
ccgcaagucaacaucauga

SEQ ID NO: 960680 - RNA, 19 nt, Homo sapiens
agaacugucuuggccaugu

SEQ ID NO: 960681 - RNA, 19 nt, Homo sapiens
ucagaugaagaaagcauga

SEQ ID NO: 960682 - RNA, 19 nt, Homo sapiens
aagaaacugacuaaagcua

SEQ ID NO: 960683 - RNA, 19 nt, Homo sapiens
ccaaaccagcagaacauuc

SEQ ID NO: 960684 - RNA, 19 nt, Homo sapiens
aagcaugaacauugcauug

SEQ ID NO: 960685 - RNA, 19 nt, Homo sapiens
agaaacugacuaaagcuau

SEQ ID NO: 960686 - RNA, 19 nt, Homo sapiens
ggagucauucaaguuuauu

SEQ ID NO: 960687 - RNA, 19 nt, Homo sapiens
aagcugcaaggauauauau

SEQ ID NO: 960688 - RNA, 19 nt, Homo sapiens
gagaugcaggaauuacugu

SEQ ID NO: 960689 - RNA, 19 nt, Homo sapiens
ggaagaagaugaaauggaa

SEQ ID NO: 960690 - RNA, 19 nt, Homo sapiens
gagauuauuuccuguguua

SEQ ID NO: 960691 - RNA, 19 nt, Homo sapiens
gaagaccaauguucauaua

SEQ ID NO: 960692 - RNA, 19 nt, Homo sapiens
ggacagacauuaccucuuc

SEQ ID NO: 960693 - RNA, 19 nt, Homo sapiens
ugaaauaaguccagacaaa

SEQ ID NO: 960694 - RNA, 19 nt, Homo sapiens
guauaaggcuugcaacuug

SEQ ID NO: 960695 - RNA, 19 nt, Homo sapiens
gaacaacagcagagauaua

SEQ ID NO: 960696 - RNA, 19 nt, Homo sapiens
gaaauuauugccucugaua

SEQ ID NO: 960697 - RNA, 19 nt, Homo sapiens
gaugauguauugagaauuc

SEQ ID NO: 960698 - RNA, 19 nt, Homo sapiens
gaacggcagucuagaauac

SEQ ID NO: 960699 - RNA, 19 nt, Homo sapiens
gaauugagauagugaaagu

SEQ ID NO: 960700 - RNA, 19 nt, Homo sapiens
guacuucccuuugcuguaa

SEQ ID NO: 960701 - RNA, 19 nt, Homo sapiens
ggaaagggaagcacaguuu

SEQ ID NO: 960702 - RNA, 19 nt, Homo sapiens
caauuagaaucccucaaua

SEQ ID NO: 960703 - RNA, 19 nt, Homo sapiens
gaaagcaauuggaagacaa

SEQ ID NO: 960704 - RNA, 19 nt, Homo sapiens
aaacagaugugauagagau

SEQ ID NO: 960705 - RNA, 19 nt, Homo sapiens
gacauuaccucuucagcuu

SEQ ID NO: 960706 - RNA, 19 nt, Homo sapiens
ucuaagaucugcuuuggaa

SEQ ID NO: 960707 - RNA, 19 nt, Homo sapiens
cgauggagcuuaugugaau

SEQ ID NO: 960708 - RNA, 19 nt, Homo sapiens
gugcaaaucuaacuucaug

SEQ ID NO: 960709 - RNA, 19 nt, Homo sapiens
aaagacaugucaccucaaa

SEQ ID NO: 960710 - RNA, 19 nt, Homo sapiens
uagaaucccucaauaagug

SEQ ID NO: 960711 - RNA, 19 nt, Homo sapiens
gugcugauauggaagaauu

SEQ ID NO: 960712 - RNA, 19 nt, Homo sapiens
gaucugcuuuggaaauuau

SEQ ID NO: 960713 - RNA, 19 nt, Homo sapiens
gaauucagcuccuuaaaau

SEQ ID NO: 960714 - RNA, 19 nt, Homo sapiens
cagaguagcugcuugucuu

SEQ ID NO: 960715 - RNA, 19 nt, Homo sapiens
gagaagaccaauguucaua

SEQ ID NO: 960716 - RNA, 19 nt, Homo sapiens
cauauuggaugggaaguuu

SEQ ID NO: 960717 - RNA, 19 nt, Homo sapiens
agaaauaccagaagagaaa

SEQ ID NO: 960718 - RNA, 19 nt, Homo sapiens
guaaacagaugugauagag

SEQ ID NO: 960719 - RNA, 19 nt, Homo sapiens
gcaggacuuugcacgauga

SEQ ID NO: 960720 - RNA, 19 nt, Homo sapiens
cgacuucgcugugaauuag

SEQ ID NO: 960721 - RNA, 19 nt, Homo sapiens
ucugauacauaccuaagua

SEQ ID NO: 960722 - RNA, 19 nt, Homo sapiens
gcuugcaacuugaaucuga

SEQ ID NO: 960723 - RNA, 19 nt, Homo sapiens
gaauguguguugccuucaa

SEQ ID NO: 960724 - RNA, 19 nt, Homo sapiens
ggguaugccuggacuguug

SEQ ID NO: 960725 - RNA, 19 nt, Homo sapiens
gaagacaaagguucaaagu

SEQ ID NO: 960726 - RNA, 19 nt, Homo sapiens
gaacaggauuuuggaauug

SEQ ID NO: 960727 - RNA, 19 nt, Homo sapiens
aagaugaaauggaaguuga

SEQ ID NO: 960728 - RNA, 19 nt, Homo sapiens
gaaauaaguccagacaaag

SEQ ID NO: 960729 - RNA, 19 nt, Homo sapiens
gcagaaauaccagaagaga

SEQ ID NO: 960730 - RNA, 19 nt, Homo sapiens
ccagcaagcuaaagugcaa

SEQ ID NO: 960731 - RNA, 19 nt, Homo sapiens
gaaagggaagcacaguuug

SEQ ID NO: 960732 - RNA, 19 nt, Homo sapiens
gaacacagucagauggaau

SEQ ID NO: 960733 - RNA, 19 nt, Homo sapiens
caaaguccuugagcuaaga

SEQ ID NO: 960734 - RNA, 19 nt, Homo sapiens
gaaagugaaagcaauugga

SEQ ID NO: 960735 - RNA, 19 nt, Homo sapiens
gacaucacauacauaccua

SEQ ID NO: 960736 - RNA, 19 nt, Homo sapiens
agaaacagcuacgugaaug

SEQ ID NO: 960737 - RNA, 19 nt, Homo sapiens
gaagaugaaauggaaguug

SEQ ID NO: 960738 - RNA, 19 nt, Homo sapiens
gaagcacaguuuggaacaa

SEQ ID NO: 960739 - RNA, 19 nt, Homo sapiens
uauaaaugguggcagaaau

SEQ ID NO: 960740 - RNA, 19 nt, Homo sapiens
caagagaagaccaauguuc

SEQ ID NO: 960741 - RNA, 19 nt, Homo sapiens
cagaugugauagagauaaa

SEQ ID NO: 960742 - RNA, 19 nt, Homo sapiens
cugcuugucuuccuauuga

SEQ ID NO: 960743 - RNA, 19 nt, Homo sapiens
gaaguugaagaccaggaua

SEQ ID NO: 960744 - RNA, 19 nt, Homo sapiens
ggaaauuauugccucugau

SEQ ID NO: 960745 - RNA, 19 nt, Homo sapiens
gcugugaauuagacauuau

SEQ ID NO: 960746 - RNA, 19 nt, Homo sapiens
ccuaggugcugauauggaa

SEQ ID NO: 960747 - RNA, 19 nt, Homo sapiens
gguugcaguuucuaaguga

SEQ ID NO: 960748 - RNA, 19 nt, Homo sapiens
ucaguauggugcggaauuu

SEQ ID NO: 960749 - RNA, 19 nt, Homo sapiens
uauaaggcuugcaacuuga

SEQ ID NO: 960750 - RNA, 19 nt, Homo sapiens
uaaauguacuucccuuugc

SEQ ID NO: 960751 - RNA, 19 nt, Homo sapiens
auaaaugguggcagaaaua

SEQ ID NO: 960752 - RNA, 19 nt, Homo sapiens
ucaauuagaaucccucaau

SEQ ID NO: 960753 - RNA, 19 nt, Homo sapiens
agaccaggauaguaaagaa

SEQ ID NO: 960754 - RNA, 19 nt, Homo sapiens
gcaauuggaagacaaaggu

SEQ ID NO: 960755 - RNA, 19 nt, Homo sapiens
ugaggaagaagaugaaaug

SEQ ID NO: 960756 - RNA, 19 nt, Homo sapiens
gaaguuuacggccaccaaa

SEQ ID NO: 960757 - RNA, 19 nt, Homo sapiens
caagaaacagcuacgugaa

SEQ ID NO: 960758 - RNA, 19 nt, Homo sapiens
cucaauaagugccagauau

SEQ ID NO: 960759 - RNA, 19 nt, Homo sapiens
caugucugcaguucaauua

SEQ ID NO: 960760 - RNA, 19 nt, Homo sapiens
uaagaucugcuuuggaaau

SEQ ID NO: 960761 - RNA, 19 nt, Homo sapiens
auaccuaggugcugauaug

SEQ ID NO: 960762 - RNA, 19 nt, Homo sapiens
uggcagaaauaccagaaga

SEQ ID NO: 960763 - RNA, 19 nt, Homo sapiens
ccagauauuuccuucaaaa

SEQ ID NO: 960764 - RNA, 19 nt, Homo sapiens
cacugaagaugaaauaagu

SEQ ID NO: 960765 - RNA, 19 nt, Homo sapiens
agacacugaagaugaaaua

SEQ ID NO: 960766 - RNA, 19 nt, Homo sapiens
gagaauucagcuccuuaaa

SEQ ID NO: 960767 - RNA, 19 nt, Homo sapiens
uggaacaacagcagagaua

SEQ ID NO: 960768 - RNA, 19 nt, Homo sapiens
uugaagaccaggauaguaa

SEQ ID NO: 960769 - RNA, 19 nt, Homo sapiens
uggaaauuauugccucuga

SEQ ID NO: 960770 - RNA, 19 nt, Homo sapiens
gaugaaauaaguccagaca

SEQ ID NO: 960771 - RNA, 19 nt, Homo sapiens
augauucucuuccuucaaa

SEQ ID NO: 960772 - RNA, 19 nt, Homo sapiens
cuacgugaaugggaugaaa

SEQ ID NO: 960773 - RNA, 19 nt, Homo sapiens
caagcuaaagugcaaauuc

SEQ ID NO: 960774 - RNA, 19 nt, Homo sapiens
ugaaagcaauuggaagaca

SEQ ID NO: 960775 - RNA, 19 nt, Homo sapiens
agacaucuuuggaaaugau

SEQ ID NO: 960776 - RNA, 19 nt, Homo sapiens
ugaaugggaugaaaaucua

SEQ ID NO: 960777 - RNA, 19 nt, Homo sapiens
cccagacacugaagaugaa

SEQ ID NO: 960778 - RNA, 19 nt, Homo sapiens
aagcuaaagugcaaauucu

SEQ ID NO: 960779 - RNA, 19 nt, Homo sapiens
uguggaaucugauaugucu

SEQ ID NO: 960780 - RNA, 19 nt, Homo sapiens
gccauuauccuguggaauc

SEQ ID NO: 960781 - RNA, 19 nt, Homo sapiens
aagaucugcuuuggaaauu

SEQ ID NO: 960782 - RNA, 19 nt, Homo sapiens
cuuguaaacagaugugaua

SEQ ID NO: 960783 - RNA, 19 nt, Homo sapiens
aauaaguccagacaaagua

SEQ ID NO: 960784 - RNA, 19 nt, Homo sapiens
ugccagauauuuccuucaa

SEQ ID NO: 960785 - RNA, 19 nt, Homo sapiens
aaccaugucugcaguucaa

SEQ ID NO: 960786 - RNA, 19 nt, Homo sapiens
gcuaaagugcaaauucuuc

SEQ ID NO: 960787 - RNA, 19 nt, Homo sapiens
ugagauagugaaagugaaa

SEQ ID NO: 960788 - RNA, 19 nt, Homo sapiens
uagaauaccagaaacaucu

SEQ ID NO: 960789 - RNA, 19 nt, Homo sapiens
gaagagagguagacagaua

SEQ ID NO: 960790 - RNA, 19 nt, Homo sapiens
ggacauaacuugugaagga

SEQ ID NO: 960791 - RNA, 19 nt, Homo sapiens
gaagauauguuuagagaag

SEQ ID NO: 960792 - RNA, 19 nt, Homo sapiens
guagacagauacaagauga

SEQ ID NO: 960793 - RNA, 19 nt, Homo sapiens
caacaggcauuuaagcaau

SEQ ID NO: 960794 - RNA, 19 nt, Homo sapiens
caaagaagaauaagcaaga

SEQ ID NO: 960795 - RNA, 19 nt, Homo sapiens
gaaggaaggaagagaggua

SEQ ID NO: 960796 - RNA, 19 nt, Homo sapiens
ugaaauagaugagauaagg

SEQ ID NO: 960797 - RNA, 19 nt, Homo sapiens
guggugggauuaugaauga

SEQ ID NO: 960798 - RNA, 19 nt, Homo sapiens
guuggaagguuaaucgaaa

SEQ ID NO: 960799 - RNA, 19 nt, Homo sapiens
gugaugcguuggaagguua

SEQ ID NO: 960800 - RNA, 19 nt, Homo sapiens
aagaugaaauccugucaaa

SEQ ID NO: 960801 - RNA, 19 nt, Homo sapiens
gcaaugaagauauguuuag

SEQ ID NO: 960802 - RNA, 19 nt, Homo sapiens
agaaguggaugaaauagau

SEQ ID NO: 960803 - RNA, 19 nt, Homo sapiens
cuuauaaccuguugcuauu

SEQ ID NO: 960804 - RNA, 19 nt, Homo sapiens
gaagaauaagcaagaaaga

SEQ ID NO: 960805 - RNA, 19 nt, Homo sapiens
uagagaaguggaugaaaua

SEQ ID NO: 960806 - RNA, 19 nt, Homo sapiens
uuagagaaguggaugaaau

SEQ ID NO: 960807 - RNA, 19 nt, Homo sapiens
ggaugaaauagaugagaua

SEQ ID NO: 960808 - RNA, 19 nt, Homo sapiens
cauaacuugugaaggauga

SEQ ID NO: 960809 - RNA, 19 nt, Homo sapiens
acaagucucugucuuuuaa

SEQ ID NO: 960810 - RNA, 19 nt, Homo sapiens
gaugagauaaggagaguca

SEQ ID NO: 960811 - RNA, 19 nt, Homo sapiens
auacacaacaggcauuuaa

SEQ ID NO: 960812 - RNA, 19 nt, Homo sapiens
agagaaaggcugauucaau

SEQ ID NO: 960813 - RNA, 19 nt, Homo sapiens
gugggauuaugaaugauuu

SEQ ID NO: 960814 - RNA, 19 nt, Homo sapiens
ugauauuccuuuguccaua

SEQ ID NO: 960815 - RNA, 19 nt, Homo sapiens
gagucaaacuugcgggaau

SEQ ID NO: 960816 - RNA, 19 nt, Homo sapiens
gagaaguggaugaaauaga

SEQ ID NO: 960817 - RNA, 19 nt, Homo sapiens
cagaagucauuguauucaa

SEQ ID NO: 960818 - RNA, 19 nt, Homo sapiens
ugccagaagucauuguauu

SEQ ID NO: 960819 - RNA, 19 nt, Homo sapiens
gaaauagaugagauaagga

SEQ ID NO: 960820 - RNA, 19 nt, Homo sapiens
gagauaaggagagucagaa

SEQ ID NO: 960821 - RNA, 19 nt, Homo sapiens
gaagaaacugacccgauca

SEQ ID NO: 960822 - RNA, 19 nt, Homo sapiens
uaaggagagucagaaacaa

SEQ ID NO: 960823 - RNA, 19 nt, Homo sapiens
gauauacacaacaggcauu

SEQ ID NO: 960824 - RNA, 19 nt, Homo sapiens
gagguagacagauacaaga

SEQ ID NO: 960825 - RNA, 19 nt, Homo sapiens
gcaucucauuguuuauugu

SEQ ID NO: 960826 - RNA, 19 nt, Homo sapiens
agagucagaaacaaacuua

SEQ ID NO: 960827 - RNA, 19 nt, Homo sapiens
ccagcaagacccaaagcua

SEQ ID NO: 960828 - RNA, 19 nt, Homo sapiens
uccaggaguuuaaagaaga

SEQ ID NO: 960829 - RNA, 19 nt, Homo sapiens
agagugaaccaaagcauga

SEQ ID NO: 960830 - RNA, 19 nt, Homo sapiens
aaccaaagcaugaggaaga

SEQ ID NO: 960831 - RNA, 19 nt, Homo sapiens
gcaagacccaaagcuagaa

SEQ ID NO: 960832 - RNA, 19 nt, Homo sapiens
ugugaaggaugaaagaaag

SEQ ID NO: 960833 - RNA, 19 nt, Homo sapiens
gcgggaauuuugcaguuua

SEQ ID NO: 960834 - RNA, 19 nt, Homo sapiens
gaaggaugaaagaaaguca

SEQ ID NO: 960835 - RNA, 19 nt, Homo sapiens
cagaaacaaacuuauagug

SEQ ID NO: 960836 - RNA, 19 nt, Homo sapiens
gacauaacuugugaaggau

SEQ ID NO: 960837 - RNA, 19 nt, Homo sapiens
agacagauacaagaugaaa

SEQ ID NO: 960838 - RNA, 19 nt, Homo sapiens
gguaaucugguccuuguuc

SEQ ID NO: 960839 - RNA, 19 nt, Homo sapiens
gaagucauuguauucaaag

SEQ ID NO: 960840 - RNA, 19 nt, Homo sapiens
uaucugcaucucauuguuu

SEQ ID NO: 960841 - RNA, 19 nt, Homo sapiens
aagaagauauacacaacag

SEQ ID NO: 960842 - RNA, 19 nt, Homo sapiens
acagauacaagaugaaauc

SEQ ID NO: 960843 - RNA, 19 nt, Homo sapiens
gccagaagucauuguauuc

SEQ ID NO: 960844 - RNA, 19 nt, Homo sapiens
aaggcuaaguaauauguga

SEQ ID NO: 960845 - RNA, 19 nt, Homo sapiens
cuacaagucucugucuuuu

SEQ ID NO: 960846 - RNA, 19 nt, Homo sapiens
ucuacaagucucugucuuu

SEQ ID NO: 960847 - RNA, 19 nt, Homo sapiens
gaaguggaugaaauagaug

SEQ ID NO: 960848 - RNA, 19 nt, Homo sapiens
guggaaggagucaaacuug

SEQ ID NO: 960849 - RNA, 19 nt, Homo sapiens
ccaggaguuuaaagaagau

SEQ ID NO: 960850 - RNA, 19 nt, Homo sapiens
ggaaggaaaaccagaaaau

SEQ ID NO: 960851 - RNA, 19 nt, Homo sapiens
gaaggaagagagguagaca

SEQ ID NO: 960852 - RNA, 19 nt, Homo sapiens
gucauuguauucaaagaag

SEQ ID NO: 960853 - RNA, 19 nt, Homo sapiens
ggugggauuaugaaugauu

SEQ ID NO: 960854 - RNA, 19 nt, Homo sapiens
cugguaaucugguccuugu

SEQ ID NO: 960855 - RNA, 19 nt, Homo sapiens
uagaugagauaaggagagu

SEQ ID NO: 960856 - RNA, 19 nt, Homo sapiens
uggaugaaauagaugagau

SEQ ID NO: 960857 - RNA, 19 nt, Homo sapiens
gaaggaaaaccagaaaaug

SEQ ID NO: 960858 - RNA, 19 nt, Homo sapiens
agucaaacuugcgggaauu

SEQ ID NO: 960859 - RNA, 19 nt, Homo sapiens
aaaugagagugaaccaaag

SEQ ID NO: 960860 - RNA, 19 nt, Homo sapiens
caagaugaaauccugucaa

SEQ ID NO: 960861 - RNA, 19 nt, Homo sapiens
ccagaagucauuguauuca

SEQ ID NO: 960862 - RNA, 19 nt, Homo sapiens
gagagucagaaacaaacuu

SEQ ID NO: 960863 - RNA, 19 nt, Homo sapiens
auaaggagagucagaaaca

SEQ ID NO: 960864 - RNA, 19 nt, Homo sapiens
ggaggaggccaaagcaaaa

SEQ ID NO: 960865 - RNA, 19 nt, Homo sapiens
gguagacagauacaagaug

SEQ ID NO: 960866 - RNA, 19 nt, Homo sapiens
uuaaucgaaaccauccuua

SEQ ID NO: 960867 - RNA, 19 nt, Homo sapiens
gucagaaacaaacuuauag

SEQ ID NO: 960868 - RNA, 19 nt, Homo sapiens
aaggagagucagaaacaaa

SEQ ID NO: 960869 - RNA, 19 nt, Homo sapiens
gauaaggagagucagaaac

SEQ ID NO: 960870 - RNA, 19 nt, Homo sapiens
gguggugggauuaugaaug

SEQ ID NO: 960871 - RNA, 19 nt, Homo sapiens
caagacccaaagcuagaaa

SEQ ID NO: 960872 - RNA, 19 nt, Homo sapiens
uaaccuguugcuauuaaug

SEQ ID NO: 960873 - RNA, 19 nt, Homo sapiens
ugagauaaggagagucaga

SEQ ID NO: 960874 - RNA, 19 nt, Homo sapiens
gagccaaagccugaggaaa

SEQ ID NO: 960875 - RNA, 19 nt, Homo sapiens
aggaagagagguagacaga

SEQ ID NO: 960876 - RNA, 19 nt, Homo sapiens
cuguugcuauuaaugguuu

SEQ ID NO: 960877 - RNA, 19 nt, Homo sapiens
gcccguggaaggagucaaa

SEQ ID NO: 960878 - RNA, 19 nt, Homo sapiens
acaacaggcauuuaagcaa

SEQ ID NO: 960879 - RNA, 19 nt, Homo sapiens
uuagagaaaggcugauuca

SEQ ID NO: 960880 - RNA, 19 nt, Homo sapiens
agaagaauaagcaagaaag

SEQ ID NO: 960881 - RNA, 19 nt, Homo sapiens
gaucagugccagaagucau

SEQ ID NO: 960882 - RNA, 19 nt, Homo sapiens
aucugcaucucauuguuua

SEQ ID NO: 960883 - RNA, 19 nt, Homo sapiens
acuuauaaccuguugcuau

SEQ ID NO: 960884 - RNA, 19 nt, Homo sapiens
cugcagggcuguuguuucc

SEQ ID NO: 960885 - RNA, 19 nt, Homo sapiens
agauauguuuagagaagug

SEQ ID NO: 960886 - RNA, 19 nt, Homo sapiens
aggaggaggccaaagcaaa

SEQ ID NO: 960887 - RNA, 19 nt, Homo sapiens
cagaagaggaggagaagcu

SEQ ID NO: 960888 - RNA, 19 nt, Homo sapiens
aaaaugagagugaaccaaa

SEQ ID NO: 960889 - RNA, 19 nt, Homo sapiens
gaagagaguugaagaaauc

SEQ ID NO: 960890 - RNA, 19 nt, Homo sapiens
gaaagcagcugguaaagag

SEQ ID NO: 960891 - RNA, 19 nt, Homo sapiens
gaugagaacugaauaaucu

SEQ ID NO: 960892 - RNA, 19 nt, Homo sapiens
gcgccaagcuaaauuuaua

SEQ ID NO: 960893 - RNA, 19 nt, Homo sapiens
ggaaacaguuggaagagaa

SEQ ID NO: 960894 - RNA, 19 nt, Homo sapiens
acacuacacucuagaauuu

SEQ ID NO: 960895 - RNA, 19 nt, Homo sapiens
guacaacguauguucauua

SEQ ID NO: 960896 - RNA, 19 nt, Homo sapiens
gcacuaggcagcauuugua

SEQ ID NO: 960897 - RNA, 19 nt, Homo sapiens
gaagugaauuguggacgua

SEQ ID NO: 960898 - RNA, 19 nt, Homo sapiens
uaauuaugcuggacuguuu

SEQ ID NO: 960899 - RNA, 19 nt, Homo sapiens
gaaaagcgauuaaaagaca

SEQ ID NO: 960900 - RNA, 19 nt, Homo sapiens
acuuggaacugcuaaauua

SEQ ID NO: 960901 - RNA, 19 nt, Homo sapiens
cauggaagaugcuccuuaa

SEQ ID NO: 960902 - RNA, 19 nt, Homo sapiens
auaaagagcuacagaaagu

SEQ ID NO: 960903 - RNA, 19 nt, Homo sapiens
gcgcaauccucgcaaaguu

SEQ ID NO: 960904 - RNA, 19 nt, Homo sapiens
gaccaaagcauuccggaaa

SEQ ID NO: 960905 - RNA, 19 nt, Homo sapiens
caacuugugauuccugaua

SEQ ID NO: 960906 - RNA, 19 nt, Homo sapiens
gaagcgcaauccucgcaaa

SEQ ID NO: 960907 - RNA, 19 nt, Homo sapiens
gaaaguucaggauaucaaa

SEQ ID NO: 960908 - RNA, 19 nt, Homo sapiens
gaagcgccaagcuaaauuu

SEQ ID NO: 960909 - RNA, 19 nt, Homo sapiens
aaaguuagguggaccaaag

SEQ ID NO: 960910 - RNA, 19 nt, Homo sapiens
gaacagacuuuacuuuucu

SEQ ID NO: 960911 - RNA, 19 nt, Homo sapiens
ggcagcauuuguauaguaa

SEQ ID NO: 960912 - RNA, 19 nt, Homo sapiens
gcauugccaucuacauaau

SEQ ID NO: 960913 - RNA, 19 nt, Homo sapiens
aaacagaagcgccaagcua

SEQ ID NO: 960914 - RNA, 19 nt, Homo sapiens
ugaagagaguugaagaaau

SEQ ID NO: 960915 - RNA, 19 nt, Homo sapiens
ggagaauacucaguuccaa

SEQ ID NO: 960916 - RNA, 19 nt, Homo sapiens
gauugcaucucaguguuaa

SEQ ID NO: 960917 - RNA, 19 nt, Homo sapiens
ucaaagaagucaagcaaaa

SEQ ID NO: 960918 - RNA, 19 nt, Homo sapiens
cuacagaaaguucaggaua

SEQ ID NO: 960919 - RNA, 19 nt, Homo sapiens
ggaaagcagcugguaaaga

SEQ ID NO: 960920 - RNA, 19 nt, Homo sapiens
agacaucuuuccugcauug

SEQ ID NO: 960921 - RNA, 19 nt, Homo sapiens
uacagaaaguucaggauau

SEQ ID NO: 960922 - RNA, 19 nt, Homo sapiens
gcccagcauugaucuagaa

SEQ ID NO: 960923 - RNA, 19 nt, Homo sapiens
gcaguaaaauauucccuuu

SEQ ID NO: 960924 - RNA, 19 nt, Homo sapiens
guauggcagugucagauau

SEQ ID NO: 960925 - RNA, 19 nt, Homo sapiens
auucauggcuagugaugua

SEQ ID NO: 960926 - RNA, 19 nt, Homo sapiens
gggaaacaguuggaagaga

SEQ ID NO: 960927 - RNA, 19 nt, Homo sapiens
gagcuuacaguggauaauu

SEQ ID NO: 960928 - RNA, 19 nt, Homo sapiens
acucuagaauuuccacuuu

SEQ ID NO: 960929 - RNA, 19 nt, Homo sapiens
aggcagcauuuguauagua

SEQ ID NO: 960930 - RNA, 19 nt, Homo sapiens
cagcauugaucuagaagca

SEQ ID NO: 960931 - RNA, 19 nt, Homo sapiens
gaaacaguuggaagagaaa

SEQ ID NO: 960932 - RNA, 19 nt, Homo sapiens
gaugaagagaguugaagaa

SEQ ID NO: 960933 - RNA, 19 nt, Homo sapiens
gaaaaugguacagcaguua

SEQ ID NO: 960934 - RNA, 19 nt, Homo sapiens
cgagagcuauggaauaaaa

SEQ ID NO: 960935 - RNA, 19 nt, Homo sapiens
gacacuacacucuagaauu

SEQ ID NO: 960936 - RNA, 19 nt, Homo sapiens
uauuacggauguuagauug

SEQ ID NO: 960937 - RNA, 19 nt, Homo sapiens
gcaaagggaaacaguugga

SEQ ID NO: 960938 - RNA, 19 nt, Homo sapiens
agcgagagcuauggaauaa

SEQ ID NO: 960939 - RNA, 19 nt, Homo sapiens
cagcgagagcuauggaaua

SEQ ID NO: 960940 - RNA, 19 nt, Homo sapiens
guaaaaugguugugcuauu

SEQ ID NO: 960941 - RNA, 19 nt, Homo sapiens
gcaucucaguguuaaaucu

SEQ ID NO: 960942 - RNA, 19 nt, Homo sapiens
gauagaacagacuuuacuu

SEQ ID NO: 960943 - RNA, 19 nt, Homo sapiens
gaugaagccuaauuaugcu

SEQ ID NO: 960944 - RNA, 19 nt, Homo sapiens
cauggcuagugauguauaa

SEQ ID NO: 960945 - RNA, 19 nt, Homo sapiens
acugauagauguacuuaag

SEQ ID NO: 960946 - RNA, 19 nt, Homo sapiens
gaaaaugcccuuuggauac

SEQ ID NO: 960947 - RNA, 19 nt, Homo sapiens
gguacaacguauguucauu

SEQ ID NO: 960948 - RNA, 19 nt, Homo sapiens
uagaagagcauaaugacau

SEQ ID NO: 960949 - RNA, 19 nt, Homo sapiens
ucagauauuacggauguua

SEQ ID NO: 960950 - RNA, 19 nt, Homo sapiens
uaucaaagaagucaagcaa

SEQ ID NO: 960951 - RNA, 19 nt, Homo sapiens
caaauaccagcgagagcua

SEQ ID NO: 960952 - RNA, 19 nt, Homo sapiens
ggaugagaacugaauaauc

SEQ ID NO: 960953 - RNA, 19 nt, Homo sapiens
ccugauagaacagacuuua

SEQ ID NO: 960954 - RNA, 19 nt, Homo sapiens
ugaugaagccuaauuaugc

SEQ ID NO: 960955 - RNA, 19 nt, Homo sapiens
ccaucuacauaauaucaga

SEQ ID NO: 960956 - RNA, 19 nt, Homo sapiens
gagaacugaauaaucuuug

SEQ ID NO: 960957 - RNA, 19 nt, Homo sapiens
aagcaaaacauccaucuua

SEQ ID NO: 960958 - RNA, 19 nt, Homo sapiens
acagaaaguucaggauauc

SEQ ID NO: 960959 - RNA, 19 nt, Homo sapiens
ccggaaagcagcugguaaa

SEQ ID NO: 960960 - RNA, 19 nt, Homo sapiens
cuaggcagcauuuguauag

SEQ ID NO: 960961 - RNA, 19 nt, Homo sapiens
gcaauccucgcaaaguuag

SEQ ID NO: 960962 - RNA, 19 nt, Homo sapiens
cugcauugccaucuacaua

SEQ ID NO: 960963 - RNA, 19 nt, Homo sapiens
aacagaagcgccaagcuaa

SEQ ID NO: 960964 - RNA, 19 nt, Homo sapiens
guagaaaugaaccuaucaa

SEQ ID NO: 960965 - RNA, 19 nt, Homo sapiens
uaaagagcuuacaguggau

SEQ ID NO: 960966 - RNA, 19 nt, Homo sapiens
gaauuuauggguacaacgu

SEQ ID NO: 960967 - RNA, 19 nt, Homo sapiens
ugaaaaugcccuuuggaua

SEQ ID NO: 960968 - RNA, 19 nt, Homo sapiens
cagaagcgccaagcuaaau

SEQ ID NO: 960969 - RNA, 19 nt, Homo sapiens
gaggaaucccagcgccuuu

SEQ ID NO: 960970 - RNA, 19 nt, Homo sapiens
guuugaugaagccuaauua

SEQ ID NO: 960971 - RNA, 19 nt, Homo sapiens
cgcaauccucgcaaaguua

SEQ ID NO: 960972 - RNA, 19 nt, Homo sapiens
caacaugcguaucgaaaag

SEQ ID NO: 960973 - RNA, 19 nt, Homo sapiens
gggaugagaacugaauaau

SEQ ID NO: 960974 - RNA, 19 nt, Homo sapiens
aaacguagaaaugaaccua

SEQ ID NO: 960975 - RNA, 19 nt, Homo sapiens
guuuaacccuucugauagg

SEQ ID NO: 960976 - RNA, 19 nt, Homo sapiens
uugcaucacuuccucucaa

SEQ ID NO: 960977 - RNA, 19 nt, Homo sapiens
ggauaucaaagaagucaag

SEQ ID NO: 960978 - RNA, 19 nt, Homo sapiens
ugugauuccugauagaaca

SEQ ID NO: 960979 - RNA, 19 nt, Homo sapiens
ucuagaauuuccacuuugg

SEQ ID NO: 960980 - RNA, 19 nt, Homo sapiens
cagcauuuguauaguaacu

SEQ ID NO: 960981 - RNA, 19 nt, Homo sapiens
ugguugugcuauuuggaua

SEQ ID NO: 960982 - RNA, 19 nt, Homo sapiens
acauggaagaugcuccuua

SEQ ID NO: 960983 - RNA, 19 nt, Homo sapiens
aaagagcuacagaaaguuc

SEQ ID NO: 960984 - RNA, 19 nt, Homo sapiens
ccacuuuggagaauacuca

SEQ ID NO: 960985 - RNA, 19 nt, Homo sapiens
auugcaagguguucagauu

SEQ ID NO: 960986 - RNA, 19 nt, Homo sapiens
caaagggaaacaguuggaa

SEQ ID NO: 960987 - RNA, 19 nt, Homo sapiens
ucucaagcuuggcguuugu

SEQ ID NO: 960988 - RNA, 19 nt, Homo sapiens
caguggauaauucauuuga

SEQ ID NO: 960989 - RNA, 19 nt, Homo sapiens
gaagaaagcuacuaacuua

SEQ ID NO: 960990 - RNA, 19 nt, Homo sapiens
gcaaaucccucaauaaguu

SEQ ID NO: 960991 - RNA, 19 nt, Homo sapiens
uaacuuagcuguauucuca

SEQ ID NO: 960992 - RNA, 19 nt, Homo sapiens
gaauguaauccaucucuua

SEQ ID NO: 960993 - RNA, 19 nt, Homo sapiens
gaggaguaauugaauguaa

SEQ ID NO: 960994 - RNA, 19 nt, Homo sapiens
ugagauuccugacuugaua

SEQ ID NO: 960995 - RNA, 19 nt, Homo sapiens
gcaauggaauaaucuuuca

SEQ ID NO: 960996 - RNA, 19 nt, Homo sapiens
gagcccagguguccucuuu

SEQ ID NO: 960997 - RNA, 19 nt, Homo sapiens
uuaagcaaaucccucaaua

SEQ ID NO: 960998 - RNA, 19 nt, Homo sapiens
agaauaaucuuccauuugg

SEQ ID NO: 960999 - RNA, 19 nt, Homo sapiens
cuugauaccuugcuaaaug

SEQ ID NO: 961000 - RNA, 19 nt, Homo sapiens
gcaguaccagcauguguua

SEQ ID NO: 961001 - RNA, 19 nt, Homo sapiens
gcuguauucucauguaaau

SEQ ID NO: 961002 - RNA, 19 nt, Homo sapiens
ucacugggauguucaaguc

SEQ ID NO: 961003 - RNA, 19 nt, Homo sapiens
gaacuuggagcauguuugg

SEQ ID NO: 961004 - RNA, 19 nt, Homo sapiens
ggaauccaaucaacuucga

SEQ ID NO: 961005 - RNA, 19 nt, Homo sapiens
ccuaucaguuuguaaaugu

SEQ ID NO: 961006 - RNA, 19 nt, Homo sapiens
ggcaggaauuggugagauu

SEQ ID NO: 961007 - RNA, 19 nt, Homo sapiens
uaagcaaaucccucaauaa

SEQ ID NO: 961008 - RNA, 19 nt, Homo sapiens
caaaagcaauggaauaauc

SEQ ID NO: 961009 - RNA, 19 nt, Homo sapiens
ggaacgagugcgugcagua

SEQ ID NO: 961010 - RNA, 19 nt, Homo sapiens
ugaagaaagcuacuaacuu

SEQ ID NO: 961011 - RNA, 19 nt, Homo sapiens
gcaauagaauaaucuucca

SEQ ID NO: 961012 - RNA, 19 nt, Homo sapiens
uaaauggacauguaacugu

SEQ ID NO: 961013 - RNA, 19 nt, Homo sapiens
gcaaggcggaagucaauca

SEQ ID NO: 961014 - RNA, 19 nt, Homo sapiens
gggcaaggcggaagucaau

SEQ ID NO: 961015 - RNA, 19 nt, Homo sapiens
gacagggucuuuaccaacu

SEQ ID NO: 961016 - RNA, 19 nt, Homo sapiens
uagcuguauucucauguaa

SEQ ID NO: 961017 - RNA, 19 nt, Homo sapiens
gcuguauuguggaguauca

SEQ ID NO: 961018 - RNA, 19 nt, Homo sapiens
caacucaacugguuaaaac

SEQ ID NO: 961019 - RNA, 19 nt, Homo sapiens
uuagcuguauucucaugua

SEQ ID NO: 961020 - RNA, 19 nt, Homo sapiens
aagcaaaucccucaauaag

SEQ ID NO: 961021 - RNA, 19 nt, Homo sapiens
gcgggaauccaaucaacuu

SEQ ID NO: 961022 - RNA, 19 nt, Homo sapiens
aggcggaagucaaucaaga

SEQ ID NO: 961023 - RNA, 19 nt, Homo sapiens
cuugcuaaauggacaugua

SEQ ID NO: 961024 - RNA, 19 nt, Homo sapiens
ggaguaauugaauguaauc

SEQ ID NO: 961025 - RNA, 19 nt, Homo sapiens
gggcaggaauuggugagau

SEQ ID NO: 961026 - RNA, 19 nt, Homo sapiens
aaaccucuguggcucuuuc

SEQ ID NO: 961027 - RNA, 19 nt, Homo sapiens
cuuggagcauguuuggaua

SEQ ID NO: 961028 - RNA, 19 nt, Homo sapiens
gcagaugccaguccaacca

SEQ ID NO: 961029 - RNA, 19 nt, Homo sapiens
gcuccuuccuaucaguuug

SEQ ID NO: 961030 - RNA, 19 nt, Homo sapiens
gaaaaugugaagaaagcua

SEQ ID NO: 961031 - RNA, 19 nt, Homo sapiens
ugaauguaauccaucucuu

SEQ ID NO: 961032 - RNA, 19 nt, Homo sapiens
ugacugcuguuuucagauu

SEQ ID NO: 961033 - RNA, 19 nt, Homo sapiens
ccucuuuccugaacuugga

SEQ ID NO: 961034 - RNA, 19 nt, Homo sapiens
cgugaggaguaauugaaug

SEQ ID NO: 961035 - RNA, 19 nt, Homo sapiens
ggucgugguuccggaguuc

SEQ ID NO: 961036 - RNA, 19 nt, Homo sapiens
gacuugauaccuugcuaaa

SEQ ID NO: 961037 - RNA, 19 nt, Homo sapiens
ugaaaccucuguggcucuu

SEQ ID NO: 961038 - RNA, 19 nt, Homo sapiens
gaacgagugcgugcaguac

SEQ ID NO: 961039 - RNA, 19 nt, Homo sapiens
caaaucccucaauaaguug

SEQ ID NO: 961040 - RNA, 19 nt, Homo sapiens
ggaugucgguggccuucgu

SEQ ID NO: 961041 - RNA, 19 nt, Homo sapiens
uuggugagauuccugacuu

SEQ ID NO: 961042 - RNA, 19 nt, Homo sapiens
acugggauguucaagucua

SEQ ID NO: 961043 - RNA, 19 nt, Homo sapiens
gcggaagucaaucaagaga

SEQ ID NO: 961044 - RNA, 19 nt, Homo sapiens
ugacuugauaccuugcuaa

SEQ ID NO: 961045 - RNA, 19 nt, Homo sapiens
cagcgggaauccaaucaac

SEQ ID NO: 961046 - RNA, 19 nt, Homo sapiens
gguguccucuuuccugaac

SEQ ID NO: 961047 - RNA, 19 nt, Homo sapiens
gugaagaaagcuacuaacu

SEQ ID NO: 961048 - RNA, 19 nt, Homo sapiens
ggagaaugaccagcugauc

SEQ ID NO: 961049 - RNA, 19 nt, Homo sapiens
gcugauccgcuguauugug

SEQ ID NO: 961050 - RNA, 19 nt, Homo sapiens
gcagcgggaauccaaucaa

SEQ ID NO: 961051 - RNA, 19 nt, Homo sapiens
ucauuuauuuggcuaccau

SEQ ID NO: 961052 - RNA, 19 nt, Homo sapiens
gcuaaauggacauguaacu

SEQ ID NO: 961053 - RNA, 19 nt, Homo sapiens
ggaaacucaguagguguug

SEQ ID NO: 961054 - RNA, 19 nt, Homo sapiens
ccucuguggcucuuucaaa

SEQ ID NO: 961055 - RNA, 19 nt, Homo sapiens
gugaggaguaauugaaugu

SEQ ID NO: 961056 - RNA, 19 nt, Homo sapiens
acugugugcuccuuccuau

SEQ ID NO: 961057 - RNA, 19 nt, Homo sapiens
ggugagauuccugacuuga

SEQ ID NO: 961058 - RNA, 19 nt, Homo sapiens
gaugucgguggccuucgua

SEQ ID NO: 961059 - RNA, 19 nt, Homo sapiens
uuauuuggcuaccauugca

SEQ ID NO: 961060 - RNA, 19 nt, Homo sapiens
ugugugcuccuuccuauca

SEQ ID NO: 961061 - RNA, 19 nt, Homo sapiens
ugaagaggaaacucaguag

SEQ ID NO: 961062 - RNA, 19 nt, Homo sapiens
ggauaacaaagacaucacu

SEQ ID NO: 961063 - RNA, 19 nt, Homo sapiens
caaggcggaagucaaucaa

SEQ ID NO: 961064 - RNA, 19 nt, Homo sapiens
guccaaccagcacuucaaa

SEQ ID NO: 961065 - RNA, 19 nt, Homo sapiens
gaaacuggguugaaauuug

SEQ ID NO: 961066 - RNA, 19 nt, Homo sapiens
ggacauugcggcacauuua

SEQ ID NO: 961067 - RNA, 19 nt, Homo sapiens
gcaguuauccgacacguua

SEQ ID NO: 961068 - RNA, 19 nt, Homo sapiens
ggacagagaauuugauuga

SEQ ID NO: 961069 - RNA, 19 nt, Homo sapiens
ggacuacaaucaugucgaa

SEQ ID NO: 961070 - RNA, 19 nt, Homo sapiens
caacugaauuuggcgcuua

SEQ ID NO: 961071 - RNA, 19 nt, Homo sapiens
caacagacccugcaguuau

SEQ ID NO: 961072 - RNA, 19 nt, Homo sapiens
caaauacggugaccacuag

SEQ ID NO: 961073 - RNA, 19 nt, Homo sapiens
ugaagaaacuggguugaaa

SEQ ID NO: 961074 - RNA, 19 nt, Homo sapiens
gaucaaaccuuagccaaag

SEQ ID NO: 961075 - RNA, 19 nt, Homo sapiens
gcaacaagaauaugaagaa

SEQ ID NO: 961076 - RNA, 19 nt, Homo sapiens
aaacuggguugaaauuuga

SEQ ID NO: 961077 - RNA, 19 nt, Homo sapiens
gaauacguaucaugugguu

SEQ ID NO: 961078 - RNA, 19 nt, Homo sapiens
aaagcgacaugaugaauug

SEQ ID NO: 961079 - RNA, 19 nt, Homo sapiens
gaacggacagagaauuuga

SEQ ID NO: 961080 - RNA, 19 nt, Homo sapiens
gcaacagacccugcaguua

SEQ ID NO: 961081 - RNA, 19 nt, Homo sapiens
ggauggcgcugacgauauc

SEQ ID NO: 961082 - RNA, 19 nt, Homo sapiens
gcgacaugaugaauuguuu

SEQ ID NO: 961083 - RNA, 19 nt, Homo sapiens
gcgacgagcaacuuuauuu

SEQ ID NO: 961084 - RNA, 19 nt, Homo sapiens
acaaauuauucgugcguua

SEQ ID NO: 961085 - RNA, 19 nt, Homo sapiens
gaauuuggcgcuuacuuug

SEQ ID NO: 961086 - RNA, 19 nt, Homo sapiens
uuaaaggacuacaaucaug

SEQ ID NO: 961087 - RNA, 19 nt, Homo sapiens
gaagaaacuggguugaaau

SEQ ID NO: 961088 - RNA, 19 nt, Homo sapiens
gaccaucgcggcagauaaa

SEQ ID NO: 961089 - RNA, 19 nt, Homo sapiens
auaagcaaguucagcauuu

SEQ ID NO: 961090 - RNA, 19 nt, Homo sapiens
agccaucgaucaaaccuua

SEQ ID NO: 961091 - RNA, 19 nt, Homo sapiens
ccaaauacggugaccacua

SEQ ID NO: 961092 - RNA, 19 nt, Homo sapiens
gcagcgacgagcaacuuua

SEQ ID NO: 961093 - RNA, 19 nt, Homo sapiens
cagaugaaguggauuggau

SEQ ID NO: 961094 - RNA, 19 nt, Homo sapiens
ugaaguggauuggaucgaa

SEQ ID NO: 961095 - RNA, 19 nt, Homo sapiens
uaagcaaguucagcauuug

SEQ ID NO: 961096 - RNA, 19 nt, Homo sapiens
uuacgacuggcacaaauua

SEQ ID NO: 961097 - RNA, 19 nt, Homo sapiens
gaugauacuuuacguuuug

SEQ ID NO: 961098 - RNA, 19 nt, Homo sapiens
cagagaauuugauugauac

SEQ ID NO: 961099 - RNA, 19 nt, Homo sapiens
ugaauuuggcgcuuacuuu

SEQ ID NO: 961100 - RNA, 19 nt, Homo sapiens
cgacuuacagcaacucuau

SEQ ID NO: 961101 - RNA, 19 nt, Homo sapiens
gaugacauaucacgaaacg

SEQ ID NO: 961102 - RNA, 19 nt, Homo sapiens
gcacuugaaacaacugaau

SEQ ID NO: 961103 - RNA, 19 nt, Homo sapiens
guuguuagccagucagaaa

SEQ ID NO: 961104 - RNA, 19 nt, Homo sapiens
uaaagcgacaugaugaauu

SEQ ID NO: 961105 - RNA, 19 nt, Homo sapiens
caauaugucguggcaagua

SEQ ID NO: 961106 - RNA, 19 nt, Homo sapiens
cgacaugaugaauuguuua

SEQ ID NO: 961107 - RNA, 19 nt, Homo sapiens
ucaaagcgacuuacagcaa

SEQ ID NO: 961108 - RNA, 19 nt, Homo sapiens
gaacccaugcggcaauugu

SEQ ID NO: 961109 - RNA, 19 nt, Homo sapiens
guugaccgcuugcauccaa

SEQ ID NO: 961110 - RNA, 19 nt, Homo sapiens
uggcauccguuccauguau

SEQ ID NO: 961111 - RNA, 19 nt, Homo sapiens
caugccaaguuuacucaaa

SEQ ID NO: 961112 - RNA, 19 nt, Homo sapiens
gacauugcggcacauuuaa

SEQ ID NO: 961113 - RNA, 19 nt, Homo sapiens
aagaguacccgcagucuga

SEQ ID NO: 961114 - RNA, 19 nt, Homo sapiens
ggcaauuguuaaaggacua

SEQ ID NO: 961115 - RNA, 19 nt, Homo sapiens
ugacagaugaaguggauug

SEQ ID NO: 961116 - RNA, 19 nt, Homo sapiens
cugaauugauggcggguuu

SEQ ID NO: 961117 - RNA, 19 nt, Homo sapiens
cauuuguacacaccaauua

SEQ ID NO: 961118 - RNA, 19 nt, Homo sapiens
ccgaugcgcaacaagaaua

SEQ ID NO: 961119 - RNA, 19 nt, Homo sapiens
cgacgagcaacuuuauuug

SEQ ID NO: 961120 - RNA, 19 nt, Homo sapiens
ccauguaugugaaucaaac

SEQ ID NO: 961121 - RNA, 19 nt, Homo sapiens
gcaacucuaugcggcacuu

SEQ ID NO: 961122 - RNA, 19 nt, Homo sapiens
uaaaggacuacaaucaugu

SEQ ID NO: 961123 - RNA, 19 nt, Homo sapiens
cagguccuauuggcuauuu

SEQ ID NO: 961124 - RNA, 19 nt, Homo sapiens
gcauuuguacacaccaauu

SEQ ID NO: 961125 - RNA, 19 nt, Homo sapiens
cgacuggcacaaauuauuc

SEQ ID NO: 961126 - RNA, 19 nt, Homo sapiens
aagaaacuggguugaaauu

SEQ ID NO: 961127 - RNA, 19 nt, Homo sapiens
ggcaacagacccugcaguu

SEQ ID NO: 961128 - RNA, 19 nt, Homo sapiens
gacagagaauuugauugau

SEQ ID NO: 961129 - RNA, 19 nt, Homo sapiens
ggaucgaacggacagagaa

SEQ ID NO: 961130 - RNA, 19 nt, Homo sapiens
cugaugauacuuuacguuu

SEQ ID NO: 961131 - RNA, 19 nt, Homo sapiens
uagcugagcaggcgaauac

SEQ ID NO: 961132 - RNA, 19 nt, Homo sapiens
cgaucaaaccuuagccaaa

SEQ ID NO: 961133 - RNA, 19 nt, Homo sapiens
guuaggcgaagcguuguua

SEQ ID NO: 961134 - RNA, 19 nt, Homo sapiens
uaugucagguggucagauc

SEQ ID NO: 961135 - RNA, 19 nt, Homo sapiens
ugugacagaugaaguggau

SEQ ID NO: 961136 - RNA, 19 nt, Homo sapiens
ggugcgcagucauuugaug

SEQ ID NO: 961137 - RNA, 19 nt, Homo sapiens
guuaaaggacuacaaucau

SEQ ID NO: 961138 - RNA, 19 nt, Homo sapiens
ugacuccgaugcgcaacaa

SEQ ID NO: 961139 - RNA, 19 nt, Homo sapiens
ucacgacacgcuugcaaga

SEQ ID NO: 961140 - RNA, 19 nt, Homo sapiens
ucgaacggacagagaauuu

SEQ ID NO: 961141 - RNA, 19 nt, Homo sapiens
cagcgacgagcaacuuuau

SEQ ID NO: 961142 - RNA, 19 nt, Homo sapiens
aauaugucguggcaaguau

SEQ ID NO: 961143 - RNA, 19 nt, Homo sapiens
gaucgaacggacagagaau

SEQ ID NO: 961144 - RNA, 19 nt, Homo sapiens
gacaccucguggcuuguuu

SEQ ID NO: 961145 - RNA, 19 nt, Homo sapiens
cagcauuuguacacaccaa

SEQ ID NO: 961146 - RNA, 19 nt, Homo sapiens
gaacgguuaguggcuaugu

SEQ ID NO: 961147 - RNA, 19 nt, Homo sapiens
gacacccgcugaugauacu

SEQ ID NO: 961148 - RNA, 19 nt, Homo sapiens
caaauuauucgugcguuag

SEQ ID NO: 961149 - RNA, 19 nt, Homo sapiens
aaccuuagccaaagucguu

SEQ ID NO: 961150 - RNA, 19 nt, Homo sapiens
uguuaaaggacuacaauca

SEQ ID NO: 961151 - RNA, 19 nt, Homo sapiens
aacagacccugcaguuauc

SEQ ID NO: 961152 - RNA, 19 nt, Homo sapiens
uaccuuagccaucgaucaa

SEQ ID NO: 961153 - RNA, 19 nt, Homo sapiens
agaaacuggguugaaauuu

SEQ ID NO: 961154 - RNA, 19 nt, Homo sapiens
aaacggcucaggcauuaca

SEQ ID NO: 961155 - RNA, 19 nt, Homo sapiens
gcgcaaucgcuacggcaaa

SEQ ID NO: 961156 - RNA, 19 nt, Homo sapiens
gcaaguucagcauuuguac

SEQ ID NO: 961157 - RNA, 19 nt, Homo sapiens
cugagcaggcgaauacgua

SEQ ID NO: 961158 - RNA, 19 nt, Homo sapiens
cguuacgacuggcacaaau

SEQ ID NO: 961159 - RNA, 19 nt, Homo sapiens
cgcugacgauaucgcguua

SEQ ID NO: 961160 - RNA, 19 nt, Homo sapiens
gcgacacccgcugaugaua

SEQ ID NO: 961161 - RNA, 19 nt, Homo sapiens
uaaaaucacguucggauca

SEQ ID NO: 961162 - RNA, 19 nt, Homo sapiens
caaacgcagcgacgagcaa

SEQ ID NO: 961163 - RNA, 19 nt, Homo sapiens
ggcauccguuccauguaug

SEQ ID NO: 961164 - RNA, 19 nt, Homo sapiens
uaagugugaccgcgauugu

SEQ ID NO: 961165 - RNA, 19 nt, Homo sapiens
ccaagaagcuuuagaaauu

SEQ ID NO: 961166 - RNA, 19 nt, Homo sapiens
uaagagcacugacauguuu

SEQ ID NO: 961167 - RNA, 19 nt, Homo sapiens
gagacuauguuucuaagua

SEQ ID NO: 961168 - RNA, 19 nt, Homo sapiens
ggacuuaaauaaagcaaga

SEQ ID NO: 961169 - RNA, 19 nt, Homo sapiens
gcacagcucuggcucuuuc

SEQ ID NO: 961170 - RNA, 19 nt, Homo sapiens
ggaaguagcauaacuguca

SEQ ID NO: 961171 - RNA, 19 nt, Homo sapiens
gacacaaacuuaauuccua

SEQ ID NO: 961172 - RNA, 19 nt, Homo sapiens
gaaaguaucaucaagugaa

SEQ ID NO: 961173 - RNA, 19 nt, Homo sapiens
caaauugacucuggaagaa

SEQ ID NO: 961174 - RNA, 19 nt, Homo sapiens
gaaccaggauauaacaguu

SEQ ID NO: 961175 - RNA, 19 nt, Homo sapiens
cagaaaugaugccuguuua

SEQ ID NO: 961176 - RNA, 19 nt, Homo sapiens
ugaugaaggugauaacuuu

SEQ ID NO: 961177 - RNA, 19 nt, Homo sapiens
ccaccugccucaaagauaa

SEQ ID NO: 961178 - RNA, 19 nt, Homo sapiens
ugaaagagacccuauaaga

SEQ ID NO: 961179 - RNA, 19 nt, Homo sapiens
gaaagaauuugcaaacacu

SEQ ID NO: 961180 - RNA, 19 nt, Homo sapiens
gaaaugaugccuguuuauu

SEQ ID NO: 961181 - RNA, 19 nt, Homo sapiens
caaaaggacuggauuacua

SEQ ID NO: 961182 - RNA, 19 nt, Homo sapiens
gcacacacuugccuauguu

SEQ ID NO: 961183 - RNA, 19 nt, Homo sapiens
ggucauaauucaacacaga

SEQ ID NO: 961184 - RNA, 19 nt, Homo sapiens
guacaaugcugcgucauau

SEQ ID NO: 961185 - RNA, 19 nt, Homo sapiens
ucaacuaccugaaaguauu

SEQ ID NO: 961186 - RNA, 19 nt, Homo sapiens
aagaagaacuacagaaaug

SEQ ID NO: 961187 - RNA, 19 nt, Homo sapiens
gaaagagggaugaagaaga

SEQ ID NO: 961188 - RNA, 19 nt, Homo sapiens
gaaagagacccuauaagag

SEQ ID NO: 961189 - RNA, 19 nt, Homo sapiens
ccgaagaacugaaggaugu

SEQ ID NO: 961190 - RNA, 19 nt, Homo sapiens
cagaaacgacacaaacuua

SEQ ID NO: 961191 - RNA, 19 nt, Homo sapiens
ugaagggacuguaaagaga

SEQ ID NO: 961192 - RNA, 19 nt, Homo sapiens
gccgaaaugcauuaaauua

SEQ ID NO: 961193 - RNA, 19 nt, Homo sapiens
gaagaaagagagucugaau

SEQ ID NO: 961194 - RNA, 19 nt, Homo sapiens
ugacaacuauagcaugaaa

SEQ ID NO: 961195 - RNA, 19 nt, Homo sapiens
caacaacaacagaggauuu

SEQ ID NO: 961196 - RNA, 19 nt, Homo sapiens
aaacacuucuggaugauga

SEQ ID NO: 961197 - RNA, 19 nt, Homo sapiens
ggaaagaauuugcaaacac

SEQ ID NO: 961198 - RNA, 19 nt, Homo sapiens
gggcaacucugcaagaauc

SEQ ID NO: 961199 - RNA, 19 nt, Homo sapiens
gcaacuuggucauaauuca

SEQ ID NO: 961200 - RNA, 19 nt, Homo sapiens
aaaugaauguggacaacua

SEQ ID NO: 961201 - RNA, 19 nt, Homo sapiens
ccugaaaguuggaaugaaa

SEQ ID NO: 961202 - RNA, 19 nt, Homo sapiens
aauaugggauguucaugua

SEQ ID NO: 961203 - RNA, 19 nt, Homo sapiens
uaaaccaggugaaauguca

SEQ ID NO: 961204 - RNA, 19 nt, Homo sapiens
gaaaaccauuugaguauga

SEQ ID NO: 961205 - RNA, 19 nt, Homo sapiens
gaucacauguggagauuac

SEQ ID NO: 961206 - RNA, 19 nt, Homo sapiens
ucauauuccuuaccucuuu

SEQ ID NO: 961207 - RNA, 19 nt, Homo sapiens
gacuuucccuguucaauug

SEQ ID NO: 961208 - RNA, 19 nt, Homo sapiens
ggacuuucccuguucaauu

SEQ ID NO: 961209 - RNA, 19 nt, Homo sapiens
ugaaucagcuaagucaauu

SEQ ID NO: 961210 - RNA, 19 nt, Homo sapiens
gaaugaaagagacccuaua

SEQ ID NO: 961211 - RNA, 19 nt, Homo sapiens
cgacgaagacauuaucaaa

SEQ ID NO: 961212 - RNA, 19 nt, Homo sapiens
caaccagacuaacaagaga

SEQ ID NO: 961213 - RNA, 19 nt, Homo sapiens
aaugaugccuguuuauuug

SEQ ID NO: 961214 - RNA, 19 nt, Homo sapiens
gauaaccaccugccucaaa

SEQ ID NO: 961215 - RNA, 19 nt, Homo sapiens
uacaggaacugacagacua

SEQ ID NO: 961216 - RNA, 19 nt, Homo sapiens
caagagagacuauguuucu

SEQ ID NO: 961217 - RNA, 19 nt, Homo sapiens
uaugacaacuauagcauga

SEQ ID NO: 961218 - RNA, 19 nt, Homo sapiens
ggagaaugguaauguucaa

SEQ ID NO: 961219 - RNA, 19 nt, Homo sapiens
ggauaaagaaagagaauuc

SEQ ID NO: 961220 - RNA, 19 nt, Homo sapiens
cgaaaugcauuaaauuagg

SEQ ID NO: 961221 - RNA, 19 nt, Homo sapiens
ggacaauuccuacucugaa

SEQ ID NO: 961222 - RNA, 19 nt, Homo sapiens
gugaaaguaucaucaagug

SEQ ID NO: 961223 - RNA, 19 nt, Homo sapiens
guggagaaauuggguauga

SEQ ID NO: 961224 - RNA, 19 nt, Homo sapiens
agaaagagagucugaauuc

SEQ ID NO: 961225 - RNA, 19 nt, Homo sapiens
ggacuggauuacuaacaug

SEQ ID NO: 961226 - RNA, 19 nt, Homo sapiens
ggaguacccuuggcucaga

SEQ ID NO: 961227 - RNA, 19 nt, Homo sapiens
gaacugacagacuacaaau

SEQ ID NO: 961228 - RNA, 19 nt, Homo sapiens
ggaacugacagacuacaaa

SEQ ID NO: 961229 - RNA, 19 nt, Homo sapiens
gaaguagcauaacugucaa

SEQ ID NO: 961230 - RNA, 19 nt, Homo sapiens
gaaacgacacaaacuuaau

SEQ ID NO: 961231 - RNA, 19 nt, Homo sapiens
ucagaaaguugaauuuguc

SEQ ID NO: 961232 - RNA, 19 nt, Homo sapiens
aaagagggaugaagaagag

SEQ ID NO: 961233 - RNA, 19 nt, Homo sapiens
ggauauaacaguucacauc

SEQ ID NO: 961234 - RNA, 19 nt, Homo sapiens
ggacagaaacgacacaaac

SEQ ID NO: 961235 - RNA, 19 nt, Homo sapiens
gaauaugggauguucaugu

SEQ ID NO: 961236 - RNA, 19 nt, Homo sapiens
uucagucacuuuccauuua

SEQ ID NO: 961237 - RNA, 19 nt, Homo sapiens
guagaaguaugcagaaggu

SEQ ID NO: 961238 - RNA, 19 nt, Homo sapiens
ucauaugccaguuggauua

SEQ ID NO: 961239 - RNA, 19 nt, Homo sapiens
gcaugaaacaucuaagguu

SEQ ID NO: 961240 - RNA, 19 nt, Homo sapiens
agagauggauugcugaugu

SEQ ID NO: 961241 - RNA, 19 nt, Homo sapiens
ugcaaacacuucuggauga

SEQ ID NO: 961242 - RNA, 19 nt, Homo sapiens
gggaaagaauuugcaaaca

SEQ ID NO: 961243 - RNA, 19 nt, Homo sapiens
gaaugaagaccugaggaaa

SEQ ID NO: 961244 - RNA, 19 nt, Homo sapiens
agaauccacuuucagcaaa

SEQ ID NO: 961245 - RNA, 19 nt, Homo sapiens
ggagggaaucaaagcauuu

SEQ ID NO: 961246 - RNA, 19 nt, Homo sapiens
ugaaagccauaccucagaa

SEQ ID NO: 961247 - RNA, 19 nt, Homo sapiens
ggaugaagaagaggguuua

SEQ ID NO: 961248 - RNA, 19 nt, Homo sapiens
gagagacuauguuucuaag

SEQ ID NO: 961249 - RNA, 19 nt, Homo sapiens
ugaaagugcugaggagaau

SEQ ID NO: 961250 - RNA, 19 nt, Homo sapiens
caggaugggcugcuguuua

SEQ ID NO: 961251 - RNA, 19 nt, Homo sapiens
gaaugcacguuaugaacca

SEQ ID NO: 961252 - RNA, 19 nt, Homo sapiens
caucuaagguuugaaagca

SEQ ID NO: 961253 - RNA, 19 nt, Homo sapiens
gaaagagagucugaauucg

SEQ ID NO: 961254 - RNA, 19 nt, Homo sapiens
aaagggaaauccaagagau

SEQ ID NO: 961255 - RNA, 19 nt, Homo sapiens
acacugagaguaaagauga

SEQ ID NO: 961256 - RNA, 19 nt, Homo sapiens
gaacugaaggaugugauug

SEQ ID NO: 961257 - RNA, 19 nt, Homo sapiens
ggcgguuuaugaagaauuu

SEQ ID NO: 961258 - RNA, 19 nt, Homo sapiens
caaacuuaauuccuaaugg

SEQ ID NO: 961259 - RNA, 19 nt, Homo sapiens
gcaaacacuucuggaugau

SEQ ID NO: 961260 - RNA, 19 nt, Homo sapiens
gaucuaacagucagaagga

SEQ ID NO: 961261 - RNA, 19 nt, Homo sapiens
gaagaacuacagaaaugau

SEQ ID NO: 961262 - RNA, 19 nt, Homo sapiens
gagcuaagacccuguuugg

SEQ ID NO: 961263 - RNA, 19 nt, Homo sapiens
guuguuguuucucuacuuu

SEQ ID NO: 961264 - RNA, 19 nt, Homo sapiens
aagaagccaucaacaacaa

SEQ ID NO: 961265 - RNA, 19 nt, Homo sapiens
gagaagaguugagggaaag

SEQ ID NO: 961266 - RNA, 19 nt, Homo sapiens
ugagaagaguugagggaaa

SEQ ID NO: 961267 - RNA, 19 nt, Homo sapiens
cagcgguccuuaccagaaa

SEQ ID NO: 961268 - RNA, 19 nt, Homo sapiens
gaaaggccacgugaagaug

SEQ ID NO: 961269 - RNA, 19 nt, Homo sapiens
ggaagcuucuguucaaucc

SEQ ID NO: 961270 - RNA, 19 nt, Homo sapiens
ugaaaggccacgugaagau

SEQ ID NO: 961271 - RNA, 19 nt, Homo sapiens
gcacuugugacagcaguau

SEQ ID NO: 961272 - RNA, 19 nt, Homo sapiens
aagccgagcugggcgagaa

SEQ ID NO: 961273 - RNA, 19 nt, Homo sapiens
accggaagcuucuguucaa

SEQ ID NO: 961274 - RNA, 19 nt, Homo sapiens
gcugguguuugcacuugug

SEQ ID NO: 961275 - RNA, 19 nt, Homo sapiens
ccagcgguccuuaccagaa

SEQ ID NO: 961276 - RNA, 19 nt, Homo sapiens
cggcugguguuugcacuug

SEQ ID NO: 961277 - RNA, 19 nt, Homo sapiens
gugaaaggccacgugaaga

SEQ ID NO: 961278 - RNA, 19 nt, Homo sapiens
cagacgcgauggauaacgu

SEQ ID NO: 961279 - RNA, 19 nt, Homo sapiens
gaagaguugagggaaagug

SEQ ID NO: 961280 - RNA, 19 nt, Homo sapiens
ugaagucaccguuaucuua

SEQ ID NO: 961281 - RNA, 19 nt, Homo sapiens
acucagacuugaucgauua

SEQ ID NO: 961282 - RNA, 19 nt, Homo sapiens
ccugaaccauauauuguua

SEQ ID NO: 961283 - RNA, 19 nt, Homo sapiens
ccagaaaccacaacauuga

SEQ ID NO: 961284 - RNA, 19 nt, Homo sapiens
ggccuuugcuugauauuau

SEQ ID NO: 961285 - RNA, 19 nt, Homo sapiens
gaagucaccguuaucuuau

SEQ ID NO: 961286 - RNA, 19 nt, Homo sapiens
gauuugaagucaccguuau

SEQ ID NO: 961287 - RNA, 19 nt, Homo sapiens
gagaagaguugagggaaag

SEQ ID NO: 961288 - RNA, 19 nt, Homo sapiens
ugagaagaguugagggaaa

SEQ ID NO: 961289 - RNA, 19 nt, Homo sapiens
gcacuaacugugacaucua

SEQ ID NO: 961290 - RNA, 19 nt, Homo sapiens
gguaacaacaguauucaug

SEQ ID NO: 961291 - RNA, 19 nt, Homo sapiens
cagcgguccuuaccagaaa

SEQ ID NO: 961292 - RNA, 19 nt, Homo sapiens
ggauuugaagucaccguua

SEQ ID NO: 961293 - RNA, 19 nt, Homo sapiens
cagacuugaucgauuaaug

SEQ ID NO: 961294 - RNA, 19 nt, Homo sapiens
gaaaggccacgugaagaug

SEQ ID NO: 961295 - RNA, 19 nt, Homo sapiens
auuaucaacucacugguaa

SEQ ID NO: 961296 - RNA, 19 nt, Homo sapiens
ggaagcuucuguucaaucc

SEQ ID NO: 961297 - RNA, 19 nt, Homo sapiens
agucaccguuaucuuauuu

SEQ ID NO: 961298 - RNA, 19 nt, Homo sapiens
uguuaucacuggauuugaa

SEQ ID NO: 961299 - RNA, 19 nt, Homo sapiens
uaccagaaaccacaacauu

SEQ ID NO: 961300 - RNA, 19 nt, Homo sapiens
gcucaucguaucuguguug

SEQ ID NO: 961301 - RNA, 19 nt, Homo sapiens
uaacaacaguauucaugcu

SEQ ID NO: 961302 - RNA, 19 nt, Homo sapiens
agacuugaucgauuaauga

SEQ ID NO: 961303 - RNA, 19 nt, Homo sapiens
ucaacucacugguaacaac

SEQ ID NO: 961304 - RNA, 19 nt, Homo sapiens
ugaaaggccacgugaagau

SEQ ID NO: 961305 - RNA, 19 nt, Homo sapiens
cuugaucgauuaaugaagu

SEQ ID NO: 961306 - RNA, 19 nt, Homo sapiens
cacuaacugugacaucuau

SEQ ID NO: 961307 - RNA, 19 nt, Homo sapiens
uauauguacucagacuuga

SEQ ID NO: 961308 - RNA, 19 nt, Homo sapiens
gcacugauaccagaaacca

SEQ ID NO: 961309 - RNA, 19 nt, Homo sapiens
caacaguauucaugcucau

SEQ ID NO: 961310 - RNA, 19 nt, Homo sapiens
gcacuugugacagcaguau

SEQ ID NO: 961311 - RNA, 19 nt, Homo sapiens
aagccgagcugggcgagaa

SEQ ID NO: 961312 - RNA, 19 nt, Homo sapiens
ugugacaucuaugaccuuu

SEQ ID NO: 961313 - RNA, 19 nt, Homo sapiens
accggaagcuucuguucaa

SEQ ID NO: 961314 - RNA, 19 nt, Homo sapiens
uauuaucaacucacuggua

SEQ ID NO: 961315 - RNA, 19 nt, Homo sapiens
guacucagacuugaucgau

SEQ ID NO: 961316 - RNA, 19 nt, Homo sapiens
ggcacuaacugugacaucu

SEQ ID NO: 961317 - RNA, 19 nt, Homo sapiens
cuaacugugacaucuauga

SEQ ID NO: 961318 - RNA, 19 nt, Homo sapiens
guaucuguguuggcacuga

SEQ ID NO: 961319 - RNA, 19 nt, Homo sapiens
guauucaugcucaucguau

SEQ ID NO: 961320 - RNA, 19 nt, Homo sapiens
gacuugaucgauuaaugaa

SEQ ID NO: 961321 - RNA, 19 nt, Homo sapiens
ccagcgguccuuaccagaa

SEQ ID NO: 961322 - RNA, 19 nt, Homo sapiens
gaagaguugagggaaagug

SEQ ID NO: 961323 - RNA, 19 nt, Homo sapiens
gugaaaggccacgugaaga

SEQ ID NO: 961324 - RNA, 19 nt, Homo sapiens
uuauauguacucagacuug

SEQ ID NO: 961325 - RNA, 19 nt, Homo sapiens
cagacgcgauggauaacgu

SEQ ID NO: 961326 - RNA, 19 nt, Homo sapiens
caacucacugguaacaaca

SEQ ID NO: 961327 - RNA, 19 nt, Homo sapiens
cggcuggcacuaacuguga

SEQ ID NO: 961328 - RNA, 19 nt, Homo sapiens
ggagggguguuugcacuug

SEQ ID NO: 961329 - RNA, 19 nt, Homo sapiens
uaucaacucacugguaaca

SEQ ID NO: 961330 - RNA, 19 nt, Homo sapiens
gaaauggccuuuacugaga

SEQ ID NO: 961331 - RNA, 19 nt, Homo sapiens
gagcaugcauguaaauuaa

SEQ ID NO: 961332 - RNA, 19 nt, Homo sapiens
caacaaagaugaugauucu

SEQ ID NO: 961333 - RNA, 19 nt, Homo sapiens
gaugagaucucgcuauguu

SEQ ID NO: 961334 - RNA, 19 nt, Homo sapiens
ggaguagacuucacacaaa

SEQ ID NO: 961335 - RNA, 19 nt, Homo sapiens
gcagauggauucaauggaa

SEQ ID NO: 961336 - RNA, 19 nt, Homo sapiens
uaaaugagcaugcauguaa

SEQ ID NO: 961337 - RNA, 19 nt, Homo sapiens
gaaagggaauuaauaaguc

SEQ ID NO: 961338 - RNA, 19 nt, Homo sapiens
gcaguggccucuauaaaug

SEQ ID NO: 961339 - RNA, 19 nt, Homo sapiens
ccaaauuucugaugucaaa

SEQ ID NO: 961340 - RNA, 19 nt, Homo sapiens
gaacaguacuugugucagu

SEQ ID NO: 961341 - RNA, 19 nt, Homo sapiens
caaguaugcuagaauauug

SEQ ID NO: 961342 - RNA, 19 nt, Homo sapiens
ugagacaacuugauuauuc

SEQ ID NO: 961343 - RNA, 19 nt, Homo sapiens
ccaauaugcuucugauaga

SEQ ID NO: 961344 - RNA, 19 nt, Homo sapiens
gaugucaaauuguucauug

SEQ ID NO: 961345 - RNA, 19 nt, Homo sapiens
gaugagggaggaacuaaua

SEQ ID NO: 961346 - RNA, 19 nt, Homo sapiens
ugacuugccucauaaaugu

SEQ ID NO: 961347 - RNA, 19 nt, Homo sapiens
gcagugaacucuaccuaca

SEQ ID NO: 961348 - RNA, 19 nt, Homo sapiens
ggagaguccuauagaaguu

SEQ ID NO: 961349 - RNA, 19 nt, Homo sapiens
gaagaggaucccuacauuu

SEQ ID NO: 961350 - RNA, 19 nt, Homo sapiens
ugaagaggaucccuacauu

SEQ ID NO: 961351 - RNA, 19 nt, Homo sapiens
gauagaacaugccaaacug

SEQ ID NO: 961352 - RNA, 19 nt, Homo sapiens
agaccaaacugaugaagaa

SEQ ID NO: 961353 - RNA, 19 nt, Homo sapiens
gaggaaccauaaauucauu

SEQ ID NO: 961354 - RNA, 19 nt, Homo sapiens
cauauucucugauuucaug

SEQ ID NO: 961355 - RNA, 19 nt, Homo sapiens
ucaaaugugugucgaguau

SEQ ID NO: 961356 - RNA, 19 nt, Homo sapiens
gcauaaacguacugauuca

SEQ ID NO: 961357 - RNA, 19 nt, Homo sapiens
gaagugagcuacaguuuuc

SEQ ID NO: 961358 - RNA, 19 nt, Homo sapiens
caauauagccucuuaagca

SEQ ID NO: 961359 - RNA, 19 nt, Homo sapiens
ggacaaauugaagaucuua

SEQ ID NO: 961360 - RNA, 19 nt, Homo sapiens
uaacaauggugaacaugga

SEQ ID NO: 961361 - RNA, 19 nt, Homo sapiens
ccacugaaguauuuaaagu

SEQ ID NO: 961362 - RNA, 19 nt, Homo sapiens
gagccacuaucuauuguug

SEQ ID NO: 961363 - RNA, 19 nt, Homo sapiens
cagcugacuugccucauaa

SEQ ID NO: 961364 - RNA, 19 nt, Homo sapiens
gaacaugaaacuaaugauc

SEQ ID NO: 961365 - RNA, 19 nt, Homo sapiens
ccacggauacucccauuaa

SEQ ID NO: 961366 - RNA, 19 nt, Homo sapiens
gagccaagcuuugaaugug

SEQ ID NO: 961367 - RNA, 19 nt, Homo sapiens
gaaacagaaaucagaacua

SEQ ID NO: 961368 - RNA, 19 nt, Homo sapiens
ggagugcagugguugauca

SEQ ID NO: 961369 - RNA, 19 nt, Homo sapiens
acaguuaaguccacggaua

SEQ ID NO: 961370 - RNA, 19 nt, Homo sapiens
ggaaaugaaagggaauuaa

SEQ ID NO: 961371 - RNA, 19 nt, Homo sapiens
ucagcugacuugccucaua

SEQ ID NO: 961372 - RNA, 19 nt, Homo sapiens
agacuucacacaaauguua

SEQ ID NO: 961373 - RNA, 19 nt, Homo sapiens
guacaguucuccucaagca

SEQ ID NO: 961374 - RNA, 19 nt, Homo sapiens
gaugagguuuggaaaugaa

SEQ ID NO: 961375 - RNA, 19 nt, Homo sapiens
gagcaauccucccacuuca

SEQ ID NO: 961376 - RNA, 19 nt, Homo sapiens
gaagggauuuauuuauguc

SEQ ID NO: 961377 - RNA, 19 nt, Homo sapiens
ucacacugcugaagauguu

SEQ ID NO: 961378 - RNA, 19 nt, Homo sapiens
caaaugacuugccaaaauu

SEQ ID NO: 961379 - RNA, 19 nt, Homo sapiens
ucaauugcgugauaguuug

SEQ ID NO: 961380 - RNA, 19 nt, Homo sapiens
acauuuaucugaagggauu

SEQ ID NO: 961381 - RNA, 19 nt, Homo sapiens
gaaccgccagcuaaacuuu

SEQ ID NO: 961382 - RNA, 19 nt, Homo sapiens
gaaaacaauuccucugaga

SEQ ID NO: 961383 - RNA, 19 nt, Homo sapiens
gaagaagugagcuacaguu

SEQ ID NO: 961384 - RNA, 19 nt, Homo sapiens
ucucugauuucaugaauug

SEQ ID NO: 961385 - RNA, 19 nt, Homo sapiens
gaaaucugccuuuaacaag

SEQ ID NO: 961386 - RNA, 19 nt, Homo sapiens
gaguagacuucacacaaau

SEQ ID NO: 961387 - RNA, 19 nt, Homo sapiens
aaacagaaaucagaacuac

SEQ ID NO: 961388 - RNA, 19 nt, Homo sapiens
uguagugacugcuugauga

SEQ ID NO: 961389 - RNA, 19 nt, Homo sapiens
gcaagcauuuaaauucaca

SEQ ID NO: 961390 - RNA, 19 nt, Homo sapiens
ggaggacagugaugugauc

SEQ ID NO: 961391 - RNA, 19 nt, Homo sapiens
cagcagaaauggccuuuac

SEQ ID NO: 961392 - RNA, 19 nt, Homo sapiens
gacaagagccaagcuuuga

SEQ ID NO: 961393 - RNA, 19 nt, Homo sapiens
caaagaugaugauucugau

SEQ ID NO: 961394 - RNA, 19 nt, Homo sapiens
caugggugcuaguaacuuu

SEQ ID NO: 961395 - RNA, 19 nt, Homo sapiens
caaauguauugaagaagug

SEQ ID NO: 961396 - RNA, 19 nt, Homo sapiens
caacaggacaaauugaaga

SEQ ID NO: 961397 - RNA, 19 nt, Homo sapiens
cugaagggauuuauuuaug

SEQ ID NO: 961398 - RNA, 19 nt, Homo sapiens
gcuagaauauugcaagcau

SEQ ID NO: 961399 - RNA, 19 nt, Homo sapiens
gcauagccaugugguaaau

SEQ ID NO: 961400 - RNA, 19 nt, Homo sapiens
cugcugauauuguaauuug

SEQ ID NO: 961401 - RNA, 19 nt, Homo sapiens
ugagacagccagauuuaaa

SEQ ID NO: 961402 - RNA, 19 nt, Homo sapiens
uaugaaaucugccuuuaac

SEQ ID NO: 961403 - RNA, 19 nt, Homo sapiens
uggacaauauagccucuua

SEQ ID NO: 961404 - RNA, 19 nt, Homo sapiens
uaugagacagccagauuua

SEQ ID NO: 961405 - RNA, 19 nt, Homo sapiens
gcaccaugcccgcuaaguu

SEQ ID NO: 961406 - RNA, 19 nt, Homo sapiens
gccacuaucuauuguugaa

SEQ ID NO: 961407 - RNA, 19 nt, Homo sapiens
aaucugccuuuaacaagua

SEQ ID NO: 961408 - RNA, 19 nt, Homo sapiens
ugagcaugcauguaaauua

SEQ ID NO: 961409 - RNA, 19 nt, Homo sapiens
acaaagaugaugauucuga

SEQ ID NO: 961410 - RNA, 19 nt, Homo sapiens
ccaaagugcugggauuaca

SEQ ID NO: 961411 - RNA, 19 nt, Homo sapiens
cuuaugaaaucugccuuua

SEQ ID NO: 961412 - RNA, 19 nt, Homo sapiens
ucaaaugacuugccaaaau

SEQ ID NO: 961413 - RNA, 19 nt, Homo sapiens
gagacaacuugauuauucu

SEQ ID NO: 961414 - RNA, 19 nt, Homo sapiens
guauaacaauggugaacau

SEQ ID NO: 961415 - RNA, 19 nt, Homo sapiens
cggauacucccauuaauga

SEQ ID NO: 961416 - RNA, 19 nt, Homo sapiens
cgugauaguuuguaguuuc

SEQ ID NO: 961417 - RNA, 19 nt, Homo sapiens
ugaaaucugccuuuaacaa

SEQ ID NO: 961418 - RNA, 19 nt, Homo sapiens
aauauagccucuuaagcaa

SEQ ID NO: 961419 - RNA, 19 nt, Homo sapiens
caaacugcaugaagaggau

SEQ ID NO: 961420 - RNA, 19 nt, Homo sapiens
aagcauaaacguacugauu

SEQ ID NO: 961421 - RNA, 19 nt, Homo sapiens
gcagaaauggccuuuacug

SEQ ID NO: 961422 - RNA, 19 nt, Homo sapiens
caccaugcccgcuaaguuu

SEQ ID NO: 961423 - RNA, 19 nt, Homo sapiens
caucuagauuucaagcauu

SEQ ID NO: 961424 - RNA, 19 nt, Homo sapiens
guacuugugucaguucugu

SEQ ID NO: 961425 - RNA, 19 nt, Homo sapiens
acaggcauguugcuauuga

SEQ ID NO: 961426 - RNA, 19 nt, Homo sapiens
ccgaguagcucagauuaca

SEQ ID NO: 961427 - RNA, 19 nt, Homo sapiens
ugaaacuaaugauccagaa

SEQ ID NO: 961428 - RNA, 19 nt, Homo sapiens
uuauaggcaugagccauua

SEQ ID NO: 961429 - RNA, 19 nt, Homo sapiens
gugcagugguugaucauag

SEQ ID NO: 961430 - RNA, 19 nt, Homo sapiens
gacaauagcugcuuaguuu

SEQ ID NO: 961431 - RNA, 19 nt, Homo sapiens
ggaagaugguuuagaauua

SEQ ID NO: 961432 - RNA, 19 nt, Homo sapiens
gaagauuagucucucauua

SEQ ID NO: 961433 - RNA, 19 nt, Homo sapiens
gcaagaaccuguacccuuu

SEQ ID NO: 961434 - RNA, 19 nt, Homo sapiens
gaacuaauucccacucuua

SEQ ID NO: 961435 - RNA, 19 nt, Homo sapiens
ugacaaagcuguucagaug

SEQ ID NO: 961436 - RNA, 19 nt, Homo sapiens
gaaguuaacuguugaugau

SEQ ID NO: 961437 - RNA, 19 nt, Homo sapiens
gaagauagcagcccugaaa

SEQ ID NO: 961438 - RNA, 19 nt, Homo sapiens
gauaaauucugugggauua

SEQ ID NO: 961439 - RNA, 19 nt, Homo sapiens
gccaugcacugaaguauua

SEQ ID NO: 961440 - RNA, 19 nt, Homo sapiens
gaacuagucuuccuuccuu

SEQ ID NO: 961441 - RNA, 19 nt, Homo sapiens
caucagggccucaauaaua

SEQ ID NO: 961442 - RNA, 19 nt, Homo sapiens
gaacacugcuaucauugaa

SEQ ID NO: 961443 - RNA, 19 nt, Homo sapiens
ccaagacacuggcaucuaa

SEQ ID NO: 961444 - RNA, 19 nt, Homo sapiens
guuaauaccugagauguuu

SEQ ID NO: 961445 - RNA, 19 nt, Homo sapiens
caaugaagcugcaacuuug

SEQ ID NO: 961446 - RNA, 19 nt, Homo sapiens
gcaaugaagcugcaacuuu

SEQ ID NO: 961447 - RNA, 19 nt, Homo sapiens
gaaaacaguccauguauua

SEQ ID NO: 961448 - RNA, 19 nt, Homo sapiens
ucaaagaugcuguguauaa

SEQ ID NO: 961449 - RNA, 19 nt, Homo sapiens
ggaaugcaguagaaguaua

SEQ ID NO: 961450 - RNA, 19 nt, Homo sapiens
gagcauuacuuaccuucua

SEQ ID NO: 961451 - RNA, 19 nt, Homo sapiens
guaaauacauugggucuau

SEQ ID NO: 961452 - RNA, 19 nt, Homo sapiens
gcagcaagcuacagaaugu

SEQ ID NO: 961453 - RNA, 19 nt, Homo sapiens
gcuucaagaucaagauuua

SEQ ID NO: 961454 - RNA, 19 nt, Homo sapiens
ugauuuagcuucuggaauu

SEQ ID NO: 961455 - RNA, 19 nt, Homo sapiens
ggagauucuuggaaauaua

SEQ ID NO: 961456 - RNA, 19 nt, Homo sapiens
ccuauuaacugaagaagaa

SEQ ID NO: 961457 - RNA, 19 nt, Homo sapiens
gaaggacccuguucauaca

SEQ ID NO: 961458 - RNA, 19 nt, Homo sapiens
ugaaacagcuacaacuuug

SEQ ID NO: 961459 - RNA, 19 nt, Homo sapiens
caaccacacuuuggauaua

SEQ ID NO: 961460 - RNA, 19 nt, Homo sapiens
aaucaaagaugcuguguau

SEQ ID NO: 961461 - RNA, 19 nt, Homo sapiens
gaccauaugugggauguuu

SEQ ID NO: 961462 - RNA, 19 nt, Homo sapiens
gaucaucaaugguuauauc

SEQ ID NO: 961463 - RNA, 19 nt, Homo sapiens
gaaagugcugcguaaguua

SEQ ID NO: 961464 - RNA, 19 nt, Homo sapiens
gaagaagaacugacaaugu

SEQ ID NO: 961465 - RNA, 19 nt, Homo sapiens
ggagagguauccuguagug

SEQ ID NO: 961466 - RNA, 19 nt, Homo sapiens
uuacuuaccuucuaucaug

SEQ ID NO: 961467 - RNA, 19 nt, Homo sapiens
cagaauaugucaccacuuc

SEQ ID NO: 961468 - RNA, 19 nt, Homo sapiens
uaagacccaugcuuuauga

SEQ ID NO: 961469 - RNA, 19 nt, Homo sapiens
ucaggauacugcuguguua

SEQ ID NO: 961470 - RNA, 19 nt, Homo sapiens
agauaugaaugcacuguua

SEQ ID NO: 961471 - RNA, 19 nt, Homo sapiens
gaaaugaugcaaacacuuc

SEQ ID NO: 961472 - RNA, 19 nt, Homo sapiens
ugacaacacuuauucaucu

SEQ ID NO: 961473 - RNA, 19 nt, Homo sapiens
ggaaauuacuacagaaggu

SEQ ID NO: 961474 - RNA, 19 nt, Homo sapiens
gaauacaaucagacucuua

SEQ ID NO: 961475 - RNA, 19 nt, Homo sapiens
gaaaaugcccuuaaaguga

SEQ ID NO: 961476 - RNA, 19 nt, Homo sapiens
cagcacagagcauuacuua

SEQ ID NO: 961477 - RNA, 19 nt, Homo sapiens
ccacguaucuuggaguuau

SEQ ID NO: 961478 - RNA, 19 nt, Homo sapiens
gaaaccauguucacacuac

SEQ ID NO: 961479 - RNA, 19 nt, Homo sapiens
caaagaugcuguguauaau

SEQ ID NO: 961480 - RNA, 19 nt, Homo sapiens
ugaaugcacuguuaaucaa

SEQ ID NO: 961481 - RNA, 19 nt, Homo sapiens
ucacaaaccuauuccucaa

SEQ ID NO: 961482 - RNA, 19 nt, Homo sapiens
gaacuugcuuuaagaucau

SEQ ID NO: 961483 - RNA, 19 nt, Homo sapiens
aagaagaacugacaaugug

SEQ ID NO: 961484 - RNA, 19 nt, Homo sapiens
acaguggccugaacuaauu

SEQ ID NO: 961485 - RNA, 19 nt, Homo sapiens
uaaaccagauugcaacuca

SEQ ID NO: 961486 - RNA, 19 nt, Homo sapiens
aagcaaagaccacacauuu

SEQ ID NO: 961487 - RNA, 19 nt, Homo sapiens
gacggaagauccugaaaca

SEQ ID NO: 961488 - RNA, 19 nt, Homo sapiens
gugaaggcguuacauuuga

SEQ ID NO: 961489 - RNA, 19 nt, Homo sapiens
ugaaagugcugcguaaguu

SEQ ID NO: 961490 - RNA, 19 nt, Homo sapiens
gaaaguguguuuuaucaga

SEQ ID NO: 961491 - RNA, 19 nt, Homo sapiens
gaccucugguuaugguuua

SEQ ID NO: 961492 - RNA, 19 nt, Homo sapiens
guagaaggccugcaugaug

SEQ ID NO: 961493 - RNA, 19 nt, Homo sapiens
gaggagauucuuggaaaua

SEQ ID NO: 961494 - RNA, 19 nt, Homo sapiens
acagagauauguagaagau

SEQ ID NO: 961495 - RNA, 19 nt, Homo sapiens
gugcagggcucaucaccaa

SEQ ID NO: 961496 - RNA, 19 nt, Homo sapiens
uguaaauccugcauaacua

SEQ ID NO: 961497 - RNA, 19 nt, Homo sapiens
uaaagugaacccaauacua

SEQ ID NO: 961498 - RNA, 19 nt, Homo sapiens
gcuuuaagaucaucaaugg

SEQ ID NO: 961499 - RNA, 19 nt, Homo sapiens
gaagaaacaggaggagauu

SEQ ID NO: 961500 - RNA, 19 nt, Homo sapiens
aguccuaguuccuuuguua

SEQ ID NO: 961501 - RNA, 19 nt, Homo sapiens
guaaauccugcauaacuaa

SEQ ID NO: 961502 - RNA, 19 nt, Homo sapiens
gaaacaggaacuuauaaag

SEQ ID NO: 961503 - RNA, 19 nt, Homo sapiens
uagaaggccugcaugaugu

SEQ ID NO: 961504 - RNA, 19 nt, Homo sapiens
ucuggaagaugguuuagaa

SEQ ID NO: 961505 - RNA, 19 nt, Homo sapiens
acacaaagaugcauguuuu

SEQ ID NO: 961506 - RNA, 19 nt, Homo sapiens
gaaguauagguacagauaa

SEQ ID NO: 961507 - RNA, 19 nt, Homo sapiens
gaacgaacacugcuaucau

SEQ ID NO: 961508 - RNA, 19 nt, Homo sapiens
guucagaugaugcuauuaa

SEQ ID NO: 961509 - RNA, 19 nt, Homo sapiens
aauacuagguccacaaaug

SEQ ID NO: 961510 - RNA, 19 nt, Homo sapiens
agaguugcuucguauauuu

SEQ ID NO: 961511 - RNA, 19 nt, Homo sapiens
ggaaaacaguccauguauu

SEQ ID NO: 961512 - RNA, 19 nt, Homo sapiens
ggaagaaacaggaggagau

SEQ ID NO: 961513 - RNA, 19 nt, Homo sapiens
cagaugaugcuauuaaaga

SEQ ID NO: 961514 - RNA, 19 nt, Homo sapiens
ggaggagauucuuggaaau

SEQ ID NO: 961515 - RNA, 19 nt, Homo sapiens
ucagagaucacuggaauuu

SEQ ID NO: 961516 - RNA, 19 nt, Homo sapiens
guaaggaaacuuuaaagca

SEQ ID NO: 961517 - RNA, 19 nt, Homo sapiens
gaacaugcaguacauaaaa

SEQ ID NO: 961518 - RNA, 19 nt, Homo sapiens
ggagaccucugguuauggu

SEQ ID NO: 961519 - RNA, 19 nt, Homo sapiens
gagguauccuguagugaug

SEQ ID NO: 961520 - RNA, 19 nt, Homo sapiens
ggugaaggcguuacauuug

SEQ ID NO: 961521 - RNA, 19 nt, Homo sapiens
cagauaauguuuguagaga

SEQ ID NO: 961522 - RNA, 19 nt, Homo sapiens
agaaguauagguacagaua

SEQ ID NO: 961523 - RNA, 19 nt, Homo sapiens
uauagagucuguuaaaguc

SEQ ID NO: 961524 - RNA, 19 nt, Homo sapiens
aaaguuggguacaguaugu

SEQ ID NO: 961525 - RNA, 19 nt, Homo sapiens
acaaauguuucaaccgauu

SEQ ID NO: 961526 - RNA, 19 nt, Homo sapiens
cagaguugcuucguauauu

SEQ ID NO: 961527 - RNA, 19 nt, Homo sapiens
caccagaguugcuucguau

SEQ ID NO: 961528 - RNA, 19 nt, Homo sapiens
caacugaguacagauguuu

SEQ ID NO: 961529 - RNA, 19 nt, Homo sapiens
gauaugaaugcacuguuaa

SEQ ID NO: 961530 - RNA, 19 nt, Homo sapiens
gaaagagccuuguaucaua

SEQ ID NO: 961531 - RNA, 19 nt, Homo sapiens
ggaaagaggucgauggauu

SEQ ID NO: 961532 - RNA, 19 nt, Homo sapiens
gaacuuguuucgcaaauuu

SEQ ID NO: 961533 - RNA, 19 nt, Homo sapiens
ccaaagcucuggaauugua

SEQ ID NO: 961534 - RNA, 19 nt, Homo sapiens
gaagugaucuccaaaauga

SEQ ID NO: 961535 - RNA, 19 nt, Homo sapiens
gaucuauaccugcuaauua

SEQ ID NO: 961536 - RNA, 19 nt, Homo sapiens
ggagaaacuucaauauuca

SEQ ID NO: 961537 - RNA, 19 nt, Homo sapiens
gaaagaggucgauggauuu

SEQ ID NO: 961538 - RNA, 19 nt, Homo sapiens
gcucuggaauuguacauuu

SEQ ID NO: 961539 - RNA, 19 nt, Homo sapiens
gcgcgcagcugcucaagaa

SEQ ID NO: 961540 - RNA, 19 nt, Homo sapiens
cggagaaacuucaauauuc

SEQ ID NO: 961541 - RNA, 19 nt, Homo sapiens
gaacauuguaucauaggua

SEQ ID NO: 961542 - RNA, 19 nt, Homo sapiens
gagugcaucugguaauuga

SEQ ID NO: 961543 - RNA, 19 nt, Homo sapiens
ucaagaaguucaucaagau

SEQ ID NO: 961544 - RNA, 19 nt, Homo sapiens
ggaaagagccuuguaucau

SEQ ID NO: 961545 - RNA, 19 nt, Homo sapiens
gaaagcuccuuccucuaug

SEQ ID NO: 961546 - RNA, 19 nt, Homo sapiens
gcuaugaggguguauauau

SEQ ID NO: 961547 - RNA, 19 nt, Homo sapiens
gagaagaagccgauaaagu

SEQ ID NO: 961548 - RNA, 19 nt, Homo sapiens
ccaaucaccugcagaccaa

SEQ ID NO: 961549 - RNA, 19 nt, Homo sapiens
ggaguaagacccuuguaga

SEQ ID NO: 961550 - RNA, 19 nt, Homo sapiens
ugggauaucuaacugcuaa

SEQ ID NO: 961551 - RNA, 19 nt, Homo sapiens
gaggguggauguugugugu

SEQ ID NO: 961552 - RNA, 19 nt, Homo sapiens
ccuacaagcuggaggcaaa

SEQ ID NO: 961553 - RNA, 19 nt, Homo sapiens
aaagagccuuguaucauau

SEQ ID NO: 961554 - RNA, 19 nt, Homo sapiens
gggaugggcucugaugaga

SEQ ID NO: 961555 - RNA, 19 nt, Homo sapiens
aaacuacacuuugcugguu

SEQ ID NO: 961556 - RNA, 19 nt, Homo sapiens
accaacaucugacaucuuu

SEQ ID NO: 961557 - RNA, 19 nt, Homo sapiens
ugaggacaauccgcaaaua

SEQ ID NO: 961558 - RNA, 19 nt, Homo sapiens
ugacggagaaacuucaaua

SEQ ID NO: 961559 - RNA, 19 nt, Homo sapiens
gagaucuucugccguguau

SEQ ID NO: 961560 - RNA, 19 nt, Homo sapiens
uagccaugcuucuccauuu

SEQ ID NO: 961561 - RNA, 19 nt, Homo sapiens
gagugaaccauguguauug

SEQ ID NO: 961562 - RNA, 19 nt, Homo sapiens
acccaaagcucuggaauug

SEQ ID NO: 961563 - RNA, 19 nt, Homo sapiens
ucgagaagcugcauucagu

SEQ ID NO: 961564 - RNA, 19 nt, Homo sapiens
agaagaagccgauaaaguc

SEQ ID NO: 961565 - RNA, 19 nt, Homo sapiens
cuaugaggguguauauauu

SEQ ID NO: 961566 - RNA, 19 nt, Homo sapiens
ugcaggagcuacaccagua

SEQ ID NO: 961567 - RNA, 19 nt, Homo sapiens
agaaagcuccuuccucuau

SEQ ID NO: 961568 - RNA, 19 nt, Homo sapiens
gcaccacucuuucccuuuu

SEQ ID NO: 961569 - RNA, 19 nt, Homo sapiens
ccgauaaagucuaugaauc

SEQ ID NO: 961570 - RNA, 19 nt, Homo sapiens
gggaaagagccuuguauca

SEQ ID NO: 961571 - RNA, 19 nt, Homo sapiens
ccugaccacucuuauguga

SEQ ID NO: 961572 - RNA, 19 nt, Homo sapiens
gaagaagccgauaaagucu

SEQ ID NO: 961573 - RNA, 19 nt, Homo sapiens
cagggaaauucaagaacuu

SEQ ID NO: 961574 - RNA, 19 nt, Homo sapiens
gagcuacaccaguacuuug

SEQ ID NO: 961575 - RNA, 19 nt, Homo sapiens
ggagcuacaccaguacuuu

SEQ ID NO: 961576 - RNA, 19 nt, Homo sapiens
ccguugcccugcagcuuua

SEQ ID NO: 961577 - RNA, 19 nt, Homo sapiens
gaguaagacccuuguagau

SEQ ID NO: 961578 - RNA, 19 nt, Homo sapiens
ccagggaaauucaagaacu

SEQ ID NO: 961579 - RNA, 19 nt, Homo sapiens
cucaagaaguucaucaaga

SEQ ID NO: 961580 - RNA, 19 nt, Homo sapiens
agaagccgauaaagucuau

SEQ ID NO: 961581 - RNA, 19 nt, Homo sapiens
ucucuuagacucucccuuu

SEQ ID NO: 961582 - RNA, 19 nt, Homo sapiens
caaccaacaucugacaucu

SEQ ID NO: 961583 - RNA, 19 nt, Homo sapiens
guagaugguuuggugaaca

SEQ ID NO: 961584 - RNA, 19 nt, Homo sapiens
gcacagacucacccuucuu

SEQ ID NO: 961585 - RNA, 19 nt, Homo sapiens
gugugugugugucuucuuu

SEQ ID NO: 961586 - RNA, 19 nt, Homo sapiens
aaagaggucgauggauuua

SEQ ID NO: 961587 - RNA, 19 nt, Homo sapiens
gcaaacagucagugagagu

SEQ ID NO: 961588 - RNA, 19 nt, Homo sapiens
uggagacgguggaacuaaa

SEQ ID NO: 961589 - RNA, 19 nt, Homo sapiens
gcaggagugcaucugguaa

SEQ ID NO: 961590 - RNA, 19 nt, Homo sapiens
gggauuggcagccuucuuc

SEQ ID NO: 961591 - RNA, 19 nt, Homo sapiens
cacgaugucucaaccaaca

SEQ ID NO: 961592 - RNA, 19 nt, Homo sapiens
ggaggcaaacagucaguga

SEQ ID NO: 961593 - RNA, 19 nt, Homo sapiens
auacaugccugaccacucu

SEQ ID NO: 961594 - RNA, 19 nt, Homo sapiens
gagggaaagagccuuguau

SEQ ID NO: 961595 - RNA, 19 nt, Homo sapiens
ggaucuauaccugcuaauu

SEQ ID NO: 961596 - RNA, 19 nt, Homo sapiens
gaucuucugccguguauac

SEQ ID NO: 961597 - RNA, 19 nt, Homo sapiens
guacagacccuuuuauaca

SEQ ID NO: 961598 - RNA, 19 nt, Homo sapiens
aaggaucuauaccugcuaa

SEQ ID NO: 961599 - RNA, 19 nt, Homo sapiens
gaaugcugcucacccuucu

SEQ ID NO: 961600 - RNA, 19 nt, Homo sapiens
ggcaaggccuuuauuaccu

SEQ ID NO: 961601 - RNA, 19 nt, Homo sapiens
cuacaccaguacuuuguuc

SEQ ID NO: 961602 - RNA, 19 nt, Homo sapiens
gugcuacccuugucuacuc

SEQ ID NO: 961603 - RNA, 19 nt, Homo sapiens
ugaaccauguguauuguac

SEQ ID NO: 961604 - RNA, 19 nt, Homo sapiens
uaaagauuccagaggagaa

SEQ ID NO: 961605 - RNA, 19 nt, Homo sapiens
uaacagagugaaccaugug

SEQ ID NO: 961606 - RNA, 19 nt, Homo sapiens
guccagggaugggcucuga

SEQ ID NO: 961607 - RNA, 19 nt, Homo sapiens
ggagugcaucugguaauug

SEQ ID NO: 961608 - RNA, 19 nt, Homo sapiens
caagcacuuugcacgaugu

SEQ ID NO: 961609 - RNA, 19 nt, Homo sapiens
cagcaucugugcaggacau

SEQ ID NO: 961610 - RNA, 19 nt, Homo sapiens
cagagugaaccauguguau

SEQ ID NO: 961611 - RNA, 19 nt, Homo sapiens
cagcaacagccguagcaaa

SEQ ID NO: 961612 - RNA, 19 nt, Homo sapiens
gacgguggaacuaaagauu

SEQ ID NO: 961613 - RNA, 19 nt, Homo sapiens
uaaaagaugcucagggaaa

SEQ ID NO: 961614 - RNA, 19 nt, Homo sapiens
ucuucgagcucuccuacaa

SEQ ID NO: 961615 - RNA, 19 nt, Homo sapiens
gaagcugccagggaaauuc

SEQ ID NO: 961616 - RNA, 19 nt, Homo sapiens
cucuggaauuguacauuua

SEQ ID NO: 961617 - RNA, 19 nt, Homo sapiens
cacagacucacccuucuuu

SEQ ID NO: 961618 - RNA, 19 nt, Homo sapiens
caaccagaaccuccucuuc

SEQ ID NO: 961619 - RNA, 19 nt, Homo sapiens
uggagaagaagccgauaaa

SEQ ID NO: 961620 - RNA, 19 nt, Homo sapiens
uuaacagagugaaccaugu

SEQ ID NO: 961621 - RNA, 19 nt, Homo sapiens
aaagcuccuuccucuaugu

SEQ ID NO: 961622 - RNA, 19 nt, Homo sapiens
gcaggaaccacaaaagcua

SEQ ID NO: 961623 - RNA, 19 nt, Homo sapiens
ggagaagcugccagggaaa

SEQ ID NO: 961624 - RNA, 19 nt, Homo sapiens
acggagaaacuucaauauu

SEQ ID NO: 961625 - RNA, 19 nt, Homo sapiens
gacggagaaacuucaauau

SEQ ID NO: 961626 - RNA, 19 nt, Homo sapiens
agccuuguaucauauguga

SEQ ID NO: 961627 - RNA, 19 nt, Homo sapiens
ucuggcaaggccuuuauua

SEQ ID NO: 961628 - RNA, 19 nt, Homo sapiens
caucaucaaggaucuauac

SEQ ID NO: 961629 - RNA, 19 nt, Homo sapiens
cuauaccugcuaauuauga

SEQ ID NO: 961630 - RNA, 19 nt, Homo sapiens
gaagagaaauggucccuua

SEQ ID NO: 961631 - RNA, 19 nt, Homo sapiens
gaaauucccugaccaaaga

SEQ ID NO: 961632 - RNA, 19 nt, Homo sapiens
gcaaaaggcucaucaguua

SEQ ID NO: 961633 - RNA, 19 nt, Homo sapiens
gcauauaccuguaaacuga

SEQ ID NO: 961634 - RNA, 19 nt, Homo sapiens
gaacguggcuguauuccaa

SEQ ID NO: 961635 - RNA, 19 nt, Homo sapiens
gaacgaacguggcuguauu

SEQ ID NO: 961636 - RNA, 19 nt, Homo sapiens
gagaaaagcuggugacuaa

SEQ ID NO: 961637 - RNA, 19 nt, Homo sapiens
gcaaggagcugaucgaucu

SEQ ID NO: 961638 - RNA, 19 nt, Homo sapiens
gcaagaaguuaaagaguga

SEQ ID NO: 961639 - RNA, 19 nt, Homo sapiens
ggagaacacugcacuuaug

SEQ ID NO: 961640 - RNA, 19 nt, Homo sapiens
ggacuucccugauaauugu

SEQ ID NO: 961641 - RNA, 19 nt, Homo sapiens
gaagggcaguauuucauuu

SEQ ID NO: 961642 - RNA, 19 nt, Homo sapiens
gaggagaucaugcaaauuu

SEQ ID NO: 961643 - RNA, 19 nt, Homo sapiens
ucagcaagcuugucuguaa

SEQ ID NO: 961644 - RNA, 19 nt, Homo sapiens
ccaauuuacugaugaauga

SEQ ID NO: 961645 - RNA, 19 nt, Homo sapiens
gcaaggaccugaaggaucu

SEQ ID NO: 961646 - RNA, 19 nt, Homo sapiens
gcaacaacauauugagaaa

SEQ ID NO: 961647 - RNA, 19 nt, Homo sapiens
guaaagggccaaacaguaa

SEQ ID NO: 961648 - RNA, 19 nt, Homo sapiens
gcuggugacuaaauucuua

SEQ ID NO: 961649 - RNA, 19 nt, Homo sapiens
ggagauuucuaguuuauuc

SEQ ID NO: 961650 - RNA, 19 nt, Homo sapiens
ugagaaagaugaggaaauu

SEQ ID NO: 961651 - RNA, 19 nt, Homo sapiens
ggacuucaauaucgcagua

SEQ ID NO: 961652 - RNA, 19 nt, Homo sapiens
cuucgaagaucuuguauuu

SEQ ID NO: 961653 - RNA, 19 nt, Homo sapiens
cgacuaccuuugcuucuua

SEQ ID NO: 961654 - RNA, 19 nt, Homo sapiens
gaaagacacuaccaacaag

SEQ ID NO: 961655 - RNA, 19 nt, Homo sapiens
guggauaucuuaaagcaaa

SEQ ID NO: 961656 - RNA, 19 nt, Homo sapiens
ugaaggaucuguuugaugu

SEQ ID NO: 961657 - RNA, 19 nt, Homo sapiens
gaauacgacucucaugguu

SEQ ID NO: 961658 - RNA, 19 nt, Homo sapiens
gaagacuuguguuuagaaa

SEQ ID NO: 961659 - RNA, 19 nt, Homo sapiens
ucaagaagcucaccaaguc

SEQ ID NO: 961660 - RNA, 19 nt, Homo sapiens
gcaaggcugucgaagugua

SEQ ID NO: 961661 - RNA, 19 nt, Homo sapiens
gaauucaacuggaacuaga

SEQ ID NO: 961662 - RNA, 19 nt, Homo sapiens
ccagagcccuuuaccguuu

SEQ ID NO: 961663 - RNA, 19 nt, Homo sapiens
gaaauuaucccuuuguucu

SEQ ID NO: 961664 - RNA, 19 nt, Homo sapiens
ggaagugguugaagccauu

SEQ ID NO: 961665 - RNA, 19 nt, Homo sapiens
uuucagagcuucaugguuu

SEQ ID NO: 961666 - RNA, 19 nt, Homo sapiens
gaggaagacuuguguuuag

SEQ ID NO: 961667 - RNA, 19 nt, Homo sapiens
gacuuaaacuggaaauuga

SEQ ID NO: 961668 - RNA, 19 nt, Homo sapiens
gaucuuguauuucuucguu

SEQ ID NO: 961669 - RNA, 19 nt, Homo sapiens
ggaguuacauagaucagaa

SEQ ID NO: 961670 - RNA, 19 nt, Homo sapiens
gaugagaacaguaaugaaa

SEQ ID NO: 961671 - RNA, 19 nt, Homo sapiens
ggagcgauccacuuuguua

SEQ ID NO: 961672 - RNA, 19 nt, Homo sapiens
uaacucugcuugcaacaaa

SEQ ID NO: 961673 - RNA, 19 nt, Homo sapiens
cauaagcacuaccaagaaa

SEQ ID NO: 961674 - RNA, 19 nt, Homo sapiens
caagacaucaaaccuguua

SEQ ID NO: 961675 - RNA, 19 nt, Homo sapiens
gcacaucccuggcuguaag

SEQ ID NO: 961676 - RNA, 19 nt, Homo sapiens
gagaagagaagaaacagaa

SEQ ID NO: 961677 - RNA, 19 nt, Homo sapiens
gaaacaaccauuccagaga

SEQ ID NO: 961678 - RNA, 19 nt, Homo sapiens
gaccacagacaacagauua

SEQ ID NO: 961679 - RNA, 19 nt, Homo sapiens
ccaaaggacuucaauaucg

SEQ ID NO: 961680 - RNA, 19 nt, Homo sapiens
uggaagagguggugaaaga

SEQ ID NO: 961681 - RNA, 19 nt, Homo sapiens
cagcagaccuuaugcaaag

SEQ ID NO: 961682 - RNA, 19 nt, Homo sapiens
gaaaauuccucuggcaaua

SEQ ID NO: 961683 - RNA, 19 nt, Homo sapiens
gaugaucucccuuuacauu

SEQ ID NO: 961684 - RNA, 19 nt, Homo sapiens
ggauaaagaaagcagauaa

SEQ ID NO: 961685 - RNA, 19 nt, Homo sapiens
gagaaggaguccacuguca

SEQ ID NO: 961686 - RNA, 19 nt, Homo sapiens
ugugacaccuugaaugaua

SEQ ID NO: 961687 - RNA, 19 nt, Homo sapiens
gccaaagauucucucaaua

SEQ ID NO: 961688 - RNA, 19 nt, Homo sapiens
gaucucccuuuacauuuaa

SEQ ID NO: 961689 - RNA, 19 nt, Homo sapiens
ugaucucccuuuacauuua

SEQ ID NO: 961690 - RNA, 19 nt, Homo sapiens
ggaacugggagaagaauuu

SEQ ID NO: 961691 - RNA, 19 nt, Homo sapiens
ccagguuucugauggauaa

SEQ ID NO: 961692 - RNA, 19 nt, Homo sapiens
acaccaaccugacaauuga

SEQ ID NO: 961693 - RNA, 19 nt, Homo sapiens
gcuguaaggugguuccauu

SEQ ID NO: 961694 - RNA, 19 nt, Homo sapiens
gcacaaugcccuugaagau

SEQ ID NO: 961695 - RNA, 19 nt, Homo sapiens
ugacagagaaguuaagaaa

SEQ ID NO: 961696 - RNA, 19 nt, Homo sapiens
uuagaacucccaaauguua

SEQ ID NO: 961697 - RNA, 19 nt, Homo sapiens
ggacgaauaugauuaugac

SEQ ID NO: 961698 - RNA, 19 nt, Homo sapiens
gagcacaucucugggcauu

SEQ ID NO: 961699 - RNA, 19 nt, Homo sapiens
ugagaagguugacauggua

SEQ ID NO: 961700 - RNA, 19 nt, Homo sapiens
ccuguaaacugauggaauu

SEQ ID NO: 961701 - RNA, 19 nt, Homo sapiens
gaaguugacagaagaaugu

SEQ ID NO: 961702 - RNA, 19 nt, Homo sapiens
ggccaaacaguaaauauuu

SEQ ID NO: 961703 - RNA, 19 nt, Homo sapiens
gcucagaggaggagaguuu

SEQ ID NO: 961704 - RNA, 19 nt, Homo sapiens
ccaggacugucaacucuaa

SEQ ID NO: 961705 - RNA, 19 nt, Homo sapiens
gagcaagagcagacuauuu

SEQ ID NO: 961706 - RNA, 19 nt, Homo sapiens
caagugaacucaagaagcu

SEQ ID NO: 961707 - RNA, 19 nt, Homo sapiens
guacaauucccaagaagaa

SEQ ID NO: 961708 - RNA, 19 nt, Homo sapiens
uuacauagaucagaagaga

SEQ ID NO: 961709 - RNA, 19 nt, Homo sapiens
acagagaaguuaagaaauc

SEQ ID NO: 961710 - RNA, 19 nt, Homo sapiens
ggacuuacaucaccuucuc

SEQ ID NO: 961711 - RNA, 19 nt, Homo sapiens
gcagaaggauggaagaaaa

SEQ ID NO: 961712 - RNA, 19 nt, Homo sapiens
acacugcacuuaugaugaa

SEQ ID NO: 961713 - RNA, 19 nt, Homo sapiens
gaacacugcacuuaugaug

SEQ ID NO: 961714 - RNA, 19 nt, Homo sapiens
ugcgaaaccuucacaauga

SEQ ID NO: 961715 - RNA, 19 nt, Homo sapiens
gagaaauggucccuuacug

SEQ ID NO: 961716 - RNA, 19 nt, Homo sapiens
aaagagaucuggacagcau

SEQ ID NO: 961717 - RNA, 19 nt, Homo sapiens
gcacaucucugggcauuuu

SEQ ID NO: 961718 - RNA, 19 nt, Homo sapiens
gacgaaugaugcugaaaga

SEQ ID NO: 961719 - RNA, 19 nt, Homo sapiens
cauaccaucucacaacuga

SEQ ID NO: 961720 - RNA, 19 nt, Homo sapiens
gcaacaaaggaaagguuua

SEQ ID NO: 961721 - RNA, 19 nt, Homo sapiens
agacagaccugaaaauaaa

SEQ ID NO: 961722 - RNA, 19 nt, Homo sapiens
cgauggcaguuuauaauug

SEQ ID NO: 961723 - RNA, 19 nt, Homo sapiens
ggugauagcuuuuguagga

SEQ ID NO: 961724 - RNA, 19 nt, Homo sapiens
ucucagacaucaauauuuc

SEQ ID NO: 961725 - RNA, 19 nt, Homo sapiens
gaugauuucugaacugaag

SEQ ID NO: 961726 - RNA, 19 nt, Homo sapiens
ccagugacacaauggauua

SEQ ID NO: 961727 - RNA, 19 nt, Homo sapiens
gaaugaauguaggaaacaa

SEQ ID NO: 961728 - RNA, 19 nt, Homo sapiens
ucgaagaucuuguauuucu

SEQ ID NO: 961729 - RNA, 19 nt, Homo sapiens
ggaacgagcaguuucuguu

SEQ ID NO: 961730 - RNA, 19 nt, Homo sapiens
uguaauaggugcucaauaa

SEQ ID NO: 961731 - RNA, 19 nt, Homo sapiens
gcacgaggguuuuauguua

SEQ ID NO: 961732 - RNA, 19 nt, Homo sapiens
gaaacaacagugucagaaa

SEQ ID NO: 961733 - RNA, 19 nt, Homo sapiens
cagaaacgaugcugucuuc

SEQ ID NO: 961734 - RNA, 19 nt, Homo sapiens
gcgaugaaauuguuguaau

SEQ ID NO: 961735 - RNA, 19 nt, Homo sapiens
gcagaguuccuuccgguuu

SEQ ID NO: 961736 - RNA, 19 nt, Homo sapiens
agagauacaugaaacaaca

SEQ ID NO: 961737 - RNA, 19 nt, Homo sapiens
gcugaggccuggugagcaa

SEQ ID NO: 961738 - RNA, 19 nt, Homo sapiens
guaauaggugcucaauaaa

SEQ ID NO: 961739 - RNA, 19 nt, Homo sapiens
aaacaacagugucagaaac

SEQ ID NO: 961740 - RNA, 19 nt, Homo sapiens
gaauucggcacgaggguuu

SEQ ID NO: 961741 - RNA, 19 nt, Homo sapiens
aaacgaugcugucuuccau

SEQ ID NO: 961742 - RNA, 19 nt, Homo sapiens
gugccagucucgagucuau

SEQ ID NO: 961743 - RNA, 19 nt, Homo sapiens
agacacggcuuuugauauu

SEQ ID NO: 961744 - RNA, 19 nt, Homo sapiens
cagaguuccuuccgguuug

SEQ ID NO: 961745 - RNA, 19 nt, Homo sapiens
ucuaagagauacaugaaac

SEQ ID NO: 961746 - RNA, 19 nt, Homo sapiens
gaucuugagacacggcuuu

SEQ ID NO: 961747 - RNA, 19 nt, Homo sapiens
uauguggcguguacccuaa

SEQ ID NO: 961748 - RNA, 19 nt, Homo sapiens
gaaacgaugcugucuucca

SEQ ID NO: 961749 - RNA, 19 nt, Homo sapiens
ucccaaaccucgcgugauc

SEQ ID NO: 961750 - RNA, 19 nt, Homo sapiens
uccaugcgaugaaauuguu

SEQ ID NO: 961751 - RNA, 19 nt, Homo sapiens
uuucaucgaucuugagaca

SEQ ID NO: 961752 - RNA, 19 nt, Homo sapiens
uauguuauguggcguguac

SEQ ID NO: 961753 - RNA, 19 nt, Homo sapiens
ugaaacaacagugucagaa

SEQ ID NO: 961754 - RNA, 19 nt, Homo sapiens
ccgcgugccugcaacaauc

SEQ ID NO: 961755 - RNA, 19 nt, Homo sapiens
ggaaggggaagccggauaa

SEQ ID NO: 961756 - RNA, 19 nt, Homo sapiens
ugucuuccaugcgaugaaa

SEQ ID NO: 961757 - RNA, 19 nt, Homo sapiens
acacggcuuuugauauuuu

SEQ ID NO: 961758 - RNA, 19 nt, Homo sapiens
caacagugucagaaacgau

SEQ ID NO: 961759 - RNA, 19 nt, Homo sapiens
aggguuggcuggauucagu

SEQ ID NO: 961760 - RNA, 19 nt, Homo sapiens
gguuggcuggauucaguua

SEQ ID NO: 961761 - RNA, 19 nt, Homo sapiens
aggggaagccggauaaaua

SEQ ID NO: 961762 - RNA, 19 nt, Homo sapiens
ucagaaacgaugcugucuu

SEQ ID NO: 961763 - RNA, 19 nt, Homo sapiens
cgcauuucaucgaucuuga

SEQ ID NO: 961764 - RNA, 19 nt, Homo sapiens
gauuaaagaugcuugguua

SEQ ID NO: 961765 - RNA, 19 nt, Homo sapiens
gaaauugccugguuacaug

SEQ ID NO: 961766 - RNA, 19 nt, Homo sapiens
gaaacacacucuugagaaa

SEQ ID NO: 961767 - RNA, 19 nt, Homo sapiens
caagagaaguuuaaucuga

SEQ ID NO: 961768 - RNA, 19 nt, Homo sapiens
gaacgaaacgcacaccuua

SEQ ID NO: 961769 - RNA, 19 nt, Homo sapiens
caaacaaacuucagagaaa

SEQ ID NO: 961770 - RNA, 19 nt, Homo sapiens
ggacauauguugccucaga

SEQ ID NO: 961771 - RNA, 19 nt, Homo sapiens
gaaaauggcuacugaaauu

SEQ ID NO: 961772 - RNA, 19 nt, Homo sapiens
gauagaaguugaacagaaa

SEQ ID NO: 961773 - RNA, 19 nt, Homo sapiens
ggaaacagaguguaauaua

SEQ ID NO: 961774 - RNA, 19 nt, Homo sapiens
ggaagucacugaaacauuc

SEQ ID NO: 961775 - RNA, 19 nt, Homo sapiens
gcaagaaguuugugaagau

SEQ ID NO: 961776 - RNA, 19 nt, Homo sapiens
uuaaauagcugugucgaua

SEQ ID NO: 961777 - RNA, 19 nt, Homo sapiens
gaacagaaacugaaacuag

SEQ ID NO: 961778 - RNA, 19 nt, Homo sapiens
gcagagagcucaugaacag

SEQ ID NO: 961779 - RNA, 19 nt, Homo sapiens
ccgagaagcucaagucuuu

SEQ ID NO: 961780 - RNA, 19 nt, Homo sapiens
ggaagaagcuggucuccau

SEQ ID NO: 961781 - RNA, 19 nt, Homo sapiens
gaagagagacugacacaga

SEQ ID NO: 961782 - RNA, 19 nt, Homo sapiens
gaugaaaucugaccuacga

SEQ ID NO: 961783 - RNA, 19 nt, Homo sapiens
gaagaacacuuucaagaac

SEQ ID NO: 961784 - RNA, 19 nt, Homo sapiens
gaaagugaaucagcucaaa

SEQ ID NO: 961785 - RNA, 19 nt, Homo sapiens
ggaagaauaucgugcacaa

SEQ ID NO: 961786 - RNA, 19 nt, Homo sapiens
gagagagugugaucaguuu

SEQ ID NO: 961787 - RNA, 19 nt, Homo sapiens
ugaaacagcugcacagaug

SEQ ID NO: 961788 - RNA, 19 nt, Homo sapiens
gacuggagcucgaagauaa

SEQ ID NO: 961789 - RNA, 19 nt, Homo sapiens
gaacccagaugacuugaau

SEQ ID NO: 961790 - RNA, 19 nt, Homo sapiens
cagagaaguuggcagaaua

SEQ ID NO: 961791 - RNA, 19 nt, Homo sapiens
cagaagaaguugaggcuaa

SEQ ID NO: 961792 - RNA, 19 nt, Homo sapiens
agucugagcuggaagaaua

SEQ ID NO: 961793 - RNA, 19 nt, Homo sapiens
gaacuuaaucaacgucuaa

SEQ ID NO: 961794 - RNA, 19 nt, Homo sapiens
gaaccagacugcucacuag

SEQ ID NO: 961795 - RNA, 19 nt, Homo sapiens
ggagcucucugaaguuaaa

SEQ ID NO: 961796 - RNA, 19 nt, Homo sapiens
ugacacagaugagaaauga

SEQ ID NO: 961797 - RNA, 19 nt, Homo sapiens
gcggagcucucugaaguua

SEQ ID NO: 961798 - RNA, 19 nt, Homo sapiens
gaaauauacuccagcucaa

SEQ ID NO: 961799 - RNA, 19 nt, Homo sapiens
uagaugaacuccagucuga

SEQ ID NO: 961800 - RNA, 19 nt, Homo sapiens
gaaacuggaugaagaguac

SEQ ID NO: 961801 - RNA, 19 nt, Homo sapiens
gcacagaaaucuccagacu

SEQ ID NO: 961802 - RNA, 19 nt, Homo sapiens
gaacucaccgucagaagaa

SEQ ID NO: 961803 - RNA, 19 nt, Homo sapiens
gacgaucaccucuaaguua

SEQ ID NO: 961804 - RNA, 19 nt, Homo sapiens
gaauguggauggagagaug

SEQ ID NO: 961805 - RNA, 19 nt, Homo sapiens
guucuaagcuacaacgaaa

SEQ ID NO: 961806 - RNA, 19 nt, Homo sapiens
gaagagaccaggacugaau

SEQ ID NO: 961807 - RNA, 19 nt, Homo sapiens
gggagcagcuguuggaaga

SEQ ID NO: 961808 - RNA, 19 nt, Homo sapiens
ugaaucagcucaaagaaca

SEQ ID NO: 961809 - RNA, 19 nt, Homo sapiens
ggaaaagguucagaauuua

SEQ ID NO: 961810 - RNA, 19 nt, Homo sapiens
acagaaaucuccagacuuc

SEQ ID NO: 961811 - RNA, 19 nt, Homo sapiens
gacagcagaucgagaaaga

SEQ ID NO: 961812 - RNA, 19 nt, Homo sapiens
ucaaauagaagcccaguuu

SEQ ID NO: 961813 - RNA, 19 nt, Homo sapiens
aggcagagcuggucauuga

SEQ ID NO: 961814 - RNA, 19 nt, Homo sapiens
ugacaagccugguggagaa

SEQ ID NO: 961815 - RNA, 19 nt, Homo sapiens
gcaaaggcaugagaacgaa

SEQ ID NO: 961816 - RNA, 19 nt, Homo sapiens
ucaggaaacuggaugaaga

SEQ ID NO: 961817 - RNA, 19 nt, Homo sapiens
ccaaauauaagcuguugua

SEQ ID NO: 961818 - RNA, 19 nt, Homo sapiens
gacuagaaauggaacauga

SEQ ID NO: 961819 - RNA, 19 nt, Homo sapiens
auaagaaccucucaaauag

SEQ ID NO: 961820 - RNA, 19 nt, Homo sapiens
gaagauaaagugcgccauu

SEQ ID NO: 961821 - RNA, 19 nt, Homo sapiens
gcaaaugucccggaugaaa

SEQ ID NO: 961822 - RNA, 19 nt, Homo sapiens
gaacaauucagacacauca

SEQ ID NO: 961823 - RNA, 19 nt, Homo sapiens
caacaucuccucucucaau

SEQ ID NO: 961824 - RNA, 19 nt, Homo sapiens
agagagagaugcuggagaa

SEQ ID NO: 961825 - RNA, 19 nt, Homo sapiens
gaugagaaaugaauaugag

SEQ ID NO: 961826 - RNA, 19 nt, Homo sapiens
gcagagaaguuggcagaau

SEQ ID NO: 961827 - RNA, 19 nt, Homo sapiens
gaagagaaacugcaagaag

SEQ ID NO: 961828 - RNA, 19 nt, Homo sapiens
ccagaugacuugaaugcuu

SEQ ID NO: 961829 - RNA, 19 nt, Homo sapiens
guuagagaguucuguaauu

SEQ ID NO: 961830 - RNA, 19 nt, Homo sapiens
gaacaacugguaacuguca

SEQ ID NO: 961831 - RNA, 19 nt, Homo sapiens
caucuaaacccaucaggua

SEQ ID NO: 961832 - RNA, 19 nt, Homo sapiens
ccugggagcugaagaauca

SEQ ID NO: 961833 - RNA, 19 nt, Homo sapiens
gagcagcuguuggaagaaa

SEQ ID NO: 961834 - RNA, 19 nt, Homo sapiens
gaaacgcacaccuuagaaa

SEQ ID NO: 961835 - RNA, 19 nt, Homo sapiens
gcaguaugguuuacagaau

SEQ ID NO: 961836 - RNA, 19 nt, Homo sapiens
gaacuuugccacauguuga

SEQ ID NO: 961837 - RNA, 19 nt, Homo sapiens
aaagaacaaucuccugcua

SEQ ID NO: 961838 - RNA, 19 nt, Homo sapiens
gaagauagcauuucuaacc

SEQ ID NO: 961839 - RNA, 19 nt, Homo sapiens
gaacacacagcucuuggaa

SEQ ID NO: 961840 - RNA, 19 nt, Homo sapiens
gagaagcucaagucuuuaa

SEQ ID NO: 961841 - RNA, 19 nt, Homo sapiens
gcucagcccaaauauguua

SEQ ID NO: 961842 - RNA, 19 nt, Homo sapiens
gaacgaaugauagaaguug

SEQ ID NO: 961843 - RNA, 19 nt, Homo sapiens
gaagacaccgugcagaaug

SEQ ID NO: 961844 - RNA, 19 nt, Homo sapiens
gcugguggcuucucaggaa

SEQ ID NO: 961845 - RNA, 19 nt, Homo sapiens
ugaaggcaaugaugcauga

SEQ ID NO: 961846 - RNA, 19 nt, Homo sapiens
uacaggagcugacuaggaa

SEQ ID NO: 961847 - RNA, 19 nt, Homo sapiens
gcucaaggcuagacugaca

SEQ ID NO: 961848 - RNA, 19 nt, Homo sapiens
ugauagaaguugaacagaa

SEQ ID NO: 961849 - RNA, 19 nt, Homo sapiens
gaacuggaacguuguaaag

SEQ ID NO: 961850 - RNA, 19 nt, Homo sapiens
gcagugagaugcagcaaaa

SEQ ID NO: 961851 - RNA, 19 nt, Homo sapiens
ggaaagacuagaaauggaa

SEQ ID NO: 961852 - RNA, 19 nt, Homo sapiens
ccuaagaaauguaucugaa

SEQ ID NO: 961853 - RNA, 19 nt, Homo sapiens
gacagcagcuacuccaaga

SEQ ID NO: 961854 - RNA, 19 nt, Homo sapiens
cccaggagcugcugaaaga

SEQ ID NO: 961855 - RNA, 19 nt, Homo sapiens
ugaaggaccuccaggaaca

SEQ ID NO: 961856 - RNA, 19 nt, Homo sapiens
gcaagaaggcacaggagaa

SEQ ID NO: 961857 - RNA, 19 nt, Homo sapiens
aagauaaagugcgccauua

SEQ ID NO: 961858 - RNA, 19 nt, Homo sapiens
gaaaauguguuagcagaaa

SEQ ID NO: 961859 - RNA, 19 nt, Homo sapiens
gaagaugugagccgagaaa

SEQ ID NO: 961860 - RNA, 19 nt, Homo sapiens
ggcaacaucuccucucuca

SEQ ID NO: 961861 - RNA, 19 nt, Homo sapiens
aagaaccucucaaauagaa

SEQ ID NO: 961862 - RNA, 19 nt, Homo sapiens
agaaagaggaguuaagaaa

SEQ ID NO: 961863 - RNA, 19 nt, Homo sapiens
caaugaguguagaagauuu

SEQ ID NO: 961864 - RNA, 19 nt, Homo sapiens
gaacaacucugcaagaaca

SEQ ID NO: 961865 - RNA, 19 nt, Homo sapiens
gaaauugccugguuacaug

SEQ ID NO: 961866 - RNA, 19 nt, Homo sapiens
gaaacacacucuugagaaa

SEQ ID NO: 961867 - RNA, 19 nt, Homo sapiens
caagagaaguuuaaucuga

SEQ ID NO: 961868 - RNA, 19 nt, Homo sapiens
gaacgaaacgcacaccuua

SEQ ID NO: 961869 - RNA, 19 nt, Homo sapiens
ggacauauguugccucaga

SEQ ID NO: 961870 - RNA, 19 nt, Homo sapiens
gaaaauggcuacugaaauu

SEQ ID NO: 961871 - RNA, 19 nt, Homo sapiens
gauagaaguugaacagaaa

SEQ ID NO: 961872 - RNA, 19 nt, Homo sapiens
ggaagucacugaaacauuc

SEQ ID NO: 961873 - RNA, 19 nt, Homo sapiens
gaaacagaguguaauagaa

SEQ ID NO: 961874 - RNA, 19 nt, Homo sapiens
gcaagaaguuugugaagau

SEQ ID NO: 961875 - RNA, 19 nt, Homo sapiens
uuaaauagcugugucgaua

SEQ ID NO: 961876 - RNA, 19 nt, Homo sapiens
gaacagaaacugaaacuag

SEQ ID NO: 961877 - RNA, 19 nt, Homo sapiens
uaagugaccuggaagauga

SEQ ID NO: 961878 - RNA, 19 nt, Homo sapiens
gcagagagcucaugaacag

SEQ ID NO: 961879 - RNA, 19 nt, Homo sapiens
uagaagaaccucucaaaua

SEQ ID NO: 961880 - RNA, 19 nt, Homo sapiens
ccgagaagcucaagucuuu

SEQ ID NO: 961881 - RNA, 19 nt, Homo sapiens
ggaagaagcuggucuccau

SEQ ID NO: 961882 - RNA, 19 nt, Homo sapiens
gaagagagacugacacaga

SEQ ID NO: 961883 - RNA, 19 nt, Homo sapiens
gaugaaaucugaccuacga

SEQ ID NO: 961884 - RNA, 19 nt, Homo sapiens
gaagaacacuuucaagaac

SEQ ID NO: 961885 - RNA, 19 nt, Homo sapiens
gaaagugaaucagcucaaa

SEQ ID NO: 961886 - RNA, 19 nt, Homo sapiens
ggaagaauaucgugcacaa

SEQ ID NO: 961887 - RNA, 19 nt, Homo sapiens
gagagagugugaucaguuu

SEQ ID NO: 961888 - RNA, 19 nt, Homo sapiens
ugaaacagcugcacagaug

SEQ ID NO: 961889 - RNA, 19 nt, Homo sapiens
gacuggagcucgaagauaa

SEQ ID NO: 961890 - RNA, 19 nt, Homo sapiens
gaacccagaugacuugaau

SEQ ID NO: 961891 - RNA, 19 nt, Homo sapiens
cagaagaaguugaggcuaa

SEQ ID NO: 961892 - RNA, 19 nt, Homo sapiens
agucugagcuggaagaaua

SEQ ID NO: 961893 - RNA, 19 nt, Homo sapiens
gaacuuaaucaacgucuaa

SEQ ID NO: 961894 - RNA, 19 nt, Homo sapiens
gaaccagacugcucacuag

SEQ ID NO: 961895 - RNA, 19 nt, Homo sapiens
ggagcucucugaaguuaaa

SEQ ID NO: 961896 - RNA, 19 nt, Homo sapiens
agaagaaccucucaaauag

SEQ ID NO: 961897 - RNA, 19 nt, Homo sapiens
ugaaagcucuggaaguuga

SEQ ID NO: 961898 - RNA, 19 nt, Homo sapiens
gaagguccgucaauuggaa

SEQ ID NO: 961899 - RNA, 19 nt, Homo sapiens
ugacacagaugagaaauga

SEQ ID NO: 961900 - RNA, 19 nt, Homo sapiens
gugaaggacuuguauguug

SEQ ID NO: 961901 - RNA, 19 nt, Homo sapiens
gcggagcucucugaaguua

SEQ ID NO: 961902 - RNA, 19 nt, Homo sapiens
gaaauauacuccagcucaa

SEQ ID NO: 961903 - RNA, 19 nt, Homo sapiens
uagaugaacuccagucuga

SEQ ID NO: 961904 - RNA, 19 nt, Homo sapiens
gaaacuggaugaagaguac

SEQ ID NO: 961905 - RNA, 19 nt, Homo sapiens
caacaucuccucucucuau

SEQ ID NO: 961906 - RNA, 19 nt, Homo sapiens
gcacagaaaucuccagacu

SEQ ID NO: 961907 - RNA, 19 nt, Homo sapiens
gaacucaccgucagaagaa

SEQ ID NO: 961908 - RNA, 19 nt, Homo sapiens
gaauguggauggagagaug

SEQ ID NO: 961909 - RNA, 19 nt, Homo sapiens
guucuaagcuacaacgaaa

SEQ ID NO: 961910 - RNA, 19 nt, Homo sapiens
gaagagaccaggacugaau

SEQ ID NO: 961911 - RNA, 19 nt, Homo sapiens
gggagcagcuguuggaaga

SEQ ID NO: 961912 - RNA, 19 nt, Homo sapiens
gagaauguguuagcagaaa

SEQ ID NO: 961913 - RNA, 19 nt, Homo sapiens
guugaaagcucuggaaguu

SEQ ID NO: 961914 - RNA, 19 nt, Homo sapiens
ugaaucagcucaaagaaca

SEQ ID NO: 961915 - RNA, 19 nt, Homo sapiens
ggaaaagguucagaauuua

SEQ ID NO: 961916 - RNA, 19 nt, Homo sapiens
acagaaaucuccagacuuc

SEQ ID NO: 961917 - RNA, 19 nt, Homo sapiens
gacagcagaucgagaaaga

SEQ ID NO: 961918 - RNA, 19 nt, Homo sapiens
ucaaauagaagcccaguuu

SEQ ID NO: 961919 - RNA, 19 nt, Homo sapiens
ggaaacagaguguaauaga

SEQ ID NO: 961920 - RNA, 19 nt, Homo sapiens
aggcagagcuggucauuga

SEQ ID NO: 961921 - RNA, 19 nt, Homo sapiens
gaaauuagggacauuauac

SEQ ID NO: 961922 - RNA, 19 nt, Homo sapiens
ugacaagccugguggagaa

SEQ ID NO: 961923 - RNA, 19 nt, Homo sapiens
gcaaaggcaugagaacgaa

SEQ ID NO: 961924 - RNA, 19 nt, Homo sapiens
ucaggaaacuggaugaaga

SEQ ID NO: 961925 - RNA, 19 nt, Homo sapiens
ccaaauauaagcuguugua

SEQ ID NO: 961926 - RNA, 19 nt, Homo sapiens
gacuagaaauggaacauga

SEQ ID NO: 961927 - RNA, 19 nt, Homo sapiens
gaagauaaagugcgccauu

SEQ ID NO: 961928 - RNA, 19 nt, Homo sapiens
gcaaaugucccggaugaaa

SEQ ID NO: 961929 - RNA, 19 nt, Homo sapiens
gaacaauucagacacauca

SEQ ID NO: 961930 - RNA, 19 nt, Homo sapiens
agagagagaugcuggagaa

SEQ ID NO: 961931 - RNA, 19 nt, Homo sapiens
gaugagaaaugaauaugag

SEQ ID NO: 961932 - RNA, 19 nt, Homo sapiens
gaagagaaacugcaagaag

SEQ ID NO: 961933 - RNA, 19 nt, Homo sapiens
ccagaugacuugaaugcuu

SEQ ID NO: 961934 - RNA, 19 nt, Homo sapiens
gcuaugggauggaugaguu

SEQ ID NO: 961935 - RNA, 19 nt, Homo sapiens
gaacaacugguaacuguca

SEQ ID NO: 961936 - RNA, 19 nt, Homo sapiens
caucuaaacccaucaggua

SEQ ID NO: 961937 - RNA, 19 nt, Homo sapiens
ggagaagguccgucaauug

SEQ ID NO: 961938 - RNA, 19 nt, Homo sapiens
ccugggagcugaagaauca

SEQ ID NO: 961939 - RNA, 19 nt, Homo sapiens
gagcagcuguuggaagaaa

SEQ ID NO: 961940 - RNA, 19 nt, Homo sapiens
gaaacgcacaccuuagaaa

SEQ ID NO: 961941 - RNA, 19 nt, Homo sapiens
gcaguaugguuuacagaau

SEQ ID NO: 961942 - RNA, 19 nt, Homo sapiens
aaagaacaaucuccugcua

SEQ ID NO: 961943 - RNA, 19 nt, Homo sapiens
gggagaagguccgucaauu

SEQ ID NO: 961944 - RNA, 19 nt, Homo sapiens
gaagauagcauuucuaacc

SEQ ID NO: 961945 - RNA, 19 nt, Homo sapiens
gaacacacagcucuuggaa

SEQ ID NO: 961946 - RNA, 19 nt, Homo sapiens
gaacaggcagugaaggaaa

SEQ ID NO: 961947 - RNA, 19 nt, Homo sapiens
gagaagcucaagucuuuaa

SEQ ID NO: 961948 - RNA, 19 nt, Homo sapiens
gcucagcccaaauauguua

SEQ ID NO: 961949 - RNA, 19 nt, Homo sapiens
gaacgaaugauagaaguug

SEQ ID NO: 961950 - RNA, 19 nt, Homo sapiens
gaagacaccgugcagaaug

SEQ ID NO: 961951 - RNA, 19 nt, Homo sapiens
gcugguggcuucucaggaa

SEQ ID NO: 961952 - RNA, 19 nt, Homo sapiens
ugaaggcaaugaugcauga

SEQ ID NO: 961953 - RNA, 19 nt, Homo sapiens
uacaggagcugacuaggaa

SEQ ID NO: 961954 - RNA, 19 nt, Homo sapiens
gcucaaggcuagacugaca

SEQ ID NO: 961955 - RNA, 19 nt, Homo sapiens
ugauagaaguugaacagaa

SEQ ID NO: 961956 - RNA, 19 nt, Homo sapiens
gaacuggaacguuguaaag

SEQ ID NO: 961957 - RNA, 19 nt, Homo sapiens
gcagugagaugcagcaaaa

SEQ ID NO: 961958 - RNA, 19 nt, Homo sapiens
ugaagaugcuugagagaau

SEQ ID NO: 961959 - RNA, 19 nt, Homo sapiens
ggaaagacuagaaauggaa

SEQ ID NO: 961960 - RNA, 19 nt, Homo sapiens
ccuaagaaauguaucugaa

SEQ ID NO: 961961 - RNA, 19 nt, Homo sapiens
gacagcagcuacuccaaga

SEQ ID NO: 961962 - RNA, 19 nt, Homo sapiens
cccaggagcugcugaaaga

SEQ ID NO: 961963 - RNA, 19 nt, Homo sapiens
ugaaggaccuccaggaaca

SEQ ID NO: 961964 - RNA, 19 nt, Homo sapiens
caaugaagaugaugaaaug

SEQ ID NO: 961965 - RNA, 19 nt, Homo sapiens
gcacugaggccauuguuaa

SEQ ID NO: 961966 - RNA, 19 nt, Homo sapiens
caccaugccuggcuaauuu

SEQ ID NO: 961967 - RNA, 19 nt, Homo sapiens
ucucaaagaugauguagaa

SEQ ID NO: 961968 - RNA, 19 nt, Homo sapiens
caacauugccgcagacuuu

SEQ ID NO: 961969 - RNA, 19 nt, Homo sapiens
gaacucacuucaaagaugu

SEQ ID NO: 961970 - RNA, 19 nt, Homo sapiens
gaacggagcaguaauaacu

SEQ ID NO: 961971 - RNA, 19 nt, Homo sapiens
caagaacggagcaguaaua

SEQ ID NO: 961972 - RNA, 19 nt, Homo sapiens
gagacgagaucagcaaauu

SEQ ID NO: 961973 - RNA, 19 nt, Homo sapiens
gcucugcucugucuacauu

SEQ ID NO: 961974 - RNA, 19 nt, Homo sapiens
gacaugagguggauacugu

SEQ ID NO: 961975 - RNA, 19 nt, Homo sapiens
ggauauguguauacucaaa

SEQ ID NO: 961976 - RNA, 19 nt, Homo sapiens
gcaguaauaacuucaacua

SEQ ID NO: 961977 - RNA, 19 nt, Homo sapiens
ugacaacggcaucaaauuu

SEQ ID NO: 961978 - RNA, 19 nt, Homo sapiens
uugaguagcuugguuuaua

SEQ ID NO: 961979 - RNA, 19 nt, Homo sapiens
gaucuuggcucaccacaac

SEQ ID NO: 961980 - RNA, 19 nt, Homo sapiens
ccuggaagcuccugcauug

SEQ ID NO: 961981 - RNA, 19 nt, Homo sapiens
gaagauuggacauucguuu

SEQ ID NO: 961982 - RNA, 19 nt, Homo sapiens
ggaaaucucccuccuccuu

SEQ ID NO: 961983 - RNA, 19 nt, Homo sapiens
ucaaccagcugccuuuguu

SEQ ID NO: 961984 - RNA, 19 nt, Homo sapiens
caucaaauuugcauucaca

SEQ ID NO: 961985 - RNA, 19 nt, Homo sapiens
ggaagacgcggucccgaaa

SEQ ID NO: 961986 - RNA, 19 nt, Homo sapiens
gcacguaccaucguccuuu

SEQ ID NO: 961987 - RNA, 19 nt, Homo sapiens
ugagucaacuagugaauuc

SEQ ID NO: 961988 - RNA, 19 nt, Homo sapiens
gacgagaucagcaaauuga

SEQ ID NO: 961989 - RNA, 19 nt, Homo sapiens
gaggauuaaugucagaaau

SEQ ID NO: 961990 - RNA, 19 nt, Homo sapiens
ggauuaaugucagaaaugg

SEQ ID NO: 961991 - RNA, 19 nt, Homo sapiens
caucuggccuggauaaucu

SEQ ID NO: 961992 - RNA, 19 nt, Homo sapiens
acauuugaguugagagaua

SEQ ID NO: 961993 - RNA, 19 nt, Homo sapiens
gaccaaguuuugaggauua

SEQ ID NO: 961994 - RNA, 19 nt, Homo sapiens
gacaacggcaucaaauuug

SEQ ID NO: 961995 - RNA, 19 nt, Homo sapiens
cgauguauguacugaaguu

SEQ ID NO: 961996 - RNA, 19 nt, Homo sapiens
cuaaguagagcaagaauuc

SEQ ID NO: 961997 - RNA, 19 nt, Homo sapiens
uuacuccucucuucccuuu

SEQ ID NO: 961998 - RNA, 19 nt, Homo sapiens
cagcaucuguggccgagaa

SEQ ID NO: 961999 - RNA, 19 nt, Homo sapiens
ugaagaugaugaaaugcaa

SEQ ID NO: 962000 - RNA, 19 nt, Homo sapiens
agacaggguuucuccaugu

SEQ ID NO: 962001 - RNA, 19 nt, Homo sapiens
gaugaaaugcaacacaaug

SEQ ID NO: 962002 - RNA, 19 nt, Homo sapiens
ucacucaucuggccuggau

SEQ ID NO: 962003 - RNA, 19 nt, Homo sapiens
gggcaagaacggagcagua

SEQ ID NO: 962004 - RNA, 19 nt, Homo sapiens
cagcugccuuuguuucauu

SEQ ID NO: 962005 - RNA, 19 nt, Homo sapiens
caggugaucugcccuccuu

SEQ ID NO: 962006 - RNA, 19 nt, Homo sapiens
gcauucacauuugaguuga

SEQ ID NO: 962007 - RNA, 19 nt, Homo sapiens
ggaggugaaaucaguggua

SEQ ID NO: 962008 - RNA, 19 nt, Homo sapiens
gcgaggagggugaagauug

SEQ ID NO: 962009 - RNA, 19 nt, Homo sapiens
gaaaugcaacacaaugaag

SEQ ID NO: 962010 - RNA, 19 nt, Homo sapiens
ucacugugcugagaauuuc

SEQ ID NO: 962011 - RNA, 19 nt, Homo sapiens
ccagagggauccagcuauc

SEQ ID NO: 962012 - RNA, 19 nt, Homo sapiens
gauuggacauucguuugaa

SEQ ID NO: 962013 - RNA, 19 nt, Homo sapiens
gguccuaaaucacucaucu

SEQ ID NO: 962014 - RNA, 19 nt, Homo sapiens
cugccagccugcucaauuu

SEQ ID NO: 962015 - RNA, 19 nt, Homo sapiens
ccauauggguacucaguca

SEQ ID NO: 962016 - RNA, 19 nt, Homo sapiens
ggaaguggaggugaaauca

SEQ ID NO: 962017 - RNA, 19 nt, Homo sapiens
gugcugacccaaauagaaa

SEQ ID NO: 962018 - RNA, 19 nt, Homo sapiens
ucaucgaccugcacagcua

SEQ ID NO: 962019 - RNA, 19 nt, Homo sapiens
gaaguucagcacugggaaa

SEQ ID NO: 962020 - RNA, 19 nt, Homo sapiens
cggcccaaguuccuaagua

SEQ ID NO: 962021 - RNA, 19 nt, Homo sapiens
ucugcucugucuacauuua

SEQ ID NO: 962022 - RNA, 19 nt, Homo sapiens
ggcaagaacggagcaguaa

SEQ ID NO: 962023 - RNA, 19 nt, Homo sapiens
ucuuacagguccuaaauca

SEQ ID NO: 962024 - RNA, 19 nt, Homo sapiens
gacaggguuucuccauguu

SEQ ID NO: 962025 - RNA, 19 nt, Homo sapiens
ugaguagcuugguuuauag

SEQ ID NO: 962026 - RNA, 19 nt, Homo sapiens
cgaggagggugaagauugg

SEQ ID NO: 962027 - RNA, 19 nt, Homo sapiens
gaucccagggcuuagagua

SEQ ID NO: 962028 - RNA, 19 nt, Homo sapiens
ucucuucccuuuguuauuc

SEQ ID NO: 962029 - RNA, 19 nt, Homo sapiens
gggugaagauuggacauuc

SEQ ID NO: 962030 - RNA, 19 nt, Homo sapiens
uaggauuuguacagcauuu

SEQ ID NO: 962031 - RNA, 19 nt, Homo sapiens
gguggcaugucucucucua

SEQ ID NO: 962032 - RNA, 19 nt, Homo sapiens
ccugauggauauguguaua

SEQ ID NO: 962033 - RNA, 19 nt, Homo sapiens
gggcuucccuccucuuugc

SEQ ID NO: 962034 - RNA, 19 nt, Homo sapiens
gcaaaucuuguagggauau

SEQ ID NO: 962035 - RNA, 19 nt, Homo sapiens
uuaggugggucucaaagau

SEQ ID NO: 962036 - RNA, 19 nt, Homo sapiens
ugaaaugcaacacaaugaa

SEQ ID NO: 962037 - RNA, 19 nt, Homo sapiens
ggcccaaguuccuaaguag

SEQ ID NO: 962038 - RNA, 19 nt, Homo sapiens
caucuuacagguccuaaau

SEQ ID NO: 962039 - RNA, 19 nt, Homo sapiens
cuagauacuacaguucuua

SEQ ID NO: 962040 - RNA, 19 nt, Homo sapiens
ggcgauggcucugcucugu

SEQ ID NO: 962041 - RNA, 19 nt, Homo sapiens
ggacggcaaggaagauugu

SEQ ID NO: 962042 - RNA, 19 nt, Homo sapiens
cauuuggugugugcuuaua

SEQ ID NO: 962043 - RNA, 19 nt, Homo sapiens
cauuucaccucagcacgua

SEQ ID NO: 962044 - RNA, 19 nt, Homo sapiens
guuccuaaguagagcaaga

SEQ ID NO: 962045 - RNA, 19 nt, Homo sapiens
caggaaggcugggugaagu

SEQ ID NO: 962046 - RNA, 19 nt, Homo sapiens
uuaaauccuuccugagauc

SEQ ID NO: 962047 - RNA, 19 nt, Homo sapiens
agugguagauuucauccaa

SEQ ID NO: 962048 - RNA, 19 nt, Homo sapiens
gagcaguaauaacuucaac

SEQ ID NO: 962049 - RNA, 19 nt, Homo sapiens
gguggauacuguucauugg

SEQ ID NO: 962050 - RNA, 19 nt, Homo sapiens
gaaagggagccagcgacaa

SEQ ID NO: 962051 - RNA, 19 nt, Homo sapiens
ggugcugacccaaauagaa

SEQ ID NO: 962052 - RNA, 19 nt, Homo sapiens
gucaacuagugaauucaaa

SEQ ID NO: 962053 - RNA, 19 nt, Homo sapiens
ucaaucggccuguggaugu

SEQ ID NO: 962054 - RNA, 19 nt, Homo sapiens
ccuggcacauucccauuug

SEQ ID NO: 962055 - RNA, 19 nt, Homo sapiens
gcaggauggcgaaauuauc

SEQ ID NO: 962056 - RNA, 19 nt, Homo sapiens
caacuagugaauucaaaca

SEQ ID NO: 962057 - RNA, 19 nt, Homo sapiens
ggcaucaaauuugcauuca

SEQ ID NO: 962058 - RNA, 19 nt, Homo sapiens
guaugacaacggcaucaaa

SEQ ID NO: 962059 - RNA, 19 nt, Homo sapiens
gccgauguauguacugaag

SEQ ID NO: 962060 - RNA, 19 nt, Homo sapiens
gcaagaacggagcaguaau

SEQ ID NO: 962061 - RNA, 19 nt, Homo sapiens
gcucugucuacauuuauuu

SEQ ID NO: 962062 - RNA, 19 nt, Homo sapiens
gugguagauuucauccaaa

SEQ ID NO: 962063 - RNA, 19 nt, Homo sapiens
gaagacgcggucccgaaau

SEQ ID NO: 962064 - RNA, 19 nt, Homo sapiens
agaaauaucugcagucuuu

SEQ ID NO: 962065 - RNA, 19 nt, Homo sapiens
ggaagaggauuguuauuuc

SEQ ID NO: 962066 - RNA, 19 nt, Homo sapiens
gaaaguuaguucaacauga

SEQ ID NO: 962067 - RNA, 19 nt, Homo sapiens
gaaaacaucuucuccaaaa

SEQ ID NO: 962068 - RNA, 19 nt, Homo sapiens
gcaguuggcuggaauacuu

SEQ ID NO: 962069 - RNA, 19 nt, Homo sapiens
caagccaaguuccauauua

SEQ ID NO: 962070 - RNA, 19 nt, Homo sapiens
ccaaggaucuucccaucua

SEQ ID NO: 962071 - RNA, 19 nt, Homo sapiens
gagauaaacuaaagugugu

SEQ ID NO: 962072 - RNA, 19 nt, Homo sapiens
gaugacagguaaacuauau

SEQ ID NO: 962073 - RNA, 19 nt, Homo sapiens
gaacagauaagaauggauu

SEQ ID NO: 962074 - RNA, 19 nt, Homo sapiens
gaagaggauuguuauuuca

SEQ ID NO: 962075 - RNA, 19 nt, Homo sapiens
cauagaaacuccauuaauc

SEQ ID NO: 962076 - RNA, 19 nt, Homo sapiens
gcaauucuuugaacaauag

SEQ ID NO: 962077 - RNA, 19 nt, Homo sapiens
gauuuacccuccagugaua

SEQ ID NO: 962078 - RNA, 19 nt, Homo sapiens
uagcacaguuuaucacaua

SEQ ID NO: 962079 - RNA, 19 nt, Homo sapiens
cagcuugucuucucuguuu

SEQ ID NO: 962080 - RNA, 19 nt, Homo sapiens
guauuaugcugaagaguuu

SEQ ID NO: 962081 - RNA, 19 nt, Homo sapiens
acaaauggccuaccugaua

SEQ ID NO: 962082 - RNA, 19 nt, Homo sapiens
ucacauagaaacuccauua

SEQ ID NO: 962083 - RNA, 19 nt, Homo sapiens
ugacagaugccaacuuaua

SEQ ID NO: 962084 - RNA, 19 nt, Homo sapiens
gaacaguugcaucugaaua

SEQ ID NO: 962085 - RNA, 19 nt, Homo sapiens
ggacaggauucgauuaagu

SEQ ID NO: 962086 - RNA, 19 nt, Homo sapiens
gaacuaaaauggcaugcua

SEQ ID NO: 962087 - RNA, 19 nt, Homo sapiens
uaugagcaauccugcauua

SEQ ID NO: 962088 - RNA, 19 nt, Homo sapiens
gcaaagccauugagagagu

SEQ ID NO: 962089 - RNA, 19 nt, Homo sapiens
ggcaacagauuuacaguau

SEQ ID NO: 962090 - RNA, 19 nt, Homo sapiens
gaaaauaaguguggacauu

SEQ ID NO: 962091 - RNA, 19 nt, Homo sapiens
ugugacagaugccaacuua

SEQ ID NO: 962092 - RNA, 19 nt, Homo sapiens
gggaggaaauuuaugauag

SEQ ID NO: 962093 - RNA, 19 nt, Homo sapiens
gaaacuccauuaaucaucu

SEQ ID NO: 962094 - RNA, 19 nt, Homo sapiens
aaagaacaguugcaucuga

SEQ ID NO: 962095 - RNA, 19 nt, Homo sapiens
gauuaaguauucccucuug

SEQ ID NO: 962096 - RNA, 19 nt, Homo sapiens
gggaagaggauuguuauuu

SEQ ID NO: 962097 - RNA, 19 nt, Homo sapiens
ucacuuaauuccagccuuu

SEQ ID NO: 962098 - RNA, 19 nt, Homo sapiens
caacuugccuuguuaacca

SEQ ID NO: 962099 - RNA, 19 nt, Homo sapiens
gccagaggauaauggaaua

SEQ ID NO: 962100 - RNA, 19 nt, Homo sapiens
agacuuaacucuucaagca

SEQ ID NO: 962101 - RNA, 19 nt, Homo sapiens
guccaugggugaacaauug

SEQ ID NO: 962102 - RNA, 19 nt, Homo sapiens
guagggaagaggauuguua

SEQ ID NO: 962103 - RNA, 19 nt, Homo sapiens
ggaaaacacuggcgaacaa

SEQ ID NO: 962104 - RNA, 19 nt, Homo sapiens
ggugauggcugcuccuuuc

SEQ ID NO: 962105 - RNA, 19 nt, Homo sapiens
auucagaaguccaguauuu

SEQ ID NO: 962106 - RNA, 19 nt, Homo sapiens
gcaacagauuuacaguauu

SEQ ID NO: 962107 - RNA, 19 nt, Homo sapiens
gauuauuucuccuguugaa

SEQ ID NO: 962108 - RNA, 19 nt, Homo sapiens
ugaagaucaucaaccauuu

SEQ ID NO: 962109 - RNA, 19 nt, Homo sapiens
gaaacaaugucagccaagu

SEQ ID NO: 962110 - RNA, 19 nt, Homo sapiens
caacuaacacaaauuccua

SEQ ID NO: 962111 - RNA, 19 nt, Homo sapiens
cagcuuggguuucaguaaa

SEQ ID NO: 962112 - RNA, 19 nt, Homo sapiens
ucacagauuuguauuaugc

SEQ ID NO: 962113 - RNA, 19 nt, Homo sapiens
uaauugugcuuauggaaga

SEQ ID NO: 962114 - RNA, 19 nt, Homo sapiens
aaauaaguguggacauuga

SEQ ID NO: 962115 - RNA, 19 nt, Homo sapiens
ggauucagcuuggguuuca

SEQ ID NO: 962116 - RNA, 19 nt, Homo sapiens
uggcuuaacucgaacuuga

SEQ ID NO: 962117 - RNA, 19 nt, Homo sapiens
gacaggauucgauuaagua

SEQ ID NO: 962118 - RNA, 19 nt, Homo sapiens
gcacaggauguauuaagaa

SEQ ID NO: 962119 - RNA, 19 nt, Homo sapiens
aaacuggaccaacuaagua

SEQ ID NO: 962120 - RNA, 19 nt, Homo sapiens
aaacuaaaguguguugaug

SEQ ID NO: 962121 - RNA, 19 nt, Homo sapiens
uagauuauuucuccuguug

SEQ ID NO: 962122 - RNA, 19 nt, Homo sapiens
gacagaugccaacuuauaa

SEQ ID NO: 962123 - RNA, 19 nt, Homo sapiens
gugaacaaagugcuaaaua

SEQ ID NO: 962124 - RNA, 19 nt, Homo sapiens
uuucagagauuucaaguca

SEQ ID NO: 962125 - RNA, 19 nt, Homo sapiens
uaucaaugcuguagaugga

SEQ ID NO: 962126 - RNA, 19 nt, Homo sapiens
caaauggccuaccugauac

SEQ ID NO: 962127 - RNA, 19 nt, Homo sapiens
caaagcaguuggcuggaau

SEQ ID NO: 962128 - RNA, 19 nt, Homo sapiens
gagauuucaagucacauua

SEQ ID NO: 962129 - RNA, 19 nt, Homo sapiens
gacaaucugcuucaagaaa

SEQ ID NO: 962130 - RNA, 19 nt, Homo sapiens
cagacugagugaacuguaa

SEQ ID NO: 962131 - RNA, 19 nt, Homo sapiens
aaaugagacuuaacucuuc

SEQ ID NO: 962132 - RNA, 19 nt, Homo sapiens
gaagaaguacugguugcua

SEQ ID NO: 962133 - RNA, 19 nt, Homo sapiens
gauugcauaucucauuaga

SEQ ID NO: 962134 - RNA, 19 nt, Homo sapiens
ggacggagagcagcauaaa

SEQ ID NO: 962135 - RNA, 19 nt, Homo sapiens
uggcaaaccauacuucuuu

SEQ ID NO: 962136 - RNA, 19 nt, Homo sapiens
ucccagagccaccuucuua

SEQ ID NO: 962137 - RNA, 19 nt, Homo sapiens
ccagaucgcugccaucacu

SEQ ID NO: 962138 - RNA, 19 nt, Homo sapiens
cuagaaggccagaggauaa

SEQ ID NO: 962139 - RNA, 19 nt, Homo sapiens
cuccuaauauacccuaaua

SEQ ID NO: 962140 - RNA, 19 nt, Homo sapiens
caugaauucacuccuaaua

SEQ ID NO: 962141 - RNA, 19 nt, Homo sapiens
aguauucccucuugucaaa

SEQ ID NO: 962142 - RNA, 19 nt, Homo sapiens
aggauucgauuaaguauuc

SEQ ID NO: 962143 - RNA, 19 nt, Homo sapiens
ucagagauuucaagucaca

SEQ ID NO: 962144 - RNA, 19 nt, Homo sapiens
agaauuccaucucucuuau

SEQ ID NO: 962145 - RNA, 19 nt, Homo sapiens
cuaauaaagugguugaaac

SEQ ID NO: 962146 - RNA, 19 nt, Homo sapiens
gauaaacuaaaguguguug

SEQ ID NO: 962147 - RNA, 19 nt, Homo sapiens
ggaaaugcagaauaugaau

SEQ ID NO: 962148 - RNA, 19 nt, Homo sapiens
ggcuggaaaugcagaauau

SEQ ID NO: 962149 - RNA, 19 nt, Homo sapiens
acaguugcaucugaauaua

SEQ ID NO: 962150 - RNA, 19 nt, Homo sapiens
acaaucugcuucaagaaau

SEQ ID NO: 962151 - RNA, 19 nt, Homo sapiens
ugccuuguaugcacuauuu

SEQ ID NO: 962152 - RNA, 19 nt, Homo sapiens
ggaaaguuaguucaacaug

SEQ ID NO: 962153 - RNA, 19 nt, Homo sapiens
ggaggaaauuuaugauagc

SEQ ID NO: 962154 - RNA, 19 nt, Homo sapiens
gcaaagcugguaugagcaa

SEQ ID NO: 962155 - RNA, 19 nt, Homo sapiens
cuuuggagaugauugcaua

SEQ ID NO: 962156 - RNA, 19 nt, Homo sapiens
gccagaauguucagcuuca

SEQ ID NO: 962157 - RNA, 19 nt, Homo sapiens
uaugaagucagguuuguuu

SEQ ID NO: 962158 - RNA, 19 nt, Homo sapiens
aaccaaacauucaacacaa

SEQ ID NO: 962159 - RNA, 19 nt, Homo sapiens
ucaaagcaguuggcuggaa

SEQ ID NO: 962160 - RNA, 19 nt, Homo sapiens
agagccaccuucuuacuga

SEQ ID NO: 962161 - RNA, 19 nt, Homo sapiens
aagccaaguuccauauuau

SEQ ID NO: 962162 - RNA, 19 nt, Homo sapiens
guaccaaugcuucauauac

SEQ ID NO: 962163 - RNA, 19 nt, Homo sapiens
gaauacgguacauuucuau

SEQ ID NO: 962164 - RNA, 19 nt, Homo sapiens
caucuuggcuugugcuuua

SEQ ID NO: 962165 - RNA, 19 nt, Homo sapiens
gcuggaaacuccuuuauga

SEQ ID NO: 962166 - RNA, 19 nt, Homo sapiens
gaaacuggcucuggaaaga

SEQ ID NO: 962167 - RNA, 19 nt, Homo sapiens
ggaaacuccuuuaugauau

SEQ ID NO: 962168 - RNA, 19 nt, Homo sapiens
ggaugaagccgaccgaaua

SEQ ID NO: 962169 - RNA, 19 nt, Homo sapiens
ugacagauguguuguguga

SEQ ID NO: 962170 - RNA, 19 nt, Homo sapiens
caacagagaucaugagacu

SEQ ID NO: 962171 - RNA, 19 nt, Homo sapiens
gaaaggccguuaaucacuu

SEQ ID NO: 962172 - RNA, 19 nt, Homo sapiens
ggacaaaugagucagagua

SEQ ID NO: 962173 - RNA, 19 nt, Homo sapiens
gcagagugcugugauugua

SEQ ID NO: 962174 - RNA, 19 nt, Homo sapiens
gaagaauccugugaaaugu

SEQ ID NO: 962175 - RNA, 19 nt, Homo sapiens
gacaagauccucaaaguga

SEQ ID NO: 962176 - RNA, 19 nt, Homo sapiens
gcgcauagaacacuuaauu

SEQ ID NO: 962177 - RNA, 19 nt, Homo sapiens
agacagagguugacaagau

SEQ ID NO: 962178 - RNA, 19 nt, Homo sapiens
gauugaagcuauuccuuug

SEQ ID NO: 962179 - RNA, 19 nt, Homo sapiens
gagaacagcuuugcuacug

SEQ ID NO: 962180 - RNA, 19 nt, Homo sapiens
uaaaugaauuggcuggaaa

SEQ ID NO: 962181 - RNA, 19 nt, Homo sapiens
uaaagaagcuuggacaucu

SEQ ID NO: 962182 - RNA, 19 nt, Homo sapiens
gugcucagcuaauucagua

SEQ ID NO: 962183 - RNA, 19 nt, Homo sapiens
ggaggaaacuaaaacauuu

SEQ ID NO: 962184 - RNA, 19 nt, Homo sapiens
ugaagaauccugugaaaug

SEQ ID NO: 962185 - RNA, 19 nt, Homo sapiens
cccaugaccuguaauugua

SEQ ID NO: 962186 - RNA, 19 nt, Homo sapiens
ugcagcaccuguaauaaua

SEQ ID NO: 962187 - RNA, 19 nt, Homo sapiens
auaccuaccugguuuauau

SEQ ID NO: 962188 - RNA, 19 nt, Homo sapiens
cgccuaggaucccuuaaua

SEQ ID NO: 962189 - RNA, 19 nt, Homo sapiens
ggacaucugcaaaugauau

SEQ ID NO: 962190 - RNA, 19 nt, Homo sapiens
gaguucugcuguucuguaa

SEQ ID NO: 962191 - RNA, 19 nt, Homo sapiens
ucaaauacuuggucaugga

SEQ ID NO: 962192 - RNA, 19 nt, Homo sapiens
uggaaacuccuuuaugaua

SEQ ID NO: 962193 - RNA, 19 nt, Homo sapiens
gauuguagguggaauugau

SEQ ID NO: 962194 - RNA, 19 nt, Homo sapiens
gagcuggccuuucagaucu

SEQ ID NO: 962195 - RNA, 19 nt, Homo sapiens
ggaagaggaggaaacuaaa

SEQ ID NO: 962196 - RNA, 19 nt, Homo sapiens
gaccuguaauuguaaagaa

SEQ ID NO: 962197 - RNA, 19 nt, Homo sapiens
agaaugugcucagcuaauu

SEQ ID NO: 962198 - RNA, 19 nt, Homo sapiens
gcggaaaggccguuaauca

SEQ ID NO: 962199 - RNA, 19 nt, Homo sapiens
cagccgagguuuggacaua

SEQ ID NO: 962200 - RNA, 19 nt, Homo sapiens
aaggauaccuaccugguuu

SEQ ID NO: 962201 - RNA, 19 nt, Homo sapiens
ccggagaccucacacaaga

SEQ ID NO: 962202 - RNA, 19 nt, Homo sapiens
gcugaugucaagacuguua

SEQ ID NO: 962203 - RNA, 19 nt, Homo sapiens
ccagagaacagcuuugcua

SEQ ID NO: 962204 - RNA, 19 nt, Homo sapiens
cuaaauaccagacaguuga

SEQ ID NO: 962205 - RNA, 19 nt, Homo sapiens
acacagaccuuuugccuuu

SEQ ID NO: 962206 - RNA, 19 nt, Homo sapiens
agaauuguguccagaaugu

SEQ ID NO: 962207 - RNA, 19 nt, Homo sapiens
gagaggaugcuggagauaa

SEQ ID NO: 962208 - RNA, 19 nt, Homo sapiens
gggaagaaacuaccagguu

SEQ ID NO: 962209 - RNA, 19 nt, Homo sapiens
caagguggcuggaggaaaa

SEQ ID NO: 962210 - RNA, 19 nt, Homo sapiens
gagauaaugaugacacaga

SEQ ID NO: 962211 - RNA, 19 nt, Homo sapiens
gcauagaacacuuaauugg

SEQ ID NO: 962212 - RNA, 19 nt, Homo sapiens
ugucaagacuguuacuguu

SEQ ID NO: 962213 - RNA, 19 nt, Homo sapiens
gugcugaugucaagacugu

SEQ ID NO: 962214 - RNA, 19 nt, Homo sapiens
aaugaaaccugcuccaaca

SEQ ID NO: 962215 - RNA, 19 nt, Homo sapiens
gacaaaugagucagaguaa

SEQ ID NO: 962216 - RNA, 19 nt, Homo sapiens
gaauauggauuuugagaca

SEQ ID NO: 962217 - RNA, 19 nt, Homo sapiens
caaagugauuccucgagau

SEQ ID NO: 962218 - RNA, 19 nt, Homo sapiens
gaagccgaccgaauacuga

SEQ ID NO: 962219 - RNA, 19 nt, Homo sapiens
uuacagugcugaugucaag

SEQ ID NO: 962220 - RNA, 19 nt, Homo sapiens
acagagaucaugagacuga

SEQ ID NO: 962221 - RNA, 19 nt, Homo sapiens
uggaagaggaggaaacuaa

SEQ ID NO: 962222 - RNA, 19 nt, Homo sapiens
cuaccugguuuauauucua

SEQ ID NO: 962223 - RNA, 19 nt, Homo sapiens
ggacaaaacccaccaagau

SEQ ID NO: 962224 - RNA, 19 nt, Homo sapiens
ggcuugugcuuuauucaaa

SEQ ID NO: 962225 - RNA, 19 nt, Homo sapiens
gaucaugagacugaaauug

SEQ ID NO: 962226 - RNA, 19 nt, Homo sapiens
gcgagaggaugcuggagau

SEQ ID NO: 962227 - RNA, 19 nt, Homo sapiens
acacuuaauugggaagaaa

SEQ ID NO: 962228 - RNA, 19 nt, Homo sapiens
cuaaaugaauuggcuggaa

SEQ ID NO: 962229 - RNA, 19 nt, Homo sapiens
gacaggcgccuuugcuuug

SEQ ID NO: 962230 - RNA, 19 nt, Homo sapiens
gcucuucugucacuucaca

SEQ ID NO: 962231 - RNA, 19 nt, Homo sapiens
uaugaaggcucgaguucug

SEQ ID NO: 962232 - RNA, 19 nt, Homo sapiens
cagcuuugcuacugcgaaa

SEQ ID NO: 962233 - RNA, 19 nt, Homo sapiens
ggaaaggccguuaaucacu

SEQ ID NO: 962234 - RNA, 19 nt, Homo sapiens
ucugaagaauccugugaaa

SEQ ID NO: 962235 - RNA, 19 nt, Homo sapiens
gacagagguugacaagauc

SEQ ID NO: 962236 - RNA, 19 nt, Homo sapiens
acaaggucgugauaucauu

SEQ ID NO: 962237 - RNA, 19 nt, Homo sapiens
aaugugccguuuccucuaa

SEQ ID NO: 962238 - RNA, 19 nt, Homo sapiens
gaccgaauacugaauaugg

SEQ ID NO: 962239 - RNA, 19 nt, Homo sapiens
guaaagaagcuuggacauc

SEQ ID NO: 962240 - RNA, 19 nt, Homo sapiens
ggagaccucacacaagaug

SEQ ID NO: 962241 - RNA, 19 nt, Homo sapiens
agaggaugcuggagauaau

SEQ ID NO: 962242 - RNA, 19 nt, Homo sapiens
ggagcuggccuuucagauc

SEQ ID NO: 962243 - RNA, 19 nt, Homo sapiens
uaaaccaucuuggcuugug

SEQ ID NO: 962244 - RNA, 19 nt, Homo sapiens
guaauaauacccagagaac

SEQ ID NO: 962245 - RNA, 19 nt, Homo sapiens
gcccaugaccuguaauugu

SEQ ID NO: 962246 - RNA, 19 nt, Homo sapiens
ucagaauuguguccagaau

SEQ ID NO: 962247 - RNA, 19 nt, Homo sapiens
uuacauccaucgaguaggu

SEQ ID NO: 962248 - RNA, 19 nt, Homo sapiens
gcucagcuaauucaguauu

SEQ ID NO: 962249 - RNA, 19 nt, Homo sapiens
ugacacagagggugcuauu

SEQ ID NO: 962250 - RNA, 19 nt, Homo sapiens
caagauccucaaagugauu

SEQ ID NO: 962251 - RNA, 19 nt, Homo sapiens
uucaaugucucaaucuuug

SEQ ID NO: 962252 - RNA, 19 nt, Homo sapiens
gcuuggacaucugcaaaug

SEQ ID NO: 962253 - RNA, 19 nt, Homo sapiens
gaagcggaaaggccguuaa

SEQ ID NO: 962254 - RNA, 19 nt, Homo sapiens
gaaacgcucgcgagaggau

SEQ ID NO: 962255 - RNA, 19 nt, Homo sapiens
ucaagacuguuacuguucu

SEQ ID NO: 962256 - RNA, 19 nt, Homo sapiens
agacaggcgccuuugcuuu

SEQ ID NO: 962257 - RNA, 19 nt, Homo sapiens
acagauguguugugugaag

SEQ ID NO: 962258 - RNA, 19 nt, Homo sapiens
caaggauaccuaccugguu

SEQ ID NO: 962259 - RNA, 19 nt, Homo sapiens
caugaccuguaauuguaaa

SEQ ID NO: 962260 - RNA, 19 nt, Homo sapiens
ugaugcccaugaccuguaa

SEQ ID NO: 962261 - RNA, 19 nt, Homo sapiens
uccagaaugugcucagcua

SEQ ID NO: 962262 - RNA, 19 nt, Homo sapiens
gagaucaugagacugaaau

SEQ ID NO: 962263 - RNA, 19 nt, Homo sapiens
caaggcccguuccauucuu

SEQ ID NO: 962264 - RNA, 19 nt, Homo sapiens
uaacagagauucaaaggua

SEQ ID NO: 962265 - RNA, 19 nt, Homo sapiens
uaacagaacugcagucuuc

SEQ ID NO: 962266 - RNA, 19 nt, Homo sapiens
caacaugucaacagaauua

SEQ ID NO: 962267 - RNA, 19 nt, Homo sapiens
gaaaugagaaucaggauga

SEQ ID NO: 962268 - RNA, 19 nt, Homo sapiens
ggaaagaaaucucucuaca

SEQ ID NO: 962269 - RNA, 19 nt, Homo sapiens
guucaaauauccucaugua

SEQ ID NO: 962270 - RNA, 19 nt, Homo sapiens
gaaaggagaagaaagcaaa

SEQ ID NO: 962271 - RNA, 19 nt, Homo sapiens
caggagaauuugaacaaua

SEQ ID NO: 962272 - RNA, 19 nt, Homo sapiens
aaagaaaucucucuacaca

SEQ ID NO: 962273 - RNA, 19 nt, Homo sapiens
caguggagcuucugaguuu

SEQ ID NO: 962274 - RNA, 19 nt, Homo sapiens
gaauucugcugcuguuauu

SEQ ID NO: 962275 - RNA, 19 nt, Homo sapiens
agaaaucucucuacacaga

SEQ ID NO: 962276 - RNA, 19 nt, Homo sapiens
gagcauaagcguucacuga

SEQ ID NO: 962277 - RNA, 19 nt, Homo sapiens
gaaaagacguuaucaccuu

SEQ ID NO: 962278 - RNA, 19 nt, Homo sapiens
gaagaacacaauuccauga

SEQ ID NO: 962279 - RNA, 19 nt, Homo sapiens
uaaguaaucccacugaauu

SEQ ID NO: 962280 - RNA, 19 nt, Homo sapiens
gugaaauuguuuaggcuua

SEQ ID NO: 962281 - RNA, 19 nt, Homo sapiens
gagaagaaagcaaagguuu

SEQ ID NO: 962282 - RNA, 19 nt, Homo sapiens
gaagaaacgcgagcaagaa

SEQ ID NO: 962283 - RNA, 19 nt, Homo sapiens
ggaagaaacgcgagcaaga

SEQ ID NO: 962284 - RNA, 19 nt, Homo sapiens
ccaaauguacuucuuauuc

SEQ ID NO: 962285 - RNA, 19 nt, Homo sapiens
ccuuaaagcucaaauucuu

SEQ ID NO: 962286 - RNA, 19 nt, Homo sapiens
gaaguuuggugauccaucu

SEQ ID NO: 962287 - RNA, 19 nt, Homo sapiens
gagcuggacucccucaagu

SEQ ID NO: 962288 - RNA, 19 nt, Homo sapiens
ccugcugguucuaauauua

SEQ ID NO: 962289 - RNA, 19 nt, Homo sapiens
uuaccuaggugaaauuguu

SEQ ID NO: 962290 - RNA, 19 nt, Homo sapiens
uaugcaagcuucaggagaa

SEQ ID NO: 962291 - RNA, 19 nt, Homo sapiens
acagugaccugcagaacuu

SEQ ID NO: 962292 - RNA, 19 nt, Homo sapiens
caauucagguuucuaacga

SEQ ID NO: 962293 - RNA, 19 nt, Homo sapiens
gaaaugcgaggauuaaugc

SEQ ID NO: 962294 - RNA, 19 nt, Homo sapiens
gaaauuguuuaggcuuaug

SEQ ID NO: 962295 - RNA, 19 nt, Homo sapiens
gcaagcuucaggagaauuu

SEQ ID NO: 962296 - RNA, 19 nt, Homo sapiens
ucacuacuccaaacuuuaa

SEQ ID NO: 962297 - RNA, 19 nt, Homo sapiens
gaaucaggaugaaagucaa

SEQ ID NO: 962298 - RNA, 19 nt, Homo sapiens
ccucuucacucucuauaga

SEQ ID NO: 962299 - RNA, 19 nt, Homo sapiens
uaacgagacccauccuaaa

SEQ ID NO: 962300 - RNA, 19 nt, Homo sapiens
aaucacuacuccaaacuuu

SEQ ID NO: 962301 - RNA, 19 nt, Homo sapiens
cucaagaucgucauaaaua

SEQ ID NO: 962302 - RNA, 19 nt, Homo sapiens
caauagcauuuaccugaug

SEQ ID NO: 962303 - RNA, 19 nt, Homo sapiens
ggaauucugcugcuguuau

SEQ ID NO: 962304 - RNA, 19 nt, Homo sapiens
gcuugggacacacaaauua

SEQ ID NO: 962305 - RNA, 19 nt, Homo sapiens
ccaccaaauguacuucuua

SEQ ID NO: 962306 - RNA, 19 nt, Homo sapiens
ggaaagccaggaucucaga

SEQ ID NO: 962307 - RNA, 19 nt, Homo sapiens
caccaaauguacuucuuau

SEQ ID NO: 962308 - RNA, 19 nt, Homo sapiens
caugugcuaugaucucuga

SEQ ID NO: 962309 - RNA, 19 nt, Homo sapiens
gaucuuaaagcaaguuugu

SEQ ID NO: 962310 - RNA, 19 nt, Homo sapiens
gauggcagcuaguuaugca

SEQ ID NO: 962311 - RNA, 19 nt, Homo sapiens
ccacacaaaggaaagcuaa

SEQ ID NO: 962312 - RNA, 19 nt, Homo sapiens
gaaaggcuacauuaaacau

SEQ ID NO: 962313 - RNA, 19 nt, Homo sapiens
gcaccaagaagcugagaau

SEQ ID NO: 962314 - RNA, 19 nt, Homo sapiens
cagcugcuacuaaagauaa

SEQ ID NO: 962315 - RNA, 19 nt, Homo sapiens
ggagaagaaagcaaagguu

SEQ ID NO: 962316 - RNA, 19 nt, Homo sapiens
caacuaugaaccacacaaa

SEQ ID NO: 962317 - RNA, 19 nt, Homo sapiens
uaaaagaacugcaaucacu

SEQ ID NO: 962318 - RNA, 19 nt, Homo sapiens
ccaagaagcugagaaugcu

SEQ ID NO: 962319 - RNA, 19 nt, Homo sapiens
cgaaaugcgaggauuaaug

SEQ ID NO: 962320 - RNA, 19 nt, Homo sapiens
ccaauagcauuuaccugau

SEQ ID NO: 962321 - RNA, 19 nt, Homo sapiens
gaacgaaaggagaagaaag

SEQ ID NO: 962322 - RNA, 19 nt, Homo sapiens
guucauagucuguguagug

SEQ ID NO: 962323 - RNA, 19 nt, Homo sapiens
uaucgaaaugcgaggauua

SEQ ID NO: 962324 - RNA, 19 nt, Homo sapiens
uuauguaccuucguucaaa

SEQ ID NO: 962325 - RNA, 19 nt, Homo sapiens
cugcagaacuuagccaaga

SEQ ID NO: 962326 - RNA, 19 nt, Homo sapiens
cuaacgagacccauccuaa

SEQ ID NO: 962327 - RNA, 19 nt, Homo sapiens
gcuaugaucucugaaaaga

SEQ ID NO: 962328 - RNA, 19 nt, Homo sapiens
gaagagcaacggaagaaac

SEQ ID NO: 962329 - RNA, 19 nt, Homo sapiens
aaaucaacaugucaacaga

SEQ ID NO: 962330 - RNA, 19 nt, Homo sapiens
gaaaaggaaaugagaauca

SEQ ID NO: 962331 - RNA, 19 nt, Homo sapiens
gaaagaaaucucucuacac

SEQ ID NO: 962332 - RNA, 19 nt, Homo sapiens
gaucagcaaccaggaagaa

SEQ ID NO: 962333 - RNA, 19 nt, Homo sapiens
gaaacgcgagcaagaacga

SEQ ID NO: 962334 - RNA, 19 nt, Homo sapiens
aaggcuacauuaaacauga

SEQ ID NO: 962335 - RNA, 19 nt, Homo sapiens
ccaagacuccagccagaaa

SEQ ID NO: 962336 - RNA, 19 nt, Homo sapiens
caagcgcucugcuaucucu

SEQ ID NO: 962337 - RNA, 19 nt, Homo sapiens
cuugaaaggcuacauuaaa

SEQ ID NO: 962338 - RNA, 19 nt, Homo sapiens
gcucaagaucgucauaaau

SEQ ID NO: 962339 - RNA, 19 nt, Homo sapiens
acaacucauucuaacauug

SEQ ID NO: 962340 - RNA, 19 nt, Homo sapiens
aggguaagcugggauagaa

SEQ ID NO: 962341 - RNA, 19 nt, Homo sapiens
cauuuuggcugaagauuaa

SEQ ID NO: 962342 - RNA, 19 nt, Homo sapiens
ggucaggacuccaguaccu

SEQ ID NO: 962343 - RNA, 19 nt, Homo sapiens
aagcagcagcccaucaaua

SEQ ID NO: 962344 - RNA, 19 nt, Homo sapiens
cauuaaacaugaggcaaga

SEQ ID NO: 962345 - RNA, 19 nt, Homo sapiens
ucucagagcuacugcaaaa

SEQ ID NO: 962346 - RNA, 19 nt, Homo sapiens
gaaaggccaccucuucacu

SEQ ID NO: 962347 - RNA, 19 nt, Homo sapiens
cauuaacaauucagguuuc

SEQ ID NO: 962348 - RNA, 19 nt, Homo sapiens
aaaagacguuaucaccuua

SEQ ID NO: 962349 - RNA, 19 nt, Homo sapiens
ugauccaucuuccgaguau

SEQ ID NO: 962350 - RNA, 19 nt, Homo sapiens
ggagaaggugcaagacugu

SEQ ID NO: 962351 - RNA, 19 nt, Homo sapiens
aaugucaaguucccaaguu

SEQ ID NO: 962352 - RNA, 19 nt, Homo sapiens
ccacuuuagucacgagauc

SEQ ID NO: 962353 - RNA, 19 nt, Homo sapiens
gaaggaaagaaaucucucu

SEQ ID NO: 962354 - RNA, 19 nt, Homo sapiens
gaucucagagcuacugcaa

SEQ ID NO: 962355 - RNA, 19 nt, Homo sapiens
ccaggaagaagcugagaga

SEQ ID NO: 962356 - RNA, 19 nt, Homo sapiens
uugaaaggcuacauuaaac

SEQ ID NO: 962357 - RNA, 19 nt, Homo sapiens
gugaugagacugagauaca

SEQ ID NO: 962358 - RNA, 19 nt, Homo sapiens
augcgaggauuaaugcuuu

SEQ ID NO: 962359 - RNA, 19 nt, Homo sapiens
guaccuucguucaaauauc

SEQ ID NO: 962360 - RNA, 19 nt, Homo sapiens
ggccauauaguuugguuau

SEQ ID NO: 962361 - RNA, 19 nt, Homo sapiens
ccauuaacaauucagguuu

SEQ ID NO: 962362 - RNA, 19 nt, Homo sapiens
ggaagagcaacggaagaaa

SEQ ID NO: 962363 - RNA, 19 nt, Homo sapiens
ccaauaagaaaccaguguu

SEQ ID NO: 962364 - RNA, 19 nt, Homo sapiens
uaacagagauucaaaggua

SEQ ID NO: 962365 - RNA, 19 nt, Homo sapiens
caacaugucaacagaauua

SEQ ID NO: 962366 - RNA, 19 nt, Homo sapiens
gaaaugagaaucaggauga

SEQ ID NO: 962367 - RNA, 19 nt, Homo sapiens
ggaaagaaaucucucuaca

SEQ ID NO: 962368 - RNA, 19 nt, Homo sapiens
gaaaggagaagaaagcaaa

SEQ ID NO: 962369 - RNA, 19 nt, Homo sapiens
ugaagcagcccaucaauaa

SEQ ID NO: 962370 - RNA, 19 nt, Homo sapiens
aaagaaaucucucuacaca

SEQ ID NO: 962371 - RNA, 19 nt, Homo sapiens
gaauucugcugcuguuauu

SEQ ID NO: 962372 - RNA, 19 nt, Homo sapiens
agaaaucucucuacacaga

SEQ ID NO: 962373 - RNA, 19 nt, Homo sapiens
gagcauaagcguucacuga

SEQ ID NO: 962374 - RNA, 19 nt, Homo sapiens
gaagaacacaauuccauga

SEQ ID NO: 962375 - RNA, 19 nt, Homo sapiens
uaaguaaucccacugaauu

SEQ ID NO: 962376 - RNA, 19 nt, Homo sapiens
gagaagaaagcaaagguuu

SEQ ID NO: 962377 - RNA, 19 nt, Homo sapiens
gaagaaacgcgagcaagaa

SEQ ID NO: 962378 - RNA, 19 nt, Homo sapiens
ggaagaaacgcgagcaaga

SEQ ID NO: 962379 - RNA, 19 nt, Homo sapiens
gaacugaagcagcccauca

SEQ ID NO: 962380 - RNA, 19 nt, Homo sapiens
gagcuggacucccucaagu

SEQ ID NO: 962381 - RNA, 19 nt, Homo sapiens
acagugaccugcagaacuu

SEQ ID NO: 962382 - RNA, 19 nt, Homo sapiens
ucacuacuccaaacuuuaa

SEQ ID NO: 962383 - RNA, 19 nt, Homo sapiens
gaaucaggaugaaagucaa

SEQ ID NO: 962384 - RNA, 19 nt, Homo sapiens
aaucacuacuccaaacuuu

SEQ ID NO: 962385 - RNA, 19 nt, Homo sapiens
ggaauucugcugcuguuau

SEQ ID NO: 962386 - RNA, 19 nt, Homo sapiens
gcuugggacacacaaauua

SEQ ID NO: 962387 - RNA, 19 nt, Homo sapiens
ggaaagccaggaucucaga

SEQ ID NO: 962388 - RNA, 19 nt, Homo sapiens
gaucuuaaagcaaguuugu

SEQ ID NO: 962389 - RNA, 19 nt, Homo sapiens
ccacacaaaggaaagcuaa

SEQ ID NO: 962390 - RNA, 19 nt, Homo sapiens
gcaccaagaagcugagaau

SEQ ID NO: 962391 - RNA, 19 nt, Homo sapiens
gaaaggcuacauuaaacau

SEQ ID NO: 962392 - RNA, 19 nt, Homo sapiens
cagcugcuacuaaagauaa

SEQ ID NO: 962393 - RNA, 19 nt, Homo sapiens
ggagaagaaagcaaagguu

SEQ ID NO: 962394 - RNA, 19 nt, Homo sapiens
caacuaugaaccacacaaa

SEQ ID NO: 962395 - RNA, 19 nt, Homo sapiens
uaaaagaacugcaaucacu

SEQ ID NO: 962396 - RNA, 19 nt, Homo sapiens
ccaagaagcugagaaugcu

SEQ ID NO: 962397 - RNA, 19 nt, Homo sapiens
gaacgaaaggagaagaaag

SEQ ID NO: 962398 - RNA, 19 nt, Homo sapiens
cugcagaacuuagccaaga

SEQ ID NO: 962399 - RNA, 19 nt, Homo sapiens
gaagagcaacggaagaaac

SEQ ID NO: 962400 - RNA, 19 nt, Homo sapiens
aaaucaacaugucaacaga

SEQ ID NO: 962401 - RNA, 19 nt, Homo sapiens
gaaagaaaucucucuacac

SEQ ID NO: 962402 - RNA, 19 nt, Homo sapiens
gaucagcaaccaggaagaa

SEQ ID NO: 962403 - RNA, 19 nt, Homo sapiens
gaaaaggaaaugagaauca

SEQ ID NO: 962404 - RNA, 19 nt, Homo sapiens
gaaacgcgagcaagaacga

SEQ ID NO: 962405 - RNA, 19 nt, Homo sapiens
ccaagacuccagccagaaa

SEQ ID NO: 962406 - RNA, 19 nt, Homo sapiens
caagcgcucugcuaucucu

SEQ ID NO: 962407 - RNA, 19 nt, Homo sapiens
aaggcuacauuaaacauga

SEQ ID NO: 962408 - RNA, 19 nt, Homo sapiens
cuugaaaggcuacauuaaa

SEQ ID NO: 962409 - RNA, 19 nt, Homo sapiens
cauuuuggcugaagauuaa

SEQ ID NO: 962410 - RNA, 19 nt, Homo sapiens
ggucaggacuccaguaccu

SEQ ID NO: 962411 - RNA, 19 nt, Homo sapiens
cauuaaacaugaggcaaga

SEQ ID NO: 962412 - RNA, 19 nt, Homo sapiens
ucucagagcuacugcaaaa

SEQ ID NO: 962413 - RNA, 19 nt, Homo sapiens
ggagaaggugcaagacugu

SEQ ID NO: 962414 - RNA, 19 nt, Homo sapiens
gaaggaaagaaaucucucu

SEQ ID NO: 962415 - RNA, 19 nt, Homo sapiens
gaucucagagcuacugcaa

SEQ ID NO: 962416 - RNA, 19 nt, Homo sapiens
ccaggaagaagcugagaga

SEQ ID NO: 962417 - RNA, 19 nt, Homo sapiens
uugaaaggcuacauuaaac

SEQ ID NO: 962418 - RNA, 19 nt, Homo sapiens
ggaagagcaacggaagaaa

SEQ ID NO: 962419 - RNA, 19 nt, Homo sapiens
ccaauaagaaaccaguguu

SEQ ID NO: 962420 - RNA, 19 nt, Homo sapiens
acuccagucuccaauaaga

SEQ ID NO: 962421 - RNA, 19 nt, Homo sapiens
gugaugagacugagauaca

SEQ ID NO: 962422 - RNA, 19 nt, Homo sapiens
aaccaguguuugaucuuaa

SEQ ID NO: 962423 - RNA, 19 nt, Homo sapiens
acaaggagaaggugcaaga

SEQ ID NO: 962424 - RNA, 19 nt, Homo sapiens
uuaaacaugaggcaagaaa

SEQ ID NO: 962425 - RNA, 19 nt, Homo sapiens
cugaagcagcccaucaaua

SEQ ID NO: 962426 - RNA, 19 nt, Homo sapiens
uaaaucaacaugucaacag

SEQ ID NO: 962427 - RNA, 19 nt, Homo sapiens
gaagcagcccaucaauaag

SEQ ID NO: 962428 - RNA, 19 nt, Homo sapiens
gaagcucauuuuaaggaaa

SEQ ID NO: 962429 - RNA, 19 nt, Homo sapiens
aauaaguaaucccacugaa

SEQ ID NO: 962430 - RNA, 19 nt, Homo sapiens
aaacuucugcauccucuug

SEQ ID NO: 962431 - RNA, 19 nt, Homo sapiens
ucacucaagcgcucugcua

SEQ ID NO: 962432 - RNA, 19 nt, Homo sapiens
gcaagaaaaggaaaugaga

SEQ ID NO: 962433 - RNA, 19 nt, Homo sapiens
ggacacacaaauuaaagac

SEQ ID NO: 962434 - RNA, 19 nt, Homo sapiens
aaauaaguaaucccacuga

SEQ ID NO: 962435 - RNA, 19 nt, Homo sapiens
agaaucaggaugaaaguca

SEQ ID NO: 962436 - RNA, 19 nt, Homo sapiens
gggacacacaaauuaaaga

SEQ ID NO: 962437 - RNA, 19 nt, Homo sapiens
caggaaagccaggaucuca

SEQ ID NO: 962438 - RNA, 19 nt, Homo sapiens
gaugagacugagauacaga

SEQ ID NO: 962439 - RNA, 19 nt, Homo sapiens
aaaugagaaucaggaugaa

SEQ ID NO: 962440 - RNA, 19 nt, Homo sapiens
ugaaaggcuacauuaaaca

SEQ ID NO: 962441 - RNA, 19 nt, Homo sapiens
gguaacagagauucaaagg

SEQ ID NO: 962442 - RNA, 19 nt, Homo sapiens
caagaacgaaaggagaaga

SEQ ID NO: 962443 - RNA, 19 nt, Homo sapiens
ugcuaucucugcagcuaaa

SEQ ID NO: 962444 - RNA, 19 nt, Homo sapiens
gaagcugagaaugcuguuu

SEQ ID NO: 962445 - RNA, 19 nt, Homo sapiens
gagacugagauacagauca

SEQ ID NO: 962446 - RNA, 19 nt, Homo sapiens
ggggcaaucuaaagaaaau

SEQ ID NO: 962447 - RNA, 19 nt, Homo sapiens
cuaugaaccacacaaagga

SEQ ID NO: 962448 - RNA, 19 nt, Homo sapiens
gcaaucacuacuccaaacu

SEQ ID NO: 962449 - RNA, 19 nt, Homo sapiens
gcagaacuuagccaagagu

SEQ ID NO: 962450 - RNA, 19 nt, Homo sapiens
cagguaacagagauucaaa

SEQ ID NO: 962451 - RNA, 19 nt, Homo sapiens
cgaaaggagaagaaagcaa

SEQ ID NO: 962452 - RNA, 19 nt, Homo sapiens
ccagacaaaggaagagcaa

SEQ ID NO: 962453 - RNA, 19 nt, Homo sapiens
gggaauucugcugcuguua

SEQ ID NO: 962454 - RNA, 19 nt, Homo sapiens
cuacuccaaacuuuaagaa

SEQ ID NO: 962455 - RNA, 19 nt, Homo sapiens
uuucagcugcuacuaaaga

SEQ ID NO: 962456 - RNA, 19 nt, Homo sapiens
cucaagcgcucugcuaucu

SEQ ID NO: 962457 - RNA, 19 nt, Homo sapiens
aagaacacaauuccaugaa

SEQ ID NO: 962458 - RNA, 19 nt, Homo sapiens
caaucacuacuccaaacuu

SEQ ID NO: 962459 - RNA, 19 nt, Homo sapiens
gcgaaggggccucauuuug

SEQ ID NO: 962460 - RNA, 19 nt, Homo sapiens
accaguguuugaucuuaaa

SEQ ID NO: 962461 - RNA, 19 nt, Homo sapiens
gcuggacucccucaaguac

SEQ ID NO: 962462 - RNA, 19 nt, Homo sapiens
caccagacgagcaccaaga

SEQ ID NO: 962463 - RNA, 19 nt, Homo sapiens
guuuucagcugcuacuaaa

SEQ ID NO: 962464 - RNA, 19 nt, Homo sapiens
gaagaaggcugugaaccua

SEQ ID NO: 962465 - RNA, 19 nt, Homo sapiens
caaggaaacugaagaugaa

SEQ ID NO: 962466 - RNA, 19 nt, Homo sapiens
ggacaggacuugcgaccuu

SEQ ID NO: 962467 - RNA, 19 nt, Homo sapiens
gcaaacauaugcccaaguc

SEQ ID NO: 962468 - RNA, 19 nt, Homo sapiens
caaccuggccaauaucuua

SEQ ID NO: 962469 - RNA, 19 nt, Homo sapiens
agacauauccugaauaaga

SEQ ID NO: 962470 - RNA, 19 nt, Homo sapiens
acacuuauuugcuguauga

SEQ ID NO: 962471 - RNA, 19 nt, Homo sapiens
gacauauccugaauaagaa

SEQ ID NO: 962472 - RNA, 19 nt, Homo sapiens
ucacgucuaugauaacauu

SEQ ID NO: 962473 - RNA, 19 nt, Homo sapiens
gaacaggccgcacaucuca

SEQ ID NO: 962474 - RNA, 19 nt, Homo sapiens
gaagaagaaaggaacguuu

SEQ ID NO: 962475 - RNA, 19 nt, Homo sapiens
cgaaaggagucgcaucuuc

SEQ ID NO: 962476 - RNA, 19 nt, Homo sapiens
gaggcgcucuguacuagaa

SEQ ID NO: 962477 - RNA, 19 nt, Homo sapiens
ccaaaggaaucucacuugu

SEQ ID NO: 962478 - RNA, 19 nt, Homo sapiens
acagcaaccuggccaauau

SEQ ID NO: 962479 - RNA, 19 nt, Homo sapiens
ugauucacgucuaugauaa

SEQ ID NO: 962480 - RNA, 19 nt, Homo sapiens
ucaaggaaacugaagauga

SEQ ID NO: 962481 - RNA, 19 nt, Homo sapiens
agaaauccaaggacacuua

SEQ ID NO: 962482 - RNA, 19 nt, Homo sapiens
caagcagacauuagacaua

SEQ ID NO: 962483 - RNA, 19 nt, Homo sapiens
ggacacuuauuugcuguau

SEQ ID NO: 962484 - RNA, 19 nt, Homo sapiens
cuagaaacugcucuuaaua

SEQ ID NO: 962485 - RNA, 19 nt, Homo sapiens
ggaaacugaagaugaagaa

SEQ ID NO: 962486 - RNA, 19 nt, Homo sapiens
gaaaggagucgcaucuucu

SEQ ID NO: 962487 - RNA, 19 nt, Homo sapiens
acuagaaacugcucuuaau

SEQ ID NO: 962488 - RNA, 19 nt, Homo sapiens
gagcugaggaugucaagga

SEQ ID NO: 962489 - RNA, 19 nt, Homo sapiens
ggacaguguagggucauua

SEQ ID NO: 962490 - RNA, 19 nt, Homo sapiens
aagcagacauuagacauau

SEQ ID NO: 962491 - RNA, 19 nt, Homo sapiens
guacuagaaacugcucuua

SEQ ID NO: 962492 - RNA, 19 nt, Homo sapiens
gaggcauuaucuaacagua

SEQ ID NO: 962493 - RNA, 19 nt, Homo sapiens
gcucuucucugcucaucga

SEQ ID NO: 962494 - RNA, 19 nt, Homo sapiens
gagagaagaaggcugugaa

SEQ ID NO: 962495 - RNA, 19 nt, Homo sapiens
uguaggagcucgucacucu

SEQ ID NO: 962496 - RNA, 19 nt, Homo sapiens
ugaauaaccaggcuacaug

SEQ ID NO: 962497 - RNA, 19 nt, Homo sapiens
gaaauccaaggacacuuau

SEQ ID NO: 962498 - RNA, 19 nt, Homo sapiens
aaacugaagaugaagaaga

SEQ ID NO: 962499 - RNA, 19 nt, Homo sapiens
aaacauaugcccaagucaa

SEQ ID NO: 962500 - RNA, 19 nt, Homo sapiens
caaaggaaucucacuugug

SEQ ID NO: 962501 - RNA, 19 nt, Homo sapiens
gaauaaccaggcuacaugu

SEQ ID NO: 962502 - RNA, 19 nt, Homo sapiens
caaccacgaggaugugauu

SEQ ID NO: 962503 - RNA, 19 nt, Homo sapiens
ggagauggcaaucgaagca

SEQ ID NO: 962504 - RNA, 19 nt, Homo sapiens
aauccaaggacacuuauuu

SEQ ID NO: 962505 - RNA, 19 nt, Homo sapiens
cauuagacauauccugaau

SEQ ID NO: 962506 - RNA, 19 nt, Homo sapiens
aacugaagaugaagaagaa

SEQ ID NO: 962507 - RNA, 19 nt, Homo sapiens
gccaaaggaaucucacuug

SEQ ID NO: 962508 - RNA, 19 nt, Homo sapiens
gcacaacaagugguccaaa

SEQ ID NO: 962509 - RNA, 19 nt, Homo sapiens
ccacccagcuggucagacu

SEQ ID NO: 962510 - RNA, 19 nt, Homo sapiens
caacaagugguccaaaguc

SEQ ID NO: 962511 - RNA, 19 nt, Homo sapiens
agaaggcugugaaccuaga

SEQ ID NO: 962512 - RNA, 19 nt, Homo sapiens
gcucaucgaggcauuaucu

SEQ ID NO: 962513 - RNA, 19 nt, Homo sapiens
ccucuucacugcaccaagu

SEQ ID NO: 962514 - RNA, 19 nt, Homo sapiens
uaggagcucgucacucuuu

SEQ ID NO: 962515 - RNA, 19 nt, Homo sapiens
gauugagacagcacugaaa

SEQ ID NO: 962516 - RNA, 19 nt, Homo sapiens
gaagaugaagaagaaagga

SEQ ID NO: 962517 - RNA, 19 nt, Homo sapiens
cgucuaugauaacauugaa

SEQ ID NO: 962518 - RNA, 19 nt, Homo sapiens
cacaacaagugguccaaag

SEQ ID NO: 962519 - RNA, 19 nt, Homo sapiens
gugccaagcagacauuaga

SEQ ID NO: 962520 - RNA, 19 nt, Homo sapiens
caagugccaagcagacauu

SEQ ID NO: 962521 - RNA, 19 nt, Homo sapiens
uuggguagcuggccucugu

SEQ ID NO: 962522 - RNA, 19 nt, Homo sapiens
ccggguuccuuccuagaaa

SEQ ID NO: 962523 - RNA, 19 nt, Homo sapiens
guagggucauuagcuguug

SEQ ID NO: 962524 - RNA, 19 nt, Homo sapiens
gugugucgcagcaaacaua

SEQ ID NO: 962525 - RNA, 19 nt, Homo sapiens
agaggugugucgcagcaaa

SEQ ID NO: 962526 - RNA, 19 nt, Homo sapiens
ggaacaggccgcacaucuc

SEQ ID NO: 962527 - RNA, 19 nt, Homo sapiens
gaaguggaggacagagaga

SEQ ID NO: 962528 - RNA, 19 nt, Homo sapiens
ucaucgaggcauuaucuaa

SEQ ID NO: 962529 - RNA, 19 nt, Homo sapiens
aacaagugguccaaaguca

SEQ ID NO: 962530 - RNA, 19 nt, Homo sapiens
ggagaaauccaaggacacu

SEQ ID NO: 962531 - RNA, 19 nt, Homo sapiens
uaagaauggaggagugaug

SEQ ID NO: 962532 - RNA, 19 nt, Homo sapiens
agacagcacugaaaaugga

SEQ ID NO: 962533 - RNA, 19 nt, Homo sapiens
caucuucuccaaacucugu

SEQ ID NO: 962534 - RNA, 19 nt, Homo sapiens
caaagucaggcacaucaag

SEQ ID NO: 962535 - RNA, 19 nt, Homo sapiens
uacuagaaacugcucuuaa

SEQ ID NO: 962536 - RNA, 19 nt, Homo sapiens
caacagcaaccuggccaau

SEQ ID NO: 962537 - RNA, 19 nt, Homo sapiens
cugaggcgcucuguacuag

SEQ ID NO: 962538 - RNA, 19 nt, Homo sapiens
ccaaggacacuuauuugcu

SEQ ID NO: 962539 - RNA, 19 nt, Homo sapiens
ccugaggcgcucuguacua

SEQ ID NO: 962540 - RNA, 19 nt, Homo sapiens
agcaaucucugaggguaaa

SEQ ID NO: 962541 - RNA, 19 nt, Homo sapiens
ggaugucaaggaaacugaa

SEQ ID NO: 962542 - RNA, 19 nt, Homo sapiens
cagcaaucucugaggguaa

SEQ ID NO: 962543 - RNA, 19 nt, Homo sapiens
ugaagaagaaaggaacguu

SEQ ID NO: 962544 - RNA, 19 nt, Homo sapiens
gggacaguguagggucauu

SEQ ID NO: 962545 - RNA, 19 nt, Homo sapiens
ccaagcagacauuagacau

SEQ ID NO: 962546 - RNA, 19 nt, Homo sapiens
cgauugagacagcacugaa

SEQ ID NO: 962547 - RNA, 19 nt, Homo sapiens
gcaaccuggccaauaucuu

SEQ ID NO: 962548 - RNA, 19 nt, Homo sapiens
cgaagcaggagcugaggau

SEQ ID NO: 962549 - RNA, 19 nt, Homo sapiens
acaggccgcacaucucauu

SEQ ID NO: 962550 - RNA, 19 nt, Homo sapiens
cugaggaugucaaggaaac

SEQ ID NO: 962551 - RNA, 19 nt, Homo sapiens
gacaguguagggucauuag

SEQ ID NO: 962552 - RNA, 19 nt, Homo sapiens
gguaggagcuugcuuauag

SEQ ID NO: 962553 - RNA, 19 nt, Homo sapiens
ucagaaagcuguaucucua

SEQ ID NO: 962554 - RNA, 19 nt, Homo sapiens
ggacacauccuuguacaua

SEQ ID NO: 962555 - RNA, 19 nt, Homo sapiens
ugaaugccaugucaguuua

SEQ ID NO: 962556 - RNA, 19 nt, Homo sapiens
gauggaaguuggaaaugaa

SEQ ID NO: 962557 - RNA, 19 nt, Homo sapiens
ggagagagacugaggaaga

SEQ ID NO: 962558 - RNA, 19 nt, Homo sapiens
caugucaguuuauaccuua

SEQ ID NO: 962559 - RNA, 19 nt, Homo sapiens
gagagagacugaggaagaa

SEQ ID NO: 962560 - RNA, 19 nt, Homo sapiens
gcagaagacuuguguuugc

SEQ ID NO: 962561 - RNA, 19 nt, Homo sapiens
gaaagaaggacccaucauc

SEQ ID NO: 962562 - RNA, 19 nt, Homo sapiens
caggaggucuuuauucguu

SEQ ID NO: 962563 - RNA, 19 nt, Homo sapiens
gaaaccauauucuccuuac

SEQ ID NO: 962564 - RNA, 19 nt, Homo sapiens
ggccaaacuugaaauacaa

SEQ ID NO: 962565 - RNA, 19 nt, Homo sapiens
caugaucacugguguguuc

SEQ ID NO: 962566 - RNA, 19 nt, Homo sapiens
ggaaaugaagaguaacuga

SEQ ID NO: 962567 - RNA, 19 nt, Homo sapiens
gaaaugaagaguaacugau

SEQ ID NO: 962568 - RNA, 19 nt, Homo sapiens
aaacucaggugauggaagu

SEQ ID NO: 962569 - RNA, 19 nt, Homo sapiens
gcacucugcucucaaacuc

SEQ ID NO: 962570 - RNA, 19 nt, Homo sapiens
ccacaaauggccaccguuu

SEQ ID NO: 962571 - RNA, 19 nt, Homo sapiens
ugacaguagugauaaagug

SEQ ID NO: 962572 - RNA, 19 nt, Homo sapiens
gaagaacuauguggaagac

SEQ ID NO: 962573 - RNA, 19 nt, Homo sapiens
ggaggccaaacuugaaaua

SEQ ID NO: 962574 - RNA, 19 nt, Homo sapiens
gguuugugcagcucuauua

SEQ ID NO: 962575 - RNA, 19 nt, Homo sapiens
cagggaaagucuucagaug

SEQ ID NO: 962576 - RNA, 19 nt, Homo sapiens
ggaagaacuauguggaaga

SEQ ID NO: 962577 - RNA, 19 nt, Homo sapiens
ugauggaaguuggaaauga

SEQ ID NO: 962578 - RNA, 19 nt, Homo sapiens
ggaugggcauugacaguag

SEQ ID NO: 962579 - RNA, 19 nt, Homo sapiens
gggcaugcagcaaauguuu

SEQ ID NO: 962580 - RNA, 19 nt, Homo sapiens
caugcacucugcucucaaa

SEQ ID NO: 962581 - RNA, 19 nt, Homo sapiens
guaggagcuugcuuauaga

SEQ ID NO: 962582 - RNA, 19 nt, Homo sapiens
gcacacaaccucccaagcu

SEQ ID NO: 962583 - RNA, 19 nt, Homo sapiens
ggcauugacaguagugaua

SEQ ID NO: 962584 - RNA, 19 nt, Homo sapiens
gaggaagaacuauguggaa

SEQ ID NO: 962585 - RNA, 19 nt, Homo sapiens
guucuugaaugccauguca

SEQ ID NO: 962586 - RNA, 19 nt, Homo sapiens
ggagcuugcuuauagaaaa

SEQ ID NO: 962587 - RNA, 19 nt, Homo sapiens
gaccugaccauggaacuuu

SEQ ID NO: 962588 - RNA, 19 nt, Homo sapiens
guacauacugcccaaggaa

SEQ ID NO: 962589 - RNA, 19 nt, Homo sapiens
aaagaaggacccaucauca

SEQ ID NO: 962590 - RNA, 19 nt, Homo sapiens
ccacaggaggucuuuauuc

SEQ ID NO: 962591 - RNA, 19 nt, Homo sapiens
ugaccucgcuggcguacug

SEQ ID NO: 962592 - RNA, 19 nt, Homo sapiens
gcauugacaguagugauaa

SEQ ID NO: 962593 - RNA, 19 nt, Homo sapiens
gagcaggugccgagagguu

SEQ ID NO: 962594 - RNA, 19 nt, Homo sapiens
ccacacugaugaagcagau

SEQ ID NO: 962595 - RNA, 19 nt, Homo sapiens
cgaaaccauauucuccuua

SEQ ID NO: 962596 - RNA, 19 nt, Homo sapiens
ccgcagaagacuuguguuu

SEQ ID NO: 962597 - RNA, 19 nt, Homo sapiens
aaagcaggauguguugauu

SEQ ID NO: 962598 - RNA, 19 nt, Homo sapiens
aguuggaaaugaagaguaa

SEQ ID NO: 962599 - RNA, 19 nt, Homo sapiens
agaaagcuguaucucuaug

SEQ ID NO: 962600 - RNA, 19 nt, Homo sapiens
aaaguggaaucgaguaguc

SEQ ID NO: 962601 - RNA, 19 nt, Homo sapiens
ggaguccacccguuguuug

SEQ ID NO: 962602 - RNA, 19 nt, Homo sapiens
caggauguguugauuuuaa

SEQ ID NO: 962603 - RNA, 19 nt, Homo sapiens
cuucauaccgcucuuaaug

SEQ ID NO: 962604 - RNA, 19 nt, Homo sapiens
uuacgacucucaauaccau

SEQ ID NO: 962605 - RNA, 19 nt, Homo sapiens
ccaugucaguuuauaccuu

SEQ ID NO: 962606 - RNA, 19 nt, Homo sapiens
gcacggaugaucgaacaga

SEQ ID NO: 962607 - RNA, 19 nt, Homo sapiens
gccgagagguugcccugau

SEQ ID NO: 962608 - RNA, 19 nt, Homo sapiens
ggccaccguuugcuguuga

SEQ ID NO: 962609 - RNA, 19 nt, Homo sapiens
cacaggaggucuuuauucg

SEQ ID NO: 962610 - RNA, 19 nt, Homo sapiens
agacauucccuuucuuuca

SEQ ID NO: 962611 - RNA, 19 nt, Homo sapiens
gacauucccuuucuuucac

SEQ ID NO: 962612 - RNA, 19 nt, Homo sapiens
ggugauggaaguuggaaau

SEQ ID NO: 962613 - RNA, 19 nt, Homo sapiens
gacacauccuuguacauac

SEQ ID NO: 962614 - RNA, 19 nt, Homo sapiens
cauugacaguagugauaaa

SEQ ID NO: 962615 - RNA, 19 nt, Homo sapiens
aggccaaacuugaaauaca

SEQ ID NO: 962616 - RNA, 19 nt, Homo sapiens
gcuggaggccaaacuugaa

SEQ ID NO: 962617 - RNA, 19 nt, Homo sapiens
ccgaaaccauauucuccuu

SEQ ID NO: 962618 - RNA, 19 nt, Homo sapiens
ucacugguguguucagcau

SEQ ID NO: 962619 - RNA, 19 nt, Homo sapiens
uugaaugccaugucaguuu

SEQ ID NO: 962620 - RNA, 19 nt, Homo sapiens
cuggacauguucuugaaug

SEQ ID NO: 962621 - RNA, 19 nt, Homo sapiens
ccgagagguugcccugaug

SEQ ID NO: 962622 - RNA, 19 nt, Homo sapiens
gaagcagauucagaagucu

SEQ ID NO: 962623 - RNA, 19 nt, Homo sapiens
gggccuaccaccaugauca

SEQ ID NO: 962624 - RNA, 19 nt, Homo sapiens
caaggaagacagggaaagu

SEQ ID NO: 962625 - RNA, 19 nt, Homo sapiens
acacauccuuguacauacu

SEQ ID NO: 962626 - RNA, 19 nt, Homo sapiens
agaaggacccaucaucauc

SEQ ID NO: 962627 - RNA, 19 nt, Homo sapiens
gaaucuaaggagugguuug

SEQ ID NO: 962628 - RNA, 19 nt, Homo sapiens
cuaugcggcucaugaugug

SEQ ID NO: 962629 - RNA, 19 nt, Homo sapiens
cagaaagcuguaucucuau

SEQ ID NO: 962630 - RNA, 19 nt, Homo sapiens
guggacacauccuuguaca

SEQ ID NO: 962631 - RNA, 19 nt, Homo sapiens
gaugggcauugacaguagu

SEQ ID NO: 962632 - RNA, 19 nt, Homo sapiens
uuuauucguuccacuaaca

SEQ ID NO: 962633 - RNA, 19 nt, Homo sapiens
aaugccaugucaguuuaua

SEQ ID NO: 962634 - RNA, 19 nt, Homo sapiens
ggguaggagcuugcuuaua

SEQ ID NO: 962635 - RNA, 19 nt, Homo sapiens
cagaaagaaggacccauca

SEQ ID NO: 962636 - RNA, 19 nt, Homo sapiens
uuacacagucaccaaucua

SEQ ID NO: 962637 - RNA, 19 nt, Homo sapiens
gcugaaagccauggacucu

SEQ ID NO: 962638 - RNA, 19 nt, Homo sapiens
aagcaggauguguugauuu

SEQ ID NO: 962639 - RNA, 19 nt, Homo sapiens
gaaguuggaaaugaagagu

SEQ ID NO: 962640 - RNA, 19 nt, Homo sapiens
gaccuucauaccgcucuua

SEQ ID NO: 962641 - RNA, 19 nt, Homo sapiens
gacagggaaagucuucaga

SEQ ID NO: 962642 - RNA, 19 nt, Homo sapiens
cagauucagaagucuugua

SEQ ID NO: 962643 - RNA, 19 nt, Homo sapiens
ccaucaucauccacacuga

SEQ ID NO: 962644 - RNA, 19 nt, Homo sapiens
ggaaguuggaaaugaagag

SEQ ID NO: 962645 - RNA, 19 nt, Homo sapiens
gaaugccaugucaguuuau

SEQ ID NO: 962646 - RNA, 19 nt, Homo sapiens
gacaggaugggcauugaca

SEQ ID NO: 962647 - RNA, 19 nt, Homo sapiens
gaagucuuguaucccaacu

SEQ ID NO: 962648 - RNA, 19 nt, Homo sapiens
caacccacaggaggucuuu

SEQ ID NO: 962649 - RNA, 19 nt, Homo sapiens
ugaccaaggugggcaugca

SEQ ID NO: 962650 - RNA, 19 nt, Homo sapiens
gaaagcuguaucucuaugc

SEQ ID NO: 962651 - RNA, 19 nt, Homo sapiens
aggagcagguagaguggaa

SEQ ID NO: 962652 - RNA, 19 nt, Homo sapiens
gaucaugucuguaauccua

SEQ ID NO: 962653 - RNA, 19 nt, Homo sapiens
gaucauagcacguuguaua

SEQ ID NO: 962654 - RNA, 19 nt, Homo sapiens
gaacugaccgucucauuca

SEQ ID NO: 962655 - RNA, 19 nt, Homo sapiens
ggacguaacccuacagugu

SEQ ID NO: 962656 - RNA, 19 nt, Homo sapiens
guauacauguacugcaaua

SEQ ID NO: 962657 - RNA, 19 nt, Homo sapiens
gggaugaauaugucaauua

SEQ ID NO: 962658 - RNA, 19 nt, Homo sapiens
ggugaaaccucaucucuac

SEQ ID NO: 962659 - RNA, 19 nt, Homo sapiens
ggacagggcugaggaacca

SEQ ID NO: 962660 - RNA, 19 nt, Homo sapiens
ggaugaauaugucaauuac

SEQ ID NO: 962661 - RNA, 19 nt, Homo sapiens
ccacugcggucuaacaaau

SEQ ID NO: 962662 - RNA, 19 nt, Homo sapiens
guauggcuuugaccaauuu

SEQ ID NO: 962663 - RNA, 19 nt, Homo sapiens
ccucaucucuaccaacaaa

SEQ ID NO: 962664 - RNA, 19 nt, Homo sapiens
gaugguaccgggcuaguuu

SEQ ID NO: 962665 - RNA, 19 nt, Homo sapiens
caauuacccugauuugauc

SEQ ID NO: 962666 - RNA, 19 nt, Homo sapiens
cuacaagaaucccgagaga

SEQ ID NO: 962667 - RNA, 19 nt, Homo sapiens
caagugcaguggaucaugu

SEQ ID NO: 962668 - RNA, 19 nt, Homo sapiens
caaacaaagucuucacaac

SEQ ID NO: 962669 - RNA, 19 nt, Homo sapiens
gguauggcuuugaccaauu

SEQ ID NO: 962670 - RNA, 19 nt, Homo sapiens
ucacaccacugcacucuag

SEQ ID NO: 962671 - RNA, 19 nt, Homo sapiens
gaccaucuaaugaguguaa

SEQ ID NO: 962672 - RNA, 19 nt, Homo sapiens
uacauguacugcaauauug

SEQ ID NO: 962673 - RNA, 19 nt, Homo sapiens
gggcugaggugggagaaug

SEQ ID NO: 962674 - RNA, 19 nt, Homo sapiens
gcaggcaguuuggguaugu

SEQ ID NO: 962675 - RNA, 19 nt, Homo sapiens
gggcugugauccuaauaau

SEQ ID NO: 962676 - RNA, 19 nt, Homo sapiens
gaaauguuaggucuucuca

SEQ ID NO: 962677 - RNA, 19 nt, Homo sapiens
acaagaaucccgagagaug

SEQ ID NO: 962678 - RNA, 19 nt, Homo sapiens
gaaaccucaucucuaccaa

SEQ ID NO: 962679 - RNA, 19 nt, Homo sapiens
uuggguaugucauucauuu

SEQ ID NO: 962680 - RNA, 19 nt, Homo sapiens
caaaucuccuuucgucucu

SEQ ID NO: 962681 - RNA, 19 nt, Homo sapiens
acaaagucuucacaacuga

SEQ ID NO: 962682 - RNA, 19 nt, Homo sapiens
agccugaccuugucucaaa

SEQ ID NO: 962683 - RNA, 19 nt, Homo sapiens
ccaauuugcucuguacaag

SEQ ID NO: 962684 - RNA, 19 nt, Homo sapiens
ccgcuucccuucacauuag

SEQ ID NO: 962685 - RNA, 19 nt, Homo sapiens
gcaguuuggguaugucauu

SEQ ID NO: 962686 - RNA, 19 nt, Homo sapiens
ccagacggaucucuaaggu

SEQ ID NO: 962687 - RNA, 19 nt, Homo sapiens
ucuucaaccucucuaauau

SEQ ID NO: 962688 - RNA, 19 nt, Homo sapiens
cauagcacguuguauacau

SEQ ID NO: 962689 - RNA, 19 nt, Homo sapiens
auacagggaugaauauguc

SEQ ID NO: 962690 - RNA, 19 nt, Homo sapiens
gcaaaauccuccugugcuu

SEQ ID NO: 962691 - RNA, 19 nt, Homo sapiens
aacaaagucuucacaacug

SEQ ID NO: 962692 - RNA, 19 nt, Homo sapiens
aauguuaggucuucucaag

SEQ ID NO: 962693 - RNA, 19 nt, Homo sapiens
acugagacuucuaggagua

SEQ ID NO: 962694 - RNA, 19 nt, Homo sapiens
aaacaaagucuucacaacu

SEQ ID NO: 962695 - RNA, 19 nt, Homo sapiens
caguggaucaugucuguaa

SEQ ID NO: 962696 - RNA, 19 nt, Homo sapiens
ggucuaacaaaucuccuuu

SEQ ID NO: 962697 - RNA, 19 nt, Homo sapiens
gcuccagacggaucucuaa

SEQ ID NO: 962698 - RNA, 19 nt, Homo sapiens
auacuggccucuuucuuca

SEQ ID NO: 962699 - RNA, 19 nt, Homo sapiens
cacuguggaugacauggua

SEQ ID NO: 962700 - RNA, 19 nt, Homo sapiens
gaaggaaauguuaggucuu

SEQ ID NO: 962701 - RNA, 19 nt, Homo sapiens
cauacuggccucuuucuuc

SEQ ID NO: 962702 - RNA, 19 nt, Homo sapiens
uuauagcguuuaggcauuu

SEQ ID NO: 962703 - RNA, 19 nt, Homo sapiens
cgaccgcccucuucugucu

SEQ ID NO: 962704 - RNA, 19 nt, Homo sapiens
guuaggucuucucaaggua

SEQ ID NO: 962705 - RNA, 19 nt, Homo sapiens
aaggaaauguuaggucuuc

SEQ ID NO: 962706 - RNA, 19 nt, Homo sapiens
ccucucauauuuacuuucu

SEQ ID NO: 962707 - RNA, 19 nt, Homo sapiens
ucugugcucuugucugguu

SEQ ID NO: 962708 - RNA, 19 nt, Homo sapiens
ggauggaggccgacaggau

SEQ ID NO: 962709 - RNA, 19 nt, Homo sapiens
gaagccaccgcugaacuga

SEQ ID NO: 962710 - RNA, 19 nt, Homo sapiens
ugaccaauuugcucuguac

SEQ ID NO: 962711 - RNA, 19 nt, Homo sapiens
aauuugcucuguacaagga

SEQ ID NO: 962712 - RNA, 19 nt, Homo sapiens
ucucaggguugacucuguu

SEQ ID NO: 962713 - RNA, 19 nt, Homo sapiens
gaccccaucucuacuuaaa

SEQ ID NO: 962714 - RNA, 19 nt, Homo sapiens
gaucaggcaguccucuuca

SEQ ID NO: 962715 - RNA, 19 nt, Homo sapiens
gcugugauccuaauaaucc

SEQ ID NO: 962716 - RNA, 19 nt, Homo sapiens
ugaacugaccgucucauuc

SEQ ID NO: 962717 - RNA, 19 nt, Homo sapiens
gaucagccugugcaacaug

SEQ ID NO: 962718 - RNA, 19 nt, Homo sapiens
cauuugggauggaaggaau

SEQ ID NO: 962719 - RNA, 19 nt, Homo sapiens
cucaaagacuggcgugugu

SEQ ID NO: 962720 - RNA, 19 nt, Homo sapiens
gcguuuaggcauuucuuga

SEQ ID NO: 962721 - RNA, 19 nt, Homo sapiens
ggaucaggcaguccucuuc

SEQ ID NO: 962722 - RNA, 19 nt, Homo sapiens
aaccucaucucuaccaaca

SEQ ID NO: 962723 - RNA, 19 nt, Homo sapiens
ucacaacugagacuucuag

SEQ ID NO: 962724 - RNA, 19 nt, Homo sapiens
ggcauuucuugaccaucua

SEQ ID NO: 962725 - RNA, 19 nt, Homo sapiens
gauuugaucauagcacguu

SEQ ID NO: 962726 - RNA, 19 nt, Homo sapiens
ccacauacuggccucuuuc

SEQ ID NO: 962727 - RNA, 19 nt, Homo sapiens
ugcaguggaucaugucugu

SEQ ID NO: 962728 - RNA, 19 nt, Homo sapiens
gcauuucuugaccaucuaa

SEQ ID NO: 962729 - RNA, 19 nt, Homo sapiens
uaugucaauuacccugauu

SEQ ID NO: 962730 - RNA, 19 nt, Homo sapiens
ccuccucccugcacacugu

SEQ ID NO: 962731 - RNA, 19 nt, Homo sapiens
gcaugggaggcgacucaaa

SEQ ID NO: 962732 - RNA, 19 nt, Homo sapiens
gcaaccugguccggauaug

SEQ ID NO: 962733 - RNA, 19 nt, Homo sapiens
gggcaaccugguccggaua

SEQ ID NO: 962734 - RNA, 19 nt, Homo sapiens
acaaacaaagucuucacaa

SEQ ID NO: 962735 - RNA, 19 nt, Homo sapiens
uaggucuucucaagguaaa

SEQ ID NO: 962736 - RNA, 19 nt, Homo sapiens
aagaucagccugugcaaca

SEQ ID NO: 962737 - RNA, 19 nt, Homo sapiens
ucuaacaaaucuccuuucg

SEQ ID NO: 962738 - RNA, 19 nt, Homo sapiens
uuucuugaccaucuaauga

SEQ ID NO: 962739 - RNA, 19 nt, Homo sapiens
uguuaggucuucucaaggu

SEQ ID NO: 962740 - RNA, 19 nt, Homo sapiens
gaagccugaccuugucuca

SEQ ID NO: 962741 - RNA, 19 nt, Homo sapiens
caggcacggucguauccaa

SEQ ID NO: 962742 - RNA, 19 nt, Homo sapiens
ggaaauguuaggucuucuc

SEQ ID NO: 962743 - RNA, 19 nt, Homo sapiens
gcacguuguauacauguac

SEQ ID NO: 962744 - RNA, 19 nt, Homo sapiens
cgguauggcuuugaccaau

SEQ ID NO: 962745 - RNA, 19 nt, Homo sapiens
aggcauuucuugaccaucu

SEQ ID NO: 962746 - RNA, 19 nt, Homo sapiens
auuauagcguuuaggcauu

SEQ ID NO: 962747 - RNA, 19 nt, Homo sapiens
uuguauacauguacugcaa

SEQ ID NO: 962748 - RNA, 19 nt, Homo sapiens
gaucacaccacugcacucu

SEQ ID NO: 962749 - RNA, 19 nt, Homo sapiens
gguggugcaucccuauacu

SEQ ID NO: 962750 - RNA, 19 nt, Homo sapiens
uucaaccucucuaauaugg

SEQ ID NO: 962751 - RNA, 19 nt, Homo sapiens
caugggaggcgacucaaag

SEQ ID NO: 962752 - RNA, 19 nt, Homo sapiens
ggacacaggugccaaauuc

SEQ ID NO: 962753 - RNA, 19 nt, Homo sapiens
gaaugucccuggaguacua

SEQ ID NO: 962754 - RNA, 19 nt, Homo sapiens
ggauuucccugacccaauu

SEQ ID NO: 962755 - RNA, 19 nt, Homo sapiens
gcucugcuguuucuaguga

SEQ ID NO: 962756 - RNA, 19 nt, Homo sapiens
gcuggguggugaccucuua

SEQ ID NO: 962757 - RNA, 19 nt, Homo sapiens
cgaccucagugucuacuuu

SEQ ID NO: 962758 - RNA, 19 nt, Homo sapiens
caguccaucucuauaauaa

SEQ ID NO: 962759 - RNA, 19 nt, Homo sapiens
cagagauucuuuaugcaaa

SEQ ID NO: 962760 - RNA, 19 nt, Homo sapiens
ccaauucagagauucuuua

SEQ ID NO: 962761 - RNA, 19 nt, Homo sapiens
ccucuuagcggguggauuu

SEQ ID NO: 962762 - RNA, 19 nt, Homo sapiens
cuagugacccugagaugua

SEQ ID NO: 962763 - RNA, 19 nt, Homo sapiens
guucaguccaucucuauaa

SEQ ID NO: 962764 - RNA, 19 nt, Homo sapiens
cauccgagcugcccucagu

SEQ ID NO: 962765 - RNA, 19 nt, Homo sapiens
gaacugcccgucagagaag

SEQ ID NO: 962766 - RNA, 19 nt, Homo sapiens
guccuggccuuccucauga

SEQ ID NO: 962767 - RNA, 19 nt, Homo sapiens
cgcaauaucugcccuaacu

SEQ ID NO: 962768 - RNA, 19 nt, Homo sapiens
gaacaugacgcugguagag

SEQ ID NO: 962769 - RNA, 19 nt, Homo sapiens
ggagacaggcggcugaaag

SEQ ID NO: 962770 - RNA, 19 nt, Homo sapiens
ugaguucaguccaucucua

SEQ ID NO: 962771 - RNA, 19 nt, Homo sapiens
gccaaauucuaccguggaa

SEQ ID NO: 962772 - RNA, 19 nt, Homo sapiens
auucagagauucuuuaugc

SEQ ID NO: 962773 - RNA, 19 nt, Homo sapiens
gugcaggcccaccgcaaua

SEQ ID NO: 962774 - RNA, 19 nt, Homo sapiens
gggaaucacccacguugug

SEQ ID NO: 962775 - RNA, 19 nt, Homo sapiens
aaauauucaucgucgcaaa

SEQ ID NO: 962776 - RNA, 19 nt, Homo sapiens
acacaggugccaaauucua

SEQ ID NO: 962777 - RNA, 19 nt, Homo sapiens
caauaucugcccuaacuca

SEQ ID NO: 962778 - RNA, 19 nt, Homo sapiens
gcacgaacugcccgucaga

SEQ ID NO: 962779 - RNA, 19 nt, Homo sapiens
ucaguccaucucuauaaua

SEQ ID NO: 962780 - RNA, 19 nt, Homo sapiens
ccugagauguaaacagcaa

SEQ ID NO: 962781 - RNA, 19 nt, Homo sapiens
uagugacccugagauguaa

SEQ ID NO: 962782 - RNA, 19 nt, Homo sapiens
ucagagauucuuuaugcaa

SEQ ID NO: 962783 - RNA, 19 nt, Homo sapiens
cgaacugcccgucagagaa

SEQ ID NO: 962784 - RNA, 19 nt, Homo sapiens
cugccacacugaaccauau

SEQ ID NO: 962785 - RNA, 19 nt, Homo sapiens
gaguucaguccaucucuau

SEQ ID NO: 962786 - RNA, 19 nt, Homo sapiens
caucaagugugcggagaca

SEQ ID NO: 962787 - RNA, 19 nt, Homo sapiens
ugaggcagaggcagggaua

SEQ ID NO: 962788 - RNA, 19 nt, Homo sapiens
ggacaagagcaagcugauc

SEQ ID NO: 962789 - RNA, 19 nt, Homo sapiens
ccagauacucccacaggau

SEQ ID NO: 962790 - RNA, 19 nt, Homo sapiens
gcagccguguggacgaagu

SEQ ID NO: 962791 - RNA, 19 nt, Homo sapiens
gcugccacacugaaccaua

SEQ ID NO: 962792 - RNA, 19 nt, Homo sapiens
ggauggacucacugcagaa

SEQ ID NO: 962793 - RNA, 19 nt, Homo sapiens
uggccuuccucaugaucua

SEQ ID NO: 962794 - RNA, 19 nt, Homo sapiens
gccuguugcucgauacauc

SEQ ID NO: 962795 - RNA, 19 nt, Homo sapiens
gguggacacaggugccaaa

SEQ ID NO: 962796 - RNA, 19 nt, Homo sapiens
cacugaaccauaucgauga

SEQ ID NO: 962797 - RNA, 19 nt, Homo sapiens
uggacucacugcagaagca

SEQ ID NO: 962798 - RNA, 19 nt, Homo sapiens
aagccgcucugccacacuu

SEQ ID NO: 962799 - RNA, 19 nt, Homo sapiens
cgagcugcccucaguguuc

SEQ ID NO: 962800 - RNA, 19 nt, Homo sapiens
ccaacaugcuggugacuaa

SEQ ID NO: 962801 - RNA, 19 nt, Homo sapiens
cuacaaagccguuucuuau

SEQ ID NO: 962802 - RNA, 19 nt, Homo sapiens
acaaagccguuucuuauca

SEQ ID NO: 962803 - RNA, 19 nt, Homo sapiens
gaagaaaccaacuacaaag

SEQ ID NO: 962804 - RNA, 19 nt, Homo sapiens
gcuggaggccucacacuaa

SEQ ID NO: 962805 - RNA, 19 nt, Homo sapiens
caagcacgacuauguguaa

SEQ ID NO: 962806 - RNA, 19 nt, Homo sapiens
gugacuaacuucuggaugu

SEQ ID NO: 962807 - RNA, 19 nt, Homo sapiens
gagguacaaucuuauccuu

SEQ ID NO: 962808 - RNA, 19 nt, Homo sapiens
aggacgagguacaaucuua

SEQ ID NO: 962809 - RNA, 19 nt, Homo sapiens
agaagaaaccaacuacaaa

SEQ ID NO: 962810 - RNA, 19 nt, Homo sapiens
cagaagaaaccaacuacaa

SEQ ID NO: 962811 - RNA, 19 nt, Homo sapiens
gcacagaggacgagguaca

SEQ ID NO: 962812 - RNA, 19 nt, Homo sapiens
gaaugcaggcccuauuuca

SEQ ID NO: 962813 - RNA, 19 nt, Homo sapiens
gcacgacuauguguaaugc

SEQ ID NO: 962814 - RNA, 19 nt, Homo sapiens
ucaccuccguguuccagua

SEQ ID NO: 962815 - RNA, 19 nt, Homo sapiens
ggaggccucacacuaauug

SEQ ID NO: 962816 - RNA, 19 nt, Homo sapiens
gggaucauguucauugucu

SEQ ID NO: 962817 - RNA, 19 nt, Homo sapiens
gcagugcgagcccugauga

SEQ ID NO: 962818 - RNA, 19 nt, Homo sapiens
acacugaccuccgggauca

SEQ ID NO: 962819 - RNA, 19 nt, Homo sapiens
ggacgagguacaaucuuau

SEQ ID NO: 962820 - RNA, 19 nt, Homo sapiens
caaagccguuucuuaucau

SEQ ID NO: 962821 - RNA, 19 nt, Homo sapiens
cagaccagguacacauuug

SEQ ID NO: 962822 - RNA, 19 nt, Homo sapiens
guccacagcuaacauguac

SEQ ID NO: 962823 - RNA, 19 nt, Homo sapiens
ccaccgggauggacaugug

SEQ ID NO: 962824 - RNA, 19 nt, Homo sapiens
ccacaguguugccuacaag

SEQ ID NO: 962825 - RNA, 19 nt, Homo sapiens
guucaggcuucaccgaaug

SEQ ID NO: 962826 - RNA, 19 nt, Homo sapiens
acuacaaagccguuucuua

SEQ ID NO: 962827 - RNA, 19 nt, Homo sapiens
gaucauguucauugucuca

SEQ ID NO: 962828 - RNA, 19 nt, Homo sapiens
uauguguaaugcucuaaga

SEQ ID NO: 962829 - RNA, 19 nt, Homo sapiens
ccgaaugcaggcccuauuu

SEQ ID NO: 962830 - RNA, 19 nt, Homo sapiens
gacuauguguaaugcucua

SEQ ID NO: 962831 - RNA, 19 nt, Homo sapiens
ucaggucuuugugcaauug

SEQ ID NO: 962832 - RNA, 19 nt, Homo sapiens
aaucuuauccuuccaagca

SEQ ID NO: 962833 - RNA, 19 nt, Homo sapiens
ccaagcacgacuaugugua

SEQ ID NO: 962834 - RNA, 19 nt, Homo sapiens
ccgcacagaggacgaggua

SEQ ID NO: 962835 - RNA, 19 nt, Homo sapiens
gccacaguguugccuacaa

SEQ ID NO: 962836 - RNA, 19 nt, Homo sapiens
caccagaagaaaccaacua

SEQ ID NO: 962837 - RNA, 19 nt, Homo sapiens
ucucaggucuuugugcaau

SEQ ID NO: 962838 - RNA, 19 nt, Homo sapiens
ccauuggccuccugguauc

SEQ ID NO: 962839 - RNA, 19 nt, Homo sapiens
ucagaccagguacacauuu

SEQ ID NO: 962840 - RNA, 19 nt, Homo sapiens
gcuggagugucuguguuug

SEQ ID NO: 962841 - RNA, 19 nt, Homo sapiens
caagaagauauacgaugga

SEQ ID NO: 962842 - RNA, 19 nt, Homo sapiens
aaagccaacaugacacuga

SEQ ID NO: 962843 - RNA, 19 nt, Homo sapiens
caacuacaaagccguuucu

SEQ ID NO: 962844 - RNA, 19 nt, Homo sapiens
guucagaccagguacacau

SEQ ID NO: 962845 - RNA, 19 nt, Homo sapiens
uucauugucucaggucuuu

SEQ ID NO: 962846 - RNA, 19 nt, Homo sapiens
cauggaggacucugccaaa

SEQ ID NO: 962847 - RNA, 19 nt, Homo sapiens
agacuguucagaccaggua

SEQ ID NO: 962848 - RNA, 19 nt, Homo sapiens
cgaaugcaggcccuauuuc

SEQ ID NO: 962849 - RNA, 19 nt, Homo sapiens
ugacuaacuucuggauguc

SEQ ID NO: 962850 - RNA, 19 nt, Homo sapiens
ugcaauugcuggagugucu

SEQ ID NO: 962851 - RNA, 19 nt, Homo sapiens
cuggaggccucacacuaau

SEQ ID NO: 962852 - RNA, 19 nt, Homo sapiens
cuuccaagcacgacuaugu

SEQ ID NO: 962853 - RNA, 19 nt, Homo sapiens
ggauggugcagacuguuca

SEQ ID NO: 962854 - RNA, 19 nt, Homo sapiens
gugggauggugcagacugu

SEQ ID NO: 962855 - RNA, 19 nt, Homo sapiens
ugccaaagccaacaugaca

SEQ ID NO: 962856 - RNA, 19 nt, Homo sapiens
guacaaucuuauccuucca

SEQ ID NO: 962857 - RNA, 19 nt, Homo sapiens
aaagccguuucuuaucaug

SEQ ID NO: 962858 - RNA, 19 nt, Homo sapiens
ggaaaucccugcucuuaaa

SEQ ID NO: 962859 - RNA, 19 nt, Homo sapiens
aaacagagccuuucaaauu

SEQ ID NO: 962860 - RNA, 19 nt, Homo sapiens
ggagguagauggacgcuuu

SEQ ID NO: 962861 - RNA, 19 nt, Homo sapiens
ggauuacccuuauuuagaa

SEQ ID NO: 962862 - RNA, 19 nt, Homo sapiens
guaacaagguagacaaaga

SEQ ID NO: 962863 - RNA, 19 nt, Homo sapiens
guagauggacgcuuuguaa

SEQ ID NO: 962864 - RNA, 19 nt, Homo sapiens
ccaaauugaucagucagua

SEQ ID NO: 962865 - RNA, 19 nt, Homo sapiens
gaaggacccugagcauuuc

SEQ ID NO: 962866 - RNA, 19 nt, Homo sapiens
ugaaggacccugagcauuu

SEQ ID NO: 962867 - RNA, 19 nt, Homo sapiens
gggauuacccuuauuuaga

SEQ ID NO: 962868 - RNA, 19 nt, Homo sapiens
gaacguuucaagagccuua

SEQ ID NO: 962869 - RNA, 19 nt, Homo sapiens
gacaguggccuuugaagaa

SEQ ID NO: 962870 - RNA, 19 nt, Homo sapiens
ccaaagaugauacuaaugu

SEQ ID NO: 962871 - RNA, 19 nt, Homo sapiens
gggaaaaguucgcuuauga

SEQ ID NO: 962872 - RNA, 19 nt, Homo sapiens
aggaacagcuggagcauug

SEQ ID NO: 962873 - RNA, 19 nt, Homo sapiens
gcagugacggugacucuaa

SEQ ID NO: 962874 - RNA, 19 nt, Homo sapiens
gaaacuagugccaaagaug

SEQ ID NO: 962875 - RNA, 19 nt, Homo sapiens
gaacaguggcuccaaagca

SEQ ID NO: 962876 - RNA, 19 nt, Homo sapiens
guaacuggcagaaagaauu

SEQ ID NO: 962877 - RNA, 19 nt, Homo sapiens
caaauugaaguguagauug

SEQ ID NO: 962878 - RNA, 19 nt, Homo sapiens
aacagagccuuucaaauug

SEQ ID NO: 962879 - RNA, 19 nt, Homo sapiens
caaagaugauacuaaugug

SEQ ID NO: 962880 - RNA, 19 nt, Homo sapiens
ccacuggguucucuugguu

SEQ ID NO: 962881 - RNA, 19 nt, Homo sapiens
ggugcuggcuguagaggaa

SEQ ID NO: 962882 - RNA, 19 nt, Homo sapiens
gcuggagcauugcauguug

SEQ ID NO: 962883 - RNA, 19 nt, Homo sapiens
caaagaggauaggcaagug

SEQ ID NO: 962884 - RNA, 19 nt, Homo sapiens
cggcagagcuucgagaauc

SEQ ID NO: 962885 - RNA, 19 nt, Homo sapiens
uaacuggcagaaagaauuu

SEQ ID NO: 962886 - RNA, 19 nt, Homo sapiens
agucaguaguguaagaaua

SEQ ID NO: 962887 - RNA, 19 nt, Homo sapiens
cauguugggucacaccauu

SEQ ID NO: 962888 - RNA, 19 nt, Homo sapiens
ugccaaagaugauacuaau

SEQ ID NO: 962889 - RNA, 19 nt, Homo sapiens
aaacuagugccaaagauga

SEQ ID NO: 962890 - RNA, 19 nt, Homo sapiens
gucaguaguguaagaauaa

SEQ ID NO: 962891 - RNA, 19 nt, Homo sapiens
guucuuaaaucgagaucug

SEQ ID NO: 962892 - RNA, 19 nt, Homo sapiens
ggguagaguucuuaaaucg

SEQ ID NO: 962893 - RNA, 19 nt, Homo sapiens
cuuaugaaccguuacguaa

SEQ ID NO: 962894 - RNA, 19 nt, Homo sapiens
aaaucgagaucuggaggua

SEQ ID NO: 962895 - RNA, 19 nt, Homo sapiens
uuuagaaacuagugccaaa

SEQ ID NO: 962896 - RNA, 19 nt, Homo sapiens
gaggauaggcaagugacua

SEQ ID NO: 962897 - RNA, 19 nt, Homo sapiens
gggcaggaacguuucaaga

SEQ ID NO: 962898 - RNA, 19 nt, Homo sapiens
gaauggggauuacccuuau

SEQ ID NO: 962899 - RNA, 19 nt, Homo sapiens
caagguagacaaagaggau

SEQ ID NO: 962900 - RNA, 19 nt, Homo sapiens
gcuuaugaaccguuacgua

SEQ ID NO: 962901 - RNA, 19 nt, Homo sapiens
gaauaacugugccccucua

SEQ ID NO: 962902 - RNA, 19 nt, Homo sapiens
ggcaggugcuggcuguaga

SEQ ID NO: 962903 - RNA, 19 nt, Homo sapiens
ugacaguggccuuugaaga

SEQ ID NO: 962904 - RNA, 19 nt, Homo sapiens
gaggguaagagacaagguu

SEQ ID NO: 962905 - RNA, 19 nt, Homo sapiens
auaggcaagugacuacuga

SEQ ID NO: 962906 - RNA, 19 nt, Homo sapiens
ucuuaaaggucauucucuu

SEQ ID NO: 962907 - RNA, 19 nt, Homo sapiens
gugccaaagaugauacuaa

SEQ ID NO: 962908 - RNA, 19 nt, Homo sapiens
ucgagaaucuugguaacug

SEQ ID NO: 962909 - RNA, 19 nt, Homo sapiens
uagaaacuagugccaaaga

SEQ ID NO: 962910 - RNA, 19 nt, Homo sapiens
uaacaagguagacaaagag

SEQ ID NO: 962911 - RNA, 19 nt, Homo sapiens
gaacagcuggagcauugca

SEQ ID NO: 962912 - RNA, 19 nt, Homo sapiens
gaaaucccugcucuuaaag

SEQ ID NO: 962913 - RNA, 19 nt, Homo sapiens
gguagauggacgcuuugua

SEQ ID NO: 962914 - RNA, 19 nt, Homo sapiens
gauagggagccuuuuaaaa

SEQ ID NO: 962915 - RNA, 19 nt, Homo sapiens
agaaacuagugccaaagau

SEQ ID NO: 962916 - RNA, 19 nt, Homo sapiens
guaagagacaagguucuga

SEQ ID NO: 962917 - RNA, 19 nt, Homo sapiens
cuugguaacuggcagaaag

SEQ ID NO: 962918 - RNA, 19 nt, Homo sapiens
caaauugaucagucaguag

SEQ ID NO: 962919 - RNA, 19 nt, Homo sapiens
gcagggucuucgugcuguu

SEQ ID NO: 962920 - RNA, 19 nt, Homo sapiens
gucauucucuugggugaug

SEQ ID NO: 962921 - RNA, 19 nt, Homo sapiens
gagcagugacggugacucu

SEQ ID NO: 962922 - RNA, 19 nt, Homo sapiens
uaagagacaagguucugau

SEQ ID NO: 962923 - RNA, 19 nt, Homo sapiens
cacaagaggguaagagaca

SEQ ID NO: 962924 - RNA, 19 nt, Homo sapiens
cuugaacaguggcuccaaa

SEQ ID NO: 962925 - RNA, 19 nt, Homo sapiens
gauaggcaagugacuacug

SEQ ID NO: 962926 - RNA, 19 nt, Homo sapiens
gcuucgagaaucuugguaa

SEQ ID NO: 962927 - RNA, 19 nt, Homo sapiens
ggaaaaguucgcuuaugaa

SEQ ID NO: 962928 - RNA, 19 nt, Homo sapiens
agagacaagguucugauug

SEQ ID NO: 962929 - RNA, 19 nt, Homo sapiens
acaaacuccuucccuucug

SEQ ID NO: 962930 - RNA, 19 nt, Homo sapiens
ggguaacaagguagacaaa

SEQ ID NO: 962931 - RNA, 19 nt, Homo sapiens
acaagaggguaagagacaa

SEQ ID NO: 962932 - RNA, 19 nt, Homo sapiens
gaggaacagcuggagcauu

SEQ ID NO: 962933 - RNA, 19 nt, Homo sapiens
ccuguuuccuucccauugu

SEQ ID NO: 962934 - RNA, 19 nt, Homo sapiens
aaagaggauaggcaaguga

SEQ ID NO: 962935 - RNA, 19 nt, Homo sapiens
gugaaggacccugagcauu

SEQ ID NO: 962936 - RNA, 19 nt, Homo sapiens
ggcagagcuucgagaaucu

SEQ ID NO: 962937 - RNA, 19 nt, Homo sapiens
ugaucagucaguaguguaa

SEQ ID NO: 962938 - RNA, 19 nt, Homo sapiens
ucacaccauugacuugaac

SEQ ID NO: 962939 - RNA, 19 nt, Homo sapiens
gcauggagaauggggauua

SEQ ID NO: 962940 - RNA, 19 nt, Homo sapiens
gcauuuccccuuuguaguu

SEQ ID NO: 962941 - RNA, 19 nt, Homo sapiens
ggcaggaacguuucaagag

SEQ ID NO: 962942 - RNA, 19 nt, Homo sapiens
gguaagagacaagguucug

SEQ ID NO: 962943 - RNA, 19 nt, Homo sapiens
uaacugugccccucuaaga

SEQ ID NO: 962944 - RNA, 19 nt, Homo sapiens
aaaaugugccccaaauuga

SEQ ID NO: 962945 - RNA, 19 nt, Homo sapiens
uggguucucuugguuacaa

SEQ ID NO: 962946 - RNA, 19 nt, Homo sapiens
acaguggccuuugaagaag

SEQ ID NO: 962947 - RNA, 19 nt, Homo sapiens
ccuggugcauggagaaugg

SEQ ID NO: 962948 - RNA, 19 nt, Homo sapiens
acaaagaggauaggcaagu

SEQ ID NO: 962949 - RNA, 19 nt, Homo sapiens
gcagagcuucgagaaucuu

SEQ ID NO: 962950 - RNA, 19 nt, Homo sapiens
gaaguaagcagccuccuaa

SEQ ID NO: 962951 - RNA, 19 nt, Homo sapiens
cuacuugggugaugaauuu

SEQ ID NO: 962952 - RNA, 19 nt, Homo sapiens
aaagaggaauggagaauga

SEQ ID NO: 962953 - RNA, 19 nt, Homo sapiens
ggcauaagguagagauuaa

SEQ ID NO: 962954 - RNA, 19 nt, Homo sapiens
gaaugaaauuaccugcuaa

SEQ ID NO: 962955 - RNA, 19 nt, Homo sapiens
ggagaauuauaacaccaua

SEQ ID NO: 962956 - RNA, 19 nt, Homo sapiens
guaagcagccuccuaagaa

SEQ ID NO: 962957 - RNA, 19 nt, Homo sapiens
agaaugaaauuaccugcua

SEQ ID NO: 962958 - RNA, 19 nt, Homo sapiens
gaaaugggcugggaauggu

SEQ ID NO: 962959 - RNA, 19 nt, Homo sapiens
gggagcagauauucuagaa

SEQ ID NO: 962960 - RNA, 19 nt, Homo sapiens
ugacagagcaagaaucauu

SEQ ID NO: 962961 - RNA, 19 nt, Homo sapiens
gguaugcaaaggagaauua

SEQ ID NO: 962962 - RNA, 19 nt, Homo sapiens
uaagcagccuccuaagaaa

SEQ ID NO: 962963 - RNA, 19 nt, Homo sapiens
gaaugaggauccuucucuu

SEQ ID NO: 962964 - RNA, 19 nt, Homo sapiens
gaaagacuaugcauaugcu

SEQ ID NO: 962965 - RNA, 19 nt, Homo sapiens
ggaauggagaaugaaauua

SEQ ID NO: 962966 - RNA, 19 nt, Homo sapiens
ugagaccacuagguauuua

SEQ ID NO: 962967 - RNA, 19 nt, Homo sapiens
caaaugauucagccuauug

SEQ ID NO: 962968 - RNA, 19 nt, Homo sapiens
ucuaucagcuuucagucua

SEQ ID NO: 962969 - RNA, 19 nt, Homo sapiens
gaauggagaaugaaauuac

SEQ ID NO: 962970 - RNA, 19 nt, Homo sapiens
ugaaggagaaagacuguaa

SEQ ID NO: 962971 - RNA, 19 nt, Homo sapiens
gcaaaggagaauuauaaca

SEQ ID NO: 962972 - RNA, 19 nt, Homo sapiens
ugauucagccuauuguuaa

SEQ ID NO: 962973 - RNA, 19 nt, Homo sapiens
gaaagacuguaagccaagu

SEQ ID NO: 962974 - RNA, 19 nt, Homo sapiens
ggaaaugggcugggaaugg

SEQ ID NO: 962975 - RNA, 19 nt, Homo sapiens
ggugagaccacuagguauu

SEQ ID NO: 962976 - RNA, 19 nt, Homo sapiens
acacaaagaauguucacuu

SEQ ID NO: 962977 - RNA, 19 nt, Homo sapiens
aggcugcccuuuacacaaa

SEQ ID NO: 962978 - RNA, 19 nt, Homo sapiens
uaucagcucuuauucucau

SEQ ID NO: 962979 - RNA, 19 nt, Homo sapiens
ggucaucaaauaaucaaug

SEQ ID NO: 962980 - RNA, 19 nt, Homo sapiens
cacuagguauuuacaagaa

SEQ ID NO: 962981 - RNA, 19 nt, Homo sapiens
guucugauuugcaaacauc

SEQ ID NO: 962982 - RNA, 19 nt, Homo sapiens
ucaaaugauucagccuauu

SEQ ID NO: 962983 - RNA, 19 nt, Homo sapiens
gacacuauuuggucaucaa

SEQ ID NO: 962984 - RNA, 19 nt, Homo sapiens
ggugacagagcaagaauca

SEQ ID NO: 962985 - RNA, 19 nt, Homo sapiens
gcaggagaguggugugaac

SEQ ID NO: 962986 - RNA, 19 nt, Homo sapiens
gcuagacggacacuauuug

SEQ ID NO: 962987 - RNA, 19 nt, Homo sapiens
caaaggagaauuauaacac

SEQ ID NO: 962988 - RNA, 19 nt, Homo sapiens
cuugaaagacuaugcauau

SEQ ID NO: 962989 - RNA, 19 nt, Homo sapiens
uggcauaagguagagauua

SEQ ID NO: 962990 - RNA, 19 nt, Homo sapiens
acaccauacuuuggcauaa

SEQ ID NO: 962991 - RNA, 19 nt, Homo sapiens
gauucagccuauuguuaau

SEQ ID NO: 962992 - RNA, 19 nt, Homo sapiens
ggacacuauuuggucauca

SEQ ID NO: 962993 - RNA, 19 nt, Homo sapiens
gaaagcggaauguuuugua

SEQ ID NO: 962994 - RNA, 19 nt, Homo sapiens
ccacuagguauuuacaaga

SEQ ID NO: 962995 - RNA, 19 nt, Homo sapiens
uaagccaagugucaaaguc

SEQ ID NO: 962996 - RNA, 19 nt, Homo sapiens
aaauauuucugcaguacca

SEQ ID NO: 962997 - RNA, 19 nt, Homo sapiens
ucagaaagcggaauguuuu

SEQ ID NO: 962998 - RNA, 19 nt, Homo sapiens
uaucagcuuucagucuaaa

SEQ ID NO: 962999 - RNA, 19 nt, Homo sapiens
gaggaauggagaaugaaau

SEQ ID NO: 963000 - RNA, 19 nt, Homo sapiens
gugagaccacuagguauuu

SEQ ID NO: 963001 - RNA, 19 nt, Homo sapiens
uaaauuacaacucgauugc

SEQ ID NO: 963002 - RNA, 19 nt, Homo sapiens
gcaguaccaaccauauauc

SEQ ID NO: 963003 - RNA, 19 nt, Homo sapiens
uaaagaggaauggagaaug

SEQ ID NO: 963004 - RNA, 19 nt, Homo sapiens
ccuaucaucccagcacuuu

SEQ ID NO: 963005 - RNA, 19 nt, Homo sapiens
cuagguauuuacaagaaca

SEQ ID NO: 963006 - RNA, 19 nt, Homo sapiens
gaaggagaaagacuguaag

SEQ ID NO: 963007 - RNA, 19 nt, Homo sapiens
uugcaaacaucuggugaga

SEQ ID NO: 963008 - RNA, 19 nt, Homo sapiens
augauucagccuauuguua

SEQ ID NO: 963009 - RNA, 19 nt, Homo sapiens
agaaguaagcagccuccua

SEQ ID NO: 963010 - RNA, 19 nt, Homo sapiens
cuaucagcuuucagucuaa

SEQ ID NO: 963011 - RNA, 19 nt, Homo sapiens
ucccuucccaacaguauua

SEQ ID NO: 963012 - RNA, 19 nt, Homo sapiens
uucagaauaucacugucua

SEQ ID NO: 963013 - RNA, 19 nt, Homo sapiens
cauaacacgguauaaccuu

SEQ ID NO: 963014 - RNA, 19 nt, Homo sapiens
aggaauggagaaugaaauu

SEQ ID NO: 963015 - RNA, 19 nt, Homo sapiens
ugaaagacuaugcauaugc

SEQ ID NO: 963016 - RNA, 19 nt, Homo sapiens
gaugagggcaggaauucag

SEQ ID NO: 963017 - RNA, 19 nt, Homo sapiens
gagccuaggaguuuaagac

SEQ ID NO: 963018 - RNA, 19 nt, Homo sapiens
aauggugguucaugccuau

SEQ ID NO: 963019 - RNA, 19 nt, Homo sapiens
ggcuagacggacacuauuu

SEQ ID NO: 963020 - RNA, 19 nt, Homo sapiens
ccuugagccuaggaguuua

SEQ ID NO: 963021 - RNA, 19 nt, Homo sapiens
cugcaguaccaaccauaua

SEQ ID NO: 963022 - RNA, 19 nt, Homo sapiens
guggcuagacggacacuau

SEQ ID NO: 963023 - RNA, 19 nt, Homo sapiens
cucagaaagcggaauguuu

SEQ ID NO: 963024 - RNA, 19 nt, Homo sapiens
aaugaggauccuucucuuu

SEQ ID NO: 963025 - RNA, 19 nt, Homo sapiens
guacaggggagcagauauu

SEQ ID NO: 963026 - RNA, 19 nt, Homo sapiens
caccauacuuuggcauaag

SEQ ID NO: 963027 - RNA, 19 nt, Homo sapiens
guauuuacaagaacagagu

SEQ ID NO: 963028 - RNA, 19 nt, Homo sapiens
gcauaagguagagauuaau

SEQ ID NO: 963029 - RNA, 19 nt, Homo sapiens
uugaaagacuaugcauaug

SEQ ID NO: 963030 - RNA, 19 nt, Homo sapiens
gacuguaagccaaguguca

SEQ ID NO: 963031 - RNA, 19 nt, Homo sapiens
caggaugagggcaggaauu

SEQ ID NO: 963032 - RNA, 19 nt, Homo sapiens
cuaaagaggaauggagaau

SEQ ID NO: 963033 - RNA, 19 nt, Homo sapiens
ggugaaggagaaagacugu

SEQ ID NO: 963034 - RNA, 19 nt, Homo sapiens
guaagccaagugucaaagu

SEQ ID NO: 963035 - RNA, 19 nt, Homo sapiens
aguauuagaugggcugucu

SEQ ID NO: 963036 - RNA, 19 nt, Homo sapiens
agaggaauggagaaugaaa

SEQ ID NO: 963037 - RNA, 19 nt, Homo sapiens
guucacauuuucauccaaa

SEQ ID NO: 963038 - RNA, 19 nt, Homo sapiens
aguaagcagccuccuaaga

SEQ ID NO: 963039 - RNA, 19 nt, Homo sapiens
ugaugaauuuacucaggau

SEQ ID NO: 963040 - RNA, 19 nt, Homo sapiens
uaucaucccagcacuuugg

SEQ ID NO: 963041 - RNA, 19 nt, Homo sapiens
cugacaggcugcccuuuac

SEQ ID NO: 963042 - RNA, 19 nt, Homo sapiens
ggaaggaaaucaugauaaa

SEQ ID NO: 963043 - RNA, 19 nt, Homo sapiens
ggacaacacccuuuaaaug

SEQ ID NO: 963044 - RNA, 19 nt, Homo sapiens
gacaaaugcugaagaagaa

SEQ ID NO: 963045 - RNA, 19 nt, Homo sapiens
gaagugcagugacaauuau

SEQ ID NO: 963046 - RNA, 19 nt, Homo sapiens
uauauucacuguugccuua

SEQ ID NO: 963047 - RNA, 19 nt, Homo sapiens
caagagaucucauggucaa

SEQ ID NO: 963048 - RNA, 19 nt, Homo sapiens
ggacaaaugcugaagaaga

SEQ ID NO: 963049 - RNA, 19 nt, Homo sapiens
acaacuaacugccaaauug

SEQ ID NO: 963050 - RNA, 19 nt, Homo sapiens
gaaccagcaucaaucagaa

SEQ ID NO: 963051 - RNA, 19 nt, Homo sapiens
aagguuaacuuccuagaua

SEQ ID NO: 963052 - RNA, 19 nt, Homo sapiens
gcagacaaaugguagaugu

SEQ ID NO: 963053 - RNA, 19 nt, Homo sapiens
caagaugucccauuaaguu

SEQ ID NO: 963054 - RNA, 19 nt, Homo sapiens
gaauggagguaauacauac

SEQ ID NO: 963055 - RNA, 19 nt, Homo sapiens
uacccaagaugucccauua

SEQ ID NO: 963056 - RNA, 19 nt, Homo sapiens
gaggauauauucuaugcau

SEQ ID NO: 963057 - RNA, 19 nt, Homo sapiens
guacucagccuuuccuauu

SEQ ID NO: 963058 - RNA, 19 nt, Homo sapiens
caaaucagaccauaugaga

SEQ ID NO: 963059 - RNA, 19 nt, Homo sapiens
cagaaagacaucagagaua

SEQ ID NO: 963060 - RNA, 19 nt, Homo sapiens
guugaauucuguggaaaua

SEQ ID NO: 963061 - RNA, 19 nt, Homo sapiens
cagagauacucaacaggua

SEQ ID NO: 963062 - RNA, 19 nt, Homo sapiens
uagguaagcuaaucuaaca

SEQ ID NO: 963063 - RNA, 19 nt, Homo sapiens
ugaauucuguggaaauaga

SEQ ID NO: 963064 - RNA, 19 nt, Homo sapiens
guacugggaguuauuuaaa

SEQ ID NO: 963065 - RNA, 19 nt, Homo sapiens
gagaggauauauucuaugc

SEQ ID NO: 963066 - RNA, 19 nt, Homo sapiens
ggacaaaucagaagaaucc

SEQ ID NO: 963067 - RNA, 19 nt, Homo sapiens
gaggaaggaaaucaugaua

SEQ ID NO: 963068 - RNA, 19 nt, Homo sapiens
aaagacagaaccauaguaa

SEQ ID NO: 963069 - RNA, 19 nt, Homo sapiens
gaagagccguauguacuca

SEQ ID NO: 963070 - RNA, 19 nt, Homo sapiens
gaaauccggacaaaucaga

SEQ ID NO: 963071 - RNA, 19 nt, Homo sapiens
ggaaccagcaucaaucaga

SEQ ID NO: 963072 - RNA, 19 nt, Homo sapiens
augcuaaccuucugaauau

SEQ ID NO: 963073 - RNA, 19 nt, Homo sapiens
agaagugcagugacaauua

SEQ ID NO: 963074 - RNA, 19 nt, Homo sapiens
caacuaacugccaaauuga

SEQ ID NO: 963075 - RNA, 19 nt, Homo sapiens
guugaaacauguauauugg

SEQ ID NO: 963076 - RNA, 19 nt, Homo sapiens
gacaacacccuuuaaaugg

SEQ ID NO: 963077 - RNA, 19 nt, Homo sapiens
ucucauagccacucagaaa

SEQ ID NO: 963078 - RNA, 19 nt, Homo sapiens
gcaguuuguuugguuauuc

SEQ ID NO: 963079 - RNA, 19 nt, Homo sapiens
caucagagauacucaacag

SEQ ID NO: 963080 - RNA, 19 nt, Homo sapiens
agaaggaaauccggacaaa

SEQ ID NO: 963081 - RNA, 19 nt, Homo sapiens
gaugucccauuaaguuguu

SEQ ID NO: 963082 - RNA, 19 nt, Homo sapiens
uaaauguacugggaguuau

SEQ ID NO: 963083 - RNA, 19 nt, Homo sapiens
gaauaucucuuuugugucu

SEQ ID NO: 963084 - RNA, 19 nt, Homo sapiens
uuaaauguacugggaguua

SEQ ID NO: 963085 - RNA, 19 nt, Homo sapiens
gaaaccacuuagagagauc

SEQ ID NO: 963086 - RNA, 19 nt, Homo sapiens
ucuaagcuaucauccaguu

SEQ ID NO: 963087 - RNA, 19 nt, Homo sapiens
gaucucauggucaaucuga

SEQ ID NO: 963088 - RNA, 19 nt, Homo sapiens
caggagaagugcagugaca

SEQ ID NO: 963089 - RNA, 19 nt, Homo sapiens
ccuaagccauccucagaga

SEQ ID NO: 963090 - RNA, 19 nt, Homo sapiens
gagaucucauggccaauca

SEQ ID NO: 963091 - RNA, 19 nt, Homo sapiens
gaucucauggucacucaaa

SEQ ID NO: 963092 - RNA, 19 nt, Homo sapiens
cgaaaccacuuagagagau

SEQ ID NO: 963093 - RNA, 19 nt, Homo sapiens
cagcaucaaucagaaggaa

SEQ ID NO: 963094 - RNA, 19 nt, Homo sapiens
gagaagugcagugacaauu

SEQ ID NO: 963095 - RNA, 19 nt, Homo sapiens
uaauugagcaggagaagug

SEQ ID NO: 963096 - RNA, 19 nt, Homo sapiens
aaugcuaaccuucugaaua

SEQ ID NO: 963097 - RNA, 19 nt, Homo sapiens
gggacaaagacauaaauau

SEQ ID NO: 963098 - RNA, 19 nt, Homo sapiens
agaaagacaucagagauac

SEQ ID NO: 963099 - RNA, 19 nt, Homo sapiens
gacguuccaacuugacuua

SEQ ID NO: 963100 - RNA, 19 nt, Homo sapiens
agaauggagguaauacaua

SEQ ID NO: 963101 - RNA, 19 nt, Homo sapiens
cauggucacucaaagagau

SEQ ID NO: 963102 - RNA, 19 nt, Homo sapiens
gcuaaccuucugaauauau

SEQ ID NO: 963103 - RNA, 19 nt, Homo sapiens
ccucaaaucagaccauaug

SEQ ID NO: 963104 - RNA, 19 nt, Homo sapiens
gagaucucguggccacuga

SEQ ID NO: 963105 - RNA, 19 nt, Homo sapiens
cggagaggcuacucaagau

SEQ ID NO: 963106 - RNA, 19 nt, Homo sapiens
gagauacucaacagguaaa

SEQ ID NO: 963107 - RNA, 19 nt, Homo sapiens
ucucauggccaaucagaaa

SEQ ID NO: 963108 - RNA, 19 nt, Homo sapiens
ggagguaauacauacauag

SEQ ID NO: 963109 - RNA, 19 nt, Homo sapiens
aagcaacucugaggaagga

SEQ ID NO: 963110 - RNA, 19 nt, Homo sapiens
gacaaaugguagauguauc

SEQ ID NO: 963111 - RNA, 19 nt, Homo sapiens
ggaagagccguauguacuc

SEQ ID NO: 963112 - RNA, 19 nt, Homo sapiens
gauguccucuaagcuauca

SEQ ID NO: 963113 - RNA, 19 nt, Homo sapiens
gaucucauagucacucaga

SEQ ID NO: 963114 - RNA, 19 nt, Homo sapiens
gagaucuuguggacacuca

SEQ ID NO: 963115 - RNA, 19 nt, Homo sapiens
gagaucucauggucacuca

SEQ ID NO: 963116 - RNA, 19 nt, Homo sapiens
gagaucucauggucacuca

SEQ ID NO: 963117 - RNA, 19 nt, Homo sapiens
gagaucucauggucacuca

SEQ ID NO: 963118 - RNA, 19 nt, Homo sapiens
gaaggaaauccggacaaau

SEQ ID NO: 963119 - RNA, 19 nt, Homo sapiens
gcaucaaucagaaggaaau

SEQ ID NO: 963120 - RNA, 19 nt, Homo sapiens
gaagaaucaaggccaguca

SEQ ID NO: 963121 - RNA, 19 nt, Homo sapiens
ggagaagugcagugacaau

SEQ ID NO: 963122 - RNA, 19 nt, Homo sapiens
acauguauauugggacaaa

SEQ ID NO: 963123 - RNA, 19 nt, Homo sapiens
acaauguguugaauucugu

SEQ ID NO: 963124 - RNA, 19 nt, Homo sapiens
gaucucauggccaauacaa

SEQ ID NO: 963125 - RNA, 19 nt, Homo sapiens
aaggaaauccggacaaauc

SEQ ID NO: 963126 - RNA, 19 nt, Homo sapiens
uauucacuguugccuuaua

SEQ ID NO: 963127 - RNA, 19 nt, Homo sapiens
cagaccauaugagaggaua

SEQ ID NO: 963128 - RNA, 19 nt, Homo sapiens
gagaguccuuagcagacaa

SEQ ID NO: 963129 - RNA, 19 nt, Homo sapiens
guuccaacuugacuuagug

SEQ ID NO: 963130 - RNA, 19 nt, Homo sapiens
cauagucacucagagagau

SEQ ID NO: 963131 - RNA, 19 nt, Homo sapiens
agggacaaaugcugaagaa

SEQ ID NO: 963132 - RNA, 19 nt, Homo sapiens
cccaagaugucccauuaag

SEQ ID NO: 963133 - RNA, 19 nt, Homo sapiens
agacagaaccauaguaaaa

SEQ ID NO: 963134 - RNA, 19 nt, Homo sapiens
uggagguaauacauacaua

SEQ ID NO: 963135 - RNA, 19 nt, Homo sapiens
ucagaaagacaucagagau

SEQ ID NO: 963136 - RNA, 19 nt, Homo sapiens
gaucucauggccaaucaga

SEQ ID NO: 963137 - RNA, 19 nt, Homo sapiens
gaucucauagccacucaga

SEQ ID NO: 963138 - RNA, 19 nt, Homo sapiens
gaucucauagccacucaga

SEQ ID NO: 963139 - RNA, 19 nt, Homo sapiens
gaucucauagccacucaga

SEQ ID NO: 963140 - RNA, 19 nt, Homo sapiens
gaucucauagccacucaga

SEQ ID NO: 963141 - RNA, 19 nt, Homo sapiens
gaucucauggucacucaga

SEQ ID NO: 963142 - RNA, 19 nt, Homo sapiens
gaaggaagcuuuaccugua

SEQ ID NO: 963143 - RNA, 19 nt, Homo sapiens
gagaugaccucuuuuaaaa

SEQ ID NO: 963144 - RNA, 19 nt, Homo sapiens
cgaaugagaucuuugcaau

SEQ ID NO: 963145 - RNA, 19 nt, Homo sapiens
aaugagaucuuugcaauga

SEQ ID NO: 963146 - RNA, 19 nt, Homo sapiens
gugagaaguuugccuagaa

SEQ ID NO: 963147 - RNA, 19 nt, Homo sapiens
gcaaugagcaaacgaaagu

SEQ ID NO: 963148 - RNA, 19 nt, Homo sapiens
gaagaaguggugagaaguu

SEQ ID NO: 963149 - RNA, 19 nt, Homo sapiens
gggaagaaguggugagaag

SEQ ID NO: 963150 - RNA, 19 nt, Homo sapiens
uugcugagaugaccucuuu

SEQ ID NO: 963151 - RNA, 19 nt, Homo sapiens
ugagaaguuugccuagaaa

SEQ ID NO: 963152 - RNA, 19 nt, Homo sapiens
ucagucuccuguccaauuu

SEQ ID NO: 963153 - RNA, 19 nt, Homo sapiens
ggagaucccaguucgaaga

SEQ ID NO: 963154 - RNA, 19 nt, Homo sapiens
ggacuaaggacccgaacug

SEQ ID NO: 963155 - RNA, 19 nt, Homo sapiens
gguggagggugcacacgaa

SEQ ID NO: 963156 - RNA, 19 nt, Homo sapiens
ggugagaaguuugccuaga

SEQ ID NO: 963157 - RNA, 19 nt, Homo sapiens
aagaaguggugagaaguuu

SEQ ID NO: 963158 - RNA, 19 nt, Homo sapiens
ggacauggagggccguugu

SEQ ID NO: 963159 - RNA, 19 nt, Homo sapiens
ccagaucccagcuguguga

SEQ ID NO: 963160 - RNA, 19 nt, Homo sapiens
gaaugagaucuuugcaaug

SEQ ID NO: 963161 - RNA, 19 nt, Homo sapiens
cuaaggacccgaacugcaa

SEQ ID NO: 963162 - RNA, 19 nt, Homo sapiens
ccgagacccuucuguugga

SEQ ID NO: 963163 - RNA, 19 nt, Homo sapiens
ggaccaagcccagcauuuu

SEQ ID NO: 963164 - RNA, 19 nt, Homo sapiens
gguggacgcugcugaagcu

SEQ ID NO: 963165 - RNA, 19 nt, Homo sapiens
ggucauggcacggaauaug

SEQ ID NO: 963166 - RNA, 19 nt, Homo sapiens
gaccaagcccagcauuuua

SEQ ID NO: 963167 - RNA, 19 nt, Homo sapiens
ggccgagacccuucuguug

SEQ ID NO: 963168 - RNA, 19 nt, Homo sapiens
caggagggaaggaagcuuu

SEQ ID NO: 963169 - RNA, 19 nt, Homo sapiens
ggagggugcacacgaaugg

SEQ ID NO: 963170 - RNA, 19 nt, Homo sapiens
gcugagaugaccucuuuua

SEQ ID NO: 963171 - RNA, 19 nt, Homo sapiens
gggaccaagcccagcauuu

SEQ ID NO: 963172 - RNA, 19 nt, Homo sapiens
acacacagcucugcuugac

SEQ ID NO: 963173 - RNA, 19 nt, Homo sapiens
ggaagaaguggugagaagu

SEQ ID NO: 963174 - RNA, 19 nt, Homo sapiens
ccuguaaaaugguguauau

SEQ ID NO: 963175 - RNA, 19 nt, Homo sapiens
gagggaagaaguggugaga

SEQ ID NO: 963176 - RNA, 19 nt, Homo sapiens
aaagauauugcugagauga

SEQ ID NO: 963177 - RNA, 19 nt, Homo sapiens
ccagcugugugacugaauc

SEQ ID NO: 963178 - RNA, 19 nt, Homo sapiens
gaggagagaagcuaaaccu

SEQ ID NO: 963179 - RNA, 19 nt, Homo sapiens
gaaguggugagaaguuugc

SEQ ID NO: 963180 - RNA, 19 nt, Homo sapiens
ugagaugaccucuuuuaaa

SEQ ID NO: 963181 - RNA, 19 nt, Homo sapiens
ggaggcaggagggaaggaa

SEQ ID NO: 963182 - RNA, 19 nt, Homo sapiens
ccagggugcaacagagaaa

SEQ ID NO: 963183 - RNA, 19 nt, Homo sapiens
uauaagggagggaagaagu

SEQ ID NO: 963184 - RNA, 19 nt, Homo sapiens
ccucaggacugggcucucu

SEQ ID NO: 963185 - RNA, 19 nt, Homo sapiens
ggccugggaaguaggacua

SEQ ID NO: 963186 - RNA, 19 nt, Homo sapiens
ucaggaggagagaagcuaa

SEQ ID NO: 963187 - RNA, 19 nt, Homo sapiens
ccacgaaugagaucuuugc

SEQ ID NO: 963188 - RNA, 19 nt, Homo sapiens
gacacacagcucugcuuga

SEQ ID NO: 963189 - RNA, 19 nt, Homo sapiens
cagacgaggcgcugaccuu

SEQ ID NO: 963190 - RNA, 19 nt, Homo sapiens
ccacugcacuguaaugauu

SEQ ID NO: 963191 - RNA, 19 nt, Homo sapiens
gaaguuaaauaggagcuuu

SEQ ID NO: 963192 - RNA, 19 nt, Homo sapiens
gcacuguaaugauucaaug

SEQ ID NO: 963193 - RNA, 19 nt, Homo sapiens
guaccucaauggcgaguuu

SEQ ID NO: 963194 - RNA, 19 nt, Homo sapiens
aauaggagcuuuggaauca

SEQ ID NO: 963195 - RNA, 19 nt, Homo sapiens
gugcaugccugaguugauu

SEQ ID NO: 963196 - RNA, 19 nt, Homo sapiens
agaaaagccuuacccauuu

SEQ ID NO: 963197 - RNA, 19 nt, Homo sapiens
caugagcaguuggugauuu

SEQ ID NO: 963198 - RNA, 19 nt, Homo sapiens
uuaaauaggagcuuuggaa

SEQ ID NO: 963199 - RNA, 19 nt, Homo sapiens
guaaugauucaaugcugua

SEQ ID NO: 963200 - RNA, 19 nt, Homo sapiens
gguguucgggcuaagaaua

SEQ ID NO: 963201 - RNA, 19 nt, Homo sapiens
uaggagcuuuggaaucauu

SEQ ID NO: 963202 - RNA, 19 nt, Homo sapiens
ggucugguguucgggcuaa

SEQ ID NO: 963203 - RNA, 19 nt, Homo sapiens
agaccaagacuccaaguga

SEQ ID NO: 963204 - RNA, 19 nt, Homo sapiens
gagacucacugccagaaaa

SEQ ID NO: 963205 - RNA, 19 nt, Homo sapiens
uaaauaggagcuuuggaau

SEQ ID NO: 963206 - RNA, 19 nt, Homo sapiens
cagaaaagccuuacccauu

SEQ ID NO: 963207 - RNA, 19 nt, Homo sapiens
gggagccguucaugucaga

SEQ ID NO: 963208 - RNA, 19 nt, Homo sapiens
gggauccacuccgcccuuu

SEQ ID NO: 963209 - RNA, 19 nt, Homo sapiens
gcagagagggagccguuca

SEQ ID NO: 963210 - RNA, 19 nt, Homo sapiens
gagcuuuggaaucauuauu

SEQ ID NO: 963211 - RNA, 19 nt, Homo sapiens
ggacuugguggaagaacug

SEQ ID NO: 963212 - RNA, 19 nt, Homo sapiens
gagagggagccguucaugu

SEQ ID NO: 963213 - RNA, 19 nt, Homo sapiens
gauccacuccgcccuuuua

SEQ ID NO: 963214 - RNA, 19 nt, Homo sapiens
gauucaaugcuguauuaug

SEQ ID NO: 963215 - RNA, 19 nt, Homo sapiens
caaccacugcacuguaaug

SEQ ID NO: 963216 - RNA, 19 nt, Homo sapiens
agaaagaccaagacuccaa

SEQ ID NO: 963217 - RNA, 19 nt, Homo sapiens
gagggagccguucauguca

SEQ ID NO: 963218 - RNA, 19 nt, Homo sapiens
aaagaaacugugauaacug

SEQ ID NO: 963219 - RNA, 19 nt, Homo sapiens
caacugcuugcacugauca

SEQ ID NO: 963220 - RNA, 19 nt, Homo sapiens
agagggagccguucauguc

SEQ ID NO: 963221 - RNA, 19 nt, Homo sapiens
ugacauucuucugcagaug

SEQ ID NO: 963222 - RNA, 19 nt, Homo sapiens
cuuauucuuugccugauuc

SEQ ID NO: 963223 - RNA, 19 nt, Homo sapiens
gugacauucuucugcagau

SEQ ID NO: 963224 - RNA, 19 nt, Homo sapiens
cugcuugcacugaucauuu

SEQ ID NO: 963225 - RNA, 19 nt, Homo sapiens
aaaugugucagucuccaaa

SEQ ID NO: 963226 - RNA, 19 nt, Homo sapiens
aaauaggagcuuuggaauc

SEQ ID NO: 963227 - RNA, 19 nt, Homo sapiens
ccucaauggcgaguuugua

SEQ ID NO: 963228 - RNA, 19 nt, Homo sapiens
caaaugugucagucuccaa

SEQ ID NO: 963229 - RNA, 19 nt, Homo sapiens
guucgggcuaagaauauuu

SEQ ID NO: 963230 - RNA, 19 nt, Homo sapiens
gagccguucaugucagaga

SEQ ID NO: 963231 - RNA, 19 nt, Homo sapiens
agaaagagaugccugguuu

SEQ ID NO: 963232 - RNA, 19 nt, Homo sapiens
ggagcuggcugguguuuga

SEQ ID NO: 963233 - RNA, 19 nt, Homo sapiens
gggagcauauggugguuua

SEQ ID NO: 963234 - RNA, 19 nt, Homo sapiens
ggacagguuucucucuuuc

SEQ ID NO: 963235 - RNA, 19 nt, Homo sapiens
ggggaacgauuauaacuua

SEQ ID NO: 963236 - RNA, 19 nt, Homo sapiens
gagcauauggugguuuaua

SEQ ID NO: 963237 - RNA, 19 nt, Homo sapiens
ggagaaagaaagaaagaga

SEQ ID NO: 963238 - RNA, 19 nt, Homo sapiens
gaguggcugugucuuguaa

SEQ ID NO: 963239 - RNA, 19 nt, Homo sapiens
ccugggaguuugucaagua

SEQ ID NO: 963240 - RNA, 19 nt, Homo sapiens
gggcuuuguuuccuucuuu

SEQ ID NO: 963241 - RNA, 19 nt, Homo sapiens
gggacagguuucucucuuu

SEQ ID NO: 963242 - RNA, 19 nt, Homo sapiens
gcaccgggaccauucauga

SEQ ID NO: 963243 - RNA, 19 nt, Homo sapiens
ugucaaacgucacuucuuc

SEQ ID NO: 963244 - RNA, 19 nt, Homo sapiens
gcacagauggcuucguuca

SEQ ID NO: 963245 - RNA, 19 nt, Homo sapiens
ggagugcaauggcgugauc

SEQ ID NO: 963246 - RNA, 19 nt, Homo sapiens
ccaaagugcugggauuaca

SEQ ID NO: 963247 - RNA, 19 nt, Homo sapiens
gcauauggugguuuauaaa

SEQ ID NO: 963248 - RNA, 19 nt, Homo sapiens
gggaacgauuauaacuuaa

SEQ ID NO: 963249 - RNA, 19 nt, Homo sapiens
cuccugaccuguaaauuug

SEQ ID NO: 963250 - RNA, 19 nt, Homo sapiens
uggcacagauggcuucguu

SEQ ID NO: 963251 - RNA, 19 nt, Homo sapiens
ggauuuccaccaggaguua

SEQ ID NO: 963252 - RNA, 19 nt, Homo sapiens
cagcugcagugucuaagug

SEQ ID NO: 963253 - RNA, 19 nt, Homo sapiens
ccuccugaccuguaaauuu

SEQ ID NO: 963254 - RNA, 19 nt, Homo sapiens
ccgaguagcugggauuaca

SEQ ID NO: 963255 - RNA, 19 nt, Homo sapiens
ggcauuacauaacacuuca

SEQ ID NO: 963256 - RNA, 19 nt, Homo sapiens
agcauauggugguuuauaa

SEQ ID NO: 963257 - RNA, 19 nt, Homo sapiens
gagaaagaaagaaagagau

SEQ ID NO: 963258 - RNA, 19 nt, Homo sapiens
uuucaaagaugucaaacgu

SEQ ID NO: 963259 - RNA, 19 nt, Homo sapiens
guggcugugucuuguaauu

SEQ ID NO: 963260 - RNA, 19 nt, Homo sapiens
ggcuuuguuuccuucuuua

SEQ ID NO: 963261 - RNA, 19 nt, Homo sapiens
acaaccagcugcagugucu

SEQ ID NO: 963262 - RNA, 19 nt, Homo sapiens
uguguuguccacccuauua

SEQ ID NO: 963263 - RNA, 19 nt, Homo sapiens
uaucagggccagaucauag

SEQ ID NO: 963264 - RNA, 19 nt, Homo sapiens
cagggaagcgccauccauu

SEQ ID NO: 963265 - RNA, 19 nt, Homo sapiens
cauggugguuucauuacga

SEQ ID NO: 963266 - RNA, 19 nt, Homo sapiens
cccaguagcaggagaaaga

SEQ ID NO: 963267 - RNA, 19 nt, Homo sapiens
ccacagcaccgggaccauu

SEQ ID NO: 963268 - RNA, 19 nt, Homo sapiens
agaaagaaagaaagagaug

SEQ ID NO: 963269 - RNA, 19 nt, Homo sapiens
caggagaaagaaagaaaga

SEQ ID NO: 963270 - RNA, 19 nt, Homo sapiens
gggaagcgccauccauuuu

SEQ ID NO: 963271 - RNA, 19 nt, Homo sapiens
uuacauaacacuucaugag

SEQ ID NO: 963272 - RNA, 19 nt, Homo sapiens
ggaagucucaagcccaaag

SEQ ID NO: 963273 - RNA, 19 nt, Homo sapiens
gggaguuugucaaguaagg

SEQ ID NO: 963274 - RNA, 19 nt, Homo sapiens
gcccagagacugacaacca

SEQ ID NO: 963275 - RNA, 19 nt, Homo sapiens
caaguaaggaagucucaag

SEQ ID NO: 963276 - RNA, 19 nt, Homo sapiens
uguuugagcuguggcagaa

SEQ ID NO: 963277 - RNA, 19 nt, Homo sapiens
gaagcgccauccauuuuca

SEQ ID NO: 963278 - RNA, 19 nt, Homo sapiens
gcugcagugucuaaguguu

SEQ ID NO: 963279 - RNA, 19 nt, Homo sapiens
caugaguggcugugucuug

SEQ ID NO: 963280 - RNA, 19 nt, Homo sapiens
gaagucucaagcccaaaga

SEQ ID NO: 963281 - RNA, 19 nt, Homo sapiens
gcaggagaaagaaagaaag

SEQ ID NO: 963282 - RNA, 19 nt, Homo sapiens
cugggaguuugucaaguaa

SEQ ID NO: 963283 - RNA, 19 nt, Homo sapiens
gcagcguccugaccauggu

SEQ ID NO: 963284 - RNA, 19 nt, Homo sapiens
guuguccacccuauuauuc

SEQ ID NO: 963285 - RNA, 19 nt, Homo sapiens
ggcugugucuuguaauuuu

SEQ ID NO: 963286 - RNA, 19 nt, Homo sapiens
guagcaggagaaagaaaga

SEQ ID NO: 963287 - RNA, 19 nt, Homo sapiens
ggaugggccucaggagcau

SEQ ID NO: 963288 - RNA, 19 nt, Homo sapiens
gaguuugucaaguaaggaa

SEQ ID NO: 963289 - RNA, 19 nt, Homo sapiens
ccugaccuguaaauuuguu

SEQ ID NO: 963290 - RNA, 19 nt, Homo sapiens
cuccacguccggcuaauuu

SEQ ID NO: 963291 - RNA, 19 nt, Homo sapiens
uagcugccguguguacuuc

SEQ ID NO: 963292 - RNA, 19 nt, Homo sapiens
cggucaggcuggucucgaa

SEQ ID NO: 963293 - RNA, 19 nt, Homo sapiens
gaaagagaugccugguuuu

SEQ ID NO: 963294 - RNA, 19 nt, Homo sapiens
ggcugcaggugggagcaua

SEQ ID NO: 963295 - RNA, 19 nt, Homo sapiens
gcaggugggagcauauggu

SEQ ID NO: 963296 - RNA, 19 nt, Homo sapiens
ccacccuauuauucaugua

SEQ ID NO: 963297 - RNA, 19 nt, Homo sapiens
ccaauaaacaggugucuua

SEQ ID NO: 963298 - RNA, 19 nt, Homo sapiens
ggccagagcuuuacacagu

SEQ ID NO: 963299 - RNA, 19 nt, Homo sapiens
gcggugagcuggucugaga

SEQ ID NO: 963300 - RNA, 19 nt, Homo sapiens
ggaagagaaugggcuguug

SEQ ID NO: 963301 - RNA, 19 nt, Homo sapiens
ggaggagccugaggaagaa

SEQ ID NO: 963302 - RNA, 19 nt, Homo sapiens
gaagguuugugucccuguu

SEQ ID NO: 963303 - RNA, 19 nt, Homo sapiens
ucaacucuauccuugcuuu

SEQ ID NO: 963304 - RNA, 19 nt, Homo sapiens
ccauaggcgugagaguuua

SEQ ID NO: 963305 - RNA, 19 nt, Homo sapiens
gcaccuguugccuucauua

SEQ ID NO: 963306 - RNA, 19 nt, Homo sapiens
ucacagugccuuagaagug

SEQ ID NO: 963307 - RNA, 19 nt, Homo sapiens
auaaacaggugucuuaagg

SEQ ID NO: 963308 - RNA, 19 nt, Homo sapiens
gcucaaguaucaccuacag

SEQ ID NO: 963309 - RNA, 19 nt, Homo sapiens
gaguuccgcugccaagugu

SEQ ID NO: 963310 - RNA, 19 nt, Homo sapiens
gagccacucugccagucuu

SEQ ID NO: 963311 - RNA, 19 nt, Homo sapiens
gagcccugguuccuuaaga

SEQ ID NO: 963312 - RNA, 19 nt, Homo sapiens
cggaggagccugaggaaga

SEQ ID NO: 963313 - RNA, 19 nt, Homo sapiens
gcacuucccagaaccaaag

SEQ ID NO: 963314 - RNA, 19 nt, Homo sapiens
gagucacagugccuuagaa

SEQ ID NO: 963315 - RNA, 19 nt, Homo sapiens
caauaaacaggugucuuaa

SEQ ID NO: 963316 - RNA, 19 nt, Homo sapiens
ccggcucgcucaaguauca

SEQ ID NO: 963317 - RNA, 19 nt, Homo sapiens
ucaagggccacaugcguaa

SEQ ID NO: 963318 - RNA, 19 nt, Homo sapiens
gcucauggccuugcaccuu

SEQ ID NO: 963319 - RNA, 19 nt, Homo sapiens
ggaguuccgcugccaagug

SEQ ID NO: 963320 - RNA, 19 nt, Homo sapiens
ccuguugccuucauuagca

SEQ ID NO: 963321 - RNA, 19 nt, Homo sapiens
ucccugggcuggcagagaa

SEQ ID NO: 963322 - RNA, 19 nt, Homo sapiens
ggagucacagugccuuaga

SEQ ID NO: 963323 - RNA, 19 nt, Homo sapiens
cagcacaucaccucaaagu

SEQ ID NO: 963324 - RNA, 19 nt, Homo sapiens
cuacugcaaaggcaaguuu

SEQ ID NO: 963325 - RNA, 19 nt, Homo sapiens
agagguaguuggguagaga

SEQ ID NO: 963326 - RNA, 19 nt, Homo sapiens
cgaguaccaucaggagaga

SEQ ID NO: 963327 - RNA, 19 nt, Homo sapiens
acacagucuugguuucuca

SEQ ID NO: 963328 - RNA, 19 nt, Homo sapiens
agucuuugcugguccauag

SEQ ID NO: 963329 - RNA, 19 nt, Homo sapiens
ccagaaccaaagaauguga

SEQ ID NO: 963330 - RNA, 19 nt, Homo sapiens
gcucagcacaucaccucaa

SEQ ID NO: 963331 - RNA, 19 nt, Homo sapiens
uccauaggcgugagaguuu

SEQ ID NO: 963332 - RNA, 19 nt, Homo sapiens
uggcagagaagguuugugu

SEQ ID NO: 963333 - RNA, 19 nt, Homo sapiens
ucccagaaccaaagaaugu

SEQ ID NO: 963334 - RNA, 19 nt, Homo sapiens
uuaagaaccacaugaaggu

SEQ ID NO: 963335 - RNA, 19 nt, Homo sapiens
ccacaugcguaagcacaag

SEQ ID NO: 963336 - RNA, 19 nt, Homo sapiens
cgauuccugucaucccuau

SEQ ID NO: 963337 - RNA, 19 nt, Homo sapiens
gaggugagggucaaagaac

SEQ ID NO: 963338 - RNA, 19 nt, Homo sapiens
uggcagaggugagggucaa

SEQ ID NO: 963339 - RNA, 19 nt, Homo sapiens
ccagagcuuuacacagucu

SEQ ID NO: 963340 - RNA, 19 nt, Homo sapiens
cucagcacaucaccucaaa

SEQ ID NO: 963341 - RNA, 19 nt, Homo sapiens
cagcaccuguugccuucau

SEQ ID NO: 963342 - RNA, 19 nt, Homo sapiens
guccauaggcgugagaguu

SEQ ID NO: 963343 - RNA, 19 nt, Homo sapiens
gcuuuacacagucuugguu

SEQ ID NO: 963344 - RNA, 19 nt, Homo sapiens
gccuguugcuggaguugga

SEQ ID NO: 963345 - RNA, 19 nt, Homo sapiens
cagaggugagggucaaaga

SEQ ID NO: 963346 - RNA, 19 nt, Homo sapiens
ggacuugccuugcagauaa

SEQ ID NO: 963347 - RNA, 19 nt, Homo sapiens
gaaacaggcugccaagaaa

SEQ ID NO: 963348 - RNA, 19 nt, Homo sapiens
gcacagcucuggugagaug

SEQ ID NO: 963349 - RNA, 19 nt, Homo sapiens
ggaaacaggcugccaagaa

SEQ ID NO: 963350 - RNA, 19 nt, Homo sapiens
cagaagauaugaacgcauu

SEQ ID NO: 963351 - RNA, 19 nt, Homo sapiens
ggagaacaccucagaauuc

SEQ ID NO: 963352 - RNA, 19 nt, Homo sapiens
gagaacaccucagaauuca

SEQ ID NO: 963353 - RNA, 19 nt, Homo sapiens
ccacugcacuuggagauaa

SEQ ID NO: 963354 - RNA, 19 nt, Homo sapiens
gaacaccucagaauucaga

SEQ ID NO: 963355 - RNA, 19 nt, Homo sapiens
gaugaucuguuucaaaucu

SEQ ID NO: 963356 - RNA, 19 nt, Homo sapiens
gcagaaagaaagacaauca

SEQ ID NO: 963357 - RNA, 19 nt, Homo sapiens
caaaucgucucgccaggaa

SEQ ID NO: 963358 - RNA, 19 nt, Homo sapiens
cacccuaguuguaauuaua

SEQ ID NO: 963359 - RNA, 19 nt, Homo sapiens
gacaaucacgcacucguua

SEQ ID NO: 963360 - RNA, 19 nt, Homo sapiens
gaucagcuguaucgcagaa

SEQ ID NO: 963361 - RNA, 19 nt, Homo sapiens
gaagaggccucagcacagu

SEQ ID NO: 963362 - RNA, 19 nt, Homo sapiens
gccaagacgccuuaugaua

SEQ ID NO: 963363 - RNA, 19 nt, Homo sapiens
cgacuuugccagagacuua

SEQ ID NO: 963364 - RNA, 19 nt, Homo sapiens
uagagagacagacgaauua

SEQ ID NO: 963365 - RNA, 19 nt, Homo sapiens
gggauucggcuaagaaauu

SEQ ID NO: 963366 - RNA, 19 nt, Homo sapiens
ccucagaauucagaagaua

SEQ ID NO: 963367 - RNA, 19 nt, Homo sapiens
caccagaaccuuuaacuug

SEQ ID NO: 963368 - RNA, 19 nt, Homo sapiens
gcacuuggagauaaacaaa

SEQ ID NO: 963369 - RNA, 19 nt, Homo sapiens
ggauucggcuaagaaauug

SEQ ID NO: 963370 - RNA, 19 nt, Homo sapiens
gaauuacggaggaaucauu

SEQ ID NO: 963371 - RNA, 19 nt, Homo sapiens
ggacgcagagugaaugcua

SEQ ID NO: 963372 - RNA, 19 nt, Homo sapiens
gcccagagcugagagaaag

SEQ ID NO: 963373 - RNA, 19 nt, Homo sapiens
ggauguucacugauaauuu

SEQ ID NO: 963374 - RNA, 19 nt, Homo sapiens
gcagagaggcaaagaugau

SEQ ID NO: 963375 - RNA, 19 nt, Homo sapiens
cagagugaaugcuaagaug

SEQ ID NO: 963376 - RNA, 19 nt, Homo sapiens
ucacagcccugagcacaga

SEQ ID NO: 963377 - RNA, 19 nt, Homo sapiens
caagacgccuuaugauacu

SEQ ID NO: 963378 - RNA, 19 nt, Homo sapiens
ggaaagcaaacgaauccaa

SEQ ID NO: 963379 - RNA, 19 nt, Homo sapiens
ggagauaaacaaaggaaag

SEQ ID NO: 963380 - RNA, 19 nt, Homo sapiens
agauauggcugaggaauuc

SEQ ID NO: 963381 - RNA, 19 nt, Homo sapiens
cacagucacucgaacaaga

SEQ ID NO: 963382 - RNA, 19 nt, Homo sapiens
gcaauucgagacuacaaga

SEQ ID NO: 963383 - RNA, 19 nt, Homo sapiens
ccaagacgccuuaugauac

SEQ ID NO: 963384 - RNA, 19 nt, Homo sapiens
aagagcagcuuuccaacga

SEQ ID NO: 963385 - RNA, 19 nt, Homo sapiens
ccaaggcaauucgagacua

SEQ ID NO: 963386 - RNA, 19 nt, Homo sapiens
gugcccaggugcuuagaaa

SEQ ID NO: 963387 - RNA, 19 nt, Homo sapiens
caggaaagccagucagaga

SEQ ID NO: 963388 - RNA, 19 nt, Homo sapiens
ugagaguaaugacaacgaa

SEQ ID NO: 963389 - RNA, 19 nt, Homo sapiens
aaacuuggagggagcagua

SEQ ID NO: 963390 - RNA, 19 nt, Homo sapiens
gaagaaaagccacaggaaa

SEQ ID NO: 963391 - RNA, 19 nt, Homo sapiens
gcccagccaugucuucuca

SEQ ID NO: 963392 - RNA, 19 nt, Homo sapiens
gauaaacaaaggaaagcaa

SEQ ID NO: 963393 - RNA, 19 nt, Homo sapiens
agaguaaugacaacgaaua

SEQ ID NO: 963394 - RNA, 19 nt, Homo sapiens
caaaggaaagcaaacgaau

SEQ ID NO: 963395 - RNA, 19 nt, Homo sapiens
acgauaaacucaggacuug

SEQ ID NO: 963396 - RNA, 19 nt, Homo sapiens
aagauucucccgacgauaa

SEQ ID NO: 963397 - RNA, 19 nt, Homo sapiens
gagacuggaaucagaaaga

SEQ ID NO: 963398 - RNA, 19 nt, Homo sapiens
gacgcagagugaaugcuaa

SEQ ID NO: 963399 - RNA, 19 nt, Homo sapiens
ggcggagacuggaaucaga

SEQ ID NO: 963400 - RNA, 19 nt, Homo sapiens
gagaaauauuugcagaaac

SEQ ID NO: 963401 - RNA, 19 nt, Homo sapiens
ucaaaucuguggccaagac

SEQ ID NO: 963402 - RNA, 19 nt, Homo sapiens
uuagagagacagacgaauu

SEQ ID NO: 963403 - RNA, 19 nt, Homo sapiens
gcagagugaaugcuaagau

SEQ ID NO: 963404 - RNA, 19 nt, Homo sapiens
gagagaaagugccccagaa

SEQ ID NO: 963405 - RNA, 19 nt, Homo sapiens
aaguugagccuuugaauuc

SEQ ID NO: 963406 - RNA, 19 nt, Homo sapiens
gacgauaaacucaggacuu

SEQ ID NO: 963407 - RNA, 19 nt, Homo sapiens
gaagaggcccagucuagac

SEQ ID NO: 963408 - RNA, 19 nt, Homo sapiens
caaggcaauucgagacuac

SEQ ID NO: 963409 - RNA, 19 nt, Homo sapiens
gaguaaugacaacgaauau

SEQ ID NO: 963410 - RNA, 19 nt, Homo sapiens
augcuaagaugccggugua

SEQ ID NO: 963411 - RNA, 19 nt, Homo sapiens
caacuacgauccgcuuucg

SEQ ID NO: 963412 - RNA, 19 nt, Homo sapiens
gagaaagugccccagaaua

SEQ ID NO: 963413 - RNA, 19 nt, Homo sapiens
gaagauucucccgacgaua

SEQ ID NO: 963414 - RNA, 19 nt, Homo sapiens
cugcacagcucuggugaga

SEQ ID NO: 963415 - RNA, 19 nt, Homo sapiens
gcacucucuucaccaaagu

SEQ ID NO: 963416 - RNA, 19 nt, Homo sapiens
ccagccaugucuucucaga

SEQ ID NO: 963417 - RNA, 19 nt, Homo sapiens
aagaagaggcccagucuag

SEQ ID NO: 963418 - RNA, 19 nt, Homo sapiens
gccaccgacugcucauuug

SEQ ID NO: 963419 - RNA, 19 nt, Homo sapiens
aaacacccuaguuguaauu

SEQ ID NO: 963420 - RNA, 19 nt, Homo sapiens
ccagaaccuuuaacuuggu

SEQ ID NO: 963421 - RNA, 19 nt, Homo sapiens
gacuugccuugcagauaaa

SEQ ID NO: 963422 - RNA, 19 nt, Homo sapiens
gcugauggccaaggcaauu

SEQ ID NO: 963423 - RNA, 19 nt, Homo sapiens
uggccaagacgccuuauga

SEQ ID NO: 963424 - RNA, 19 nt, Homo sapiens
cggcagagaggcaaagaug

SEQ ID NO: 963425 - RNA, 19 nt, Homo sapiens
cuacuuugaucagggagaa

SEQ ID NO: 963426 - RNA, 19 nt, Homo sapiens
uggagaacaccucagaauu

SEQ ID NO: 963427 - RNA, 19 nt, Homo sapiens
gaauucugcaggugucaug

SEQ ID NO: 963428 - RNA, 19 nt, Homo sapiens
gagacuacaagagaagauu

SEQ ID NO: 963429 - RNA, 19 nt, Homo sapiens
gaucugcacguggaaacaa

SEQ ID NO: 963430 - RNA, 19 nt, Homo sapiens
ggaugcaggccaacuacga

SEQ ID NO: 963431 - RNA, 19 nt, Homo sapiens
gcagcccacucugucaugu

SEQ ID NO: 963432 - RNA, 19 nt, Homo sapiens
caagaagaggcccagucua

SEQ ID NO: 963433 - RNA, 19 nt, Homo sapiens
gaagauaugaacgcauugg

SEQ ID NO: 963434 - RNA, 19 nt, Homo sapiens
gacaacgaauauccgaucu

SEQ ID NO: 963435 - RNA, 19 nt, Homo sapiens
acaaaggaaagcaaacgaa

SEQ ID NO: 963436 - RNA, 19 nt, Homo sapiens
ucagaaagacggugaagcu

SEQ ID NO: 963437 - RNA, 19 nt, Homo sapiens
guaaugacaacgaauaucc

SEQ ID NO: 963438 - RNA, 19 nt, Homo sapiens
uagauauggcugaggaauu

SEQ ID NO: 963439 - RNA, 19 nt, Homo sapiens
cuucggacuucaagacaga

SEQ ID NO: 963440 - RNA, 19 nt, Homo sapiens
ucagaauucagaagauaug

SEQ ID NO: 963441 - RNA, 19 nt, Homo sapiens
caaggaggcaagagaaguc

SEQ ID NO: 963442 - RNA, 19 nt, Homo sapiens
caaucacgcacucguuaga

SEQ ID NO: 963443 - RNA, 19 nt, Homo sapiens
ccaggugcuuagaaacaau

SEQ ID NO: 963444 - RNA, 19 nt, Homo sapiens
gcccaggugcuuagaaaca

SEQ ID NO: 963445 - RNA, 19 nt, Homo sapiens
acucaggacuugccuugca

SEQ ID NO: 963446 - RNA, 19 nt, Homo sapiens
gggaagagcuggaaaccaa

SEQ ID NO: 963447 - RNA, 19 nt, Homo sapiens
gcacgcagcugucaagaac

SEQ ID NO: 963448 - RNA, 19 nt, Homo sapiens
caagaaguuugucaacaga

SEQ ID NO: 963449 - RNA, 19 nt, Homo sapiens
cuaaggcugcugcuaauua

SEQ ID NO: 963450 - RNA, 19 nt, Homo sapiens
gaacaugcauauggagaag

SEQ ID NO: 963451 - RNA, 19 nt, Homo sapiens
gcugugagcuguguucugu

SEQ ID NO: 963452 - RNA, 19 nt, Homo sapiens
ggacugacuuccucuuguc

SEQ ID NO: 963453 - RNA, 19 nt, Homo sapiens
gaaaggcaucccaguucua

SEQ ID NO: 963454 - RNA, 19 nt, Homo sapiens
gagcaugccugcccuuugc

SEQ ID NO: 963455 - RNA, 19 nt, Homo sapiens
ccaagaaguuugucaacag

SEQ ID NO: 963456 - RNA, 19 nt, Homo sapiens
acaaugagcucuccuucuc

SEQ ID NO: 963457 - RNA, 19 nt, Homo sapiens
gcugaugucugcacugagu

SEQ ID NO: 963458 - RNA, 19 nt, Homo sapiens
guucuaaggcugcugcuaa

SEQ ID NO: 963459 - RNA, 19 nt, Homo sapiens
cagcugaugucugcacuga

SEQ ID NO: 963460 - RNA, 19 nt, Homo sapiens
ucccugagcuucccaagga

SEQ ID NO: 963461 - RNA, 19 nt, Homo sapiens
ugagggcacugucaucugu

SEQ ID NO: 963462 - RNA, 19 nt, Homo sapiens
gccauugacugcaacuugu

SEQ ID NO: 963463 - RNA, 19 nt, Homo sapiens
gaagagcuggaaaccaaga

SEQ ID NO: 963464 - RNA, 19 nt, Homo sapiens
gaaggcagagcaaccaauc

SEQ ID NO: 963465 - RNA, 19 nt, Homo sapiens
gcugggugccugccucaua

SEQ ID NO: 963466 - RNA, 19 nt, Homo sapiens
caaagugcagcccacauug

SEQ ID NO: 963467 - RNA, 19 nt, Homo sapiens
cccaccagcugaccuagaa

SEQ ID NO: 963468 - RNA, 19 nt, Homo sapiens
uaaggcugcugcuaauuac

SEQ ID NO: 963469 - RNA, 19 nt, Homo sapiens
gcagguggaagcccgugua

SEQ ID NO: 963470 - RNA, 19 nt, Homo sapiens
aaaggcaucccaguucuaa

SEQ ID NO: 963471 - RNA, 19 nt, Homo sapiens
ugaaaggcaucccaguucu

SEQ ID NO: 963472 - RNA, 19 nt, Homo sapiens
cagcagccgucgagguguu

SEQ ID NO: 963473 - RNA, 19 nt, Homo sapiens
acaaagugcagcccacauu

SEQ ID NO: 963474 - RNA, 19 nt, Homo sapiens
cagaugauguccugugacu

SEQ ID NO: 963475 - RNA, 19 nt, Homo sapiens
gaggaaaccaaaagcaaua

SEQ ID NO: 963476 - RNA, 19 nt, Homo sapiens
ugacugcaacuuguucuuu

SEQ ID NO: 963477 - RNA, 19 nt, Homo sapiens
caacccaccagcugaccua

SEQ ID NO: 963478 - RNA, 19 nt, Homo sapiens
uggugacacuguacccaua

SEQ ID NO: 963479 - RNA, 19 nt, Homo sapiens
ucacgcagaggaaaccaaa

SEQ ID NO: 963480 - RNA, 19 nt, Homo sapiens
ccagccagaaggacaauga

SEQ ID NO: 963481 - RNA, 19 nt, Homo sapiens
gguggaagcccguguaagc

SEQ ID NO: 963482 - RNA, 19 nt, Homo sapiens
cuacugcgaggacaacuau

SEQ ID NO: 963483 - RNA, 19 nt, Homo sapiens
ggaaggcagagcaaccaau

SEQ ID NO: 963484 - RNA, 19 nt, Homo sapiens
aagcagcaucuucccauuu

SEQ ID NO: 963485 - RNA, 19 nt, Homo sapiens
ggaccagggagcaaucaca

SEQ ID NO: 963486 - RNA, 19 nt, Homo sapiens
caggagaccccucaacuuu

SEQ ID NO: 963487 - RNA, 19 nt, Homo sapiens
caagcagguuugggucuca

SEQ ID NO: 963488 - RNA, 19 nt, Homo sapiens
gaauaaaacagaugauguc

SEQ ID NO: 963489 - RNA, 19 nt, Homo sapiens
agucccaacuuugaauaaa

SEQ ID NO: 963490 - RNA, 19 nt, Homo sapiens
gaaaccaaaagcaauaaga

SEQ ID NO: 963491 - RNA, 19 nt, Homo sapiens
gacugcaacuuguucuuuu

SEQ ID NO: 963492 - RNA, 19 nt, Homo sapiens
gggccaggagggauugaaa

SEQ ID NO: 963493 - RNA, 19 nt, Homo sapiens
ggagaccccucaacuuugg

SEQ ID NO: 963494 - RNA, 19 nt, Homo sapiens
ugaacaugcauauggagaa

SEQ ID NO: 963495 - RNA, 19 nt, Homo sapiens
gaggagaccauggccuuca

SEQ ID NO: 963496 - RNA, 19 nt, Homo sapiens
agcagcaucuucccauuuc

SEQ ID NO: 963497 - RNA, 19 nt, Homo sapiens
gagaccauggccuucacua

SEQ ID NO: 963498 - RNA, 19 nt, Homo sapiens
ugagcuguguucuguccuu

SEQ ID NO: 963499 - RNA, 19 nt, Homo sapiens
ggcacccugucucgaaaga

SEQ ID NO: 963500 - RNA, 19 nt, Homo sapiens
gacauuggccaugggauca

SEQ ID NO: 963501 - RNA, 19 nt, Homo sapiens
ccucaguacccacaaagug

SEQ ID NO: 963502 - RNA, 19 nt, Homo sapiens
gagcuggaaaccaagaagu

SEQ ID NO: 963503 - RNA, 19 nt, Homo sapiens
aaaaccagcuccagucaca

SEQ ID NO: 963504 - RNA, 19 nt, Homo sapiens
ggcacacucugcgcauguu

SEQ ID NO: 963505 - RNA, 19 nt, Homo sapiens
cagauggugaacaugcaua

SEQ ID NO: 963506 - RNA, 19 nt, Homo sapiens
gccagauggugaacaugca

SEQ ID NO: 963507 - RNA, 19 nt, Homo sapiens
gcacacucugcgcauguug

SEQ ID NO: 963508 - RNA, 19 nt, Homo sapiens
gacaaugagcucuccuucu

SEQ ID NO: 963509 - RNA, 19 nt, Homo sapiens
gggcacacucugcgcaugu

SEQ ID NO: 963510 - RNA, 19 nt, Homo sapiens
uugaaaggcaucccaguuc

SEQ ID NO: 963511 - RNA, 19 nt, Homo sapiens
uggugaacaugcauaugga

SEQ ID NO: 963512 - RNA, 19 nt, Homo sapiens
ggccuuaacucauaucuua

SEQ ID NO: 963513 - RNA, 19 nt, Homo sapiens
gcauugaccucuuccuaua

SEQ ID NO: 963514 - RNA, 19 nt, Homo sapiens
gaacagcauugaccucuuc

SEQ ID NO: 963515 - RNA, 19 nt, Homo sapiens
gcccuggccuuaacucaua

SEQ ID NO: 963516 - RNA, 19 nt, Homo sapiens
ucccagaacugacuccuaa

SEQ ID NO: 963517 - RNA, 19 nt, Homo sapiens
ccaaggaacaaauuaaaug

SEQ ID NO: 963518 - RNA, 19 nt, Homo sapiens
gaaaugaaggcuguggauu

SEQ ID NO: 963519 - RNA, 19 nt, Homo sapiens
guucucaccugccuguuug

SEQ ID NO: 963520 - RNA, 19 nt, Homo sapiens
cuucugagaugcaaagguu

SEQ ID NO: 963521 - RNA, 19 nt, Homo sapiens
guauuaugaugacacauuc

SEQ ID NO: 963522 - RNA, 19 nt, Homo sapiens
acucauaucuuaggcauuc

SEQ ID NO: 963523 - RNA, 19 nt, Homo sapiens
ugaaccacauguuaaggaa

SEQ ID NO: 963524 - RNA, 19 nt, Homo sapiens
guaugaccaucgucuacaa

SEQ ID NO: 963525 - RNA, 19 nt, Homo sapiens
caaguauuaugaugacaca

SEQ ID NO: 963526 - RNA, 19 nt, Homo sapiens
uaaggaagaacguggagaa

SEQ ID NO: 963527 - RNA, 19 nt, Homo sapiens
ggacugagagugagauugc

SEQ ID NO: 963528 - RNA, 19 nt, Homo sapiens
caucaaggcuguuuucauc

SEQ ID NO: 963529 - RNA, 19 nt, Homo sapiens
gauggcggcuugacugaac

SEQ ID NO: 963530 - RNA, 19 nt, Homo sapiens
gcugguugcuggagaacau

SEQ ID NO: 963531 - RNA, 19 nt, Homo sapiens
aaccacauguuaaggaaga

SEQ ID NO: 963532 - RNA, 19 nt, Homo sapiens
gggcucauccuacgagaau

SEQ ID NO: 963533 - RNA, 19 nt, Homo sapiens
ugaccaucgucuacaagaa

SEQ ID NO: 963534 - RNA, 19 nt, Homo sapiens
aaaugaaggcuguggauuc

SEQ ID NO: 963535 - RNA, 19 nt, Homo sapiens
cggcuugacugaacagagu

SEQ ID NO: 963536 - RNA, 19 nt, Homo sapiens
ucucugaaccacauguuaa

SEQ ID NO: 963537 - RNA, 19 nt, Homo sapiens
cagcauugaccucuuccua

SEQ ID NO: 963538 - RNA, 19 nt, Homo sapiens
caaggaacaaauuaaaugg

SEQ ID NO: 963539 - RNA, 19 nt, Homo sapiens
uaauaaaccugcuuuuguc

SEQ ID NO: 963540 - RNA, 19 nt, Homo sapiens
gccaaggaacaaauuaaau

SEQ ID NO: 963541 - RNA, 19 nt, Homo sapiens
ccaggucccucccagaacu

SEQ ID NO: 963542 - RNA, 19 nt, Homo sapiens
gugugauucuggagaguga

SEQ ID NO: 963543 - RNA, 19 nt, Homo sapiens
cuacgagaaugagcugaug

SEQ ID NO: 963544 - RNA, 19 nt, Homo sapiens
ggccaaguauuaugaugac

SEQ ID NO: 963545 - RNA, 19 nt, Homo sapiens
aauggucguuauugaaaug

SEQ ID NO: 963546 - RNA, 19 nt, Homo sapiens
ugaaggagcagaugguuuu

SEQ ID NO: 963547 - RNA, 19 nt, Homo sapiens
ggucguuauugaaaugaag

SEQ ID NO: 963548 - RNA, 19 nt, Homo sapiens
ggauggcggugugauucug

SEQ ID NO: 963549 - RNA, 19 nt, Homo sapiens
ugagagugagauugcauuu

SEQ ID NO: 963550 - RNA, 19 nt, Homo sapiens
ugauccagaaggugaauuu

SEQ ID NO: 963551 - RNA, 19 nt, Homo sapiens
cccagcaagugauccagaa

SEQ ID NO: 963552 - RNA, 19 nt, Homo sapiens
gcccuaauaaaccugcuuu

SEQ ID NO: 963553 - RNA, 19 nt, Homo sapiens
ugccaaggaacaaauuaaa

SEQ ID NO: 963554 - RNA, 19 nt, Homo sapiens
ugaaaugaaggcuguggau

SEQ ID NO: 963555 - RNA, 19 nt, Homo sapiens
gaccaucgucuacaagaac

SEQ ID NO: 963556 - RNA, 19 nt, Homo sapiens
cuaauaaaccugcuuuugu

SEQ ID NO: 963557 - RNA, 19 nt, Homo sapiens
ccucaggagagucaccuuu

SEQ ID NO: 963558 - RNA, 19 nt, Homo sapiens
agaacagcauugaccucuu

SEQ ID NO: 963559 - RNA, 19 nt, Homo sapiens
uaaaccugcuuuugucuuc

SEQ ID NO: 963560 - RNA, 19 nt, Homo sapiens
ccagggcccuaauaaaccu

SEQ ID NO: 963561 - RNA, 19 nt, Homo sapiens
cauggacggagccuucuug

SEQ ID NO: 963562 - RNA, 19 nt, Homo sapiens
ggcugcuggccaaguauua

SEQ ID NO: 963563 - RNA, 19 nt, Homo sapiens
ggagacagaugguacuuua

SEQ ID NO: 963564 - RNA, 19 nt, Homo sapiens
ccaagcacguauuuauuua

SEQ ID NO: 963565 - RNA, 19 nt, Homo sapiens
gaccaucucucuuauuaau

SEQ ID NO: 963566 - RNA, 19 nt, Homo sapiens
gaagggaucucguguuugc

SEQ ID NO: 963567 - RNA, 19 nt, Homo sapiens
gcgcugagauugucuaaag

SEQ ID NO: 963568 - RNA, 19 nt, Homo sapiens
ccacucgacuccauccaua

SEQ ID NO: 963569 - RNA, 19 nt, Homo sapiens
aaucuuggcuaaacucuuu

SEQ ID NO: 963570 - RNA, 19 nt, Homo sapiens
gggauuaacaugaugagua

SEQ ID NO: 963571 - RNA, 19 nt, Homo sapiens
uugaccaucucucuuauua

SEQ ID NO: 963572 - RNA, 19 nt, Homo sapiens
ggauuaacaugaugaguac

SEQ ID NO: 963573 - RNA, 19 nt, Homo sapiens
aaccaaauguucuuucuug

SEQ ID NO: 963574 - RNA, 19 nt, Homo sapiens
cugaagggaucucguguuu

SEQ ID NO: 963575 - RNA, 19 nt, Homo sapiens
ugaacuguguguaaccaua

SEQ ID NO: 963576 - RNA, 19 nt, Homo sapiens
gaccuucucuuagauuaug

SEQ ID NO: 963577 - RNA, 19 nt, Homo sapiens
uaacaccaagcacguauuu

SEQ ID NO: 963578 - RNA, 19 nt, Homo sapiens
gaaguaaaccaaauguucu

SEQ ID NO: 963579 - RNA, 19 nt, Homo sapiens
ccaucucucuuauuaauag

SEQ ID NO: 963580 - RNA, 19 nt, Homo sapiens
gcaguugcauuaccugucu

SEQ ID NO: 963581 - RNA, 19 nt, Homo sapiens
uuaccugucuaccuccuua

SEQ ID NO: 963582 - RNA, 19 nt, Homo sapiens
ccagaaagagcgauuuaug

SEQ ID NO: 963583 - RNA, 19 nt, Homo sapiens
ugaaguaaaccaaauguuc

SEQ ID NO: 963584 - RNA, 19 nt, Homo sapiens
ucacagauaacuaugcaaa

SEQ ID NO: 963585 - RNA, 19 nt, Homo sapiens
uccauacaaucacagauaa

SEQ ID NO: 963586 - RNA, 19 nt, Homo sapiens
acaccaagcacguauuuau

SEQ ID NO: 963587 - RNA, 19 nt, Homo sapiens
uuaaggaggucguggucuu

SEQ ID NO: 963588 - RNA, 19 nt, Homo sapiens
aaguugaccuucucuuaga

SEQ ID NO: 963589 - RNA, 19 nt, Homo sapiens
aauuugaccaucucucuua

SEQ ID NO: 963590 - RNA, 19 nt, Homo sapiens
gaacuguguguaaccauag

SEQ ID NO: 963591 - RNA, 19 nt, Homo sapiens
aaacugaacuguguguaac

SEQ ID NO: 963592 - RNA, 19 nt, Homo sapiens
cagacgcgauggcaaagug

SEQ ID NO: 963593 - RNA, 19 nt, Homo sapiens
uuucuuaagcucccaauuu

SEQ ID NO: 963594 - RNA, 19 nt, Homo sapiens
auuccagccuuaagagaua

SEQ ID NO: 963595 - RNA, 19 nt, Homo sapiens
gcuacgugcucuuguuugg

SEQ ID NO: 963596 - RNA, 19 nt, Homo sapiens
caccaagcacguauuuauu

SEQ ID NO: 963597 - RNA, 19 nt, Homo sapiens
gcagaagaaauaccaagag

SEQ ID NO: 963598 - RNA, 19 nt, Homo sapiens
aucaacagcagaagaaaua

SEQ ID NO: 963599 - RNA, 19 nt, Homo sapiens
auauugggcaguugcauua

SEQ ID NO: 963600 - RNA, 19 nt, Homo sapiens
cagaaagagcgauuuaugg

SEQ ID NO: 963601 - RNA, 19 nt, Homo sapiens
accaagcacguauuuauuu

SEQ ID NO: 963602 - RNA, 19 nt, Homo sapiens
aaucacagauaacuaugca

SEQ ID NO: 963603 - RNA, 19 nt, Homo sapiens
uucuuaagcucccaauuug

SEQ ID NO: 963604 - RNA, 19 nt, Homo sapiens
aaauguaaguugaccuucu

SEQ ID NO: 963605 - RNA, 19 nt, Homo sapiens
gugcucuuguuugggauua

SEQ ID NO: 963606 - RNA, 19 nt, Homo sapiens
uugaccuucucuuagauua

SEQ ID NO: 963607 - RNA, 19 nt, Homo sapiens
guaaaccaaauguucuuuc

SEQ ID NO: 963608 - RNA, 19 nt, Homo sapiens
cuaccuccuuauugcuaua

SEQ ID NO: 963609 - RNA, 19 nt, Homo sapiens
ccuccuuauugcuauagua

SEQ ID NO: 963610 - RNA, 19 nt, Homo sapiens
caccagacgcgauggcaaa

SEQ ID NO: 963611 - RNA, 19 nt, Homo sapiens
gcgauggcaaaguggauaa

SEQ ID NO: 963612 - RNA, 19 nt, Homo sapiens
ugccagaaagagcgauuua

SEQ ID NO: 963613 - RNA, 19 nt, Homo sapiens
aagagcgauuuauggcuuu

SEQ ID NO: 963614 - RNA, 19 nt, Homo sapiens
gaucucguguuugcugagu

SEQ ID NO: 963615 - RNA, 19 nt, Homo sapiens
ccaaauguucuuucuugca

SEQ ID NO: 963616 - RNA, 19 nt, Homo sapiens
ggccauuccagccuuaaga

SEQ ID NO: 963617 - RNA, 19 nt, Homo sapiens
guucuuucuugcagccaaa

SEQ ID NO: 963618 - RNA, 19 nt, Homo sapiens
guaacaccaagcacguauu

SEQ ID NO: 963619 - RNA, 19 nt, Homo sapiens
guaaccauaguaacaccaa

SEQ ID NO: 963620 - RNA, 19 nt, Homo sapiens
uggcuuuguucuuuucuua

SEQ ID NO: 963621 - RNA, 19 nt, Homo sapiens
gauuuauggcuuuguucuu

SEQ ID NO: 963622 - RNA, 19 nt, Homo sapiens
ugaccaucucucuuauuaa

SEQ ID NO: 963623 - RNA, 19 nt, Homo sapiens
gaaucuuggcuaaacucuu

SEQ ID NO: 963624 - RNA, 19 nt, Homo sapiens
ccuggucccugcccuuaag

SEQ ID NO: 963625 - RNA, 19 nt, Homo sapiens
aauguaaguugaccuucuc

SEQ ID NO: 963626 - RNA, 19 nt, Homo sapiens
guguguaaccauaguaaca

SEQ ID NO: 963627 - RNA, 19 nt, Homo sapiens
aaaaucaacagcagaagaa

SEQ ID NO: 963628 - RNA, 19 nt, Homo sapiens
auccauacaaucacagaua

SEQ ID NO: 963629 - RNA, 19 nt, Homo sapiens
ucgacuccauccauacaau

SEQ ID NO: 963630 - RNA, 19 nt, Homo sapiens
uaaggaggucguggucuug

SEQ ID NO: 963631 - RNA, 19 nt, Homo sapiens
caauuuggcuucauacuuu

SEQ ID NO: 963632 - RNA, 19 nt, Homo sapiens
ccaagcacguauuuauuua

SEQ ID NO: 963633 - RNA, 19 nt, Homo sapiens
gcacaucgcugacgcugau

SEQ ID NO: 963634 - RNA, 19 nt, Homo sapiens
gaccaucucucuuauuaau

SEQ ID NO: 963635 - RNA, 19 nt, Homo sapiens
ccacucgacuccauccaua

SEQ ID NO: 963636 - RNA, 19 nt, Homo sapiens
aaucuuggcuaaacucuuu

SEQ ID NO: 963637 - RNA, 19 nt, Homo sapiens
gggauuaacaugaugagua

SEQ ID NO: 963638 - RNA, 19 nt, Homo sapiens
uugaccaucucucuuauua

SEQ ID NO: 963639 - RNA, 19 nt, Homo sapiens
ggauuaacaugaugaguac

SEQ ID NO: 963640 - RNA, 19 nt, Homo sapiens
caauauugcauucccauaa

SEQ ID NO: 963641 - RNA, 19 nt, Homo sapiens
aaccaaauguucuuucuug

SEQ ID NO: 963642 - RNA, 19 nt, Homo sapiens
ugaacuguguguaaccaua

SEQ ID NO: 963643 - RNA, 19 nt, Homo sapiens
gaccuucucuuagauuaug

SEQ ID NO: 963644 - RNA, 19 nt, Homo sapiens
uaacaccaagcacguauuu

SEQ ID NO: 963645 - RNA, 19 nt, Homo sapiens
gaaguaaaccaaauguucu

SEQ ID NO: 963646 - RNA, 19 nt, Homo sapiens
ccaucucucuuauuaauag

SEQ ID NO: 963647 - RNA, 19 nt, Homo sapiens
gcaguugcauuaccugucu

SEQ ID NO: 963648 - RNA, 19 nt, Homo sapiens
uuaccugucuaccuccuua

SEQ ID NO: 963649 - RNA, 19 nt, Homo sapiens
ccagaaagagcgauuuaug

SEQ ID NO: 963650 - RNA, 19 nt, Homo sapiens
ugaaguaaaccaaauguuc

SEQ ID NO: 963651 - RNA, 19 nt, Homo sapiens
ucacagauaacuaugcaaa

SEQ ID NO: 963652 - RNA, 19 nt, Homo sapiens
uccauacaaucacagauaa

SEQ ID NO: 963653 - RNA, 19 nt, Homo sapiens
acaccaagcacguauuuau

SEQ ID NO: 963654 - RNA, 19 nt, Homo sapiens
aaguugaccuucucuuaga

SEQ ID NO: 963655 - RNA, 19 nt, Homo sapiens
aauuugaccaucucucuua

SEQ ID NO: 963656 - RNA, 19 nt, Homo sapiens
gaacuguguguaaccauag

SEQ ID NO: 963657 - RNA, 19 nt, Homo sapiens
aaacugaacuguguguaac

SEQ ID NO: 963658 - RNA, 19 nt, Homo sapiens
uuucuuaagcucccaauuu

SEQ ID NO: 963659 - RNA, 19 nt, Homo sapiens
auuccagccuuaagagaua

SEQ ID NO: 963660 - RNA, 19 nt, Homo sapiens
gcuacgugcucuuguuugg

SEQ ID NO: 963661 - RNA, 19 nt, Homo sapiens
caccaagcacguauuuauu

SEQ ID NO: 963662 - RNA, 19 nt, Homo sapiens
gcagaagaaauaccaagag

SEQ ID NO: 963663 - RNA, 19 nt, Homo sapiens
aucaacagcagaagaaaua

SEQ ID NO: 963664 - RNA, 19 nt, Homo sapiens
auauugggcaguugcauua

SEQ ID NO: 963665 - RNA, 19 nt, Homo sapiens
accaagcacguauuuauuu

SEQ ID NO: 963666 - RNA, 19 nt, Homo sapiens
cagaaagagcgauuuaugg

SEQ ID NO: 963667 - RNA, 19 nt, Homo sapiens
aaucacagauaacuaugca

SEQ ID NO: 963668 - RNA, 19 nt, Homo sapiens
uucuuaagcucccaauuug

SEQ ID NO: 963669 - RNA, 19 nt, Homo sapiens
aaauguaaguugaccuucu

SEQ ID NO: 963670 - RNA, 19 nt, Homo sapiens
gugcucuuguuugggauua

SEQ ID NO: 963671 - RNA, 19 nt, Homo sapiens
uugaccuucucuuagauua

SEQ ID NO: 963672 - RNA, 19 nt, Homo sapiens
guaaaccaaauguucuuuc

SEQ ID NO: 963673 - RNA, 19 nt, Homo sapiens
cuaccuccuuauugcuaua

SEQ ID NO: 963674 - RNA, 19 nt, Homo sapiens
ggagcgaggaggcgagaau

SEQ ID NO: 963675 - RNA, 19 nt, Homo sapiens
ccuccuuauugcuauagua

SEQ ID NO: 963676 - RNA, 19 nt, Homo sapiens
uuccacagauugucuaaag

SEQ ID NO: 963677 - RNA, 19 nt, Homo sapiens
ugccagaaagagcgauuua

SEQ ID NO: 963678 - RNA, 19 nt, Homo sapiens
ccaaauguucuuucuugca

SEQ ID NO: 963679 - RNA, 19 nt, Homo sapiens
aagagcgauuuauggcuuu

SEQ ID NO: 963680 - RNA, 19 nt, Homo sapiens
ggccauuccagccuuaaga

SEQ ID NO: 963681 - RNA, 19 nt, Homo sapiens
guucuuucuugcagccaaa

SEQ ID NO: 963682 - RNA, 19 nt, Homo sapiens
aggcgagaauggaucaaug

SEQ ID NO: 963683 - RNA, 19 nt, Homo sapiens
gcgaggaggcgagaaugga

SEQ ID NO: 963684 - RNA, 19 nt, Homo sapiens
guaacaccaagcacguauu

SEQ ID NO: 963685 - RNA, 19 nt, Homo sapiens
guaaccauaguaacaccaa

SEQ ID NO: 963686 - RNA, 19 nt, Homo sapiens
acaauauugcauucccaua

SEQ ID NO: 963687 - RNA, 19 nt, Homo sapiens
uggcuuuguucuuuucuua

SEQ ID NO: 963688 - RNA, 19 nt, Homo sapiens
gauuuauggcuuuguucuu

SEQ ID NO: 963689 - RNA, 19 nt, Homo sapiens
ugaccaucucucuuauuaa

SEQ ID NO: 963690 - RNA, 19 nt, Homo sapiens
gaaucuuggcuaaacucuu

SEQ ID NO: 963691 - RNA, 19 nt, Homo sapiens
aauguaaguugaccuucuc

SEQ ID NO: 963692 - RNA, 19 nt, Homo sapiens
gagcgaggaggcgagaaug

SEQ ID NO: 963693 - RNA, 19 nt, Homo sapiens
guguguaaccauaguaaca

SEQ ID NO: 963694 - RNA, 19 nt, Homo sapiens
aaaaucaacagcagaagaa

SEQ ID NO: 963695 - RNA, 19 nt, Homo sapiens
auccauacaaucacagaua

SEQ ID NO: 963696 - RNA, 19 nt, Homo sapiens
ucgacuccauccauacaau

SEQ ID NO: 963697 - RNA, 19 nt, Homo sapiens
cgcugacgcugauuguguu

SEQ ID NO: 963698 - RNA, 19 nt, Homo sapiens
caauuuggcuucauacuuu

SEQ ID NO: 963699 - RNA, 19 nt, Homo sapiens
ccaagcacguauuuauuua

SEQ ID NO: 963700 - RNA, 19 nt, Homo sapiens
gaccaucucucuuauuaau

SEQ ID NO: 963701 - RNA, 19 nt, Homo sapiens
gcgcugagauugucuaaag

SEQ ID NO: 963702 - RNA, 19 nt, Homo sapiens
ccacucgacuccauccaua

SEQ ID NO: 963703 - RNA, 19 nt, Homo sapiens
aaucuuggcuaaacucuuu

SEQ ID NO: 963704 - RNA, 19 nt, Homo sapiens
gggauuaacaugaugagua

SEQ ID NO: 963705 - RNA, 19 nt, Homo sapiens
uugaccaucucucuuauua

SEQ ID NO: 963706 - RNA, 19 nt, Homo sapiens
ggauuaacaugaugaguac

SEQ ID NO: 963707 - RNA, 19 nt, Homo sapiens
aaccaaauguucuuucuug

SEQ ID NO: 963708 - RNA, 19 nt, Homo sapiens
ugaacuguguguaaccaua

SEQ ID NO: 963709 - RNA, 19 nt, Homo sapiens
gaccuucucuuagauuaug

SEQ ID NO: 963710 - RNA, 19 nt, Homo sapiens
uaacaccaagcacguauuu

SEQ ID NO: 963711 - RNA, 19 nt, Homo sapiens
gaaguaaaccaaauguucu

SEQ ID NO: 963712 - RNA, 19 nt, Homo sapiens
ccaucucucuuauuaauag

SEQ ID NO: 963713 - RNA, 19 nt, Homo sapiens
gcaguugcauuaccugucu

SEQ ID NO: 963714 - RNA, 19 nt, Homo sapiens
uuaccugucuaccuccuua

SEQ ID NO: 963715 - RNA, 19 nt, Homo sapiens
ccagaaagagcgauuuaug

SEQ ID NO: 963716 - RNA, 19 nt, Homo sapiens
ugaaguaaaccaaauguuc

SEQ ID NO: 963717 - RNA, 19 nt, Homo sapiens
ucacagauaacuaugcaaa

SEQ ID NO: 963718 - RNA, 19 nt, Homo sapiens
uccauacaaucacagauaa

SEQ ID NO: 963719 - RNA, 19 nt, Homo sapiens
acaccaagcacguauuuau

SEQ ID NO: 963720 - RNA, 19 nt, Homo sapiens
aaguugaccuucucuuaga

SEQ ID NO: 963721 - RNA, 19 nt, Homo sapiens
aauuugaccaucucucuua

SEQ ID NO: 963722 - RNA, 19 nt, Homo sapiens
gaacuguguguaaccauag

SEQ ID NO: 963723 - RNA, 19 nt, Homo sapiens
aaacugaacuguguguaac

SEQ ID NO: 963724 - RNA, 19 nt, Homo sapiens
uuucuuaagcucccaauuu

SEQ ID NO: 963725 - RNA, 19 nt, Homo sapiens
auuccagccuuaagagaua

SEQ ID NO: 963726 - RNA, 19 nt, Homo sapiens
gcuacgugcucuuguuugg

SEQ ID NO: 963727 - RNA, 19 nt, Homo sapiens
caccaagcacguauuuauu

SEQ ID NO: 963728 - RNA, 19 nt, Homo sapiens
gcagaagaaauaccaagag

SEQ ID NO: 963729 - RNA, 19 nt, Homo sapiens
aucaacagcagaagaaaua

SEQ ID NO: 963730 - RNA, 19 nt, Homo sapiens
auauugggcaguugcauua

SEQ ID NO: 963731 - RNA, 19 nt, Homo sapiens
accaagcacguauuuauuu

SEQ ID NO: 963732 - RNA, 19 nt, Homo sapiens
cagaaagagcgauuuaugg

SEQ ID NO: 963733 - RNA, 19 nt, Homo sapiens
aaucacagauaacuaugca

SEQ ID NO: 963734 - RNA, 19 nt, Homo sapiens
uucuuaagcucccaauuug

SEQ ID NO: 963735 - RNA, 19 nt, Homo sapiens
aaauguaaguugaccuucu

SEQ ID NO: 963736 - RNA, 19 nt, Homo sapiens
gugcucuuguuugggauua

SEQ ID NO: 963737 - RNA, 19 nt, Homo sapiens
uugaccuucucuuagauua

SEQ ID NO: 963738 - RNA, 19 nt, Homo sapiens
guaaaccaaauguucuuuc

SEQ ID NO: 963739 - RNA, 19 nt, Homo sapiens
cuaccuccuuauugcuaua

SEQ ID NO: 963740 - RNA, 19 nt, Homo sapiens
ccuccuuauugcuauagua

SEQ ID NO: 963741 - RNA, 19 nt, Homo sapiens
ugccagaaagagcgauuua

SEQ ID NO: 963742 - RNA, 19 nt, Homo sapiens
ccaaauguucuuucuugca

SEQ ID NO: 963743 - RNA, 19 nt, Homo sapiens
aagagcgauuuauggcuuu

SEQ ID NO: 963744 - RNA, 19 nt, Homo sapiens
ggccauuccagccuuaaga

SEQ ID NO: 963745 - RNA, 19 nt, Homo sapiens
guucuuucuugcagccaaa

SEQ ID NO: 963746 - RNA, 19 nt, Homo sapiens
guaacaccaagcacguauu

SEQ ID NO: 963747 - RNA, 19 nt, Homo sapiens
guaaccauaguaacaccaa

SEQ ID NO: 963748 - RNA, 19 nt, Homo sapiens
gauuuauggcuuuguucuu

SEQ ID NO: 963749 - RNA, 19 nt, Homo sapiens
uggcuuuguucuuuucuua

SEQ ID NO: 963750 - RNA, 19 nt, Homo sapiens
ugaccaucucucuuauuaa

SEQ ID NO: 963751 - RNA, 19 nt, Homo sapiens
gaaucuuggcuaaacucuu

SEQ ID NO: 963752 - RNA, 19 nt, Homo sapiens
aauguaaguugaccuucuc

SEQ ID NO: 963753 - RNA, 19 nt, Homo sapiens
guguguaaccauaguaaca

SEQ ID NO: 963754 - RNA, 19 nt, Homo sapiens
aaaaucaacagcagaagaa

SEQ ID NO: 963755 - RNA, 19 nt, Homo sapiens
auccauacaaucacagaua

SEQ ID NO: 963756 - RNA, 19 nt, Homo sapiens
ucgacuccauccauacaau

SEQ ID NO: 963757 - RNA, 19 nt, Homo sapiens
gagcugagaucgcaccauu

SEQ ID NO: 963758 - RNA, 19 nt, Homo sapiens
cuaaaggaccaguaaauaa

SEQ ID NO: 963759 - RNA, 19 nt, Homo sapiens
acgcugagcuuaacuacaa

SEQ ID NO: 963760 - RNA, 19 nt, Homo sapiens
gagcgaaacucugucucaa

SEQ ID NO: 963761 - RNA, 19 nt, Homo sapiens
agauggcccucaagaagua

SEQ ID NO: 963762 - RNA, 19 nt, Homo sapiens
gacauaagcggcaacauca

SEQ ID NO: 963763 - RNA, 19 nt, Homo sapiens
gcgaaacucugucucaaaa

SEQ ID NO: 963764 - RNA, 19 nt, Homo sapiens
uaacacuucuaaugaguca

SEQ ID NO: 963765 - RNA, 19 nt, Homo sapiens
gaaacaggcaaaccagaau

SEQ ID NO: 963766 - RNA, 19 nt, Homo sapiens
ucuaaugagucaaguccua

SEQ ID NO: 963767 - RNA, 19 nt, Homo sapiens
cagcacagacugacuuuau

SEQ ID NO: 963768 - RNA, 19 nt, Homo sapiens
gaugaacgcugagcuuaac

SEQ ID NO: 963769 - RNA, 19 nt, Homo sapiens
gaucuuacuuccaaaucuc

SEQ ID NO: 963770 - RNA, 19 nt, Homo sapiens
ucuaaaggaccaguaaaua

SEQ ID NO: 963771 - RNA, 19 nt, Homo sapiens
cagacugacuuuauaccuu

SEQ ID NO: 963772 - RNA, 19 nt, Homo sapiens
cagaugaacgcugagcuua

SEQ ID NO: 963773 - RNA, 19 nt, Homo sapiens
gcaggagaaucgcuugaac

SEQ ID NO: 963774 - RNA, 19 nt, Homo sapiens
gaaaccccaucgcuacuaa

SEQ ID NO: 963775 - RNA, 19 nt, Homo sapiens
gcacagacugacuuuauac

SEQ ID NO: 963776 - RNA, 19 nt, Homo sapiens
gagcagaguggcccaaagu

SEQ ID NO: 963777 - RNA, 19 nt, Homo sapiens
ucauccaccucgcuuuaaa

SEQ ID NO: 963778 - RNA, 19 nt, Homo sapiens
cgagauggcccucaagaag

SEQ ID NO: 963779 - RNA, 19 nt, Homo sapiens
ggagguggagaaagaaaug

SEQ ID NO: 963780 - RNA, 19 nt, Homo sapiens
gagauguacacccagauga

SEQ ID NO: 963781 - RNA, 19 nt, Homo sapiens
gagauggcccucaagaagu

SEQ ID NO: 963782 - RNA, 19 nt, Homo sapiens
gcagaguggcccaaaguag

SEQ ID NO: 963783 - RNA, 19 nt, Homo sapiens
caccaaggccuacgagaug

SEQ ID NO: 963784 - RNA, 19 nt, Homo sapiens
agcacagacugacuuuaua

SEQ ID NO: 963785 - RNA, 19 nt, Homo sapiens
guacgcagcacccuauaag

SEQ ID NO: 963786 - RNA, 19 nt, Homo sapiens
ggagaaagaaauguaugga

SEQ ID NO: 963787 - RNA, 19 nt, Homo sapiens
ugucauccaccucgcuuua

SEQ ID NO: 963788 - RNA, 19 nt, Homo sapiens
cgacagcacagacugacuu

SEQ ID NO: 963789 - RNA, 19 nt, Homo sapiens
gcgcugauguggcugaaaa

SEQ ID NO: 963790 - RNA, 19 nt, Homo sapiens
aaggaccaguaaauaauga

SEQ ID NO: 963791 - RNA, 19 nt, Homo sapiens
agacauaagcggcaacauc

SEQ ID NO: 963792 - RNA, 19 nt, Homo sapiens
gaaucaagucggugaacug

SEQ ID NO: 963793 - RNA, 19 nt, Homo sapiens
agaaacaggcaaaccagaa

SEQ ID NO: 963794 - RNA, 19 nt, Homo sapiens
gcugcuggccgaacacuug

SEQ ID NO: 963795 - RNA, 19 nt, Homo sapiens
ggagcagaguggcccaaag

SEQ ID NO: 963796 - RNA, 19 nt, Homo sapiens
gacuuuauaccuucauuuc

SEQ ID NO: 963797 - RNA, 19 nt, Homo sapiens
caacaucacgaaaaucaaa

SEQ ID NO: 963798 - RNA, 19 nt, Homo sapiens
gcgcacgccuguaguucca

SEQ ID NO: 963799 - RNA, 19 nt, Homo sapiens
ccuguaaucccagcacuuu

SEQ ID NO: 963800 - RNA, 19 nt, Homo sapiens
gagucaaguccuaggguuu

SEQ ID NO: 963801 - RNA, 19 nt, Homo sapiens
aaaggaccaguaaauaaug

SEQ ID NO: 963802 - RNA, 19 nt, Homo sapiens
gaggagugccuggagaaga

SEQ ID NO: 963803 - RNA, 19 nt, Homo sapiens
ccaccaaggccuacgagau

SEQ ID NO: 963804 - RNA, 19 nt, Homo sapiens
gaacgcugagcuuaacuac

SEQ ID NO: 963805 - RNA, 19 nt, Homo sapiens
caucaaggcagacauaagc

SEQ ID NO: 963806 - RNA, 19 nt, Homo sapiens
aggagugccuggagaagau

SEQ ID NO: 963807 - RNA, 19 nt, Homo sapiens
acaccaacccagccaaguu

SEQ ID NO: 963808 - RNA, 19 nt, Homo sapiens
ccuacgagauggcccucaa

SEQ ID NO: 963809 - RNA, 19 nt, Homo sapiens
gacagcacagacugacuuu

SEQ ID NO: 963810 - RNA, 19 nt, Homo sapiens
ccagaugaacgcugagcuu

SEQ ID NO: 963811 - RNA, 19 nt, Homo sapiens
aaagaggccuccgcuucau

SEQ ID NO: 963812 - RNA, 19 nt, Homo sapiens
uccuggagguggagaaaga

SEQ ID NO: 963813 - RNA, 19 nt, Homo sapiens
agaugaacgcugagcuuaa

SEQ ID NO: 963814 - RNA, 19 nt, Homo sapiens
gcuggaucgugcagaagau

SEQ ID NO: 963815 - RNA, 19 nt, Homo sapiens
gguggagaaagaaauguau

SEQ ID NO: 963816 - RNA, 19 nt, Homo sapiens
gaaaaucaaagcuguguac

SEQ ID NO: 963817 - RNA, 19 nt, Homo sapiens
ucacgacagcacagacuga

SEQ ID NO: 963818 - RNA, 19 nt, Homo sapiens
gcugagaucgcaccauugc

SEQ ID NO: 963819 - RNA, 19 nt, Homo sapiens
ugaacgcugagcuuaacua

SEQ ID NO: 963820 - RNA, 19 nt, Homo sapiens
cgagauguacacccagaug

SEQ ID NO: 963821 - RNA, 19 nt, Homo sapiens
acacggcgaccaucgaugu

SEQ ID NO: 963822 - RNA, 19 nt, Homo sapiens
aaaauuagcugggcauggu

SEQ ID NO: 963823 - RNA, 19 nt, Homo sapiens
ccugaggucgggaguuuga

SEQ ID NO: 963824 - RNA, 19 nt, Homo sapiens
cuuuauaccuucauuucag

SEQ ID NO: 963825 - RNA, 19 nt, Homo sapiens
ugaucuuacuuccaaaucu

SEQ ID NO: 963826 - RNA, 19 nt, Homo sapiens
ggaccaguaaauaaugauc

SEQ ID NO: 963827 - RNA, 19 nt, Homo sapiens
uuuggucuauucuaaagga

SEQ ID NO: 963828 - RNA, 19 nt, Homo sapiens
caccaacccagccaaguuc

SEQ ID NO: 963829 - RNA, 19 nt, Homo sapiens
caaagaagauaaacccuua

SEQ ID NO: 963830 - RNA, 19 nt, Homo sapiens
ggauggaucuucugaauuu

SEQ ID NO: 963831 - RNA, 19 nt, Homo sapiens
gaaggaauaugucuccaaa

SEQ ID NO: 963832 - RNA, 19 nt, Homo sapiens
gaagauaaacccuuaaaga

SEQ ID NO: 963833 - RNA, 19 nt, Homo sapiens
gcaaaguuguggacuguuu

SEQ ID NO: 963834 - RNA, 19 nt, Homo sapiens
gaaggaaaguuaaucuguu

SEQ ID NO: 963835 - RNA, 19 nt, Homo sapiens
gaaauacaccuguuauguu

SEQ ID NO: 963836 - RNA, 19 nt, Homo sapiens
gaaaaguacucauccauuu

SEQ ID NO: 963837 - RNA, 19 nt, Homo sapiens
ggaaagagggcuugcauga

SEQ ID NO: 963838 - RNA, 19 nt, Homo sapiens
gaugugaagucccauuaaa

SEQ ID NO: 963839 - RNA, 19 nt, Homo sapiens
gaagaaagacaaagaagau

SEQ ID NO: 963840 - RNA, 19 nt, Homo sapiens
gagagaaguuuaaagaaca

SEQ ID NO: 963841 - RNA, 19 nt, Homo sapiens
guacuuacacugugaaauu

SEQ ID NO: 963842 - RNA, 19 nt, Homo sapiens
gaacuacucccaucagaau

SEQ ID NO: 963843 - RNA, 19 nt, Homo sapiens
caaggaaucugaagaaggu

SEQ ID NO: 963844 - RNA, 19 nt, Homo sapiens
gaaaguuaaucuguucuga

SEQ ID NO: 963845 - RNA, 19 nt, Homo sapiens
ugacaaagcauccaccuaa

SEQ ID NO: 963846 - RNA, 19 nt, Homo sapiens
gaggauggaucuucugaau

SEQ ID NO: 963847 - RNA, 19 nt, Homo sapiens
caagcagccugauaaagaa

SEQ ID NO: 963848 - RNA, 19 nt, Homo sapiens
gcuccaagcuauagaacuu

SEQ ID NO: 963849 - RNA, 19 nt, Homo sapiens
ccaagcagccugauaaaga

SEQ ID NO: 963850 - RNA, 19 nt, Homo sapiens
uaacaaggaugguacuuac

SEQ ID NO: 963851 - RNA, 19 nt, Homo sapiens
cgaccuagaccauaaguuu

SEQ ID NO: 963852 - RNA, 19 nt, Homo sapiens
gauucaaacucucaaacuu

SEQ ID NO: 963853 - RNA, 19 nt, Homo sapiens
ccaaagaucagaauauugu

SEQ ID NO: 963854 - RNA, 19 nt, Homo sapiens
guauccagcucacauagaa

SEQ ID NO: 963855 - RNA, 19 nt, Homo sapiens
uggaaucucuucaggauga

SEQ ID NO: 963856 - RNA, 19 nt, Homo sapiens
aaagagggcuugcaugaag

SEQ ID NO: 963857 - RNA, 19 nt, Homo sapiens
gaccauaaguuuagaugca

SEQ ID NO: 963858 - RNA, 19 nt, Homo sapiens
caaagucacugcuguuaac

SEQ ID NO: 963859 - RNA, 19 nt, Homo sapiens
aaauacagcugaggaaaga

SEQ ID NO: 963860 - RNA, 19 nt, Homo sapiens
gagaacuacucccaucaga

SEQ ID NO: 963861 - RNA, 19 nt, Homo sapiens
gcagugaggagaucaguga

SEQ ID NO: 963862 - RNA, 19 nt, Homo sapiens
gaagaaauucaaggaguuu

SEQ ID NO: 963863 - RNA, 19 nt, Homo sapiens
uacaagagauuucgacugu

SEQ ID NO: 963864 - RNA, 19 nt, Homo sapiens
cagcaccaguggcaguuua

SEQ ID NO: 963865 - RNA, 19 nt, Homo sapiens
gaggauaauuugagugagu

SEQ ID NO: 963866 - RNA, 19 nt, Homo sapiens
gaaacaucccugucacuga

SEQ ID NO: 963867 - RNA, 19 nt, Homo sapiens
guugaagucugcuuuggaa

SEQ ID NO: 963868 - RNA, 19 nt, Homo sapiens
uagaagacauugacuacga

SEQ ID NO: 963869 - RNA, 19 nt, Homo sapiens
ccacaaagggaaagugaaa

SEQ ID NO: 963870 - RNA, 19 nt, Homo sapiens
ggaaagaggcauguccaaa

SEQ ID NO: 963871 - RNA, 19 nt, Homo sapiens
gaccuagaccauaaguuua

SEQ ID NO: 963872 - RNA, 19 nt, Homo sapiens
ccuccaggcuguccacuaa

SEQ ID NO: 963873 - RNA, 19 nt, Homo sapiens
ggaggaggauaauuugagu

SEQ ID NO: 963874 - RNA, 19 nt, Homo sapiens
cuacugcuguggauucaaa

SEQ ID NO: 963875 - RNA, 19 nt, Homo sapiens
cgagagaaguuuaaagaac

SEQ ID NO: 963876 - RNA, 19 nt, Homo sapiens
gaugguacuuacacuguga

SEQ ID NO: 963877 - RNA, 19 nt, Homo sapiens
gaaagagggcuugcaugaa

SEQ ID NO: 963878 - RNA, 19 nt, Homo sapiens
gcucaagcauuguaucaag

SEQ ID NO: 963879 - RNA, 19 nt, Homo sapiens
gagugaagccaaagaagaa

SEQ ID NO: 963880 - RNA, 19 nt, Homo sapiens
gaaagaggcauguccaaac

SEQ ID NO: 963881 - RNA, 19 nt, Homo sapiens
gauccugacuugguuguau

SEQ ID NO: 963882 - RNA, 19 nt, Homo sapiens
gacccaagcagccugauaa

SEQ ID NO: 963883 - RNA, 19 nt, Homo sapiens
caacagugaaugugaagaa

SEQ ID NO: 963884 - RNA, 19 nt, Homo sapiens
agaagaaauucaaggaguu

SEQ ID NO: 963885 - RNA, 19 nt, Homo sapiens
gaacugagaagaaggaaaa

SEQ ID NO: 963886 - RNA, 19 nt, Homo sapiens
ucacugcuguuaacaagga

SEQ ID NO: 963887 - RNA, 19 nt, Homo sapiens
gagaaggaguuggaugugu

SEQ ID NO: 963888 - RNA, 19 nt, Homo sapiens
ucaaggaguuugugagagu

SEQ ID NO: 963889 - RNA, 19 nt, Homo sapiens
aagccaaacuguugcacua

SEQ ID NO: 963890 - RNA, 19 nt, Homo sapiens
ccgcaaagccaaacuguug

SEQ ID NO: 963891 - RNA, 19 nt, Homo sapiens
gugaagaguccacaagaaa

SEQ ID NO: 963892 - RNA, 19 nt, Homo sapiens
cagugaaugugaagaaaga

SEQ ID NO: 963893 - RNA, 19 nt, Homo sapiens
ccaaacuguugcacuauca

SEQ ID NO: 963894 - RNA, 19 nt, Homo sapiens
aaguuuagaugcaaaguug

SEQ ID NO: 963895 - RNA, 19 nt, Homo sapiens
gauuucgacuguggaagua

SEQ ID NO: 963896 - RNA, 19 nt, Homo sapiens
aaacacugacaaagacuua

SEQ ID NO: 963897 - RNA, 19 nt, Homo sapiens
agaaggaguuggauguguu

SEQ ID NO: 963898 - RNA, 19 nt, Homo sapiens
gggcuggccucuagaccaa

SEQ ID NO: 963899 - RNA, 19 nt, Homo sapiens
caacccagaugaggaacuu

SEQ ID NO: 963900 - RNA, 19 nt, Homo sapiens
caaaguuguggacuguuua

SEQ ID NO: 963901 - RNA, 19 nt, Homo sapiens
gagaugcccaaguggauaa

SEQ ID NO: 963902 - RNA, 19 nt, Homo sapiens
ggagaaaacacgaugaaaa

SEQ ID NO: 963903 - RNA, 19 nt, Homo sapiens
ugaagaaggucaguugaag

SEQ ID NO: 963904 - RNA, 19 nt, Homo sapiens
ggagaugcccaaguggaua

SEQ ID NO: 963905 - RNA, 19 nt, Homo sapiens
guucagacugucaaacaua

SEQ ID NO: 963906 - RNA, 19 nt, Homo sapiens
cccaaggcauuugcuguua

SEQ ID NO: 963907 - RNA, 19 nt, Homo sapiens
ggaaaacacugacaaagac

SEQ ID NO: 963908 - RNA, 19 nt, Homo sapiens
ggggagaucucauuucaga

SEQ ID NO: 963909 - RNA, 19 nt, Homo sapiens
gagaaauacaccuguuaug

SEQ ID NO: 963910 - RNA, 19 nt, Homo sapiens
ugacuugguuguaucagau

SEQ ID NO: 963911 - RNA, 19 nt, Homo sapiens
gcagagagugauugagguu

SEQ ID NO: 963912 - RNA, 19 nt, Homo sapiens
ucagaggccuggcuucaag

SEQ ID NO: 963913 - RNA, 19 nt, Homo sapiens
gacgaggaaucagcuuuga

SEQ ID NO: 963914 - RNA, 19 nt, Homo sapiens
cauuggaggaggauaauuu

SEQ ID NO: 963915 - RNA, 19 nt, Homo sapiens
gccaaagucacugcuguua

SEQ ID NO: 963916 - RNA, 19 nt, Homo sapiens
gaagaaggucaguugaagu

SEQ ID NO: 963917 - RNA, 19 nt, Homo sapiens
guaaugcuaggccuaaaga

SEQ ID NO: 963918 - RNA, 19 nt, Homo sapiens
ccaaagucacugcuguuaa

SEQ ID NO: 963919 - RNA, 19 nt, Homo sapiens
gaaggaguuggauguguug

SEQ ID NO: 963920 - RNA, 19 nt, Homo sapiens
caaaggugaaggaauaugu

SEQ ID NO: 963921 - RNA, 19 nt, Homo sapiens
ccccaaaggugaaggaaua

SEQ ID NO: 963922 - RNA, 19 nt, Homo sapiens
ggagugaugaugaguaugg

SEQ ID NO: 963923 - RNA, 19 nt, Homo sapiens
ggucucaucugcacugacu

SEQ ID NO: 963924 - RNA, 19 nt, Homo sapiens
ggaugugaagucccauuaa

SEQ ID NO: 963925 - RNA, 19 nt, Homo sapiens
gaacgagaaggaagacaag

SEQ ID NO: 963926 - RNA, 19 nt, Homo sapiens
aaggaaaguuaaucuguuc

SEQ ID NO: 963927 - RNA, 19 nt, Homo sapiens
aagggaaagugaaagcauu

SEQ ID NO: 963928 - RNA, 19 nt, Homo sapiens
ugaagaaagacaaagaaga

SEQ ID NO: 963929 - RNA, 19 nt, Homo sapiens
ggaacaaccuagaagcuuu

SEQ ID NO: 963930 - RNA, 19 nt, Homo sapiens
ggacagugcugacagacaa

SEQ ID NO: 963931 - RNA, 19 nt, Homo sapiens
cagagacccugcagaagua

SEQ ID NO: 963932 - RNA, 19 nt, Homo sapiens
ugaaaccucuccuaagaaa

SEQ ID NO: 963933 - RNA, 19 nt, Homo sapiens
gaugggcgcuuguucaaug

SEQ ID NO: 963934 - RNA, 19 nt, Homo sapiens
gaaauucuuugccuguaga

SEQ ID NO: 963935 - RNA, 19 nt, Homo sapiens
gauuaucccucuucucaga

SEQ ID NO: 963936 - RNA, 19 nt, Homo sapiens
ccaccucacuugaagcuuu

SEQ ID NO: 963937 - RNA, 19 nt, Homo sapiens
ccucugugcuuugguaaua

SEQ ID NO: 963938 - RNA, 19 nt, Homo sapiens
ggaaauucuuugccuguag

SEQ ID NO: 963939 - RNA, 19 nt, Homo sapiens
ggacaaauacagguucuug

SEQ ID NO: 963940 - RNA, 19 nt, Homo sapiens
gaacaagcccuggaaugug

SEQ ID NO: 963941 - RNA, 19 nt, Homo sapiens
uuugaaaccucuccuaaga

SEQ ID NO: 963942 - RNA, 19 nt, Homo sapiens
gccagaccgugaccucaua

SEQ ID NO: 963943 - RNA, 19 nt, Homo sapiens
gaacaaccuagaagcuuug

SEQ ID NO: 963944 - RNA, 19 nt, Homo sapiens
ugauggcccucacguauga

SEQ ID NO: 963945 - RNA, 19 nt, Homo sapiens
caaacuggaugccaaggau

SEQ ID NO: 963946 - RNA, 19 nt, Homo sapiens
cauaaagcaugaucuccuu

SEQ ID NO: 963947 - RNA, 19 nt, Homo sapiens
agaggucgcugucaagaug

SEQ ID NO: 963948 - RNA, 19 nt, Homo sapiens
gugcuuugguaauaaauug

SEQ ID NO: 963949 - RNA, 19 nt, Homo sapiens
acucaaggccugcuguuua

SEQ ID NO: 963950 - RNA, 19 nt, Homo sapiens
caaauugccuucccaacac

SEQ ID NO: 963951 - RNA, 19 nt, Homo sapiens
cucaaggccugcuguuuaa

SEQ ID NO: 963952 - RNA, 19 nt, Homo sapiens
gaggacaucaugaagcaaa

SEQ ID NO: 963953 - RNA, 19 nt, Homo sapiens
gaaguggcucuacggguuu

SEQ ID NO: 963954 - RNA, 19 nt, Homo sapiens
ggaaaugugacagcugaaa

SEQ ID NO: 963955 - RNA, 19 nt, Homo sapiens
gaccuugaguucauuagca

SEQ ID NO: 963956 - RNA, 19 nt, Homo sapiens
auccagaacuuuccauuug

SEQ ID NO: 963957 - RNA, 19 nt, Homo sapiens
ccaagcggcauucaaauuc

SEQ ID NO: 963958 - RNA, 19 nt, Homo sapiens
uauccaagcggcauucaaa

SEQ ID NO: 963959 - RNA, 19 nt, Homo sapiens
ccucagagacccugcagaa

SEQ ID NO: 963960 - RNA, 19 nt, Homo sapiens
ccaagccucugcaagucaa

SEQ ID NO: 963961 - RNA, 19 nt, Homo sapiens
gcuacugcaugcugaagug

SEQ ID NO: 963962 - RNA, 19 nt, Homo sapiens
aguggaagcugaaguccuu

SEQ ID NO: 963963 - RNA, 19 nt, Homo sapiens
ccagggcauucucuaugaa

SEQ ID NO: 963964 - RNA, 19 nt, Homo sapiens
ugacaguucugagucugaa

SEQ ID NO: 963965 - RNA, 19 nt, Homo sapiens
ccgauuaucccucuucuca

SEQ ID NO: 963966 - RNA, 19 nt, Homo sapiens
gaauccagaacuuuccauu

SEQ ID NO: 963967 - RNA, 19 nt, Homo sapiens
ggaguuuccaacccaguaa

SEQ ID NO: 963968 - RNA, 19 nt, Homo sapiens
ucagagacccugcagaagu

SEQ ID NO: 963969 - RNA, 19 nt, Homo sapiens
uuucugccauggacaaauu

SEQ ID NO: 963970 - RNA, 19 nt, Homo sapiens
acacugaggacaucaugaa

SEQ ID NO: 963971 - RNA, 19 nt, Homo sapiens
caaccagggcauucucuau

SEQ ID NO: 963972 - RNA, 19 nt, Homo sapiens
caagcggcauucaaauucu

SEQ ID NO: 963973 - RNA, 19 nt, Homo sapiens
ggccugcuguuuaaucaca

SEQ ID NO: 963974 - RNA, 19 nt, Homo sapiens
ccagaacuuuccauuugca

SEQ ID NO: 963975 - RNA, 19 nt, Homo sapiens
acaaauugccuucccaaca

SEQ ID NO: 963976 - RNA, 19 nt, Homo sapiens
cgucaccucuccccgauua

SEQ ID NO: 963977 - RNA, 19 nt, Homo sapiens
aaaccucuccuaagaaagu

SEQ ID NO: 963978 - RNA, 19 nt, Homo sapiens
cagccaguguccuagcaaa

SEQ ID NO: 963979 - RNA, 19 nt, Homo sapiens
ugaguauguucauggaaau

SEQ ID NO: 963980 - RNA, 19 nt, Homo sapiens
cugcauggguuucgguguu

SEQ ID NO: 963981 - RNA, 19 nt, Homo sapiens
gcaaaaguucucacucaaa

SEQ ID NO: 963982 - RNA, 19 nt, Homo sapiens
uggaaauucuuugccugua

SEQ ID NO: 963983 - RNA, 19 nt, Homo sapiens
agaacaagcccuggaaugu

SEQ ID NO: 963984 - RNA, 19 nt, Homo sapiens
guguucaccaggacaaaua

SEQ ID NO: 963985 - RNA, 19 nt, Homo sapiens
caagucaacaaguggaaga

SEQ ID NO: 963986 - RNA, 19 nt, Homo sapiens
cagggacagugcugacaga

SEQ ID NO: 963987 - RNA, 19 nt, Homo sapiens
caguuucccucccgugaau

SEQ ID NO: 963988 - RNA, 19 nt, Homo sapiens
acagaaguuuguugauaag

SEQ ID NO: 963989 - RNA, 19 nt, Homo sapiens
caacacugaggacaucaug

SEQ ID NO: 963990 - RNA, 19 nt, Homo sapiens
gcugaggaacaaccuagaa

SEQ ID NO: 963991 - RNA, 19 nt, Homo sapiens
acaaguggaagaagcugua

SEQ ID NO: 963992 - RNA, 19 nt, Homo sapiens
gaaaugugacagcugaaaa

SEQ ID NO: 963993 - RNA, 19 nt, Homo sapiens
caaaaguucucacucaaac

SEQ ID NO: 963994 - RNA, 19 nt, Homo sapiens
ucaaagagagggcugaacu

SEQ ID NO: 963995 - RNA, 19 nt, Homo sapiens
ucugugcuuugguaauaaa

SEQ ID NO: 963996 - RNA, 19 nt, Homo sapiens
aagcuuugcugcaggaucu

SEQ ID NO: 963997 - RNA, 19 nt, Homo sapiens
cugaggacaucaugaagca

SEQ ID NO: 963998 - RNA, 19 nt, Homo sapiens
guauguucauggaaaugug

SEQ ID NO: 963999 - RNA, 19 nt, Homo sapiens
ccaugagaaugaguauguu

SEQ ID NO: 964000 - RNA, 19 nt, Homo sapiens
accagggcauucucuauga

SEQ ID NO: 964001 - RNA, 19 nt, Homo sapiens
ccucagaagaccagcugua

SEQ ID NO: 964002 - RNA, 19 nt, Homo sapiens
ucccagaccuuugucaauc

SEQ ID NO: 964003 - RNA, 19 nt, Homo sapiens
gcauuccugccacugguuu

SEQ ID NO: 964004 - RNA, 19 nt, Homo sapiens
uagaacaagcccuggaaug

SEQ ID NO: 964005 - RNA, 19 nt, Homo sapiens
auacagguucuugguguua

SEQ ID NO: 964006 - RNA, 19 nt, Homo sapiens
ugccacugguuucaggaua

SEQ ID NO: 964007 - RNA, 19 nt, Homo sapiens
caccucacuugaagcuuug

SEQ ID NO: 964008 - RNA, 19 nt, Homo sapiens
acuccucugugcuuuggua

SEQ ID NO: 964009 - RNA, 19 nt, Homo sapiens
caaggccugcuguuuaauc

SEQ ID NO: 964010 - RNA, 19 nt, Homo sapiens
aauccagaacuuuccauuu

SEQ ID NO: 964011 - RNA, 19 nt, Homo sapiens
gauggugcccuagguggaa

SEQ ID NO: 964012 - RNA, 19 nt, Homo sapiens
aagcaaaaguucucacuca

SEQ ID NO: 964013 - RNA, 19 nt, Homo sapiens
gacaagagugggcgacagu

SEQ ID NO: 964014 - RNA, 19 nt, Homo sapiens
ccucagaagaccaggaaga

SEQ ID NO: 964015 - RNA, 19 nt, Homo sapiens
guucugagucugaagauac

SEQ ID NO: 964016 - RNA, 19 nt, Homo sapiens
gauggugacaguucugagu

SEQ ID NO: 964017 - RNA, 19 nt, Homo sapiens
cuucucagauggugacagu

SEQ ID NO: 964018 - RNA, 19 nt, Homo sapiens
ggacaaccagggcauucuc

SEQ ID NO: 964019 - RNA, 19 nt, Homo sapiens
uccaagcggcauucaaauu

SEQ ID NO: 964020 - RNA, 19 nt, Homo sapiens
ugacuccucugugcuuugg

SEQ ID NO: 964021 - RNA, 19 nt, Homo sapiens
gaccgugaccucauaaagc

SEQ ID NO: 964022 - RNA, 19 nt, Homo sapiens
cugcgugugucuccauaug

SEQ ID NO: 964023 - RNA, 19 nt, Homo sapiens
gaggaacaaccuagaagcu

SEQ ID NO: 964024 - RNA, 19 nt, Homo sapiens
ccuacgccaugcugaggaa

SEQ ID NO: 964025 - RNA, 19 nt, Homo sapiens
uggcuucgccuuccgcuau

SEQ ID NO: 964026 - RNA, 19 nt, Homo sapiens
acaaauacagguucuuggu

SEQ ID NO: 964027 - RNA, 19 nt, Homo sapiens
aaaagcagcccucagaaga

SEQ ID NO: 964028 - RNA, 19 nt, Homo sapiens
aauacagguucuugguguu

SEQ ID NO: 964029 - RNA, 19 nt, Homo sapiens
uaagauagcuguagagaua

SEQ ID NO: 964030 - RNA, 19 nt, Homo sapiens
ggagaaaccugguaacaua

SEQ ID NO: 964031 - RNA, 19 nt, Homo sapiens
gaacaagcauucccacuuu

SEQ ID NO: 964032 - RNA, 19 nt, Homo sapiens
caagauaacugaccaagug

SEQ ID NO: 964033 - RNA, 19 nt, Homo sapiens
ggagaaacguggaacauug

SEQ ID NO: 964034 - RNA, 19 nt, Homo sapiens
caucauaguucuacaguuu

SEQ ID NO: 964035 - RNA, 19 nt, Homo sapiens
ugaaacaacuacuggaaua

SEQ ID NO: 964036 - RNA, 19 nt, Homo sapiens
gaacuggacugaugaccaa

SEQ ID NO: 964037 - RNA, 19 nt, Homo sapiens
gaugagaacuggacugaug

SEQ ID NO: 964038 - RNA, 19 nt, Homo sapiens
gaacaaaggcagauaaaca

SEQ ID NO: 964039 - RNA, 19 nt, Homo sapiens
acaauaagcuggaaguuug

SEQ ID NO: 964040 - RNA, 19 nt, Homo sapiens
ggaaguugcugcccaaugu

SEQ ID NO: 964041 - RNA, 19 nt, Homo sapiens
gggaaggacugcauuaaug

SEQ ID NO: 964042 - RNA, 19 nt, Homo sapiens
ggacagagguugcugaacu

SEQ ID NO: 964043 - RNA, 19 nt, Homo sapiens
ccagagcucucaugcagua

SEQ ID NO: 964044 - RNA, 19 nt, Homo sapiens
agaauuaucugcaacuuga

SEQ ID NO: 964045 - RNA, 19 nt, Homo sapiens
gaacaagaucuaagucauu

SEQ ID NO: 964046 - RNA, 19 nt, Homo sapiens
guucuuaucugcaucacua

SEQ ID NO: 964047 - RNA, 19 nt, Homo sapiens
aaacagcccuuagcacuuu

SEQ ID NO: 964048 - RNA, 19 nt, Homo sapiens
guaacuaucuuaugcuuca

SEQ ID NO: 964049 - RNA, 19 nt, Homo sapiens
caacuaagccuucuuccuu

SEQ ID NO: 964050 - RNA, 19 nt, Homo sapiens
gcagaugguugcuguacuu

SEQ ID NO: 964051 - RNA, 19 nt, Homo sapiens
gcagacaauuucuaccaaa

SEQ ID NO: 964052 - RNA, 19 nt, Homo sapiens
ggaaaugugugcccugauc

SEQ ID NO: 964053 - RNA, 19 nt, Homo sapiens
ggacagcuaugaaacucaa

SEQ ID NO: 964054 - RNA, 19 nt, Homo sapiens
ggacagaccugcacaaacc

SEQ ID NO: 964055 - RNA, 19 nt, Homo sapiens
ggagacauguuucgaaugg

SEQ ID NO: 964056 - RNA, 19 nt, Homo sapiens
gaagacgacugcacauucu

SEQ ID NO: 964057 - RNA, 19 nt, Homo sapiens
ggagagugcugcccagugu

SEQ ID NO: 964058 - RNA, 19 nt, Homo sapiens
guaguaugccucaaauaua

SEQ ID NO: 964059 - RNA, 19 nt, Homo sapiens
ccacuuggauugcugaaga

SEQ ID NO: 964060 - RNA, 19 nt, Homo sapiens
cauaaucugugacaaguau

SEQ ID NO: 964061 - RNA, 19 nt, Homo sapiens
gcaauaacagcguaccuaa

SEQ ID NO: 964062 - RNA, 19 nt, Homo sapiens
ugaaugagcaggaaacaaa

SEQ ID NO: 964063 - RNA, 19 nt, Homo sapiens
gaagacacaauuccaaaga

SEQ ID NO: 964064 - RNA, 19 nt, Homo sapiens
guaagagaauuaucugcaa

SEQ ID NO: 964065 - RNA, 19 nt, Homo sapiens
uaaagcggguuauuaagga

SEQ ID NO: 964066 - RNA, 19 nt, Homo sapiens
ggacagugcugcccaucau

SEQ ID NO: 964067 - RNA, 19 nt, Homo sapiens
agagguugcugaacuuuaa

SEQ ID NO: 964068 - RNA, 19 nt, Homo sapiens
gaagaaaggcaacuaggau

SEQ ID NO: 964069 - RNA, 19 nt, Homo sapiens
gcacggcugugacaucugu

SEQ ID NO: 964070 - RNA, 19 nt, Homo sapiens
ggaaagugcugugaugucu

SEQ ID NO: 964071 - RNA, 19 nt, Homo sapiens
gauagcggcauuucucuaa

SEQ ID NO: 964072 - RNA, 19 nt, Homo sapiens
ggucuaaagccacaaguuu

SEQ ID NO: 964073 - RNA, 19 nt, Homo sapiens
caacuaggaugagguuuca

SEQ ID NO: 964074 - RNA, 19 nt, Homo sapiens
ccagguagauuacagagau

SEQ ID NO: 964075 - RNA, 19 nt, Homo sapiens
ggauauaggacaaggugua

SEQ ID NO: 964076 - RNA, 19 nt, Homo sapiens
gauaaacaggcauuccaua

SEQ ID NO: 964077 - RNA, 19 nt, Homo sapiens
gagcacaucagaacccuuu

SEQ ID NO: 964078 - RNA, 19 nt, Homo sapiens
ggaaguuuguuguaguaug

SEQ ID NO: 964079 - RNA, 19 nt, Homo sapiens
cauucuaccugcaguuuaa

SEQ ID NO: 964080 - RNA, 19 nt, Homo sapiens
agaaauguaugucccagaa

SEQ ID NO: 964081 - RNA, 19 nt, Homo sapiens
ggaagacgacugcacauuc

SEQ ID NO: 964082 - RNA, 19 nt, Homo sapiens
gcugugaugucuuugaaug

SEQ ID NO: 964083 - RNA, 19 nt, Homo sapiens
gcucaguacucccuccauu

SEQ ID NO: 964084 - RNA, 19 nt, Homo sapiens
uuggauugcugaagaauaa

SEQ ID NO: 964085 - RNA, 19 nt, Homo sapiens
gcuuuguucuguuauauug

SEQ ID NO: 964086 - RNA, 19 nt, Homo sapiens
gcacaugaacaagaucuaa

SEQ ID NO: 964087 - RNA, 19 nt, Homo sapiens
gauaacugaccaaguguuu

SEQ ID NO: 964088 - RNA, 19 nt, Homo sapiens
gaauuugugcacuugcuua

SEQ ID NO: 964089 - RNA, 19 nt, Homo sapiens
cagagaaugcuaagaauug

SEQ ID NO: 964090 - RNA, 19 nt, Homo sapiens
gaaguuuguuguaguaugc

SEQ ID NO: 964091 - RNA, 19 nt, Homo sapiens
aauaacagcguaccuaauu

SEQ ID NO: 964092 - RNA, 19 nt, Homo sapiens
cuaugaaacucaagucaga

SEQ ID NO: 964093 - RNA, 19 nt, Homo sapiens
gcagcaaucccuuugaguu

SEQ ID NO: 964094 - RNA, 19 nt, Homo sapiens
aaacaggcauuccauagca

SEQ ID NO: 964095 - RNA, 19 nt, Homo sapiens
ugaugccucuuuaaacuuu

SEQ ID NO: 964096 - RNA, 19 nt, Homo sapiens
gacuaaaucugcucuaaaa

SEQ ID NO: 964097 - RNA, 19 nt, Homo sapiens
ccaguaugcuuaacgugaa

SEQ ID NO: 964098 - RNA, 19 nt, Homo sapiens
gagaaaccugguaacauaa

SEQ ID NO: 964099 - RNA, 19 nt, Homo sapiens
uguauuggauugugacuug

SEQ ID NO: 964100 - RNA, 19 nt, Homo sapiens
gaaugcuacugucucaaug

SEQ ID NO: 964101 - RNA, 19 nt, Homo sapiens
gaagaaccaaccaucauca

SEQ ID NO: 964102 - RNA, 19 nt, Homo sapiens
aaagccagccugcguauuu

SEQ ID NO: 964103 - RNA, 19 nt, Homo sapiens
guauuugugugcaugugua

SEQ ID NO: 964104 - RNA, 19 nt, Homo sapiens
gaucuaagucauuucuuga

SEQ ID NO: 964105 - RNA, 19 nt, Homo sapiens
cauaaccaccuuagaacua

SEQ ID NO: 964106 - RNA, 19 nt, Homo sapiens
gcaggaggauguacuuggu

SEQ ID NO: 964107 - RNA, 19 nt, Homo sapiens
gagaaacguggaacauuga

SEQ ID NO: 964108 - RNA, 19 nt, Homo sapiens
ggaaugcccuccuguucag

SEQ ID NO: 964109 - RNA, 19 nt, Homo sapiens
gggcuauauuucacuguuu

SEQ ID NO: 964110 - RNA, 19 nt, Homo sapiens
auaacagcguaccuaauua

SEQ ID NO: 964111 - RNA, 19 nt, Homo sapiens
ggaaugcuacugucucaau

SEQ ID NO: 964112 - RNA, 19 nt, Homo sapiens
aaagagaauugaagaagag

SEQ ID NO: 964113 - RNA, 19 nt, Homo sapiens
aauuguagaugcuugcuuu

SEQ ID NO: 964114 - RNA, 19 nt, Homo sapiens
gacagagguugcugaacuu

SEQ ID NO: 964115 - RNA, 19 nt, Homo sapiens
cagcaaucccuuugaguuu

SEQ ID NO: 964116 - RNA, 19 nt, Homo sapiens
gcuaagaauugcagaacca

SEQ ID NO: 964117 - RNA, 19 nt, Homo sapiens
gaagaagagaagccagauu

SEQ ID NO: 964118 - RNA, 19 nt, Homo sapiens
ggacuccauugccucaguu

SEQ ID NO: 964119 - RNA, 19 nt, Homo sapiens
gaacugucccuucgguuuc

SEQ ID NO: 964120 - RNA, 19 nt, Homo sapiens
gugugaagauccaguguau

SEQ ID NO: 964121 - RNA, 19 nt, Homo sapiens
ccugagugcuguaucuauu

SEQ ID NO: 964122 - RNA, 19 nt, Homo sapiens
ugaggaagccagagaaaug

SEQ ID NO: 964123 - RNA, 19 nt, Homo sapiens
gcacaucagaacccuuuga

SEQ ID NO: 964124 - RNA, 19 nt, Homo sapiens
auaaucagcuaguaucugu

SEQ ID NO: 964125 - RNA, 19 nt, Homo sapiens
gcacccaagugaagauucu

SEQ ID NO: 964126 - RNA, 19 nt, Homo sapiens
ggacugcauuaaugguuuc

SEQ ID NO: 964127 - RNA, 19 nt, Homo sapiens
gaagauccaguguauccuu

SEQ ID NO: 964128 - RNA, 19 nt, Homo sapiens
gauauaggacaagguguaa

SEQ ID NO: 964129 - RNA, 19 nt, Homo sapiens
ggaauauacugaccuguug

SEQ ID NO: 964130 - RNA, 19 nt, Homo sapiens
ggaaggacgcacccuguua

SEQ ID NO: 964131 - RNA, 19 nt, Homo sapiens
ggagguggcggcagaauaa

SEQ ID NO: 964132 - RNA, 19 nt, Homo sapiens
ucaccuaucuggccgguuu

SEQ ID NO: 964133 - RNA, 19 nt, Homo sapiens
ggacgcacccuguuaugaa

SEQ ID NO: 964134 - RNA, 19 nt, Homo sapiens
ccagagacauccucagcuu

SEQ ID NO: 964135 - RNA, 19 nt, Homo sapiens
gaaggacgcacccuguuau

SEQ ID NO: 964136 - RNA, 19 nt, Homo sapiens
gcagcacaguuacaauuuc

SEQ ID NO: 964137 - RNA, 19 nt, Homo sapiens
gagcgaaacuccgucucaa

SEQ ID NO: 964138 - RNA, 19 nt, Homo sapiens
gggcagcacaguuacaauu

SEQ ID NO: 964139 - RNA, 19 nt, Homo sapiens
gccaagaccugcagcacau

SEQ ID NO: 964140 - RNA, 19 nt, Homo sapiens
gcuaagggucagauuguuu

SEQ ID NO: 964141 - RNA, 19 nt, Homo sapiens
gggaauauacugaccuguu

SEQ ID NO: 964142 - RNA, 19 nt, Homo sapiens
gauggagccugggcaacaa

SEQ ID NO: 964143 - RNA, 19 nt, Homo sapiens
gacucugccuccugucuuu

SEQ ID NO: 964144 - RNA, 19 nt, Homo sapiens
caaaagaugcccacaggua

SEQ ID NO: 964145 - RNA, 19 nt, Homo sapiens
gggucaggcugcuucuaaa

SEQ ID NO: 964146 - RNA, 19 nt, Homo sapiens
guuaugaaucugauacuga

SEQ ID NO: 964147 - RNA, 19 nt, Homo sapiens
uaaaugaaggaaccagcua

SEQ ID NO: 964148 - RNA, 19 nt, Homo sapiens
gacgcacccuguuaugaau

SEQ ID NO: 964149 - RNA, 19 nt, Homo sapiens
gacuguggcugcugcaaca

SEQ ID NO: 964150 - RNA, 19 nt, Homo sapiens
gggagguggcggcagaaua

SEQ ID NO: 964151 - RNA, 19 nt, Homo sapiens
cagcacaucagcaaccaaa

SEQ ID NO: 964152 - RNA, 19 nt, Homo sapiens
ggcagcacaguuacaauuu

SEQ ID NO: 964153 - RNA, 19 nt, Homo sapiens
ccucauagaccagcuaguu

SEQ ID NO: 964154 - RNA, 19 nt, Homo sapiens
ucucuagccucaccuaucu

SEQ ID NO: 964155 - RNA, 19 nt, Homo sapiens
aaagaugcccacagguaaa

SEQ ID NO: 964156 - RNA, 19 nt, Homo sapiens
caucagaauccacuacugu

SEQ ID NO: 964157 - RNA, 19 nt, Homo sapiens
gugcuugucauguucguuu

SEQ ID NO: 964158 - RNA, 19 nt, Homo sapiens
ucauagaccagcuaguuug

SEQ ID NO: 964159 - RNA, 19 nt, Homo sapiens
cagcuaagggucagauugu

SEQ ID NO: 964160 - RNA, 19 nt, Homo sapiens
cuccaacugugcucuuuga

SEQ ID NO: 964161 - RNA, 19 nt, Homo sapiens
ucuuccaucucuuaaggua

SEQ ID NO: 964162 - RNA, 19 nt, Homo sapiens
gcgaaacuccgucucaaaa

SEQ ID NO: 964163 - RNA, 19 nt, Homo sapiens
gggaaggacgcacccuguu

SEQ ID NO: 964164 - RNA, 19 nt, Homo sapiens
gaauauacugaccuguugu

SEQ ID NO: 964165 - RNA, 19 nt, Homo sapiens
gcucuuugauggcaguuuu

SEQ ID NO: 964166 - RNA, 19 nt, Homo sapiens
aaaugaaggaaccagcuaa

SEQ ID NO: 964167 - RNA, 19 nt, Homo sapiens
caguuacaauuucgcugaa

SEQ ID NO: 964168 - RNA, 19 nt, Homo sapiens
cagcacaguuacaauuucg

SEQ ID NO: 964169 - RNA, 19 nt, Homo sapiens
gggccacccucaguagugu

SEQ ID NO: 964170 - RNA, 19 nt, Homo sapiens
caacaucagaauccacuac

SEQ ID NO: 964171 - RNA, 19 nt, Homo sapiens
ccaacugugcucuuugaug

SEQ ID NO: 964172 - RNA, 19 nt, Homo sapiens
cuaucuggccgguuuggua

SEQ ID NO: 964173 - RNA, 19 nt, Homo sapiens
ccagcuaagggucagauug

SEQ ID NO: 964174 - RNA, 19 nt, Homo sapiens
aauauacugaccuguugua

SEQ ID NO: 964175 - RNA, 19 nt, Homo sapiens
gggcugaggacccagaucu

SEQ ID NO: 964176 - RNA, 19 nt, Homo sapiens
ccgguuugguaccuaaaug

SEQ ID NO: 964177 - RNA, 19 nt, Homo sapiens
ccagcucccuccuguccau

SEQ ID NO: 964178 - RNA, 19 nt, Homo sapiens
uuugggugcuugucauguu

SEQ ID NO: 964179 - RNA, 19 nt, Homo sapiens
gguuugguaccuaaaugaa

SEQ ID NO: 964180 - RNA, 19 nt, Homo sapiens
aaaagaugcccacagguaa

SEQ ID NO: 964181 - RNA, 19 nt, Homo sapiens
caagaccugcagcacauca

SEQ ID NO: 964182 - RNA, 19 nt, Homo sapiens
ucuuugucguugagacuuu

SEQ ID NO: 964183 - RNA, 19 nt, Homo sapiens
gagaauaacugcugcuaaa

SEQ ID NO: 964184 - RNA, 19 nt, Homo sapiens
ggaguacgcuuuggacuga

SEQ ID NO: 964185 - RNA, 19 nt, Homo sapiens
cagcaucuccuuucaauaa

SEQ ID NO: 964186 - RNA, 19 nt, Homo sapiens
ucaaacagauucccaugaa

SEQ ID NO: 964187 - RNA, 19 nt, Homo sapiens
gcaauacuaucuccaucuu

SEQ ID NO: 964188 - RNA, 19 nt, Homo sapiens
gaaggacaaugugcauauu

SEQ ID NO: 964189 - RNA, 19 nt, Homo sapiens
cagcauacucuuaaacuaa

SEQ ID NO: 964190 - RNA, 19 nt, Homo sapiens
gaauaacugcugcuaaauc

SEQ ID NO: 964191 - RNA, 19 nt, Homo sapiens
aauaacugcugcuaaauca

SEQ ID NO: 964192 - RNA, 19 nt, Homo sapiens
ggcauuggcuguuuacaag

SEQ ID NO: 964193 - RNA, 19 nt, Homo sapiens
cuacuaugaugguguguau

SEQ ID NO: 964194 - RNA, 19 nt, Homo sapiens
ucagcauacucuuaaacua

SEQ ID NO: 964195 - RNA, 19 nt, Homo sapiens
guauuugggucuuauuuac

SEQ ID NO: 964196 - RNA, 19 nt, Homo sapiens
gacaagcaagugccugaua

SEQ ID NO: 964197 - RNA, 19 nt, Homo sapiens
caagugggccauugagcua

SEQ ID NO: 964198 - RNA, 19 nt, Homo sapiens
ugagaagcaucgaggcuau

SEQ ID NO: 964199 - RNA, 19 nt, Homo sapiens
gguuuggucuaucucauug

SEQ ID NO: 964200 - RNA, 19 nt, Homo sapiens
gcaucuccuuucaauaaau

SEQ ID NO: 964201 - RNA, 19 nt, Homo sapiens
guaaacaagagaauaacug

SEQ ID NO: 964202 - RNA, 19 nt, Homo sapiens
gauaccagcgugcaagaga

SEQ ID NO: 964203 - RNA, 19 nt, Homo sapiens
gcugcuaaaucaagaacug

SEQ ID NO: 964204 - RNA, 19 nt, Homo sapiens
ggacuguuaccuacacaug

SEQ ID NO: 964205 - RNA, 19 nt, Homo sapiens
guacauggcaggcaauacu

SEQ ID NO: 964206 - RNA, 19 nt, Homo sapiens
gagcaaaacaacaacaaaa

SEQ ID NO: 964207 - RNA, 19 nt, Homo sapiens
cgacaaacacaaagaaacu

SEQ ID NO: 964208 - RNA, 19 nt, Homo sapiens
gcuccucagcauacucuua

SEQ ID NO: 964209 - RNA, 19 nt, Homo sapiens
gacaaacacaaagaaacua

SEQ ID NO: 964210 - RNA, 19 nt, Homo sapiens
gagaagcaucgaggcuaua

SEQ ID NO: 964211 - RNA, 19 nt, Homo sapiens
ccugauggguuuggcauug

SEQ ID NO: 964212 - RNA, 19 nt, Homo sapiens
guacagagcaaaacaacaa

SEQ ID NO: 964213 - RNA, 19 nt, Homo sapiens
aaggacaaugugcauauua

SEQ ID NO: 964214 - RNA, 19 nt, Homo sapiens
ucaagauguuagaaaguuc

SEQ ID NO: 964215 - RNA, 19 nt, Homo sapiens
guuuggcauuggcuguuua

SEQ ID NO: 964216 - RNA, 19 nt, Homo sapiens
gcuaaaucaagaacuguug

SEQ ID NO: 964217 - RNA, 19 nt, Homo sapiens
uaacugcugcuaaaucaag

SEQ ID NO: 964218 - RNA, 19 nt, Homo sapiens
agaaggacaaugugcauau

SEQ ID NO: 964219 - RNA, 19 nt, Homo sapiens
gguuuggcauuggcuguuu

SEQ ID NO: 964220 - RNA, 19 nt, Homo sapiens
gcagcaucuccuuucaaua

SEQ ID NO: 964221 - RNA, 19 nt, Homo sapiens
ccuauguauuugggucuua

SEQ ID NO: 964222 - RNA, 19 nt, Homo sapiens
gcuauaggacgcagcuguu

SEQ ID NO: 964223 - RNA, 19 nt, Homo sapiens
acaagcaagugccugauac

SEQ ID NO: 964224 - RNA, 19 nt, Homo sapiens
gaaaguucaagccagaagu

SEQ ID NO: 964225 - RNA, 19 nt, Homo sapiens
ugcagcaucuccuuucaau

SEQ ID NO: 964226 - RNA, 19 nt, Homo sapiens
cauauuacgacaaacacaa

SEQ ID NO: 964227 - RNA, 19 nt, Homo sapiens
cuacacaugcaucggauug

SEQ ID NO: 964228 - RNA, 19 nt, Homo sapiens
cauuggcuguuuacaagug

SEQ ID NO: 964229 - RNA, 19 nt, Homo sapiens
gacaaugugcauauuacga

SEQ ID NO: 964230 - RNA, 19 nt, Homo sapiens
acaugcaucggauugguua

SEQ ID NO: 964231 - RNA, 19 nt, Homo sapiens
gcacuuauggccauuucag

SEQ ID NO: 964232 - RNA, 19 nt, Homo sapiens
gugggccuguuguggagua

SEQ ID NO: 964233 - RNA, 19 nt, Homo sapiens
cagccacuuucaagauguu

SEQ ID NO: 964234 - RNA, 19 nt, Homo sapiens
gcauacucuuaaacuaauc

SEQ ID NO: 964235 - RNA, 19 nt, Homo sapiens
aaaguucaagccagaaguu

SEQ ID NO: 964236 - RNA, 19 nt, Homo sapiens
caagauguuagaaaguuca

SEQ ID NO: 964237 - RNA, 19 nt, Homo sapiens
acuaugaugguguguauga

SEQ ID NO: 964238 - RNA, 19 nt, Homo sapiens
gugcauauuacgacaaaca

SEQ ID NO: 964239 - RNA, 19 nt, Homo sapiens
guugagaacaaugcauaaa

SEQ ID NO: 964240 - RNA, 19 nt, Homo sapiens
gguugagaacaaugcauaa

SEQ ID NO: 964241 - RNA, 19 nt, Homo sapiens
agagaauaacugcugcuaa

SEQ ID NO: 964242 - RNA, 19 nt, Homo sapiens
acacaaagaaacuauacca

SEQ ID NO: 964243 - RNA, 19 nt, Homo sapiens
uuacgacaaacacaaagaa

SEQ ID NO: 964244 - RNA, 19 nt, Homo sapiens
ccaguggcuccucagcaua

SEQ ID NO: 964245 - RNA, 19 nt, Homo sapiens
ggauugguuagccuucauu

SEQ ID NO: 964246 - RNA, 19 nt, Homo sapiens
ggguuuggucuaucucauu

SEQ ID NO: 964247 - RNA, 19 nt, Homo sapiens
aagcaucgaggcuauagga

SEQ ID NO: 964248 - RNA, 19 nt, Homo sapiens
gccuggucccuauguauuu

SEQ ID NO: 964249 - RNA, 19 nt, Homo sapiens
ggacugcuuuugugaacau

SEQ ID NO: 964250 - RNA, 19 nt, Homo sapiens
uagaaggacaaugugcaua

SEQ ID NO: 964251 - RNA, 19 nt, Homo sapiens
ccuggucccuauguauuug

SEQ ID NO: 964252 - RNA, 19 nt, Homo sapiens
guugcagcaucuccuuuca

SEQ ID NO: 964253 - RNA, 19 nt, Homo sapiens
cccaguggcuccucagcau

SEQ ID NO: 964254 - RNA, 19 nt, Homo sapiens
ccacuuucaagauguuaga

SEQ ID NO: 964255 - RNA, 19 nt, Homo sapiens
ucagccacuuucaagaugu

SEQ ID NO: 964256 - RNA, 19 nt, Homo sapiens
ugguugagaacaaugcaua

SEQ ID NO: 964257 - RNA, 19 nt, Homo sapiens
gcauauuacgacaaacaca

SEQ ID NO: 964258 - RNA, 19 nt, Homo sapiens
gcgccuggucccuauguau

SEQ ID NO: 964259 - RNA, 19 nt, Homo sapiens
uaaaugguugagaacaaug

SEQ ID NO: 964260 - RNA, 19 nt, Homo sapiens
cuacccagucgguuacuug

SEQ ID NO: 964261 - RNA, 19 nt, Homo sapiens
aggacaaugugcauauuac

SEQ ID NO: 964262 - RNA, 19 nt, Homo sapiens
acacaugcaucggauuggu

SEQ ID NO: 964263 - RNA, 19 nt, Homo sapiens
uggcauuggcuguuuacaa

SEQ ID NO: 964264 - RNA, 19 nt, Homo sapiens
gagcugaccugaccucacu

SEQ ID NO: 964265 - RNA, 19 nt, Homo sapiens
gugcagagcaguacuguga

SEQ ID NO: 964266 - RNA, 19 nt, Homo sapiens
gcagggagcaggagcaguu

SEQ ID NO: 964267 - RNA, 19 nt, Homo sapiens
ccaagagccuccagaugug

SEQ ID NO: 964268 - RNA, 19 nt, Homo sapiens
gccaagagccuccagaugu

SEQ ID NO: 964269 - RNA, 19 nt, Homo sapiens
agacugugcucuucugaga

SEQ ID NO: 964270 - RNA, 19 nt, Homo sapiens
uuaaagcucugccacucaa

SEQ ID NO: 964271 - RNA, 19 nt, Homo sapiens
cagcaagaaugaagguugu

SEQ ID NO: 964272 - RNA, 19 nt, Homo sapiens
gucaagcccuggugaagga

SEQ ID NO: 964273 - RNA, 19 nt, Homo sapiens
ucauuggccucucuagcua

SEQ ID NO: 964274 - RNA, 19 nt, Homo sapiens
ggacugugccucccugcuu

SEQ ID NO: 964275 - RNA, 19 nt, Homo sapiens
gcggacggcuugugagaag

SEQ ID NO: 964276 - RNA, 19 nt, Homo sapiens
uggcugggccugaggauuu

SEQ ID NO: 964277 - RNA, 19 nt, Homo sapiens
ccagggcacugcagagucu

SEQ ID NO: 964278 - RNA, 19 nt, Homo sapiens
ccaggcgccuuacgugcuu

SEQ ID NO: 964279 - RNA, 19 nt, Homo sapiens
agaggugggcgcauaggua

SEQ ID NO: 964280 - RNA, 19 nt, Homo sapiens
ccagggagccaugagaaga

SEQ ID NO: 964281 - RNA, 19 nt, Homo sapiens
gccugaacguggcauggaa

SEQ ID NO: 964282 - RNA, 19 nt, Homo sapiens
cuugucagcucccuaaguc

SEQ ID NO: 964283 - RNA, 19 nt, Homo sapiens
ucccuaagucuuccuguuu

SEQ ID NO: 964284 - RNA, 19 nt, Homo sapiens
aggcagagguggugaagcu

SEQ ID NO: 964285 - RNA, 19 nt, Homo sapiens
ccacacagcggaccccuaa

SEQ ID NO: 964286 - RNA, 19 nt, Homo sapiens
ccagcccugugcaguguug

SEQ ID NO: 964287 - RNA, 19 nt, Homo sapiens
ucccucaccugccaguuau

SEQ ID NO: 964288 - RNA, 19 nt, Homo sapiens
ggacagaaaaccacugcaa

SEQ ID NO: 964289 - RNA, 19 nt, Homo sapiens
ggccagggagccaugagaa

SEQ ID NO: 964290 - RNA, 19 nt, Homo sapiens
gcucauccaggugcuuauu

SEQ ID NO: 964291 - RNA, 19 nt, Homo sapiens
cagcugaagccucccaauc

SEQ ID NO: 964292 - RNA, 19 nt, Homo sapiens
gcagcgagaaccugaugca

SEQ ID NO: 964293 - RNA, 19 nt, Homo sapiens
acugccaccucuugcauug

SEQ ID NO: 964294 - RNA, 19 nt, Homo sapiens
cccuaagucuuccuguuuc

SEQ ID NO: 964295 - RNA, 19 nt, Homo sapiens
ccuagucccugcccaagcu

SEQ ID NO: 964296 - RNA, 19 nt, Homo sapiens
ugacccagccauacguaga

SEQ ID NO: 964297 - RNA, 19 nt, Homo sapiens
gggcgcauagguacaagug

SEQ ID NO: 964298 - RNA, 19 nt, Homo sapiens
ucauccaggugcuuauugg

SEQ ID NO: 964299 - RNA, 19 nt, Homo sapiens
gagaagaccagaucuauga

SEQ ID NO: 964300 - RNA, 19 nt, Homo sapiens
gcagagaccaaacuucaua

SEQ ID NO: 964301 - RNA, 19 nt, Homo sapiens
ggacauguuugcacuacuu

SEQ ID NO: 964302 - RNA, 19 nt, Homo sapiens
gcugaugucccuugugaaa

SEQ ID NO: 964303 - RNA, 19 nt, Homo sapiens
gaaggugucagccacaaga

SEQ ID NO: 964304 - RNA, 19 nt, Homo sapiens
cuacggaguucgagaagug

SEQ ID NO: 964305 - RNA, 19 nt, Homo sapiens
ggacuacggaguucgagaa

SEQ ID NO: 964306 - RNA, 19 nt, Homo sapiens
gcagagcuguggcuuacca

SEQ ID NO: 964307 - RNA, 19 nt, Homo sapiens
acacacaucugcaccucaa

SEQ ID NO: 964308 - RNA, 19 nt, Homo sapiens
gagcugagcgaguugucua

SEQ ID NO: 964309 - RNA, 19 nt, Homo sapiens
gagaaggugucagccacaa

SEQ ID NO: 964310 - RNA, 19 nt, Homo sapiens
ggagaagaccagaucuaug

SEQ ID NO: 964311 - RNA, 19 nt, Homo sapiens
cgaguugucuacacgaugu

SEQ ID NO: 964312 - RNA, 19 nt, Homo sapiens
acucuacccuccucugaaa

SEQ ID NO: 964313 - RNA, 19 nt, Homo sapiens
ggacucuacccuccucuga

SEQ ID NO: 964314 - RNA, 19 nt, Homo sapiens
gcaccucaaccacagacua

SEQ ID NO: 964315 - RNA, 19 nt, Homo sapiens
agaaguggaccaagugaaa

SEQ ID NO: 964316 - RNA, 19 nt, Homo sapiens
cugcugaugucccuuguga

SEQ ID NO: 964317 - RNA, 19 nt, Homo sapiens
gugcagacauugguguuuc

SEQ ID NO: 964318 - RNA, 19 nt, Homo sapiens
ccucuggacucaaauaaaa

SEQ ID NO: 964319 - RNA, 19 nt, Homo sapiens
agacuacacuugcugaacu

SEQ ID NO: 964320 - RNA, 19 nt, Homo sapiens
cuaugaagcccaccaacaa

SEQ ID NO: 964321 - RNA, 19 nt, Homo sapiens
ccaaacuucauaccucaaa

SEQ ID NO: 964322 - RNA, 19 nt, Homo sapiens
ggugucagccacaagagaa

SEQ ID NO: 964323 - RNA, 19 nt, Homo sapiens
gaagaccagaucuaugaag

SEQ ID NO: 964324 - RNA, 19 nt, Homo sapiens
caaccacagacuacacuug

SEQ ID NO: 964325 - RNA, 19 nt, Homo sapiens
gagaaguggaccaagugaa

SEQ ID NO: 964326 - RNA, 19 nt, Homo sapiens
cugcagagcuguggcuuac

SEQ ID NO: 964327 - RNA, 19 nt, Homo sapiens
ggcaaaggcagagaccaaa

SEQ ID NO: 964328 - RNA, 19 nt, Homo sapiens
uggaugaugaggagaugua

SEQ ID NO: 964329 - RNA, 19 nt, Homo sapiens
ggcugggagugcagacauu

SEQ ID NO: 964330 - RNA, 19 nt, Homo sapiens
gacuacacuugcugaacug

SEQ ID NO: 964331 - RNA, 19 nt, Homo sapiens
gaggggcucuggaggcauu

SEQ ID NO: 964332 - RNA, 19 nt, Homo sapiens
gcaggacuacggaguucga

SEQ ID NO: 964333 - RNA, 19 nt, Homo sapiens
aggcagagaccaaacuuca

SEQ ID NO: 964334 - RNA, 19 nt, Homo sapiens
gaucuaugaagcccaccaa

SEQ ID NO: 964335 - RNA, 19 nt, Homo sapiens
cgagaaguggaccaaguga

SEQ ID NO: 964336 - RNA, 19 nt, Homo sapiens
uggagaagaccagaucuau

SEQ ID NO: 964337 - RNA, 19 nt, Homo sapiens
caaaggcagagaccaaacu

SEQ ID NO: 964338 - RNA, 19 nt, Homo sapiens
caggacauguuugcacuac

SEQ ID NO: 964339 - RNA, 19 nt, Homo sapiens
gaaguggaccaagugaaac

SEQ ID NO: 964340 - RNA, 19 nt, Homo sapiens
ccccacaacuggaugauga

SEQ ID NO: 964341 - RNA, 19 nt, Homo sapiens
gcaaaggcagagaccaaac

SEQ ID NO: 964342 - RNA, 19 nt, Homo sapiens
caaacuucauaccucaaac

SEQ ID NO: 964343 - RNA, 19 nt, Homo sapiens
gcucuggaggcauugcuau

SEQ ID NO: 964344 - RNA, 19 nt, Homo sapiens
gaccaagugaaacgucuca

SEQ ID NO: 964345 - RNA, 19 nt, Homo sapiens
uggcaggacuacggaguuc

SEQ ID NO: 964346 - RNA, 19 nt, Homo sapiens
uggcaaaggcagagaccaa

SEQ ID NO: 964347 - RNA, 19 nt, Homo sapiens
uaacauaaccucaugaaga

SEQ ID NO: 964348 - RNA, 19 nt, Homo sapiens
gcuucucacucuuguauua

SEQ ID NO: 964349 - RNA, 19 nt, Homo sapiens
ccacugggcuggauucaug

SEQ ID NO: 964350 - RNA, 19 nt, Homo sapiens
gagaacagaccuagaaaug

SEQ ID NO: 964351 - RNA, 19 nt, Homo sapiens
ggaauuccuuugugguuug

SEQ ID NO: 964352 - RNA, 19 nt, Homo sapiens
gcguacgacuuacugcuua

SEQ ID NO: 964353 - RNA, 19 nt, Homo sapiens
uaagaaggauuccacaaag

SEQ ID NO: 964354 - RNA, 19 nt, Homo sapiens
aacauaaccucaugaagaa

SEQ ID NO: 964355 - RNA, 19 nt, Homo sapiens
guaguaacauaaccucaug

SEQ ID NO: 964356 - RNA, 19 nt, Homo sapiens
gcuaggcuguaucccauaa

SEQ ID NO: 964357 - RNA, 19 nt, Homo sapiens
gcgcagcuaucccuuagug

SEQ ID NO: 964358 - RNA, 19 nt, Homo sapiens
gaaggccgaucgucucaag

SEQ ID NO: 964359 - RNA, 19 nt, Homo sapiens
gagcuggaauuccuuugug

SEQ ID NO: 964360 - RNA, 19 nt, Homo sapiens
ccacugggcugggaucuuc

SEQ ID NO: 964361 - RNA, 19 nt, Homo sapiens
caccugacccuguaaauga

SEQ ID NO: 964362 - RNA, 19 nt, Homo sapiens
cuagcuugcugguaacuuu

SEQ ID NO: 964363 - RNA, 19 nt, Homo sapiens
aaacuuguauucucaggau

SEQ ID NO: 964364 - RNA, 19 nt, Homo sapiens
uaccuacucugccaaguga

SEQ ID NO: 964365 - RNA, 19 nt, Homo sapiens
ccuucuagcuugcugguaa

SEQ ID NO: 964366 - RNA, 19 nt, Homo sapiens
ggucugagcuggaauuccu

SEQ ID NO: 964367 - RNA, 19 nt, Homo sapiens
ccagcaagguugacucauc

SEQ ID NO: 964368 - RNA, 19 nt, Homo sapiens
aaacaccuuuaaagcauga

SEQ ID NO: 964369 - RNA, 19 nt, Homo sapiens
caggagaacagaccuagaa

SEQ ID NO: 964370 - RNA, 19 nt, Homo sapiens
gcgacuugcguacgacuua

SEQ ID NO: 964371 - RNA, 19 nt, Homo sapiens
uuaagaaggauuccacaaa

SEQ ID NO: 964372 - RNA, 19 nt, Homo sapiens
ucccauaauuucaggauga

SEQ ID NO: 964373 - RNA, 19 nt, Homo sapiens
uaucaguuguugccuucua

SEQ ID NO: 964374 - RNA, 19 nt, Homo sapiens
gauggcgacuugcguacga

SEQ ID NO: 964375 - RNA, 19 nt, Homo sapiens
gaucuucugggucauguga

SEQ ID NO: 964376 - RNA, 19 nt, Homo sapiens
gguggugccugcucaucuu

SEQ ID NO: 964377 - RNA, 19 nt, Homo sapiens
cagcaagguugacucaucu

SEQ ID NO: 964378 - RNA, 19 nt, Homo sapiens
ggagaacagaccuagaaau

SEQ ID NO: 964379 - RNA, 19 nt, Homo sapiens
cagcaccaaagauguauuu

SEQ ID NO: 964380 - RNA, 19 nt, Homo sapiens
gagccaggguuaccuacuc

SEQ ID NO: 964381 - RNA, 19 nt, Homo sapiens
gagaggugcuuugcugucu

SEQ ID NO: 964382 - RNA, 19 nt, Homo sapiens
caccauguguccugucaau

SEQ ID NO: 964383 - RNA, 19 nt, Homo sapiens
caccaaagauguauuuuca

SEQ ID NO: 964384 - RNA, 19 nt, Homo sapiens
uaggcuguaucccauaauu

SEQ ID NO: 964385 - RNA, 19 nt, Homo sapiens
gcuguugcccugaaaccua

SEQ ID NO: 964386 - RNA, 19 nt, Homo sapiens
gcagggcaacgacuucuuc

SEQ ID NO: 964387 - RNA, 19 nt, Homo sapiens
ucuugcagcuguauacgaa

SEQ ID NO: 964388 - RNA, 19 nt, Homo sapiens
uagcugcacugcggcguuu

SEQ ID NO: 964389 - RNA, 19 nt, Homo sapiens
uggaauuccuuugugguuu

SEQ ID NO: 964390 - RNA, 19 nt, Homo sapiens
gggcugaccuccguuucug

SEQ ID NO: 964391 - RNA, 19 nt, Homo sapiens
gggcuggauucauguucaa

SEQ ID NO: 964392 - RNA, 19 nt, Homo sapiens
gcuaucccuuagugaggua

SEQ ID NO: 964393 - RNA, 19 nt, Homo sapiens
cauaauuucaggaugagaa

SEQ ID NO: 964394 - RNA, 19 nt, Homo sapiens
gugguuugcucuucugcuu

SEQ ID NO: 964395 - RNA, 19 nt, Homo sapiens
ggaugagaaacauuaacaa

SEQ ID NO: 964396 - RNA, 19 nt, Homo sapiens
ggagcagaaacuuguauuc

SEQ ID NO: 964397 - RNA, 19 nt, Homo sapiens
ugagggcuaucaguuguug

SEQ ID NO: 964398 - RNA, 19 nt, Homo sapiens
ggaucuacccagcaccaaa

SEQ ID NO: 964399 - RNA, 19 nt, Homo sapiens
cuuccaggcugaccacaga

SEQ ID NO: 964400 - RNA, 19 nt, Homo sapiens
gaucuacccagcaccaaag

SEQ ID NO: 964401 - RNA, 19 nt, Homo sapiens
acaaacugcuaggcuguau

SEQ ID NO: 964402 - RNA, 19 nt, Homo sapiens
cagcaagccuaccuuucuc

SEQ ID NO: 964403 - RNA, 19 nt, Homo sapiens
acacagcaagccuaccuuu

SEQ ID NO: 964404 - RNA, 19 nt, Homo sapiens
ugagccaugugcuucuuug

SEQ ID NO: 964405 - RNA, 19 nt, Homo sapiens
ugugagggcuaucaguugu

SEQ ID NO: 964406 - RNA, 19 nt, Homo sapiens
gacaaacugcuaggcugua

SEQ ID NO: 964407 - RNA, 19 nt, Homo sapiens
cggcgcagcuaucccuuag

SEQ ID NO: 964408 - RNA, 19 nt, Homo sapiens
ggcuguaucccauaauuuc

SEQ ID NO: 964409 - RNA, 19 nt, Homo sapiens
gaggugcuuugcugucucu

SEQ ID NO: 964410 - RNA, 19 nt, Homo sapiens
caggugcucuuuccauggu

SEQ ID NO: 964411 - RNA, 19 nt, Homo sapiens
gagcuucugugggucuaca

SEQ ID NO: 964412 - RNA, 19 nt, Homo sapiens
cgucucaagucgugaugau

SEQ ID NO: 964413 - RNA, 19 nt, Homo sapiens
gguuugcucuucugcuucu

SEQ ID NO: 964414 - RNA, 19 nt, Homo sapiens
ccucggaugucccuuugca

SEQ ID NO: 964415 - RNA, 19 nt, Homo sapiens
uagcugggcuggucuugcu

SEQ ID NO: 964416 - RNA, 19 nt, Homo sapiens
cgacuuacugcuuagaauc

SEQ ID NO: 964417 - RNA, 19 nt, Homo sapiens
gcuuugcuguugcccugaa

SEQ ID NO: 964418 - RNA, 19 nt, Homo sapiens
uucaggaugagaaacauua

SEQ ID NO: 964419 - RNA, 19 nt, Homo sapiens
aagaaggauuccacaaagg

SEQ ID NO: 964420 - RNA, 19 nt, Homo sapiens
agugugagagccaggguua

SEQ ID NO: 964421 - RNA, 19 nt, Homo sapiens
gcagcucucccagguacuu

SEQ ID NO: 964422 - RNA, 19 nt, Homo sapiens
cuacccagcaccaaagaug

SEQ ID NO: 964423 - RNA, 19 nt, Homo sapiens
ucaggaugagaaacauuaa

SEQ ID NO: 964424 - RNA, 19 nt, Homo sapiens
ugagagccaggguuaccua

SEQ ID NO: 964425 - RNA, 19 nt, Homo sapiens
acagcaagccuaccuuucu

SEQ ID NO: 964426 - RNA, 19 nt, Homo sapiens
ccucaugaagaacuagaaa

SEQ ID NO: 964427 - RNA, 19 nt, Homo sapiens
ucucaggauucaggaucua

SEQ ID NO: 964428 - RNA, 19 nt, Homo sapiens
gggaucuucugggucaugu

SEQ ID NO: 964429 - RNA, 19 nt, Homo sapiens
ccaggagcagaaacuugua

SEQ ID NO: 964430 - RNA, 19 nt, Homo sapiens
gaugccugcagcccacuuu

SEQ ID NO: 964431 - RNA, 19 nt, Homo sapiens
gggacuaugggaucacugu

SEQ ID NO: 964432 - RNA, 19 nt, Homo sapiens
gcaaguuaaggcuuuauuu

SEQ ID NO: 964433 - RNA, 19 nt, Homo sapiens
gacagaugaucauauucua

SEQ ID NO: 964434 - RNA, 19 nt, Homo sapiens
gaagcgagggaguagauuu

SEQ ID NO: 964435 - RNA, 19 nt, Homo sapiens
ggacagaugaucauauucu

SEQ ID NO: 964436 - RNA, 19 nt, Homo sapiens
ggaaagcggagcuaagugu

SEQ ID NO: 964437 - RNA, 19 nt, Homo sapiens
cuggacagaugaucauauu

SEQ ID NO: 964438 - RNA, 19 nt, Homo sapiens
acacugcgcugcacuaugc

SEQ ID NO: 964439 - RNA, 19 nt, Homo sapiens
guuuaagacuggacagaug

SEQ ID NO: 964440 - RNA, 19 nt, Homo sapiens
guucauaugagacaucuau

SEQ ID NO: 964441 - RNA, 19 nt, Homo sapiens
ggcaugaccagucugcaua

SEQ ID NO: 964442 - RNA, 19 nt, Homo sapiens
gcaugaccagucugcauaa

SEQ ID NO: 964443 - RNA, 19 nt, Homo sapiens
ugaagcauuuaauccagaa

SEQ ID NO: 964444 - RNA, 19 nt, Homo sapiens
guuauauccuuaccucaca

SEQ ID NO: 964445 - RNA, 19 nt, Homo sapiens
acacagaccaguucuccaa

SEQ ID NO: 964446 - RNA, 19 nt, Homo sapiens
aggcacggcuagcauguga

SEQ ID NO: 964447 - RNA, 19 nt, Homo sapiens
uggaggagauggacuucga

SEQ ID NO: 964448 - RNA, 19 nt, Homo sapiens
gcacuaugccagccgcaau

SEQ ID NO: 964449 - RNA, 19 nt, Homo sapiens
guagauuugguguggcuaa

SEQ ID NO: 964450 - RNA, 19 nt, Homo sapiens
aauugcaaguuaaggcuuu

SEQ ID NO: 964451 - RNA, 19 nt, Homo sapiens
gagugaagcauuuaaucca

SEQ ID NO: 964452 - RNA, 19 nt, Homo sapiens
uagauuugguguggcuaaa

SEQ ID NO: 964453 - RNA, 19 nt, Homo sapiens
uaucuccagcugccuuuaa

SEQ ID NO: 964454 - RNA, 19 nt, Homo sapiens
gaaggccgaggacccaagu

SEQ ID NO: 964455 - RNA, 19 nt, Homo sapiens
gcgagggaguagauuuggu

SEQ ID NO: 964456 - RNA, 19 nt, Homo sapiens
ggaagcgagggaguagauu

SEQ ID NO: 964457 - RNA, 19 nt, Homo sapiens
gggccgagugaagcauuua

SEQ ID NO: 964458 - RNA, 19 nt, Homo sapiens
cgaaaggcacggcuagcau

SEQ ID NO: 964459 - RNA, 19 nt, Homo sapiens
aagcggagcuaagugugau

SEQ ID NO: 964460 - RNA, 19 nt, Homo sapiens
aaagcggagcuaaguguga

SEQ ID NO: 964461 - RNA, 19 nt, Homo sapiens
gcuacacugcgcugcacua

SEQ ID NO: 964462 - RNA, 19 nt, Homo sapiens
aagcgagggaguagauuug

SEQ ID NO: 964463 - RNA, 19 nt, Homo sapiens
ggaguuggcuugcuucaua

SEQ ID NO: 964464 - RNA, 19 nt, Homo sapiens
guucggaucuuuggaauua

SEQ ID NO: 964465 - RNA, 19 nt, Homo sapiens
gaaaguuugucaucauuug

SEQ ID NO: 964466 - RNA, 19 nt, Homo sapiens
uaauacaccugguacauuu

SEQ ID NO: 964467 - RNA, 19 nt, Homo sapiens
gaaacaacgucucuagcaa

SEQ ID NO: 964468 - RNA, 19 nt, Homo sapiens
gaagugcagauuuccauua

SEQ ID NO: 964469 - RNA, 19 nt, Homo sapiens
gaacagcaaccacauugaa

SEQ ID NO: 964470 - RNA, 19 nt, Homo sapiens
gaaacuaggaccagcuuaa

SEQ ID NO: 964471 - RNA, 19 nt, Homo sapiens
caacacagguaccuuguca

SEQ ID NO: 964472 - RNA, 19 nt, Homo sapiens
gcaaggcuccuaacucauu

SEQ ID NO: 964473 - RNA, 19 nt, Homo sapiens
ggaccagcuuaacuuauaa

SEQ ID NO: 964474 - RNA, 19 nt, Homo sapiens
ccaacucacuucauccuaa

SEQ ID NO: 964475 - RNA, 19 nt, Homo sapiens
gcuuggacuuuaacaaaua

SEQ ID NO: 964476 - RNA, 19 nt, Homo sapiens
gguguuagguugccaguug

SEQ ID NO: 964477 - RNA, 19 nt, Homo sapiens
uaggaaagcuucuuauagu

SEQ ID NO: 964478 - RNA, 19 nt, Homo sapiens
aaaggugucugcuuauuug

SEQ ID NO: 964479 - RNA, 19 nt, Homo sapiens
uaaagcagacuuacaugua

SEQ ID NO: 964480 - RNA, 19 nt, Homo sapiens
gggaacaacuggacuaugg

SEQ ID NO: 964481 - RNA, 19 nt, Homo sapiens
ggaauccucucuauacaag

SEQ ID NO: 964482 - RNA, 19 nt, Homo sapiens
ggaaagcuucuuauaguug

SEQ ID NO: 964483 - RNA, 19 nt, Homo sapiens
gggaaaguuugucaucauu

SEQ ID NO: 964484 - RNA, 19 nt, Homo sapiens
ugagucaaguguucuaauu

SEQ ID NO: 964485 - RNA, 19 nt, Homo sapiens
aggcccagcuuauaaguua

SEQ ID NO: 964486 - RNA, 19 nt, Homo sapiens
aaacaaaguucagauaugg

SEQ ID NO: 964487 - RNA, 19 nt, Homo sapiens
gaacauuuccagucauuca

SEQ ID NO: 964488 - RNA, 19 nt, Homo sapiens
caacucacuucauccuaaa

SEQ ID NO: 964489 - RNA, 19 nt, Homo sapiens
ggaguacaguuuacaucuu

SEQ ID NO: 964490 - RNA, 19 nt, Homo sapiens
aagcaaggcuccuaacuca

SEQ ID NO: 964491 - RNA, 19 nt, Homo sapiens
ccaaauacccgugucauga

SEQ ID NO: 964492 - RNA, 19 nt, Homo sapiens
gcaaccacauugaauucuu

SEQ ID NO: 964493 - RNA, 19 nt, Homo sapiens
caaccacauugaauucuug

SEQ ID NO: 964494 - RNA, 19 nt, Homo sapiens
gaaaagaguuacagaccaa

SEQ ID NO: 964495 - RNA, 19 nt, Homo sapiens
caacgucucuagcaauagu

SEQ ID NO: 964496 - RNA, 19 nt, Homo sapiens
acaagccaguucccacuua

SEQ ID NO: 964497 - RNA, 19 nt, Homo sapiens
aggaccagcuuaacuuaua

SEQ ID NO: 964498 - RNA, 19 nt, Homo sapiens
ggaaggagugguuaguaaa

SEQ ID NO: 964499 - RNA, 19 nt, Homo sapiens
gaguacaguuuacaucuuc

SEQ ID NO: 964500 - RNA, 19 nt, Homo sapiens
acacaaggcugcuaaacca

SEQ ID NO: 964501 - RNA, 19 nt, Homo sapiens
gcaaguuucuauacgaagu

SEQ ID NO: 964502 - RNA, 19 nt, Homo sapiens
ggacuauggaguacaguuu

SEQ ID NO: 964503 - RNA, 19 nt, Homo sapiens
aacaacgucucuagcaaua

SEQ ID NO: 964504 - RNA, 19 nt, Homo sapiens
uaaaggugucugcuuauuu

SEQ ID NO: 964505 - RNA, 19 nt, Homo sapiens
gauaaaagauagccaagug

SEQ ID NO: 964506 - RNA, 19 nt, Homo sapiens
auucagcugugguuauuua

SEQ ID NO: 964507 - RNA, 19 nt, Homo sapiens
ggaaaguuugucaucauuu

SEQ ID NO: 964508 - RNA, 19 nt, Homo sapiens
caaggcugcuaaaccaauu

SEQ ID NO: 964509 - RNA, 19 nt, Homo sapiens
cagaccaacuuaaacauca

SEQ ID NO: 964510 - RNA, 19 nt, Homo sapiens
uauguaagcggauguauau

SEQ ID NO: 964511 - RNA, 19 nt, Homo sapiens
acagugaagugaauccaaa

SEQ ID NO: 964512 - RNA, 19 nt, Homo sapiens
uagcaauaguaccaaagua

SEQ ID NO: 964513 - RNA, 19 nt, Homo sapiens
gagaaguauuuacauugga

SEQ ID NO: 964514 - RNA, 19 nt, Homo sapiens
cagcuucucuccugagugu

SEQ ID NO: 964515 - RNA, 19 nt, Homo sapiens
ugauucaucucauuacuuc

SEQ ID NO: 964516 - RNA, 19 nt, Homo sapiens
caaauacccgugucaugaa

SEQ ID NO: 964517 - RNA, 19 nt, Homo sapiens
gcagaaacaacgucucuag

SEQ ID NO: 964518 - RNA, 19 nt, Homo sapiens
auuuaaaggugucugcuua

SEQ ID NO: 964519 - RNA, 19 nt, Homo sapiens
aggaaggagugguuaguaa

SEQ ID NO: 964520 - RNA, 19 nt, Homo sapiens
gugaggguguaguagauaa

SEQ ID NO: 964521 - RNA, 19 nt, Homo sapiens
ucauucagcugugguuauu

SEQ ID NO: 964522 - RNA, 19 nt, Homo sapiens
ugagaaguauuuacauugg

SEQ ID NO: 964523 - RNA, 19 nt, Homo sapiens
aaaccggaauccucucuau

SEQ ID NO: 964524 - RNA, 19 nt, Homo sapiens
aagaacauuuccagucauu

SEQ ID NO: 964525 - RNA, 19 nt, Homo sapiens
cugauaaugugaaaugaga

SEQ ID NO: 964526 - RNA, 19 nt, Homo sapiens
caucaauucgugucaguaa

SEQ ID NO: 964527 - RNA, 19 nt, Homo sapiens
ucuuauaguugcugacauu

SEQ ID NO: 964528 - RNA, 19 nt, Homo sapiens
gaauucuugugacuuagga

SEQ ID NO: 964529 - RNA, 19 nt, Homo sapiens
ggugucugcuuauuugguu

SEQ ID NO: 964530 - RNA, 19 nt, Homo sapiens
uuaaaggugucugcuuauu

SEQ ID NO: 964531 - RNA, 19 nt, Homo sapiens
aagugcagauuuccauuaa

SEQ ID NO: 964532 - RNA, 19 nt, Homo sapiens
aaacaugaacguuggaguu

SEQ ID NO: 964533 - RNA, 19 nt, Homo sapiens
gacuauggaguacaguuua

SEQ ID NO: 964534 - RNA, 19 nt, Homo sapiens
gagaaguaaacaugucaaa

SEQ ID NO: 964535 - RNA, 19 nt, Homo sapiens
gaacaaagcagguuuuacu

SEQ ID NO: 964536 - RNA, 19 nt, Homo sapiens
cagcugugguuauuuaaag

SEQ ID NO: 964537 - RNA, 19 nt, Homo sapiens
ucucauuacuuccuacaga

SEQ ID NO: 964538 - RNA, 19 nt, Homo sapiens
gagucaaguguucuaauuu

SEQ ID NO: 964539 - RNA, 19 nt, Homo sapiens
ccugguacauuucugaaga

SEQ ID NO: 964540 - RNA, 19 nt, Homo sapiens
aaaugaugccucuguuuaa

SEQ ID NO: 964541 - RNA, 19 nt, Homo sapiens
cagaacagcaaccacauug

SEQ ID NO: 964542 - RNA, 19 nt, Homo sapiens
aguaaguaauggagucuuu

SEQ ID NO: 964543 - RNA, 19 nt, Homo sapiens
caagccaguucccacuuau

SEQ ID NO: 964544 - RNA, 19 nt, Homo sapiens
acagguaccuugucauguc

SEQ ID NO: 964545 - RNA, 19 nt, Homo sapiens
caaggcuccuaacucauug

SEQ ID NO: 964546 - RNA, 19 nt, Homo sapiens
gcaauaguaccaaaguaag

SEQ ID NO: 964547 - RNA, 19 nt, Homo sapiens
caacuggacuauggaguac

SEQ ID NO: 964548 - RNA, 19 nt, Homo sapiens
gguaaagcaaggcuccuaa

SEQ ID NO: 964549 - RNA, 19 nt, Homo sapiens
acaagcagccucugaguca

SEQ ID NO: 964550 - RNA, 19 nt, Homo sapiens
ccacuuaugaggguacuuu

SEQ ID NO: 964551 - RNA, 19 nt, Homo sapiens
cgaaguaugauccaacuca

SEQ ID NO: 964552 - RNA, 19 nt, Homo sapiens
gaguuggcuugcuucauau

SEQ ID NO: 964553 - RNA, 19 nt, Homo sapiens
aggaaagcuucuuauaguu

SEQ ID NO: 964554 - RNA, 19 nt, Homo sapiens
guaccaaaguaaguaaugg

SEQ ID NO: 964555 - RNA, 19 nt, Homo sapiens
gcugcuaaaccaauuaaga

SEQ ID NO: 964556 - RNA, 19 nt, Homo sapiens
aauccucucuauacaaguu

SEQ ID NO: 964557 - RNA, 19 nt, Homo sapiens
aaaagaacauuuccaguca

SEQ ID NO: 964558 - RNA, 19 nt, Homo sapiens
ucuccugaguguacuaauu

SEQ ID NO: 964559 - RNA, 19 nt, Homo sapiens
ccaguuguaucaguguuga

SEQ ID NO: 964560 - RNA, 19 nt, Homo sapiens
aaauaauccucgcaacaca

SEQ ID NO: 964561 - RNA, 19 nt, Homo sapiens
cuaggaccagcuuaacuua

SEQ ID NO: 964562 - RNA, 19 nt, Homo sapiens
uggcaaguuucuauacgaa

SEQ ID NO: 964563 - RNA, 19 nt, Homo sapiens
gaacaagacucucggcuau

SEQ ID NO: 964564 - RNA, 19 nt, Homo sapiens
uaacuggacuuccuaauau

SEQ ID NO: 964565 - RNA, 19 nt, Homo sapiens
cagaaagccuuaagacuaa

SEQ ID NO: 964566 - RNA, 19 nt, Homo sapiens
ccagaaagccuuaagacua

SEQ ID NO: 964567 - RNA, 19 nt, Homo sapiens
ccaaauuucucacaguaaa

SEQ ID NO: 964568 - RNA, 19 nt, Homo sapiens
caacuugacucugcugauu

SEQ ID NO: 964569 - RNA, 19 nt, Homo sapiens
ggauauggguaauuugaug

SEQ ID NO: 964570 - RNA, 19 nt, Homo sapiens
aaucaaagacuccaaguuu

SEQ ID NO: 964571 - RNA, 19 nt, Homo sapiens
ggucugggauccaaauuuc

SEQ ID NO: 964572 - RNA, 19 nt, Homo sapiens
uuugaugacuggaagaaua

SEQ ID NO: 964573 - RNA, 19 nt, Homo sapiens
guauuccacucuccaacua

SEQ ID NO: 964574 - RNA, 19 nt, Homo sapiens
gauuucugauuccuaauga

SEQ ID NO: 964575 - RNA, 19 nt, Homo sapiens
cugauucucugauuucuga

SEQ ID NO: 964576 - RNA, 19 nt, Homo sapiens
gaaacuuggauauggguaa

SEQ ID NO: 964577 - RNA, 19 nt, Homo sapiens
uaaaggucauguacagguu

SEQ ID NO: 964578 - RNA, 19 nt, Homo sapiens
guucugagccgauggaaga

SEQ ID NO: 964579 - RNA, 19 nt, Homo sapiens
uuaacuggacuuccuaaua

SEQ ID NO: 964580 - RNA, 19 nt, Homo sapiens
caaggaagaaauccagaaa

SEQ ID NO: 964581 - RNA, 19 nt, Homo sapiens
gauccaaauuucucacagu

SEQ ID NO: 964582 - RNA, 19 nt, Homo sapiens
ucugauuucugauuccuaa

SEQ ID NO: 964583 - RNA, 19 nt, Homo sapiens
ucucaaauccgauaugaug

SEQ ID NO: 964584 - RNA, 19 nt, Homo sapiens
gauuucugauucucugauu

SEQ ID NO: 964585 - RNA, 19 nt, Homo sapiens
cauggaaacuuggauaugg

SEQ ID NO: 964586 - RNA, 19 nt, Homo sapiens
gauaugaugcugugaagag

SEQ ID NO: 964587 - RNA, 19 nt, Homo sapiens
uaaaauggauccugagcuu

SEQ ID NO: 964588 - RNA, 19 nt, Homo sapiens
ccacauauuccuuugcaau

SEQ ID NO: 964589 - RNA, 19 nt, Homo sapiens
gauauggguaauuugauga

SEQ ID NO: 964590 - RNA, 19 nt, Homo sapiens
agcgugagcugcugagauu

SEQ ID NO: 964591 - RNA, 19 nt, Homo sapiens
ccaggcccauggaaacuug

SEQ ID NO: 964592 - RNA, 19 nt, Homo sapiens
aaauggauccugagcuuga

SEQ ID NO: 964593 - RNA, 19 nt, Homo sapiens
ucuaucaaguggaaaggaa

SEQ ID NO: 964594 - RNA, 19 nt, Homo sapiens
agaaauccagaaagccuua

SEQ ID NO: 964595 - RNA, 19 nt, Homo sapiens
caauguuggccacguauau

SEQ ID NO: 964596 - RNA, 19 nt, Homo sapiens
aaacuuggauauggguaau

SEQ ID NO: 964597 - RNA, 19 nt, Homo sapiens
augaugcugugaagaguaa

SEQ ID NO: 964598 - RNA, 19 nt, Homo sapiens
acaagacucucggcuaugg

SEQ ID NO: 964599 - RNA, 19 nt, Homo sapiens
auccaaauuucucacagua

SEQ ID NO: 964600 - RNA, 19 nt, Homo sapiens
gcccauggaaacuuggaua

SEQ ID NO: 964601 - RNA, 19 nt, Homo sapiens
ccaaggaagaaauccagaa

SEQ ID NO: 964602 - RNA, 19 nt, Homo sapiens
cacuaaaggucauguacag

SEQ ID NO: 964603 - RNA, 19 nt, Homo sapiens
acuuggauauggguaauuu

SEQ ID NO: 964604 - RNA, 19 nt, Homo sapiens
aacuggacuuccuaauaua

SEQ ID NO: 964605 - RNA, 19 nt, Homo sapiens
gaaauccagaaagccuuaa

SEQ ID NO: 964606 - RNA, 19 nt, Homo sapiens
ggucacagucugcuuagag

SEQ ID NO: 964607 - RNA, 19 nt, Homo sapiens
aauggucacagucugcuua

SEQ ID NO: 964608 - RNA, 19 nt, Homo sapiens
gaugacaaauaaucuucac

SEQ ID NO: 964609 - RNA, 19 nt, Homo sapiens
ugacucugcugauucuuuu

SEQ ID NO: 964610 - RNA, 19 nt, Homo sapiens
aggaagaaauccagaaagc

SEQ ID NO: 964611 - RNA, 19 nt, Homo sapiens
uuucucaaauccgauauga

SEQ ID NO: 964612 - RNA, 19 nt, Homo sapiens
cuacccacauauuccuuug

SEQ ID NO: 964613 - RNA, 19 nt, Homo sapiens
cuuuagagucggaauauga

SEQ ID NO: 964614 - RNA, 19 nt, Homo sapiens
ucauucugauuucugauuc

SEQ ID NO: 964615 - RNA, 19 nt, Homo sapiens
uggaugaaaguaacaaugu

SEQ ID NO: 964616 - RNA, 19 nt, Homo sapiens
ucccagcuauuccaucugu

SEQ ID NO: 964617 - RNA, 19 nt, Homo sapiens
gagcgugagcugcugagau

SEQ ID NO: 964618 - RNA, 19 nt, Homo sapiens
uuaagacuaagacaacuug

SEQ ID NO: 964619 - RNA, 19 nt, Homo sapiens
gcaguaauuuucucuucau

SEQ ID NO: 964620 - RNA, 19 nt, Homo sapiens
gggucugggauccaaauuu

SEQ ID NO: 964621 - RNA, 19 nt, Homo sapiens
ccauguuguugcugauugu

SEQ ID NO: 964622 - RNA, 19 nt, Homo sapiens
uaucuuuagagucggaaua

SEQ ID NO: 964623 - RNA, 19 nt, Homo sapiens
ccgauaugaugcugugaag

SEQ ID NO: 964624 - RNA, 19 nt, Homo sapiens
gucacagucugcuuagagu

SEQ ID NO: 964625 - RNA, 19 nt, Homo sapiens
ggaguucugagccgaugga

SEQ ID NO: 964626 - RNA, 19 nt, Homo sapiens
ucacuaaaggucauguaca

SEQ ID NO: 964627 - RNA, 19 nt, Homo sapiens
cccauguuguugcugauug

SEQ ID NO: 964628 - RNA, 19 nt, Homo sapiens
cugagccgauggaagaguu

SEQ ID NO: 964629 - RNA, 19 nt, Homo sapiens
cgugagcugcugagauuug

SEQ ID NO: 964630 - RNA, 19 nt, Homo sapiens
cuggacuuccuaauauaua

SEQ ID NO: 964631 - RNA, 19 nt, Homo sapiens
gcugauuguuggagguucu

SEQ ID NO: 964632 - RNA, 19 nt, Homo sapiens
gaugacuggaagaauauuc

SEQ ID NO: 964633 - RNA, 19 nt, Homo sapiens
gcugcgagaagacgacaga

SEQ ID NO: 964634 - RNA, 19 nt, Homo sapiens
gauucucugauuucugauu

SEQ ID NO: 964635 - RNA, 19 nt, Homo sapiens
gccauuagggcaucauuuu

SEQ ID NO: 964636 - RNA, 19 nt, Homo sapiens
guggaugaaaguaacaaug

SEQ ID NO: 964637 - RNA, 19 nt, Homo sapiens
aaaggucauguacagguuu

SEQ ID NO: 964638 - RNA, 19 nt, Homo sapiens
agacuaagacaacuugacu

SEQ ID NO: 964639 - RNA, 19 nt, Homo sapiens
ccaaguuugaugacuggaa

SEQ ID NO: 964640 - RNA, 19 nt, Homo sapiens
aaaucaaagacuccaaguu

SEQ ID NO: 964641 - RNA, 19 nt, Homo sapiens
uaugaugcugugaagagua

SEQ ID NO: 964642 - RNA, 19 nt, Homo sapiens
ggacauaccuaccuggauu

SEQ ID NO: 964643 - RNA, 19 nt, Homo sapiens
gaacugaauuguaccuuug

SEQ ID NO: 964644 - RNA, 19 nt, Homo sapiens
ugagagagauccugaguuu

SEQ ID NO: 964645 - RNA, 19 nt, Homo sapiens
ggaacugaauuguaccuuu

SEQ ID NO: 964646 - RNA, 19 nt, Homo sapiens
ggaccuagcccugaacaua

SEQ ID NO: 964647 - RNA, 19 nt, Homo sapiens
gcaagaagaauucaaacaa

SEQ ID NO: 964648 - RNA, 19 nt, Homo sapiens
acacugagaugugcuuaua

SEQ ID NO: 964649 - RNA, 19 nt, Homo sapiens
gagcugcgauagaauagaa

SEQ ID NO: 964650 - RNA, 19 nt, Homo sapiens
caagugacaugaucuuuca

SEQ ID NO: 964651 - RNA, 19 nt, Homo sapiens
acagaagacuuuagacaaa

SEQ ID NO: 964652 - RNA, 19 nt, Homo sapiens
gaaggaugcugaacagaag

SEQ ID NO: 964653 - RNA, 19 nt, Homo sapiens
gaaauaacuuuaggaacug

SEQ ID NO: 964654 - RNA, 19 nt, Homo sapiens
gaacagaagacuuuagaca

SEQ ID NO: 964655 - RNA, 19 nt, Homo sapiens
ggagaaauaacuuuaggaa

SEQ ID NO: 964656 - RNA, 19 nt, Homo sapiens
ugacuuggguuuguacuuu

SEQ ID NO: 964657 - RNA, 19 nt, Homo sapiens
gaauguaggcguuucaaau

SEQ ID NO: 964658 - RNA, 19 nt, Homo sapiens
caagaagaauucaaacaag

SEQ ID NO: 964659 - RNA, 19 nt, Homo sapiens
caugugagcugcgauagaa

SEQ ID NO: 964660 - RNA, 19 nt, Homo sapiens
ccacuuggcuguucauuuu

SEQ ID NO: 964661 - RNA, 19 nt, Homo sapiens
gcaaugggaggaagaagaa

SEQ ID NO: 964662 - RNA, 19 nt, Homo sapiens
ccaaguaucuggagcaaac

SEQ ID NO: 964663 - RNA, 19 nt, Homo sapiens
ggaggaaaguuauggaaac

SEQ ID NO: 964664 - RNA, 19 nt, Homo sapiens
uaucuacucccacgacuua

SEQ ID NO: 964665 - RNA, 19 nt, Homo sapiens
uggauuacguggacucuuu

SEQ ID NO: 964666 - RNA, 19 nt, Homo sapiens
auauguaccuuguggauuu

SEQ ID NO: 964667 - RNA, 19 nt, Homo sapiens
gagaaagauuugccagauc

SEQ ID NO: 964668 - RNA, 19 nt, Homo sapiens
cuuauaacccuguuucaua

SEQ ID NO: 964669 - RNA, 19 nt, Homo sapiens
cacagaagaucauagacaa

SEQ ID NO: 964670 - RNA, 19 nt, Homo sapiens
uaagugggauagggacaua

SEQ ID NO: 964671 - RNA, 19 nt, Homo sapiens
gcacagacuucggguugga

SEQ ID NO: 964672 - RNA, 19 nt, Homo sapiens
ggagaagggacgacgauga

SEQ ID NO: 964673 - RNA, 19 nt, Homo sapiens
gacaugauuuccuauuaca

SEQ ID NO: 964674 - RNA, 19 nt, Homo sapiens
ccacggaccuagcccugaa

SEQ ID NO: 964675 - RNA, 19 nt, Homo sapiens
uggaugacaugauuuccua

SEQ ID NO: 964676 - RNA, 19 nt, Homo sapiens
ggaaaaugauggagauguu

SEQ ID NO: 964677 - RNA, 19 nt, Homo sapiens
gugaagaauggguggauua

SEQ ID NO: 964678 - RNA, 19 nt, Homo sapiens
aaggagacuuuauagauga

SEQ ID NO: 964679 - RNA, 19 nt, Homo sapiens
acaaacaagugacaugauc

SEQ ID NO: 964680 - RNA, 19 nt, Homo sapiens
gaaagagaggcccugaaga

SEQ ID NO: 964681 - RNA, 19 nt, Homo sapiens
ugagaaagauuugccagau

SEQ ID NO: 964682 - RNA, 19 nt, Homo sapiens
ucagcaaggaggaaaguua

SEQ ID NO: 964683 - RNA, 19 nt, Homo sapiens
gaucauagacaagcgcaaa

SEQ ID NO: 964684 - RNA, 19 nt, Homo sapiens
aggcugaacucuuccgaaa

SEQ ID NO: 964685 - RNA, 19 nt, Homo sapiens
caaaguagaagucauuguc

SEQ ID NO: 964686 - RNA, 19 nt, Homo sapiens
gaacuucagcgccagcaau

SEQ ID NO: 964687 - RNA, 19 nt, Homo sapiens
ugacaugauuuccuauuac

SEQ ID NO: 964688 - RNA, 19 nt, Homo sapiens
gagauguuauugggccuuu

SEQ ID NO: 964689 - RNA, 19 nt, Homo sapiens
uagaggauauguaccuugu

SEQ ID NO: 964690 - RNA, 19 nt, Homo sapiens
ccacgacuuacucauauuu

SEQ ID NO: 964691 - RNA, 19 nt, Homo sapiens
ucuuaaggcugaacucuuc

SEQ ID NO: 964692 - RNA, 19 nt, Homo sapiens
gcugaacucuuccgaaagc

SEQ ID NO: 964693 - RNA, 19 nt, Homo sapiens
uagcaaaguagaagucauu

SEQ ID NO: 964694 - RNA, 19 nt, Homo sapiens
ucacacagaagaucauaga

SEQ ID NO: 964695 - RNA, 19 nt, Homo sapiens
gaagauugaagaacagaag

SEQ ID NO: 964696 - RNA, 19 nt, Homo sapiens
gaacagaagauugaagaac

SEQ ID NO: 964697 - RNA, 19 nt, Homo sapiens
ggucagaagagaacugguu

SEQ ID NO: 964698 - RNA, 19 nt, Homo sapiens
gaaagcaagaagaauucaa

SEQ ID NO: 964699 - RNA, 19 nt, Homo sapiens
gaagaacagaagacuuuag

SEQ ID NO: 964700 - RNA, 19 nt, Homo sapiens
uugaagaacagaagacuuu

SEQ ID NO: 964701 - RNA, 19 nt, Homo sapiens
aacagaagauugaagaaca

SEQ ID NO: 964702 - RNA, 19 nt, Homo sapiens
agagggagaaauaacuuua

SEQ ID NO: 964703 - RNA, 19 nt, Homo sapiens
gaugacaugauuuccuauu

SEQ ID NO: 964704 - RNA, 19 nt, Homo sapiens
gaccagagccacggaccua

SEQ ID NO: 964705 - RNA, 19 nt, Homo sapiens
ugagaaggaugcugaacag

SEQ ID NO: 964706 - RNA, 19 nt, Homo sapiens
cuaccuggauuuacaugug

SEQ ID NO: 964707 - RNA, 19 nt, Homo sapiens
auaccuaccuggauuuaca

SEQ ID NO: 964708 - RNA, 19 nt, Homo sapiens
uuuaggaacugaauuguac

SEQ ID NO: 964709 - RNA, 19 nt, Homo sapiens
ggucgaagaggcagucaga

SEQ ID NO: 964710 - RNA, 19 nt, Homo sapiens
gaaaaugauggagauguua

SEQ ID NO: 964711 - RNA, 19 nt, Homo sapiens
gcuuguaugagaaagauuu

SEQ ID NO: 964712 - RNA, 19 nt, Homo sapiens
gagacuuuauagaugaaga

SEQ ID NO: 964713 - RNA, 19 nt, Homo sapiens
guacuuugacagugccuuu

SEQ ID NO: 964714 - RNA, 19 nt, Homo sapiens
aaagagaggcccugaagag

SEQ ID NO: 964715 - RNA, 19 nt, Homo sapiens
gcgcuuguaugagaaagau

SEQ ID NO: 964716 - RNA, 19 nt, Homo sapiens
agaaggaugcugaacagaa

SEQ ID NO: 964717 - RNA, 19 nt, Homo sapiens
uaacccuguuucauaucua

SEQ ID NO: 964718 - RNA, 19 nt, Homo sapiens
uggaaacuuuggccacuug

SEQ ID NO: 964719 - RNA, 19 nt, Homo sapiens
gccgucagauuacuuugug

SEQ ID NO: 964720 - RNA, 19 nt, Homo sapiens
ucuaaaagauucuggaguu

SEQ ID NO: 964721 - RNA, 19 nt, Homo sapiens
gaagaaguagaggauaugu

SEQ ID NO: 964722 - RNA, 19 nt, Homo sapiens
gaugaagaaguagaggaua

SEQ ID NO: 964723 - RNA, 19 nt, Homo sapiens
ucccacgacuuacucauau

SEQ ID NO: 964724 - RNA, 19 nt, Homo sapiens
gacuuggguuuguacuuug

SEQ ID NO: 964725 - RNA, 19 nt, Homo sapiens
gcccguacauuaugaagac

SEQ ID NO: 964726 - RNA, 19 nt, Homo sapiens
caaaucgagcugagaagga

SEQ ID NO: 964727 - RNA, 19 nt, Homo sapiens
aagaauggguggauuacgu

SEQ ID NO: 964728 - RNA, 19 nt, Homo sapiens
gagaagggacgacgaugag

SEQ ID NO: 964729 - RNA, 19 nt, Homo sapiens
gcaaggaggaaaguuaugg

SEQ ID NO: 964730 - RNA, 19 nt, Homo sapiens
cagcaaggaggaaaguuau

SEQ ID NO: 964731 - RNA, 19 nt, Homo sapiens
ccucguugguagaucuuaa

SEQ ID NO: 964732 - RNA, 19 nt, Homo sapiens
ggauauguaccuuguggau

SEQ ID NO: 964733 - RNA, 19 nt, Homo sapiens
uaccuggauuuacauguga

SEQ ID NO: 964734 - RNA, 19 nt, Homo sapiens
uagacaagcgcaaagaaau

SEQ ID NO: 964735 - RNA, 19 nt, Homo sapiens
augaagaaguagaggauau

SEQ ID NO: 964736 - RNA, 19 nt, Homo sapiens
ugaagaacagaagacuuua

SEQ ID NO: 964737 - RNA, 19 nt, Homo sapiens
cgaagaggcagucagaucu

SEQ ID NO: 964738 - RNA, 19 nt, Homo sapiens
gauauguaccuuguggauu

SEQ ID NO: 964739 - RNA, 19 nt, Homo sapiens
ugugagcugcgauagaaua

SEQ ID NO: 964740 - RNA, 19 nt, Homo sapiens
uuacaugugagcugcgaua

SEQ ID NO: 964741 - RNA, 19 nt, Homo sapiens
aaacaagugacaugaucuu

SEQ ID NO: 964742 - RNA, 19 nt, Homo sapiens
gcucaaaucuguuguguuu

SEQ ID NO: 964743 - RNA, 19 nt, Homo sapiens
gaaucaggcuguacucuuu

SEQ ID NO: 964744 - RNA, 19 nt, Homo sapiens
gaacaauccuugccagagu

SEQ ID NO: 964745 - RNA, 19 nt, Homo sapiens
gcucugacgugcugaagaa

SEQ ID NO: 964746 - RNA, 19 nt, Homo sapiens
caugauaguugauaugaga

SEQ ID NO: 964747 - RNA, 19 nt, Homo sapiens
ugucuuagcucaaaucugu

SEQ ID NO: 964748 - RNA, 19 nt, Homo sapiens
acaccagccucauggaaua

SEQ ID NO: 964749 - RNA, 19 nt, Homo sapiens
gcagauguguccugguuuc

SEQ ID NO: 964750 - RNA, 19 nt, Homo sapiens
gggcacaucuggaguucuu

SEQ ID NO: 964751 - RNA, 19 nt, Homo sapiens
ucucuucccugcaguguuu

SEQ ID NO: 964752 - RNA, 19 nt, Homo sapiens
gaauuggaaucaggcugua

SEQ ID NO: 964753 - RNA, 19 nt, Homo sapiens
ucaaaucuguuguguuucu

SEQ ID NO: 964754 - RNA, 19 nt, Homo sapiens
cagcgugccugccagugua

SEQ ID NO: 964755 - RNA, 19 nt, Homo sapiens
ggccucggcugcuggaauu

SEQ ID NO: 964756 - RNA, 19 nt, Homo sapiens
aagccaaacucaaagaaug

SEQ ID NO: 964757 - RNA, 19 nt, Homo sapiens
ucuagggucuguacacuug

SEQ ID NO: 964758 - RNA, 19 nt, Homo sapiens
gaccagacuuuguucucuu

SEQ ID NO: 964759 - RNA, 19 nt, Homo sapiens
ggaaucaggcuguacucuu

SEQ ID NO: 964760 - RNA, 19 nt, Homo sapiens
ggaccagacuuuguucucu

SEQ ID NO: 964761 - RNA, 19 nt, Homo sapiens
ccuaaaaucucaagccaaa

SEQ ID NO: 964762 - RNA, 19 nt, Homo sapiens
guaccugugaugaccaaua

SEQ ID NO: 964763 - RNA, 19 nt, Homo sapiens
cugaaauuaugcuuccuaa

SEQ ID NO: 964764 - RNA, 19 nt, Homo sapiens
cugacgugcugaagaaauu

SEQ ID NO: 964765 - RNA, 19 nt, Homo sapiens
gggcagaugucccauugcu

SEQ ID NO: 964766 - RNA, 19 nt, Homo sapiens
uggacaaccuggcaacugu

SEQ ID NO: 964767 - RNA, 19 nt, Homo sapiens
ucacuaucaucaucugcuu

SEQ ID NO: 964768 - RNA, 19 nt, Homo sapiens
cauggaauaugcaacaacu

SEQ ID NO: 964769 - RNA, 19 nt, Homo sapiens
gagccugucaugccuguug

SEQ ID NO: 964770 - RNA, 19 nt, Homo sapiens
gcagcacccuacccaaugc

SEQ ID NO: 964771 - RNA, 19 nt, Homo sapiens
gcuguacucuuuccaucca

SEQ ID NO: 964772 - RNA, 19 nt, Homo sapiens
guuccuccucccucuauua

SEQ ID NO: 964773 - RNA, 19 nt, Homo sapiens
ccaaguagggccugucaca

SEQ ID NO: 964774 - RNA, 19 nt, Homo sapiens
cgaguccuguccagauuuc

SEQ ID NO: 964775 - RNA, 19 nt, Homo sapiens
guccaggcacgguuccuua

SEQ ID NO: 964776 - RNA, 19 nt, Homo sapiens
ccagccagccuccuuacaa

SEQ ID NO: 964777 - RNA, 19 nt, Homo sapiens
ggucuguacacuuguuuau

SEQ ID NO: 964778 - RNA, 19 nt, Homo sapiens
augcagauguguccugguu

SEQ ID NO: 964779 - RNA, 19 nt, Homo sapiens
uguguguccugccuguaua

SEQ ID NO: 964780 - RNA, 19 nt, Homo sapiens
ccacuugguuauguugugu

SEQ ID NO: 964781 - RNA, 19 nt, Homo sapiens
cgacaccagccucauggaa

SEQ ID NO: 964782 - RNA, 19 nt, Homo sapiens
cagcagcacccuacccaau

SEQ ID NO: 964783 - RNA, 19 nt, Homo sapiens
guacucuuuccauccauuu

SEQ ID NO: 964784 - RNA, 19 nt, Homo sapiens
ccuccucccucuauuacug

SEQ ID NO: 964785 - RNA, 19 nt, Homo sapiens
gacaccagccucauggaau

SEQ ID NO: 964786 - RNA, 19 nt, Homo sapiens
caagccaaacucaaagaau

SEQ ID NO: 964787 - RNA, 19 nt, Homo sapiens
uagcucaaaucuguugugu

SEQ ID NO: 964788 - RNA, 19 nt, Homo sapiens
guuggacuuugauccuuug

SEQ ID NO: 964789 - RNA, 19 nt, Homo sapiens
uauauguggcuuccucuga

SEQ ID NO: 964790 - RNA, 19 nt, Homo sapiens
ugcaguacccaccaccuua

SEQ ID NO: 964791 - RNA, 19 nt, Homo sapiens
ugucgucacuaucaucauc

SEQ ID NO: 964792 - RNA, 19 nt, Homo sapiens
cccgaguccuguccagauu

SEQ ID NO: 964793 - RNA, 19 nt, Homo sapiens
gacaaccuggcaacuguga

SEQ ID NO: 964794 - RNA, 19 nt, Homo sapiens
gcagagccagggacaugau

SEQ ID NO: 964795 - RNA, 19 nt, Homo sapiens
uuccucaccugaaauuaug

SEQ ID NO: 964796 - RNA, 19 nt, Homo sapiens
cacccuacccaaugcagua

SEQ ID NO: 964797 - RNA, 19 nt, Homo sapiens
gcugcugccuuuacaagac

SEQ ID NO: 964798 - RNA, 19 nt, Homo sapiens
uaccugugaugaccaauac

SEQ ID NO: 964799 - RNA, 19 nt, Homo sapiens
cugcaguguuuucauuuua

SEQ ID NO: 964800 - RNA, 19 nt, Homo sapiens
gaccaaguagggccuguca

SEQ ID NO: 964801 - RNA, 19 nt, Homo sapiens
uguccugccuguauaugug

SEQ ID NO: 964802 - RNA, 19 nt, Homo sapiens
uugguuauguugugugugu

SEQ ID NO: 964803 - RNA, 19 nt, Homo sapiens
gcugccacuugguuauguu

SEQ ID NO: 964804 - RNA, 19 nt, Homo sapiens
caacugugagucccugcuu

SEQ ID NO: 964805 - RNA, 19 nt, Homo sapiens
gagcucugcugcccuugcu

SEQ ID NO: 964806 - RNA, 19 nt, Homo sapiens
ucaagccaaacucaaagaa

SEQ ID NO: 964807 - RNA, 19 nt, Homo sapiens
cagccagccuccuuacaac

SEQ ID NO: 964808 - RNA, 19 nt, Homo sapiens
gaccaucuuugugcugucu

SEQ ID NO: 964809 - RNA, 19 nt, Homo sapiens
uagggucuguacacuuguu

SEQ ID NO: 964810 - RNA, 19 nt, Homo sapiens
caaccuggcaacugugagu

SEQ ID NO: 964811 - RNA, 19 nt, Homo sapiens
gcacaucuggaguucuucu

SEQ ID NO: 964812 - RNA, 19 nt, Homo sapiens
gccacuugguuauguugug

SEQ ID NO: 964813 - RNA, 19 nt, Homo sapiens
gcaguacccaccaccuuac

SEQ ID NO: 964814 - RNA, 19 nt, Homo sapiens
ccucauggaauaugcaaca

SEQ ID NO: 964815 - RNA, 19 nt, Homo sapiens
uauguggcuuccucugaug

SEQ ID NO: 964816 - RNA, 19 nt, Homo sapiens
aguuggacuuugauccuuu

SEQ ID NO: 964817 - RNA, 19 nt, Homo sapiens
aggcgaagcuugggaucug

SEQ ID NO: 964818 - RNA, 19 nt, Homo sapiens
ccugaaauuaugcuuccua

SEQ ID NO: 964819 - RNA, 19 nt, Homo sapiens
caaaucuguuguguuucug

SEQ ID NO: 964820 - RNA, 19 nt, Homo sapiens
gacaugaauaccucguguu

SEQ ID NO: 964821 - RNA, 19 nt, Homo sapiens
uaguugauaugagacugaa

SEQ ID NO: 964822 - RNA, 19 nt, Homo sapiens
ccagcacacucaguucucu

SEQ ID NO: 964823 - RNA, 19 nt, Homo sapiens
auauguggcuuccucugau

SEQ ID NO: 964824 - RNA, 19 nt, Homo sapiens
gaacaaagauacuguaaca

SEQ ID NO: 964825 - RNA, 19 nt, Homo sapiens
uaacaaagcuagaacaguu

SEQ ID NO: 964826 - RNA, 19 nt, Homo sapiens
gcuaaucuaucacuuguua

SEQ ID NO: 964827 - RNA, 19 nt, Homo sapiens
gaacaagcaccaaauuaaa

SEQ ID NO: 964828 - RNA, 19 nt, Homo sapiens
ggaaguauguaauuugaga

SEQ ID NO: 964829 - RNA, 19 nt, Homo sapiens
guacggaaauauuugagua

SEQ ID NO: 964830 - RNA, 19 nt, Homo sapiens
gaaggucuguuaguuaauu

SEQ ID NO: 964831 - RNA, 19 nt, Homo sapiens
gaggaaguauguaauuuga

SEQ ID NO: 964832 - RNA, 19 nt, Homo sapiens
gaaagaagcaccagucaag

SEQ ID NO: 964833 - RNA, 19 nt, Homo sapiens
uuacugaggcuacaaguua

SEQ ID NO: 964834 - RNA, 19 nt, Homo sapiens
gaacaguuuuggcuucuua

SEQ ID NO: 964835 - RNA, 19 nt, Homo sapiens
gaagaugacaauccauuug

SEQ ID NO: 964836 - RNA, 19 nt, Homo sapiens
ugaacaagcaccaaauuaa

SEQ ID NO: 964837 - RNA, 19 nt, Homo sapiens
caacaucagccaugaaaga

SEQ ID NO: 964838 - RNA, 19 nt, Homo sapiens
uaauccagcugaacaaaga

SEQ ID NO: 964839 - RNA, 19 nt, Homo sapiens
gcauauuucucagacuuaa

SEQ ID NO: 964840 - RNA, 19 nt, Homo sapiens
gggauucacugcaucauag

SEQ ID NO: 964841 - RNA, 19 nt, Homo sapiens
acaaauagaagaggaguua

SEQ ID NO: 964842 - RNA, 19 nt, Homo sapiens
ggaagaagagcaugaaugg

SEQ ID NO: 964843 - RNA, 19 nt, Homo sapiens
cugaaggucuguuaguuaa

SEQ ID NO: 964844 - RNA, 19 nt, Homo sapiens
gugcugagacuguuacuaa

SEQ ID NO: 964845 - RNA, 19 nt, Homo sapiens
caaccaacaucagccauga

SEQ ID NO: 964846 - RNA, 19 nt, Homo sapiens
gaaguacggaaauauuuga

SEQ ID NO: 964847 - RNA, 19 nt, Homo sapiens
cgagaucucccacaaacua

SEQ ID NO: 964848 - RNA, 19 nt, Homo sapiens
gugaacaagcaccaaauua

SEQ ID NO: 964849 - RNA, 19 nt, Homo sapiens
gaagacagcaaggaaagaa

SEQ ID NO: 964850 - RNA, 19 nt, Homo sapiens
gaagagcaugaaugguuua

SEQ ID NO: 964851 - RNA, 19 nt, Homo sapiens
agaagagcaugaaugguuu

SEQ ID NO: 964852 - RNA, 19 nt, Homo sapiens
ggaguuaugggaagaagaa

SEQ ID NO: 964853 - RNA, 19 nt, Homo sapiens
gaauucaacagacaaauag

SEQ ID NO: 964854 - RNA, 19 nt, Homo sapiens
gaagaauucaacagacaaa

SEQ ID NO: 964855 - RNA, 19 nt, Homo sapiens
gaccuaaaccuuaccaaau

SEQ ID NO: 964856 - RNA, 19 nt, Homo sapiens
ccaagucgcagcaguacua

SEQ ID NO: 964857 - RNA, 19 nt, Homo sapiens
gaguacauguggauggaaa

SEQ ID NO: 964858 - RNA, 19 nt, Homo sapiens
agucuugcaugcuuaauaa

SEQ ID NO: 964859 - RNA, 19 nt, Homo sapiens
agagcaaucugaauccaaa

SEQ ID NO: 964860 - RNA, 19 nt, Homo sapiens
ccaaauccaagaccaguuu

SEQ ID NO: 964861 - RNA, 19 nt, Homo sapiens
cagcacaacuuuuaacaaa

SEQ ID NO: 964862 - RNA, 19 nt, Homo sapiens
guuaugggaagaagaauuu

SEQ ID NO: 964863 - RNA, 19 nt, Homo sapiens
gauccaagucgcagcagua

SEQ ID NO: 964864 - RNA, 19 nt, Homo sapiens
gugaaguacggaaauauuu

SEQ ID NO: 964865 - RNA, 19 nt, Homo sapiens
uggaagaucuuguggucaa

SEQ ID NO: 964866 - RNA, 19 nt, Homo sapiens
gugaauaguguuuaaguug

SEQ ID NO: 964867 - RNA, 19 nt, Homo sapiens
aagaagagcaugaaugguu

SEQ ID NO: 964868 - RNA, 19 nt, Homo sapiens
ugaacgcuguuuccaagaa

SEQ ID NO: 964869 - RNA, 19 nt, Homo sapiens
gggaagaagaauuuauuga

SEQ ID NO: 964870 - RNA, 19 nt, Homo sapiens
gauggaaaaugaagaagaa

SEQ ID NO: 964871 - RNA, 19 nt, Homo sapiens
caaguuagucagcagauga

SEQ ID NO: 964872 - RNA, 19 nt, Homo sapiens
caucugaggaaguauguaa

SEQ ID NO: 964873 - RNA, 19 nt, Homo sapiens
accuaaaccuuaccaaauu

SEQ ID NO: 964874 - RNA, 19 nt, Homo sapiens
ggaaagaagcaccagucaa

SEQ ID NO: 964875 - RNA, 19 nt, Homo sapiens
gaccaauaccaacccauaa

SEQ ID NO: 964876 - RNA, 19 nt, Homo sapiens
ccuaaaccuuaccaaauug

SEQ ID NO: 964877 - RNA, 19 nt, Homo sapiens
ggcaguauuagaagacuua

SEQ ID NO: 964878 - RNA, 19 nt, Homo sapiens
ugaaggcaguauuagaaga

SEQ ID NO: 964879 - RNA, 19 nt, Homo sapiens
cacaaacuauggaccaaau

SEQ ID NO: 964880 - RNA, 19 nt, Homo sapiens
ggugaaguacggaaauauu

SEQ ID NO: 964881 - RNA, 19 nt, Homo sapiens
ccauacguguucaguguga

SEQ ID NO: 964882 - RNA, 19 nt, Homo sapiens
ugaccaauaccaacccaua

SEQ ID NO: 964883 - RNA, 19 nt, Homo sapiens
ucuaacauaugaccaauac

SEQ ID NO: 964884 - RNA, 19 nt, Homo sapiens
aagcauauuucucagacuu

SEQ ID NO: 964885 - RNA, 19 nt, Homo sapiens
aaagcacucuugucacugu

SEQ ID NO: 964886 - RNA, 19 nt, Homo sapiens
uuaaugaccuuguuaucag

SEQ ID NO: 964887 - RNA, 19 nt, Homo sapiens
aagaagaauucaacagaca

SEQ ID NO: 964888 - RNA, 19 nt, Homo sapiens
ucugaaggucuguuaguua

SEQ ID NO: 964889 - RNA, 19 nt, Homo sapiens
gcacucuugucacuguguu

SEQ ID NO: 964890 - RNA, 19 nt, Homo sapiens
uccaagaccaguuuaauga

SEQ ID NO: 964891 - RNA, 19 nt, Homo sapiens
acaauccauuugcagagua

SEQ ID NO: 964892 - RNA, 19 nt, Homo sapiens
uaacauaugaccaauacca

SEQ ID NO: 964893 - RNA, 19 nt, Homo sapiens
cugaggaaguauguaauuu

SEQ ID NO: 964894 - RNA, 19 nt, Homo sapiens
uguuacaucugaggaagua

SEQ ID NO: 964895 - RNA, 19 nt, Homo sapiens
gaagaugugauuauuaacg

SEQ ID NO: 964896 - RNA, 19 nt, Homo sapiens
ccaguuuaaugaccuuguu

SEQ ID NO: 964897 - RNA, 19 nt, Homo sapiens
cagugugaauaguguuuaa

SEQ ID NO: 964898 - RNA, 19 nt, Homo sapiens
caaauccaagaccaguuua

SEQ ID NO: 964899 - RNA, 19 nt, Homo sapiens
caacagacaaauagaagag

SEQ ID NO: 964900 - RNA, 19 nt, Homo sapiens
ugaagaugacaauccauuu

SEQ ID NO: 964901 - RNA, 19 nt, Homo sapiens
ugaggaaguauguaauuug

SEQ ID NO: 964902 - RNA, 19 nt, Homo sapiens
uaaaagaccuaaaccuuac

SEQ ID NO: 964903 - RNA, 19 nt, Homo sapiens
gacaauccauuugcagagu

SEQ ID NO: 964904 - RNA, 19 nt, Homo sapiens
guuaaaggcaaguauguca

SEQ ID NO: 964905 - RNA, 19 nt, Homo sapiens
ugaaguacggaaauauuug

SEQ ID NO: 964906 - RNA, 19 nt, Homo sapiens
ugccauacguguucagugu

SEQ ID NO: 964907 - RNA, 19 nt, Homo sapiens
cagaguacauguggaugga

SEQ ID NO: 964908 - RNA, 19 nt, Homo sapiens
ugugaaggcaguauuagaa

SEQ ID NO: 964909 - RNA, 19 nt, Homo sapiens
ggauguagcacaauuucca

SEQ ID NO: 964910 - RNA, 19 nt, Homo sapiens
gcugaacaaagauacugua

SEQ ID NO: 964911 - RNA, 19 nt, Homo sapiens
gaggcuaaucuaucacuug

SEQ ID NO: 964912 - RNA, 19 nt, Homo sapiens
ggaagaggaagaagagcau

SEQ ID NO: 964913 - RNA, 19 nt, Homo sapiens
ucuaagggauucacugcau

SEQ ID NO: 964914 - RNA, 19 nt, Homo sapiens
gagugccaguccagccuuu

SEQ ID NO: 964915 - RNA, 19 nt, Homo sapiens
ggaaaaugaagaagaauuc

SEQ ID NO: 964916 - RNA, 19 nt, Homo sapiens
agaagcaccagucaaguug

SEQ ID NO: 964917 - RNA, 19 nt, Homo sapiens
uaaaagcacucuugucacu

SEQ ID NO: 964918 - RNA, 19 nt, Homo sapiens
caacuguuaagcauauuuc

SEQ ID NO: 964919 - RNA, 19 nt, Homo sapiens
aggcuaaucuaucacuugu

SEQ ID NO: 964920 - RNA, 19 nt, Homo sapiens
aagaagcaccagucaaguu

SEQ ID NO: 964921 - RNA, 19 nt, Homo sapiens
agaccuaaaccuuaccaaa

SEQ ID NO: 964922 - RNA, 19 nt, Homo sapiens
acacuuaugcauugccaaa

SEQ ID NO: 964923 - RNA, 19 nt, Homo sapiens
aaauagaagaggaguuaug

SEQ ID NO: 964924 - RNA, 19 nt, Homo sapiens
gaagacagcucgugaaauc

SEQ ID NO: 964925 - RNA, 19 nt, Homo sapiens
gaaagacaacugacauuua

SEQ ID NO: 964926 - RNA, 19 nt, Homo sapiens
gaaaggaggaugaugauau

SEQ ID NO: 964927 - RNA, 19 nt, Homo sapiens
ggagacagcuaaccaacug

SEQ ID NO: 964928 - RNA, 19 nt, Homo sapiens
gcacuagucccuuacauau

SEQ ID NO: 964929 - RNA, 19 nt, Homo sapiens
ggaaagacaacugacauuu

SEQ ID NO: 964930 - RNA, 19 nt, Homo sapiens
gagcucaguugggauuuaa

SEQ ID NO: 964931 - RNA, 19 nt, Homo sapiens
ggagcucaguugggauuua

SEQ ID NO: 964932 - RNA, 19 nt, Homo sapiens
ggaggaugaugauaucuag

SEQ ID NO: 964933 - RNA, 19 nt, Homo sapiens
uaaccuagccugugaggaa

SEQ ID NO: 964934 - RNA, 19 nt, Homo sapiens
ggcauaaccuagccuguga

SEQ ID NO: 964935 - RNA, 19 nt, Homo sapiens
cagcuaaccaacugcauua

SEQ ID NO: 964936 - RNA, 19 nt, Homo sapiens
acaaugaguugacccaguu

SEQ ID NO: 964937 - RNA, 19 nt, Homo sapiens
aaaggaggaugaugauauc

SEQ ID NO: 964938 - RNA, 19 nt, Homo sapiens
ugacuucccuggccaucuu

SEQ ID NO: 964939 - RNA, 19 nt, Homo sapiens
cagaagauucauacacuuu

SEQ ID NO: 964940 - RNA, 19 nt, Homo sapiens
ggacugugcacuagaaagu

SEQ ID NO: 964941 - RNA, 19 nt, Homo sapiens
ccagaagauucauacacuu

SEQ ID NO: 964942 - RNA, 19 nt, Homo sapiens
gaugauaucuaggcauaac

SEQ ID NO: 964943 - RNA, 19 nt, Homo sapiens
acuagucccuuacauaugu

SEQ ID NO: 964944 - RNA, 19 nt, Homo sapiens
agacaacugacauuuauug

SEQ ID NO: 964945 - RNA, 19 nt, Homo sapiens
augaugauaucuaggcaua

SEQ ID NO: 964946 - RNA, 19 nt, Homo sapiens
gaagauucauacacuuuug
